United States Patent 7,655,785 (BIOINFORMATICALLY DETECTABLE GROUP OF NOVEL REGULATORY OLIGONUCLEOTIDES AND USES THEREOF) - sequence listing, part 51

SEQ ID NO: 2115413 - RNA, 15 nt, Homo sapiens
cccuggauuugcaua

SEQ ID NO: 2115414 - RNA, 14 nt, Homo sapiens
uagccccauuacac

SEQ ID NO: 2115415 - RNA, 22 nt, Homo sapiens
aauuuaaacguauaauauguac

SEQ ID NO: 2115416 - RNA, 17 nt, Homo sapiens
acagaccuuaguugaaa

SEQ ID NO: 2115417 - RNA, 18 nt, Homo sapiens
aaagccauguuuauuaca

SEQ ID NO: 2115418 - RNA, 19 nt, Homo sapiens
ucugccucucuuguaauuu

SEQ ID NO: 2115419 - RNA, 20 nt, Homo sapiens
caacccaaggaaccauuugc

SEQ ID NO: 2115420 - RNA, 16 nt, Homo sapiens
uaagggagcugagcca

SEQ ID NO: 2115421 - RNA, 15 nt, Homo sapiens
uccauucucugaguc

SEQ ID NO: 2115422 - RNA, 15 nt, Homo sapiens
uaagacacaaaugca

SEQ ID NO: 2115423 - RNA, 14 nt, Homo sapiens
uauauauugcuuau

SEQ ID NO: 2115424 - RNA, 17 nt, Homo sapiens
guguaucaaaaugcucu

SEQ ID NO: 2115425 - RNA, 19 nt, Homo sapiens
auuucuuuauguaaucuau

SEQ ID NO: 2115426 - RNA, 16 nt, Homo sapiens
cauaagaaaacuaaga

SEQ ID NO: 2115427 - RNA, 12 nt, Homo sapiens
gagaagcuucua

SEQ ID NO: 2115428 - RNA, 18 nt, Homo sapiens
ggccgcuguguuuggaga

SEQ ID NO: 2115429 - RNA, 20 nt, Homo sapiens
cgcucaggcuggagugcagu

SEQ ID NO: 2115430 - RNA, 22 nt, Homo sapiens
uucccaucuccuuucucuggua

SEQ ID NO: 2115431 - RNA, 14 nt, Homo sapiens
cgggcuuuccccca

SEQ ID NO: 2115432 - RNA, 14 nt, Homo sapiens
ggcagcagcuguga

SEQ ID NO: 2115433 - RNA, 16 nt, Homo sapiens
gcagccacauuccuga

SEQ ID NO: 2115434 - RNA, 15 nt, Homo sapiens
aaaugagccaugaga

SEQ ID NO: 2115435 - RNA, 18 nt, Homo sapiens
uaaugcauguggcacuua

SEQ ID NO: 2115436 - RNA, 20 nt, Homo sapiens
aaaucuguaaucagcaauaa

SEQ ID NO: 2115437 - RNA, 13 nt, Homo sapiens
aaggcuccaucuc

SEQ ID NO: 2115438 - RNA, 14 nt, Homo sapiens
uggaauauuugcug

SEQ ID NO: 2115439 - RNA, 13 nt, Homo sapiens
aagucacauucca

SEQ ID NO: 2115440 - RNA, 23 nt, Homo sapiens
aaauguuuaauaucugacugaaa

SEQ ID NO: 2115441 - RNA, 15 nt, Homo sapiens
caaaagggacacaua

SEQ ID NO: 2115442 - RNA, 22 nt, Homo sapiens
agcagggugaagaguccaagaa

SEQ ID NO: 2115443 - RNA, 17 nt, Homo sapiens
uuucauauaauuugcca

SEQ ID NO: 2115444 - RNA, 13 nt, Homo sapiens
auguuuugcccac

SEQ ID NO: 2115445 - RNA, 19 nt, Homo sapiens
agugacagcucugccuguu

SEQ ID NO: 2115446 - RNA, 17 nt, Homo sapiens
acagucccauuccucca

SEQ ID NO: 2115447 - RNA, 20 nt, Homo sapiens
gagaaaauccuaggugcuac

SEQ ID NO: 2115448 - RNA, 21 nt, Homo sapiens
ccucauuacugggccuuagug

SEQ ID NO: 2115449 - RNA, 23 nt, Homo sapiens
aagaccuggagcggcuauuccag

SEQ ID NO: 2115450 - RNA, 20 nt, Homo sapiens
acugaaaaaucuaagugaua

SEQ ID NO: 2115451 - RNA, 19 nt, Homo sapiens
uaagaaacuguuacugucc

SEQ ID NO: 2115452 - RNA, 18 nt, Homo sapiens
uggcucacucagcacuug

SEQ ID NO: 2115453 - RNA, 15 nt, Homo sapiens
cauuucaccauucaa

SEQ ID NO: 2115454 - RNA, 14 nt, Homo sapiens
uuugcucucuggcc

SEQ ID NO: 2115455 - RNA, 12 nt, Homo sapiens
ccucugcuggag

SEQ ID NO: 2115456 - RNA, 15 nt, Homo sapiens
ugguggcccagcucc

SEQ ID NO: 2115457 - RNA, 13 nt, Homo sapiens
ucucaagugccau

SEQ ID NO: 2115458 - RNA, 23 nt, Homo sapiens
gauguggcugaaccgagcuggag

SEQ ID NO: 2115459 - RNA, 17 nt, Homo sapiens
uggcugcuagauuuuaa

SEQ ID NO: 2115460 - RNA, 15 nt, Homo sapiens
cauuaaacuuaccug

SEQ ID NO: 2115461 - RNA, 13 nt, Homo sapiens
acauuaggcugug

SEQ ID NO: 2115462 - RNA, 21 nt, Homo sapiens
ugguaauaaaugugacucagc

SEQ ID NO: 2115463 - RNA, 17 nt, Homo sapiens
guguuaauuuugcuaac

SEQ ID NO: 2115464 - RNA, 14 nt, Homo sapiens
accauguggccauu

SEQ ID NO: 2115465 - RNA, 14 nt, Homo sapiens
aacacuaaacauuc

SEQ ID NO: 2115466 - RNA, 18 nt, Homo sapiens
ugcaagcaaacacacucu

SEQ ID NO: 2115467 - RNA, 20 nt, Homo sapiens
auggguaucaaacagcucag

SEQ ID NO: 2115468 - RNA, 19 nt, Homo sapiens
uauugaaguuguuuaucaa

SEQ ID NO: 2115469 - RNA, 14 nt, Homo sapiens
gugccaauaaccaa

SEQ ID NO: 2115470 - RNA, 16 nt, Homo sapiens
uggggugugacacuuu

SEQ ID NO: 2115471 - RNA, 22 nt, Homo sapiens
cuaccucauggggguauuguau

SEQ ID NO: 2115472 - RNA, 15 nt, Homo sapiens
ggagcugcggccacu

SEQ ID NO: 2115473 - RNA, 20 nt, Homo sapiens
acucuggaccucucuuguga

SEQ ID NO: 2115474 - RNA, 20 nt, Homo sapiens
aauccaugaacagcauuaga

SEQ ID NO: 2115475 - RNA, 20 nt, Homo sapiens
cauuaccagacgguucacca

SEQ ID NO: 2115476 - RNA, 15 nt, Homo sapiens
cuuucagacuugcca

SEQ ID NO: 2115477 - RNA, 22 nt, Homo sapiens
acacucuccugugaacacugga

SEQ ID NO: 2115478 - RNA, 15 nt, Homo sapiens
guuguugacugugau

SEQ ID NO: 2115479 - RNA, 19 nt, Homo sapiens
gccuacaucccgggccuca

SEQ ID NO: 2115480 - RNA, 12 nt, Homo sapiens
uugccucuaugu

SEQ ID NO: 2115481 - RNA, 23 nt, Homo sapiens
aucuuaccagaugcuacuggacu

SEQ ID NO: 2115482 - RNA, 14 nt, Homo sapiens
acccggacaggugg

SEQ ID NO: 2115483 - RNA, 16 nt, Homo sapiens
aauaugcuuuacaauc

SEQ ID NO: 2115484 - RNA, 11 nt, Homo sapiens
uaggugccuuu

SEQ ID NO: 2115485 - RNA, 13 nt, Homo sapiens
ccucaaugugacc

SEQ ID NO: 2115486 - RNA, 15 nt, Homo sapiens
aucugccuuuaccua

SEQ ID NO: 2115487 - RNA, 19 nt, Homo sapiens
gguggguguggccagcaca

SEQ ID NO: 2115488 - RNA, 11 nt, Homo sapiens
cuucauaauau

SEQ ID NO: 2115489 - RNA, 14 nt, Homo sapiens
gcugugaucaguga

SEQ ID NO: 2115490 - RNA, 20 nt, Homo sapiens
uugcagaaauacaguaugau

SEQ ID NO: 2115491 - RNA, 20 nt, Homo sapiens
ucguuaauagauuauuucau

SEQ ID NO: 2115492 - RNA, 16 nt, Homo sapiens
auuagaagucuuucag

SEQ ID NO: 2115493 - RNA, 16 nt, Homo sapiens
cacacuuuccaucucu

SEQ ID NO: 2115494 - RNA, 22 nt, Homo sapiens
uaagucaaccugccugacauuu

SEQ ID NO: 2115495 - RNA, 16 nt, Homo sapiens
gacuugaaauucucau

SEQ ID NO: 2115496 - RNA, 21 nt, Homo sapiens
gaaaccugucauuguauucag

SEQ ID NO: 2115497 - RNA, 13 nt, Homo sapiens
uccugccuacccc

SEQ ID NO: 2115498 - RNA, 21 nt, Homo sapiens
uaugcucucgcaccuuuccaa

SEQ ID NO: 2115499 - RNA, 20 nt, Homo sapiens
cuucuaagagguagauacca

SEQ ID NO: 2115500 - RNA, 15 nt, Homo sapiens
uugaccuacccugga

SEQ ID NO: 2115501 - RNA, 19 nt, Homo sapiens
accuuguaaccagugcaga

SEQ ID NO: 2115502 - RNA, 19 nt, Homo sapiens
caugauguuaaccagaaua

SEQ ID NO: 2115503 - RNA, 15 nt, Homo sapiens
aacgagagguaugcc

SEQ ID NO: 2115504 - RNA, 15 nt, Homo sapiens
uaggacaauucacuu

SEQ ID NO: 2115505 - RNA, 16 nt, Homo sapiens
uucuguaccauagcgc

SEQ ID NO: 2115506 - RNA, 23 nt, Homo sapiens
uggcccaagugguuugugcuaac

SEQ ID NO: 2115507 - RNA, 14 nt, Homo sapiens
cuagcugucccaug

SEQ ID NO: 2115508 - RNA, 14 nt, Homo sapiens
acgucucagcccuu

SEQ ID NO: 2115509 - RNA, 20 nt, Homo sapiens
agucacuuguuucuacucaa

SEQ ID NO: 2115510 - RNA, 22 nt, Homo sapiens
aacucaaaaggagaacugugcu

SEQ ID NO: 2115511 - RNA, 18 nt, Homo sapiens
cauauucuaguaauaaag

SEQ ID NO: 2115512 - RNA, 20 nt, Homo sapiens
gagauuuugucgggacagag

SEQ ID NO: 2115513 - RNA, 22 nt, Homo sapiens
gcauguccaacaugguaauuca

SEQ ID NO: 2115514 - RNA, 17 nt, Homo sapiens
uucauuaaugaugaucu

SEQ ID NO: 2115515 - RNA, 22 nt, Homo sapiens
auccgaggcagggucaggagag

SEQ ID NO: 2115516 - RNA, 21 nt, Homo sapiens
uucaaaauauguguaucucaa

SEQ ID NO: 2115517 - RNA, 16 nt, Homo sapiens
uaaauuuaucaucucg

SEQ ID NO: 2115518 - RNA, 15 nt, Homo sapiens
uggacgaacaggggc

SEQ ID NO: 2115519 - RNA, 17 nt, Homo sapiens
augaagauacacauuac

SEQ ID NO: 2115520 - RNA, 21 nt, Homo sapiens
agagcauucugggguggggcu

SEQ ID NO: 2115521 - RNA, 21 nt, Homo sapiens
uacagguuaugcuuugagauc

SEQ ID NO: 2115522 - RNA, 20 nt, Homo sapiens
caguguaaagaauaaaugaa

SEQ ID NO: 2115523 - RNA, 14 nt, Homo sapiens
ucccugcuguguga

SEQ ID NO: 2115524 - RNA, 20 nt, Homo sapiens
gccauguuauucagcucacu

SEQ ID NO: 2115525 - RNA, 18 nt, Homo sapiens
gcacauuuaaggcgccau

SEQ ID NO: 2115526 - RNA, 21 nt, Homo sapiens
agacauuuuuuaggggaauaa

SEQ ID NO: 2115527 - RNA, 19 nt, Homo sapiens
aaugaauuauaacaguuau

SEQ ID NO: 2115528 - RNA, 20 nt, Homo sapiens
gacaaagaaggaaaagagua

SEQ ID NO: 2115529 - RNA, 20 nt, Homo sapiens
aauacauuauuggacuucca

SEQ ID NO: 2115530 - RNA, 14 nt, Homo sapiens
gaacucugguggca

SEQ ID NO: 2115531 - RNA, 20 nt, Homo sapiens
gaacuggggcuuugccuugc

SEQ ID NO: 2115532 - RNA, 15 nt, Homo sapiens
gaacuccugaccuca

SEQ ID NO: 2115533 - RNA, 14 nt, Homo sapiens
acucagcagcagag

SEQ ID NO: 2115534 - RNA, 19 nt, Homo sapiens
gaaaagucaaaguguugcu

SEQ ID NO: 2115535 - RNA, 17 nt, Homo sapiens
acucagcuguccugcag

SEQ ID NO: 2115536 - RNA, 19 nt, Homo sapiens
cacagggaagcauguacug

SEQ ID NO: 2115537 - RNA, 15 nt, Homo sapiens
cacucgaugagauaa

SEQ ID NO: 2115538 - RNA, 22 nt, Homo sapiens
gaacaggggucgccaacacuug

SEQ ID NO: 2115539 - RNA, 20 nt, Homo sapiens
uuacaaugcauucugaggua

SEQ ID NO: 2115540 - RNA, 21 nt, Homo sapiens
cugugacugggaccugaauga

SEQ ID NO: 2115541 - RNA, 17 nt, Homo sapiens
acuuggcugcauuugcc

SEQ ID NO: 2115542 - RNA, 17 nt, Homo sapiens
acagcaugaaccuuuag

SEQ ID NO: 2115543 - RNA, 18 nt, Homo sapiens
augcagugauauggcaga

SEQ ID NO: 2115544 - RNA, 17 nt, Homo sapiens
cacauacaggugcucaa

SEQ ID NO: 2115545 - RNA, 12 nt, Homo sapiens
ucccucuguaua

SEQ ID NO: 2115546 - RNA, 14 nt, Homo sapiens
ucccagaaccuauu

SEQ ID NO: 2115547 - RNA, 14 nt, Homo sapiens
gccucugugcugca

SEQ ID NO: 2115548 - RNA, 17 nt, Homo sapiens
gccuaauaugaugacug

SEQ ID NO: 2115549 - RNA, 22 nt, Homo sapiens
uccuggcaucaguagcaucugu

SEQ ID NO: 2115550 - RNA, 15 nt, Homo sapiens
gaacccagaaggcag

SEQ ID NO: 2115551 - RNA, 15 nt, Homo sapiens
ggagccagaggccag

SEQ ID NO: 2115552 - RNA, 15 nt, Homo sapiens
caucguguauuccau

SEQ ID NO: 2115553 - RNA, 13 nt, Homo sapiens
ucacccacuccua

SEQ ID NO: 2115554 - RNA, 13 nt, Homo sapiens
guuuugacaucaa

SEQ ID NO: 2115555 - RNA, 18 nt, Homo sapiens
uacacacacacaaaaaca

SEQ ID NO: 2115556 - RNA, 17 nt, Homo sapiens
agauaccaggcacuuaa

SEQ ID NO: 2115557 - RNA, 18 nt, Homo sapiens
gcagggcccagugacaag

SEQ ID NO: 2115558 - RNA, 16 nt, Homo sapiens
auacggagccauguca

SEQ ID NO: 2115559 - RNA, 19 nt, Homo sapiens
ugucugccagccagcagcc

SEQ ID NO: 2115560 - RNA, 19 nt, Homo sapiens
gagauuuaaagaauucucu

SEQ ID NO: 2115561 - RNA, 21 nt, Homo sapiens
uggaaagaaaagaauguacau

SEQ ID NO: 2115562 - RNA, 18 nt, Homo sapiens
guccugaugcugugcuca

SEQ ID NO: 2115563 - RNA, 11 nt, Homo sapiens
gaguugcuaag

SEQ ID NO: 2115564 - RNA, 12 nt, Homo sapiens
guaacacuacag

SEQ ID NO: 2115565 - RNA, 18 nt, Homo sapiens
gacaaguggggucuuuca

SEQ ID NO: 2115566 - RNA, 13 nt, Homo sapiens
auugagauuuacc

SEQ ID NO: 2115567 - RNA, 21 nt, Homo sapiens
ccaagaugacacaacugcacu

SEQ ID NO: 2115568 - RNA, 12 nt, Homo sapiens
agcgaagucuca

SEQ ID NO: 2115569 - RNA, 20 nt, Homo sapiens
cagcucauuucacuuuacac

SEQ ID NO: 2115570 - RNA, 15 nt, Homo sapiens
acauacaggauuuga

SEQ ID NO: 2115571 - RNA, 20 nt, Homo sapiens
uuaccauacacgcaacuaua

SEQ ID NO: 2115572 - RNA, 18 nt, Homo sapiens
ggagucucaugcaagacu

SEQ ID NO: 2115573 - RNA, 19 nt, Homo sapiens
ccccauaucuuuaaagugu

SEQ ID NO: 2115574 - RNA, 13 nt, Homo sapiens
agauggauuucac

SEQ ID NO: 2115575 - RNA, 13 nt, Homo sapiens
cuccaacuccuga

SEQ ID NO: 2115576 - RNA, 22 nt, Homo sapiens
ggcugcagagccugcaggguga

SEQ ID NO: 2115577 - RNA, 15 nt, Homo sapiens
ccauuuuuugaacca

SEQ ID NO: 2115578 - RNA, 21 nt, Homo sapiens
cuacagugucucgaugccaua

SEQ ID NO: 2115579 - RNA, 12 nt, Homo sapiens
aaacaaucuuag

SEQ ID NO: 2115580 - RNA, 22 nt, Homo sapiens
gcuuccuugguucaugcuucua

SEQ ID NO: 2115581 - RNA, 18 nt, Homo sapiens
accuugggaucagaucaa

SEQ ID NO: 2115582 - RNA, 20 nt, Homo sapiens
aaagcauuacauuuccaaau

SEQ ID NO: 2115583 - RNA, 16 nt, Homo sapiens
ccuccauacucaggac

SEQ ID NO: 2115584 - RNA, 17 nt, Homo sapiens
ucagaauaaaagaugau

SEQ ID NO: 2115585 - RNA, 14 nt, Homo sapiens
acaugccuucacuc

SEQ ID NO: 2115586 - RNA, 13 nt, Homo sapiens
acaacucauccag

SEQ ID NO: 2115587 - RNA, 15 nt, Homo sapiens
caccucagugcccac

SEQ ID NO: 2115588 - RNA, 15 nt, Homo sapiens
auuaccagacaaaaa

SEQ ID NO: 2115589 - RNA, 14 nt, Homo sapiens
gcacaggggcccau

SEQ ID NO: 2115590 - RNA, 19 nt, Homo sapiens
acuccaugcuccuugagag

SEQ ID NO: 2115591 - RNA, 23 nt, Homo sapiens
agguccagccugggcuccuccac

SEQ ID NO: 2115592 - RNA, 15 nt, Homo sapiens
agguugacacaggaa

SEQ ID NO: 2115593 - RNA, 19 nt, Homo sapiens
accucacuggccugccaug

SEQ ID NO: 2115594 - RNA, 21 nt, Homo sapiens
aauagauggauuuguaucaau

SEQ ID NO: 2115595 - RNA, 15 nt, Homo sapiens
augcugccuggcaca

SEQ ID NO: 2115596 - RNA, 17 nt, Homo sapiens
ugugggcagaauccuug

SEQ ID NO: 2115597 - RNA, 20 nt, Homo sapiens
ccccagauaccaugaugcug

SEQ ID NO: 2115598 - RNA, 17 nt, Homo sapiens
aaggucagcccguuuca

SEQ ID NO: 2115599 - RNA, 19 nt, Homo sapiens
uguguuuguagucuugucu

SEQ ID NO: 2115600 - RNA, 23 nt, Homo sapiens
aaccuggccgcguuuagaccaag

SEQ ID NO: 2115601 - RNA, 15 nt, Homo sapiens
acuguuccaaagcca

SEQ ID NO: 2115602 - RNA, 18 nt, Homo sapiens
acuccaggaaaagccauu

SEQ ID NO: 2115603 - RNA, 18 nt, Homo sapiens
ucuuuuacuagucuuuca

SEQ ID NO: 2115604 - RNA, 15 nt, Homo sapiens
aaccccuccacugcu

SEQ ID NO: 2115605 - RNA, 17 nt, Homo sapiens
uuucaugcuuuccuaaa

SEQ ID NO: 2115606 - RNA, 13 nt, Homo sapiens
aacucaccauaga

SEQ ID NO: 2115607 - RNA, 19 nt, Homo sapiens
ggcacaagugucugugcau

SEQ ID NO: 2115608 - RNA, 22 nt, Homo sapiens
uuaauaaacucacaacucucug

SEQ ID NO: 2115609 - RNA, 18 nt, Homo sapiens
uucugaucuaauauccca

SEQ ID NO: 2115610 - RNA, 23 nt, Homo sapiens
acaauuaagagagugaacauauc

SEQ ID NO: 2115611 - RNA, 19 nt, Homo sapiens
aacuauuuuaaauauccau

SEQ ID NO: 2115612 - RNA, 19 nt, Homo sapiens
aaauggaagcaaagacaaa

SEQ ID NO: 2115613 - RNA, 17 nt, Homo sapiens
uucugggcuucaucugg

SEQ ID NO: 2115614 - RNA, 17 nt, Homo sapiens
cuaguagaacaauguac

SEQ ID NO: 2115615 - RNA, 18 nt, Homo sapiens
aggaaccagagugcugaa

SEQ ID NO: 2115616 - RNA, 11 nt, Homo sapiens
cagcacucugc

SEQ ID NO: 2115617 - RNA, 12 nt, Homo sapiens
ucccacagccuc

SEQ ID NO: 2115618 - RNA, 10 nt, Homo sapiens
ucaugcauuu

SEQ ID NO: 2115619 - RNA, 20 nt, Homo sapiens
gaggggcauagccuuucccu

SEQ ID NO: 2115620 - RNA, 11 nt, Homo sapiens
ccucaagcacc

SEQ ID NO: 2115621 - RNA, 18 nt, Homo sapiens
ccugcagagggaccagag

SEQ ID NO: 2115622 - RNA, 17 nt, Homo sapiens
auguggccuuuaucuca

SEQ ID NO: 2115623 - RNA, 17 nt, Homo sapiens
ggcugccggaacaacag

SEQ ID NO: 2115624 - RNA, 13 nt, Homo sapiens
gcuuugcugcuac

SEQ ID NO: 2115625 - RNA, 20 nt, Homo sapiens
uacagugcuguguacccugg

SEQ ID NO: 2115626 - RNA, 23 nt, Homo sapiens
auaaacuccuacuaaaucccucc

SEQ ID NO: 2115627 - RNA, 16 nt, Homo sapiens
agugcaguagugucac

SEQ ID NO: 2115628 - RNA, 12 nt, Homo sapiens
gugaacucaucc

SEQ ID NO: 2115629 - RNA, 16 nt, Homo sapiens
ccuggagaguacauuu

SEQ ID NO: 2115630 - RNA, 21 nt, Homo sapiens
caugcccucggucacugaguc

SEQ ID NO: 2115631 - RNA, 17 nt, Homo sapiens
cagaucaagccugccuc

SEQ ID NO: 2115632 - RNA, 22 nt, Homo sapiens
agagguguacacuaacauuucc

SEQ ID NO: 2115633 - RNA, 22 nt, Homo sapiens
aaauguguucuguaauggggac

SEQ ID NO: 2115634 - RNA, 19 nt, Homo sapiens
caagauuuaacuguuugau

SEQ ID NO: 2115635 - RNA, 16 nt, Homo sapiens
gggagcugggagccag

SEQ ID NO: 2115636 - RNA, 14 nt, Homo sapiens
uuucauacauuuga

SEQ ID NO: 2115637 - RNA, 18 nt, Homo sapiens
caugcccacggaugcuca

SEQ ID NO: 2115638 - RNA, 12 nt, Homo sapiens
agcagaaagcca

SEQ ID NO: 2115639 - RNA, 14 nt, Homo sapiens
cuaaugacagccuu

SEQ ID NO: 2115640 - RNA, 20 nt, Homo sapiens
ugcaugaugucuaccucaga

SEQ ID NO: 2115641 - RNA, 20 nt, Homo sapiens
aggaucuccccgaaucucaa

SEQ ID NO: 2115642 - RNA, 20 nt, Homo sapiens
ggaaugccgcuagucucuga

SEQ ID NO: 2115643 - RNA, 20 nt, Homo sapiens
acgugacacugugggucuga

SEQ ID NO: 2115644 - RNA, 13 nt, Homo sapiens
ccaagcagugcac

SEQ ID NO: 2115645 - RNA, 22 nt, Homo sapiens
aagggagucauuuuuuaaguga

SEQ ID NO: 2115646 - RNA, 12 nt, Homo sapiens
ugccccaacugc

SEQ ID NO: 2115647 - RNA, 19 nt, Homo sapiens
guugaugguagguggcaca

SEQ ID NO: 2115648 - RNA, 18 nt, Homo sapiens
acucaaagaaaacugucu

SEQ ID NO: 2115649 - RNA, 17 nt, Homo sapiens
gccgccgaccugugacu

SEQ ID NO: 2115650 - RNA, 15 nt, Homo sapiens
uccccucagccucuu

SEQ ID NO: 2115651 - RNA, 14 nt, Homo sapiens
auaauucacuguac

SEQ ID NO: 2115652 - RNA, 21 nt, Homo sapiens
ugucauauauuacuagcauau

SEQ ID NO: 2115653 - RNA, 18 nt, Homo sapiens
uaagaaaccauuauuuca

SEQ ID NO: 2115654 - RNA, 23 nt, Homo sapiens
agagacucuccugccucagccuc

SEQ ID NO: 2115655 - RNA, 12 nt, Homo sapiens
agagaccaaaaa

SEQ ID NO: 2115656 - RNA, 15 nt, Homo sapiens
aauccagaacucaaa

SEQ ID NO: 2115657 - RNA, 18 nt, Homo sapiens
agcacccuauauacacuu

SEQ ID NO: 2115658 - RNA, 17 nt, Homo sapiens
uuauucauaaugugaga

SEQ ID NO: 2115659 - RNA, 16 nt, Homo sapiens
ccugcucacucuucca

SEQ ID NO: 2115660 - RNA, 18 nt, Homo sapiens
ucacagcccucaugauca

SEQ ID NO: 2115661 - RNA, 20 nt, Homo sapiens
caugaugcugagcccggaaa

SEQ ID NO: 2115662 - RNA, 20 nt, Homo sapiens
aaggcuucucuccacagugu

SEQ ID NO: 2115663 - RNA, 19 nt, Homo sapiens
augucccagaucgucucca

SEQ ID NO: 2115664 - RNA, 19 nt, Homo sapiens
uccacuggaaaaguguaau

SEQ ID NO: 2115665 - RNA, 16 nt, Homo sapiens
ccugcugcucccucag

SEQ ID NO: 2115666 - RNA, 21 nt, Homo sapiens
aaugcuggguguugcauuucu

SEQ ID NO: 2115667 - RNA, 13 nt, Homo sapiens
uccguacauucaa

SEQ ID NO: 2115668 - RNA, 13 nt, Homo sapiens
ugcuuaaauucaa

SEQ ID NO: 2115669 - RNA, 15 nt, Homo sapiens
acuugggacauugcc

SEQ ID NO: 2115670 - RNA, 18 nt, Homo sapiens
ucacagaggcaguaggaa

SEQ ID NO: 2115671 - RNA, 18 nt, Homo sapiens
cacaagccaggaccugcu

SEQ ID NO: 2115672 - RNA, 20 nt, Homo sapiens
auauugagcaauaugucagu

SEQ ID NO: 2115673 - RNA, 17 nt, Homo sapiens
accaguugggagcacug

SEQ ID NO: 2115674 - RNA, 15 nt, Homo sapiens
auacacauauacaaa

SEQ ID NO: 2115675 - RNA, 22 nt, Homo sapiens
cccagcccucggguccauagag

SEQ ID NO: 2115676 - RNA, 14 nt, Homo sapiens
uauauucaagguua

SEQ ID NO: 2115677 - RNA, 21 nt, Homo sapiens
uaaaacaaaacaaacaaccug

SEQ ID NO: 2115678 - RNA, 22 nt, Homo sapiens
ucagaacucuguguugugaaug

SEQ ID NO: 2115679 - RNA, 15 nt, Homo sapiens
ccaauuuacuugcca

SEQ ID NO: 2115680 - RNA, 19 nt, Homo sapiens
gcagcagauuuuaggaaau

SEQ ID NO: 2115681 - RNA, 15 nt, Homo sapiens
uauguagauauuugg

SEQ ID NO: 2115682 - RNA, 14 nt, Homo sapiens
guuuaaacagucaa

SEQ ID NO: 2115683 - RNA, 16 nt, Homo sapiens
guaacgauugacacca

SEQ ID NO: 2115684 - RNA, 14 nt, Homo sapiens
cacuaccaauuucc

SEQ ID NO: 2115685 - RNA, 14 nt, Homo sapiens
aacacucacuuaau

SEQ ID NO: 2115686 - RNA, 22 nt, Homo sapiens
gagcccaucaccgccucuugca

SEQ ID NO: 2115687 - RNA, 13 nt, Homo sapiens
cccuccccugggc

SEQ ID NO: 2115688 - RNA, 18 nt, Homo sapiens
ggcaccaaaguccaggac

SEQ ID NO: 2115689 - RNA, 22 nt, Homo sapiens
agugccgaaaacuucacugugc

SEQ ID NO: 2115690 - RNA, 18 nt, Homo sapiens
uccuuuccaucagcuuua

SEQ ID NO: 2115691 - RNA, 19 nt, Homo sapiens
ugccaggcucuaaagccaa

SEQ ID NO: 2115692 - RNA, 12 nt, Homo sapiens
uaguuaaucucc

SEQ ID NO: 2115693 - RNA, 20 nt, Homo sapiens
augaccaaaacuauuccauu

SEQ ID NO: 2115694 - RNA, 15 nt, Homo sapiens
acaucagagugacau

SEQ ID NO: 2115695 - RNA, 16 nt, Homo sapiens
ggcauuagugcugaua

SEQ ID NO: 2115696 - RNA, 15 nt, Homo sapiens
cuccuuccagccuga

SEQ ID NO: 2115697 - RNA, 14 nt, Homo sapiens
gacaccaggcaaga

SEQ ID NO: 2115698 - RNA, 14 nt, Homo sapiens
gcccucagcucuua

SEQ ID NO: 2115699 - RNA, 13 nt, Homo sapiens
uauagguuuccaa

SEQ ID NO: 2115700 - RNA, 22 nt, Homo sapiens
uacaaguuuauguggcacacaa

SEQ ID NO: 2115701 - RNA, 22 nt, Homo sapiens
gaaacaaagaagguuaccaaga

SEQ ID NO: 2115702 - RNA, 21 nt, Homo sapiens
aggaagaucuugagagcugcu

SEQ ID NO: 2115703 - RNA, 15 nt, Homo sapiens
uacuacacccagcua

SEQ ID NO: 2115704 - RNA, 13 nt, Homo sapiens
ugauccucagugc

SEQ ID NO: 2115705 - RNA, 12 nt, Homo sapiens
aaaaugauacug

SEQ ID NO: 2115706 - RNA, 19 nt, Homo sapiens
acaugagaaggaacuucca

SEQ ID NO: 2115707 - RNA, 17 nt, Homo sapiens
ugcaaugugaucuaugu

SEQ ID NO: 2115708 - RNA, 16 nt, Homo sapiens
caagcaaaccuucuca

SEQ ID NO: 2115709 - RNA, 14 nt, Homo sapiens
ucucccucugauug

SEQ ID NO: 2115710 - RNA, 19 nt, Homo sapiens
agaaacucaaaaauauuug

SEQ ID NO: 2115711 - RNA, 21 nt, Homo sapiens
agcuaauuugugaaaguggca

SEQ ID NO: 2115712 - RNA, 18 nt, Homo sapiens
cauuaaccaagaaaacca

SEQ ID NO: 2115713 - RNA, 19 nt, Homo sapiens
gcuaagaauauuugaaugu

SEQ ID NO: 2115714 - RNA, 19 nt, Homo sapiens
ugaaggggcugguggagau

SEQ ID NO: 2115715 - RNA, 17 nt, Homo sapiens
gauuggcuuaaagugaa

SEQ ID NO: 2115716 - RNA, 19 nt, Homo sapiens
augaaaucugcuagaaagu

SEQ ID NO: 2115717 - RNA, 15 nt, Homo sapiens
augugauccuuuuau

SEQ ID NO: 2115718 - RNA, 22 nt, Homo sapiens
ggaggaaaagacuaacaggaga

SEQ ID NO: 2115719 - RNA, 21 nt, Homo sapiens
gagccacucagucucuuccac

SEQ ID NO: 2115720 - RNA, 23 nt, Homo sapiens
uaucauugcuaaacugaugacuu

SEQ ID NO: 2115721 - RNA, 21 nt, Homo sapiens
aaggacaccauuuuggcaagc

SEQ ID NO: 2115722 - RNA, 20 nt, Homo sapiens
caguucaccuauuucaaaaa

SEQ ID NO: 2115723 - RNA, 22 nt, Homo sapiens
cagauuauaacuguugucauau

SEQ ID NO: 2115724 - RNA, 16 nt, Homo sapiens
aggcaaaggcucucac

SEQ ID NO: 2115725 - RNA, 15 nt, Homo sapiens
cccuccaccuuccau

SEQ ID NO: 2115726 - RNA, 17 nt, Homo sapiens
agaaauaauacccugcc

SEQ ID NO: 2115727 - RNA, 15 nt, Homo sapiens
uaaaacagauauuau

SEQ ID NO: 2115728 - RNA, 15 nt, Homo sapiens
uguagcuaaauguac

SEQ ID NO: 2115729 - RNA, 13 nt, Homo sapiens
aagcccaggagcc

SEQ ID NO: 2115730 - RNA, 15 nt, Homo sapiens
ccugcuuuucacugc

SEQ ID NO: 2115731 - RNA, 21 nt, Homo sapiens
caguaugagucaaugugcagu

SEQ ID NO: 2115732 - RNA, 14 nt, Homo sapiens
agcccuuuccccac

SEQ ID NO: 2115733 - RNA, 23 nt, Homo sapiens
cguguauguuuuucaguucaaag

SEQ ID NO: 2115734 - RNA, 19 nt, Homo sapiens
agcucauccaugccucaga

SEQ ID NO: 2115735 - RNA, 11 nt, Homo sapiens
acucugaagac

SEQ ID NO: 2115736 - RNA, 13 nt, Homo sapiens
cauauaugaauuu

SEQ ID NO: 2115737 - RNA, 13 nt, Homo sapiens
auuucuaccucag

SEQ ID NO: 2115738 - RNA, 15 nt, Homo sapiens
agaagugaguggugu

SEQ ID NO: 2115739 - RNA, 19 nt, Homo sapiens
ccaugugcacaagugugca

SEQ ID NO: 2115740 - RNA, 17 nt, Homo sapiens
gccgauuacacccaaau

SEQ ID NO: 2115741 - RNA, 20 nt, Homo sapiens
aguuauuacauguaauuuga

SEQ ID NO: 2115742 - RNA, 17 nt, Homo sapiens
acugcagagagacaaca

SEQ ID NO: 2115743 - RNA, 17 nt, Homo sapiens
guauauccuguauacuu

SEQ ID NO: 2115744 - RNA, 21 nt, Homo sapiens
acaacauugcauugugacuau

SEQ ID NO: 2115745 - RNA, 14 nt, Homo sapiens
cccugacaaaaagg

SEQ ID NO: 2115746 - RNA, 13 nt, Homo sapiens
guguguuguuaca

SEQ ID NO: 2115747 - RNA, 21 nt, Homo sapiens
cuauuuggaaagcacuggaau

SEQ ID NO: 2115748 - RNA, 18 nt, Homo sapiens
guccuacucauauuccuc

SEQ ID NO: 2115749 - RNA, 15 nt, Homo sapiens
uugaaugaugagccu

SEQ ID NO: 2115750 - RNA, 13 nt, Homo sapiens
cgcucucuuccag

SEQ ID NO: 2115751 - RNA, 21 nt, Homo sapiens
cuuuaaguucuucuauuucaa

SEQ ID NO: 2115752 - RNA, 14 nt, Homo sapiens
aaugucagugacau

SEQ ID NO: 2115753 - RNA, 14 nt, Homo sapiens
cuguuugucucacc

SEQ ID NO: 2115754 - RNA, 16 nt, Homo sapiens
uccaccuagacuguaa

SEQ ID NO: 2115755 - RNA, 13 nt, Homo sapiens
cagcccuuuccag

SEQ ID NO: 2115756 - RNA, 16 nt, Homo sapiens
uggaaaaguacaagua

SEQ ID NO: 2115757 - RNA, 13 nt, Homo sapiens
ggcagagcuucuu

SEQ ID NO: 2115758 - RNA, 16 nt, Homo sapiens
guugauuuccgugaaa

SEQ ID NO: 2115759 - RNA, 20 nt, Homo sapiens
ugcuggagacauugaggcag

SEQ ID NO: 2115760 - RNA, 22 nt, Homo sapiens
auccuccucccaacucuagccu

SEQ ID NO: 2115761 - RNA, 14 nt, Homo sapiens
aauaaaugaaugca

SEQ ID NO: 2115762 - RNA, 13 nt, Homo sapiens
caaacugcaaaua

SEQ ID NO: 2115763 - RNA, 23 nt, Homo sapiens
cagcagauaaggccgagcccaca

SEQ ID NO: 2115764 - RNA, 16 nt, Homo sapiens
ugagguuuugaaagaa

SEQ ID NO: 2115765 - RNA, 18 nt, Homo sapiens
cuuaucuuucuaaaacug

SEQ ID NO: 2115766 - RNA, 16 nt, Homo sapiens
agggagggcucugagg

SEQ ID NO: 2115767 - RNA, 17 nt, Homo sapiens
gcacuugcugaggccaa

SEQ ID NO: 2115768 - RNA, 19 nt, Homo sapiens
ccucauuguucuguacaaa

SEQ ID NO: 2115769 - RNA, 13 nt, Homo sapiens
agaaggcaaccca

SEQ ID NO: 2115770 - RNA, 15 nt, Homo sapiens
cgauucaaacugcuc

SEQ ID NO: 2115771 - RNA, 21 nt, Homo sapiens
acaacuuucacuauaauguga

SEQ ID NO: 2115772 - RNA, 19 nt, Homo sapiens
acauuaaauucacaugcag

SEQ ID NO: 2115773 - RNA, 20 nt, Homo sapiens
ucucaaacuccugggcucaa

SEQ ID NO: 2115774 - RNA, 16 nt, Homo sapiens
gcaccccugucucuag

SEQ ID NO: 2115775 - RNA, 19 nt, Homo sapiens
cacagaccccgggucuccu

SEQ ID NO: 2115776 - RNA, 17 nt, Homo sapiens
agcaucaaagagauggu

SEQ ID NO: 2115777 - RNA, 20 nt, Homo sapiens
cuauuuuuguagaucuccau

SEQ ID NO: 2115778 - RNA, 13 nt, Homo sapiens
ggccccacugggg

SEQ ID NO: 2115779 - RNA, 13 nt, Homo sapiens
aucauagcucacu

SEQ ID NO: 2115780 - RNA, 17 nt, Homo sapiens
uuaaauaguucaguaua

SEQ ID NO: 2115781 - RNA, 22 nt, Homo sapiens
uaguugcguggacucugcacau

SEQ ID NO: 2115782 - RNA, 18 nt, Homo sapiens
acuggcauaaaucugaag

SEQ ID NO: 2115783 - RNA, 22 nt, Homo sapiens
cagugaaggguuuuguguguuu

SEQ ID NO: 2115784 - RNA, 14 nt, Homo sapiens
gggaaagcagagug

SEQ ID NO: 2115785 - RNA, 20 nt, Homo sapiens
cagaaacugaauucuggaca

SEQ ID NO: 2115786 - RNA, 19 nt, Homo sapiens
gggugcccucuccaaaggc

SEQ ID NO: 2115787 - RNA, 19 nt, Homo sapiens
ucccuuuuuuuacauuuca

SEQ ID NO: 2115788 - RNA, 20 nt, Homo sapiens
agugaacauucgaccuccau

SEQ ID NO: 2115789 - RNA, 16 nt, Homo sapiens
gcccccgccacaaccc

SEQ ID NO: 2115790 - RNA, 16 nt, Homo sapiens
ucuucccuuaccucaa

SEQ ID NO: 2115791 - RNA, 16 nt, Homo sapiens
cauucccaccccucau

SEQ ID NO: 2115792 - RNA, 21 nt, Homo sapiens
uucaaugguuuaacauauaau

SEQ ID NO: 2115793 - RNA, 13 nt, Homo sapiens
gaguauacuaaaa

SEQ ID NO: 2115794 - RNA, 21 nt, Homo sapiens
gagcaugcucaguuggugcug

SEQ ID NO: 2115795 - RNA, 20 nt, Homo sapiens
gcaguucucgcagauguuac

SEQ ID NO: 2115796 - RNA, 15 nt, Homo sapiens
cucauugugucuccc

SEQ ID NO: 2115797 - RNA, 20 nt, Homo sapiens
gaauccuggaccaagcacaa

SEQ ID NO: 2115798 - RNA, 19 nt, Homo sapiens
ucagaaaagacgcaccagc

SEQ ID NO: 2115799 - RNA, 21 nt, Homo sapiens
auucccaucauacacuuccuu

SEQ ID NO: 2115800 - RNA, 22 nt, Homo sapiens
caaccuucugcccuccugccaa

SEQ ID NO: 2115801 - RNA, 20 nt, Homo sapiens
acuuggagacuugguggucu

SEQ ID NO: 2115802 - RNA, 22 nt, Homo sapiens
aguaaguacuuaauaaacugug

SEQ ID NO: 2115803 - RNA, 17 nt, Homo sapiens
cagccucggccucccaa

SEQ ID NO: 2115804 - RNA, 22 nt, Homo sapiens
gguuggucaaggccaccucugc

SEQ ID NO: 2115805 - RNA, 15 nt, Homo sapiens
ugucacagcuaccaa

SEQ ID NO: 2115806 - RNA, 15 nt, Homo sapiens
agucaaaagaacucu

SEQ ID NO: 2115807 - RNA, 18 nt, Homo sapiens
agaggcuggaguugucac

SEQ ID NO: 2115808 - RNA, 19 nt, Homo sapiens
ucucaaaugaaaauuuaau

SEQ ID NO: 2115809 - RNA, 15 nt, Homo sapiens
uaugcaagugcaaaa

SEQ ID NO: 2115810 - RNA, 10 nt, Homo sapiens
aaauggaaca

SEQ ID NO: 2115811 - RNA, 22 nt, Homo sapiens
cauaccuggcccugugccuugg

SEQ ID NO: 2115812 - RNA, 11 nt, Homo sapiens
caccacuccac

SEQ ID NO: 2115813 - RNA, 18 nt, Homo sapiens
ucaguaucaguauuuaca

SEQ ID NO: 2115814 - RNA, 18 nt, Homo sapiens
uaugaugucccuauggaa

SEQ ID NO: 2115815 - RNA, 15 nt, Homo sapiens
uaaaauaggggagcc

SEQ ID NO: 2115816 - RNA, 18 nt, Homo sapiens
uggccagugugaucccaa

SEQ ID NO: 2115817 - RNA, 21 nt, Homo sapiens
ggagccggacacuucucagga

SEQ ID NO: 2115818 - RNA, 19 nt, Homo sapiens
gaaaaccaacuaauauaca

SEQ ID NO: 2115819 - RNA, 19 nt, Homo sapiens
ugcuuucuuauaacuuugg

SEQ ID NO: 2115820 - RNA, 20 nt, Homo sapiens
ccacugcacccccuccugcu

SEQ ID NO: 2115821 - RNA, 13 nt, Homo sapiens
guucaaaguuuaa

SEQ ID NO: 2115822 - RNA, 21 nt, Homo sapiens
gccuauguugugguccaucag

SEQ ID NO: 2115823 - RNA, 21 nt, Homo sapiens
uucauuaccuuuuuugauaaa

SEQ ID NO: 2115824 - RNA, 13 nt, Homo sapiens
acaaaaugauacu

SEQ ID NO: 2115825 - RNA, 18 nt, Homo sapiens
ccucaagggccaggacuu

SEQ ID NO: 2115826 - RNA, 19 nt, Homo sapiens
uggcaaauguagcccugca

SEQ ID NO: 2115827 - RNA, 20 nt, Homo sapiens
uuuaccaaaauucagaacau

SEQ ID NO: 2115828 - RNA, 19 nt, Homo sapiens
auuaucacauuaaucucaa

SEQ ID NO: 2115829 - RNA, 21 nt, Homo sapiens
agcuccucccacaaugcugaa

SEQ ID NO: 2115830 - RNA, 20 nt, Homo sapiens
ucaguuuuguucacuuguua

SEQ ID NO: 2115831 - RNA, 13 nt, Homo sapiens
gagauuacaggug

SEQ ID NO: 2115832 - RNA, 22 nt, Homo sapiens
uccugaagcccagcgacacaga

SEQ ID NO: 2115833 - RNA, 15 nt, Homo sapiens
cuuucacccucauga

SEQ ID NO: 2115834 - RNA, 22 nt, Homo sapiens
cugcugagagacagagcuauuc

SEQ ID NO: 2115835 - RNA, 19 nt, Homo sapiens
ugucucgauuagacuccau

SEQ ID NO: 2115836 - RNA, 23 nt, Homo sapiens
aauugucuuaauggaugaaauca

SEQ ID NO: 2115837 - RNA, 19 nt, Homo sapiens
uggagaaagggcagaggaa

SEQ ID NO: 2115838 - RNA, 17 nt, Homo sapiens
uugacucucacacugaa

SEQ ID NO: 2115839 - RNA, 16 nt, Homo sapiens
uuugauuucagguuug

SEQ ID NO: 2115840 - RNA, 13 nt, Homo sapiens
aaacagugcuguu

SEQ ID NO: 2115841 - RNA, 14 nt, Homo sapiens
aauacccauauguc

SEQ ID NO: 2115842 - RNA, 21 nt, Homo sapiens
guguagcugugaccugcugag

SEQ ID NO: 2115843 - RNA, 14 nt, Homo sapiens
gugcaguaucucaa

SEQ ID NO: 2115844 - RNA, 15 nt, Homo sapiens
guuccaaguuuccaa

SEQ ID NO: 2115845 - RNA, 15 nt, Homo sapiens
uucuugaggucuuga

SEQ ID NO: 2115846 - RNA, 13 nt, Homo sapiens
auaguaaacuacg

SEQ ID NO: 2115847 - RNA, 13 nt, Homo sapiens
acaggaaaccacu

SEQ ID NO: 2115848 - RNA, 20 nt, Homo sapiens
aaugggugauauccugaaaa

SEQ ID NO: 2115849 - RNA, 14 nt, Homo sapiens
agccucccuuccau

SEQ ID NO: 2115850 - RNA, 17 nt, Homo sapiens
acucauuuuuguuuuca

SEQ ID NO: 2115851 - RNA, 15 nt, Homo sapiens
agagauauaucugaa

SEQ ID NO: 2115852 - RNA, 13 nt, Homo sapiens
guuaugacaguga

SEQ ID NO: 2115853 - RNA, 17 nt, Homo sapiens
gcacacaccucaugcua

SEQ ID NO: 2115854 - RNA, 21 nt, Homo sapiens
gauggaauaaagcccuugaac

SEQ ID NO: 2115855 - RNA, 20 nt, Homo sapiens
uugaauuuuuuucugcacag

SEQ ID NO: 2115856 - RNA, 17 nt, Homo sapiens
gguucugucuacaggga

SEQ ID NO: 2115857 - RNA, 13 nt, Homo sapiens
agugcaguggcgu

SEQ ID NO: 2115858 - RNA, 22 nt, Homo sapiens
guaaacuuuucaguauugcugu

SEQ ID NO: 2115859 - RNA, 18 nt, Homo sapiens
auguggcaaaauguuaca

SEQ ID NO: 2115860 - RNA, 20 nt, Homo sapiens
auuuaauacccugcaaugua

SEQ ID NO: 2115861 - RNA, 16 nt, Homo sapiens
cauuuuuuaccacaau

SEQ ID NO: 2115862 - RNA, 21 nt, Homo sapiens
guguuuauaauaaaugaggaa

SEQ ID NO: 2115863 - RNA, 20 nt, Homo sapiens
uauccacuggacacugugaa

SEQ ID NO: 2115864 - RNA, 15 nt, Homo sapiens
cuccauugugccuaa

SEQ ID NO: 2115865 - RNA, 22 nt, Homo sapiens
uauuaggcuauaaauguccuaa

SEQ ID NO: 2115866 - RNA, 15 nt, Homo sapiens
gaaaacaccuuuauu

SEQ ID NO: 2115867 - RNA, 15 nt, Homo sapiens
gaacacaaagaucaa

SEQ ID NO: 2115868 - RNA, 20 nt, Homo sapiens
ugcggaccaaacuacuucau

SEQ ID NO: 2115869 - RNA, 20 nt, Homo sapiens
uuuguauuuaaaaccuugau

SEQ ID NO: 2115870 - RNA, 20 nt, Homo sapiens
agauucucaaaauuccuaca

SEQ ID NO: 2115871 - RNA, 22 nt, Homo sapiens
cagcccagaccucugacacauu

SEQ ID NO: 2115872 - RNA, 22 nt, Homo sapiens
guaaccugggaaagccaugacc

SEQ ID NO: 2115873 - RNA, 22 nt, Homo sapiens
acuguugguguucggagcucuu

SEQ ID NO: 2115874 - RNA, 20 nt, Homo sapiens
ggcugugcggaucucuggag

SEQ ID NO: 2115875 - RNA, 19 nt, Homo sapiens
acaaucaugaaauaugcau

SEQ ID NO: 2115876 - RNA, 17 nt, Homo sapiens
cgugauggaccaaagcc

SEQ ID NO: 2115877 - RNA, 17 nt, Homo sapiens
uccucaggugaccaaaa

SEQ ID NO: 2115878 - RNA, 21 nt, Homo sapiens
ucccuguguggaccaugggga

SEQ ID NO: 2115879 - RNA, 16 nt, Homo sapiens
ggcgagccugacucug

SEQ ID NO: 2115880 - RNA, 15 nt, Homo sapiens
ugucaucugcugcga

SEQ ID NO: 2115881 - RNA, 21 nt, Homo sapiens
cuaggauuuucucauccucau

SEQ ID NO: 2115882 - RNA, 17 nt, Homo sapiens
guaaaaugcuggugaaa

SEQ ID NO: 2115883 - RNA, 14 nt, Homo sapiens
ugccuuacaaaaua

SEQ ID NO: 2115884 - RNA, 14 nt, Homo sapiens
aggcucagcacuuu

SEQ ID NO: 2115885 - RNA, 14 nt, Homo sapiens
gaguugaagacaga

SEQ ID NO: 2115886 - RNA, 20 nt, Homo sapiens
ucuccagcaauaauguuuuc

SEQ ID NO: 2115887 - RNA, 15 nt, Homo sapiens
ccauguuggccucca

SEQ ID NO: 2115888 - RNA, 16 nt, Homo sapiens
cuugagaaaaugcagg

SEQ ID NO: 2115889 - RNA, 21 nt, Homo sapiens
uugcugucauaagaaugaaua

SEQ ID NO: 2115890 - RNA, 23 nt, Homo sapiens
cuuguaaacauugccugauuugu

SEQ ID NO: 2115891 - RNA, 14 nt, Homo sapiens
ucaggacucugaaa

SEQ ID NO: 2115892 - RNA, 17 nt, Homo sapiens
ucaggcauugaaugaca

SEQ ID NO: 2115893 - RNA, 21 nt, Homo sapiens
ccucuagguaaacuagcaaaa

SEQ ID NO: 2115894 - RNA, 14 nt, Homo sapiens
caugaggucuuccc

SEQ ID NO: 2115895 - RNA, 21 nt, Homo sapiens
uaccuucuaccucuuggcugc

SEQ ID NO: 2115896 - RNA, 23 nt, Homo sapiens
gaacugaaguuuccgcccccgcc

SEQ ID NO: 2115897 - RNA, 21 nt, Homo sapiens
auuugccuguaacaagccaga

SEQ ID NO: 2115898 - RNA, 19 nt, Homo sapiens
guugcaauagaacagagaa

SEQ ID NO: 2115899 - RNA, 17 nt, Homo sapiens
uuacaucuaucccagag

SEQ ID NO: 2115900 - RNA, 15 nt, Homo sapiens
gcaaagugcacauga

SEQ ID NO: 2115901 - RNA, 23 nt, Homo sapiens
gcaaaaguggggcuaaaugaagu

SEQ ID NO: 2115902 - RNA, 20 nt, Homo sapiens
auucuuuucuuuuccauuua

SEQ ID NO: 2115903 - RNA, 16 nt, Homo sapiens
gccagaugauuguuca

SEQ ID NO: 2115904 - RNA, 23 nt, Homo sapiens
auguuguuaugcuauuaaaguga

SEQ ID NO: 2115905 - RNA, 14 nt, Homo sapiens
aaaggaaguucucc

SEQ ID NO: 2115906 - RNA, 16 nt, Homo sapiens
acaauggcaccucugc

SEQ ID NO: 2115907 - RNA, 19 nt, Homo sapiens
aaugauacuugguccuuaa

SEQ ID NO: 2115908 - RNA, 17 nt, Homo sapiens
aaauauaauucuguuuc

SEQ ID NO: 2115909 - RNA, 20 nt, Homo sapiens
gauguauaaaauggucaugg

SEQ ID NO: 2115910 - RNA, 19 nt, Homo sapiens
uauuuuugugaaguauuca

SEQ ID NO: 2115911 - RNA, 14 nt, Homo sapiens
uuaacacauucaau

SEQ ID NO: 2115912 - RNA, 15 nt, Homo sapiens
uuuucaagcaaaaca

SEQ ID NO: 2115913 - RNA, 15 nt, Homo sapiens
ugcaugacuuuacac

SEQ ID NO: 2115914 - RNA, 15 nt, Homo sapiens
aacuuuaugaacucc

SEQ ID NO: 2115915 - RNA, 14 nt, Homo sapiens
gaaugcaauaucau

SEQ ID NO: 2115916 - RNA, 19 nt, Homo sapiens
uuuucuguaaauggaacaa

SEQ ID NO: 2115917 - RNA, 15 nt, Homo sapiens
ccuugcugugaaauu

SEQ ID NO: 2115918 - RNA, 17 nt, Homo sapiens
gcaacucacacauuccc

SEQ ID NO: 2115919 - RNA, 13 nt, Homo sapiens
uucugcuccuuag

SEQ ID NO: 2115920 - RNA, 18 nt, Homo sapiens
uccaugaaaaugaaccau

SEQ ID NO: 2115921 - RNA, 13 nt, Homo sapiens
agaaucacuuaag

SEQ ID NO: 2115922 - RNA, 20 nt, Homo sapiens
cagacgcucauucagcaucu

SEQ ID NO: 2115923 - RNA, 16 nt, Homo sapiens
cuuuguugcucagcaa

SEQ ID NO: 2115924 - RNA, 17 nt, Homo sapiens
cuucugaggacauucca

SEQ ID NO: 2115925 - RNA, 20 nt, Homo sapiens
gccugaagaaacaaggcauu

SEQ ID NO: 2115926 - RNA, 16 nt, Homo sapiens
aagaaauaaccaugaa

SEQ ID NO: 2115927 - RNA, 20 nt, Homo sapiens
aagccccucuauacccuggu

SEQ ID NO: 2115928 - RNA, 19 nt, Homo sapiens
gagauuccagucuacuuga

SEQ ID NO: 2115929 - RNA, 17 nt, Homo sapiens
caacccaauaaaacuga

SEQ ID NO: 2115930 - RNA, 22 nt, Homo sapiens
accguccucgagcaacugcugu

SEQ ID NO: 2115931 - RNA, 22 nt, Homo sapiens
ccagaggugucgggacaugguu

SEQ ID NO: 2115932 - RNA, 15 nt, Homo sapiens
ggcucaugccuguaa

SEQ ID NO: 2115933 - RNA, 16 nt, Homo sapiens
caccucuuuuugaaca

SEQ ID NO: 2115934 - RNA, 16 nt, Homo sapiens
auggcaggugccugua

SEQ ID NO: 2115935 - RNA, 20 nt, Homo sapiens
agucacugcucuucagccau

SEQ ID NO: 2115936 - RNA, 19 nt, Homo sapiens
uaacaacaacaacaaaagc

SEQ ID NO: 2115937 - RNA, 15 nt, Homo sapiens
uauagcaaugugauu

SEQ ID NO: 2115938 - RNA, 16 nt, Homo sapiens
aauuaaagucuacacu

SEQ ID NO: 2115939 - RNA, 17 nt, Homo sapiens
gccuauugcaacaaagu

SEQ ID NO: 2115940 - RNA, 12 nt, Homo sapiens
cuuccauuugcu

SEQ ID NO: 2115941 - RNA, 15 nt, Homo sapiens
cucauagauugcaaa

SEQ ID NO: 2115942 - RNA, 19 nt, Homo sapiens
uaaaugugauuuacgcuca

SEQ ID NO: 2115943 - RNA, 15 nt, Homo sapiens
acaagacacccaagu

SEQ ID NO: 2115944 - RNA, 17 nt, Homo sapiens
uggaagaguaguaauag

SEQ ID NO: 2115945 - RNA, 22 nt, Homo sapiens
gaugacucugucucauugaccu

SEQ ID NO: 2115946 - RNA, 16 nt, Homo sapiens
gauggagcgcaccugc

SEQ ID NO: 2115947 - RNA, 24 nt, Homo sapiens
aaggugugcucugaucauccacug

SEQ ID NO: 2115948 - RNA, 20 nt, Homo sapiens
ugacagcuguguacucuuag

SEQ ID NO: 2115949 - RNA, 14 nt, Homo sapiens
caacaccaucacag

SEQ ID NO: 2115950 - RNA, 13 nt, Homo sapiens
cauaucagugaac

SEQ ID NO: 2115951 - RNA, 15 nt, Homo sapiens
uacauuaugcccuug

SEQ ID NO: 2115952 - RNA, 20 nt, Homo sapiens
cagcgugcuggcgacacuca

SEQ ID NO: 2115953 - RNA, 17 nt, Homo sapiens
gcuuaagugacuuccuc

SEQ ID NO: 2115954 - RNA, 16 nt, Homo sapiens
aggcacuguaguucua

SEQ ID NO: 2115955 - RNA, 21 nt, Homo sapiens
uguaaacauagauagugcuuu

SEQ ID NO: 2115956 - RNA, 17 nt, Homo sapiens
aagauuucagaagccaa

SEQ ID NO: 2115957 - RNA, 19 nt, Homo sapiens
ugcugcugagugcaccacu

SEQ ID NO: 2115958 - RNA, 17 nt, Homo sapiens
gaaaucacgcagaccca

SEQ ID NO: 2115959 - RNA, 17 nt, Homo sapiens
agucuuuguuuacauga

SEQ ID NO: 2115960 - RNA, 17 nt, Homo sapiens
uuccuacuugcacucuu

SEQ ID NO: 2115961 - RNA, 15 nt, Homo sapiens
caagcagagugcaca

SEQ ID NO: 2115962 - RNA, 22 nt, Homo sapiens
gcccuuacuugcuucucuagcu

SEQ ID NO: 2115963 - RNA, 14 nt, Homo sapiens
uacugagagcaugu

SEQ ID NO: 2115964 - RNA, 17 nt, Homo sapiens
acaggcacgugccacca

SEQ ID NO: 2115965 - RNA, 15 nt, Homo sapiens
ccuggccucagggcu

SEQ ID NO: 2115966 - RNA, 20 nt, Homo sapiens
cuguguugucagcacuguaa

SEQ ID NO: 2115967 - RNA, 18 nt, Homo sapiens
aauccuuuacuguuaguc

SEQ ID NO: 2115968 - RNA, 22 nt, Homo sapiens
gacgccacucauuucaucucau

SEQ ID NO: 2115969 - RNA, 15 nt, Homo sapiens
ucucugaaugaagcu

SEQ ID NO: 2115970 - RNA, 15 nt, Homo sapiens
caugcagaacaccaa

SEQ ID NO: 2115971 - RNA, 14 nt, Homo sapiens
cuuguguuuuuaac

SEQ ID NO: 2115972 - RNA, 22 nt, Homo sapiens
gaggccccuccugcccaaguga

SEQ ID NO: 2115973 - RNA, 18 nt, Homo sapiens
uacauugccaauuuucca

SEQ ID NO: 2115974 - RNA, 13 nt, Homo sapiens
uagaggcuuuuau

SEQ ID NO: 2115975 - RNA, 18 nt, Homo sapiens
gccaccaagauguguucu

SEQ ID NO: 2115976 - RNA, 20 nt, Homo sapiens
acaucacuuguacaaaauaa

SEQ ID NO: 2115977 - RNA, 17 nt, Homo sapiens
cucuccccugauuacac

SEQ ID NO: 2115978 - RNA, 20 nt, Homo sapiens
cuucucaaauuagcugcaau

SEQ ID NO: 2115979 - RNA, 22 nt, Homo sapiens
ucaauccaagagucugaugauu

SEQ ID NO: 2115980 - RNA, 14 nt, Homo sapiens
ugccccucucucca

SEQ ID NO: 2115981 - RNA, 20 nt, Homo sapiens
ucuaccuucaaauaaagaua

SEQ ID NO: 2115982 - RNA, 11 nt, Homo sapiens
ccauuuugccu

SEQ ID NO: 2115983 - RNA, 15 nt, Homo sapiens
uggcagcaaacugcu

SEQ ID NO: 2115984 - RNA, 12 nt, Homo sapiens
cagaacagaaua

SEQ ID NO: 2115985 - RNA, 14 nt, Homo sapiens
uagacucaggaaag

SEQ ID NO: 2115986 - RNA, 22 nt, Homo sapiens
ugaguagcugggacuacaggug

SEQ ID NO: 2115987 - RNA, 20 nt, Homo sapiens
guauguauuauuuacauuua

SEQ ID NO: 2115988 - RNA, 15 nt, Homo sapiens
agcccuucaguuugg

SEQ ID NO: 2115989 - RNA, 16 nt, Homo sapiens
ccagguuggagugcag

SEQ ID NO: 2115990 - RNA, 20 nt, Homo sapiens
agagcagccugcugcucuca

SEQ ID NO: 2115991 - RNA, 17 nt, Homo sapiens
cuacagguugugaaaua

SEQ ID NO: 2115992 - RNA, 16 nt, Homo sapiens
ugccugcuccaagaaa

SEQ ID NO: 2115993 - RNA, 15 nt, Homo sapiens
guugcuuucuuaucc

SEQ ID NO: 2115994 - RNA, 18 nt, Homo sapiens
uucuggacggaaccacgu

SEQ ID NO: 2115995 - RNA, 18 nt, Homo sapiens
gcaaccagucaaaaccag

SEQ ID NO: 2115996 - RNA, 15 nt, Homo sapiens
acagaguuacugcca

SEQ ID NO: 2115997 - RNA, 16 nt, Homo sapiens
gaugaguccauuugaa

SEQ ID NO: 2115998 - RNA, 17 nt, Homo sapiens
ccuauccacaggggugu

SEQ ID NO: 2115999 - RNA, 13 nt, Homo sapiens
ucaagcuucauua

SEQ ID NO: 2116000 - RNA, 14 nt, Homo sapiens
acccgucugggaau

SEQ ID NO: 2116001 - RNA, 18 nt, Homo sapiens
guuuucugguguuauauc

SEQ ID NO: 2116002 - RNA, 22 nt, Homo sapiens
aaaauuaaaugcauguccucaa

SEQ ID NO: 2116003 - RNA, 16 nt, Homo sapiens
uaagcaaaagcaucca

SEQ ID NO: 2116004 - RNA, 18 nt, Homo sapiens
gucccauucccugggauc

SEQ ID NO: 2116005 - RNA, 20 nt, Homo sapiens
cuucuuuuaguuguaucucu

SEQ ID NO: 2116006 - RNA, 20 nt, Homo sapiens
uccagauugggugccagcau

SEQ ID NO: 2116007 - RNA, 20 nt, Homo sapiens
agcgggcuugacugcauugc

SEQ ID NO: 2116008 - RNA, 20 nt, Homo sapiens
gaaaguucaacuuccaaagg

SEQ ID NO: 2116009 - RNA, 13 nt, Homo sapiens
agcuggccugaga

SEQ ID NO: 2116010 - RNA, 15 nt, Homo sapiens
aggcuucaucaaggu

SEQ ID NO: 2116011 - RNA, 17 nt, Homo sapiens
ucuguaaucucugucaa

SEQ ID NO: 2116012 - RNA, 20 nt, Homo sapiens
uucauuauuacguggcaaaa

SEQ ID NO: 2116013 - RNA, 19 nt, Homo sapiens
aacuaagaaauaugcacaa

SEQ ID NO: 2116014 - RNA, 23 nt, Homo sapiens
gaaucaucaugugacgcuuucaa

SEQ ID NO: 2116015 - RNA, 12 nt, Homo sapiens
cauggcuacuac

SEQ ID NO: 2116016 - RNA, 14 nt, Homo sapiens
acagucaccucaca

SEQ ID NO: 2116017 - RNA, 17 nt, Homo sapiens
gagguuugccagcauuu

SEQ ID NO: 2116018 - RNA, 15 nt, Homo sapiens
aggaaauaaaguaua

SEQ ID NO: 2116019 - RNA, 22 nt, Homo sapiens
agaaauguauaugcuacugugu

SEQ ID NO: 2116020 - RNA, 22 nt, Homo sapiens
guauucuugagggacaaugcca

SEQ ID NO: 2116021 - RNA, 12 nt, Homo sapiens
cuuugauacuga

SEQ ID NO: 2116022 - RNA, 22 nt, Homo sapiens
aaucacuggauuauaaguucua

SEQ ID NO: 2116023 - RNA, 21 nt, Homo sapiens
acucaaagagggagugcauuu

SEQ ID NO: 2116024 - RNA, 15 nt, Homo sapiens
ucggcuagggguccu

SEQ ID NO: 2116025 - RNA, 23 nt, Homo sapiens
cagcaauacuaagggaagaaaca

SEQ ID NO: 2116026 - RNA, 20 nt, Homo sapiens
caaaacucacuaaguuuacu

SEQ ID NO: 2116027 - RNA, 15 nt, Homo sapiens
cucucgacaguaucc

SEQ ID NO: 2116028 - RNA, 18 nt, Homo sapiens
gaaaaugaacaggacaug

SEQ ID NO: 2116029 - RNA, 18 nt, Homo sapiens
ccucugguaggaggcaaa

SEQ ID NO: 2116030 - RNA, 17 nt, Homo sapiens
ugcuagccacuggaaau

SEQ ID NO: 2116031 - RNA, 18 nt, Homo sapiens
aagaaaccuggaaccaga

SEQ ID NO: 2116032 - RNA, 23 nt, Homo sapiens
ggccagucaggcugcagaggcac

SEQ ID NO: 2116033 - RNA, 21 nt, Homo sapiens
gacaaugucacauaaugaaug

SEQ ID NO: 2116034 - RNA, 13 nt, Homo sapiens
aaaacuaguucuu

SEQ ID NO: 2116035 - RNA, 21 nt, Homo sapiens
ccccucagauuccaccuagag

SEQ ID NO: 2116036 - RNA, 15 nt, Homo sapiens
ccaacacuuagggaa

SEQ ID NO: 2116037 - RNA, 14 nt, Homo sapiens
aauuucgccuuaaa

SEQ ID NO: 2116038 - RNA, 14 nt, Homo sapiens
ugccucggggacac

SEQ ID NO: 2116039 - RNA, 20 nt, Homo sapiens
aauucuagcuuugagcuuaa

SEQ ID NO: 2116040 - RNA, 18 nt, Homo sapiens
cuggccagcguaaaugac

SEQ ID NO: 2116041 - RNA, 16 nt, Homo sapiens
ccaccaaaacugcucc

SEQ ID NO: 2116042 - RNA, 18 nt, Homo sapiens
gucucaucuccugacccu

SEQ ID NO: 2116043 - RNA, 14 nt, Homo sapiens
caguaaacacucca

SEQ ID NO: 2116044 - RNA, 13 nt, Homo sapiens
acccccuucccug

SEQ ID NO: 2116045 - RNA, 13 nt, Homo sapiens
gccucauuucacu

SEQ ID NO: 2116046 - RNA, 13 nt, Homo sapiens
gaaccauuuacuu

SEQ ID NO: 2116047 - RNA, 14 nt, Homo sapiens
uuauugacucuuga

SEQ ID NO: 2116048 - RNA, 21 nt, Homo sapiens
uaaaaauaaacucugcacuua

SEQ ID NO: 2116049 - RNA, 18 nt, Homo sapiens
aagaagccaggugcaaaa

SEQ ID NO: 2116050 - RNA, 18 nt, Homo sapiens
caucucacgcugaucauu

SEQ ID NO: 2116051 - RNA, 23 nt, Homo sapiens
acaguuuuccuaaauguauaccu

SEQ ID NO: 2116052 - RNA, 21 nt, Homo sapiens
auguggaugugacaguggcgu

SEQ ID NO: 2116053 - RNA, 22 nt, Homo sapiens
accaugaauacacuuacaguua

SEQ ID NO: 2116054 - RNA, 16 nt, Homo sapiens
acaucuggcugcacag

SEQ ID NO: 2116055 - RNA, 22 nt, Homo sapiens
agauugcuuugaaaacaugacu

SEQ ID NO: 2116056 - RNA, 18 nt, Homo sapiens
ucauacaaauaaugagcc

SEQ ID NO: 2116057 - RNA, 16 nt, Homo sapiens
uaugguuuuugagaua

SEQ ID NO: 2116058 - RNA, 16 nt, Homo sapiens
cuggaaaucauaauaa

SEQ ID NO: 2116059 - RNA, 20 nt, Homo sapiens
caucucuacugaaaguacaa

SEQ ID NO: 2116060 - RNA, 20 nt, Homo sapiens
uaaauuacagcuuuuaugga

SEQ ID NO: 2116061 - RNA, 14 nt, Homo sapiens
auauggacuuccaa

SEQ ID NO: 2116062 - RNA, 17 nt, Homo sapiens
cuugcugugugaccuca

SEQ ID NO: 2116063 - RNA, 21 nt, Homo sapiens
gagacugggcgcaguggcuca

SEQ ID NO: 2116064 - RNA, 14 nt, Homo sapiens
gcuguauuuuagaa

SEQ ID NO: 2116065 - RNA, 17 nt, Homo sapiens
uaggaaucauucuguaa

SEQ ID NO: 2116066 - RNA, 19 nt, Homo sapiens
cucaagucuucccugauca

SEQ ID NO: 2116067 - RNA, 19 nt, Homo sapiens
caucucuggagccagagag

SEQ ID NO: 2116068 - RNA, 19 nt, Homo sapiens
ccagaaagaggcagugauu

SEQ ID NO: 2116069 - RNA, 15 nt, Homo sapiens
acugcucgucuauca

SEQ ID NO: 2116070 - RNA, 18 nt, Homo sapiens
gcaaaaagauuuacuuug

SEQ ID NO: 2116071 - RNA, 15 nt, Homo sapiens
caugaaaauaccauu

SEQ ID NO: 2116072 - RNA, 16 nt, Homo sapiens
cuuugagccugggaaa

SEQ ID NO: 2116073 - RNA, 17 nt, Homo sapiens
uugcagcuggacuucuc

SEQ ID NO: 2116074 - RNA, 16 nt, Homo sapiens
uuacauuugaacuaua

SEQ ID NO: 2116075 - RNA, 16 nt, Homo sapiens
gucaaauuuacauuua

SEQ ID NO: 2116076 - RNA, 22 nt, Homo sapiens
uuuggaugugugcuuuaauuca

SEQ ID NO: 2116077 - RNA, 21 nt, Homo sapiens
uuuuuacugucuuuugaagaa

SEQ ID NO: 2116078 - RNA, 17 nt, Homo sapiens
ggcccacuucaccguac

SEQ ID NO: 2116079 - RNA, 14 nt, Homo sapiens
ccuacaagauuuag

SEQ ID NO: 2116080 - RNA, 15 nt, Homo sapiens
aauguuuacagugga

SEQ ID NO: 2116081 - RNA, 16 nt, Homo sapiens
augggagucugaaaug

SEQ ID NO: 2116082 - RNA, 14 nt, Homo sapiens
uccucaauccagcu

SEQ ID NO: 2116083 - RNA, 18 nt, Homo sapiens
uggagccuggcacaggac

SEQ ID NO: 2116084 - RNA, 13 nt, Homo sapiens
guagcucuuugcc

SEQ ID NO: 2116085 - RNA, 13 nt, Homo sapiens
guacaucuuugga

SEQ ID NO: 2116086 - RNA, 13 nt, Homo sapiens
uccccacugccug

SEQ ID NO: 2116087 - RNA, 14 nt, Homo sapiens
accacacacaacag

SEQ ID NO: 2116088 - RNA, 21 nt, Homo sapiens
cauauucuaaguuagacucuu

SEQ ID NO: 2116089 - RNA, 19 nt, Homo sapiens
aagcacauaugaacuggac

SEQ ID NO: 2116090 - RNA, 16 nt, Homo sapiens
ugcccaggguuggcau

SEQ ID NO: 2116091 - RNA, 11 nt, Homo sapiens
ccagagcaguu

SEQ ID NO: 2116092 - RNA, 21 nt, Homo sapiens
cauuuguacugaccccaucac

SEQ ID NO: 2116093 - RNA, 19 nt, Homo sapiens
ggugggauuuuuggugcaa

SEQ ID NO: 2116094 - RNA, 19 nt, Homo sapiens
agcagggccaaagcacagc

SEQ ID NO: 2116095 - RNA, 21 nt, Homo sapiens
ggcgaaauccugucuguacua

SEQ ID NO: 2116096 - RNA, 19 nt, Homo sapiens
augguuuccacaggaacaa

SEQ ID NO: 2116097 - RNA, 22 nt, Homo sapiens
uaaaggcaaugguuugugucaa

SEQ ID NO: 2116098 - RNA, 16 nt, Homo sapiens
cacuucuuuccucaaa

SEQ ID NO: 2116099 - RNA, 11 nt, Homo sapiens
auauguggaau

SEQ ID NO: 2116100 - RNA, 15 nt, Homo sapiens
gcagaggcaacacug

SEQ ID NO: 2116101 - RNA, 18 nt, Homo sapiens
gcagcuuauuggcuuaaa

SEQ ID NO: 2116102 - RNA, 17 nt, Homo sapiens
cguacgggaaugugcuu

SEQ ID NO: 2116103 - RNA, 17 nt, Homo sapiens
cuuuugagaaccaagua

SEQ ID NO: 2116104 - RNA, 18 nt, Homo sapiens
gcaccucagccaucugua

SEQ ID NO: 2116105 - RNA, 12 nt, Homo sapiens
ugcaagcacucg

SEQ ID NO: 2116106 - RNA, 13 nt, Homo sapiens
cuauaaaacacau

SEQ ID NO: 2116107 - RNA, 19 nt, Homo sapiens
aucaccaggaucgcuuugu

SEQ ID NO: 2116108 - RNA, 23 nt, Homo sapiens
auuuuuugcccagagaguccagc

SEQ ID NO: 2116109 - RNA, 16 nt, Homo sapiens
gcucugccccaccuug

SEQ ID NO: 2116110 - RNA, 19 nt, Homo sapiens
gugccccugcucacugggc

SEQ ID NO: 2116111 - RNA, 19 nt, Homo sapiens
uacccucugagacagagag

SEQ ID NO: 2116112 - RNA, 17 nt, Homo sapiens
uaacacucagaagccug

SEQ ID NO: 2116113 - RNA, 20 nt, Homo sapiens
ccagauucuaccacacagca

SEQ ID NO: 2116114 - RNA, 21 nt, Homo sapiens
auaaauuucaauuagauuuaa

SEQ ID NO: 2116115 - RNA, 14 nt, Homo sapiens
ccagaacccuuccu

SEQ ID NO: 2116116 - RNA, 20 nt, Homo sapiens
gcuacgguuccauguucacc

SEQ ID NO: 2116117 - RNA, 13 nt, Homo sapiens
ucacagucaccaa

SEQ ID NO: 2116118 - RNA, 16 nt, Homo sapiens
aagcauggacuaaccc

SEQ ID NO: 2116119 - RNA, 13 nt, Homo sapiens
auuuacuggaccc

SEQ ID NO: 2116120 - RNA, 14 nt, Homo sapiens
cagccacacuucuc

SEQ ID NO: 2116121 - RNA, 20 nt, Homo sapiens
gaagcucacacauccuguca

SEQ ID NO: 2116122 - RNA, 17 nt, Homo sapiens
cuaauuccacuuguuca

SEQ ID NO: 2116123 - RNA, 12 nt, Homo sapiens
ugccccuaugcc

SEQ ID NO: 2116124 - RNA, 12 nt, Homo sapiens
acaucauggacu

SEQ ID NO: 2116125 - RNA, 15 nt, Homo sapiens
aagaagcauuuugca

SEQ ID NO: 2116126 - RNA, 18 nt, Homo sapiens
uauuauuucuuacucaaa

SEQ ID NO: 2116127 - RNA, 17 nt, Homo sapiens
auucccaacgugcaaag

SEQ ID NO: 2116128 - RNA, 13 nt, Homo sapiens
cgagggagcugcu

SEQ ID NO: 2116129 - RNA, 14 nt, Homo sapiens
aaccagacaccucc

SEQ ID NO: 2116130 - RNA, 21 nt, Homo sapiens
uaaaucuguucugggcucuuu

SEQ ID NO: 2116131 - RNA, 20 nt, Homo sapiens
gagcccaggggaggcacaaa

SEQ ID NO: 2116132 - RNA, 14 nt, Homo sapiens
guguacauuucuau

SEQ ID NO: 2116133 - RNA, 17 nt, Homo sapiens
cccuuggaaaaacagga

SEQ ID NO: 2116134 - RNA, 14 nt, Homo sapiens
gagcagacaggcua

SEQ ID NO: 2116135 - RNA, 17 nt, Homo sapiens
cuccccuugucugcacu

SEQ ID NO: 2116136 - RNA, 11 nt, Homo sapiens
aacuuggcacu

SEQ ID NO: 2116137 - RNA, 14 nt, Homo sapiens
uaccugaauggaga

SEQ ID NO: 2116138 - RNA, 22 nt, Homo sapiens
ucaacaaggggucaaugucaua

SEQ ID NO: 2116139 - RNA, 22 nt, Homo sapiens
auucugauacauuagcagcuau

SEQ ID NO: 2116140 - RNA, 17 nt, Homo sapiens
acccccaaaaaacaauu

SEQ ID NO: 2116141 - RNA, 18 nt, Homo sapiens
agacaucuggacacuggg

SEQ ID NO: 2116142 - RNA, 17 nt, Homo sapiens
gaaguggcaccuaauaa

SEQ ID NO: 2116143 - RNA, 12 nt, Homo sapiens
ucuccucuccau

SEQ ID NO: 2116144 - RNA, 22 nt, Homo sapiens
acccugacuguauacagaauga

SEQ ID NO: 2116145 - RNA, 15 nt, Homo sapiens
agccaucucaagcaa

SEQ ID NO: 2116146 - RNA, 22 nt, Homo sapiens
aaacuguuuauuugcacuauga

SEQ ID NO: 2116147 - RNA, 21 nt, Homo sapiens
uccauguagaauaaaugaaga

SEQ ID NO: 2116148 - RNA, 18 nt, Homo sapiens
caacauucaaaagcacaa

SEQ ID NO: 2116149 - RNA, 23 nt, Homo sapiens
agaacguggugaccuuucacgaa

SEQ ID NO: 2116150 - RNA, 18 nt, Homo sapiens
ggacaagagccugcagcg

SEQ ID NO: 2116151 - RNA, 12 nt, Homo sapiens
cuuggagcugcc

SEQ ID NO: 2116152 - RNA, 19 nt, Homo sapiens
cagucaaugaggaagauuu

SEQ ID NO: 2116153 - RNA, 14 nt, Homo sapiens
ccaaccaaugcaca

SEQ ID NO: 2116154 - RNA, 18 nt, Homo sapiens
ggaaagacagcuucucau

SEQ ID NO: 2116155 - RNA, 21 nt, Homo sapiens
aacagcuauuauaucagcuuu

SEQ ID NO: 2116156 - RNA, 17 nt, Homo sapiens
aaaagaaagcugugaaa

SEQ ID NO: 2116157 - RNA, 20 nt, Homo sapiens
caguaauuauuauuuaacuc

SEQ ID NO: 2116158 - RNA, 20 nt, Homo sapiens
aaauaccuauaugaauauga

SEQ ID NO: 2116159 - RNA, 14 nt, Homo sapiens
accucuuauugcaa

SEQ ID NO: 2116160 - RNA, 21 nt, Homo sapiens
acugugaggugggccuuugag

SEQ ID NO: 2116161 - RNA, 14 nt, Homo sapiens
acuuaaacaauguc

SEQ ID NO: 2116162 - RNA, 20 nt, Homo sapiens
uuacuuuuuugguacuauaa

SEQ ID NO: 2116163 - RNA, 18 nt, Homo sapiens
aucugggcugugggcaag

SEQ ID NO: 2116164 - RNA, 15 nt, Homo sapiens
uuccuguucuauuaa

SEQ ID NO: 2116165 - RNA, 14 nt, Homo sapiens
guuuuaaauugaua

SEQ ID NO: 2116166 - RNA, 18 nt, Homo sapiens
aaaaccccaucucuacua

SEQ ID NO: 2116167 - RNA, 13 nt, Homo sapiens
ugugcgcacacau

SEQ ID NO: 2116168 - RNA, 22 nt, Homo sapiens
acaugucuccuacugaggauau

SEQ ID NO: 2116169 - RNA, 17 nt, Homo sapiens
augaugucggucuugca

SEQ ID NO: 2116170 - RNA, 18 nt, Homo sapiens
agaaaaagaaaugaacau

SEQ ID NO: 2116171 - RNA, 15 nt, Homo sapiens
cugccaggcugaaaa

SEQ ID NO: 2116172 - RNA, 15 nt, Homo sapiens
ucgagucuaccucuu

SEQ ID NO: 2116173 - RNA, 15 nt, Homo sapiens
acgugucuuccacuu

SEQ ID NO: 2116174 - RNA, 17 nt, Homo sapiens
ucauucuuucugcuaua

SEQ ID NO: 2116175 - RNA, 16 nt, Homo sapiens
uuacaaaaacaagaca

SEQ ID NO: 2116176 - RNA, 15 nt, Homo sapiens
gcauggcuggcacau

SEQ ID NO: 2116177 - RNA, 14 nt, Homo sapiens
acguugauguaaug

SEQ ID NO: 2116178 - RNA, 20 nt, Homo sapiens
ggacaaaggagccugugaac

SEQ ID NO: 2116179 - RNA, 21 nt, Homo sapiens
acagauuccaggcgaugugca

SEQ ID NO: 2116180 - RNA, 15 nt, Homo sapiens
gccaggugcugugac

SEQ ID NO: 2116181 - RNA, 19 nt, Homo sapiens
uucagagcuaauaagugcu

SEQ ID NO: 2116182 - RNA, 19 nt, Homo sapiens
cuauucccuuugacuucag

SEQ ID NO: 2116183 - RNA, 15 nt, Homo sapiens
ccugcuuaaugaaaa

SEQ ID NO: 2116184 - RNA, 19 nt, Homo sapiens
uaacauuguaaaguaugug

SEQ ID NO: 2116185 - RNA, 12 nt, Homo sapiens
cccuccauucca

SEQ ID NO: 2116186 - RNA, 13 nt, Homo sapiens
uguuuuuaagcug

SEQ ID NO: 2116187 - RNA, 19 nt, Homo sapiens
gggcuucauacacaugaga

SEQ ID NO: 2116188 - RNA, 18 nt, Homo sapiens
aacucacaagugcucauc

SEQ ID NO: 2116189 - RNA, 16 nt, Homo sapiens
auugaaggaaagcuau

SEQ ID NO: 2116190 - RNA, 19 nt, Homo sapiens
cagaacacacuccaucagc

SEQ ID NO: 2116191 - RNA, 21 nt, Homo sapiens
ccucaagugccuuauucucac

SEQ ID NO: 2116192 - RNA, 21 nt, Homo sapiens
gaagugaccuggaaucaguga

SEQ ID NO: 2116193 - RNA, 22 nt, Homo sapiens
aagauuguaauuaaaaugauag

SEQ ID NO: 2116194 - RNA, 13 nt, Homo sapiens
aucacacauauca

SEQ ID NO: 2116195 - RNA, 14 nt, Homo sapiens
agccauugcauuua

SEQ ID NO: 2116196 - RNA, 22 nt, Homo sapiens
ccaaggaauguguccaagacac

SEQ ID NO: 2116197 - RNA, 14 nt, Homo sapiens
cugaguauuuucac

SEQ ID NO: 2116198 - RNA, 20 nt, Homo sapiens
agcuuccaacccgaggcaau

SEQ ID NO: 2116199 - RNA, 15 nt, Homo sapiens
ucaauagauugcuca

SEQ ID NO: 2116200 - RNA, 16 nt, Homo sapiens
gagcuggcugucuucc

SEQ ID NO: 2116201 - RNA, 23 nt, Homo sapiens
acaaaacauacauuuuguaccaa

SEQ ID NO: 2116202 - RNA, 23 nt, Homo sapiens
acaccacaucuaagccugaaggg

SEQ ID NO: 2116203 - RNA, 13 nt, Homo sapiens
uuguuucuuccaa

SEQ ID NO: 2116204 - RNA, 22 nt, Homo sapiens
uauuuuagcugcacggcauuac

SEQ ID NO: 2116205 - RNA, 22 nt, Homo sapiens
ucaagcaggcgccaagugcuau

SEQ ID NO: 2116206 - RNA, 15 nt, Homo sapiens
guaagcgauuugaaa

SEQ ID NO: 2116207 - RNA, 21 nt, Homo sapiens
aaucuauuuuugugugcugug

SEQ ID NO: 2116208 - RNA, 14 nt, Homo sapiens
cccugccuaaggaa

SEQ ID NO: 2116209 - RNA, 18 nt, Homo sapiens
acuguguggaccaaggag

SEQ ID NO: 2116210 - RNA, 14 nt, Homo sapiens
guucacaccauucu

SEQ ID NO: 2116211 - RNA, 17 nt, Homo sapiens
caagacggagaugcaug

SEQ ID NO: 2116212 - RNA, 20 nt, Homo sapiens
uugaugcuugagccuuugac

SEQ ID NO: 2116213 - RNA, 17 nt, Homo sapiens
augugaaaguuacaaau

SEQ ID NO: 2116214 - RNA, 14 nt, Homo sapiens
aacuguuucugcag

SEQ ID NO: 2116215 - RNA, 18 nt, Homo sapiens
agccucccccaaagcaau

SEQ ID NO: 2116216 - RNA, 19 nt, Homo sapiens
uguagauuuucuacaggaa

SEQ ID NO: 2116217 - RNA, 21 nt, Homo sapiens
gucuuguucugucccuuccac

SEQ ID NO: 2116218 - RNA, 15 nt, Homo sapiens
gcagcccagccucug

SEQ ID NO: 2116219 - RNA, 13 nt, Homo sapiens
aagucauccuccu

SEQ ID NO: 2116220 - RNA, 20 nt, Homo sapiens
gacaguuuguaaauguuauu

SEQ ID NO: 2116221 - RNA, 22 nt, Homo sapiens
auaaaacaaaacaaacaaccug

SEQ ID NO: 2116222 - RNA, 12 nt, Homo sapiens
gccauuauuuaa

SEQ ID NO: 2116223 - RNA, 18 nt, Homo sapiens
ugagaguuccucuuugcc

SEQ ID NO: 2116224 - RNA, 19 nt, Homo sapiens
ccaaauaaaauguuuacau

SEQ ID NO: 2116225 - RNA, 13 nt, Homo sapiens
ccuucucccucau

SEQ ID NO: 2116226 - RNA, 16 nt, Homo sapiens
uuggaacggcaaaaaa

SEQ ID NO: 2116227 - RNA, 21 nt, Homo sapiens
ccaugagcucacccgugucua

SEQ ID NO: 2116228 - RNA, 21 nt, Homo sapiens
cacagauccccauggucuuca

SEQ ID NO: 2116229 - RNA, 20 nt, Homo sapiens
aagaucacgccacugcacuc

SEQ ID NO: 2116230 - RNA, 20 nt, Homo sapiens
gagaucacaccacugcacuc

SEQ ID NO: 2116231 - RNA, 13 nt, Homo sapiens
aaguaaaaaucca

SEQ ID NO: 2116232 - RNA, 13 nt, Homo sapiens
caugagcaccuuu

SEQ ID NO: 2116233 - RNA, 13 nt, Homo sapiens
auauccacaucua

SEQ ID NO: 2116234 - RNA, 17 nt, Homo sapiens
uguguacaacacuggug

SEQ ID NO: 2116235 - RNA, 17 nt, Homo sapiens
gaaacugcuaaauucua

SEQ ID NO: 2116236 - RNA, 20 nt, Homo sapiens
cagacugaaccagagcugga

SEQ ID NO: 2116237 - RNA, 21 nt, Homo sapiens
cucgggugcauuugagagaag

SEQ ID NO: 2116238 - RNA, 21 nt, Homo sapiens
uuugauacaggcaauucagug

SEQ ID NO: 2116239 - RNA, 17 nt, Homo sapiens
augaggaaaaagcgaga

SEQ ID NO: 2116240 - RNA, 20 nt, Homo sapiens
caaagaauuacaguacacau

SEQ ID NO: 2116241 - RNA, 18 nt, Homo sapiens
aacuaaugaaagcacucc

SEQ ID NO: 2116242 - RNA, 20 nt, Homo sapiens
agucucugauacacaguaau

SEQ ID NO: 2116243 - RNA, 16 nt, Homo sapiens
aaucuuugcugaagcu

SEQ ID NO: 2116244 - RNA, 15 nt, Homo sapiens
gaacauacuucaucg

SEQ ID NO: 2116245 - RNA, 21 nt, Homo sapiens
ugcauccuaucgaucuggaaa

SEQ ID NO: 2116246 - RNA, 14 nt, Homo sapiens
ucucaagugccaua

SEQ ID NO: 2116247 - RNA, 11 nt, Homo sapiens
ccuaacugauc

SEQ ID NO: 2116248 - RNA, 21 nt, Homo sapiens
gucaagagugaauucccucac

SEQ ID NO: 2116249 - RNA, 22 nt, Homo sapiens
aucuuacccuucaauguuaaau

SEQ ID NO: 2116250 - RNA, 18 nt, Homo sapiens
agaaagaaacauaggcau

SEQ ID NO: 2116251 - RNA, 11 nt, Homo sapiens
ucauuugcauc

SEQ ID NO: 2116252 - RNA, 23 nt, Homo sapiens
cccugugguccccgagacacagg

SEQ ID NO: 2116253 - RNA, 22 nt, Homo sapiens
augcuaccuugugacccagcac

SEQ ID NO: 2116254 - RNA, 19 nt, Homo sapiens
ucacaccauucuccugccu

SEQ ID NO: 2116255 - RNA, 17 nt, Homo sapiens
aauuuuuccgcucuuaa

SEQ ID NO: 2116256 - RNA, 15 nt, Homo sapiens
uccuagugaaccuca

SEQ ID NO: 2116257 - RNA, 23 nt, Homo sapiens
cucuagaaagcucuaaagaccau

SEQ ID NO: 2116258 - RNA, 13 nt, Homo sapiens
gagaugaauugca

SEQ ID NO: 2116259 - RNA, 17 nt, Homo sapiens
acuucugcccauucucu

SEQ ID NO: 2116260 - RNA, 15 nt, Homo sapiens
uccugccacugccgc

SEQ ID NO: 2116261 - RNA, 22 nt, Homo sapiens
ucccgggggccccaccucggca

SEQ ID NO: 2116262 - RNA, 13 nt, Homo sapiens
auaagacauuugu

SEQ ID NO: 2116263 - RNA, 13 nt, Homo sapiens
ucuauacaacagg

SEQ ID NO: 2116264 - RNA, 22 nt, Homo sapiens
cuggccgccacccccaucuucc

SEQ ID NO: 2116265 - RNA, 20 nt, Homo sapiens
uucugucugggcucagacau

SEQ ID NO: 2116266 - RNA, 12 nt, Homo sapiens
uuugugaacugg

SEQ ID NO: 2116267 - RNA, 21 nt, Homo sapiens
cacuuuugauagauuacgucu

SEQ ID NO: 2116268 - RNA, 13 nt, Homo sapiens
gauuccugaccca

SEQ ID NO: 2116269 - RNA, 21 nt, Homo sapiens
uuucagaauugaaggagaaaa

SEQ ID NO: 2116270 - RNA, 16 nt, Homo sapiens
guccccagucagagau

SEQ ID NO: 2116271 - RNA, 19 nt, Homo sapiens
auuggaccagucagcacag

SEQ ID NO: 2116272 - RNA, 15 nt, Homo sapiens
uuucuuaaaaacagc

SEQ ID NO: 2116273 - RNA, 13 nt, Homo sapiens
uuggugugccuua

SEQ ID NO: 2116274 - RNA, 16 nt, Homo sapiens
ggucaggggugacaca

SEQ ID NO: 2116275 - RNA, 19 nt, Homo sapiens
ccagcgaccucucugccuc

SEQ ID NO: 2116276 - RNA, 12 nt, Homo sapiens
cggcugaacuga

SEQ ID NO: 2116277 - RNA, 17 nt, Homo sapiens
uuccucaaauacaugca

SEQ ID NO: 2116278 - RNA, 19 nt, Homo sapiens
agaagugcaauccagccca

SEQ ID NO: 2116279 - RNA, 15 nt, Homo sapiens
cuagagacaacaaaa

SEQ ID NO: 2116280 - RNA, 21 nt, Homo sapiens
auggcaucaaaugucaguccu

SEQ ID NO: 2116281 - RNA, 21 nt, Homo sapiens
auauuaucuacaaacacugca

SEQ ID NO: 2116282 - RNA, 22 nt, Homo sapiens
cuuagagcacuagaagcacagg

SEQ ID NO: 2116283 - RNA, 18 nt, Homo sapiens
aucguccucccaggccag

SEQ ID NO: 2116284 - RNA, 23 nt, Homo sapiens
uaaaagaucuugaauagucucau

SEQ ID NO: 2116285 - RNA, 23 nt, Homo sapiens
ccagacagcaacggggaggccaa

SEQ ID NO: 2116286 - RNA, 21 nt, Homo sapiens
uuuuaugaaaccaacuguuga

SEQ ID NO: 2116287 - RNA, 16 nt, Homo sapiens
gcagaauccuuacuuu

SEQ ID NO: 2116288 - RNA, 23 nt, Homo sapiens
uuaagaagaaauacccacuaaca

SEQ ID NO: 2116289 - RNA, 22 nt, Homo sapiens
cucuccugcccaugauagugua

SEQ ID NO: 2116290 - RNA, 18 nt, Homo sapiens
uauaguuccuugccuuaa

SEQ ID NO: 2116291 - RNA, 14 nt, Homo sapiens
uggcacuaauauaa

SEQ ID NO: 2116292 - RNA, 16 nt, Homo sapiens
acaggucgagcugugc

SEQ ID NO: 2116293 - RNA, 18 nt, Homo sapiens
caagaauguuaugugcaa

SEQ ID NO: 2116294 - RNA, 12 nt, Homo sapiens
aggcugcucaga

SEQ ID NO: 2116295 - RNA, 12 nt, Homo sapiens
gaacugcuuuau

SEQ ID NO: 2116296 - RNA, 20 nt, Homo sapiens
gacuuaaacagcagauuuca

SEQ ID NO: 2116297 - RNA, 22 nt, Homo sapiens
acuguaugugugugugugaacc

SEQ ID NO: 2116298 - RNA, 22 nt, Homo sapiens
caccaagagccucccugccguu

SEQ ID NO: 2116299 - RNA, 12 nt, Homo sapiens
uucuccaucucc

SEQ ID NO: 2116300 - RNA, 17 nt, Homo sapiens
cucaaaacacccaaaaa

SEQ ID NO: 2116301 - RNA, 19 nt, Homo sapiens
aagcauuuugccuaccugg

SEQ ID NO: 2116302 - RNA, 14 nt, Homo sapiens
ugaaugucacugac

SEQ ID NO: 2116303 - RNA, 13 nt, Homo sapiens
guuucuacuuuau

SEQ ID NO: 2116304 - RNA, 16 nt, Homo sapiens
ggugacaaaaggcaga

SEQ ID NO: 2116305 - RNA, 19 nt, Homo sapiens
acucguuauucauacaaau

SEQ ID NO: 2116306 - RNA, 23 nt, Homo sapiens
ccugugaaauauucuuaggcaga

SEQ ID NO: 2116307 - RNA, 21 nt, Homo sapiens
aucgcugaugcagacacagau

SEQ ID NO: 2116308 - RNA, 15 nt, Homo sapiens
ggccacacauccugc

SEQ ID NO: 2116309 - RNA, 16 nt, Homo sapiens
caaggauccugagcca

SEQ ID NO: 2116310 - RNA, 22 nt, Homo sapiens
aguauugccacaaugccucucc

SEQ ID NO: 2116311 - RNA, 16 nt, Homo sapiens
uggaaauugaggucca

SEQ ID NO: 2116312 - RNA, 22 nt, Homo sapiens
gucaguaaagauauuugaauau

SEQ ID NO: 2116313 - RNA, 21 nt, Homo sapiens
cucagagaagaccacaccaag

SEQ ID NO: 2116314 - RNA, 16 nt, Homo sapiens
uaaacaccauuauuca

SEQ ID NO: 2116315 - RNA, 14 nt, Homo sapiens
uauugagcauguga

SEQ ID NO: 2116316 - RNA, 21 nt, Homo sapiens
ggccuccagagaccccaggaa

SEQ ID NO: 2116317 - RNA, 12 nt, Homo sapiens
agacugagcucc

SEQ ID NO: 2116318 - RNA, 17 nt, Homo sapiens
uugucacugcuguaaag

SEQ ID NO: 2116319 - RNA, 13 nt, Homo sapiens
ccaccaaaauuau

SEQ ID NO: 2116320 - RNA, 21 nt, Homo sapiens
guuaaugaaggugugcuacag

SEQ ID NO: 2116321 - RNA, 20 nt, Homo sapiens
ucuauuugccuccagugcag

SEQ ID NO: 2116322 - RNA, 17 nt, Homo sapiens
aguucagccuccuugaa

SEQ ID NO: 2116323 - RNA, 20 nt, Homo sapiens
gugauuauuggauucacacc

SEQ ID NO: 2116324 - RNA, 15 nt, Homo sapiens
caugccuggagacau

SEQ ID NO: 2116325 - RNA, 13 nt, Homo sapiens
agcauaagcaaaa

SEQ ID NO: 2116326 - RNA, 14 nt, Homo sapiens
ugacauuguuggcc

SEQ ID NO: 2116327 - RNA, 17 nt, Homo sapiens
auuaauuuucaacucaa

SEQ ID NO: 2116328 - RNA, 17 nt, Homo sapiens
ucagaauacuugcacuc

SEQ ID NO: 2116329 - RNA, 13 nt, Homo sapiens
cagauuucaggaa

SEQ ID NO: 2116330 - RNA, 17 nt, Homo sapiens
aagcugacauugccaaa

SEQ ID NO: 2116331 - RNA, 19 nt, Homo sapiens
uccuguuuaaaaaaccaca

SEQ ID NO: 2116332 - RNA, 16 nt, Homo sapiens
uccuacaaaauggagg

SEQ ID NO: 2116333 - RNA, 17 nt, Homo sapiens
ccugaaauuuuaaugaa

SEQ ID NO: 2116334 - RNA, 20 nt, Homo sapiens
aaugcuuuucccacucucau

SEQ ID NO: 2116335 - RNA, 16 nt, Homo sapiens
uugagaaaauaaacau

SEQ ID NO: 2116336 - RNA, 23 nt, Homo sapiens
gguguuggacaagcuucugagac

SEQ ID NO: 2116337 - RNA, 15 nt, Homo sapiens
gaggaacucucaagu

SEQ ID NO: 2116338 - RNA, 16 nt, Homo sapiens
uaccauucacuacuca

SEQ ID NO: 2116339 - RNA, 22 nt, Homo sapiens
ugcucauuucaugaagcaagaa

SEQ ID NO: 2116340 - RNA, 23 nt, Homo sapiens
ugcuucugaaacuggaguaucau

SEQ ID NO: 2116341 - RNA, 19 nt, Homo sapiens
acaauggacuguacaauaa

SEQ ID NO: 2116342 - RNA, 16 nt, Homo sapiens
acaaguuacauacauu

SEQ ID NO: 2116343 - RNA, 18 nt, Homo sapiens
aacucaaauaaaaugccc

SEQ ID NO: 2116344 - RNA, 22 nt, Homo sapiens
auggaugccgugggaguacaaa

SEQ ID NO: 2116345 - RNA, 20 nt, Homo sapiens
cgaggagcuagaacauucca

SEQ ID NO: 2116346 - RNA, 23 nt, Homo sapiens
uaaaacaaaaucugaacucucaa

SEQ ID NO: 2116347 - RNA, 19 nt, Homo sapiens
aucagagcugcagccaguc

SEQ ID NO: 2116348 - RNA, 16 nt, Homo sapiens
aaaaaggaauccucug

SEQ ID NO: 2116349 - RNA, 15 nt, Homo sapiens
ugacaugugccauuu

SEQ ID NO: 2116350 - RNA, 21 nt, Homo sapiens
uuugaaaaauauugcuaaaag

SEQ ID NO: 2116351 - RNA, 18 nt, Homo sapiens
ugcuucuaccaacuggaa

SEQ ID NO: 2116352 - RNA, 24 nt, Homo sapiens
uauuuuuuaaugcuaaucuuguga

SEQ ID NO: 2116353 - RNA, 20 nt, Homo sapiens
uacggaaggcucugggaucu

SEQ ID NO: 2116354 - RNA, 16 nt, Homo sapiens
gaaacaugaauuauuu

SEQ ID NO: 2116355 - RNA, 22 nt, Homo sapiens
uuucugggggaaaaagccauau

SEQ ID NO: 2116356 - RNA, 14 nt, Homo sapiens
aggcugcucuugaa

SEQ ID NO: 2116357 - RNA, 19 nt, Homo sapiens
aaauccuaccaaccucuga

SEQ ID NO: 2116358 - RNA, 16 nt, Homo sapiens
ucgauuuaugccucag

SEQ ID NO: 2116359 - RNA, 22 nt, Homo sapiens
ucauugaaggguguucacccau

SEQ ID NO: 2116360 - RNA, 19 nt, Homo sapiens
gaauccagaucauuccuca

SEQ ID NO: 2116361 - RNA, 21 nt, Homo sapiens
uacagugauagaacaaaagag

SEQ ID NO: 2116362 - RNA, 17 nt, Homo sapiens
ggagacaucacaaccuc

SEQ ID NO: 2116363 - RNA, 22 nt, Homo sapiens
aaguucaccguaguaacacaua

SEQ ID NO: 2116364 - RNA, 17 nt, Homo sapiens
uuuccaaauaacaucaa

SEQ ID NO: 2116365 - RNA, 13 nt, Homo sapiens
agaaacagugcaa

SEQ ID NO: 2116366 - RNA, 18 nt, Homo sapiens
ccuuugaaauucccccac

SEQ ID NO: 2116367 - RNA, 19 nt, Homo sapiens
caaaccaagagauugcuaa

SEQ ID NO: 2116368 - RNA, 18 nt, Homo sapiens
uugcccuguuuccugcug

SEQ ID NO: 2116369 - RNA, 18 nt, Homo sapiens
aauaauuuuucacuucaa

SEQ ID NO: 2116370 - RNA, 18 nt, Homo sapiens
uaaaguaacaguauguca

SEQ ID NO: 2116371 - RNA, 19 nt, Homo sapiens
uggcuccgaucucugcuca

SEQ ID NO: 2116372 - RNA, 18 nt, Homo sapiens
uacccuuuuucuccagcu

SEQ ID NO: 2116373 - RNA, 14 nt, Homo sapiens
ucuaauguacaaua

SEQ ID NO: 2116374 - RNA, 14 nt, Homo sapiens
auuuauguuuauua

SEQ ID NO: 2116375 - RNA, 12 nt, Homo sapiens
agcuagaaggcc

SEQ ID NO: 2116376 - RNA, 22 nt, Homo sapiens
acauggagagagacucaaagag

SEQ ID NO: 2116377 - RNA, 14 nt, Homo sapiens
caguuacuuaauga

SEQ ID NO: 2116378 - RNA, 16 nt, Homo sapiens
cgagggauguggagca

SEQ ID NO: 2116379 - RNA, 16 nt, Homo sapiens
gugacauguguuggca

SEQ ID NO: 2116380 - RNA, 19 nt, Homo sapiens
uggcaucagugucuuucca

SEQ ID NO: 2116381 - RNA, 16 nt, Homo sapiens
caaguccuguucuguu

SEQ ID NO: 2116382 - RNA, 21 nt, Homo sapiens
auucucauuuagugcccucuu

SEQ ID NO: 2116383 - RNA, 20 nt, Homo sapiens
gucacaggguguuggaagau

SEQ ID NO: 2116384 - RNA, 13 nt, Homo sapiens
uuauguacuguaa

SEQ ID NO: 2116385 - RNA, 13 nt, Homo sapiens
ugauguacuuuaa

SEQ ID NO: 2116386 - RNA, 14 nt, Homo sapiens
acacuagccagaca

SEQ ID NO: 2116387 - RNA, 21 nt, Homo sapiens
gucuuucgcacauucuccuga

SEQ ID NO: 2116388 - RNA, 19 nt, Homo sapiens
aggacccauagaugaacua

SEQ ID NO: 2116389 - RNA, 13 nt, Homo sapiens
cccugaggaauaa

SEQ ID NO: 2116390 - RNA, 22 nt, Homo sapiens
uguacauguuccuguuuaugca

SEQ ID NO: 2116391 - RNA, 17 nt, Homo sapiens
ggaaaaugugacccaga

SEQ ID NO: 2116392 - RNA, 18 nt, Homo sapiens
gcagcccacagaggacag

SEQ ID NO: 2116393 - RNA, 21 nt, Homo sapiens
aucagaccaaacagugcuguu

SEQ ID NO: 2116394 - RNA, 18 nt, Homo sapiens
aaucacugaccagccuug

SEQ ID NO: 2116395 - RNA, 22 nt, Homo sapiens
uccugaaagccacagacaauau

SEQ ID NO: 2116396 - RNA, 14 nt, Homo sapiens
acuacaagucagcu

SEQ ID NO: 2116397 - RNA, 15 nt, Homo sapiens
agaaauuauacuuac

SEQ ID NO: 2116398 - RNA, 23 nt, Homo sapiens
ucucaaaacagagggcugcauuc

SEQ ID NO: 2116399 - RNA, 20 nt, Homo sapiens
agcgcccccagagcccguca

SEQ ID NO: 2116400 - RNA, 17 nt, Homo sapiens
uaaaacuuaacauucau

SEQ ID NO: 2116401 - RNA, 22 nt, Homo sapiens
caacugggccugggauggggcu

SEQ ID NO: 2116402 - RNA, 14 nt, Homo sapiens
cucagaacugcaau

SEQ ID NO: 2116403 - RNA, 20 nt, Homo sapiens
ucuagacuagcaaucucuuc

SEQ ID NO: 2116404 - RNA, 19 nt, Homo sapiens
uccccagagauggcuccuu

SEQ ID NO: 2116405 - RNA, 15 nt, Homo sapiens
auaauaggaauucaa

SEQ ID NO: 2116406 - RNA, 21 nt, Homo sapiens
gacauugaguucaaauugccu

SEQ ID NO: 2116407 - RNA, 12 nt, Homo sapiens
ggaaaguucagc

SEQ ID NO: 2116408 - RNA, 13 nt, Homo sapiens
ugucacuacacac

SEQ ID NO: 2116409 - RNA, 17 nt, Homo sapiens
auguuacucucuugcac

SEQ ID NO: 2116410 - RNA, 13 nt, Homo sapiens
cuauuaacuacca

SEQ ID NO: 2116411 - RNA, 17 nt, Homo sapiens
caacauuguaagaacaa

SEQ ID NO: 2116412 - RNA, 16 nt, Homo sapiens
gaauugcgcucagggg

SEQ ID NO: 2116413 - RNA, 15 nt, Homo sapiens
caauuaagcagcuug

SEQ ID NO: 2116414 - RNA, 11 nt, Homo sapiens
accacugccug

SEQ ID NO: 2116415 - RNA, 11 nt, Homo sapiens
augacugcccc

SEQ ID NO: 2116416 - RNA, 21 nt, Homo sapiens
acagaucacacacaugcacac

SEQ ID NO: 2116417 - RNA, 20 nt, Homo sapiens
uauuaggucgguacuaagaa

SEQ ID NO: 2116418 - RNA, 19 nt, Homo sapiens
ugaggugcugaucuguggu

SEQ ID NO: 2116419 - RNA, 23 nt, Homo sapiens
agaucaucuccaaaucuugccau

SEQ ID NO: 2116420 - RNA, 16 nt, Homo sapiens
ucagauagaucugugu

SEQ ID NO: 2116421 - RNA, 22 nt, Homo sapiens
cuaggaugggaacaaggaagga

SEQ ID NO: 2116422 - RNA, 14 nt, Homo sapiens
cacgucugugcucu

SEQ ID NO: 2116423 - RNA, 15 nt, Homo sapiens
auucuccggccucag

SEQ ID NO: 2116424 - RNA, 13 nt, Homo sapiens
uuauacauaucag

SEQ ID NO: 2116425 - RNA, 20 nt, Homo sapiens
caauuucuuuaaaucauuua

SEQ ID NO: 2116426 - RNA, 16 nt, Homo sapiens
ugggaugagagggccc

SEQ ID NO: 2116427 - RNA, 14 nt, Homo sapiens
gaagauaauuugca

SEQ ID NO: 2116428 - RNA, 20 nt, Homo sapiens
auauuaaauuucaaaugcag

SEQ ID NO: 2116429 - RNA, 16 nt, Homo sapiens
ccuguaauaaauaugu

SEQ ID NO: 2116430 - RNA, 15 nt, Homo sapiens
uccaguccagugaug

SEQ ID NO: 2116431 - RNA, 11 nt, Homo sapiens
agagcacauuu

SEQ ID NO: 2116432 - RNA, 15 nt, Homo sapiens
acuuaguccugaugu

SEQ ID NO: 2116433 - RNA, 16 nt, Homo sapiens
gcgagacuccaucucu

SEQ ID NO: 2116434 - RNA, 18 nt, Homo sapiens
acguccagcucguucucu

SEQ ID NO: 2116435 - RNA, 16 nt, Homo sapiens
cuuuccccuaagcaga

SEQ ID NO: 2116436 - RNA, 16 nt, Homo sapiens
agcauguguucuguua

SEQ ID NO: 2116437 - RNA, 13 nt, Homo sapiens
cacuggcauuguc

SEQ ID NO: 2116438 - RNA, 21 nt, Homo sapiens
ggaaagcacaagacuggccca

SEQ ID NO: 2116439 - RNA, 19 nt, Homo sapiens
ucucaaaguuugacaggaa

SEQ ID NO: 2116440 - RNA, 22 nt, Homo sapiens
agugguguuacauuuucuuguc

SEQ ID NO: 2116441 - RNA, 15 nt, Homo sapiens
uaugguugauuccca

SEQ ID NO: 2116442 - RNA, 22 nt, Homo sapiens
gucaacauuuguuagaaccagu

SEQ ID NO: 2116443 - RNA, 23 nt, Homo sapiens
guggauuauaaauuucuuucaua

SEQ ID NO: 2116444 - RNA, 16 nt, Homo sapiens
acagaugauacuucca

SEQ ID NO: 2116445 - RNA, 15 nt, Homo sapiens
aaaauauauacuaaa

SEQ ID NO: 2116446 - RNA, 14 nt, Homo sapiens
aaaccuuucauaau

SEQ ID NO: 2116447 - RNA, 23 nt, Homo sapiens
ggucuugugguuguguguguucu

SEQ ID NO: 2116448 - RNA, 13 nt, Homo sapiens
cucauguccuuca

SEQ ID NO: 2116449 - RNA, 15 nt, Homo sapiens
acaguagcauggcuc

SEQ ID NO: 2116450 - RNA, 20 nt, Homo sapiens
acauuuaucaaucaguauaa

SEQ ID NO: 2116451 - RNA, 17 nt, Homo sapiens
cuuugucuccaaagaag

SEQ ID NO: 2116452 - RNA, 12 nt, Homo sapiens
uuacuuauauau

SEQ ID NO: 2116453 - RNA, 13 nt, Homo sapiens
guaaagccucagc

SEQ ID NO: 2116454 - RNA, 16 nt, Homo sapiens
uauacacgaauagaca

SEQ ID NO: 2116455 - RNA, 20 nt, Homo sapiens
gaauggagggcaacauucca

SEQ ID NO: 2116456 - RNA, 23 nt, Homo sapiens
uguagaaugucuugguguuauca

SEQ ID NO: 2116457 - RNA, 18 nt, Homo sapiens
aaacaaauauuucacuua

SEQ ID NO: 2116458 - RNA, 21 nt, Homo sapiens
auuuguuaggccauucuugca

SEQ ID NO: 2116459 - RNA, 13 nt, Homo sapiens
accuccuguggaa

SEQ ID NO: 2116460 - RNA, 15 nt, Homo sapiens
auuuaaauguaacuu

SEQ ID NO: 2116461 - RNA, 23 nt, Homo sapiens
caaaauagucuucucaaauuaga

SEQ ID NO: 2116462 - RNA, 16 nt, Homo sapiens
ccuaccccaagaugcc

SEQ ID NO: 2116463 - RNA, 21 nt, Homo sapiens
guacuugaauuuuucuuccuc

SEQ ID NO: 2116464 - RNA, 23 nt, Homo sapiens
cccaggccaguaagggaaauaga

SEQ ID NO: 2116465 - RNA, 18 nt, Homo sapiens
caaaaacuuuucauuuca

SEQ ID NO: 2116466 - RNA, 21 nt, Homo sapiens
aggaaaugaaugaucuuggcu

SEQ ID NO: 2116467 - RNA, 15 nt, Homo sapiens
cugaauuccauaaua

SEQ ID NO: 2116468 - RNA, 16 nt, Homo sapiens
acaaauuuaacuuuua

SEQ ID NO: 2116469 - RNA, 22 nt, Homo sapiens
gcugagcuugugccuuggugau

SEQ ID NO: 2116470 - RNA, 17 nt, Homo sapiens
auaaaucauuaagacaa

SEQ ID NO: 2116471 - RNA, 13 nt, Homo sapiens
cacccaaagcaug

SEQ ID NO: 2116472 - RNA, 20 nt, Homo sapiens
auuuuccgggaacuuugcag

SEQ ID NO: 2116473 - RNA, 19 nt, Homo sapiens
uguuggauagucagcugua

SEQ ID NO: 2116474 - RNA, 20 nt, Homo sapiens
cucccagaacacacuccauc

SEQ ID NO: 2116475 - RNA, 17 nt, Homo sapiens
cauauuucaaaccacaa

SEQ ID NO: 2116476 - RNA, 19 nt, Homo sapiens
uccacugauuggaccuuau

SEQ ID NO: 2116477 - RNA, 16 nt, Homo sapiens
ccaaaagugcauucaa

SEQ ID NO: 2116478 - RNA, 18 nt, Homo sapiens
aagauguugucuugcgau

SEQ ID NO: 2116479 - RNA, 15 nt, Homo sapiens
gcccuggaggcggug

SEQ ID NO: 2116480 - RNA, 18 nt, Homo sapiens
ucccaguacaacaacaug

SEQ ID NO: 2116481 - RNA, 19 nt, Homo sapiens
uauuagauaauauaccgua

SEQ ID NO: 2116482 - RNA, 19 nt, Homo sapiens
uuuuuaauuuuuugucaag

SEQ ID NO: 2116483 - RNA, 22 nt, Homo sapiens
aagacaccaaauugaacucacu

SEQ ID NO: 2116484 - RNA, 17 nt, Homo sapiens
acacugauccagucaca

SEQ ID NO: 2116485 - RNA, 14 nt, Homo sapiens
cucccccaguuccu

SEQ ID NO: 2116486 - RNA, 18 nt, Homo sapiens
aaauugaugauccauuaa

SEQ ID NO: 2116487 - RNA, 17 nt, Homo sapiens
agauauuacagcuuauu

SEQ ID NO: 2116488 - RNA, 16 nt, Homo sapiens
cucgaguuacagacaa

SEQ ID NO: 2116489 - RNA, 20 nt, Homo sapiens
ucgcaucuugugucgcugaa

SEQ ID NO: 2116490 - RNA, 17 nt, Homo sapiens
gaggcugaggcacuggc

SEQ ID NO: 2116491 - RNA, 16 nt, Homo sapiens
cugcucaccaccugcc

SEQ ID NO: 2116492 - RNA, 12 nt, Homo sapiens
ggcaggcagcug

SEQ ID NO: 2116493 - RNA, 23 nt, Homo sapiens
uuaguauacugcccaaacuaaug

SEQ ID NO: 2116494 - RNA, 12 nt, Homo sapiens
ucauuuugccaa

SEQ ID NO: 2116495 - RNA, 12 nt, Homo sapiens
uaccacuugccu

SEQ ID NO: 2116496 - RNA, 15 nt, Homo sapiens
aaaauuuaacaucug

SEQ ID NO: 2116497 - RNA, 18 nt, Homo sapiens
gguccauuucaugugauc

SEQ ID NO: 2116498 - RNA, 12 nt, Homo sapiens
ccuucucaaaag

SEQ ID NO: 2116499 - RNA, 11 nt, Homo sapiens
caaugggaccu

SEQ ID NO: 2116500 - RNA, 23 nt, Homo sapiens
uccccaaacaccaugaaucuuuu

SEQ ID NO: 2116501 - RNA, 12 nt, Homo sapiens
cugggaagcaaa

SEQ ID NO: 2116502 - RNA, 24 nt, Homo sapiens
uuuacaucuauguguauguugacu

SEQ ID NO: 2116503 - RNA, 15 nt, Homo sapiens
gcuccuccagggugu

SEQ ID NO: 2116504 - RNA, 22 nt, Homo sapiens
uuaagcagaacuaagcucagua

SEQ ID NO: 2116505 - RNA, 17 nt, Homo sapiens
augaaugauguuuuaga

SEQ ID NO: 2116506 - RNA, 20 nt, Homo sapiens
cggacauacucucugccugg

SEQ ID NO: 2116507 - RNA, 15 nt, Homo sapiens
uuaacgcaaauauua

SEQ ID NO: 2116508 - RNA, 15 nt, Homo sapiens
acauauauauuacaa

SEQ ID NO: 2116509 - RNA, 14 nt, Homo sapiens
aacuguaacauaua

SEQ ID NO: 2116510 - RNA, 21 nt, Homo sapiens
aacuguuaagggaagcugaua

SEQ ID NO: 2116511 - RNA, 21 nt, Homo sapiens
ccugucuuccuugaccaaagc

SEQ ID NO: 2116512 - RNA, 12 nt, Homo sapiens
ccaccuucuuca

SEQ ID NO: 2116513 - RNA, 18 nt, Homo sapiens
guuuccuggaccagugac

SEQ ID NO: 2116514 - RNA, 16 nt, Homo sapiens
ugaccaagcaucuuug

SEQ ID NO: 2116515 - RNA, 22 nt, Homo sapiens
ccuugucaauacugagccauuu

SEQ ID NO: 2116516 - RNA, 14 nt, Homo sapiens
gaaacuaagccagg

SEQ ID NO: 2116517 - RNA, 17 nt, Homo sapiens
aaaucgugauauugaaa

SEQ ID NO: 2116518 - RNA, 22 nt, Homo sapiens
aacccuggaagcuguaugccac

SEQ ID NO: 2116519 - RNA, 21 nt, Homo sapiens
guaaguuuaugcauacaguaa

SEQ ID NO: 2116520 - RNA, 19 nt, Homo sapiens
cuaacuuuguaaccagaau

SEQ ID NO: 2116521 - RNA, 17 nt, Homo sapiens
ccuuaugauauucucau

SEQ ID NO: 2116522 - RNA, 16 nt, Homo sapiens
aggccaaagaccuccc

SEQ ID NO: 2116523 - RNA, 17 nt, Homo sapiens
cuccaggcauuuauuca

SEQ ID NO: 2116524 - RNA, 16 nt, Homo sapiens
uuuauaauaagacauu

SEQ ID NO: 2116525 - RNA, 20 nt, Homo sapiens
agaacuggcaguugucauca

SEQ ID NO: 2116526 - RNA, 16 nt, Homo sapiens
aaagacuuccuugcag

SEQ ID NO: 2116527 - RNA, 13 nt, Homo sapiens
acauacauucccu

SEQ ID NO: 2116528 - RNA, 14 nt, Homo sapiens
auguugucacuggu

SEQ ID NO: 2116529 - RNA, 21 nt, Homo sapiens
gcagaauucuaggcagcaccu

SEQ ID NO: 2116530 - RNA, 21 nt, Homo sapiens
ugauggaaaauaaacaucagu

SEQ ID NO: 2116531 - RNA, 18 nt, Homo sapiens
agauuugugcccauuccu

SEQ ID NO: 2116532 - RNA, 19 nt, Homo sapiens
cccagcugaggagcaggug

SEQ ID NO: 2116533 - RNA, 17 nt, Homo sapiens
acaggccgcacaucuca

SEQ ID NO: 2116534 - RNA, 19 nt, Homo sapiens
cugggugcuacuggggaaa

SEQ ID NO: 2116535 - RNA, 20 nt, Homo sapiens
cugcuugauuuuaauacauu

SEQ ID NO: 2116536 - RNA, 21 nt, Homo sapiens
ugaguaaauauugaggcuuug

SEQ ID NO: 2116537 - RNA, 17 nt, Homo sapiens
ugaaauguuugcauaaa

SEQ ID NO: 2116538 - RNA, 18 nt, Homo sapiens
agaugugaugaauuaucc

SEQ ID NO: 2116539 - RNA, 20 nt, Homo sapiens
ucaaaauaaguguaauccac

SEQ ID NO: 2116540 - RNA, 11 nt, Homo sapiens
ccaagugcaau

SEQ ID NO: 2116541 - RNA, 23 nt, Homo sapiens
acaauggcuggguuugggcagug

SEQ ID NO: 2116542 - RNA, 16 nt, Homo sapiens
augggugggggcuccu

SEQ ID NO: 2116543 - RNA, 13 nt, Homo sapiens
guuucuccuggua

SEQ ID NO: 2116544 - RNA, 14 nt, Homo sapiens
cauucuggcuuaaa

SEQ ID NO: 2116545 - RNA, 23 nt, Homo sapiens
ugcagaccucccgcuuuggcuua

SEQ ID NO: 2116546 - RNA, 23 nt, Homo sapiens
ucuuaauuaaguaaacuaaugag

SEQ ID NO: 2116547 - RNA, 13 nt, Homo sapiens
accagauauuuga

SEQ ID NO: 2116548 - RNA, 15 nt, Homo sapiens
ugucguugugcuuuu

SEQ ID NO: 2116549 - RNA, 12 nt, Homo sapiens
aauacacaggga

SEQ ID NO: 2116550 - RNA, 12 nt, Homo sapiens
gcccugggaugu

SEQ ID NO: 2116551 - RNA, 21 nt, Homo sapiens
acauuucauuagugagccaug

SEQ ID NO: 2116552 - RNA, 14 nt, Homo sapiens
aucuuguaaaggau

SEQ ID NO: 2116553 - RNA, 21 nt, Homo sapiens
ugauuuuaaccaauguagcac

SEQ ID NO: 2116554 - RNA, 18 nt, Homo sapiens
caauggaacaguagcuuu

SEQ ID NO: 2116555 - RNA, 13 nt, Homo sapiens
caguguacagucu

SEQ ID NO: 2116556 - RNA, 16 nt, Homo sapiens
acugaaggugauucac

SEQ ID NO: 2116557 - RNA, 22 nt, Homo sapiens
cccgcaggcagccccacacccg

SEQ ID NO: 2116558 - RNA, 14 nt, Homo sapiens
uggugacagucucc

SEQ ID NO: 2116559 - RNA, 20 nt, Homo sapiens
uuuucgucuucccugcuuca

SEQ ID NO: 2116560 - RNA, 22 nt, Homo sapiens
uuauuuauaaugaagacaucua

SEQ ID NO: 2116561 - RNA, 19 nt, Homo sapiens
uacuguugcacugaugucc

SEQ ID NO: 2116562 - RNA, 16 nt, Homo sapiens
cccagcuaacucugac

SEQ ID NO: 2116563 - RNA, 14 nt, Homo sapiens
agaucaaaugcccu

SEQ ID NO: 2116564 - RNA, 22 nt, Homo sapiens
gcucucaaaccccugaccucaa

SEQ ID NO: 2116565 - RNA, 21 nt, Homo sapiens
auauuuauuauuuucauauaa

SEQ ID NO: 2116566 - RNA, 14 nt, Homo sapiens
caagcagcguggaa

SEQ ID NO: 2116567 - RNA, 14 nt, Homo sapiens
gcaauuugcaagga

SEQ ID NO: 2116568 - RNA, 17 nt, Homo sapiens
caaaagaagaaaccuuc

SEQ ID NO: 2116569 - RNA, 16 nt, Homo sapiens
auaaaacccaauacuu

SEQ ID NO: 2116570 - RNA, 15 nt, Homo sapiens
auuuuuagcuuuuca

SEQ ID NO: 2116571 - RNA, 13 nt, Homo sapiens
cuuaaagcacuua

SEQ ID NO: 2116572 - RNA, 18 nt, Homo sapiens
uuuggauuacuauugcaa

SEQ ID NO: 2116573 - RNA, 17 nt, Homo sapiens
auguauguguaccuaag

SEQ ID NO: 2116574 - RNA, 13 nt, Homo sapiens
gaggaaccucaaa

SEQ ID NO: 2116575 - RNA, 14 nt, Homo sapiens
ucugaauugcacau

SEQ ID NO: 2116576 - RNA, 13 nt, Homo sapiens
aaaaccuacccuc

SEQ ID NO: 2116577 - RNA, 17 nt, Homo sapiens
agcccagugcacugaaa

SEQ ID NO: 2116578 - RNA, 13 nt, Homo sapiens
cagagcuuccuua

SEQ ID NO: 2116579 - RNA, 23 nt, Homo sapiens
acgguuucuccccggacacucgc

SEQ ID NO: 2116580 - RNA, 18 nt, Homo sapiens
uuaugucaucaguaaagu

SEQ ID NO: 2116581 - RNA, 22 nt, Homo sapiens
ucuucccucuccccauucggug

SEQ ID NO: 2116582 - RNA, 15 nt, Homo sapiens
caugagacugcccug

SEQ ID NO: 2116583 - RNA, 19 nt, Homo sapiens
acuucugcgggcucccucc

SEQ ID NO: 2116584 - RNA, 14 nt, Homo sapiens
gccaugaaggcacc

SEQ ID NO: 2116585 - RNA, 17 nt, Homo sapiens
auugcaucccaaaccac

SEQ ID NO: 2116586 - RNA, 22 nt, Homo sapiens
cuuaagcaaaggggacagcugu

SEQ ID NO: 2116587 - RNA, 19 nt, Homo sapiens
gggauucccuggugggccu

SEQ ID NO: 2116588 - RNA, 17 nt, Homo sapiens
acucaccuucuggccag

SEQ ID NO: 2116589 - RNA, 13 nt, Homo sapiens
uacaggacauaua

SEQ ID NO: 2116590 - RNA, 15 nt, Homo sapiens
uccagccuccagggc

SEQ ID NO: 2116591 - RNA, 16 nt, Homo sapiens
acuuaguugcguuaca

SEQ ID NO: 2116592 - RNA, 18 nt, Homo sapiens
ugggaguaaguucuucaa

SEQ ID NO: 2116593 - RNA, 12 nt, Homo sapiens
cuguugcucaaa

SEQ ID NO: 2116594 - RNA, 15 nt, Homo sapiens
aaggcagccaggcug

SEQ ID NO: 2116595 - RNA, 16 nt, Homo sapiens
uccaucaaguaccuca

SEQ ID NO: 2116596 - RNA, 15 nt, Homo sapiens
uagacucaucuuuug

SEQ ID NO: 2116597 - RNA, 18 nt, Homo sapiens
auucaaauuccuacaguu

SEQ ID NO: 2116598 - RNA, 16 nt, Homo sapiens
auuccaacaaaggguu

SEQ ID NO: 2116599 - RNA, 12 nt, Homo sapiens
cuugcugugagc

SEQ ID NO: 2116600 - RNA, 23 nt, Homo sapiens
caaaauaccuucugaacuacacu

SEQ ID NO: 2116601 - RNA, 11 nt, Homo sapiens
uuccuuucauu

SEQ ID NO: 2116602 - RNA, 17 nt, Homo sapiens
cuugaauucauguuggu

SEQ ID NO: 2116603 - RNA, 22 nt, Homo sapiens
aggcaauggugaacugucauua

SEQ ID NO: 2116604 - RNA, 14 nt, Homo sapiens
auuccugcaggaaa

SEQ ID NO: 2116605 - RNA, 16 nt, Homo sapiens
agggggccuggaugcc

SEQ ID NO: 2116606 - RNA, 20 nt, Homo sapiens
auuauaguaccacugcacau

SEQ ID NO: 2116607 - RNA, 21 nt, Homo sapiens
auacaguggauagcuugauau

SEQ ID NO: 2116608 - RNA, 22 nt, Homo sapiens
cuauacacuuaaugauacaugu

SEQ ID NO: 2116609 - RNA, 22 nt, Homo sapiens
cccggccagcgggcacagggca

SEQ ID NO: 2116610 - RNA, 16 nt, Homo sapiens
ugaaaauuuuacuucc

SEQ ID NO: 2116611 - RNA, 21 nt, Homo sapiens
gagguggcuaagggggaccau

SEQ ID NO: 2116612 - RNA, 15 nt, Homo sapiens
uggcacacgccugua

SEQ ID NO: 2116613 - RNA, 12 nt, Homo sapiens
ccauaacuuuau

SEQ ID NO: 2116614 - RNA, 21 nt, Homo sapiens
ccaaggccacggagcaguuca

SEQ ID NO: 2116615 - RNA, 13 nt, Homo sapiens
guaggugucucau

SEQ ID NO: 2116616 - RNA, 15 nt, Homo sapiens
cacugagagugaagu

SEQ ID NO: 2116617 - RNA, 23 nt, Homo sapiens
aaacaucacaaaauguaauuuaa

SEQ ID NO: 2116618 - RNA, 20 nt, Homo sapiens
uggaggguaaugagaagcuu

SEQ ID NO: 2116619 - RNA, 18 nt, Homo sapiens
auuuugggguaagacuuu

SEQ ID NO: 2116620 - RNA, 13 nt, Homo sapiens
aguaggugcuuga

SEQ ID NO: 2116621 - RNA, 15 nt, Homo sapiens
cacccaggcaggugc

SEQ ID NO: 2116622 - RNA, 11 nt, Homo sapiens
caagccacaag

SEQ ID NO: 2116623 - RNA, 15 nt, Homo sapiens
uugaaggacacaaga

SEQ ID NO: 2116624 - RNA, 21 nt, Homo sapiens
acauguuccuuauauuuacuc

SEQ ID NO: 2116625 - RNA, 18 nt, Homo sapiens
ugaguggaucuccaagga

SEQ ID NO: 2116626 - RNA, 21 nt, Homo sapiens
aagggcuaugccuccauuuca

SEQ ID NO: 2116627 - RNA, 12 nt, Homo sapiens
agccaagcccug

SEQ ID NO: 2116628 - RNA, 19 nt, Homo sapiens
ucccgggcuuaccagguga

SEQ ID NO: 2116629 - RNA, 22 nt, Homo sapiens
guaauuuguuuaaaaaguaaua

SEQ ID NO: 2116630 - RNA, 24 nt, Homo sapiens
gaggaaucacucuuguggauguuu

SEQ ID NO: 2116631 - RNA, 21 nt, Homo sapiens
cagcaaugacaucucaggggc

SEQ ID NO: 2116632 - RNA, 15 nt, Homo sapiens
ucuuguucagauuaa

SEQ ID NO: 2116633 - RNA, 13 nt, Homo sapiens
auaaaacagcugc

SEQ ID NO: 2116634 - RNA, 22 nt, Homo sapiens
uuagauugaguaagauuuaccc

SEQ ID NO: 2116635 - RNA, 13 nt, Homo sapiens
acguuguuaaaug

SEQ ID NO: 2116636 - RNA, 21 nt, Homo sapiens
guucaucaauaccugcugaga

SEQ ID NO: 2116637 - RNA, 15 nt, Homo sapiens
gcacaaaaauaaugu

SEQ ID NO: 2116638 - RNA, 13 nt, Homo sapiens
cuugggucccgga

SEQ ID NO: 2116639 - RNA, 17 nt, Homo sapiens
ggaugacuaacaagauu

SEQ ID NO: 2116640 - RNA, 20 nt, Homo sapiens
agauaauugaauaaguaccu

SEQ ID NO: 2116641 - RNA, 20 nt, Homo sapiens
auacuagaguugauuauaga

SEQ ID NO: 2116642 - RNA, 22 nt, Homo sapiens
acgacaaagccaaacucugcca

SEQ ID NO: 2116643 - RNA, 14 nt, Homo sapiens
agaacgaauuauuu

SEQ ID NO: 2116644 - RNA, 17 nt, Homo sapiens
ggcaggaccuguggcca

SEQ ID NO: 2116645 - RNA, 19 nt, Homo sapiens
cuggagacaguaacauuuc

SEQ ID NO: 2116646 - RNA, 19 nt, Homo sapiens
ccguguuggucuguacuga

SEQ ID NO: 2116647 - RNA, 13 nt, Homo sapiens
agguacuguauga

SEQ ID NO: 2116648 - RNA, 23 nt, Homo sapiens
auacuagucaccccaaguagucu

SEQ ID NO: 2116649 - RNA, 16 nt, Homo sapiens
gacaaagagccagaaa

SEQ ID NO: 2116650 - RNA, 19 nt, Homo sapiens
acugaugccccagggauuc

SEQ ID NO: 2116651 - RNA, 15 nt, Homo sapiens
aagauugaaauucca

SEQ ID NO: 2116652 - RNA, 21 nt, Homo sapiens
uacaacaaucccagcaucuga

SEQ ID NO: 2116653 - RNA, 18 nt, Homo sapiens
uuucugugcauucaugca

SEQ ID NO: 2116654 - RNA, 22 nt, Homo sapiens
caaauaaaucauccucaugucc

SEQ ID NO: 2116655 - RNA, 17 nt, Homo sapiens
uucauagacccucucaa

SEQ ID NO: 2116656 - RNA, 18 nt, Homo sapiens
uuuauuuuugagacagag

SEQ ID NO: 2116657 - RNA, 18 nt, Homo sapiens
cauggugaaaauguacug

SEQ ID NO: 2116658 - RNA, 17 nt, Homo sapiens
uuaugcuaccuacugau

SEQ ID NO: 2116659 - RNA, 18 nt, Homo sapiens
caggcauuugacugaaga

SEQ ID NO: 2116660 - RNA, 13 nt, Homo sapiens
ggaacuccagggg

SEQ ID NO: 2116661 - RNA, 17 nt, Homo sapiens
aucucagucauccugca

SEQ ID NO: 2116662 - RNA, 16 nt, Homo sapiens
gguuccuggugacucc

SEQ ID NO: 2116663 - RNA, 20 nt, Homo sapiens
augcuguggacaccaccuau

SEQ ID NO: 2116664 - RNA, 14 nt, Homo sapiens
accucuuccuggcc

SEQ ID NO: 2116665 - RNA, 20 nt, Homo sapiens
ccaaugaguuggccuuuaaa

SEQ ID NO: 2116666 - RNA, 16 nt, Homo sapiens
cugauggugcugcuca

SEQ ID NO: 2116667 - RNA, 21 nt, Homo sapiens
ucgcuuucuaaaggaaaucaa

SEQ ID NO: 2116668 - RNA, 21 nt, Homo sapiens
aaauaucaaagucauuaaaga

SEQ ID NO: 2116669 - RNA, 21 nt, Homo sapiens
aucaaaaucuggcagagucag

SEQ ID NO: 2116670 - RNA, 22 nt, Homo sapiens
ucauuacaaucgagacugcaau

SEQ ID NO: 2116671 - RNA, 19 nt, Homo sapiens
aacauacaagagacauaua

SEQ ID NO: 2116672 - RNA, 15 nt, Homo sapiens
gagacaugugacauu

SEQ ID NO: 2116673 - RNA, 12 nt, Homo sapiens
uccuaugcuuua

SEQ ID NO: 2116674 - RNA, 16 nt, Homo sapiens
gucuccaaggucccau

SEQ ID NO: 2116675 - RNA, 12 nt, Homo sapiens
uuaggaguacug

SEQ ID NO: 2116676 - RNA, 16 nt, Homo sapiens
ugcuguuccaccuucc

SEQ ID NO: 2116677 - RNA, 20 nt, Homo sapiens
aggcugccuggagaaaggau

SEQ ID NO: 2116678 - RNA, 18 nt, Homo sapiens
uuauagcaacaacaauug

SEQ ID NO: 2116679 - RNA, 13 nt, Homo sapiens
aucaauucuuaga

SEQ ID NO: 2116680 - RNA, 15 nt, Homo sapiens
gacaucaacagauaa

SEQ ID NO: 2116681 - RNA, 11 nt, Homo sapiens
ccauguuguua

SEQ ID NO: 2116682 - RNA, 23 nt, Homo sapiens
aaggcuaucggagcaguucaaua

SEQ ID NO: 2116683 - RNA, 22 nt, Homo sapiens
cagccagcgcaggcccuggugg

SEQ ID NO: 2116684 - RNA, 19 nt, Homo sapiens
gcacaggccauggugcaca

SEQ ID NO: 2116685 - RNA, 20 nt, Homo sapiens
cucuggcuucccugcccaau

SEQ ID NO: 2116686 - RNA, 22 nt, Homo sapiens
aacagcugguccuccacuuugc

SEQ ID NO: 2116687 - RNA, 22 nt, Homo sapiens
cuguagaaaaaaaaauucacau

SEQ ID NO: 2116688 - RNA, 11 nt, Homo sapiens
ccacacccacu

SEQ ID NO: 2116689 - RNA, 16 nt, Homo sapiens
auacuaugugggacac

SEQ ID NO: 2116690 - RNA, 17 nt, Homo sapiens
acccuuagccuccagca

SEQ ID NO: 2116691 - RNA, 21 nt, Homo sapiens
ugauggguuaguggauggaag

SEQ ID NO: 2116692 - RNA, 20 nt, Homo sapiens
caugcaaaucuggcuuagua

SEQ ID NO: 2116693 - RNA, 14 nt, Homo sapiens
ugggcuugauucug

SEQ ID NO: 2116694 - RNA, 20 nt, Homo sapiens
cuccucagcggcuccagcuc

SEQ ID NO: 2116695 - RNA, 17 nt, Homo sapiens
aaugagcuguaucugua

SEQ ID NO: 2116696 - RNA, 19 nt, Homo sapiens
uaaauguuuuucuauguag

SEQ ID NO: 2116697 - RNA, 16 nt, Homo sapiens
ucgcaaccuugaggaa

SEQ ID NO: 2116698 - RNA, 20 nt, Homo sapiens
uguuuggaauauuccacuau

SEQ ID NO: 2116699 - RNA, 18 nt, Homo sapiens
ugaagcccuuugccugua

SEQ ID NO: 2116700 - RNA, 18 nt, Homo sapiens
gcaauaaggaucuuccca

SEQ ID NO: 2116701 - RNA, 16 nt, Homo sapiens
acuguuugucuucucc

SEQ ID NO: 2116702 - RNA, 19 nt, Homo sapiens
ucacaugaauuauuacagu

SEQ ID NO: 2116703 - RNA, 18 nt, Homo sapiens
ggagaaucacuugcacuc

SEQ ID NO: 2116704 - RNA, 23 nt, Homo sapiens
ugagccacugcucguggccaaaa

SEQ ID NO: 2116705 - RNA, 17 nt, Homo sapiens
cauggaauaaaccauuu

SEQ ID NO: 2116706 - RNA, 15 nt, Homo sapiens
aauaauaccauaaua

SEQ ID NO: 2116707 - RNA, 15 nt, Homo sapiens
aaugugaccauguga

SEQ ID NO: 2116708 - RNA, 15 nt, Homo sapiens
aaacgugcgcucaca

SEQ ID NO: 2116709 - RNA, 19 nt, Homo sapiens
aauugcuccauuccugagu

SEQ ID NO: 2116710 - RNA, 21 nt, Homo sapiens
ccauuaaaauaaaacaagccu

SEQ ID NO: 2116711 - RNA, 12 nt, Homo sapiens
gccugcucuuuc

SEQ ID NO: 2116712 - RNA, 19 nt, Homo sapiens
uguggagggagggcagcug

SEQ ID NO: 2116713 - RNA, 19 nt, Homo sapiens
caccaggcagcuccagcug

SEQ ID NO: 2116714 - RNA, 17 nt, Homo sapiens
aauuaaaaaagcauacu

SEQ ID NO: 2116715 - RNA, 18 nt, Homo sapiens
caauaaacgaaacacaga

SEQ ID NO: 2116716 - RNA, 20 nt, Homo sapiens
aggcuggaagagccaaagaa

SEQ ID NO: 2116717 - RNA, 19 nt, Homo sapiens
uuuaaaaaugucuugcugu

SEQ ID NO: 2116718 - RNA, 14 nt, Homo sapiens
gugcacucacuccu

SEQ ID NO: 2116719 - RNA, 20 nt, Homo sapiens
uauaauucacucaagcacug

SEQ ID NO: 2116720 - RNA, 17 nt, Homo sapiens
aucagaacugugccaca

SEQ ID NO: 2116721 - RNA, 15 nt, Homo sapiens
cccuggaaacauaca

SEQ ID NO: 2116722 - RNA, 16 nt, Homo sapiens
agccuggggccaagca

SEQ ID NO: 2116723 - RNA, 17 nt, Homo sapiens
cugagguugaccagcuc

SEQ ID NO: 2116724 - RNA, 22 nt, Homo sapiens
uugugaaggaaaaacaugcuua

SEQ ID NO: 2116725 - RNA, 15 nt, Homo sapiens
cauuuuggaaccuaa

SEQ ID NO: 2116726 - RNA, 22 nt, Homo sapiens
cauagagaauauaaaaauaaag

SEQ ID NO: 2116727 - RNA, 14 nt, Homo sapiens
aaaccuucucagga

SEQ ID NO: 2116728 - RNA, 17 nt, Homo sapiens
uaggguagugcuaagag

SEQ ID NO: 2116729 - RNA, 15 nt, Homo sapiens
uucuuuuuugccaaa

SEQ ID NO: 2116730 - RNA, 16 nt, Homo sapiens
ucccagcgcucuggga

SEQ ID NO: 2116731 - RNA, 19 nt, Homo sapiens
acauguaguaguacuugaa

SEQ ID NO: 2116732 - RNA, 18 nt, Homo sapiens
gaggucaagauuucagga

SEQ ID NO: 2116733 - RNA, 13 nt, Homo sapiens
ugccuuacuguac

SEQ ID NO: 2116734 - RNA, 13 nt, Homo sapiens
uccacuacucucu

SEQ ID NO: 2116735 - RNA, 21 nt, Homo sapiens
cagcccagaggccaacacugu

SEQ ID NO: 2116736 - RNA, 21 nt, Homo sapiens
cacagagagggacacaugccc

SEQ ID NO: 2116737 - RNA, 16 nt, Homo sapiens
aauuauuauauauaca

SEQ ID NO: 2116738 - RNA, 21 nt, Homo sapiens
acuggcacagagguagucuca

SEQ ID NO: 2116739 - RNA, 19 nt, Homo sapiens
aaggugugcucugagccac

SEQ ID NO: 2116740 - RNA, 16 nt, Homo sapiens
ugggcaagugaggcaa

SEQ ID NO: 2116741 - RNA, 18 nt, Homo sapiens
aaugccuuauuucaaaac

SEQ ID NO: 2116742 - RNA, 18 nt, Homo sapiens
augugcucccaccaggca

SEQ ID NO: 2116743 - RNA, 19 nt, Homo sapiens
gacauuuucaauaauguga

SEQ ID NO: 2116744 - RNA, 22 nt, Homo sapiens
cuuuuaagcaaaguugggugua

SEQ ID NO: 2116745 - RNA, 18 nt, Homo sapiens
gaaccaauaugaacugca

SEQ ID NO: 2116746 - RNA, 14 nt, Homo sapiens
aagaucucaguggu

SEQ ID NO: 2116747 - RNA, 20 nt, Homo sapiens
gaaucaaaagugccucaaga

SEQ ID NO: 2116748 - RNA, 22 nt, Homo sapiens
ccagagccugucuuucagcauu

SEQ ID NO: 2116749 - RNA, 18 nt, Homo sapiens
uuaugauuucauuaucac

SEQ ID NO: 2116750 - RNA, 18 nt, Homo sapiens
gcuguuguaaagaauugg

SEQ ID NO: 2116751 - RNA, 19 nt, Homo sapiens
ggcagaauggugggcucca

SEQ ID NO: 2116752 - RNA, 13 nt, Homo sapiens
auccucaagagaa

SEQ ID NO: 2116753 - RNA, 23 nt, Homo sapiens
gguacauucuagcugagaagcaa

SEQ ID NO: 2116754 - RNA, 23 nt, Homo sapiens
gcuaaugacgacaccuagcucua

SEQ ID NO: 2116755 - RNA, 15 nt, Homo sapiens
aacagaugugucagc

SEQ ID NO: 2116756 - RNA, 15 nt, Homo sapiens
cagacucguucuucu

SEQ ID NO: 2116757 - RNA, 15 nt, Homo sapiens
uaaauaucacaaagu

SEQ ID NO: 2116758 - RNA, 19 nt, Homo sapiens
agucaguugcaaauuuuag

SEQ ID NO: 2116759 - RNA, 14 nt, Homo sapiens
guucuuuugcaaua

SEQ ID NO: 2116760 - RNA, 18 nt, Homo sapiens
caauucaaauugacugaa

SEQ ID NO: 2116761 - RNA, 20 nt, Homo sapiens
cacagcaaggaaauucaccu

SEQ ID NO: 2116762 - RNA, 15 nt, Homo sapiens
uuagauccaaaauaa

SEQ ID NO: 2116763 - RNA, 18 nt, Homo sapiens
cccaggagcaacagccua

SEQ ID NO: 2116764 - RNA, 16 nt, Homo sapiens
agacaagguucugccc

SEQ ID NO: 2116765 - RNA, 19 nt, Homo sapiens
accaucgucuucuuggcca

SEQ ID NO: 2116766 - RNA, 19 nt, Homo sapiens
ggcuccgacuugugcacag

SEQ ID NO: 2116767 - RNA, 16 nt, Homo sapiens
uuguucagacauucca

SEQ ID NO: 2116768 - RNA, 17 nt, Homo sapiens
auccuuccucauuugca

SEQ ID NO: 2116769 - RNA, 16 nt, Homo sapiens
agugaggugacacucc

SEQ ID NO: 2116770 - RNA, 17 nt, Homo sapiens
auacuguacauagcugu

SEQ ID NO: 2116771 - RNA, 14 nt, Homo sapiens
aaaguccaguuuau

SEQ ID NO: 2116772 - RNA, 22 nt, Homo sapiens
cuaaauggugcugcagauuuga

SEQ ID NO: 2116773 - RNA, 18 nt, Homo sapiens
agguuuaacucagaucac

SEQ ID NO: 2116774 - RNA, 23 nt, Homo sapiens
agcuuccaacccgaggcaauaaa

SEQ ID NO: 2116775 - RNA, 22 nt, Homo sapiens
ccccugcaaugcgucuugugaa

SEQ ID NO: 2116776 - RNA, 19 nt, Homo sapiens
gacaggucauccuugccag

SEQ ID NO: 2116777 - RNA, 16 nt, Homo sapiens
guucugcucacagaca

SEQ ID NO: 2116778 - RNA, 18 nt, Homo sapiens
uugaggacaagauaccaa

SEQ ID NO: 2116779 - RNA, 15 nt, Homo sapiens
gcccagcuauacugu

SEQ ID NO: 2116780 - RNA, 21 nt, Homo sapiens
uuucucaaaauggaagcccuu

SEQ ID NO: 2116781 - RNA, 17 nt, Homo sapiens
gucuggaaugcauggga

SEQ ID NO: 2116782 - RNA, 15 nt, Homo sapiens
aagaccaaucucuug

SEQ ID NO: 2116783 - RNA, 15 nt, Homo sapiens
aauucugucugggga

SEQ ID NO: 2116784 - RNA, 19 nt, Homo sapiens
acauaccaagugguuucca

SEQ ID NO: 2116785 - RNA, 17 nt, Homo sapiens
uuuggagccugccaaga

SEQ ID NO: 2116786 - RNA, 20 nt, Homo sapiens
guuccuuacuuuacugccug

SEQ ID NO: 2116787 - RNA, 17 nt, Homo sapiens
uauucaaaaugauguau

SEQ ID NO: 2116788 - RNA, 18 nt, Homo sapiens
agaagagaaaugcugcua

SEQ ID NO: 2116789 - RNA, 18 nt, Homo sapiens
ugugaugcugacaccagc

SEQ ID NO: 2116790 - RNA, 16 nt, Homo sapiens
uugagaggcugaggug

SEQ ID NO: 2116791 - RNA, 18 nt, Homo sapiens
caaagagguacaaaaaag

SEQ ID NO: 2116792 - RNA, 19 nt, Homo sapiens
aucuguaaggaacuggaac

SEQ ID NO: 2116793 - RNA, 13 nt, Homo sapiens
cugcggcgaccgc

SEQ ID NO: 2116794 - RNA, 13 nt, Homo sapiens
aaccagucuucuc

SEQ ID NO: 2116795 - RNA, 16 nt, Homo sapiens
ccaaagacuguacugg

SEQ ID NO: 2116796 - RNA, 18 nt, Homo sapiens
ccucugcuguagagccau

SEQ ID NO: 2116797 - RNA, 14 nt, Homo sapiens
auaaugcuaaagaa

SEQ ID NO: 2116798 - RNA, 21 nt, Homo sapiens
cccaggaccugagccuggcca

SEQ ID NO: 2116799 - RNA, 17 nt, Homo sapiens
gcugaucgggaagcccu

SEQ ID NO: 2116800 - RNA, 20 nt, Homo sapiens
uauaacuuccuaugcaaaua

SEQ ID NO: 2116801 - RNA, 12 nt, Homo sapiens
aguccuacuuac

SEQ ID NO: 2116802 - RNA, 22 nt, Homo sapiens
uccaacuauuucuuucaucaga

SEQ ID NO: 2116803 - RNA, 15 nt, Homo sapiens
cacaccgaugugcgc

SEQ ID NO: 2116804 - RNA, 21 nt, Homo sapiens
auuguauuccucaugucauca

SEQ ID NO: 2116805 - RNA, 21 nt, Homo sapiens
ccuuuucuuuguucaagauga

SEQ ID NO: 2116806 - RNA, 19 nt, Homo sapiens
ugaaaggagacauugcucu

SEQ ID NO: 2116807 - RNA, 19 nt, Homo sapiens
uaaaacugccuuucuggug

SEQ ID NO: 2116808 - RNA, 15 nt, Homo sapiens
cccaaugcugcucca

SEQ ID NO: 2116809 - RNA, 15 nt, Homo sapiens
gugcaccugggagaa

SEQ ID NO: 2116810 - RNA, 18 nt, Homo sapiens
gcagcuccggaaggacac

SEQ ID NO: 2116811 - RNA, 21 nt, Homo sapiens
uauguauugugcaauguguau

SEQ ID NO: 2116812 - RNA, 11 nt, Homo sapiens
aaccacaagca

SEQ ID NO: 2116813 - RNA, 15 nt, Homo sapiens
cuuacauaucugacu

SEQ ID NO: 2116814 - RNA, 22 nt, Homo sapiens
caagcugauuaaaugacacuca

SEQ ID NO: 2116815 - RNA, 22 nt, Homo sapiens
gcacuguggggcaggacaaggg

SEQ ID NO: 2116816 - RNA, 15 nt, Homo sapiens
uaagaggcuauuuaa

SEQ ID NO: 2116817 - RNA, 12 nt, Homo sapiens
cuaaugcucaac

SEQ ID NO: 2116818 - RNA, 17 nt, Homo sapiens
auguuuaaaaguauaua

SEQ ID NO: 2116819 - RNA, 16 nt, Homo sapiens
guaguuugcauuccag

SEQ ID NO: 2116820 - RNA, 22 nt, Homo sapiens
gcugcccaggcuagagugcagu

SEQ ID NO: 2116821 - RNA, 14 nt, Homo sapiens
uuguuagacauuuu

SEQ ID NO: 2116822 - RNA, 22 nt, Homo sapiens
aagaaaccuggccuuauaucau

SEQ ID NO: 2116823 - RNA, 14 nt, Homo sapiens
gcuucccacuuugg

SEQ ID NO: 2116824 - RNA, 15 nt, Homo sapiens
cagagguucauuuca

SEQ ID NO: 2116825 - RNA, 22 nt, Homo sapiens
aaacaauaaagaaagaaauauu

SEQ ID NO: 2116826 - RNA, 23 nt, Homo sapiens
ucuuugaagcgagcagucagcau

SEQ ID NO: 2116827 - RNA, 17 nt, Homo sapiens
guggcugcuucauauga

SEQ ID NO: 2116828 - RNA, 18 nt, Homo sapiens
cuguaagaguucacaugg

SEQ ID NO: 2116829 - RNA, 16 nt, Homo sapiens
agagcuucucccaaac

SEQ ID NO: 2116830 - RNA, 19 nt, Homo sapiens
gcgacggcuuccaucugcc

SEQ ID NO: 2116831 - RNA, 21 nt, Homo sapiens
gacauuccaagacaguauaca

SEQ ID NO: 2116832 - RNA, 15 nt, Homo sapiens
auuauuuacaaugca

SEQ ID NO: 2116833 - RNA, 21 nt, Homo sapiens
ggcccuggacuucccaaggaa

SEQ ID NO: 2116834 - RNA, 16 nt, Homo sapiens
acccuuggacaagaca

SEQ ID NO: 2116835 - RNA, 23 nt, Homo sapiens
ugcugccaccccuuggcacugug

SEQ ID NO: 2116836 - RNA, 13 nt, Homo sapiens
acccucucagcuc

SEQ ID NO: 2116837 - RNA, 14 nt, Homo sapiens
gucugggacaggga

SEQ ID NO: 2116838 - RNA, 15 nt, Homo sapiens
aggaacgugguucag

SEQ ID NO: 2116839 - RNA, 17 nt, Homo sapiens
ugccuuuggacuugucc

SEQ ID NO: 2116840 - RNA, 14 nt, Homo sapiens
gacucucagcagcu

SEQ ID NO: 2116841 - RNA, 19 nt, Homo sapiens
aggugggguuuucacuucc

SEQ ID NO: 2116842 - RNA, 13 nt, Homo sapiens
aaauaaguuacau

SEQ ID NO: 2116843 - RNA, 16 nt, Homo sapiens
ucugcaagcuuuucaa

SEQ ID NO: 2116844 - RNA, 15 nt, Homo sapiens
uaaauaaauuugcuu

SEQ ID NO: 2116845 - RNA, 21 nt, Homo sapiens
uacaauggcgugaucucagcu

SEQ ID NO: 2116846 - RNA, 23 nt, Homo sapiens
caguacccacucuggagcauuuc

SEQ ID NO: 2116847 - RNA, 15 nt, Homo sapiens
uagcccucacacugu

SEQ ID NO: 2116848 - RNA, 21 nt, Homo sapiens
aaaccugagcagcaacugugu

SEQ ID NO: 2116849 - RNA, 13 nt, Homo sapiens
ccccuaaagccag

SEQ ID NO: 2116850 - RNA, 22 nt, Homo sapiens
uuagagcagcuuugggauccca

SEQ ID NO: 2116851 - RNA, 15 nt, Homo sapiens
aacacucuucuugag

SEQ ID NO: 2116852 - RNA, 13 nt, Homo sapiens
uaaacuaagagaa

SEQ ID NO: 2116853 - RNA, 22 nt, Homo sapiens
agcagaugcuggucauguguuu

SEQ ID NO: 2116854 - RNA, 19 nt, Homo sapiens
uccuucuacuguccuggcu

SEQ ID NO: 2116855 - RNA, 20 nt, Homo sapiens
ccaaguuucauaccaaauau

SEQ ID NO: 2116856 - RNA, 16 nt, Homo sapiens
aucucagcagccagcu

SEQ ID NO: 2116857 - RNA, 19 nt, Homo sapiens
auccaagccuugugucugc

SEQ ID NO: 2116858 - RNA, 15 nt, Homo sapiens
auaaucauacugucu

SEQ ID NO: 2116859 - RNA, 12 nt, Homo sapiens
aagacaccacca

SEQ ID NO: 2116860 - RNA, 22 nt, Homo sapiens
cuuuuguuuugaagcuguugcu

SEQ ID NO: 2116861 - RNA, 21 nt, Homo sapiens
agucauccaaucuaaccacau

SEQ ID NO: 2116862 - RNA, 15 nt, Homo sapiens
aggggcccuaccugg

SEQ ID NO: 2116863 - RNA, 22 nt, Homo sapiens
uccuuacauuaaaaagccuuac

SEQ ID NO: 2116864 - RNA, 15 nt, Homo sapiens
ccaacacccugucua

SEQ ID NO: 2116865 - RNA, 15 nt, Homo sapiens
aucaugugaaaucau

SEQ ID NO: 2116866 - RNA, 18 nt, Homo sapiens
auuaauuugaccaucucu

SEQ ID NO: 2116867 - RNA, 15 nt, Homo sapiens
gcccaucaccucuaa

SEQ ID NO: 2116868 - RNA, 20 nt, Homo sapiens
cuuuugaaaagaggugugca

SEQ ID NO: 2116869 - RNA, 14 nt, Homo sapiens
aaguuaauuuuccc

SEQ ID NO: 2116870 - RNA, 20 nt, Homo sapiens
aagcuuggugcuaaaccaca

SEQ ID NO: 2116871 - RNA, 15 nt, Homo sapiens
agaccugagcuggga

SEQ ID NO: 2116872 - RNA, 21 nt, Homo sapiens
accccaggcaucccaucccuu

SEQ ID NO: 2116873 - RNA, 19 nt, Homo sapiens
guuuuuccuggaauugcca

SEQ ID NO: 2116874 - RNA, 15 nt, Homo sapiens
cuaagucauuccucc

SEQ ID NO: 2116875 - RNA, 18 nt, Homo sapiens
cacaguuggcuggaugaa

SEQ ID NO: 2116876 - RNA, 20 nt, Homo sapiens
caaugggacuggagucagau

SEQ ID NO: 2116877 - RNA, 20 nt, Homo sapiens
uagauccagugcugagcaag

SEQ ID NO: 2116878 - RNA, 13 nt, Homo sapiens
cacauugcuguau

SEQ ID NO: 2116879 - RNA, 15 nt, Homo sapiens
uguacagguguauau

SEQ ID NO: 2116880 - RNA, 23 nt, Homo sapiens
caaagugcugggauuacaggugu

SEQ ID NO: 2116881 - RNA, 13 nt, Homo sapiens
cccucccuucaca

SEQ ID NO: 2116882 - RNA, 20 nt, Homo sapiens
uuuuagaguugcaacuuaag

SEQ ID NO: 2116883 - RNA, 12 nt, Homo sapiens
ucuugacauuca

SEQ ID NO: 2116884 - RNA, 19 nt, Homo sapiens
cuugaaagaaaauaugcau

SEQ ID NO: 2116885 - RNA, 23 nt, Homo sapiens
aguuaauuuuauuccaguaagga

SEQ ID NO: 2116886 - RNA, 14 nt, Homo sapiens
uaaagucaguaacu

SEQ ID NO: 2116887 - RNA, 18 nt, Homo sapiens
ucaaccaacaacaaugug

SEQ ID NO: 2116888 - RNA, 18 nt, Homo sapiens
caacaugcauauuacauu

SEQ ID NO: 2116889 - RNA, 22 nt, Homo sapiens
ugacauaggauccgaagugcaa

SEQ ID NO: 2116890 - RNA, 18 nt, Homo sapiens
aucuuuuaaaauucacac

SEQ ID NO: 2116891 - RNA, 16 nt, Homo sapiens
cuauucaauuuaauuc

SEQ ID NO: 2116892 - RNA, 23 nt, Homo sapiens
ucagaaaaaggaaaccacaguga

SEQ ID NO: 2116893 - RNA, 14 nt, Homo sapiens
ggcggugugugugc

SEQ ID NO: 2116894 - RNA, 14 nt, Homo sapiens
caccuccuagccac

SEQ ID NO: 2116895 - RNA, 15 nt, Homo sapiens
auuaaaaugugcagu

SEQ ID NO: 2116896 - RNA, 20 nt, Homo sapiens
auggacaagcagugucuguc

SEQ ID NO: 2116897 - RNA, 16 nt, Homo sapiens
ugagugaccuccuucu

SEQ ID NO: 2116898 - RNA, 14 nt, Homo sapiens
uauuccuguuucca

SEQ ID NO: 2116899 - RNA, 12 nt, Homo sapiens
gugacaugaagc

SEQ ID NO: 2116900 - RNA, 12 nt, Homo sapiens
uuuuaauuccac

SEQ ID NO: 2116901 - RNA, 20 nt, Homo sapiens
gucuuggggacuaacccaau

SEQ ID NO: 2116902 - RNA, 23 nt, Homo sapiens
uuuggugcuggaaccagcucucu

SEQ ID NO: 2116903 - RNA, 17 nt, Homo sapiens
cuuccucagcaggccaa

SEQ ID NO: 2116904 - RNA, 18 nt, Homo sapiens
ccugccucauccaccaau

SEQ ID NO: 2116905 - RNA, 22 nt, Homo sapiens
cagcaauucuccugccucagcc

SEQ ID NO: 2116906 - RNA, 21 nt, Homo sapiens
aaucaugugggugagccagug

SEQ ID NO: 2116907 - RNA, 18 nt, Homo sapiens
auugaaugcauacucugu

SEQ ID NO: 2116908 - RNA, 19 nt, Homo sapiens
ucacuacuuaaagugcuau

SEQ ID NO: 2116909 - RNA, 22 nt, Homo sapiens
caggcuguaagcauucugagcu

SEQ ID NO: 2116910 - RNA, 12 nt, Homo sapiens
uugccacugugu

SEQ ID NO: 2116911 - RNA, 23 nt, Homo sapiens
aauccuaguuuaugcacaugagu

SEQ ID NO: 2116912 - RNA, 19 nt, Homo sapiens
gcugauaccauaugaauga

SEQ ID NO: 2116913 - RNA, 22 nt, Homo sapiens
ugagauauaucuuuauacuuaa

SEQ ID NO: 2116914 - RNA, 22 nt, Homo sapiens
uggacuuuuauuuccagugaaa

SEQ ID NO: 2116915 - RNA, 20 nt, Homo sapiens
aacuguauacauuacaauca

SEQ ID NO: 2116916 - RNA, 23 nt, Homo sapiens
aaacaucuuaguugaugcuacaa

SEQ ID NO: 2116917 - RNA, 14 nt, Homo sapiens
aauuaagugcaauu

SEQ ID NO: 2116918 - RNA, 15 nt, Homo sapiens
uuuuuggaaagucag

SEQ ID NO: 2116919 - RNA, 17 nt, Homo sapiens
guacuuauuacugcuaa

SEQ ID NO: 2116920 - RNA, 13 nt, Homo sapiens
uaccacacauauu

SEQ ID NO: 2116921 - RNA, 15 nt, Homo sapiens
gccuaaaaguuacuu

SEQ ID NO: 2116922 - RNA, 16 nt, Homo sapiens
gcaucuuuaacacagc

SEQ ID NO: 2116923 - RNA, 23 nt, Homo sapiens
aacauggucacccccacucugca

SEQ ID NO: 2116924 - RNA, 15 nt, Homo sapiens
aagaaauaaugccuc

SEQ ID NO: 2116925 - RNA, 23 nt, Homo sapiens
acagccuggccccugugcaccga

SEQ ID NO: 2116926 - RNA, 18 nt, Homo sapiens
cuguaacacagaauauag

SEQ ID NO: 2116927 - RNA, 12 nt, Homo sapiens
aagcacaugugu

SEQ ID NO: 2116928 - RNA, 12 nt, Homo sapiens
aaauacauguac

SEQ ID NO: 2116929 - RNA, 12 nt, Homo sapiens
cuuuacucuggg

SEQ ID NO: 2116930 - RNA, 18 nt, Homo sapiens
aaauguaaaagcacauga

SEQ ID NO: 2116931 - RNA, 14 nt, Homo sapiens
caacccugccccug

SEQ ID NO: 2116932 - RNA, 13 nt, Homo sapiens
gucugucaucugc

SEQ ID NO: 2116933 - RNA, 22 nt, Homo sapiens
guuaacuagugucaucuauuua

SEQ ID NO: 2116934 - RNA, 21 nt, Homo sapiens
caaccuagaaacacacauuuc

SEQ ID NO: 2116935 - RNA, 18 nt, Homo sapiens
gggugccgcgagccaggc

SEQ ID NO: 2116936 - RNA, 20 nt, Homo sapiens
aggcagggucucacucuguc

SEQ ID NO: 2116937 - RNA, 14 nt, Homo sapiens
agggcccugcucag

SEQ ID NO: 2116938 - RNA, 13 nt, Homo sapiens
auguggucuuaug

SEQ ID NO: 2116939 - RNA, 21 nt, Homo sapiens
ucacacagccaagccagucaa

SEQ ID NO: 2116940 - RNA, 20 nt, Homo sapiens
gaccccaggucagcaucucg

SEQ ID NO: 2116941 - RNA, 14 nt, Homo sapiens
cuggcaacacagag

SEQ ID NO: 2116942 - RNA, 20 nt, Homo sapiens
ccucagcguccugggcucaa

SEQ ID NO: 2116943 - RNA, 13 nt, Homo sapiens
cugaagaugucaa

SEQ ID NO: 2116944 - RNA, 21 nt, Homo sapiens
agucagcuuuacuagugccaa

SEQ ID NO: 2116945 - RNA, 21 nt, Homo sapiens
gauucagcacuuugcucuuuu

SEQ ID NO: 2116946 - RNA, 13 nt, Homo sapiens
acuucaagugacc

SEQ ID NO: 2116947 - RNA, 16 nt, Homo sapiens
aguuuaucaguaaaua

SEQ ID NO: 2116948 - RNA, 15 nt, Homo sapiens
ccaaugcucuuuuca

SEQ ID NO: 2116949 - RNA, 18 nt, Homo sapiens
auuugauucuaugacuga

SEQ ID NO: 2116950 - RNA, 15 nt, Homo sapiens
uguauagaccuaaaa

SEQ ID NO: 2116951 - RNA, 13 nt, Homo sapiens
ugacagcuuuauc

SEQ ID NO: 2116952 - RNA, 22 nt, Homo sapiens
gccaaaauagagaguauacagu

SEQ ID NO: 2116953 - RNA, 20 nt, Homo sapiens
caggacugaucgauuugcac

SEQ ID NO: 2116954 - RNA, 21 nt, Homo sapiens
aaaaggggcuccuugcuccac

SEQ ID NO: 2116955 - RNA, 22 nt, Homo sapiens
cugggagcccggcaacucuagu

SEQ ID NO: 2116956 - RNA, 22 nt, Homo sapiens
gauuaaugaaucguaaugaagu

SEQ ID NO: 2116957 - RNA, 19 nt, Homo sapiens
uggagucucucucucucca

SEQ ID NO: 2116958 - RNA, 20 nt, Homo sapiens
acuacuagggaaaugccuuu

SEQ ID NO: 2116959 - RNA, 20 nt, Homo sapiens
gcucauuucacuauucuguu

SEQ ID NO: 2116960 - RNA, 22 nt, Homo sapiens
aaauauaugucuauauacacag

SEQ ID NO: 2116961 - RNA, 21 nt, Homo sapiens
cggggacgcccccaccagcuc

SEQ ID NO: 2116962 - RNA, 23 nt, Homo sapiens
cuggaacacaaccauagccuguu

SEQ ID NO: 2116963 - RNA, 17 nt, Homo sapiens
caucugucccacuggga

SEQ ID NO: 2116964 - RNA, 19 nt, Homo sapiens
uuaaauaaaucauuaauac

SEQ ID NO: 2116965 - RNA, 11 nt, Homo sapiens
ugcggacauca

SEQ ID NO: 2116966 - RNA, 21 nt, Homo sapiens
acagcuaguagacaugaauuu

SEQ ID NO: 2116967 - RNA, 21 nt, Homo sapiens
uuaccaaagcaagguacaggu

SEQ ID NO: 2116968 - RNA, 16 nt, Homo sapiens
gccuccaaugcauugg

SEQ ID NO: 2116969 - RNA, 23 nt, Homo sapiens
gggagagagagcuagagggacaa

SEQ ID NO: 2116970 - RNA, 14 nt, Homo sapiens
aacuagcaccaggg

SEQ ID NO: 2116971 - RNA, 20 nt, Homo sapiens
uacuuaucuauauccauaac

SEQ ID NO: 2116972 - RNA, 14 nt, Homo sapiens
cuaccuugccccaa

SEQ ID NO: 2116973 - RNA, 17 nt, Homo sapiens
cgucaaagcaguaguca

SEQ ID NO: 2116974 - RNA, 12 nt, Homo sapiens
gcucagugcaaa

SEQ ID NO: 2116975 - RNA, 15 nt, Homo sapiens
guauaugcaugcuga

SEQ ID NO: 2116976 - RNA, 16 nt, Homo sapiens
aaacuucucacccgcu

SEQ ID NO: 2116977 - RNA, 20 nt, Homo sapiens
auauaaaucguaaccuauga

SEQ ID NO: 2116978 - RNA, 15 nt, Homo sapiens
uacucugugccuuua

SEQ ID NO: 2116979 - RNA, 13 nt, Homo sapiens
ugauggugcugac

SEQ ID NO: 2116980 - RNA, 15 nt, Homo sapiens
ugcagagugcaacaa

SEQ ID NO: 2116981 - RNA, 17 nt, Homo sapiens
acuacacacaccagaug

SEQ ID NO: 2116982 - RNA, 21 nt, Homo sapiens
acacaccuggguggacacaag

SEQ ID NO: 2116983 - RNA, 17 nt, Homo sapiens
uagcaugauguauuuaa

SEQ ID NO: 2116984 - RNA, 13 nt, Homo sapiens
uccuucuuccuag

SEQ ID NO: 2116985 - RNA, 13 nt, Homo sapiens
cccugcuuucuau

SEQ ID NO: 2116986 - RNA, 12 nt, Homo sapiens
cucuugagaaau

SEQ ID NO: 2116987 - RNA, 14 nt, Homo sapiens
gucucugcucuuuc

SEQ ID NO: 2116988 - RNA, 19 nt, Homo sapiens
auucaagucaccuccuuaa

SEQ ID NO: 2116989 - RNA, 19 nt, Homo sapiens
acauguccuacaacagccu

SEQ ID NO: 2116990 - RNA, 17 nt, Homo sapiens
caauuuauaauuacaau

SEQ ID NO: 2116991 - RNA, 17 nt, Homo sapiens
gcugggauuacaggugc

SEQ ID NO: 2116992 - RNA, 19 nt, Homo sapiens
cucuuaguuuuuaaaaagg

SEQ ID NO: 2116993 - RNA, 16 nt, Homo sapiens
aauaaaugacaaugua

SEQ ID NO: 2116994 - RNA, 17 nt, Homo sapiens
ccugcccuucucaagac

SEQ ID NO: 2116995 - RNA, 19 nt, Homo sapiens
uuccuaauaugcuuuacaa

SEQ ID NO: 2116996 - RNA, 17 nt, Homo sapiens
cugcucuauacuguggc

SEQ ID NO: 2116997 - RNA, 16 nt, Homo sapiens
ugccaacccuguguca

SEQ ID NO: 2116998 - RNA, 13 nt, Homo sapiens
cugcugcugagaa

SEQ ID NO: 2116999 - RNA, 18 nt, Homo sapiens
cuguuuuuuuugcugcua

SEQ ID NO: 2117000 - RNA, 16 nt, Homo sapiens
aaguuaacuacagugu

SEQ ID NO: 2117001 - RNA, 15 nt, Homo sapiens
acuucaaagugccug

SEQ ID NO: 2117002 - RNA, 16 nt, Homo sapiens
gggccucgggaccuca

SEQ ID NO: 2117003 - RNA, 16 nt, Homo sapiens
caaaaaaacagaaaag

SEQ ID NO: 2117004 - RNA, 18 nt, Homo sapiens
cgauccuuguagacgcac

SEQ ID NO: 2117005 - RNA, 23 nt, Homo sapiens
caaggguuuuccagguguagcua

SEQ ID NO: 2117006 - RNA, 14 nt, Homo sapiens
uugguccuuuacac

SEQ ID NO: 2117007 - RNA, 15 nt, Homo sapiens
ugcugggcuuggcag

SEQ ID NO: 2117008 - RNA, 19 nt, Homo sapiens
cuccauccaauucuuugaa

SEQ ID NO: 2117009 - RNA, 21 nt, Homo sapiens
uggagcccagcauucaggggu

SEQ ID NO: 2117010 - RNA, 15 nt, Homo sapiens
guucuauuuguauau

SEQ ID NO: 2117011 - RNA, 18 nt, Homo sapiens
cuugcacaacauccucag

SEQ ID NO: 2117012 - RNA, 18 nt, Homo sapiens
uuuguaaaauaaaaccac

SEQ ID NO: 2117013 - RNA, 16 nt, Homo sapiens
uaccuguucuucuauc

SEQ ID NO: 2117014 - RNA, 20 nt, Homo sapiens
uaucucacaaauaaguaaua

SEQ ID NO: 2117015 - RNA, 17 nt, Homo sapiens
uuaguugcuaguuuagu

SEQ ID NO: 2117016 - RNA, 15 nt, Homo sapiens
gaacaaaaaugacag

SEQ ID NO: 2117017 - RNA, 19 nt, Homo sapiens
aggggccuaggccucagcc

SEQ ID NO: 2117018 - RNA, 19 nt, Homo sapiens
auuuucuuggcaguauucc

SEQ ID NO: 2117019 - RNA, 15 nt, Homo sapiens
cacacugucuguaua

SEQ ID NO: 2117020 - RNA, 21 nt, Homo sapiens
uacaaagugaucuuguucaca

SEQ ID NO: 2117021 - RNA, 21 nt, Homo sapiens
auucucuccauuucacuggcu

SEQ ID NO: 2117022 - RNA, 21 nt, Homo sapiens
augcccuccacuccacugccu

SEQ ID NO: 2117023 - RNA, 21 nt, Homo sapiens
uguagggcacccaaaacucaa

SEQ ID NO: 2117024 - RNA, 21 nt, Homo sapiens
ugaggucaggaguucaagacc

SEQ ID NO: 2117025 - RNA, 23 nt, Homo sapiens
uagagacaggacagaauguguuc

SEQ ID NO: 2117026 - RNA, 12 nt, Homo sapiens
uucuuucugucu

SEQ ID NO: 2117027 - RNA, 23 nt, Homo sapiens
gggccuucacagugaccaucgca

SEQ ID NO: 2117028 - RNA, 19 nt, Homo sapiens
ccccaguggacaccaauga

SEQ ID NO: 2117029 - RNA, 21 nt, Homo sapiens
gccaauuucucucagauuucc

SEQ ID NO: 2117030 - RNA, 18 nt, Homo sapiens
auguuacuuaaacaucau

SEQ ID NO: 2117031 - RNA, 20 nt, Homo sapiens
gaaacgcaagcagacuggau

SEQ ID NO: 2117032 - RNA, 15 nt, Homo sapiens
uacaguggaucucaa

SEQ ID NO: 2117033 - RNA, 19 nt, Homo sapiens
aagagaucuuucuuuccaa

SEQ ID NO: 2117034 - RNA, 12 nt, Homo sapiens
aaaaaacacaua

SEQ ID NO: 2117035 - RNA, 18 nt, Homo sapiens
agcuggguaccaggccac

SEQ ID NO: 2117036 - RNA, 22 nt, Homo sapiens
gaggccgagucuguccuggaac

SEQ ID NO: 2117037 - RNA, 17 nt, Homo sapiens
aauucauaaccaaagag

SEQ ID NO: 2117038 - RNA, 22 nt, Homo sapiens
guaaauuaguguaccuauuaaa

SEQ ID NO: 2117039 - RNA, 15 nt, Homo sapiens
guauagaccaaagca

SEQ ID NO: 2117040 - RNA, 20 nt, Homo sapiens
aaggucuugccugaauccau

SEQ ID NO: 2117041 - RNA, 16 nt, Homo sapiens
gcccugcccauacuga

SEQ ID NO: 2117042 - RNA, 11 nt, Homo sapiens
agcauggaaaa

SEQ ID NO: 2117043 - RNA, 15 nt, Homo sapiens
caaccuugugugagu

SEQ ID NO: 2117044 - RNA, 22 nt, Homo sapiens
caaaaacauucuuacauuuuac

SEQ ID NO: 2117045 - RNA, 21 nt, Homo sapiens
uuggaacaguguuuacuuuaa

SEQ ID NO: 2117046 - RNA, 17 nt, Homo sapiens
caagcaacagacucuca

SEQ ID NO: 2117047 - RNA, 13 nt, Homo sapiens
aggccgcuaugca

SEQ ID NO: 2117048 - RNA, 15 nt, Homo sapiens
cacagcccaggccac

SEQ ID NO: 2117049 - RNA, 17 nt, Homo sapiens
ugguugaguucagguag

SEQ ID NO: 2117050 - RNA, 18 nt, Homo sapiens
gcucccagcgcacacaaa

SEQ ID NO: 2117051 - RNA, 19 nt, Homo sapiens
gccaucaugugccuggaaa

SEQ ID NO: 2117052 - RNA, 14 nt, Homo sapiens
aaaaaacucuugau

SEQ ID NO: 2117053 - RNA, 18 nt, Homo sapiens
aaagugacccugcucuca

SEQ ID NO: 2117054 - RNA, 18 nt, Homo sapiens
augugugguacuuugcag

SEQ ID NO: 2117055 - RNA, 15 nt, Homo sapiens
cgggcagucugcucu

SEQ ID NO: 2117056 - RNA, 21 nt, Homo sapiens
cccagggccuccugggggacc

SEQ ID NO: 2117057 - RNA, 17 nt, Homo sapiens
cucuggcaccaucagcc

SEQ ID NO: 2117058 - RNA, 17 nt, Homo sapiens
uguucagugucccgggc

SEQ ID NO: 2117059 - RNA, 17 nt, Homo sapiens
cuuuacaguggcaaaaa

SEQ ID NO: 2117060 - RNA, 20 nt, Homo sapiens
acagaauguuuuacugugaa

SEQ ID NO: 2117061 - RNA, 22 nt, Homo sapiens
cccacauuugggcucaggguug

SEQ ID NO: 2117062 - RNA, 23 nt, Homo sapiens
auucugcaguaaaucuuuuacaa

SEQ ID NO: 2117063 - RNA, 15 nt, Homo sapiens
uauuaguuaaucucc

SEQ ID NO: 2117064 - RNA, 10 nt, Homo sapiens
auauacaaau

SEQ ID NO: 2117065 - RNA, 21 nt, Homo sapiens
ugaauacugcauuuacagugu

SEQ ID NO: 2117066 - RNA, 17 nt, Homo sapiens
aagaagauucauuuaag

SEQ ID NO: 2117067 - RNA, 14 nt, Homo sapiens
cuugaaucaaagaa

SEQ ID NO: 2117068 - RNA, 20 nt, Homo sapiens
aauucauguauuaugauuaa

SEQ ID NO: 2117069 - RNA, 14 nt, Homo sapiens
caaccaauggcaga

SEQ ID NO: 2117070 - RNA, 22 nt, Homo sapiens
auuuguuaggccauucuugcau

SEQ ID NO: 2117071 - RNA, 19 nt, Homo sapiens
uggaaaaggaagacuagag

SEQ ID NO: 2117072 - RNA, 22 nt, Homo sapiens
uaaauuaagagcauaaacaaua

SEQ ID NO: 2117073 - RNA, 17 nt, Homo sapiens
aggaauuccucuaugaa

SEQ ID NO: 2117074 - RNA, 15 nt, Homo sapiens
aauuaaaacagcugc

SEQ ID NO: 2117075 - RNA, 14 nt, Homo sapiens
ccuggcaucaguuu

SEQ ID NO: 2117076 - RNA, 16 nt, Homo sapiens
uacaaguuucuagcuc

SEQ ID NO: 2117077 - RNA, 19 nt, Homo sapiens
ugaacacaaguuccugaua

SEQ ID NO: 2117078 - RNA, 16 nt, Homo sapiens
ggucaaggcaccagca

SEQ ID NO: 2117079 - RNA, 19 nt, Homo sapiens
aacccauauacucuucgau

SEQ ID NO: 2117080 - RNA, 18 nt, Homo sapiens
acuuccacaagagugaau

SEQ ID NO: 2117081 - RNA, 18 nt, Homo sapiens
aacacuacagacaauaaa

SEQ ID NO: 2117082 - RNA, 20 nt, Homo sapiens
ccacguugccucuacuuuau

SEQ ID NO: 2117083 - RNA, 15 nt, Homo sapiens
gugcauggaggcccu

SEQ ID NO: 2117084 - RNA, 15 nt, Homo sapiens
ucaagcuauucucau

SEQ ID NO: 2117085 - RNA, 18 nt, Homo sapiens
aaugcugaugaaaacugu

SEQ ID NO: 2117086 - RNA, 14 nt, Homo sapiens
cuaacuguaugugu

SEQ ID NO: 2117087 - RNA, 24 nt, Homo sapiens
ggugagaacgugcccagccacauc

SEQ ID NO: 2117088 - RNA, 19 nt, Homo sapiens
ucuuucuuugcaccaaaga

SEQ ID NO: 2117089 - RNA, 20 nt, Homo sapiens
cccugucagcauguuuccag

SEQ ID NO: 2117090 - RNA, 23 nt, Homo sapiens
cuugcagauuuucuuaaggaauu

SEQ ID NO: 2117091 - RNA, 16 nt, Homo sapiens
cccccuguucuaaggg

SEQ ID NO: 2117092 - RNA, 21 nt, Homo sapiens
gagucauauugaggcauucaa

SEQ ID NO: 2117093 - RNA, 13 nt, Homo sapiens
gcaggggaagccu

SEQ ID NO: 2117094 - RNA, 23 nt, Homo sapiens
gccuucuccagacaaaccagaag

SEQ ID NO: 2117095 - RNA, 15 nt, Homo sapiens
uugaaugcagggaca

SEQ ID NO: 2117096 - RNA, 13 nt, Homo sapiens
aaaucagugcagu

SEQ ID NO: 2117097 - RNA, 14 nt, Homo sapiens
cuguuuuuaaucca

SEQ ID NO: 2117098 - RNA, 23 nt, Homo sapiens
ucuguaucccuacaucuaacuca

SEQ ID NO: 2117099 - RNA, 23 nt, Homo sapiens
uaaaggacuauuuauaacuaaua

SEQ ID NO: 2117100 - RNA, 15 nt, Homo sapiens
uguacucaaguacca

SEQ ID NO: 2117101 - RNA, 15 nt, Homo sapiens
ucuucuaaacuuccc

SEQ ID NO: 2117102 - RNA, 13 nt, Homo sapiens
gcacaagugucug

SEQ ID NO: 2117103 - RNA, 14 nt, Homo sapiens
aaaacuuaacauuc

SEQ ID NO: 2117104 - RNA, 19 nt, Homo sapiens
uggacccuggaccauucca

SEQ ID NO: 2117105 - RNA, 19 nt, Homo sapiens
gcuaguguaccuccucuca

SEQ ID NO: 2117106 - RNA, 19 nt, Homo sapiens
gagcauguuugccuagaca

SEQ ID NO: 2117107 - RNA, 21 nt, Homo sapiens
uguccccccuugaagcaauaa

SEQ ID NO: 2117108 - RNA, 14 nt, Homo sapiens
cauguauacuucaa

SEQ ID NO: 2117109 - RNA, 24 nt, Homo sapiens
ggccagagccaagaaacacuuuca

SEQ ID NO: 2117110 - RNA, 19 nt, Homo sapiens
aaucuuucuuuaccugaga

SEQ ID NO: 2117111 - RNA, 20 nt, Homo sapiens
aucauauaucaaacuaggca

SEQ ID NO: 2117112 - RNA, 16 nt, Homo sapiens
agcugcuggaugacuu

SEQ ID NO: 2117113 - RNA, 23 nt, Homo sapiens
uggcuuuuuauuaggcucaguga

SEQ ID NO: 2117114 - RNA, 19 nt, Homo sapiens
cugcuuucccugagccccu

SEQ ID NO: 2117115 - RNA, 16 nt, Homo sapiens
uguaauuucgccuuaa

SEQ ID NO: 2117116 - RNA, 17 nt, Homo sapiens
caggauuuaaguuucac

SEQ ID NO: 2117117 - RNA, 14 nt, Homo sapiens
aucaagcaguuucu

SEQ ID NO: 2117118 - RNA, 22 nt, Homo sapiens
gccccagagaggggacauuucc

SEQ ID NO: 2117119 - RNA, 15 nt, Homo sapiens
ugguuuuacuucuga

SEQ ID NO: 2117120 - RNA, 21 nt, Homo sapiens
auuagaaaaguuaacauuuau

SEQ ID NO: 2117121 - RNA, 23 nt, Homo sapiens
cuucagaagacacugcaaaggcg

SEQ ID NO: 2117122 - RNA, 14 nt, Homo sapiens
ugucacaucaagca

SEQ ID NO: 2117123 - RNA, 19 nt, Homo sapiens
uuaaaaaaaaauacugaug

SEQ ID NO: 2117124 - RNA, 12 nt, Homo sapiens
cgcaacauuucu

SEQ ID NO: 2117125 - RNA, 20 nt, Homo sapiens
augaauauuuuguaacuauu

SEQ ID NO: 2117126 - RNA, 16 nt, Homo sapiens
agcuuauuaaaacuca

SEQ ID NO: 2117127 - RNA, 20 nt, Homo sapiens
ccuaucugaccaaacuggau

SEQ ID NO: 2117128 - RNA, 20 nt, Homo sapiens
augcuuuuacuaagcacugu

SEQ ID NO: 2117129 - RNA, 21 nt, Homo sapiens
agugcuguauaaaaucagcca

SEQ ID NO: 2117130 - RNA, 19 nt, Homo sapiens
uuaauauacugcauauccu

SEQ ID NO: 2117131 - RNA, 19 nt, Homo sapiens
guugaauucuuuugccaag

SEQ ID NO: 2117132 - RNA, 14 nt, Homo sapiens
uuacauauuugacu

SEQ ID NO: 2117133 - RNA, 21 nt, Homo sapiens
ucccaggucacacugauucau

SEQ ID NO: 2117134 - RNA, 13 nt, Homo sapiens
uuguuucacucca

SEQ ID NO: 2117135 - RNA, 13 nt, Homo sapiens
guugggaugccag

SEQ ID NO: 2117136 - RNA, 12 nt, Homo sapiens
aagaccaaagca

SEQ ID NO: 2117137 - RNA, 15 nt, Homo sapiens
uaucgccuuuugaca

SEQ ID NO: 2117138 - RNA, 19 nt, Homo sapiens
aaauaaacacauagauuca

SEQ ID NO: 2117139 - RNA, 16 nt, Homo sapiens
agugcaccaucucacu

SEQ ID NO: 2117140 - RNA, 18 nt, Homo sapiens
ccuaguucaaaacaacca

SEQ ID NO: 2117141 - RNA, 16 nt, Homo sapiens
ccucaugcuguuccac

SEQ ID NO: 2117142 - RNA, 16 nt, Homo sapiens
gguuagagccaagcug

SEQ ID NO: 2117143 - RNA, 18 nt, Homo sapiens
ccagguaauggcaugaga

SEQ ID NO: 2117144 - RNA, 22 nt, Homo sapiens
guuacaaauucaaggagauaua

SEQ ID NO: 2117145 - RNA, 15 nt, Homo sapiens
ucaccccacuuccau

SEQ ID NO: 2117146 - RNA, 22 nt, Homo sapiens
cuggaggacggccggcucucua

SEQ ID NO: 2117147 - RNA, 20 nt, Homo sapiens
cacagccuuggaucaggaca

SEQ ID NO: 2117148 - RNA, 16 nt, Homo sapiens
gauggcaccacugcac

SEQ ID NO: 2117149 - RNA, 14 nt, Homo sapiens
cccaggcugucacc

SEQ ID NO: 2117150 - RNA, 18 nt, Homo sapiens
ccacuuucaacguguagu

SEQ ID NO: 2117151 - RNA, 17 nt, Homo sapiens
ccuugguaucauuuucu

SEQ ID NO: 2117152 - RNA, 23 nt, Homo sapiens
gaucacuugaggccaggacuuug

SEQ ID NO: 2117153 - RNA, 19 nt, Homo sapiens
aaaaucagagaacuuuccc

SEQ ID NO: 2117154 - RNA, 16 nt, Homo sapiens
auucuuggaccaugcc

SEQ ID NO: 2117155 - RNA, 19 nt, Homo sapiens
aaugugucuuucuuuuugg

SEQ ID NO: 2117156 - RNA, 18 nt, Homo sapiens
ugcuccguggacugcagu

SEQ ID NO: 2117157 - RNA, 23 nt, Homo sapiens
uuaagcacaaccauguucuugag

SEQ ID NO: 2117158 - RNA, 20 nt, Homo sapiens
ugcuacuuuguauccucuga

SEQ ID NO: 2117159 - RNA, 13 nt, Homo sapiens
gauuguacuuugu

SEQ ID NO: 2117160 - RNA, 19 nt, Homo sapiens
cccaggccaacaguagcca

SEQ ID NO: 2117161 - RNA, 18 nt, Homo sapiens
cauuuuaugauagauuug

SEQ ID NO: 2117162 - RNA, 15 nt, Homo sapiens
aaguggaacugcccu

SEQ ID NO: 2117163 - RNA, 19 nt, Homo sapiens
cuuuaugaucuggcccuug

SEQ ID NO: 2117164 - RNA, 14 nt, Homo sapiens
ggccuguucacgug

SEQ ID NO: 2117165 - RNA, 23 nt, Homo sapiens
gacuuggacaggagucagugucu

SEQ ID NO: 2117166 - RNA, 20 nt, Homo sapiens
gugccucagccguucuugac

SEQ ID NO: 2117167 - RNA, 18 nt, Homo sapiens
auuguauuuaagacauaa

SEQ ID NO: 2117168 - RNA, 16 nt, Homo sapiens
aguuaauuuaauuugc

SEQ ID NO: 2117169 - RNA, 20 nt, Homo sapiens
uuaaagcaucuauaaggugc

SEQ ID NO: 2117170 - RNA, 19 nt, Homo sapiens
uccugccugcggaccagau

SEQ ID NO: 2117171 - RNA, 14 nt, Homo sapiens
ugauucgaaugaca

SEQ ID NO: 2117172 - RNA, 23 nt, Homo sapiens
aaccucagguacggagaagaaua

SEQ ID NO: 2117173 - RNA, 14 nt, Homo sapiens
uuucaggguuuuaa

SEQ ID NO: 2117174 - RNA, 15 nt, Homo sapiens
ugggguugggggaca

SEQ ID NO: 2117175 - RNA, 21 nt, Homo sapiens
ccacaacuauauuaucaugca

SEQ ID NO: 2117176 - RNA, 18 nt, Homo sapiens
caccucaggaccauguga

SEQ ID NO: 2117177 - RNA, 16 nt, Homo sapiens
auuuggacugcauuua

SEQ ID NO: 2117178 - RNA, 16 nt, Homo sapiens
ugggaauugugugaug

SEQ ID NO: 2117179 - RNA, 17 nt, Homo sapiens
cagacauaaagccaugu

SEQ ID NO: 2117180 - RNA, 18 nt, Homo sapiens
auaaacaugcuugcauua

SEQ ID NO: 2117181 - RNA, 15 nt, Homo sapiens
ugcgaggacaucaaa

SEQ ID NO: 2117182 - RNA, 23 nt, Homo sapiens
uaaagcuuuuauucguccuuuga

SEQ ID NO: 2117183 - RNA, 20 nt, Homo sapiens
uagagucggccaccacagau

SEQ ID NO: 2117184 - RNA, 15 nt, Homo sapiens
acugugaagcauuua

SEQ ID NO: 2117185 - RNA, 16 nt, Homo sapiens
gaugggcugaggccag

SEQ ID NO: 2117186 - RNA, 14 nt, Homo sapiens
ccugcaccugugca

SEQ ID NO: 2117187 - RNA, 18 nt, Homo sapiens
cuuggaugucacugccug

SEQ ID NO: 2117188 - RNA, 13 nt, Homo sapiens
cuucugaccacac

SEQ ID NO: 2117189 - RNA, 18 nt, Homo sapiens
ccacucaggggucauuca

SEQ ID NO: 2117190 - RNA, 16 nt, Homo sapiens
uauacugcuuggagcu

SEQ ID NO: 2117191 - RNA, 14 nt, Homo sapiens
uuuaaaauugugau

SEQ ID NO: 2117192 - RNA, 19 nt, Homo sapiens
gucuaaacuuuagaauuaa

SEQ ID NO: 2117193 - RNA, 11 nt, Homo sapiens
auaaauaucaa

SEQ ID NO: 2117194 - RNA, 11 nt, Homo sapiens
augaauaucag

SEQ ID NO: 2117195 - RNA, 13 nt, Homo sapiens
cuucacuugcacu

SEQ ID NO: 2117196 - RNA, 15 nt, Homo sapiens
auaaugaucagcaaa

SEQ ID NO: 2117197 - RNA, 18 nt, Homo sapiens
caugggaagcauguggau

SEQ ID NO: 2117198 - RNA, 17 nt, Homo sapiens
ucacuuuaaagcccuuu

SEQ ID NO: 2117199 - RNA, 23 nt, Homo sapiens
uugacaggccauccauucacagc

SEQ ID NO: 2117200 - RNA, 23 nt, Homo sapiens
gugggugggagugugucugcuga

SEQ ID NO: 2117201 - RNA, 18 nt, Homo sapiens
uguacauuuuagugauuu

SEQ ID NO: 2117202 - RNA, 20 nt, Homo sapiens
caguucauuauuuugugguu

SEQ ID NO: 2117203 - RNA, 22 nt, Homo sapiens
cuuuccugguucugucuagacu

SEQ ID NO: 2117204 - RNA, 15 nt, Homo sapiens
cauuauauugcaaug

SEQ ID NO: 2117205 - RNA, 11 nt, Homo sapiens
ugacuggugcu

SEQ ID NO: 2117206 - RNA, 15 nt, Homo sapiens
aagauaagcuuccag

SEQ ID NO: 2117207 - RNA, 20 nt, Homo sapiens
gcucagcccugcaccaugcu

SEQ ID NO: 2117208 - RNA, 15 nt, Homo sapiens
ucguuugaaucacag

SEQ ID NO: 2117209 - RNA, 19 nt, Homo sapiens
cuguguacacaugggaguu

SEQ ID NO: 2117210 - RNA, 21 nt, Homo sapiens
ggaagaggaacagcacugggg

SEQ ID NO: 2117211 - RNA, 14 nt, Homo sapiens
guuccaugucugaa

SEQ ID NO: 2117212 - RNA, 19 nt, Homo sapiens
aggcaggaggaucauuuga

SEQ ID NO: 2117213 - RNA, 22 nt, Homo sapiens
acagaaccaauuuacacucaac

SEQ ID NO: 2117214 - RNA, 16 nt, Homo sapiens
aaugucaguaaugcaa

SEQ ID NO: 2117215 - RNA, 13 nt, Homo sapiens
cagggaaggugag

SEQ ID NO: 2117216 - RNA, 20 nt, Homo sapiens
cacagcuccugccaggguga

SEQ ID NO: 2117217 - RNA, 20 nt, Homo sapiens
agugccuucugcccucccug

SEQ ID NO: 2117218 - RNA, 17 nt, Homo sapiens
acacagggugcauguga

SEQ ID NO: 2117219 - RNA, 14 nt, Homo sapiens
cugacaagcacugc

SEQ ID NO: 2117220 - RNA, 18 nt, Homo sapiens
auacaguucuaugcagaa

SEQ ID NO: 2117221 - RNA, 14 nt, Homo sapiens
uuagaaagcuaaau

SEQ ID NO: 2117222 - RNA, 13 nt, Homo sapiens
uuaauagacauuu

SEQ ID NO: 2117223 - RNA, 20 nt, Homo sapiens
agcaguguccugugcuuucu

SEQ ID NO: 2117224 - RNA, 15 nt, Homo sapiens
cucuauaaguguuca

SEQ ID NO: 2117225 - RNA, 21 nt, Homo sapiens
gcugaagugguugcauucuac

SEQ ID NO: 2117226 - RNA, 15 nt, Homo sapiens
caaggucuguaauug

SEQ ID NO: 2117227 - RNA, 16 nt, Homo sapiens
caaaggaaaccaaagg

SEQ ID NO: 2117228 - RNA, 18 nt, Homo sapiens
ggcccggagcagcaggaa

SEQ ID NO: 2117229 - RNA, 13 nt, Homo sapiens
cccccuguccuga

SEQ ID NO: 2117230 - RNA, 16 nt, Homo sapiens
uguacacacacagaca

SEQ ID NO: 2117231 - RNA, 19 nt, Homo sapiens
gaaugcagcacugcugccu

SEQ ID NO: 2117232 - RNA, 14 nt, Homo sapiens
agagagauguuccu

SEQ ID NO: 2117233 - RNA, 18 nt, Homo sapiens
cucaauaaaggucauauu

SEQ ID NO: 2117234 - RNA, 21 nt, Homo sapiens
aaugauaagcaggaaggaugg

SEQ ID NO: 2117235 - RNA, 19 nt, Homo sapiens
cucuaugccagcucagucc

SEQ ID NO: 2117236 - RNA, 14 nt, Homo sapiens
auuucuuaccaugc

SEQ ID NO: 2117237 - RNA, 23 nt, Homo sapiens
aagcccuggagccaacugcugcu

SEQ ID NO: 2117238 - RNA, 12 nt, Homo sapiens
cagacaacagaa

SEQ ID NO: 2117239 - RNA, 18 nt, Homo sapiens
uguauuaaacucuucaca

SEQ ID NO: 2117240 - RNA, 18 nt, Homo sapiens
ugccggcccccaggacaa

SEQ ID NO: 2117241 - RNA, 12 nt, Homo sapiens
cccauacagggc

SEQ ID NO: 2117242 - RNA, 16 nt, Homo sapiens
cuuagaaucccugugu

SEQ ID NO: 2117243 - RNA, 15 nt, Homo sapiens
guuuaauugugauau

SEQ ID NO: 2117244 - RNA, 18 nt, Homo sapiens
agggccaaagaaccaaag

SEQ ID NO: 2117245 - RNA, 18 nt, Homo sapiens
agaagccugggggccugg

SEQ ID NO: 2117246 - RNA, 22 nt, Homo sapiens
ugugcuuuuugggaccaucacu

SEQ ID NO: 2117247 - RNA, 17 nt, Homo sapiens
aguccaaaauacuguuc

SEQ ID NO: 2117248 - RNA, 20 nt, Homo sapiens
uggaugggggaaauggugcc

SEQ ID NO: 2117249 - RNA, 15 nt, Homo sapiens
ucucaccacuucagu

SEQ ID NO: 2117250 - RNA, 16 nt, Homo sapiens
gaacaaaauaaagugu

SEQ ID NO: 2117251 - RNA, 15 nt, Homo sapiens
caggugguggcacug

SEQ ID NO: 2117252 - RNA, 17 nt, Homo sapiens
uucuaccuggucucucc

SEQ ID NO: 2117253 - RNA, 22 nt, Homo sapiens
gaaugucaagaaaaggagucaa

SEQ ID NO: 2117254 - RNA, 15 nt, Homo sapiens
ugcacuuguuauauu

SEQ ID NO: 2117255 - RNA, 18 nt, Homo sapiens
auacaugcuuuuuaauga

SEQ ID NO: 2117256 - RNA, 17 nt, Homo sapiens
ucuaugaucuugagggc

SEQ ID NO: 2117257 - RNA, 21 nt, Homo sapiens
uuuuaaaagaauuucauagau

SEQ ID NO: 2117258 - RNA, 17 nt, Homo sapiens
guacaggaaggugccug

SEQ ID NO: 2117259 - RNA, 21 nt, Homo sapiens
auguggacuaaauaucuguca

SEQ ID NO: 2117260 - RNA, 21 nt, Homo sapiens
uaaauuuaugguucucaggcc

SEQ ID NO: 2117261 - RNA, 15 nt, Homo sapiens
gcucugucucaaaag

SEQ ID NO: 2117262 - RNA, 22 nt, Homo sapiens
uuugaaccauaaagggugccag

SEQ ID NO: 2117263 - RNA, 19 nt, Homo sapiens
gcucccucugcugaucuca

SEQ ID NO: 2117264 - RNA, 23 nt, Homo sapiens
auaaacaaucuuagacauuuauc

SEQ ID NO: 2117265 - RNA, 22 nt, Homo sapiens
cuuugcuauggggacauuccaa

SEQ ID NO: 2117266 - RNA, 20 nt, Homo sapiens
gcuggaaaagucacacagac

SEQ ID NO: 2117267 - RNA, 16 nt, Homo sapiens
auguuuauacuguauu

SEQ ID NO: 2117268 - RNA, 16 nt, Homo sapiens
gggaaaggcugccgag

SEQ ID NO: 2117269 - RNA, 22 nt, Homo sapiens
ugguaugaaacaaauauacuca

SEQ ID NO: 2117270 - RNA, 19 nt, Homo sapiens
gcuauuuucugaccaaaau

SEQ ID NO: 2117271 - RNA, 19 nt, Homo sapiens
aauuuuaaaaugaaaugca

SEQ ID NO: 2117272 - RNA, 22 nt, Homo sapiens
ccuccaacgccccuguggccaa

SEQ ID NO: 2117273 - RNA, 16 nt, Homo sapiens
ggcaaaaaaauuaaau

SEQ ID NO: 2117274 - RNA, 21 nt, Homo sapiens
ugcacaugugccacacaguga

SEQ ID NO: 2117275 - RNA, 14 nt, Homo sapiens
ucagccauuugcca

SEQ ID NO: 2117276 - RNA, 21 nt, Homo sapiens
cuggaggcugcaccuacugag

SEQ ID NO: 2117277 - RNA, 14 nt, Homo sapiens
gcaguggugcaauc

SEQ ID NO: 2117278 - RNA, 23 nt, Homo sapiens
aaucuccucuuuuagcugaugaa

SEQ ID NO: 2117279 - RNA, 19 nt, Homo sapiens
uuucuccuaucuucauauc

SEQ ID NO: 2117280 - RNA, 17 nt, Homo sapiens
acauacagaauguucua

SEQ ID NO: 2117281 - RNA, 16 nt, Homo sapiens
uagaauaagucauugu

SEQ ID NO: 2117282 - RNA, 16 nt, Homo sapiens
uuaagagaccaggucu

SEQ ID NO: 2117283 - RNA, 21 nt, Homo sapiens
caaucccuggggcugugcauu

SEQ ID NO: 2117284 - RNA, 10 nt, Homo sapiens
uaaucccagc

SEQ ID NO: 2117285 - RNA, 21 nt, Homo sapiens
uagaacugcccauuuccaugg

SEQ ID NO: 2117286 - RNA, 20 nt, Homo sapiens
agccugcuuugcuuuacugc

SEQ ID NO: 2117287 - RNA, 15 nt, Homo sapiens
auauccaugaugcug

SEQ ID NO: 2117288 - RNA, 17 nt, Homo sapiens
aauacugcuacagcaau

SEQ ID NO: 2117289 - RNA, 13 nt, Homo sapiens
gauggucucucac

SEQ ID NO: 2117290 - RNA, 14 nt, Homo sapiens
ccaaaguuugcaac

SEQ ID NO: 2117291 - RNA, 16 nt, Homo sapiens
uggaaaugucuuucua

SEQ ID NO: 2117292 - RNA, 13 nt, Homo sapiens
cugcaugcugaaa

SEQ ID NO: 2117293 - RNA, 12 nt, Homo sapiens
cuguagccucag

SEQ ID NO: 2117294 - RNA, 17 nt, Homo sapiens
cuuccucugauuuacau

SEQ ID NO: 2117295 - RNA, 22 nt, Homo sapiens
acucagcuauaccucauucaca

SEQ ID NO: 2117296 - RNA, 15 nt, Homo sapiens
ugugaacagcuugcu

SEQ ID NO: 2117297 - RNA, 22 nt, Homo sapiens
ugacuugcagaguucauggaau

SEQ ID NO: 2117298 - RNA, 18 nt, Homo sapiens
uccaaaauaucgagugaa

SEQ ID NO: 2117299 - RNA, 18 nt, Homo sapiens
ugcugcucuaagcaccgu

SEQ ID NO: 2117300 - RNA, 14 nt, Homo sapiens
ucccagacauucau

SEQ ID NO: 2117301 - RNA, 15 nt, Homo sapiens
uugcagacaguguuu

SEQ ID NO: 2117302 - RNA, 14 nt, Homo sapiens
gcaaauauaaucca

SEQ ID NO: 2117303 - RNA, 14 nt, Homo sapiens
agggcagaggugga

SEQ ID NO: 2117304 - RNA, 18 nt, Homo sapiens
aaagcaacuacagaauuu

SEQ ID NO: 2117305 - RNA, 19 nt, Homo sapiens
uagaacagugcuugccaca

SEQ ID NO: 2117306 - RNA, 15 nt, Homo sapiens
accccaauccuccca

SEQ ID NO: 2117307 - RNA, 14 nt, Homo sapiens
ugugcacauucucc

SEQ ID NO: 2117308 - RNA, 21 nt, Homo sapiens
ccuuccagggguuuacagucu

SEQ ID NO: 2117309 - RNA, 17 nt, Homo sapiens
cuguggcgacucugcag

SEQ ID NO: 2117310 - RNA, 23 nt, Homo sapiens
aagugcuauuucagcaacaacca

SEQ ID NO: 2117311 - RNA, 18 nt, Homo sapiens
caacacggagcagggaga

SEQ ID NO: 2117312 - RNA, 11 nt, Homo sapiens
agccuccucau

SEQ ID NO: 2117313 - RNA, 11 nt, Homo sapiens
gagcuagaagc

SEQ ID NO: 2117314 - RNA, 15 nt, Homo sapiens
acuagaaucagauac

SEQ ID NO: 2117315 - RNA, 16 nt, Homo sapiens
aacaauggaaugagaa

SEQ ID NO: 2117316 - RNA, 12 nt, Homo sapiens
augaaauacuua

SEQ ID NO: 2117317 - RNA, 10 nt, Homo sapiens
ggaugacccc

SEQ ID NO: 2117318 - RNA, 15 nt, Homo sapiens
gagucuugugugcau

SEQ ID NO: 2117319 - RNA, 17 nt, Homo sapiens
cuguccucucaucccag

SEQ ID NO: 2117320 - RNA, 16 nt, Homo sapiens
ucucuuucucuuaaua

SEQ ID NO: 2117321 - RNA, 21 nt, Homo sapiens
uagugugaaauauauuacuua

SEQ ID NO: 2117322 - RNA, 16 nt, Homo sapiens
caaaugccaacuguug

SEQ ID NO: 2117323 - RNA, 23 nt, Homo sapiens
ggcccgcaccgcugggagucuga

SEQ ID NO: 2117324 - RNA, 22 nt, Homo sapiens
gaaugauuuugcugacuuccca

SEQ ID NO: 2117325 - RNA, 12 nt, Homo sapiens
uucaaugaaaua

SEQ ID NO: 2117326 - RNA, 14 nt, Homo sapiens
guuuucacauucuu

SEQ ID NO: 2117327 - RNA, 22 nt, Homo sapiens
gugaacucaaucuccagggcuc

SEQ ID NO: 2117328 - RNA, 21 nt, Homo sapiens
aguaacacaauacaguacuca

SEQ ID NO: 2117329 - RNA, 17 nt, Homo sapiens
cuucugucugcagugug

SEQ ID NO: 2117330 - RNA, 21 nt, Homo sapiens
uacacaauggguaucuaauaa

SEQ ID NO: 2117331 - RNA, 17 nt, Homo sapiens
uuccccaaguacaacca

SEQ ID NO: 2117332 - RNA, 15 nt, Homo sapiens
caguucccucuugcu

SEQ ID NO: 2117333 - RNA, 17 nt, Homo sapiens
uaaacgucacagcagua

SEQ ID NO: 2117334 - RNA, 23 nt, Homo sapiens
gcaccagaugccauuacauuuau

SEQ ID NO: 2117335 - RNA, 15 nt, Homo sapiens
ccugcccuuggcacc

SEQ ID NO: 2117336 - RNA, 18 nt, Homo sapiens
gacuccaagagggugaag

SEQ ID NO: 2117337 - RNA, 17 nt, Homo sapiens
ucaaccaugaccucacc

SEQ ID NO: 2117338 - RNA, 11 nt, Homo sapiens
acuugcaauug

SEQ ID NO: 2117339 - RNA, 16 nt, Homo sapiens
ucuagggccucuccag

SEQ ID NO: 2117340 - RNA, 14 nt, Homo sapiens
aguacuuuaccuaa

SEQ ID NO: 2117341 - RNA, 12 nt, Homo sapiens
ugcuugccaucc

SEQ ID NO: 2117342 - RNA, 20 nt, Homo sapiens
ugagggugacuauggagcug

SEQ ID NO: 2117343 - RNA, 23 nt, Homo sapiens
aacaacacuacgaagaguauuug

SEQ ID NO: 2117344 - RNA, 18 nt, Homo sapiens
aacgcaaaccucuccuuc

SEQ ID NO: 2117345 - RNA, 13 nt, Homo sapiens
ggaaaacuacuga

SEQ ID NO: 2117346 - RNA, 17 nt, Homo sapiens
auugcccuuuaacaaga

SEQ ID NO: 2117347 - RNA, 16 nt, Homo sapiens
uguacacagaaguuua

SEQ ID NO: 2117348 - RNA, 16 nt, Homo sapiens
acugcagugaccaggg

SEQ ID NO: 2117349 - RNA, 19 nt, Homo sapiens
accucggccucccaaagug

SEQ ID NO: 2117350 - RNA, 15 nt, Homo sapiens
uaguuacagcuguga

SEQ ID NO: 2117351 - RNA, 23 nt, Homo sapiens
agcccgggucaucuguaccucug

SEQ ID NO: 2117352 - RNA, 17 nt, Homo sapiens
acaacuuagaaaccaaa

SEQ ID NO: 2117353 - RNA, 17 nt, Homo sapiens
agcccuguuggcagcuc

SEQ ID NO: 2117354 - RNA, 22 nt, Homo sapiens
cuaacuacaaggacaaugccuu

SEQ ID NO: 2117355 - RNA, 21 nt, Homo sapiens
aauguucccuuaggagcaaaa

SEQ ID NO: 2117356 - RNA, 16 nt, Homo sapiens
gcccugcaccaugcug

SEQ ID NO: 2117357 - RNA, 17 nt, Homo sapiens
agcuuaaaucauggguc

SEQ ID NO: 2117358 - RNA, 12 nt, Homo sapiens
aaacaaugcaga

SEQ ID NO: 2117359 - RNA, 17 nt, Homo sapiens
gcugcaucccaccagcc

SEQ ID NO: 2117360 - RNA, 22 nt, Homo sapiens
uuauaaaucuuucucucacugu

SEQ ID NO: 2117361 - RNA, 20 nt, Homo sapiens
ccuuaauaacauacaaugac

SEQ ID NO: 2117362 - RNA, 20 nt, Homo sapiens
acacccacccccaugcacuc

SEQ ID NO: 2117363 - RNA, 21 nt, Homo sapiens
ugagaccuacugggcugcauu

SEQ ID NO: 2117364 - RNA, 22 nt, Homo sapiens
ccuuuaccacccagaaauccau

SEQ ID NO: 2117365 - RNA, 16 nt, Homo sapiens
uuuuuaaaaaaguaag

SEQ ID NO: 2117366 - RNA, 21 nt, Homo sapiens
aacaacccacaccgucuuccu

SEQ ID NO: 2117367 - RNA, 16 nt, Homo sapiens
aagacaucacaucccu

SEQ ID NO: 2117368 - RNA, 17 nt, Homo sapiens
uaacaaacccaacuaaa

SEQ ID NO: 2117369 - RNA, 12 nt, Homo sapiens
cuuccuucaggg

SEQ ID NO: 2117370 - RNA, 20 nt, Homo sapiens
uguugggauuacagguguga

SEQ ID NO: 2117371 - RNA, 14 nt, Homo sapiens
ccugugggaguaga

SEQ ID NO: 2117372 - RNA, 15 nt, Homo sapiens
ggcugucuuccccca

SEQ ID NO: 2117373 - RNA, 13 nt, Homo sapiens
agcagugugauug

SEQ ID NO: 2117374 - RNA, 19 nt, Homo sapiens
gagcagccacaaccaaaaa

SEQ ID NO: 2117375 - RNA, 20 nt, Homo sapiens
auguuccaccauugcuggaa

SEQ ID NO: 2117376 - RNA, 19 nt, Homo sapiens
ucucagcucuucugacuua

SEQ ID NO: 2117377 - RNA, 19 nt, Homo sapiens
acauauuacaacacuuuaa

SEQ ID NO: 2117378 - RNA, 13 nt, Homo sapiens
uguguuguagucg

SEQ ID NO: 2117379 - RNA, 13 nt, Homo sapiens
ccuugcugggacu

SEQ ID NO: 2117380 - RNA, 15 nt, Homo sapiens
gucuugcuggaagac

SEQ ID NO: 2117381 - RNA, 18 nt, Homo sapiens
agcaucaaaaacaucacu

SEQ ID NO: 2117382 - RNA, 17 nt, Homo sapiens
agcaaggccuugguguu

SEQ ID NO: 2117383 - RNA, 17 nt, Homo sapiens
gaagugugaagugcaga

SEQ ID NO: 2117384 - RNA, 23 nt, Homo sapiens
cagaucuguuucgugcauuggaa

SEQ ID NO: 2117385 - RNA, 18 nt, Homo sapiens
cccaagugaaaucaaagg

SEQ ID NO: 2117386 - RNA, 23 nt, Homo sapiens
gcuauaagugcucaauagcuuga

SEQ ID NO: 2117387 - RNA, 16 nt, Homo sapiens
acauuaacaagcucuu

SEQ ID NO: 2117388 - RNA, 18 nt, Homo sapiens
augagcugcugugcccag

SEQ ID NO: 2117389 - RNA, 16 nt, Homo sapiens
acucugacuggcacag

SEQ ID NO: 2117390 - RNA, 16 nt, Homo sapiens
auaaaauacauacuau

SEQ ID NO: 2117391 - RNA, 14 nt, Homo sapiens
uuuaauuaaaucuc

SEQ ID NO: 2117392 - RNA, 21 nt, Homo sapiens
ggacaaaauaaaccguguauu

SEQ ID NO: 2117393 - RNA, 15 nt, Homo sapiens
uaaguguguguauac

SEQ ID NO: 2117394 - RNA, 13 nt, Homo sapiens
gccaaccuggacu

SEQ ID NO: 2117395 - RNA, 16 nt, Homo sapiens
ugccuuccagccacau

SEQ ID NO: 2117396 - RNA, 17 nt, Homo sapiens
cugauggaaacaaagug

SEQ ID NO: 2117397 - RNA, 21 nt, Homo sapiens
caccuguaaaaacugcacaua

SEQ ID NO: 2117398 - RNA, 13 nt, Homo sapiens
aaccaucacauga

SEQ ID NO: 2117399 - RNA, 19 nt, Homo sapiens
guacuaagaggcuauuuaa

SEQ ID NO: 2117400 - RNA, 22 nt, Homo sapiens
auguuucauguuuugugacuau

SEQ ID NO: 2117401 - RNA, 21 nt, Homo sapiens
auuucacucuggguaccaaau

SEQ ID NO: 2117402 - RNA, 19 nt, Homo sapiens
ugcagcaagcaauaaacac

SEQ ID NO: 2117403 - RNA, 22 nt, Homo sapiens
ugucuugguguucaugaucucc

SEQ ID NO: 2117404 - RNA, 23 nt, Homo sapiens
gccucccucccgggggcacugcc

SEQ ID NO: 2117405 - RNA, 19 nt, Homo sapiens
cagcacucuuaucuacaua

SEQ ID NO: 2117406 - RNA, 14 nt, Homo sapiens
gcuuuaaaaccaca

SEQ ID NO: 2117407 - RNA, 14 nt, Homo sapiens
ccuuguacuuuuca

SEQ ID NO: 2117408 - RNA, 17 nt, Homo sapiens
acugcuucuccaaggac

SEQ ID NO: 2117409 - RNA, 17 nt, Homo sapiens
gccuuuugggcauucuc

SEQ ID NO: 2117410 - RNA, 18 nt, Homo sapiens
uugaaagguguagguuug

SEQ ID NO: 2117411 - RNA, 18 nt, Homo sapiens
auauauggcauuugcaga

SEQ ID NO: 2117412 - RNA, 22 nt, Homo sapiens
accugggcugaggcauccuucc

SEQ ID NO: 2117413 - RNA, 19 nt, Homo sapiens
ugacacuuccauuguuuaa

SEQ ID NO: 2117414 - RNA, 11 nt, Homo sapiens
uagaucuggca

SEQ ID NO: 2117415 - RNA, 14 nt, Homo sapiens
cucuaaacugcggu

SEQ ID NO: 2117416 - RNA, 20 nt, Homo sapiens
uuucaauaguacccaaccaa

SEQ ID NO: 2117417 - RNA, 22 nt, Homo sapiens
agagcaggggcuccagcaccuu

SEQ ID NO: 2117418 - RNA, 15 nt, Homo sapiens
caccaaaguauuaau

SEQ ID NO: 2117419 - RNA, 20 nt, Homo sapiens
aaggaaacccccaguguaau

SEQ ID NO: 2117420 - RNA, 17 nt, Homo sapiens
ucauaaucugaugauau

SEQ ID NO: 2117421 - RNA, 17 nt, Homo sapiens
uuguuugccaggacaug

SEQ ID NO: 2117422 - RNA, 23 nt, Homo sapiens
cugucuaaaaaccagacaaggaa

SEQ ID NO: 2117423 - RNA, 20 nt, Homo sapiens
uccuuguuagaaugcaagca

SEQ ID NO: 2117424 - RNA, 17 nt, Homo sapiens
aauauaaaacagucaug

SEQ ID NO: 2117425 - RNA, 17 nt, Homo sapiens
aaaacauugcugccuaa

SEQ ID NO: 2117426 - RNA, 18 nt, Homo sapiens
caauaaaaugucuucucc

SEQ ID NO: 2117427 - RNA, 19 nt, Homo sapiens
cgucugcuccaaugacuga

SEQ ID NO: 2117428 - RNA, 13 nt, Homo sapiens
ccuaaagcagcca

SEQ ID NO: 2117429 - RNA, 13 nt, Homo sapiens
cgcacagcacucc

SEQ ID NO: 2117430 - RNA, 22 nt, Homo sapiens
ugggcuguuacuugcuuugagu

SEQ ID NO: 2117431 - RNA, 13 nt, Homo sapiens
acaacuugccaaa

SEQ ID NO: 2117432 - RNA, 16 nt, Homo sapiens
gcgucugcacugauga

SEQ ID NO: 2117433 - RNA, 18 nt, Homo sapiens
aucugggucuuaguucug

SEQ ID NO: 2117434 - RNA, 12 nt, Homo sapiens
ggcauuggccau

SEQ ID NO: 2117435 - RNA, 15 nt, Homo sapiens
agcugaaaugcugca

SEQ ID NO: 2117436 - RNA, 15 nt, Homo sapiens
ugacccaaagaccaa

SEQ ID NO: 2117437 - RNA, 16 nt, Homo sapiens
ccuccaccccccagaa

SEQ ID NO: 2117438 - RNA, 19 nt, Homo sapiens
aaagcccuuuuauaccucc

SEQ ID NO: 2117439 - RNA, 19 nt, Homo sapiens
guauucaugacuauggaua

SEQ ID NO: 2117440 - RNA, 19 nt, Homo sapiens
uaaagugcuugcuuuuugc

SEQ ID NO: 2117441 - RNA, 17 nt, Homo sapiens
aucauuuccugggagaa

SEQ ID NO: 2117442 - RNA, 16 nt, Homo sapiens
agcuugccacuuucca

SEQ ID NO: 2117443 - RNA, 20 nt, Homo sapiens
gggaaguccucccugguguc

SEQ ID NO: 2117444 - RNA, 13 nt, Homo sapiens
ugugacagucuug

SEQ ID NO: 2117445 - RNA, 19 nt, Homo sapiens
uuuaagccugcggcgccag

SEQ ID NO: 2117446 - RNA, 15 nt, Homo sapiens
caacucaagggcaca

SEQ ID NO: 2117447 - RNA, 17 nt, Homo sapiens
ugcugucaagcaccugc

SEQ ID NO: 2117448 - RNA, 16 nt, Homo sapiens
cuauuuaaguggacug

SEQ ID NO: 2117449 - RNA, 17 nt, Homo sapiens
gccgcugggguguuaau

SEQ ID NO: 2117450 - RNA, 18 nt, Homo sapiens
caguguaagaaaauugga

SEQ ID NO: 2117451 - RNA, 18 nt, Homo sapiens
ggaugucccugggccagg

SEQ ID NO: 2117452 - RNA, 13 nt, Homo sapiens
gcuguugccucau

SEQ ID NO: 2117453 - RNA, 19 nt, Homo sapiens
uagucaauauaccaugaca

SEQ ID NO: 2117454 - RNA, 22 nt, Homo sapiens
gagauggguugaguuugcugua

SEQ ID NO: 2117455 - RNA, 14 nt, Homo sapiens
uauaagaucacuga

SEQ ID NO: 2117456 - RNA, 20 nt, Homo sapiens
cagagagaagcccagacuuc

SEQ ID NO: 2117457 - RNA, 16 nt, Homo sapiens
cuuuaugcaaauacaa

SEQ ID NO: 2117458 - RNA, 16 nt, Homo sapiens
uuaaauauagauuaga

SEQ ID NO: 2117459 - RNA, 18 nt, Homo sapiens
gccagaugauuguucaaa

SEQ ID NO: 2117460 - RNA, 22 nt, Homo sapiens
auucuaauaaauauacuaugaa

SEQ ID NO: 2117461 - RNA, 20 nt, Homo sapiens
cccaaccccagcuacucuga

SEQ ID NO: 2117462 - RNA, 21 nt, Homo sapiens
agaaccuugugccuggcucag

SEQ ID NO: 2117463 - RNA, 20 nt, Homo sapiens
agacaaacuccugaaaugcc

SEQ ID NO: 2117464 - RNA, 20 nt, Homo sapiens
aauguuuaaagaucaugaca

SEQ ID NO: 2117465 - RNA, 14 nt, Homo sapiens
cucuacuacccuaa

SEQ ID NO: 2117466 - RNA, 18 nt, Homo sapiens
aggaacuuuauguucuaa

SEQ ID NO: 2117467 - RNA, 21 nt, Homo sapiens
gcacagccuuugcccaaaacu

SEQ ID NO: 2117468 - RNA, 19 nt, Homo sapiens
uguacaucagacaauugca

SEQ ID NO: 2117469 - RNA, 14 nt, Homo sapiens
gaccauaagaguuu

SEQ ID NO: 2117470 - RNA, 16 nt, Homo sapiens
ccuauggcccagccac

SEQ ID NO: 2117471 - RNA, 16 nt, Homo sapiens
agauuauagauucuaa

SEQ ID NO: 2117472 - RNA, 14 nt, Homo sapiens
cuucauacuccuuu

SEQ ID NO: 2117473 - RNA, 21 nt, Homo sapiens
cacugcacugccauugucuuu

SEQ ID NO: 2117474 - RNA, 18 nt, Homo sapiens
ccuuucuaaccuucacga

SEQ ID NO: 2117475 - RNA, 14 nt, Homo sapiens
acuugaagccaaac

SEQ ID NO: 2117476 - RNA, 21 nt, Homo sapiens
aauacuuaccgagucagacuu

SEQ ID NO: 2117477 - RNA, 22 nt, Homo sapiens
aggggcuuuggaagcucuguug

SEQ ID NO: 2117478 - RNA, 17 nt, Homo sapiens
ugaaacccuccuucugu

SEQ ID NO: 2117479 - RNA, 16 nt, Homo sapiens
auccaucaaguugcac

SEQ ID NO: 2117480 - RNA, 20 nt, Homo sapiens
uggugaugggguuuagcaac

SEQ ID NO: 2117481 - RNA, 20 nt, Homo sapiens
auucuaaggagcaaauaccu

SEQ ID NO: 2117482 - RNA, 15 nt, Homo sapiens
cacagggcaauugag

SEQ ID NO: 2117483 - RNA, 12 nt, Homo sapiens
cugggggccaug

SEQ ID NO: 2117484 - RNA, 15 nt, Homo sapiens
auguguccucaggga

SEQ ID NO: 2117485 - RNA, 14 nt, Homo sapiens
auauguagauguau

SEQ ID NO: 2117486 - RNA, 21 nt, Homo sapiens
uuuugcauuuucaucuacuca

SEQ ID NO: 2117487 - RNA, 14 nt, Homo sapiens
auccaucagcaaug

SEQ ID NO: 2117488 - RNA, 12 nt, Homo sapiens
cagugcaauggg

SEQ ID NO: 2117489 - RNA, 21 nt, Homo sapiens
cuaccaacgaaagacgugauu

SEQ ID NO: 2117490 - RNA, 18 nt, Homo sapiens
agguacugagagugaaca

SEQ ID NO: 2117491 - RNA, 17 nt, Homo sapiens
gggcucugauggcugcu

SEQ ID NO: 2117492 - RNA, 15 nt, Homo sapiens
accaguaauugugaa

SEQ ID NO: 2117493 - RNA, 12 nt, Homo sapiens
caucaauagugu

SEQ ID NO: 2117494 - RNA, 22 nt, Homo sapiens
ugacagagcucuggguugugca

SEQ ID NO: 2117495 - RNA, 15 nt, Homo sapiens
auuucacugacacug

SEQ ID NO: 2117496 - RNA, 14 nt, Homo sapiens
uaaauaaaugugag

SEQ ID NO: 2117497 - RNA, 21 nt, Homo sapiens
ucucgggacuagcugccuucg

SEQ ID NO: 2117498 - RNA, 18 nt, Homo sapiens
ucugagacagaaucucag

SEQ ID NO: 2117499 - RNA, 17 nt, Homo sapiens
uaauucuaagucuucca

SEQ ID NO: 2117500 - RNA, 17 nt, Homo sapiens
uguguugggaccuguga

SEQ ID NO: 2117501 - RNA, 19 nt, Homo sapiens
gucaacacaaagacaugga

SEQ ID NO: 2117502 - RNA, 18 nt, Homo sapiens
ugagccagcagacauugu

SEQ ID NO: 2117503 - RNA, 13 nt, Homo sapiens
aacuagaagccua

SEQ ID NO: 2117504 - RNA, 16 nt, Homo sapiens
uaugaugucccuaugg

SEQ ID NO: 2117505 - RNA, 16 nt, Homo sapiens
uccauuucuucugcac

SEQ ID NO: 2117506 - RNA, 20 nt, Homo sapiens
auguacgcugcgugccauga

SEQ ID NO: 2117507 - RNA, 19 nt, Homo sapiens
cuaccuggucucuccuugu

SEQ ID NO: 2117508 - RNA, 18 nt, Homo sapiens
cagggcccccacaggagc

SEQ ID NO: 2117509 - RNA, 15 nt, Homo sapiens
ucagagcuaaacucc

SEQ ID NO: 2117510 - RNA, 12 nt, Homo sapiens
aaggcugccuca

SEQ ID NO: 2117511 - RNA, 23 nt, Homo sapiens
ucugucuggcauuacaauugcag

SEQ ID NO: 2117512 - RNA, 19 nt, Homo sapiens
ugccaccagcgaacucuca

SEQ ID NO: 2117513 - RNA, 14 nt, Homo sapiens
guaaaugguguaca

SEQ ID NO: 2117514 - RNA, 19 nt, Homo sapiens
uuuaauuaaucaugaaugu

SEQ ID NO: 2117515 - RNA, 20 nt, Homo sapiens
cguccagggagcauuuuccu

SEQ ID NO: 2117516 - RNA, 14 nt, Homo sapiens
caaugcacauuuac

SEQ ID NO: 2117517 - RNA, 13 nt, Homo sapiens
uguaaagauguca

SEQ ID NO: 2117518 - RNA, 22 nt, Homo sapiens
caagccuguauagacagcacuu

SEQ ID NO: 2117519 - RNA, 19 nt, Homo sapiens
aucaccguuucugcucugu

SEQ ID NO: 2117520 - RNA, 14 nt, Homo sapiens
aggugggcaugcca

SEQ ID NO: 2117521 - RNA, 16 nt, Homo sapiens
gaguucaucuugaauu

SEQ ID NO: 2117522 - RNA, 22 nt, Homo sapiens
ggagugcucaccgccucacuca

SEQ ID NO: 2117523 - RNA, 11 nt, Homo sapiens
guccaugccua

SEQ ID NO: 2117524 - RNA, 14 nt, Homo sapiens
guauaguggaucca

SEQ ID NO: 2117525 - RNA, 14 nt, Homo sapiens
gauaaaauuaauuu

SEQ ID NO: 2117526 - RNA, 14 nt, Homo sapiens
guaaguuucuuccu

SEQ ID NO: 2117527 - RNA, 15 nt, Homo sapiens
ucccaagacugcucc

SEQ ID NO: 2117528 - RNA, 17 nt, Homo sapiens
cuggggaugggacaaga

SEQ ID NO: 2117529 - RNA, 12 nt, Homo sapiens
cuguuuucaaua

SEQ ID NO: 2117530 - RNA, 23 nt, Homo sapiens
augcuguucucuuugcugacacu

SEQ ID NO: 2117531 - RNA, 19 nt, Homo sapiens
guuccucccccugcucccc

SEQ ID NO: 2117532 - RNA, 22 nt, Homo sapiens
uauguggauugaguaaugggau

SEQ ID NO: 2117533 - RNA, 12 nt, Homo sapiens
ucucuagcagug

SEQ ID NO: 2117534 - RNA, 19 nt, Homo sapiens
uguguuccuaacauaaaau

SEQ ID NO: 2117535 - RNA, 19 nt, Homo sapiens
cagccugcagcaagugcuu

SEQ ID NO: 2117536 - RNA, 20 nt, Homo sapiens
aguuccauuuaaauugacuu

SEQ ID NO: 2117537 - RNA, 13 nt, Homo sapiens
cugcccaggugug

SEQ ID NO: 2117538 - RNA, 22 nt, Homo sapiens
cugagucaggacuugaacccag

SEQ ID NO: 2117539 - RNA, 23 nt, Homo sapiens
acucucuagcuuuaggggaccau

SEQ ID NO: 2117540 - RNA, 14 nt, Homo sapiens
uccccuuguaaaaa

SEQ ID NO: 2117541 - RNA, 18 nt, Homo sapiens
uugguuuccaaaggcauu

SEQ ID NO: 2117542 - RNA, 17 nt, Homo sapiens
gccacugugucuggcca

SEQ ID NO: 2117543 - RNA, 15 nt, Homo sapiens
ucccucagauuucca

SEQ ID NO: 2117544 - RNA, 20 nt, Homo sapiens
agauguucgcucgugcagua

SEQ ID NO: 2117545 - RNA, 19 nt, Homo sapiens
cauguuuuaacaaaaacca

SEQ ID NO: 2117546 - RNA, 16 nt, Homo sapiens
uccucuaauaugccua

SEQ ID NO: 2117547 - RNA, 16 nt, Homo sapiens
ggagguauucaguuga

SEQ ID NO: 2117548 - RNA, 21 nt, Homo sapiens
ucugugaggggcucucucaug

SEQ ID NO: 2117549 - RNA, 17 nt, Homo sapiens
guaucugauagcucuuu

SEQ ID NO: 2117550 - RNA, 19 nt, Homo sapiens
gcuagagugcaguggugca

SEQ ID NO: 2117551 - RNA, 19 nt, Homo sapiens
gaaaggcugcuguacugaa

SEQ ID NO: 2117552 - RNA, 20 nt, Homo sapiens
aacagggcugaagcuguguc

SEQ ID NO: 2117553 - RNA, 23 nt, Homo sapiens
ugaacauuaauccacauguuuca

SEQ ID NO: 2117554 - RNA, 13 nt, Homo sapiens
accuggacccaga

SEQ ID NO: 2117555 - RNA, 14 nt, Homo sapiens
ccugagagccugug

SEQ ID NO: 2117556 - RNA, 14 nt, Homo sapiens
uuaauaaguuaaaa

SEQ ID NO: 2117557 - RNA, 15 nt, Homo sapiens
ggcaacaauuuaccu

SEQ ID NO: 2117558 - RNA, 18 nt, Homo sapiens
ccucugggccaagucaaa

SEQ ID NO: 2117559 - RNA, 16 nt, Homo sapiens
auguagcagacaacac

SEQ ID NO: 2117560 - RNA, 15 nt, Homo sapiens
cacaagcaacaaacc

SEQ ID NO: 2117561 - RNA, 21 nt, Homo sapiens
uccaguuugaguuaaugugcu

SEQ ID NO: 2117562 - RNA, 17 nt, Homo sapiens
ucucucuugucaaguca

SEQ ID NO: 2117563 - RNA, 12 nt, Homo sapiens
uggugucauuua

SEQ ID NO: 2117564 - RNA, 12 nt, Homo sapiens
uuguuuugcacu

SEQ ID NO: 2117565 - RNA, 15 nt, Homo sapiens
caucaguauugugua

SEQ ID NO: 2117566 - RNA, 20 nt, Homo sapiens
auggugaaaccguaucucua

SEQ ID NO: 2117567 - RNA, 14 nt, Homo sapiens
cuuccuaggucaug

SEQ ID NO: 2117568 - RNA, 23 nt, Homo sapiens
cccucagucacccccacuuccca

SEQ ID NO: 2117569 - RNA, 23 nt, Homo sapiens
gauuucaccacucaaaggccaga

SEQ ID NO: 2117570 - RNA, 19 nt, Homo sapiens
acuuuuaugcgcaaauaca

SEQ ID NO: 2117571 - RNA, 21 nt, Homo sapiens
cuggugugucauacugugcag

SEQ ID NO: 2117572 - RNA, 13 nt, Homo sapiens
uuucuacucgagu

SEQ ID NO: 2117573 - RNA, 21 nt, Homo sapiens
caugugauuggcagcuucaaa

SEQ ID NO: 2117574 - RNA, 19 nt, Homo sapiens
uucuaaucccagcacuuug

SEQ ID NO: 2117575 - RNA, 22 nt, Homo sapiens
gcgcacuuuccuccuggcagaa

SEQ ID NO: 2117576 - RNA, 13 nt, Homo sapiens
cuauguguacugu

SEQ ID NO: 2117577 - RNA, 20 nt, Homo sapiens
agaugaaaccaggucacugg

SEQ ID NO: 2117578 - RNA, 17 nt, Homo sapiens
augcacauauacacauu

SEQ ID NO: 2117579 - RNA, 23 nt, Homo sapiens
uagaauggaggggacuccaaagc

SEQ ID NO: 2117580 - RNA, 21 nt, Homo sapiens
uuccugauagcauaugacaaa

SEQ ID NO: 2117581 - RNA, 15 nt, Homo sapiens
ugaauuggaaaggaa

SEQ ID NO: 2117582 - RNA, 15 nt, Homo sapiens
aagguacuuaaagcu

SEQ ID NO: 2117583 - RNA, 23 nt, Homo sapiens
uagcaauuggcagcccuauuuca

SEQ ID NO: 2117584 - RNA, 14 nt, Homo sapiens
gagggcagggacca

SEQ ID NO: 2117585 - RNA, 15 nt, Homo sapiens
ucagaauccacaacu

SEQ ID NO: 2117586 - RNA, 22 nt, Homo sapiens
ccagcugcagggcacggggacc

SEQ ID NO: 2117587 - RNA, 13 nt, Homo sapiens
cuaugauauaaca

SEQ ID NO: 2117588 - RNA, 19 nt, Homo sapiens
agccgggugugguggcaca

SEQ ID NO: 2117589 - RNA, 19 nt, Homo sapiens
agccgggcaugguggugca

SEQ ID NO: 2117590 - RNA, 16 nt, Homo sapiens
augaagaaggucucau

SEQ ID NO: 2117591 - RNA, 16 nt, Homo sapiens
agcgauucucuugccu

SEQ ID NO: 2117592 - RNA, 16 nt, Homo sapiens
agugauucuccugccu

SEQ ID NO: 2117593 - RNA, 13 nt, Homo sapiens
cauuuucuucucu

SEQ ID NO: 2117594 - RNA, 16 nt, Homo sapiens
uuagaguguagcugua

SEQ ID NO: 2117595 - RNA, 13 nt, Homo sapiens
agcaccucugagc

SEQ ID NO: 2117596 - RNA, 14 nt, Homo sapiens
cagccuccuugaag

SEQ ID NO: 2117597 - RNA, 12 nt, Homo sapiens
ggucagcauuug

SEQ ID NO: 2117598 - RNA, 18 nt, Homo sapiens
ucauuacuaaccauaguu

SEQ ID NO: 2117599 - RNA, 23 nt, Homo sapiens
agaaacuucugcuuuaauggcuu

SEQ ID NO: 2117600 - RNA, 22 nt, Homo sapiens
aggcccuuccucuccacugccu

SEQ ID NO: 2117601 - RNA, 18 nt, Homo sapiens
gcaaguuugacacaaacu

SEQ ID NO: 2117602 - RNA, 11 nt, Homo sapiens
cccccaaaggu

SEQ ID NO: 2117603 - RNA, 14 nt, Homo sapiens
aagacuuaacuggu

SEQ ID NO: 2117604 - RNA, 17 nt, Homo sapiens
guauaucuucuacaugc

SEQ ID NO: 2117605 - RNA, 18 nt, Homo sapiens
gcuccaggauuaggaaau

SEQ ID NO: 2117606 - RNA, 13 nt, Homo sapiens
aaccuacaguuuu

SEQ ID NO: 2117607 - RNA, 22 nt, Homo sapiens
ccgguugugagagccugugauc

SEQ ID NO: 2117608 - RNA, 16 nt, Homo sapiens
agcuuaaucaacagaa

SEQ ID NO: 2117609 - RNA, 18 nt, Homo sapiens
auaagaaagcacuauuaa

SEQ ID NO: 2117610 - RNA, 17 nt, Homo sapiens
cccaacuucgccagccu

SEQ ID NO: 2117611 - RNA, 19 nt, Homo sapiens
agcccugcagucacagcua

SEQ ID NO: 2117612 - RNA, 16 nt, Homo sapiens
cuaaauaugugacuga

SEQ ID NO: 2117613 - RNA, 18 nt, Homo sapiens
uugacacugaaaguuuug

SEQ ID NO: 2117614 - RNA, 14 nt, Homo sapiens
gccagcccaaagcu

SEQ ID NO: 2117615 - RNA, 23 nt, Homo sapiens
uuuggggaagugaggaagccagg

SEQ ID NO: 2117616 - RNA, 18 nt, Homo sapiens
agcagcggauugcucugg

SEQ ID NO: 2117617 - RNA, 20 nt, Homo sapiens
aauggaggggacuccaaagc

SEQ ID NO: 2117618 - RNA, 13 nt, Homo sapiens
acggcucuaggug

SEQ ID NO: 2117619 - RNA, 15 nt, Homo sapiens
ccaaggaugcuguca

SEQ ID NO: 2117620 - RNA, 14 nt, Homo sapiens
cggagcacugugca

SEQ ID NO: 2117621 - RNA, 12 nt, Homo sapiens
gcccuaccuaaa

SEQ ID NO: 2117622 - RNA, 12 nt, Homo sapiens
cugaagccaaag

SEQ ID NO: 2117623 - RNA, 21 nt, Homo sapiens
ggaucaacaacauccacuguu

SEQ ID NO: 2117624 - RNA, 16 nt, Homo sapiens
uauuucauccaguuug

SEQ ID NO: 2117625 - RNA, 15 nt, Homo sapiens
cccaugaaugugagc

SEQ ID NO: 2117626 - RNA, 18 nt, Homo sapiens
ucuaucugguuggauggu

SEQ ID NO: 2117627 - RNA, 18 nt, Homo sapiens
caagucccccaagaccua

SEQ ID NO: 2117628 - RNA, 18 nt, Homo sapiens
gcuuucuagaaagaauaa

SEQ ID NO: 2117629 - RNA, 19 nt, Homo sapiens
gagaccccuuguugcacug

SEQ ID NO: 2117630 - RNA, 19 nt, Homo sapiens
uacucaggaggcugaggca

SEQ ID NO: 2117631 - RNA, 16 nt, Homo sapiens
gggaaauaacugccuu

SEQ ID NO: 2117632 - RNA, 23 nt, Homo sapiens
ccaucucaacaauauauguccua

SEQ ID NO: 2117633 - RNA, 21 nt, Homo sapiens
cagcccuuccccauccugggg

SEQ ID NO: 2117634 - RNA, 17 nt, Homo sapiens
gcuuggggaacccauga

SEQ ID NO: 2117635 - RNA, 19 nt, Homo sapiens
gaacagcugugucugccaa

SEQ ID NO: 2117636 - RNA, 21 nt, Homo sapiens
gagcacacugcacacaugcac

SEQ ID NO: 2117637 - RNA, 21 nt, Homo sapiens
ccaagaugggcacaugaggag

SEQ ID NO: 2117638 - RNA, 12 nt, Homo sapiens
agccagcaagag

SEQ ID NO: 2117639 - RNA, 14 nt, Homo sapiens
gcuaccacagacuu

SEQ ID NO: 2117640 - RNA, 21 nt, Homo sapiens
gaaacaauacucauaauguga

SEQ ID NO: 2117641 - RNA, 13 nt, Homo sapiens
agaaaugugauuu

SEQ ID NO: 2117642 - RNA, 19 nt, Homo sapiens
uuucugagagagugccaug

SEQ ID NO: 2117643 - RNA, 20 nt, Homo sapiens
gucucccuccgacuccagau

SEQ ID NO: 2117644 - RNA, 17 nt, Homo sapiens
aaaagcccauucauucc

SEQ ID NO: 2117645 - RNA, 15 nt, Homo sapiens
acaaugaguguuaua

SEQ ID NO: 2117646 - RNA, 18 nt, Homo sapiens
acaaugcaguagccagca

SEQ ID NO: 2117647 - RNA, 17 nt, Homo sapiens
agugccaugggggcaac

SEQ ID NO: 2117648 - RNA, 17 nt, Homo sapiens
uccaaguugcuaauaca

SEQ ID NO: 2117649 - RNA, 21 nt, Homo sapiens
uggaucuuauacccaacacac

SEQ ID NO: 2117650 - RNA, 23 nt, Homo sapiens
gccaguuuuccgaagucucugau

SEQ ID NO: 2117651 - RNA, 21 nt, Homo sapiens
caagugcugccccugccugug

SEQ ID NO: 2117652 - RNA, 18 nt, Homo sapiens
ugaaccguuacaaaagaa

SEQ ID NO: 2117653 - RNA, 21 nt, Homo sapiens
auuuauguaacuugaaccuau

SEQ ID NO: 2117654 - RNA, 15 nt, Homo sapiens
auagaauauuuacaa

SEQ ID NO: 2117655 - RNA, 19 nt, Homo sapiens
uaaauuaaugaguuuuauc

SEQ ID NO: 2117656 - RNA, 15 nt, Homo sapiens
ugcuggcacuaucca

SEQ ID NO: 2117657 - RNA, 18 nt, Homo sapiens
ugugaggccacacccaga

SEQ ID NO: 2117658 - RNA, 18 nt, Homo sapiens
ccugugaucuauaccacc

SEQ ID NO: 2117659 - RNA, 12 nt, Homo sapiens
acauuuacuguu

SEQ ID NO: 2117660 - RNA, 23 nt, Homo sapiens
auuuauugugaaucgauucccaa

SEQ ID NO: 2117661 - RNA, 17 nt, Homo sapiens
cacugccgaugcccaau

SEQ ID NO: 2117662 - RNA, 21 nt, Homo sapiens
uaaaggaguaagaaccuugcc

SEQ ID NO: 2117663 - RNA, 15 nt, Homo sapiens
ugcagaguguuuacc

SEQ ID NO: 2117664 - RNA, 20 nt, Homo sapiens
uacuagcuaacuaauucugu

SEQ ID NO: 2117665 - RNA, 23 nt, Homo sapiens
auacagguauucugcugaugcua

SEQ ID NO: 2117666 - RNA, 15 nt, Homo sapiens
cucuuguccaauggg

SEQ ID NO: 2117667 - RNA, 18 nt, Homo sapiens
cacugucuuuaauucugu

SEQ ID NO: 2117668 - RNA, 18 nt, Homo sapiens
ggauuccucacagccuug

SEQ ID NO: 2117669 - RNA, 14 nt, Homo sapiens
ugugacccuaggcc

SEQ ID NO: 2117670 - RNA, 17 nt, Homo sapiens
gaaguuauaccuuccuc

SEQ ID NO: 2117671 - RNA, 21 nt, Homo sapiens
agaccagagggacacuaggaa

SEQ ID NO: 2117672 - RNA, 22 nt, Homo sapiens
cuuguggcuucucucucuagca

SEQ ID NO: 2117673 - RNA, 15 nt, Homo sapiens
caggggcagguggug

SEQ ID NO: 2117674 - RNA, 18 nt, Homo sapiens
ugaaaaaacaccuagcuu

SEQ ID NO: 2117675 - RNA, 10 nt, Homo sapiens
agaugcaguu

SEQ ID NO: 2117676 - RNA, 20 nt, Homo sapiens
auggccuuaauauacuacuu

SEQ ID NO: 2117677 - RNA, 19 nt, Homo sapiens
augcacucagcucuuggcu

SEQ ID NO: 2117678 - RNA, 18 nt, Homo sapiens
uggauccuggauugagac

SEQ ID NO: 2117679 - RNA, 17 nt, Homo sapiens
uguacauuccugauacu

SEQ ID NO: 2117680 - RNA, 14 nt, Homo sapiens
cuguuuaaauugcu

SEQ ID NO: 2117681 - RNA, 21 nt, Homo sapiens
ucguauuucaccucuacauuu

SEQ ID NO: 2117682 - RNA, 19 nt, Homo sapiens
gcaaaugaaggaaugcaau

SEQ ID NO: 2117683 - RNA, 11 nt, Homo sapiens
aagcugugaug

SEQ ID NO: 2117684 - RNA, 17 nt, Homo sapiens
ucugaggauucaggggc

SEQ ID NO: 2117685 - RNA, 22 nt, Homo sapiens
gcucccgaagaaugaacccaag

SEQ ID NO: 2117686 - RNA, 16 nt, Homo sapiens
uggauucaaaugucag

SEQ ID NO: 2117687 - RNA, 22 nt, Homo sapiens
aaaguauguuuuuacauuaugc

SEQ ID NO: 2117688 - RNA, 14 nt, Homo sapiens
ccacuguguauaga

SEQ ID NO: 2117689 - RNA, 18 nt, Homo sapiens
gccugagcgaguguccag

SEQ ID NO: 2117690 - RNA, 18 nt, Homo sapiens
accaacccuguuuccuga

SEQ ID NO: 2117691 - RNA, 18 nt, Homo sapiens
ccugacggcuggggaccc

SEQ ID NO: 2117692 - RNA, 20 nt, Homo sapiens
agaguacaccccaacagcac

SEQ ID NO: 2117693 - RNA, 12 nt, Homo sapiens
agauuaucuggg

SEQ ID NO: 2117694 - RNA, 16 nt, Homo sapiens
aacuuuuauaccuauc

SEQ ID NO: 2117695 - RNA, 21 nt, Homo sapiens
cucacgucucucuggcccacu

SEQ ID NO: 2117696 - RNA, 21 nt, Homo sapiens
aaaauaguuuuacauuaacau

SEQ ID NO: 2117697 - RNA, 17 nt, Homo sapiens
ccuucugugcugugagu

SEQ ID NO: 2117698 - RNA, 23 nt, Homo sapiens
ggauuucugcuuaggccccucag

SEQ ID NO: 2117699 - RNA, 11 nt, Homo sapiens
uugcuacugua

SEQ ID NO: 2117700 - RNA, 23 nt, Homo sapiens
ucgugggagagagacguguacau

SEQ ID NO: 2117701 - RNA, 18 nt, Homo sapiens
auggcuaguaucaaaaga

SEQ ID NO: 2117702 - RNA, 12 nt, Homo sapiens
cuuagauuuccc

SEQ ID NO: 2117703 - RNA, 21 nt, Homo sapiens
cugcagaagcagaagugcaau

SEQ ID NO: 2117704 - RNA, 17 nt, Homo sapiens
gcacuuuaacacagugu

SEQ ID NO: 2117705 - RNA, 20 nt, Homo sapiens
ccagaaaaccucuccugacc

SEQ ID NO: 2117706 - RNA, 14 nt, Homo sapiens
caacccugugaucu

SEQ ID NO: 2117707 - RNA, 22 nt, Homo sapiens
acccuccaagucuguaccucaa

SEQ ID NO: 2117708 - RNA, 17 nt, Homo sapiens
augcagaguaaguauua

SEQ ID NO: 2117709 - RNA, 14 nt, Homo sapiens
cagaggccaugaag

SEQ ID NO: 2117710 - RNA, 20 nt, Homo sapiens
cuuaaacucucuucuuccau

SEQ ID NO: 2117711 - RNA, 19 nt, Homo sapiens
caguguuauuuauucccca

SEQ ID NO: 2117712 - RNA, 19 nt, Homo sapiens
cuuuagcgggacucaguga

SEQ ID NO: 2117713 - RNA, 20 nt, Homo sapiens
agccauaguggaucacucac

SEQ ID NO: 2117714 - RNA, 17 nt, Homo sapiens
cccaggaccaagccaca

SEQ ID NO: 2117715 - RNA, 18 nt, Homo sapiens
uucuuuuucccuuuccuu

SEQ ID NO: 2117716 - RNA, 13 nt, Homo sapiens
cugccaagccacc

SEQ ID NO: 2117717 - RNA, 13 nt, Homo sapiens
uugaaaagucaaa

SEQ ID NO: 2117718 - RNA, 20 nt, Homo sapiens
uuuuaauuuuuugucaagac

SEQ ID NO: 2117719 - RNA, 17 nt, Homo sapiens
ugaggcaaccacaggca

SEQ ID NO: 2117720 - RNA, 16 nt, Homo sapiens
cuuugagaacaaugga

SEQ ID NO: 2117721 - RNA, 15 nt, Homo sapiens
uuuauugugaucuau

SEQ ID NO: 2117722 - RNA, 17 nt, Homo sapiens
caauuuuaaaucugaga

SEQ ID NO: 2117723 - RNA, 11 nt, Homo sapiens
acuucccugaa

SEQ ID NO: 2117724 - RNA, 21 nt, Homo sapiens
aguaggcaucaguaugucacu

SEQ ID NO: 2117725 - RNA, 20 nt, Homo sapiens
gcaaaccaggccacuugccu

SEQ ID NO: 2117726 - RNA, 22 nt, Homo sapiens
guagacuggggcgucaccucca

SEQ ID NO: 2117727 - RNA, 17 nt, Homo sapiens
cagacaagaaugugcac

SEQ ID NO: 2117728 - RNA, 17 nt, Homo sapiens
gucucaccuacccauga

SEQ ID NO: 2117729 - RNA, 16 nt, Homo sapiens
uaagcacaaagcccau

SEQ ID NO: 2117730 - RNA, 17 nt, Homo sapiens
uuaugucaccagaauau

SEQ ID NO: 2117731 - RNA, 14 nt, Homo sapiens
uuggcuuuuacuga

SEQ ID NO: 2117732 - RNA, 22 nt, Homo sapiens
guuccauuuuuccucuguucac

SEQ ID NO: 2117733 - RNA, 14 nt, Homo sapiens
ucuucaagaccaaa

SEQ ID NO: 2117734 - RNA, 19 nt, Homo sapiens
aagggcgccucaccugcuc

SEQ ID NO: 2117735 - RNA, 21 nt, Homo sapiens
auuguuagucucuugauucau

SEQ ID NO: 2117736 - RNA, 17 nt, Homo sapiens
accaagguucuuuuugu

SEQ ID NO: 2117737 - RNA, 23 nt, Homo sapiens
accuaauuguagcaucuaaugaa

SEQ ID NO: 2117738 - RNA, 20 nt, Homo sapiens
agcuggugccccaccugccu

SEQ ID NO: 2117739 - RNA, 15 nt, Homo sapiens
agguucacugagcuc

SEQ ID NO: 2117740 - RNA, 18 nt, Homo sapiens
cuacucaggaagguggga

SEQ ID NO: 2117741 - RNA, 23 nt, Homo sapiens
gggcuauuuuuucccccacaaac

SEQ ID NO: 2117742 - RNA, 15 nt, Homo sapiens
cacugcacccuccac

SEQ ID NO: 2117743 - RNA, 19 nt, Homo sapiens
gggggcgcgcuuaaauuuc

SEQ ID NO: 2117744 - RNA, 14 nt, Homo sapiens
auucaggcuuugga

SEQ ID NO: 2117745 - RNA, 17 nt, Homo sapiens
auccagcagcagcacuu

SEQ ID NO: 2117746 - RNA, 18 nt, Homo sapiens
gucuggcagggauggguu

SEQ ID NO: 2117747 - RNA, 15 nt, Homo sapiens
uucacggcaggacaa

SEQ ID NO: 2117748 - RNA, 14 nt, Homo sapiens
ggagaaugaugucc

SEQ ID NO: 2117749 - RNA, 21 nt, Homo sapiens
uaagggguugguaucucaggu

SEQ ID NO: 2117750 - RNA, 19 nt, Homo sapiens
augcuauugucagucagca

SEQ ID NO: 2117751 - RNA, 14 nt, Homo sapiens
cccuggugaugguc

SEQ ID NO: 2117752 - RNA, 23 nt, Homo sapiens
auauuuauuugacucagcacugu

SEQ ID NO: 2117753 - RNA, 16 nt, Homo sapiens
augcccaaccuauccu

SEQ ID NO: 2117754 - RNA, 14 nt, Homo sapiens
aaugauaguuuuca

SEQ ID NO: 2117755 - RNA, 22 nt, Homo sapiens
cccaguaaaaucaaaugugcau

SEQ ID NO: 2117756 - RNA, 15 nt, Homo sapiens
uccuccugaccucaa

SEQ ID NO: 2117757 - RNA, 23 nt, Homo sapiens
ccauuuucugugagaagugcaac

SEQ ID NO: 2117758 - RNA, 23 nt, Homo sapiens
gcagagcggguaaagugcaaugg

SEQ ID NO: 2117759 - RNA, 21 nt, Homo sapiens
cuugcgauaguuuacugagaa

SEQ ID NO: 2117760 - RNA, 18 nt, Homo sapiens
cauuugcugaauaugcaa

SEQ ID NO: 2117761 - RNA, 17 nt, Homo sapiens
cucagcucccacaagcc

SEQ ID NO: 2117762 - RNA, 19 nt, Homo sapiens
uuccccuuuucccaaccug

SEQ ID NO: 2117763 - RNA, 13 nt, Homo sapiens
ggauauuuacuau

SEQ ID NO: 2117764 - RNA, 14 nt, Homo sapiens
uaauuuuacacucu

SEQ ID NO: 2117765 - RNA, 20 nt, Homo sapiens
uucagaacagaggcauuuaa

SEQ ID NO: 2117766 - RNA, 15 nt, Homo sapiens
caaauccgcucucuu

SEQ ID NO: 2117767 - RNA, 19 nt, Homo sapiens
acucaugugacucuuucca

SEQ ID NO: 2117768 - RNA, 12 nt, Homo sapiens
aacauaugucac

SEQ ID NO: 2117769 - RNA, 13 nt, Homo sapiens
augcagcaucuaa

SEQ ID NO: 2117770 - RNA, 15 nt, Homo sapiens
cucuauuccaaaaag

SEQ ID NO: 2117771 - RNA, 17 nt, Homo sapiens
uuauacaaugauaucca

SEQ ID NO: 2117772 - RNA, 14 nt, Homo sapiens
uugaaaaggacucu

SEQ ID NO: 2117773 - RNA, 18 nt, Homo sapiens
ccagguuuaaacaucacu

SEQ ID NO: 2117774 - RNA, 18 nt, Homo sapiens
uuacuucuggcauaacua

SEQ ID NO: 2117775 - RNA, 17 nt, Homo sapiens
uuuacgguccaugccuu

SEQ ID NO: 2117776 - RNA, 21 nt, Homo sapiens
gccaaacaaaggcccagcagc

SEQ ID NO: 2117777 - RNA, 18 nt, Homo sapiens
auuauuuuucacugcccc

SEQ ID NO: 2117778 - RNA, 22 nt, Homo sapiens
cccuaccguccuccugagccac

SEQ ID NO: 2117779 - RNA, 23 nt, Homo sapiens
cuucaucauucccucucaucuca

SEQ ID NO: 2117780 - RNA, 20 nt, Homo sapiens
ucuaauauauccacacauuu

SEQ ID NO: 2117781 - RNA, 14 nt, Homo sapiens
aacucuugaccuca

SEQ ID NO: 2117782 - RNA, 13 nt, Homo sapiens
cagcuuauucaca

SEQ ID NO: 2117783 - RNA, 22 nt, Homo sapiens
gauaucauuuuaaaaacuuuau

SEQ ID NO: 2117784 - RNA, 17 nt, Homo sapiens
acagcccgggagcuuug

SEQ ID NO: 2117785 - RNA, 20 nt, Homo sapiens
uaaaauccaagcugcucauu

SEQ ID NO: 2117786 - RNA, 13 nt, Homo sapiens
auuuuuacauuca

SEQ ID NO: 2117787 - RNA, 22 nt, Homo sapiens
aauaugcuuauauuguucacuu

SEQ ID NO: 2117788 - RNA, 14 nt, Homo sapiens
acagaagcuguuuu

SEQ ID NO: 2117789 - RNA, 13 nt, Homo sapiens
gcacagauggauu

SEQ ID NO: 2117790 - RNA, 18 nt, Homo sapiens
uugugaacaagucccugu

SEQ ID NO: 2117791 - RNA, 18 nt, Homo sapiens
gcagaagcuggaggcaca

SEQ ID NO: 2117792 - RNA, 21 nt, Homo sapiens
cucuguggugguucauuccac

SEQ ID NO: 2117793 - RNA, 14 nt, Homo sapiens
uagaaaaacaggca

SEQ ID NO: 2117794 - RNA, 23 nt, Homo sapiens
agcaggaauauaugugugccuau

SEQ ID NO: 2117795 - RNA, 16 nt, Homo sapiens
uuugcacccaugccau

SEQ ID NO: 2117796 - RNA, 16 nt, Homo sapiens
cuccaaacaauucuga

SEQ ID NO: 2117797 - RNA, 17 nt, Homo sapiens
cuguagguuaaaugcag

SEQ ID NO: 2117798 - RNA, 23 nt, Homo sapiens
caugacuucuuuacuaacacugg

SEQ ID NO: 2117799 - RNA, 21 nt, Homo sapiens
ucacagccacaccuggacuga

SEQ ID NO: 2117800 - RNA, 23 nt, Homo sapiens
uagugaaguucuuuuacuguaau

SEQ ID NO: 2117801 - RNA, 22 nt, Homo sapiens
uaaauccuuugcuucauuccaa

SEQ ID NO: 2117802 - RNA, 15 nt, Homo sapiens
ccuggcacauucauu

SEQ ID NO: 2117803 - RNA, 17 nt, Homo sapiens
aauauuuugcacaguua

SEQ ID NO: 2117804 - RNA, 15 nt, Homo sapiens
auuucauaaacaacu

SEQ ID NO: 2117805 - RNA, 16 nt, Homo sapiens
gcacugcccaaagugc

SEQ ID NO: 2117806 - RNA, 19 nt, Homo sapiens
ucccaccugccacaguuca

SEQ ID NO: 2117807 - RNA, 15 nt, Homo sapiens
auuaaucaacuuucc

SEQ ID NO: 2117808 - RNA, 18 nt, Homo sapiens
ccaggugggugugggaca

SEQ ID NO: 2117809 - RNA, 14 nt, Homo sapiens
ucaaaggcaaugcu

SEQ ID NO: 2117810 - RNA, 17 nt, Homo sapiens
ccuguaaugcacuccug

SEQ ID NO: 2117811 - RNA, 12 nt, Homo sapiens
cuugaagccauc

SEQ ID NO: 2117812 - RNA, 19 nt, Homo sapiens
cuuugucuaauaaagagau

SEQ ID NO: 2117813 - RNA, 22 nt, Homo sapiens
cagagucuucuuugugccugag

SEQ ID NO: 2117814 - RNA, 15 nt, Homo sapiens
cuuuccaaaggccau

SEQ ID NO: 2117815 - RNA, 17 nt, Homo sapiens
ucucugauuccccaaau

SEQ ID NO: 2117816 - RNA, 13 nt, Homo sapiens
gaggcuagcaaag

SEQ ID NO: 2117817 - RNA, 20 nt, Homo sapiens
aaaugucugggaagcccucc

SEQ ID NO: 2117818 - RNA, 21 nt, Homo sapiens
acucgcuugagaugggaaagc

SEQ ID NO: 2117819 - RNA, 19 nt, Homo sapiens
accccuccccuaaugccug

SEQ ID NO: 2117820 - RNA, 12 nt, Homo sapiens
gucaaugacauc

SEQ ID NO: 2117821 - RNA, 13 nt, Homo sapiens
uccgaggccagua

SEQ ID NO: 2117822 - RNA, 13 nt, Homo sapiens
gaaccuuuccucu

SEQ ID NO: 2117823 - RNA, 15 nt, Homo sapiens
ucggugcauaccuua

SEQ ID NO: 2117824 - RNA, 16 nt, Homo sapiens
ugacagggaugccaac

SEQ ID NO: 2117825 - RNA, 13 nt, Homo sapiens
gagagaccaggca

SEQ ID NO: 2117826 - RNA, 11 nt, Homo sapiens
cacaacacaga

SEQ ID NO: 2117827 - RNA, 17 nt, Homo sapiens
guuuuuaaaaaggccuu

SEQ ID NO: 2117828 - RNA, 18 nt, Homo sapiens
aggcauccaguaucuuga

SEQ ID NO: 2117829 - RNA, 17 nt, Homo sapiens
ggccauaaacgguuccu

SEQ ID NO: 2117830 - RNA, 22 nt, Homo sapiens
ucuaggucaguacccaccugag

SEQ ID NO: 2117831 - RNA, 22 nt, Homo sapiens
acuacaugaaauaaugcacuga

SEQ ID NO: 2117832 - RNA, 15 nt, Homo sapiens
ugagccacucagagc

SEQ ID NO: 2117833 - RNA, 13 nt, Homo sapiens
cguucagcuguga

SEQ ID NO: 2117834 - RNA, 16 nt, Homo sapiens
agcaaaagcagaacac

SEQ ID NO: 2117835 - RNA, 20 nt, Homo sapiens
agauuuauguaaugcuuuau

SEQ ID NO: 2117836 - RNA, 17 nt, Homo sapiens
uaaggcucugugccuug

SEQ ID NO: 2117837 - RNA, 11 nt, Homo sapiens
ugaaguggcac

SEQ ID NO: 2117838 - RNA, 18 nt, Homo sapiens
agauuuugcaaucugugu

SEQ ID NO: 2117839 - RNA, 15 nt, Homo sapiens
ugaaaacuggauuau

SEQ ID NO: 2117840 - RNA, 19 nt, Homo sapiens
cauuaggucccucacucca

SEQ ID NO: 2117841 - RNA, 15 nt, Homo sapiens
guaauucccaaaacu

SEQ ID NO: 2117842 - RNA, 19 nt, Homo sapiens
cugcaacaggcuugugcaa

SEQ ID NO: 2117843 - RNA, 16 nt, Homo sapiens
auauuaaauguugcuu

SEQ ID NO: 2117844 - RNA, 23 nt, Homo sapiens
gccacaugggaaacuuccaagac

SEQ ID NO: 2117845 - RNA, 14 nt, Homo sapiens
ugggaaccuucaua

SEQ ID NO: 2117846 - RNA, 22 nt, Homo sapiens
gggacguuucuggaacugucug

SEQ ID NO: 2117847 - RNA, 15 nt, Homo sapiens
ucugcaugagcugau

SEQ ID NO: 2117848 - RNA, 15 nt, Homo sapiens
gaguuauuuuguguc

SEQ ID NO: 2117849 - RNA, 21 nt, Homo sapiens
cgaacuuggguuugcgcuaaa

SEQ ID NO: 2117850 - RNA, 14 nt, Homo sapiens
cauguaauguguac

SEQ ID NO: 2117851 - RNA, 18 nt, Homo sapiens
cuacaacaugauagaacu

SEQ ID NO: 2117852 - RNA, 15 nt, Homo sapiens
gacucaucauuuaau

SEQ ID NO: 2117853 - RNA, 14 nt, Homo sapiens
ggagcaaauguuuc

SEQ ID NO: 2117854 - RNA, 18 nt, Homo sapiens
ugccuuauuaaagcaaaa

SEQ ID NO: 2117855 - RNA, 23 nt, Homo sapiens
uaauuucagugggaaauaugcca

SEQ ID NO: 2117856 - RNA, 15 nt, Homo sapiens
cuaauuuaguucuca

SEQ ID NO: 2117857 - RNA, 14 nt, Homo sapiens
ccaauacccuguaa

SEQ ID NO: 2117858 - RNA, 21 nt, Homo sapiens
aaguacuuuucuguucaucac

SEQ ID NO: 2117859 - RNA, 16 nt, Homo sapiens
aagcagaacagugauu

SEQ ID NO: 2117860 - RNA, 19 nt, Homo sapiens
ccguagcucugcugcugau

SEQ ID NO: 2117861 - RNA, 22 nt, Homo sapiens
acauaugguuaaguaauugcau

SEQ ID NO: 2117862 - RNA, 23 nt, Homo sapiens
uaggccucaacuccucccauaga

SEQ ID NO: 2117863 - RNA, 14 nt, Homo sapiens
cuacaccugucauu

SEQ ID NO: 2117864 - RNA, 20 nt, Homo sapiens
aucugucgcauuucaucaag

SEQ ID NO: 2117865 - RNA, 21 nt, Homo sapiens
aauguuggagcagcaggccuc

SEQ ID NO: 2117866 - RNA, 14 nt, Homo sapiens
uggcagccaguacc

SEQ ID NO: 2117867 - RNA, 19 nt, Homo sapiens
aaucuuuuugcuucuacuu

SEQ ID NO: 2117868 - RNA, 23 nt, Homo sapiens
uguagaaaaaaaaauucacauga

SEQ ID NO: 2117869 - RNA, 18 nt, Homo sapiens
cuagauuccauacaguga

SEQ ID NO: 2117870 - RNA, 22 nt, Homo sapiens
gaucucucgagcugucuugcug

SEQ ID NO: 2117871 - RNA, 20 nt, Homo sapiens
aaugacacccugaucuucac

SEQ ID NO: 2117872 - RNA, 17 nt, Homo sapiens
gcuaguacucaguacua

SEQ ID NO: 2117873 - RNA, 12 nt, Homo sapiens
aucuucagcucc

SEQ ID NO: 2117874 - RNA, 21 nt, Homo sapiens
guccauguccuaugccucaca

SEQ ID NO: 2117875 - RNA, 22 nt, Homo sapiens
ugcaagccuccugaucaggaaa

SEQ ID NO: 2117876 - RNA, 11 nt, Homo sapiens
agagugcagaa

SEQ ID NO: 2117877 - RNA, 13 nt, Homo sapiens
guuguuguuaaca

SEQ ID NO: 2117878 - RNA, 12 nt, Homo sapiens
caccacagagaa

SEQ ID NO: 2117879 - RNA, 21 nt, Homo sapiens
uuacuuauaaaauacaucuca

SEQ ID NO: 2117880 - RNA, 14 nt, Homo sapiens
caaccagagcagcu

SEQ ID NO: 2117881 - RNA, 22 nt, Homo sapiens
gacagcucucugggcacccggu

SEQ ID NO: 2117882 - RNA, 21 nt, Homo sapiens
gccacguguucucacacuggu

SEQ ID NO: 2117883 - RNA, 13 nt, Homo sapiens
agauauugguuua

SEQ ID NO: 2117884 - RNA, 23 nt, Homo sapiens
ugagaaauaaaaagccugucauu

SEQ ID NO: 2117885 - RNA, 15 nt, Homo sapiens
cugccgucugugcuu

SEQ ID NO: 2117886 - RNA, 12 nt, Homo sapiens
auggaccaaagc

SEQ ID NO: 2117887 - RNA, 17 nt, Homo sapiens
auuagcaccagcuugcu

SEQ ID NO: 2117888 - RNA, 13 nt, Homo sapiens
agaacaguaucuu

SEQ ID NO: 2117889 - RNA, 14 nt, Homo sapiens
acccgaugcugcuu

SEQ ID NO: 2117890 - RNA, 14 nt, Homo sapiens
uuucaacauaugaa

SEQ ID NO: 2117891 - RNA, 14 nt, Homo sapiens
gaggagcagugcag

SEQ ID NO: 2117892 - RNA, 16 nt, Homo sapiens
augaaaaacaucccaa

SEQ ID NO: 2117893 - RNA, 19 nt, Homo sapiens
guagugucacugcuuguua

SEQ ID NO: 2117894 - RNA, 17 nt, Homo sapiens
aaauacaugcacaguca

SEQ ID NO: 2117895 - RNA, 15 nt, Homo sapiens
uuugccuucacccau

SEQ ID NO: 2117896 - RNA, 14 nt, Homo sapiens
ugagcacuacucua

SEQ ID NO: 2117897 - RNA, 13 nt, Homo sapiens
ucuugcuacugaa

SEQ ID NO: 2117898 - RNA, 21 nt, Homo sapiens
ugccugugcaugaccugauca

SEQ ID NO: 2117899 - RNA, 22 nt, Homo sapiens
auggggagagccuuugccucca

SEQ ID NO: 2117900 - RNA, 17 nt, Homo sapiens
auauauaguuagcuuua

SEQ ID NO: 2117901 - RNA, 22 nt, Homo sapiens
agacccugguuuuuuuccugug

SEQ ID NO: 2117902 - RNA, 21 nt, Homo sapiens
gucccagcggaugcugccagg

SEQ ID NO: 2117903 - RNA, 18 nt, Homo sapiens
aaguuuuccaguauugaa

SEQ ID NO: 2117904 - RNA, 22 nt, Homo sapiens
agaaaauucuaaaucaauuauu

SEQ ID NO: 2117905 - RNA, 15 nt, Homo sapiens
acuauuuaguggaac

SEQ ID NO: 2117906 - RNA, 18 nt, Homo sapiens
gccuaucuggaagccacc

SEQ ID NO: 2117907 - RNA, 17 nt, Homo sapiens
uucuuaaaaaacauaua

SEQ ID NO: 2117908 - RNA, 22 nt, Homo sapiens
cagaagaggagacaguuuacca

SEQ ID NO: 2117909 - RNA, 21 nt, Homo sapiens
gugaggggagauuugcaccua

SEQ ID NO: 2117910 - RNA, 23 nt, Homo sapiens
ugugauuggcugguuaaugggaa

SEQ ID NO: 2117911 - RNA, 16 nt, Homo sapiens
ccaauaugaaaaccgu

SEQ ID NO: 2117912 - RNA, 20 nt, Homo sapiens
gcauagggucacuuugccau

SEQ ID NO: 2117913 - RNA, 14 nt, Homo sapiens
gagugugcugcuau

SEQ ID NO: 2117914 - RNA, 18 nt, Homo sapiens
agguucggacuaacauuu

SEQ ID NO: 2117915 - RNA, 21 nt, Homo sapiens
aauguuaacuguucuuggaaa

SEQ ID NO: 2117916 - RNA, 20 nt, Homo sapiens
acugacuucauuugugccac

SEQ ID NO: 2117917 - RNA, 20 nt, Homo sapiens
auaauguccuuucccuggag

SEQ ID NO: 2117918 - RNA, 19 nt, Homo sapiens
aaaaucacaaacucaucca

SEQ ID NO: 2117919 - RNA, 20 nt, Homo sapiens
acggggggcuccugcccagg

SEQ ID NO: 2117920 - RNA, 14 nt, Homo sapiens
aaucauacuuucuc

SEQ ID NO: 2117921 - RNA, 21 nt, Homo sapiens
uguuuccugaauaccagugga

SEQ ID NO: 2117922 - RNA, 20 nt, Homo sapiens
ugagccagagacaaggucac

SEQ ID NO: 2117923 - RNA, 14 nt, Homo sapiens
caucguuugcaaau

SEQ ID NO: 2117924 - RNA, 15 nt, Homo sapiens
aucaauguaauguca

SEQ ID NO: 2117925 - RNA, 16 nt, Homo sapiens
cugcgugccuguggaa

SEQ ID NO: 2117926 - RNA, 22 nt, Homo sapiens
acugcucaagagaagcacauga

SEQ ID NO: 2117927 - RNA, 18 nt, Homo sapiens
ggacugagcccaugacac

SEQ ID NO: 2117928 - RNA, 18 nt, Homo sapiens
uaaacgcuccccucagac

SEQ ID NO: 2117929 - RNA, 12 nt, Homo sapiens
agacucuaccag

SEQ ID NO: 2117930 - RNA, 20 nt, Homo sapiens
aacccgugacuguuacuuua

SEQ ID NO: 2117931 - RNA, 19 nt, Homo sapiens
cuuaaacuacaaacacaag

SEQ ID NO: 2117932 - RNA, 11 nt, Homo sapiens
aacccaaagau

SEQ ID NO: 2117933 - RNA, 16 nt, Homo sapiens
uaggcggggcuugccu

SEQ ID NO: 2117934 - RNA, 19 nt, Homo sapiens
aggaaucuaaacaaacagg

SEQ ID NO: 2117935 - RNA, 19 nt, Homo sapiens
aguuaccugguagaucaag

SEQ ID NO: 2117936 - RNA, 15 nt, Homo sapiens
gcccuccagggccag

SEQ ID NO: 2117937 - RNA, 14 nt, Homo sapiens
uaaauucaucuaga

SEQ ID NO: 2117938 - RNA, 15 nt, Homo sapiens
caaauaacagcuuuc

SEQ ID NO: 2117939 - RNA, 15 nt, Homo sapiens
acccuccaaggccag

SEQ ID NO: 2117940 - RNA, 12 nt, Homo sapiens
auauuuacaugc

SEQ ID NO: 2117941 - RNA, 18 nt, Homo sapiens
agugcuguccaugcuucu

SEQ ID NO: 2117942 - RNA, 20 nt, Homo sapiens
aucucuaauuccauccauaa

SEQ ID NO: 2117943 - RNA, 20 nt, Homo sapiens
agggagaaccucuccaaaga

SEQ ID NO: 2117944 - RNA, 15 nt, Homo sapiens
ucuccaccugugcuu

SEQ ID NO: 2117945 - RNA, 14 nt, Homo sapiens
caagugaaggagcu

SEQ ID NO: 2117946 - RNA, 18 nt, Homo sapiens
ccagagcccugaguuucu

SEQ ID NO: 2117947 - RNA, 20 nt, Homo sapiens
gcacaaauugggccaaagaa

SEQ ID NO: 2117948 - RNA, 16 nt, Homo sapiens
ccuggaacauccuuug

SEQ ID NO: 2117949 - RNA, 17 nt, Homo sapiens
ugcuuccgcugcuugaa

SEQ ID NO: 2117950 - RNA, 20 nt, Homo sapiens
ugagacccccaucucuacaa

SEQ ID NO: 2117951 - RNA, 15 nt, Homo sapiens
caacaauugguaaaa

SEQ ID NO: 2117952 - RNA, 20 nt, Homo sapiens
agguuugauucaacacuuaa

SEQ ID NO: 2117953 - RNA, 19 nt, Homo sapiens
acguauuuaugucccugac

SEQ ID NO: 2117954 - RNA, 20 nt, Homo sapiens
aucugaguugccaagacaaa

SEQ ID NO: 2117955 - RNA, 19 nt, Homo sapiens
cucauccuggcacgcccua

SEQ ID NO: 2117956 - RNA, 20 nt, Homo sapiens
caugugaaguuuugcaaaua

SEQ ID NO: 2117957 - RNA, 12 nt, Homo sapiens
uaacaaccugga

SEQ ID NO: 2117958 - RNA, 18 nt, Homo sapiens
caaacauugagacugcua

SEQ ID NO: 2117959 - RNA, 21 nt, Homo sapiens
ugccuucucacaucuguccag

SEQ ID NO: 2117960 - RNA, 23 nt, Homo sapiens
ggcaggaggcuuuggguggcuca

SEQ ID NO: 2117961 - RNA, 18 nt, Homo sapiens
ucauauugcaucauaguu

SEQ ID NO: 2117962 - RNA, 17 nt, Homo sapiens
ucgcauggcagccauca

SEQ ID NO: 2117963 - RNA, 21 nt, Homo sapiens
augaccugggaggacucucuu

SEQ ID NO: 2117964 - RNA, 20 nt, Homo sapiens
gaccagagggacacuaggaa

SEQ ID NO: 2117965 - RNA, 17 nt, Homo sapiens
auucuauucuccagaca

SEQ ID NO: 2117966 - RNA, 20 nt, Homo sapiens
augagccuggcaagaaugug

SEQ ID NO: 2117967 - RNA, 15 nt, Homo sapiens
augcaagugcaaaag

SEQ ID NO: 2117968 - RNA, 19 nt, Homo sapiens
uugccaucaccccaaacaa

SEQ ID NO: 2117969 - RNA, 18 nt, Homo sapiens
aaggcaagucaaauacca

SEQ ID NO: 2117970 - RNA, 15 nt, Homo sapiens
cagccaguacaguau

SEQ ID NO: 2117971 - RNA, 14 nt, Homo sapiens
agaaaauaugauau

SEQ ID NO: 2117972 - RNA, 12 nt, Homo sapiens
uucauauuucaa

SEQ ID NO: 2117973 - RNA, 13 nt, Homo sapiens
aaacuuagccaga

SEQ ID NO: 2117974 - RNA, 14 nt, Homo sapiens
cacacgugugcauu

SEQ ID NO: 2117975 - RNA, 14 nt, Homo sapiens
acguggacuccucu

SEQ ID NO: 2117976 - RNA, 14 nt, Homo sapiens
cuauggccuugcua

SEQ ID NO: 2117977 - RNA, 22 nt, Homo sapiens
auuguucacuucuaaaccaaaa

SEQ ID NO: 2117978 - RNA, 18 nt, Homo sapiens
ggagcccuauugcugcua

SEQ ID NO: 2117979 - RNA, 19 nt, Homo sapiens
cugcuuuuaaaugaccaaa

SEQ ID NO: 2117980 - RNA, 14 nt, Homo sapiens
accuuuuacuguga

SEQ ID NO: 2117981 - RNA, 18 nt, Homo sapiens
ucuucaaauuaaagugcu

SEQ ID NO: 2117982 - RNA, 19 nt, Homo sapiens
ccaaaaaggaacacuggaa

SEQ ID NO: 2117983 - RNA, 13 nt, Homo sapiens
caaggcagugcau

SEQ ID NO: 2117984 - RNA, 15 nt, Homo sapiens
gagaugaccagggau

SEQ ID NO: 2117985 - RNA, 13 nt, Homo sapiens
ccaccacauagca

SEQ ID NO: 2117986 - RNA, 14 nt, Homo sapiens
aaaucaguuacuaa

SEQ ID NO: 2117987 - RNA, 12 nt, Homo sapiens
ucuuugcaugga

SEQ ID NO: 2117988 - RNA, 18 nt, Homo sapiens
ccuuccucaguccuggaa

SEQ ID NO: 2117989 - RNA, 20 nt, Homo sapiens
uacauacuggccucugugau

SEQ ID NO: 2117990 - RNA, 11 nt, Homo sapiens
cccccaaaauu

SEQ ID NO: 2117991 - RNA, 20 nt, Homo sapiens
aucacaaaccaagccaugcu

SEQ ID NO: 2117992 - RNA, 14 nt, Homo sapiens
agaccgaaucucac

SEQ ID NO: 2117993 - RNA, 22 nt, Homo sapiens
cccuagucaucguuugugugua

SEQ ID NO: 2117994 - RNA, 18 nt, Homo sapiens
accuucccuaccaaaggg

SEQ ID NO: 2117995 - RNA, 21 nt, Homo sapiens
gccugcccagugcacuugcug

SEQ ID NO: 2117996 - RNA, 17 nt, Homo sapiens
cagcaccuccuccaugc

SEQ ID NO: 2117997 - RNA, 14 nt, Homo sapiens
auccaacuccucua

SEQ ID NO: 2117998 - RNA, 18 nt, Homo sapiens
augcucuuguucuguucc

SEQ ID NO: 2117999 - RNA, 13 nt, Homo sapiens
gggcaucucaagc

SEQ ID NO: 2118000 - RNA, 14 nt, Homo sapiens
ccuacucuguguca

SEQ ID NO: 2118001 - RNA, 23 nt, Homo sapiens
aguucccuacgugaaccugccuu

SEQ ID NO: 2118002 - RNA, 20 nt, Homo sapiens
cccugggccaaaaccaaugc

SEQ ID NO: 2118003 - RNA, 12 nt, Homo sapiens
auaccguuuaua

SEQ ID NO: 2118004 - RNA, 16 nt, Homo sapiens
aaucuuaccagucugu

SEQ ID NO: 2118005 - RNA, 16 nt, Homo sapiens
gucccucucagugccu

SEQ ID NO: 2118006 - RNA, 19 nt, Homo sapiens
ucuauaguugucaguauua

SEQ ID NO: 2118007 - RNA, 23 nt, Homo sapiens
uguacacaaaggauuugaugcuu

SEQ ID NO: 2118008 - RNA, 13 nt, Homo sapiens
ugccucuuggccu

SEQ ID NO: 2118009 - RNA, 14 nt, Homo sapiens
caguaucucuucag

SEQ ID NO: 2118010 - RNA, 22 nt, Homo sapiens
agccuguggccccgaggcuggg

SEQ ID NO: 2118011 - RNA, 14 nt, Homo sapiens
ugucaccuugauga

SEQ ID NO: 2118012 - RNA, 12 nt, Homo sapiens
auacuuuacuuu

SEQ ID NO: 2118013 - RNA, 13 nt, Homo sapiens
gccacaccaccua

SEQ ID NO: 2118014 - RNA, 22 nt, Homo sapiens
gcuaagacccaaacauaugcac

SEQ ID NO: 2118015 - RNA, 16 nt, Homo sapiens
cucauuacuacccucc

SEQ ID NO: 2118016 - RNA, 16 nt, Homo sapiens
uguuaaaguggucuga

SEQ ID NO: 2118017 - RNA, 18 nt, Homo sapiens
aaaugugugccauauucu

SEQ ID NO: 2118018 - RNA, 18 nt, Homo sapiens
gacaacaguucugagcug

SEQ ID NO: 2118019 - RNA, 14 nt, Homo sapiens
cuaacucccuaggc

SEQ ID NO: 2118020 - RNA, 14 nt, Homo sapiens
ugaauucauguugg

SEQ ID NO: 2118021 - RNA, 14 nt, Homo sapiens
uccugauacugggu

SEQ ID NO: 2118022 - RNA, 21 nt, Homo sapiens
ugcaacuuagcucacaccuga

SEQ ID NO: 2118023 - RNA, 16 nt, Homo sapiens
cugaaaccccaucucc

SEQ ID NO: 2118024 - RNA, 21 nt, Homo sapiens
ugguauggacaaaauugcaga

SEQ ID NO: 2118025 - RNA, 20 nt, Homo sapiens
gcccaggauggagugcaaug

SEQ ID NO: 2118026 - RNA, 18 nt, Homo sapiens
aagugcgugaauguaugu

SEQ ID NO: 2118027 - RNA, 15 nt, Homo sapiens
agguauuagugcuag

SEQ ID NO: 2118028 - RNA, 21 nt, Homo sapiens
aagacauccugagcagugcca

SEQ ID NO: 2118029 - RNA, 17 nt, Homo sapiens
uugcucaaaaucuguga

SEQ ID NO: 2118030 - RNA, 15 nt, Homo sapiens
acccgcauguacaaa

SEQ ID NO: 2118031 - RNA, 14 nt, Homo sapiens
cacugccagugcag

SEQ ID NO: 2118032 - RNA, 14 nt, Homo sapiens
agugguacuucagg

SEQ ID NO: 2118033 - RNA, 24 nt, Homo sapiens
aauuggcuuuucauagugcucaga

SEQ ID NO: 2118034 - RNA, 19 nt, Homo sapiens
gaguacuuugaagauguca

SEQ ID NO: 2118035 - RNA, 14 nt, Homo sapiens
aucagaguauguca

SEQ ID NO: 2118036 - RNA, 19 nt, Homo sapiens
uuuaguuugaucagacagc

SEQ ID NO: 2118037 - RNA, 19 nt, Homo sapiens
uguuggaaauguaguauag

SEQ ID NO: 2118038 - RNA, 14 nt, Homo sapiens
agcccauagcuauu

SEQ ID NO: 2118039 - RNA, 15 nt, Homo sapiens
gagcguuacuguaga

SEQ ID NO: 2118040 - RNA, 19 nt, Homo sapiens
acugaguacguugugcauu

SEQ ID NO: 2118041 - RNA, 19 nt, Homo sapiens
uauucuuuuauauaacuac

SEQ ID NO: 2118042 - RNA, 13 nt, Homo sapiens
ucugaaacacagu

SEQ ID NO: 2118043 - RNA, 22 nt, Homo sapiens
gaaauagugauuuccacaguga

SEQ ID NO: 2118044 - RNA, 23 nt, Homo sapiens
aacauuuguuccgugucuggcca

SEQ ID NO: 2118045 - RNA, 19 nt, Homo sapiens
acugguucauucuacguau

SEQ ID NO: 2118046 - RNA, 16 nt, Homo sapiens
gucaacaaagugcuuu

SEQ ID NO: 2118047 - RNA, 23 nt, Homo sapiens
aaguacuuuuggcauuuuacugu

SEQ ID NO: 2118048 - RNA, 18 nt, Homo sapiens
uuggcaugaaagugcgau

SEQ ID NO: 2118049 - RNA, 20 nt, Homo sapiens
cgugauaaugcagacuuccu

SEQ ID NO: 2118050 - RNA, 13 nt, Homo sapiens
caagcacaaagcu

SEQ ID NO: 2118051 - RNA, 14 nt, Homo sapiens
cuuuuucuaccuuu

SEQ ID NO: 2118052 - RNA, 22 nt, Homo sapiens
cagagucguuggagacugaaga

SEQ ID NO: 2118053 - RNA, 17 nt, Homo sapiens
gggagccuguccuucca

SEQ ID NO: 2118054 - RNA, 20 nt, Homo sapiens
ugaacaauuaugaacaucca

SEQ ID NO: 2118055 - RNA, 17 nt, Homo sapiens
acucuacucaacccauu

SEQ ID NO: 2118056 - RNA, 17 nt, Homo sapiens
cuccaccucuaccaaaa

SEQ ID NO: 2118057 - RNA, 16 nt, Homo sapiens
cccuucagguguuacu

SEQ ID NO: 2118058 - RNA, 15 nt, Homo sapiens
uccuuuugaccaaau

SEQ ID NO: 2118059 - RNA, 17 nt, Homo sapiens
cacaaaagaagaaauaa

SEQ ID NO: 2118060 - RNA, 15 nt, Homo sapiens
guuucacuugcacau

SEQ ID NO: 2118061 - RNA, 20 nt, Homo sapiens
ugccccccuccuuuccaaau

SEQ ID NO: 2118062 - RNA, 14 nt, Homo sapiens
aagagggaauagua

SEQ ID NO: 2118063 - RNA, 19 nt, Homo sapiens
aauccuuuacuguuaguca

SEQ ID NO: 2118064 - RNA, 18 nt, Homo sapiens
uugaauaccagcuuucua

SEQ ID NO: 2118065 - RNA, 12 nt, Homo sapiens
guccucagucca

SEQ ID NO: 2118066 - RNA, 12 nt, Homo sapiens
guuaucagucuc

SEQ ID NO: 2118067 - RNA, 13 nt, Homo sapiens
cccuugacuguua

SEQ ID NO: 2118068 - RNA, 18 nt, Homo sapiens
ggucugcaagucagagga

SEQ ID NO: 2118069 - RNA, 15 nt, Homo sapiens
caaggaaagggcagu

SEQ ID NO: 2118070 - RNA, 14 nt, Homo sapiens
caacuucccaaagc

SEQ ID NO: 2118071 - RNA, 15 nt, Homo sapiens
gcuuccaugauucua

SEQ ID NO: 2118072 - RNA, 18 nt, Homo sapiens
acugaucaccuguuagca

SEQ ID NO: 2118073 - RNA, 17 nt, Homo sapiens
ucuggauggugugccuu

SEQ ID NO: 2118074 - RNA, 21 nt, Homo sapiens
caaaaaguuuaucacacagug

SEQ ID NO: 2118075 - RNA, 22 nt, Homo sapiens
aaaucuauucuguguugcauua

SEQ ID NO: 2118076 - RNA, 14 nt, Homo sapiens
uaugagauugggua

SEQ ID NO: 2118077 - RNA, 21 nt, Homo sapiens
uuggacagcuacuucugggaa

SEQ ID NO: 2118078 - RNA, 17 nt, Homo sapiens
ucaaacugcaugauuca

SEQ ID NO: 2118079 - RNA, 20 nt, Homo sapiens
accuguccaggugaguguga

SEQ ID NO: 2118080 - RNA, 19 nt, Homo sapiens
agucacacuuuaaauuaag

SEQ ID NO: 2118081 - RNA, 23 nt, Homo sapiens
uauguucuggacagcuaaaucau

SEQ ID NO: 2118082 - RNA, 12 nt, Homo sapiens
ggugaaauccag

SEQ ID NO: 2118083 - RNA, 22 nt, Homo sapiens
gcaaaauggaagcaaagacaaa

SEQ ID NO: 2118084 - RNA, 22 nt, Homo sapiens
gacagcucagaaaaucaaagag

SEQ ID NO: 2118085 - RNA, 15 nt, Homo sapiens
uggcguuacugcuug

SEQ ID NO: 2118086 - RNA, 20 nt, Homo sapiens
caccuccuguguugugcugg

SEQ ID NO: 2118087 - RNA, 17 nt, Homo sapiens
ucaaccccucacaggag

SEQ ID NO: 2118088 - RNA, 15 nt, Homo sapiens
agaaaugacuguggu

SEQ ID NO: 2118089 - RNA, 12 nt, Homo sapiens
aauuuacuugau

SEQ ID NO: 2118090 - RNA, 17 nt, Homo sapiens
ccuacuuacaugcauua

SEQ ID NO: 2118091 - RNA, 23 nt, Homo sapiens
acaaaauuagcugaagaaguuau

SEQ ID NO: 2118092 - RNA, 20 nt, Homo sapiens
uaagaauuguuuuugaauuu

SEQ ID NO: 2118093 - RNA, 21 nt, Homo sapiens
cuuugcauagcagcugcuacu

SEQ ID NO: 2118094 - RNA, 20 nt, Homo sapiens
ccuuuuuuccccagacuugu

SEQ ID NO: 2118095 - RNA, 22 nt, Homo sapiens
accucaacugccuacuccaaaa

SEQ ID NO: 2118096 - RNA, 23 nt, Homo sapiens
aggguguaucuagcucuaguuca

SEQ ID NO: 2118097 - RNA, 21 nt, Homo sapiens
gcacugcuaggcgagugccag

SEQ ID NO: 2118098 - RNA, 14 nt, Homo sapiens
acaagauugcuuaa

SEQ ID NO: 2118099 - RNA, 15 nt, Homo sapiens
guauguguaccuaag

SEQ ID NO: 2118100 - RNA, 20 nt, Homo sapiens
agagcgcaagcugggagcac

SEQ ID NO: 2118101 - RNA, 21 nt, Homo sapiens
uuccagguagcugaaagggga

SEQ ID NO: 2118102 - RNA, 15 nt, Homo sapiens
uuacagcugagcaca

SEQ ID NO: 2118103 - RNA, 22 nt, Homo sapiens
aaaaguuggucaggcgcagugg

SEQ ID NO: 2118104 - RNA, 20 nt, Homo sapiens
aauaaaguuguugcauuccc

SEQ ID NO: 2118105 - RNA, 24 nt, Homo sapiens
acauggugaaaaccccaucucuac

SEQ ID NO: 2118106 - RNA, 21 nt, Homo sapiens
uaggucccuuggucuguacaa

SEQ ID NO: 2118107 - RNA, 17 nt, Homo sapiens
uuauaaaaaaugguuca

SEQ ID NO: 2118108 - RNA, 13 nt, Homo sapiens
guauuccacuuag

SEQ ID NO: 2118109 - RNA, 13 nt, Homo sapiens
aucagccuucaag

SEQ ID NO: 2118110 - RNA, 21 nt, Homo sapiens
uaagcaugacgggaaaaccaa

SEQ ID NO: 2118111 - RNA, 12 nt, Homo sapiens
agacaacucuac

SEQ ID NO: 2118112 - RNA, 22 nt, Homo sapiens
accuguucacgugacuccucaa

SEQ ID NO: 2118113 - RNA, 21 nt, Homo sapiens
caucaaaaucugcacagucac

SEQ ID NO: 2118114 - RNA, 19 nt, Homo sapiens
cuacugggaaauuacuuau

SEQ ID NO: 2118115 - RNA, 19 nt, Homo sapiens
gcagaacguauuuagccau

SEQ ID NO: 2118116 - RNA, 18 nt, Homo sapiens
ugcaguacaggacauaua

SEQ ID NO: 2118117 - RNA, 11 nt, Homo sapiens
gacaacucugu

SEQ ID NO: 2118118 - RNA, 18 nt, Homo sapiens
cauggggccccucucauc

SEQ ID NO: 2118119 - RNA, 18 nt, Homo sapiens
uccuuuuaguauucuuag

SEQ ID NO: 2118120 - RNA, 18 nt, Homo sapiens
auaucccuuccucucagg

SEQ ID NO: 2118121 - RNA, 15 nt, Homo sapiens
aagcucagcuuagaa

SEQ ID NO: 2118122 - RNA, 16 nt, Homo sapiens
cacguauguuauacaa

SEQ ID NO: 2118123 - RNA, 20 nt, Homo sapiens
gagacugacaccucacugag

SEQ ID NO: 2118124 - RNA, 16 nt, Homo sapiens
gcugucuggggccuuu

SEQ ID NO: 2118125 - RNA, 20 nt, Homo sapiens
ccacccauaauaagagaaug

SEQ ID NO: 2118126 - RNA, 23 nt, Homo sapiens
cuuuuguuguacuuuauaucuug

SEQ ID NO: 2118127 - RNA, 16 nt, Homo sapiens
cuaugauccacaaaaa

SEQ ID NO: 2118128 - RNA, 16 nt, Homo sapiens
ccuucagcuccaggga

SEQ ID NO: 2118129 - RNA, 19 nt, Homo sapiens
cauccgggaggacaaccag

SEQ ID NO: 2118130 - RNA, 14 nt, Homo sapiens
ccacgacauggcug

SEQ ID NO: 2118131 - RNA, 20 nt, Homo sapiens
uacuuauuguauuuaugugu

SEQ ID NO: 2118132 - RNA, 17 nt, Homo sapiens
uaaauaugaaugaacaa

SEQ ID NO: 2118133 - RNA, 21 nt, Homo sapiens
uaaacugaagcugcuguaacu

SEQ ID NO: 2118134 - RNA, 20 nt, Homo sapiens
aaucagauuauuaagggaau

SEQ ID NO: 2118135 - RNA, 19 nt, Homo sapiens
aaccacucauaauucuuca

SEQ ID NO: 2118136 - RNA, 18 nt, Homo sapiens
cuggaucacgacgcugca

SEQ ID NO: 2118137 - RNA, 23 nt, Homo sapiens
uuuauaguacuaguuuugcuuua

SEQ ID NO: 2118138 - RNA, 16 nt, Homo sapiens
uuaguagagacagggu

SEQ ID NO: 2118139 - RNA, 19 nt, Homo sapiens
gaaacccguguaucuggga

SEQ ID NO: 2118140 - RNA, 22 nt, Homo sapiens
acgggacccugagccugugugu

SEQ ID NO: 2118141 - RNA, 21 nt, Homo sapiens
aacaugcggugccaugaaggg

SEQ ID NO: 2118142 - RNA, 19 nt, Homo sapiens
uccuccuccagggacagca

SEQ ID NO: 2118143 - RNA, 19 nt, Homo sapiens
cuuaaugacuuacuuagaa

SEQ ID NO: 2118144 - RNA, 21 nt, Homo sapiens
guaugcauucuuuauagugaa

SEQ ID NO: 2118145 - RNA, 16 nt, Homo sapiens
gagacugcuugacaaa

SEQ ID NO: 2118146 - RNA, 17 nt, Homo sapiens
auaagccagugagacca

SEQ ID NO: 2118147 - RNA, 22 nt, Homo sapiens
ucauaacaacuuaugacuaaaa

SEQ ID NO: 2118148 - RNA, 12 nt, Homo sapiens
auuuaaaaggga

SEQ ID NO: 2118149 - RNA, 17 nt, Homo sapiens
gaacauguaugauuucu

SEQ ID NO: 2118150 - RNA, 22 nt, Homo sapiens
uugagcucuauuaugaauguga

SEQ ID NO: 2118151 - RNA, 20 nt, Homo sapiens
cuuuugccgaccccaagagu

SEQ ID NO: 2118152 - RNA, 21 nt, Homo sapiens
gaccacgcccccagcugugac

SEQ ID NO: 2118153 - RNA, 14 nt, Homo sapiens
acaccuggccuuaa

SEQ ID NO: 2118154 - RNA, 15 nt, Homo sapiens
gucacacaguauuaa

SEQ ID NO: 2118155 - RNA, 16 nt, Homo sapiens
ccuugaaccacuuccc

SEQ ID NO: 2118156 - RNA, 18 nt, Homo sapiens
aguaaaugaaacuaauca

SEQ ID NO: 2118157 - RNA, 20 nt, Homo sapiens
uuugccagccaccccuccuc

SEQ ID NO: 2118158 - RNA, 14 nt, Homo sapiens
ucauccaacuuaug

SEQ ID NO: 2118159 - RNA, 11 nt, Homo sapiens
cuaaauuugaa

SEQ ID NO: 2118160 - RNA, 14 nt, Homo sapiens
cuuuaagccugcau

SEQ ID NO: 2118161 - RNA, 22 nt, Homo sapiens
aauaggcuguguauuuacauga

SEQ ID NO: 2118162 - RNA, 23 nt, Homo sapiens
guauuuauucaauaaaguauuua

SEQ ID NO: 2118163 - RNA, 21 nt, Homo sapiens
auauaaaagcugcauaugccu

SEQ ID NO: 2118164 - RNA, 17 nt, Homo sapiens
ugugacuuacaauuugc

SEQ ID NO: 2118165 - RNA, 17 nt, Homo sapiens
caugucagcaaguccua

SEQ ID NO: 2118166 - RNA, 19 nt, Homo sapiens
caaaaccuuuaaucugcac

SEQ ID NO: 2118167 - RNA, 15 nt, Homo sapiens
cuggauucuaaggaa

SEQ ID NO: 2118168 - RNA, 19 nt, Homo sapiens
auuuauggucaacacuuaa

SEQ ID NO: 2118169 - RNA, 14 nt, Homo sapiens
ggcagcuacucaga

SEQ ID NO: 2118170 - RNA, 16 nt, Homo sapiens
gaugggcgucacuacu

SEQ ID NO: 2118171 - RNA, 11 nt, Homo sapiens
agaauccaaac

SEQ ID NO: 2118172 - RNA, 14 nt, Homo sapiens
auuauauacuccuu

SEQ ID NO: 2118173 - RNA, 22 nt, Homo sapiens
aguccugguccuggcugcacuc

SEQ ID NO: 2118174 - RNA, 16 nt, Homo sapiens
agaaauccuuucauaa

SEQ ID NO: 2118175 - RNA, 17 nt, Homo sapiens
agggguuuacagucuau

SEQ ID NO: 2118176 - RNA, 23 nt, Homo sapiens
ugggggaagaccuggcaaggaca

SEQ ID NO: 2118177 - RNA, 20 nt, Homo sapiens
uaugaagugacucucacaag

SEQ ID NO: 2118178 - RNA, 15 nt, Homo sapiens
gaucaucaagacaga

SEQ ID NO: 2118179 - RNA, 22 nt, Homo sapiens
caggggugcacaauaaaggggg

SEQ ID NO: 2118180 - RNA, 13 nt, Homo sapiens
gacaaggcccuga

SEQ ID NO: 2118181 - RNA, 16 nt, Homo sapiens
gcccggaaccccagga

SEQ ID NO: 2118182 - RNA, 20 nt, Homo sapiens
cccagggccugggggcagug

SEQ ID NO: 2118183 - RNA, 14 nt, Homo sapiens
aguaugguaauuaa

SEQ ID NO: 2118184 - RNA, 17 nt, Homo sapiens
uaucuuuaagcugugau

SEQ ID NO: 2118185 - RNA, 22 nt, Homo sapiens
ucuacuuccccuucuugccauu

SEQ ID NO: 2118186 - RNA, 21 nt, Homo sapiens
gcagaucuacaugucuagaga

SEQ ID NO: 2118187 - RNA, 17 nt, Homo sapiens
uaaaaauaaaagcuauu

SEQ ID NO: 2118188 - RNA, 18 nt, Homo sapiens
guugcuuuugugaacuuu

SEQ ID NO: 2118189 - RNA, 15 nt, Homo sapiens
agccaggaccacaga

SEQ ID NO: 2118190 - RNA, 23 nt, Homo sapiens
aauaaaguugcugugaauacuua

SEQ ID NO: 2118191 - RNA, 21 nt, Homo sapiens
guauaaauuaaauaaacuguu

SEQ ID NO: 2118192 - RNA, 11 nt, Homo sapiens
ucacaugacca

SEQ ID NO: 2118193 - RNA, 18 nt, Homo sapiens
agaaucuguuaccagagg

SEQ ID NO: 2118194 - RNA, 17 nt, Homo sapiens
gagguagccgaccugag

SEQ ID NO: 2118195 - RNA, 19 nt, Homo sapiens
cagauuuuuacacauguau

SEQ ID NO: 2118196 - RNA, 23 nt, Homo sapiens
auuguauuuuggauuuuuacaca

SEQ ID NO: 2118197 - RNA, 16 nt, Homo sapiens
aauuaaaggcuuugca

SEQ ID NO: 2118198 - RNA, 23 nt, Homo sapiens
cagcagccccaggagaaggggcu

SEQ ID NO: 2118199 - RNA, 14 nt, Homo sapiens
augacuacuuuuuc

SEQ ID NO: 2118200 - RNA, 14 nt, Homo sapiens
uuccgagaggacca

SEQ ID NO: 2118201 - RNA, 17 nt, Homo sapiens
agcaccugaaccacugu

SEQ ID NO: 2118202 - RNA, 21 nt, Homo sapiens
uaguggggaccaaguucauua

SEQ ID NO: 2118203 - RNA, 16 nt, Homo sapiens
cacacauuucugaggg

SEQ ID NO: 2118204 - RNA, 12 nt, Homo sapiens
ggaauuaccuua

SEQ ID NO: 2118205 - RNA, 22 nt, Homo sapiens
uccaccccuccccaucuggacc

SEQ ID NO: 2118206 - RNA, 20 nt, Homo sapiens
gcagagauugggggggcuug

SEQ ID NO: 2118207 - RNA, 23 nt, Homo sapiens
auuuauccaaaauguguauuucu

SEQ ID NO: 2118208 - RNA, 14 nt, Homo sapiens
gucacagaugaaga

SEQ ID NO: 2118209 - RNA, 14 nt, Homo sapiens
aagccaaauuuuau

SEQ ID NO: 2118210 - RNA, 19 nt, Homo sapiens
ugucuggccacacuggaau

SEQ ID NO: 2118211 - RNA, 19 nt, Homo sapiens
agccacaagccugaauuuc

SEQ ID NO: 2118212 - RNA, 23 nt, Homo sapiens
aacgguuuuuuucuuuggcugca

SEQ ID NO: 2118213 - RNA, 20 nt, Homo sapiens
agauuugaacccagcuagaa

SEQ ID NO: 2118214 - RNA, 14 nt, Homo sapiens
ccugcgugcgcugg

SEQ ID NO: 2118215 - RNA, 15 nt, Homo sapiens
cauuuaugcaugaga

SEQ ID NO: 2118216 - RNA, 20 nt, Homo sapiens
gacuucucccgugagccagg

SEQ ID NO: 2118217 - RNA, 14 nt, Homo sapiens
uaugaggcuauuaa

SEQ ID NO: 2118218 - RNA, 18 nt, Homo sapiens
agaaucccuagucuucaa

SEQ ID NO: 2118219 - RNA, 15 nt, Homo sapiens
uggggauaaagacag

SEQ ID NO: 2118220 - RNA, 16 nt, Homo sapiens
cagagguuugcuuccu

SEQ ID NO: 2118221 - RNA, 21 nt, Homo sapiens
ugaagucuugaaaacagugug

SEQ ID NO: 2118222 - RNA, 13 nt, Homo sapiens
uugaaguguuccc

SEQ ID NO: 2118223 - RNA, 14 nt, Homo sapiens
cccugccuugccgc

SEQ ID NO: 2118224 - RNA, 15 nt, Homo sapiens
agcuucucauguuaa

SEQ ID NO: 2118225 - RNA, 14 nt, Homo sapiens
auuuuggcauugua

SEQ ID NO: 2118226 - RNA, 18 nt, Homo sapiens
aaauguacuacauuugca

SEQ ID NO: 2118227 - RNA, 16 nt, Homo sapiens
agacuuggacaucucu

SEQ ID NO: 2118228 - RNA, 16 nt, Homo sapiens
auuuguuuuguuuaca

SEQ ID NO: 2118229 - RNA, 22 nt, Homo sapiens
cuuccuaaugucagaacagagu

SEQ ID NO: 2118230 - RNA, 18 nt, Homo sapiens
gucuccuacccucuuauu

SEQ ID NO: 2118231 - RNA, 18 nt, Homo sapiens
gucguccccagaccagua

SEQ ID NO: 2118232 - RNA, 22 nt, Homo sapiens
cugccagagcccaagugccauc

SEQ ID NO: 2118233 - RNA, 19 nt, Homo sapiens
cuccucaccucaugcccac

SEQ ID NO: 2118234 - RNA, 20 nt, Homo sapiens
gaucuugcaaaacagggauu

SEQ ID NO: 2118235 - RNA, 13 nt, Homo sapiens
cacccaugccaua

SEQ ID NO: 2118236 - RNA, 19 nt, Homo sapiens
cugcucaaugccauugugc

SEQ ID NO: 2118237 - RNA, 23 nt, Homo sapiens
ugaagaaagucagcucuugucaa

SEQ ID NO: 2118238 - RNA, 21 nt, Homo sapiens
ccuguggggccugauggugcu

SEQ ID NO: 2118239 - RNA, 17 nt, Homo sapiens
cccaugcaucuuccacu

SEQ ID NO: 2118240 - RNA, 13 nt, Homo sapiens
agaaaccaugaca

SEQ ID NO: 2118241 - RNA, 16 nt, Homo sapiens
aagccuccuuacauua

SEQ ID NO: 2118242 - RNA, 18 nt, Homo sapiens
agcaaacacuuacagaau

SEQ ID NO: 2118243 - RNA, 23 nt, Homo sapiens
aaagcauagacgucucagguuau

SEQ ID NO: 2118244 - RNA, 14 nt, Homo sapiens
cacuagggaucaaa

SEQ ID NO: 2118245 - RNA, 18 nt, Homo sapiens
uucgcgcuggaauccaga

SEQ ID NO: 2118246 - RNA, 22 nt, Homo sapiens
aggaaguugacuuauaguacau

SEQ ID NO: 2118247 - RNA, 16 nt, Homo sapiens
gucccacccucccuag

SEQ ID NO: 2118248 - RNA, 16 nt, Homo sapiens
gagaccaaaucuugcu

SEQ ID NO: 2118249 - RNA, 13 nt, Homo sapiens
uucgagaagcaau

SEQ ID NO: 2118250 - RNA, 17 nt, Homo sapiens
cauagcaccuaacaaca

SEQ ID NO: 2118251 - RNA, 13 nt, Homo sapiens
agcugucuuguca

SEQ ID NO: 2118252 - RNA, 19 nt, Homo sapiens
gcuuuaagcgcaacauuuc

SEQ ID NO: 2118253 - RNA, 15 nt, Homo sapiens
cauauucagcauuug

SEQ ID NO: 2118254 - RNA, 23 nt, Homo sapiens
cauugauauaaagaaauaccuga

SEQ ID NO: 2118255 - RNA, 13 nt, Homo sapiens
agaggauuuggcu

SEQ ID NO: 2118256 - RNA, 17 nt, Homo sapiens
cuucuuacuugucugua

SEQ ID NO: 2118257 - RNA, 14 nt, Homo sapiens
cuuuuaggaugugg

SEQ ID NO: 2118258 - RNA, 20 nt, Homo sapiens
aguacuccaagacagagaca

SEQ ID NO: 2118259 - RNA, 14 nt, Homo sapiens
cauggccacaucug

SEQ ID NO: 2118260 - RNA, 21 nt, Homo sapiens
uucugauggguucaugucucu

SEQ ID NO: 2118261 - RNA, 14 nt, Homo sapiens
auuuaaaaugccua

SEQ ID NO: 2118262 - RNA, 18 nt, Homo sapiens
aucauuuugaacaugugu

SEQ ID NO: 2118263 - RNA, 22 nt, Homo sapiens
gacucugaccccagcauucuca

SEQ ID NO: 2118264 - RNA, 16 nt, Homo sapiens
caguuuaacagaguuu

SEQ ID NO: 2118265 - RNA, 20 nt, Homo sapiens
aagaacuuggaggcaccauu

SEQ ID NO: 2118266 - RNA, 16 nt, Homo sapiens
ccaacucacugugcuc

SEQ ID NO: 2118267 - RNA, 14 nt, Homo sapiens
ucugugugugacac

SEQ ID NO: 2118268 - RNA, 22 nt, Homo sapiens
cucacugccaucaaacuguaaa

SEQ ID NO: 2118269 - RNA, 17 nt, Homo sapiens
agcugagaagcaauggg

SEQ ID NO: 2118270 - RNA, 16 nt, Homo sapiens
uggacagcuuugcucc

SEQ ID NO: 2118271 - RNA, 17 nt, Homo sapiens
agcaggggggcugugcc

SEQ ID NO: 2118272 - RNA, 16 nt, Homo sapiens
cuaacaagauuuguaa

SEQ ID NO: 2118273 - RNA, 17 nt, Homo sapiens
accaugggcaccaggca

SEQ ID NO: 2118274 - RNA, 17 nt, Homo sapiens
gacacaucucccaccau

SEQ ID NO: 2118275 - RNA, 14 nt, Homo sapiens
uagaaagggucccu

SEQ ID NO: 2118276 - RNA, 19 nt, Homo sapiens
gagcagggagccacuugcc

SEQ ID NO: 2118277 - RNA, 12 nt, Homo sapiens
aaaaucauauaa

SEQ ID NO: 2118278 - RNA, 22 nt, Homo sapiens
aacaucagcuucaauccuccau

SEQ ID NO: 2118279 - RNA, 18 nt, Homo sapiens
ggaaaauguccuguggug

SEQ ID NO: 2118280 - RNA, 15 nt, Homo sapiens
uaauaccagaacucu

SEQ ID NO: 2118281 - RNA, 20 nt, Homo sapiens
ucaaaccuaccacucaggaa

SEQ ID NO: 2118282 - RNA, 15 nt, Homo sapiens
cucuucugugcccug

SEQ ID NO: 2118283 - RNA, 16 nt, Homo sapiens
ccguggcacucaugga

SEQ ID NO: 2118284 - RNA, 22 nt, Homo sapiens
ugcugggccgggguguggaauc

SEQ ID NO: 2118285 - RNA, 17 nt, Homo sapiens
guuucuguuucuauucu

SEQ ID NO: 2118286 - RNA, 13 nt, Homo sapiens
aauaaccuuucac

SEQ ID NO: 2118287 - RNA, 23 nt, Homo sapiens
acagaccuccaggucccuaagcu

SEQ ID NO: 2118288 - RNA, 14 nt, Homo sapiens
aacagaaauuagaa

SEQ ID NO: 2118289 - RNA, 16 nt, Homo sapiens
ucaaaacacuuuccca

SEQ ID NO: 2118290 - RNA, 15 nt, Homo sapiens
uaccuuucagugcag

SEQ ID NO: 2118291 - RNA, 15 nt, Homo sapiens
ccagaaaaaaagccc

SEQ ID NO: 2118292 - RNA, 20 nt, Homo sapiens
aggcccauggaucagcucuu

SEQ ID NO: 2118293 - RNA, 16 nt, Homo sapiens
agccugggccccucag

SEQ ID NO: 2118294 - RNA, 17 nt, Homo sapiens
acguggacucugugcuc

SEQ ID NO: 2118295 - RNA, 19 nt, Homo sapiens
uacugcaguugaaagggca

SEQ ID NO: 2118296 - RNA, 14 nt, Homo sapiens
auaggaauauucaa

SEQ ID NO: 2118297 - RNA, 17 nt, Homo sapiens
uucucauugaucacaga

SEQ ID NO: 2118298 - RNA, 20 nt, Homo sapiens
uaauccucacaccuacugua

SEQ ID NO: 2118299 - RNA, 18 nt, Homo sapiens
gaauguugaauguuugaa

SEQ ID NO: 2118300 - RNA, 22 nt, Homo sapiens
auaauguuuauaagcugggcau

SEQ ID NO: 2118301 - RNA, 16 nt, Homo sapiens
cuguuuuaaugacaag

SEQ ID NO: 2118302 - RNA, 21 nt, Homo sapiens
gaccaauuugcaccaguuuua

SEQ ID NO: 2118303 - RNA, 22 nt, Homo sapiens
caugcagauaguauacacauca

SEQ ID NO: 2118304 - RNA, 20 nt, Homo sapiens
guauauucugguuacugugg

SEQ ID NO: 2118305 - RNA, 16 nt, Homo sapiens
guaggaaaugaaugau

SEQ ID NO: 2118306 - RNA, 23 nt, Homo sapiens
gggccugccaaggaugacacugc

SEQ ID NO: 2118307 - RNA, 19 nt, Homo sapiens
aucaaacucaaugcuuuau

SEQ ID NO: 2118308 - RNA, 22 nt, Homo sapiens
ccaacccgucuggcccaccagg

SEQ ID NO: 2118309 - RNA, 18 nt, Homo sapiens
uccaggaauauaugucag

SEQ ID NO: 2118310 - RNA, 14 nt, Homo sapiens
auagaaacugagga

SEQ ID NO: 2118311 - RNA, 13 nt, Homo sapiens
ugaauccuacaua

SEQ ID NO: 2118312 - RNA, 15 nt, Homo sapiens
uccacagucucuggg

SEQ ID NO: 2118313 - RNA, 16 nt, Homo sapiens
aagaaagaugaaauaa

SEQ ID NO: 2118314 - RNA, 15 nt, Homo sapiens
cacagucucugggag

SEQ ID NO: 2118315 - RNA, 15 nt, Homo sapiens
gcuuuucggcaaagc

SEQ ID NO: 2118316 - RNA, 18 nt, Homo sapiens
uauuguacagaagcucuu

SEQ ID NO: 2118317 - RNA, 15 nt, Homo sapiens
cugcuggccaagaag

SEQ ID NO: 2118318 - RNA, 20 nt, Homo sapiens
ggcaacaguacuucaaacag

SEQ ID NO: 2118319 - RNA, 20 nt, Homo sapiens
agccccagguaauggcauga

SEQ ID NO: 2118320 - RNA, 12 nt, Homo sapiens
ugaaacaucauu

SEQ ID NO: 2118321 - RNA, 22 nt, Homo sapiens
ggaaaaugugcaauaugugaug

SEQ ID NO: 2118322 - RNA, 21 nt, Homo sapiens
ucauuuacuguggcuucuuaa

SEQ ID NO: 2118323 - RNA, 13 nt, Homo sapiens
gaccacugucucc

SEQ ID NO: 2118324 - RNA, 16 nt, Homo sapiens
caugggcacaagcaaa

SEQ ID NO: 2118325 - RNA, 11 nt, Homo sapiens
acccucagcug

SEQ ID NO: 2118326 - RNA, 16 nt, Homo sapiens
cagauggugucauuua

SEQ ID NO: 2118327 - RNA, 16 nt, Homo sapiens
ucuaggagaugcuuuc

SEQ ID NO: 2118328 - RNA, 14 nt, Homo sapiens
auaauaauuugcac

SEQ ID NO: 2118329 - RNA, 21 nt, Homo sapiens
gugcugggaugacagguguga

SEQ ID NO: 2118330 - RNA, 22 nt, Homo sapiens
ugcuaacuagcuuggaaacugg

SEQ ID NO: 2118331 - RNA, 16 nt, Homo sapiens
aaaucaccacaaccaa

SEQ ID NO: 2118332 - RNA, 15 nt, Homo sapiens
ugauacuuccucaua

SEQ ID NO: 2118333 - RNA, 21 nt, Homo sapiens
agcuacagucuaaaauugcuu

SEQ ID NO: 2118334 - RNA, 19 nt, Homo sapiens
ccuuaaauaucuuucacau

SEQ ID NO: 2118335 - RNA, 13 nt, Homo sapiens
ccuagucuauuca

SEQ ID NO: 2118336 - RNA, 13 nt, Homo sapiens
gcugcaaaggaca

SEQ ID NO: 2118337 - RNA, 20 nt, Homo sapiens
gcucaugucuauaaucccag

SEQ ID NO: 2118338 - RNA, 15 nt, Homo sapiens
aaaugugaacugacu

SEQ ID NO: 2118339 - RNA, 19 nt, Homo sapiens
ugaguccacccuuuggaga

SEQ ID NO: 2118340 - RNA, 13 nt, Homo sapiens
aagcgcugcagua

SEQ ID NO: 2118341 - RNA, 23 nt, Homo sapiens
ugcagguucauggauuacuucuc

SEQ ID NO: 2118342 - RNA, 13 nt, Homo sapiens
cccuccucuccca

SEQ ID NO: 2118343 - RNA, 16 nt, Homo sapiens
cugagagcccacugca

SEQ ID NO: 2118344 - RNA, 15 nt, Homo sapiens
acugcaaccucugcc

SEQ ID NO: 2118345 - RNA, 15 nt, Homo sapiens
cauccccuagaaauc

SEQ ID NO: 2118346 - RNA, 19 nt, Homo sapiens
accuaacauuauacuucau

SEQ ID NO: 2118347 - RNA, 20 nt, Homo sapiens
aguccuugcaagaauggaga

SEQ ID NO: 2118348 - RNA, 22 nt, Homo sapiens
acuaaaccaacucuaauauugc

SEQ ID NO: 2118349 - RNA, 18 nt, Homo sapiens
gaagcaacaaauauguca

SEQ ID NO: 2118350 - RNA, 19 nt, Homo sapiens
uccaauuccuugcacauag

SEQ ID NO: 2118351 - RNA, 14 nt, Homo sapiens
ugagccaugagaug

SEQ ID NO: 2118352 - RNA, 16 nt, Homo sapiens
ggaacaugagccuuug

SEQ ID NO: 2118353 - RNA, 16 nt, Homo sapiens
ccacaagugugcauua

SEQ ID NO: 2118354 - RNA, 17 nt, Homo sapiens
acuaugaaccuucuuaa

SEQ ID NO: 2118355 - RNA, 22 nt, Homo sapiens
caaaaaaauacugccagaugcu

SEQ ID NO: 2118356 - RNA, 17 nt, Homo sapiens
cuucgggaaaauauuca

SEQ ID NO: 2118357 - RNA, 22 nt, Homo sapiens
uuccauaagcuuggugacaaaa

SEQ ID NO: 2118358 - RNA, 19 nt, Homo sapiens
ccaccaaaaacacagugaa

SEQ ID NO: 2118359 - RNA, 12 nt, Homo sapiens
auugcuggaaaa

SEQ ID NO: 2118360 - RNA, 19 nt, Homo sapiens
acaccguacaucugcaaua

SEQ ID NO: 2118361 - RNA, 20 nt, Homo sapiens
cuuuugguagagaaggagca

SEQ ID NO: 2118362 - RNA, 15 nt, Homo sapiens
uguggcaaagcucac

SEQ ID NO: 2118363 - RNA, 13 nt, Homo sapiens
gugaucuacccac

SEQ ID NO: 2118364 - RNA, 20 nt, Homo sapiens
aggauaugaguacauacuca

SEQ ID NO: 2118365 - RNA, 20 nt, Homo sapiens
acauuuuccugagaccucaa

SEQ ID NO: 2118366 - RNA, 15 nt, Homo sapiens
uccaaagagugcuaa

SEQ ID NO: 2118367 - RNA, 21 nt, Homo sapiens
aaaucuguuuuucuaacuggg

SEQ ID NO: 2118368 - RNA, 14 nt, Homo sapiens
ucccaaaugcagcu

SEQ ID NO: 2118369 - RNA, 14 nt, Homo sapiens
gaucggacucugcc

SEQ ID NO: 2118370 - RNA, 17 nt, Homo sapiens
ccccucuucaaagcaga

SEQ ID NO: 2118371 - RNA, 23 nt, Homo sapiens
gcuccuuauucccaguguuccau

SEQ ID NO: 2118372 - RNA, 16 nt, Homo sapiens
uaaagaggcgucuugu

SEQ ID NO: 2118373 - RNA, 13 nt, Homo sapiens
ccaucugugcagu

SEQ ID NO: 2118374 - RNA, 16 nt, Homo sapiens
cuauuagagcauugaa

SEQ ID NO: 2118375 - RNA, 22 nt, Homo sapiens
agcucuuugucucaccagcuca

SEQ ID NO: 2118376 - RNA, 16 nt, Homo sapiens
ugaggcauuuuuacua

SEQ ID NO: 2118377 - RNA, 18 nt, Homo sapiens
agccuagcggagcccagc

SEQ ID NO: 2118378 - RNA, 19 nt, Homo sapiens
caugggcaucuaugggaga

SEQ ID NO: 2118379 - RNA, 19 nt, Homo sapiens
gauauucuaagaaauaucu

SEQ ID NO: 2118380 - RNA, 14 nt, Homo sapiens
uggaggcugagcug

SEQ ID NO: 2118381 - RNA, 13 nt, Homo sapiens
gaaaacuugacau

SEQ ID NO: 2118382 - RNA, 17 nt, Homo sapiens
aagcacuuugcacuuaa

SEQ ID NO: 2118383 - RNA, 15 nt, Homo sapiens
aggggugggagccaa

SEQ ID NO: 2118384 - RNA, 13 nt, Homo sapiens
cuugaagcacaga

SEQ ID NO: 2118385 - RNA, 22 nt, Homo sapiens
gagcuugcaggguuucucgcca

SEQ ID NO: 2118386 - RNA, 14 nt, Homo sapiens
uauauauucuuaca

SEQ ID NO: 2118387 - RNA, 17 nt, Homo sapiens
cuuaaggggcagcuucu

SEQ ID NO: 2118388 - RNA, 16 nt, Homo sapiens
ucaucuacccugcuga

SEQ ID NO: 2118389 - RNA, 13 nt, Homo sapiens
accugagcaacaa

SEQ ID NO: 2118390 - RNA, 17 nt, Homo sapiens
uuuuaaacaaaugugau

SEQ ID NO: 2118391 - RNA, 15 nt, Homo sapiens
gaaauacuugacaac

SEQ ID NO: 2118392 - RNA, 17 nt, Homo sapiens
augucaaauaaagcaaa

SEQ ID NO: 2118393 - RNA, 19 nt, Homo sapiens
augugacgcacuguauucc

SEQ ID NO: 2118394 - RNA, 18 nt, Homo sapiens
caucuauuauaaaaccau

SEQ ID NO: 2118395 - RNA, 23 nt, Homo sapiens
accaguguuagugggaagagcug

SEQ ID NO: 2118396 - RNA, 22 nt, Homo sapiens
cgugugggagaccggccugcca

SEQ ID NO: 2118397 - RNA, 21 nt, Homo sapiens
agauaaagucaaaugccaaac

SEQ ID NO: 2118398 - RNA, 17 nt, Homo sapiens
agaaauaugaagcacuu

SEQ ID NO: 2118399 - RNA, 12 nt, Homo sapiens
aaaaaaauggau

SEQ ID NO: 2118400 - RNA, 21 nt, Homo sapiens
cagaucaagaaaaaaagggag

SEQ ID NO: 2118401 - RNA, 16 nt, Homo sapiens
acuuuccugacuuaca

SEQ ID NO: 2118402 - RNA, 18 nt, Homo sapiens
agaucauaggaaguggcu

SEQ ID NO: 2118403 - RNA, 13 nt, Homo sapiens
cacuuaaaacacg

SEQ ID NO: 2118404 - RNA, 17 nt, Homo sapiens
ggcaguggagaucagga

SEQ ID NO: 2118405 - RNA, 16 nt, Homo sapiens
aggaacuagggauauu

SEQ ID NO: 2118406 - RNA, 13 nt, Homo sapiens
caguaguugcaau

SEQ ID NO: 2118407 - RNA, 14 nt, Homo sapiens
ucugaaagcuuuau

SEQ ID NO: 2118408 - RNA, 18 nt, Homo sapiens
uucucuucccaccuguca

SEQ ID NO: 2118409 - RNA, 13 nt, Homo sapiens
acaacaugguguc

SEQ ID NO: 2118410 - RNA, 15 nt, Homo sapiens
gacuucuaaaucaua

SEQ ID NO: 2118411 - RNA, 11 nt, Homo sapiens
cggguggcauu

SEQ ID NO: 2118412 - RNA, 20 nt, Homo sapiens
cugcacccuguuuaacauuu

SEQ ID NO: 2118413 - RNA, 14 nt, Homo sapiens
gagaagcucaccca

SEQ ID NO: 2118414 - RNA, 14 nt, Homo sapiens
cucagcccuagccc

SEQ ID NO: 2118415 - RNA, 21 nt, Homo sapiens
caaagcagacauuuuccucac

SEQ ID NO: 2118416 - RNA, 18 nt, Homo sapiens
aggcagauuaaaagcaca

SEQ ID NO: 2118417 - RNA, 15 nt, Homo sapiens
uccaucccacuccac

SEQ ID NO: 2118418 - RNA, 22 nt, Homo sapiens
acgugggugcccucuccaaagg

SEQ ID NO: 2118419 - RNA, 23 nt, Homo sapiens
agccugacauggacccacuaccc

SEQ ID NO: 2118420 - RNA, 15 nt, Homo sapiens
gcuuguuggcuuccg

SEQ ID NO: 2118421 - RNA, 15 nt, Homo sapiens
auuuuaagcuaggaa

SEQ ID NO: 2118422 - RNA, 17 nt, Homo sapiens
uucagaacauccuccaa

SEQ ID NO: 2118423 - RNA, 15 nt, Homo sapiens
guuuuuuuggucacu

SEQ ID NO: 2118424 - RNA, 18 nt, Homo sapiens
uccaagugcggcacugca

SEQ ID NO: 2118425 - RNA, 22 nt, Homo sapiens
aacaggggccaaacugguggga

SEQ ID NO: 2118426 - RNA, 16 nt, Homo sapiens
uaacugaaaagcaguu

SEQ ID NO: 2118427 - RNA, 17 nt, Homo sapiens
ucuccucaaacauuuau

SEQ ID NO: 2118428 - RNA, 17 nt, Homo sapiens
auauguacauacauuca

SEQ ID NO: 2118429 - RNA, 15 nt, Homo sapiens
cucccaugggcugag

SEQ ID NO: 2118430 - RNA, 16 nt, Homo sapiens
gccugacugccaagcc

SEQ ID NO: 2118431 - RNA, 20 nt, Homo sapiens
cuuccagugcccuaggccug

SEQ ID NO: 2118432 - RNA, 16 nt, Homo sapiens
ucccugcaaacauggg

SEQ ID NO: 2118433 - RNA, 15 nt, Homo sapiens
gcucuuuaacauggu

SEQ ID NO: 2118434 - RNA, 13 nt, Homo sapiens
ugauugcugccau

SEQ ID NO: 2118435 - RNA, 16 nt, Homo sapiens
gaacgugguucagaga

SEQ ID NO: 2118436 - RNA, 13 nt, Homo sapiens
ucagaaaacaggg

SEQ ID NO: 2118437 - RNA, 22 nt, Homo sapiens
uauacaaugaguaaaaucacag

SEQ ID NO: 2118438 - RNA, 21 nt, Homo sapiens
caaacucucccccaaauguau

SEQ ID NO: 2118439 - RNA, 14 nt, Homo sapiens
ucaggaaacauuca

SEQ ID NO: 2118440 - RNA, 18 nt, Homo sapiens
cacagugcuauuugcauu

SEQ ID NO: 2118441 - RNA, 14 nt, Homo sapiens
ucuugaaacaagca

SEQ ID NO: 2118442 - RNA, 17 nt, Homo sapiens
guauaugguggagccaa

SEQ ID NO: 2118443 - RNA, 22 nt, Homo sapiens
acccuuccuaaguuuaagggaa

SEQ ID NO: 2118444 - RNA, 14 nt, Homo sapiens
aaacauacgacuua

SEQ ID NO: 2118445 - RNA, 17 nt, Homo sapiens
aaauuuaaguccaccuc

SEQ ID NO: 2118446 - RNA, 18 nt, Homo sapiens
cagaaucagauucaggag

SEQ ID NO: 2118447 - RNA, 14 nt, Homo sapiens
cgcucucucaggcg

SEQ ID NO: 2118448 - RNA, 22 nt, Homo sapiens
agucucuaucauuaaaguucua

SEQ ID NO: 2118449 - RNA, 17 nt, Homo sapiens
cuucuguuuuccaaagg

SEQ ID NO: 2118450 - RNA, 17 nt, Homo sapiens
agucauaaacagcauuu

SEQ ID NO: 2118451 - RNA, 14 nt, Homo sapiens
gucauccucuggaa

SEQ ID NO: 2118452 - RNA, 21 nt, Homo sapiens
aagccuuccccuuauccuccc

SEQ ID NO: 2118453 - RNA, 19 nt, Homo sapiens
caaggacugcccuucauuc

SEQ ID NO: 2118454 - RNA, 21 nt, Homo sapiens
ucuuugagauaauacauuccg

SEQ ID NO: 2118455 - RNA, 22 nt, Homo sapiens
ugcugccccuugcaagccauaa

SEQ ID NO: 2118456 - RNA, 12 nt, Homo sapiens
acgccuccccaa

SEQ ID NO: 2118457 - RNA, 14 nt, Homo sapiens
cuaaaggugcacug

SEQ ID NO: 2118458 - RNA, 19 nt, Homo sapiens
ccccgcauuccaggcuccu

SEQ ID NO: 2118459 - RNA, 18 nt, Homo sapiens
cacugaaaccaaaacaua

SEQ ID NO: 2118460 - RNA, 14 nt, Homo sapiens
uggcugaccugcug

SEQ ID NO: 2118461 - RNA, 16 nt, Homo sapiens
ccacgaugucaaggac

SEQ ID NO: 2118462 - RNA, 16 nt, Homo sapiens
uauuuuuuacuuugcc

SEQ ID NO: 2118463 - RNA, 15 nt, Homo sapiens
ccacuggaaacaaca

SEQ ID NO: 2118464 - RNA, 17 nt, Homo sapiens
ggucuccggggaggcag

SEQ ID NO: 2118465 - RNA, 18 nt, Homo sapiens
aagcuauugucuguaaua

SEQ ID NO: 2118466 - RNA, 19 nt, Homo sapiens
gaguuccggaaagccuucc

SEQ ID NO: 2118467 - RNA, 21 nt, Homo sapiens
acaaaugcuggggucauauaa

SEQ ID NO: 2118468 - RNA, 12 nt, Homo sapiens
auauuucacuua

SEQ ID NO: 2118469 - RNA, 22 nt, Homo sapiens
guguuaauagggauuuuuucag

SEQ ID NO: 2118470 - RNA, 19 nt, Homo sapiens
gcgcccugcagacccugcc

SEQ ID NO: 2118471 - RNA, 13 nt, Homo sapiens
uccaugcugccag

SEQ ID NO: 2118472 - RNA, 19 nt, Homo sapiens
gccacauggccccauccca

SEQ ID NO: 2118473 - RNA, 18 nt, Homo sapiens
uuauguguaauucuucca

SEQ ID NO: 2118474 - RNA, 15 nt, Homo sapiens
auguaccugauguac

SEQ ID NO: 2118475 - RNA, 17 nt, Homo sapiens
ccugucaaccugaauua

SEQ ID NO: 2118476 - RNA, 23 nt, Homo sapiens
cauagagaucuauguacuguaau

SEQ ID NO: 2118477 - RNA, 22 nt, Homo sapiens
gcuucaaggaguaugcagggag

SEQ ID NO: 2118478 - RNA, 17 nt, Homo sapiens
ucacaucuuaaauucau

SEQ ID NO: 2118479 - RNA, 11 nt, Homo sapiens
caucaaaaaga

SEQ ID NO: 2118480 - RNA, 15 nt, Homo sapiens
auacucuaauucuaa

SEQ ID NO: 2118481 - RNA, 23 nt, Homo sapiens
caucuauuuggaaagcacuggaa

SEQ ID NO: 2118482 - RNA, 15 nt, Homo sapiens
auucaauauugacau

SEQ ID NO: 2118483 - RNA, 20 nt, Homo sapiens
uguggagagagaggcuucaa

SEQ ID NO: 2118484 - RNA, 14 nt, Homo sapiens
uccucacaaugagg

SEQ ID NO: 2118485 - RNA, 15 nt, Homo sapiens
uucccuguucuuuga

SEQ ID NO: 2118486 - RNA, 16 nt, Homo sapiens
agcauagucuuauuaa

SEQ ID NO: 2118487 - RNA, 13 nt, Homo sapiens
ugaggaauguguu

SEQ ID NO: 2118488 - RNA, 17 nt, Homo sapiens
gcccugaauuucuucuu

SEQ ID NO: 2118489 - RNA, 16 nt, Homo sapiens
auuaaaacacuuucaa

SEQ ID NO: 2118490 - RNA, 16 nt, Homo sapiens
uugagucaccaugcca

SEQ ID NO: 2118491 - RNA, 22 nt, Homo sapiens
auggagacuuuuaucuacuucu

SEQ ID NO: 2118492 - RNA, 20 nt, Homo sapiens
gcagguuccuuaucugucac

SEQ ID NO: 2118493 - RNA, 17 nt, Homo sapiens
auggaugguugaauuaa

SEQ ID NO: 2118494 - RNA, 21 nt, Homo sapiens
ugaagcccuguugugccacag

SEQ ID NO: 2118495 - RNA, 17 nt, Homo sapiens
cacggcucucaccagug

SEQ ID NO: 2118496 - RNA, 16 nt, Homo sapiens
ggaacagggaccagcu

SEQ ID NO: 2118497 - RNA, 19 nt, Homo sapiens
uaccuauuuggugcuagua

SEQ ID NO: 2118498 - RNA, 15 nt, Homo sapiens
cuuauuucauaaaca

SEQ ID NO: 2118499 - RNA, 19 nt, Homo sapiens
ccagcagaagcaggguacc

SEQ ID NO: 2118500 - RNA, 13 nt, Homo sapiens
cauguagccucaa

SEQ ID NO: 2118501 - RNA, 19 nt, Homo sapiens
gcaaaaccacuagaacucu

SEQ ID NO: 2118502 - RNA, 17 nt, Homo sapiens
uuaaaaauagcaguauu

SEQ ID NO: 2118503 - RNA, 15 nt, Homo sapiens
ucaucaucagucuua

SEQ ID NO: 2118504 - RNA, 14 nt, Homo sapiens
agaaauaugugaga

SEQ ID NO: 2118505 - RNA, 14 nt, Homo sapiens
cagacacauucaca

SEQ ID NO: 2118506 - RNA, 21 nt, Homo sapiens
aagguguugguguauuugcca

SEQ ID NO: 2118507 - RNA, 19 nt, Homo sapiens
cuuuaacugacaagccauc

SEQ ID NO: 2118508 - RNA, 16 nt, Homo sapiens
ucauaugauugugcac

SEQ ID NO: 2118509 - RNA, 14 nt, Homo sapiens
cagaguuguugcuu

SEQ ID NO: 2118510 - RNA, 15 nt, Homo sapiens
caaccaauuuacacu

SEQ ID NO: 2118511 - RNA, 15 nt, Homo sapiens
acuugcaagucccau

SEQ ID NO: 2118512 - RNA, 15 nt, Homo sapiens
caugaaauuuugccu

SEQ ID NO: 2118513 - RNA, 20 nt, Homo sapiens
ugauaaaaagaaaugugauu

SEQ ID NO: 2118514 - RNA, 15 nt, Homo sapiens
ggugcugucaugccc

SEQ ID NO: 2118515 - RNA, 13 nt, Homo sapiens
accacacaccuca

SEQ ID NO: 2118516 - RNA, 20 nt, Homo sapiens
caguucucccaccagccucc

SEQ ID NO: 2118517 - RNA, 22 nt, Homo sapiens
auguuucugugaaauucucaga

SEQ ID NO: 2118518 - RNA, 13 nt, Homo sapiens
aauaaacuaaaga

SEQ ID NO: 2118519 - RNA, 15 nt, Homo sapiens
cuacacaccauuucu

SEQ ID NO: 2118520 - RNA, 16 nt, Homo sapiens
uucacaaccagccaca

SEQ ID NO: 2118521 - RNA, 22 nt, Homo sapiens
acuugggggaggaggaacaaau

SEQ ID NO: 2118522 - RNA, 20 nt, Homo sapiens
cugucccaccccuaccucua

SEQ ID NO: 2118523 - RNA, 18 nt, Homo sapiens
uacaggaucuguacauaa

SEQ ID NO: 2118524 - RNA, 15 nt, Homo sapiens
guggucuguguguga

SEQ ID NO: 2118525 - RNA, 20 nt, Homo sapiens
uggucaauuccauguggcug

SEQ ID NO: 2118526 - RNA, 23 nt, Homo sapiens
aauagccauguacuauaauguga

SEQ ID NO: 2118527 - RNA, 22 nt, Homo sapiens
caaguucauaggucuccaagac

SEQ ID NO: 2118528 - RNA, 22 nt, Homo sapiens
gcuccccggacauacucucugc

SEQ ID NO: 2118529 - RNA, 14 nt, Homo sapiens
accgugaacuggaa

SEQ ID NO: 2118530 - RNA, 23 nt, Homo sapiens
uguacuguucugugucuuucaca

SEQ ID NO: 2118531 - RNA, 22 nt, Homo sapiens
ccuuacucauuaauucaaugaa

SEQ ID NO: 2118532 - RNA, 13 nt, Homo sapiens
uagcuacugcuaa

SEQ ID NO: 2118533 - RNA, 22 nt, Homo sapiens
cuauccugauccccaacugaag

SEQ ID NO: 2118534 - RNA, 10 nt, Homo sapiens
cccaacagca

SEQ ID NO: 2118535 - RNA, 18 nt, Homo sapiens
auaaagcgaauggaccau

SEQ ID NO: 2118536 - RNA, 14 nt, Homo sapiens
ucuguagggccacc

SEQ ID NO: 2118537 - RNA, 15 nt, Homo sapiens
cgugggggcacugac

SEQ ID NO: 2118538 - RNA, 20 nt, Homo sapiens
ggcuauuaacugccaaaaca

SEQ ID NO: 2118539 - RNA, 11 nt, Homo sapiens
gcaacugcugu

SEQ ID NO: 2118540 - RNA, 14 nt, Homo sapiens
aucuguaaagauaa

SEQ ID NO: 2118541 - RNA, 17 nt, Homo sapiens
cugugcagggcugguuu

SEQ ID NO: 2118542 - RNA, 18 nt, Homo sapiens
cuggcuggaaaaagguga

SEQ ID NO: 2118543 - RNA, 23 nt, Homo sapiens
uuacuggaauuaaaaauauauau

SEQ ID NO: 2118544 - RNA, 17 nt, Homo sapiens
aguguacuggauuuaac

SEQ ID NO: 2118545 - RNA, 19 nt, Homo sapiens
uucagaaacuaagaaucau

SEQ ID NO: 2118546 - RNA, 23 nt, Homo sapiens
gaugagacaggaggucagcacaa

SEQ ID NO: 2118547 - RNA, 21 nt, Homo sapiens
aaccuugaccaaccccagcaa

SEQ ID NO: 2118548 - RNA, 23 nt, Homo sapiens
auuguuugaacccgggaggcaga

SEQ ID NO: 2118549 - RNA, 20 nt, Homo sapiens
uuuaaaaucugcugaucucu

SEQ ID NO: 2118550 - RNA, 13 nt, Homo sapiens
cucucucucucuc

SEQ ID NO: 2118551 - RNA, 15 nt, Homo sapiens
ccauggaggguauac

SEQ ID NO: 2118552 - RNA, 13 nt, Homo sapiens
gucucucugucuc

SEQ ID NO: 2118553 - RNA, 13 nt, Homo sapiens
auacaauuaugaa

SEQ ID NO: 2118554 - RNA, 13 nt, Homo sapiens
gcaccaccagggc

SEQ ID NO: 2118555 - RNA, 13 nt, Homo sapiens
ccuucucuccuuc

SEQ ID NO: 2118556 - RNA, 13 nt, Homo sapiens
aaaaaauugcaca

SEQ ID NO: 2118557 - RNA, 18 nt, Homo sapiens
cucccuguuaucugcuag

SEQ ID NO: 2118558 - RNA, 18 nt, Homo sapiens
ugauuaaauuaugaauga

SEQ ID NO: 2118559 - RNA, 18 nt, Homo sapiens
uucacaaaacagccuuug

SEQ ID NO: 2118560 - RNA, 18 nt, Homo sapiens
cacccccagucuccaggg

SEQ ID NO: 2118561 - RNA, 11 nt, Homo sapiens
aaagcaaaaua

SEQ ID NO: 2118562 - RNA, 14 nt, Homo sapiens
cauuguagccucaa

SEQ ID NO: 2118563 - RNA, 23 nt, Homo sapiens
cuacuaaggcugaaaaugugcau

SEQ ID NO: 2118564 - RNA, 12 nt, Homo sapiens
ucaucgucuuuu

SEQ ID NO: 2118565 - RNA, 19 nt, Homo sapiens
auggucauauccaaucuca

SEQ ID NO: 2118566 - RNA, 21 nt, Homo sapiens
cccacuuacuaaccugguccu

SEQ ID NO: 2118567 - RNA, 12 nt, Homo sapiens
acuuuccuccac

SEQ ID NO: 2118568 - RNA, 19 nt, Homo sapiens
auccuggagggguguugua

SEQ ID NO: 2118569 - RNA, 14 nt, Homo sapiens
auuuauucuacuuu

SEQ ID NO: 2118570 - RNA, 18 nt, Homo sapiens
gccaggcaugguggcuca

SEQ ID NO: 2118571 - RNA, 18 nt, Homo sapiens
gagguggagguugcagug

SEQ ID NO: 2118572 - RNA, 17 nt, Homo sapiens
ccaggcuggagugcaga

SEQ ID NO: 2118573 - RNA, 19 nt, Homo sapiens
aggaauucaauuuggcaaa

SEQ ID NO: 2118574 - RNA, 13 nt, Homo sapiens
aaugcaugugauu

SEQ ID NO: 2118575 - RNA, 19 nt, Homo sapiens
auuuccgugaaaaugcaag

SEQ ID NO: 2118576 - RNA, 14 nt, Homo sapiens
aaaguagagcccuu

SEQ ID NO: 2118577 - RNA, 16 nt, Homo sapiens
uauaaagauauaccaa

SEQ ID NO: 2118578 - RNA, 15 nt, Homo sapiens
gugacccugcucuca

SEQ ID NO: 2118579 - RNA, 18 nt, Homo sapiens
gggcacugucaugcccag

SEQ ID NO: 2118580 - RNA, 11 nt, Homo sapiens
uccauggugcc

SEQ ID NO: 2118581 - RNA, 16 nt, Homo sapiens
gccuugaaaccaccuu

SEQ ID NO: 2118582 - RNA, 14 nt, Homo sapiens
uguggcuuccucag

SEQ ID NO: 2118583 - RNA, 17 nt, Homo sapiens
cauucuuucugcuauau

SEQ ID NO: 2118584 - RNA, 22 nt, Homo sapiens
aguuuaugaaacagaaaaguag

SEQ ID NO: 2118585 - RNA, 12 nt, Homo sapiens
aggaaaauccaa

SEQ ID NO: 2118586 - RNA, 23 nt, Homo sapiens
acagcucgggcccucugugagau

SEQ ID NO: 2118587 - RNA, 20 nt, Homo sapiens
guuuacggccuaugagauga

SEQ ID NO: 2118588 - RNA, 21 nt, Homo sapiens
cuauuuggggcuugcaugcca

SEQ ID NO: 2118589 - RNA, 22 nt, Homo sapiens
uccaggaauaggcauuugccua

SEQ ID NO: 2118590 - RNA, 22 nt, Homo sapiens
uagcaccucccccuaaccaaau

SEQ ID NO: 2118591 - RNA, 17 nt, Homo sapiens
acuccuccucacuaaaa

SEQ ID NO: 2118592 - RNA, 16 nt, Homo sapiens
uauuuuucauaaacaa

SEQ ID NO: 2118593 - RNA, 19 nt, Homo sapiens
ugaaauaaagucaaaucaa

SEQ ID NO: 2118594 - RNA, 19 nt, Homo sapiens
guggagcagccaacaagca

SEQ ID NO: 2118595 - RNA, 18 nt, Homo sapiens
gauguggcccuggcugcc

SEQ ID NO: 2118596 - RNA, 22 nt, Homo sapiens
ucuacgcaaaaaauaacuacag

SEQ ID NO: 2118597 - RNA, 20 nt, Homo sapiens
acuguuggagcuacugcaaa

SEQ ID NO: 2118598 - RNA, 14 nt, Homo sapiens
auucuacccugaaa

SEQ ID NO: 2118599 - RNA, 18 nt, Homo sapiens
ugugcuugcccaccacag

SEQ ID NO: 2118600 - RNA, 16 nt, Homo sapiens
uguguuuuacaguaua

SEQ ID NO: 2118601 - RNA, 16 nt, Homo sapiens
ggugcccguauccaga

SEQ ID NO: 2118602 - RNA, 18 nt, Homo sapiens
caggaguauccucuugcc

SEQ ID NO: 2118603 - RNA, 19 nt, Homo sapiens
uaauguuuuauacuguuua

SEQ ID NO: 2118604 - RNA, 12 nt, Homo sapiens
gaauugcucaaa

SEQ ID NO: 2118605 - RNA, 16 nt, Homo sapiens
agccugccucugccac

SEQ ID NO: 2118606 - RNA, 18 nt, Homo sapiens
ggugcccauuugugauca

SEQ ID NO: 2118607 - RNA, 16 nt, Homo sapiens
acuauuuaugaauauu

SEQ ID NO: 2118608 - RNA, 19 nt, Homo sapiens
ucuuaugcuguacccaguu

SEQ ID NO: 2118609 - RNA, 12 nt, Homo sapiens
cugaugauuugu

SEQ ID NO: 2118610 - RNA, 16 nt, Homo sapiens
aauacggaacacuguc

SEQ ID NO: 2118611 - RNA, 14 nt, Homo sapiens
acuguuugucuucu

SEQ ID NO: 2118612 - RNA, 15 nt, Homo sapiens
cagaaggaaggcuuu

SEQ ID NO: 2118613 - RNA, 18 nt, Homo sapiens
gaccaauuagcauuccau

SEQ ID NO: 2118614 - RNA, 22 nt, Homo sapiens
aaccccaaagaagaagugacca

SEQ ID NO: 2118615 - RNA, 21 nt, Homo sapiens
caaaaagccuuuuccagaaga

SEQ ID NO: 2118616 - RNA, 16 nt, Homo sapiens
ggaaauaaaccuggag

SEQ ID NO: 2118617 - RNA, 17 nt, Homo sapiens
aggucugcagcuccagg

SEQ ID NO: 2118618 - RNA, 23 nt, Homo sapiens
gauucaccucuucuuucccuccu

SEQ ID NO: 2118619 - RNA, 19 nt, Homo sapiens
acgaagagacagaacuguc

SEQ ID NO: 2118620 - RNA, 19 nt, Homo sapiens
aaugucacagugcuacaau

SEQ ID NO: 2118621 - RNA, 14 nt, Homo sapiens
aaguauaaagugau

SEQ ID NO: 2118622 - RNA, 23 nt, Homo sapiens
guuacuguguaaacucaucugaa

SEQ ID NO: 2118623 - RNA, 11 nt, Homo sapiens
ugcugugcaaa

SEQ ID NO: 2118624 - RNA, 13 nt, Homo sapiens
uucgcagcacaga

SEQ ID NO: 2118625 - RNA, 13 nt, Homo sapiens
uuaguuaaucucc

SEQ ID NO: 2118626 - RNA, 17 nt, Homo sapiens
acuugcagauacauuca

SEQ ID NO: 2118627 - RNA, 15 nt, Homo sapiens
augacauugaacuga

SEQ ID NO: 2118628 - RNA, 19 nt, Homo sapiens
aaccagaacccaguguuuc

SEQ ID NO: 2118629 - RNA, 21 nt, Homo sapiens
agacuuccaucuagucacaaa

SEQ ID NO: 2118630 - RNA, 22 nt, Homo sapiens
cgcugagcgucacggccaagug

SEQ ID NO: 2118631 - RNA, 21 nt, Homo sapiens
agacauaaacaaagacauuga

SEQ ID NO: 2118632 - RNA, 13 nt, Homo sapiens
uaauuuugucaaa

SEQ ID NO: 2118633 - RNA, 13 nt, Homo sapiens
ccaagcucugcag

SEQ ID NO: 2118634 - RNA, 13 nt, Homo sapiens
cugccuugaugaa

SEQ ID NO: 2118635 - RNA, 20 nt, Homo sapiens
uagagaauuuucugcauuau

SEQ ID NO: 2118636 - RNA, 20 nt, Homo sapiens
gucacaccugacaaauggaa

SEQ ID NO: 2118637 - RNA, 11 nt, Homo sapiens
gagugcagugg

SEQ ID NO: 2118638 - RNA, 14 nt, Homo sapiens
uccgagggcccaac

SEQ ID NO: 2118639 - RNA, 16 nt, Homo sapiens
uacuaagugacaguau

SEQ ID NO: 2118640 - RNA, 14 nt, Homo sapiens
ucucccuggagcug

SEQ ID NO: 2118641 - RNA, 13 nt, Homo sapiens
ggucguucuuauc

SEQ ID NO: 2118642 - RNA, 15 nt, Homo sapiens
augacuucacccacg

SEQ ID NO: 2118643 - RNA, 14 nt, Homo sapiens
cuaauggcacuuau

SEQ ID NO: 2118644 - RNA, 19 nt, Homo sapiens
uaugaaaauacaacuuaaa

SEQ ID NO: 2118645 - RNA, 16 nt, Homo sapiens
uggcacccacacagag

SEQ ID NO: 2118646 - RNA, 22 nt, Homo sapiens
caauucauauauuugaagugga

SEQ ID NO: 2118647 - RNA, 22 nt, Homo sapiens
cuguucuguuggaugacuuuga

SEQ ID NO: 2118648 - RNA, 17 nt, Homo sapiens
gacagcucuuccccacc

SEQ ID NO: 2118649 - RNA, 17 nt, Homo sapiens
gacucgaguccccauga

SEQ ID NO: 2118650 - RNA, 14 nt, Homo sapiens
augcccaacugccu

SEQ ID NO: 2118651 - RNA, 20 nt, Homo sapiens
aaacaacuaaauaacuguau

SEQ ID NO: 2118652 - RNA, 18 nt, Homo sapiens
ccucccacugccaaagaa

SEQ ID NO: 2118653 - RNA, 12 nt, Homo sapiens
ccugcugugauu

SEQ ID NO: 2118654 - RNA, 11 nt, Homo sapiens
agccuuccagg

SEQ ID NO: 2118655 - RNA, 22 nt, Homo sapiens
ucuaaguugaguauauuauaau

SEQ ID NO: 2118656 - RNA, 21 nt, Homo sapiens
acccuugagcugugugccaca

SEQ ID NO: 2118657 - RNA, 12 nt, Homo sapiens
aacacuaacuuu

SEQ ID NO: 2118658 - RNA, 22 nt, Homo sapiens
gcgaaaguaaaaacacuaccuc

SEQ ID NO: 2118659 - RNA, 23 nt, Homo sapiens
accagucuauuuccacugaacaa

SEQ ID NO: 2118660 - RNA, 15 nt, Homo sapiens
aaggacgaauuugca

SEQ ID NO: 2118661 - RNA, 17 nt, Homo sapiens
gaaaaauaacaauuuua

SEQ ID NO: 2118662 - RNA, 12 nt, Homo sapiens
uauccauggcaa

SEQ ID NO: 2118663 - RNA, 15 nt, Homo sapiens
caucauuugcauaug

SEQ ID NO: 2118664 - RNA, 13 nt, Homo sapiens
guauccauucuac

SEQ ID NO: 2118665 - RNA, 19 nt, Homo sapiens
uggagugcaauggugcgau

SEQ ID NO: 2118666 - RNA, 17 nt, Homo sapiens
ugcagagcaggaaauga

SEQ ID NO: 2118667 - RNA, 17 nt, Homo sapiens
uagagugaugacugcuu

SEQ ID NO: 2118668 - RNA, 16 nt, Homo sapiens
cugccugcccugguga

SEQ ID NO: 2118669 - RNA, 17 nt, Homo sapiens
ggggaggccucacccca

SEQ ID NO: 2118670 - RNA, 21 nt, Homo sapiens
agggcaggcuugccaccgggg

SEQ ID NO: 2118671 - RNA, 21 nt, Homo sapiens
aaggccagcugacuagaucuc

SEQ ID NO: 2118672 - RNA, 15 nt, Homo sapiens
ugugccuguguuuca

SEQ ID NO: 2118673 - RNA, 17 nt, Homo sapiens
cagagaaagaagagaca

SEQ ID NO: 2118674 - RNA, 18 nt, Homo sapiens
acuucaccuaacuagaga

SEQ ID NO: 2118675 - RNA, 16 nt, Homo sapiens
cgugucaggcugucag

SEQ ID NO: 2118676 - RNA, 17 nt, Homo sapiens
acucaccccuucuaauc

SEQ ID NO: 2118677 - RNA, 13 nt, Homo sapiens
uuggccacacugu

SEQ ID NO: 2118678 - RNA, 19 nt, Homo sapiens
cagaccaacccugggaccu

SEQ ID NO: 2118679 - RNA, 20 nt, Homo sapiens
gaaaccagaauuguuuugca

SEQ ID NO: 2118680 - RNA, 19 nt, Homo sapiens
caaggagggugagugcaag

SEQ ID NO: 2118681 - RNA, 23 nt, Homo sapiens
ggcagguguugggaccugcugcu

SEQ ID NO: 2118682 - RNA, 21 nt, Homo sapiens
caccaccgcccuccucgcugu

SEQ ID NO: 2118683 - RNA, 14 nt, Homo sapiens
uucaugcauggaaa

SEQ ID NO: 2118684 - RNA, 19 nt, Homo sapiens
aguaacaguguaguacuca

SEQ ID NO: 2118685 - RNA, 18 nt, Homo sapiens
gcgagggaagcaauugaa

SEQ ID NO: 2118686 - RNA, 22 nt, Homo sapiens
aguggacucagcagugaccaca

SEQ ID NO: 2118687 - RNA, 22 nt, Homo sapiens
cuucaacaaccggccaccagau

SEQ ID NO: 2118688 - RNA, 22 nt, Homo sapiens
uuuugaacaaaggaauuuucaa

SEQ ID NO: 2118689 - RNA, 16 nt, Homo sapiens
cuuugccuuuaggggu

SEQ ID NO: 2118690 - RNA, 21 nt, Homo sapiens
uuuguucuccggguguggccu

SEQ ID NO: 2118691 - RNA, 14 nt, Homo sapiens
uccugcauguuaau

SEQ ID NO: 2118692 - RNA, 18 nt, Homo sapiens
agaagguucuaccauuac

SEQ ID NO: 2118693 - RNA, 20 nt, Homo sapiens
ggagacagacacacacuggc

SEQ ID NO: 2118694 - RNA, 13 nt, Homo sapiens
caaguuccugaua

SEQ ID NO: 2118695 - RNA, 16 nt, Homo sapiens
uuauagucuguacuuc

SEQ ID NO: 2118696 - RNA, 16 nt, Homo sapiens
agcccagugggcugca

SEQ ID NO: 2118697 - RNA, 15 nt, Homo sapiens
aaugagcagggaugg

SEQ ID NO: 2118698 - RNA, 14 nt, Homo sapiens
cuauauuuagcccc

SEQ ID NO: 2118699 - RNA, 13 nt, Homo sapiens
uuccauaguauau

SEQ ID NO: 2118700 - RNA, 13 nt, Homo sapiens
auuccuugcugaa

SEQ ID NO: 2118701 - RNA, 19 nt, Homo sapiens
ccacgucucucugccugcu

SEQ ID NO: 2118702 - RNA, 16 nt, Homo sapiens
ugaaaaugaacuguaa

SEQ ID NO: 2118703 - RNA, 15 nt, Homo sapiens
aagccacacucuggg

SEQ ID NO: 2118704 - RNA, 17 nt, Homo sapiens
uuaaucguacauuuuca

SEQ ID NO: 2118705 - RNA, 23 nt, Homo sapiens
aucgccugaguugcuuuuacuuc

SEQ ID NO: 2118706 - RNA, 18 nt, Homo sapiens
cauaagggagauuguaua

SEQ ID NO: 2118707 - RNA, 15 nt, Homo sapiens
aaacugaacacugca

SEQ ID NO: 2118708 - RNA, 21 nt, Homo sapiens
auccaaggccgcggcccagac

SEQ ID NO: 2118709 - RNA, 21 nt, Homo sapiens
guuugcuuuguuuaagcauca

SEQ ID NO: 2118710 - RNA, 13 nt, Homo sapiens
agacuuucuguua

SEQ ID NO: 2118711 - RNA, 15 nt, Homo sapiens
gcacaucaauuacaa

SEQ ID NO: 2118712 - RNA, 13 nt, Homo sapiens
uugguaccagaua

SEQ ID NO: 2118713 - RNA, 18 nt, Homo sapiens
auccgucaccagaauuag

SEQ ID NO: 2118714 - RNA, 16 nt, Homo sapiens
aagugaagcauggcau

SEQ ID NO: 2118715 - RNA, 13 nt, Homo sapiens
gucuugucuucaa

SEQ ID NO: 2118716 - RNA, 17 nt, Homo sapiens
uuucauuguucacuucu

SEQ ID NO: 2118717 - RNA, 14 nt, Homo sapiens
ucucgguggcagaa

SEQ ID NO: 2118718 - RNA, 17 nt, Homo sapiens
ucgccucauuacuguga

SEQ ID NO: 2118719 - RNA, 17 nt, Homo sapiens
ucaggucccaggccagc

SEQ ID NO: 2118720 - RNA, 17 nt, Homo sapiens
aaucuuuaggcuuucaa

SEQ ID NO: 2118721 - RNA, 18 nt, Homo sapiens
cagggcaggaaggggaaa

SEQ ID NO: 2118722 - RNA, 22 nt, Homo sapiens
cugacaaugggcacugauuuga

SEQ ID NO: 2118723 - RNA, 17 nt, Homo sapiens
ugguuauccugugcuac

SEQ ID NO: 2118724 - RNA, 21 nt, Homo sapiens
guuuuucuaaaggaguuuaug

SEQ ID NO: 2118725 - RNA, 16 nt, Homo sapiens
aggcagagaaucauac

SEQ ID NO: 2118726 - RNA, 15 nt, Homo sapiens
acuauuaauuccaug

SEQ ID NO: 2118727 - RNA, 14 nt, Homo sapiens
agcucacaaccacc

SEQ ID NO: 2118728 - RNA, 14 nt, Homo sapiens
uugaaaaacacuau

SEQ ID NO: 2118729 - RNA, 17 nt, Homo sapiens
ucguagaaacaagacaa

SEQ ID NO: 2118730 - RNA, 13 nt, Homo sapiens
uuaugagcacaga

SEQ ID NO: 2118731 - RNA, 16 nt, Homo sapiens
uguuuugcucuuucag

SEQ ID NO: 2118732 - RNA, 20 nt, Homo sapiens
cuacacugauacacuugaag

SEQ ID NO: 2118733 - RNA, 14 nt, Homo sapiens
ucugcaucucuggu

SEQ ID NO: 2118734 - RNA, 16 nt, Homo sapiens
agauguggacaugcac

SEQ ID NO: 2118735 - RNA, 22 nt, Homo sapiens
aagcuuuuccuuucucuuacac

SEQ ID NO: 2118736 - RNA, 15 nt, Homo sapiens
ccaacgggaagcaac

SEQ ID NO: 2118737 - RNA, 18 nt, Homo sapiens
uccuggugccaauuucaa

SEQ ID NO: 2118738 - RNA, 22 nt, Homo sapiens
ccugaagugucgaguccagucc

SEQ ID NO: 2118739 - RNA, 22 nt, Homo sapiens
gcacugaucuuacucuacugcu

SEQ ID NO: 2118740 - RNA, 20 nt, Homo sapiens
ucauuggcauucuuugcaau

SEQ ID NO: 2118741 - RNA, 18 nt, Homo sapiens
uaagguaaaaugccauga

SEQ ID NO: 2118742 - RNA, 20 nt, Homo sapiens
aacagguaaacagaaauccu

SEQ ID NO: 2118743 - RNA, 21 nt, Homo sapiens
gaucaacaacauccacuguua

SEQ ID NO: 2118744 - RNA, 19 nt, Homo sapiens
aaguugccauuuugucuca

SEQ ID NO: 2118745 - RNA, 14 nt, Homo sapiens
aguagaugccuguu

SEQ ID NO: 2118746 - RNA, 18 nt, Homo sapiens
auauagauuuuguaauau

SEQ ID NO: 2118747 - RNA, 15 nt, Homo sapiens
ucuaaaucaccagaa

SEQ ID NO: 2118748 - RNA, 18 nt, Homo sapiens
gacagugaggcaggagaa

SEQ ID NO: 2118749 - RNA, 14 nt, Homo sapiens
uccuagugaaagag

SEQ ID NO: 2118750 - RNA, 21 nt, Homo sapiens
ggccuugaugguguagugcau

SEQ ID NO: 2118751 - RNA, 23 nt, Homo sapiens
uucagacccucauuccuucccag

SEQ ID NO: 2118752 - RNA, 20 nt, Homo sapiens
gacucuuggcagcagaccag

SEQ ID NO: 2118753 - RNA, 19 nt, Homo sapiens
gcagucuguaacacuuugg

SEQ ID NO: 2118754 - RNA, 15 nt, Homo sapiens
gcagcuagcucuuug

SEQ ID NO: 2118755 - RNA, 22 nt, Homo sapiens
agcccuauccuucucugccucu

SEQ ID NO: 2118756 - RNA, 19 nt, Homo sapiens
cuccagaaagcucaucuca

SEQ ID NO: 2118757 - RNA, 17 nt, Homo sapiens
agaggacaguuuaggac

SEQ ID NO: 2118758 - RNA, 14 nt, Homo sapiens
gugcauaucugccu

SEQ ID NO: 2118759 - RNA, 19 nt, Homo sapiens
ugccaaguaucuuuccagc

SEQ ID NO: 2118760 - RNA, 15 nt, Homo sapiens
auuuaaacuucuuaa

SEQ ID NO: 2118761 - RNA, 23 nt, Homo sapiens
cuuuccaggaaggcuaaagggaa

SEQ ID NO: 2118762 - RNA, 23 nt, Homo sapiens
gugugcuuauuuuaaauguuacu

SEQ ID NO: 2118763 - RNA, 20 nt, Homo sapiens
ucacugcauuuggucagggg

SEQ ID NO: 2118764 - RNA, 13 nt, Homo sapiens
cuguguguggaag

SEQ ID NO: 2118765 - RNA, 16 nt, Homo sapiens
augcuuuuuaucgcua

SEQ ID NO: 2118766 - RNA, 15 nt, Homo sapiens
gucagagaccuggga

SEQ ID NO: 2118767 - RNA, 13 nt, Homo sapiens
auuccagccaggg

SEQ ID NO: 2118768 - RNA, 16 nt, Homo sapiens
gacccaucacuuugga

SEQ ID NO: 2118769 - RNA, 22 nt, Homo sapiens
gaaauaugcuuucaucuucugu

SEQ ID NO: 2118770 - RNA, 20 nt, Homo sapiens
ucauaggauuaagcaguuua

SEQ ID NO: 2118771 - RNA, 22 nt, Homo sapiens
caauguagucucauaaccagga

SEQ ID NO: 2118772 - RNA, 21 nt, Homo sapiens
aucugaggcacaugucagcaa

SEQ ID NO: 2118773 - RNA, 15 nt, Homo sapiens
gagcaucggagggag

SEQ ID NO: 2118774 - RNA, 22 nt, Homo sapiens
ugagauucuucguguauagcug

SEQ ID NO: 2118775 - RNA, 17 nt, Homo sapiens
acagcgaagccagucca

SEQ ID NO: 2118776 - RNA, 18 nt, Homo sapiens
aacccgguuuaccaguuu

SEQ ID NO: 2118777 - RNA, 20 nt, Homo sapiens
auuguuugugacccugagaa

SEQ ID NO: 2118778 - RNA, 12 nt, Homo sapiens
augugaagccaa

SEQ ID NO: 2118779 - RNA, 22 nt, Homo sapiens
uguaaaaggcucagaucuuaau

SEQ ID NO: 2118780 - RNA, 23 nt, Homo sapiens
auuucaguuucuaucaaccuuca

SEQ ID NO: 2118781 - RNA, 18 nt, Homo sapiens
gcaguggcgcgaucucag

SEQ ID NO: 2118782 - RNA, 16 nt, Homo sapiens
acaauaauuacauugg

SEQ ID NO: 2118783 - RNA, 18 nt, Homo sapiens
cucuugaaguacuuaaca

SEQ ID NO: 2118784 - RNA, 14 nt, Homo sapiens
agaaaguacuucuc

SEQ ID NO: 2118785 - RNA, 19 nt, Homo sapiens
ggauggggagucucaugca

SEQ ID NO: 2118786 - RNA, 22 nt, Homo sapiens
ucucagacaucaagucaacuuu

SEQ ID NO: 2118787 - RNA, 18 nt, Homo sapiens
aaaguuuuccaguauuga

SEQ ID NO: 2118788 - RNA, 21 nt, Homo sapiens
uaaacuauucuauaaacauau

SEQ ID NO: 2118789 - RNA, 22 nt, Homo sapiens
ggcccugcagccggagaucuga

SEQ ID NO: 2118790 - RNA, 22 nt, Homo sapiens
cuaaaaaggucuguuaauguca

SEQ ID NO: 2118791 - RNA, 23 nt, Homo sapiens
cagagguggcugcugugcuagug

SEQ ID NO: 2118792 - RNA, 14 nt, Homo sapiens
gacuugauagcaaa

SEQ ID NO: 2118793 - RNA, 16 nt, Homo sapiens
gugccuucugccaacg

SEQ ID NO: 2118794 - RNA, 18 nt, Homo sapiens
aucacguuauaguccaug

SEQ ID NO: 2118795 - RNA, 16 nt, Homo sapiens
ucggaguugggggucc

SEQ ID NO: 2118796 - RNA, 20 nt, Homo sapiens
auucacagcaagucacuggc

SEQ ID NO: 2118797 - RNA, 17 nt, Homo sapiens
gugacuggcccacacgu

SEQ ID NO: 2118798 - RNA, 22 nt, Homo sapiens
uuugaaaacauauaaagcacua

SEQ ID NO: 2118799 - RNA, 17 nt, Homo sapiens
gacugcaccauugcugc

SEQ ID NO: 2118800 - RNA, 11 nt, Homo sapiens
uuugaccaguu

SEQ ID NO: 2118801 - RNA, 23 nt, Homo sapiens
gcccagccccuacugcugugaac

SEQ ID NO: 2118802 - RNA, 13 nt, Homo sapiens
uugaauagucuca

SEQ ID NO: 2118803 - RNA, 17 nt, Homo sapiens
uuugaaaagucacuuac

SEQ ID NO: 2118804 - RNA, 19 nt, Homo sapiens
cuccacuuggucugugaga

SEQ ID NO: 2118805 - RNA, 21 nt, Homo sapiens
ugggaagggcucccagccaca

SEQ ID NO: 2118806 - RNA, 23 nt, Homo sapiens
cagcugauugggcaccugaccac

SEQ ID NO: 2118807 - RNA, 19 nt, Homo sapiens
agugguggcagcucaaaau

SEQ ID NO: 2118808 - RNA, 16 nt, Homo sapiens
ucagacaggaaaggga

SEQ ID NO: 2118809 - RNA, 21 nt, Homo sapiens
ugccuuugguuuacucagggu

SEQ ID NO: 2118810 - RNA, 22 nt, Homo sapiens
aaggaggucaggccccacuccu

SEQ ID NO: 2118811 - RNA, 13 nt, Homo sapiens
gacucugcacuga

SEQ ID NO: 2118812 - RNA, 22 nt, Homo sapiens
cagccucccgaguagcugagau

SEQ ID NO: 2118813 - RNA, 11 nt, Homo sapiens
acgacucuucc

SEQ ID NO: 2118814 - RNA, 13 nt, Homo sapiens
cuauuuccacuga

SEQ ID NO: 2118815 - RNA, 16 nt, Homo sapiens
acagcugauacuucau

SEQ ID NO: 2118816 - RNA, 19 nt, Homo sapiens
gauccuuucucucaagggc

SEQ ID NO: 2118817 - RNA, 16 nt, Homo sapiens
acgaucuucuccacau

SEQ ID NO: 2118818 - RNA, 14 nt, Homo sapiens
caaaaugcucaagg

SEQ ID NO: 2118819 - RNA, 20 nt, Homo sapiens
aaauuuacaguuacugccua

SEQ ID NO: 2118820 - RNA, 19 nt, Homo sapiens
uaauaaaucuguugccaag

SEQ ID NO: 2118821 - RNA, 12 nt, Homo sapiens
cucuauaccaau

SEQ ID NO: 2118822 - RNA, 17 nt, Homo sapiens
cccucacaauaccuuau

SEQ ID NO: 2118823 - RNA, 16 nt, Homo sapiens
cuucggaauccagugc

SEQ ID NO: 2118824 - RNA, 20 nt, Homo sapiens
guuugcaguuggcuaagaga

SEQ ID NO: 2118825 - RNA, 20 nt, Homo sapiens
gacucuccaaauagcauuag

SEQ ID NO: 2118826 - RNA, 22 nt, Homo sapiens
gccagcugcccuugcagggugg

SEQ ID NO: 2118827 - RNA, 12 nt, Homo sapiens
ccaucucaaaaa

SEQ ID NO: 2118828 - RNA, 19 nt, Homo sapiens
uagcauggccacaucugag

SEQ ID NO: 2118829 - RNA, 21 nt, Homo sapiens
cucccucuccagcaggcccau

SEQ ID NO: 2118830 - RNA, 17 nt, Homo sapiens
aaaauuaucaauaucua

SEQ ID NO: 2118831 - RNA, 15 nt, Homo sapiens
gcagaaacacacagu

SEQ ID NO: 2118832 - RNA, 13 nt, Homo sapiens
uaaaaguguaaca

SEQ ID NO: 2118833 - RNA, 15 nt, Homo sapiens
aucugccaucugcuu

SEQ ID NO: 2118834 - RNA, 22 nt, Homo sapiens
uuguguugacacauaugaacac

SEQ ID NO: 2118835 - RNA, 14 nt, Homo sapiens
gaccauugucuucc

SEQ ID NO: 2118836 - RNA, 16 nt, Homo sapiens
ugggacagacagcagc

SEQ ID NO: 2118837 - RNA, 13 nt, Homo sapiens
uaucuguguauau

SEQ ID NO: 2118838 - RNA, 15 nt, Homo sapiens
cacaucuuaaauuca

SEQ ID NO: 2118839 - RNA, 20 nt, Homo sapiens
uuccagaaaaacauuuggca

SEQ ID NO: 2118840 - RNA, 19 nt, Homo sapiens
cuuaagauuuugcaccugu

SEQ ID NO: 2118841 - RNA, 19 nt, Homo sapiens
acacccuucucccacucuc

SEQ ID NO: 2118842 - RNA, 18 nt, Homo sapiens
uccagugaggaacccuga

SEQ ID NO: 2118843 - RNA, 13 nt, Homo sapiens
aaugaccaaggac

SEQ ID NO: 2118844 - RNA, 14 nt, Homo sapiens
ucagcaucugacca

SEQ ID NO: 2118845 - RNA, 14 nt, Homo sapiens
gcuuugaggacaaa

SEQ ID NO: 2118846 - RNA, 18 nt, Homo sapiens
ucuugcauugacauuaua

SEQ ID NO: 2118847 - RNA, 21 nt, Homo sapiens
uagaagcuguaacagaauaca

SEQ ID NO: 2118848 - RNA, 21 nt, Homo sapiens
accauuuuuuaauuuacuugu

SEQ ID NO: 2118849 - RNA, 22 nt, Homo sapiens
ggaaauauuugucuucucaggc

SEQ ID NO: 2118850 - RNA, 16 nt, Homo sapiens
ucagggauagcacuga

SEQ ID NO: 2118851 - RNA, 20 nt, Homo sapiens
uauauuugugauagcacuuu

SEQ ID NO: 2118852 - RNA, 20 nt, Homo sapiens
augaaggauuacucuccaua

SEQ ID NO: 2118853 - RNA, 21 nt, Homo sapiens
aggaagugauaacacuggagu

SEQ ID NO: 2118854 - RNA, 17 nt, Homo sapiens
gccgcuuaaacauuucc

SEQ ID NO: 2118855 - RNA, 18 nt, Homo sapiens
ugucgaugacuucaucaa

SEQ ID NO: 2118856 - RNA, 23 nt, Homo sapiens
ucucccggcaacaucucugggaa

SEQ ID NO: 2118857 - RNA, 23 nt, Homo sapiens
cuuuugaauaauguagugcaguc

SEQ ID NO: 2118858 - RNA, 14 nt, Homo sapiens
cccuuuccucuuaa

SEQ ID NO: 2118859 - RNA, 18 nt, Homo sapiens
gcuuuuccugauguucca

SEQ ID NO: 2118860 - RNA, 24 nt, Homo sapiens
cauagauaauaguacaugucaccu

SEQ ID NO: 2118861 - RNA, 13 nt, Homo sapiens
caguuguuugugu

SEQ ID NO: 2118862 - RNA, 17 nt, Homo sapiens
ugcuaacuguguguaca

SEQ ID NO: 2118863 - RNA, 15 nt, Homo sapiens
aaguuuaucuuugca

SEQ ID NO: 2118864 - RNA, 22 nt, Homo sapiens
cuauacaaauauaaaucuuaaa

SEQ ID NO: 2118865 - RNA, 16 nt, Homo sapiens
ucccuugagugaggca

SEQ ID NO: 2118866 - RNA, 12 nt, Homo sapiens
agcagcuuugua

SEQ ID NO: 2118867 - RNA, 13 nt, Homo sapiens
uaaacuuuucaaa

SEQ ID NO: 2118868 - RNA, 20 nt, Homo sapiens
cuggcaggagacacuggucu

SEQ ID NO: 2118869 - RNA, 18 nt, Homo sapiens
uguaugcacaugaacuua

SEQ ID NO: 2118870 - RNA, 15 nt, Homo sapiens
aauuaguucuccuau

SEQ ID NO: 2118871 - RNA, 17 nt, Homo sapiens
agagaagccuuuuccau

SEQ ID NO: 2118872 - RNA, 23 nt, Homo sapiens
agacaugggugaacuuacuugca

SEQ ID NO: 2118873 - RNA, 15 nt, Homo sapiens
uaagaggccugugau

SEQ ID NO: 2118874 - RNA, 14 nt, Homo sapiens
ugggaagugacuua

SEQ ID NO: 2118875 - RNA, 19 nt, Homo sapiens
gagacuucacgggcaauca

SEQ ID NO: 2118876 - RNA, 15 nt, Homo sapiens
aaggcauaucuucua

SEQ ID NO: 2118877 - RNA, 13 nt, Homo sapiens
uacaaucuucauu

SEQ ID NO: 2118878 - RNA, 21 nt, Homo sapiens
ugucuacauagugacaugcac

SEQ ID NO: 2118879 - RNA, 16 nt, Homo sapiens
agccaaagaacaaaua

SEQ ID NO: 2118880 - RNA, 16 nt, Homo sapiens
ucccuggggaugugcu

SEQ ID NO: 2118881 - RNA, 12 nt, Homo sapiens
aaugucauaaau

SEQ ID NO: 2118882 - RNA, 23 nt, Homo sapiens
aguaauuggucaugugaugcaag

SEQ ID NO: 2118883 - RNA, 22 nt, Homo sapiens
cuaaagcuaggggcccacuaaa

SEQ ID NO: 2118884 - RNA, 18 nt, Homo sapiens
ucugguugagagccugcc

SEQ ID NO: 2118885 - RNA, 13 nt, Homo sapiens
uucgaaacugcca

SEQ ID NO: 2118886 - RNA, 16 nt, Homo sapiens
cauguucacugcaaug

SEQ ID NO: 2118887 - RNA, 12 nt, Homo sapiens
caucagccagac

SEQ ID NO: 2118888 - RNA, 14 nt, Homo sapiens
gaguuuacuaccug

SEQ ID NO: 2118889 - RNA, 17 nt, Homo sapiens
cauugggcacauaucuc

SEQ ID NO: 2118890 - RNA, 14 nt, Homo sapiens
agaacugcuuagua

SEQ ID NO: 2118891 - RNA, 14 nt, Homo sapiens
ggagccaugcucuu

SEQ ID NO: 2118892 - RNA, 21 nt, Homo sapiens
ggcgaccuccuuucaucacac

SEQ ID NO: 2118893 - RNA, 23 nt, Homo sapiens
ucauuggggugguugucauguga

SEQ ID NO: 2118894 - RNA, 23 nt, Homo sapiens
guaaaaaagauuuguagagucaa

SEQ ID NO: 2118895 - RNA, 13 nt, Homo sapiens
gacccaaccacuu

SEQ ID NO: 2118896 - RNA, 17 nt, Homo sapiens
ucccuucaugcauggaa

SEQ ID NO: 2118897 - RNA, 16 nt, Homo sapiens
ucaggauggcucagac

SEQ ID NO: 2118898 - RNA, 22 nt, Homo sapiens
uguauuuauccaauaaauguga

SEQ ID NO: 2118899 - RNA, 19 nt, Homo sapiens
cagggauggguuugcuuug

SEQ ID NO: 2118900 - RNA, 17 nt, Homo sapiens
cgcaaauuuucuuccau

SEQ ID NO: 2118901 - RNA, 14 nt, Homo sapiens
ucaaauauugaaug

SEQ ID NO: 2118902 - RNA, 23 nt, Homo sapiens
acugguuucucagaauccaaaga

SEQ ID NO: 2118903 - RNA, 14 nt, Homo sapiens
agauggaugcaugu

SEQ ID NO: 2118904 - RNA, 19 nt, Homo sapiens
agccaaggucaugccacug

SEQ ID NO: 2118905 - RNA, 13 nt, Homo sapiens
gucagucuacagg

SEQ ID NO: 2118906 - RNA, 13 nt, Homo sapiens
aaugucagcacau

SEQ ID NO: 2118907 - RNA, 18 nt, Homo sapiens
ucaauaugcaagcagcuu

SEQ ID NO: 2118908 - RNA, 23 nt, Homo sapiens
aacacauuuccauucauggauau

SEQ ID NO: 2118909 - RNA, 20 nt, Homo sapiens
gaacugcuugugcacuggau

SEQ ID NO: 2118910 - RNA, 18 nt, Homo sapiens
uuaaaagcccuaccuaaa

SEQ ID NO: 2118911 - RNA, 18 nt, Homo sapiens
ucuucaauaaaccacaag

SEQ ID NO: 2118912 - RNA, 23 nt, Homo sapiens
auucaaucuuuggaggcuuuuaa

SEQ ID NO: 2118913 - RNA, 18 nt, Homo sapiens
cuuuaaagaugauuguuc

SEQ ID NO: 2118914 - RNA, 14 nt, Homo sapiens
auuuguccaaacag

SEQ ID NO: 2118915 - RNA, 22 nt, Homo sapiens
uuuuguauuuaaagcauuuuga

SEQ ID NO: 2118916 - RNA, 13 nt, Homo sapiens
aaagcuaaugucu

SEQ ID NO: 2118917 - RNA, 15 nt, Homo sapiens
cagcacacaugcauc

SEQ ID NO: 2118918 - RNA, 21 nt, Homo sapiens
uaaacuaaugagcaaguaaca

SEQ ID NO: 2118919 - RNA, 17 nt, Homo sapiens
ccuguugguuagauuca

SEQ ID NO: 2118920 - RNA, 13 nt, Homo sapiens
auguugaagccuu

SEQ ID NO: 2118921 - RNA, 21 nt, Homo sapiens
agggaaguucaggcucugaga

SEQ ID NO: 2118922 - RNA, 15 nt, Homo sapiens
cuggcauugaaaugc

SEQ ID NO: 2118923 - RNA, 23 nt, Homo sapiens
uuaaauuucugcccugagcccuc

SEQ ID NO: 2118924 - RNA, 17 nt, Homo sapiens
ccaucaugccacaccgg

SEQ ID NO: 2118925 - RNA, 16 nt, Homo sapiens
cagccuggggccaagc

SEQ ID NO: 2118926 - RNA, 14 nt, Homo sapiens
uuuccuaagacauu

SEQ ID NO: 2118927 - RNA, 21 nt, Homo sapiens
auugaacuuuuguacugaauu

SEQ ID NO: 2118928 - RNA, 22 nt, Homo sapiens
acugaauuaaacuuaaguccag

SEQ ID NO: 2118929 - RNA, 16 nt, Homo sapiens
ugcugugucauuccaa

SEQ ID NO: 2118930 - RNA, 18 nt, Homo sapiens
cuuuagacaaauuguuaa

SEQ ID NO: 2118931 - RNA, 20 nt, Homo sapiens
acauaacguuuuuccuuuaa

SEQ ID NO: 2118932 - RNA, 16 nt, Homo sapiens
ucucauuugccaggaa

SEQ ID NO: 2118933 - RNA, 17 nt, Homo sapiens
guauagccccacagauu

SEQ ID NO: 2118934 - RNA, 16 nt, Homo sapiens
gcccggccuaugauuc

SEQ ID NO: 2118935 - RNA, 18 nt, Homo sapiens
acgguaggccaagcugaa

SEQ ID NO: 2118936 - RNA, 22 nt, Homo sapiens
uucuguggcugccaucagaaau

SEQ ID NO: 2118937 - RNA, 19 nt, Homo sapiens
gugucaguucaacuuucag

SEQ ID NO: 2118938 - RNA, 16 nt, Homo sapiens
aacacuagacaagcca

SEQ ID NO: 2118939 - RNA, 22 nt, Homo sapiens
ggagaucauccuaacaaugugg

SEQ ID NO: 2118940 - RNA, 16 nt, Homo sapiens
ucacguaaagcuagaa

SEQ ID NO: 2118941 - RNA, 21 nt, Homo sapiens
cauuuacuuguacgagacaga

SEQ ID NO: 2118942 - RNA, 20 nt, Homo sapiens
cugcacaaaagcagauacuu

SEQ ID NO: 2118943 - RNA, 12 nt, Homo sapiens
gcauaaagccaa

SEQ ID NO: 2118944 - RNA, 21 nt, Homo sapiens
uuccaguaugaaaagcuaucu

SEQ ID NO: 2118945 - RNA, 21 nt, Homo sapiens
uaaaugaccaaagaugaccug

SEQ ID NO: 2118946 - RNA, 14 nt, Homo sapiens
caaacacauuguga

SEQ ID NO: 2118947 - RNA, 19 nt, Homo sapiens
uucaucuacccugcugacc

SEQ ID NO: 2118948 - RNA, 20 nt, Homo sapiens
ggauuugaugaaagugcaaa

SEQ ID NO: 2118949 - RNA, 14 nt, Homo sapiens
aguugaagacagcu

SEQ ID NO: 2118950 - RNA, 19 nt, Homo sapiens
uccacuggggaaugcuccc

SEQ ID NO: 2118951 - RNA, 23 nt, Homo sapiens
augcagugaaaagggcagaaaua

SEQ ID NO: 2118952 - RNA, 16 nt, Homo sapiens
uggagccuguguaaca

SEQ ID NO: 2118953 - RNA, 19 nt, Homo sapiens
gaccuguucaaaaaggaaa

SEQ ID NO: 2118954 - RNA, 16 nt, Homo sapiens
gcucuucucagugucu

SEQ ID NO: 2118955 - RNA, 18 nt, Homo sapiens
gcacugucuguaccuaaa

SEQ ID NO: 2118956 - RNA, 21 nt, Homo sapiens
aguuggugcuuuugagaacca

SEQ ID NO: 2118957 - RNA, 13 nt, Homo sapiens
aacagaugaauaa

SEQ ID NO: 2118958 - RNA, 15 nt, Homo sapiens
acauugacuguggcu

SEQ ID NO: 2118959 - RNA, 21 nt, Homo sapiens
ugugcaguggcccccacagaa

SEQ ID NO: 2118960 - RNA, 14 nt, Homo sapiens
caagcuccucaauc

SEQ ID NO: 2118961 - RNA, 19 nt, Homo sapiens
gagcccccugaccuuccaa

SEQ ID NO: 2118962 - RNA, 13 nt, Homo sapiens
aaaugcugugcaa

SEQ ID NO: 2118963 - RNA, 23 nt, Homo sapiens
caauuauggagugucaccagcug

SEQ ID NO: 2118964 - RNA, 13 nt, Homo sapiens
gauguuagcccaa

SEQ ID NO: 2118965 - RNA, 21 nt, Homo sapiens
uuuaagccaauauaaugggcu

SEQ ID NO: 2118966 - RNA, 23 nt, Homo sapiens
guggcccaugugacuguggcauu

SEQ ID NO: 2118967 - RNA, 17 nt, Homo sapiens
gauuagugucuaaggaa

SEQ ID NO: 2118968 - RNA, 14 nt, Homo sapiens
uccacacgcauuaa

SEQ ID NO: 2118969 - RNA, 17 nt, Homo sapiens
caaugucuuuugacagg

SEQ ID NO: 2118970 - RNA, 18 nt, Homo sapiens
uaagacaaacacugccau

SEQ ID NO: 2118971 - RNA, 16 nt, Homo sapiens
gaaccaggaaauggaa

SEQ ID NO: 2118972 - RNA, 22 nt, Homo sapiens
cuaugggagagugucaaccaga

SEQ ID NO: 2118973 - RNA, 13 nt, Homo sapiens
ccuuccuuaccug

SEQ ID NO: 2118974 - RNA, 17 nt, Homo sapiens
uacacaaaagccaaaag

SEQ ID NO: 2118975 - RNA, 22 nt, Homo sapiens
ccaagacaaaaagccacaauga

SEQ ID NO: 2118976 - RNA, 14 nt, Homo sapiens
gucacccuccucac

SEQ ID NO: 2118977 - RNA, 21 nt, Homo sapiens
augaucccacugaccuacucu

SEQ ID NO: 2118978 - RNA, 14 nt, Homo sapiens
gcugucuucuggac

SEQ ID NO: 2118979 - RNA, 22 nt, Homo sapiens
guacuuuauuuguauuugccau

SEQ ID NO: 2118980 - RNA, 17 nt, Homo sapiens
uugagcuguggcuguga

SEQ ID NO: 2118981 - RNA, 20 nt, Homo sapiens
auagggggaagacagauaug

SEQ ID NO: 2118982 - RNA, 14 nt, Homo sapiens
cuugcauugcugga

SEQ ID NO: 2118983 - RNA, 21 nt, Homo sapiens
agucaucuguuuaauuuacac

SEQ ID NO: 2118984 - RNA, 14 nt, Homo sapiens
ugagcuggggaccu

SEQ ID NO: 2118985 - RNA, 15 nt, Homo sapiens
auggaugcguggaua

SEQ ID NO: 2118986 - RNA, 20 nt, Homo sapiens
cuuauauuuacaacacuuua

SEQ ID NO: 2118987 - RNA, 16 nt, Homo sapiens
uggaauuugcuuuauc

SEQ ID NO: 2118988 - RNA, 16 nt, Homo sapiens
aauaaacgcauuauca

SEQ ID NO: 2118989 - RNA, 23 nt, Homo sapiens
uaauuaaaaagaugguugccaag

SEQ ID NO: 2118990 - RNA, 21 nt, Homo sapiens
ccacgaggugguagcucugag

SEQ ID NO: 2118991 - RNA, 16 nt, Homo sapiens
gccuugucugggugca

SEQ ID NO: 2118992 - RNA, 19 nt, Homo sapiens
guugguuccaagucuuugc

SEQ ID NO: 2118993 - RNA, 17 nt, Homo sapiens
aagggagguaaaaaauc

SEQ ID NO: 2118994 - RNA, 20 nt, Homo sapiens
cacacguuugauuucuuccu

SEQ ID NO: 2118995 - RNA, 17 nt, Homo sapiens
augaguccccugugaga

SEQ ID NO: 2118996 - RNA, 17 nt, Homo sapiens
auccauccagcuugcca

SEQ ID NO: 2118997 - RNA, 18 nt, Homo sapiens
ccaaguccucccucucua

SEQ ID NO: 2118998 - RNA, 13 nt, Homo sapiens
cagccagauccuc

SEQ ID NO: 2118999 - RNA, 16 nt, Homo sapiens
aagcauauuguuauua

SEQ ID NO: 2119000 - RNA, 12 nt, Homo sapiens
uagaaugcagcu

SEQ ID NO: 2119001 - RNA, 13 nt, Homo sapiens
auaucucaucucu

SEQ ID NO: 2119002 - RNA, 22 nt, Homo sapiens
gcaucauuacaauacaguauuu

SEQ ID NO: 2119003 - RNA, 15 nt, Homo sapiens
gcaauuuugcauagc

SEQ ID NO: 2119004 - RNA, 14 nt, Homo sapiens
gcuggcaguagugc

SEQ ID NO: 2119005 - RNA, 13 nt, Homo sapiens
uggguuugagaag

SEQ ID NO: 2119006 - RNA, 18 nt, Homo sapiens
aagaggagccucagaaga

SEQ ID NO: 2119007 - RNA, 14 nt, Homo sapiens
aagcagaugggaac

SEQ ID NO: 2119008 - RNA, 17 nt, Homo sapiens
aaacuuuaagaacaaac

SEQ ID NO: 2119009 - RNA, 18 nt, Homo sapiens
cugagcccggaaacucca

SEQ ID NO: 2119010 - RNA, 18 nt, Homo sapiens
gacuaugauggaccagcc

SEQ ID NO: 2119011 - RNA, 21 nt, Homo sapiens
ugaccuauaguaagugcuuaa

SEQ ID NO: 2119012 - RNA, 12 nt, Homo sapiens
cugucauaacau

SEQ ID NO: 2119013 - RNA, 23 nt, Homo sapiens
aaguugauauagaacagugcuug

SEQ ID NO: 2119014 - RNA, 16 nt, Homo sapiens
gcaacagcuaggaaau

SEQ ID NO: 2119015 - RNA, 20 nt, Homo sapiens
gagucucacucuguugccca

SEQ ID NO: 2119016 - RNA, 16 nt, Homo sapiens
cacagcaugugcaaua

SEQ ID NO: 2119017 - RNA, 22 nt, Homo sapiens
uaauuugaaauuugacucauga

SEQ ID NO: 2119018 - RNA, 14 nt, Homo sapiens
ggaccuuacaggcc

SEQ ID NO: 2119019 - RNA, 20 nt, Homo sapiens
gguggcugagcaucggagug

SEQ ID NO: 2119020 - RNA, 12 nt, Homo sapiens
augcacaugccu

SEQ ID NO: 2119021 - RNA, 16 nt, Homo sapiens
caagcuccucccuuga

SEQ ID NO: 2119022 - RNA, 23 nt, Homo sapiens
uguuuucuguagacucuaagaua

SEQ ID NO: 2119023 - RNA, 13 nt, Homo sapiens
ucaggcugugcuu

SEQ ID NO: 2119024 - RNA, 17 nt, Homo sapiens
agcuuccuucugugaaa

SEQ ID NO: 2119025 - RNA, 13 nt, Homo sapiens
uccucgacaucuu

SEQ ID NO: 2119026 - RNA, 15 nt, Homo sapiens
guauuauugauauua

SEQ ID NO: 2119027 - RNA, 12 nt, Homo sapiens
uaugaucuuggc

SEQ ID NO: 2119028 - RNA, 16 nt, Homo sapiens
aucuuccacaggucuc

SEQ ID NO: 2119029 - RNA, 18 nt, Homo sapiens
uuaacuuauugcauaaca

SEQ ID NO: 2119030 - RNA, 20 nt, Homo sapiens
cccuuaggucgcgcucuugc

SEQ ID NO: 2119031 - RNA, 20 nt, Homo sapiens
cgccuccaaccccucgccca

SEQ ID NO: 2119032 - RNA, 19 nt, Homo sapiens
aauauuuuguuuugugcag

SEQ ID NO: 2119033 - RNA, 16 nt, Homo sapiens
uaccuuagacugaaaa

SEQ ID NO: 2119034 - RNA, 21 nt, Homo sapiens
gccugggguguuaguggcacc

SEQ ID NO: 2119035 - RNA, 13 nt, Homo sapiens
uuuucacucuggg

SEQ ID NO: 2119036 - RNA, 21 nt, Homo sapiens
guauguuuucuguaaggaaua

SEQ ID NO: 2119037 - RNA, 23 nt, Homo sapiens
aaucaguaugaagacacugucaa

SEQ ID NO: 2119038 - RNA, 13 nt, Homo sapiens
uaaagcaggauuu

SEQ ID NO: 2119039 - RNA, 18 nt, Homo sapiens
uuuaugagucagucucuc

SEQ ID NO: 2119040 - RNA, 16 nt, Homo sapiens
auaacuauuacagugu

SEQ ID NO: 2119041 - RNA, 16 nt, Homo sapiens
uauucauuauuuguca

SEQ ID NO: 2119042 - RNA, 16 nt, Homo sapiens
ugucuggguuccaaaa

SEQ ID NO: 2119043 - RNA, 16 nt, Homo sapiens
ggugaaggauugaaau

SEQ ID NO: 2119044 - RNA, 19 nt, Homo sapiens
guacucuuuagaucuccca

SEQ ID NO: 2119045 - RNA, 20 nt, Homo sapiens
uacgcacgauaucuagugac

SEQ ID NO: 2119046 - RNA, 22 nt, Homo sapiens
cucaaaggaacuuucugguccc

SEQ ID NO: 2119047 - RNA, 17 nt, Homo sapiens
uguaaauuguauucuca

SEQ ID NO: 2119048 - RNA, 23 nt, Homo sapiens
uugagaagcaaauauguuugcau

SEQ ID NO: 2119049 - RNA, 13 nt, Homo sapiens
accauguacauga

SEQ ID NO: 2119050 - RNA, 21 nt, Homo sapiens
ucauuagcaacaacaugcuaa

SEQ ID NO: 2119051 - RNA, 17 nt, Homo sapiens
aauaaacuugugccucc

SEQ ID NO: 2119052 - RNA, 13 nt, Homo sapiens
auaaugugcuuua

SEQ ID NO: 2119053 - RNA, 13 nt, Homo sapiens
acuuugugccaaa

SEQ ID NO: 2119054 - RNA, 16 nt, Homo sapiens
aaaaugguaaaauugc

SEQ ID NO: 2119055 - RNA, 22 nt, Homo sapiens
uuucacgggcaacacucacugc

SEQ ID NO: 2119056 - RNA, 17 nt, Homo sapiens
uacaugguuuaaaguca

SEQ ID NO: 2119057 - RNA, 15 nt, Homo sapiens
cagagcccaccuuga

SEQ ID NO: 2119058 - RNA, 22 nt, Homo sapiens
gguaaaaauauaagaacuugau

SEQ ID NO: 2119059 - RNA, 23 nt, Homo sapiens
acauuaaacacaaagcuguugaa

SEQ ID NO: 2119060 - RNA, 21 nt, Homo sapiens
caaguauugucgguuaccucu

SEQ ID NO: 2119061 - RNA, 16 nt, Homo sapiens
auauggagugccugua

SEQ ID NO: 2119062 - RNA, 14 nt, Homo sapiens
ccuuggcagaggca

SEQ ID NO: 2119063 - RNA, 13 nt, Homo sapiens
gcaaagugcugua

SEQ ID NO: 2119064 - RNA, 15 nt, Homo sapiens
ugaacuaaccaaaua

SEQ ID NO: 2119065 - RNA, 19 nt, Homo sapiens
aaugccacacggcucucac

SEQ ID NO: 2119066 - RNA, 20 nt, Homo sapiens
aguucuaugaagaguauuaa

SEQ ID NO: 2119067 - RNA, 20 nt, Homo sapiens
aucucuacuaaaaacacaaa

SEQ ID NO: 2119068 - RNA, 20 nt, Homo sapiens
ugcucacacuauauacagau

SEQ ID NO: 2119069 - RNA, 13 nt, Homo sapiens
cccaacccuggcu

SEQ ID NO: 2119070 - RNA, 18 nt, Homo sapiens
uguggaguggacauucaa

SEQ ID NO: 2119071 - RNA, 16 nt, Homo sapiens
ugcaacaguagcauag

SEQ ID NO: 2119072 - RNA, 18 nt, Homo sapiens
gaaggacaguugauuucc

SEQ ID NO: 2119073 - RNA, 20 nt, Homo sapiens
acauuccucagaaaccaaag

SEQ ID NO: 2119074 - RNA, 20 nt, Homo sapiens
uugguaguggaauagugaau

SEQ ID NO: 2119075 - RNA, 16 nt, Homo sapiens
cuguuucucaugaagc

SEQ ID NO: 2119076 - RNA, 15 nt, Homo sapiens
acugagaagcaauca

SEQ ID NO: 2119077 - RNA, 17 nt, Homo sapiens
caaauauuuauaagcua

SEQ ID NO: 2119078 - RNA, 23 nt, Homo sapiens
ccugcagucagggcccagaguug

SEQ ID NO: 2119079 - RNA, 14 nt, Homo sapiens
ucaggggucacuga

SEQ ID NO: 2119080 - RNA, 13 nt, Homo sapiens
auuaacaaaugug

SEQ ID NO: 2119081 - RNA, 13 nt, Homo sapiens
ugcuccaguaugg

SEQ ID NO: 2119082 - RNA, 14 nt, Homo sapiens
guaagguauugcaa

SEQ ID NO: 2119083 - RNA, 23 nt, Homo sapiens
ucaaagugugacauucaguguua

SEQ ID NO: 2119084 - RNA, 20 nt, Homo sapiens
gugaagaaaccguauccaua

SEQ ID NO: 2119085 - RNA, 21 nt, Homo sapiens
aacacagcauguguauuucca

SEQ ID NO: 2119086 - RNA, 21 nt, Homo sapiens
gaaacugugaagaucucacuc

SEQ ID NO: 2119087 - RNA, 23 nt, Homo sapiens
ggccaucaggacuuucccugaca

SEQ ID NO: 2119088 - RNA, 16 nt, Homo sapiens
accucaucucuacuaa

SEQ ID NO: 2119089 - RNA, 16 nt, Homo sapiens
cucuucuugacaucaa

SEQ ID NO: 2119090 - RNA, 15 nt, Homo sapiens
guacccugcuguaua

SEQ ID NO: 2119091 - RNA, 13 nt, Homo sapiens
agugagaaacuga

SEQ ID NO: 2119092 - RNA, 19 nt, Homo sapiens
uguuaggaagggugagaau

SEQ ID NO: 2119093 - RNA, 15 nt, Homo sapiens
cagaagcaagccaga

SEQ ID NO: 2119094 - RNA, 11 nt, Homo sapiens
cuuuacuccuc

SEQ ID NO: 2119095 - RNA, 18 nt, Homo sapiens
ggagugagaucauuuucu

SEQ ID NO: 2119096 - RNA, 13 nt, Homo sapiens
gcccacacuugag

SEQ ID NO: 2119097 - RNA, 24 nt, Homo sapiens
gugccuccagacaugugcacauga

SEQ ID NO: 2119098 - RNA, 16 nt, Homo sapiens
ccaguuacguugugua

SEQ ID NO: 2119099 - RNA, 14 nt, Homo sapiens
aaggaagacuugaa

SEQ ID NO: 2119100 - RNA, 20 nt, Homo sapiens
aguuguuuucccgagcaaag

SEQ ID NO: 2119101 - RNA, 23 nt, Homo sapiens
gccacgcuuuaugcccuugccuc

SEQ ID NO: 2119102 - RNA, 20 nt, Homo sapiens
aauccaugugacucaagccu

SEQ ID NO: 2119103 - RNA, 21 nt, Homo sapiens
gaugggagagguucugugcaa

SEQ ID NO: 2119104 - RNA, 17 nt, Homo sapiens
acucugagcccccugac

SEQ ID NO: 2119105 - RNA, 12 nt, Homo sapiens
gcucaggugccu

SEQ ID NO: 2119106 - RNA, 19 nt, Homo sapiens
accguggaccuuccugcca

SEQ ID NO: 2119107 - RNA, 23 nt, Homo sapiens
aaugcccaacagggcaaccaaua

SEQ ID NO: 2119108 - RNA, 21 nt, Homo sapiens
cacucacacggacacucaaaa

SEQ ID NO: 2119109 - RNA, 16 nt, Homo sapiens
uuugaggaacauucaa

SEQ ID NO: 2119110 - RNA, 14 nt, Homo sapiens
ugugcugguguccu

SEQ ID NO: 2119111 - RNA, 16 nt, Homo sapiens
agccacagaccaccug

SEQ ID NO: 2119112 - RNA, 17 nt, Homo sapiens
gcuccagaucugcacug

SEQ ID NO: 2119113 - RNA, 15 nt, Homo sapiens
aggaaaaaaaugacu

SEQ ID NO: 2119114 - RNA, 22 nt, Homo sapiens
uguguauguauaaguguguaca

SEQ ID NO: 2119115 - RNA, 18 nt, Homo sapiens
agaaucuagauaggugcu

SEQ ID NO: 2119116 - RNA, 12 nt, Homo sapiens
augucauucauu

SEQ ID NO: 2119117 - RNA, 16 nt, Homo sapiens
uugaugccaaagcaga

SEQ ID NO: 2119118 - RNA, 20 nt, Homo sapiens
aaucaugggcagaggaugag

SEQ ID NO: 2119119 - RNA, 23 nt, Homo sapiens
gaaggagaugaauagaagaaaga

SEQ ID NO: 2119120 - RNA, 16 nt, Homo sapiens
cccaaauggcugcuuu

SEQ ID NO: 2119121 - RNA, 23 nt, Homo sapiens
aaacauuguuuuuguugucuuua

SEQ ID NO: 2119122 - RNA, 16 nt, Homo sapiens
gucagggccauuucag

SEQ ID NO: 2119123 - RNA, 20 nt, Homo sapiens
auauauuuaugaaugugcau

SEQ ID NO: 2119124 - RNA, 18 nt, Homo sapiens
cccucugggcucugagua

SEQ ID NO: 2119125 - RNA, 17 nt, Homo sapiens
uucuuuaagucaguuca

SEQ ID NO: 2119126 - RNA, 16 nt, Homo sapiens
auuuuugcugagacua

SEQ ID NO: 2119127 - RNA, 16 nt, Homo sapiens
uagugucccuuaccug

SEQ ID NO: 2119128 - RNA, 17 nt, Homo sapiens
cuagcaggcacaggaca

SEQ ID NO: 2119129 - RNA, 19 nt, Homo sapiens
uugacuaauagagcuccau

SEQ ID NO: 2119130 - RNA, 20 nt, Homo sapiens
agaauucuggauaucucagg

SEQ ID NO: 2119131 - RNA, 15 nt, Homo sapiens
cuccgcgccuacccu

SEQ ID NO: 2119132 - RNA, 21 nt, Homo sapiens
aagaggggacaggucccucac

SEQ ID NO: 2119133 - RNA, 19 nt, Homo sapiens
ucaaaaucuguagagcagg

SEQ ID NO: 2119134 - RNA, 13 nt, Homo sapiens
ucuugaaacugug

SEQ ID NO: 2119135 - RNA, 13 nt, Homo sapiens
uuuaaaaaccgaa

SEQ ID NO: 2119136 - RNA, 17 nt, Homo sapiens
augccaugugcaggugg

SEQ ID NO: 2119137 - RNA, 13 nt, Homo sapiens
uggugauggucuc

SEQ ID NO: 2119138 - RNA, 22 nt, Homo sapiens
ccugugugggacugaguggcaa

SEQ ID NO: 2119139 - RNA, 16 nt, Homo sapiens
cuaaaaugaguuaccu

SEQ ID NO: 2119140 - RNA, 16 nt, Homo sapiens
acccugucucuacuaa

SEQ ID NO: 2119141 - RNA, 23 nt, Homo sapiens
uagaacauagaugcuacaguauu

SEQ ID NO: 2119142 - RNA, 17 nt, Homo sapiens
cccaguuugcuggguuu

SEQ ID NO: 2119143 - RNA, 18 nt, Homo sapiens
ucuuuguuacuuccuuau

SEQ ID NO: 2119144 - RNA, 17 nt, Homo sapiens
caaagcuuccauuccac

SEQ ID NO: 2119145 - RNA, 22 nt, Homo sapiens
uaugugagauuuuuuauugcua

SEQ ID NO: 2119146 - RNA, 13 nt, Homo sapiens
agaaguccugcac

SEQ ID NO: 2119147 - RNA, 21 nt, Homo sapiens
ccaucugguaucaucuucuca

SEQ ID NO: 2119148 - RNA, 18 nt, Homo sapiens
uaucagcucucugcagaa

SEQ ID NO: 2119149 - RNA, 17 nt, Homo sapiens
caggcaaggaugucuga

SEQ ID NO: 2119150 - RNA, 21 nt, Homo sapiens
uuaguauuaauacuacccaua

SEQ ID NO: 2119151 - RNA, 13 nt, Homo sapiens
aggcauugcacag

SEQ ID NO: 2119152 - RNA, 14 nt, Homo sapiens
aaagguugacucau

SEQ ID NO: 2119153 - RNA, 21 nt, Homo sapiens
ucuaagugggacauucaaaaa

SEQ ID NO: 2119154 - RNA, 22 nt, Homo sapiens
gagagcucgcuuugagugacug

SEQ ID NO: 2119155 - RNA, 22 nt, Homo sapiens
cugggauggggcauguggccaa

SEQ ID NO: 2119156 - RNA, 16 nt, Homo sapiens
auuuucuagacuguga

SEQ ID NO: 2119157 - RNA, 16 nt, Homo sapiens
aucacuuuucucugag

SEQ ID NO: 2119158 - RNA, 17 nt, Homo sapiens
ccuuaguuugaaacaga

SEQ ID NO: 2119159 - RNA, 14 nt, Homo sapiens
guuuucaagucaaa

SEQ ID NO: 2119160 - RNA, 13 nt, Homo sapiens
caacagcagugag

SEQ ID NO: 2119161 - RNA, 15 nt, Homo sapiens
gagagcagcauuccc

SEQ ID NO: 2119162 - RNA, 18 nt, Homo sapiens
uaaaguuguucacauaua

SEQ ID NO: 2119163 - RNA, 13 nt, Homo sapiens
gaaagcauuauuu

SEQ ID NO: 2119164 - RNA, 23 nt, Homo sapiens
acucauuugaaugcuuaauucaa

SEQ ID NO: 2119165 - RNA, 21 nt, Homo sapiens
aauuuaacagaaguugugaaa

SEQ ID NO: 2119166 - RNA, 21 nt, Homo sapiens
ucuuguguauuucucugugaa

SEQ ID NO: 2119167 - RNA, 22 nt, Homo sapiens
ucauccaaugcaggcuguuucc

SEQ ID NO: 2119168 - RNA, 17 nt, Homo sapiens
uagauguuacuguguga

SEQ ID NO: 2119169 - RNA, 19 nt, Homo sapiens
cugugcugguguccugacc

SEQ ID NO: 2119170 - RNA, 15 nt, Homo sapiens
cuggaaucgggguca

SEQ ID NO: 2119171 - RNA, 16 nt, Homo sapiens
ucugccacgcuuuaug

SEQ ID NO: 2119172 - RNA, 17 nt, Homo sapiens
auguccuguggugacag

SEQ ID NO: 2119173 - RNA, 15 nt, Homo sapiens
ugggaccacaugcca

SEQ ID NO: 2119174 - RNA, 18 nt, Homo sapiens
gauucuggcuagugucua

SEQ ID NO: 2119175 - RNA, 22 nt, Homo sapiens
ugugugagauuuuauuuugaca

SEQ ID NO: 2119176 - RNA, 15 nt, Homo sapiens
ugaaaacagugugua

SEQ ID NO: 2119177 - RNA, 12 nt, Homo sapiens
uuauacuguaua

SEQ ID NO: 2119178 - RNA, 16 nt, Homo sapiens
ccucucacuaacuaau

SEQ ID NO: 2119179 - RNA, 14 nt, Homo sapiens
ccucuugccagcuc

SEQ ID NO: 2119180 - RNA, 17 nt, Homo sapiens
uauuaaggcuuacuagu

SEQ ID NO: 2119181 - RNA, 17 nt, Homo sapiens
aucugaaugugccucuc

SEQ ID NO: 2119182 - RNA, 17 nt, Homo sapiens
ggccuuaacacacuggc

SEQ ID NO: 2119183 - RNA, 14 nt, Homo sapiens
gacggccacucugu

SEQ ID NO: 2119184 - RNA, 12 nt, Homo sapiens
ugugcagacuga

SEQ ID NO: 2119185 - RNA, 14 nt, Homo sapiens
ggaaacaauaucaa

SEQ ID NO: 2119186 - RNA, 17 nt, Homo sapiens
uggugcugagguugaga

SEQ ID NO: 2119187 - RNA, 17 nt, Homo sapiens
uaagaaaacaucacuga

SEQ ID NO: 2119188 - RNA, 12 nt, Homo sapiens
ccuguuccccaa

SEQ ID NO: 2119189 - RNA, 18 nt, Homo sapiens
uacuucggggcugggaag

SEQ ID NO: 2119190 - RNA, 19 nt, Homo sapiens
gcgggccccucaccuggua

SEQ ID NO: 2119191 - RNA, 14 nt, Homo sapiens
cagaacaguuugua

SEQ ID NO: 2119192 - RNA, 12 nt, Homo sapiens
auucacaaugaa

SEQ ID NO: 2119193 - RNA, 12 nt, Homo sapiens
auuaacaaugac

SEQ ID NO: 2119194 - RNA, 23 nt, Homo sapiens
gaaugucaugcaccgcugcagcc

SEQ ID NO: 2119195 - RNA, 14 nt, Homo sapiens
uaauaacagcuccu

SEQ ID NO: 2119196 - RNA, 14 nt, Homo sapiens
agaagucucuucca

SEQ ID NO: 2119197 - RNA, 22 nt, Homo sapiens
ugcugcagauuugauauuugca

SEQ ID NO: 2119198 - RNA, 23 nt, Homo sapiens
caccagagggauaaaaacaauac

SEQ ID NO: 2119199 - RNA, 20 nt, Homo sapiens
accuugggacuuaccugaca

SEQ ID NO: 2119200 - RNA, 17 nt, Homo sapiens
uuagcuagaaugcacac

SEQ ID NO: 2119201 - RNA, 16 nt, Homo sapiens
cuuaccugggcacaaa

SEQ ID NO: 2119202 - RNA, 15 nt, Homo sapiens
uaauuucaugcacac

SEQ ID NO: 2119203 - RNA, 14 nt, Homo sapiens
uggaaccauuggca

SEQ ID NO: 2119204 - RNA, 13 nt, Homo sapiens
aaauacaguauga

SEQ ID NO: 2119205 - RNA, 21 nt, Homo sapiens
augcucuuauuucaucauuca

SEQ ID NO: 2119206 - RNA, 12 nt, Homo sapiens
aacucaaggguu

SEQ ID NO: 2119207 - RNA, 20 nt, Homo sapiens
acuuaagggaaaaguucucc

SEQ ID NO: 2119208 - RNA, 14 nt, Homo sapiens
uuaauauaucccag

SEQ ID NO: 2119209 - RNA, 21 nt, Homo sapiens
aacacuguagcuacauuuuca

SEQ ID NO: 2119210 - RNA, 18 nt, Homo sapiens
ugcucuugagucuuugca

SEQ ID NO: 2119211 - RNA, 21 nt, Homo sapiens
ggagccaccugucccaccuca

SEQ ID NO: 2119212 - RNA, 13 nt, Homo sapiens
ugguuccaugccu

SEQ ID NO: 2119213 - RNA, 22 nt, Homo sapiens
aaacuuaagggaaaaguucucc

SEQ ID NO: 2119214 - RNA, 14 nt, Homo sapiens
caaacuuccaguca

SEQ ID NO: 2119215 - RNA, 14 nt, Homo sapiens
uaaaguucuaguga

SEQ ID NO: 2119216 - RNA, 14 nt, Homo sapiens
agauuuaagaauac

SEQ ID NO: 2119217 - RNA, 22 nt, Homo sapiens
ccccaucuagcaagcacuugau

SEQ ID NO: 2119218 - RNA, 16 nt, Homo sapiens
uguuuaucuagcauag

SEQ ID NO: 2119219 - RNA, 16 nt, Homo sapiens
cuuuuauuuuccugcu

SEQ ID NO: 2119220 - RNA, 12 nt, Homo sapiens
gacauguguuaa

SEQ ID NO: 2119221 - RNA, 14 nt, Homo sapiens
cugcaacucaagga

SEQ ID NO: 2119222 - RNA, 20 nt, Homo sapiens
caaauuuucuuccauuucau

SEQ ID NO: 2119223 - RNA, 17 nt, Homo sapiens
cuuccucuagagucuca

SEQ ID NO: 2119224 - RNA, 21 nt, Homo sapiens
ucaacaaaauggucauccaaa

SEQ ID NO: 2119225 - RNA, 22 nt, Homo sapiens
caacaaaauaaugcacuuccuu

SEQ ID NO: 2119226 - RNA, 13 nt, Homo sapiens
ucucccucucagu

SEQ ID NO: 2119227 - RNA, 15 nt, Homo sapiens
ccuugcuaucaagaa

SEQ ID NO: 2119228 - RNA, 22 nt, Homo sapiens
ggaaggcaauuucucugcacac

SEQ ID NO: 2119229 - RNA, 21 nt, Homo sapiens
auagcagcccucaauugugaa

SEQ ID NO: 2119230 - RNA, 16 nt, Homo sapiens
cacugccagccgccac

SEQ ID NO: 2119231 - RNA, 20 nt, Homo sapiens
cugggccccacuggacaaca

SEQ ID NO: 2119232 - RNA, 13 nt, Homo sapiens
uccuaacauauau

SEQ ID NO: 2119233 - RNA, 20 nt, Homo sapiens
uacauuuaaacuugucaggg

SEQ ID NO: 2119234 - RNA, 15 nt, Homo sapiens
uauauccauguacug

SEQ ID NO: 2119235 - RNA, 13 nt, Homo sapiens
agcuacugaugaa

SEQ ID NO: 2119236 - RNA, 20 nt, Homo sapiens
ccauuaaaaagugggcaaag

SEQ ID NO: 2119237 - RNA, 19 nt, Homo sapiens
uaaacacaaaguguauaca

SEQ ID NO: 2119238 - RNA, 20 nt, Homo sapiens
ucagacuugauuuacaauuu

SEQ ID NO: 2119239 - RNA, 13 nt, Homo sapiens
gauaacacugacu

SEQ ID NO: 2119240 - RNA, 14 nt, Homo sapiens
uccaaugaugggau

SEQ ID NO: 2119241 - RNA, 14 nt, Homo sapiens
ugccgugacagggc

SEQ ID NO: 2119242 - RNA, 17 nt, Homo sapiens
caaagugcggcugccau

SEQ ID NO: 2119243 - RNA, 18 nt, Homo sapiens
ugguagaggggagacauu

SEQ ID NO: 2119244 - RNA, 16 nt, Homo sapiens
uaccuccaacccugcc

SEQ ID NO: 2119245 - RNA, 17 nt, Homo sapiens
caaaauaaggggcaccu

SEQ ID NO: 2119246 - RNA, 13 nt, Homo sapiens
ccugaacaucagc

SEQ ID NO: 2119247 - RNA, 18 nt, Homo sapiens
cacaaugcgcguugacua

SEQ ID NO: 2119248 - RNA, 20 nt, Homo sapiens
auuauuugacaacaauccaa

SEQ ID NO: 2119249 - RNA, 16 nt, Homo sapiens
uggugucgcaucaaga

SEQ ID NO: 2119250 - RNA, 15 nt, Homo sapiens
agucuguuuacugca

SEQ ID NO: 2119251 - RNA, 15 nt, Homo sapiens
aacuaauguaaauau

SEQ ID NO: 2119252 - RNA, 13 nt, Homo sapiens
ugaaccacaucuu

SEQ ID NO: 2119253 - RNA, 15 nt, Homo sapiens
auuauguauguuuac

SEQ ID NO: 2119254 - RNA, 22 nt, Homo sapiens
ucuaacucccuccucacacucc

SEQ ID NO: 2119255 - RNA, 17 nt, Homo sapiens
ccaggagauggccccaa

SEQ ID NO: 2119256 - RNA, 23 nt, Homo sapiens
cagauggcugugaaaauuacacc

SEQ ID NO: 2119257 - RNA, 18 nt, Homo sapiens
ccggccaggugggcgggc

SEQ ID NO: 2119258 - RNA, 19 nt, Homo sapiens
gcuagggcggggcacagau

SEQ ID NO: 2119259 - RNA, 13 nt, Homo sapiens
aaaacacaaaguc

SEQ ID NO: 2119260 - RNA, 13 nt, Homo sapiens
ggauuacagggau

SEQ ID NO: 2119261 - RNA, 22 nt, Homo sapiens
cccuggggcacuuucauccuca

SEQ ID NO: 2119262 - RNA, 20 nt, Homo sapiens
ccaguaccugaaagcacugu

SEQ ID NO: 2119263 - RNA, 17 nt, Homo sapiens
aaucuaaaaccaaauau

SEQ ID NO: 2119264 - RNA, 20 nt, Homo sapiens
aaaagcagaaaauacagcug

SEQ ID NO: 2119265 - RNA, 18 nt, Homo sapiens
cuuauuacauauuuacac

SEQ ID NO: 2119266 - RNA, 20 nt, Homo sapiens
auaaucugacaaagucauga

SEQ ID NO: 2119267 - RNA, 14 nt, Homo sapiens
agcaccuggugggg

SEQ ID NO: 2119268 - RNA, 15 nt, Homo sapiens
uguuuuaaacuguga

SEQ ID NO: 2119269 - RNA, 20 nt, Homo sapiens
gacaaugauauugacacugu

SEQ ID NO: 2119270 - RNA, 15 nt, Homo sapiens
uacaggaaagcaaua

SEQ ID NO: 2119271 - RNA, 21 nt, Homo sapiens
aagaagaauauucuaugaagu

SEQ ID NO: 2119272 - RNA, 18 nt, Homo sapiens
cgguccuacugcugugag

SEQ ID NO: 2119273 - RNA, 17 nt, Homo sapiens
augcgucccuguacaga

SEQ ID NO: 2119274 - RNA, 21 nt, Homo sapiens
accuccuccuccaguucugau

SEQ ID NO: 2119275 - RNA, 11 nt, Homo sapiens
aaguguuccag

SEQ ID NO: 2119276 - RNA, 17 nt, Homo sapiens
uugaucaaaucuaaugu

SEQ ID NO: 2119277 - RNA, 21 nt, Homo sapiens
gacaauuccuagauaaaaaga

SEQ ID NO: 2119278 - RNA, 23 nt, Homo sapiens
cuagcacaauuugcacuaaauca

SEQ ID NO: 2119279 - RNA, 18 nt, Homo sapiens
agcauaccaacacgagca

SEQ ID NO: 2119280 - RNA, 18 nt, Homo sapiens
aguccaggaaugauccca

SEQ ID NO: 2119281 - RNA, 22 nt, Homo sapiens
cagcucauuucaguuucuauca

SEQ ID NO: 2119282 - RNA, 15 nt, Homo sapiens
acuacuuuuugguca

SEQ ID NO: 2119283 - RNA, 18 nt, Homo sapiens
uagaaagcaacuuaucag

SEQ ID NO: 2119284 - RNA, 19 nt, Homo sapiens
cucuggccuguacccagua

SEQ ID NO: 2119285 - RNA, 22 nt, Homo sapiens
gaacauaucauuugugaagaau

SEQ ID NO: 2119286 - RNA, 16 nt, Homo sapiens
gaggauuucaucucuu

SEQ ID NO: 2119287 - RNA, 16 nt, Homo sapiens
cuuugaauaaugugau

SEQ ID NO: 2119288 - RNA, 16 nt, Homo sapiens
auucgacauaccccac

SEQ ID NO: 2119289 - RNA, 13 nt, Homo sapiens
cagagcagggugu

SEQ ID NO: 2119290 - RNA, 14 nt, Homo sapiens
cuacacagaucaca

SEQ ID NO: 2119291 - RNA, 20 nt, Homo sapiens
uauuggcaguuggaggacac

SEQ ID NO: 2119292 - RNA, 19 nt, Homo sapiens
caguucacacccugcaagg

SEQ ID NO: 2119293 - RNA, 18 nt, Homo sapiens
gguguaauuccucccuaa

SEQ ID NO: 2119294 - RNA, 15 nt, Homo sapiens
acuuuucucaauauu

SEQ ID NO: 2119295 - RNA, 16 nt, Homo sapiens
cuggaaugcagugaca

SEQ ID NO: 2119296 - RNA, 19 nt, Homo sapiens
ucccacuuuugccagacgc

SEQ ID NO: 2119297 - RNA, 23 nt, Homo sapiens
cacaacaugcacauucauccuca

SEQ ID NO: 2119298 - RNA, 12 nt, Homo sapiens
cccugucauccu

SEQ ID NO: 2119299 - RNA, 13 nt, Homo sapiens
cgagcggggagcc

SEQ ID NO: 2119300 - RNA, 20 nt, Homo sapiens
ccugaagggggacacuccau

SEQ ID NO: 2119301 - RNA, 18 nt, Homo sapiens
uaaugagagugcacugcu

SEQ ID NO: 2119302 - RNA, 15 nt, Homo sapiens
auuucaccaccaaau

SEQ ID NO: 2119303 - RNA, 17 nt, Homo sapiens
gcuguguaagcucacau

SEQ ID NO: 2119304 - RNA, 14 nt, Homo sapiens
ccaaaagaugccuu

SEQ ID NO: 2119305 - RNA, 13 nt, Homo sapiens
ucuucgcagccua

SEQ ID NO: 2119306 - RNA, 20 nt, Homo sapiens
agauaacuguaaaugugaca

SEQ ID NO: 2119307 - RNA, 16 nt, Homo sapiens
gcuccccccaguggga

SEQ ID NO: 2119308 - RNA, 20 nt, Homo sapiens
acgguggcucaugccuguaa

SEQ ID NO: 2119309 - RNA, 13 nt, Homo sapiens
cugaaacuugaac

SEQ ID NO: 2119310 - RNA, 14 nt, Homo sapiens
accaucauagcuca

SEQ ID NO: 2119311 - RNA, 13 nt, Homo sapiens
cuucuuccaggga

SEQ ID NO: 2119312 - RNA, 20 nt, Homo sapiens
ccugaaacuuacacacaaaa

SEQ ID NO: 2119313 - RNA, 23 nt, Homo sapiens
uucauggaaaaauaaaaugcaaa

SEQ ID NO: 2119314 - RNA, 19 nt, Homo sapiens
caacuggggggaccaaaua

SEQ ID NO: 2119315 - RNA, 21 nt, Homo sapiens
aucauguuuuuucugcaauga

SEQ ID NO: 2119316 - RNA, 19 nt, Homo sapiens
aguccacaagaacaauuca

SEQ ID NO: 2119317 - RNA, 17 nt, Homo sapiens
uuugugggaaauccaca

SEQ ID NO: 2119318 - RNA, 13 nt, Homo sapiens
cagaacagcaugg

SEQ ID NO: 2119319 - RNA, 18 nt, Homo sapiens
acuuaccccgagaccuca

SEQ ID NO: 2119320 - RNA, 18 nt, Homo sapiens
aggccuggggaggcccua

SEQ ID NO: 2119321 - RNA, 21 nt, Homo sapiens
uuuagaagcagcgagugcaug

SEQ ID NO: 2119322 - RNA, 14 nt, Homo sapiens
uaaagugacagaug

SEQ ID NO: 2119323 - RNA, 20 nt, Homo sapiens
caggcacccaccaccaugcc

SEQ ID NO: 2119324 - RNA, 11 nt, Homo sapiens
ccuuucaucuu

SEQ ID NO: 2119325 - RNA, 17 nt, Homo sapiens
aguacaggcagcacaga

SEQ ID NO: 2119326 - RNA, 13 nt, Homo sapiens
cucccaagggaug

SEQ ID NO: 2119327 - RNA, 15 nt, Homo sapiens
ccagcgaggugggag

SEQ ID NO: 2119328 - RNA, 14 nt, Homo sapiens
aacaggucacuuga

SEQ ID NO: 2119329 - RNA, 18 nt, Homo sapiens
auuuuugaugacuaccuc

SEQ ID NO: 2119330 - RNA, 14 nt, Homo sapiens
uaaaguuacauugc

SEQ ID NO: 2119331 - RNA, 14 nt, Homo sapiens
ucuguaauucacua

SEQ ID NO: 2119332 - RNA, 14 nt, Homo sapiens
gcucugaugcagug

SEQ ID NO: 2119333 - RNA, 19 nt, Homo sapiens
ccgaauauauuacugauuu

SEQ ID NO: 2119334 - RNA, 16 nt, Homo sapiens
ugaacuaggugaucuc

SEQ ID NO: 2119335 - RNA, 18 nt, Homo sapiens
uuugccuuuguaccauau

SEQ ID NO: 2119336 - RNA, 14 nt, Homo sapiens
ccaggacugugaua

SEQ ID NO: 2119337 - RNA, 18 nt, Homo sapiens
ccccaaagacacuaccac

SEQ ID NO: 2119338 - RNA, 18 nt, Homo sapiens
cacaggcagauguuugcc

SEQ ID NO: 2119339 - RNA, 17 nt, Homo sapiens
cagagagggaagcugag

SEQ ID NO: 2119340 - RNA, 18 nt, Homo sapiens
cagcgauggcagugagaa

SEQ ID NO: 2119341 - RNA, 16 nt, Homo sapiens
caagugucugugugca

SEQ ID NO: 2119342 - RNA, 16 nt, Homo sapiens
ccaugguccccaagac

SEQ ID NO: 2119343 - RNA, 23 nt, Homo sapiens
cacuugcacugugcuugcuccua

SEQ ID NO: 2119344 - RNA, 19 nt, Homo sapiens
guugaaaucagaagccuac

SEQ ID NO: 2119345 - RNA, 21 nt, Homo sapiens
ccacugagagaucugcuguca

SEQ ID NO: 2119346 - RNA, 14 nt, Homo sapiens
acuaauugguacuu

SEQ ID NO: 2119347 - RNA, 17 nt, Homo sapiens
uuccauuuccauguccc

SEQ ID NO: 2119348 - RNA, 15 nt, Homo sapiens
ucuuucucucacugu

SEQ ID NO: 2119349 - RNA, 15 nt, Homo sapiens
gaauguuaucaguau

SEQ ID NO: 2119350 - RNA, 14 nt, Homo sapiens
ccauggcacugaca

SEQ ID NO: 2119351 - RNA, 18 nt, Homo sapiens
agccacuauuaacauuuc

SEQ ID NO: 2119352 - RNA, 23 nt, Homo sapiens
caguagcagguaaggaaagggcu

SEQ ID NO: 2119353 - RNA, 17 nt, Homo sapiens
aguguaaaauguauauu

SEQ ID NO: 2119354 - RNA, 13 nt, Homo sapiens
gagccacagaaaa

SEQ ID NO: 2119355 - RNA, 23 nt, Homo sapiens
ugccacauggagcuugacuucau

SEQ ID NO: 2119356 - RNA, 15 nt, Homo sapiens
acagaguaucagauc

SEQ ID NO: 2119357 - RNA, 17 nt, Homo sapiens
gaacccuuccugagacc

SEQ ID NO: 2119358 - RNA, 17 nt, Homo sapiens
gccccccccagagccag

SEQ ID NO: 2119359 - RNA, 15 nt, Homo sapiens
aaggccgggugacac

SEQ ID NO: 2119360 - RNA, 22 nt, Homo sapiens
acuucugaagagaccacucaau

SEQ ID NO: 2119361 - RNA, 13 nt, Homo sapiens
ugcagcuaucugg

SEQ ID NO: 2119362 - RNA, 15 nt, Homo sapiens
auauaacaaguauaa

SEQ ID NO: 2119363 - RNA, 16 nt, Homo sapiens
agccguugcuaaugcc

SEQ ID NO: 2119364 - RNA, 22 nt, Homo sapiens
acccacuuaccuugcaucucac

SEQ ID NO: 2119365 - RNA, 12 nt, Homo sapiens
aacacugggcug

SEQ ID NO: 2119366 - RNA, 13 nt, Homo sapiens
agcccucacagcu

SEQ ID NO: 2119367 - RNA, 15 nt, Homo sapiens
ccuaugucauuucua

SEQ ID NO: 2119368 - RNA, 14 nt, Homo sapiens
cuuuuuaaugucag

SEQ ID NO: 2119369 - RNA, 19 nt, Homo sapiens
gacccucuuugcugaagaa

SEQ ID NO: 2119370 - RNA, 21 nt, Homo sapiens
guguccuguccuuucuugcag

SEQ ID NO: 2119371 - RNA, 19 nt, Homo sapiens
agguugggcuggugcucac

SEQ ID NO: 2119372 - RNA, 12 nt, Homo sapiens
ggcaacugagag

SEQ ID NO: 2119373 - RNA, 20 nt, Homo sapiens
aaauaugugauuuucucuaa

SEQ ID NO: 2119374 - RNA, 13 nt, Homo sapiens
cauggugacauug

SEQ ID NO: 2119375 - RNA, 14 nt, Homo sapiens
uguuuuggcucaau

SEQ ID NO: 2119376 - RNA, 15 nt, Homo sapiens
cacacagccaauaca

SEQ ID NO: 2119377 - RNA, 21 nt, Homo sapiens
uuagaaaaagaacaugcaguu

SEQ ID NO: 2119378 - RNA, 20 nt, Homo sapiens
ccacuaagaacaccugcauu

SEQ ID NO: 2119379 - RNA, 17 nt, Homo sapiens
ucugaaggagagagucu

SEQ ID NO: 2119380 - RNA, 11 nt, Homo sapiens
uaagcuuuauu

SEQ ID NO: 2119381 - RNA, 11 nt, Homo sapiens
auugcuuuuaa

SEQ ID NO: 2119382 - RNA, 21 nt, Homo sapiens
ggggcagggccguagacucac

SEQ ID NO: 2119383 - RNA, 20 nt, Homo sapiens
cuuugcugcacaaacaugaa

SEQ ID NO: 2119384 - RNA, 23 nt, Homo sapiens
ccugagaagagagaucaaaugga

SEQ ID NO: 2119385 - RNA, 22 nt, Homo sapiens
aucugagacuauaacugucauc

SEQ ID NO: 2119386 - RNA, 18 nt, Homo sapiens
ugcuuaaugauagucuua

SEQ ID NO: 2119387 - RNA, 18 nt, Homo sapiens
uccacgcggccaccucac

SEQ ID NO: 2119388 - RNA, 13 nt, Homo sapiens
agcugagcuuuaa

SEQ ID NO: 2119389 - RNA, 15 nt, Homo sapiens
augagaaauuaccaa

SEQ ID NO: 2119390 - RNA, 15 nt, Homo sapiens
ggaaaaaugaacugu

SEQ ID NO: 2119391 - RNA, 21 nt, Homo sapiens
gacaguuuguggcaucuugcc

SEQ ID NO: 2119392 - RNA, 16 nt, Homo sapiens
cacagcuacagcuuuc

SEQ ID NO: 2119393 - RNA, 20 nt, Homo sapiens
caauuauguuucuugcugua

SEQ ID NO: 2119394 - RNA, 14 nt, Homo sapiens
gcccgcagcacauu

SEQ ID NO: 2119395 - RNA, 14 nt, Homo sapiens
aaaagaauucucag

SEQ ID NO: 2119396 - RNA, 17 nt, Homo sapiens
uggacaaagacuaccug

SEQ ID NO: 2119397 - RNA, 21 nt, Homo sapiens
cuccaagggacccuuugccuu

SEQ ID NO: 2119398 - RNA, 16 nt, Homo sapiens
aaaucagcaugacaaa

SEQ ID NO: 2119399 - RNA, 16 nt, Homo sapiens
uaaagugcuuguguaa

SEQ ID NO: 2119400 - RNA, 19 nt, Homo sapiens
cugagcauccagaccugag

SEQ ID NO: 2119401 - RNA, 16 nt, Homo sapiens
uaauauucugcuauug

SEQ ID NO: 2119402 - RNA, 15 nt, Homo sapiens
gaacacaaagaccaa

SEQ ID NO: 2119403 - RNA, 17 nt, Homo sapiens
ucaauuuuaaacauauc

SEQ ID NO: 2119404 - RNA, 18 nt, Homo sapiens
uacugguuuuccaacuua

SEQ ID NO: 2119405 - RNA, 20 nt, Homo sapiens
aauggcuuuaaucaauucua

SEQ ID NO: 2119406 - RNA, 20 nt, Homo sapiens
gccuuucucuggcuccagaa

SEQ ID NO: 2119407 - RNA, 18 nt, Homo sapiens
gccgggcaugguggcaca

SEQ ID NO: 2119408 - RNA, 15 nt, Homo sapiens
ucacaaggucaggag

SEQ ID NO: 2119409 - RNA, 21 nt, Homo sapiens
ugaaagggaaagucagcuuuc

SEQ ID NO: 2119410 - RNA, 22 nt, Homo sapiens
cugguggccugccccagcucuc

SEQ ID NO: 2119411 - RNA, 15 nt, Homo sapiens
accucaucacugaga

SEQ ID NO: 2119412 - RNA, 19 nt, Homo sapiens
guguuaggacagcauauaa

SEQ ID NO: 2119413 - RNA, 22 nt, Homo sapiens
agagcagauucuagcacaucau

SEQ ID NO: 2119414 - RNA, 17 nt, Homo sapiens
ugucagaaugcuauuga

SEQ ID NO: 2119415 - RNA, 15 nt, Homo sapiens
cgcuagcauuuccca

SEQ ID NO: 2119416 - RNA, 15 nt, Homo sapiens
uuguccgguuuacuu

SEQ ID NO: 2119417 - RNA, 16 nt, Homo sapiens
uccuuucuuccuccaa

SEQ ID NO: 2119418 - RNA, 18 nt, Homo sapiens
agccuccagaguagcugg

SEQ ID NO: 2119419 - RNA, 23 nt, Homo sapiens
uagagaugauaaucccauacucu

SEQ ID NO: 2119420 - RNA, 21 nt, Homo sapiens
auuugcaagggaaaagucucu

SEQ ID NO: 2119421 - RNA, 21 nt, Homo sapiens
auuuucuuacacugugucauu

SEQ ID NO: 2119422 - RNA, 13 nt, Homo sapiens
ucagcaucuguga

SEQ ID NO: 2119423 - RNA, 16 nt, Homo sapiens
cuccuugcuuguuaca

SEQ ID NO: 2119424 - RNA, 22 nt, Homo sapiens
agaauugcuugaacccaggagg

SEQ ID NO: 2119425 - RNA, 21 nt, Homo sapiens
uggguuggugcacagugauuu

SEQ ID NO: 2119426 - RNA, 12 nt, Homo sapiens
uguccagacuca

SEQ ID NO: 2119427 - RNA, 19 nt, Homo sapiens
gucagggggagucuuugca

SEQ ID NO: 2119428 - RNA, 18 nt, Homo sapiens
ucggauacacacucgaau

SEQ ID NO: 2119429 - RNA, 15 nt, Homo sapiens
uuuuccagauucuuc

SEQ ID NO: 2119430 - RNA, 19 nt, Homo sapiens
ugaauuaauaauaaagcua

SEQ ID NO: 2119431 - RNA, 19 nt, Homo sapiens
uuucuuuuacccaguagga

SEQ ID NO: 2119432 - RNA, 22 nt, Homo sapiens
agcaauaauccaguaaucuaaa

SEQ ID NO: 2119433 - RNA, 22 nt, Homo sapiens
auauguauauuuuaauagaauu

SEQ ID NO: 2119434 - RNA, 17 nt, Homo sapiens
aaaccucuacauauuua

SEQ ID NO: 2119435 - RNA, 19 nt, Homo sapiens
acacucauauugcccuaau

SEQ ID NO: 2119436 - RNA, 15 nt, Homo sapiens
aagcacuugcuauuu

SEQ ID NO: 2119437 - RNA, 14 nt, Homo sapiens
cccuuucuguggua

SEQ ID NO: 2119438 - RNA, 17 nt, Homo sapiens
ugggaacuccuaaauca

SEQ ID NO: 2119439 - RNA, 14 nt, Homo sapiens
gucgcugugcccug

SEQ ID NO: 2119440 - RNA, 22 nt, Homo sapiens
auaaauccauccauccaaaggc

SEQ ID NO: 2119441 - RNA, 15 nt, Homo sapiens
uauuaagacuggcuu

SEQ ID NO: 2119442 - RNA, 22 nt, Homo sapiens
gaaaaaccacugcuaugccauu

SEQ ID NO: 2119443 - RNA, 12 nt, Homo sapiens
gauaaccacagg

SEQ ID NO: 2119444 - RNA, 12 nt, Homo sapiens
ugccaaaaucaa

SEQ ID NO: 2119445 - RNA, 22 nt, Homo sapiens
caugacagugguuauauuucaa

SEQ ID NO: 2119446 - RNA, 20 nt, Homo sapiens
caaguccuuaggcuacugua

SEQ ID NO: 2119447 - RNA, 16 nt, Homo sapiens
ucccaaaggcuuucuu

SEQ ID NO: 2119448 - RNA, 23 nt, Homo sapiens
uuaaguguaacuggcaguuuucc

SEQ ID NO: 2119449 - RNA, 14 nt, Homo sapiens
uggugucaucugcu

SEQ ID NO: 2119450 - RNA, 16 nt, Homo sapiens
cccugagcauucuugg

SEQ ID NO: 2119451 - RNA, 22 nt, Homo sapiens
guuauauuacuugccuaucuga

SEQ ID NO: 2119452 - RNA, 14 nt, Homo sapiens
aagaggucugagcc

SEQ ID NO: 2119453 - RNA, 15 nt, Homo sapiens
auuaauaucauuuau

SEQ ID NO: 2119454 - RNA, 12 nt, Homo sapiens
uacauauacuga

SEQ ID NO: 2119455 - RNA, 19 nt, Homo sapiens
gucaucauuuaucaucaca

SEQ ID NO: 2119456 - RNA, 19 nt, Homo sapiens
cccacccacagccauagac

SEQ ID NO: 2119457 - RNA, 20 nt, Homo sapiens
gcaaauaucauacuguucaa

SEQ ID NO: 2119458 - RNA, 24 nt, Homo sapiens
acccaggcccccugccaguugaag

SEQ ID NO: 2119459 - RNA, 12 nt, Homo sapiens
uuuugagcacaa

SEQ ID NO: 2119460 - RNA, 22 nt, Homo sapiens
cacaagguccggaugucacuca

SEQ ID NO: 2119461 - RNA, 21 nt, Homo sapiens
uguauauuuuuuaauguauuc

SEQ ID NO: 2119462 - RNA, 14 nt, Homo sapiens
uucaaaaugucuca

SEQ ID NO: 2119463 - RNA, 22 nt, Homo sapiens
agcuccucugccuuugugcucu

SEQ ID NO: 2119464 - RNA, 17 nt, Homo sapiens
auggaaacaauguggag

SEQ ID NO: 2119465 - RNA, 21 nt, Homo sapiens
uguuaguaaauccaugguguu

SEQ ID NO: 2119466 - RNA, 13 nt, Homo sapiens
ugcgcuucacuug

SEQ ID NO: 2119467 - RNA, 18 nt, Homo sapiens
ccacuccgguaacuuugg

SEQ ID NO: 2119468 - RNA, 13 nt, Homo sapiens
gguauauuuccau

SEQ ID NO: 2119469 - RNA, 19 nt, Homo sapiens
aacccucuaagggaccuca

SEQ ID NO: 2119470 - RNA, 17 nt, Homo sapiens
augucagcaucagcuca

SEQ ID NO: 2119471 - RNA, 20 nt, Homo sapiens
acauccuccagauaguguag

SEQ ID NO: 2119472 - RNA, 22 nt, Homo sapiens
cacaguugugguacugucauug

SEQ ID NO: 2119473 - RNA, 20 nt, Homo sapiens
cacgugagaucauucacuca

SEQ ID NO: 2119474 - RNA, 11 nt, Homo sapiens
cuccccagugu

SEQ ID NO: 2119475 - RNA, 20 nt, Homo sapiens
gcaaccuccgccuccugggu

SEQ ID NO: 2119476 - RNA, 22 nt, Homo sapiens
uaauguggaagaaaaugguuua

SEQ ID NO: 2119477 - RNA, 20 nt, Homo sapiens
ucucacucugucgcccaguc

SEQ ID NO: 2119478 - RNA, 18 nt, Homo sapiens
cuuuucuugaccauauca

SEQ ID NO: 2119479 - RNA, 17 nt, Homo sapiens
cagacccugcccugugg

SEQ ID NO: 2119480 - RNA, 16 nt, Homo sapiens
agcuaaacuccuuccu

SEQ ID NO: 2119481 - RNA, 21 nt, Homo sapiens
agaauuuugaguauuccauga

SEQ ID NO: 2119482 - RNA, 14 nt, Homo sapiens
uucuccaaagggag

SEQ ID NO: 2119483 - RNA, 19 nt, Homo sapiens
ugcuguuagauguccucag

SEQ ID NO: 2119484 - RNA, 21 nt, Homo sapiens
auagcaaaugcagaaccacaa

SEQ ID NO: 2119485 - RNA, 20 nt, Homo sapiens
acggacugaggugccugcuc

SEQ ID NO: 2119486 - RNA, 18 nt, Homo sapiens
caugcucagaguggcuga

SEQ ID NO: 2119487 - RNA, 14 nt, Homo sapiens
aguuuaugauggaa

SEQ ID NO: 2119488 - RNA, 21 nt, Homo sapiens
auucauaaaaacugcuuacuu

SEQ ID NO: 2119489 - RNA, 21 nt, Homo sapiens
ucuucaguguccuucacggca

SEQ ID NO: 2119490 - RNA, 21 nt, Homo sapiens
auugcauaacagcagaugcca

SEQ ID NO: 2119491 - RNA, 20 nt, Homo sapiens
auaucaauauugggccuaaa

SEQ ID NO: 2119492 - RNA, 16 nt, Homo sapiens
agagggccugaugaca

SEQ ID NO: 2119493 - RNA, 16 nt, Homo sapiens
ucuugaaaacugggac

SEQ ID NO: 2119494 - RNA, 22 nt, Homo sapiens
gcucccacaggcaccagcaaaa

SEQ ID NO: 2119495 - RNA, 13 nt, Homo sapiens
gucaauacugccu

SEQ ID NO: 2119496 - RNA, 22 nt, Homo sapiens
auucucacacacauacauaccu

SEQ ID NO: 2119497 - RNA, 14 nt, Homo sapiens
guugguucaucccu

SEQ ID NO: 2119498 - RNA, 18 nt, Homo sapiens
auaagcuaaagaggcuga

SEQ ID NO: 2119499 - RNA, 14 nt, Homo sapiens
uagacucauacuca

SEQ ID NO: 2119500 - RNA, 16 nt, Homo sapiens
gauuugggugaacaaa

SEQ ID NO: 2119501 - RNA, 14 nt, Homo sapiens
gaaaauuauaucuc

SEQ ID NO: 2119502 - RNA, 22 nt, Homo sapiens
auaaucaaaacccaacaugacu

SEQ ID NO: 2119503 - RNA, 12 nt, Homo sapiens
uucaaaauugcu

SEQ ID NO: 2119504 - RNA, 18 nt, Homo sapiens
cuugggguuuaaauaucc

SEQ ID NO: 2119505 - RNA, 15 nt, Homo sapiens
uaagcauacaacugg

SEQ ID NO: 2119506 - RNA, 11 nt, Homo sapiens
acucucaggug

SEQ ID NO: 2119507 - RNA, 16 nt, Homo sapiens
caaucuccuuacugug

SEQ ID NO: 2119508 - RNA, 16 nt, Homo sapiens
ccccugugucauccca

SEQ ID NO: 2119509 - RNA, 15 nt, Homo sapiens
cugcuccuacaucca

SEQ ID NO: 2119510 - RNA, 13 nt, Homo sapiens
auccuaccuugcu

SEQ ID NO: 2119511 - RNA, 13 nt, Homo sapiens
cuuuugaauucag

SEQ ID NO: 2119512 - RNA, 20 nt, Homo sapiens
ucuaaugcucacgcucccaa

SEQ ID NO: 2119513 - RNA, 23 nt, Homo sapiens
gcugucucagacgacuagcccag

SEQ ID NO: 2119514 - RNA, 12 nt, Homo sapiens
aaaccacuugcc

SEQ ID NO: 2119515 - RNA, 21 nt, Homo sapiens
auuggacauuuuaaacacuua

SEQ ID NO: 2119516 - RNA, 18 nt, Homo sapiens
caucguggagacagggca

SEQ ID NO: 2119517 - RNA, 15 nt, Homo sapiens
acugacuuucucagc

SEQ ID NO: 2119518 - RNA, 17 nt, Homo sapiens
acucuaacccuguggaa

SEQ ID NO: 2119519 - RNA, 23 nt, Homo sapiens
cuauauauaaucaucaaguaaua

SEQ ID NO: 2119520 - RNA, 16 nt, Homo sapiens
uguucuuuuuauugaa

SEQ ID NO: 2119521 - RNA, 18 nt, Homo sapiens
gagaagacccacgugcua

SEQ ID NO: 2119522 - RNA, 20 nt, Homo sapiens
aaggcaggaggaucacuuga

SEQ ID NO: 2119523 - RNA, 17 nt, Homo sapiens
uggcuuuaugcaaauac

SEQ ID NO: 2119524 - RNA, 21 nt, Homo sapiens
auuuaugguucucaggccuga

SEQ ID NO: 2119525 - RNA, 19 nt, Homo sapiens
gcaccuaaacuuacauuua

SEQ ID NO: 2119526 - RNA, 19 nt, Homo sapiens
gauaugaugucccuaugga

SEQ ID NO: 2119527 - RNA, 16 nt, Homo sapiens
ugaggccgaagcugcu

SEQ ID NO: 2119528 - RNA, 17 nt, Homo sapiens
auuccaccugcaaucaa

SEQ ID NO: 2119529 - RNA, 23 nt, Homo sapiens
cacugaugguauaucaguaucug

SEQ ID NO: 2119530 - RNA, 14 nt, Homo sapiens
aaauuacaguaugg

SEQ ID NO: 2119531 - RNA, 24 nt, Homo sapiens
ugcuaaguguaugaugucacacaa

SEQ ID NO: 2119532 - RNA, 12 nt, Homo sapiens
uugccugcaaaa

SEQ ID NO: 2119533 - RNA, 21 nt, Homo sapiens
ugauucagagcuuucaaggau

SEQ ID NO: 2119534 - RNA, 20 nt, Homo sapiens
ggcaugguaguauacaaaaa

SEQ ID NO: 2119535 - RNA, 17 nt, Homo sapiens
ggcucauucuucuuggc

SEQ ID NO: 2119536 - RNA, 15 nt, Homo sapiens
uaccauuuauuugcu

SEQ ID NO: 2119537 - RNA, 14 nt, Homo sapiens
uccccuaaagccag

SEQ ID NO: 2119538 - RNA, 19 nt, Homo sapiens
agggcuccugcacuuacuu

SEQ ID NO: 2119539 - RNA, 17 nt, Homo sapiens
acugcaugcacuucuua

SEQ ID NO: 2119540 - RNA, 19 nt, Homo sapiens
agucuaucaaccccagaca

SEQ ID NO: 2119541 - RNA, 18 nt, Homo sapiens
auauaacaauauaugaua

SEQ ID NO: 2119542 - RNA, 18 nt, Homo sapiens
uguccauguguauuuuag

SEQ ID NO: 2119543 - RNA, 22 nt, Homo sapiens
caugcuccuggcccacugcauc

SEQ ID NO: 2119544 - RNA, 18 nt, Homo sapiens
uggugguuccgccuccag

SEQ ID NO: 2119545 - RNA, 17 nt, Homo sapiens
cugggcuauugcugcug

SEQ ID NO: 2119546 - RNA, 21 nt, Homo sapiens
ggcaauguucccccucuccuc

SEQ ID NO: 2119547 - RNA, 19 nt, Homo sapiens
ccaauacaaagaugacugg

SEQ ID NO: 2119548 - RNA, 12 nt, Homo sapiens
aggcuccagaaa

SEQ ID NO: 2119549 - RNA, 13 nt, Homo sapiens
cccugcccacaga

SEQ ID NO: 2119550 - RNA, 21 nt, Homo sapiens
cuaauuugcauuaaauucaca

SEQ ID NO: 2119551 - RNA, 14 nt, Homo sapiens
uguggcagcugucu

SEQ ID NO: 2119552 - RNA, 23 nt, Homo sapiens
gcaaaaacaaaugggaaaauguc

SEQ ID NO: 2119553 - RNA, 20 nt, Homo sapiens
gugauuacauaaucuguaca

SEQ ID NO: 2119554 - RNA, 15 nt, Homo sapiens
acuaaugacaaguga

SEQ ID NO: 2119555 - RNA, 17 nt, Homo sapiens
cuguuuugcauggagua

SEQ ID NO: 2119556 - RNA, 21 nt, Homo sapiens
ucaauuuaaaaaaaaaccuga

SEQ ID NO: 2119557 - RNA, 18 nt, Homo sapiens
uuucuuuacuuaacauau

SEQ ID NO: 2119558 - RNA, 14 nt, Homo sapiens
uauuuucaaaauag

SEQ ID NO: 2119559 - RNA, 16 nt, Homo sapiens
uuaacaucaucaggcu

SEQ ID NO: 2119560 - RNA, 17 nt, Homo sapiens
guauacuucagugcuca

SEQ ID NO: 2119561 - RNA, 16 nt, Homo sapiens
cgcugugggcaauugu

SEQ ID NO: 2119562 - RNA, 22 nt, Homo sapiens
auucguacauaauaaguuucau

SEQ ID NO: 2119563 - RNA, 21 nt, Homo sapiens
aucaacacgagaauacaggag

SEQ ID NO: 2119564 - RNA, 15 nt, Homo sapiens
ugcaaaauauaucac

SEQ ID NO: 2119565 - RNA, 23 nt, Homo sapiens
gcaugugccuaaaggcucaaggg

SEQ ID NO: 2119566 - RNA, 15 nt, Homo sapiens
ugcacuuguggcaac

SEQ ID NO: 2119567 - RNA, 15 nt, Homo sapiens
gagcugaacuggggu

SEQ ID NO: 2119568 - RNA, 18 nt, Homo sapiens
cagccauuuguaaugaau

SEQ ID NO: 2119569 - RNA, 20 nt, Homo sapiens
aucucugucagugugaaaau

SEQ ID NO: 2119570 - RNA, 14 nt, Homo sapiens
gugacuuguucuga

SEQ ID NO: 2119571 - RNA, 19 nt, Homo sapiens
ggauaacuuagguggcaag

SEQ ID NO: 2119572 - RNA, 23 nt, Homo sapiens
cugcagggcccucccuuuuccca

SEQ ID NO: 2119573 - RNA, 17 nt, Homo sapiens
ucuuggaauuacaagcc

SEQ ID NO: 2119574 - RNA, 15 nt, Homo sapiens
auauuuauuuccugc

SEQ ID NO: 2119575 - RNA, 12 nt, Homo sapiens
gaaaugaucauu

SEQ ID NO: 2119576 - RNA, 16 nt, Homo sapiens
guagcaaacuuuucac

SEQ ID NO: 2119577 - RNA, 21 nt, Homo sapiens
uugaagaagaguuucuccuuu

SEQ ID NO: 2119578 - RNA, 17 nt, Homo sapiens
uugacaugauauacaau

SEQ ID NO: 2119579 - RNA, 20 nt, Homo sapiens
gcuaagugaaauaagccaga

SEQ ID NO: 2119580 - RNA, 22 nt, Homo sapiens
ccuucuuuucaaaacugcuaaa

SEQ ID NO: 2119581 - RNA, 16 nt, Homo sapiens
gcagacuggugagcag

SEQ ID NO: 2119582 - RNA, 17 nt, Homo sapiens
ugagaugguauauccuu

SEQ ID NO: 2119583 - RNA, 11 nt, Homo sapiens
aacacacauaa

SEQ ID NO: 2119584 - RNA, 17 nt, Homo sapiens
auggaaugcuguguuaa

SEQ ID NO: 2119585 - RNA, 16 nt, Homo sapiens
cauaugacuugaucuu

SEQ ID NO: 2119586 - RNA, 22 nt, Homo sapiens
ccuugcgccgcauucgcacugg

SEQ ID NO: 2119587 - RNA, 17 nt, Homo sapiens
ucaaagaggaaccagga

SEQ ID NO: 2119588 - RNA, 22 nt, Homo sapiens
auagaaccaacccaaacugugu

SEQ ID NO: 2119589 - RNA, 23 nt, Homo sapiens
uuaucugagcugagccaggcuag

SEQ ID NO: 2119590 - RNA, 19 nt, Homo sapiens
guaaaauuaauguaauaaa

SEQ ID NO: 2119591 - RNA, 14 nt, Homo sapiens
gacuaaguacuugc

SEQ ID NO: 2119592 - RNA, 15 nt, Homo sapiens
uacguguuuacuugg

SEQ ID NO: 2119593 - RNA, 22 nt, Homo sapiens
cuuccagaugauccuugcacag

SEQ ID NO: 2119594 - RNA, 13 nt, Homo sapiens
agguuaucugugc

SEQ ID NO: 2119595 - RNA, 18 nt, Homo sapiens
uaaacauuggacagugag

SEQ ID NO: 2119596 - RNA, 11 nt, Homo sapiens
uuuagccuuua

SEQ ID NO: 2119597 - RNA, 14 nt, Homo sapiens
uagacagguguuua

SEQ ID NO: 2119598 - RNA, 21 nt, Homo sapiens
acucacucaguaaaacauaau

SEQ ID NO: 2119599 - RNA, 13 nt, Homo sapiens
cuggucuccuugc

SEQ ID NO: 2119600 - RNA, 13 nt, Homo sapiens
aggugcugugaca

SEQ ID NO: 2119601 - RNA, 18 nt, Homo sapiens
auauggugucuugauaua

SEQ ID NO: 2119602 - RNA, 12 nt, Homo sapiens
cuggaaauggac

SEQ ID NO: 2119603 - RNA, 17 nt, Homo sapiens
aagugagacccaaagga

SEQ ID NO: 2119604 - RNA, 16 nt, Homo sapiens
gcugaggcaagagaau

SEQ ID NO: 2119605 - RNA, 17 nt, Homo sapiens
aucgccucugucuccuc

SEQ ID NO: 2119606 - RNA, 15 nt, Homo sapiens
uuucacuuucugucu

SEQ ID NO: 2119607 - RNA, 15 nt, Homo sapiens
ccuggucagaaggcc

SEQ ID NO: 2119608 - RNA, 18 nt, Homo sapiens
caccacgguagugccuga

SEQ ID NO: 2119609 - RNA, 22 nt, Homo sapiens
agcucucuuugagguccaaaaa

SEQ ID NO: 2119610 - RNA, 20 nt, Homo sapiens
gggcuuaguauuucucagga

SEQ ID NO: 2119611 - RNA, 20 nt, Homo sapiens
auacguacuuuagcuggaau

SEQ ID NO: 2119612 - RNA, 14 nt, Homo sapiens
augcccuccuggug

SEQ ID NO: 2119613 - RNA, 20 nt, Homo sapiens
aagagcccaucuuugucagu

SEQ ID NO: 2119614 - RNA, 19 nt, Homo sapiens
aauuuuuaaggauguugcc

SEQ ID NO: 2119615 - RNA, 18 nt, Homo sapiens
acugauuucaaaucaugu

SEQ ID NO: 2119616 - RNA, 18 nt, Homo sapiens
uaaagggcgcaaagggca

SEQ ID NO: 2119617 - RNA, 19 nt, Homo sapiens
agccugcagcuuucuggaa

SEQ ID NO: 2119618 - RNA, 21 nt, Homo sapiens
ggcuaagaagaaaugcaaaag

SEQ ID NO: 2119619 - RNA, 11 nt, Homo sapiens
cuucugccaac

SEQ ID NO: 2119620 - RNA, 19 nt, Homo sapiens
auucaaaguuuguggcaua

SEQ ID NO: 2119621 - RNA, 13 nt, Homo sapiens
ucacacacaugca

SEQ ID NO: 2119622 - RNA, 22 nt, Homo sapiens
auguaggggccaagcagugccc

SEQ ID NO: 2119623 - RNA, 18 nt, Homo sapiens
aaacuccugggcucaggc

SEQ ID NO: 2119624 - RNA, 16 nt, Homo sapiens
cauuugcuaguucugc

SEQ ID NO: 2119625 - RNA, 17 nt, Homo sapiens
aucuaauaauuauucau

SEQ ID NO: 2119626 - RNA, 17 nt, Homo sapiens
uccaauaggcauuugau

SEQ ID NO: 2119627 - RNA, 16 nt, Homo sapiens
ugguccccacagccuc

SEQ ID NO: 2119628 - RNA, 17 nt, Homo sapiens
accagaagcagaugcca

SEQ ID NO: 2119629 - RNA, 14 nt, Homo sapiens
cuucaggcaccuga

SEQ ID NO: 2119630 - RNA, 22 nt, Homo sapiens
uccucccuuguggcuuccucag

SEQ ID NO: 2119631 - RNA, 14 nt, Homo sapiens
aagaacaugaaucu

SEQ ID NO: 2119632 - RNA, 13 nt, Homo sapiens
gccaguggugcua

SEQ ID NO: 2119633 - RNA, 14 nt, Homo sapiens
uuucaucagucaau

SEQ ID NO: 2119634 - RNA, 14 nt, Homo sapiens
ucuuagcugucacc

SEQ ID NO: 2119635 - RNA, 23 nt, Homo sapiens
caugcgaacauaaaugucuguau

SEQ ID NO: 2119636 - RNA, 13 nt, Homo sapiens
uagacaaaaucag

SEQ ID NO: 2119637 - RNA, 14 nt, Homo sapiens
ucucgaacuccuga

SEQ ID NO: 2119638 - RNA, 15 nt, Homo sapiens
ugaaggacuacaggu

SEQ ID NO: 2119639 - RNA, 11 nt, Homo sapiens
aguaagcccuu

SEQ ID NO: 2119640 - RNA, 13 nt, Homo sapiens
aaccuuuucccaa

SEQ ID NO: 2119641 - RNA, 15 nt, Homo sapiens
aggaaggacaugggu

SEQ ID NO: 2119642 - RNA, 20 nt, Homo sapiens
ucauccaggcccaacuguga

SEQ ID NO: 2119643 - RNA, 20 nt, Homo sapiens
ugaggugaaauucaguuaua

SEQ ID NO: 2119644 - RNA, 20 nt, Homo sapiens
gugggguccccaucauccca

SEQ ID NO: 2119645 - RNA, 14 nt, Homo sapiens
auuuuuugcuacuu

SEQ ID NO: 2119646 - RNA, 14 nt, Homo sapiens
ccaaccaugaauga

SEQ ID NO: 2119647 - RNA, 20 nt, Homo sapiens
aucccuucacaaaauuuugu

SEQ ID NO: 2119648 - RNA, 20 nt, Homo sapiens
ccaacuccaggaaagagcag

SEQ ID NO: 2119649 - RNA, 19 nt, Homo sapiens
uuguuccgugucuggccag

SEQ ID NO: 2119650 - RNA, 19 nt, Homo sapiens
auucaguaaggcagugaag

SEQ ID NO: 2119651 - RNA, 14 nt, Homo sapiens
uggaauaaagcccu

SEQ ID NO: 2119652 - RNA, 14 nt, Homo sapiens
uggaccaaagccac

SEQ ID NO: 2119653 - RNA, 20 nt, Homo sapiens
uaguuguuggucuguagcaa

SEQ ID NO: 2119654 - RNA, 15 nt, Homo sapiens
uguucacuuccaaga

SEQ ID NO: 2119655 - RNA, 15 nt, Homo sapiens
ccucagcuagcucug

SEQ ID NO: 2119656 - RNA, 16 nt, Homo sapiens
cuucuacaauuguggu

SEQ ID NO: 2119657 - RNA, 22 nt, Homo sapiens
acuuucaggaccuuccuuccuc

SEQ ID NO: 2119658 - RNA, 13 nt, Homo sapiens
ugaccaacugugu

SEQ ID NO: 2119659 - RNA, 13 nt, Homo sapiens
uauagccucuguc

SEQ ID NO: 2119660 - RNA, 16 nt, Homo sapiens
aauauagcaguagucu

SEQ ID NO: 2119661 - RNA, 19 nt, Homo sapiens
cugggacuaaagccaggaa

SEQ ID NO: 2119662 - RNA, 21 nt, Homo sapiens
gcugcugagucgcucucauga

SEQ ID NO: 2119663 - RNA, 18 nt, Homo sapiens
ccaccuguagcugaagca

SEQ ID NO: 2119664 - RNA, 13 nt, Homo sapiens
gauccgcggggac

SEQ ID NO: 2119665 - RNA, 21 nt, Homo sapiens
cguagcuauccggacagagca

SEQ ID NO: 2119666 - RNA, 15 nt, Homo sapiens
cagaaccagccucaa

SEQ ID NO: 2119667 - RNA, 16 nt, Homo sapiens
gacggucccacacugg

SEQ ID NO: 2119668 - RNA, 13 nt, Homo sapiens
cugaaagccagca

SEQ ID NO: 2119669 - RNA, 14 nt, Homo sapiens
cuguagucccaguu

SEQ ID NO: 2119670 - RNA, 17 nt, Homo sapiens
ucaaucaacacuaccag

SEQ ID NO: 2119671 - RNA, 23 nt, Homo sapiens
aaucauuaggaaacacugauuaa

SEQ ID NO: 2119672 - RNA, 13 nt, Homo sapiens
gggaguggcagaa

SEQ ID NO: 2119673 - RNA, 23 nt, Homo sapiens
aauuccagaggacucugcuuaaa

SEQ ID NO: 2119674 - RNA, 23 nt, Homo sapiens
agcuuauaaacagaagugacuga

SEQ ID NO: 2119675 - RNA, 12 nt, Homo sapiens
uauucaugccau

SEQ ID NO: 2119676 - RNA, 12 nt, Homo sapiens
ucuucaugcaau

SEQ ID NO: 2119677 - RNA, 20 nt, Homo sapiens
cgagcggggagccaggaaag

SEQ ID NO: 2119678 - RNA, 18 nt, Homo sapiens
cuaacaaaagaacuaaga

SEQ ID NO: 2119679 - RNA, 15 nt, Homo sapiens
cgggucuccuagcuc

SEQ ID NO: 2119680 - RNA, 22 nt, Homo sapiens
uggaaaaggccuguggcccaga

SEQ ID NO: 2119681 - RNA, 20 nt, Homo sapiens
gaaugaccagguaacaucau

SEQ ID NO: 2119682 - RNA, 15 nt, Homo sapiens
cccuuggugacucug

SEQ ID NO: 2119683 - RNA, 12 nt, Homo sapiens
gaaggcuaugua

SEQ ID NO: 2119684 - RNA, 21 nt, Homo sapiens
augguuuuuaaagaaaccuca

SEQ ID NO: 2119685 - RNA, 15 nt, Homo sapiens
guccccuccguagga

SEQ ID NO: 2119686 - RNA, 15 nt, Homo sapiens
auaagcacgcauuuu

SEQ ID NO: 2119687 - RNA, 14 nt, Homo sapiens
gugcucugaugcaa

SEQ ID NO: 2119688 - RNA, 17 nt, Homo sapiens
aguacacagcugagcaa

SEQ ID NO: 2119689 - RNA, 17 nt, Homo sapiens
ucauuuccaaacuugaa

SEQ ID NO: 2119690 - RNA, 17 nt, Homo sapiens
auaagaagcauuuugca

SEQ ID NO: 2119691 - RNA, 20 nt, Homo sapiens
uguuccugaaaauugcaaua

SEQ ID NO: 2119692 - RNA, 19 nt, Homo sapiens
ggcugacaugcucacacau

SEQ ID NO: 2119693 - RNA, 19 nt, Homo sapiens
agaaacaaaauccucagga

SEQ ID NO: 2119694 - RNA, 14 nt, Homo sapiens
cagaaacagugagu

SEQ ID NO: 2119695 - RNA, 14 nt, Homo sapiens
uuuauuccuuugaa

SEQ ID NO: 2119696 - RNA, 13 nt, Homo sapiens
cuaaccaaaugca

SEQ ID NO: 2119697 - RNA, 14 nt, Homo sapiens
acugcuaaaugcac

SEQ ID NO: 2119698 - RNA, 22 nt, Homo sapiens
cucacuggccacaauacccacc

SEQ ID NO: 2119699 - RNA, 13 nt, Homo sapiens
aauguauugaacu

SEQ ID NO: 2119700 - RNA, 20 nt, Homo sapiens
cuccacaaaugggaaaacca

SEQ ID NO: 2119701 - RNA, 16 nt, Homo sapiens
aauccaucaggacuug

SEQ ID NO: 2119702 - RNA, 15 nt, Homo sapiens
gggcaauccagacag

SEQ ID NO: 2119703 - RNA, 15 nt, Homo sapiens
auaaagcacugagca

SEQ ID NO: 2119704 - RNA, 19 nt, Homo sapiens
ccucuucaaaggugacuuc

SEQ ID NO: 2119705 - RNA, 15 nt, Homo sapiens
aaaggccacaggaga

SEQ ID NO: 2119706 - RNA, 18 nt, Homo sapiens
uggaaugcuucuucucag

SEQ ID NO: 2119707 - RNA, 14 nt, Homo sapiens
acugcuuaguauua

SEQ ID NO: 2119708 - RNA, 17 nt, Homo sapiens
gucuuuuuucucucuua

SEQ ID NO: 2119709 - RNA, 22 nt, Homo sapiens
aaaugcuguugguaaagcacau

SEQ ID NO: 2119710 - RNA, 22 nt, Homo sapiens
ucucuuugguguacaaaaugga

SEQ ID NO: 2119711 - RNA, 14 nt, Homo sapiens
ucaugugugcaugu

SEQ ID NO: 2119712 - RNA, 14 nt, Homo sapiens
ucagaagugcagaa

SEQ ID NO: 2119713 - RNA, 22 nt, Homo sapiens
ccagcacuuuagaucacuugag

SEQ ID NO: 2119714 - RNA, 13 nt, Homo sapiens
guccucuacugcu

SEQ ID NO: 2119715 - RNA, 23 nt, Homo sapiens
uaaaaacucuauaaccucagcuu

SEQ ID NO: 2119716 - RNA, 22 nt, Homo sapiens
uggccaguagcuaaagugcaag

SEQ ID NO: 2119717 - RNA, 21 nt, Homo sapiens
ugaacuguaccaugugcuaca

SEQ ID NO: 2119718 - RNA, 19 nt, Homo sapiens
uaagugauuuguaugucua

SEQ ID NO: 2119719 - RNA, 13 nt, Homo sapiens
ugucgucuuuaug

SEQ ID NO: 2119720 - RNA, 20 nt, Homo sapiens
uggauucaggugcuggagaa

SEQ ID NO: 2119721 - RNA, 14 nt, Homo sapiens
aucaagcuuaguga

SEQ ID NO: 2119722 - RNA, 17 nt, Homo sapiens
caucucuggaugccuga

SEQ ID NO: 2119723 - RNA, 19 nt, Homo sapiens
cauuuuagucccauuugac

SEQ ID NO: 2119724 - RNA, 18 nt, Homo sapiens
cuuuggucaaaguuuucu

SEQ ID NO: 2119725 - RNA, 14 nt, Homo sapiens
gugaaggagccagu

SEQ ID NO: 2119726 - RNA, 16 nt, Homo sapiens
acacagcaucagcuca

SEQ ID NO: 2119727 - RNA, 22 nt, Homo sapiens
aauuuuauugacacaguaccau

SEQ ID NO: 2119728 - RNA, 22 nt, Homo sapiens
cugugaugugaagacaccugca

SEQ ID NO: 2119729 - RNA, 20 nt, Homo sapiens
auuuucaccuauccagagag

SEQ ID NO: 2119730 - RNA, 22 nt, Homo sapiens
ugaagccucugcccugccuccc

SEQ ID NO: 2119731 - RNA, 20 nt, Homo sapiens
cucgauuauucccuguacaa

SEQ ID NO: 2119732 - RNA, 15 nt, Homo sapiens
ccugccggugcacag

SEQ ID NO: 2119733 - RNA, 14 nt, Homo sapiens
uggcacccaccacu

SEQ ID NO: 2119734 - RNA, 19 nt, Homo sapiens
cuucauuuuuguaauaaca

SEQ ID NO: 2119735 - RNA, 20 nt, Homo sapiens
agaacuggaacuacguagcu

SEQ ID NO: 2119736 - RNA, 18 nt, Homo sapiens
cccuuucuugaagaacaa

SEQ ID NO: 2119737 - RNA, 16 nt, Homo sapiens
gccaagauacuugaac

SEQ ID NO: 2119738 - RNA, 17 nt, Homo sapiens
uaagguaauucauggca

SEQ ID NO: 2119739 - RNA, 21 nt, Homo sapiens
ucauaacaauguaugugaaag

SEQ ID NO: 2119740 - RNA, 13 nt, Homo sapiens
caggugaugggcu

SEQ ID NO: 2119741 - RNA, 16 nt, Homo sapiens
caacauguguacuuaa

SEQ ID NO: 2119742 - RNA, 18 nt, Homo sapiens
cuuuucaauuauuucaau

SEQ ID NO: 2119743 - RNA, 16 nt, Homo sapiens
guggagauagugccag

SEQ ID NO: 2119744 - RNA, 21 nt, Homo sapiens
gacauaacagugcagggcaaa

SEQ ID NO: 2119745 - RNA, 18 nt, Homo sapiens
accuggaggcuggaccaa

SEQ ID NO: 2119746 - RNA, 17 nt, Homo sapiens
ugcgcgcgugcaugugu

SEQ ID NO: 2119747 - RNA, 19 nt, Homo sapiens
uuuaagaaaaacaugucau

SEQ ID NO: 2119748 - RNA, 16 nt, Homo sapiens
ccaccucacagccaga

SEQ ID NO: 2119749 - RNA, 17 nt, Homo sapiens
uguaagaaacacacuga

SEQ ID NO: 2119750 - RNA, 20 nt, Homo sapiens
cuggugaaggaucuugccug

SEQ ID NO: 2119751 - RNA, 21 nt, Homo sapiens
cucaaccagagucacccaguu

SEQ ID NO: 2119752 - RNA, 15 nt, Homo sapiens
ggcuuugggguccua

SEQ ID NO: 2119753 - RNA, 15 nt, Homo sapiens
aaaugcaccaaucag

SEQ ID NO: 2119754 - RNA, 14 nt, Homo sapiens
ggaacccagacuca

SEQ ID NO: 2119755 - RNA, 23 nt, Homo sapiens
aauaguuaaaaauuaaauauuua

SEQ ID NO: 2119756 - RNA, 11 nt, Homo sapiens
gcaccaaagac

SEQ ID NO: 2119757 - RNA, 14 nt, Homo sapiens
acuuccaucccugc

SEQ ID NO: 2119758 - RNA, 17 nt, Homo sapiens
ugcaacuucuaaacaca

SEQ ID NO: 2119759 - RNA, 15 nt, Homo sapiens
ugauaccugcacugu

SEQ ID NO: 2119760 - RNA, 10 nt, Homo sapiens
ucguagccaa

SEQ ID NO: 2119761 - RNA, 23 nt, Homo sapiens
cauauacugccauguacuaguuu

SEQ ID NO: 2119762 - RNA, 17 nt, Homo sapiens
auaaucugcaugaagga

SEQ ID NO: 2119763 - RNA, 23 nt, Homo sapiens
agacgccuuugugagcugugagu

SEQ ID NO: 2119764 - RNA, 14 nt, Homo sapiens
uccuguaaauguga

SEQ ID NO: 2119765 - RNA, 18 nt, Homo sapiens
uaaggugugaaaucauca

SEQ ID NO: 2119766 - RNA, 15 nt, Homo sapiens
cauccggcagccugg

SEQ ID NO: 2119767 - RNA, 16 nt, Homo sapiens
agaaauguaacauacu

SEQ ID NO: 2119768 - RNA, 18 nt, Homo sapiens
auacuucauucucucuca

SEQ ID NO: 2119769 - RNA, 20 nt, Homo sapiens
cguggugggauuugcuccug

SEQ ID NO: 2119770 - RNA, 11 nt, Homo sapiens
gggcacuguca

SEQ ID NO: 2119771 - RNA, 12 nt, Homo sapiens
uauaauacugua

SEQ ID NO: 2119772 - RNA, 13 nt, Homo sapiens
auuuaacaugacu

SEQ ID NO: 2119773 - RNA, 20 nt, Homo sapiens
acucacccuuccuggcccag

SEQ ID NO: 2119774 - RNA, 16 nt, Homo sapiens
ccuguguuaaugcuuu

SEQ ID NO: 2119775 - RNA, 23 nt, Homo sapiens
uuaaaagaucauaguugcaaaau

SEQ ID NO: 2119776 - RNA, 16 nt, Homo sapiens
cauaacaaugucucau

SEQ ID NO: 2119777 - RNA, 19 nt, Homo sapiens
gcuuggcccuuuccuucca

SEQ ID NO: 2119778 - RNA, 19 nt, Homo sapiens
aucaauuuuuauacauauc

SEQ ID NO: 2119779 - RNA, 17 nt, Homo sapiens
aggacucacuagacuca

SEQ ID NO: 2119780 - RNA, 14 nt, Homo sapiens
uggaaagcuuugaa

SEQ ID NO: 2119781 - RNA, 15 nt, Homo sapiens
auauugcacaggcug

SEQ ID NO: 2119782 - RNA, 14 nt, Homo sapiens
gccucugagccacu

SEQ ID NO: 2119783 - RNA, 14 nt, Homo sapiens
aauaaagaaauuaa

SEQ ID NO: 2119784 - RNA, 21 nt, Homo sapiens
ucccaagucacacccacuccc

SEQ ID NO: 2119785 - RNA, 19 nt, Homo sapiens
uguguugaagcacuguugg

SEQ ID NO: 2119786 - RNA, 17 nt, Homo sapiens
acuauaacaaucacugg

SEQ ID NO: 2119787 - RNA, 17 nt, Homo sapiens
ucuucuuugcuucucca

SEQ ID NO: 2119788 - RNA, 15 nt, Homo sapiens
cagaaaauagcuuuu

SEQ ID NO: 2119789 - RNA, 13 nt, Homo sapiens
uguuccuaucaaa

SEQ ID NO: 2119790 - RNA, 15 nt, Homo sapiens
ccccaguucuacuga

SEQ ID NO: 2119791 - RNA, 14 nt, Homo sapiens
uacaugucuaucaa

SEQ ID NO: 2119792 - RNA, 21 nt, Homo sapiens
cugucuuccuugaccaaagcu

SEQ ID NO: 2119793 - RNA, 17 nt, Homo sapiens
uccugcugcuucugcaa

SEQ ID NO: 2119794 - RNA, 17 nt, Homo sapiens
cccuuaagagucaucca

SEQ ID NO: 2119795 - RNA, 21 nt, Homo sapiens
ucagcgcucuccccugaggga

SEQ ID NO: 2119796 - RNA, 17 nt, Homo sapiens
gucagauacaauguauu

SEQ ID NO: 2119797 - RNA, 20 nt, Homo sapiens
ucaugcccuuaaguucagca

SEQ ID NO: 2119798 - RNA, 17 nt, Homo sapiens
ugcuucuuuccucuuaa

SEQ ID NO: 2119799 - RNA, 15 nt, Homo sapiens
auuuucuaaaacaag

SEQ ID NO: 2119800 - RNA, 17 nt, Homo sapiens
cuacugcuaaauccuca

SEQ ID NO: 2119801 - RNA, 23 nt, Homo sapiens
aaucccagauaugguugcacaaa

SEQ ID NO: 2119802 - RNA, 23 nt, Homo sapiens
acuaccccaggaugcaugcaggg

SEQ ID NO: 2119803 - RNA, 17 nt, Homo sapiens
uuacuuaauugccagca

SEQ ID NO: 2119804 - RNA, 18 nt, Homo sapiens
gaggucaggaguucgaga

SEQ ID NO: 2119805 - RNA, 16 nt, Homo sapiens
uccuccacucacucca

SEQ ID NO: 2119806 - RNA, 16 nt, Homo sapiens
cauguguguauauaug

SEQ ID NO: 2119807 - RNA, 17 nt, Homo sapiens
agugcugggaccagagc

SEQ ID NO: 2119808 - RNA, 20 nt, Homo sapiens
cagugaugaaaaccuaacag

SEQ ID NO: 2119809 - RNA, 14 nt, Homo sapiens
gugaugcccaaaga

SEQ ID NO: 2119810 - RNA, 17 nt, Homo sapiens
ucuucucaaagcacugu

SEQ ID NO: 2119811 - RNA, 19 nt, Homo sapiens
gguuuccuggcagccugcu

SEQ ID NO: 2119812 - RNA, 13 nt, Homo sapiens
cuuccucucucua

SEQ ID NO: 2119813 - RNA, 16 nt, Homo sapiens
cuccuaacuacaggua

SEQ ID NO: 2119814 - RNA, 20 nt, Homo sapiens
cugcuacaccuauuauccca

SEQ ID NO: 2119815 - RNA, 16 nt, Homo sapiens
ucaaaugguuagcuua

SEQ ID NO: 2119816 - RNA, 21 nt, Homo sapiens
auggggguuggggugcuuccu

SEQ ID NO: 2119817 - RNA, 20 nt, Homo sapiens
uucaguagguugaacuauga

SEQ ID NO: 2119818 - RNA, 14 nt, Homo sapiens
ugucuguucacuuu

SEQ ID NO: 2119819 - RNA, 14 nt, Homo sapiens
agugguuugugcua

SEQ ID NO: 2119820 - RNA, 21 nt, Homo sapiens
cauccggcaugagggcugaga

SEQ ID NO: 2119821 - RNA, 17 nt, Homo sapiens
ccagaaugugaagacaa

SEQ ID NO: 2119822 - RNA, 16 nt, Homo sapiens
ugaaggaacuagggau

SEQ ID NO: 2119823 - RNA, 20 nt, Homo sapiens
cacaucagcccuguguauaa

SEQ ID NO: 2119824 - RNA, 17 nt, Homo sapiens
uuagccgggccccaugg

SEQ ID NO: 2119825 - RNA, 18 nt, Homo sapiens
ugccuuucaaauuuagaa

SEQ ID NO: 2119826 - RNA, 18 nt, Homo sapiens
cacuuaaaaaauguccau

SEQ ID NO: 2119827 - RNA, 12 nt, Homo sapiens
ugaucugaugca

SEQ ID NO: 2119828 - RNA, 14 nt, Homo sapiens
uaaaggccuggaac

SEQ ID NO: 2119829 - RNA, 11 nt, Homo sapiens
gaagucuucaa

SEQ ID NO: 2119830 - RNA, 22 nt, Homo sapiens
agauuaggcugaggcagugcua

SEQ ID NO: 2119831 - RNA, 19 nt, Homo sapiens
gagaaauggcgaaugucau

SEQ ID NO: 2119832 - RNA, 13 nt, Homo sapiens
ugcuucuaguauu

SEQ ID NO: 2119833 - RNA, 22 nt, Homo sapiens
gcagagucugccccacaugugg

SEQ ID NO: 2119834 - RNA, 15 nt, Homo sapiens
uuucuuuuaagcuau

SEQ ID NO: 2119835 - RNA, 14 nt, Homo sapiens
ccugaucaugguca

SEQ ID NO: 2119836 - RNA, 23 nt, Homo sapiens
gccaucaccucagauggcagcuu

SEQ ID NO: 2119837 - RNA, 16 nt, Homo sapiens
augauacugaugccau

SEQ ID NO: 2119838 - RNA, 12 nt, Homo sapiens
cagaacagugau

SEQ ID NO: 2119839 - RNA, 19 nt, Homo sapiens
ugucaacuugaaauguguu

SEQ ID NO: 2119840 - RNA, 16 nt, Homo sapiens
cagccagguucugacu

SEQ ID NO: 2119841 - RNA, 14 nt, Homo sapiens
ucccuggaugacau

SEQ ID NO: 2119842 - RNA, 12 nt, Homo sapiens
acauuacaaucc

SEQ ID NO: 2119843 - RNA, 14 nt, Homo sapiens
caucacaaccucca

SEQ ID NO: 2119844 - RNA, 13 nt, Homo sapiens
cugaucuauacaa

SEQ ID NO: 2119845 - RNA, 15 nt, Homo sapiens
uuuguaccaguguga

SEQ ID NO: 2119846 - RNA, 20 nt, Homo sapiens
gguugucuccaaaaggccuu

SEQ ID NO: 2119847 - RNA, 15 nt, Homo sapiens
aaauguguacaguga

SEQ ID NO: 2119848 - RNA, 22 nt, Homo sapiens
auuugccuugcagaacugccau

SEQ ID NO: 2119849 - RNA, 17 nt, Homo sapiens
cacugauacacagaaua

SEQ ID NO: 2119850 - RNA, 16 nt, Homo sapiens
guuaacauuucuuugu

SEQ ID NO: 2119851 - RNA, 17 nt, Homo sapiens
cuccguaugaugugaua

SEQ ID NO: 2119852 - RNA, 20 nt, Homo sapiens
acagcuucuuuacuacugca

SEQ ID NO: 2119853 - RNA, 15 nt, Homo sapiens
cugcaccuguaggau

SEQ ID NO: 2119854 - RNA, 16 nt, Homo sapiens
aauucuuuugccaagg

SEQ ID NO: 2119855 - RNA, 13 nt, Homo sapiens
uccccaggacuug

SEQ ID NO: 2119856 - RNA, 12 nt, Homo sapiens
aaaauaaauucc

SEQ ID NO: 2119857 - RNA, 21 nt, Homo sapiens
cuuucuuuuuaagcucagugg

SEQ ID NO: 2119858 - RNA, 13 nt, Homo sapiens
uaguuuauuucaa

SEQ ID NO: 2119859 - RNA, 20 nt, Homo sapiens
agacuaugauuuaccuauac

SEQ ID NO: 2119860 - RNA, 20 nt, Homo sapiens
agagugagacuccgucucaa

SEQ ID NO: 2119861 - RNA, 23 nt, Homo sapiens
auccagagagcuuaaauugucau

SEQ ID NO: 2119862 - RNA, 15 nt, Homo sapiens
gagaaguggggaccc

SEQ ID NO: 2119863 - RNA, 15 nt, Homo sapiens
cuaacaguggacaaa

SEQ ID NO: 2119864 - RNA, 14 nt, Homo sapiens
aguaaaugccucau

SEQ ID NO: 2119865 - RNA, 19 nt, Homo sapiens
caguggcuucaucugucaa

SEQ ID NO: 2119866 - RNA, 17 nt, Homo sapiens
acacauggcaugaaaua

SEQ ID NO: 2119867 - RNA, 22 nt, Homo sapiens
agucugguggauaaagauggau

SEQ ID NO: 2119868 - RNA, 16 nt, Homo sapiens
ucagugagaccuggau

SEQ ID NO: 2119869 - RNA, 18 nt, Homo sapiens
ugauuucuuucuuugcac

SEQ ID NO: 2119870 - RNA, 14 nt, Homo sapiens
ugcauuauaucaaa

SEQ ID NO: 2119871 - RNA, 21 nt, Homo sapiens
aaguagugauauucuacuucu

SEQ ID NO: 2119872 - RNA, 21 nt, Homo sapiens
cauagaacuccggaaugacca

SEQ ID NO: 2119873 - RNA, 13 nt, Homo sapiens
uguagugagccaa

SEQ ID NO: 2119874 - RNA, 13 nt, Homo sapiens
aaccucucgccau

SEQ ID NO: 2119875 - RNA, 22 nt, Homo sapiens
cuggcuuuucaccccagaggac

SEQ ID NO: 2119876 - RNA, 16 nt, Homo sapiens
aaaugaaagucaguuu

SEQ ID NO: 2119877 - RNA, 16 nt, Homo sapiens
aaaucaaugucacuua

SEQ ID NO: 2119878 - RNA, 17 nt, Homo sapiens
caaccugaaauuaacuc

SEQ ID NO: 2119879 - RNA, 22 nt, Homo sapiens
cugggcaucucugagcaauugu

SEQ ID NO: 2119880 - RNA, 19 nt, Homo sapiens
agaggugacaguggaugac

SEQ ID NO: 2119881 - RNA, 18 nt, Homo sapiens
uuucaauugaaggugcug

SEQ ID NO: 2119882 - RNA, 18 nt, Homo sapiens
ccucagggacaacauuuu

SEQ ID NO: 2119883 - RNA, 15 nt, Homo sapiens
ggaauacucacauuu

SEQ ID NO: 2119884 - RNA, 19 nt, Homo sapiens
aaugcuaauaaaguccuau

SEQ ID NO: 2119885 - RNA, 17 nt, Homo sapiens
ucaaacugaaacaaaau

SEQ ID NO: 2119886 - RNA, 20 nt, Homo sapiens
auacauucuccuuuuugccc

SEQ ID NO: 2119887 - RNA, 17 nt, Homo sapiens
aauguauuuuagacuuc

SEQ ID NO: 2119888 - RNA, 12 nt, Homo sapiens
augucugugcca

SEQ ID NO: 2119889 - RNA, 16 nt, Homo sapiens
aggacaaucuagcucu

SEQ ID NO: 2119890 - RNA, 16 nt, Homo sapiens
uacccuauaucuauaa

SEQ ID NO: 2119891 - RNA, 13 nt, Homo sapiens
uggugacugagau

SEQ ID NO: 2119892 - RNA, 16 nt, Homo sapiens
agcccaggaagucuca

SEQ ID NO: 2119893 - RNA, 16 nt, Homo sapiens
uuucauaucacacugu

SEQ ID NO: 2119894 - RNA, 20 nt, Homo sapiens
aaaauauuugccuccaugua

SEQ ID NO: 2119895 - RNA, 15 nt, Homo sapiens
ccuggaucaggguug

SEQ ID NO: 2119896 - RNA, 16 nt, Homo sapiens
ccacucuguaauaguu

SEQ ID NO: 2119897 - RNA, 22 nt, Homo sapiens
guggcccuuucggauccaggga

SEQ ID NO: 2119898 - RNA, 21 nt, Homo sapiens
aaaacuucauucuaaaccaaa

SEQ ID NO: 2119899 - RNA, 19 nt, Homo sapiens
guugucucuagagcaggga

SEQ ID NO: 2119900 - RNA, 16 nt, Homo sapiens
ucaaagaaauccucca

SEQ ID NO: 2119901 - RNA, 14 nt, Homo sapiens
aaaagucuucacuc

SEQ ID NO: 2119902 - RNA, 18 nt, Homo sapiens
uguuacuggccaaggcua

SEQ ID NO: 2119903 - RNA, 19 nt, Homo sapiens
cccauaauuauuauuucca

SEQ ID NO: 2119904 - RNA, 22 nt, Homo sapiens
uagggacacacaggcagcugaa

SEQ ID NO: 2119905 - RNA, 14 nt, Homo sapiens
ggacucugugcuca

SEQ ID NO: 2119906 - RNA, 16 nt, Homo sapiens
auaaacucauuuaucu

SEQ ID NO: 2119907 - RNA, 13 nt, Homo sapiens
gaguggagcauug

SEQ ID NO: 2119908 - RNA, 19 nt, Homo sapiens
agcauuuaccaugugcuaa

SEQ ID NO: 2119909 - RNA, 18 nt, Homo sapiens
aucccccuugccaaauuc

SEQ ID NO: 2119910 - RNA, 17 nt, Homo sapiens
ugugcccuguggcugcc

SEQ ID NO: 2119911 - RNA, 16 nt, Homo sapiens
ggaggcucaggugauc

SEQ ID NO: 2119912 - RNA, 18 nt, Homo sapiens
caaacacaaaaaucauua

SEQ ID NO: 2119913 - RNA, 21 nt, Homo sapiens
ggacauugccuuuucuagccc

SEQ ID NO: 2119914 - RNA, 22 nt, Homo sapiens
ugaagccugacucagcuaaugu

SEQ ID NO: 2119915 - RNA, 13 nt, Homo sapiens
cauucaucucuca

SEQ ID NO: 2119916 - RNA, 18 nt, Homo sapiens
gauacagacauucaauga

SEQ ID NO: 2119917 - RNA, 16 nt, Homo sapiens
uggcugggaacaacuu

SEQ ID NO: 2119918 - RNA, 17 nt, Homo sapiens
uguaugagacuaugcaa

SEQ ID NO: 2119919 - RNA, 19 nt, Homo sapiens
acagcccugcucauuccuc

SEQ ID NO: 2119920 - RNA, 15 nt, Homo sapiens
ggcuucucccugggg

SEQ ID NO: 2119921 - RNA, 22 nt, Homo sapiens
cugacugugaggugggccuuug

SEQ ID NO: 2119922 - RNA, 15 nt, Homo sapiens
aucgaggaagcaccu

SEQ ID NO: 2119923 - RNA, 21 nt, Homo sapiens
cccaucugacaagaaagccug

SEQ ID NO: 2119924 - RNA, 12 nt, Homo sapiens
ccccagcucaau

SEQ ID NO: 2119925 - RNA, 20 nt, Homo sapiens
cuccauaauugcaagggaag

SEQ ID NO: 2119926 - RNA, 17 nt, Homo sapiens
uguccugcccccaagga

SEQ ID NO: 2119927 - RNA, 20 nt, Homo sapiens
gucaccuacaggacugggcc

SEQ ID NO: 2119928 - RNA, 12 nt, Homo sapiens
uaaaguagcuuu

SEQ ID NO: 2119929 - RNA, 23 nt, Homo sapiens
gccaccuagaaaggggcccauuc

SEQ ID NO: 2119930 - RNA, 14 nt, Homo sapiens
auauaugucaauau

SEQ ID NO: 2119931 - RNA, 14 nt, Homo sapiens
aagucugucugucu

SEQ ID NO: 2119932 - RNA, 20 nt, Homo sapiens
acuaccaaaugagcauuagc

SEQ ID NO: 2119933 - RNA, 22 nt, Homo sapiens
gccaugcagaccucaugcccag

SEQ ID NO: 2119934 - RNA, 20 nt, Homo sapiens
cuguauacagauucuagcca

SEQ ID NO: 2119935 - RNA, 18 nt, Homo sapiens
cuuguguuggcuguggca

SEQ ID NO: 2119936 - RNA, 20 nt, Homo sapiens
aggguaaugagaagcuuugg

SEQ ID NO: 2119937 - RNA, 15 nt, Homo sapiens
uuaaagaagcuuuau

SEQ ID NO: 2119938 - RNA, 12 nt, Homo sapiens
uguaaacauuuc

SEQ ID NO: 2119939 - RNA, 16 nt, Homo sapiens
uaaaauaaugaacacu

SEQ ID NO: 2119940 - RNA, 18 nt, Homo sapiens
uccugauuucccuaagga

SEQ ID NO: 2119941 - RNA, 20 nt, Homo sapiens
acgaggugguagcucugagc

SEQ ID NO: 2119942 - RNA, 17 nt, Homo sapiens
aauauacaggaggaugu

SEQ ID NO: 2119943 - RNA, 19 nt, Homo sapiens
ugcccugcuacuaacuuuu

SEQ ID NO: 2119944 - RNA, 18 nt, Homo sapiens
auggaaauaaaaggcauu

SEQ ID NO: 2119945 - RNA, 17 nt, Homo sapiens
cagcccuccucugucaa

SEQ ID NO: 2119946 - RNA, 12 nt, Homo sapiens
agccaggagcag

SEQ ID NO: 2119947 - RNA, 12 nt, Homo sapiens
uaguccagauuu

SEQ ID NO: 2119948 - RNA, 23 nt, Homo sapiens
caagugguuaagaauguauauca

SEQ ID NO: 2119949 - RNA, 14 nt, Homo sapiens
ccugaaacaucuca

SEQ ID NO: 2119950 - RNA, 21 nt, Homo sapiens
aacacaaaauccaugggcagu

SEQ ID NO: 2119951 - RNA, 13 nt, Homo sapiens
acuuuaacuucca

SEQ ID NO: 2119952 - RNA, 14 nt, Homo sapiens
cuaccuccaaagcu

SEQ ID NO: 2119953 - RNA, 14 nt, Homo sapiens
augcagugcugcuu

SEQ ID NO: 2119954 - RNA, 14 nt, Homo sapiens
caggauugaaggug

SEQ ID NO: 2119955 - RNA, 15 nt, Homo sapiens
gaggcaaagguucua

SEQ ID NO: 2119956 - RNA, 15 nt, Homo sapiens
ugucuugguugccag

SEQ ID NO: 2119957 - RNA, 11 nt, Homo sapiens
uuggugaauga

SEQ ID NO: 2119958 - RNA, 23 nt, Homo sapiens
acuccucccccuccuccaugcug

SEQ ID NO: 2119959 - RNA, 15 nt, Homo sapiens
gcagagcccaccagc

SEQ ID NO: 2119960 - RNA, 21 nt, Homo sapiens
cucccugucacucagcugaga

SEQ ID NO: 2119961 - RNA, 13 nt, Homo sapiens
gggccacugccug

SEQ ID NO: 2119962 - RNA, 22 nt, Homo sapiens
caaagaacuuggaaauagugau

SEQ ID NO: 2119963 - RNA, 16 nt, Homo sapiens
augacaucaacauucc

SEQ ID NO: 2119964 - RNA, 21 nt, Homo sapiens
ggaaaaagaacccugcaaaug

SEQ ID NO: 2119965 - RNA, 22 nt, Homo sapiens
auauccauauuaaguaagucuc

SEQ ID NO: 2119966 - RNA, 16 nt, Homo sapiens
acuuuuggaaggugac

SEQ ID NO: 2119967 - RNA, 15 nt, Homo sapiens
uuguacauauggaaa

SEQ ID NO: 2119968 - RNA, 20 nt, Homo sapiens
uguacaaggggccauuuggc

SEQ ID NO: 2119969 - RNA, 13 nt, Homo sapiens
aguugaaacaaga

SEQ ID NO: 2119970 - RNA, 19 nt, Homo sapiens
agccaagccuuaaacugua

SEQ ID NO: 2119971 - RNA, 19 nt, Homo sapiens
uuauuaauuuuuauuauga

SEQ ID NO: 2119972 - RNA, 13 nt, Homo sapiens
cagccaccuuccu

SEQ ID NO: 2119973 - RNA, 14 nt, Homo sapiens
cccucuuugcugca

SEQ ID NO: 2119974 - RNA, 19 nt, Homo sapiens
caccaauauuucucagaca

SEQ ID NO: 2119975 - RNA, 12 nt, Homo sapiens
uaucuaugcauu

SEQ ID NO: 2119976 - RNA, 23 nt, Homo sapiens
ggcagugaugcuggaugcuccuu

SEQ ID NO: 2119977 - RNA, 14 nt, Homo sapiens
uucguaagaaggaa

SEQ ID NO: 2119978 - RNA, 19 nt, Homo sapiens
gagggaccaauauuaccau

SEQ ID NO: 2119979 - RNA, 21 nt, Homo sapiens
uaaagacagggaagagcagaa

SEQ ID NO: 2119980 - RNA, 14 nt, Homo sapiens
agggcuacagucuc

SEQ ID NO: 2119981 - RNA, 14 nt, Homo sapiens
caggucaccauccu

SEQ ID NO: 2119982 - RNA, 14 nt, Homo sapiens
cucuaaccagugua

SEQ ID NO: 2119983 - RNA, 16 nt, Homo sapiens
agcccaagaggacuga

SEQ ID NO: 2119984 - RNA, 16 nt, Homo sapiens
uucccagguugacuaa

SEQ ID NO: 2119985 - RNA, 13 nt, Homo sapiens
ucaauaugugauu

SEQ ID NO: 2119986 - RNA, 16 nt, Homo sapiens
cauuuuagaagaguua

SEQ ID NO: 2119987 - RNA, 20 nt, Homo sapiens
acaaagaugaccauaaccac

SEQ ID NO: 2119988 - RNA, 16 nt, Homo sapiens
guacucccaaacugac

SEQ ID NO: 2119989 - RNA, 18 nt, Homo sapiens
uaugccacuaacuucuaa

SEQ ID NO: 2119990 - RNA, 12 nt, Homo sapiens
uccccacccacc

SEQ ID NO: 2119991 - RNA, 20 nt, Homo sapiens
aucuuucugugucuucacau

SEQ ID NO: 2119992 - RNA, 21 nt, Homo sapiens
aacauuccagggaugagccaa

SEQ ID NO: 2119993 - RNA, 15 nt, Homo sapiens
uuguguucaccagag

SEQ ID NO: 2119994 - RNA, 14 nt, Homo sapiens
uuaagacacuguga

SEQ ID NO: 2119995 - RNA, 15 nt, Homo sapiens
uggauugggagccau

SEQ ID NO: 2119996 - RNA, 20 nt, Homo sapiens
uaagcuucaaagcugcuuua

SEQ ID NO: 2119997 - RNA, 13 nt, Homo sapiens
uuuauuucuguca

SEQ ID NO: 2119998 - RNA, 13 nt, Homo sapiens
uuuaauucugucu

SEQ ID NO: 2119999 - RNA, 23 nt, Homo sapiens
ggaaacagaagcuuuuuguuugc

SEQ ID NO: 2120000 - RNA, 19 nt, Homo sapiens
aucacugcauuauucucuu

SEQ ID NO: 2120001 - RNA, 14 nt, Homo sapiens
aucagcagugauug

SEQ ID NO: 2120002 - RNA, 19 nt, Homo sapiens
ugucugaacaggaugcuga

SEQ ID NO: 2120003 - RNA, 15 nt, Homo sapiens
gacaggcaggugauc

SEQ ID NO: 2120004 - RNA, 10 nt, Homo sapiens
aaugcauugu

SEQ ID NO: 2120005 - RNA, 23 nt, Homo sapiens
guaccucugcuauuugcuguuau

SEQ ID NO: 2120006 - RNA, 14 nt, Homo sapiens
acuuuacacaagaa

SEQ ID NO: 2120007 - RNA, 14 nt, Homo sapiens
acagagcacauuug

SEQ ID NO: 2120008 - RNA, 20 nt, Homo sapiens
ugacagauggugaaguaaca

SEQ ID NO: 2120009 - RNA, 23 nt, Homo sapiens
auaaagcacagauuugcauuuca

SEQ ID NO: 2120010 - RNA, 16 nt, Homo sapiens
uuccugauacauuaaa

SEQ ID NO: 2120011 - RNA, 16 nt, Homo sapiens
agggcauguugggaua

SEQ ID NO: 2120012 - RNA, 17 nt, Homo sapiens
cuuuggcugacugggaa

SEQ ID NO: 2120013 - RNA, 21 nt, Homo sapiens
agcacuacaggaggaaugcac

SEQ ID NO: 2120014 - RNA, 17 nt, Homo sapiens
ccucuuucuucccauga

SEQ ID NO: 2120015 - RNA, 19 nt, Homo sapiens
uucaccaagaaguggagac

SEQ ID NO: 2120016 - RNA, 23 nt, Homo sapiens
ccaaugagguggcucaugccugu

SEQ ID NO: 2120017 - RNA, 16 nt, Homo sapiens
cccgaugcaggggaug

SEQ ID NO: 2120018 - RNA, 16 nt, Homo sapiens
ccuuugcuucaaauaa

SEQ ID NO: 2120019 - RNA, 18 nt, Homo sapiens
gagauagcuuagugucuc

SEQ ID NO: 2120020 - RNA, 22 nt, Homo sapiens
agucaccugccccagcacucac

SEQ ID NO: 2120021 - RNA, 21 nt, Homo sapiens
auuauauuucacccaucucuc

SEQ ID NO: 2120022 - RNA, 16 nt, Homo sapiens
uugacccauguucccu

SEQ ID NO: 2120023 - RNA, 17 nt, Homo sapiens
ugucggcuuuuugccau

SEQ ID NO: 2120024 - RNA, 14 nt, Homo sapiens
uucaaauggacuca

SEQ ID NO: 2120025 - RNA, 23 nt, Homo sapiens
aauugcugccuuuucucauucug

SEQ ID NO: 2120026 - RNA, 23 nt, Homo sapiens
cagaugucgcuggguccucugca

SEQ ID NO: 2120027 - RNA, 17 nt, Homo sapiens
cugccccucucaccaaa

SEQ ID NO: 2120028 - RNA, 17 nt, Homo sapiens
cuacccuuaauaacaua

SEQ ID NO: 2120029 - RNA, 15 nt, Homo sapiens
caauaaaauggguuu

SEQ ID NO: 2120030 - RNA, 23 nt, Homo sapiens
uauguagccuuagagcaucucug

SEQ ID NO: 2120031 - RNA, 13 nt, Homo sapiens
uuuaccaggguag

SEQ ID NO: 2120032 - RNA, 23 nt, Homo sapiens
aaaucauguguugcagcuuuaua

SEQ ID NO: 2120033 - RNA, 21 nt, Homo sapiens
uaaucauuucugauauuugcu

SEQ ID NO: 2120034 - RNA, 20 nt, Homo sapiens
auguugcuuucuuaucccag

SEQ ID NO: 2120035 - RNA, 18 nt, Homo sapiens
aacuccaucauucaucca

SEQ ID NO: 2120036 - RNA, 20 nt, Homo sapiens
aaugguuuucuaauaucuua

SEQ ID NO: 2120037 - RNA, 17 nt, Homo sapiens
cccucaaaacuuggaau

SEQ ID NO: 2120038 - RNA, 17 nt, Homo sapiens
auguccagcaccuugug

SEQ ID NO: 2120039 - RNA, 23 nt, Homo sapiens
uuuguuggucacauggagcucuu

SEQ ID NO: 2120040 - RNA, 21 nt, Homo sapiens
aaggaacugaggcccagaaag

SEQ ID NO: 2120041 - RNA, 18 nt, Homo sapiens
aaaguggcauuucuuuau

SEQ ID NO: 2120042 - RNA, 17 nt, Homo sapiens
agaacaggguuucucag

SEQ ID NO: 2120043 - RNA, 15 nt, Homo sapiens
agcagcugaagccag

SEQ ID NO: 2120044 - RNA, 20 nt, Homo sapiens
cugcaguagugcaccaucuc

SEQ ID NO: 2120045 - RNA, 15 nt, Homo sapiens
gcccaagaggucuga

SEQ ID NO: 2120046 - RNA, 23 nt, Homo sapiens
gcccagaggcuucuccaaaggga

SEQ ID NO: 2120047 - RNA, 23 nt, Homo sapiens
aaaucaauuuaaaaaaugggcua

SEQ ID NO: 2120048 - RNA, 18 nt, Homo sapiens
ucucacaguguugcccag

SEQ ID NO: 2120049 - RNA, 20 nt, Homo sapiens
acugcugucagccaagucau

SEQ ID NO: 2120050 - RNA, 13 nt, Homo sapiens
uacacacauauaa

SEQ ID NO: 2120051 - RNA, 21 nt, Homo sapiens
aaauuauuauuuagcuucucc

SEQ ID NO: 2120052 - RNA, 20 nt, Homo sapiens
gagucaacucuggccaggaa

SEQ ID NO: 2120053 - RNA, 19 nt, Homo sapiens
agcacauucuggcucaggg

SEQ ID NO: 2120054 - RNA, 19 nt, Homo sapiens
uacaaaguaagccauguau

SEQ ID NO: 2120055 - RNA, 17 nt, Homo sapiens
auaguuuuuaaagaucu

SEQ ID NO: 2120056 - RNA, 14 nt, Homo sapiens
uucuccaaaugaga

SEQ ID NO: 2120057 - RNA, 22 nt, Homo sapiens
gcuugcucagauagaucugugu

SEQ ID NO: 2120058 - RNA, 23 nt, Homo sapiens
ccacacugauggcucaagacaag

SEQ ID NO: 2120059 - RNA, 13 nt, Homo sapiens
ugccaucaccauu

SEQ ID NO: 2120060 - RNA, 19 nt, Homo sapiens
gucauuucaaagacucuca

SEQ ID NO: 2120061 - RNA, 21 nt, Homo sapiens
ugcaugucccaucacguguac

SEQ ID NO: 2120062 - RNA, 16 nt, Homo sapiens
uaguuauaaaccaaug

SEQ ID NO: 2120063 - RNA, 22 nt, Homo sapiens
ucucagcacuaauuagugucca

SEQ ID NO: 2120064 - RNA, 20 nt, Homo sapiens
agccguggggggaagcacau

SEQ ID NO: 2120065 - RNA, 19 nt, Homo sapiens
cccugucuuagacuuugaa

SEQ ID NO: 2120066 - RNA, 13 nt, Homo sapiens
aacauagccaaaa

SEQ ID NO: 2120067 - RNA, 13 nt, Homo sapiens
uaacagauguuga

SEQ ID NO: 2120068 - RNA, 16 nt, Homo sapiens
agugccccaguggugc

SEQ ID NO: 2120069 - RNA, 15 nt, Homo sapiens
ggcuuaacacaucuc

SEQ ID NO: 2120070 - RNA, 14 nt, Homo sapiens
uuccaacaccacag

SEQ ID NO: 2120071 - RNA, 14 nt, Homo sapiens
uacuuuacugccug

SEQ ID NO: 2120072 - RNA, 18 nt, Homo sapiens
caauauaucuugucuacu

SEQ ID NO: 2120073 - RNA, 13 nt, Homo sapiens
auaucaugaguga

SEQ ID NO: 2120074 - RNA, 15 nt, Homo sapiens
cagaacaugcuguua

SEQ ID NO: 2120075 - RNA, 14 nt, Homo sapiens
uauuccccauuucc

SEQ ID NO: 2120076 - RNA, 14 nt, Homo sapiens
uagaaaccaugaaa

SEQ ID NO: 2120077 - RNA, 12 nt, Homo sapiens
cuuuuccugucu

SEQ ID NO: 2120078 - RNA, 21 nt, Homo sapiens
ggaccccugaguaaaaaagcu

SEQ ID NO: 2120079 - RNA, 22 nt, Homo sapiens
gcucugcuugccgaaacuggaa

SEQ ID NO: 2120080 - RNA, 21 nt, Homo sapiens
aauguaugcauucacauuuag

SEQ ID NO: 2120081 - RNA, 15 nt, Homo sapiens
uuuuuacaucaaaau

SEQ ID NO: 2120082 - RNA, 15 nt, Homo sapiens
acgggugaugugauu

SEQ ID NO: 2120083 - RNA, 14 nt, Homo sapiens
aagagcguuacugu

SEQ ID NO: 2120084 - RNA, 18 nt, Homo sapiens
aagugugcuuuaugcuga

SEQ ID NO: 2120085 - RNA, 14 nt, Homo sapiens
gcauccacuggaaa

SEQ ID NO: 2120086 - RNA, 19 nt, Homo sapiens
uaacuuaagauuugcucau

SEQ ID NO: 2120087 - RNA, 19 nt, Homo sapiens
guauaucucaacagaauua

SEQ ID NO: 2120088 - RNA, 19 nt, Homo sapiens
auggcaggauccaaggggc

SEQ ID NO: 2120089 - RNA, 17 nt, Homo sapiens
aggauacccagaugcca

SEQ ID NO: 2120090 - RNA, 13 nt, Homo sapiens
ggucauaaugaac

SEQ ID NO: 2120091 - RNA, 18 nt, Homo sapiens
cuuaucagcagcaacaac

SEQ ID NO: 2120092 - RNA, 13 nt, Homo sapiens
guauaaacacucu

SEQ ID NO: 2120093 - RNA, 17 nt, Homo sapiens
uggaaauuuuguccauu

SEQ ID NO: 2120094 - RNA, 12 nt, Homo sapiens
gacugcuuuuag

SEQ ID NO: 2120095 - RNA, 16 nt, Homo sapiens
gagaugcugggccagu

SEQ ID NO: 2120096 - RNA, 21 nt, Homo sapiens
gaaagagaaugaacuguggaa

SEQ ID NO: 2120097 - RNA, 18 nt, Homo sapiens
cacuaguagagcaaagac

SEQ ID NO: 2120098 - RNA, 14 nt, Homo sapiens
auacuguacaugaa

SEQ ID NO: 2120099 - RNA, 21 nt, Homo sapiens
ugaugaguguccuugcagggg

SEQ ID NO: 2120100 - RNA, 16 nt, Homo sapiens
acuguagcugaugaaa

SEQ ID NO: 2120101 - RNA, 23 nt, Homo sapiens
caaggaaauauauuuuaccauac

SEQ ID NO: 2120102 - RNA, 17 nt, Homo sapiens
uaaugugaagcaaaaca

SEQ ID NO: 2120103 - RNA, 14 nt, Homo sapiens
caucagcaaaaaag

SEQ ID NO: 2120104 - RNA, 18 nt, Homo sapiens
aguaggacaaacgggcuc

SEQ ID NO: 2120105 - RNA, 17 nt, Homo sapiens
auguagcaacaugagaa

SEQ ID NO: 2120106 - RNA, 15 nt, Homo sapiens
caaggccagaaggag

SEQ ID NO: 2120107 - RNA, 15 nt, Homo sapiens
ucugacuccacucaa

SEQ ID NO: 2120108 - RNA, 23 nt, Homo sapiens
ccuccugacaacgucucuucaag

SEQ ID NO: 2120109 - RNA, 18 nt, Homo sapiens
guggucaguaguuucauu

SEQ ID NO: 2120110 - RNA, 14 nt, Homo sapiens
auggauagucuguc

SEQ ID NO: 2120111 - RNA, 22 nt, Homo sapiens
uacccccacaugccaauuucag

SEQ ID NO: 2120112 - RNA, 16 nt, Homo sapiens
gaaaggaaagccaaac

SEQ ID NO: 2120113 - RNA, 13 nt, Homo sapiens
ucccuuucuuccc

SEQ ID NO: 2120114 - RNA, 12 nt, Homo sapiens
gccauucauccu

SEQ ID NO: 2120115 - RNA, 13 nt, Homo sapiens
acagaggcaguag

SEQ ID NO: 2120116 - RNA, 13 nt, Homo sapiens
gaauuacauauga

SEQ ID NO: 2120117 - RNA, 14 nt, Homo sapiens
gcaguuggacucuc

SEQ ID NO: 2120118 - RNA, 15 nt, Homo sapiens
gagucugcaugugca

SEQ ID NO: 2120119 - RNA, 13 nt, Homo sapiens
uaauauuuccaga

SEQ ID NO: 2120120 - RNA, 23 nt, Homo sapiens
uuccacuaagaacaccugcauuc

SEQ ID NO: 2120121 - RNA, 13 nt, Homo sapiens
aauuuuaucucuu

SEQ ID NO: 2120122 - RNA, 14 nt, Homo sapiens
uuggguuccagaca

SEQ ID NO: 2120123 - RNA, 23 nt, Homo sapiens
auccgggacgcuuccagaccacc

SEQ ID NO: 2120124 - RNA, 16 nt, Homo sapiens
acuacaguaacuguga

SEQ ID NO: 2120125 - RNA, 22 nt, Homo sapiens
uuuuccauuuauuuauucaugu

SEQ ID NO: 2120126 - RNA, 14 nt, Homo sapiens
cagggaauggagcu

SEQ ID NO: 2120127 - RNA, 17 nt, Homo sapiens
aucccgaagaauggaga

SEQ ID NO: 2120128 - RNA, 20 nt, Homo sapiens
auuauaauaugugccuuaag

SEQ ID NO: 2120129 - RNA, 22 nt, Homo sapiens
cauuuccucuuuccaagaccaa

SEQ ID NO: 2120130 - RNA, 20 nt, Homo sapiens
gcaucacguaccccacuggg

SEQ ID NO: 2120131 - RNA, 21 nt, Homo sapiens
auugacccagacauauuguac

SEQ ID NO: 2120132 - RNA, 22 nt, Homo sapiens
gcagcuccacagggcagggccu

SEQ ID NO: 2120133 - RNA, 22 nt, Homo sapiens
uccacaguuaucuuagcuggau

SEQ ID NO: 2120134 - RNA, 16 nt, Homo sapiens
gaccuaguauaucagu

SEQ ID NO: 2120135 - RNA, 19 nt, Homo sapiens
gauaaaauuauugaugauu

SEQ ID NO: 2120136 - RNA, 14 nt, Homo sapiens
aacugcgaguggcu

SEQ ID NO: 2120137 - RNA, 14 nt, Homo sapiens
cuuauuaguuacaa

SEQ ID NO: 2120138 - RNA, 23 nt, Homo sapiens
guagccuggucugugcauugugg

SEQ ID NO: 2120139 - RNA, 20 nt, Homo sapiens
uggaagaggugggugguggg

SEQ ID NO: 2120140 - RNA, 19 nt, Homo sapiens
gaauuacggaaaaugccug

SEQ ID NO: 2120141 - RNA, 16 nt, Homo sapiens
aaacaagaggacacaa

SEQ ID NO: 2120142 - RNA, 20 nt, Homo sapiens
aaaagagcccaaaugaccaa

SEQ ID NO: 2120143 - RNA, 18 nt, Homo sapiens
auagcccucagacauuua

SEQ ID NO: 2120144 - RNA, 18 nt, Homo sapiens
auccuggcaacucaaggc

SEQ ID NO: 2120145 - RNA, 16 nt, Homo sapiens
auguuuauccauguac

SEQ ID NO: 2120146 - RNA, 21 nt, Homo sapiens
cccagugcuugcaagauucca

SEQ ID NO: 2120147 - RNA, 17 nt, Homo sapiens
ucuaaaaugaguuaccu

SEQ ID NO: 2120148 - RNA, 18 nt, Homo sapiens
aacaaucagacaugaguc

SEQ ID NO: 2120149 - RNA, 19 nt, Homo sapiens
auugagacacugucaagau

SEQ ID NO: 2120150 - RNA, 20 nt, Homo sapiens
agcauaggaaaccacacaga

SEQ ID NO: 2120151 - RNA, 15 nt, Homo sapiens
agcuuaaagagaaaa

SEQ ID NO: 2120152 - RNA, 17 nt, Homo sapiens
ucuuccuggaaugcauu

SEQ ID NO: 2120153 - RNA, 19 nt, Homo sapiens
ccuacuccaagaauggagg

SEQ ID NO: 2120154 - RNA, 16 nt, Homo sapiens
auaauugccacugaga

SEQ ID NO: 2120155 - RNA, 20 nt, Homo sapiens
auucugucccaaucuuacca

SEQ ID NO: 2120156 - RNA, 18 nt, Homo sapiens
uccgcuccccuuucccau

SEQ ID NO: 2120157 - RNA, 20 nt, Homo sapiens
ucuggucuaccugagaucua

SEQ ID NO: 2120158 - RNA, 15 nt, Homo sapiens
ccggggaaaggcaag

SEQ ID NO: 2120159 - RNA, 20 nt, Homo sapiens
agaccugguucccgccuccc

SEQ ID NO: 2120160 - RNA, 17 nt, Homo sapiens
agaucacugacucugac

SEQ ID NO: 2120161 - RNA, 23 nt, Homo sapiens
gacccagccccuuccccugggaa

SEQ ID NO: 2120162 - RNA, 18 nt, Homo sapiens
guuucaaaagagauuuac

SEQ ID NO: 2120163 - RNA, 14 nt, Homo sapiens
gagaaaggauggca

SEQ ID NO: 2120164 - RNA, 21 nt, Homo sapiens
uuugguuuguuuccagguuug

SEQ ID NO: 2120165 - RNA, 15 nt, Homo sapiens
uuccuugccagugag

SEQ ID NO: 2120166 - RNA, 20 nt, Homo sapiens
aucuauauauguguauguac

SEQ ID NO: 2120167 - RNA, 20 nt, Homo sapiens
auuuugggguacccacugcu

SEQ ID NO: 2120168 - RNA, 14 nt, Homo sapiens
ugaugaaccagagu

SEQ ID NO: 2120169 - RNA, 13 nt, Homo sapiens
cugacccaugcaa

SEQ ID NO: 2120170 - RNA, 19 nt, Homo sapiens
ugcccccagcuucugccac

SEQ ID NO: 2120171 - RNA, 23 nt, Homo sapiens
auaagcucaguaacugugcaucu

SEQ ID NO: 2120172 - RNA, 17 nt, Homo sapiens
accuugcuuuugcuucu

SEQ ID NO: 2120173 - RNA, 22 nt, Homo sapiens
aauguguauugaagaaaagcac

SEQ ID NO: 2120174 - RNA, 13 nt, Homo sapiens
ugcuaauguugcu

SEQ ID NO: 2120175 - RNA, 13 nt, Homo sapiens
uaaaacauuucau

SEQ ID NO: 2120176 - RNA, 20 nt, Homo sapiens
aguacucaggcagugcagua

SEQ ID NO: 2120177 - RNA, 19 nt, Homo sapiens
acaucuugguaaacaacag

SEQ ID NO: 2120178 - RNA, 19 nt, Homo sapiens
caucccggagcgcaccugc

SEQ ID NO: 2120179 - RNA, 19 nt, Homo sapiens
aaauguaucugaguauuga

SEQ ID NO: 2120180 - RNA, 17 nt, Homo sapiens
accaguuuucuuuauga

SEQ ID NO: 2120181 - RNA, 13 nt, Homo sapiens
uaugcacaccucc

SEQ ID NO: 2120182 - RNA, 14 nt, Homo sapiens
ccauccugauccca

SEQ ID NO: 2120183 - RNA, 14 nt, Homo sapiens
guuuuacgcaagga

SEQ ID NO: 2120184 - RNA, 19 nt, Homo sapiens
aucuucagggcacugcugc

SEQ ID NO: 2120185 - RNA, 10 nt, Homo sapiens
gcauuuugcu

SEQ ID NO: 2120186 - RNA, 22 nt, Homo sapiens
gcuacauugacgagcaugagcu

SEQ ID NO: 2120187 - RNA, 13 nt, Homo sapiens
aacagauauuuag

SEQ ID NO: 2120188 - RNA, 19 nt, Homo sapiens
ccuaagaacaaaacuguaa

SEQ ID NO: 2120189 - RNA, 15 nt, Homo sapiens
cauaaacuucaucuu

SEQ ID NO: 2120190 - RNA, 14 nt, Homo sapiens
uguuuuuuacucaa

SEQ ID NO: 2120191 - RNA, 12 nt, Homo sapiens
guagcugggauu

SEQ ID NO: 2120192 - RNA, 19 nt, Homo sapiens
cugaguuauuuugcuaaac

SEQ ID NO: 2120193 - RNA, 16 nt, Homo sapiens
cagcauggagucacag

SEQ ID NO: 2120194 - RNA, 17 nt, Homo sapiens
augauaucuucaagccu

SEQ ID NO: 2120195 - RNA, 15 nt, Homo sapiens
ugauauaauuacuua

SEQ ID NO: 2120196 - RNA, 17 nt, Homo sapiens
aguaguuguacuaugau

SEQ ID NO: 2120197 - RNA, 16 nt, Homo sapiens
caaaacuugcaucuaa

SEQ ID NO: 2120198 - RNA, 17 nt, Homo sapiens
auuccagcguacuauaa

SEQ ID NO: 2120199 - RNA, 23 nt, Homo sapiens
ccagaaggggauggacuucauuu

SEQ ID NO: 2120200 - RNA, 23 nt, Homo sapiens
uugaaauaaaugacaauguaauu

SEQ ID NO: 2120201 - RNA, 16 nt, Homo sapiens
cugcuggaugacuuga

SEQ ID NO: 2120202 - RNA, 16 nt, Homo sapiens
cuacacccaccagagu

SEQ ID NO: 2120203 - RNA, 20 nt, Homo sapiens
uaaagauugcagcauuuaug

SEQ ID NO: 2120204 - RNA, 17 nt, Homo sapiens
cuuagaagccaugggac

SEQ ID NO: 2120205 - RNA, 17 nt, Homo sapiens
aagaugaugaugaucuu

SEQ ID NO: 2120206 - RNA, 15 nt, Homo sapiens
ccaagcccccuccuu

SEQ ID NO: 2120207 - RNA, 13 nt, Homo sapiens
ucacaacuuugcu

SEQ ID NO: 2120208 - RNA, 15 nt, Homo sapiens
ccccagagugacuga

SEQ ID NO: 2120209 - RNA, 20 nt, Homo sapiens
aaguaccccugauaagcaaa

SEQ ID NO: 2120210 - RNA, 16 nt, Homo sapiens
ccccugaccuuccaaa

SEQ ID NO: 2120211 - RNA, 22 nt, Homo sapiens
uugguaauaacuucucugugaa

SEQ ID NO: 2120212 - RNA, 18 nt, Homo sapiens
cuggcauuauaaagaaca

SEQ ID NO: 2120213 - RNA, 23 nt, Homo sapiens
augcaggagccuacuucuagcug

SEQ ID NO: 2120214 - RNA, 12 nt, Homo sapiens
acauacaauuau

SEQ ID NO: 2120215 - RNA, 12 nt, Homo sapiens
aauugugccaaa

SEQ ID NO: 2120216 - RNA, 21 nt, Homo sapiens
ggguaggcugucugugccaug

SEQ ID NO: 2120217 - RNA, 16 nt, Homo sapiens
acuuuuuuuugacaua

SEQ ID NO: 2120218 - RNA, 15 nt, Homo sapiens
gggacugaugucauc

SEQ ID NO: 2120219 - RNA, 22 nt, Homo sapiens
caccaguaaucccagcuacuca

SEQ ID NO: 2120220 - RNA, 21 nt, Homo sapiens
cagcaauggugucaguaucca

SEQ ID NO: 2120221 - RNA, 12 nt, Homo sapiens
gaacccugagca

SEQ ID NO: 2120222 - RNA, 16 nt, Homo sapiens
uaaaacacaucaucaa

SEQ ID NO: 2120223 - RNA, 18 nt, Homo sapiens
gccugaaggcuauccacu

SEQ ID NO: 2120224 - RNA, 13 nt, Homo sapiens
uuagguagcuuua

SEQ ID NO: 2120225 - RNA, 17 nt, Homo sapiens
ucaaacccagucucaga

SEQ ID NO: 2120226 - RNA, 20 nt, Homo sapiens
agcaggccacuagugacagu

SEQ ID NO: 2120227 - RNA, 19 nt, Homo sapiens
auuuuuaaaaucauaacau

SEQ ID NO: 2120228 - RNA, 20 nt, Homo sapiens
acaguuuaggaguacugaua

SEQ ID NO: 2120229 - RNA, 12 nt, Homo sapiens
auagucuauuca

SEQ ID NO: 2120230 - RNA, 14 nt, Homo sapiens
agaacccaaacuuc

SEQ ID NO: 2120231 - RNA, 17 nt, Homo sapiens
aaaugaaugaucuuggc

SEQ ID NO: 2120232 - RNA, 18 nt, Homo sapiens
cuuagugaaauuacuucu

SEQ ID NO: 2120233 - RNA, 15 nt, Homo sapiens
ucucacugucugcug

SEQ ID NO: 2120234 - RNA, 19 nt, Homo sapiens
aacacaagaauuacacuaa

SEQ ID NO: 2120235 - RNA, 20 nt, Homo sapiens
guuaauaaucuaugaugaag

SEQ ID NO: 2120236 - RNA, 19 nt, Homo sapiens
cuuucugcucuuuacauuu

SEQ ID NO: 2120237 - RNA, 15 nt, Homo sapiens
ggcuugacucaggau

SEQ ID NO: 2120238 - RNA, 14 nt, Homo sapiens
ucacaccaccugac

SEQ ID NO: 2120239 - RNA, 19 nt, Homo sapiens
ggaccuguauuuaagcaaa

SEQ ID NO: 2120240 - RNA, 17 nt, Homo sapiens
uuuacuaaguaaucuca

SEQ ID NO: 2120241 - RNA, 17 nt, Homo sapiens
cugcccucagccuguug

SEQ ID NO: 2120242 - RNA, 22 nt, Homo sapiens
aguuccuuggagggacaugacu

SEQ ID NO: 2120243 - RNA, 15 nt, Homo sapiens
uacauuagcugaaaa

SEQ ID NO: 2120244 - RNA, 20 nt, Homo sapiens
caaugcaccuaaagaaaaac

SEQ ID NO: 2120245 - RNA, 15 nt, Homo sapiens
gcugcuggugcacag

SEQ ID NO: 2120246 - RNA, 15 nt, Homo sapiens
ucuggaggggcagug

SEQ ID NO: 2120247 - RNA, 14 nt, Homo sapiens
aguacuaagcauuu

SEQ ID NO: 2120248 - RNA, 19 nt, Homo sapiens
cuuagagugcugugagaug

SEQ ID NO: 2120249 - RNA, 19 nt, Homo sapiens
gcuuccuuuuauuuuuaua

SEQ ID NO: 2120250 - RNA, 14 nt, Homo sapiens
auaagaauuacuuu

SEQ ID NO: 2120251 - RNA, 20 nt, Homo sapiens
aggccagcugacuagaucuc

SEQ ID NO: 2120252 - RNA, 20 nt, Homo sapiens
ccuagucuggacugcuuccc

SEQ ID NO: 2120253 - RNA, 19 nt, Homo sapiens
caaggcuuuauauuuuuaa

SEQ ID NO: 2120254 - RNA, 21 nt, Homo sapiens
cuucaacugucuccuaccucu

SEQ ID NO: 2120255 - RNA, 18 nt, Homo sapiens
augcuuccucgugccaau

SEQ ID NO: 2120256 - RNA, 21 nt, Homo sapiens
uaaaauuucacucuggcauau

SEQ ID NO: 2120257 - RNA, 14 nt, Homo sapiens
gauacuuuugcccu

SEQ ID NO: 2120258 - RNA, 21 nt, Homo sapiens
aaacaggcaccacugcuuuaa

SEQ ID NO: 2120259 - RNA, 19 nt, Homo sapiens
gauguucgcucgugcagua

SEQ ID NO: 2120260 - RNA, 18 nt, Homo sapiens
guggccccaaauuugcua

SEQ ID NO: 2120261 - RNA, 22 nt, Homo sapiens
agcuccccaggacucacccuca

SEQ ID NO: 2120262 - RNA, 12 nt, Homo sapiens
gaauuggcauuu

SEQ ID NO: 2120263 - RNA, 15 nt, Homo sapiens
auggacuguguuucc

SEQ ID NO: 2120264 - RNA, 22 nt, Homo sapiens
ggcucugcccuggaaagggggu

SEQ ID NO: 2120265 - RNA, 18 nt, Homo sapiens
gcugccaaacacccaugc

SEQ ID NO: 2120266 - RNA, 17 nt, Homo sapiens
uuccucccucauggaag

SEQ ID NO: 2120267 - RNA, 13 nt, Homo sapiens
caccacuuuguaa

SEQ ID NO: 2120268 - RNA, 20 nt, Homo sapiens
gcacagagucgaugcucaau

SEQ ID NO: 2120269 - RNA, 23 nt, Homo sapiens
acaaauggggacaggaaggauca

SEQ ID NO: 2120270 - RNA, 17 nt, Homo sapiens
cuauguugugguccauc

SEQ ID NO: 2120271 - RNA, 15 nt, Homo sapiens
gaucagaucuuacaa

SEQ ID NO: 2120272 - RNA, 15 nt, Homo sapiens
aacaaauaauuuaga

SEQ ID NO: 2120273 - RNA, 16 nt, Homo sapiens
cacguugggacaggga

SEQ ID NO: 2120274 - RNA, 14 nt, Homo sapiens
uuuaaucacauucg

SEQ ID NO: 2120275 - RNA, 22 nt, Homo sapiens
cucuuccuccucgcugccagau

SEQ ID NO: 2120276 - RNA, 14 nt, Homo sapiens
acggaagcugacau

SEQ ID NO: 2120277 - RNA, 20 nt, Homo sapiens
cuuagauuuaguaguguaag

SEQ ID NO: 2120278 - RNA, 22 nt, Homo sapiens
cuuucuggaauccaaaccacag

SEQ ID NO: 2120279 - RNA, 14 nt, Homo sapiens
ccaaggccaaagga

SEQ ID NO: 2120280 - RNA, 19 nt, Homo sapiens
gggcggcacagccuucucc

SEQ ID NO: 2120281 - RNA, 19 nt, Homo sapiens
gaucuuuuguucccauccu

SEQ ID NO: 2120282 - RNA, 17 nt, Homo sapiens
ugaaaaguguccucugg

SEQ ID NO: 2120283 - RNA, 21 nt, Homo sapiens
ucuggcagagucagcugcuga

SEQ ID NO: 2120284 - RNA, 17 nt, Homo sapiens
ugugggacgaaagcaca

SEQ ID NO: 2120285 - RNA, 15 nt, Homo sapiens
cucacuaugcugcuu

SEQ ID NO: 2120286 - RNA, 14 nt, Homo sapiens
uagccaaccagcag

SEQ ID NO: 2120287 - RNA, 17 nt, Homo sapiens
gagccucgggacaucaa

SEQ ID NO: 2120288 - RNA, 14 nt, Homo sapiens
cuggaggcacccuu

SEQ ID NO: 2120289 - RNA, 17 nt, Homo sapiens
ccaagaguuguugugca

SEQ ID NO: 2120290 - RNA, 16 nt, Homo sapiens
auugcauauuugcuau

SEQ ID NO: 2120291 - RNA, 12 nt, Homo sapiens
gacaaaugcauu

SEQ ID NO: 2120292 - RNA, 18 nt, Homo sapiens
aguacugguugacuuucu

SEQ ID NO: 2120293 - RNA, 15 nt, Homo sapiens
cugguuuaaccuccu

SEQ ID NO: 2120294 - RNA, 18 nt, Homo sapiens
augcuguacguacugcau

SEQ ID NO: 2120295 - RNA, 22 nt, Homo sapiens
accuggagggcuagaaccugga

SEQ ID NO: 2120296 - RNA, 13 nt, Homo sapiens
uuccucuuugcau

SEQ ID NO: 2120297 - RNA, 13 nt, Homo sapiens
ugacccugaugaa

SEQ ID NO: 2120298 - RNA, 23 nt, Homo sapiens
caggcauuuuuguaaugagccau

SEQ ID NO: 2120299 - RNA, 15 nt, Homo sapiens
acuagcuaucucugu

SEQ ID NO: 2120300 - RNA, 22 nt, Homo sapiens
uuaguucugguugauucacuca

SEQ ID NO: 2120301 - RNA, 17 nt, Homo sapiens
uuuuaaaacccauuuaa

SEQ ID NO: 2120302 - RNA, 17 nt, Homo sapiens
auggcaaaaguaggcau

SEQ ID NO: 2120303 - RNA, 14 nt, Homo sapiens
aaacauguauguaa

SEQ ID NO: 2120304 - RNA, 22 nt, Homo sapiens
cugcugagcagcccagcacaac

SEQ ID NO: 2120305 - RNA, 13 nt, Homo sapiens
cagcaagaugaaa

SEQ ID NO: 2120306 - RNA, 15 nt, Homo sapiens
aauuacuaccagagc

SEQ ID NO: 2120307 - RNA, 17 nt, Homo sapiens
guaauaagcaaucaagg

SEQ ID NO: 2120308 - RNA, 12 nt, Homo sapiens
uuuauuugucug

SEQ ID NO: 2120309 - RNA, 15 nt, Homo sapiens
ugaguuuucaaagau

SEQ ID NO: 2120310 - RNA, 19 nt, Homo sapiens
uaaagcacuauuguuuaga

SEQ ID NO: 2120311 - RNA, 21 nt, Homo sapiens
gccugccaaggaugacacugc

SEQ ID NO: 2120312 - RNA, 12 nt, Homo sapiens
ggaucagugaaa

SEQ ID NO: 2120313 - RNA, 14 nt, Homo sapiens
gaaugauacgauua

SEQ ID NO: 2120314 - RNA, 13 nt, Homo sapiens
gguccuuuggaca

SEQ ID NO: 2120315 - RNA, 17 nt, Homo sapiens
auauuuauucaucuggg

SEQ ID NO: 2120316 - RNA, 14 nt, Homo sapiens
cacuccacuauguu

SEQ ID NO: 2120317 - RNA, 16 nt, Homo sapiens
cagcugcuucugccca

SEQ ID NO: 2120318 - RNA, 22 nt, Homo sapiens
uuauauuuccuuuaugugaauu

SEQ ID NO: 2120319 - RNA, 21 nt, Homo sapiens
ucacugcugcaaauacuguau

SEQ ID NO: 2120320 - RNA, 21 nt, Homo sapiens
caaagauaugugggugcuccu

SEQ ID NO: 2120321 - RNA, 12 nt, Homo sapiens
uuguaaggggaa

SEQ ID NO: 2120322 - RNA, 19 nt, Homo sapiens
gacacaugugccgggccau

SEQ ID NO: 2120323 - RNA, 23 nt, Homo sapiens
cccuuuagggaaauucaaagcag

SEQ ID NO: 2120324 - RNA, 21 nt, Homo sapiens
aaagauguuauacaaccauca

SEQ ID NO: 2120325 - RNA, 21 nt, Homo sapiens
acacuuuggacuucucugaaa

SEQ ID NO: 2120326 - RNA, 17 nt, Homo sapiens
uuaguauccacaggaua

SEQ ID NO: 2120327 - RNA, 12 nt, Homo sapiens
gcgguggcucac

SEQ ID NO: 2120328 - RNA, 16 nt, Homo sapiens
ccugggggaggucaga

SEQ ID NO: 2120329 - RNA, 17 nt, Homo sapiens
guuucaaaauagucauu

SEQ ID NO: 2120330 - RNA, 13 nt, Homo sapiens
uaaucaucuucuc

SEQ ID NO: 2120331 - RNA, 14 nt, Homo sapiens
gagcacaagccaca

SEQ ID NO: 2120332 - RNA, 12 nt, Homo sapiens
uuggcaagccac

SEQ ID NO: 2120333 - RNA, 13 nt, Homo sapiens
cuugaaucuguua

SEQ ID NO: 2120334 - RNA, 14 nt, Homo sapiens
aagagaacugauga

SEQ ID NO: 2120335 - RNA, 15 nt, Homo sapiens
ccucccuucuucuga

SEQ ID NO: 2120336 - RNA, 15 nt, Homo sapiens
cauaguuuauuucaa

SEQ ID NO: 2120337 - RNA, 20 nt, Homo sapiens
aaaggcugagaacacuguga

SEQ ID NO: 2120338 - RNA, 21 nt, Homo sapiens
aauaagcgguuuucuuaggca

SEQ ID NO: 2120339 - RNA, 24 nt, Homo sapiens
auuuauuaguuaggugugccaaac

SEQ ID NO: 2120340 - RNA, 18 nt, Homo sapiens
cugacugccaauaacauu

SEQ ID NO: 2120341 - RNA, 23 nt, Homo sapiens
cugucuuagagugggaccaacuu

SEQ ID NO: 2120342 - RNA, 11 nt, Homo sapiens
uuuuggaugag

SEQ ID NO: 2120343 - RNA, 22 nt, Homo sapiens
uaaagcuuuugcauagaauaau

SEQ ID NO: 2120344 - RNA, 12 nt, Homo sapiens
auguuauaucau

SEQ ID NO: 2120345 - RNA, 16 nt, Homo sapiens
uguuugauuccauucc

SEQ ID NO: 2120346 - RNA, 14 nt, Homo sapiens
auaaugaacacgug

SEQ ID NO: 2120347 - RNA, 16 nt, Homo sapiens
acccaccccugcacag

SEQ ID NO: 2120348 - RNA, 17 nt, Homo sapiens
auuuacaggaacuucau

SEQ ID NO: 2120349 - RNA, 17 nt, Homo sapiens
uuggagagaagggcauu

SEQ ID NO: 2120350 - RNA, 12 nt, Homo sapiens
aguguuuaucuu

SEQ ID NO: 2120351 - RNA, 16 nt, Homo sapiens
gugccagugcacuccg

SEQ ID NO: 2120352 - RNA, 20 nt, Homo sapiens
gaacacuugaagccaucuaa

SEQ ID NO: 2120353 - RNA, 20 nt, Homo sapiens
cucaccagccccacugccag

SEQ ID NO: 2120354 - RNA, 17 nt, Homo sapiens
gaaucuaaugaaugugc

SEQ ID NO: 2120355 - RNA, 21 nt, Homo sapiens
acagcuggagacgaucuugcu

SEQ ID NO: 2120356 - RNA, 18 nt, Homo sapiens
cugaccuggcuggugaca

SEQ ID NO: 2120357 - RNA, 18 nt, Homo sapiens
auucuaauggggacacag

SEQ ID NO: 2120358 - RNA, 12 nt, Homo sapiens
cacugcaaacac

SEQ ID NO: 2120359 - RNA, 20 nt, Homo sapiens
auguagcugaaacaaaaaug

SEQ ID NO: 2120360 - RNA, 20 nt, Homo sapiens
acuucucuccuccacucuga

SEQ ID NO: 2120361 - RNA, 20 nt, Homo sapiens
uuauucuacaucauuaacca

SEQ ID NO: 2120362 - RNA, 12 nt, Homo sapiens
aguuuaccucuu

SEQ ID NO: 2120363 - RNA, 16 nt, Homo sapiens
ccuaucuguaugucug

SEQ ID NO: 2120364 - RNA, 14 nt, Homo sapiens
ucucucaccugcuc

SEQ ID NO: 2120365 - RNA, 22 nt, Homo sapiens
gauacuugugaacaugccuuau

SEQ ID NO: 2120366 - RNA, 16 nt, Homo sapiens
acugaagcuguucuca

SEQ ID NO: 2120367 - RNA, 14 nt, Homo sapiens
uucucuauguauca

SEQ ID NO: 2120368 - RNA, 16 nt, Homo sapiens
uaaaauucacuaauga

SEQ ID NO: 2120369 - RNA, 14 nt, Homo sapiens
cucccuuugccagc

SEQ ID NO: 2120370 - RNA, 16 nt, Homo sapiens
gaaaaaaaaauggaag

SEQ ID NO: 2120371 - RNA, 12 nt, Homo sapiens
agccuuacaaag

SEQ ID NO: 2120372 - RNA, 12 nt, Homo sapiens
guugaaaaccac

SEQ ID NO: 2120373 - RNA, 20 nt, Homo sapiens
uggcccauacuuguaauccc

SEQ ID NO: 2120374 - RNA, 13 nt, Homo sapiens
gcaaagugcccau

SEQ ID NO: 2120375 - RNA, 23 nt, Homo sapiens
ucucccgcguggaguucuccuca

SEQ ID NO: 2120376 - RNA, 17 nt, Homo sapiens
uaccagugaaccaaaga

SEQ ID NO: 2120377 - RNA, 23 nt, Homo sapiens
aauagggccucacucuguugcuc

SEQ ID NO: 2120378 - RNA, 15 nt, Homo sapiens
gagaccguccucacc

SEQ ID NO: 2120379 - RNA, 15 nt, Homo sapiens
acaagugggugaaug

SEQ ID NO: 2120380 - RNA, 21 nt, Homo sapiens
ucuuaauuaaguaaacuaaug

SEQ ID NO: 2120381 - RNA, 15 nt, Homo sapiens
cuucugucugcagug

SEQ ID NO: 2120382 - RNA, 20 nt, Homo sapiens
agcuccuuucccuuuuccau

SEQ ID NO: 2120383 - RNA, 18 nt, Homo sapiens
uguaaucucauaacuuuc

SEQ ID NO: 2120384 - RNA, 21 nt, Homo sapiens
caggaggcugaggcaggagaa

SEQ ID NO: 2120385 - RNA, 14 nt, Homo sapiens
aaauuaugaauauu

SEQ ID NO: 2120386 - RNA, 13 nt, Homo sapiens
uccuuugucuuaa

SEQ ID NO: 2120387 - RNA, 18 nt, Homo sapiens
ggcaccguauuccucucc

SEQ ID NO: 2120388 - RNA, 22 nt, Homo sapiens
ccuccagaagcagccccucgga

SEQ ID NO: 2120389 - RNA, 22 nt, Homo sapiens
ggaaucacuggcuguuaaucuu

SEQ ID NO: 2120390 - RNA, 15 nt, Homo sapiens
aggucccaggaagug

SEQ ID NO: 2120391 - RNA, 21 nt, Homo sapiens
uucaauugcuucugugcaaua

SEQ ID NO: 2120392 - RNA, 17 nt, Homo sapiens
cagcagguggaaugugu

SEQ ID NO: 2120393 - RNA, 23 nt, Homo sapiens
uguaaacacuuuugggaaagggc

SEQ ID NO: 2120394 - RNA, 16 nt, Homo sapiens
auucaacucuccaaug

SEQ ID NO: 2120395 - RNA, 16 nt, Homo sapiens
aacagugagaaaccau

SEQ ID NO: 2120396 - RNA, 18 nt, Homo sapiens
aagggcguggcucugggu

SEQ ID NO: 2120397 - RNA, 13 nt, Homo sapiens
uacauauaugcaa

SEQ ID NO: 2120398 - RNA, 22 nt, Homo sapiens
acaaauggcuuguucagucacu

SEQ ID NO: 2120399 - RNA, 12 nt, Homo sapiens
uccuuacuucca

SEQ ID NO: 2120400 - RNA, 12 nt, Homo sapiens
auaauacuauau

SEQ ID NO: 2120401 - RNA, 12 nt, Homo sapiens
uuguuacuuuga

SEQ ID NO: 2120402 - RNA, 21 nt, Homo sapiens
uggcuuggguucacagugcau

SEQ ID NO: 2120403 - RNA, 20 nt, Homo sapiens
cuaauuccccuuccauuccc

SEQ ID NO: 2120404 - RNA, 14 nt, Homo sapiens
ccaauuauuugacu

SEQ ID NO: 2120405 - RNA, 21 nt, Homo sapiens
cauauaccagaggaaagacca

SEQ ID NO: 2120406 - RNA, 19 nt, Homo sapiens
caaagccacuggaaggagc

SEQ ID NO: 2120407 - RNA, 12 nt, Homo sapiens
cagcugcuccua

SEQ ID NO: 2120408 - RNA, 21 nt, Homo sapiens
ccccucccagcugacaguccu

SEQ ID NO: 2120409 - RNA, 17 nt, Homo sapiens
uuuggaugucuguagca

SEQ ID NO: 2120410 - RNA, 20 nt, Homo sapiens
gagccuuucuuauggaagaa

SEQ ID NO: 2120411 - RNA, 20 nt, Homo sapiens
ugaaaaaccugggcaccuaa

SEQ ID NO: 2120412 - RNA, 16 nt, Homo sapiens
ucaccuggccugccac

SEQ ID NO: 2120413 - RNA, 20 nt, Homo sapiens
ggcugaauaaagccuuugau

SEQ ID NO: 2120414 - RNA, 11 nt, Homo sapiens
gccaaucucaa

SEQ ID NO: 2120415 - RNA, 14 nt, Homo sapiens
uuguccaugugcaa

SEQ ID NO: 2120416 - RNA, 23 nt, Homo sapiens
cugauucccuguggugauaccua

SEQ ID NO: 2120417 - RNA, 19 nt, Homo sapiens
auaagauuuguacauauua

SEQ ID NO: 2120418 - RNA, 16 nt, Homo sapiens
gccaacauagugaaac

SEQ ID NO: 2120419 - RNA, 12 nt, Homo sapiens
aauuguguuacu

SEQ ID NO: 2120420 - RNA, 13 nt, Homo sapiens
caggaaaauaaca

SEQ ID NO: 2120421 - RNA, 13 nt, Homo sapiens
caagguccacucc

SEQ ID NO: 2120422 - RNA, 13 nt, Homo sapiens
cucuacgccaaag

SEQ ID NO: 2120423 - RNA, 15 nt, Homo sapiens
cugucagcugugaag

SEQ ID NO: 2120424 - RNA, 17 nt, Homo sapiens
uaaaggccacaggagac

SEQ ID NO: 2120425 - RNA, 15 nt, Homo sapiens
acggggcucuucuca

SEQ ID NO: 2120426 - RNA, 12 nt, Homo sapiens
cuguaguggaau

SEQ ID NO: 2120427 - RNA, 19 nt, Homo sapiens
acugagauaagaaaagccu

SEQ ID NO: 2120428 - RNA, 12 nt, Homo sapiens
auagcucuaaug

SEQ ID NO: 2120429 - RNA, 16 nt, Homo sapiens
gcaaaaggccucuugu

SEQ ID NO: 2120430 - RNA, 19 nt, Homo sapiens
aaucaguauaauucuguac

SEQ ID NO: 2120431 - RNA, 22 nt, Homo sapiens
caguugcccagagcacuuuagc

SEQ ID NO: 2120432 - RNA, 19 nt, Homo sapiens
acucugaaacacacugaaa

SEQ ID NO: 2120433 - RNA, 19 nt, Homo sapiens
uauuuaucagugacagagu

SEQ ID NO: 2120434 - RNA, 21 nt, Homo sapiens
uggaagccucuauugccauga

SEQ ID NO: 2120435 - RNA, 19 nt, Homo sapiens
acugaaggugcaguugaau

SEQ ID NO: 2120436 - RNA, 17 nt, Homo sapiens
auggacugcacaaaagu

SEQ ID NO: 2120437 - RNA, 15 nt, Homo sapiens
caugacacagcuuua

SEQ ID NO: 2120438 - RNA, 22 nt, Homo sapiens
aaucuuguuuccaaaaaccaug

SEQ ID NO: 2120439 - RNA, 19 nt, Homo sapiens
ucuacucuuaaguuucuca

SEQ ID NO: 2120440 - RNA, 21 nt, Homo sapiens
acauauucacagugaacauaa

SEQ ID NO: 2120441 - RNA, 21 nt, Homo sapiens
ccuccugacucuucaggccag

SEQ ID NO: 2120442 - RNA, 13 nt, Homo sapiens
aacucugauguaa

SEQ ID NO: 2120443 - RNA, 17 nt, Homo sapiens
caauguggcaaacugaa

SEQ ID NO: 2120444 - RNA, 22 nt, Homo sapiens
aacuuucucuagucuacuguca

SEQ ID NO: 2120445 - RNA, 22 nt, Homo sapiens
aguuccuuaggagaugucauga

SEQ ID NO: 2120446 - RNA, 16 nt, Homo sapiens
acuucucaucacacac

SEQ ID NO: 2120447 - RNA, 19 nt, Homo sapiens
uuagugaaaauuuuacaca

SEQ ID NO: 2120448 - RNA, 18 nt, Homo sapiens
uuguuacauuauguggaa

SEQ ID NO: 2120449 - RNA, 20 nt, Homo sapiens
ugagcuucauauaccagcaa

SEQ ID NO: 2120450 - RNA, 20 nt, Homo sapiens
agccaucccuuuuuuuacau

SEQ ID NO: 2120451 - RNA, 21 nt, Homo sapiens
gagugauuuuggccacacugu

SEQ ID NO: 2120452 - RNA, 13 nt, Homo sapiens
auugaacacugcg

SEQ ID NO: 2120453 - RNA, 19 nt, Homo sapiens
guugcccauuuaauguggu

SEQ ID NO: 2120454 - RNA, 19 nt, Homo sapiens
aguggugucugugaagggu

SEQ ID NO: 2120455 - RNA, 15 nt, Homo sapiens
aggcucacacugugc

SEQ ID NO: 2120456 - RNA, 17 nt, Homo sapiens
ucucagaccgucuuccu

SEQ ID NO: 2120457 - RNA, 17 nt, Homo sapiens
ugccuuaaucccagcac

SEQ ID NO: 2120458 - RNA, 12 nt, Homo sapiens
ccuucaccaaag

SEQ ID NO: 2120459 - RNA, 15 nt, Homo sapiens
aauuaugggaucuca

SEQ ID NO: 2120460 - RNA, 13 nt, Homo sapiens
cccaguaaaauca

SEQ ID NO: 2120461 - RNA, 13 nt, Homo sapiens
cacaauaaacucg

SEQ ID NO: 2120462 - RNA, 13 nt, Homo sapiens
agcuggugucagc

SEQ ID NO: 2120463 - RNA, 23 nt, Homo sapiens
acacggucagggucagggccauu

SEQ ID NO: 2120464 - RNA, 21 nt, Homo sapiens
gaaugcucauauuaauguacu

SEQ ID NO: 2120465 - RNA, 15 nt, Homo sapiens
cucgaugacugugaa

SEQ ID NO: 2120466 - RNA, 14 nt, Homo sapiens
aucuacuacagggu

SEQ ID NO: 2120467 - RNA, 12 nt, Homo sapiens
auuuaugugcac

SEQ ID NO: 2120468 - RNA, 20 nt, Homo sapiens
ccucaugcugugugacucaa

SEQ ID NO: 2120469 - RNA, 21 nt, Homo sapiens
ggaagaagcaaaccugauaca

SEQ ID NO: 2120470 - RNA, 18 nt, Homo sapiens
cauggcuuccuaaauggc

SEQ ID NO: 2120471 - RNA, 22 nt, Homo sapiens
caggauggagcugacuacggaa

SEQ ID NO: 2120472 - RNA, 12 nt, Homo sapiens
cacauugccuuc

SEQ ID NO: 2120473 - RNA, 19 nt, Homo sapiens
uacaccacacacaacagcc

SEQ ID NO: 2120474 - RNA, 22 nt, Homo sapiens
agacagccaacuauggccugug

SEQ ID NO: 2120475 - RNA, 14 nt, Homo sapiens
uagcucgagcaaaa

SEQ ID NO: 2120476 - RNA, 20 nt, Homo sapiens
uugggauucuaggaaaccca

SEQ ID NO: 2120477 - RNA, 21 nt, Homo sapiens
cugccauuacagagguauuaa

SEQ ID NO: 2120478 - RNA, 15 nt, Homo sapiens
gcugcaccacuucca

SEQ ID NO: 2120479 - RNA, 19 nt, Homo sapiens
uacaggagaugcugucacu

SEQ ID NO: 2120480 - RNA, 19 nt, Homo sapiens
ucuacccuugagucauauu

SEQ ID NO: 2120481 - RNA, 14 nt, Homo sapiens
augguuaugugcau

SEQ ID NO: 2120482 - RNA, 13 nt, Homo sapiens
cuguugaaucaca

SEQ ID NO: 2120483 - RNA, 16 nt, Homo sapiens
cugguuagugugaaau

SEQ ID NO: 2120484 - RNA, 19 nt, Homo sapiens
aaucuuugccuuuaucucu

SEQ ID NO: 2120485 - RNA, 19 nt, Homo sapiens
ucuuauggccacaagcaaa

SEQ ID NO: 2120486 - RNA, 13 nt, Homo sapiens
uggguacccugag

SEQ ID NO: 2120487 - RNA, 18 nt, Homo sapiens
ccuuccugccugaugugg

SEQ ID NO: 2120488 - RNA, 17 nt, Homo sapiens
cauacacucaaacaauc

SEQ ID NO: 2120489 - RNA, 16 nt, Homo sapiens
cagaaaguaagcauuu

SEQ ID NO: 2120490 - RNA, 11 nt, Homo sapiens
ggaauggugua

SEQ ID NO: 2120491 - RNA, 17 nt, Homo sapiens
cagacauggacaaggag

SEQ ID NO: 2120492 - RNA, 23 nt, Homo sapiens
cuucuggggcaggcugggccaug

SEQ ID NO: 2120493 - RNA, 22 nt, Homo sapiens
cuucccaaaauggcaacuuccc

SEQ ID NO: 2120494 - RNA, 17 nt, Homo sapiens
guguuuuuuuaauuucu

SEQ ID NO: 2120495 - RNA, 19 nt, Homo sapiens
ucuucuccccucacccaug

SEQ ID NO: 2120496 - RNA, 19 nt, Homo sapiens
gcuccuaggucucagagaa

SEQ ID NO: 2120497 - RNA, 20 nt, Homo sapiens
ugaaaggaaaaacagaacau

SEQ ID NO: 2120498 - RNA, 16 nt, Homo sapiens
auuuuugagacagagu

SEQ ID NO: 2120499 - RNA, 18 nt, Homo sapiens
uagaacucuccaucuuau

SEQ ID NO: 2120500 - RNA, 19 nt, Homo sapiens
ugaaaaggcagcauuugaa

SEQ ID NO: 2120501 - RNA, 22 nt, Homo sapiens
cauugaggaaggaaaucuggcc

SEQ ID NO: 2120502 - RNA, 15 nt, Homo sapiens
gaccuugggccaaga

SEQ ID NO: 2120503 - RNA, 22 nt, Homo sapiens
ggaauauaaacaggaucucaaa

SEQ ID NO: 2120504 - RNA, 17 nt, Homo sapiens
gaugcaauauaagcaua

SEQ ID NO: 2120505 - RNA, 13 nt, Homo sapiens
ucuguaaauacca

SEQ ID NO: 2120506 - RNA, 13 nt, Homo sapiens
acauuaucucacu

SEQ ID NO: 2120507 - RNA, 14 nt, Homo sapiens
aucagggaauccag

SEQ ID NO: 2120508 - RNA, 22 nt, Homo sapiens
gacuaagagaaaccuugcaaac

SEQ ID NO: 2120509 - RNA, 15 nt, Homo sapiens
ggcaaauggggugca

SEQ ID NO: 2120510 - RNA, 14 nt, Homo sapiens
gcgugaccuugcaa

SEQ ID NO: 2120511 - RNA, 22 nt, Homo sapiens
ugagauauuaaauucucaaagu

SEQ ID NO: 2120512 - RNA, 14 nt, Homo sapiens
ccauaacugaacau

SEQ ID NO: 2120513 - RNA, 17 nt, Homo sapiens
ggccugcugcugagaac

SEQ ID NO: 2120514 - RNA, 16 nt, Homo sapiens
aauguaggcuuucaug

SEQ ID NO: 2120515 - RNA, 17 nt, Homo sapiens
guagauaaaaaacauca

SEQ ID NO: 2120516 - RNA, 19 nt, Homo sapiens
cuguagggcacccaaaacu

SEQ ID NO: 2120517 - RNA, 21 nt, Homo sapiens
uaaccuaguuuguuacuuuaa

SEQ ID NO: 2120518 - RNA, 16 nt, Homo sapiens
ucaggauacucuguca

SEQ ID NO: 2120519 - RNA, 14 nt, Homo sapiens
uaaaagcuauggug

SEQ ID NO: 2120520 - RNA, 18 nt, Homo sapiens
auggaaacaucacugggg

SEQ ID NO: 2120521 - RNA, 14 nt, Homo sapiens
uauuauaugugcac

SEQ ID NO: 2120522 - RNA, 13 nt, Homo sapiens
gucacacacugga

SEQ ID NO: 2120523 - RNA, 16 nt, Homo sapiens
cccugccugguccuca

SEQ ID NO: 2120524 - RNA, 22 nt, Homo sapiens
uagcuucuuucccuuagugacu

SEQ ID NO: 2120525 - RNA, 16 nt, Homo sapiens
acauguauguaaauag

SEQ ID NO: 2120526 - RNA, 18 nt, Homo sapiens
auuuuuuuaaaucaagga

SEQ ID NO: 2120527 - RNA, 20 nt, Homo sapiens
augacuauguuucuauucua

SEQ ID NO: 2120528 - RNA, 18 nt, Homo sapiens
gaucauagcugacucaga

SEQ ID NO: 2120529 - RNA, 13 nt, Homo sapiens
aaaaguccuguca

SEQ ID NO: 2120530 - RNA, 20 nt, Homo sapiens
ggcccacugugccucagaga

SEQ ID NO: 2120531 - RNA, 21 nt, Homo sapiens
agaucagagcugcagccaguc

SEQ ID NO: 2120532 - RNA, 18 nt, Homo sapiens
gcaguagcgcuggcgcca

SEQ ID NO: 2120533 - RNA, 20 nt, Homo sapiens
uaugggcauccucucugguc

SEQ ID NO: 2120534 - RNA, 18 nt, Homo sapiens
uguauuggcuaugauggu

SEQ ID NO: 2120535 - RNA, 16 nt, Homo sapiens
ccagcaguuacuguga

SEQ ID NO: 2120536 - RNA, 21 nt, Homo sapiens
aacauuuggauuggugaaugg

SEQ ID NO: 2120537 - RNA, 16 nt, Homo sapiens
agagcuagagggacaa

SEQ ID NO: 2120538 - RNA, 22 nt, Homo sapiens
gucacaagggauuggcaauugu

SEQ ID NO: 2120539 - RNA, 23 nt, Homo sapiens
ccacagucccccacccaccuccu

SEQ ID NO: 2120540 - RNA, 21 nt, Homo sapiens
cacauguauguccauucacuu

SEQ ID NO: 2120541 - RNA, 11 nt, Homo sapiens
ccaaagccaga

SEQ ID NO: 2120542 - RNA, 14 nt, Homo sapiens
ccucgggaccccac

SEQ ID NO: 2120543 - RNA, 22 nt, Homo sapiens
aaaugguccaggagaaggccaa

SEQ ID NO: 2120544 - RNA, 15 nt, Homo sapiens
uggcagugguuugaa

SEQ ID NO: 2120545 - RNA, 16 nt, Homo sapiens
aaugugcuaugaagcu

SEQ ID NO: 2120546 - RNA, 15 nt, Homo sapiens
accaguuacuguuca

SEQ ID NO: 2120547 - RNA, 11 nt, Homo sapiens
ggugagccaau

SEQ ID NO: 2120548 - RNA, 14 nt, Homo sapiens
auuuaaacuucuua

SEQ ID NO: 2120549 - RNA, 18 nt, Homo sapiens
uccuuuaccuaccaccuu

SEQ ID NO: 2120550 - RNA, 19 nt, Homo sapiens
cuaguaauacgaaggugag

SEQ ID NO: 2120551 - RNA, 18 nt, Homo sapiens
ggcaacauaguaagaccc

SEQ ID NO: 2120552 - RNA, 18 nt, Homo sapiens
guaggcugucugugccau

SEQ ID NO: 2120553 - RNA, 20 nt, Homo sapiens
ucaagauggggcgagccagg

SEQ ID NO: 2120554 - RNA, 15 nt, Homo sapiens
agcauuacgaucccc

SEQ ID NO: 2120555 - RNA, 14 nt, Homo sapiens
agguaaaacaaauc

SEQ ID NO: 2120556 - RNA, 17 nt, Homo sapiens
ccaagguucugggugca

SEQ ID NO: 2120557 - RNA, 14 nt, Homo sapiens
acagacaggcucuu

SEQ ID NO: 2120558 - RNA, 15 nt, Homo sapiens
cugauuaaugcuaaa

SEQ ID NO: 2120559 - RNA, 22 nt, Homo sapiens
ugcacacaagcccacagcacag

SEQ ID NO: 2120560 - RNA, 13 nt, Homo sapiens
cccagcacuuuga

SEQ ID NO: 2120561 - RNA, 16 nt, Homo sapiens
ugccaggcaacuuuua

SEQ ID NO: 2120562 - RNA, 16 nt, Homo sapiens
uccccagcccaggaaa

SEQ ID NO: 2120563 - RNA, 17 nt, Homo sapiens
aaaguccugucaguuca

SEQ ID NO: 2120564 - RNA, 21 nt, Homo sapiens
agggcugacuucuccaggacc

SEQ ID NO: 2120565 - RNA, 21 nt, Homo sapiens
gguggggggugcaggugggca

SEQ ID NO: 2120566 - RNA, 19 nt, Homo sapiens
cuuauuagaagccaaguaa

SEQ ID NO: 2120567 - RNA, 21 nt, Homo sapiens
cugcauaaaauagagugcauu

SEQ ID NO: 2120568 - RNA, 12 nt, Homo sapiens
cugauuacugua

SEQ ID NO: 2120569 - RNA, 18 nt, Homo sapiens
ccuacauugaugccaagc

SEQ ID NO: 2120570 - RNA, 21 nt, Homo sapiens
acucugcucuaugccaggcug

SEQ ID NO: 2120571 - RNA, 20 nt, Homo sapiens
cguagaaagauccuucgggu

SEQ ID NO: 2120572 - RNA, 18 nt, Homo sapiens
agcauuaugauguggguc

SEQ ID NO: 2120573 - RNA, 14 nt, Homo sapiens
gcagaaaacacagc

SEQ ID NO: 2120574 - RNA, 20 nt, Homo sapiens
auccuauggcagagcauuca

SEQ ID NO: 2120575 - RNA, 23 nt, Homo sapiens
uaucaaagugucguaucugggag

SEQ ID NO: 2120576 - RNA, 16 nt, Homo sapiens
ucuaaaugccuuugac

SEQ ID NO: 2120577 - RNA, 17 nt, Homo sapiens
gcucaccgcccaucagg

SEQ ID NO: 2120578 - RNA, 21 nt, Homo sapiens
gaguucacaggaggccagugg

SEQ ID NO: 2120579 - RNA, 20 nt, Homo sapiens
auaaacgguuccuggugacu

SEQ ID NO: 2120580 - RNA, 12 nt, Homo sapiens
uaguacucagua

SEQ ID NO: 2120581 - RNA, 18 nt, Homo sapiens
cucuauuuugaaaaacca

SEQ ID NO: 2120582 - RNA, 16 nt, Homo sapiens
uguauacuguaggcac

SEQ ID NO: 2120583 - RNA, 16 nt, Homo sapiens
uuuaaaugcuguguac

SEQ ID NO: 2120584 - RNA, 18 nt, Homo sapiens
acucugaaaucucagaau

SEQ ID NO: 2120585 - RNA, 14 nt, Homo sapiens
ccccggaguucagu

SEQ ID NO: 2120586 - RNA, 17 nt, Homo sapiens
uugcauauguaaggaag

SEQ ID NO: 2120587 - RNA, 14 nt, Homo sapiens
uuuuuagaaaucag

SEQ ID NO: 2120588 - RNA, 18 nt, Homo sapiens
uggacuauggugcuguau

SEQ ID NO: 2120589 - RNA, 18 nt, Homo sapiens
ccaauacacggacacaac

SEQ ID NO: 2120590 - RNA, 14 nt, Homo sapiens
uggaaaccaagcaa

SEQ ID NO: 2120591 - RNA, 15 nt, Homo sapiens
aauucauuccauuug

SEQ ID NO: 2120592 - RNA, 15 nt, Homo sapiens
accgggcgcucgccc

SEQ ID NO: 2120593 - RNA, 15 nt, Homo sapiens
uaauaaacugcaagu

SEQ ID NO: 2120594 - RNA, 16 nt, Homo sapiens
ugacauuuuuccucuc

SEQ ID NO: 2120595 - RNA, 12 nt, Homo sapiens
aaagccagaacc

SEQ ID NO: 2120596 - RNA, 19 nt, Homo sapiens
uaauuugugucuguguuua

SEQ ID NO: 2120597 - RNA, 19 nt, Homo sapiens
ucccagcccugcccagagu

SEQ ID NO: 2120598 - RNA, 22 nt, Homo sapiens
cuguuauuagcugggaagacca

SEQ ID NO: 2120599 - RNA, 20 nt, Homo sapiens
ugagcugcucauuacaguuc

SEQ ID NO: 2120600 - RNA, 15 nt, Homo sapiens
cguaguuacucucag

SEQ ID NO: 2120601 - RNA, 20 nt, Homo sapiens
cuuaaucaagaauauucaaa

SEQ ID NO: 2120602 - RNA, 18 nt, Homo sapiens
uggaaaaaaaauauucaa

SEQ ID NO: 2120603 - RNA, 19 nt, Homo sapiens
uuuuuaagucacaauuuca

SEQ ID NO: 2120604 - RNA, 22 nt, Homo sapiens
cugacaccagagcccacuucca

SEQ ID NO: 2120605 - RNA, 21 nt, Homo sapiens
cauuuuaaaaugcuuggguac

SEQ ID NO: 2120606 - RNA, 12 nt, Homo sapiens
aggaaagggauu

SEQ ID NO: 2120607 - RNA, 11 nt, Homo sapiens
agaguggaaua

SEQ ID NO: 2120608 - RNA, 15 nt, Homo sapiens
aagaaagagccugaa

SEQ ID NO: 2120609 - RNA, 15 nt, Homo sapiens
cagaagaaaagcaaa

SEQ ID NO: 2120610 - RNA, 21 nt, Homo sapiens
agaaauagaggugaugcugcu

SEQ ID NO: 2120611 - RNA, 21 nt, Homo sapiens
ugaagcagauguggugauacu

SEQ ID NO: 2120612 - RNA, 16 nt, Homo sapiens
gcuuuggcaaugccca

SEQ ID NO: 2120613 - RNA, 21 nt, Homo sapiens
gggcaugggggaggcucugaa

SEQ ID NO: 2120614 - RNA, 18 nt, Homo sapiens
ucucauuacugcuucauu

SEQ ID NO: 2120615 - RNA, 13 nt, Homo sapiens
ggaagcacaggca

SEQ ID NO: 2120616 - RNA, 16 nt, Homo sapiens
ccucaaaauaagccau

SEQ ID NO: 2120617 - RNA, 17 nt, Homo sapiens
guuuuaacaguucacuu

SEQ ID NO: 2120618 - RNA, 18 nt, Homo sapiens
caaagcugaaaaugugua

SEQ ID NO: 2120619 - RNA, 18 nt, Homo sapiens
cuuucuauuggcauggau

SEQ ID NO: 2120620 - RNA, 19 nt, Homo sapiens
auuuucucuuaacaagacu

SEQ ID NO: 2120621 - RNA, 16 nt, Homo sapiens
auucacuugcauuucu

SEQ ID NO: 2120622 - RNA, 14 nt, Homo sapiens
cugguuuacuucaa

SEQ ID NO: 2120623 - RNA, 16 nt, Homo sapiens
uauggcuuaaugacac

SEQ ID NO: 2120624 - RNA, 12 nt, Homo sapiens
aaaaugcacugu

SEQ ID NO: 2120625 - RNA, 14 nt, Homo sapiens
auaaaaaacucaca

SEQ ID NO: 2120626 - RNA, 16 nt, Homo sapiens
uccuuccuuuuacuac

SEQ ID NO: 2120627 - RNA, 15 nt, Homo sapiens
ugggcucugaggcug

SEQ ID NO: 2120628 - RNA, 14 nt, Homo sapiens
acaugaacugccag

SEQ ID NO: 2120629 - RNA, 18 nt, Homo sapiens
aggaagcaccccaugcca

SEQ ID NO: 2120630 - RNA, 15 nt, Homo sapiens
ucauccucugaguua

SEQ ID NO: 2120631 - RNA, 19 nt, Homo sapiens
cuuggugcgguaggugcug

SEQ ID NO: 2120632 - RNA, 20 nt, Homo sapiens
acaaaucaugcaaugcagcc

SEQ ID NO: 2120633 - RNA, 22 nt, Homo sapiens
ugaaaauggacagaaugugucu

SEQ ID NO: 2120634 - RNA, 16 nt, Homo sapiens
agugcagcaaccagag

SEQ ID NO: 2120635 - RNA, 22 nt, Homo sapiens
cucgggggaaagcacaccucau

SEQ ID NO: 2120636 - RNA, 21 nt, Homo sapiens
auuugggauggaagcaggaca

SEQ ID NO: 2120637 - RNA, 13 nt, Homo sapiens
ucuccccucagcc

SEQ ID NO: 2120638 - RNA, 22 nt, Homo sapiens
ucccuacuuccucugcaaaaag

SEQ ID NO: 2120639 - RNA, 13 nt, Homo sapiens
agugggacccaua

SEQ ID NO: 2120640 - RNA, 13 nt, Homo sapiens
uucacauauugca

SEQ ID NO: 2120641 - RNA, 17 nt, Homo sapiens
gcuccaggcuuccugcc

SEQ ID NO: 2120642 - RNA, 23 nt, Homo sapiens
uccucaucugggggaguggaaua

SEQ ID NO: 2120643 - RNA, 17 nt, Homo sapiens
auguugcacaacacaga

SEQ ID NO: 2120644 - RNA, 18 nt, Homo sapiens
ucaugaaucugcaaugug

SEQ ID NO: 2120645 - RNA, 12 nt, Homo sapiens
uucaacuccaga

SEQ ID NO: 2120646 - RNA, 21 nt, Homo sapiens
gugccugagcucugacagugu

SEQ ID NO: 2120647 - RNA, 15 nt, Homo sapiens
agcgaaaucaugguu

SEQ ID NO: 2120648 - RNA, 19 nt, Homo sapiens
aauauucagccagcuuaaa

SEQ ID NO: 2120649 - RNA, 16 nt, Homo sapiens
guauccagaggugagg

SEQ ID NO: 2120650 - RNA, 19 nt, Homo sapiens
agauggcaaaaucaucuua

SEQ ID NO: 2120651 - RNA, 15 nt, Homo sapiens
gagugucacaucucu

SEQ ID NO: 2120652 - RNA, 11 nt, Homo sapiens
caccagguguc

SEQ ID NO: 2120653 - RNA, 20 nt, Homo sapiens
cucaacaaagcacaguguua

SEQ ID NO: 2120654 - RNA, 18 nt, Homo sapiens
accuaaaacuuaagccaa

SEQ ID NO: 2120655 - RNA, 19 nt, Homo sapiens
acaaagcccauagcacugg

SEQ ID NO: 2120656 - RNA, 18 nt, Homo sapiens
acauagguuagauucuca

SEQ ID NO: 2120657 - RNA, 16 nt, Homo sapiens
acauguguguauauau

SEQ ID NO: 2120658 - RNA, 16 nt, Homo sapiens
acgcgcgcgugcacac

SEQ ID NO: 2120659 - RNA, 17 nt, Homo sapiens
aaucuaacuacaaggac

SEQ ID NO: 2120660 - RNA, 12 nt, Homo sapiens
aacuauauugcg

SEQ ID NO: 2120661 - RNA, 18 nt, Homo sapiens
aaaaugcuugggaccaga

SEQ ID NO: 2120662 - RNA, 18 nt, Homo sapiens
uguuaucuuccacuggaa

SEQ ID NO: 2120663 - RNA, 22 nt, Homo sapiens
gaggaugcugacaucauuugua

SEQ ID NO: 2120664 - RNA, 20 nt, Homo sapiens
agcucuuggcuccacuggga

SEQ ID NO: 2120665 - RNA, 14 nt, Homo sapiens
uuugcauguuugua

SEQ ID NO: 2120666 - RNA, 15 nt, Homo sapiens
ccugagacacauggg

SEQ ID NO: 2120667 - RNA, 22 nt, Homo sapiens
cacacuuuuggaaccaugccuu

SEQ ID NO: 2120668 - RNA, 22 nt, Homo sapiens
gguuccauuuuuccucuguuca

SEQ ID NO: 2120669 - RNA, 19 nt, Homo sapiens
ugaacuguuuuccuggcau

SEQ ID NO: 2120670 - RNA, 23 nt, Homo sapiens
gauuaaauaaaacuuaaaucuca

SEQ ID NO: 2120671 - RNA, 13 nt, Homo sapiens
cuuccccauggga

SEQ ID NO: 2120672 - RNA, 21 nt, Homo sapiens
uggugcccccagacagcugcu

SEQ ID NO: 2120673 - RNA, 14 nt, Homo sapiens
gaccucacuggccu

SEQ ID NO: 2120674 - RNA, 22 nt, Homo sapiens
aaaacucuaauuguccauucuu

SEQ ID NO: 2120675 - RNA, 15 nt, Homo sapiens
gucuaauuuauucaa

SEQ ID NO: 2120676 - RNA, 11 nt, Homo sapiens
uaacacaugca

SEQ ID NO: 2120677 - RNA, 14 nt, Homo sapiens
ggccucugugauua

SEQ ID NO: 2120678 - RNA, 23 nt, Homo sapiens
ucaggaauuuuguaaucucauaa

SEQ ID NO: 2120679 - RNA, 12 nt, Homo sapiens
acaccuggacug

SEQ ID NO: 2120680 - RNA, 17 nt, Homo sapiens
gucuggccacugucaag

SEQ ID NO: 2120681 - RNA, 14 nt, Homo sapiens
cugaaaaaugucag

SEQ ID NO: 2120682 - RNA, 20 nt, Homo sapiens
gagauaagggugucuuccua

SEQ ID NO: 2120683 - RNA, 20 nt, Homo sapiens
aaggccuggcgucggccaga

SEQ ID NO: 2120684 - RNA, 17 nt, Homo sapiens
ugcaccaggggugcaca

SEQ ID NO: 2120685 - RNA, 15 nt, Homo sapiens
agcaauggaguggcu

SEQ ID NO: 2120686 - RNA, 15 nt, Homo sapiens
uguguaccuaaggga

SEQ ID NO: 2120687 - RNA, 20 nt, Homo sapiens
ccagcuucccucugccugac

SEQ ID NO: 2120688 - RNA, 16 nt, Homo sapiens
acuucccguuuccucu

SEQ ID NO: 2120689 - RNA, 16 nt, Homo sapiens
ucuuccugauuccuuu

SEQ ID NO: 2120690 - RNA, 20 nt, Homo sapiens
aagauccaagaggcccugca

SEQ ID NO: 2120691 - RNA, 16 nt, Homo sapiens
uucuaaauaugaauga

SEQ ID NO: 2120692 - RNA, 18 nt, Homo sapiens
ucugugacuuaucuacca

SEQ ID NO: 2120693 - RNA, 21 nt, Homo sapiens
agcuucauaauuuccaugaua

SEQ ID NO: 2120694 - RNA, 15 nt, Homo sapiens
acuacuguccaauca

SEQ ID NO: 2120695 - RNA, 15 nt, Homo sapiens
cuaucuguauuuuca

SEQ ID NO: 2120696 - RNA, 23 nt, Homo sapiens
uaacccucacugggacuuuguaa

SEQ ID NO: 2120697 - RNA, 20 nt, Homo sapiens
uacauuuucaguaccaaaga

SEQ ID NO: 2120698 - RNA, 16 nt, Homo sapiens
aggugggacuuuguug

SEQ ID NO: 2120699 - RNA, 21 nt, Homo sapiens
acugcguacaaacauccaaaa

SEQ ID NO: 2120700 - RNA, 21 nt, Homo sapiens
cuauuauacuuuaucaaagau

SEQ ID NO: 2120701 - RNA, 18 nt, Homo sapiens
cauaugugaucugucuug

SEQ ID NO: 2120702 - RNA, 18 nt, Homo sapiens
aaagaauuccaaagcaaa

SEQ ID NO: 2120703 - RNA, 18 nt, Homo sapiens
uaauuugauacugaccuu

SEQ ID NO: 2120704 - RNA, 22 nt, Homo sapiens
aagaguccuuacugaagccagg

SEQ ID NO: 2120705 - RNA, 15 nt, Homo sapiens
aaagacaggagguaa

SEQ ID NO: 2120706 - RNA, 23 nt, Homo sapiens
uuuagcuaccucacuaugcugcu

SEQ ID NO: 2120707 - RNA, 13 nt, Homo sapiens
ucaccuugcacuc

SEQ ID NO: 2120708 - RNA, 20 nt, Homo sapiens
cuggguuaacaaaugagcca

SEQ ID NO: 2120709 - RNA, 13 nt, Homo sapiens
uguaccauuccuu

SEQ ID NO: 2120710 - RNA, 17 nt, Homo sapiens
acuuuaucuauaucuca

SEQ ID NO: 2120711 - RNA, 15 nt, Homo sapiens
gggucaaaccaagaa

SEQ ID NO: 2120712 - RNA, 18 nt, Homo sapiens
ccuuuuuuccccagacuu

SEQ ID NO: 2120713 - RNA, 16 nt, Homo sapiens
ugauggacaaaggccu

SEQ ID NO: 2120714 - RNA, 19 nt, Homo sapiens
cugcagucucuauaccaau

SEQ ID NO: 2120715 - RNA, 16 nt, Homo sapiens
uaucaaucaguauaau

SEQ ID NO: 2120716 - RNA, 11 nt, Homo sapiens
aacaguggcug

SEQ ID NO: 2120717 - RNA, 17 nt, Homo sapiens
uauagauuaaaucauac

SEQ ID NO: 2120718 - RNA, 23 nt, Homo sapiens
cguuuccugagaagugucuaaaa

SEQ ID NO: 2120719 - RNA, 14 nt, Homo sapiens
uaaaacagauauua

SEQ ID NO: 2120720 - RNA, 20 nt, Homo sapiens
acuugcauaccaaguugaua

SEQ ID NO: 2120721 - RNA, 21 nt, Homo sapiens
uuuuaacuuuuauaccuaucu

SEQ ID NO: 2120722 - RNA, 18 nt, Homo sapiens
cacucuucauucuuugaa

SEQ ID NO: 2120723 - RNA, 23 nt, Homo sapiens
gugcaggggugagggguccaugc

SEQ ID NO: 2120724 - RNA, 20 nt, Homo sapiens
acuguuaaauugcuguguau

SEQ ID NO: 2120725 - RNA, 18 nt, Homo sapiens
gaccucccccucuugguc

SEQ ID NO: 2120726 - RNA, 22 nt, Homo sapiens
acccucuggagaaggugggcac

SEQ ID NO: 2120727 - RNA, 16 nt, Homo sapiens
ucggugggcauucaca

SEQ ID NO: 2120728 - RNA, 17 nt, Homo sapiens
agauuagacacuaugug

SEQ ID NO: 2120729 - RNA, 16 nt, Homo sapiens
auuuguauacacauaa

SEQ ID NO: 2120730 - RNA, 19 nt, Homo sapiens
cuggcuggugacagaacau

SEQ ID NO: 2120731 - RNA, 17 nt, Homo sapiens
uuuagaaauuaugcugu

SEQ ID NO: 2120732 - RNA, 14 nt, Homo sapiens
augauggaugccaa

SEQ ID NO: 2120733 - RNA, 19 nt, Homo sapiens
gucacagggaggaaggcag

SEQ ID NO: 2120734 - RNA, 11 nt, Homo sapiens
ugaacagaauu

SEQ ID NO: 2120735 - RNA, 13 nt, Homo sapiens
ugucuuagcugua

SEQ ID NO: 2120736 - RNA, 12 nt, Homo sapiens
cuagacauauuu

SEQ ID NO: 2120737 - RNA, 18 nt, Homo sapiens
caagagcuuaacagugug

SEQ ID NO: 2120738 - RNA, 12 nt, Homo sapiens
ggccuucucacc

SEQ ID NO: 2120739 - RNA, 17 nt, Homo sapiens
caguggauugauuauaa

SEQ ID NO: 2120740 - RNA, 15 nt, Homo sapiens
acuuuaauccaaaga

SEQ ID NO: 2120741 - RNA, 16 nt, Homo sapiens
uucccuguggccuuau

SEQ ID NO: 2120742 - RNA, 15 nt, Homo sapiens
auggaauuuauaauu

SEQ ID NO: 2120743 - RNA, 23 nt, Homo sapiens
gaaaaguuuccuaggaugucaug

SEQ ID NO: 2120744 - RNA, 17 nt, Homo sapiens
aucuuuacacaauguca

SEQ ID NO: 2120745 - RNA, 16 nt, Homo sapiens
ucuggcuccucggggc

SEQ ID NO: 2120746 - RNA, 20 nt, Homo sapiens
gcuacagaugguagaacuaa

SEQ ID NO: 2120747 - RNA, 14 nt, Homo sapiens
ggcugcggugggca

SEQ ID NO: 2120748 - RNA, 17 nt, Homo sapiens
aaauuuggggacagauu

SEQ ID NO: 2120749 - RNA, 16 nt, Homo sapiens
gacugcucaaccucac

SEQ ID NO: 2120750 - RNA, 17 nt, Homo sapiens
aacucagaucugucuga

SEQ ID NO: 2120751 - RNA, 20 nt, Homo sapiens
cuuugcuccuuuuguaguau

SEQ ID NO: 2120752 - RNA, 14 nt, Homo sapiens
cuccaaacauuacu

SEQ ID NO: 2120753 - RNA, 21 nt, Homo sapiens
aaccuucuuuucaaugcaaug

SEQ ID NO: 2120754 - RNA, 20 nt, Homo sapiens
aauuuauuucaaaaagggaa

SEQ ID NO: 2120755 - RNA, 19 nt, Homo sapiens
gauaacagaaaggcuuuuu

SEQ ID NO: 2120756 - RNA, 20 nt, Homo sapiens
acugaaaagacaaaguuuau

SEQ ID NO: 2120757 - RNA, 19 nt, Homo sapiens
uaacauggacugcuucauc

SEQ ID NO: 2120758 - RNA, 13 nt, Homo sapiens
uguggggggugca

SEQ ID NO: 2120759 - RNA, 18 nt, Homo sapiens
cagcauuucccgaaggcc

SEQ ID NO: 2120760 - RNA, 19 nt, Homo sapiens
uggacuguggcacuugccu

SEQ ID NO: 2120761 - RNA, 17 nt, Homo sapiens
agguucgagucuugcuc

SEQ ID NO: 2120762 - RNA, 15 nt, Homo sapiens
cauuagcagcaucuu

SEQ ID NO: 2120763 - RNA, 16 nt, Homo sapiens
cugauuagugucucca

SEQ ID NO: 2120764 - RNA, 21 nt, Homo sapiens
guccagagcggaggcugugug

SEQ ID NO: 2120765 - RNA, 17 nt, Homo sapiens
gaaaaaaaguacaugua

SEQ ID NO: 2120766 - RNA, 17 nt, Homo sapiens
uacucaggcagugcagu

SEQ ID NO: 2120767 - RNA, 14 nt, Homo sapiens
aggaaauaagucau

SEQ ID NO: 2120768 - RNA, 23 nt, Homo sapiens
uugcaauacauuucuuccuucaa

SEQ ID NO: 2120769 - RNA, 16 nt, Homo sapiens
cacagaugaugaagaa

SEQ ID NO: 2120770 - RNA, 22 nt, Homo sapiens
aucaccaaaugcuuuuugaucu

SEQ ID NO: 2120771 - RNA, 15 nt, Homo sapiens
gcaucuuggaaauca

SEQ ID NO: 2120772 - RNA, 22 nt, Homo sapiens
uaccuagauuuuaaauagacaa

SEQ ID NO: 2120773 - RNA, 15 nt, Homo sapiens
auugaugagcaagac

SEQ ID NO: 2120774 - RNA, 20 nt, Homo sapiens
aagagagagcugagugagcu

SEQ ID NO: 2120775 - RNA, 12 nt, Homo sapiens
agaauaaugugu

SEQ ID NO: 2120776 - RNA, 13 nt, Homo sapiens
ucuuccugcaaag

SEQ ID NO: 2120777 - RNA, 15 nt, Homo sapiens
cuauacauaugugca

SEQ ID NO: 2120778 - RNA, 11 nt, Homo sapiens
ugaaugcucug

SEQ ID NO: 2120779 - RNA, 16 nt, Homo sapiens
caaauacuguguuuca

SEQ ID NO: 2120780 - RNA, 20 nt, Homo sapiens
uccugggcucaagcaaucca

SEQ ID NO: 2120781 - RNA, 16 nt, Homo sapiens
cagguggaauguguau

SEQ ID NO: 2120782 - RNA, 16 nt, Homo sapiens
uuggaaacucaaggaa

SEQ ID NO: 2120783 - RNA, 20 nt, Homo sapiens
ugaucagaauuuuaccaaaa

SEQ ID NO: 2120784 - RNA, 17 nt, Homo sapiens
gcuaagauaccaaaacc

SEQ ID NO: 2120785 - RNA, 22 nt, Homo sapiens
uacuccuggagcacuguaaaaa

SEQ ID NO: 2120786 - RNA, 21 nt, Homo sapiens
aggcacaagucaccaugccug

SEQ ID NO: 2120787 - RNA, 13 nt, Homo sapiens
guuguuaaaggca

SEQ ID NO: 2120788 - RNA, 20 nt, Homo sapiens
agaugacaaugggagccuca

SEQ ID NO: 2120789 - RNA, 16 nt, Homo sapiens
ccaaauggcagggaua

SEQ ID NO: 2120790 - RNA, 23 nt, Homo sapiens
cugaagaaaaauuuauauuucag

SEQ ID NO: 2120791 - RNA, 15 nt, Homo sapiens
gaauacauucuuugc

SEQ ID NO: 2120792 - RNA, 19 nt, Homo sapiens
aagccuucagccacaggga

SEQ ID NO: 2120793 - RNA, 18 nt, Homo sapiens
ccacuguggcacuggcca

SEQ ID NO: 2120794 - RNA, 20 nt, Homo sapiens
ccaagaccuuacaaccacau

SEQ ID NO: 2120795 - RNA, 17 nt, Homo sapiens
gaagggccugcucugcu

SEQ ID NO: 2120796 - RNA, 14 nt, Homo sapiens
agaaaguccagcua

SEQ ID NO: 2120797 - RNA, 13 nt, Homo sapiens
gagaguaauuugg

SEQ ID NO: 2120798 - RNA, 16 nt, Homo sapiens
ugagaauaauugugua

SEQ ID NO: 2120799 - RNA, 22 nt, Homo sapiens
acccaucuuuaauuuauaucag

SEQ ID NO: 2120800 - RNA, 15 nt, Homo sapiens
caauaccugcugaga

SEQ ID NO: 2120801 - RNA, 21 nt, Homo sapiens
aaggggccuuugucuugucaa

SEQ ID NO: 2120802 - RNA, 17 nt, Homo sapiens
guacaaauauaagaaua

SEQ ID NO: 2120803 - RNA, 18 nt, Homo sapiens
uucccuagucuauucauu

SEQ ID NO: 2120804 - RNA, 17 nt, Homo sapiens
aacugagucuguggaca

SEQ ID NO: 2120805 - RNA, 22 nt, Homo sapiens
cacagcagguuuauccagauga

SEQ ID NO: 2120806 - RNA, 22 nt, Homo sapiens
ccugaauuaaagucuacacugc

SEQ ID NO: 2120807 - RNA, 11 nt, Homo sapiens
uaacuauucau

SEQ ID NO: 2120808 - RNA, 17 nt, Homo sapiens
cuccuauuugaccagaa

SEQ ID NO: 2120809 - RNA, 17 nt, Homo sapiens
uacagaaaagacucuga

SEQ ID NO: 2120810 - RNA, 20 nt, Homo sapiens
uuuacguagugucauguucu

SEQ ID NO: 2120811 - RNA, 13 nt, Homo sapiens
cuccacaguguug

SEQ ID NO: 2120812 - RNA, 17 nt, Homo sapiens
ggcccuggcagcaggaa

SEQ ID NO: 2120813 - RNA, 14 nt, Homo sapiens
acuuuuuccaaucu

SEQ ID NO: 2120814 - RNA, 14 nt, Homo sapiens
agaaaagcaugaaa

SEQ ID NO: 2120815 - RNA, 15 nt, Homo sapiens
cuguggcacuggcca

SEQ ID NO: 2120816 - RNA, 15 nt, Homo sapiens
gauuccccuggacau

SEQ ID NO: 2120817 - RNA, 17 nt, Homo sapiens
uaccagagcgugcacuu

SEQ ID NO: 2120818 - RNA, 22 nt, Homo sapiens
ccaggaggcccugguccuggcc

SEQ ID NO: 2120819 - RNA, 16 nt, Homo sapiens
caaaggagccuacucc

SEQ ID NO: 2120820 - RNA, 13 nt, Homo sapiens
ccuguagucccag

SEQ ID NO: 2120821 - RNA, 16 nt, Homo sapiens
aggcccuggucagcuu

SEQ ID NO: 2120822 - RNA, 17 nt, Homo sapiens
agaacuguugguuauuu

SEQ ID NO: 2120823 - RNA, 12 nt, Homo sapiens
uccuccuaccug

SEQ ID NO: 2120824 - RNA, 16 nt, Homo sapiens
ccuguuucccacccag

SEQ ID NO: 2120825 - RNA, 14 nt, Homo sapiens
gaaaagcagaugca

SEQ ID NO: 2120826 - RNA, 22 nt, Homo sapiens
aauccuagcacuugucucagga

SEQ ID NO: 2120827 - RNA, 18 nt, Homo sapiens
cuggcaagacugucuuac

SEQ ID NO: 2120828 - RNA, 18 nt, Homo sapiens
gugucaaugugauuuaug

SEQ ID NO: 2120829 - RNA, 15 nt, Homo sapiens
cagggagggggaccu

SEQ ID NO: 2120830 - RNA, 22 nt, Homo sapiens
augggagagguucugugcaaaa

SEQ ID NO: 2120831 - RNA, 20 nt, Homo sapiens
aguguugaggaggggagcaa

SEQ ID NO: 2120832 - RNA, 23 nt, Homo sapiens
caaagauugcaacccagggcaaa

SEQ ID NO: 2120833 - RNA, 13 nt, Homo sapiens
ugacauugacuau

SEQ ID NO: 2120834 - RNA, 15 nt, Homo sapiens
caguucccagaauca

SEQ ID NO: 2120835 - RNA, 13 nt, Homo sapiens
agagaccaggagg

SEQ ID NO: 2120836 - RNA, 20 nt, Homo sapiens
cuuucaucuaaauuacugau

SEQ ID NO: 2120837 - RNA, 19 nt, Homo sapiens
gucccacucccacagagga

SEQ ID NO: 2120838 - RNA, 15 nt, Homo sapiens
aucaacuaaugauuu

SEQ ID NO: 2120839 - RNA, 20 nt, Homo sapiens
gaaaauaauugcaaauaucc

SEQ ID NO: 2120840 - RNA, 17 nt, Homo sapiens
aaccguacacuguguuu

SEQ ID NO: 2120841 - RNA, 16 nt, Homo sapiens
ggcuucuaguuugcaa

SEQ ID NO: 2120842 - RNA, 20 nt, Homo sapiens
cugcuuuggcugacugggaa

SEQ ID NO: 2120843 - RNA, 23 nt, Homo sapiens
acauggugaaaccucaucucuac

SEQ ID NO: 2120844 - RNA, 21 nt, Homo sapiens
accggggccagcaccacuucc

SEQ ID NO: 2120845 - RNA, 18 nt, Homo sapiens
cuggucugaacuaguuga

SEQ ID NO: 2120846 - RNA, 20 nt, Homo sapiens
uuagagagcaucugcaacaa

SEQ ID NO: 2120847 - RNA, 20 nt, Homo sapiens
cuuuguuaaacuuauuucaa

SEQ ID NO: 2120848 - RNA, 11 nt, Homo sapiens
ccauuugcaau

SEQ ID NO: 2120849 - RNA, 23 nt, Homo sapiens
gucaugugcgaacacagugacac

SEQ ID NO: 2120850 - RNA, 23 nt, Homo sapiens
augaauucuuuguuuaugcacuu

SEQ ID NO: 2120851 - RNA, 15 nt, Homo sapiens
aagaagccacagacc

SEQ ID NO: 2120852 - RNA, 14 nt, Homo sapiens
uaugaaaugacuuc

SEQ ID NO: 2120853 - RNA, 14 nt, Homo sapiens
aaccuugcuaucaa

SEQ ID NO: 2120854 - RNA, 13 nt, Homo sapiens
uagucaugugacc

SEQ ID NO: 2120855 - RNA, 13 nt, Homo sapiens
ucuagaaggccag

SEQ ID NO: 2120856 - RNA, 10 nt, Homo sapiens
uaaagacuua

SEQ ID NO: 2120857 - RNA, 20 nt, Homo sapiens
uggugcuuuauaauguauac

SEQ ID NO: 2120858 - RNA, 17 nt, Homo sapiens
ccugcuguccuccagaa

SEQ ID NO: 2120859 - RNA, 18 nt, Homo sapiens
cagacacaggcccggcuc

SEQ ID NO: 2120860 - RNA, 14 nt, Homo sapiens
aggugggugcugcc

SEQ ID NO: 2120861 - RNA, 19 nt, Homo sapiens
gcucugccacccuaccugu

SEQ ID NO: 2120862 - RNA, 18 nt, Homo sapiens
uaaugauuguuugucaau

SEQ ID NO: 2120863 - RNA, 12 nt, Homo sapiens
cuuacaauguga

SEQ ID NO: 2120864 - RNA, 19 nt, Homo sapiens
cguugcccuaauucaucuu

SEQ ID NO: 2120865 - RNA, 18 nt, Homo sapiens
uccuuagaauacuguauu

SEQ ID NO: 2120866 - RNA, 18 nt, Homo sapiens
auaguuaaucuauaacua

SEQ ID NO: 2120867 - RNA, 23 nt, Homo sapiens
cucgugguggaaacuuuucuuaa

SEQ ID NO: 2120868 - RNA, 19 nt, Homo sapiens
accaucuggaaggacaucu

SEQ ID NO: 2120869 - RNA, 14 nt, Homo sapiens
auaagaaagccuga

SEQ ID NO: 2120870 - RNA, 16 nt, Homo sapiens
ccacaaaaaauacuuu

SEQ ID NO: 2120871 - RNA, 19 nt, Homo sapiens
gaaggguggucaguaguuu

SEQ ID NO: 2120872 - RNA, 14 nt, Homo sapiens
acauacgugcacag

SEQ ID NO: 2120873 - RNA, 17 nt, Homo sapiens
acuuccccacaggugaa

SEQ ID NO: 2120874 - RNA, 19 nt, Homo sapiens
acugaugagauacauuuga

SEQ ID NO: 2120875 - RNA, 20 nt, Homo sapiens
uggauuccucgaaacugcca

SEQ ID NO: 2120876 - RNA, 19 nt, Homo sapiens
aaaauggagguggaaagac

SEQ ID NO: 2120877 - RNA, 15 nt, Homo sapiens
cucagaguccaguca

SEQ ID NO: 2120878 - RNA, 18 nt, Homo sapiens
aaagcacuguuucucuca

SEQ ID NO: 2120879 - RNA, 18 nt, Homo sapiens
aaaaugcuauauaaucug

SEQ ID NO: 2120880 - RNA, 19 nt, Homo sapiens
auaaccccaggcaucccau

SEQ ID NO: 2120881 - RNA, 13 nt, Homo sapiens
cauugcuuucuaa

SEQ ID NO: 2120882 - RNA, 18 nt, Homo sapiens
aagcucagaguugagacc

SEQ ID NO: 2120883 - RNA, 19 nt, Homo sapiens
auacugacacuuugccaga

SEQ ID NO: 2120884 - RNA, 19 nt, Homo sapiens
aggcugaaaggaauauagu

SEQ ID NO: 2120885 - RNA, 18 nt, Homo sapiens
guagcauuuuaaacaaaa

SEQ ID NO: 2120886 - RNA, 15 nt, Homo sapiens
caagucaccaugccu

SEQ ID NO: 2120887 - RNA, 15 nt, Homo sapiens
ccaccuggcucucac

SEQ ID NO: 2120888 - RNA, 19 nt, Homo sapiens
cccaucagggcccagggag

SEQ ID NO: 2120889 - RNA, 14 nt, Homo sapiens
caguuugcacuuau

SEQ ID NO: 2120890 - RNA, 13 nt, Homo sapiens
aguauaacauguc

SEQ ID NO: 2120891 - RNA, 15 nt, Homo sapiens
cucacauggucugcu

SEQ ID NO: 2120892 - RNA, 19 nt, Homo sapiens
cgucuccugacaugucuca

SEQ ID NO: 2120893 - RNA, 20 nt, Homo sapiens
acugugccaacuacuacugg

SEQ ID NO: 2120894 - RNA, 19 nt, Homo sapiens
aagguuaugaaacauauca

SEQ ID NO: 2120895 - RNA, 16 nt, Homo sapiens
ggaaaguuuuguucug

SEQ ID NO: 2120896 - RNA, 19 nt, Homo sapiens
gaagcucuuggacaacagc

SEQ ID NO: 2120897 - RNA, 21 nt, Homo sapiens
auuuccaugggccccaccauu

SEQ ID NO: 2120898 - RNA, 15 nt, Homo sapiens
agaaagacuaucuaa

SEQ ID NO: 2120899 - RNA, 18 nt, Homo sapiens
augucauauuggcaguug

SEQ ID NO: 2120900 - RNA, 23 nt, Homo sapiens
cuccauuauccauucccaagaug

SEQ ID NO: 2120901 - RNA, 17 nt, Homo sapiens
augccuuaaucccagca

SEQ ID NO: 2120902 - RNA, 21 nt, Homo sapiens
cuugauggaagugggccaguc

SEQ ID NO: 2120903 - RNA, 17 nt, Homo sapiens
uaaaaaggaaguacugc

SEQ ID NO: 2120904 - RNA, 16 nt, Homo sapiens
ugucuggaagacaugu

SEQ ID NO: 2120905 - RNA, 13 nt, Homo sapiens
cauggagccagug

SEQ ID NO: 2120906 - RNA, 13 nt, Homo sapiens
augguagcauuuu

SEQ ID NO: 2120907 - RNA, 21 nt, Homo sapiens
acuuuucuguucaucaccagu

SEQ ID NO: 2120908 - RNA, 19 nt, Homo sapiens
ggaaggcaauuucucugca

SEQ ID NO: 2120909 - RNA, 15 nt, Homo sapiens
gagacugcugaguca

SEQ ID NO: 2120910 - RNA, 13 nt, Homo sapiens
ucucagcucacua

SEQ ID NO: 2120911 - RNA, 14 nt, Homo sapiens
guccugaggggcug

SEQ ID NO: 2120912 - RNA, 14 nt, Homo sapiens
augaaaagagcaaa

SEQ ID NO: 2120913 - RNA, 14 nt, Homo sapiens
uugcucagugccuc

SEQ ID NO: 2120914 - RNA, 19 nt, Homo sapiens
aagaaccacagcacuugag

SEQ ID NO: 2120915 - RNA, 19 nt, Homo sapiens
agaaaagauuauauauuau

SEQ ID NO: 2120916 - RNA, 15 nt, Homo sapiens
ccugcaaaccuuccu

SEQ ID NO: 2120917 - RNA, 22 nt, Homo sapiens
cuuacccugguaaucagcaaaa

SEQ ID NO: 2120918 - RNA, 13 nt, Homo sapiens
aaucaaguccuuu

SEQ ID NO: 2120919 - RNA, 17 nt, Homo sapiens
uuccuuuaugugaauuu

SEQ ID NO: 2120920 - RNA, 18 nt, Homo sapiens
acauguauugcacauugu

SEQ ID NO: 2120921 - RNA, 15 nt, Homo sapiens
gcaauacuguaggaa

SEQ ID NO: 2120922 - RNA, 23 nt, Homo sapiens
auccugucuguuuuuguauuuau

SEQ ID NO: 2120923 - RNA, 18 nt, Homo sapiens
auuggccacacacugagu

SEQ ID NO: 2120924 - RNA, 19 nt, Homo sapiens
gaacaagcagcuaagcaau

SEQ ID NO: 2120925 - RNA, 21 nt, Homo sapiens
uaguggcugccucauauagca

SEQ ID NO: 2120926 - RNA, 18 nt, Homo sapiens
gaaagccaacauguggcu

SEQ ID NO: 2120927 - RNA, 18 nt, Homo sapiens
uccuuuuuugcaugugca

SEQ ID NO: 2120928 - RNA, 18 nt, Homo sapiens
agcauuuagcacauacua

SEQ ID NO: 2120929 - RNA, 19 nt, Homo sapiens
auaccucaguuugcauauu

SEQ ID NO: 2120930 - RNA, 16 nt, Homo sapiens
aaaaggugucaacuuu

SEQ ID NO: 2120931 - RNA, 19 nt, Homo sapiens
cucaagccgcaucccagac

SEQ ID NO: 2120932 - RNA, 18 nt, Homo sapiens
gucugcaauggugacuga

SEQ ID NO: 2120933 - RNA, 19 nt, Homo sapiens
auauuuuugccauaaugac

SEQ ID NO: 2120934 - RNA, 23 nt, Homo sapiens
caauuaacaucgugggucacuac

SEQ ID NO: 2120935 - RNA, 17 nt, Homo sapiens
gaaacaaaaauguacaa

SEQ ID NO: 2120936 - RNA, 15 nt, Homo sapiens
cucugauuacaauuc

SEQ ID NO: 2120937 - RNA, 16 nt, Homo sapiens
caagcugguauuuuca

SEQ ID NO: 2120938 - RNA, 15 nt, Homo sapiens
ugggaacuaauuuca

SEQ ID NO: 2120939 - RNA, 11 nt, Homo sapiens
cugcagagccc

SEQ ID NO: 2120940 - RNA, 16 nt, Homo sapiens
ggaaaaacaugcgaug

SEQ ID NO: 2120941 - RNA, 13 nt, Homo sapiens
uauuggacagucu

SEQ ID NO: 2120942 - RNA, 19 nt, Homo sapiens
gaacuucaguguagagaaa

SEQ ID NO: 2120943 - RNA, 20 nt, Homo sapiens
uuauuuccagugaaaucagu

SEQ ID NO: 2120944 - RNA, 22 nt, Homo sapiens
cuuggugggggagccucuggaa

SEQ ID NO: 2120945 - RNA, 14 nt, Homo sapiens
uuagaagacaauuu

SEQ ID NO: 2120946 - RNA, 16 nt, Homo sapiens
ggcaacagauugaaaa

SEQ ID NO: 2120947 - RNA, 16 nt, Homo sapiens
gucacguacugucuga

SEQ ID NO: 2120948 - RNA, 15 nt, Homo sapiens
aacucccgaccucag

SEQ ID NO: 2120949 - RNA, 15 nt, Homo sapiens
aaaggacucuccaaa

SEQ ID NO: 2120950 - RNA, 19 nt, Homo sapiens
guauucuuaaaaugcaaua

SEQ ID NO: 2120951 - RNA, 12 nt, Homo sapiens
gggucuuucaug

SEQ ID NO: 2120952 - RNA, 12 nt, Homo sapiens
cugcaccugcag

SEQ ID NO: 2120953 - RNA, 20 nt, Homo sapiens
uaaucuugcucugcuugaca

SEQ ID NO: 2120954 - RNA, 21 nt, Homo sapiens
gccaggacaugcagcccagaa

SEQ ID NO: 2120955 - RNA, 23 nt, Homo sapiens
cuggucauggaauggcagguguc

SEQ ID NO: 2120956 - RNA, 17 nt, Homo sapiens
ugcagaaccagcacuaa

SEQ ID NO: 2120957 - RNA, 20 nt, Homo sapiens
ugcuacuaagauacuccaua

SEQ ID NO: 2120958 - RNA, 14 nt, Homo sapiens
acucugcacaugaa

SEQ ID NO: 2120959 - RNA, 21 nt, Homo sapiens
acuggaugaacaggauguaua

SEQ ID NO: 2120960 - RNA, 20 nt, Homo sapiens
cuuauuuuuuucugauugua

SEQ ID NO: 2120961 - RNA, 22 nt, Homo sapiens
uaauucuaguuucucucaauga

SEQ ID NO: 2120962 - RNA, 22 nt, Homo sapiens
gcuuccaaaagugauagugugu

SEQ ID NO: 2120963 - RNA, 21 nt, Homo sapiens
cugacauuuuuuccuaaggaa

SEQ ID NO: 2120964 - RNA, 20 nt, Homo sapiens
cuucaguucucuacucccuc

SEQ ID NO: 2120965 - RNA, 19 nt, Homo sapiens
auguaauauuaauaguuau

SEQ ID NO: 2120966 - RNA, 13 nt, Homo sapiens
cacuguuucauga

SEQ ID NO: 2120967 - RNA, 11 nt, Homo sapiens
auagcuuccaa

SEQ ID NO: 2120968 - RNA, 21 nt, Homo sapiens
cucagagcaggggccagauga

SEQ ID NO: 2120969 - RNA, 14 nt, Homo sapiens
aggcgcucaggcau

SEQ ID NO: 2120970 - RNA, 12 nt, Homo sapiens
aaucacugacca

SEQ ID NO: 2120971 - RNA, 17 nt, Homo sapiens
gcaacuggaguuccuua

SEQ ID NO: 2120972 - RNA, 16 nt, Homo sapiens
agaauuucaauaucaa

SEQ ID NO: 2120973 - RNA, 20 nt, Homo sapiens
aauuaacugcuaacuucuau

SEQ ID NO: 2120974 - RNA, 16 nt, Homo sapiens
uacagaaaagucauau

SEQ ID NO: 2120975 - RNA, 16 nt, Homo sapiens
acaauauuaauucagg

SEQ ID NO: 2120976 - RNA, 17 nt, Homo sapiens
cuucauagcccaaaaca

SEQ ID NO: 2120977 - RNA, 14 nt, Homo sapiens
ccaggccugaccag

SEQ ID NO: 2120978 - RNA, 18 nt, Homo sapiens
cuagcuuaucuacuucca

SEQ ID NO: 2120979 - RNA, 16 nt, Homo sapiens
gcucaggucaacugac

SEQ ID NO: 2120980 - RNA, 19 nt, Homo sapiens
uuauacuuuauuaagcaac

SEQ ID NO: 2120981 - RNA, 13 nt, Homo sapiens
aagaauaugaagu

SEQ ID NO: 2120982 - RNA, 12 nt, Homo sapiens
ugaagacuuccu

SEQ ID NO: 2120983 - RNA, 13 nt, Homo sapiens
agggaaguugucu

SEQ ID NO: 2120984 - RNA, 18 nt, Homo sapiens
ccgcugcucacuuuccac

SEQ ID NO: 2120985 - RNA, 23 nt, Homo sapiens
agccacccucccagcucugagga

SEQ ID NO: 2120986 - RNA, 15 nt, Homo sapiens
uaugcagccauauau

SEQ ID NO: 2120987 - RNA, 19 nt, Homo sapiens
caacuuagaaaccaaauua

SEQ ID NO: 2120988 - RNA, 20 nt, Homo sapiens
ucuguuauauccccugcuac

SEQ ID NO: 2120989 - RNA, 20 nt, Homo sapiens
uugacgaacuggcuacagua

SEQ ID NO: 2120990 - RNA, 19 nt, Homo sapiens
ccugcccccgcucccgcuc

SEQ ID NO: 2120991 - RNA, 16 nt, Homo sapiens
cauuguggaaacugga

SEQ ID NO: 2120992 - RNA, 15 nt, Homo sapiens
caaaacuacaugaga

SEQ ID NO: 2120993 - RNA, 18 nt, Homo sapiens
acagcgagggcagcugcu

SEQ ID NO: 2120994 - RNA, 18 nt, Homo sapiens
uucuauugccucugagag

SEQ ID NO: 2120995 - RNA, 23 nt, Homo sapiens
uguaugccuuuugggcauucucc

SEQ ID NO: 2120996 - RNA, 22 nt, Homo sapiens
gguuucuaacccacccucacga

SEQ ID NO: 2120997 - RNA, 22 nt, Homo sapiens
ccuccagcuucaggcaggccaa

SEQ ID NO: 2120998 - RNA, 19 nt, Homo sapiens
agccccuuccucugccagg

SEQ ID NO: 2120999 - RNA, 18 nt, Homo sapiens
uaauauaaaugaaugaaa

SEQ ID NO: 2121000 - RNA, 22 nt, Homo sapiens
cagccuggccaagagaccagcc

SEQ ID NO: 2121001 - RNA, 19 nt, Homo sapiens
aacuagaagccuagugugu

SEQ ID NO: 2121002 - RNA, 16 nt, Homo sapiens
auaguggccuugucca

SEQ ID NO: 2121003 - RNA, 20 nt, Homo sapiens
cuuguauaacaucacuguca

SEQ ID NO: 2121004 - RNA, 15 nt, Homo sapiens
cugugcccuguggua

SEQ ID NO: 2121005 - RNA, 15 nt, Homo sapiens
accucuugugcugag

SEQ ID NO: 2121006 - RNA, 13 nt, Homo sapiens
ugguccaucucau

SEQ ID NO: 2121007 - RNA, 22 nt, Homo sapiens
gccacaaauucuuugacacuca

SEQ ID NO: 2121008 - RNA, 22 nt, Homo sapiens
aguucggaaaccguccugugua

SEQ ID NO: 2121009 - RNA, 19 nt, Homo sapiens
cuuaaaacaauucugugac

SEQ ID NO: 2121010 - RNA, 16 nt, Homo sapiens
cuuuuauggaugauua

SEQ ID NO: 2121011 - RNA, 14 nt, Homo sapiens
ccgcuaaggugaaa

SEQ ID NO: 2121012 - RNA, 14 nt, Homo sapiens
agaggacuuggcaa

SEQ ID NO: 2121013 - RNA, 16 nt, Homo sapiens
ucccuucaucugggca

SEQ ID NO: 2121014 - RNA, 18 nt, Homo sapiens
gcagauuacagucauuuc

SEQ ID NO: 2121015 - RNA, 19 nt, Homo sapiens
ugccgcuggaggauccgga

SEQ ID NO: 2121016 - RNA, 16 nt, Homo sapiens
ccccuaccucuaguaa

SEQ ID NO: 2121017 - RNA, 18 nt, Homo sapiens
caguguggggauaaagac

SEQ ID NO: 2121018 - RNA, 21 nt, Homo sapiens
agaaccugucuccuacuuuga

SEQ ID NO: 2121019 - RNA, 15 nt, Homo sapiens
ccaaaagaucugggg

SEQ ID NO: 2121020 - RNA, 23 nt, Homo sapiens
caucaggucaccgcgaggccuau

SEQ ID NO: 2121021 - RNA, 17 nt, Homo sapiens
ugccaaaaucaauacaa

SEQ ID NO: 2121022 - RNA, 13 nt, Homo sapiens
uugggggggcucc

SEQ ID NO: 2121023 - RNA, 16 nt, Homo sapiens
gucuguguauacauau

SEQ ID NO: 2121024 - RNA, 15 nt, Homo sapiens
caaacucaccugccc

SEQ ID NO: 2121025 - RNA, 22 nt, Homo sapiens
cauguuucaagaaaauggauuu

SEQ ID NO: 2121026 - RNA, 20 nt, Homo sapiens
uacaggaugguuacugagga

SEQ ID NO: 2121027 - RNA, 13 nt, Homo sapiens
gccugaccaacau

SEQ ID NO: 2121028 - RNA, 17 nt, Homo sapiens
gucagcugcagccacuu

SEQ ID NO: 2121029 - RNA, 17 nt, Homo sapiens
auucugagcauacucaa

SEQ ID NO: 2121030 - RNA, 20 nt, Homo sapiens
uccuaccaucagcucugccu

SEQ ID NO: 2121031 - RNA, 16 nt, Homo sapiens
uuaacacuaccaauuu

SEQ ID NO: 2121032 - RNA, 22 nt, Homo sapiens
ucagcuuucccuggcucaggga

SEQ ID NO: 2121033 - RNA, 17 nt, Homo sapiens
ucagacgagcagugacg

SEQ ID NO: 2121034 - RNA, 18 nt, Homo sapiens
acccaaagcaaaacauca

SEQ ID NO: 2121035 - RNA, 23 nt, Homo sapiens
caugguagucacuaacauauaua

SEQ ID NO: 2121036 - RNA, 21 nt, Homo sapiens
auaacaccaagaguagcaccu

SEQ ID NO: 2121037 - RNA, 15 nt, Homo sapiens
caggaagaaggugug

SEQ ID NO: 2121038 - RNA, 18 nt, Homo sapiens
ccagaaccccaacuccca

SEQ ID NO: 2121039 - RNA, 12 nt, Homo sapiens
gaacacugcacu

SEQ ID NO: 2121040 - RNA, 13 nt, Homo sapiens
gcuccugcuccac

SEQ ID NO: 2121041 - RNA, 13 nt, Homo sapiens
aagggaagcagaa

SEQ ID NO: 2121042 - RNA, 16 nt, Homo sapiens
caugugccgaaugugc

SEQ ID NO: 2121043 - RNA, 16 nt, Homo sapiens
aggccagcaggggcuu

SEQ ID NO: 2121044 - RNA, 20 nt, Homo sapiens
cacaaauuucucuguuccau

SEQ ID NO: 2121045 - RNA, 23 nt, Homo sapiens
gaucuccccucacacuuugccau

SEQ ID NO: 2121046 - RNA, 21 nt, Homo sapiens
ugaguuaacucacugagggua

SEQ ID NO: 2121047 - RNA, 23 nt, Homo sapiens
aucugccggcccccaggacaagu

SEQ ID NO: 2121048 - RNA, 15 nt, Homo sapiens
acugcccuccagggc

SEQ ID NO: 2121049 - RNA, 13 nt, Homo sapiens
auuuaaauaggaa

SEQ ID NO: 2121050 - RNA, 14 nt, Homo sapiens
ugaacucucaaauc

SEQ ID NO: 2121051 - RNA, 15 nt, Homo sapiens
ggaguuugcauucuu

SEQ ID NO: 2121052 - RNA, 17 nt, Homo sapiens
uacacccacaguggaaa

SEQ ID NO: 2121053 - RNA, 18 nt, Homo sapiens
cagcagagaucugcaggc

SEQ ID NO: 2121054 - RNA, 20 nt, Homo sapiens
aacaccacgacuucugccca

SEQ ID NO: 2121055 - RNA, 19 nt, Homo sapiens
uugguucuguuccugauaa

SEQ ID NO: 2121056 - RNA, 14 nt, Homo sapiens
cucuggaagaccug

SEQ ID NO: 2121057 - RNA, 18 nt, Homo sapiens
ccuggcccagaugauaua

SEQ ID NO: 2121058 - RNA, 19 nt, Homo sapiens
agcccacauauuucaauag

SEQ ID NO: 2121059 - RNA, 15 nt, Homo sapiens
cugauguacuuuaaa

SEQ ID NO: 2121060 - RNA, 14 nt, Homo sapiens
uugaaaagcuauua

SEQ ID NO: 2121061 - RNA, 22 nt, Homo sapiens
agacauugugcuagugcuuuua

SEQ ID NO: 2121062 - RNA, 19 nt, Homo sapiens
gcaguaggggcuacuguga

SEQ ID NO: 2121063 - RNA, 11 nt, Homo sapiens
uuugggguccu

SEQ ID NO: 2121064 - RNA, 17 nt, Homo sapiens
cuggccaauacggcaaa

SEQ ID NO: 2121065 - RNA, 16 nt, Homo sapiens
cccaaauagaacaaga

SEQ ID NO: 2121066 - RNA, 13 nt, Homo sapiens
gacaaucacgggc

SEQ ID NO: 2121067 - RNA, 12 nt, Homo sapiens
ucacuugccuua

SEQ ID NO: 2121068 - RNA, 21 nt, Homo sapiens
caaauuguuaagaguaucaug

SEQ ID NO: 2121069 - RNA, 21 nt, Homo sapiens
cuuuaauaaauuuaauaaaua

SEQ ID NO: 2121070 - RNA, 23 nt, Homo sapiens
cuccugggagagaaggagaucag

SEQ ID NO: 2121071 - RNA, 12 nt, Homo sapiens
agagccuuccag

SEQ ID NO: 2121072 - RNA, 22 nt, Homo sapiens
ucacugucuuuaauucuguauc

SEQ ID NO: 2121073 - RNA, 22 nt, Homo sapiens
cuauuuuuugacacuuccauug

SEQ ID NO: 2121074 - RNA, 13 nt, Homo sapiens
cuucugcuccuua

SEQ ID NO: 2121075 - RNA, 18 nt, Homo sapiens
auaaacuucaacacucuu

SEQ ID NO: 2121076 - RNA, 16 nt, Homo sapiens
cuccagggcaucacau

SEQ ID NO: 2121077 - RNA, 16 nt, Homo sapiens
uucacugauuugacau

SEQ ID NO: 2121078 - RNA, 13 nt, Homo sapiens
auaggacaauuca

SEQ ID NO: 2121079 - RNA, 12 nt, Homo sapiens
uugaacuauaac

SEQ ID NO: 2121080 - RNA, 16 nt, Homo sapiens
ucuagggaaaaaccag

SEQ ID NO: 2121081 - RNA, 19 nt, Homo sapiens
aaguaaauacauuauugaa

SEQ ID NO: 2121082 - RNA, 20 nt, Homo sapiens
uaguaauugucaauaccccu

SEQ ID NO: 2121083 - RNA, 18 nt, Homo sapiens
uuaggcaguauaaagaau

SEQ ID NO: 2121084 - RNA, 14 nt, Homo sapiens
ugcagaaacuacug

SEQ ID NO: 2121085 - RNA, 23 nt, Homo sapiens
acccugaccgugcuaacugugug

SEQ ID NO: 2121086 - RNA, 23 nt, Homo sapiens
ccaaacuaaacccucacaaguaa

SEQ ID NO: 2121087 - RNA, 18 nt, Homo sapiens
caaguuccgucaguccaa

SEQ ID NO: 2121088 - RNA, 24 nt, Homo sapiens
uuaguuuugcauaguucuagugca

SEQ ID NO: 2121089 - RNA, 21 nt, Homo sapiens
cauuaugugaguuuccugcua

SEQ ID NO: 2121090 - RNA, 15 nt, Homo sapiens
agcaaugucugugcu

SEQ ID NO: 2121091 - RNA, 20 nt, Homo sapiens
cugaaguugcucuguaccca

SEQ ID NO: 2121092 - RNA, 18 nt, Homo sapiens
gaacauugcauauaacuu

SEQ ID NO: 2121093 - RNA, 16 nt, Homo sapiens
agggaaucagggagca

SEQ ID NO: 2121094 - RNA, 13 nt, Homo sapiens
uaauuuauuucca

SEQ ID NO: 2121095 - RNA, 18 nt, Homo sapiens
agcucuggagaacagugg

SEQ ID NO: 2121096 - RNA, 23 nt, Homo sapiens
aguguucacauggcucucaugua

SEQ ID NO: 2121097 - RNA, 22 nt, Homo sapiens
gaguuugacuuagaauaaugaa

SEQ ID NO: 2121098 - RNA, 16 nt, Homo sapiens
caggccucgggaccaa

SEQ ID NO: 2121099 - RNA, 14 nt, Homo sapiens
ccaaaaacagugau

SEQ ID NO: 2121100 - RNA, 18 nt, Homo sapiens
uuuuuuccuaugcaacuu

SEQ ID NO: 2121101 - RNA, 21 nt, Homo sapiens
aguuaacaauuuugcacugua

SEQ ID NO: 2121102 - RNA, 18 nt, Homo sapiens
gggaguuuggucaguggg

SEQ ID NO: 2121103 - RNA, 20 nt, Homo sapiens
uccaaaguagcugggauuac

SEQ ID NO: 2121104 - RNA, 20 nt, Homo sapiens
uaccacaugauuuuacucau

SEQ ID NO: 2121105 - RNA, 14 nt, Homo sapiens
guauucuauucaaa

SEQ ID NO: 2121106 - RNA, 18 nt, Homo sapiens
gacagcucuguaucugcc

SEQ ID NO: 2121107 - RNA, 13 nt, Homo sapiens
cugugggugguga

SEQ ID NO: 2121108 - RNA, 21 nt, Homo sapiens
gcucuccgcaggcccacuguc

SEQ ID NO: 2121109 - RNA, 22 nt, Homo sapiens
aaccauugucuuguucugugau

SEQ ID NO: 2121110 - RNA, 16 nt, Homo sapiens
auuuaacuaaaguuaa

SEQ ID NO: 2121111 - RNA, 17 nt, Homo sapiens
gguugccucucuugccc

SEQ ID NO: 2121112 - RNA, 18 nt, Homo sapiens
cuuggagcccgugcagua

SEQ ID NO: 2121113 - RNA, 21 nt, Homo sapiens
uuuagaaagguuuugagcaug

SEQ ID NO: 2121114 - RNA, 20 nt, Homo sapiens
uucucacacccacacaaaua

SEQ ID NO: 2121115 - RNA, 20 nt, Homo sapiens
uuaaaaaaaauuaaaaccaa

SEQ ID NO: 2121116 - RNA, 22 nt, Homo sapiens
gcuccucgcccccaccagugua

SEQ ID NO: 2121117 - RNA, 16 nt, Homo sapiens
auaaggugcucugaag

SEQ ID NO: 2121118 - RNA, 15 nt, Homo sapiens
uugggccugcuccag

SEQ ID NO: 2121119 - RNA, 18 nt, Homo sapiens
gucucugccggcucuuuc

SEQ ID NO: 2121120 - RNA, 18 nt, Homo sapiens
aaaccuugaaagacauuu

SEQ ID NO: 2121121 - RNA, 20 nt, Homo sapiens
agaaacuuauuucucauauc

SEQ ID NO: 2121122 - RNA, 13 nt, Homo sapiens
cugcaggugggac

SEQ ID NO: 2121123 - RNA, 15 nt, Homo sapiens
uuggccaggcuguuc

SEQ ID NO: 2121124 - RNA, 17 nt, Homo sapiens
gacuuuauguugaaaua

SEQ ID NO: 2121125 - RNA, 17 nt, Homo sapiens
gacauuguggacuguau

SEQ ID NO: 2121126 - RNA, 18 nt, Homo sapiens
ugcccuccugugcucagc

SEQ ID NO: 2121127 - RNA, 15 nt, Homo sapiens
uuauaguuacugugu

SEQ ID NO: 2121128 - RNA, 14 nt, Homo sapiens
uccggugccuucca

SEQ ID NO: 2121129 - RNA, 19 nt, Homo sapiens
ugugauucaaucuguaaac

SEQ ID NO: 2121130 - RNA, 15 nt, Homo sapiens
ucuagauaaucuuuc

SEQ ID NO: 2121131 - RNA, 21 nt, Homo sapiens
caguuaaaugccgucuaucag

SEQ ID NO: 2121132 - RNA, 18 nt, Homo sapiens
uuucaucucaagcuugcu

SEQ ID NO: 2121133 - RNA, 19 nt, Homo sapiens
cguguguagauaguaugca

SEQ ID NO: 2121134 - RNA, 21 nt, Homo sapiens
ucuuuaacccacuaacuggcu

SEQ ID NO: 2121135 - RNA, 13 nt, Homo sapiens
ucugagacucaca

SEQ ID NO: 2121136 - RNA, 22 nt, Homo sapiens
uagggcaaagaaucaacaguga

SEQ ID NO: 2121137 - RNA, 19 nt, Homo sapiens
gaaagacucuauguuuggc

SEQ ID NO: 2121138 - RNA, 21 nt, Homo sapiens
agugauccuguccuuuuaaca

SEQ ID NO: 2121139 - RNA, 18 nt, Homo sapiens
gcccacugcuggcugcag

SEQ ID NO: 2121140 - RNA, 11 nt, Homo sapiens
ucuauguccaa

SEQ ID NO: 2121141 - RNA, 16 nt, Homo sapiens
uugccucaccugcugu

SEQ ID NO: 2121142 - RNA, 14 nt, Homo sapiens
uguguauacuugua

SEQ ID NO: 2121143 - RNA, 21 nt, Homo sapiens
uaaauuugguauuucuuaaca

SEQ ID NO: 2121144 - RNA, 21 nt, Homo sapiens
uucaugcuggccugugugaua

SEQ ID NO: 2121145 - RNA, 20 nt, Homo sapiens
ggcaaaugcuugauucuuuc

SEQ ID NO: 2121146 - RNA, 16 nt, Homo sapiens
aggcgcuguucuugcu

SEQ ID NO: 2121147 - RNA, 14 nt, Homo sapiens
acgcagacugacuc

SEQ ID NO: 2121148 - RNA, 18 nt, Homo sapiens
cugcccuuccuccaggag

SEQ ID NO: 2121149 - RNA, 16 nt, Homo sapiens
aaggcagccuucaguc

SEQ ID NO: 2121150 - RNA, 21 nt, Homo sapiens
ccggaaguugcugugccccau

SEQ ID NO: 2121151 - RNA, 21 nt, Homo sapiens
ucacaauuuacgaaaccaaaa

SEQ ID NO: 2121152 - RNA, 22 nt, Homo sapiens
agcugacccccaggaacagcuu

SEQ ID NO: 2121153 - RNA, 20 nt, Homo sapiens
uacauuauuaaucauuccau

SEQ ID NO: 2121154 - RNA, 14 nt, Homo sapiens
uuuauaucucucau

SEQ ID NO: 2121155 - RNA, 13 nt, Homo sapiens
accaagcaggaag

SEQ ID NO: 2121156 - RNA, 19 nt, Homo sapiens
agccugggugacagagcaa

SEQ ID NO: 2121157 - RNA, 12 nt, Homo sapiens
ucaaaaccaagu

SEQ ID NO: 2121158 - RNA, 20 nt, Homo sapiens
caaggucaaggcaccagcaa

SEQ ID NO: 2121159 - RNA, 23 nt, Homo sapiens
aauugaguugcacuuauugacca

SEQ ID NO: 2121160 - RNA, 24 nt, Homo sapiens
ugucccugugggugaaacagaaca

SEQ ID NO: 2121161 - RNA, 12 nt, Homo sapiens
gggcggucacag

SEQ ID NO: 2121162 - RNA, 13 nt, Homo sapiens
auuuuuacuauca

SEQ ID NO: 2121163 - RNA, 16 nt, Homo sapiens
ccccaagacacuuccc

SEQ ID NO: 2121164 - RNA, 16 nt, Homo sapiens
gaguuugacauuuaau

SEQ ID NO: 2121165 - RNA, 12 nt, Homo sapiens
uacauuugcaug

SEQ ID NO: 2121166 - RNA, 21 nt, Homo sapiens
gagcacguuugcagaaggggg

SEQ ID NO: 2121167 - RNA, 15 nt, Homo sapiens
gauauagaacagugc

SEQ ID NO: 2121168 - RNA, 20 nt, Homo sapiens
gccucuuucugugcuucucu

SEQ ID NO: 2121169 - RNA, 12 nt, Homo sapiens
acuagcugagca

SEQ ID NO: 2121170 - RNA, 14 nt, Homo sapiens
auguccuauucauu

SEQ ID NO: 2121171 - RNA, 20 nt, Homo sapiens
cugacaccgucccucaguga

SEQ ID NO: 2121172 - RNA, 13 nt, Homo sapiens
ucagcaaugauua

SEQ ID NO: 2121173 - RNA, 15 nt, Homo sapiens
cagcauggagucaca

SEQ ID NO: 2121174 - RNA, 14 nt, Homo sapiens
aagacggauuugcu

SEQ ID NO: 2121175 - RNA, 21 nt, Homo sapiens
cagagccggccgccuucuccc

SEQ ID NO: 2121176 - RNA, 17 nt, Homo sapiens
caguucugaauaugcug

SEQ ID NO: 2121177 - RNA, 18 nt, Homo sapiens
uauuuguggaaacuguca

SEQ ID NO: 2121178 - RNA, 18 nt, Homo sapiens
auuagccaaacacuguaa

SEQ ID NO: 2121179 - RNA, 15 nt, Homo sapiens
acacuaacaugauuu

SEQ ID NO: 2121180 - RNA, 22 nt, Homo sapiens
ggccugugucccccgaacgcuc

SEQ ID NO: 2121181 - RNA, 16 nt, Homo sapiens
ucaguuacugaugcuc

SEQ ID NO: 2121182 - RNA, 16 nt, Homo sapiens
auaauaacuacuucca

SEQ ID NO: 2121183 - RNA, 12 nt, Homo sapiens
ggcagggccuug

SEQ ID NO: 2121184 - RNA, 18 nt, Homo sapiens
ccauuuguuaucugggaa

SEQ ID NO: 2121185 - RNA, 15 nt, Homo sapiens
cuagagacaggcaaa

SEQ ID NO: 2121186 - RNA, 19 nt, Homo sapiens
uucccuugugugagggcaa

SEQ ID NO: 2121187 - RNA, 18 nt, Homo sapiens
cucacuggagacucacuu

SEQ ID NO: 2121188 - RNA, 20 nt, Homo sapiens
guuaguuuauuugagcacuu

SEQ ID NO: 2121189 - RNA, 16 nt, Homo sapiens
uuauguuuucaacuca

SEQ ID NO: 2121190 - RNA, 17 nt, Homo sapiens
augacauggacacauca

SEQ ID NO: 2121191 - RNA, 18 nt, Homo sapiens
ccauguaaauugcaaaua

SEQ ID NO: 2121192 - RNA, 16 nt, Homo sapiens
guauuagggcauuugu

SEQ ID NO: 2121193 - RNA, 16 nt, Homo sapiens
cccuguagcucugaau

SEQ ID NO: 2121194 - RNA, 12 nt, Homo sapiens
uugugaacagaa

SEQ ID NO: 2121195 - RNA, 17 nt, Homo sapiens
ugucuauguugugaucc

SEQ ID NO: 2121196 - RNA, 21 nt, Homo sapiens
acauucccugggccaacagac

SEQ ID NO: 2121197 - RNA, 18 nt, Homo sapiens
aggagggggcucaggcca

SEQ ID NO: 2121198 - RNA, 16 nt, Homo sapiens
cacaauguuauuaccu

SEQ ID NO: 2121199 - RNA, 15 nt, Homo sapiens
gauacaggggguccc

SEQ ID NO: 2121200 - RNA, 17 nt, Homo sapiens
guacuaguucagacacu

SEQ ID NO: 2121201 - RNA, 14 nt, Homo sapiens
augaugacuccucu

SEQ ID NO: 2121202 - RNA, 22 nt, Homo sapiens
aggucuuugccauaacuuuaug

SEQ ID NO: 2121203 - RNA, 16 nt, Homo sapiens
agcccugccaugucac

SEQ ID NO: 2121204 - RNA, 16 nt, Homo sapiens
auggcuggguccuugg

SEQ ID NO: 2121205 - RNA, 16 nt, Homo sapiens
uuuccugaggucaucu

SEQ ID NO: 2121206 - RNA, 13 nt, Homo sapiens
gagugcccugucc

SEQ ID NO: 2121207 - RNA, 18 nt, Homo sapiens
ccacaucucuaucuggcc

SEQ ID NO: 2121208 - RNA, 16 nt, Homo sapiens
cugggaacacagugcc

SEQ ID NO: 2121209 - RNA, 23 nt, Homo sapiens
cuugaucaacaucuuuucuugcc

SEQ ID NO: 2121210 - RNA, 14 nt, Homo sapiens
ccagccuggccaac

SEQ ID NO: 2121211 - RNA, 15 nt, Homo sapiens
ccaauuuuaaauaca

SEQ ID NO: 2121212 - RNA, 15 nt, Homo sapiens
acuaauuucauuuca

SEQ ID NO: 2121213 - RNA, 21 nt, Homo sapiens
caggauggggacacuaaugaa

SEQ ID NO: 2121214 - RNA, 19 nt, Homo sapiens
aacuuuuuaaagugacaua

SEQ ID NO: 2121215 - RNA, 14 nt, Homo sapiens
gacguguacagcac

SEQ ID NO: 2121216 - RNA, 14 nt, Homo sapiens
ccaucguucucugc

SEQ ID NO: 2121217 - RNA, 22 nt, Homo sapiens
auaagucuugguaacaaauaac

SEQ ID NO: 2121218 - RNA, 22 nt, Homo sapiens
caaacuuuuccuggacacuuua

SEQ ID NO: 2121219 - RNA, 15 nt, Homo sapiens
cccaccaaugggccu

SEQ ID NO: 2121220 - RNA, 14 nt, Homo sapiens
cuuaacacuugacc

SEQ ID NO: 2121221 - RNA, 14 nt, Homo sapiens
acccucaauucaua

SEQ ID NO: 2121222 - RNA, 17 nt, Homo sapiens
ucucgaaugcugagaag

SEQ ID NO: 2121223 - RNA, 15 nt, Homo sapiens
cagaugggucugaua

SEQ ID NO: 2121224 - RNA, 15 nt, Homo sapiens
caguucuguguccuc

SEQ ID NO: 2121225 - RNA, 20 nt, Homo sapiens
acuggccucugugauuacau

SEQ ID NO: 2121226 - RNA, 15 nt, Homo sapiens
agcuauggaaucaau

SEQ ID NO: 2121227 - RNA, 18 nt, Homo sapiens
agccuagagugagggccu

SEQ ID NO: 2121228 - RNA, 14 nt, Homo sapiens
cacuuacagaauua

SEQ ID NO: 2121229 - RNA, 23 nt, Homo sapiens
gaagaugagccuugcagauaucu

SEQ ID NO: 2121230 - RNA, 15 nt, Homo sapiens
gaggcaguggcagca

SEQ ID NO: 2121231 - RNA, 23 nt, Homo sapiens
caggcccuccuugucuuuuuacu

SEQ ID NO: 2121232 - RNA, 13 nt, Homo sapiens
ucuguugugcaug

SEQ ID NO: 2121233 - RNA, 17 nt, Homo sapiens
acuuuauauaaggcauu

SEQ ID NO: 2121234 - RNA, 22 nt, Homo sapiens
uuccguuggaaagaacauuuaa

SEQ ID NO: 2121235 - RNA, 22 nt, Homo sapiens
accaggaaccuccuccacacca

SEQ ID NO: 2121236 - RNA, 17 nt, Homo sapiens
aauagccacauuuggaa

SEQ ID NO: 2121237 - RNA, 14 nt, Homo sapiens
aacuccugaguuca

SEQ ID NO: 2121238 - RNA, 21 nt, Homo sapiens
acagccuccucugucugcccu

SEQ ID NO: 2121239 - RNA, 17 nt, Homo sapiens
gguauguggguggcacu

SEQ ID NO: 2121240 - RNA, 20 nt, Homo sapiens
gggguagaaggauccuccaa

SEQ ID NO: 2121241 - RNA, 14 nt, Homo sapiens
uccugaaccagcac

SEQ ID NO: 2121242 - RNA, 23 nt, Homo sapiens
agacacaauauguaugcuuuuua

SEQ ID NO: 2121243 - RNA, 20 nt, Homo sapiens
cagaaaccaguuaugugaau

SEQ ID NO: 2121244 - RNA, 20 nt, Homo sapiens
aauauguucuuuuaaaugau

SEQ ID NO: 2121245 - RNA, 20 nt, Homo sapiens
cuaauaugccuaaucuguaa

SEQ ID NO: 2121246 - RNA, 11 nt, Homo sapiens
ggucccagugc

SEQ ID NO: 2121247 - RNA, 17 nt, Homo sapiens
ggucccccgacugccug

SEQ ID NO: 2121248 - RNA, 14 nt, Homo sapiens
gaauuaugcuguua

SEQ ID NO: 2121249 - RNA, 13 nt, Homo sapiens
aauauguauacac

SEQ ID NO: 2121250 - RNA, 17 nt, Homo sapiens
uguggagagugagaaua

SEQ ID NO: 2121251 - RNA, 12 nt, Homo sapiens
cugucagugucc

SEQ ID NO: 2121252 - RNA, 22 nt, Homo sapiens
aaagcagaaaaucuaccaagaa

SEQ ID NO: 2121253 - RNA, 12 nt, Homo sapiens
ccuccucaguga

SEQ ID NO: 2121254 - RNA, 21 nt, Homo sapiens
augcauauuguauuacuagaa

SEQ ID NO: 2121255 - RNA, 22 nt, Homo sapiens
aucagcccccagccuuguuucu

SEQ ID NO: 2121256 - RNA, 20 nt, Homo sapiens
uuucagauauaaauacugac

SEQ ID NO: 2121257 - RNA, 17 nt, Homo sapiens
gauuacuuuggccaaaa

SEQ ID NO: 2121258 - RNA, 18 nt, Homo sapiens
aggaauauuaaagggauu

SEQ ID NO: 2121259 - RNA, 19 nt, Homo sapiens
ucugaucugugcaggguau

SEQ ID NO: 2121260 - RNA, 17 nt, Homo sapiens
aguaaaaucaaaugugc

SEQ ID NO: 2121261 - RNA, 16 nt, Homo sapiens
ugucuuggacucuagu

SEQ ID NO: 2121262 - RNA, 12 nt, Homo sapiens
uucacuuggcca

SEQ ID NO: 2121263 - RNA, 15 nt, Homo sapiens
aaggcuuugaguuaa

SEQ ID NO: 2121264 - RNA, 22 nt, Homo sapiens
cagaugaucagggauccaauau

SEQ ID NO: 2121265 - RNA, 23 nt, Homo sapiens
auguuguuguugauggcaaaaaa

SEQ ID NO: 2121266 - RNA, 16 nt, Homo sapiens
ucaccaguuuccaggu

SEQ ID NO: 2121267 - RNA, 18 nt, Homo sapiens
uaacucuguauuacagcu

SEQ ID NO: 2121268 - RNA, 13 nt, Homo sapiens
uaugaucuuggcu

SEQ ID NO: 2121269 - RNA, 21 nt, Homo sapiens
gugccacccuccucccuccaa

SEQ ID NO: 2121270 - RNA, 19 nt, Homo sapiens
uucccuagucuauucauua

SEQ ID NO: 2121271 - RNA, 21 nt, Homo sapiens
gugaaguuaaauucuccacuc

SEQ ID NO: 2121272 - RNA, 22 nt, Homo sapiens
acuuucucuuugccauuucuuc

SEQ ID NO: 2121273 - RNA, 18 nt, Homo sapiens
aaauaucugguuauauca

SEQ ID NO: 2121274 - RNA, 16 nt, Homo sapiens
ucccaguggagccaua

SEQ ID NO: 2121275 - RNA, 18 nt, Homo sapiens
ugaguugcuuuucagcug

SEQ ID NO: 2121276 - RNA, 13 nt, Homo sapiens
ccuuuuguaaaau

SEQ ID NO: 2121277 - RNA, 19 nt, Homo sapiens
acaagcccguuagccccag

SEQ ID NO: 2121278 - RNA, 20 nt, Homo sapiens
acaggccaaugcuacuuuca

SEQ ID NO: 2121279 - RNA, 15 nt, Homo sapiens
ugagcagugccucuu

SEQ ID NO: 2121280 - RNA, 17 nt, Homo sapiens
caucaacauuccaggga

SEQ ID NO: 2121281 - RNA, 13 nt, Homo sapiens
uggggaagugcgu

SEQ ID NO: 2121282 - RNA, 14 nt, Homo sapiens
cuucaaaugcgaac

SEQ ID NO: 2121283 - RNA, 14 nt, Homo sapiens
ccugaggucgucaa

SEQ ID NO: 2121284 - RNA, 13 nt, Homo sapiens
gaaaugacaacaa

SEQ ID NO: 2121285 - RNA, 13 nt, Homo sapiens
ggugggggguccc

SEQ ID NO: 2121286 - RNA, 14 nt, Homo sapiens
caaaaccgccagcu

SEQ ID NO: 2121287 - RNA, 21 nt, Homo sapiens
gagcaagcgaaagagcaaagu

SEQ ID NO: 2121288 - RNA, 20 nt, Homo sapiens
uguguguuccaaguuuccaa

SEQ ID NO: 2121289 - RNA, 21 nt, Homo sapiens
cagagcauugcuauuuaucuc

SEQ ID NO: 2121290 - RNA, 14 nt, Homo sapiens
cagaucaaauuuca

SEQ ID NO: 2121291 - RNA, 21 nt, Homo sapiens
gugugcccacccguguucucc

SEQ ID NO: 2121292 - RNA, 20 nt, Homo sapiens
gagcugcccuccuuguccac

SEQ ID NO: 2121293 - RNA, 19 nt, Homo sapiens
cacuuagguccaaggucuc

SEQ ID NO: 2121294 - RNA, 14 nt, Homo sapiens
ccaaugauggucac

SEQ ID NO: 2121295 - RNA, 13 nt, Homo sapiens
cucuccaguguuu

SEQ ID NO: 2121296 - RNA, 18 nt, Homo sapiens
auugauuucaacagaauc

SEQ ID NO: 2121297 - RNA, 22 nt, Homo sapiens
auaccuucugaacuacacugca

SEQ ID NO: 2121298 - RNA, 18 nt, Homo sapiens
uaucagaaauagauuucc

SEQ ID NO: 2121299 - RNA, 14 nt, Homo sapiens
acuccuccuagcca

SEQ ID NO: 2121300 - RNA, 16 nt, Homo sapiens
ucaccaugccaaugaa

SEQ ID NO: 2121301 - RNA, 21 nt, Homo sapiens
acagcuuucccagguauaaaa

SEQ ID NO: 2121302 - RNA, 19 nt, Homo sapiens
auagacaucaguauucugc

SEQ ID NO: 2121303 - RNA, 21 nt, Homo sapiens
auuagaaacacacuuuugcac

SEQ ID NO: 2121304 - RNA, 22 nt, Homo sapiens
cuuugccagagcgugcuuucaa

SEQ ID NO: 2121305 - RNA, 15 nt, Homo sapiens
agaagaaacagaagc

SEQ ID NO: 2121306 - RNA, 13 nt, Homo sapiens
uugcauaugcaua

SEQ ID NO: 2121307 - RNA, 18 nt, Homo sapiens
uaaucuggaauaugcaac

SEQ ID NO: 2121308 - RNA, 14 nt, Homo sapiens
aagcugggagcaca

SEQ ID NO: 2121309 - RNA, 23 nt, Homo sapiens
aaaacaagagaccacuuccuuaa

SEQ ID NO: 2121310 - RNA, 15 nt, Homo sapiens
aaucagagagcucac

SEQ ID NO: 2121311 - RNA, 19 nt, Homo sapiens
gcccucccccagcaguuga

SEQ ID NO: 2121312 - RNA, 20 nt, Homo sapiens
acucugguggcugccagcuu

SEQ ID NO: 2121313 - RNA, 22 nt, Homo sapiens
guccuuccugugcccugcaaau

SEQ ID NO: 2121314 - RNA, 20 nt, Homo sapiens
gccuccaaguccacagugga

SEQ ID NO: 2121315 - RNA, 22 nt, Homo sapiens
cuggggucaucgggaaaggcaa

SEQ ID NO: 2121316 - RNA, 15 nt, Homo sapiens
guacuaguccaucau

SEQ ID NO: 2121317 - RNA, 14 nt, Homo sapiens
gagacuuggggcca

SEQ ID NO: 2121318 - RNA, 15 nt, Homo sapiens
acucaaaugcucaga

SEQ ID NO: 2121319 - RNA, 12 nt, Homo sapiens
uuauaccaagag

SEQ ID NO: 2121320 - RNA, 19 nt, Homo sapiens
caacuguauaacuauuuac

SEQ ID NO: 2121321 - RNA, 17 nt, Homo sapiens
aguugcauugacuguca

SEQ ID NO: 2121322 - RNA, 17 nt, Homo sapiens
ugcaaauccccucccca

SEQ ID NO: 2121323 - RNA, 22 nt, Homo sapiens
ggccagugggccugguagcaca

SEQ ID NO: 2121324 - RNA, 19 nt, Homo sapiens
gcucuaagucaaauuccaa

SEQ ID NO: 2121325 - RNA, 20 nt, Homo sapiens
ugcucaguaaggcagugaau

SEQ ID NO: 2121326 - RNA, 20 nt, Homo sapiens
ucauaucauccacacaugaa

SEQ ID NO: 2121327 - RNA, 16 nt, Homo sapiens
aucaaugucacuuaaa

SEQ ID NO: 2121328 - RNA, 22 nt, Homo sapiens
agauacaugauugaaaccaagu

SEQ ID NO: 2121329 - RNA, 21 nt, Homo sapiens
auuauagaauucuguacuuga

SEQ ID NO: 2121330 - RNA, 14 nt, Homo sapiens
uucuacacauauau

SEQ ID NO: 2121331 - RNA, 22 nt, Homo sapiens
ugaugcagucuuagaucauagu

SEQ ID NO: 2121332 - RNA, 12 nt, Homo sapiens
gcugacacugug

SEQ ID NO: 2121333 - RNA, 18 nt, Homo sapiens
cuacuuccccuucuugcc

SEQ ID NO: 2121334 - RNA, 12 nt, Homo sapiens
ugggcacaagca

SEQ ID NO: 2121335 - RNA, 14 nt, Homo sapiens
ugugaauuuuacaa

SEQ ID NO: 2121336 - RNA, 20 nt, Homo sapiens
cagcagacuguguuucguga

SEQ ID NO: 2121337 - RNA, 18 nt, Homo sapiens
caggagaaacacuugaac

SEQ ID NO: 2121338 - RNA, 12 nt, Homo sapiens
agcuguggcuca

SEQ ID NO: 2121339 - RNA, 12 nt, Homo sapiens
cuguuaguauua

SEQ ID NO: 2121340 - RNA, 13 nt, Homo sapiens
cauagcacugggc

SEQ ID NO: 2121341 - RNA, 14 nt, Homo sapiens
uguugacauacauu

SEQ ID NO: 2121342 - RNA, 20 nt, Homo sapiens
acuuaaaagcuggcuuucau

SEQ ID NO: 2121343 - RNA, 16 nt, Homo sapiens
aacaauaugaaguaca

SEQ ID NO: 2121344 - RNA, 15 nt, Homo sapiens
aagauuccaaaaagc

SEQ ID NO: 2121345 - RNA, 11 nt, Homo sapiens
cccuguuugcc

SEQ ID NO: 2121346 - RNA, 17 nt, Homo sapiens
aauauuuauuaccucug

SEQ ID NO: 2121347 - RNA, 13 nt, Homo sapiens
aacccggcacugc

SEQ ID NO: 2121348 - RNA, 15 nt, Homo sapiens
ggacacaguggagcc

SEQ ID NO: 2121349 - RNA, 17 nt, Homo sapiens
uggaaucauauaguguc

SEQ ID NO: 2121350 - RNA, 12 nt, Homo sapiens
aaaaaaaagggg

SEQ ID NO: 2121351 - RNA, 18 nt, Homo sapiens
uguuccugggacuggcag

SEQ ID NO: 2121352 - RNA, 13 nt, Homo sapiens
ccucauucaucuu

SEQ ID NO: 2121353 - RNA, 22 nt, Homo sapiens
ucaaaauggaaaauuaauucua

SEQ ID NO: 2121354 - RNA, 20 nt, Homo sapiens
ucccaaagaggcuacuguaa

SEQ ID NO: 2121355 - RNA, 22 nt, Homo sapiens
uggaagaaggaagaagccagac

SEQ ID NO: 2121356 - RNA, 23 nt, Homo sapiens
aacccgagaaaacaaacccaggu

SEQ ID NO: 2121357 - RNA, 12 nt, Homo sapiens
aaugaaagugag

SEQ ID NO: 2121358 - RNA, 20 nt, Homo sapiens
uuguugagaauuguuuucuu

SEQ ID NO: 2121359 - RNA, 21 nt, Homo sapiens
guuugugaagauuuaaucuca

SEQ ID NO: 2121360 - RNA, 16 nt, Homo sapiens
agcuucggaagcaucu

SEQ ID NO: 2121361 - RNA, 22 nt, Homo sapiens
ucaaauuguccuauugugacuc

SEQ ID NO: 2121362 - RNA, 18 nt, Homo sapiens
aaucucugcucucuaugu

SEQ ID NO: 2121363 - RNA, 17 nt, Homo sapiens
cauucccucucauccag

SEQ ID NO: 2121364 - RNA, 17 nt, Homo sapiens
uuuuaacaaaucuaaaa

SEQ ID NO: 2121365 - RNA, 21 nt, Homo sapiens
acucacugaaucuaaccauag

SEQ ID NO: 2121366 - RNA, 21 nt, Homo sapiens
caucuuuucuaaucacagugu

SEQ ID NO: 2121367 - RNA, 20 nt, Homo sapiens
ucacuuauaccaaagggaaa

SEQ ID NO: 2121368 - RNA, 19 nt, Homo sapiens
cccacauguccagcaccuu

SEQ ID NO: 2121369 - RNA, 16 nt, Homo sapiens
acagaacccauuccau

SEQ ID NO: 2121370 - RNA, 17 nt, Homo sapiens
acacugaucaauuucaa

SEQ ID NO: 2121371 - RNA, 23 nt, Homo sapiens
gccuguuucuggauuugcaggug

SEQ ID NO: 2121372 - RNA, 10 nt, Homo sapiens
cauccuccag

SEQ ID NO: 2121373 - RNA, 23 nt, Homo sapiens
cagagugaccagcacacuggacu

SEQ ID NO: 2121374 - RNA, 12 nt, Homo sapiens
acucaugaacua

SEQ ID NO: 2121375 - RNA, 18 nt, Homo sapiens
ucaggacccucccaggag

SEQ ID NO: 2121376 - RNA, 14 nt, Homo sapiens
uucacccugcauua

SEQ ID NO: 2121377 - RNA, 14 nt, Homo sapiens
acuugcucagccau

SEQ ID NO: 2121378 - RNA, 20 nt, Homo sapiens
caugcuuaauaaacauguca

SEQ ID NO: 2121379 - RNA, 14 nt, Homo sapiens
caggaccaggagcc

SEQ ID NO: 2121380 - RNA, 16 nt, Homo sapiens
ucugaggacauuccaa

SEQ ID NO: 2121381 - RNA, 13 nt, Homo sapiens
uuaacugcuucaa

SEQ ID NO: 2121382 - RNA, 22 nt, Homo sapiens
caagacauuucucuaacuccug

SEQ ID NO: 2121383 - RNA, 16 nt, Homo sapiens
uauggaauauucauuu

SEQ ID NO: 2121384 - RNA, 15 nt, Homo sapiens
agggaguccagggug

SEQ ID NO: 2121385 - RNA, 22 nt, Homo sapiens
gggaagagugacucuccagggg

SEQ ID NO: 2121386 - RNA, 23 nt, Homo sapiens
acagcaaucuguguacugaacau

SEQ ID NO: 2121387 - RNA, 16 nt, Homo sapiens
ucagaaacacuggggc

SEQ ID NO: 2121388 - RNA, 16 nt, Homo sapiens
auuuuuaccuguuuaa

SEQ ID NO: 2121389 - RNA, 16 nt, Homo sapiens
ucugcagcauugaagu

SEQ ID NO: 2121390 - RNA, 20 nt, Homo sapiens
ucaacuuucagaagugccac

SEQ ID NO: 2121391 - RNA, 17 nt, Homo sapiens
gcauuauguccacugug

SEQ ID NO: 2121392 - RNA, 20 nt, Homo sapiens
uuagcuguuucucaagacca

SEQ ID NO: 2121393 - RNA, 21 nt, Homo sapiens
acuuuaaaacugcucauuuca

SEQ ID NO: 2121394 - RNA, 17 nt, Homo sapiens
ggugcacagccacuccc

SEQ ID NO: 2121395 - RNA, 15 nt, Homo sapiens
guuuacuagacuuug

SEQ ID NO: 2121396 - RNA, 17 nt, Homo sapiens
ugauccaguggacacuu

SEQ ID NO: 2121397 - RNA, 16 nt, Homo sapiens
gccucuuucacauuga

SEQ ID NO: 2121398 - RNA, 22 nt, Homo sapiens
ucaauucccacguagacucuua

SEQ ID NO: 2121399 - RNA, 22 nt, Homo sapiens
aguguucaguaaaagcaaaaug

SEQ ID NO: 2121400 - RNA, 15 nt, Homo sapiens
gcaaauaaagccuuu

SEQ ID NO: 2121401 - RNA, 17 nt, Homo sapiens
ucccucccugugccaga

SEQ ID NO: 2121402 - RNA, 19 nt, Homo sapiens
cuuuuaucuuggacugaca

SEQ ID NO: 2121403 - RNA, 19 nt, Homo sapiens
ucacaccucacugucaucu

SEQ ID NO: 2121404 - RNA, 23 nt, Homo sapiens
cacccagggagcugaugccccuu

SEQ ID NO: 2121405 - RNA, 17 nt, Homo sapiens
aucucggcucacugcaa

SEQ ID NO: 2121406 - RNA, 13 nt, Homo sapiens
acacaacaacucc

SEQ ID NO: 2121407 - RNA, 15 nt, Homo sapiens
accuagcaucuuaca

SEQ ID NO: 2121408 - RNA, 15 nt, Homo sapiens
uguuggcaagcugca

SEQ ID NO: 2121409 - RNA, 14 nt, Homo sapiens
cugcccagugccau

SEQ ID NO: 2121410 - RNA, 21 nt, Homo sapiens
cuuagacauaacaaaacacuc

SEQ ID NO: 2121411 - RNA, 12 nt, Homo sapiens
uagucugcauau

SEQ ID NO: 2121412 - RNA, 20 nt, Homo sapiens
agaaacuuuggaagcacuuu

SEQ ID NO: 2121413 - RNA, 11 nt, Homo sapiens
acaaacaaaca

SEQ ID NO: 2121414 - RNA, 23 nt, Homo sapiens
ucacauucuauuuuggguauuaa

SEQ ID NO: 2121415 - RNA, 11 nt, Homo sapiens
uaacuccucaa

SEQ ID NO: 2121416 - RNA, 16 nt, Homo sapiens
gcuauugccaaccagu

SEQ ID NO: 2121417 - RNA, 21 nt, Homo sapiens
cugugacucccccucuuucac

SEQ ID NO: 2121418 - RNA, 21 nt, Homo sapiens
aagaaauuauuuaauaugcau

SEQ ID NO: 2121419 - RNA, 15 nt, Homo sapiens
aauaaagaugugcuu

SEQ ID NO: 2121420 - RNA, 13 nt, Homo sapiens
uucucuuugccau

SEQ ID NO: 2121421 - RNA, 17 nt, Homo sapiens
uccgacgcugccucuca

SEQ ID NO: 2121422 - RNA, 20 nt, Homo sapiens
ucuuacguuuuucuggugcu

SEQ ID NO: 2121423 - RNA, 21 nt, Homo sapiens
acaagagaucuacacauguug

SEQ ID NO: 2121424 - RNA, 21 nt, Homo sapiens
aaauaucauaaucugaugaua

SEQ ID NO: 2121425 - RNA, 14 nt, Homo sapiens
ccuuuccuagcuag

SEQ ID NO: 2121426 - RNA, 19 nt, Homo sapiens
uacauuugaacuauauccu

SEQ ID NO: 2121427 - RNA, 20 nt, Homo sapiens
ccugguauuuucaaccauaa

SEQ ID NO: 2121428 - RNA, 22 nt, Homo sapiens
ugaguuuaguuuuucacuuuag

SEQ ID NO: 2121429 - RNA, 15 nt, Homo sapiens
aucaauugauauuaa

SEQ ID NO: 2121430 - RNA, 13 nt, Homo sapiens
ucuggacuuucuc

SEQ ID NO: 2121431 - RNA, 15 nt, Homo sapiens
accccaucucuacua

SEQ ID NO: 2121432 - RNA, 14 nt, Homo sapiens
caauuuuugaacaa

SEQ ID NO: 2121433 - RNA, 18 nt, Homo sapiens
ucuuugcuaguaccaaaa

SEQ ID NO: 2121434 - RNA, 14 nt, Homo sapiens
acuuccccuugcac

SEQ ID NO: 2121435 - RNA, 16 nt, Homo sapiens
uaaauauauauuauuc

SEQ ID NO: 2121436 - RNA, 17 nt, Homo sapiens
agggauagcacugagca

SEQ ID NO: 2121437 - RNA, 15 nt, Homo sapiens
ucaucugucuuucac

SEQ ID NO: 2121438 - RNA, 21 nt, Homo sapiens
uuucugggucuuuugcuacua

SEQ ID NO: 2121439 - RNA, 21 nt, Homo sapiens
cccauuccuaagaggaguuua

SEQ ID NO: 2121440 - RNA, 19 nt, Homo sapiens
ugccccacagagacacuuu

SEQ ID NO: 2121441 - RNA, 13 nt, Homo sapiens
caucucugaccag

SEQ ID NO: 2121442 - RNA, 18 nt, Homo sapiens
ccacagggugagcacucu

SEQ ID NO: 2121443 - RNA, 15 nt, Homo sapiens
cuuucgguacuguaa

SEQ ID NO: 2121444 - RNA, 14 nt, Homo sapiens
ucccagaaccacac

SEQ ID NO: 2121445 - RNA, 23 nt, Homo sapiens
cucccucagcuccgcaagcauca

SEQ ID NO: 2121446 - RNA, 15 nt, Homo sapiens
agagaugaaccacau

SEQ ID NO: 2121447 - RNA, 13 nt, Homo sapiens
agccucaccagcg

SEQ ID NO: 2121448 - RNA, 13 nt, Homo sapiens
ccacugucuuuca

SEQ ID NO: 2121449 - RNA, 17 nt, Homo sapiens
gagcccuauugcugcua

SEQ ID NO: 2121450 - RNA, 20 nt, Homo sapiens
ggaccuggggacucgggugc

SEQ ID NO: 2121451 - RNA, 16 nt, Homo sapiens
gcagcagugugcuguu

SEQ ID NO: 2121452 - RNA, 22 nt, Homo sapiens
acauugaucuguuuuacaggaa

SEQ ID NO: 2121453 - RNA, 20 nt, Homo sapiens
aaaguuggugcaucuagaaa

SEQ ID NO: 2121454 - RNA, 22 nt, Homo sapiens
ggcagagccaccugacucuugc

SEQ ID NO: 2121455 - RNA, 21 nt, Homo sapiens
ccugcugggugccaggugcug

SEQ ID NO: 2121456 - RNA, 21 nt, Homo sapiens
cauggcagcaugcgaugucau

SEQ ID NO: 2121457 - RNA, 12 nt, Homo sapiens
cuuuugcuauac

SEQ ID NO: 2121458 - RNA, 23 nt, Homo sapiens
auccuggaaaauucuauggaaua

SEQ ID NO: 2121459 - RNA, 23 nt, Homo sapiens
uaugaacuaaaaagagacugugc

SEQ ID NO: 2121460 - RNA, 17 nt, Homo sapiens
uggaaacagcaugaaua

SEQ ID NO: 2121461 - RNA, 13 nt, Homo sapiens
uucagcugcauac

SEQ ID NO: 2121462 - RNA, 16 nt, Homo sapiens
uugaauggaagcaaaa

SEQ ID NO: 2121463 - RNA, 14 nt, Homo sapiens
acuaguguuuguua

SEQ ID NO: 2121464 - RNA, 17 nt, Homo sapiens
agaaagauuucaucucc

SEQ ID NO: 2121465 - RNA, 23 nt, Homo sapiens
uugauauuucaauguuagccuca

SEQ ID NO: 2121466 - RNA, 23 nt, Homo sapiens
caguugacuuacuguuucuuacc

SEQ ID NO: 2121467 - RNA, 17 nt, Homo sapiens
cuucccaaaaacagccc

SEQ ID NO: 2121468 - RNA, 14 nt, Homo sapiens
auuuggucagcaua

SEQ ID NO: 2121469 - RNA, 18 nt, Homo sapiens
ugaggugcgcucaccuca

SEQ ID NO: 2121470 - RNA, 18 nt, Homo sapiens
aauaauugcucauaagca

SEQ ID NO: 2121471 - RNA, 16 nt, Homo sapiens
gucucuguacaugugu

SEQ ID NO: 2121472 - RNA, 18 nt, Homo sapiens
acauuggaagcuuugagu

SEQ ID NO: 2121473 - RNA, 20 nt, Homo sapiens
uaagauguuuuaauauguau

SEQ ID NO: 2121474 - RNA, 21 nt, Homo sapiens
aaggugcuuuguaauauucuc

SEQ ID NO: 2121475 - RNA, 13 nt, Homo sapiens
gccucgcacuugc

SEQ ID NO: 2121476 - RNA, 19 nt, Homo sapiens
guacacucagccacuguca

SEQ ID NO: 2121477 - RNA, 17 nt, Homo sapiens
caucacuuccuugcccc

SEQ ID NO: 2121478 - RNA, 22 nt, Homo sapiens
guaccauucucagguggugaua

SEQ ID NO: 2121479 - RNA, 22 nt, Homo sapiens
uuguuuaauuuuuauuucuucc

SEQ ID NO: 2121480 - RNA, 22 nt, Homo sapiens
ucaagaagaagaggggcauaaa

SEQ ID NO: 2121481 - RNA, 14 nt, Homo sapiens
cgcgcacuccagcg

SEQ ID NO: 2121482 - RNA, 12 nt, Homo sapiens
ccaagcuuucuu

SEQ ID NO: 2121483 - RNA, 15 nt, Homo sapiens
accagagacuuuagg

SEQ ID NO: 2121484 - RNA, 17 nt, Homo sapiens
cagaguaauccaagcaa

SEQ ID NO: 2121485 - RNA, 18 nt, Homo sapiens
ugggguuggaacauuuca

SEQ ID NO: 2121486 - RNA, 17 nt, Homo sapiens
uuuaucaauaaagcacu

SEQ ID NO: 2121487 - RNA, 12 nt, Homo sapiens
cagguucuugcc

SEQ ID NO: 2121488 - RNA, 21 nt, Homo sapiens
ugcccccucccccaugggcug

SEQ ID NO: 2121489 - RNA, 21 nt, Homo sapiens
uggaaccaaucccgugaaaga

SEQ ID NO: 2121490 - RNA, 22 nt, Homo sapiens
aaugcuguuuuaaaaacaaaga

SEQ ID NO: 2121491 - RNA, 22 nt, Homo sapiens
gauggaauauuccccuaucucu

SEQ ID NO: 2121492 - RNA, 17 nt, Homo sapiens
aauguccuuucauuugu

SEQ ID NO: 2121493 - RNA, 15 nt, Homo sapiens
uguuauaauuauucc

SEQ ID NO: 2121494 - RNA, 14 nt, Homo sapiens
gauagaacuacuuu

SEQ ID NO: 2121495 - RNA, 15 nt, Homo sapiens
uaucuuguguaugga

SEQ ID NO: 2121496 - RNA, 23 nt, Homo sapiens
uaagaagcaauaacuauuuuucc

SEQ ID NO: 2121497 - RNA, 12 nt, Homo sapiens
aaucaguuuaaa

SEQ ID NO: 2121498 - RNA, 21 nt, Homo sapiens
auauaaccauaaaucaauuca

SEQ ID NO: 2121499 - RNA, 18 nt, Homo sapiens
agggaugggaccugauga

SEQ ID NO: 2121500 - RNA, 14 nt, Homo sapiens
gcugagugggagaa

SEQ ID NO: 2121501 - RNA, 21 nt, Homo sapiens
cacaauuauuggcaaaguuua

SEQ ID NO: 2121502 - RNA, 18 nt, Homo sapiens
aaugcacaaaacuuugau

SEQ ID NO: 2121503 - RNA, 13 nt, Homo sapiens
uauugauuucaag

SEQ ID NO: 2121504 - RNA, 18 nt, Homo sapiens
uuuauccagccgagcuua

SEQ ID NO: 2121505 - RNA, 21 nt, Homo sapiens
cccugaaauugcauauaugua

SEQ ID NO: 2121506 - RNA, 17 nt, Homo sapiens
cucuagagucacugaua

SEQ ID NO: 2121507 - RNA, 13 nt, Homo sapiens
cugacaauugcaa

SEQ ID NO: 2121508 - RNA, 19 nt, Homo sapiens
cagacuguucuuacuguaa

SEQ ID NO: 2121509 - RNA, 14 nt, Homo sapiens
ugagagaagggaau

SEQ ID NO: 2121510 - RNA, 22 nt, Homo sapiens
uuuaugguauuugagugugcaa

SEQ ID NO: 2121511 - RNA, 19 nt, Homo sapiens
uucaggguuauacacagaa

SEQ ID NO: 2121512 - RNA, 14 nt, Homo sapiens
uuugaccccuuaca

SEQ ID NO: 2121513 - RNA, 16 nt, Homo sapiens
acucugcucuaugcca

SEQ ID NO: 2121514 - RNA, 19 nt, Homo sapiens
aaagaaggcauggacuucu

SEQ ID NO: 2121515 - RNA, 16 nt, Homo sapiens
guuuaaccuguuuuca

SEQ ID NO: 2121516 - RNA, 18 nt, Homo sapiens
cugcagcuuuacugccuu

SEQ ID NO: 2121517 - RNA, 21 nt, Homo sapiens
caaaucauucaaaacuuucag

SEQ ID NO: 2121518 - RNA, 19 nt, Homo sapiens
caaacugcaugcccagaga

SEQ ID NO: 2121519 - RNA, 15 nt, Homo sapiens
ucucgacucacugca

SEQ ID NO: 2121520 - RNA, 15 nt, Homo sapiens
ugagagcugcuuuga

SEQ ID NO: 2121521 - RNA, 20 nt, Homo sapiens
uccucagauccccagcuuuc

SEQ ID NO: 2121522 - RNA, 24 nt, Homo sapiens
uaaaguauuuaucuccugucuaca

SEQ ID NO: 2121523 - RNA, 21 nt, Homo sapiens
agaggaaauucaaaucccuuu

SEQ ID NO: 2121524 - RNA, 14 nt, Homo sapiens
caggagaguagcaa

SEQ ID NO: 2121525 - RNA, 16 nt, Homo sapiens
acauuuaucaaucuga

SEQ ID NO: 2121526 - RNA, 16 nt, Homo sapiens
cuccagcaucaauucc

SEQ ID NO: 2121527 - RNA, 15 nt, Homo sapiens
ccaaagugacacaga

SEQ ID NO: 2121528 - RNA, 20 nt, Homo sapiens
caggagguggagguugcagu

SEQ ID NO: 2121529 - RNA, 14 nt, Homo sapiens
uaaacaaagcagua

SEQ ID NO: 2121530 - RNA, 23 nt, Homo sapiens
aaucuguugauaaauccaucacu

SEQ ID NO: 2121531 - RNA, 13 nt, Homo sapiens
cccuguauuuauu

SEQ ID NO: 2121532 - RNA, 16 nt, Homo sapiens
uucacaugccuauaau

SEQ ID NO: 2121533 - RNA, 23 nt, Homo sapiens
aaauauuucccauuugugccaga

SEQ ID NO: 2121534 - RNA, 15 nt, Homo sapiens
ccacugcugcugcag

SEQ ID NO: 2121535 - RNA, 17 nt, Homo sapiens
gugcaucuggcacgugg

SEQ ID NO: 2121536 - RNA, 18 nt, Homo sapiens
aggaauaggcaaaauguu

SEQ ID NO: 2121537 - RNA, 17 nt, Homo sapiens
uacuuuguccuaagaga

SEQ ID NO: 2121538 - RNA, 19 nt, Homo sapiens
aggauacuugcuccauuca

SEQ ID NO: 2121539 - RNA, 21 nt, Homo sapiens
uuucgcacaaugggaaucucu

SEQ ID NO: 2121540 - RNA, 17 nt, Homo sapiens
ugcccaacccuauccca

SEQ ID NO: 2121541 - RNA, 20 nt, Homo sapiens
uucaugaaugugcuggugaa

SEQ ID NO: 2121542 - RNA, 21 nt, Homo sapiens
ccauaggaaggcacuacauga

SEQ ID NO: 2121543 - RNA, 16 nt, Homo sapiens
caggugucaccaucau

SEQ ID NO: 2121544 - RNA, 16 nt, Homo sapiens
gaaaagggcaaaaaga

SEQ ID NO: 2121545 - RNA, 16 nt, Homo sapiens
cccugggggccugaga

SEQ ID NO: 2121546 - RNA, 20 nt, Homo sapiens
uacugugucauaaacagaug

SEQ ID NO: 2121547 - RNA, 23 nt, Homo sapiens
accuagauugcaccauugcacuc

SEQ ID NO: 2121548 - RNA, 23 nt, Homo sapiens
uacuaagccacaagaaauuugau

SEQ ID NO: 2121549 - RNA, 14 nt, Homo sapiens
ggcagguuugccag

SEQ ID NO: 2121550 - RNA, 16 nt, Homo sapiens
uaguuagugauuauau

SEQ ID NO: 2121551 - RNA, 19 nt, Homo sapiens
ucaggaaauacaccuggac

SEQ ID NO: 2121552 - RNA, 19 nt, Homo sapiens
cacuucccugggccucaac

SEQ ID NO: 2121553 - RNA, 23 nt, Homo sapiens
aucaucccucccugccuaaggaa

SEQ ID NO: 2121554 - RNA, 12 nt, Homo sapiens
cuguccuaggcc

SEQ ID NO: 2121555 - RNA, 22 nt, Homo sapiens
uccuugaggucuugaguuucau

SEQ ID NO: 2121556 - RNA, 13 nt, Homo sapiens
ccaacaccacaga

SEQ ID NO: 2121557 - RNA, 14 nt, Homo sapiens
uugccagacuggag

SEQ ID NO: 2121558 - RNA, 18 nt, Homo sapiens
ggcaggagaaucacuuga

SEQ ID NO: 2121559 - RNA, 16 nt, Homo sapiens
gcagucuuauuuccaa

SEQ ID NO: 2121560 - RNA, 15 nt, Homo sapiens
gcuggaguacgugaa

SEQ ID NO: 2121561 - RNA, 23 nt, Homo sapiens
agaaucugcugcauagcucuauu

SEQ ID NO: 2121562 - RNA, 21 nt, Homo sapiens
agccuacugucuccuucccac

SEQ ID NO: 2121563 - RNA, 15 nt, Homo sapiens
gacauugacagcaau

SEQ ID NO: 2121564 - RNA, 14 nt, Homo sapiens
gaggcucacacugu

SEQ ID NO: 2121565 - RNA, 16 nt, Homo sapiens
cauuguuaaauacaca

SEQ ID NO: 2121566 - RNA, 14 nt, Homo sapiens
cugagagaccugcc

SEQ ID NO: 2121567 - RNA, 16 nt, Homo sapiens
ucgcaucucagugcag

SEQ ID NO: 2121568 - RNA, 21 nt, Homo sapiens
ucuuccuugaggggcaguuug

SEQ ID NO: 2121569 - RNA, 15 nt, Homo sapiens
uauuuguacaaaaaa

SEQ ID NO: 2121570 - RNA, 23 nt, Homo sapiens
cagcuguccccccacucccucac

SEQ ID NO: 2121571 - RNA, 13 nt, Homo sapiens
acccauaugggaa

SEQ ID NO: 2121572 - RNA, 19 nt, Homo sapiens
auagcuugcauagucaaua

SEQ ID NO: 2121573 - RNA, 16 nt, Homo sapiens
gcauuggccucuguac

SEQ ID NO: 2121574 - RNA, 17 nt, Homo sapiens
auugucccacaauauua

SEQ ID NO: 2121575 - RNA, 12 nt, Homo sapiens
aaaccauucuag

SEQ ID NO: 2121576 - RNA, 18 nt, Homo sapiens
ccuuggaaaguucagcca

SEQ ID NO: 2121577 - RNA, 15 nt, Homo sapiens
augccucgaccugcc

SEQ ID NO: 2121578 - RNA, 21 nt, Homo sapiens
uagugaccccugccuacuucc

SEQ ID NO: 2121579 - RNA, 18 nt, Homo sapiens
gcccacggcucaagugaa

SEQ ID NO: 2121580 - RNA, 14 nt, Homo sapiens
uauauaaccucaaa

SEQ ID NO: 2121581 - RNA, 15 nt, Homo sapiens
cucuaacucacugcc

SEQ ID NO: 2121582 - RNA, 17 nt, Homo sapiens
caggccuuugagcucag

SEQ ID NO: 2121583 - RNA, 20 nt, Homo sapiens
uguggacguggguugcacug

SEQ ID NO: 2121584 - RNA, 21 nt, Homo sapiens
gguucacacccuguuuuauaa

SEQ ID NO: 2121585 - RNA, 16 nt, Homo sapiens
caggccucucuucaca

SEQ ID NO: 2121586 - RNA, 21 nt, Homo sapiens
aaaaauguaucugugugugau

SEQ ID NO: 2121587 - RNA, 21 nt, Homo sapiens
ggacccgucuccagcugcuga

SEQ ID NO: 2121588 - RNA, 16 nt, Homo sapiens
cuaguccugacacuga

SEQ ID NO: 2121589 - RNA, 23 nt, Homo sapiens
gggaggguggugggcccagacca

SEQ ID NO: 2121590 - RNA, 13 nt, Homo sapiens
caggugacaugaa

SEQ ID NO: 2121591 - RNA, 21 nt, Homo sapiens
uccccaacauggauguguugc

SEQ ID NO: 2121592 - RNA, 24 nt, Homo sapiens
ucuaaacauuuugggguuagaccu

SEQ ID NO: 2121593 - RNA, 16 nt, Homo sapiens
aaaguaaugcuucaau

SEQ ID NO: 2121594 - RNA, 16 nt, Homo sapiens
uuuuuguacuuuggaa

SEQ ID NO: 2121595 - RNA, 16 nt, Homo sapiens
gccuuuagaaauuaua

SEQ ID NO: 2121596 - RNA, 17 nt, Homo sapiens
gagaacaugcuggugaa

SEQ ID NO: 2121597 - RNA, 21 nt, Homo sapiens
gacggcugcucgaagaacaau

SEQ ID NO: 2121598 - RNA, 15 nt, Homo sapiens
agagggaacuaagca

SEQ ID NO: 2121599 - RNA, 23 nt, Homo sapiens
acucaaaaggagaacugugcucu

SEQ ID NO: 2121600 - RNA, 23 nt, Homo sapiens
gccaugagaaaagggaagccgcc

SEQ ID NO: 2121601 - RNA, 20 nt, Homo sapiens
caaauggacauaggacucaa

SEQ ID NO: 2121602 - RNA, 18 nt, Homo sapiens
agugagaacccagcuguc

SEQ ID NO: 2121603 - RNA, 17 nt, Homo sapiens
ugccugugccaggugag

SEQ ID NO: 2121604 - RNA, 22 nt, Homo sapiens
ugauuaaagaaaauaugcauaa

SEQ ID NO: 2121605 - RNA, 18 nt, Homo sapiens
caccuuccugacugggaa

SEQ ID NO: 2121606 - RNA, 15 nt, Homo sapiens
ugaaugaauaaagca

SEQ ID NO: 2121607 - RNA, 13 nt, Homo sapiens
acuaaacuucuua

SEQ ID NO: 2121608 - RNA, 13 nt, Homo sapiens
uggggcccagugc

SEQ ID NO: 2121609 - RNA, 19 nt, Homo sapiens
cugugggucguagagccuu

SEQ ID NO: 2121610 - RNA, 21 nt, Homo sapiens
cauacacacauaugucauaua

SEQ ID NO: 2121611 - RNA, 16 nt, Homo sapiens
uaagaauguacaguug

SEQ ID NO: 2121612 - RNA, 19 nt, Homo sapiens
uucagaaaucaaacugcuu

SEQ ID NO: 2121613 - RNA, 17 nt, Homo sapiens
cuaaggaagcuaaaagc

SEQ ID NO: 2121614 - RNA, 14 nt, Homo sapiens
agccuuauccucug

SEQ ID NO: 2121615 - RNA, 18 nt, Homo sapiens
cacugauauucagaauua

SEQ ID NO: 2121616 - RNA, 18 nt, Homo sapiens
aggcagaggcuggcacca

SEQ ID NO: 2121617 - RNA, 17 nt, Homo sapiens
acaccagaagugccaug

SEQ ID NO: 2121618 - RNA, 12 nt, Homo sapiens
gcucugagccaa

SEQ ID NO: 2121619 - RNA, 14 nt, Homo sapiens
ugagauacauacag

SEQ ID NO: 2121620 - RNA, 13 nt, Homo sapiens
ggcagagcuuuua

SEQ ID NO: 2121621 - RNA, 13 nt, Homo sapiens
ggcauucuucuaa

SEQ ID NO: 2121622 - RNA, 19 nt, Homo sapiens
acuacaggaggaaugcacc

SEQ ID NO: 2121623 - RNA, 17 nt, Homo sapiens
aaagucagaucuggucu

SEQ ID NO: 2121624 - RNA, 18 nt, Homo sapiens
acacuguugucaaaaagu

SEQ ID NO: 2121625 - RNA, 20 nt, Homo sapiens
ccucccagugugcugggauu

SEQ ID NO: 2121626 - RNA, 15 nt, Homo sapiens
auaaaugccccaaag

SEQ ID NO: 2121627 - RNA, 21 nt, Homo sapiens
aacuggaggaguuccuugauc

SEQ ID NO: 2121628 - RNA, 16 nt, Homo sapiens
ccguaccccacccuca

SEQ ID NO: 2121629 - RNA, 21 nt, Homo sapiens
aaccaguccgccgcugcacau

SEQ ID NO: 2121630 - RNA, 21 nt, Homo sapiens
cuaugguuuuucugugucaau

SEQ ID NO: 2121631 - RNA, 21 nt, Homo sapiens
ucccaacuacgcugauuugau

SEQ ID NO: 2121632 - RNA, 18 nt, Homo sapiens
uggaaauccuguuacuua

SEQ ID NO: 2121633 - RNA, 17 nt, Homo sapiens
augcaacaggcacucaa

SEQ ID NO: 2121634 - RNA, 17 nt, Homo sapiens
uacagaaaauagcuuuu

SEQ ID NO: 2121635 - RNA, 19 nt, Homo sapiens
ucuuaaauuugauuuacau

SEQ ID NO: 2121636 - RNA, 22 nt, Homo sapiens
cagagccucggcccuagcauug

SEQ ID NO: 2121637 - RNA, 14 nt, Homo sapiens
accccucacuguga

SEQ ID NO: 2121638 - RNA, 23 nt, Homo sapiens
aguacaccccaacagcacccucu

SEQ ID NO: 2121639 - RNA, 16 nt, Homo sapiens
gguucagacacagcuc

SEQ ID NO: 2121640 - RNA, 19 nt, Homo sapiens
aucucgccacugcacucca

SEQ ID NO: 2121641 - RNA, 16 nt, Homo sapiens
ccccugguguguagcu

SEQ ID NO: 2121642 - RNA, 18 nt, Homo sapiens
gccacugagcggcuaaau

SEQ ID NO: 2121643 - RNA, 16 nt, Homo sapiens
ugaguauuaaguagua

SEQ ID NO: 2121644 - RNA, 16 nt, Homo sapiens
acuugcuuuaugccuu

SEQ ID NO: 2121645 - RNA, 18 nt, Homo sapiens
uugguuuuggggguguga

SEQ ID NO: 2121646 - RNA, 18 nt, Homo sapiens
ugaagccggacagcugcc

SEQ ID NO: 2121647 - RNA, 14 nt, Homo sapiens
cuuugccacagauu

SEQ ID NO: 2121648 - RNA, 19 nt, Homo sapiens
ccaagccuggcaagggaau

SEQ ID NO: 2121649 - RNA, 21 nt, Homo sapiens
agggauuuuuuuuuucagggc

SEQ ID NO: 2121650 - RNA, 16 nt, Homo sapiens
gacaaagaugauuuaa

SEQ ID NO: 2121651 - RNA, 13 nt, Homo sapiens
uaaaagaaaugca

SEQ ID NO: 2121652 - RNA, 12 nt, Homo sapiens
cccagugcaaac

SEQ ID NO: 2121653 - RNA, 16 nt, Homo sapiens
cuguuguuuuggcuca

SEQ ID NO: 2121654 - RNA, 17 nt, Homo sapiens
acuaugaaugggcaaaa

SEQ ID NO: 2121655 - RNA, 12 nt, Homo sapiens
agacacugcaca

SEQ ID NO: 2121656 - RNA, 12 nt, Homo sapiens
caacacugagca

SEQ ID NO: 2121657 - RNA, 14 nt, Homo sapiens
ccccaugcacucaa

SEQ ID NO: 2121658 - RNA, 13 nt, Homo sapiens
ugcagccacuggc

SEQ ID NO: 2121659 - RNA, 18 nt, Homo sapiens
uccacccccaagcacucc

SEQ ID NO: 2121660 - RNA, 21 nt, Homo sapiens
cgcuggcuuugggaaagccca

SEQ ID NO: 2121661 - RNA, 21 nt, Homo sapiens
uuguaacgacuucuccaucuc

SEQ ID NO: 2121662 - RNA, 23 nt, Homo sapiens
uaagguguugguguauuugccag

SEQ ID NO: 2121663 - RNA, 17 nt, Homo sapiens
auaacauuuuauacaau

SEQ ID NO: 2121664 - RNA, 20 nt, Homo sapiens
uucacccagagccagugugg

SEQ ID NO: 2121665 - RNA, 21 nt, Homo sapiens
uggaagcacuuuuucugcaua

SEQ ID NO: 2121666 - RNA, 18 nt, Homo sapiens
gccuccuucuuaacucug

SEQ ID NO: 2121667 - RNA, 20 nt, Homo sapiens
caggagcagcuggcacugac

SEQ ID NO: 2121668 - RNA, 15 nt, Homo sapiens
uuaaaaaaucuguug

SEQ ID NO: 2121669 - RNA, 20 nt, Homo sapiens
ucucccugucacacacugga

SEQ ID NO: 2121670 - RNA, 21 nt, Homo sapiens
uccucaaacacacaaacuauu

SEQ ID NO: 2121671 - RNA, 13 nt, Homo sapiens
gcacuauuuccac

SEQ ID NO: 2121672 - RNA, 11 nt, Homo sapiens
aguaucuauau

SEQ ID NO: 2121673 - RNA, 22 nt, Homo sapiens
gaccuucuaggaagcuccaguu

SEQ ID NO: 2121674 - RNA, 19 nt, Homo sapiens
cccaggcaguaccauucag

SEQ ID NO: 2121675 - RNA, 23 nt, Homo sapiens
gagcccacgcccccacuggugac

SEQ ID NO: 2121676 - RNA, 17 nt, Homo sapiens
aucagggggaagaagca

SEQ ID NO: 2121677 - RNA, 17 nt, Homo sapiens
caagaaaguauuuggua

SEQ ID NO: 2121678 - RNA, 19 nt, Homo sapiens
cuagaauuuucucccuuua

SEQ ID NO: 2121679 - RNA, 15 nt, Homo sapiens
uuguacugauauaau

SEQ ID NO: 2121680 - RNA, 20 nt, Homo sapiens
uuuauaugauuaaauuauca

SEQ ID NO: 2121681 - RNA, 15 nt, Homo sapiens
aaggcugcagauaac

SEQ ID NO: 2121682 - RNA, 18 nt, Homo sapiens
ucccaaucccauuccugg

SEQ ID NO: 2121683 - RNA, 21 nt, Homo sapiens
uccaacugcugccccaaagga

SEQ ID NO: 2121684 - RNA, 15 nt, Homo sapiens
auuacaguauugcua

SEQ ID NO: 2121685 - RNA, 20 nt, Homo sapiens
ucuugaaagaggcacgcauu

SEQ ID NO: 2121686 - RNA, 21 nt, Homo sapiens
uucaugaaaagauuaugaucu

SEQ ID NO: 2121687 - RNA, 24 nt, Homo sapiens
uucaaacagaacugcagucagcau

SEQ ID NO: 2121688 - RNA, 13 nt, Homo sapiens
cugguguucacca

SEQ ID NO: 2121689 - RNA, 13 nt, Homo sapiens
aaaaugagugcuu

SEQ ID NO: 2121690 - RNA, 23 nt, Homo sapiens
uuuuuccugcauguucugugacu

SEQ ID NO: 2121691 - RNA, 18 nt, Homo sapiens
ucgggaguucgagaccag

SEQ ID NO: 2121692 - RNA, 15 nt, Homo sapiens
ccaucugccugccaa

SEQ ID NO: 2121693 - RNA, 21 nt, Homo sapiens
ucaaacuccugaccucaggug

SEQ ID NO: 2121694 - RNA, 14 nt, Homo sapiens
ggccacaacuacac

SEQ ID NO: 2121695 - RNA, 12 nt, Homo sapiens
ccguccaagaac

SEQ ID NO: 2121696 - RNA, 20 nt, Homo sapiens
aaccuauggaaguuguugcu

SEQ ID NO: 2121697 - RNA, 13 nt, Homo sapiens
acuuccauuugcu

SEQ ID NO: 2121698 - RNA, 19 nt, Homo sapiens
ucuguuugauacaguauua

SEQ ID NO: 2121699 - RNA, 19 nt, Homo sapiens
cuuuuuccccuugauggaa

SEQ ID NO: 2121700 - RNA, 17 nt, Homo sapiens
ugauugguguugccagu

SEQ ID NO: 2121701 - RNA, 17 nt, Homo sapiens
cuugugguuauaacuua

SEQ ID NO: 2121702 - RNA, 19 nt, Homo sapiens
cacuacacuccagccugag

SEQ ID NO: 2121703 - RNA, 19 nt, Homo sapiens
uuugaccucauuuguaaaa

SEQ ID NO: 2121704 - RNA, 22 nt, Homo sapiens
uaaccagauggaacacuggaac

SEQ ID NO: 2121705 - RNA, 14 nt, Homo sapiens
uccaguauaaccag

SEQ ID NO: 2121706 - RNA, 23 nt, Homo sapiens
aauuuuauguuuaguugcacaaa

SEQ ID NO: 2121707 - RNA, 20 nt, Homo sapiens
gaauucuaggcagcaccuua

SEQ ID NO: 2121708 - RNA, 21 nt, Homo sapiens
cucuaacgugauaaaccugcu

SEQ ID NO: 2121709 - RNA, 15 nt, Homo sapiens
augcagcuauuucaa

SEQ ID NO: 2121710 - RNA, 22 nt, Homo sapiens
cagugaaagacaagcugcaaau

SEQ ID NO: 2121711 - RNA, 20 nt, Homo sapiens
agguaacuagcugagcacua

SEQ ID NO: 2121712 - RNA, 18 nt, Homo sapiens
cagccccgggcacccgcc

SEQ ID NO: 2121713 - RNA, 21 nt, Homo sapiens
agucaauauaccaugacauga

SEQ ID NO: 2121714 - RNA, 15 nt, Homo sapiens
uauuuaaacaacagc

SEQ ID NO: 2121715 - RNA, 22 nt, Homo sapiens
gcccagacgcagcugagucgga

SEQ ID NO: 2121716 - RNA, 17 nt, Homo sapiens
acucaggaggcugaggc

SEQ ID NO: 2121717 - RNA, 18 nt, Homo sapiens
uggaaaugacccaaacau

SEQ ID NO: 2121718 - RNA, 15 nt, Homo sapiens
cauuguuggcgcuga

SEQ ID NO: 2121719 - RNA, 20 nt, Homo sapiens
agcuuguccagguugaucuu

SEQ ID NO: 2121720 - RNA, 13 nt, Homo sapiens
agagcauaggguc

SEQ ID NO: 2121721 - RNA, 23 nt, Homo sapiens
ccuucugcuaugacaaaaccuuu

SEQ ID NO: 2121722 - RNA, 18 nt, Homo sapiens
ggaugucugaacuuuggg

SEQ ID NO: 2121723 - RNA, 21 nt, Homo sapiens
gccugcaauuucauaugcugu

SEQ ID NO: 2121724 - RNA, 14 nt, Homo sapiens
gaguccaaagaagg

SEQ ID NO: 2121725 - RNA, 23 nt, Homo sapiens
gcaguauccaauaggcauuugau

SEQ ID NO: 2121726 - RNA, 15 nt, Homo sapiens
cagcuggucuucagc

SEQ ID NO: 2121727 - RNA, 17 nt, Homo sapiens
cugccacucaaugggag

SEQ ID NO: 2121728 - RNA, 12 nt, Homo sapiens
ugucagcacugu

SEQ ID NO: 2121729 - RNA, 21 nt, Homo sapiens
cuacucacacaggcauuuccu

SEQ ID NO: 2121730 - RNA, 23 nt, Homo sapiens
uccacaccaguaauaaaaagcca

SEQ ID NO: 2121731 - RNA, 15 nt, Homo sapiens
acucccacuuggcau

SEQ ID NO: 2121732 - RNA, 11 nt, Homo sapiens
acagcauuaaa

SEQ ID NO: 2121733 - RNA, 22 nt, Homo sapiens
uuaaaaggcaguugcuguggaa

SEQ ID NO: 2121734 - RNA, 22 nt, Homo sapiens
ccuucaccucacugaaaacauc

SEQ ID NO: 2121735 - RNA, 17 nt, Homo sapiens
aaccucuaccagcacau

SEQ ID NO: 2121736 - RNA, 19 nt, Homo sapiens
uguucacaacagugaaaag

SEQ ID NO: 2121737 - RNA, 19 nt, Homo sapiens
gacaacacguuacuagcag

SEQ ID NO: 2121738 - RNA, 14 nt, Homo sapiens
accaaauuacaagu

SEQ ID NO: 2121739 - RNA, 22 nt, Homo sapiens
gugaguagcugcauuccuagaa

SEQ ID NO: 2121740 - RNA, 17 nt, Homo sapiens
uccucauuguaaacaaa

SEQ ID NO: 2121741 - RNA, 15 nt, Homo sapiens
uauuuagugaacuac

SEQ ID NO: 2121742 - RNA, 21 nt, Homo sapiens
ccucugagggaaagcccagaa

SEQ ID NO: 2121743 - RNA, 15 nt, Homo sapiens
uggcauuugcaauaa

SEQ ID NO: 2121744 - RNA, 20 nt, Homo sapiens
gguaagagucacaauuugca

SEQ ID NO: 2121745 - RNA, 22 nt, Homo sapiens
acauguaaagcuguuaaaauac

SEQ ID NO: 2121746 - RNA, 15 nt, Homo sapiens
ggagcagcagccagc

SEQ ID NO: 2121747 - RNA, 13 nt, Homo sapiens
gcugcaucuucca

SEQ ID NO: 2121748 - RNA, 19 nt, Homo sapiens
accaauuagcauuccauca

SEQ ID NO: 2121749 - RNA, 17 nt, Homo sapiens
ugcuaagguucuaaggc

SEQ ID NO: 2121750 - RNA, 17 nt, Homo sapiens
ggucaagaguucaagac

SEQ ID NO: 2121751 - RNA, 20 nt, Homo sapiens
gaacaucucaugugugcuca

SEQ ID NO: 2121752 - RNA, 20 nt, Homo sapiens
uuccacuggaaaaguguaau

SEQ ID NO: 2121753 - RNA, 17 nt, Homo sapiens
uuagaagaaaaaaccac

SEQ ID NO: 2121754 - RNA, 13 nt, Homo sapiens
uauccaugcaccu

SEQ ID NO: 2121755 - RNA, 19 nt, Homo sapiens
uacaagugauaauacagau

SEQ ID NO: 2121756 - RNA, 17 nt, Homo sapiens
uuggccagcgucuugcu

SEQ ID NO: 2121757 - RNA, 18 nt, Homo sapiens
uucgcagugcccagugau

SEQ ID NO: 2121758 - RNA, 18 nt, Homo sapiens
ccugccugucugaagcca

SEQ ID NO: 2121759 - RNA, 15 nt, Homo sapiens
ucaagagcacacaga

SEQ ID NO: 2121760 - RNA, 16 nt, Homo sapiens
gaugauggaugccaau

SEQ ID NO: 2121761 - RNA, 16 nt, Homo sapiens
gaacauugccuuccuc

SEQ ID NO: 2121762 - RNA, 18 nt, Homo sapiens
gugagacagcucugcaua

SEQ ID NO: 2121763 - RNA, 13 nt, Homo sapiens
gcaccagcauuug

SEQ ID NO: 2121764 - RNA, 23 nt, Homo sapiens
uaaacagcaggguuugagcacaa

SEQ ID NO: 2121765 - RNA, 15 nt, Homo sapiens
augcauauuacugua

SEQ ID NO: 2121766 - RNA, 23 nt, Homo sapiens
uucacuuuuggcaaugacucaaa

SEQ ID NO: 2121767 - RNA, 12 nt, Homo sapiens
caaacaugccag

SEQ ID NO: 2121768 - RNA, 23 nt, Homo sapiens
aacagccuaaucccgugccccuu

SEQ ID NO: 2121769 - RNA, 18 nt, Homo sapiens
uggggccccaaagcccag

SEQ ID NO: 2121770 - RNA, 19 nt, Homo sapiens
aaauugcuccuaacuccac

SEQ ID NO: 2121771 - RNA, 15 nt, Homo sapiens
auucaauaaaaaccu

SEQ ID NO: 2121772 - RNA, 17 nt, Homo sapiens
uggguaauuaaaaacag

SEQ ID NO: 2121773 - RNA, 12 nt, Homo sapiens
agcagcauccac

SEQ ID NO: 2121774 - RNA, 22 nt, Homo sapiens
cagagaugcauuuggaacagug

SEQ ID NO: 2121775 - RNA, 15 nt, Homo sapiens
acuaaauaagcuucc

SEQ ID NO: 2121776 - RNA, 16 nt, Homo sapiens
cugacuguugccuuug

SEQ ID NO: 2121777 - RNA, 16 nt, Homo sapiens
aagccauguuuccucu

SEQ ID NO: 2121778 - RNA, 21 nt, Homo sapiens
gcacuguggcccuucugucca

SEQ ID NO: 2121779 - RNA, 14 nt, Homo sapiens
agaggacacaucuc

SEQ ID NO: 2121780 - RNA, 17 nt, Homo sapiens
aaggagaacuauccaaa

SEQ ID NO: 2121781 - RNA, 17 nt, Homo sapiens
cucuacuccuaccucag

SEQ ID NO: 2121782 - RNA, 11 nt, Homo sapiens
augugagauac

SEQ ID NO: 2121783 - RNA, 18 nt, Homo sapiens
guugagaaacaguuccau

SEQ ID NO: 2121784 - RNA, 20 nt, Homo sapiens
cagagucaacuguucccaua

SEQ ID NO: 2121785 - RNA, 22 nt, Homo sapiens
agaaacgcagauugggcuggcu

SEQ ID NO: 2121786 - RNA, 19 nt, Homo sapiens
ggcaguauuuuguguccuc

SEQ ID NO: 2121787 - RNA, 23 nt, Homo sapiens
uggauuggaaugcagaggucucc

SEQ ID NO: 2121788 - RNA, 20 nt, Homo sapiens
agaucaaggaguacaaugcc

SEQ ID NO: 2121789 - RNA, 13 nt, Homo sapiens
aucuggucacuuu

SEQ ID NO: 2121790 - RNA, 12 nt, Homo sapiens
caagacuuugac

SEQ ID NO: 2121791 - RNA, 15 nt, Homo sapiens
cagaugaaaagcuac

SEQ ID NO: 2121792 - RNA, 14 nt, Homo sapiens
auucucugccuuua

SEQ ID NO: 2121793 - RNA, 17 nt, Homo sapiens
aguagugcaccaucuca

SEQ ID NO: 2121794 - RNA, 23 nt, Homo sapiens
ugauuggaccaggccauucugcc

SEQ ID NO: 2121795 - RNA, 16 nt, Homo sapiens
cuugggagauucaugc

SEQ ID NO: 2121796 - RNA, 17 nt, Homo sapiens
gucaggggaacagagaa

SEQ ID NO: 2121797 - RNA, 14 nt, Homo sapiens
aaugaaccacaaaa

SEQ ID NO: 2121798 - RNA, 20 nt, Homo sapiens
agaauucauuccccagcucc

SEQ ID NO: 2121799 - RNA, 21 nt, Homo sapiens
aacgaauggucuuugcuccag

SEQ ID NO: 2121800 - RNA, 18 nt, Homo sapiens
agccggggugggugugcu

SEQ ID NO: 2121801 - RNA, 14 nt, Homo sapiens
ugucuccuaccucu

SEQ ID NO: 2121802 - RNA, 16 nt, Homo sapiens
ccguguuggauuuccg

SEQ ID NO: 2121803 - RNA, 23 nt, Homo sapiens
cuaacauaccguuuauaaugcca

SEQ ID NO: 2121804 - RNA, 21 nt, Homo sapiens
agagcagccugcugcucucag

SEQ ID NO: 2121805 - RNA, 15 nt, Homo sapiens
acuuuaagugaaaga

SEQ ID NO: 2121806 - RNA, 17 nt, Homo sapiens
cacccuucugcuguaua

SEQ ID NO: 2121807 - RNA, 15 nt, Homo sapiens
cugugaccucaggca

SEQ ID NO: 2121808 - RNA, 23 nt, Homo sapiens
aguacugguuuuccaacuuaaua

SEQ ID NO: 2121809 - RNA, 16 nt, Homo sapiens
ucauucauaguaguua

SEQ ID NO: 2121810 - RNA, 14 nt, Homo sapiens
ucauaauucuaauc

SEQ ID NO: 2121811 - RNA, 22 nt, Homo sapiens
uaauuugcaauuugucagugua

SEQ ID NO: 2121812 - RNA, 21 nt, Homo sapiens
ccaugcagccgcaccagagag

SEQ ID NO: 2121813 - RNA, 19 nt, Homo sapiens
uaucgagaguuucuaugga

SEQ ID NO: 2121814 - RNA, 23 nt, Homo sapiens
uuugcccccauucacuuugucag

SEQ ID NO: 2121815 - RNA, 18 nt, Homo sapiens
cuagagugccuccagggu

SEQ ID NO: 2121816 - RNA, 15 nt, Homo sapiens
auuuggccugcacua

SEQ ID NO: 2121817 - RNA, 20 nt, Homo sapiens
cuuuuguaaaaaugucccca

SEQ ID NO: 2121818 - RNA, 19 nt, Homo sapiens
accuacugcuuacuguugc

SEQ ID NO: 2121819 - RNA, 17 nt, Homo sapiens
cuagguuuuauucauac

SEQ ID NO: 2121820 - RNA, 15 nt, Homo sapiens
ccaguagcucuugca

SEQ ID NO: 2121821 - RNA, 12 nt, Homo sapiens
cucuauggauua

SEQ ID NO: 2121822 - RNA, 19 nt, Homo sapiens
guugcaacuuaaguauauu

SEQ ID NO: 2121823 - RNA, 11 nt, Homo sapiens
ucaaaaaucug

SEQ ID NO: 2121824 - RNA, 21 nt, Homo sapiens
aauacuuuuuucuaguuucag

SEQ ID NO: 2121825 - RNA, 21 nt, Homo sapiens
ugcugccaggcucccacugcc

SEQ ID NO: 2121826 - RNA, 18 nt, Homo sapiens
agccccuuauuugcacuu

SEQ ID NO: 2121827 - RNA, 17 nt, Homo sapiens
accagagucaaauuuga

SEQ ID NO: 2121828 - RNA, 20 nt, Homo sapiens
cgguuaaaacauaagccaca

SEQ ID NO: 2121829 - RNA, 14 nt, Homo sapiens
aacauugcacuuua

SEQ ID NO: 2121830 - RNA, 13 nt, Homo sapiens
ggugcuucucaca

SEQ ID NO: 2121831 - RNA, 18 nt, Homo sapiens
acuuuucuguucaucacc

SEQ ID NO: 2121832 - RNA, 20 nt, Homo sapiens
ucaaacuaccuauauuccuu

SEQ ID NO: 2121833 - RNA, 19 nt, Homo sapiens
gcuuuccguggcacugcau

SEQ ID NO: 2121834 - RNA, 18 nt, Homo sapiens
aggagcuuccagcucuaa

SEQ ID NO: 2121835 - RNA, 15 nt, Homo sapiens
uuauuggucagggug

SEQ ID NO: 2121836 - RNA, 12 nt, Homo sapiens
uacugugcaguu

SEQ ID NO: 2121837 - RNA, 19 nt, Homo sapiens
uaugucauuucuacuuuga

SEQ ID NO: 2121838 - RNA, 14 nt, Homo sapiens
uccaggaucuuuga

SEQ ID NO: 2121839 - RNA, 21 nt, Homo sapiens
ugucauauggaagaguuaaaa

SEQ ID NO: 2121840 - RNA, 19 nt, Homo sapiens
uuuuaguuuaaaaucuugc

SEQ ID NO: 2121841 - RNA, 15 nt, Homo sapiens
uauuguauaaacuau

SEQ ID NO: 2121842 - RNA, 17 nt, Homo sapiens
ugccaccugcacaggua

SEQ ID NO: 2121843 - RNA, 12 nt, Homo sapiens
agacuugugcau

SEQ ID NO: 2121844 - RNA, 15 nt, Homo sapiens
ucucuauauugcuua

SEQ ID NO: 2121845 - RNA, 19 nt, Homo sapiens
cuacacaguuugguuacag

SEQ ID NO: 2121846 - RNA, 17 nt, Homo sapiens
cacuugcccuguucucu

SEQ ID NO: 2121847 - RNA, 18 nt, Homo sapiens
ucagcauucucacuccua

SEQ ID NO: 2121848 - RNA, 15 nt, Homo sapiens
uuggcuucugugaug

SEQ ID NO: 2121849 - RNA, 15 nt, Homo sapiens
agugaagcauggcau

SEQ ID NO: 2121850 - RNA, 19 nt, Homo sapiens
auguaaaaagauucccaaa

SEQ ID NO: 2121851 - RNA, 18 nt, Homo sapiens
ugagucucaaguuuuauu

SEQ ID NO: 2121852 - RNA, 12 nt, Homo sapiens
ucauaccaaaua

SEQ ID NO: 2121853 - RNA, 20 nt, Homo sapiens
aaaugacuauuucuacccuu

SEQ ID NO: 2121854 - RNA, 14 nt, Homo sapiens
agugcaaaaaacau

SEQ ID NO: 2121855 - RNA, 14 nt, Homo sapiens
ugagcaaauaucau

SEQ ID NO: 2121856 - RNA, 10 nt, Homo sapiens
guacaguacu

SEQ ID NO: 2121857 - RNA, 13 nt, Homo sapiens
uccucugccaugu

SEQ ID NO: 2121858 - RNA, 15 nt, Homo sapiens
ggugucucgcugcau

SEQ ID NO: 2121859 - RNA, 18 nt, Homo sapiens
acugccaugccucaagaa

SEQ ID NO: 2121860 - RNA, 16 nt, Homo sapiens
uguucugucccuugcc

SEQ ID NO: 2121861 - RNA, 19 nt, Homo sapiens
gaagcagugccuuccauaa

SEQ ID NO: 2121862 - RNA, 22 nt, Homo sapiens
cuaaauacuguaacacuguaua

SEQ ID NO: 2121863 - RNA, 18 nt, Homo sapiens
auuugaggugaaauucag

SEQ ID NO: 2121864 - RNA, 20 nt, Homo sapiens
ccaaggccggagacccacag

SEQ ID NO: 2121865 - RNA, 15 nt, Homo sapiens
auaaauagaguucca

SEQ ID NO: 2121866 - RNA, 18 nt, Homo sapiens
uuugagcugagugcugaa

SEQ ID NO: 2121867 - RNA, 17 nt, Homo sapiens
uucagugauaacucuga

SEQ ID NO: 2121868 - RNA, 23 nt, Homo sapiens
augacuaaagagagaauguagau

SEQ ID NO: 2121869 - RNA, 17 nt, Homo sapiens
ucuacccuguugcaaag

SEQ ID NO: 2121870 - RNA, 16 nt, Homo sapiens
gacauauaccuucuca

SEQ ID NO: 2121871 - RNA, 12 nt, Homo sapiens
gacgacaguacu

SEQ ID NO: 2121872 - RNA, 12 nt, Homo sapiens
gaauacaguaag

SEQ ID NO: 2121873 - RNA, 17 nt, Homo sapiens
guuuuguaaaacuguua

SEQ ID NO: 2121874 - RNA, 14 nt, Homo sapiens
uucagaggcagcac

SEQ ID NO: 2121875 - RNA, 21 nt, Homo sapiens
caacaaaccacacacaguaaa

SEQ ID NO: 2121876 - RNA, 20 nt, Homo sapiens
cuuaucaagaguugugacaa

SEQ ID NO: 2121877 - RNA, 16 nt, Homo sapiens
agaaugauuaaucaaa

SEQ ID NO: 2121878 - RNA, 19 nt, Homo sapiens
cugacuucucacuuccuaa

SEQ ID NO: 2121879 - RNA, 19 nt, Homo sapiens
uuuaaaaaguuaacucuua

SEQ ID NO: 2121880 - RNA, 18 nt, Homo sapiens
aaaaucuccaauccacac

SEQ ID NO: 2121881 - RNA, 22 nt, Homo sapiens
acaaaaauugagacauuuacau

SEQ ID NO: 2121882 - RNA, 23 nt, Homo sapiens
aguaaauauugucacaacacuga

SEQ ID NO: 2121883 - RNA, 20 nt, Homo sapiens
auuuuuuguuauguuugcac

SEQ ID NO: 2121884 - RNA, 17 nt, Homo sapiens
augcacaauuccaugac

SEQ ID NO: 2121885 - RNA, 22 nt, Homo sapiens
cuucucccgugagccaggcaaa

SEQ ID NO: 2121886 - RNA, 18 nt, Homo sapiens
aguauauauaucauagca

SEQ ID NO: 2121887 - RNA, 16 nt, Homo sapiens
gcagagugcacagcug

SEQ ID NO: 2121888 - RNA, 16 nt, Homo sapiens
cuggaguguggcugag

SEQ ID NO: 2121889 - RNA, 15 nt, Homo sapiens
acaaugaacacuuau

SEQ ID NO: 2121890 - RNA, 14 nt, Homo sapiens
auuugcccuaucau

SEQ ID NO: 2121891 - RNA, 23 nt, Homo sapiens
auagaauauacugucuugucuca

SEQ ID NO: 2121892 - RNA, 16 nt, Homo sapiens
ccugggugguacccag

SEQ ID NO: 2121893 - RNA, 23 nt, Homo sapiens
uaagauucaguuuucccacuuuu

SEQ ID NO: 2121894 - RNA, 14 nt, Homo sapiens
auucuauagccaua

SEQ ID NO: 2121895 - RNA, 15 nt, Homo sapiens
auuuuuggugcaagu

SEQ ID NO: 2121896 - RNA, 16 nt, Homo sapiens
aaaguggugcucaguu

SEQ ID NO: 2121897 - RNA, 21 nt, Homo sapiens
ugcaccaacgagcuguacaug

SEQ ID NO: 2121898 - RNA, 18 nt, Homo sapiens
cuaggagcaggcuugugg

SEQ ID NO: 2121899 - RNA, 19 nt, Homo sapiens
ucaauaaaaaauuaugaca

SEQ ID NO: 2121900 - RNA, 17 nt, Homo sapiens
aacaguguuggcuuuca

SEQ ID NO: 2121901 - RNA, 15 nt, Homo sapiens
uacauucacccagau

SEQ ID NO: 2121902 - RNA, 16 nt, Homo sapiens
ggaaaagcauguuaug

SEQ ID NO: 2121903 - RNA, 19 nt, Homo sapiens
ugaaaacucuaauugucca

SEQ ID NO: 2121904 - RNA, 18 nt, Homo sapiens
ucacugauauauuuucca

SEQ ID NO: 2121905 - RNA, 21 nt, Homo sapiens
acugacaacauuauaacugua

SEQ ID NO: 2121906 - RNA, 14 nt, Homo sapiens
guacauuuggugca

SEQ ID NO: 2121907 - RNA, 18 nt, Homo sapiens
acgugucccgagcuuaga

SEQ ID NO: 2121908 - RNA, 15 nt, Homo sapiens
gcugccucacuuccu

SEQ ID NO: 2121909 - RNA, 16 nt, Homo sapiens
cucuuguugugcucuu

SEQ ID NO: 2121910 - RNA, 16 nt, Homo sapiens
aguuuaaagcggcuuu

SEQ ID NO: 2121911 - RNA, 22 nt, Homo sapiens
aaguugcugugccccaucagca

SEQ ID NO: 2121912 - RNA, 15 nt, Homo sapiens
ucacagauuguucua

SEQ ID NO: 2121913 - RNA, 18 nt, Homo sapiens
ugacaugggugugccagg

SEQ ID NO: 2121914 - RNA, 14 nt, Homo sapiens
ucugacagagccau

SEQ ID NO: 2121915 - RNA, 14 nt, Homo sapiens
ucccccagagugcu

SEQ ID NO: 2121916 - RNA, 13 nt, Homo sapiens
acuuuaacccucu

SEQ ID NO: 2121917 - RNA, 13 nt, Homo sapiens
aacuuaaccaccu

SEQ ID NO: 2121918 - RNA, 14 nt, Homo sapiens
auggcuuauucaca

SEQ ID NO: 2121919 - RNA, 22 nt, Homo sapiens
cagguaggaugaacacaggcaa

SEQ ID NO: 2121920 - RNA, 18 nt, Homo sapiens
cuggguuccccacaguga

SEQ ID NO: 2121921 - RNA, 19 nt, Homo sapiens
acuaccauugcuguucuac

SEQ ID NO: 2121922 - RNA, 23 nt, Homo sapiens
cagucaccuaagcaaucacuggg

SEQ ID NO: 2121923 - RNA, 23 nt, Homo sapiens
cauguuucuguauuguacaugua

SEQ ID NO: 2121924 - RNA, 17 nt, Homo sapiens
gccuggaugggggugca

SEQ ID NO: 2121925 - RNA, 19 nt, Homo sapiens
aaauuuauaagccaaaggu

SEQ ID NO: 2121926 - RNA, 19 nt, Homo sapiens
caaaaugucuuaaugcaaa

SEQ ID NO: 2121927 - RNA, 20 nt, Homo sapiens
cugagccuccacagcagugg

SEQ ID NO: 2121928 - RNA, 18 nt, Homo sapiens
cagcucccuuauaccccc

SEQ ID NO: 2121929 - RNA, 20 nt, Homo sapiens
gaauuuucucuaacuucaag

SEQ ID NO: 2121930 - RNA, 12 nt, Homo sapiens
uaagauauguga

SEQ ID NO: 2121931 - RNA, 23 nt, Homo sapiens
ugcacucugugcccaugggcacu

SEQ ID NO: 2121932 - RNA, 18 nt, Homo sapiens
auuacccaaauauaacca

SEQ ID NO: 2121933 - RNA, 21 nt, Homo sapiens
uguauccuuuauuucugauaa

SEQ ID NO: 2121934 - RNA, 21 nt, Homo sapiens
cuuacauuuuucagacuucau

SEQ ID NO: 2121935 - RNA, 9 nt, Homo sapiens
agacagggu

SEQ ID NO: 2121936 - RNA, 17 nt, Homo sapiens
uggaaguucauaccuaa

SEQ ID NO: 2121937 - RNA, 18 nt, Homo sapiens
cacaggggaugguuucac

SEQ ID NO: 2121938 - RNA, 22 nt, Homo sapiens
aagaagagcgagagaucaaaga

SEQ ID NO: 2121939 - RNA, 21 nt, Homo sapiens
caaaauaagguuauaugagua

SEQ ID NO: 2121940 - RNA, 16 nt, Homo sapiens
uauucuguuuccauag

SEQ ID NO: 2121941 - RNA, 20 nt, Homo sapiens
cuguuaaagccuaugaaugc

SEQ ID NO: 2121942 - RNA, 16 nt, Homo sapiens
caucuccauugcauuc

SEQ ID NO: 2121943 - RNA, 23 nt, Homo sapiens
caccauacuguuaagaguccuuu

SEQ ID NO: 2121944 - RNA, 18 nt, Homo sapiens
aaggagagggaguacaaa

SEQ ID NO: 2121945 - RNA, 16 nt, Homo sapiens
gggcccgaacagggac

SEQ ID NO: 2121946 - RNA, 21 nt, Homo sapiens
ugugaaaugacugcaucaugc

SEQ ID NO: 2121947 - RNA, 17 nt, Homo sapiens
uucccauuaaagagcca

SEQ ID NO: 2121948 - RNA, 17 nt, Homo sapiens
ccauggacccaauauuu

SEQ ID NO: 2121949 - RNA, 21 nt, Homo sapiens
cuagugugccaagaaugccca

SEQ ID NO: 2121950 - RNA, 23 nt, Homo sapiens
aagagauuccugagccaguguca

SEQ ID NO: 2121951 - RNA, 13 nt, Homo sapiens
acaaauauacauu

SEQ ID NO: 2121952 - RNA, 12 nt, Homo sapiens
aauccuuuccac

SEQ ID NO: 2121953 - RNA, 12 nt, Homo sapiens
cauucuuuacau

SEQ ID NO: 2121954 - RNA, 19 nt, Homo sapiens
uccugccauggaucucuug

SEQ ID NO: 2121955 - RNA, 19 nt, Homo sapiens
aggucaccagccugacugc

SEQ ID NO: 2121956 - RNA, 20 nt, Homo sapiens
agcugggagaaccaaaaaga

SEQ ID NO: 2121957 - RNA, 19 nt, Homo sapiens
ugguaaugaaggacaguga

SEQ ID NO: 2121958 - RNA, 15 nt, Homo sapiens
cucacauugcuguau

SEQ ID NO: 2121959 - RNA, 15 nt, Homo sapiens
uccuuaggaaaaaca

SEQ ID NO: 2121960 - RNA, 18 nt, Homo sapiens
gaucuuuguauauuacau

SEQ ID NO: 2121961 - RNA, 17 nt, Homo sapiens
cccaggauacuggcaca

SEQ ID NO: 2121962 - RNA, 13 nt, Homo sapiens
caagggcagugag

SEQ ID NO: 2121963 - RNA, 17 nt, Homo sapiens
agaauguauuaguacaa

SEQ ID NO: 2121964 - RNA, 20 nt, Homo sapiens
ucuugacauucaaggcauuu

SEQ ID NO: 2121965 - RNA, 15 nt, Homo sapiens
acaauucugaugaaa

SEQ ID NO: 2121966 - RNA, 18 nt, Homo sapiens
ggcccaaccagacuucuc

SEQ ID NO: 2121967 - RNA, 23 nt, Homo sapiens
ugauacaacauuaaggaauuuga

SEQ ID NO: 2121968 - RNA, 22 nt, Homo sapiens
acuucuccagauagcugaauga

SEQ ID NO: 2121969 - RNA, 17 nt, Homo sapiens
caauuucuugguauuau

SEQ ID NO: 2121970 - RNA, 21 nt, Homo sapiens
ccaaauacucaauuuacuaau

SEQ ID NO: 2121971 - RNA, 16 nt, Homo sapiens
ugcgcauucucaugga

SEQ ID NO: 2121972 - RNA, 14 nt, Homo sapiens
uuuccauauagcuc

SEQ ID NO: 2121973 - RNA, 19 nt, Homo sapiens
uaaugugugugccaauggu

SEQ ID NO: 2121974 - RNA, 21 nt, Homo sapiens
ugaagccccacaaagccagau

SEQ ID NO: 2121975 - RNA, 18 nt, Homo sapiens
uagcaccauuccucaaga

SEQ ID NO: 2121976 - RNA, 19 nt, Homo sapiens
gcccuaauuaaaaacugug

SEQ ID NO: 2121977 - RNA, 19 nt, Homo sapiens
acugugauuagaucacauc

SEQ ID NO: 2121978 - RNA, 15 nt, Homo sapiens
auauuucuaacuaua

SEQ ID NO: 2121979 - RNA, 19 nt, Homo sapiens
gcugggcuuguagaccacu

SEQ ID NO: 2121980 - RNA, 16 nt, Homo sapiens
uucauacagcacuacu

SEQ ID NO: 2121981 - RNA, 20 nt, Homo sapiens
ccucucugagucaaauccag

SEQ ID NO: 2121982 - RNA, 19 nt, Homo sapiens
agacgucucaagacugaaa

SEQ ID NO: 2121983 - RNA, 18 nt, Homo sapiens
gugcuauagacauuagag

SEQ ID NO: 2121984 - RNA, 22 nt, Homo sapiens
ugauaagcuauugucuguaaua

SEQ ID NO: 2121985 - RNA, 20 nt, Homo sapiens
gaggccugcauguccggcug

SEQ ID NO: 2121986 - RNA, 13 nt, Homo sapiens
uccccacagugcc

SEQ ID NO: 2121987 - RNA, 13 nt, Homo sapiens
aggcuguggacca

SEQ ID NO: 2121988 - RNA, 16 nt, Homo sapiens
augacuuuacacuaua

SEQ ID NO: 2121989 - RNA, 13 nt, Homo sapiens
ugauagucaauau

SEQ ID NO: 2121990 - RNA, 17 nt, Homo sapiens
uggcacacugccagugu

SEQ ID NO: 2121991 - RNA, 16 nt, Homo sapiens
ggacuuauucauuccu

SEQ ID NO: 2121992 - RNA, 16 nt, Homo sapiens
gugagagccugugauc

SEQ ID NO: 2121993 - RNA, 16 nt, Homo sapiens
ugagauuguacauuuu

SEQ ID NO: 2121994 - RNA, 16 nt, Homo sapiens
cuacugacuacccucu

SEQ ID NO: 2121995 - RNA, 20 nt, Homo sapiens
uuuccuuuuacaauuguuga

SEQ ID NO: 2121996 - RNA, 21 nt, Homo sapiens
ggacacuuccguagacuguuu

SEQ ID NO: 2121997 - RNA, 22 nt, Homo sapiens
aaguuauacuguggcuaugcaa

SEQ ID NO: 2121998 - RNA, 17 nt, Homo sapiens
uggccccugcccggcug

SEQ ID NO: 2121999 - RNA, 15 nt, Homo sapiens
gugccuaacuccuua

SEQ ID NO: 2122000 - RNA, 17 nt, Homo sapiens
cccauagaaacaugaca

SEQ ID NO: 2122001 - RNA, 19 nt, Homo sapiens
agauaaucagugugucuaa

SEQ ID NO: 2122002 - RNA, 19 nt, Homo sapiens
ucaucaggagaaaaagccu

SEQ ID NO: 2122003 - RNA, 21 nt, Homo sapiens
cuugcaaaacagggauuauca

SEQ ID NO: 2122004 - RNA, 18 nt, Homo sapiens
uaaagugggcuuugcaag

SEQ ID NO: 2122005 - RNA, 18 nt, Homo sapiens
uccuuaugauauucucau

SEQ ID NO: 2122006 - RNA, 14 nt, Homo sapiens
ugugccaucaccau

SEQ ID NO: 2122007 - RNA, 16 nt, Homo sapiens
aggucauuacucucaa

SEQ ID NO: 2122008 - RNA, 20 nt, Homo sapiens
ugcauuugugguaaucuaca

SEQ ID NO: 2122009 - RNA, 20 nt, Homo sapiens
agcacggucccccaggaggc

SEQ ID NO: 2122010 - RNA, 15 nt, Homo sapiens
uccacuuguuugcac

SEQ ID NO: 2122011 - RNA, 22 nt, Homo sapiens
uuuccuuugucauuuccuuugu

SEQ ID NO: 2122012 - RNA, 19 nt, Homo sapiens
accgaggcagggaaggauc

SEQ ID NO: 2122013 - RNA, 24 nt, Homo sapiens
uauuugcuuuuugcuaacaaugcu

SEQ ID NO: 2122014 - RNA, 22 nt, Homo sapiens
aauuucuccaguggauucccag

SEQ ID NO: 2122015 - RNA, 20 nt, Homo sapiens
cuuaacuuugaaccauaaag

SEQ ID NO: 2122016 - RNA, 13 nt, Homo sapiens
auugacucugcau

SEQ ID NO: 2122017 - RNA, 16 nt, Homo sapiens
ucaacuugcuuaucaa

SEQ ID NO: 2122018 - RNA, 16 nt, Homo sapiens
ugguuuccaucaaagc

SEQ ID NO: 2122019 - RNA, 18 nt, Homo sapiens
cugaauuacaaccacaga

SEQ ID NO: 2122020 - RNA, 16 nt, Homo sapiens
cugucacucugugccu

SEQ ID NO: 2122021 - RNA, 22 nt, Homo sapiens
cagcucuuuauuacauagcucu

SEQ ID NO: 2122022 - RNA, 13 nt, Homo sapiens
cugucaaagugag

SEQ ID NO: 2122023 - RNA, 17 nt, Homo sapiens
uggagaguaaucuggga

SEQ ID NO: 2122024 - RNA, 20 nt, Homo sapiens
ggaauguucuuucugcucua

SEQ ID NO: 2122025 - RNA, 20 nt, Homo sapiens
ucaaagcuuugacucuauaa

SEQ ID NO: 2122026 - RNA, 21 nt, Homo sapiens
cagaugcaaucucuugucuca

SEQ ID NO: 2122027 - RNA, 18 nt, Homo sapiens
aaugaaccccacugggug

SEQ ID NO: 2122028 - RNA, 18 nt, Homo sapiens
ugagaaccccucugggaa

SEQ ID NO: 2122029 - RNA, 19 nt, Homo sapiens
gccuucugaggacauucca

SEQ ID NO: 2122030 - RNA, 15 nt, Homo sapiens
cugacucuaagaauu

SEQ ID NO: 2122031 - RNA, 16 nt, Homo sapiens
ugcauuugcagugcau

SEQ ID NO: 2122032 - RNA, 16 nt, Homo sapiens
uacucaccucacccca

SEQ ID NO: 2122033 - RNA, 11 nt, Homo sapiens
aggucagccag

SEQ ID NO: 2122034 - RNA, 13 nt, Homo sapiens
uuuuauacaaaga

SEQ ID NO: 2122035 - RNA, 15 nt, Homo sapiens
auccagaggaacaag

SEQ ID NO: 2122036 - RNA, 19 nt, Homo sapiens
cuucaacaugucacacugg

SEQ ID NO: 2122037 - RNA, 20 nt, Homo sapiens
auucuguuuaucaagccaua

SEQ ID NO: 2122038 - RNA, 16 nt, Homo sapiens
auuagaaucugaguau

SEQ ID NO: 2122039 - RNA, 14 nt, Homo sapiens
acaugcacauuuau

SEQ ID NO: 2122040 - RNA, 17 nt, Homo sapiens
ggcagcuccagugccag

SEQ ID NO: 2122041 - RNA, 21 nt, Homo sapiens
ugaaacucccuuguguuccuu

SEQ ID NO: 2122042 - RNA, 20 nt, Homo sapiens
cuccuugggaggaagcagaa

SEQ ID NO: 2122043 - RNA, 21 nt, Homo sapiens
guuucuaagcauguagccagu

SEQ ID NO: 2122044 - RNA, 15 nt, Homo sapiens
gacuaucuauccuga

SEQ ID NO: 2122045 - RNA, 15 nt, Homo sapiens
aaacagcuguauuua

SEQ ID NO: 2122046 - RNA, 14 nt, Homo sapiens
aacaaacucagauc

SEQ ID NO: 2122047 - RNA, 19 nt, Homo sapiens
uuggauuuuauguugacau

SEQ ID NO: 2122048 - RNA, 21 nt, Homo sapiens
gcagucugggccccaucauua

SEQ ID NO: 2122049 - RNA, 13 nt, Homo sapiens
auuaaucuugauc

SEQ ID NO: 2122050 - RNA, 18 nt, Homo sapiens
uggggauggagaagacaa

SEQ ID NO: 2122051 - RNA, 23 nt, Homo sapiens
ucaccuuugggcaaaggcccccu

SEQ ID NO: 2122052 - RNA, 17 nt, Homo sapiens
agccucuaugugcaagg

SEQ ID NO: 2122053 - RNA, 22 nt, Homo sapiens
acuaguaauaauguaauacugu

SEQ ID NO: 2122054 - RNA, 22 nt, Homo sapiens
uacaacgccgagugcacugcau

SEQ ID NO: 2122055 - RNA, 14 nt, Homo sapiens
agaacacuaacuca

SEQ ID NO: 2122056 - RNA, 21 nt, Homo sapiens
gacuacaggcgccugccacaa

SEQ ID NO: 2122057 - RNA, 19 nt, Homo sapiens
auuuccuucaaugugcaua

SEQ ID NO: 2122058 - RNA, 19 nt, Homo sapiens
ugggcccuaugucucagga

SEQ ID NO: 2122059 - RNA, 15 nt, Homo sapiens
uccauuuacaaacua

SEQ ID NO: 2122060 - RNA, 21 nt, Homo sapiens
gaggugggaaaaucacuugaa

SEQ ID NO: 2122061 - RNA, 19 nt, Homo sapiens
uggcagucugaauuuuuaa

SEQ ID NO: 2122062 - RNA, 23 nt, Homo sapiens
ucaugcagagggugggguacugg

SEQ ID NO: 2122063 - RNA, 23 nt, Homo sapiens
uguucuggggggacccagugcag

SEQ ID NO: 2122064 - RNA, 20 nt, Homo sapiens
ugcagcuagaggcaucuucu

SEQ ID NO: 2122065 - RNA, 16 nt, Homo sapiens
agugaaguauugcuga

SEQ ID NO: 2122066 - RNA, 19 nt, Homo sapiens
cauacuuaaaaauuuauua

SEQ ID NO: 2122067 - RNA, 22 nt, Homo sapiens
caaauaaaugauuauauucaca

SEQ ID NO: 2122068 - RNA, 14 nt, Homo sapiens
uguucguguugccc

SEQ ID NO: 2122069 - RNA, 20 nt, Homo sapiens
cucugauuuccuucugcuau

SEQ ID NO: 2122070 - RNA, 22 nt, Homo sapiens
ccuucaucaugaguucugcuga

SEQ ID NO: 2122071 - RNA, 21 nt, Homo sapiens
cugaccuuccaaagacuaaga

SEQ ID NO: 2122072 - RNA, 16 nt, Homo sapiens
cuguaggggcaaaaau

SEQ ID NO: 2122073 - RNA, 21 nt, Homo sapiens
gucagagggcccaguggugcc

SEQ ID NO: 2122074 - RNA, 20 nt, Homo sapiens
acaggcgcccgccaccaugc

SEQ ID NO: 2122075 - RNA, 12 nt, Homo sapiens
ggccucaggguc

SEQ ID NO: 2122076 - RNA, 21 nt, Homo sapiens
acccccucaaaagccaaaaaa

SEQ ID NO: 2122077 - RNA, 15 nt, Homo sapiens
ccagguacgcacaga

SEQ ID NO: 2122078 - RNA, 19 nt, Homo sapiens
aacuuguuugcugugaaca

SEQ ID NO: 2122079 - RNA, 19 nt, Homo sapiens
gaacuuuaaaaaagcaaau

SEQ ID NO: 2122080 - RNA, 22 nt, Homo sapiens
cugagcuuuggacgcacacagc

SEQ ID NO: 2122081 - RNA, 16 nt, Homo sapiens
gucuuuacuccucaca

SEQ ID NO: 2122082 - RNA, 19 nt, Homo sapiens
gaaauauccagaacauacu

SEQ ID NO: 2122083 - RNA, 16 nt, Homo sapiens
ccccuuccuucuuugu

SEQ ID NO: 2122084 - RNA, 22 nt, Homo sapiens
caaagaguguagaucagagcag

SEQ ID NO: 2122085 - RNA, 13 nt, Homo sapiens
uuuaaaauuucau

SEQ ID NO: 2122086 - RNA, 13 nt, Homo sapiens
agcaaaauaguau

SEQ ID NO: 2122087 - RNA, 13 nt, Homo sapiens
caugcucccucau

SEQ ID NO: 2122088 - RNA, 22 nt, Homo sapiens
aaguccauguuauucucucaca

SEQ ID NO: 2122089 - RNA, 13 nt, Homo sapiens
cuuguucccacac

SEQ ID NO: 2122090 - RNA, 16 nt, Homo sapiens
ggaaggcagcaggcau

SEQ ID NO: 2122091 - RNA, 17 nt, Homo sapiens
aaagaacgcugauuuaa

SEQ ID NO: 2122092 - RNA, 12 nt, Homo sapiens
accaacuuucug

SEQ ID NO: 2122093 - RNA, 12 nt, Homo sapiens
agugacuuugca

SEQ ID NO: 2122094 - RNA, 22 nt, Homo sapiens
caaguccagauuuacacuggga

SEQ ID NO: 2122095 - RNA, 18 nt, Homo sapiens
accuugucaaccucuucc

SEQ ID NO: 2122096 - RNA, 17 nt, Homo sapiens
uaggugucuguuuccca

SEQ ID NO: 2122097 - RNA, 18 nt, Homo sapiens
aggagcuagaacauucca

SEQ ID NO: 2122098 - RNA, 19 nt, Homo sapiens
uaaauggcuuuugccacau

SEQ ID NO: 2122099 - RNA, 14 nt, Homo sapiens
ccuucaagugccaa

SEQ ID NO: 2122100 - RNA, 17 nt, Homo sapiens
cuggcugguuugcccag

SEQ ID NO: 2122101 - RNA, 19 nt, Homo sapiens
acauagugaaauaaauucu

SEQ ID NO: 2122102 - RNA, 16 nt, Homo sapiens
auguuggccucuucag

SEQ ID NO: 2122103 - RNA, 13 nt, Homo sapiens
ucuacacugagga

SEQ ID NO: 2122104 - RNA, 17 nt, Homo sapiens
gcaguggugccaucacc

SEQ ID NO: 2122105 - RNA, 22 nt, Homo sapiens
accuccuuagcccugucugcua

SEQ ID NO: 2122106 - RNA, 21 nt, Homo sapiens
cuuuucuuucuacagaccaua

SEQ ID NO: 2122107 - RNA, 18 nt, Homo sapiens
agcugcuuuugcauuucu

SEQ ID NO: 2122108 - RNA, 17 nt, Homo sapiens
ccucacugcaucuuucu

SEQ ID NO: 2122109 - RNA, 18 nt, Homo sapiens
aggagggaggugcuucua

SEQ ID NO: 2122110 - RNA, 22 nt, Homo sapiens
gcucauguucuggcagcaacuu

SEQ ID NO: 2122111 - RNA, 14 nt, Homo sapiens
uaacuucuaaagaa

SEQ ID NO: 2122112 - RNA, 20 nt, Homo sapiens
accaagcauuuagugcacag

SEQ ID NO: 2122113 - RNA, 20 nt, Homo sapiens
aaugccuuauaaaccugcag

SEQ ID NO: 2122114 - RNA, 16 nt, Homo sapiens
ccucauucuagcaccu

SEQ ID NO: 2122115 - RNA, 15 nt, Homo sapiens
uugguacaugccugu

SEQ ID NO: 2122116 - RNA, 16 nt, Homo sapiens
acaugugacaucuacc

SEQ ID NO: 2122117 - RNA, 17 nt, Homo sapiens
gcuggucucacccaacu

SEQ ID NO: 2122118 - RNA, 19 nt, Homo sapiens
guauccauuauucuucuca

SEQ ID NO: 2122119 - RNA, 15 nt, Homo sapiens
auuguuaaaauaacu

SEQ ID NO: 2122120 - RNA, 19 nt, Homo sapiens
uauacuguaugugccaaag

SEQ ID NO: 2122121 - RNA, 19 nt, Homo sapiens
gacugcaaacauguugccu

SEQ ID NO: 2122122 - RNA, 21 nt, Homo sapiens
caauaacauacaugagauaac

SEQ ID NO: 2122123 - RNA, 19 nt, Homo sapiens
caagaugucaagggccaag

SEQ ID NO: 2122124 - RNA, 13 nt, Homo sapiens
gagacuaggauag

SEQ ID NO: 2122125 - RNA, 23 nt, Homo sapiens
ccagauguuuuauuuaugaaguu

SEQ ID NO: 2122126 - RNA, 15 nt, Homo sapiens
uccaaaagcaaacaa

SEQ ID NO: 2122127 - RNA, 14 nt, Homo sapiens
uucccagaaucaaa

SEQ ID NO: 2122128 - RNA, 23 nt, Homo sapiens
uugcguuucuuacugccuucuuu

SEQ ID NO: 2122129 - RNA, 12 nt, Homo sapiens
uucacaguuccu

SEQ ID NO: 2122130 - RNA, 23 nt, Homo sapiens
agccuccaccugauauucaggcu

SEQ ID NO: 2122131 - RNA, 16 nt, Homo sapiens
aaagacuuuguuaaau

SEQ ID NO: 2122132 - RNA, 13 nt, Homo sapiens
ucuaucuuauaua

SEQ ID NO: 2122133 - RNA, 13 nt, Homo sapiens
uacaaccccagcc

SEQ ID NO: 2122134 - RNA, 17 nt, Homo sapiens
ucuaacuccagugaagu

SEQ ID NO: 2122135 - RNA, 17 nt, Homo sapiens
uacacuuuuuuccaaag

SEQ ID NO: 2122136 - RNA, 14 nt, Homo sapiens
cacugcauuugcug

SEQ ID NO: 2122137 - RNA, 19 nt, Homo sapiens
uguguaagaaauacagacu

SEQ ID NO: 2122138 - RNA, 22 nt, Homo sapiens
cugcugcuucuccaagcuuuca

SEQ ID NO: 2122139 - RNA, 15 nt, Homo sapiens
cagagcuacugagac

SEQ ID NO: 2122140 - RNA, 19 nt, Homo sapiens
uggugccccagcaccaacc

SEQ ID NO: 2122141 - RNA, 22 nt, Homo sapiens
ucaauauuucuaguagcacaac

SEQ ID NO: 2122142 - RNA, 17 nt, Homo sapiens
uaugucuguaucuacuu

SEQ ID NO: 2122143 - RNA, 22 nt, Homo sapiens
ucuucccgcaaaucaacacuuu

SEQ ID NO: 2122144 - RNA, 22 nt, Homo sapiens
auagaaaugguuuccucuggau

SEQ ID NO: 2122145 - RNA, 11 nt, Homo sapiens
aaaauugcucu

SEQ ID NO: 2122146 - RNA, 20 nt, Homo sapiens
guagccaaagguucacucuc

SEQ ID NO: 2122147 - RNA, 16 nt, Homo sapiens
cugaaggacacuuccu

SEQ ID NO: 2122148 - RNA, 14 nt, Homo sapiens
accagccugagcaa

SEQ ID NO: 2122149 - RNA, 19 nt, Homo sapiens
gcucaacggcuccaucacc

SEQ ID NO: 2122150 - RNA, 14 nt, Homo sapiens
aaaauaauaaucau

SEQ ID NO: 2122151 - RNA, 19 nt, Homo sapiens
cacgccacaacuccagugu

SEQ ID NO: 2122152 - RNA, 19 nt, Homo sapiens
acaaugccucccagcuaga

SEQ ID NO: 2122153 - RNA, 23 nt, Homo sapiens
cacuuccaugagaagaagcagau

SEQ ID NO: 2122154 - RNA, 19 nt, Homo sapiens
aucagaugaacucaugucu

SEQ ID NO: 2122155 - RNA, 20 nt, Homo sapiens
aaacaccagauuccauuuca

SEQ ID NO: 2122156 - RNA, 21 nt, Homo sapiens
agccaacucacucuuaugaaa

SEQ ID NO: 2122157 - RNA, 15 nt, Homo sapiens
cuauucuggcaauaa

SEQ ID NO: 2122158 - RNA, 16 nt, Homo sapiens
aaacacuccacagugu

SEQ ID NO: 2122159 - RNA, 14 nt, Homo sapiens
ugaagccacugccu

SEQ ID NO: 2122160 - RNA, 9 nt, Homo sapiens
uuaacuuug

SEQ ID NO: 2122161 - RNA, 15 nt, Homo sapiens
ccaaggaugaaauca

SEQ ID NO: 2122162 - RNA, 20 nt, Homo sapiens
cagcugcagucaacaguuca

SEQ ID NO: 2122163 - RNA, 23 nt, Homo sapiens
uacugcagcuuuguuuguuguca

SEQ ID NO: 2122164 - RNA, 16 nt, Homo sapiens
uccuugccucugcucu

SEQ ID NO: 2122165 - RNA, 13 nt, Homo sapiens
cauuguaguuaau

SEQ ID NO: 2122166 - RNA, 18 nt, Homo sapiens
acauauuuagaccaauau

SEQ ID NO: 2122167 - RNA, 21 nt, Homo sapiens
aaucagccuuuaggucuuuag

SEQ ID NO: 2122168 - RNA, 14 nt, Homo sapiens
acuaaaaauauuau

SEQ ID NO: 2122169 - RNA, 16 nt, Homo sapiens
ucuuucucaaucuuga

SEQ ID NO: 2122170 - RNA, 20 nt, Homo sapiens
uuuuccuuacagacacccau

SEQ ID NO: 2122171 - RNA, 14 nt, Homo sapiens
gugugugucucuga

SEQ ID NO: 2122172 - RNA, 23 nt, Homo sapiens
gaguccagccccuccucccucag

SEQ ID NO: 2122173 - RNA, 14 nt, Homo sapiens
cuuaaucuuuucac

SEQ ID NO: 2122174 - RNA, 22 nt, Homo sapiens
auccuguaccaaaucugacaua

SEQ ID NO: 2122175 - RNA, 14 nt, Homo sapiens
acagggucuugcua

SEQ ID NO: 2122176 - RNA, 15 nt, Homo sapiens
cuuaguugcaugacc

SEQ ID NO: 2122177 - RNA, 20 nt, Homo sapiens
uuaaucaaugaucaucucac

SEQ ID NO: 2122178 - RNA, 12 nt, Homo sapiens
aaaacauaugca

SEQ ID NO: 2122179 - RNA, 12 nt, Homo sapiens
auauucccaugg

SEQ ID NO: 2122180 - RNA, 21 nt, Homo sapiens
acgaggagcuuccagugcaug

SEQ ID NO: 2122181 - RNA, 21 nt, Homo sapiens
agacauuuaucaacuguugau

SEQ ID NO: 2122182 - RNA, 15 nt, Homo sapiens
uacaacuucauauaa

SEQ ID NO: 2122183 - RNA, 18 nt, Homo sapiens
uuacagacucugauucua

SEQ ID NO: 2122184 - RNA, 14 nt, Homo sapiens
acauguuaaaccau

SEQ ID NO: 2122185 - RNA, 21 nt, Homo sapiens
aaaccaggauuuccuugacuu

SEQ ID NO: 2122186 - RNA, 14 nt, Homo sapiens
gcccagaagugcag

SEQ ID NO: 2122187 - RNA, 14 nt, Homo sapiens
ggaaaaguucuccu

SEQ ID NO: 2122188 - RNA, 18 nt, Homo sapiens
uuugugccaucacugagc

SEQ ID NO: 2122189 - RNA, 18 nt, Homo sapiens
ucugacauccacaugcuc

SEQ ID NO: 2122190 - RNA, 17 nt, Homo sapiens
gaaacuagauaauuuca

SEQ ID NO: 2122191 - RNA, 19 nt, Homo sapiens
agaaaauaggguggacaga

SEQ ID NO: 2122192 - RNA, 21 nt, Homo sapiens
uggaauacuagcuaacuaauu

SEQ ID NO: 2122193 - RNA, 16 nt, Homo sapiens
acuuuuguguaaugaa

SEQ ID NO: 2122194 - RNA, 17 nt, Homo sapiens
auucauggcuaccucag

SEQ ID NO: 2122195 - RNA, 15 nt, Homo sapiens
uccucccuucugcua

SEQ ID NO: 2122196 - RNA, 22 nt, Homo sapiens
auguaaaaagaucuacauacaa

SEQ ID NO: 2122197 - RNA, 19 nt, Homo sapiens
cuuucauugcuguugucuc

SEQ ID NO: 2122198 - RNA, 17 nt, Homo sapiens
gccacaucccagucaca

SEQ ID NO: 2122199 - RNA, 16 nt, Homo sapiens
ugaugggcugcacagg

SEQ ID NO: 2122200 - RNA, 22 nt, Homo sapiens
ugcaaacaggcuguucaccacc

SEQ ID NO: 2122201 - RNA, 13 nt, Homo sapiens
caucucaaggaau

SEQ ID NO: 2122202 - RNA, 19 nt, Homo sapiens
uaauaaugcacucaguuua

SEQ ID NO: 2122203 - RNA, 21 nt, Homo sapiens
gguuuuuccuacuguccucag

SEQ ID NO: 2122204 - RNA, 14 nt, Homo sapiens
uaugacacaucucu

SEQ ID NO: 2122205 - RNA, 17 nt, Homo sapiens
uuauaugugacacugca

SEQ ID NO: 2122206 - RNA, 22 nt, Homo sapiens
ccugcucuuucucugagaacca

SEQ ID NO: 2122207 - RNA, 13 nt, Homo sapiens
caauguacaauua

SEQ ID NO: 2122208 - RNA, 11 nt, Homo sapiens
uuuuugcaaua

SEQ ID NO: 2122209 - RNA, 15 nt, Homo sapiens
uguucauacugaugu

SEQ ID NO: 2122210 - RNA, 15 nt, Homo sapiens
gauuuugcaguucuu

SEQ ID NO: 2122211 - RNA, 19 nt, Homo sapiens
cauagaaauuacacccaaa

SEQ ID NO: 2122212 - RNA, 18 nt, Homo sapiens
auauaaacaugcuugcau

SEQ ID NO: 2122213 - RNA, 17 nt, Homo sapiens
acuuccccuucuugcca

SEQ ID NO: 2122214 - RNA, 17 nt, Homo sapiens
gucauguggcuaccugu

SEQ ID NO: 2122215 - RNA, 13 nt, Homo sapiens
auagaguacugca

SEQ ID NO: 2122216 - RNA, 12 nt, Homo sapiens
aaaccuguaacc

SEQ ID NO: 2122217 - RNA, 22 nt, Homo sapiens
uucauguauguaugagacagaa

SEQ ID NO: 2122218 - RNA, 12 nt, Homo sapiens
ccucacugaaaa

SEQ ID NO: 2122219 - RNA, 22 nt, Homo sapiens
acaacucccuuaaggucuccaa

SEQ ID NO: 2122220 - RNA, 18 nt, Homo sapiens
agcaaaagaugugcaaaa

SEQ ID NO: 2122221 - RNA, 20 nt, Homo sapiens
augaccagaagccuuggaac

SEQ ID NO: 2122222 - RNA, 18 nt, Homo sapiens
auuaaauggaucacugau

SEQ ID NO: 2122223 - RNA, 18 nt, Homo sapiens
uaccggacacucgucacc

SEQ ID NO: 2122224 - RNA, 12 nt, Homo sapiens
auaaucuuugcu

SEQ ID NO: 2122225 - RNA, 14 nt, Homo sapiens
ucuauuaaucaccu

SEQ ID NO: 2122226 - RNA, 15 nt, Homo sapiens
acuugggcuggcacc

SEQ ID NO: 2122227 - RNA, 13 nt, Homo sapiens
guuuuuucacaua

SEQ ID NO: 2122228 - RNA, 13 nt, Homo sapiens
acaccccaugcac

SEQ ID NO: 2122229 - RNA, 23 nt, Homo sapiens
agggccugaggucuggcugcuug

SEQ ID NO: 2122230 - RNA, 20 nt, Homo sapiens
ggcauuccuugggacucagg

SEQ ID NO: 2122231 - RNA, 20 nt, Homo sapiens
uacacagcuuuaugauauca

SEQ ID NO: 2122232 - RNA, 19 nt, Homo sapiens
uguaucauagcacugguca

SEQ ID NO: 2122233 - RNA, 19 nt, Homo sapiens
ccaccuccacccccaagaa

SEQ ID NO: 2122234 - RNA, 13 nt, Homo sapiens
gaauagucucauc

SEQ ID NO: 2122235 - RNA, 21 nt, Homo sapiens
uccauguaccuuguguacuuu

SEQ ID NO: 2122236 - RNA, 22 nt, Homo sapiens
cccaacaagugcucuuuccacc

SEQ ID NO: 2122237 - RNA, 19 nt, Homo sapiens
agcauaauucggaagggaa

SEQ ID NO: 2122238 - RNA, 15 nt, Homo sapiens
ugcuacguaaucuca

SEQ ID NO: 2122239 - RNA, 14 nt, Homo sapiens
guucugauaaugaa

SEQ ID NO: 2122240 - RNA, 20 nt, Homo sapiens
cauuguuacagguguacuau

SEQ ID NO: 2122241 - RNA, 21 nt, Homo sapiens
agacuuaaucuugaaugauac

SEQ ID NO: 2122242 - RNA, 18 nt, Homo sapiens
acauuauuuuuuauuucu

SEQ ID NO: 2122243 - RNA, 21 nt, Homo sapiens
uccagcccgcagcacauuucc

SEQ ID NO: 2122244 - RNA, 16 nt, Homo sapiens
uggcugcugcugccac

SEQ ID NO: 2122245 - RNA, 18 nt, Homo sapiens
gaucuuccucacaccaca

SEQ ID NO: 2122246 - RNA, 15 nt, Homo sapiens
aucagggacaggaug

SEQ ID NO: 2122247 - RNA, 21 nt, Homo sapiens
uggggcucauaaaacaugaau

SEQ ID NO: 2122248 - RNA, 20 nt, Homo sapiens
uacuucugcauguucauugc

SEQ ID NO: 2122249 - RNA, 21 nt, Homo sapiens
uuacauuuuuugggcagcaau

SEQ ID NO: 2122250 - RNA, 16 nt, Homo sapiens
gggccaccuccuaccc

SEQ ID NO: 2122251 - RNA, 13 nt, Homo sapiens
uagaaaaguauuc

SEQ ID NO: 2122252 - RNA, 15 nt, Homo sapiens
aucuaccccuuccuu

SEQ ID NO: 2122253 - RNA, 15 nt, Homo sapiens
agacuucguaauuaa

SEQ ID NO: 2122254 - RNA, 15 nt, Homo sapiens
auguccccaccaauc

SEQ ID NO: 2122255 - RNA, 21 nt, Homo sapiens
gggucaucccagcaccugcca

SEQ ID NO: 2122256 - RNA, 22 nt, Homo sapiens
aguuaagcagccuuucugugga

SEQ ID NO: 2122257 - RNA, 16 nt, Homo sapiens
uacuaagcauagcaaa

SEQ ID NO: 2122258 - RNA, 14 nt, Homo sapiens
uagagaaguauuua

SEQ ID NO: 2122259 - RNA, 22 nt, Homo sapiens
ugaauaaugaaugaaccaucuu

SEQ ID NO: 2122260 - RNA, 22 nt, Homo sapiens
agaagcuguguuagaacagcau

SEQ ID NO: 2122261 - RNA, 19 nt, Homo sapiens
gugcagucccaguccuuga

SEQ ID NO: 2122262 - RNA, 20 nt, Homo sapiens
aacuguuuucucaugaugcc

SEQ ID NO: 2122263 - RNA, 20 nt, Homo sapiens
guugaaacacacgugcugug

SEQ ID NO: 2122264 - RNA, 15 nt, Homo sapiens
gaacagaccagugac

SEQ ID NO: 2122265 - RNA, 24 nt, Homo sapiens
ccaccucaagugccuuauucucac

SEQ ID NO: 2122266 - RNA, 14 nt, Homo sapiens
cccuaggcaucaca

SEQ ID NO: 2122267 - RNA, 14 nt, Homo sapiens
aagggaauccuccu

SEQ ID NO: 2122268 - RNA, 13 nt, Homo sapiens
ccugacuuccucu

SEQ ID NO: 2122269 - RNA, 17 nt, Homo sapiens
acagaaucaggcacuua

SEQ ID NO: 2122270 - RNA, 20 nt, Homo sapiens
uucucucucucugucucucu

SEQ ID NO: 2122271 - RNA, 18 nt, Homo sapiens
uugaguaauucuagcuuu

SEQ ID NO: 2122272 - RNA, 14 nt, Homo sapiens
acaguccauugaaa

SEQ ID NO: 2122273 - RNA, 16 nt, Homo sapiens
aacgaugugacugcca

SEQ ID NO: 2122274 - RNA, 21 nt, Homo sapiens
uaugcagaaggcuacauauac

SEQ ID NO: 2122275 - RNA, 16 nt, Homo sapiens
uugucaucaccaugga

SEQ ID NO: 2122276 - RNA, 11 nt, Homo sapiens
gaauuaucuca

SEQ ID NO: 2122277 - RNA, 17 nt, Homo sapiens
gaugugcagauaucaca

SEQ ID NO: 2122278 - RNA, 16 nt, Homo sapiens
ucaguaaauaacugga

SEQ ID NO: 2122279 - RNA, 14 nt, Homo sapiens
agaaaaucacauca

SEQ ID NO: 2122280 - RNA, 14 nt, Homo sapiens
uccucaucugcaaa

SEQ ID NO: 2122281 - RNA, 19 nt, Homo sapiens
acacauaaaccaaaaccaa

SEQ ID NO: 2122282 - RNA, 16 nt, Homo sapiens
aaguuuagcucugaga

SEQ ID NO: 2122283 - RNA, 11 nt, Homo sapiens
ccucaagaaga

SEQ ID NO: 2122284 - RNA, 18 nt, Homo sapiens
cugcccuugaagacuucc

SEQ ID NO: 2122285 - RNA, 19 nt, Homo sapiens
acccccaguaaaaucaaau

SEQ ID NO: 2122286 - RNA, 14 nt, Homo sapiens
cuugaacacugggg

SEQ ID NO: 2122287 - RNA, 19 nt, Homo sapiens
agccagugucuaggcacug

SEQ ID NO: 2122288 - RNA, 19 nt, Homo sapiens
cugagcagcccagcacaac

SEQ ID NO: 2122289 - RNA, 15 nt, Homo sapiens
aggauuucaugauuu

SEQ ID NO: 2122290 - RNA, 15 nt, Homo sapiens
agaaacacauaaaca

SEQ ID NO: 2122291 - RNA, 19 nt, Homo sapiens
uccccucaaacucauugca

SEQ ID NO: 2122292 - RNA, 13 nt, Homo sapiens
aggaucuugccug

SEQ ID NO: 2122293 - RNA, 15 nt, Homo sapiens
cgcugcagaccccag

SEQ ID NO: 2122294 - RNA, 11 nt, Homo sapiens
uugcuguucua

SEQ ID NO: 2122295 - RNA, 14 nt, Homo sapiens
acauaacaacaucu

SEQ ID NO: 2122296 - RNA, 21 nt, Homo sapiens
uucuucauucuguaugugacu

SEQ ID NO: 2122297 - RNA, 14 nt, Homo sapiens
cagcaacacagccu

SEQ ID NO: 2122298 - RNA, 14 nt, Homo sapiens
uccccacaucccau

SEQ ID NO: 2122299 - RNA, 19 nt, Homo sapiens
gcacaugccucucucaggc

SEQ ID NO: 2122300 - RNA, 20 nt, Homo sapiens
gggcagaaauuugauuugaa

SEQ ID NO: 2122301 - RNA, 20 nt, Homo sapiens
ccagccuggucaauauagca

SEQ ID NO: 2122302 - RNA, 18 nt, Homo sapiens
ugccagagcagggggacc

SEQ ID NO: 2122303 - RNA, 15 nt, Homo sapiens
uacuggaugcuuaca

SEQ ID NO: 2122304 - RNA, 22 nt, Homo sapiens
auaucacucuuguugugcucuu

SEQ ID NO: 2122305 - RNA, 13 nt, Homo sapiens
accuucaccuuug

SEQ ID NO: 2122306 - RNA, 16 nt, Homo sapiens
aucuuguggggccagg

SEQ ID NO: 2122307 - RNA, 19 nt, Homo sapiens
uccaacccauuagccauuu

SEQ ID NO: 2122308 - RNA, 15 nt, Homo sapiens
aucuuuggauuugau

SEQ ID NO: 2122309 - RNA, 15 nt, Homo sapiens
cuggaaggggccacg

SEQ ID NO: 2122310 - RNA, 15 nt, Homo sapiens
cuucacgccugggug

SEQ ID NO: 2122311 - RNA, 22 nt, Homo sapiens
gggcaggauggcaaccagacca

SEQ ID NO: 2122312 - RNA, 16 nt, Homo sapiens
guagaauaaaugaaga

SEQ ID NO: 2122313 - RNA, 16 nt, Homo sapiens
acuggacaugaaggaa

SEQ ID NO: 2122314 - RNA, 22 nt, Homo sapiens
ugggggagaaccacugacccaa

SEQ ID NO: 2122315 - RNA, 16 nt, Homo sapiens
cugaugugacauucca

SEQ ID NO: 2122316 - RNA, 15 nt, Homo sapiens
ugcauccacuagcuu

SEQ ID NO: 2122317 - RNA, 16 nt, Homo sapiens
acgcuguccauugcca

SEQ ID NO: 2122318 - RNA, 20 nt, Homo sapiens
uccaaugcuguggguuucca

SEQ ID NO: 2122319 - RNA, 22 nt, Homo sapiens
auauuggcauagaaaaaaguag

SEQ ID NO: 2122320 - RNA, 18 nt, Homo sapiens
uucuucauccaacuucca

SEQ ID NO: 2122321 - RNA, 21 nt, Homo sapiens
gacuugguaagaugacucuga

SEQ ID NO: 2122322 - RNA, 18 nt, Homo sapiens
gauuaaggugaugugauu

SEQ ID NO: 2122323 - RNA, 16 nt, Homo sapiens
gagaugccaugagccg

SEQ ID NO: 2122324 - RNA, 15 nt, Homo sapiens
acuggaacaauguuu

SEQ ID NO: 2122325 - RNA, 22 nt, Homo sapiens
aaagcauuuguacuaagcuccu

SEQ ID NO: 2122326 - RNA, 13 nt, Homo sapiens
aauugacuugcaa

SEQ ID NO: 2122327 - RNA, 19 nt, Homo sapiens
augcuccuccuccaugcuc

SEQ ID NO: 2122328 - RNA, 20 nt, Homo sapiens
uuuccugcgccccagacucc

SEQ ID NO: 2122329 - RNA, 13 nt, Homo sapiens
ugagaaauccccc

SEQ ID NO: 2122330 - RNA, 17 nt, Homo sapiens
ccuuuaaauauuucaca

SEQ ID NO: 2122331 - RNA, 16 nt, Homo sapiens
aaccucaccauuguga

SEQ ID NO: 2122332 - RNA, 22 nt, Homo sapiens
aucugucaaagaaaacuuccaa

SEQ ID NO: 2122333 - RNA, 17 nt, Homo sapiens
cuggcacuugggacaaa

SEQ ID NO: 2122334 - RNA, 20 nt, Homo sapiens
accuggacuggaucaagaag

SEQ ID NO: 2122335 - RNA, 13 nt, Homo sapiens
cugcuccaagagg

SEQ ID NO: 2122336 - RNA, 15 nt, Homo sapiens
cuuugucccuguugg

SEQ ID NO: 2122337 - RNA, 20 nt, Homo sapiens
aaaaucuagcacacucuucu

SEQ ID NO: 2122338 - RNA, 21 nt, Homo sapiens
ggauauuaaauguugcuuuaa

SEQ ID NO: 2122339 - RNA, 17 nt, Homo sapiens
uuuucagccauaccucu

SEQ ID NO: 2122340 - RNA, 12 nt, Homo sapiens
uuauuucauaca

SEQ ID NO: 2122341 - RNA, 19 nt, Homo sapiens
ugcaugcgccuacucgcuu

SEQ ID NO: 2122342 - RNA, 23 nt, Homo sapiens
aaagaugcauguuacugccaaaa

SEQ ID NO: 2122343 - RNA, 16 nt, Homo sapiens
augccaaaaugacuuu

SEQ ID NO: 2122344 - RNA, 20 nt, Homo sapiens
uccucauuuauacuauuauu

SEQ ID NO: 2122345 - RNA, 13 nt, Homo sapiens
aacagcuaaucuu

SEQ ID NO: 2122346 - RNA, 13 nt, Homo sapiens
cucuucuacacag

SEQ ID NO: 2122347 - RNA, 20 nt, Homo sapiens
agugcaaugcacgaucucag

SEQ ID NO: 2122348 - RNA, 18 nt, Homo sapiens
ucuggccuguacccagua

SEQ ID NO: 2122349 - RNA, 21 nt, Homo sapiens
uucauaacagugccauugucu

SEQ ID NO: 2122350 - RNA, 19 nt, Homo sapiens
auuuucugcccaacuuuca

SEQ ID NO: 2122351 - RNA, 15 nt, Homo sapiens
uguugaacacuugaa

SEQ ID NO: 2122352 - RNA, 15 nt, Homo sapiens
ugccugccacccugc

SEQ ID NO: 2122353 - RNA, 14 nt, Homo sapiens
agauguagcacuga

SEQ ID NO: 2122354 - RNA, 23 nt, Homo sapiens
uauuaucccagcuugcugagggg

SEQ ID NO: 2122355 - RNA, 21 nt, Homo sapiens
ugcauaaaagacaagcacuuu

SEQ ID NO: 2122356 - RNA, 15 nt, Homo sapiens
ucucaugucauuuaa

SEQ ID NO: 2122357 - RNA, 12 nt, Homo sapiens
cuauuugcaauu

SEQ ID NO: 2122358 - RNA, 13 nt, Homo sapiens
gaggcugccacac

SEQ ID NO: 2122359 - RNA, 18 nt, Homo sapiens
cauuuauguacaaaauga

SEQ ID NO: 2122360 - RNA, 16 nt, Homo sapiens
guuuuaugcuacugaa

SEQ ID NO: 2122361 - RNA, 17 nt, Homo sapiens
uauacacuucuggcuca

SEQ ID NO: 2122362 - RNA, 18 nt, Homo sapiens
guccacucucggggcccu

SEQ ID NO: 2122363 - RNA, 18 nt, Homo sapiens
ggcaaagaacucauuuga

SEQ ID NO: 2122364 - RNA, 18 nt, Homo sapiens
accuggaaggggcaaaga

SEQ ID NO: 2122365 - RNA, 16 nt, Homo sapiens
aagccagaguguauua

SEQ ID NO: 2122366 - RNA, 16 nt, Homo sapiens
cagagauaccauucaa

SEQ ID NO: 2122367 - RNA, 21 nt, Homo sapiens
acagacgucccuccacguuca

SEQ ID NO: 2122368 - RNA, 21 nt, Homo sapiens
ggacccuuggccuccauuucu

SEQ ID NO: 2122369 - RNA, 17 nt, Homo sapiens
cuguucaaagaugcauu

SEQ ID NO: 2122370 - RNA, 22 nt, Homo sapiens
uacauuugaacuauauccuucc

SEQ ID NO: 2122371 - RNA, 13 nt, Homo sapiens
uacucaugaucuu

SEQ ID NO: 2122372 - RNA, 13 nt, Homo sapiens
aaaacauguuaau

SEQ ID NO: 2122373 - RNA, 13 nt, Homo sapiens
uuggcaugaaggu

SEQ ID NO: 2122374 - RNA, 13 nt, Homo sapiens
uacacaugaucau

SEQ ID NO: 2122375 - RNA, 15 nt, Homo sapiens
aauuuguacuucuua

SEQ ID NO: 2122376 - RNA, 21 nt, Homo sapiens
auuaccaaaauauauauuaau

SEQ ID NO: 2122377 - RNA, 20 nt, Homo sapiens
cgaagacuauuuaguggaac

SEQ ID NO: 2122378 - RNA, 11 nt, Homo sapiens
ugaacauuucu

SEQ ID NO: 2122379 - RNA, 22 nt, Homo sapiens
cccaggugguuauggagagggu

SEQ ID NO: 2122380 - RNA, 15 nt, Homo sapiens
cggagucucagucug

SEQ ID NO: 2122381 - RNA, 13 nt, Homo sapiens
gagaaccucaggc

SEQ ID NO: 2122382 - RNA, 13 nt, Homo sapiens
aggaguucuaaca

SEQ ID NO: 2122383 - RNA, 23 nt, Homo sapiens
accaucaucaucuugucuaagac

SEQ ID NO: 2122384 - RNA, 13 nt, Homo sapiens
ugaaacguggaua

SEQ ID NO: 2122385 - RNA, 23 nt, Homo sapiens
aacuggucagggcaaaccugccu

SEQ ID NO: 2122386 - RNA, 17 nt, Homo sapiens
cuuaaacuugcaucacu

SEQ ID NO: 2122387 - RNA, 17 nt, Homo sapiens
agucuuagagcuuuacc

SEQ ID NO: 2122388 - RNA, 23 nt, Homo sapiens
uccaugacaguagcauacugaug

SEQ ID NO: 2122389 - RNA, 21 nt, Homo sapiens
aagaugaagagaagcugagaa

SEQ ID NO: 2122390 - RNA, 20 nt, Homo sapiens
cuagcuuugcagucguguaa

SEQ ID NO: 2122391 - RNA, 17 nt, Homo sapiens
cucaacccugugaucua

SEQ ID NO: 2122392 - RNA, 22 nt, Homo sapiens
uguuacauguuguauuaguaaa

SEQ ID NO: 2122393 - RNA, 13 nt, Homo sapiens
ucuucugucccag

SEQ ID NO: 2122394 - RNA, 15 nt, Homo sapiens
aaagaacauuuugcc

SEQ ID NO: 2122395 - RNA, 19 nt, Homo sapiens
acucaucuuuugaaacaga

SEQ ID NO: 2122396 - RNA, 15 nt, Homo sapiens
uaaagcacgugcaag

SEQ ID NO: 2122397 - RNA, 15 nt, Homo sapiens
uggaguggcucgcca

SEQ ID NO: 2122398 - RNA, 21 nt, Homo sapiens
ucucagcccgggacagggucu

SEQ ID NO: 2122399 - RNA, 16 nt, Homo sapiens
gcuucagaugacagau

SEQ ID NO: 2122400 - RNA, 17 nt, Homo sapiens
uaauucauugugauuua

SEQ ID NO: 2122401 - RNA, 11 nt, Homo sapiens
aaagugcauau

SEQ ID NO: 2122402 - RNA, 11 nt, Homo sapiens
uaugugcaaaa

SEQ ID NO: 2122403 - RNA, 17 nt, Homo sapiens
gugucuaaaauacuuga

SEQ ID NO: 2122404 - RNA, 13 nt, Homo sapiens
aaauaaugaacag

SEQ ID NO: 2122405 - RNA, 14 nt, Homo sapiens
ccauugucuuuaua

SEQ ID NO: 2122406 - RNA, 10 nt, Homo sapiens
uuguaucauu

SEQ ID NO: 2122407 - RNA, 13 nt, Homo sapiens
ccuccucccucag

SEQ ID NO: 2122408 - RNA, 18 nt, Homo sapiens
accaaaucguggcacgua

SEQ ID NO: 2122409 - RNA, 18 nt, Homo sapiens
ucucucggaacucccgca

SEQ ID NO: 2122410 - RNA, 23 nt, Homo sapiens
ccugauggccaggccucagggac

SEQ ID NO: 2122411 - RNA, 22 nt, Homo sapiens
aacugaucuccaacaguugaca

SEQ ID NO: 2122412 - RNA, 15 nt, Homo sapiens
aguguguguucuucc

SEQ ID NO: 2122413 - RNA, 22 nt, Homo sapiens
caaaugcauuucuaaagccauu

SEQ ID NO: 2122414 - RNA, 14 nt, Homo sapiens
ggcaugugcuguga

SEQ ID NO: 2122415 - RNA, 19 nt, Homo sapiens
cagggccauggcucagggu

SEQ ID NO: 2122416 - RNA, 15 nt, Homo sapiens
ccaaguauuuugcca

SEQ ID NO: 2122417 - RNA, 22 nt, Homo sapiens
uggcccagcacugcccauccca

SEQ ID NO: 2122418 - RNA, 24 nt, Homo sapiens
auuccuuucagcaauccaugagau

SEQ ID NO: 2122419 - RNA, 19 nt, Homo sapiens
cagaugacaaggauuagaa

SEQ ID NO: 2122420 - RNA, 19 nt, Homo sapiens
uaaaaguuuauuguuugau

SEQ ID NO: 2122421 - RNA, 14 nt, Homo sapiens
ugcuucccgaguga

SEQ ID NO: 2122422 - RNA, 14 nt, Homo sapiens
aguuacacuggaag

SEQ ID NO: 2122423 - RNA, 22 nt, Homo sapiens
aauguucuauuuaacaacuggg

SEQ ID NO: 2122424 - RNA, 15 nt, Homo sapiens
accuuaccagauuuu

SEQ ID NO: 2122425 - RNA, 22 nt, Homo sapiens
uccaauuaugugacaaccuuug

SEQ ID NO: 2122426 - RNA, 15 nt, Homo sapiens
uugguguauuugcca

SEQ ID NO: 2122427 - RNA, 19 nt, Homo sapiens
gcccgccuccagcaccaag

SEQ ID NO: 2122428 - RNA, 20 nt, Homo sapiens
auuucuuaaacacuugcaac

SEQ ID NO: 2122429 - RNA, 15 nt, Homo sapiens
guacuauucauucac

SEQ ID NO: 2122430 - RNA, 17 nt, Homo sapiens
cuggaucagcguggccu

SEQ ID NO: 2122431 - RNA, 18 nt, Homo sapiens
augaauaugaucccuaau

SEQ ID NO: 2122432 - RNA, 14 nt, Homo sapiens
ugcagcuauucaca

SEQ ID NO: 2122433 - RNA, 21 nt, Homo sapiens
aaaauuaucaccuuugucaga

SEQ ID NO: 2122434 - RNA, 13 nt, Homo sapiens
auucaucagggag

SEQ ID NO: 2122435 - RNA, 16 nt, Homo sapiens
cacaccaguugcccag

SEQ ID NO: 2122436 - RNA, 19 nt, Homo sapiens
cugauugaagacacacuca

SEQ ID NO: 2122437 - RNA, 21 nt, Homo sapiens
gagccccuuugccugucaagu

SEQ ID NO: 2122438 - RNA, 16 nt, Homo sapiens
uccuagguccucugag

SEQ ID NO: 2122439 - RNA, 18 nt, Homo sapiens
agcuucaaguuuucucag

SEQ ID NO: 2122440 - RNA, 18 nt, Homo sapiens
ccccacucccucacaagu

SEQ ID NO: 2122441 - RNA, 16 nt, Homo sapiens
ccuguggaaaggccaa

SEQ ID NO: 2122442 - RNA, 18 nt, Homo sapiens
gggacuuuggcauuucca

SEQ ID NO: 2122443 - RNA, 18 nt, Homo sapiens
guucaauuggacaauuau

SEQ ID NO: 2122444 - RNA, 21 nt, Homo sapiens
accugaagugagaacccagcu

SEQ ID NO: 2122445 - RNA, 18 nt, Homo sapiens
gcauuuagaaaucaagca

SEQ ID NO: 2122446 - RNA, 17 nt, Homo sapiens
ucccuuuaucaguuuga

SEQ ID NO: 2122447 - RNA, 19 nt, Homo sapiens
cacuauggacuuacccuaa

SEQ ID NO: 2122448 - RNA, 17 nt, Homo sapiens
agaagaauaucaaauaa

SEQ ID NO: 2122449 - RNA, 23 nt, Homo sapiens
ucuccagagggaauugcagagua

SEQ ID NO: 2122450 - RNA, 15 nt, Homo sapiens
ggccaagggcagggu

SEQ ID NO: 2122451 - RNA, 17 nt, Homo sapiens
agucuuucuaucaaaua

SEQ ID NO: 2122452 - RNA, 19 nt, Homo sapiens
ucuguagguugcacacuuu

SEQ ID NO: 2122453 - RNA, 14 nt, Homo sapiens
gaaacagaaccaua

SEQ ID NO: 2122454 - RNA, 21 nt, Homo sapiens
ccuugagcaagucccaucuca

SEQ ID NO: 2122455 - RNA, 16 nt, Homo sapiens
uccccuguacuuaccu

SEQ ID NO: 2122456 - RNA, 15 nt, Homo sapiens
gcucuucacuguggu

SEQ ID NO: 2122457 - RNA, 19 nt, Homo sapiens
gaaaguuaauccacuguga

SEQ ID NO: 2122458 - RNA, 13 nt, Homo sapiens
aaaugaaaagaga

SEQ ID NO: 2122459 - RNA, 12 nt, Homo sapiens
ggaaggaggcca

SEQ ID NO: 2122460 - RNA, 20 nt, Homo sapiens
agauuagcucuggaccagcc

SEQ ID NO: 2122461 - RNA, 16 nt, Homo sapiens
aguuuauacagaacuc

SEQ ID NO: 2122462 - RNA, 23 nt, Homo sapiens
aggccuauaacuuuugguaucua

SEQ ID NO: 2122463 - RNA, 14 nt, Homo sapiens
auuuuauacauuaa

SEQ ID NO: 2122464 - RNA, 21 nt, Homo sapiens
ucagaaacacccucacacugg

SEQ ID NO: 2122465 - RNA, 21 nt, Homo sapiens
aaaagcuuuaucuauuaccaa

SEQ ID NO: 2122466 - RNA, 14 nt, Homo sapiens
uacguauaccuugu

SEQ ID NO: 2122467 - RNA, 23 nt, Homo sapiens
aauaugaucagguaacuuucgac

SEQ ID NO: 2122468 - RNA, 16 nt, Homo sapiens
agcugaaaauggagaa

SEQ ID NO: 2122469 - RNA, 18 nt, Homo sapiens
uaagaagcuuucaguauu

SEQ ID NO: 2122470 - RNA, 21 nt, Homo sapiens
agacugccagcucuuccuagc

SEQ ID NO: 2122471 - RNA, 16 nt, Homo sapiens
gcaggaguggugcaga

SEQ ID NO: 2122472 - RNA, 12 nt, Homo sapiens
ccuaggugggag

SEQ ID NO: 2122473 - RNA, 23 nt, Homo sapiens
gugcagaugagcagucacacugu

SEQ ID NO: 2122474 - RNA, 16 nt, Homo sapiens
aaagggauuuucagcc

SEQ ID NO: 2122475 - RNA, 16 nt, Homo sapiens
cccuucuccuuucuaa

SEQ ID NO: 2122476 - RNA, 14 nt, Homo sapiens
ccugccgggcacau

SEQ ID NO: 2122477 - RNA, 18 nt, Homo sapiens
aguuuuuuauacugcacu

SEQ ID NO: 2122478 - RNA, 19 nt, Homo sapiens
ugcugcacccaacuacuga

SEQ ID NO: 2122479 - RNA, 18 nt, Homo sapiens
ccugggugacagagugag

SEQ ID NO: 2122480 - RNA, 23 nt, Homo sapiens
gccauggcuggaaugaugaaggg

SEQ ID NO: 2122481 - RNA, 16 nt, Homo sapiens
cucucaacaccaugau

SEQ ID NO: 2122482 - RNA, 23 nt, Homo sapiens
gcuguccuccagggcgagcacuu

SEQ ID NO: 2122483 - RNA, 11 nt, Homo sapiens
uuccagcugcu

SEQ ID NO: 2122484 - RNA, 15 nt, Homo sapiens
uuuaauuuuugcaau

SEQ ID NO: 2122485 - RNA, 15 nt, Homo sapiens
cccuaacuucuguaa

SEQ ID NO: 2122486 - RNA, 23 nt, Homo sapiens
gaucccgcguagugucaguacua

SEQ ID NO: 2122487 - RNA, 15 nt, Homo sapiens
agaugucauuuccac

SEQ ID NO: 2122488 - RNA, 14 nt, Homo sapiens
gaaaaaggaaaaau

SEQ ID NO: 2122489 - RNA, 20 nt, Homo sapiens
ucaacuuagucaauaagaaa

SEQ ID NO: 2122490 - RNA, 19 nt, Homo sapiens
uggggaugguccacuguca

SEQ ID NO: 2122491 - RNA, 17 nt, Homo sapiens
ucuauuccuaucugugg

SEQ ID NO: 2122492 - RNA, 21 nt, Homo sapiens
uugcucuuggaaagcugauga

SEQ ID NO: 2122493 - RNA, 23 nt, Homo sapiens
cccuucuguguuucuggagugau

SEQ ID NO: 2122494 - RNA, 21 nt, Homo sapiens
cacgaacucaaggguuuucca

SEQ ID NO: 2122495 - RNA, 23 nt, Homo sapiens
cgaggaaaagagaaggaaaguga

SEQ ID NO: 2122496 - RNA, 15 nt, Homo sapiens
cacuucaaucugaga

SEQ ID NO: 2122497 - RNA, 19 nt, Homo sapiens
gaccuguaccgcagccgcc

SEQ ID NO: 2122498 - RNA, 18 nt, Homo sapiens
cuucuguuucacaguuca

SEQ ID NO: 2122499 - RNA, 17 nt, Homo sapiens
gggaaaacccaggguga

SEQ ID NO: 2122500 - RNA, 16 nt, Homo sapiens
ucuuacucuuuguaug

SEQ ID NO: 2122501 - RNA, 19 nt, Homo sapiens
aauccagagaagcgcuguu

SEQ ID NO: 2122502 - RNA, 20 nt, Homo sapiens
ucugcagcugacuaaaggcc

SEQ ID NO: 2122503 - RNA, 17 nt, Homo sapiens
cuccaucaugcuugauu

SEQ ID NO: 2122504 - RNA, 15 nt, Homo sapiens
aggaugcagcacugc

SEQ ID NO: 2122505 - RNA, 17 nt, Homo sapiens
cuacuuguaaaggugcu

SEQ ID NO: 2122506 - RNA, 13 nt, Homo sapiens
gguaguacuggga

SEQ ID NO: 2122507 - RNA, 21 nt, Homo sapiens
gggguaggugaugggggacga

SEQ ID NO: 2122508 - RNA, 17 nt, Homo sapiens
uacugucucuuucauga

SEQ ID NO: 2122509 - RNA, 18 nt, Homo sapiens
guaucucggaccuuucag

SEQ ID NO: 2122510 - RNA, 15 nt, Homo sapiens
aauacaugcaucuca

SEQ ID NO: 2122511 - RNA, 18 nt, Homo sapiens
auauguguaaagauuuau

SEQ ID NO: 2122512 - RNA, 20 nt, Homo sapiens
aucaugccccuguacuccag

SEQ ID NO: 2122513 - RNA, 13 nt, Homo sapiens
aggcaggugggcu

SEQ ID NO: 2122514 - RNA, 15 nt, Homo sapiens
uuggcaucugcaaag

SEQ ID NO: 2122515 - RNA, 19 nt, Homo sapiens
agccagcuccugcacaaau

SEQ ID NO: 2122516 - RNA, 16 nt, Homo sapiens
aagaacgugaucuccu

SEQ ID NO: 2122517 - RNA, 12 nt, Homo sapiens
caaucccaaaag

SEQ ID NO: 2122518 - RNA, 16 nt, Homo sapiens
gauauaagugcuguau

SEQ ID NO: 2122519 - RNA, 20 nt, Homo sapiens
aacaauaaagauacaugauu

SEQ ID NO: 2122520 - RNA, 16 nt, Homo sapiens
cuaaaccaacugaagg

SEQ ID NO: 2122521 - RNA, 15 nt, Homo sapiens
cuugaaaguagcaau

SEQ ID NO: 2122522 - RNA, 23 nt, Homo sapiens
gggauucacaaggugaagaacug

SEQ ID NO: 2122523 - RNA, 18 nt, Homo sapiens
cccuacuauucaguggcg

SEQ ID NO: 2122524 - RNA, 23 nt, Homo sapiens
ucugcuuuuuaaagaaugcucuu

SEQ ID NO: 2122525 - RNA, 11 nt, Homo sapiens
acucugagaug

SEQ ID NO: 2122526 - RNA, 14 nt, Homo sapiens
caaaauuccauccc

SEQ ID NO: 2122527 - RNA, 17 nt, Homo sapiens
cugaggaaugcgguuca

SEQ ID NO: 2122528 - RNA, 20 nt, Homo sapiens
aauggugugaucucggcuca

SEQ ID NO: 2122529 - RNA, 22 nt, Homo sapiens
aggguuucugagcugcucugaa

SEQ ID NO: 2122530 - RNA, 21 nt, Homo sapiens
uggccaucacuuucauucaau

SEQ ID NO: 2122531 - RNA, 21 nt, Homo sapiens
cuuugggugcuguuuugccag

SEQ ID NO: 2122532 - RNA, 15 nt, Homo sapiens
cucaggccucugcag

SEQ ID NO: 2122533 - RNA, 17 nt, Homo sapiens
aacacucaacaaacuua

SEQ ID NO: 2122534 - RNA, 21 nt, Homo sapiens
gaagauccaccuccccacugc

SEQ ID NO: 2122535 - RNA, 20 nt, Homo sapiens
cuuacauuuucccaguaauu

SEQ ID NO: 2122536 - RNA, 19 nt, Homo sapiens
gaaugcugacaaugcugcc

SEQ ID NO: 2122537 - RNA, 22 nt, Homo sapiens
ugcaugaccucuacauugaaaa

SEQ ID NO: 2122538 - RNA, 19 nt, Homo sapiens
uccuaggccacaccaucuc

SEQ ID NO: 2122539 - RNA, 22 nt, Homo sapiens
uugaaaaagauauuuaugaugu

SEQ ID NO: 2122540 - RNA, 21 nt, Homo sapiens
uccagguuuccuuaagggaca

SEQ ID NO: 2122541 - RNA, 23 nt, Homo sapiens
cacacaccaccaugcucaacuaa

SEQ ID NO: 2122542 - RNA, 18 nt, Homo sapiens
uucauuuagucaugugac

SEQ ID NO: 2122543 - RNA, 23 nt, Homo sapiens
ggaaugccagggacauuuucaag

SEQ ID NO: 2122544 - RNA, 16 nt, Homo sapiens
ucagaaaugacuuuuu

SEQ ID NO: 2122545 - RNA, 10 nt, Homo sapiens
uaggcccaag

SEQ ID NO: 2122546 - RNA, 20 nt, Homo sapiens
uuuuuauaaugacuggucuu

SEQ ID NO: 2122547 - RNA, 21 nt, Homo sapiens
cugaagaagaucccagaggau

SEQ ID NO: 2122548 - RNA, 20 nt, Homo sapiens
aaaucugugcuacacuggau

SEQ ID NO: 2122549 - RNA, 21 nt, Homo sapiens
cuggugaccacccaccaccug

SEQ ID NO: 2122550 - RNA, 19 nt, Homo sapiens
ucccuguuaucugcuagau

SEQ ID NO: 2122551 - RNA, 17 nt, Homo sapiens
agccguuuguuccccaa

SEQ ID NO: 2122552 - RNA, 15 nt, Homo sapiens
cagugauaacucuga

SEQ ID NO: 2122553 - RNA, 20 nt, Homo sapiens
gaacacuuuugaaaauguac

SEQ ID NO: 2122554 - RNA, 23 nt, Homo sapiens
aagcacaugaauaauuucacuua

SEQ ID NO: 2122555 - RNA, 18 nt, Homo sapiens
aaauaccauuuacaguau

SEQ ID NO: 2122556 - RNA, 16 nt, Homo sapiens
caaagcuuaugugaca

SEQ ID NO: 2122557 - RNA, 18 nt, Homo sapiens
aagagggggcucugccca

SEQ ID NO: 2122558 - RNA, 14 nt, Homo sapiens
agaugccaaagggg

SEQ ID NO: 2122559 - RNA, 16 nt, Homo sapiens
auuacccugagcugca

SEQ ID NO: 2122560 - RNA, 14 nt, Homo sapiens
agccaauagacuga

SEQ ID NO: 2122561 - RNA, 14 nt, Homo sapiens
aaauguuaggacau

SEQ ID NO: 2122562 - RNA, 22 nt, Homo sapiens
gcuggaguccuguucucagagc

SEQ ID NO: 2122563 - RNA, 17 nt, Homo sapiens
cagcugagcuugagcuc

SEQ ID NO: 2122564 - RNA, 22 nt, Homo sapiens
gaagucaccccuuucuguccca

SEQ ID NO: 2122565 - RNA, 18 nt, Homo sapiens
aacuccaaaugagccaua

SEQ ID NO: 2122566 - RNA, 19 nt, Homo sapiens
uguuuuuuuucagcacaug

SEQ ID NO: 2122567 - RNA, 14 nt, Homo sapiens
cugauccagccuuu

SEQ ID NO: 2122568 - RNA, 17 nt, Homo sapiens
caugauugugaccucca

SEQ ID NO: 2122569 - RNA, 23 nt, Homo sapiens
ucuacagauccuuuuuccaucau

SEQ ID NO: 2122570 - RNA, 18 nt, Homo sapiens
aauugcuaagaagggaaa

SEQ ID NO: 2122571 - RNA, 16 nt, Homo sapiens
aggacugguaaaauac

SEQ ID NO: 2122572 - RNA, 22 nt, Homo sapiens
aacuccccucagggauacgaca

SEQ ID NO: 2122573 - RNA, 13 nt, Homo sapiens
ugugucugugaac

SEQ ID NO: 2122574 - RNA, 15 nt, Homo sapiens
cagaauuuccacugu

SEQ ID NO: 2122575 - RNA, 16 nt, Homo sapiens
accaggccaagacuca

SEQ ID NO: 2122576 - RNA, 18 nt, Homo sapiens
ccauauauaacagauaca

SEQ ID NO: 2122577 - RNA, 23 nt, Homo sapiens
uuguguggagaaguguguucuga

SEQ ID NO: 2122578 - RNA, 15 nt, Homo sapiens
aaggcaaaugaugcc

SEQ ID NO: 2122579 - RNA, 16 nt, Homo sapiens
gaagacgauguguuga

SEQ ID NO: 2122580 - RNA, 20 nt, Homo sapiens
uaguguugagacccaggccu

SEQ ID NO: 2122581 - RNA, 17 nt, Homo sapiens
cuacagacuccaaaagg

SEQ ID NO: 2122582 - RNA, 22 nt, Homo sapiens
cugaauugcccguuuccauaca

SEQ ID NO: 2122583 - RNA, 23 nt, Homo sapiens
ugcugaggcccagugcauaugca

SEQ ID NO: 2122584 - RNA, 23 nt, Homo sapiens
ucuugguaacaaauaaccuauaa

SEQ ID NO: 2122585 - RNA, 14 nt, Homo sapiens
cagacuucccugaa

SEQ ID NO: 2122586 - RNA, 15 nt, Homo sapiens
uaaacuguacagugu

SEQ ID NO: 2122587 - RNA, 14 nt, Homo sapiens
gugaauaggcugcu

SEQ ID NO: 2122588 - RNA, 16 nt, Homo sapiens
aaguaccaacugagcc

SEQ ID NO: 2122589 - RNA, 19 nt, Homo sapiens
gaucaugaaucacugcacc

SEQ ID NO: 2122590 - RNA, 16 nt, Homo sapiens
ucacccaccccaugga

SEQ ID NO: 2122591 - RNA, 22 nt, Homo sapiens
gucaaggacaaaaaaccucagg

SEQ ID NO: 2122592 - RNA, 22 nt, Homo sapiens
aucuuccaaggguacuaaggaa

SEQ ID NO: 2122593 - RNA, 22 nt, Homo sapiens
agcuggcagagagcacagugau

SEQ ID NO: 2122594 - RNA, 17 nt, Homo sapiens
cuggaaugauuucagcu

SEQ ID NO: 2122595 - RNA, 13 nt, Homo sapiens
ccaggauugacag

SEQ ID NO: 2122596 - RNA, 19 nt, Homo sapiens
cagaauguaaaauugguaa

SEQ ID NO: 2122597 - RNA, 18 nt, Homo sapiens
cugaucauuaaagccuga

SEQ ID NO: 2122598 - RNA, 21 nt, Homo sapiens
cuucugacccagggcugagac

SEQ ID NO: 2122599 - RNA, 16 nt, Homo sapiens
accaauugugcugcca

SEQ ID NO: 2122600 - RNA, 18 nt, Homo sapiens
gccccgccgugucugugg

SEQ ID NO: 2122601 - RNA, 23 nt, Homo sapiens
gugcaguaucaugcccugugcaa

SEQ ID NO: 2122602 - RNA, 18 nt, Homo sapiens
ugugaaguucaucuugca

SEQ ID NO: 2122603 - RNA, 18 nt, Homo sapiens
aacuggaauuaaaaggau

SEQ ID NO: 2122604 - RNA, 21 nt, Homo sapiens
cacagagauaauucuagcuuu

SEQ ID NO: 2122605 - RNA, 20 nt, Homo sapiens
auacagguccugcacauuac

SEQ ID NO: 2122606 - RNA, 11 nt, Homo sapiens
guuuguuaaaa

SEQ ID NO: 2122607 - RNA, 12 nt, Homo sapiens
agccacuagcuu

SEQ ID NO: 2122608 - RNA, 12 nt, Homo sapiens
gagguguugcua

SEQ ID NO: 2122609 - RNA, 20 nt, Homo sapiens
caauuuuuuauucauuuuaa

SEQ ID NO: 2122610 - RNA, 16 nt, Homo sapiens
ugucugcccuagggag

SEQ ID NO: 2122611 - RNA, 17 nt, Homo sapiens
uuacuuuuaccacuauu

SEQ ID NO: 2122612 - RNA, 17 nt, Homo sapiens
uaaaauguacucuccuu

SEQ ID NO: 2122613 - RNA, 19 nt, Homo sapiens
agaaaagacaaaugugcuc

SEQ ID NO: 2122614 - RNA, 12 nt, Homo sapiens
uguacugauaua

SEQ ID NO: 2122615 - RNA, 20 nt, Homo sapiens
aaggugccacuccagugccc

SEQ ID NO: 2122616 - RNA, 20 nt, Homo sapiens
uguuaaauaaggccucaucc

SEQ ID NO: 2122617 - RNA, 21 nt, Homo sapiens
acuauuguaaugccaauauga

SEQ ID NO: 2122618 - RNA, 18 nt, Homo sapiens
auuaauguauccaaugaa

SEQ ID NO: 2122619 - RNA, 16 nt, Homo sapiens
cacccaagagcugucc

SEQ ID NO: 2122620 - RNA, 20 nt, Homo sapiens
uaaauucccuggccuuucau

SEQ ID NO: 2122621 - RNA, 14 nt, Homo sapiens
cauuaaauguuuga

SEQ ID NO: 2122622 - RNA, 19 nt, Homo sapiens
uacauuuaauagacuuaca

SEQ ID NO: 2122623 - RNA, 21 nt, Homo sapiens
uccagcacucccucccagaga

SEQ ID NO: 2122624 - RNA, 13 nt, Homo sapiens
uaggagagccaac

SEQ ID NO: 2122625 - RNA, 21 nt, Homo sapiens
cacauccuacaguuggaaauc

SEQ ID NO: 2122626 - RNA, 22 nt, Homo sapiens
gcugugcccaaguuguggugcu

SEQ ID NO: 2122627 - RNA, 18 nt, Homo sapiens
agccaaccaagaugcaaa

SEQ ID NO: 2122628 - RNA, 19 nt, Homo sapiens
agugcacuuuaagaggugg

SEQ ID NO: 2122629 - RNA, 20 nt, Homo sapiens
gcaaagauuauuuucauuua

SEQ ID NO: 2122630 - RNA, 12 nt, Homo sapiens
cucaaaauggaa

SEQ ID NO: 2122631 - RNA, 14 nt, Homo sapiens
gcuggcaguacugu

SEQ ID NO: 2122632 - RNA, 13 nt, Homo sapiens
cuauuccauugac

SEQ ID NO: 2122633 - RNA, 22 nt, Homo sapiens
acaccggguuccagcaccacac

SEQ ID NO: 2122634 - RNA, 21 nt, Homo sapiens
agacaggaaaguucagaguuu

SEQ ID NO: 2122635 - RNA, 11 nt, Homo sapiens
uuguacaguuc

SEQ ID NO: 2122636 - RNA, 13 nt, Homo sapiens
cccagaacuccau

SEQ ID NO: 2122637 - RNA, 22 nt, Homo sapiens
ucacuguucaguuuagcauuaa

SEQ ID NO: 2122638 - RNA, 19 nt, Homo sapiens
aaaauguccaccaauagaa

SEQ ID NO: 2122639 - RNA, 22 nt, Homo sapiens
cucgaacccacacugcaacagg

SEQ ID NO: 2122640 - RNA, 19 nt, Homo sapiens
ccacgcccccagcugugac

SEQ ID NO: 2122641 - RNA, 19 nt, Homo sapiens
gcaauagacacauacaugu

SEQ ID NO: 2122642 - RNA, 15 nt, Homo sapiens
ucagaaaugucauga

SEQ ID NO: 2122643 - RNA, 19 nt, Homo sapiens
uucauaaagaugucucaca

SEQ ID NO: 2122644 - RNA, 14 nt, Homo sapiens
aauuaaagugcugu

SEQ ID NO: 2122645 - RNA, 19 nt, Homo sapiens
guucauauuggacugauaa

SEQ ID NO: 2122646 - RNA, 20 nt, Homo sapiens
aguaaagaugggguuucacc

SEQ ID NO: 2122647 - RNA, 20 nt, Homo sapiens
ucaguuaucuguuuguuacu

SEQ ID NO: 2122648 - RNA, 18 nt, Homo sapiens
gaugcccacauacugucu

SEQ ID NO: 2122649 - RNA, 19 nt, Homo sapiens
accccagcugaccugguac

SEQ ID NO: 2122650 - RNA, 15 nt, Homo sapiens
cuugccaaccuguaa

SEQ ID NO: 2122651 - RNA, 15 nt, Homo sapiens
uuaucaaaucauuca

SEQ ID NO: 2122652 - RNA, 17 nt, Homo sapiens
acuacaguaacugugac

SEQ ID NO: 2122653 - RNA, 17 nt, Homo sapiens
cagcaggaugcucagug

SEQ ID NO: 2122654 - RNA, 21 nt, Homo sapiens
cagaauuuucuggccuuucau

SEQ ID NO: 2122655 - RNA, 23 nt, Homo sapiens
gcccgugagggugggggggaccg

SEQ ID NO: 2122656 - RNA, 22 nt, Homo sapiens
accauucuccggccucagucuc

SEQ ID NO: 2122657 - RNA, 15 nt, Homo sapiens
ugcuguggagccuua

SEQ ID NO: 2122658 - RNA, 23 nt, Homo sapiens
augccuggucccaagacagugag

SEQ ID NO: 2122659 - RNA, 19 nt, Homo sapiens
cagcacuguauguguugca

SEQ ID NO: 2122660 - RNA, 13 nt, Homo sapiens
ugggauacagauc

SEQ ID NO: 2122661 - RNA, 14 nt, Homo sapiens
uuagagacaucaaa

SEQ ID NO: 2122662 - RNA, 13 nt, Homo sapiens
ugaaagaaguauu

SEQ ID NO: 2122663 - RNA, 22 nt, Homo sapiens
uuuuauaaauucagaaagucau

SEQ ID NO: 2122664 - RNA, 14 nt, Homo sapiens
ugucacacacugga

SEQ ID NO: 2122665 - RNA, 15 nt, Homo sapiens
cacaccagaaagcua

SEQ ID NO: 2122666 - RNA, 19 nt, Homo sapiens
cauuguucagaugcuucuu

SEQ ID NO: 2122667 - RNA, 18 nt, Homo sapiens
uaaggggggaacaugcau

SEQ ID NO: 2122668 - RNA, 15 nt, Homo sapiens
uacuuagacaguaug

SEQ ID NO: 2122669 - RNA, 15 nt, Homo sapiens
uucuuuuacuguaau

SEQ ID NO: 2122670 - RNA, 15 nt, Homo sapiens
gauuauauaagcaaa

SEQ ID NO: 2122671 - RNA, 19 nt, Homo sapiens
agauuuaagcaagaccaug

SEQ ID NO: 2122672 - RNA, 18 nt, Homo sapiens
ccaauccucaccuaacag

SEQ ID NO: 2122673 - RNA, 17 nt, Homo sapiens
aggguuccagacagggu

SEQ ID NO: 2122674 - RNA, 12 nt, Homo sapiens
ugcuaagcucca

SEQ ID NO: 2122675 - RNA, 17 nt, Homo sapiens
cccccucuguugcacau

SEQ ID NO: 2122676 - RNA, 21 nt, Homo sapiens
acauuuagcugugcucagaag

SEQ ID NO: 2122677 - RNA, 22 nt, Homo sapiens
aggagccaccagcaccacucag

SEQ ID NO: 2122678 - RNA, 17 nt, Homo sapiens
acgggaaacucaaggag

SEQ ID NO: 2122679 - RNA, 15 nt, Homo sapiens
uccugccucuuugag

SEQ ID NO: 2122680 - RNA, 21 nt, Homo sapiens
acacugguuuggucaguuaca

SEQ ID NO: 2122681 - RNA, 17 nt, Homo sapiens
aauauguauccucuaua

SEQ ID NO: 2122682 - RNA, 21 nt, Homo sapiens
uagaacucaaccucuacaggg

SEQ ID NO: 2122683 - RNA, 18 nt, Homo sapiens
cugaugagaaaggccuga

SEQ ID NO: 2122684 - RNA, 13 nt, Homo sapiens
agccugcaccgcc

SEQ ID NO: 2122685 - RNA, 17 nt, Homo sapiens
cuuuccacuuccagagg

SEQ ID NO: 2122686 - RNA, 14 nt, Homo sapiens
ucuacaauacauau

SEQ ID NO: 2122687 - RNA, 19 nt, Homo sapiens
ugcuuaagguaugguacaa

SEQ ID NO: 2122688 - RNA, 19 nt, Homo sapiens
ggacaagacccucucaggc

SEQ ID NO: 2122689 - RNA, 18 nt, Homo sapiens
cuuuuuaaaaaaguuugg

SEQ ID NO: 2122690 - RNA, 18 nt, Homo sapiens
aaucucaaauaacuaaaa

SEQ ID NO: 2122691 - RNA, 13 nt, Homo sapiens
cugugaacacugg

SEQ ID NO: 2122692 - RNA, 22 nt, Homo sapiens
uccccugacagggccagugcag

SEQ ID NO: 2122693 - RNA, 16 nt, Homo sapiens
uaucauuccaauucua

SEQ ID NO: 2122694 - RNA, 19 nt, Homo sapiens
acucucauccaaauggcau

SEQ ID NO: 2122695 - RNA, 19 nt, Homo sapiens
cagagguugcagugagcua

SEQ ID NO: 2122696 - RNA, 16 nt, Homo sapiens
cacuacaguacaguga

SEQ ID NO: 2122697 - RNA, 19 nt, Homo sapiens
cuccagccccugugacauc

SEQ ID NO: 2122698 - RNA, 15 nt, Homo sapiens
auccuagcacuuugg

SEQ ID NO: 2122699 - RNA, 16 nt, Homo sapiens
ucgcuuaagccagcac

SEQ ID NO: 2122700 - RNA, 15 nt, Homo sapiens
uccaugauaacugca

SEQ ID NO: 2122701 - RNA, 14 nt, Homo sapiens
uagaauuagcuuuu

SEQ ID NO: 2122702 - RNA, 17 nt, Homo sapiens
cugccuuugagcuucuc

SEQ ID NO: 2122703 - RNA, 12 nt, Homo sapiens
cucauagcacuu

SEQ ID NO: 2122704 - RNA, 15 nt, Homo sapiens
gagcagcaucauuca

SEQ ID NO: 2122705 - RNA, 12 nt, Homo sapiens
ucucacucugcc

SEQ ID NO: 2122706 - RNA, 12 nt, Homo sapiens
gaaaaguguuau

SEQ ID NO: 2122707 - RNA, 15 nt, Homo sapiens
agcuguuguacguac

SEQ ID NO: 2122708 - RNA, 12 nt, Homo sapiens
acuuuccuuuaa

SEQ ID NO: 2122709 - RNA, 23 nt, Homo sapiens
aucaaccccccgacugugcugcu

SEQ ID NO: 2122710 - RNA, 13 nt, Homo sapiens
acugugcauuuga

SEQ ID NO: 2122711 - RNA, 19 nt, Homo sapiens
aaugcauauccaacaugug

SEQ ID NO: 2122712 - RNA, 15 nt, Homo sapiens
acccuugcugugaau

SEQ ID NO: 2122713 - RNA, 12 nt, Homo sapiens
ucaaaccuacca

SEQ ID NO: 2122714 - RNA, 13 nt, Homo sapiens
gugcucuuuccac

SEQ ID NO: 2122715 - RNA, 18 nt, Homo sapiens
cuugccuauuugcugacc

SEQ ID NO: 2122716 - RNA, 13 nt, Homo sapiens
gacaccugugcac

SEQ ID NO: 2122717 - RNA, 21 nt, Homo sapiens
cugaauuuuggggauuuucaa

SEQ ID NO: 2122718 - RNA, 21 nt, Homo sapiens
agguccugggggccugaccuc

SEQ ID NO: 2122719 - RNA, 16 nt, Homo sapiens
cacaccgucuuccuuc

SEQ ID NO: 2122720 - RNA, 16 nt, Homo sapiens
uuuaacuuuaccaugc

SEQ ID NO: 2122721 - RNA, 19 nt, Homo sapiens
cugagcuaacgugcuguca

SEQ ID NO: 2122722 - RNA, 14 nt, Homo sapiens
uaguguuauacuug

SEQ ID NO: 2122723 - RNA, 15 nt, Homo sapiens
auucuguguggcacc

SEQ ID NO: 2122724 - RNA, 20 nt, Homo sapiens
cuguucucuugggaacugaa

SEQ ID NO: 2122725 - RNA, 10 nt, Homo sapiens
aguccucaca

SEQ ID NO: 2122726 - RNA, 22 nt, Homo sapiens
gcccuuccuccugaagccucug

SEQ ID NO: 2122727 - RNA, 21 nt, Homo sapiens
acccgauuuguuuauuugcaa

SEQ ID NO: 2122728 - RNA, 21 nt, Homo sapiens
ugaaacugacuugcugugacu

SEQ ID NO: 2122729 - RNA, 20 nt, Homo sapiens
agccagucaugguggcacac

SEQ ID NO: 2122730 - RNA, 20 nt, Homo sapiens
ggacaaagucuccagcccac

SEQ ID NO: 2122731 - RNA, 15 nt, Homo sapiens
agcaugaugagaguu

SEQ ID NO: 2122732 - RNA, 20 nt, Homo sapiens
ccaauauuuauaauuaaaga

SEQ ID NO: 2122733 - RNA, 19 nt, Homo sapiens
cauauggauugccaaguca

SEQ ID NO: 2122734 - RNA, 13 nt, Homo sapiens
acugaauucugcc

SEQ ID NO: 2122735 - RNA, 15 nt, Homo sapiens
cgccagcucccgcca

SEQ ID NO: 2122736 - RNA, 14 nt, Homo sapiens
gaacaaagcaccuc

SEQ ID NO: 2122737 - RNA, 13 nt, Homo sapiens
uauacagugauau

SEQ ID NO: 2122738 - RNA, 16 nt, Homo sapiens
guuaagugaaugucua

SEQ ID NO: 2122739 - RNA, 18 nt, Homo sapiens
guaugcacacacauauau

SEQ ID NO: 2122740 - RNA, 14 nt, Homo sapiens
agaguagagucacu

SEQ ID NO: 2122741 - RNA, 14 nt, Homo sapiens
ggcauguugggaua

SEQ ID NO: 2122742 - RNA, 15 nt, Homo sapiens
auugguuucuaggca

SEQ ID NO: 2122743 - RNA, 16 nt, Homo sapiens
gaaauaacacugugaa

SEQ ID NO: 2122744 - RNA, 14 nt, Homo sapiens
aggggaggcucagg

SEQ ID NO: 2122745 - RNA, 12 nt, Homo sapiens
accuuguucuau

SEQ ID NO: 2122746 - RNA, 20 nt, Homo sapiens
cagcacgcuggacagcacuc

SEQ ID NO: 2122747 - RNA, 17 nt, Homo sapiens
auuuugagcaaaccaca

SEQ ID NO: 2122748 - RNA, 16 nt, Homo sapiens
ggcaggagacugugga

SEQ ID NO: 2122749 - RNA, 16 nt, Homo sapiens
aagauuaaaaagcaca

SEQ ID NO: 2122750 - RNA, 20 nt, Homo sapiens
guggaacagcccaugcugag

SEQ ID NO: 2122751 - RNA, 14 nt, Homo sapiens
cauugugauguaua

SEQ ID NO: 2122752 - RNA, 12 nt, Homo sapiens
uuucugauugca

SEQ ID NO: 2122753 - RNA, 16 nt, Homo sapiens
guagcauccucuuuaa

SEQ ID NO: 2122754 - RNA, 13 nt, Homo sapiens
aauucucaagccg

SEQ ID NO: 2122755 - RNA, 12 nt, Homo sapiens
agagagucccag

SEQ ID NO: 2122756 - RNA, 20 nt, Homo sapiens
aagcacagccucagaauaaa

SEQ ID NO: 2122757 - RNA, 16 nt, Homo sapiens
aguguuuuuacauaua

SEQ ID NO: 2122758 - RNA, 14 nt, Homo sapiens
guauuuaggggcaa

SEQ ID NO: 2122759 - RNA, 23 nt, Homo sapiens
aagcauuauccuuuuaucucaca

SEQ ID NO: 2122760 - RNA, 21 nt, Homo sapiens
acccaaccacaucccacucac

SEQ ID NO: 2122761 - RNA, 22 nt, Homo sapiens
ugaaacaaaauccaacccuguc

SEQ ID NO: 2122762 - RNA, 21 nt, Homo sapiens
aaaugaaagggaaacugggaa

SEQ ID NO: 2122763 - RNA, 16 nt, Homo sapiens
cauggagacucugaga

SEQ ID NO: 2122764 - RNA, 14 nt, Homo sapiens
uuguucuacugaga

SEQ ID NO: 2122765 - RNA, 14 nt, Homo sapiens
ucgcucgacugcga

SEQ ID NO: 2122766 - RNA, 13 nt, Homo sapiens
caggacccugcuu

SEQ ID NO: 2122767 - RNA, 16 nt, Homo sapiens
cagaugagcagucaca

SEQ ID NO: 2122768 - RNA, 18 nt, Homo sapiens
uucagacugugcaauacu

SEQ ID NO: 2122769 - RNA, 23 nt, Homo sapiens
accuaaaaggaaaucucacccca

SEQ ID NO: 2122770 - RNA, 13 nt, Homo sapiens
agugacuuugcag

SEQ ID NO: 2122771 - RNA, 19 nt, Homo sapiens
ccccuuuacucauagcacu

SEQ ID NO: 2122772 - RNA, 21 nt, Homo sapiens
cuauuuaaaaaaaaagucaga

SEQ ID NO: 2122773 - RNA, 14 nt, Homo sapiens
aaagagguuuucac

SEQ ID NO: 2122774 - RNA, 13 nt, Homo sapiens
acauauagcugau

SEQ ID NO: 2122775 - RNA, 23 nt, Homo sapiens
caaacucuggggcucaagcaguu

SEQ ID NO: 2122776 - RNA, 18 nt, Homo sapiens
cuaucauuaaaguucuag

SEQ ID NO: 2122777 - RNA, 20 nt, Homo sapiens
cuuugaaacuccaugcaaac

SEQ ID NO: 2122778 - RNA, 20 nt, Homo sapiens
uccaaauggagaagcugcag

SEQ ID NO: 2122779 - RNA, 17 nt, Homo sapiens
ucaccauacacacuguu

SEQ ID NO: 2122780 - RNA, 12 nt, Homo sapiens
cuauuaucucaa

SEQ ID NO: 2122781 - RNA, 13 nt, Homo sapiens
guacauucuuccu

SEQ ID NO: 2122782 - RNA, 18 nt, Homo sapiens
ccaagucagcaguccuag

SEQ ID NO: 2122783 - RNA, 23 nt, Homo sapiens
gucauuuauucaaguauugagaa

SEQ ID NO: 2122784 - RNA, 15 nt, Homo sapiens
ugcuuugagaucucu

SEQ ID NO: 2122785 - RNA, 18 nt, Homo sapiens
ucagcugccccaauguga

SEQ ID NO: 2122786 - RNA, 13 nt, Homo sapiens
uccuccuccugcc

SEQ ID NO: 2122787 - RNA, 15 nt, Homo sapiens
ccccaaucuugccca

SEQ ID NO: 2122788 - RNA, 21 nt, Homo sapiens
aguucugguugauucacucaa

SEQ ID NO: 2122789 - RNA, 13 nt, Homo sapiens
ccugcccacagaa

SEQ ID NO: 2122790 - RNA, 17 nt, Homo sapiens
auugcuuggacuaccua

SEQ ID NO: 2122791 - RNA, 19 nt, Homo sapiens
aucacguacaccauaugca

SEQ ID NO: 2122792 - RNA, 17 nt, Homo sapiens
ggauacuggugcaguca

SEQ ID NO: 2122793 - RNA, 13 nt, Homo sapiens
cuuuuaugauacu

SEQ ID NO: 2122794 - RNA, 20 nt, Homo sapiens
uuugaaauaaaaauggauca

SEQ ID NO: 2122795 - RNA, 19 nt, Homo sapiens
cacagagaugcaugcgcag

SEQ ID NO: 2122796 - RNA, 20 nt, Homo sapiens
uguaucugaagaccuaccag

SEQ ID NO: 2122797 - RNA, 19 nt, Homo sapiens
aggcugccaggcaccaucu

SEQ ID NO: 2122798 - RNA, 15 nt, Homo sapiens
auccugcucuucugu

SEQ ID NO: 2122799 - RNA, 15 nt, Homo sapiens
ucuuauuccaggaga

SEQ ID NO: 2122800 - RNA, 21 nt, Homo sapiens
augacggggccacgugugcug

SEQ ID NO: 2122801 - RNA, 16 nt, Homo sapiens
cugcaaagcccagcuu

SEQ ID NO: 2122802 - RNA, 21 nt, Homo sapiens
uacaguuaauuaugugcauau

SEQ ID NO: 2122803 - RNA, 20 nt, Homo sapiens
gaaacuuaaaugaacacagc

SEQ ID NO: 2122804 - RNA, 13 nt, Homo sapiens
gaaucaaagacau

SEQ ID NO: 2122805 - RNA, 12 nt, Homo sapiens
cagauaaagguu

SEQ ID NO: 2122806 - RNA, 16 nt, Homo sapiens
uaaaaaucacacugua

SEQ ID NO: 2122807 - RNA, 19 nt, Homo sapiens
uauuugccuccagugcagu

SEQ ID NO: 2122808 - RNA, 17 nt, Homo sapiens
uggaauaacuaucucac

SEQ ID NO: 2122809 - RNA, 19 nt, Homo sapiens
cagggccaccauugucuca

SEQ ID NO: 2122810 - RNA, 15 nt, Homo sapiens
cuuccaugugccuuu

SEQ ID NO: 2122811 - RNA, 15 nt, Homo sapiens
acuguguaacuuucu

SEQ ID NO: 2122812 - RNA, 15 nt, Homo sapiens
cuuuugaacuuguca

SEQ ID NO: 2122813 - RNA, 13 nt, Homo sapiens
acauauaucugau

SEQ ID NO: 2122814 - RNA, 20 nt, Homo sapiens
gcacagcugaaaguucuugc

SEQ ID NO: 2122815 - RNA, 21 nt, Homo sapiens
cuuugaaaagagaauauuuac

SEQ ID NO: 2122816 - RNA, 21 nt, Homo sapiens
uaugaucgccuguggauuuug

SEQ ID NO: 2122817 - RNA, 14 nt, Homo sapiens
aaguaaacugcccu

SEQ ID NO: 2122818 - RNA, 23 nt, Homo sapiens
aaaccugguugcagcacauucac

SEQ ID NO: 2122819 - RNA, 21 nt, Homo sapiens
acccacaugugacacauaugc

SEQ ID NO: 2122820 - RNA, 20 nt, Homo sapiens
agacuuggguugaacuauaa

SEQ ID NO: 2122821 - RNA, 14 nt, Homo sapiens
uaggcuacagagaa

SEQ ID NO: 2122822 - RNA, 22 nt, Homo sapiens
gccuuggagucgucuggcaucu

SEQ ID NO: 2122823 - RNA, 18 nt, Homo sapiens
uccagaggguugugauuu

SEQ ID NO: 2122824 - RNA, 13 nt, Homo sapiens
cacuccugaccaa

SEQ ID NO: 2122825 - RNA, 19 nt, Homo sapiens
agccggggccgucugugug

SEQ ID NO: 2122826 - RNA, 14 nt, Homo sapiens
auuccagugccagg

SEQ ID NO: 2122827 - RNA, 18 nt, Homo sapiens
uauguuuccuaacuguga

SEQ ID NO: 2122828 - RNA, 13 nt, Homo sapiens
gauuuccuugaau

SEQ ID NO: 2122829 - RNA, 17 nt, Homo sapiens
acuggaaagacauagcc

SEQ ID NO: 2122830 - RNA, 15 nt, Homo sapiens
uuuauugcuuaaucc

SEQ ID NO: 2122831 - RNA, 15 nt, Homo sapiens
acuuuugcacauucc

SEQ ID NO: 2122832 - RNA, 17 nt, Homo sapiens
uuucuuggauuaccaau

SEQ ID NO: 2122833 - RNA, 15 nt, Homo sapiens
aaacauuauugucaa

SEQ ID NO: 2122834 - RNA, 17 nt, Homo sapiens
cacagcucccugccaaa

SEQ ID NO: 2122835 - RNA, 17 nt, Homo sapiens
ccugccacugaccucac

SEQ ID NO: 2122836 - RNA, 18 nt, Homo sapiens
uagauguuauuaugcuaa

SEQ ID NO: 2122837 - RNA, 23 nt, Homo sapiens
cucacagcugacuccaagcugca

SEQ ID NO: 2122838 - RNA, 23 nt, Homo sapiens
aggcugccggagggagcccugag

SEQ ID NO: 2122839 - RNA, 20 nt, Homo sapiens
ccagaaguagcuuugcacuu

SEQ ID NO: 2122840 - RNA, 17 nt, Homo sapiens
ucuuccuguuaauguau

SEQ ID NO: 2122841 - RNA, 21 nt, Homo sapiens
uuaaaugguguuuuauuacaa

SEQ ID NO: 2122842 - RNA, 12 nt, Homo sapiens
gggacuaggacc

SEQ ID NO: 2122843 - RNA, 13 nt, Homo sapiens
cccagcggcauca

SEQ ID NO: 2122844 - RNA, 13 nt, Homo sapiens
gaagaaugaaaau

SEQ ID NO: 2122845 - RNA, 21 nt, Homo sapiens
gccugggaccucccacugccc

SEQ ID NO: 2122846 - RNA, 15 nt, Homo sapiens
ugaaucuacauucac

SEQ ID NO: 2122847 - RNA, 14 nt, Homo sapiens
gaccacggacucca

SEQ ID NO: 2122848 - RNA, 16 nt, Homo sapiens
cuccgccaagaucuac

SEQ ID NO: 2122849 - RNA, 15 nt, Homo sapiens
cuuugaaauaugcau

SEQ ID NO: 2122850 - RNA, 22 nt, Homo sapiens
gagcagugccaaucgggcagaa

SEQ ID NO: 2122851 - RNA, 14 nt, Homo sapiens
aaagcccaaggugc

SEQ ID NO: 2122852 - RNA, 16 nt, Homo sapiens
cuuccucucugugaug

SEQ ID NO: 2122853 - RNA, 13 nt, Homo sapiens
aaugacguccuuc

SEQ ID NO: 2122854 - RNA, 21 nt, Homo sapiens
ucugcacccagaaauuccuuc

SEQ ID NO: 2122855 - RNA, 20 nt, Homo sapiens
uuaaaugugacauucuuaaa

SEQ ID NO: 2122856 - RNA, 13 nt, Homo sapiens
cagccagaucuca

SEQ ID NO: 2122857 - RNA, 15 nt, Homo sapiens
cauuguaauguucau

SEQ ID NO: 2122858 - RNA, 21 nt, Homo sapiens
gucucucucuucucucuaggu

SEQ ID NO: 2122859 - RNA, 18 nt, Homo sapiens
agccaucacccucaccca

SEQ ID NO: 2122860 - RNA, 19 nt, Homo sapiens
acccucaucuuucuuccaa

SEQ ID NO: 2122861 - RNA, 17 nt, Homo sapiens
uuaaaguggcaaucuca

SEQ ID NO: 2122862 - RNA, 18 nt, Homo sapiens
ccuaggcaaggggaugag

SEQ ID NO: 2122863 - RNA, 15 nt, Homo sapiens
uccuccccacuagca

SEQ ID NO: 2122864 - RNA, 18 nt, Homo sapiens
gauggcacuguccagggc

SEQ ID NO: 2122865 - RNA, 13 nt, Homo sapiens
cuugaugauacaa

SEQ ID NO: 2122866 - RNA, 13 nt, Homo sapiens
cucuccaucauag

SEQ ID NO: 2122867 - RNA, 17 nt, Homo sapiens
auugaccuucagauucc

SEQ ID NO: 2122868 - RNA, 20 nt, Homo sapiens
uaucaauuggcagugacuuu

SEQ ID NO: 2122869 - RNA, 22 nt, Homo sapiens
gccccucccagaacacacucca

SEQ ID NO: 2122870 - RNA, 23 nt, Homo sapiens
acugcuuuuuccuuagcuuaaug

SEQ ID NO: 2122871 - RNA, 14 nt, Homo sapiens
gacacaugugccgg

SEQ ID NO: 2122872 - RNA, 23 nt, Homo sapiens
ugccuuaucuaaaucaccagaga

SEQ ID NO: 2122873 - RNA, 18 nt, Homo sapiens
agccuggcucuaucuucc

SEQ ID NO: 2122874 - RNA, 20 nt, Homo sapiens
aggauuuuagcuaggauuug

SEQ ID NO: 2122875 - RNA, 16 nt, Homo sapiens
gggaagacauugcaau

SEQ ID NO: 2122876 - RNA, 17 nt, Homo sapiens
ccugugugagcaucucu

SEQ ID NO: 2122877 - RNA, 13 nt, Homo sapiens
ucuguccuaccuu

SEQ ID NO: 2122878 - RNA, 21 nt, Homo sapiens
uguuccacauucucucucuuu

SEQ ID NO: 2122879 - RNA, 21 nt, Homo sapiens
uugcccugaggcucagucucu

SEQ ID NO: 2122880 - RNA, 22 nt, Homo sapiens
uugguucccguguuguaccuga

SEQ ID NO: 2122881 - RNA, 16 nt, Homo sapiens
ugcacaccuguggucc

SEQ ID NO: 2122882 - RNA, 16 nt, Homo sapiens
auaaaaauauguacaa

SEQ ID NO: 2122883 - RNA, 16 nt, Homo sapiens
acccagaaauuccuuc

SEQ ID NO: 2122884 - RNA, 20 nt, Homo sapiens
aagaucacgccauugcacuc

SEQ ID NO: 2122885 - RNA, 15 nt, Homo sapiens
gucauuauauucuaa

SEQ ID NO: 2122886 - RNA, 19 nt, Homo sapiens
agccugggggccagugggg

SEQ ID NO: 2122887 - RNA, 14 nt, Homo sapiens
aagaaaaauaucuu

SEQ ID NO: 2122888 - RNA, 21 nt, Homo sapiens
uuccauuuuacuuccaugaua

SEQ ID NO: 2122889 - RNA, 21 nt, Homo sapiens
cauucaugacugaacugaaaa

SEQ ID NO: 2122890 - RNA, 15 nt, Homo sapiens
acacauagauaccuu

SEQ ID NO: 2122891 - RNA, 22 nt, Homo sapiens
ccagcauucagcacacacaaac

SEQ ID NO: 2122892 - RNA, 13 nt, Homo sapiens
cuacuuuugggaa

SEQ ID NO: 2122893 - RNA, 16 nt, Homo sapiens
gcaucacagaauguga

SEQ ID NO: 2122894 - RNA, 19 nt, Homo sapiens
auuuuggcgcuauuacaaa

SEQ ID NO: 2122895 - RNA, 19 nt, Homo sapiens
aauaagauauauaugugcu

SEQ ID NO: 2122896 - RNA, 17 nt, Homo sapiens
uguuuaaaaaguaauaa

SEQ ID NO: 2122897 - RNA, 18 nt, Homo sapiens
uagucauucuaacugcac

SEQ ID NO: 2122898 - RNA, 15 nt, Homo sapiens
gagggccagagcaag

SEQ ID NO: 2122899 - RNA, 14 nt, Homo sapiens
ugcuugaaugaagu

SEQ ID NO: 2122900 - RNA, 23 nt, Homo sapiens
ugcaaccaguuugcccauucucu

SEQ ID NO: 2122901 - RNA, 19 nt, Homo sapiens
aggcccagccucucuggcu

SEQ ID NO: 2122902 - RNA, 19 nt, Homo sapiens
uaguaccuguaagcauuuu

SEQ ID NO: 2122903 - RNA, 21 nt, Homo sapiens
uucaguagaauuaccauuaau

SEQ ID NO: 2122904 - RNA, 23 nt, Homo sapiens
uuuaaaauaaguugcagaacaga

SEQ ID NO: 2122905 - RNA, 14 nt, Homo sapiens
cagaggggaaacca

SEQ ID NO: 2122906 - RNA, 15 nt, Homo sapiens
cauuuauuaaccaaa

SEQ ID NO: 2122907 - RNA, 14 nt, Homo sapiens
cauuuugcacugua

SEQ ID NO: 2122908 - RNA, 22 nt, Homo sapiens
cccaagggcaucauccucagca

SEQ ID NO: 2122909 - RNA, 18 nt, Homo sapiens
gccacaaauaaguuacau

SEQ ID NO: 2122910 - RNA, 16 nt, Homo sapiens
auugacccacaaaguu

SEQ ID NO: 2122911 - RNA, 13 nt, Homo sapiens
ccagccagccauc

SEQ ID NO: 2122912 - RNA, 13 nt, Homo sapiens
caggacagcagua

SEQ ID NO: 2122913 - RNA, 13 nt, Homo sapiens
acacaggccugug

SEQ ID NO: 2122914 - RNA, 14 nt, Homo sapiens
cuaauuauaaugca

SEQ ID NO: 2122915 - RNA, 22 nt, Homo sapiens
caucuaaauauuuccauauucu

SEQ ID NO: 2122916 - RNA, 19 nt, Homo sapiens
acucucgcacacacaguga

SEQ ID NO: 2122917 - RNA, 17 nt, Homo sapiens
agagugcugagaaccac

SEQ ID NO: 2122918 - RNA, 23 nt, Homo sapiens
ccagcgaucucuccacugugcuu

SEQ ID NO: 2122919 - RNA, 19 nt, Homo sapiens
gcaacaccuccuugcuuug

SEQ ID NO: 2122920 - RNA, 22 nt, Homo sapiens
uaguaguuucucuguaaggcaa

SEQ ID NO: 2122921 - RNA, 17 nt, Homo sapiens
caccuagcugugcaaga

SEQ ID NO: 2122922 - RNA, 12 nt, Homo sapiens
aauuccaaagau

SEQ ID NO: 2122923 - RNA, 14 nt, Homo sapiens
acccagcaguccuc

SEQ ID NO: 2122924 - RNA, 16 nt, Homo sapiens
cuucagauuaaacccu

SEQ ID NO: 2122925 - RNA, 18 nt, Homo sapiens
ccuucgggagggcacuca

SEQ ID NO: 2122926 - RNA, 23 nt, Homo sapiens
aaacaaucuuucaugucuuguca

SEQ ID NO: 2122927 - RNA, 20 nt, Homo sapiens
gaggcucagccacacaggaa

SEQ ID NO: 2122928 - RNA, 14 nt, Homo sapiens
accgaggacaugaa

SEQ ID NO: 2122929 - RNA, 14 nt, Homo sapiens
cuauuucuauccug

SEQ ID NO: 2122930 - RNA, 14 nt, Homo sapiens
gaucuucuuuauaa

SEQ ID NO: 2122931 - RNA, 18 nt, Homo sapiens
uggcaucugacacugaca

SEQ ID NO: 2122932 - RNA, 12 nt, Homo sapiens
uaacacacagcu

SEQ ID NO: 2122933 - RNA, 19 nt, Homo sapiens
auuugauauacaugcucaa

SEQ ID NO: 2122934 - RNA, 19 nt, Homo sapiens
uaaugaauuuagugagcau

SEQ ID NO: 2122935 - RNA, 23 nt, Homo sapiens
ccagccccucucccugugcugug

SEQ ID NO: 2122936 - RNA, 11 nt, Homo sapiens
uggacuaugua

SEQ ID NO: 2122937 - RNA, 20 nt, Homo sapiens
cucuacuuccccauggcccu

SEQ ID NO: 2122938 - RNA, 23 nt, Homo sapiens
agggcuguugauuuaugcuuuaa

SEQ ID NO: 2122939 - RNA, 20 nt, Homo sapiens
gcuaccuggggugggggcca

SEQ ID NO: 2122940 - RNA, 17 nt, Homo sapiens
gcacuagccaaaccuca

SEQ ID NO: 2122941 - RNA, 21 nt, Homo sapiens
uucuuagagauuaaaccaauu

SEQ ID NO: 2122942 - RNA, 12 nt, Homo sapiens
cucgagugaauu

SEQ ID NO: 2122943 - RNA, 13 nt, Homo sapiens
uguccccugccug

SEQ ID NO: 2122944 - RNA, 17 nt, Homo sapiens
acuucccugggccucaa

SEQ ID NO: 2122945 - RNA, 21 nt, Homo sapiens
uggccucauucagcagaauga

SEQ ID NO: 2122946 - RNA, 23 nt, Homo sapiens
uucgacguuugacuagccaucuc

SEQ ID NO: 2122947 - RNA, 20 nt, Homo sapiens
uggauaauaacuagaucucc

SEQ ID NO: 2122948 - RNA, 13 nt, Homo sapiens
aauaaaacaguau

SEQ ID NO: 2122949 - RNA, 15 nt, Homo sapiens
uuuuauguucuuggc

SEQ ID NO: 2122950 - RNA, 19 nt, Homo sapiens
gucugcgucgucaccaaau

SEQ ID NO: 2122951 - RNA, 19 nt, Homo sapiens
aaaucacgaccacugauag

SEQ ID NO: 2122952 - RNA, 20 nt, Homo sapiens
gguaggggcugcagggacaa

SEQ ID NO: 2122953 - RNA, 21 nt, Homo sapiens
cuccuaaauaaacuaguauga

SEQ ID NO: 2122954 - RNA, 17 nt, Homo sapiens
gcaucagccucuggcca

SEQ ID NO: 2122955 - RNA, 22 nt, Homo sapiens
cauuuguuguuguuuuuccuca

SEQ ID NO: 2122956 - RNA, 19 nt, Homo sapiens
uguaacacccuuccucuga

SEQ ID NO: 2122957 - RNA, 21 nt, Homo sapiens
aguucagggaccguccagggg

SEQ ID NO: 2122958 - RNA, 12 nt, Homo sapiens
uuaaacaugacu

SEQ ID NO: 2122959 - RNA, 15 nt, Homo sapiens
aggaaagaguauuaa

SEQ ID NO: 2122960 - RNA, 18 nt, Homo sapiens
acaucuggcggccaagug

SEQ ID NO: 2122961 - RNA, 17 nt, Homo sapiens
gacacuuuugaggacaa

SEQ ID NO: 2122962 - RNA, 23 nt, Homo sapiens
gggcuagagaaaucagcugcuau

SEQ ID NO: 2122963 - RNA, 18 nt, Homo sapiens
ugcccuuccgcagugugg

SEQ ID NO: 2122964 - RNA, 22 nt, Homo sapiens
cucagguguguugcagugucug

SEQ ID NO: 2122965 - RNA, 16 nt, Homo sapiens
acuggacucauuauca

SEQ ID NO: 2122966 - RNA, 13 nt, Homo sapiens
ucacaaaaggcau

SEQ ID NO: 2122967 - RNA, 14 nt, Homo sapiens
caucagccugugua

SEQ ID NO: 2122968 - RNA, 15 nt, Homo sapiens
acugcugcuugucaa

SEQ ID NO: 2122969 - RNA, 21 nt, Homo sapiens
auucaauuacggacucuggau

SEQ ID NO: 2122970 - RNA, 21 nt, Homo sapiens
aaguaaaaaacuucccaacuc

SEQ ID NO: 2122971 - RNA, 15 nt, Homo sapiens
gggaagaggggugca

SEQ ID NO: 2122972 - RNA, 15 nt, Homo sapiens
ccugucucuacaaaa

SEQ ID NO: 2122973 - RNA, 13 nt, Homo sapiens
uggaucuaccugg

SEQ ID NO: 2122974 - RNA, 18 nt, Homo sapiens
agauaacaaacacugaac

SEQ ID NO: 2122975 - RNA, 21 nt, Homo sapiens
cugcacgugcacacaccugca

SEQ ID NO: 2122976 - RNA, 20 nt, Homo sapiens
agaggcgcaugaauuuguga

SEQ ID NO: 2122977 - RNA, 13 nt, Homo sapiens
cuacccccugaaa

SEQ ID NO: 2122978 - RNA, 21 nt, Homo sapiens
acucgggaccaauacuacuga

SEQ ID NO: 2122979 - RNA, 12 nt, Homo sapiens
aauacauggcua

SEQ ID NO: 2122980 - RNA, 21 nt, Homo sapiens
accuagaguauaccugugguu

SEQ ID NO: 2122981 - RNA, 13 nt, Homo sapiens
cggaacacauucu

SEQ ID NO: 2122982 - RNA, 13 nt, Homo sapiens
agcccagcauuuc

SEQ ID NO: 2122983 - RNA, 13 nt, Homo sapiens
agcuaagccacau

SEQ ID NO: 2122984 - RNA, 20 nt, Homo sapiens
cuagacaccuucugugcuca

SEQ ID NO: 2122985 - RNA, 18 nt, Homo sapiens
aaaucauauuaguauuaa

SEQ ID NO: 2122986 - RNA, 15 nt, Homo sapiens
ggcugccugugugca

SEQ ID NO: 2122987 - RNA, 21 nt, Homo sapiens
gaccauaaccccggaagccaa

SEQ ID NO: 2122988 - RNA, 23 nt, Homo sapiens
uuaaauaaaucauaaaacuugau

SEQ ID NO: 2122989 - RNA, 17 nt, Homo sapiens
aaaucaaaccaggugca

SEQ ID NO: 2122990 - RNA, 21 nt, Homo sapiens
cccaacccugagcacucuuau

SEQ ID NO: 2122991 - RNA, 14 nt, Homo sapiens
ccuccuucgggaca

SEQ ID NO: 2122992 - RNA, 18 nt, Homo sapiens
cuugaaaauuaacaugaa

SEQ ID NO: 2122993 - RNA, 13 nt, Homo sapiens
cugaaacagagaa

SEQ ID NO: 2122994 - RNA, 12 nt, Homo sapiens
gcugucauuaau

SEQ ID NO: 2122995 - RNA, 12 nt, Homo sapiens
gaagucauucuu

SEQ ID NO: 2122996 - RNA, 15 nt, Homo sapiens
accccuuagccuccc

SEQ ID NO: 2122997 - RNA, 16 nt, Homo sapiens
cuaggguaggggcaag

SEQ ID NO: 2122998 - RNA, 23 nt, Homo sapiens
aacuguugucuaguauacaguga

SEQ ID NO: 2122999 - RNA, 16 nt, Homo sapiens
uccuaugggaacaauu

SEQ ID NO: 2123000 - RNA, 16 nt, Homo sapiens
augaaacagcagcuga

SEQ ID NO: 2123001 - RNA, 23 nt, Homo sapiens
uuauacccccaggaaacuagcuu

SEQ ID NO: 2123002 - RNA, 15 nt, Homo sapiens
cuaauggauguagcc

SEQ ID NO: 2123003 - RNA, 9 nt, Homo sapiens
accagcuca

SEQ ID NO: 2123004 - RNA, 17 nt, Homo sapiens
uccuguuacuugcuucu

SEQ ID NO: 2123005 - RNA, 17 nt, Homo sapiens
cacauaauucuguuacu

SEQ ID NO: 2123006 - RNA, 20 nt, Homo sapiens
gauguguauacguaggaauu

SEQ ID NO: 2123007 - RNA, 22 nt, Homo sapiens
uuaguacucuucuagcauuuag

SEQ ID NO: 2123008 - RNA, 15 nt, Homo sapiens
ucagauuuucuggac

SEQ ID NO: 2123009 - RNA, 16 nt, Homo sapiens
cggccucccacagugc

SEQ ID NO: 2123010 - RNA, 12 nt, Homo sapiens
cgggaaugagcu

SEQ ID NO: 2123011 - RNA, 23 nt, Homo sapiens
uugcuucccggcgucccuaccuc

SEQ ID NO: 2123012 - RNA, 21 nt, Homo sapiens
agaucacuuguccucuugcca

SEQ ID NO: 2123013 - RNA, 14 nt, Homo sapiens
uucuccugccuuag

SEQ ID NO: 2123014 - RNA, 18 nt, Homo sapiens
aaagacgauuugucaguu

SEQ ID NO: 2123015 - RNA, 17 nt, Homo sapiens
auggaugauucagaaau

SEQ ID NO: 2123016 - RNA, 15 nt, Homo sapiens
gaucaagugugcaua

SEQ ID NO: 2123017 - RNA, 15 nt, Homo sapiens
uagaugccaaaccac

SEQ ID NO: 2123018 - RNA, 15 nt, Homo sapiens
uaauccaguguuacu

SEQ ID NO: 2123019 - RNA, 15 nt, Homo sapiens
gagguugugcugccu

SEQ ID NO: 2123020 - RNA, 12 nt, Homo sapiens
gaucccacugac

SEQ ID NO: 2123021 - RNA, 18 nt, Homo sapiens
gacaagguucugcccuua

SEQ ID NO: 2123022 - RNA, 19 nt, Homo sapiens
agcucauguagcaaucaga

SEQ ID NO: 2123023 - RNA, 16 nt, Homo sapiens
ugugacgagguggcag

SEQ ID NO: 2123024 - RNA, 16 nt, Homo sapiens
gcugagggucugggaa

SEQ ID NO: 2123025 - RNA, 20 nt, Homo sapiens
gagcaaaucuccauacuguu

SEQ ID NO: 2123026 - RNA, 19 nt, Homo sapiens
caaauuggugaacagugua

SEQ ID NO: 2123027 - RNA, 17 nt, Homo sapiens
gccugacaugguuguca

SEQ ID NO: 2123028 - RNA, 16 nt, Homo sapiens
uacaaugugcacugaa

SEQ ID NO: 2123029 - RNA, 13 nt, Homo sapiens
uuguucagaauua

SEQ ID NO: 2123030 - RNA, 15 nt, Homo sapiens
augaaaagagguuua

SEQ ID NO: 2123031 - RNA, 15 nt, Homo sapiens
uaaacuccuacuaaa

SEQ ID NO: 2123032 - RNA, 19 nt, Homo sapiens
aauuuagacaaagccuuaa

SEQ ID NO: 2123033 - RNA, 13 nt, Homo sapiens
aagaaauccaaau

SEQ ID NO: 2123034 - RNA, 14 nt, Homo sapiens
uucauuuacucacc

SEQ ID NO: 2123035 - RNA, 19 nt, Homo sapiens
caccuucugugcucauguu

SEQ ID NO: 2123036 - RNA, 18 nt, Homo sapiens
auguaaaauauuugagaa

SEQ ID NO: 2123037 - RNA, 19 nt, Homo sapiens
auuuuacuuuaacagucua

SEQ ID NO: 2123038 - RNA, 22 nt, Homo sapiens
gggaaaccaguguagccuugcc

SEQ ID NO: 2123039 - RNA, 22 nt, Homo sapiens
gacucagcacuguuuucaucac

SEQ ID NO: 2123040 - RNA, 15 nt, Homo sapiens
aauccauccugcuca

SEQ ID NO: 2123041 - RNA, 17 nt, Homo sapiens
cauuaccauggagacaa

SEQ ID NO: 2123042 - RNA, 20 nt, Homo sapiens
cggacacagagggggccuuc

SEQ ID NO: 2123043 - RNA, 22 nt, Homo sapiens
aauccauuaucgagcagcauuu

SEQ ID NO: 2123044 - RNA, 14 nt, Homo sapiens
caaccaacaccaca

SEQ ID NO: 2123045 - RNA, 20 nt, Homo sapiens
uaacaacucguguucacuca

SEQ ID NO: 2123046 - RNA, 17 nt, Homo sapiens
uuugguuggcagcauuc

SEQ ID NO: 2123047 - RNA, 16 nt, Homo sapiens
agacugcuaaaugcac

SEQ ID NO: 2123048 - RNA, 15 nt, Homo sapiens
caggccaggccagcu

SEQ ID NO: 2123049 - RNA, 16 nt, Homo sapiens
uguccugacaccugcu

SEQ ID NO: 2123050 - RNA, 18 nt, Homo sapiens
gccauccaucaugcaaaa

SEQ ID NO: 2123051 - RNA, 13 nt, Homo sapiens
aagcaucaucugu

SEQ ID NO: 2123052 - RNA, 19 nt, Homo sapiens
gccuuuugcugcgcaccaa

SEQ ID NO: 2123053 - RNA, 22 nt, Homo sapiens
ucuaggcugcugcacaccaagg

SEQ ID NO: 2123054 - RNA, 18 nt, Homo sapiens
cuuuauuauggcuuguga

SEQ ID NO: 2123055 - RNA, 13 nt, Homo sapiens
aaacuuguguaug

SEQ ID NO: 2123056 - RNA, 17 nt, Homo sapiens
uccaggggcggugcagg

SEQ ID NO: 2123057 - RNA, 19 nt, Homo sapiens
acuccacuugaagcacuua

SEQ ID NO: 2123058 - RNA, 16 nt, Homo sapiens
gaugcuuuaacugauc

SEQ ID NO: 2123059 - RNA, 23 nt, Homo sapiens
accuccuuuuuugaggucagggg

SEQ ID NO: 2123060 - RNA, 14 nt, Homo sapiens
aagccucaugucca

SEQ ID NO: 2123061 - RNA, 12 nt, Homo sapiens
aggacaaagccu

SEQ ID NO: 2123062 - RNA, 17 nt, Homo sapiens
uauaaaauacauaauau

SEQ ID NO: 2123063 - RNA, 21 nt, Homo sapiens
ucacuuccccaagaucugcca

SEQ ID NO: 2123064 - RNA, 15 nt, Homo sapiens
uagcaucuccuuuca

SEQ ID NO: 2123065 - RNA, 21 nt, Homo sapiens
ucgaacuaaaagccuucccuu

SEQ ID NO: 2123066 - RNA, 20 nt, Homo sapiens
uggauuggggauggggacaa

SEQ ID NO: 2123067 - RNA, 14 nt, Homo sapiens
ugccugcagaguuu

SEQ ID NO: 2123068 - RNA, 21 nt, Homo sapiens
cuguuugcugugcguggaaug

SEQ ID NO: 2123069 - RNA, 20 nt, Homo sapiens
ccuacucucuuaugcauuag

SEQ ID NO: 2123070 - RNA, 16 nt, Homo sapiens
cuucugcaccaacuca

SEQ ID NO: 2123071 - RNA, 14 nt, Homo sapiens
gcccuuggcugcag

SEQ ID NO: 2123072 - RNA, 17 nt, Homo sapiens
uucacugccuuugcucc

SEQ ID NO: 2123073 - RNA, 13 nt, Homo sapiens
cauuguuuccacc

SEQ ID NO: 2123074 - RNA, 16 nt, Homo sapiens
uaaacuagguguucua

SEQ ID NO: 2123075 - RNA, 15 nt, Homo sapiens
ggacgcgcgugacac

SEQ ID NO: 2123076 - RNA, 22 nt, Homo sapiens
gccauaagcaggaguugauaca

SEQ ID NO: 2123077 - RNA, 17 nt, Homo sapiens
accagauggaacacugg

SEQ ID NO: 2123078 - RNA, 17 nt, Homo sapiens
ucauggggugaugcugg

SEQ ID NO: 2123079 - RNA, 17 nt, Homo sapiens
auuuauauaagucuguu

SEQ ID NO: 2123080 - RNA, 18 nt, Homo sapiens
gaaguuugcuuuguacug

SEQ ID NO: 2123081 - RNA, 12 nt, Homo sapiens
gaacucaguccu

SEQ ID NO: 2123082 - RNA, 19 nt, Homo sapiens
agagagguuugcaguccca

SEQ ID NO: 2123083 - RNA, 15 nt, Homo sapiens
accuccacagcuucc

SEQ ID NO: 2123084 - RNA, 22 nt, Homo sapiens
ccaucacccccuaccccagaaa

SEQ ID NO: 2123085 - RNA, 15 nt, Homo sapiens
cuauauguugcugaa

SEQ ID NO: 2123086 - RNA, 21 nt, Homo sapiens
gcuuccaaugugguggcaaua

SEQ ID NO: 2123087 - RNA, 22 nt, Homo sapiens
aagaagacaccucuaaucugga

SEQ ID NO: 2123088 - RNA, 22 nt, Homo sapiens
cauuaauguucuuuauaaaaag

SEQ ID NO: 2123089 - RNA, 22 nt, Homo sapiens
uggacaggcgccuggugugagg

SEQ ID NO: 2123090 - RNA, 13 nt, Homo sapiens
guaauuaguuuaa

SEQ ID NO: 2123091 - RNA, 19 nt, Homo sapiens
ccaaagaauuguaggcagu

SEQ ID NO: 2123092 - RNA, 18 nt, Homo sapiens
ccgcauagcacuugcaga

SEQ ID NO: 2123093 - RNA, 14 nt, Homo sapiens
gguaucaccacugg

SEQ ID NO: 2123094 - RNA, 14 nt, Homo sapiens
aguauguacuucag

SEQ ID NO: 2123095 - RNA, 23 nt, Homo sapiens
ucugauuggcuggauugccuugu

SEQ ID NO: 2123096 - RNA, 23 nt, Homo sapiens
ggugaacguguucaaagccaagc

SEQ ID NO: 2123097 - RNA, 15 nt, Homo sapiens
agaacuguacauugu

SEQ ID NO: 2123098 - RNA, 16 nt, Homo sapiens
cucgccacgaacuagg

SEQ ID NO: 2123099 - RNA, 19 nt, Homo sapiens
acccucgcaugacuguuac

SEQ ID NO: 2123100 - RNA, 22 nt, Homo sapiens
cuuaaacuagguguucuaauca

SEQ ID NO: 2123101 - RNA, 18 nt, Homo sapiens
gguugauugugcauggaa

SEQ ID NO: 2123102 - RNA, 23 nt, Homo sapiens
caaggagaagccccuacccugug

SEQ ID NO: 2123103 - RNA, 23 nt, Homo sapiens
agaaccacauauuuuagacacuu

SEQ ID NO: 2123104 - RNA, 23 nt, Homo sapiens
cuguauaaacagaacuccacugc

SEQ ID NO: 2123105 - RNA, 12 nt, Homo sapiens
gcugaccuuuaa

SEQ ID NO: 2123106 - RNA, 23 nt, Homo sapiens
aucggaacagcuccuuacucuga

SEQ ID NO: 2123107 - RNA, 14 nt, Homo sapiens
agcccagaacccac

SEQ ID NO: 2123108 - RNA, 19 nt, Homo sapiens
cagaugacaaaaaggugca

SEQ ID NO: 2123109 - RNA, 22 nt, Homo sapiens
cuugacuccuuugguauuucac

SEQ ID NO: 2123110 - RNA, 22 nt, Homo sapiens
caugggcauggccguugccucu

SEQ ID NO: 2123111 - RNA, 15 nt, Homo sapiens
cagaggcggucuuca

SEQ ID NO: 2123112 - RNA, 18 nt, Homo sapiens
aaacuaugaggacugccu

SEQ ID NO: 2123113 - RNA, 13 nt, Homo sapiens
uuguguccugaca

SEQ ID NO: 2123114 - RNA, 14 nt, Homo sapiens
gcaggcgugaccug

SEQ ID NO: 2123115 - RNA, 20 nt, Homo sapiens
caucuuaguugaugcuacaa

SEQ ID NO: 2123116 - RNA, 19 nt, Homo sapiens
aaucagaccaaggaacaag

SEQ ID NO: 2123117 - RNA, 16 nt, Homo sapiens
aagaggauugagauaa

SEQ ID NO: 2123118 - RNA, 20 nt, Homo sapiens
gguuuugcucccccuaccuu

SEQ ID NO: 2123119 - RNA, 19 nt, Homo sapiens
uaacauuugcaaaauggaa

SEQ ID NO: 2123120 - RNA, 13 nt, Homo sapiens
auauucauguaga

SEQ ID NO: 2123121 - RNA, 15 nt, Homo sapiens
cuaagagauuugcuu

SEQ ID NO: 2123122 - RNA, 20 nt, Homo sapiens
caguuuaaccugaugcaguc

SEQ ID NO: 2123123 - RNA, 14 nt, Homo sapiens
gugugcugugacaa

SEQ ID NO: 2123124 - RNA, 14 nt, Homo sapiens
aaaaacuguacugu

SEQ ID NO: 2123125 - RNA, 17 nt, Homo sapiens
cucaaggacagccacca

SEQ ID NO: 2123126 - RNA, 16 nt, Homo sapiens
caucuguauaaacaca

SEQ ID NO: 2123127 - RNA, 21 nt, Homo sapiens
uaaguggcuugucugcaguca

SEQ ID NO: 2123128 - RNA, 15 nt, Homo sapiens
uauuaaaauucugau

SEQ ID NO: 2123129 - RNA, 15 nt, Homo sapiens
aguguagguaucauu

SEQ ID NO: 2123130 - RNA, 18 nt, Homo sapiens
agugcgccuugcaaaaaa

SEQ ID NO: 2123131 - RNA, 17 nt, Homo sapiens
gcuucugcaucaaagga

SEQ ID NO: 2123132 - RNA, 12 nt, Homo sapiens
auguauguuucc

SEQ ID NO: 2123133 - RNA, 15 nt, Homo sapiens
ugagagccugugauc

SEQ ID NO: 2123134 - RNA, 22 nt, Homo sapiens
aaucccccauggaaacugcccu

SEQ ID NO: 2123135 - RNA, 12 nt, Homo sapiens
uaauaacaaacg

SEQ ID NO: 2123136 - RNA, 16 nt, Homo sapiens
cugguaacugcagaaa

SEQ ID NO: 2123137 - RNA, 17 nt, Homo sapiens
guucuccagauggagaa

SEQ ID NO: 2123138 - RNA, 18 nt, Homo sapiens
aaagccagugaaauguga

SEQ ID NO: 2123139 - RNA, 23 nt, Homo sapiens
gcgggucuccuagcucccugcca

SEQ ID NO: 2123140 - RNA, 14 nt, Homo sapiens
uuaaagaaagaaug

SEQ ID NO: 2123141 - RNA, 22 nt, Homo sapiens
uggaggccaagaacuugcaaua

SEQ ID NO: 2123142 - RNA, 20 nt, Homo sapiens
uaacuuuaaggugaaugaaa

SEQ ID NO: 2123143 - RNA, 23 nt, Homo sapiens
gguggccuggcuugucuucugaa

SEQ ID NO: 2123144 - RNA, 13 nt, Homo sapiens
gaggucaccagcu

SEQ ID NO: 2123145 - RNA, 15 nt, Homo sapiens
agagagucaauguca

SEQ ID NO: 2123146 - RNA, 19 nt, Homo sapiens
ugccgcuuucucugagggg

SEQ ID NO: 2123147 - RNA, 11 nt, Homo sapiens
uuaaacuaaaa

SEQ ID NO: 2123148 - RNA, 13 nt, Homo sapiens
aguggaguucucu

SEQ ID NO: 2123149 - RNA, 23 nt, Homo sapiens
auggaggcaggcucccccugccu

SEQ ID NO: 2123150 - RNA, 22 nt, Homo sapiens
guauauuuuaaaaauaaauuca

SEQ ID NO: 2123151 - RNA, 20 nt, Homo sapiens
ugcgaaaucuguugugcaug

SEQ ID NO: 2123152 - RNA, 14 nt, Homo sapiens
cauaacucugugau

SEQ ID NO: 2123153 - RNA, 18 nt, Homo sapiens
uaaccuguaaaaugucaa

SEQ ID NO: 2123154 - RNA, 22 nt, Homo sapiens
gucauaaugaauaaagugcaaa

SEQ ID NO: 2123155 - RNA, 20 nt, Homo sapiens
ugacaguagcauacugauga

SEQ ID NO: 2123156 - RNA, 17 nt, Homo sapiens
guuuauugaaugugauu

SEQ ID NO: 2123157 - RNA, 22 nt, Homo sapiens
cauuuuaaaagugccauuaaca

SEQ ID NO: 2123158 - RNA, 20 nt, Homo sapiens
uucaaagauuuuuauuuuga

SEQ ID NO: 2123159 - RNA, 22 nt, Homo sapiens
aaagcggccgaugggagucucc

SEQ ID NO: 2123160 - RNA, 23 nt, Homo sapiens
ggguguugucagcaucuucucac

SEQ ID NO: 2123161 - RNA, 23 nt, Homo sapiens
ugucuguacaguaccuuguugca

SEQ ID NO: 2123162 - RNA, 14 nt, Homo sapiens
agccaaacccauga

SEQ ID NO: 2123163 - RNA, 21 nt, Homo sapiens
uucaaguguaccugccauaac

SEQ ID NO: 2123164 - RNA, 11 nt, Homo sapiens
cacucaggggu

SEQ ID NO: 2123165 - RNA, 22 nt, Homo sapiens
acuuuccacuccuggcugagag

SEQ ID NO: 2123166 - RNA, 15 nt, Homo sapiens
aggagccggacacuu

SEQ ID NO: 2123167 - RNA, 11 nt, Homo sapiens
cuguucuugcu

SEQ ID NO: 2123168 - RNA, 16 nt, Homo sapiens
cuuggcaguauuccau

SEQ ID NO: 2123169 - RNA, 19 nt, Homo sapiens
auaaaggcucugugcuuga

SEQ ID NO: 2123170 - RNA, 13 nt, Homo sapiens
ugcuguagcuuau

SEQ ID NO: 2123171 - RNA, 16 nt, Homo sapiens
uauacauugucucuaa

SEQ ID NO: 2123172 - RNA, 20 nt, Homo sapiens
cuuuuaccuacccgugccug

SEQ ID NO: 2123173 - RNA, 16 nt, Homo sapiens
caacaaccacacuuaa

SEQ ID NO: 2123174 - RNA, 20 nt, Homo sapiens
gcauaaagccaaauuuccag

SEQ ID NO: 2123175 - RNA, 21 nt, Homo sapiens
uuggccgugguccagcucuug

SEQ ID NO: 2123176 - RNA, 20 nt, Homo sapiens
augucuuuccuuuugcucuu

SEQ ID NO: 2123177 - RNA, 18 nt, Homo sapiens
ccccuccuugugcugcca

SEQ ID NO: 2123178 - RNA, 20 nt, Homo sapiens
gacaccaccacccuugccau

SEQ ID NO: 2123179 - RNA, 20 nt, Homo sapiens
cauggggacauuugccaacu

SEQ ID NO: 2123180 - RNA, 13 nt, Homo sapiens
agcaacugugaau

SEQ ID NO: 2123181 - RNA, 15 nt, Homo sapiens
cucucugccuagucu

SEQ ID NO: 2123182 - RNA, 14 nt, Homo sapiens
ccaagauugcgcca

SEQ ID NO: 2123183 - RNA, 13 nt, Homo sapiens
uaggagugagaag

SEQ ID NO: 2123184 - RNA, 21 nt, Homo sapiens
cacacagggugguggcacauu

SEQ ID NO: 2123185 - RNA, 17 nt, Homo sapiens
cucagaacauacugauu

SEQ ID NO: 2123186 - RNA, 20 nt, Homo sapiens
cucccaaaugagccaugaga

SEQ ID NO: 2123187 - RNA, 19 nt, Homo sapiens
ccgcucuuggggacauggg

SEQ ID NO: 2123188 - RNA, 19 nt, Homo sapiens
ugcuggagaaaaaacacac

SEQ ID NO: 2123189 - RNA, 23 nt, Homo sapiens
ugauaguuucccauaacaaccug

SEQ ID NO: 2123190 - RNA, 18 nt, Homo sapiens
agacccaaguagcugcua

SEQ ID NO: 2123191 - RNA, 22 nt, Homo sapiens
augcuaggcugucugcgaagaa

SEQ ID NO: 2123192 - RNA, 17 nt, Homo sapiens
cugcaucccagcccaca

SEQ ID NO: 2123193 - RNA, 12 nt, Homo sapiens
uuacugucuuaa

SEQ ID NO: 2123194 - RNA, 23 nt, Homo sapiens
gcacagaagacagcagcaagugu

SEQ ID NO: 2123195 - RNA, 21 nt, Homo sapiens
agauguauuauaccagugaaa

SEQ ID NO: 2123196 - RNA, 22 nt, Homo sapiens
gccucuucuccccggcacuucc

SEQ ID NO: 2123197 - RNA, 20 nt, Homo sapiens
acaaugguuuuguuucuuuc

SEQ ID NO: 2123198 - RNA, 13 nt, Homo sapiens
acuucuuccuuuc

SEQ ID NO: 2123199 - RNA, 14 nt, Homo sapiens
uccauacucuguaa

SEQ ID NO: 2123200 - RNA, 16 nt, Homo sapiens
cagcacagucacccau

SEQ ID NO: 2123201 - RNA, 15 nt, Homo sapiens
gaaaaauaauauuca

SEQ ID NO: 2123202 - RNA, 17 nt, Homo sapiens
acuuuccugacuuacaa

SEQ ID NO: 2123203 - RNA, 23 nt, Homo sapiens
cuguacaaaguagaagucuuaga

SEQ ID NO: 2123204 - RNA, 13 nt, Homo sapiens
ccuaugcacugaa

SEQ ID NO: 2123205 - RNA, 21 nt, Homo sapiens
auucuggcuuaaacaacaccu

SEQ ID NO: 2123206 - RNA, 17 nt, Homo sapiens
uagaguuuacaguuugu

SEQ ID NO: 2123207 - RNA, 23 nt, Homo sapiens
cacagaaugcaaccaagucacac

SEQ ID NO: 2123208 - RNA, 21 nt, Homo sapiens
aagaauuccugcagcaguuau

SEQ ID NO: 2123209 - RNA, 21 nt, Homo sapiens
agaccccuacccuuucccaaa

SEQ ID NO: 2123210 - RNA, 13 nt, Homo sapiens
cagccauuuuuca

SEQ ID NO: 2123211 - RNA, 18 nt, Homo sapiens
uggaagacugugcagaag

SEQ ID NO: 2123212 - RNA, 21 nt, Homo sapiens
ucugccacuugucaaagaagg

SEQ ID NO: 2123213 - RNA, 16 nt, Homo sapiens
aaagcagauaccucac

SEQ ID NO: 2123214 - RNA, 14 nt, Homo sapiens
auuuguugcugcug

SEQ ID NO: 2123215 - RNA, 21 nt, Homo sapiens
ugaaaaaaggacaauuucaaa

SEQ ID NO: 2123216 - RNA, 14 nt, Homo sapiens
ucuugcuaccagua

SEQ ID NO: 2123217 - RNA, 22 nt, Homo sapiens
cgaucgauggaugggaugcacu

SEQ ID NO: 2123218 - RNA, 22 nt, Homo sapiens
uccaggcuggcgugcagcauca

SEQ ID NO: 2123219 - RNA, 19 nt, Homo sapiens
ugugauugcugccauaauu

SEQ ID NO: 2123220 - RNA, 10 nt, Homo sapiens
uccagugugg

SEQ ID NO: 2123221 - RNA, 14 nt, Homo sapiens
gcuggcaccugauu

SEQ ID NO: 2123222 - RNA, 24 nt, Homo sapiens
ucucuugggcccaggacuguugau

SEQ ID NO: 2123223 - RNA, 21 nt, Homo sapiens
aagaugguucuagcauggcau

SEQ ID NO: 2123224 - RNA, 15 nt, Homo sapiens
ggccuccacaugaca

SEQ ID NO: 2123225 - RNA, 15 nt, Homo sapiens
ugguaacguggcucc

SEQ ID NO: 2123226 - RNA, 14 nt, Homo sapiens
gccugacauugggg

SEQ ID NO: 2123227 - RNA, 17 nt, Homo sapiens
auucuuuacugcacuca

SEQ ID NO: 2123228 - RNA, 15 nt, Homo sapiens
uggguaucaacaccu

SEQ ID NO: 2123229 - RNA, 15 nt, Homo sapiens
gaaaauccaucucau

SEQ ID NO: 2123230 - RNA, 14 nt, Homo sapiens
uaggcuauucacaa

SEQ ID NO: 2123231 - RNA, 16 nt, Homo sapiens
uaaguuaucuuugaau

SEQ ID NO: 2123232 - RNA, 15 nt, Homo sapiens
aaauuaaaagcccua

SEQ ID NO: 2123233 - RNA, 15 nt, Homo sapiens
gaauuuaaggcccaa

SEQ ID NO: 2123234 - RNA, 21 nt, Homo sapiens
ugguuaucaaauacaucucca

SEQ ID NO: 2123235 - RNA, 16 nt, Homo sapiens
cuguuugucugaacaa

SEQ ID NO: 2123236 - RNA, 16 nt, Homo sapiens
uuuaaguuguuugcau

SEQ ID NO: 2123237 - RNA, 17 nt, Homo sapiens
uaccucuauuaguuuca

SEQ ID NO: 2123238 - RNA, 21 nt, Homo sapiens
auaggagagagaucaugagaa

SEQ ID NO: 2123239 - RNA, 17 nt, Homo sapiens
aaaaaacugcagugaaa

SEQ ID NO: 2123240 - RNA, 21 nt, Homo sapiens
agaaaacagaggccacacuuu

SEQ ID NO: 2123241 - RNA, 16 nt, Homo sapiens
cuugacccugagcuua

SEQ ID NO: 2123242 - RNA, 16 nt, Homo sapiens
auuucuauggcuuuca

SEQ ID NO: 2123243 - RNA, 12 nt, Homo sapiens
ccuccacuuugc

SEQ ID NO: 2123244 - RNA, 13 nt, Homo sapiens
aaaaugaaauguc

SEQ ID NO: 2123245 - RNA, 16 nt, Homo sapiens
cagcaucucuaccuuc

SEQ ID NO: 2123246 - RNA, 17 nt, Homo sapiens
auaaagacgucuccuca

SEQ ID NO: 2123247 - RNA, 18 nt, Homo sapiens
aggaacacccccaugaca

SEQ ID NO: 2123248 - RNA, 14 nt, Homo sapiens
agugaaauaauuaa

SEQ ID NO: 2123249 - RNA, 14 nt, Homo sapiens
aaguucauaggguc

SEQ ID NO: 2123250 - RNA, 21 nt, Homo sapiens
gcguggaguucuccucagguc

SEQ ID NO: 2123251 - RNA, 16 nt, Homo sapiens
aaucacaacacagagc

SEQ ID NO: 2123252 - RNA, 14 nt, Homo sapiens
gaguuuaaaagcau

SEQ ID NO: 2123253 - RNA, 16 nt, Homo sapiens
gaugagaaucaugcac

SEQ ID NO: 2123254 - RNA, 22 nt, Homo sapiens
caguuuaucgaccaguuugaau

SEQ ID NO: 2123255 - RNA, 16 nt, Homo sapiens
ugaauuagacuuguau

SEQ ID NO: 2123256 - RNA, 17 nt, Homo sapiens
uauaacuugcauuacau

SEQ ID NO: 2123257 - RNA, 13 nt, Homo sapiens
ugcacacuaagaa

SEQ ID NO: 2123258 - RNA, 21 nt, Homo sapiens
cuucaauugcuuugcacuuuu

SEQ ID NO: 2123259 - RNA, 22 nt, Homo sapiens
auaucacccagacauaaaggaa

SEQ ID NO: 2123260 - RNA, 14 nt, Homo sapiens
ccuuuguuaccaua

SEQ ID NO: 2123261 - RNA, 19 nt, Homo sapiens
caucuguguagcugcucuu

SEQ ID NO: 2123262 - RNA, 21 nt, Homo sapiens
aucugcacaacugacuuccaa

SEQ ID NO: 2123263 - RNA, 13 nt, Homo sapiens
accucucucacuc

SEQ ID NO: 2123264 - RNA, 19 nt, Homo sapiens
agauggaauuagaaauaua

SEQ ID NO: 2123265 - RNA, 12 nt, Homo sapiens
auguuuuccacc

SEQ ID NO: 2123266 - RNA, 11 nt, Homo sapiens
cagcccauucu

SEQ ID NO: 2123267 - RNA, 21 nt, Homo sapiens
uagucagaaacugccauuuga

SEQ ID NO: 2123268 - RNA, 17 nt, Homo sapiens
gacaaagguuuuccucu

SEQ ID NO: 2123269 - RNA, 17 nt, Homo sapiens
gcccagcaugcaggugg

SEQ ID NO: 2123270 - RNA, 15 nt, Homo sapiens
uaaaaauugugauca

SEQ ID NO: 2123271 - RNA, 17 nt, Homo sapiens
ccccagcauuuccagag

SEQ ID NO: 2123272 - RNA, 17 nt, Homo sapiens
auaguucaugucugcua

SEQ ID NO: 2123273 - RNA, 20 nt, Homo sapiens
cccuaagauuugauauaugu

SEQ ID NO: 2123274 - RNA, 13 nt, Homo sapiens
cuaccauugucac

SEQ ID NO: 2123275 - RNA, 16 nt, Homo sapiens
gcgaugucacccgugu

SEQ ID NO: 2123276 - RNA, 23 nt, Homo sapiens
aguugcccugccaucgccuccau

SEQ ID NO: 2123277 - RNA, 22 nt, Homo sapiens
acauagcucaaucacacuggaa

SEQ ID NO: 2123278 - RNA, 19 nt, Homo sapiens
gaagccaguggagcugguc

SEQ ID NO: 2123279 - RNA, 13 nt, Homo sapiens
cucugaaaaccaa

SEQ ID NO: 2123280 - RNA, 12 nt, Homo sapiens
cuggcugaugau

SEQ ID NO: 2123281 - RNA, 23 nt, Homo sapiens
uagugauuuccacagugacucca

SEQ ID NO: 2123282 - RNA, 22 nt, Homo sapiens
ggaaagggugcugcuucccucu

SEQ ID NO: 2123283 - RNA, 16 nt, Homo sapiens
uuuaagaaucuauuuc

SEQ ID NO: 2123284 - RNA, 20 nt, Homo sapiens
uuaaaauucucagaggacuu

SEQ ID NO: 2123285 - RNA, 22 nt, Homo sapiens
aagaucccuuuguccacaagua

SEQ ID NO: 2123286 - RNA, 13 nt, Homo sapiens
ugcuaaaacaaca

SEQ ID NO: 2123287 - RNA, 19 nt, Homo sapiens
agauacugugagcuuacau

SEQ ID NO: 2123288 - RNA, 20 nt, Homo sapiens
ggauaucauacuuccaucug

SEQ ID NO: 2123289 - RNA, 11 nt, Homo sapiens
uugauaccagu

SEQ ID NO: 2123290 - RNA, 13 nt, Homo sapiens
uggcuuuaugcaa

SEQ ID NO: 2123291 - RNA, 17 nt, Homo sapiens
acucaucuuagugccug

SEQ ID NO: 2123292 - RNA, 20 nt, Homo sapiens
acccuggagguaaacaaaga

SEQ ID NO: 2123293 - RNA, 13 nt, Homo sapiens
auaaaacauuaau

SEQ ID NO: 2123294 - RNA, 16 nt, Homo sapiens
uuuauagaaagcuuca

SEQ ID NO: 2123295 - RNA, 15 nt, Homo sapiens
aguaaacacugugua

SEQ ID NO: 2123296 - RNA, 20 nt, Homo sapiens
ucagagaaccuguugaaaug

SEQ ID NO: 2123297 - RNA, 13 nt, Homo sapiens
aaaccucugagug

SEQ ID NO: 2123298 - RNA, 12 nt, Homo sapiens
uuaacuaacuca

SEQ ID NO: 2123299 - RNA, 18 nt, Homo sapiens
cccagaagagucuuugau

SEQ ID NO: 2123300 - RNA, 16 nt, Homo sapiens
agaggggaagggccag

SEQ ID NO: 2123301 - RNA, 21 nt, Homo sapiens
aacacagcuacaacccuaccc

SEQ ID NO: 2123302 - RNA, 15 nt, Homo sapiens
caggaccuggagaca

SEQ ID NO: 2123303 - RNA, 22 nt, Homo sapiens
ucacaguaaugugucauaucau

SEQ ID NO: 2123304 - RNA, 16 nt, Homo sapiens
ugcccacgcagaggac

SEQ ID NO: 2123305 - RNA, 21 nt, Homo sapiens
uggagcaagugacaugccauc

SEQ ID NO: 2123306 - RNA, 13 nt, Homo sapiens
auauuuccacuuc

SEQ ID NO: 2123307 - RNA, 21 nt, Homo sapiens
uguucucuaggccuucaggac

SEQ ID NO: 2123308 - RNA, 22 nt, Homo sapiens
agauucagacuuggacuaugau

SEQ ID NO: 2123309 - RNA, 16 nt, Homo sapiens
cacuuggaugcagggu

SEQ ID NO: 2123310 - RNA, 20 nt, Homo sapiens
gccuccauggcagaagucaa

SEQ ID NO: 2123311 - RNA, 22 nt, Homo sapiens
guuugcgcuaaaaagaacucaa

SEQ ID NO: 2123312 - RNA, 12 nt, Homo sapiens
aaggaaacagaa

SEQ ID NO: 2123313 - RNA, 21 nt, Homo sapiens
gccuccuuuccccucccucag

SEQ ID NO: 2123314 - RNA, 21 nt, Homo sapiens
aacugcucccaccuccugaca

SEQ ID NO: 2123315 - RNA, 21 nt, Homo sapiens
acaggaauacuuaacucaaua

SEQ ID NO: 2123316 - RNA, 12 nt, Homo sapiens
ugggcagaucaa

SEQ ID NO: 2123317 - RNA, 15 nt, Homo sapiens
gccccugccuggacu

SEQ ID NO: 2123318 - RNA, 21 nt, Homo sapiens
cugggaaaggaaaaccaggga

SEQ ID NO: 2123319 - RNA, 19 nt, Homo sapiens
uggacccaucacuuuggac

SEQ ID NO: 2123320 - RNA, 19 nt, Homo sapiens
caggaaccucgaguacugu

SEQ ID NO: 2123321 - RNA, 20 nt, Homo sapiens
uacauccagucacuuugcca

SEQ ID NO: 2123322 - RNA, 18 nt, Homo sapiens
uuuaguacaauaaucucu

SEQ ID NO: 2123323 - RNA, 18 nt, Homo sapiens
guucucauaacucuguga

SEQ ID NO: 2123324 - RNA, 14 nt, Homo sapiens
uauuucuacacagu

SEQ ID NO: 2123325 - RNA, 14 nt, Homo sapiens
caagccauggugac

SEQ ID NO: 2123326 - RNA, 16 nt, Homo sapiens
ugucguggacuccagc

SEQ ID NO: 2123327 - RNA, 18 nt, Homo sapiens
cacuucugggggucacug

SEQ ID NO: 2123328 - RNA, 15 nt, Homo sapiens
agcgagauucugccu

SEQ ID NO: 2123329 - RNA, 19 nt, Homo sapiens
uuaccacuuuaaacacccc

SEQ ID NO: 2123330 - RNA, 14 nt, Homo sapiens
cugagacagacaca

SEQ ID NO: 2123331 - RNA, 22 nt, Homo sapiens
ugggcacaguggcucaugccug

SEQ ID NO: 2123332 - RNA, 13 nt, Homo sapiens
uguguucugucac

SEQ ID NO: 2123333 - RNA, 16 nt, Homo sapiens
caauccaaugcacuga

SEQ ID NO: 2123334 - RNA, 16 nt, Homo sapiens
ccucaaauacaugcac

SEQ ID NO: 2123335 - RNA, 14 nt, Homo sapiens
gauuucacugacac

SEQ ID NO: 2123336 - RNA, 12 nt, Homo sapiens
ugaaaggauuau

SEQ ID NO: 2123337 - RNA, 19 nt, Homo sapiens
agagcuuuuaccuguuauu

SEQ ID NO: 2123338 - RNA, 15 nt, Homo sapiens
agucagaugaggcaa

SEQ ID NO: 2123339 - RNA, 12 nt, Homo sapiens
cuccuuguuaau

SEQ ID NO: 2123340 - RNA, 18 nt, Homo sapiens
agacauuggcaccuaauc

SEQ ID NO: 2123341 - RNA, 16 nt, Homo sapiens
aaaaaggaggauagaa

SEQ ID NO: 2123342 - RNA, 23 nt, Homo sapiens
aggauuuuugguauacagguggu

SEQ ID NO: 2123343 - RNA, 17 nt, Homo sapiens
auucccaugaauaucaa

SEQ ID NO: 2123344 - RNA, 15 nt, Homo sapiens
aggagaacaguagga

SEQ ID NO: 2123345 - RNA, 23 nt, Homo sapiens
cagcucaacggaagaggcugcug

SEQ ID NO: 2123346 - RNA, 12 nt, Homo sapiens
uaagacacaaac

SEQ ID NO: 2123347 - RNA, 12 nt, Homo sapiens
cuacauuugcau

SEQ ID NO: 2123348 - RNA, 19 nt, Homo sapiens
acuuggaugucacugccug

SEQ ID NO: 2123349 - RNA, 15 nt, Homo sapiens
cuaugaucacaguga

SEQ ID NO: 2123350 - RNA, 19 nt, Homo sapiens
ugaccaauauuguacaguu

SEQ ID NO: 2123351 - RNA, 12 nt, Homo sapiens
cgacagucccag

SEQ ID NO: 2123352 - RNA, 20 nt, Homo sapiens
cuaaggaaugcacaaauuga

SEQ ID NO: 2123353 - RNA, 23 nt, Homo sapiens
ggagcugauaacauuuucccaau

SEQ ID NO: 2123354 - RNA, 14 nt, Homo sapiens
augcaaucagacaa

SEQ ID NO: 2123355 - RNA, 21 nt, Homo sapiens
cuuuuucugcacuauaugcaa

SEQ ID NO: 2123356 - RNA, 20 nt, Homo sapiens
agcugaacagccaaaugcau

SEQ ID NO: 2123357 - RNA, 22 nt, Homo sapiens
cuguauaugauucucugugguu

SEQ ID NO: 2123358 - RNA, 15 nt, Homo sapiens
uaaggcagugcagug

SEQ ID NO: 2123359 - RNA, 22 nt, Homo sapiens
ccuaguauaucagugacaguug

SEQ ID NO: 2123360 - RNA, 18 nt, Homo sapiens
cccaccuacuuagauauu

SEQ ID NO: 2123361 - RNA, 20 nt, Homo sapiens
auugaagacccucaaugcca

SEQ ID NO: 2123362 - RNA, 14 nt, Homo sapiens
ugucaaugcaucaa

SEQ ID NO: 2123363 - RNA, 15 nt, Homo sapiens
uacuauaauugagaa

SEQ ID NO: 2123364 - RNA, 19 nt, Homo sapiens
ucaagauuacaacaucugu

SEQ ID NO: 2123365 - RNA, 21 nt, Homo sapiens
cuugggcaccagcucaugcca

SEQ ID NO: 2123366 - RNA, 17 nt, Homo sapiens
ccuaugaacucuugaua

SEQ ID NO: 2123367 - RNA, 19 nt, Homo sapiens
cacccuggaugcuguugag

SEQ ID NO: 2123368 - RNA, 23 nt, Homo sapiens
cuguuauccugcuagcuguagaa

SEQ ID NO: 2123369 - RNA, 22 nt, Homo sapiens
cuuuauaaaaagugaaauaaga

SEQ ID NO: 2123370 - RNA, 16 nt, Homo sapiens
gaagucuggaacacuu

SEQ ID NO: 2123371 - RNA, 17 nt, Homo sapiens
ugucccaaacaugcacu

SEQ ID NO: 2123372 - RNA, 14 nt, Homo sapiens
ucaggaucaaugac

SEQ ID NO: 2123373 - RNA, 22 nt, Homo sapiens
uaaacccaaucagaugccucag

SEQ ID NO: 2123374 - RNA, 14 nt, Homo sapiens
auauuggcauuugu

SEQ ID NO: 2123375 - RNA, 20 nt, Homo sapiens
auuuguaugcucauugaacu

SEQ ID NO: 2123376 - RNA, 17 nt, Homo sapiens
aauccuugugagaauuu

SEQ ID NO: 2123377 - RNA, 13 nt, Homo sapiens
cgaacugcacugc

SEQ ID NO: 2123378 - RNA, 19 nt, Homo sapiens
uucaugggacuaaaugaac

SEQ ID NO: 2123379 - RNA, 18 nt, Homo sapiens
caguggauugauuauaaa

SEQ ID NO: 2123380 - RNA, 21 nt, Homo sapiens
ugucuguaaugacaaauaagu

SEQ ID NO: 2123381 - RNA, 16 nt, Homo sapiens
gaagggagaauugaga

SEQ ID NO: 2123382 - RNA, 17 nt, Homo sapiens
aaaugacaugcacugac

SEQ ID NO: 2123383 - RNA, 16 nt, Homo sapiens
ugugcggaucucugga

SEQ ID NO: 2123384 - RNA, 12 nt, Homo sapiens
auggguggcucu

SEQ ID NO: 2123385 - RNA, 20 nt, Homo sapiens
aagcaggaaaugaaaauguc

SEQ ID NO: 2123386 - RNA, 21 nt, Homo sapiens
aaacuuauucgcaauagacaa

SEQ ID NO: 2123387 - RNA, 16 nt, Homo sapiens
uaaauugucucaaaga

SEQ ID NO: 2123388 - RNA, 16 nt, Homo sapiens
aacuaguguugcuugg

SEQ ID NO: 2123389 - RNA, 19 nt, Homo sapiens
ucaauaaaguuuccugccu

SEQ ID NO: 2123390 - RNA, 21 nt, Homo sapiens
uccugggggcugcugcacugc

SEQ ID NO: 2123391 - RNA, 17 nt, Homo sapiens
aaacagcuuugucucca

SEQ ID NO: 2123392 - RNA, 13 nt, Homo sapiens
agaagccacagug

SEQ ID NO: 2123393 - RNA, 14 nt, Homo sapiens
auacacauauacaa

SEQ ID NO: 2123394 - RNA, 16 nt, Homo sapiens
aggcgggaugggcucg

SEQ ID NO: 2123395 - RNA, 21 nt, Homo sapiens
cagcaguguucucacagugug

SEQ ID NO: 2123396 - RNA, 18 nt, Homo sapiens
aguaaauauugaggcuuu

SEQ ID NO: 2123397 - RNA, 20 nt, Homo sapiens
cuaaauucaaagaaguacuu

SEQ ID NO: 2123398 - RNA, 21 nt, Homo sapiens
ucuagaggcuggcaagaacca

SEQ ID NO: 2123399 - RNA, 16 nt, Homo sapiens
augcugacccaugcaa

SEQ ID NO: 2123400 - RNA, 18 nt, Homo sapiens
ccaagcuuguuaucagcu

SEQ ID NO: 2123401 - RNA, 23 nt, Homo sapiens
gucaccaggcuggagugcagugc

SEQ ID NO: 2123402 - RNA, 14 nt, Homo sapiens
gaagucuugucuca

SEQ ID NO: 2123403 - RNA, 19 nt, Homo sapiens
uaauuguuuaaaaugccuc

SEQ ID NO: 2123404 - RNA, 17 nt, Homo sapiens
guagauaauuucagggu

SEQ ID NO: 2123405 - RNA, 20 nt, Homo sapiens
aauaaagugacccuguucuc

SEQ ID NO: 2123406 - RNA, 19 nt, Homo sapiens
caguuauuucaaccagcac

SEQ ID NO: 2123407 - RNA, 13 nt, Homo sapiens
gaagcauuuugca

SEQ ID NO: 2123408 - RNA, 17 nt, Homo sapiens
aaaacuccccuuccuca

SEQ ID NO: 2123409 - RNA, 21 nt, Homo sapiens
acggaguauucuuuaccucag

SEQ ID NO: 2123410 - RNA, 14 nt, Homo sapiens
ucugaguauugaau

SEQ ID NO: 2123411 - RNA, 21 nt, Homo sapiens
ccuggagacauaucacucaau

SEQ ID NO: 2123412 - RNA, 21 nt, Homo sapiens
augaacccugccccacuccug

SEQ ID NO: 2123413 - RNA, 13 nt, Homo sapiens
caguuuagcauua

SEQ ID NO: 2123414 - RNA, 19 nt, Homo sapiens
agacauuugcuaugagcug

SEQ ID NO: 2123415 - RNA, 17 nt, Homo sapiens
uacaagcaggcacugua

SEQ ID NO: 2123416 - RNA, 19 nt, Homo sapiens
guaaacggcccaggccagg

SEQ ID NO: 2123417 - RNA, 18 nt, Homo sapiens
guggagcugcugguguuu

SEQ ID NO: 2123418 - RNA, 16 nt, Homo sapiens
ugaggcuguuccuuga

SEQ ID NO: 2123419 - RNA, 23 nt, Homo sapiens
gcuuacuuacaaaagcagcuuuu

SEQ ID NO: 2123420 - RNA, 14 nt, Homo sapiens
cauuuuuagcuccu

SEQ ID NO: 2123421 - RNA, 22 nt, Homo sapiens
uuuuaagcaacaaaacuaugga

SEQ ID NO: 2123422 - RNA, 21 nt, Homo sapiens
gacacaccauuauauuuaauu

SEQ ID NO: 2123423 - RNA, 16 nt, Homo sapiens
ugauuagccauuugac

SEQ ID NO: 2123424 - RNA, 21 nt, Homo sapiens
uuuuuuaagcaacacuuggaa

SEQ ID NO: 2123425 - RNA, 14 nt, Homo sapiens
uguacuaccccagg

SEQ ID NO: 2123426 - RNA, 16 nt, Homo sapiens
uccugcagagauccag

SEQ ID NO: 2123427 - RNA, 20 nt, Homo sapiens
uuaauaagauuuucugggau

SEQ ID NO: 2123428 - RNA, 21 nt, Homo sapiens
gguaaauauagaaccaugaau

SEQ ID NO: 2123429 - RNA, 21 nt, Homo sapiens
cugauguugguaucuaaggcu

SEQ ID NO: 2123430 - RNA, 20 nt, Homo sapiens
gacuucaauuucccacccau

SEQ ID NO: 2123431 - RNA, 14 nt, Homo sapiens
gaaaaacaugucau

SEQ ID NO: 2123432 - RNA, 21 nt, Homo sapiens
caagcuaggacaccuguggua

SEQ ID NO: 2123433 - RNA, 19 nt, Homo sapiens
guagaggcugggggcucca

SEQ ID NO: 2123434 - RNA, 13 nt, Homo sapiens
guaauucucaggc

SEQ ID NO: 2123435 - RNA, 21 nt, Homo sapiens
ccugucaccaugacuuccuca

SEQ ID NO: 2123436 - RNA, 21 nt, Homo sapiens
gcccuggcagcaugacucaga

SEQ ID NO: 2123437 - RNA, 14 nt, Homo sapiens
gaggauuucuggga

SEQ ID NO: 2123438 - RNA, 14 nt, Homo sapiens
ucuccacaagggga

SEQ ID NO: 2123439 - RNA, 14 nt, Homo sapiens
ccugccuacuuccu

SEQ ID NO: 2123440 - RNA, 21 nt, Homo sapiens
ucaccaagcuaggugcuauuu

SEQ ID NO: 2123441 - RNA, 15 nt, Homo sapiens
agccccucacacagc

SEQ ID NO: 2123442 - RNA, 19 nt, Homo sapiens
ccacaagagccccaaagau

SEQ ID NO: 2123443 - RNA, 16 nt, Homo sapiens
aauaaaccagugugaa

SEQ ID NO: 2123444 - RNA, 13 nt, Homo sapiens
ggcaaugcaaaag

SEQ ID NO: 2123445 - RNA, 20 nt, Homo sapiens
cuuuuccuccaaccuguggc

SEQ ID NO: 2123446 - RNA, 18 nt, Homo sapiens
aagguuaugcacugccug

SEQ ID NO: 2123447 - RNA, 18 nt, Homo sapiens
aaaacauuaagaaaauca

SEQ ID NO: 2123448 - RNA, 22 nt, Homo sapiens
aauucagcuuuguccaaaggaa

SEQ ID NO: 2123449 - RNA, 16 nt, Homo sapiens
accaggagacagacag

SEQ ID NO: 2123450 - RNA, 13 nt, Homo sapiens
cugacuaccagcu

SEQ ID NO: 2123451 - RNA, 15 nt, Homo sapiens
ugcauagcuuucaca

SEQ ID NO: 2123452 - RNA, 14 nt, Homo sapiens
cagggcaaauggaa

SEQ ID NO: 2123453 - RNA, 15 nt, Homo sapiens
gccugucguguccag

SEQ ID NO: 2123454 - RNA, 21 nt, Homo sapiens
cauguuugccuucugcacaua

SEQ ID NO: 2123455 - RNA, 23 nt, Homo sapiens
ugcucagcuacuucuccugcacu

SEQ ID NO: 2123456 - RNA, 19 nt, Homo sapiens
ccuaggggaacagaccagu

SEQ ID NO: 2123457 - RNA, 15 nt, Homo sapiens
uuaucuacuucucuc

SEQ ID NO: 2123458 - RNA, 15 nt, Homo sapiens
cuccaccccuacaca

SEQ ID NO: 2123459 - RNA, 17 nt, Homo sapiens
ggacuccagaucugcac

SEQ ID NO: 2123460 - RNA, 20 nt, Homo sapiens
uaugcaaauacaaucagccc

SEQ ID NO: 2123461 - RNA, 22 nt, Homo sapiens
uuauuacccaaacccauggcuc

SEQ ID NO: 2123462 - RNA, 17 nt, Homo sapiens
aucuguauaagcuguaa

SEQ ID NO: 2123463 - RNA, 23 nt, Homo sapiens
gcaucccauacuagacucauacu

SEQ ID NO: 2123464 - RNA, 15 nt, Homo sapiens
auaggcaugagccac

SEQ ID NO: 2123465 - RNA, 14 nt, Homo sapiens
caggacuccaucuc

SEQ ID NO: 2123466 - RNA, 23 nt, Homo sapiens
ugucccuuucuuggccaguuauc

SEQ ID NO: 2123467 - RNA, 18 nt, Homo sapiens
aagacuuggguugaucuc

SEQ ID NO: 2123468 - RNA, 23 nt, Homo sapiens
ucaguaaggcagugaaguacuca

SEQ ID NO: 2123469 - RNA, 20 nt, Homo sapiens
uuggaaacaaaaauguacaa

SEQ ID NO: 2123470 - RNA, 17 nt, Homo sapiens
gaggcagauagcacugg

SEQ ID NO: 2123471 - RNA, 16 nt, Homo sapiens
auucauggcuaccuca

SEQ ID NO: 2123472 - RNA, 15 nt, Homo sapiens
ugcgggccagggucc

SEQ ID NO: 2123473 - RNA, 11 nt, Homo sapiens
aauacagugaa

SEQ ID NO: 2123474 - RNA, 11 nt, Homo sapiens
auaacaguguu

SEQ ID NO: 2123475 - RNA, 21 nt, Homo sapiens
aaauccgaaccuccucuguga

SEQ ID NO: 2123476 - RNA, 22 nt, Homo sapiens
ugcacuacauaaucucuggaaa

SEQ ID NO: 2123477 - RNA, 21 nt, Homo sapiens
acucgggcacucccuaagucc

SEQ ID NO: 2123478 - RNA, 19 nt, Homo sapiens
aucguggccuugaccucca

SEQ ID NO: 2123479 - RNA, 18 nt, Homo sapiens
aguccugauguacuuuaa

SEQ ID NO: 2123480 - RNA, 13 nt, Homo sapiens
cagcauacgucag

SEQ ID NO: 2123481 - RNA, 20 nt, Homo sapiens
gccucuucgcugaccucgac

SEQ ID NO: 2123482 - RNA, 12 nt, Homo sapiens
ggucagagccac

SEQ ID NO: 2123483 - RNA, 14 nt, Homo sapiens
gcaaaugacuguca

SEQ ID NO: 2123484 - RNA, 15 nt, Homo sapiens
aaaguguuuucacaa

SEQ ID NO: 2123485 - RNA, 17 nt, Homo sapiens
aaugaaccaaaccaaau

SEQ ID NO: 2123486 - RNA, 17 nt, Homo sapiens
caggccgcacaucucac

SEQ ID NO: 2123487 - RNA, 24 nt, Homo sapiens
uuguaacuguaaagaugaauguca

SEQ ID NO: 2123488 - RNA, 13 nt, Homo sapiens
uguguaaacucau

SEQ ID NO: 2123489 - RNA, 18 nt, Homo sapiens
aaccccuugguacugaaa

SEQ ID NO: 2123490 - RNA, 12 nt, Homo sapiens
ucaccuuauuca

SEQ ID NO: 2123491 - RNA, 14 nt, Homo sapiens
ccaucccuucucug

SEQ ID NO: 2123492 - RNA, 20 nt, Homo sapiens
cuaccuagaaauacauggac

SEQ ID NO: 2123493 - RNA, 12 nt, Homo sapiens
aaagggcacuua

SEQ ID NO: 2123494 - RNA, 23 nt, Homo sapiens
cauuugugggucuguguggcagg

SEQ ID NO: 2123495 - RNA, 21 nt, Homo sapiens
uuaagguuucaacaaauuuca

SEQ ID NO: 2123496 - RNA, 23 nt, Homo sapiens
uuuuaacacuagaaaacauucca

SEQ ID NO: 2123497 - RNA, 20 nt, Homo sapiens
gcuggcuggaaaaaggugaa

SEQ ID NO: 2123498 - RNA, 17 nt, Homo sapiens
gcuggguuuucaggggc

SEQ ID NO: 2123499 - RNA, 18 nt, Homo sapiens
caaaaccacuagaacucu

SEQ ID NO: 2123500 - RNA, 19 nt, Homo sapiens
cugccaaaagaucugggga

SEQ ID NO: 2123501 - RNA, 15 nt, Homo sapiens
aaccagaucaggaga

SEQ ID NO: 2123502 - RNA, 16 nt, Homo sapiens
gcgcacaccgccagca

SEQ ID NO: 2123503 - RNA, 20 nt, Homo sapiens
cauuaauuaguuccaguuuc

SEQ ID NO: 2123504 - RNA, 20 nt, Homo sapiens
ucaaagccauauggacacug

SEQ ID NO: 2123505 - RNA, 14 nt, Homo sapiens
uauaguucuaggca

SEQ ID NO: 2123506 - RNA, 18 nt, Homo sapiens
gaugccauauaguguuau

SEQ ID NO: 2123507 - RNA, 20 nt, Homo sapiens
uugguggccccaaccacagg

SEQ ID NO: 2123508 - RNA, 22 nt, Homo sapiens
gaggauggacuaaaugaucucu

SEQ ID NO: 2123509 - RNA, 18 nt, Homo sapiens
gugaggguccugauucuc

SEQ ID NO: 2123510 - RNA, 18 nt, Homo sapiens
caaugauuuuuugcaaaa

SEQ ID NO: 2123511 - RNA, 23 nt, Homo sapiens
ucagugcauagcgaagaccagua

SEQ ID NO: 2123512 - RNA, 14 nt, Homo sapiens
cggccuccaugcac

SEQ ID NO: 2123513 - RNA, 14 nt, Homo sapiens
cguuacccauuucu

SEQ ID NO: 2123514 - RNA, 22 nt, Homo sapiens
gcuguaaauccuagacuugaaa

SEQ ID NO: 2123515 - RNA, 16 nt, Homo sapiens
uauuacaacacuuuaa

SEQ ID NO: 2123516 - RNA, 13 nt, Homo sapiens
ggcagcuccucag

SEQ ID NO: 2123517 - RNA, 13 nt, Homo sapiens
ggcaccuccucac

SEQ ID NO: 2123518 - RNA, 19 nt, Homo sapiens
aauggauccuugucaguug

SEQ ID NO: 2123519 - RNA, 16 nt, Homo sapiens
caugagagcccagaaa

SEQ ID NO: 2123520 - RNA, 20 nt, Homo sapiens
auaguuuaaaaaucugccac

SEQ ID NO: 2123521 - RNA, 19 nt, Homo sapiens
cugggcuuugucaugucuc

SEQ ID NO: 2123522 - RNA, 19 nt, Homo sapiens
aaaugaaugcugauuguaa

SEQ ID NO: 2123523 - RNA, 16 nt, Homo sapiens
uuuuacaucuauccca

SEQ ID NO: 2123524 - RNA, 13 nt, Homo sapiens
gcuccacccauga

SEQ ID NO: 2123525 - RNA, 17 nt, Homo sapiens
auaauuuacuuuguaga

SEQ ID NO: 2123526 - RNA, 17 nt, Homo sapiens
gucuuugcuguaaacuu

SEQ ID NO: 2123527 - RNA, 13 nt, Homo sapiens
cuaagcacucuag

SEQ ID NO: 2123528 - RNA, 13 nt, Homo sapiens
accugcagauucu

SEQ ID NO: 2123529 - RNA, 17 nt, Homo sapiens
agauuccacacaggggu

SEQ ID NO: 2123530 - RNA, 15 nt, Homo sapiens
gauagauauaugcuc

SEQ ID NO: 2123531 - RNA, 16 nt, Homo sapiens
aaaguaccuugaacuc

SEQ ID NO: 2123532 - RNA, 14 nt, Homo sapiens
aaguaacauuugcc

SEQ ID NO: 2123533 - RNA, 22 nt, Homo sapiens
aacucucagucagugucaugaa

SEQ ID NO: 2123534 - RNA, 16 nt, Homo sapiens
agcgugggcucagcag

SEQ ID NO: 2123535 - RNA, 13 nt, Homo sapiens
agaauuagcuuuu

SEQ ID NO: 2123536 - RNA, 24 nt, Homo sapiens
augaccaaaaucaggaaccacaga

SEQ ID NO: 2123537 - RNA, 18 nt, Homo sapiens
aaacucuacuuaauccaa

SEQ ID NO: 2123538 - RNA, 16 nt, Homo sapiens
aggacuugaacccagg

SEQ ID NO: 2123539 - RNA, 16 nt, Homo sapiens
ccaggcgaugugcaag

SEQ ID NO: 2123540 - RNA, 18 nt, Homo sapiens
acuuucuucucuuuccca

SEQ ID NO: 2123541 - RNA, 15 nt, Homo sapiens
cccuuccuugccagu

SEQ ID NO: 2123542 - RNA, 15 nt, Homo sapiens
gauagcauugugaac

SEQ ID NO: 2123543 - RNA, 17 nt, Homo sapiens
agaaaauaagagcucag

SEQ ID NO: 2123544 - RNA, 16 nt, Homo sapiens
cuggcccuuacacacu

SEQ ID NO: 2123545 - RNA, 15 nt, Homo sapiens
cuuacaaccuuguca

SEQ ID NO: 2123546 - RNA, 11 nt, Homo sapiens
gaaacuauuaa

SEQ ID NO: 2123547 - RNA, 18 nt, Homo sapiens
gacugcuugcccuaagca

SEQ ID NO: 2123548 - RNA, 23 nt, Homo sapiens
aguauuuuuuaauccuaccucaa

SEQ ID NO: 2123549 - RNA, 17 nt, Homo sapiens
aguuuguuuuaacuucc

SEQ ID NO: 2123550 - RNA, 19 nt, Homo sapiens
guaggaaucugccuuccag

SEQ ID NO: 2123551 - RNA, 15 nt, Homo sapiens
cacaauaacuccucc

SEQ ID NO: 2123552 - RNA, 14 nt, Homo sapiens
aucauaugggauac

SEQ ID NO: 2123553 - RNA, 22 nt, Homo sapiens
cauuuuuagaaaucacaacaaa

SEQ ID NO: 2123554 - RNA, 14 nt, Homo sapiens
ucucuuuaaucuca

SEQ ID NO: 2123555 - RNA, 21 nt, Homo sapiens
gccugaggcaugagugacugu

SEQ ID NO: 2123556 - RNA, 20 nt, Homo sapiens
uauugaaaggggacaccugu

SEQ ID NO: 2123557 - RNA, 18 nt, Homo sapiens
agucccagcuacauggga

SEQ ID NO: 2123558 - RNA, 20 nt, Homo sapiens
cauugauuugauuuuuauua

SEQ ID NO: 2123559 - RNA, 14 nt, Homo sapiens
cuucauucugcaag

SEQ ID NO: 2123560 - RNA, 13 nt, Homo sapiens
uaaaaucuggaua

SEQ ID NO: 2123561 - RNA, 16 nt, Homo sapiens
accagugcagacucaa

SEQ ID NO: 2123562 - RNA, 19 nt, Homo sapiens
guauauaacuuauuugccc

SEQ ID NO: 2123563 - RNA, 22 nt, Homo sapiens
aggaagaacggggcucuucuca

SEQ ID NO: 2123564 - RNA, 18 nt, Homo sapiens
ugaggggcuaccaggaaa

SEQ ID NO: 2123565 - RNA, 22 nt, Homo sapiens
aaucugacuuuagccuaccuaa

SEQ ID NO: 2123566 - RNA, 13 nt, Homo sapiens
gccacucaaagga

SEQ ID NO: 2123567 - RNA, 16 nt, Homo sapiens
cacaccccaacacuuc

SEQ ID NO: 2123568 - RNA, 13 nt, Homo sapiens
agcacuauggaca

SEQ ID NO: 2123569 - RNA, 21 nt, Homo sapiens
uauccaaucuuguuuccaaaa

SEQ ID NO: 2123570 - RNA, 14 nt, Homo sapiens
ccuauguaugccau

SEQ ID NO: 2123571 - RNA, 18 nt, Homo sapiens
gcccuccuacagcacucc

SEQ ID NO: 2123572 - RNA, 13 nt, Homo sapiens
auugaauguggua

SEQ ID NO: 2123573 - RNA, 13 nt, Homo sapiens
ugauaacucugua

SEQ ID NO: 2123574 - RNA, 21 nt, Homo sapiens
cucuugcuggaacuguugaaa

SEQ ID NO: 2123575 - RNA, 20 nt, Homo sapiens
ucaugaacacaauacauguu

SEQ ID NO: 2123576 - RNA, 20 nt, Homo sapiens
ucauugguacccacuugcuu

SEQ ID NO: 2123577 - RNA, 18 nt, Homo sapiens
aggaaccauaugugcuac

SEQ ID NO: 2123578 - RNA, 16 nt, Homo sapiens
guguuccccacuguau

SEQ ID NO: 2123579 - RNA, 16 nt, Homo sapiens
ccagugugagacccca

SEQ ID NO: 2123580 - RNA, 13 nt, Homo sapiens
cuggcugugugac

SEQ ID NO: 2123581 - RNA, 13 nt, Homo sapiens
cugggccccaucu

SEQ ID NO: 2123582 - RNA, 13 nt, Homo sapiens
uacuauccccaaa

SEQ ID NO: 2123583 - RNA, 17 nt, Homo sapiens
uagaaaggggcccaguc

SEQ ID NO: 2123584 - RNA, 16 nt, Homo sapiens
caucuugcaagcaaau

SEQ ID NO: 2123585 - RNA, 16 nt, Homo sapiens
accccucccuacuguu

SEQ ID NO: 2123586 - RNA, 14 nt, Homo sapiens
uucucuucuggaca

SEQ ID NO: 2123587 - RNA, 19 nt, Homo sapiens
cccaggccaucaccacagc

SEQ ID NO: 2123588 - RNA, 21 nt, Homo sapiens
auaacuuauaucaucagcaua

SEQ ID NO: 2123589 - RNA, 14 nt, Homo sapiens
cucacaagcacuuu

SEQ ID NO: 2123590 - RNA, 16 nt, Homo sapiens
guuucaaguacuguaa

SEQ ID NO: 2123591 - RNA, 20 nt, Homo sapiens
uuguggaggaggugaaagaa

SEQ ID NO: 2123592 - RNA, 20 nt, Homo sapiens
gccaccccuaaucacuauug

SEQ ID NO: 2123593 - RNA, 20 nt, Homo sapiens
ucgcaaaaacguaucuccua

SEQ ID NO: 2123594 - RNA, 19 nt, Homo sapiens
cacacuuucugacugcaac

SEQ ID NO: 2123595 - RNA, 23 nt, Homo sapiens
gugccugacacauagaaaacaau

SEQ ID NO: 2123596 - RNA, 16 nt, Homo sapiens
guuucaguugacaaaa

SEQ ID NO: 2123597 - RNA, 21 nt, Homo sapiens
aaagcuacccaucugccagau

SEQ ID NO: 2123598 - RNA, 14 nt, Homo sapiens
cauggugauaugca

SEQ ID NO: 2123599 - RNA, 20 nt, Homo sapiens
augacugcuugcccuaagca

SEQ ID NO: 2123600 - RNA, 14 nt, Homo sapiens
auaauauaagccau

SEQ ID NO: 2123601 - RNA, 24 nt, Homo sapiens
agacuaagcccugucgagacacuu

SEQ ID NO: 2123602 - RNA, 14 nt, Homo sapiens
aagagaaguuguaa

SEQ ID NO: 2123603 - RNA, 21 nt, Homo sapiens
guaaaaauugauuacaauuga

SEQ ID NO: 2123604 - RNA, 21 nt, Homo sapiens
uucaggcuaagaagagauuuc

SEQ ID NO: 2123605 - RNA, 19 nt, Homo sapiens
ccuaccaaugccaaaagga

SEQ ID NO: 2123606 - RNA, 12 nt, Homo sapiens
ucuagaacagcc

SEQ ID NO: 2123607 - RNA, 19 nt, Homo sapiens
accuggcccugugccuugg

SEQ ID NO: 2123608 - RNA, 23 nt, Homo sapiens
ucgaaaauucauuucacauuaau

SEQ ID NO: 2123609 - RNA, 19 nt, Homo sapiens
gcugcauugauccaggaga

SEQ ID NO: 2123610 - RNA, 18 nt, Homo sapiens
agggggaagacagauaug

SEQ ID NO: 2123611 - RNA, 14 nt, Homo sapiens
aguaacagugcagu

SEQ ID NO: 2123612 - RNA, 22 nt, Homo sapiens
gauugaguuuucuucugugauu

SEQ ID NO: 2123613 - RNA, 19 nt, Homo sapiens
cuauggagugcaccaaaga

SEQ ID NO: 2123614 - RNA, 15 nt, Homo sapiens
uaacuuuauguguaa

SEQ ID NO: 2123615 - RNA, 16 nt, Homo sapiens
aagaacagagugccug

SEQ ID NO: 2123616 - RNA, 19 nt, Homo sapiens
cugguugucauuuuugcag

SEQ ID NO: 2123617 - RNA, 20 nt, Homo sapiens
ccauagauccccccacugag

SEQ ID NO: 2123618 - RNA, 14 nt, Homo sapiens
ggucuagcuggcca

SEQ ID NO: 2123619 - RNA, 18 nt, Homo sapiens
aaaauuauuauaagcauu

SEQ ID NO: 2123620 - RNA, 13 nt, Homo sapiens
auauuuaacuuug

SEQ ID NO: 2123621 - RNA, 20 nt, Homo sapiens
gugaaggugguggggcugcc

SEQ ID NO: 2123622 - RNA, 11 nt, Homo sapiens
ccccuuugccu

SEQ ID NO: 2123623 - RNA, 21 nt, Homo sapiens
ugagguggcuaagggggacca

SEQ ID NO: 2123624 - RNA, 20 nt, Homo sapiens
uaguucuccccgauggggca

SEQ ID NO: 2123625 - RNA, 18 nt, Homo sapiens
ccauguuguaaugcugca

SEQ ID NO: 2123626 - RNA, 18 nt, Homo sapiens
uccagcuucucaguuucu

SEQ ID NO: 2123627 - RNA, 22 nt, Homo sapiens
agggugcauguccccugcuuga

SEQ ID NO: 2123628 - RNA, 12 nt, Homo sapiens
aagaacaucagu

SEQ ID NO: 2123629 - RNA, 12 nt, Homo sapiens
aucaacaucucu

SEQ ID NO: 2123630 - RNA, 21 nt, Homo sapiens
ucucauguuuuuuccuuuuca

SEQ ID NO: 2123631 - RNA, 18 nt, Homo sapiens
accgagguguugccagug

SEQ ID NO: 2123632 - RNA, 16 nt, Homo sapiens
uauugucggaagacuu

SEQ ID NO: 2123633 - RNA, 20 nt, Homo sapiens
aacucuaagaccacagaguu

SEQ ID NO: 2123634 - RNA, 14 nt, Homo sapiens
aagaaaauccauuc

SEQ ID NO: 2123635 - RNA, 14 nt, Homo sapiens
uggauggauucauc

SEQ ID NO: 2123636 - RNA, 20 nt, Homo sapiens
ggccaucucuggaugccuga

SEQ ID NO: 2123637 - RNA, 14 nt, Homo sapiens
cacuguuucuaaaa

SEQ ID NO: 2123638 - RNA, 19 nt, Homo sapiens
gcaucauguagugcauuua

SEQ ID NO: 2123639 - RNA, 23 nt, Homo sapiens
caaaagcuuugaauacugugaaa

SEQ ID NO: 2123640 - RNA, 20 nt, Homo sapiens
ucgcccuuucuuaaagugca

SEQ ID NO: 2123641 - RNA, 14 nt, Homo sapiens
uaggcagcaccuua

SEQ ID NO: 2123642 - RNA, 16 nt, Homo sapiens
aacauaaauuuaucau

SEQ ID NO: 2123643 - RNA, 15 nt, Homo sapiens
gcuuggggacagaaa

SEQ ID NO: 2123644 - RNA, 21 nt, Homo sapiens
cugcaggggucucaugugguc

SEQ ID NO: 2123645 - RNA, 13 nt, Homo sapiens
ugaugugggagcu

SEQ ID NO: 2123646 - RNA, 21 nt, Homo sapiens
cugugggucugggagucacac

SEQ ID NO: 2123647 - RNA, 13 nt, Homo sapiens
cagauugcaugug

SEQ ID NO: 2123648 - RNA, 13 nt, Homo sapiens
cauuuugcauuag

SEQ ID NO: 2123649 - RNA, 13 nt, Homo sapiens
cuuugugcaauau

SEQ ID NO: 2123650 - RNA, 15 nt, Homo sapiens
cuucauggacuucca

SEQ ID NO: 2123651 - RNA, 19 nt, Homo sapiens
ccuaaugcuuuauccauca

SEQ ID NO: 2123652 - RNA, 21 nt, Homo sapiens
acauaacacacaucaguccac

SEQ ID NO: 2123653 - RNA, 20 nt, Homo sapiens
ucgccggcuucaaguggcag

SEQ ID NO: 2123654 - RNA, 21 nt, Homo sapiens
agccaccuggaaacacuaggu

SEQ ID NO: 2123655 - RNA, 13 nt, Homo sapiens
uacaaaugacaug

SEQ ID NO: 2123656 - RNA, 16 nt, Homo sapiens
cuauggauucacuucu

SEQ ID NO: 2123657 - RNA, 14 nt, Homo sapiens
gcagggugcuagug

SEQ ID NO: 2123658 - RNA, 23 nt, Homo sapiens
ugucuauuauuuagaaaugaaca

SEQ ID NO: 2123659 - RNA, 16 nt, Homo sapiens
acagaccucaagggac

SEQ ID NO: 2123660 - RNA, 12 nt, Homo sapiens
gauaaguguucu

SEQ ID NO: 2123661 - RNA, 15 nt, Homo sapiens
ugcuaauucaaagcu

SEQ ID NO: 2123662 - RNA, 19 nt, Homo sapiens
uggaggaacaacucuccag

SEQ ID NO: 2123663 - RNA, 17 nt, Homo sapiens
agggugugaugaaguca

SEQ ID NO: 2123664 - RNA, 18 nt, Homo sapiens
acuaaaaaggaaacuuca

SEQ ID NO: 2123665 - RNA, 12 nt, Homo sapiens
gagaaaugagcu

SEQ ID NO: 2123666 - RNA, 16 nt, Homo sapiens
agccuccagguuuccu

SEQ ID NO: 2123667 - RNA, 18 nt, Homo sapiens
cuucagacugaacaugua

SEQ ID NO: 2123668 - RNA, 14 nt, Homo sapiens
acugcagugagaau

SEQ ID NO: 2123669 - RNA, 12 nt, Homo sapiens
acaaaaguaaaa

SEQ ID NO: 2123670 - RNA, 17 nt, Homo sapiens
cuucaaccucauugaca

SEQ ID NO: 2123671 - RNA, 23 nt, Homo sapiens
uaaaagguguuguaauggugaaa

SEQ ID NO: 2123672 - RNA, 14 nt, Homo sapiens
gggagccaccacuc

SEQ ID NO: 2123673 - RNA, 11 nt, Homo sapiens
gccuguucacg

SEQ ID NO: 2123674 - RNA, 19 nt, Homo sapiens
caucaggagcuagagccau

SEQ ID NO: 2123675 - RNA, 16 nt, Homo sapiens
gcccagggacaccagc

SEQ ID NO: 2123676 - RNA, 19 nt, Homo sapiens
uuuggugaauuugaaucuc

SEQ ID NO: 2123677 - RNA, 14 nt, Homo sapiens
accuaucucaggga

SEQ ID NO: 2123678 - RNA, 13 nt, Homo sapiens
aaaauacauugua

SEQ ID NO: 2123679 - RNA, 18 nt, Homo sapiens
uuucauuacuguguucaa

SEQ ID NO: 2123680 - RNA, 15 nt, Homo sapiens
ugcauguguguauaa

SEQ ID NO: 2123681 - RNA, 21 nt, Homo sapiens
cugagaaguacuuuaccugaa

SEQ ID NO: 2123682 - RNA, 16 nt, Homo sapiens
acaaaaaaagauuuaa

SEQ ID NO: 2123683 - RNA, 16 nt, Homo sapiens
agccaccucucccuca

SEQ ID NO: 2123684 - RNA, 19 nt, Homo sapiens
gaggaaacuucgguugcag

SEQ ID NO: 2123685 - RNA, 14 nt, Homo sapiens
caaaagccagucaa

SEQ ID NO: 2123686 - RNA, 17 nt, Homo sapiens
uguguuuggaagacuau

SEQ ID NO: 2123687 - RNA, 20 nt, Homo sapiens
gaguccugaagaucaagcca

SEQ ID NO: 2123688 - RNA, 22 nt, Homo sapiens
cuccaguauaaauuacaugcau

SEQ ID NO: 2123689 - RNA, 14 nt, Homo sapiens
aauauuuaccagac

SEQ ID NO: 2123690 - RNA, 21 nt, Homo sapiens
caaaaaaaccucuaugcaauc

SEQ ID NO: 2123691 - RNA, 13 nt, Homo sapiens
gagaagaucucaa

SEQ ID NO: 2123692 - RNA, 17 nt, Homo sapiens
cuuaacaaauacauuca

SEQ ID NO: 2123693 - RNA, 15 nt, Homo sapiens
auagaauacauguaa

SEQ ID NO: 2123694 - RNA, 20 nt, Homo sapiens
aaagcacugaccugucaugc

SEQ ID NO: 2123695 - RNA, 21 nt, Homo sapiens
ccccagcuguggguacagaga

SEQ ID NO: 2123696 - RNA, 14 nt, Homo sapiens
cuagucacauauca

SEQ ID NO: 2123697 - RNA, 17 nt, Homo sapiens
agaggggcggggccagg

SEQ ID NO: 2123698 - RNA, 13 nt, Homo sapiens
guaguauuuuggc

SEQ ID NO: 2123699 - RNA, 17 nt, Homo sapiens
cucauuuacaaagcaaa

SEQ ID NO: 2123700 - RNA, 11 nt, Homo sapiens
cccauggcucu

SEQ ID NO: 2123701 - RNA, 14 nt, Homo sapiens
ccccacuccuguca

SEQ ID NO: 2123702 - RNA, 10 nt, Homo sapiens
auagcacuug

SEQ ID NO: 2123703 - RNA, 16 nt, Homo sapiens
gccuuguguuauagaa

SEQ ID NO: 2123704 - RNA, 20 nt, Homo sapiens
caugccaaugcacgcacaca

SEQ ID NO: 2123705 - RNA, 19 nt, Homo sapiens
uuuagccacucaaagucaa

SEQ ID NO: 2123706 - RNA, 21 nt, Homo sapiens
agccccucccccaucucccac

SEQ ID NO: 2123707 - RNA, 23 nt, Homo sapiens
ucugcaccccccugggcugagag

SEQ ID NO: 2123708 - RNA, 18 nt, Homo sapiens
agauuccagaaaucugcu

SEQ ID NO: 2123709 - RNA, 17 nt, Homo sapiens
auuacaggcaugagcca

SEQ ID NO: 2123710 - RNA, 19 nt, Homo sapiens
cucccaagcaccugggauu

SEQ ID NO: 2123711 - RNA, 20 nt, Homo sapiens
uucauguuuuguaccaucau

SEQ ID NO: 2123712 - RNA, 22 nt, Homo sapiens
guugaauaaauguaucugaaua

SEQ ID NO: 2123713 - RNA, 22 nt, Homo sapiens
ggaagauucccucuuccugcca

SEQ ID NO: 2123714 - RNA, 14 nt, Homo sapiens
uauuaauuuugcca

SEQ ID NO: 2123715 - RNA, 14 nt, Homo sapiens
caucauuucugucu

SEQ ID NO: 2123716 - RNA, 13 nt, Homo sapiens
accugcacugucc

SEQ ID NO: 2123717 - RNA, 19 nt, Homo sapiens
cacuaaauucgagaagcaa

SEQ ID NO: 2123718 - RNA, 20 nt, Homo sapiens
gcaaccuccgccucucaggu

SEQ ID NO: 2123719 - RNA, 23 nt, Homo sapiens
ugaugaaauaaaacuacaugguc

SEQ ID NO: 2123720 - RNA, 16 nt, Homo sapiens
cccucggguccauaga

SEQ ID NO: 2123721 - RNA, 18 nt, Homo sapiens
gccuuguccaucugauuc

SEQ ID NO: 2123722 - RNA, 20 nt, Homo sapiens
uggaauauaucaguaccucu

SEQ ID NO: 2123723 - RNA, 17 nt, Homo sapiens
ccaaacauccuacaaga

SEQ ID NO: 2123724 - RNA, 14 nt, Homo sapiens
cuccuggugcucca

SEQ ID NO: 2123725 - RNA, 13 nt, Homo sapiens
cuuccuggcacaa

SEQ ID NO: 2123726 - RNA, 18 nt, Homo sapiens
cauuuucuugucaaugga

SEQ ID NO: 2123727 - RNA, 23 nt, Homo sapiens
gccaaguaagagugguggccuau

SEQ ID NO: 2123728 - RNA, 19 nt, Homo sapiens
ggcuggccuuccccuccaa

SEQ ID NO: 2123729 - RNA, 19 nt, Homo sapiens
uuuaacaugguauuaucaa

SEQ ID NO: 2123730 - RNA, 21 nt, Homo sapiens
auagauuuucugcuacuuugc

SEQ ID NO: 2123731 - RNA, 15 nt, Homo sapiens
ucuaagguacugugg

SEQ ID NO: 2123732 - RNA, 13 nt, Homo sapiens
gcagcaucauuca

SEQ ID NO: 2123733 - RNA, 12 nt, Homo sapiens
uuucaaggccuu

SEQ ID NO: 2123734 - RNA, 19 nt, Homo sapiens
cacacaccaccaugcucaa

SEQ ID NO: 2123735 - RNA, 17 nt, Homo sapiens
agcugaggaaucuaauu

SEQ ID NO: 2123736 - RNA, 19 nt, Homo sapiens
cucacagauacccauccaa

SEQ ID NO: 2123737 - RNA, 19 nt, Homo sapiens
acuuacacucuuuuauaca

SEQ ID NO: 2123738 - RNA, 13 nt, Homo sapiens
aacguuugguuca

SEQ ID NO: 2123739 - RNA, 12 nt, Homo sapiens
cauuccaugacg

SEQ ID NO: 2123740 - RNA, 18 nt, Homo sapiens
uuccacccugucuaggca

SEQ ID NO: 2123741 - RNA, 15 nt, Homo sapiens
augcucaugucccug

SEQ ID NO: 2123742 - RNA, 16 nt, Homo sapiens
acaagugcucuuucca

SEQ ID NO: 2123743 - RNA, 14 nt, Homo sapiens
uaaaauucuuggga

SEQ ID NO: 2123744 - RNA, 22 nt, Homo sapiens
gauccaaggccgcggcccagac

SEQ ID NO: 2123745 - RNA, 13 nt, Homo sapiens
aauucuuguagau

SEQ ID NO: 2123746 - RNA, 18 nt, Homo sapiens
ugcuuucccugaagcccu

SEQ ID NO: 2123747 - RNA, 17 nt, Homo sapiens
accccgucacagccuca

SEQ ID NO: 2123748 - RNA, 20 nt, Homo sapiens
cuacugggcugcauucccau

SEQ ID NO: 2123749 - RNA, 15 nt, Homo sapiens
ggauucugagcagug

SEQ ID NO: 2123750 - RNA, 20 nt, Homo sapiens
ccaagauaaaaccagagcag

SEQ ID NO: 2123751 - RNA, 19 nt, Homo sapiens
cgcuucugccuuuucacug

SEQ ID NO: 2123752 - RNA, 14 nt, Homo sapiens
gcagcaggcagcuu

SEQ ID NO: 2123753 - RNA, 22 nt, Homo sapiens
auaacuccuuguuucagaugau

SEQ ID NO: 2123754 - RNA, 19 nt, Homo sapiens
gcugacacagacauccucu

SEQ ID NO: 2123755 - RNA, 22 nt, Homo sapiens
ugggcuucauuccggacuggca

SEQ ID NO: 2123756 - RNA, 20 nt, Homo sapiens
ccuugcuuugagacuccuca

SEQ ID NO: 2123757 - RNA, 18 nt, Homo sapiens
auucaauaaaaugcacug

SEQ ID NO: 2123758 - RNA, 20 nt, Homo sapiens
ggacaguaucguuuguuuau

SEQ ID NO: 2123759 - RNA, 13 nt, Homo sapiens
augauccugcaau

SEQ ID NO: 2123760 - RNA, 17 nt, Homo sapiens
gaacauaaaugcacaaa

SEQ ID NO: 2123761 - RNA, 18 nt, Homo sapiens
cugucauacuuuguuagg

SEQ ID NO: 2123762 - RNA, 14 nt, Homo sapiens
uguuuaugccacag

SEQ ID NO: 2123763 - RNA, 23 nt, Homo sapiens
agcccaggggaggcacaaagggc

SEQ ID NO: 2123764 - RNA, 21 nt, Homo sapiens
ugauuugaaccaaaacaguga

SEQ ID NO: 2123765 - RNA, 13 nt, Homo sapiens
uaaauccugccau

SEQ ID NO: 2123766 - RNA, 23 nt, Homo sapiens
uaauaaugauggucaacaauaag

SEQ ID NO: 2123767 - RNA, 13 nt, Homo sapiens
gaaaaugcauuag

SEQ ID NO: 2123768 - RNA, 19 nt, Homo sapiens
cauacagagacagauauac

SEQ ID NO: 2123769 - RNA, 12 nt, Homo sapiens
aguguugcccag

SEQ ID NO: 2123770 - RNA, 21 nt, Homo sapiens
agcucuuggccuuugcauuua

SEQ ID NO: 2123771 - RNA, 22 nt, Homo sapiens
aagaauucuuuuuacaucuauc

SEQ ID NO: 2123772 - RNA, 18 nt, Homo sapiens
uuaaagaugaacucugaa

SEQ ID NO: 2123773 - RNA, 17 nt, Homo sapiens
cacggcaaaaugucauu

SEQ ID NO: 2123774 - RNA, 14 nt, Homo sapiens
acucaguugcaacu

SEQ ID NO: 2123775 - RNA, 20 nt, Homo sapiens
aaggcagccacccugucacc

SEQ ID NO: 2123776 - RNA, 17 nt, Homo sapiens
ugacagugccugggaau

SEQ ID NO: 2123777 - RNA, 15 nt, Homo sapiens
ucucuguggggucua

SEQ ID NO: 2123778 - RNA, 17 nt, Homo sapiens
cuaguugaucagcuuau

SEQ ID NO: 2123779 - RNA, 16 nt, Homo sapiens
gacuugaaaugcucuu

SEQ ID NO: 2123780 - RNA, 15 nt, Homo sapiens
aggaggaaaauucca

SEQ ID NO: 2123781 - RNA, 20 nt, Homo sapiens
uggcaggaucggcuuccuca

SEQ ID NO: 2123782 - RNA, 21 nt, Homo sapiens
gccuaauggcuuucacuuucu

SEQ ID NO: 2123783 - RNA, 14 nt, Homo sapiens
ucaauuucucugag

SEQ ID NO: 2123784 - RNA, 17 nt, Homo sapiens
agccgggagccugaccc

SEQ ID NO: 2123785 - RNA, 23 nt, Homo sapiens
aaaucuggcuccuuuacaaaaga

SEQ ID NO: 2123786 - RNA, 16 nt, Homo sapiens
aaauccuuaugcauga

SEQ ID NO: 2123787 - RNA, 19 nt, Homo sapiens
agauuugcuugaaccuggg

SEQ ID NO: 2123788 - RNA, 19 nt, Homo sapiens
gcaagaagugggauucagg

SEQ ID NO: 2123789 - RNA, 15 nt, Homo sapiens
ugucagcccacagca

SEQ ID NO: 2123790 - RNA, 21 nt, Homo sapiens
uuucuaaguguucgucuuuag

SEQ ID NO: 2123791 - RNA, 16 nt, Homo sapiens
aaauuuuaagaccaag

SEQ ID NO: 2123792 - RNA, 20 nt, Homo sapiens
cgcuccucccugcuccucau

SEQ ID NO: 2123793 - RNA, 22 nt, Homo sapiens
gaucuagcuucaugccucaguu

SEQ ID NO: 2123794 - RNA, 15 nt, Homo sapiens
uugaaggaagacaug

SEQ ID NO: 2123795 - RNA, 17 nt, Homo sapiens
gugagaguuuggugaua

SEQ ID NO: 2123796 - RNA, 18 nt, Homo sapiens
ucuccaggacaaccugcu

SEQ ID NO: 2123797 - RNA, 13 nt, Homo sapiens
aacugacuucuuu

SEQ ID NO: 2123798 - RNA, 23 nt, Homo sapiens
ccaucagugcucccucacauguc

SEQ ID NO: 2123799 - RNA, 12 nt, Homo sapiens
aaaggagggaga

SEQ ID NO: 2123800 - RNA, 17 nt, Homo sapiens
cccauggcuaagcuuua

SEQ ID NO: 2123801 - RNA, 18 nt, Homo sapiens
uuaaucucuaaaauucua

SEQ ID NO: 2123802 - RNA, 15 nt, Homo sapiens
aucagcaucacccgg

SEQ ID NO: 2123803 - RNA, 18 nt, Homo sapiens
uccuaaacugaacacaug

SEQ ID NO: 2123804 - RNA, 11 nt, Homo sapiens
uugacauuccu

SEQ ID NO: 2123805 - RNA, 16 nt, Homo sapiens
uguacacgugcacaga

SEQ ID NO: 2123806 - RNA, 20 nt, Homo sapiens
ccaagagccaucugaagcca

SEQ ID NO: 2123807 - RNA, 21 nt, Homo sapiens
aggccacacacucugcauccg

SEQ ID NO: 2123808 - RNA, 21 nt, Homo sapiens
agcauuaguuguuauuauuaa

SEQ ID NO: 2123809 - RNA, 18 nt, Homo sapiens
uaacuuggcugcauuugc

SEQ ID NO: 2123810 - RNA, 14 nt, Homo sapiens
uugaagaaaagcac

SEQ ID NO: 2123811 - RNA, 23 nt, Homo sapiens
gaaaaaauuuacuuuaaacuaca

SEQ ID NO: 2123812 - RNA, 17 nt, Homo sapiens
gaauuauauguucagau

SEQ ID NO: 2123813 - RNA, 16 nt, Homo sapiens
cacuugaagaugcugc

SEQ ID NO: 2123814 - RNA, 13 nt, Homo sapiens
cacugcuguccac

SEQ ID NO: 2123815 - RNA, 17 nt, Homo sapiens
caaagggaacagugaau

SEQ ID NO: 2123816 - RNA, 19 nt, Homo sapiens
aaaugagacuuacugggug

SEQ ID NO: 2123817 - RNA, 19 nt, Homo sapiens
uaggaaggugaaucugccc

SEQ ID NO: 2123818 - RNA, 16 nt, Homo sapiens
caauugcaacagaagc

SEQ ID NO: 2123819 - RNA, 22 nt, Homo sapiens
cacaaaggaaguccaaccugag

SEQ ID NO: 2123820 - RNA, 10 nt, Homo sapiens
guaacugugu

SEQ ID NO: 2123821 - RNA, 10 nt, Homo sapiens
auaacuguau

SEQ ID NO: 2123822 - RNA, 22 nt, Homo sapiens
gcccagaaaucugggauguacu

SEQ ID NO: 2123823 - RNA, 14 nt, Homo sapiens
auuuucccaauaaa

SEQ ID NO: 2123824 - RNA, 22 nt, Homo sapiens
agagugaauuauauuuccuuaa

SEQ ID NO: 2123825 - RNA, 16 nt, Homo sapiens
gaagucuggagcaccc

SEQ ID NO: 2123826 - RNA, 14 nt, Homo sapiens
cuguuccacaccca

SEQ ID NO: 2123827 - RNA, 22 nt, Homo sapiens
ccaccgaaguggacuggccccu

SEQ ID NO: 2123828 - RNA, 19 nt, Homo sapiens
acauuaaacaaugaucaca

SEQ ID NO: 2123829 - RNA, 17 nt, Homo sapiens
aagaguaacuuuacucu

SEQ ID NO: 2123830 - RNA, 15 nt, Homo sapiens
aaagucaucaugaac

SEQ ID NO: 2123831 - RNA, 18 nt, Homo sapiens
caugaaaauuacaacaga

SEQ ID NO: 2123832 - RNA, 20 nt, Homo sapiens
agggugggggccaccugccu

SEQ ID NO: 2123833 - RNA, 21 nt, Homo sapiens
uuaaacucagggacagagcca

SEQ ID NO: 2123834 - RNA, 15 nt, Homo sapiens
cugaugacaaaccca

SEQ ID NO: 2123835 - RNA, 21 nt, Homo sapiens
uacuucaauugcuuugcacuu

SEQ ID NO: 2123836 - RNA, 14 nt, Homo sapiens
ggcacucucuuuug

SEQ ID NO: 2123837 - RNA, 15 nt, Homo sapiens
gaggaggugacaaac

SEQ ID NO: 2123838 - RNA, 15 nt, Homo sapiens
ucacacuaucacugc

SEQ ID NO: 2123839 - RNA, 15 nt, Homo sapiens
acucuguaacucacc

SEQ ID NO: 2123840 - RNA, 23 nt, Homo sapiens
acaaauaagugugcaguaucugu

SEQ ID NO: 2123841 - RNA, 17 nt, Homo sapiens
cuagaacacaaauccaa

SEQ ID NO: 2123842 - RNA, 12 nt, Homo sapiens
uuguuccaaaug

SEQ ID NO: 2123843 - RNA, 17 nt, Homo sapiens
aaccaucauuuaauuuc

SEQ ID NO: 2123844 - RNA, 14 nt, Homo sapiens
guuucuuuggccag

SEQ ID NO: 2123845 - RNA, 20 nt, Homo sapiens
ugacauucacuuccagagag

SEQ ID NO: 2123846 - RNA, 20 nt, Homo sapiens
agcaaccuauauaaaccugg

SEQ ID NO: 2123847 - RNA, 18 nt, Homo sapiens
ccugugugaacuauugag

SEQ ID NO: 2123848 - RNA, 14 nt, Homo sapiens
gccauucuuuccca

SEQ ID NO: 2123849 - RNA, 18 nt, Homo sapiens
ugucccuccuggugucac

SEQ ID NO: 2123850 - RNA, 18 nt, Homo sapiens
aggacugaccucuuccuc

SEQ ID NO: 2123851 - RNA, 19 nt, Homo sapiens
guuuauggccacauuuaau

SEQ ID NO: 2123852 - RNA, 17 nt, Homo sapiens
ggcugccugcuguguua

SEQ ID NO: 2123853 - RNA, 21 nt, Homo sapiens
gcuuuguuucuuucauaugaa

SEQ ID NO: 2123854 - RNA, 15 nt, Homo sapiens
acccgagaagcacuu

SEQ ID NO: 2123855 - RNA, 16 nt, Homo sapiens
gaucccuaacuguucc

SEQ ID NO: 2123856 - RNA, 15 nt, Homo sapiens
guuucaaauguguca

SEQ ID NO: 2123857 - RNA, 16 nt, Homo sapiens
uuucuggugcuuuaua

SEQ ID NO: 2123858 - RNA, 23 nt, Homo sapiens
auauucauuggcagcucaaagac

SEQ ID NO: 2123859 - RNA, 13 nt, Homo sapiens
ucuccuacugagg

SEQ ID NO: 2123860 - RNA, 21 nt, Homo sapiens
cuuaggugcuucuucacuuca

SEQ ID NO: 2123861 - RNA, 21 nt, Homo sapiens
aaaauuauuugaaaacauaua

SEQ ID NO: 2123862 - RNA, 22 nt, Homo sapiens
cuucuaaucugcuaugcuugaa

SEQ ID NO: 2123863 - RNA, 18 nt, Homo sapiens
acauaaggagugccugaa

SEQ ID NO: 2123864 - RNA, 18 nt, Homo sapiens
uugggcaggucugagaua

SEQ ID NO: 2123865 - RNA, 16 nt, Homo sapiens
acccuucuacaaaaga

SEQ ID NO: 2123866 - RNA, 11 nt, Homo sapiens
gcuccugaugg

SEQ ID NO: 2123867 - RNA, 22 nt, Homo sapiens
auugggcuggcucugaagccaa

SEQ ID NO: 2123868 - RNA, 21 nt, Homo sapiens
aaaaagaugaccuuugucuca

SEQ ID NO: 2123869 - RNA, 13 nt, Homo sapiens
acccuuucuccac

SEQ ID NO: 2123870 - RNA, 18 nt, Homo sapiens
ucuuaaaauuagugagau

SEQ ID NO: 2123871 - RNA, 15 nt, Homo sapiens
uggggaaaacuugca

SEQ ID NO: 2123872 - RNA, 15 nt, Homo sapiens
aaugcucaaaaccuc

SEQ ID NO: 2123873 - RNA, 21 nt, Homo sapiens
accuuguacagaaccagcacu

SEQ ID NO: 2123874 - RNA, 19 nt, Homo sapiens
ccuggaugucugggugacc

SEQ ID NO: 2123875 - RNA, 22 nt, Homo sapiens
caggugggaggugucagagccc

SEQ ID NO: 2123876 - RNA, 23 nt, Homo sapiens
cacacaagcagucuuuuucuaca

SEQ ID NO: 2123877 - RNA, 18 nt, Homo sapiens
guuugaagauuauaugaa

SEQ ID NO: 2123878 - RNA, 15 nt, Homo sapiens
auguaccagcaucuc

SEQ ID NO: 2123879 - RNA, 15 nt, Homo sapiens
ccugcuccaacucca

SEQ ID NO: 2123880 - RNA, 14 nt, Homo sapiens
cuuuaggggaccau

SEQ ID NO: 2123881 - RNA, 12 nt, Homo sapiens
cuugcaagccau

SEQ ID NO: 2123882 - RNA, 18 nt, Homo sapiens
caugguugaaaccccauc

SEQ ID NO: 2123883 - RNA, 21 nt, Homo sapiens
guuuucaauuuuaaacauauc

SEQ ID NO: 2123884 - RNA, 19 nt, Homo sapiens
cauugcucugaauauguca

SEQ ID NO: 2123885 - RNA, 14 nt, Homo sapiens
augcuccaguaugg

SEQ ID NO: 2123886 - RNA, 13 nt, Homo sapiens
cagccucuuccau

SEQ ID NO: 2123887 - RNA, 12 nt, Homo sapiens
cauaugcauauu

SEQ ID NO: 2123888 - RNA, 19 nt, Homo sapiens
caaugggcucaaacuucua

SEQ ID NO: 2123889 - RNA, 12 nt, Homo sapiens
cuguagcuugag

SEQ ID NO: 2123890 - RNA, 20 nt, Homo sapiens
ugccuagaguguagccuaaa

SEQ ID NO: 2123891 - RNA, 19 nt, Homo sapiens
gcccaggccucgggaccaa

SEQ ID NO: 2123892 - RNA, 18 nt, Homo sapiens
cuguguuuauaugucuug

SEQ ID NO: 2123893 - RNA, 13 nt, Homo sapiens
agacccuguucua

SEQ ID NO: 2123894 - RNA, 16 nt, Homo sapiens
cuggguuuucaggggc

SEQ ID NO: 2123895 - RNA, 21 nt, Homo sapiens
acugcacguuuucaucucuag

SEQ ID NO: 2123896 - RNA, 15 nt, Homo sapiens
auccaggaagacccc

SEQ ID NO: 2123897 - RNA, 22 nt, Homo sapiens
uagcacauauuucacauguuua

SEQ ID NO: 2123898 - RNA, 14 nt, Homo sapiens
uaucuaaucagauc

SEQ ID NO: 2123899 - RNA, 17 nt, Homo sapiens
gcugcccuuucugcucc

SEQ ID NO: 2123900 - RNA, 20 nt, Homo sapiens
guguaauggaaaccaaggaa

SEQ ID NO: 2123901 - RNA, 20 nt, Homo sapiens
uuuucugccuuuagcuuuga

SEQ ID NO: 2123902 - RNA, 20 nt, Homo sapiens
aauuuuccagggcucaaaaa

SEQ ID NO: 2123903 - RNA, 23 nt, Homo sapiens
gggaggcccgcggcgguggagcc

SEQ ID NO: 2123904 - RNA, 21 nt, Homo sapiens
aaacucugugucagcaucuuu

SEQ ID NO: 2123905 - RNA, 16 nt, Homo sapiens
uccgccgcugcacauc

SEQ ID NO: 2123906 - RNA, 20 nt, Homo sapiens
ugauugggaaaacauuugcu

SEQ ID NO: 2123907 - RNA, 17 nt, Homo sapiens
acgugcacacaccugca

SEQ ID NO: 2123908 - RNA, 18 nt, Homo sapiens
ucucaauaaaccagugaa

SEQ ID NO: 2123909 - RNA, 22 nt, Homo sapiens
agacacacaugaaguccaagca

SEQ ID NO: 2123910 - RNA, 15 nt, Homo sapiens
gaggcaggcauuccu

SEQ ID NO: 2123911 - RNA, 16 nt, Homo sapiens
aggcccaggaguccag

SEQ ID NO: 2123912 - RNA, 19 nt, Homo sapiens
aucagacacaauuagagaa

SEQ ID NO: 2123913 - RNA, 14 nt, Homo sapiens
agggggugucugca

SEQ ID NO: 2123914 - RNA, 18 nt, Homo sapiens
cucauuaauucaaugaaa

SEQ ID NO: 2123915 - RNA, 15 nt, Homo sapiens
auguaucucacaagu

SEQ ID NO: 2123916 - RNA, 17 nt, Homo sapiens
ccucagagcucuuaugu

SEQ ID NO: 2123917 - RNA, 14 nt, Homo sapiens
uacauauguaaaau

SEQ ID NO: 2123918 - RNA, 23 nt, Homo sapiens
agaggcgcugaguggaaccacga

SEQ ID NO: 2123919 - RNA, 23 nt, Homo sapiens
gagaagguauuagcaaagcaaaa

SEQ ID NO: 2123920 - RNA, 19 nt, Homo sapiens
gcacaaaguguauucacgu

SEQ ID NO: 2123921 - RNA, 22 nt, Homo sapiens
uucucagaccugcgcacuccau

SEQ ID NO: 2123922 - RNA, 16 nt, Homo sapiens
ccauuuucauucuguu

SEQ ID NO: 2123923 - RNA, 13 nt, Homo sapiens
gauuuuuacacau

SEQ ID NO: 2123924 - RNA, 16 nt, Homo sapiens
cugcccuuaccugcca

SEQ ID NO: 2123925 - RNA, 16 nt, Homo sapiens
gccccacauugcacuu

SEQ ID NO: 2123926 - RNA, 23 nt, Homo sapiens
ggccuaacccucagaaacacugg

SEQ ID NO: 2123927 - RNA, 14 nt, Homo sapiens
aagcugauuucccu

SEQ ID NO: 2123928 - RNA, 14 nt, Homo sapiens
aguuuuucucucaa

SEQ ID NO: 2123929 - RNA, 22 nt, Homo sapiens
auuuuuuauuucuaaguauuua

SEQ ID NO: 2123930 - RNA, 17 nt, Homo sapiens
gcagcuguuucucauga

SEQ ID NO: 2123931 - RNA, 23 nt, Homo sapiens
agccaugguguguguucagcucu

SEQ ID NO: 2123932 - RNA, 18 nt, Homo sapiens
cccacaacuugucaccca

SEQ ID NO: 2123933 - RNA, 20 nt, Homo sapiens
ucaacauccauaacucugua

SEQ ID NO: 2123934 - RNA, 14 nt, Homo sapiens
aucuguccaaaagg

SEQ ID NO: 2123935 - RNA, 17 nt, Homo sapiens
agcaaaacgcauggagu

SEQ ID NO: 2123936 - RNA, 20 nt, Homo sapiens
aauagcuagacuggugacug

SEQ ID NO: 2123937 - RNA, 14 nt, Homo sapiens
auggcaaacugcca

SEQ ID NO: 2123938 - RNA, 13 nt, Homo sapiens
uugaucacuacaa

SEQ ID NO: 2123939 - RNA, 20 nt, Homo sapiens
uggcucugcaugacaaacac

SEQ ID NO: 2123940 - RNA, 13 nt, Homo sapiens
aaagcaaaagaga

SEQ ID NO: 2123941 - RNA, 19 nt, Homo sapiens
uuggacuggagguacaaau

SEQ ID NO: 2123942 - RNA, 16 nt, Homo sapiens
ggaauauuaaagggau

SEQ ID NO: 2123943 - RNA, 18 nt, Homo sapiens
auauaaaguacaucucua

SEQ ID NO: 2123944 - RNA, 15 nt, Homo sapiens
cgcacuggagcugca

SEQ ID NO: 2123945 - RNA, 18 nt, Homo sapiens
caggaggcggcagugcaa

SEQ ID NO: 2123946 - RNA, 17 nt, Homo sapiens
cuuugagcgagcccauu

SEQ ID NO: 2123947 - RNA, 19 nt, Homo sapiens
uuugcuuuuccuucagggu

SEQ ID NO: 2123948 - RNA, 19 nt, Homo sapiens
auagauguugcucuuucac

SEQ ID NO: 2123949 - RNA, 23 nt, Homo sapiens
guguuuucauucccccuuccuag

SEQ ID NO: 2123950 - RNA, 16 nt, Homo sapiens
acccauuaaauuaaga

SEQ ID NO: 2123951 - RNA, 17 nt, Homo sapiens
agcaucuuagugccuuu

SEQ ID NO: 2123952 - RNA, 15 nt, Homo sapiens
ugcagauaacagcug

SEQ ID NO: 2123953 - RNA, 19 nt, Homo sapiens
caccuuuuuucaacaguga

SEQ ID NO: 2123954 - RNA, 21 nt, Homo sapiens
uaagaggauugcuugagccca

SEQ ID NO: 2123955 - RNA, 16 nt, Homo sapiens
agaacuagcauaacac

SEQ ID NO: 2123956 - RNA, 14 nt, Homo sapiens
ugaggugcuaugaa

SEQ ID NO: 2123957 - RNA, 23 nt, Homo sapiens
ugcucuugaacuccugaccucag

SEQ ID NO: 2123958 - RNA, 18 nt, Homo sapiens
ugcuuaaugguagcaacu

SEQ ID NO: 2123959 - RNA, 16 nt, Homo sapiens
uguggauuaaugucaa

SEQ ID NO: 2123960 - RNA, 11 nt, Homo sapiens
aaucuagacau

SEQ ID NO: 2123961 - RNA, 14 nt, Homo sapiens
gccacguggccgcu

SEQ ID NO: 2123962 - RNA, 14 nt, Homo sapiens
caaaagugcaagau

SEQ ID NO: 2123963 - RNA, 14 nt, Homo sapiens
caggugugcagauu

SEQ ID NO: 2123964 - RNA, 20 nt, Homo sapiens
ucaaacaaauagucuaucaa

SEQ ID NO: 2123965 - RNA, 13 nt, Homo sapiens
gcacucacgcccu

SEQ ID NO: 2123966 - RNA, 15 nt, Homo sapiens
cagccaaaggggagc

SEQ ID NO: 2123967 - RNA, 17 nt, Homo sapiens
caaauauauuauuuagu

SEQ ID NO: 2123968 - RNA, 14 nt, Homo sapiens
uaacucaucugcug

SEQ ID NO: 2123969 - RNA, 16 nt, Homo sapiens
caugauggugcaugcc

SEQ ID NO: 2123970 - RNA, 15 nt, Homo sapiens
cugggaauggggaca

SEQ ID NO: 2123971 - RNA, 13 nt, Homo sapiens
caguagcuuccca

SEQ ID NO: 2123972 - RNA, 13 nt, Homo sapiens
accaauagcuuua

SEQ ID NO: 2123973 - RNA, 14 nt, Homo sapiens
ggaauaaccuucca

SEQ ID NO: 2123974 - RNA, 15 nt, Homo sapiens
ugggaugaaauacuu

SEQ ID NO: 2123975 - RNA, 15 nt, Homo sapiens
gcucugcuaugagug

SEQ ID NO: 2123976 - RNA, 22 nt, Homo sapiens
aagaguccauuccccagguggg

SEQ ID NO: 2123977 - RNA, 14 nt, Homo sapiens
guacuaaaaauaca

SEQ ID NO: 2123978 - RNA, 21 nt, Homo sapiens
aaagauuauagaaguagcaaa

SEQ ID NO: 2123979 - RNA, 18 nt, Homo sapiens
caagaaagauaucuauga

SEQ ID NO: 2123980 - RNA, 20 nt, Homo sapiens
caaagccacauuauuucuag

SEQ ID NO: 2123981 - RNA, 17 nt, Homo sapiens
aucuuucaccuuucuag

SEQ ID NO: 2123982 - RNA, 16 nt, Homo sapiens
ccacuucccacuugca

SEQ ID NO: 2123983 - RNA, 21 nt, Homo sapiens
acucccccaccgcccacucuc

SEQ ID NO: 2123984 - RNA, 17 nt, Homo sapiens
uagaguuaacaaugaua

SEQ ID NO: 2123985 - RNA, 16 nt, Homo sapiens
accuagcuacacugag

SEQ ID NO: 2123986 - RNA, 15 nt, Homo sapiens
aaggagagcuuugca

SEQ ID NO: 2123987 - RNA, 14 nt, Homo sapiens
uaugugagcacuau

SEQ ID NO: 2123988 - RNA, 20 nt, Homo sapiens
ugagaacaccagagaccuca

SEQ ID NO: 2123989 - RNA, 23 nt, Homo sapiens
ggauuaaagugcccagcacaaag

SEQ ID NO: 2123990 - RNA, 22 nt, Homo sapiens
ccagaggucacacagccugugu

SEQ ID NO: 2123991 - RNA, 14 nt, Homo sapiens
gccugaacauggca

SEQ ID NO: 2123992 - RNA, 11 nt, Homo sapiens
ugcacagaauu

SEQ ID NO: 2123993 - RNA, 23 nt, Homo sapiens
ucacuuaauccauuuagcacuau

SEQ ID NO: 2123994 - RNA, 12 nt, Homo sapiens
acuaacacuggg

SEQ ID NO: 2123995 - RNA, 14 nt, Homo sapiens
ucuuggaguuacaa

SEQ ID NO: 2123996 - RNA, 18 nt, Homo sapiens
gucaaauaaacacugugu

SEQ ID NO: 2123997 - RNA, 22 nt, Homo sapiens
agggucacuaaccaagccagaa

SEQ ID NO: 2123998 - RNA, 22 nt, Homo sapiens
caccaggaggcggcagugcaac

SEQ ID NO: 2123999 - RNA, 20 nt, Homo sapiens
aauuuggccuuaagaacugu

SEQ ID NO: 2124000 - RNA, 21 nt, Homo sapiens
aggaacccuuaaacaguugca

SEQ ID NO: 2124001 - RNA, 15 nt, Homo sapiens
cugcuagcacagagg

SEQ ID NO: 2124002 - RNA, 19 nt, Homo sapiens
cugagugggagaaggcagu

SEQ ID NO: 2124003 - RNA, 14 nt, Homo sapiens
caaaaggaccccaa

SEQ ID NO: 2124004 - RNA, 16 nt, Homo sapiens
aaaaggaugucuuuca

SEQ ID NO: 2124005 - RNA, 20 nt, Homo sapiens
ucccuccuucccuucucucc

SEQ ID NO: 2124006 - RNA, 20 nt, Homo sapiens
cuucuuggggcccagugcau

SEQ ID NO: 2124007 - RNA, 18 nt, Homo sapiens
cuacucuuaaaugagaaa

SEQ ID NO: 2124008 - RNA, 21 nt, Homo sapiens
uguugcguucaaagaggugaa

SEQ ID NO: 2124009 - RNA, 14 nt, Homo sapiens
ucucuuucugcaaa

SEQ ID NO: 2124010 - RNA, 22 nt, Homo sapiens
ccacagucccauuccuccacuc

SEQ ID NO: 2124011 - RNA, 16 nt, Homo sapiens
agcuugugaauguuua

SEQ ID NO: 2124012 - RNA, 23 nt, Homo sapiens
cuaaugaagguuuucauuugcca

SEQ ID NO: 2124013 - RNA, 19 nt, Homo sapiens
ugaugcaugggccucaguc

SEQ ID NO: 2124014 - RNA, 14 nt, Homo sapiens
ccagccauggugag

SEQ ID NO: 2124015 - RNA, 17 nt, Homo sapiens
cuucucccacucuccua

SEQ ID NO: 2124016 - RNA, 20 nt, Homo sapiens
guugacaccaagaaaccacu

SEQ ID NO: 2124017 - RNA, 13 nt, Homo sapiens
cguguugucauug

SEQ ID NO: 2124018 - RNA, 20 nt, Homo sapiens
gacccaucacgccugugcag

SEQ ID NO: 2124019 - RNA, 14 nt, Homo sapiens
uaaucauaggcaga

SEQ ID NO: 2124020 - RNA, 21 nt, Homo sapiens
ccuggaugugcccacagggac

SEQ ID NO: 2124021 - RNA, 18 nt, Homo sapiens
cuguguucuuguuuucag

SEQ ID NO: 2124022 - RNA, 18 nt, Homo sapiens
cauuuuacuguuguacaa

SEQ ID NO: 2124023 - RNA, 13 nt, Homo sapiens
ccacgugugcaga

SEQ ID NO: 2124024 - RNA, 12 nt, Homo sapiens
agaccaucucuc

SEQ ID NO: 2124025 - RNA, 16 nt, Homo sapiens
aucugugucucuggaa

SEQ ID NO: 2124026 - RNA, 13 nt, Homo sapiens
uacuuacacccaa

SEQ ID NO: 2124027 - RNA, 16 nt, Homo sapiens
ccccagaccucaggga

SEQ ID NO: 2124028 - RNA, 16 nt, Homo sapiens
auucucagguugucag

SEQ ID NO: 2124029 - RNA, 23 nt, Homo sapiens
ggucccuucccgacccagccagc

SEQ ID NO: 2124030 - RNA, 16 nt, Homo sapiens
gguaaaugauguggug

SEQ ID NO: 2124031 - RNA, 23 nt, Homo sapiens
acuagaagaaaagcccauuuuca

SEQ ID NO: 2124032 - RNA, 18 nt, Homo sapiens
agagccagugaaggagcc

SEQ ID NO: 2124033 - RNA, 14 nt, Homo sapiens
uuaauguacaguaa

SEQ ID NO: 2124034 - RNA, 13 nt, Homo sapiens
aacacgacaugcu

SEQ ID NO: 2124035 - RNA, 20 nt, Homo sapiens
cagaguccugguuuccucag

SEQ ID NO: 2124036 - RNA, 17 nt, Homo sapiens
cugauaccuuuacacua

SEQ ID NO: 2124037 - RNA, 17 nt, Homo sapiens
aacauaaugcacuuuag

SEQ ID NO: 2124038 - RNA, 13 nt, Homo sapiens
agcccgaggucau

SEQ ID NO: 2124039 - RNA, 16 nt, Homo sapiens
accaguauuguacaaa

SEQ ID NO: 2124040 - RNA, 20 nt, Homo sapiens
uggauacuauuaaaguaaca

SEQ ID NO: 2124041 - RNA, 20 nt, Homo sapiens
aauccaaguuauuaaucuua

SEQ ID NO: 2124042 - RNA, 19 nt, Homo sapiens
cagccuuggauacuccaug

SEQ ID NO: 2124043 - RNA, 23 nt, Homo sapiens
aucuuaauucccaucucuauacu

SEQ ID NO: 2124044 - RNA, 13 nt, Homo sapiens
caacaucuacaaa

SEQ ID NO: 2124045 - RNA, 14 nt, Homo sapiens
uggccgagcugaag

SEQ ID NO: 2124046 - RNA, 20 nt, Homo sapiens
auuaucaaagcauugcugag

SEQ ID NO: 2124047 - RNA, 15 nt, Homo sapiens
cuaagcaaaaccacu

SEQ ID NO: 2124048 - RNA, 21 nt, Homo sapiens
guucacuacuacacccagcua

SEQ ID NO: 2124049 - RNA, 22 nt, Homo sapiens
accuaaauccuucuuauguuuc

SEQ ID NO: 2124050 - RNA, 20 nt, Homo sapiens
uuuaaacugaguagcagaaa

SEQ ID NO: 2124051 - RNA, 12 nt, Homo sapiens
cuuaaaagccau

SEQ ID NO: 2124052 - RNA, 14 nt, Homo sapiens
aaucaucucaaauc

SEQ ID NO: 2124053 - RNA, 18 nt, Homo sapiens
cagacggcggccaggcac

SEQ ID NO: 2124054 - RNA, 17 nt, Homo sapiens
agcccugcucccugccu

SEQ ID NO: 2124055 - RNA, 15 nt, Homo sapiens
cucucugugcacuga

SEQ ID NO: 2124056 - RNA, 13 nt, Homo sapiens
agaaaauuugcaa

SEQ ID NO: 2124057 - RNA, 20 nt, Homo sapiens
cagccgaggucccugcugcc

SEQ ID NO: 2124058 - RNA, 19 nt, Homo sapiens
auuuaggcaagagaaaaua

SEQ ID NO: 2124059 - RNA, 15 nt, Homo sapiens
gcaagaacagugggc

SEQ ID NO: 2124060 - RNA, 20 nt, Homo sapiens
uggccuuaaggaaaucuuua

SEQ ID NO: 2124061 - RNA, 15 nt, Homo sapiens
cugggcucacugcag

SEQ ID NO: 2124062 - RNA, 16 nt, Homo sapiens
ugcaguuggacucuca

SEQ ID NO: 2124063 - RNA, 17 nt, Homo sapiens
agacaaaauugaugauc

SEQ ID NO: 2124064 - RNA, 19 nt, Homo sapiens
ccuugauggaaauugacca

SEQ ID NO: 2124065 - RNA, 19 nt, Homo sapiens
auccauaguggacauuguu

SEQ ID NO: 2124066 - RNA, 19 nt, Homo sapiens
cuuuagggcuuauggccag

SEQ ID NO: 2124067 - RNA, 19 nt, Homo sapiens
aagcaacuguuaugaaaua

SEQ ID NO: 2124068 - RNA, 18 nt, Homo sapiens
cacugaaaauaccaucag

SEQ ID NO: 2124069 - RNA, 14 nt, Homo sapiens
aaacccccaucucu

SEQ ID NO: 2124070 - RNA, 14 nt, Homo sapiens
auccacccaaauau

SEQ ID NO: 2124071 - RNA, 17 nt, Homo sapiens
agcuauagcuaaugugc

SEQ ID NO: 2124072 - RNA, 13 nt, Homo sapiens
auuuuuacaaugu

SEQ ID NO: 2124073 - RNA, 13 nt, Homo sapiens
uuagauacuaaua

SEQ ID NO: 2124074 - RNA, 18 nt, Homo sapiens
guaacuauagacuggaaa

SEQ ID NO: 2124075 - RNA, 14 nt, Homo sapiens
uaguuagaaagggu

SEQ ID NO: 2124076 - RNA, 14 nt, Homo sapiens
agcuuccugaguca

SEQ ID NO: 2124077 - RNA, 20 nt, Homo sapiens
ugauccagcccugguucugg

SEQ ID NO: 2124078 - RNA, 23 nt, Homo sapiens
aauugcuuuugaaaaacaacugc

SEQ ID NO: 2124079 - RNA, 15 nt, Homo sapiens
cgagccuggcuccaa

SEQ ID NO: 2124080 - RNA, 22 nt, Homo sapiens
uagcucccuccucccaucuccu

SEQ ID NO: 2124081 - RNA, 21 nt, Homo sapiens
gccuguauucccagcuacuca

SEQ ID NO: 2124082 - RNA, 13 nt, Homo sapiens
gacagauuuccau

SEQ ID NO: 2124083 - RNA, 16 nt, Homo sapiens
gugacccgaccuggcc

SEQ ID NO: 2124084 - RNA, 14 nt, Homo sapiens
uuucucaaaugcac

SEQ ID NO: 2124085 - RNA, 17 nt, Homo sapiens
caaguagaacaaaaacu

SEQ ID NO: 2124086 - RNA, 18 nt, Homo sapiens
cccuccaggcccaucuca

SEQ ID NO: 2124087 - RNA, 23 nt, Homo sapiens
cacccuccagaauccugauggua

SEQ ID NO: 2124088 - RNA, 20 nt, Homo sapiens
ggcugugagaggaucaucug

SEQ ID NO: 2124089 - RNA, 23 nt, Homo sapiens
cuaaauguauuuuagacuuccug

SEQ ID NO: 2124090 - RNA, 15 nt, Homo sapiens
gaaauuagauuugug

SEQ ID NO: 2124091 - RNA, 16 nt, Homo sapiens
ccagucucucaaguga

SEQ ID NO: 2124092 - RNA, 18 nt, Homo sapiens
cuuucagcgaaugacaaa

SEQ ID NO: 2124093 - RNA, 18 nt, Homo sapiens
aagguguuguaaugguga

SEQ ID NO: 2124094 - RNA, 21 nt, Homo sapiens
uaaauguugcacaucauucau

SEQ ID NO: 2124095 - RNA, 18 nt, Homo sapiens
gucucgcuauacugcacu

SEQ ID NO: 2124096 - RNA, 19 nt, Homo sapiens
uaaaaagguccucacaggu

SEQ ID NO: 2124097 - RNA, 14 nt, Homo sapiens
cagauaacucuccu

SEQ ID NO: 2124098 - RNA, 14 nt, Homo sapiens
aacuauuacagugu

SEQ ID NO: 2124099 - RNA, 18 nt, Homo sapiens
cuaggaaaagaccaucug

SEQ ID NO: 2124100 - RNA, 22 nt, Homo sapiens
uuuuauauguuuauauucuuuc

SEQ ID NO: 2124101 - RNA, 15 nt, Homo sapiens
gcuggaagcaaagua

SEQ ID NO: 2124102 - RNA, 20 nt, Homo sapiens
acuggacuugagcuuggcag

SEQ ID NO: 2124103 - RNA, 16 nt, Homo sapiens
gcugaagcuggugcgc

SEQ ID NO: 2124104 - RNA, 17 nt, Homo sapiens
caagugauggucauuca

SEQ ID NO: 2124105 - RNA, 18 nt, Homo sapiens
cagcaaaauuuaugcaaa

SEQ ID NO: 2124106 - RNA, 14 nt, Homo sapiens
accacugcugagga

SEQ ID NO: 2124107 - RNA, 14 nt, Homo sapiens
cuauucacaaaaua

SEQ ID NO: 2124108 - RNA, 18 nt, Homo sapiens
aagcuauguaucgcuccu

SEQ ID NO: 2124109 - RNA, 22 nt, Homo sapiens
uuugccugagaaggggcagaug

SEQ ID NO: 2124110 - RNA, 22 nt, Homo sapiens
guauucacacaccccucaaaaa

SEQ ID NO: 2124111 - RNA, 17 nt, Homo sapiens
cuuccucacuaugacac

SEQ ID NO: 2124112 - RNA, 15 nt, Homo sapiens
cguggagaugucuuc

SEQ ID NO: 2124113 - RNA, 18 nt, Homo sapiens
uaaaucuuuuugcugcug

SEQ ID NO: 2124114 - RNA, 22 nt, Homo sapiens
accaaaugaguccaaacuggaa

SEQ ID NO: 2124115 - RNA, 16 nt, Homo sapiens
gauuucauugaagcuc

SEQ ID NO: 2124116 - RNA, 15 nt, Homo sapiens
auugggccaguuccu

SEQ ID NO: 2124117 - RNA, 16 nt, Homo sapiens
acaugcaaggcacuga

SEQ ID NO: 2124118 - RNA, 20 nt, Homo sapiens
agaaucugugaccucugaca

SEQ ID NO: 2124119 - RNA, 17 nt, Homo sapiens
caaucccucuccacucu

SEQ ID NO: 2124120 - RNA, 16 nt, Homo sapiens
ucggcuugaucacagc

SEQ ID NO: 2124121 - RNA, 18 nt, Homo sapiens
aauucugauugauuugau

SEQ ID NO: 2124122 - RNA, 23 nt, Homo sapiens
gcuccuggagcuauucacagugc

SEQ ID NO: 2124123 - RNA, 15 nt, Homo sapiens
gaaaaguuagucaau

SEQ ID NO: 2124124 - RNA, 17 nt, Homo sapiens
ccacaggaccccaagaa

SEQ ID NO: 2124125 - RNA, 17 nt, Homo sapiens
uuaaaguuuucaaauua

SEQ ID NO: 2124126 - RNA, 12 nt, Homo sapiens
aaacugccauua

SEQ ID NO: 2124127 - RNA, 15 nt, Homo sapiens
aaccaagaucuauaa

SEQ ID NO: 2124128 - RNA, 17 nt, Homo sapiens
uuuaaccaaucagauga

SEQ ID NO: 2124129 - RNA, 23 nt, Homo sapiens
aguggcggggggguuuugccuaa

SEQ ID NO: 2124130 - RNA, 23 nt, Homo sapiens
guacugaguucucauccacagag

SEQ ID NO: 2124131 - RNA, 18 nt, Homo sapiens
uucaaacuaauagaauua

SEQ ID NO: 2124132 - RNA, 15 nt, Homo sapiens
cagaaguguucacau

SEQ ID NO: 2124133 - RNA, 21 nt, Homo sapiens
uauguccacuguucuguucuc

SEQ ID NO: 2124134 - RNA, 18 nt, Homo sapiens
uccaagcgcgcuguugau

SEQ ID NO: 2124135 - RNA, 15 nt, Homo sapiens
cuguuaauauucuau

SEQ ID NO: 2124136 - RNA, 17 nt, Homo sapiens
acucagcugcucugcaa

SEQ ID NO: 2124137 - RNA, 18 nt, Homo sapiens
ggaaacagggcagugaca

SEQ ID NO: 2124138 - RNA, 22 nt, Homo sapiens
uggagaacccaggggacagcug

SEQ ID NO: 2124139 - RNA, 16 nt, Homo sapiens
caaacauuauucucaa

SEQ ID NO: 2124140 - RNA, 20 nt, Homo sapiens
acauaggccugcucagccuc

SEQ ID NO: 2124141 - RNA, 14 nt, Homo sapiens
uaauaugugccuua

SEQ ID NO: 2124142 - RNA, 18 nt, Homo sapiens
aaauuuguuugucacugc

SEQ ID NO: 2124143 - RNA, 19 nt, Homo sapiens
cuuguaacaguuuugugua

SEQ ID NO: 2124144 - RNA, 13 nt, Homo sapiens
guccuuccugugc

SEQ ID NO: 2124145 - RNA, 19 nt, Homo sapiens
uuccucaucccuccaucuc

SEQ ID NO: 2124146 - RNA, 20 nt, Homo sapiens
auuagacaaaguucauucaa

SEQ ID NO: 2124147 - RNA, 9 nt, Homo sapiens
acacugucc

SEQ ID NO: 2124148 - RNA, 23 nt, Homo sapiens
accauccuggcuaacacagugaa

SEQ ID NO: 2124149 - RNA, 23 nt, Homo sapiens
guaaauauuuuguuaucugaacu

SEQ ID NO: 2124150 - RNA, 13 nt, Homo sapiens
aaugaagugcaaa

SEQ ID NO: 2124151 - RNA, 24 nt, Homo sapiens
cauguuugagaacccccuaaccuc

SEQ ID NO: 2124152 - RNA, 21 nt, Homo sapiens
gcaaaggcgggaggaucacuu

SEQ ID NO: 2124153 - RNA, 21 nt, Homo sapiens
caaauaauuugaacuuuggaa

SEQ ID NO: 2124154 - RNA, 16 nt, Homo sapiens
agcccuuccuagaaga

SEQ ID NO: 2124155 - RNA, 16 nt, Homo sapiens
ucucaugugugcucac

SEQ ID NO: 2124156 - RNA, 20 nt, Homo sapiens
gagaccuguaucaaacugcu

SEQ ID NO: 2124157 - RNA, 14 nt, Homo sapiens
caacaaauacuucc

SEQ ID NO: 2124158 - RNA, 14 nt, Homo sapiens
ucaugaaauaugca

SEQ ID NO: 2124159 - RNA, 23 nt, Homo sapiens
ucaaaaaccauauuugcauucca

SEQ ID NO: 2124160 - RNA, 20 nt, Homo sapiens
auuaacagcagaaucucaga

SEQ ID NO: 2124161 - RNA, 18 nt, Homo sapiens
aacuugaaugugucaggu

SEQ ID NO: 2124162 - RNA, 20 nt, Homo sapiens
uuuaaguggcuuucagcaaa

SEQ ID NO: 2124163 - RNA, 18 nt, Homo sapiens
acaaaugggaaaaccaga

SEQ ID NO: 2124164 - RNA, 16 nt, Homo sapiens
acauggaacgcuuuca

SEQ ID NO: 2124165 - RNA, 23 nt, Homo sapiens
caaaaccuugcuaauuuucucaa

SEQ ID NO: 2124166 - RNA, 20 nt, Homo sapiens
aauucauucuggucucucua

SEQ ID NO: 2124167 - RNA, 18 nt, Homo sapiens
ccuugcccugaccuccca

SEQ ID NO: 2124168 - RNA, 16 nt, Homo sapiens
cauauugaggcauuca

SEQ ID NO: 2124169 - RNA, 13 nt, Homo sapiens
ugagcacuucuaa

SEQ ID NO: 2124170 - RNA, 15 nt, Homo sapiens
aaagucaacuuccac

SEQ ID NO: 2124171 - RNA, 12 nt, Homo sapiens
cacaaaaugcaa

SEQ ID NO: 2124172 - RNA, 18 nt, Homo sapiens
uuaacucuuuuggacaaa

SEQ ID NO: 2124173 - RNA, 14 nt, Homo sapiens
gaaccagcaucuca

SEQ ID NO: 2124174 - RNA, 20 nt, Homo sapiens
acaaggaccaggauugcacu

SEQ ID NO: 2124175 - RNA, 15 nt, Homo sapiens
ugucccuucccagcg

SEQ ID NO: 2124176 - RNA, 19 nt, Homo sapiens
caacccuuccuaaguuuaa

SEQ ID NO: 2124177 - RNA, 15 nt, Homo sapiens
guuaagaaagcacuu

SEQ ID NO: 2124178 - RNA, 17 nt, Homo sapiens
uacaguuagcagggaug

SEQ ID NO: 2124179 - RNA, 21 nt, Homo sapiens
aggaagacauuugguuuucau

SEQ ID NO: 2124180 - RNA, 12 nt, Homo sapiens
cauuaagugaaa

SEQ ID NO: 2124181 - RNA, 12 nt, Homo sapiens
cauaaagugaau

SEQ ID NO: 2124182 - RNA, 17 nt, Homo sapiens
caaauggccaguuuucu

SEQ ID NO: 2124183 - RNA, 14 nt, Homo sapiens
aagaccgauugcau

SEQ ID NO: 2124184 - RNA, 17 nt, Homo sapiens
accaaaucugacauauu

SEQ ID NO: 2124185 - RNA, 19 nt, Homo sapiens
auuucuuuugugcagauca

SEQ ID NO: 2124186 - RNA, 15 nt, Homo sapiens
uguaacauacucauu

SEQ ID NO: 2124187 - RNA, 16 nt, Homo sapiens
uguuggcucacagggc

SEQ ID NO: 2124188 - RNA, 18 nt, Homo sapiens
caagacacugaggagaua

SEQ ID NO: 2124189 - RNA, 14 nt, Homo sapiens
augcccuugccuau

SEQ ID NO: 2124190 - RNA, 22 nt, Homo sapiens
guuaccucugaguuguguucca

SEQ ID NO: 2124191 - RNA, 21 nt, Homo sapiens
cuccacugucuuuaaaaguca

SEQ ID NO: 2124192 - RNA, 21 nt, Homo sapiens
uaacgugucugagagccauaa

SEQ ID NO: 2124193 - RNA, 19 nt, Homo sapiens
aaaauauuuuuaaauggac

SEQ ID NO: 2124194 - RNA, 20 nt, Homo sapiens
aauuuuaauguuuacaacaa

SEQ ID NO: 2124195 - RNA, 18 nt, Homo sapiens
agcacaauuugcacuaaa

SEQ ID NO: 2124196 - RNA, 23 nt, Homo sapiens
uccuagcccaucugcagagcaau

SEQ ID NO: 2124197 - RNA, 17 nt, Homo sapiens
aucucagcucacugcaa

SEQ ID NO: 2124198 - RNA, 20 nt, Homo sapiens
ugcagagccacccuguguug

SEQ ID NO: 2124199 - RNA, 14 nt, Homo sapiens
cauugcagcagaua

SEQ ID NO: 2124200 - RNA, 21 nt, Homo sapiens
uaguugggggcuguccagagc

SEQ ID NO: 2124201 - RNA, 22 nt, Homo sapiens
cacauacgggcuuuaauaguca

SEQ ID NO: 2124202 - RNA, 19 nt, Homo sapiens
ugcagucgggaccucccag

SEQ ID NO: 2124203 - RNA, 18 nt, Homo sapiens
gaacucuccuuuugugcu

SEQ ID NO: 2124204 - RNA, 14 nt, Homo sapiens
aggaugaauguaug

SEQ ID NO: 2124205 - RNA, 14 nt, Homo sapiens
aaccaacaaaaaga

SEQ ID NO: 2124206 - RNA, 20 nt, Homo sapiens
cauacuucuguuuccaucug

SEQ ID NO: 2124207 - RNA, 16 nt, Homo sapiens
cuuucauucccuuuca

SEQ ID NO: 2124208 - RNA, 14 nt, Homo sapiens
uuccauuaucuuau

SEQ ID NO: 2124209 - RNA, 15 nt, Homo sapiens
ucuagagucauguga

SEQ ID NO: 2124210 - RNA, 16 nt, Homo sapiens
uucauguucacuguga

SEQ ID NO: 2124211 - RNA, 13 nt, Homo sapiens
cucccucucucuu

SEQ ID NO: 2124212 - RNA, 16 nt, Homo sapiens
ccucccaccucuguga

SEQ ID NO: 2124213 - RNA, 16 nt, Homo sapiens
gcacagguccugauga

SEQ ID NO: 2124214 - RNA, 20 nt, Homo sapiens
ucugaaaagcuguguacuuu

SEQ ID NO: 2124215 - RNA, 14 nt, Homo sapiens
gcaagggcacuuaa

SEQ ID NO: 2124216 - RNA, 22 nt, Homo sapiens
aauacacaguauucagagucuc

SEQ ID NO: 2124217 - RNA, 21 nt, Homo sapiens
aggagccagacuuguucucag

SEQ ID NO: 2124218 - RNA, 14 nt, Homo sapiens
cuaucccaucccau

SEQ ID NO: 2124219 - RNA, 13 nt, Homo sapiens
gggguaagucccu

SEQ ID NO: 2124220 - RNA, 23 nt, Homo sapiens
uguauucacgugcagcagcaaca

SEQ ID NO: 2124221 - RNA, 22 nt, Homo sapiens
gccuguaaucucagcacuuugg

SEQ ID NO: 2124222 - RNA, 17 nt, Homo sapiens
aauggucuuacauugga

SEQ ID NO: 2124223 - RNA, 19 nt, Homo sapiens
accuuggcucugccagugg

SEQ ID NO: 2124224 - RNA, 17 nt, Homo sapiens
agaauuauuaauuaucg

SEQ ID NO: 2124225 - RNA, 19 nt, Homo sapiens
cugguuauccugugcuaca

SEQ ID NO: 2124226 - RNA, 13 nt, Homo sapiens
ucuaaaacauucu

SEQ ID NO: 2124227 - RNA, 15 nt, Homo sapiens
accagcucccagggu

SEQ ID NO: 2124228 - RNA, 17 nt, Homo sapiens
uucuuucacaaggcauc

SEQ ID NO: 2124229 - RNA, 12 nt, Homo sapiens
ucuguaaauacu

SEQ ID NO: 2124230 - RNA, 18 nt, Homo sapiens
caguuuauuccugugaac

SEQ ID NO: 2124231 - RNA, 20 nt, Homo sapiens
auuuugcuaacuggguuaaa

SEQ ID NO: 2124232 - RNA, 20 nt, Homo sapiens
cuguucucgaacuccugacc

SEQ ID NO: 2124233 - RNA, 15 nt, Homo sapiens
auugaugaacugcca

SEQ ID NO: 2124234 - RNA, 15 nt, Homo sapiens
cccugucucuacuaa

SEQ ID NO: 2124235 - RNA, 16 nt, Homo sapiens
uaaacauccaauaauu

SEQ ID NO: 2124236 - RNA, 19 nt, Homo sapiens
aauguuugaaauaguucaa

SEQ ID NO: 2124237 - RNA, 16 nt, Homo sapiens
ccaaguccagguccug

SEQ ID NO: 2124238 - RNA, 14 nt, Homo sapiens
cacgaccuacauua

SEQ ID NO: 2124239 - RNA, 16 nt, Homo sapiens
aaaacaagauggagau

SEQ ID NO: 2124240 - RNA, 17 nt, Homo sapiens
uaccaaaagacauuaga

SEQ ID NO: 2124241 - RNA, 15 nt, Homo sapiens
uugucccaucugccc

SEQ ID NO: 2124242 - RNA, 20 nt, Homo sapiens
agaaaguuggccaauuucac

SEQ ID NO: 2124243 - RNA, 12 nt, Homo sapiens
agcuuacaggaa

SEQ ID NO: 2124244 - RNA, 23 nt, Homo sapiens
uggcaacaucagcuuucuaaugu

SEQ ID NO: 2124245 - RNA, 18 nt, Homo sapiens
uaccccugguaaaccaag

SEQ ID NO: 2124246 - RNA, 14 nt, Homo sapiens
ugcaauuccaagaa

SEQ ID NO: 2124247 - RNA, 24 nt, Homo sapiens
acacuugcucccaacccauucacu

SEQ ID NO: 2124248 - RNA, 16 nt, Homo sapiens
ucaugugggucuucca

SEQ ID NO: 2124249 - RNA, 12 nt, Homo sapiens
uuaacaaaagga

SEQ ID NO: 2124250 - RNA, 14 nt, Homo sapiens
ccgaggaaggugug

SEQ ID NO: 2124251 - RNA, 15 nt, Homo sapiens
aagaagcucucuccu

SEQ ID NO: 2124252 - RNA, 13 nt, Homo sapiens
auauacacacaca

SEQ ID NO: 2124253 - RNA, 22 nt, Homo sapiens
acaagucaucauaauucagcuc

SEQ ID NO: 2124254 - RNA, 16 nt, Homo sapiens
uucuuuuggcuuccau

SEQ ID NO: 2124255 - RNA, 18 nt, Homo sapiens
uagaagauccacauccuc

SEQ ID NO: 2124256 - RNA, 12 nt, Homo sapiens
cugguccaugau

SEQ ID NO: 2124257 - RNA, 14 nt, Homo sapiens
auuuccaacaccac

SEQ ID NO: 2124258 - RNA, 23 nt, Homo sapiens
uggcuacuaguuuaagcaaauaa

SEQ ID NO: 2124259 - RNA, 14 nt, Homo sapiens
cucagcucccacaa

SEQ ID NO: 2124260 - RNA, 17 nt, Homo sapiens
caaagauauauacacag

SEQ ID NO: 2124261 - RNA, 20 nt, Homo sapiens
cuuuaaguuaagugcauuga

SEQ ID NO: 2124262 - RNA, 20 nt, Homo sapiens
ugaaguucugagauacugaa

SEQ ID NO: 2124263 - RNA, 15 nt, Homo sapiens
gcaaucguucugcug

SEQ ID NO: 2124264 - RNA, 17 nt, Homo sapiens
uauuggcauagaaaaaa

SEQ ID NO: 2124265 - RNA, 13 nt, Homo sapiens
uauuagacaugaa

SEQ ID NO: 2124266 - RNA, 17 nt, Homo sapiens
aauguggaagucaguac

SEQ ID NO: 2124267 - RNA, 16 nt, Homo sapiens
gcagacuuacaaagcu

SEQ ID NO: 2124268 - RNA, 16 nt, Homo sapiens
ugguaaacaacagacu

SEQ ID NO: 2124269 - RNA, 20 nt, Homo sapiens
uuaacaugacauuuaccagc

SEQ ID NO: 2124270 - RNA, 20 nt, Homo sapiens
uucauuucuuuccuuaucac

SEQ ID NO: 2124271 - RNA, 15 nt, Homo sapiens
cuuaaucaugagaua

SEQ ID NO: 2124272 - RNA, 19 nt, Homo sapiens
acccagggaacagccacuc

SEQ ID NO: 2124273 - RNA, 15 nt, Homo sapiens
ucagaucguucauug

SEQ ID NO: 2124274 - RNA, 13 nt, Homo sapiens
uuauuuuguugaa

SEQ ID NO: 2124275 - RNA, 17 nt, Homo sapiens
auaaaucucuccuauaa

SEQ ID NO: 2124276 - RNA, 14 nt, Homo sapiens
aaaucaauguguac

SEQ ID NO: 2124277 - RNA, 14 nt, Homo sapiens
augcccaugaacaa

SEQ ID NO: 2124278 - RNA, 22 nt, Homo sapiens
ugcacauacgcaccacaucucu

SEQ ID NO: 2124279 - RNA, 16 nt, Homo sapiens
agcaacuuguguuaca

SEQ ID NO: 2124280 - RNA, 19 nt, Homo sapiens
uguugcguccaugcucaga

SEQ ID NO: 2124281 - RNA, 21 nt, Homo sapiens
ggcccccaguggggacaggga

SEQ ID NO: 2124282 - RNA, 20 nt, Homo sapiens
aucacacuuuaauguacaug

SEQ ID NO: 2124283 - RNA, 21 nt, Homo sapiens
ucuagccagagcccuucacug

SEQ ID NO: 2124284 - RNA, 17 nt, Homo sapiens
ggaccugcgcaaagggc

SEQ ID NO: 2124285 - RNA, 17 nt, Homo sapiens
cgauggaucuguggucc

SEQ ID NO: 2124286 - RNA, 18 nt, Homo sapiens
agagguuugcugacaggu

SEQ ID NO: 2124287 - RNA, 15 nt, Homo sapiens
aguuuaacacuuucu

SEQ ID NO: 2124288 - RNA, 17 nt, Homo sapiens
ugauuauauagcacaua

SEQ ID NO: 2124289 - RNA, 16 nt, Homo sapiens
gaaguauaaagugauc

SEQ ID NO: 2124290 - RNA, 16 nt, Homo sapiens
auaacaagaguuuuaa

SEQ ID NO: 2124291 - RNA, 22 nt, Homo sapiens
ucagcccagccccuccaaaggu

SEQ ID NO: 2124292 - RNA, 22 nt, Homo sapiens
caggaaaacagcuaguagacau

SEQ ID NO: 2124293 - RNA, 18 nt, Homo sapiens
auguacguuacagcuuuc

SEQ ID NO: 2124294 - RNA, 18 nt, Homo sapiens
ucaagacuugauacugca

SEQ ID NO: 2124295 - RNA, 15 nt, Homo sapiens
auaucacgacagauu

SEQ ID NO: 2124296 - RNA, 20 nt, Homo sapiens
guucuuugagggacugccuc

SEQ ID NO: 2124297 - RNA, 19 nt, Homo sapiens
cucugucugcucaaugcca

SEQ ID NO: 2124298 - RNA, 23 nt, Homo sapiens
ucauuuuugcuuuucaaaugaca

SEQ ID NO: 2124299 - RNA, 17 nt, Homo sapiens
caccuugcuccuccuuc

SEQ ID NO: 2124300 - RNA, 15 nt, Homo sapiens
auuaugugaaaugua

SEQ ID NO: 2124301 - RNA, 21 nt, Homo sapiens
cccacagaguuggggagauaa

SEQ ID NO: 2124302 - RNA, 16 nt, Homo sapiens
uguuuggaugaaaaaa

SEQ ID NO: 2124303 - RNA, 20 nt, Homo sapiens
auugcaauaaccgcuugguu

SEQ ID NO: 2124304 - RNA, 19 nt, Homo sapiens
ggccucccaaagugcuagu

SEQ ID NO: 2124305 - RNA, 15 nt, Homo sapiens
augcagcucaucacc

SEQ ID NO: 2124306 - RNA, 14 nt, Homo sapiens
uuuuaacaugucaa

SEQ ID NO: 2124307 - RNA, 15 nt, Homo sapiens
uuaggggaguucagu

SEQ ID NO: 2124308 - RNA, 14 nt, Homo sapiens
ugacccagccuguu

SEQ ID NO: 2124309 - RNA, 14 nt, Homo sapiens
ucauuuuguucuga

SEQ ID NO: 2124310 - RNA, 14 nt, Homo sapiens
aaacuggcccuguu

SEQ ID NO: 2124311 - RNA, 15 nt, Homo sapiens
ccuugguucuggcca

SEQ ID NO: 2124312 - RNA, 16 nt, Homo sapiens
uuaucaugcauguccu

SEQ ID NO: 2124313 - RNA, 19 nt, Homo sapiens
auuguuaggugcugaccua

SEQ ID NO: 2124314 - RNA, 18 nt, Homo sapiens
ucaaaaaaaaaaauggau

SEQ ID NO: 2124315 - RNA, 19 nt, Homo sapiens
aaugggagacaauuucaca

SEQ ID NO: 2124316 - RNA, 14 nt, Homo sapiens
acaccaauuaaugu

SEQ ID NO: 2124317 - RNA, 20 nt, Homo sapiens
gaggcagagguugcagugaa

SEQ ID NO: 2124318 - RNA, 19 nt, Homo sapiens
aucugaauaaaguguaaca

SEQ ID NO: 2124319 - RNA, 20 nt, Homo sapiens
guauuauaauaagcaaaaag

SEQ ID NO: 2124320 - RNA, 17 nt, Homo sapiens
aaugaguggacaaguca

SEQ ID NO: 2124321 - RNA, 13 nt, Homo sapiens
gauacacuugaag

SEQ ID NO: 2124322 - RNA, 17 nt, Homo sapiens
aucccccucuuugcaca

SEQ ID NO: 2124323 - RNA, 18 nt, Homo sapiens
auagugccagguggcuca

SEQ ID NO: 2124324 - RNA, 14 nt, Homo sapiens
auauuugagacaaa

SEQ ID NO: 2124325 - RNA, 17 nt, Homo sapiens
gaauguuuaaagaucau

SEQ ID NO: 2124326 - RNA, 14 nt, Homo sapiens
cacccccgugucca

SEQ ID NO: 2124327 - RNA, 23 nt, Homo sapiens
aucucauuggacccuuccauggu

SEQ ID NO: 2124328 - RNA, 15 nt, Homo sapiens
guucuggaaaccacg

SEQ ID NO: 2124329 - RNA, 12 nt, Homo sapiens
accaacugccuu

SEQ ID NO: 2124330 - RNA, 21 nt, Homo sapiens
gccucccggguucaagcaauu

SEQ ID NO: 2124331 - RNA, 18 nt, Homo sapiens
uauuguuguccuuuucau

SEQ ID NO: 2124332 - RNA, 17 nt, Homo sapiens
ucccccuaaaccaacug

SEQ ID NO: 2124333 - RNA, 16 nt, Homo sapiens
aaauguacuacugagc

SEQ ID NO: 2124334 - RNA, 18 nt, Homo sapiens
acauagucagcucugauc

SEQ ID NO: 2124335 - RNA, 22 nt, Homo sapiens
gcccugggucuugccaugugcu

SEQ ID NO: 2124336 - RNA, 14 nt, Homo sapiens
cccagacacauuca

SEQ ID NO: 2124337 - RNA, 17 nt, Homo sapiens
cuaucaaaacauaucaa

SEQ ID NO: 2124338 - RNA, 22 nt, Homo sapiens
gaauaugacucaggagccuccu

SEQ ID NO: 2124339 - RNA, 16 nt, Homo sapiens
gaacucugggcagcug

SEQ ID NO: 2124340 - RNA, 15 nt, Homo sapiens
caauuguaacgacuu

SEQ ID NO: 2124341 - RNA, 14 nt, Homo sapiens
uacaguauggcaau

SEQ ID NO: 2124342 - RNA, 18 nt, Homo sapiens
uucucucuuauuccacuu

SEQ ID NO: 2124343 - RNA, 16 nt, Homo sapiens
gaaucuaaaaccaaau

SEQ ID NO: 2124344 - RNA, 19 nt, Homo sapiens
uuuuuuaaggugaguucuc

SEQ ID NO: 2124345 - RNA, 20 nt, Homo sapiens
gccuccugcugaguggucca

SEQ ID NO: 2124346 - RNA, 12 nt, Homo sapiens
caguggcuguga

SEQ ID NO: 2124347 - RNA, 12 nt, Homo sapiens
aguccugggauu

SEQ ID NO: 2124348 - RNA, 14 nt, Homo sapiens
aguccagucucucc

SEQ ID NO: 2124349 - RNA, 21 nt, Homo sapiens
ccauucauacccacacaccca

SEQ ID NO: 2124350 - RNA, 17 nt, Homo sapiens
acacagaggggagucac

SEQ ID NO: 2124351 - RNA, 14 nt, Homo sapiens
uugagucuguucuu

SEQ ID NO: 2124352 - RNA, 14 nt, Homo sapiens
auguaacauacuca

SEQ ID NO: 2124353 - RNA, 21 nt, Homo sapiens
acagcacuggggagucuuugu

SEQ ID NO: 2124354 - RNA, 23 nt, Homo sapiens
gugaccaacuagacauucugucg

SEQ ID NO: 2124355 - RNA, 14 nt, Homo sapiens
aggcuucagucuca

SEQ ID NO: 2124356 - RNA, 22 nt, Homo sapiens
uccacgagaccaugaugcauug

SEQ ID NO: 2124357 - RNA, 22 nt, Homo sapiens
acuuaugagauaauuaaugauu

SEQ ID NO: 2124358 - RNA, 17 nt, Homo sapiens
cccugcacuaaagccag

SEQ ID NO: 2124359 - RNA, 20 nt, Homo sapiens
ccugauggcuggcaggcagu

SEQ ID NO: 2124360 - RNA, 16 nt, Homo sapiens
aagacuugguguccuu

SEQ ID NO: 2124361 - RNA, 21 nt, Homo sapiens
cucuuccccauaaucacugac

SEQ ID NO: 2124362 - RNA, 15 nt, Homo sapiens
ucaauaaaguacaag

SEQ ID NO: 2124363 - RNA, 19 nt, Homo sapiens
aaaacccugcaccucuuug

SEQ ID NO: 2124364 - RNA, 14 nt, Homo sapiens
ucaaguauuggcaa

SEQ ID NO: 2124365 - RNA, 13 nt, Homo sapiens
ugcauauuugcua

SEQ ID NO: 2124366 - RNA, 21 nt, Homo sapiens
auucugagccugauauugaua

SEQ ID NO: 2124367 - RNA, 14 nt, Homo sapiens
cugcguggggacag

SEQ ID NO: 2124368 - RNA, 18 nt, Homo sapiens
acacuacagguguugaau

SEQ ID NO: 2124369 - RNA, 15 nt, Homo sapiens
uacaacacacacugu

SEQ ID NO: 2124370 - RNA, 19 nt, Homo sapiens
ccagccuggccaccagcuu

SEQ ID NO: 2124371 - RNA, 12 nt, Homo sapiens
cacaucugucac

SEQ ID NO: 2124372 - RNA, 19 nt, Homo sapiens
uuccuggggcacaaguguc

SEQ ID NO: 2124373 - RNA, 20 nt, Homo sapiens
aacucccagccacagcauuu

SEQ ID NO: 2124374 - RNA, 14 nt, Homo sapiens
aagaaagccuaaaa

SEQ ID NO: 2124375 - RNA, 15 nt, Homo sapiens
cacucuccugugaga

SEQ ID NO: 2124376 - RNA, 14 nt, Homo sapiens
ccucacugggcuca

SEQ ID NO: 2124377 - RNA, 15 nt, Homo sapiens
accuuaaacuuucaa

SEQ ID NO: 2124378 - RNA, 22 nt, Homo sapiens
ggaacugaguguuagugacuuu

SEQ ID NO: 2124379 - RNA, 16 nt, Homo sapiens
agaguggguacuagaa

SEQ ID NO: 2124380 - RNA, 17 nt, Homo sapiens
uucagagucucugauac

SEQ ID NO: 2124381 - RNA, 21 nt, Homo sapiens
ggccaaccaggacccaggguc

SEQ ID NO: 2124382 - RNA, 15 nt, Homo sapiens
cauccucaugcugcu

SEQ ID NO: 2124383 - RNA, 19 nt, Homo sapiens
cuugggaaagagacagagu

SEQ ID NO: 2124384 - RNA, 21 nt, Homo sapiens
uaaaggacaggccacaccaca

SEQ ID NO: 2124385 - RNA, 14 nt, Homo sapiens
aaagaugucuuaac

SEQ ID NO: 2124386 - RNA, 19 nt, Homo sapiens
auagcgaagaccaguaugg

SEQ ID NO: 2124387 - RNA, 11 nt, Homo sapiens
ugaaucuacaa

SEQ ID NO: 2124388 - RNA, 23 nt, Homo sapiens
uugaaggguguucacccauccca

SEQ ID NO: 2124389 - RNA, 17 nt, Homo sapiens
aagauguauuucaucuc

SEQ ID NO: 2124390 - RNA, 16 nt, Homo sapiens
acgcaaauacaugccu

SEQ ID NO: 2124391 - RNA, 14 nt, Homo sapiens
uaagggguacuccu

SEQ ID NO: 2124392 - RNA, 22 nt, Homo sapiens
aagcaucuguagugacccacug

SEQ ID NO: 2124393 - RNA, 18 nt, Homo sapiens
cugccgagaguccaucag

SEQ ID NO: 2124394 - RNA, 13 nt, Homo sapiens
aauaaauguugcc

SEQ ID NO: 2124395 - RNA, 16 nt, Homo sapiens
uggcucuuuguguguc

SEQ ID NO: 2124396 - RNA, 22 nt, Homo sapiens
ucaguggaauagaugucucaaa

SEQ ID NO: 2124397 - RNA, 20 nt, Homo sapiens
agagucaacauaugugauug

SEQ ID NO: 2124398 - RNA, 18 nt, Homo sapiens
ggccgccgcugacccugg

SEQ ID NO: 2124399 - RNA, 13 nt, Homo sapiens
gaccaccggguga

SEQ ID NO: 2124400 - RNA, 15 nt, Homo sapiens
cagagaaaccagcuu

SEQ ID NO: 2124401 - RNA, 20 nt, Homo sapiens
uucuagggccgucaggacac

SEQ ID NO: 2124402 - RNA, 23 nt, Homo sapiens
uagaucugagcccucccucuucc

SEQ ID NO: 2124403 - RNA, 16 nt, Homo sapiens
aacauuucaaaaggua

SEQ ID NO: 2124404 - RNA, 19 nt, Homo sapiens
caccacggcguuguaccug

SEQ ID NO: 2124405 - RNA, 22 nt, Homo sapiens
uuacccacgugcuguuccaccu

SEQ ID NO: 2124406 - RNA, 17 nt, Homo sapiens
gccuaccuccacaccac

SEQ ID NO: 2124407 - RNA, 18 nt, Homo sapiens
uggcgcuuggaucugggg

SEQ ID NO: 2124408 - RNA, 12 nt, Homo sapiens
caaucagaauca

SEQ ID NO: 2124409 - RNA, 23 nt, Homo sapiens
aggcaggaggccauuuacuugag

SEQ ID NO: 2124410 - RNA, 15 nt, Homo sapiens
aggaaagaacaucac

SEQ ID NO: 2124411 - RNA, 16 nt, Homo sapiens
ggugaauuauguuucc

SEQ ID NO: 2124412 - RNA, 15 nt, Homo sapiens
agccaagagugcacu

SEQ ID NO: 2124413 - RNA, 23 nt, Homo sapiens
cuaaauaaagagaacuccagugu

SEQ ID NO: 2124414 - RNA, 13 nt, Homo sapiens
cagauugugauaa

SEQ ID NO: 2124415 - RNA, 14 nt, Homo sapiens
aaggcaauuucaua

SEQ ID NO: 2124416 - RNA, 21 nt, Homo sapiens
cucaguaaaucagugcaguac

SEQ ID NO: 2124417 - RNA, 19 nt, Homo sapiens
cuaagauaaauucaugcac

SEQ ID NO: 2124418 - RNA, 16 nt, Homo sapiens
caguaguaaugugcuu

SEQ ID NO: 2124419 - RNA, 16 nt, Homo sapiens
ggcucugggugcagua

SEQ ID NO: 2124420 - RNA, 13 nt, Homo sapiens
accagaagcagau

SEQ ID NO: 2124421 - RNA, 22 nt, Homo sapiens
uaaaaagagcuguccugguauc

SEQ ID NO: 2124422 - RNA, 23 nt, Homo sapiens
aauucaccucguuacucucaccu

SEQ ID NO: 2124423 - RNA, 22 nt, Homo sapiens
gcuugaaauagugucugaugaa

SEQ ID NO: 2124424 - RNA, 21 nt, Homo sapiens
ggaguguucagggccagcccu

SEQ ID NO: 2124425 - RNA, 21 nt, Homo sapiens
ccauuauuuugguuuaucuuc

SEQ ID NO: 2124426 - RNA, 21 nt, Homo sapiens
caaaaaaaguucagcaugaag

SEQ ID NO: 2124427 - RNA, 16 nt, Homo sapiens
uugagauauaguucac

SEQ ID NO: 2124428 - RNA, 18 nt, Homo sapiens
agauaauauguuaucucu

SEQ ID NO: 2124429 - RNA, 23 nt, Homo sapiens
gacacacggggcucgggccuuua

SEQ ID NO: 2124430 - RNA, 22 nt, Homo sapiens
auuuuacuacuucucucuguau

SEQ ID NO: 2124431 - RNA, 16 nt, Homo sapiens
agccccagcaccucau

SEQ ID NO: 2124432 - RNA, 19 nt, Homo sapiens
augucuaaaguuagggcau

SEQ ID NO: 2124433 - RNA, 19 nt, Homo sapiens
auuuauaauguuaguagaa

SEQ ID NO: 2124434 - RNA, 14 nt, Homo sapiens
gagggauccgucuc

SEQ ID NO: 2124435 - RNA, 23 nt, Homo sapiens
uaauuaaacaagugcacuugaac

SEQ ID NO: 2124436 - RNA, 16 nt, Homo sapiens
caguggcaucaucuca

SEQ ID NO: 2124437 - RNA, 16 nt, Homo sapiens
aaauacaagacugcca

SEQ ID NO: 2124438 - RNA, 18 nt, Homo sapiens
uuuuggucauagcauuca

SEQ ID NO: 2124439 - RNA, 20 nt, Homo sapiens
uuuaccacaggaugcauauu

SEQ ID NO: 2124440 - RNA, 16 nt, Homo sapiens
ggggacacuguggcag

SEQ ID NO: 2124441 - RNA, 13 nt, Homo sapiens
gaaguucugagau

SEQ ID NO: 2124442 - RNA, 18 nt, Homo sapiens
agaauauaaagccucaaa

SEQ ID NO: 2124443 - RNA, 22 nt, Homo sapiens
accgcacaugugccacuguuca

SEQ ID NO: 2124444 - RNA, 16 nt, Homo sapiens
ugcacguugcuucagg

SEQ ID NO: 2124445 - RNA, 14 nt, Homo sapiens
augcuguaacuuaa

SEQ ID NO: 2124446 - RNA, 14 nt, Homo sapiens
aggcauauacaaau

SEQ ID NO: 2124447 - RNA, 17 nt, Homo sapiens
caggggcuugcuuugca

SEQ ID NO: 2124448 - RNA, 22 nt, Homo sapiens
aagagggcgaguucagcaaaga

SEQ ID NO: 2124449 - RNA, 17 nt, Homo sapiens
uguguucacacuguaaa

SEQ ID NO: 2124450 - RNA, 22 nt, Homo sapiens
aucucuuucccggauccccaac

SEQ ID NO: 2124451 - RNA, 22 nt, Homo sapiens
uaucgaugauggaaauuagcca

SEQ ID NO: 2124452 - RNA, 15 nt, Homo sapiens
gagucccaaccccag

SEQ ID NO: 2124453 - RNA, 13 nt, Homo sapiens
guagucaaaggca

SEQ ID NO: 2124454 - RNA, 16 nt, Homo sapiens
uggagccccuguguug

SEQ ID NO: 2124455 - RNA, 23 nt, Homo sapiens
agccugccaagagguacuguaau

SEQ ID NO: 2124456 - RNA, 18 nt, Homo sapiens
gcauucucccuccuuccc

SEQ ID NO: 2124457 - RNA, 13 nt, Homo sapiens
cauaucuugccuu

SEQ ID NO: 2124458 - RNA, 21 nt, Homo sapiens
agcggccuccggcgucuugcc

SEQ ID NO: 2124459 - RNA, 17 nt, Homo sapiens
ucuaaaacugccuucca

SEQ ID NO: 2124460 - RNA, 20 nt, Homo sapiens
uuugcagaauuaacuauaac

SEQ ID NO: 2124461 - RNA, 20 nt, Homo sapiens
agccaaggccgagaccccau

SEQ ID NO: 2124462 - RNA, 15 nt, Homo sapiens
uucaugagcauucau

SEQ ID NO: 2124463 - RNA, 17 nt, Homo sapiens
cugagaauccaaacauc

SEQ ID NO: 2124464 - RNA, 13 nt, Homo sapiens
acuugcccugcca

SEQ ID NO: 2124465 - RNA, 16 nt, Homo sapiens
ccagcugcaucuacuc

SEQ ID NO: 2124466 - RNA, 18 nt, Homo sapiens
ccacauuaagcacugugg

SEQ ID NO: 2124467 - RNA, 22 nt, Homo sapiens
cuugguaacaaauaaccuauaa

SEQ ID NO: 2124468 - RNA, 18 nt, Homo sapiens
cuucccucugcauugacc

SEQ ID NO: 2124469 - RNA, 22 nt, Homo sapiens
uggagaaccagggcucuucuca

SEQ ID NO: 2124470 - RNA, 19 nt, Homo sapiens
ucagcgggagucuccucac

SEQ ID NO: 2124471 - RNA, 23 nt, Homo sapiens
ucucccuuccuaugcuguucacu

SEQ ID NO: 2124472 - RNA, 15 nt, Homo sapiens
agaagccuuuuccau

SEQ ID NO: 2124473 - RNA, 17 nt, Homo sapiens
uaaugaaaaacaaaaag

SEQ ID NO: 2124474 - RNA, 21 nt, Homo sapiens
auagcgcugaccaacgcacaa

SEQ ID NO: 2124475 - RNA, 20 nt, Homo sapiens
aaucccuagucuucaagcag

SEQ ID NO: 2124476 - RNA, 17 nt, Homo sapiens
aaacaaugccaucacug

SEQ ID NO: 2124477 - RNA, 21 nt, Homo sapiens
gcauggacaccccuuauccag

SEQ ID NO: 2124478 - RNA, 21 nt, Homo sapiens
ucucagcuugagaccauuuca

SEQ ID NO: 2124479 - RNA, 17 nt, Homo sapiens
agaauauuagugaccuc

SEQ ID NO: 2124480 - RNA, 17 nt, Homo sapiens
ugcacacuuacaguaua

SEQ ID NO: 2124481 - RNA, 15 nt, Homo sapiens
gauggaaaaauaagg

SEQ ID NO: 2124482 - RNA, 16 nt, Homo sapiens
uccucuuugguggcau

SEQ ID NO: 2124483 - RNA, 21 nt, Homo sapiens
cuuauuuauauaucaguuaua

SEQ ID NO: 2124484 - RNA, 22 nt, Homo sapiens
cucauggaucugcauaaccgca

SEQ ID NO: 2124485 - RNA, 15 nt, Homo sapiens
cagccuccucuggau

SEQ ID NO: 2124486 - RNA, 18 nt, Homo sapiens
ccggaagaaaaagagcca

SEQ ID NO: 2124487 - RNA, 17 nt, Homo sapiens
ucugucucagacuuuug

SEQ ID NO: 2124488 - RNA, 21 nt, Homo sapiens
cuuggagugcacugagaacag

SEQ ID NO: 2124489 - RNA, 16 nt, Homo sapiens
auagcgaaucaucuca

SEQ ID NO: 2124490 - RNA, 18 nt, Homo sapiens
ugaauccaggccacucuu

SEQ ID NO: 2124491 - RNA, 16 nt, Homo sapiens
ugguguauaagccauc

SEQ ID NO: 2124492 - RNA, 14 nt, Homo sapiens
gggacuuggcagua

SEQ ID NO: 2124493 - RNA, 14 nt, Homo sapiens
auguuaacugagcu

SEQ ID NO: 2124494 - RNA, 18 nt, Homo sapiens
ucgugaaaccccaucucu

SEQ ID NO: 2124495 - RNA, 20 nt, Homo sapiens
uggcguggagaaguggugcu

SEQ ID NO: 2124496 - RNA, 21 nt, Homo sapiens
gcuuugcaaacaucaaccugg

SEQ ID NO: 2124497 - RNA, 13 nt, Homo sapiens
ccucucuggguug

SEQ ID NO: 2124498 - RNA, 21 nt, Homo sapiens
caguucaguggcauucacauc

SEQ ID NO: 2124499 - RNA, 16 nt, Homo sapiens
ucaagugaaaccagcu

SEQ ID NO: 2124500 - RNA, 21 nt, Homo sapiens
caguacuguugcgccgcaguu

SEQ ID NO: 2124501 - RNA, 13 nt, Homo sapiens
auaaaguggcauu

SEQ ID NO: 2124502 - RNA, 15 nt, Homo sapiens
uauuuugugcaagcu

SEQ ID NO: 2124503 - RNA, 20 nt, Homo sapiens
gauguugacaucacuggcau

SEQ ID NO: 2124504 - RNA, 22 nt, Homo sapiens
agaacuuuucauagaugaacuu

SEQ ID NO: 2124505 - RNA, 13 nt, Homo sapiens
ucaaaagcacuug

SEQ ID NO: 2124506 - RNA, 15 nt, Homo sapiens
ugaacacaaagccug

SEQ ID NO: 2124507 - RNA, 16 nt, Homo sapiens
acaauacgugaaagau

SEQ ID NO: 2124508 - RNA, 13 nt, Homo sapiens
gccuguggugaag

SEQ ID NO: 2124509 - RNA, 17 nt, Homo sapiens
ccccuccacuggggaau

SEQ ID NO: 2124510 - RNA, 18 nt, Homo sapiens
auuccuucucgugcacug

SEQ ID NO: 2124511 - RNA, 22 nt, Homo sapiens
ccuaaauguucaagauaucagc

SEQ ID NO: 2124512 - RNA, 20 nt, Homo sapiens
cuuuauuuugaaacauuugc

SEQ ID NO: 2124513 - RNA, 19 nt, Homo sapiens
auggaauuagaaauauauc

SEQ ID NO: 2124514 - RNA, 22 nt, Homo sapiens
cgccuccccccacccgaagcca

SEQ ID NO: 2124515 - RNA, 19 nt, Homo sapiens
gcuuugaaaacaugacuca

SEQ ID NO: 2124516 - RNA, 13 nt, Homo sapiens
cuaucuguucccc

SEQ ID NO: 2124517 - RNA, 13 nt, Homo sapiens
uuccauguccaua

SEQ ID NO: 2124518 - RNA, 16 nt, Homo sapiens
agauauuugguaccau

SEQ ID NO: 2124519 - RNA, 17 nt, Homo sapiens
ccuucuuugucuugccc

SEQ ID NO: 2124520 - RNA, 22 nt, Homo sapiens
aucaccuagaaacuuguuagaa

SEQ ID NO: 2124521 - RNA, 22 nt, Homo sapiens
uugguguauguaugaguaucug

SEQ ID NO: 2124522 - RNA, 21 nt, Homo sapiens
uuucccuaaguuuacuucucu

SEQ ID NO: 2124523 - RNA, 21 nt, Homo sapiens
uaaucagauugacagcauaua

SEQ ID NO: 2124524 - RNA, 19 nt, Homo sapiens
cuccuccuugucuuggcag

SEQ ID NO: 2124525 - RNA, 18 nt, Homo sapiens
ugugggcagaauccuugu

SEQ ID NO: 2124526 - RNA, 23 nt, Homo sapiens
uccaugcagaucuagccaggccu

SEQ ID NO: 2124527 - RNA, 22 nt, Homo sapiens
agacuuaagcguacaaagugau

SEQ ID NO: 2124528 - RNA, 13 nt, Homo sapiens
aggcugaaaccau

SEQ ID NO: 2124529 - RNA, 21 nt, Homo sapiens
aacaucacugaaaugcuagcu

SEQ ID NO: 2124530 - RNA, 19 nt, Homo sapiens
aauguguucaccaucccaa

SEQ ID NO: 2124531 - RNA, 22 nt, Homo sapiens
gcuaggcgcuggggagacugau

SEQ ID NO: 2124532 - RNA, 14 nt, Homo sapiens
agcauaaguauaca

SEQ ID NO: 2124533 - RNA, 17 nt, Homo sapiens
uugagauccagugcagu

SEQ ID NO: 2124534 - RNA, 17 nt, Homo sapiens
ggaaauauuugcguaaa

SEQ ID NO: 2124535 - RNA, 15 nt, Homo sapiens
gacucauuguagaaa

SEQ ID NO: 2124536 - RNA, 16 nt, Homo sapiens
cagcgcagaacagccc

SEQ ID NO: 2124537 - RNA, 13 nt, Homo sapiens
gccgucugcacuu

SEQ ID NO: 2124538 - RNA, 15 nt, Homo sapiens
cgaugugacugccau

SEQ ID NO: 2124539 - RNA, 18 nt, Homo sapiens
ucauauguuuaugguaau

SEQ ID NO: 2124540 - RNA, 19 nt, Homo sapiens
aucuuccagccaccuaguc

SEQ ID NO: 2124541 - RNA, 20 nt, Homo sapiens
gacgcauuucgguugagaau

SEQ ID NO: 2124542 - RNA, 22 nt, Homo sapiens
aacuacugacggaguccugugu

SEQ ID NO: 2124543 - RNA, 23 nt, Homo sapiens
uaaccuuuucaccuccaacugga

SEQ ID NO: 2124544 - RNA, 12 nt, Homo sapiens
ugggacugagaa

SEQ ID NO: 2124545 - RNA, 22 nt, Homo sapiens
auuuaucuauaauuuaccuaag

SEQ ID NO: 2124546 - RNA, 13 nt, Homo sapiens
agucaggcccuga

SEQ ID NO: 2124547 - RNA, 12 nt, Homo sapiens
uuguugcugcug

SEQ ID NO: 2124548 - RNA, 14 nt, Homo sapiens
gaggcaucuggaaa

SEQ ID NO: 2124549 - RNA, 12 nt, Homo sapiens
gcucuuguuauu

SEQ ID NO: 2124550 - RNA, 15 nt, Homo sapiens
cacuccagugcccau

SEQ ID NO: 2124551 - RNA, 20 nt, Homo sapiens
gcuuuaaacacccuucacau

SEQ ID NO: 2124552 - RNA, 18 nt, Homo sapiens
aagaagcccauaucacau

SEQ ID NO: 2124553 - RNA, 21 nt, Homo sapiens
auucgaccuauaagaagccuu

SEQ ID NO: 2124554 - RNA, 15 nt, Homo sapiens
acccagucacuguga

SEQ ID NO: 2124555 - RNA, 15 nt, Homo sapiens
acugugucacccaga

SEQ ID NO: 2124556 - RNA, 22 nt, Homo sapiens
cauaaaucuuguaaucauguua

SEQ ID NO: 2124557 - RNA, 20 nt, Homo sapiens
cuguuauguacuguacuaau

SEQ ID NO: 2124558 - RNA, 13 nt, Homo sapiens
cuguugaugugga

SEQ ID NO: 2124559 - RNA, 12 nt, Homo sapiens
gacgacuacaga

SEQ ID NO: 2124560 - RNA, 17 nt, Homo sapiens
cuguguugugcucagga

SEQ ID NO: 2124561 - RNA, 16 nt, Homo sapiens
uauaaaacacaucauc

SEQ ID NO: 2124562 - RNA, 13 nt, Homo sapiens
cacuuuccuacaa

SEQ ID NO: 2124563 - RNA, 18 nt, Homo sapiens
acagagccagacugucuc

SEQ ID NO: 2124564 - RNA, 13 nt, Homo sapiens
ugaacugccaaag

SEQ ID NO: 2124565 - RNA, 18 nt, Homo sapiens
gucucucugucucucugu

SEQ ID NO: 2124566 - RNA, 18 nt, Homo sapiens
aucugcccgccugcccac

SEQ ID NO: 2124567 - RNA, 18 nt, Homo sapiens
gaaacugggaaacugggu

SEQ ID NO: 2124568 - RNA, 21 nt, Homo sapiens
cauacucugugcaaggaaauu

SEQ ID NO: 2124569 - RNA, 23 nt, Homo sapiens
acaguucaauucucauuugucac

SEQ ID NO: 2124570 - RNA, 17 nt, Homo sapiens
guucacuaccugucagc

SEQ ID NO: 2124571 - RNA, 21 nt, Homo sapiens
uccuaccagagugaagcccac

SEQ ID NO: 2124572 - RNA, 21 nt, Homo sapiens
uauucacaauggaaacuuuag

SEQ ID NO: 2124573 - RNA, 17 nt, Homo sapiens
aagcaacagacucucac

SEQ ID NO: 2124574 - RNA, 17 nt, Homo sapiens
cuggcuuuacauggguu

SEQ ID NO: 2124575 - RNA, 18 nt, Homo sapiens
acauaugucauauauuac

SEQ ID NO: 2124576 - RNA, 14 nt, Homo sapiens
ccuaaagucucugc

SEQ ID NO: 2124577 - RNA, 12 nt, Homo sapiens
aaugccacagac

SEQ ID NO: 2124578 - RNA, 12 nt, Homo sapiens
agggcucugagg

SEQ ID NO: 2124579 - RNA, 13 nt, Homo sapiens
ccucaaagcauuu

SEQ ID NO: 2124580 - RNA, 22 nt, Homo sapiens
ugacagccgucccaacccugcc

SEQ ID NO: 2124581 - RNA, 16 nt, Homo sapiens
aauaagugcgaucaca

SEQ ID NO: 2124582 - RNA, 13 nt, Homo sapiens
gcaaauguuacau

SEQ ID NO: 2124583 - RNA, 15 nt, Homo sapiens
cauggugcagugaag

SEQ ID NO: 2124584 - RNA, 15 nt, Homo sapiens
uaggcauuccagcuc

SEQ ID NO: 2124585 - RNA, 22 nt, Homo sapiens
auuaaccucugcacuacugaca

SEQ ID NO: 2124586 - RNA, 22 nt, Homo sapiens
auuccauaaucaaucuaucaau

SEQ ID NO: 2124587 - RNA, 18 nt, Homo sapiens
ccauucuccugccucagc

SEQ ID NO: 2124588 - RNA, 18 nt, Homo sapiens
auuaagugguuacuuugu

SEQ ID NO: 2124589 - RNA, 16 nt, Homo sapiens
uguuuauuuagcucug

SEQ ID NO: 2124590 - RNA, 14 nt, Homo sapiens
agaaccaccauuca

SEQ ID NO: 2124591 - RNA, 15 nt, Homo sapiens
aguaagaagacauga

SEQ ID NO: 2124592 - RNA, 22 nt, Homo sapiens
aauucuuauuggccaaaugccu

SEQ ID NO: 2124593 - RNA, 15 nt, Homo sapiens
agagaggaaccaaua

SEQ ID NO: 2124594 - RNA, 13 nt, Homo sapiens
cuuuaaauaucau

SEQ ID NO: 2124595 - RNA, 18 nt, Homo sapiens
gggaacagagaagugugg

SEQ ID NO: 2124596 - RNA, 17 nt, Homo sapiens
uggugcaaguagcacau

SEQ ID NO: 2124597 - RNA, 18 nt, Homo sapiens
gaggcuggagauccuuuc

SEQ ID NO: 2124598 - RNA, 19 nt, Homo sapiens
gauccacaaaaacaacuua

SEQ ID NO: 2124599 - RNA, 17 nt, Homo sapiens
uagaauauccaugaccu

SEQ ID NO: 2124600 - RNA, 21 nt, Homo sapiens
gauccccuggaaacccaccuc

SEQ ID NO: 2124601 - RNA, 20 nt, Homo sapiens
gaacauauggaaaguauuag

SEQ ID NO: 2124602 - RNA, 16 nt, Homo sapiens
ugcagaggcaccucaa

SEQ ID NO: 2124603 - RNA, 16 nt, Homo sapiens
uauauugaauauauca

SEQ ID NO: 2124604 - RNA, 10 nt, Homo sapiens
aggauggugu

SEQ ID NO: 2124605 - RNA, 20 nt, Homo sapiens
aacugcaucaagacuucaau

SEQ ID NO: 2124606 - RNA, 16 nt, Homo sapiens
uccaauuugcacuuuc

SEQ ID NO: 2124607 - RNA, 20 nt, Homo sapiens
uugaaggacuacagguauuu

SEQ ID NO: 2124608 - RNA, 21 nt, Homo sapiens
gaagaucauugccaucaccau

SEQ ID NO: 2124609 - RNA, 20 nt, Homo sapiens
cccugccuccacuugccuug

SEQ ID NO: 2124610 - RNA, 19 nt, Homo sapiens
gagagcugggacucaguuc

SEQ ID NO: 2124611 - RNA, 19 nt, Homo sapiens
agugacugccgucagcucc

SEQ ID NO: 2124612 - RNA, 18 nt, Homo sapiens
ucuuguuguuauucagaa

SEQ ID NO: 2124613 - RNA, 14 nt, Homo sapiens
cuuucucugagggg

SEQ ID NO: 2124614 - RNA, 14 nt, Homo sapiens
aaaaacaacuuuau

SEQ ID NO: 2124615 - RNA, 22 nt, Homo sapiens
auaaccuccagccuccugccca

SEQ ID NO: 2124616 - RNA, 12 nt, Homo sapiens
uuuauagcucua

SEQ ID NO: 2124617 - RNA, 14 nt, Homo sapiens
aguuucaggugaca

SEQ ID NO: 2124618 - RNA, 23 nt, Homo sapiens
aaaugucuauuauuaugaagaau

SEQ ID NO: 2124619 - RNA, 19 nt, Homo sapiens
ucgugcgacaggcauuuag

SEQ ID NO: 2124620 - RNA, 17 nt, Homo sapiens
cgacuuagccugaguca

SEQ ID NO: 2124621 - RNA, 22 nt, Homo sapiens
ugcacuccagccugagugacag

SEQ ID NO: 2124622 - RNA, 18 nt, Homo sapiens
auucuucacuguguuuua

SEQ ID NO: 2124623 - RNA, 22 nt, Homo sapiens
aaucaaccugcacuucauaucu

SEQ ID NO: 2124624 - RNA, 15 nt, Homo sapiens
guuuuauauguugcu

SEQ ID NO: 2124625 - RNA, 20 nt, Homo sapiens
cuuuugcuugaaaccaaaga

SEQ ID NO: 2124626 - RNA, 12 nt, Homo sapiens
gcucauuucacu

SEQ ID NO: 2124627 - RNA, 22 nt, Homo sapiens
agucaucuaccugaguccugaa

SEQ ID NO: 2124628 - RNA, 15 nt, Homo sapiens
ucaaaauaaugaagu

SEQ ID NO: 2124629 - RNA, 18 nt, Homo sapiens
gccaggugugguggcuca

SEQ ID NO: 2124630 - RNA, 18 nt, Homo sapiens
ugucagguggacccugua

SEQ ID NO: 2124631 - RNA, 20 nt, Homo sapiens
uuaaaauguacacuggauau

SEQ ID NO: 2124632 - RNA, 16 nt, Homo sapiens
gaacccaguguuucca

SEQ ID NO: 2124633 - RNA, 23 nt, Homo sapiens
caauucauggaagccaccaguga

SEQ ID NO: 2124634 - RNA, 15 nt, Homo sapiens
gaugaggugcucaau

SEQ ID NO: 2124635 - RNA, 14 nt, Homo sapiens
ugcaguucuacuca

SEQ ID NO: 2124636 - RNA, 20 nt, Homo sapiens
gcagccuccugcucugugaa

SEQ ID NO: 2124637 - RNA, 19 nt, Homo sapiens
gccuuaaucccagcacuuu

SEQ ID NO: 2124638 - RNA, 12 nt, Homo sapiens
gaccaccaaagu

SEQ ID NO: 2124639 - RNA, 18 nt, Homo sapiens
cuuacuaagcauagcaaa

SEQ ID NO: 2124640 - RNA, 19 nt, Homo sapiens
uaaaauaaaucuacuguuu

SEQ ID NO: 2124641 - RNA, 21 nt, Homo sapiens
ggcagauacugucucuuucau

SEQ ID NO: 2124642 - RNA, 22 nt, Homo sapiens
ugcugccucucuuucacacaau

SEQ ID NO: 2124643 - RNA, 18 nt, Homo sapiens
ugacuucagaauaacagc

SEQ ID NO: 2124644 - RNA, 19 nt, Homo sapiens
agcugcuguuagauguccu

SEQ ID NO: 2124645 - RNA, 15 nt, Homo sapiens
aagaguuauaugacu

SEQ ID NO: 2124646 - RNA, 12 nt, Homo sapiens
cccucacccauc

SEQ ID NO: 2124647 - RNA, 17 nt, Homo sapiens
cuaauaaauaaucaucc

SEQ ID NO: 2124648 - RNA, 23 nt, Homo sapiens
gcgucugcagaaagaaauugagc

SEQ ID NO: 2124649 - RNA, 21 nt, Homo sapiens
ccugaggugaaagggagcuau

SEQ ID NO: 2124650 - RNA, 16 nt, Homo sapiens
agaaugaacccauagg

SEQ ID NO: 2124651 - RNA, 17 nt, Homo sapiens
accuaugugugugcuuu

SEQ ID NO: 2124652 - RNA, 14 nt, Homo sapiens
uccaggcagccucu

SEQ ID NO: 2124653 - RNA, 21 nt, Homo sapiens
aggauuuguguuuuacaguau

SEQ ID NO: 2124654 - RNA, 10 nt, Homo sapiens
uuacauacac

SEQ ID NO: 2124655 - RNA, 21 nt, Homo sapiens
aauaccccuucucuguagcug

SEQ ID NO: 2124656 - RNA, 21 nt, Homo sapiens
uuccuggaccagugaccaaac

SEQ ID NO: 2124657 - RNA, 21 nt, Homo sapiens
guccuccagaaagcaccaagg

SEQ ID NO: 2124658 - RNA, 21 nt, Homo sapiens
augccuuucuguaaccaaaaa

SEQ ID NO: 2124659 - RNA, 18 nt, Homo sapiens
uugggugcgguuugcuca

SEQ ID NO: 2124660 - RNA, 16 nt, Homo sapiens
uauguauaacuuuaac

SEQ ID NO: 2124661 - RNA, 13 nt, Homo sapiens
aaaaccccagugu

SEQ ID NO: 2124662 - RNA, 19 nt, Homo sapiens
gaaaccuaaggcaacauuu

SEQ ID NO: 2124663 - RNA, 21 nt, Homo sapiens
acuccagccugggcaacaaga

SEQ ID NO: 2124664 - RNA, 18 nt, Homo sapiens
ucuggaaaagcuggggua

SEQ ID NO: 2124665 - RNA, 16 nt, Homo sapiens
gacagauggacacugc

SEQ ID NO: 2124666 - RNA, 21 nt, Homo sapiens
aucugagggagacugcaaaug

SEQ ID NO: 2124667 - RNA, 19 nt, Homo sapiens
uccaaaggcguauguauua

SEQ ID NO: 2124668 - RNA, 22 nt, Homo sapiens
guugagauuuuuaagaacuuca

SEQ ID NO: 2124669 - RNA, 23 nt, Homo sapiens
ccgcagaagcccugauguguccu

SEQ ID NO: 2124670 - RNA, 16 nt, Homo sapiens
gacuccuccuguggaa

SEQ ID NO: 2124671 - RNA, 13 nt, Homo sapiens
accugggaaauca

SEQ ID NO: 2124672 - RNA, 13 nt, Homo sapiens
aauuauguggauc

SEQ ID NO: 2124673 - RNA, 15 nt, Homo sapiens
cagcuuacugcagca

SEQ ID NO: 2124674 - RNA, 23 nt, Homo sapiens
ugcuauuuuugaagcagaugugg

SEQ ID NO: 2124675 - RNA, 14 nt, Homo sapiens
auucucagcacuuu

SEQ ID NO: 2124676 - RNA, 13 nt, Homo sapiens
uuacaacaaacac

SEQ ID NO: 2124677 - RNA, 21 nt, Homo sapiens
gccacccccaggcaucuguua

SEQ ID NO: 2124678 - RNA, 14 nt, Homo sapiens
ccuggaauuuaauu

SEQ ID NO: 2124679 - RNA, 19 nt, Homo sapiens
gaggcuggaccacacagga

SEQ ID NO: 2124680 - RNA, 21 nt, Homo sapiens
agccauauaaguuugaaggaa

SEQ ID NO: 2124681 - RNA, 16 nt, Homo sapiens
ugaucuugcaaaacag

SEQ ID NO: 2124682 - RNA, 19 nt, Homo sapiens
ucaggaggagauuaacaca

SEQ ID NO: 2124683 - RNA, 23 nt, Homo sapiens
gcuuugauggaggagguauugua

SEQ ID NO: 2124684 - RNA, 19 nt, Homo sapiens
cugaaaaucuggugcucaa

SEQ ID NO: 2124685 - RNA, 18 nt, Homo sapiens
ucauguaccucugauuaa

SEQ ID NO: 2124686 - RNA, 19 nt, Homo sapiens
gcaccuugggcacgggaga

SEQ ID NO: 2124687 - RNA, 19 nt, Homo sapiens
auaaucacauuaucaucug

SEQ ID NO: 2124688 - RNA, 14 nt, Homo sapiens
agccccuccaaagg

SEQ ID NO: 2124689 - RNA, 17 nt, Homo sapiens
acagguucuuaaaaagg

SEQ ID NO: 2124690 - RNA, 14 nt, Homo sapiens
aaauuaacuuuaca

SEQ ID NO: 2124691 - RNA, 14 nt, Homo sapiens
uagcuuaacuaauu

SEQ ID NO: 2124692 - RNA, 19 nt, Homo sapiens
ccauagaaauguagguccu

SEQ ID NO: 2124693 - RNA, 23 nt, Homo sapiens
cauguugcaaagaacuccagagu

SEQ ID NO: 2124694 - RNA, 17 nt, Homo sapiens
cuacuuccccauuucag

SEQ ID NO: 2124695 - RNA, 16 nt, Homo sapiens
aaagaaagcugagaag

SEQ ID NO: 2124696 - RNA, 15 nt, Homo sapiens
uugacacggccauga

SEQ ID NO: 2124697 - RNA, 16 nt, Homo sapiens
caccuccugcaauaaa

SEQ ID NO: 2124698 - RNA, 13 nt, Homo sapiens
cagagaagccaaa

SEQ ID NO: 2124699 - RNA, 18 nt, Homo sapiens
uaaagugacccugcucuc

SEQ ID NO: 2124700 - RNA, 17 nt, Homo sapiens
uagcuuugggugccuuu

SEQ ID NO: 2124701 - RNA, 16 nt, Homo sapiens
agucaaaagagagaag

SEQ ID NO: 2124702 - RNA, 16 nt, Homo sapiens
ucugcacuauguuucc

SEQ ID NO: 2124703 - RNA, 21 nt, Homo sapiens
uaaucugggccagaauuucaa

SEQ ID NO: 2124704 - RNA, 14 nt, Homo sapiens
ucuucucacuuuuu

SEQ ID NO: 2124705 - RNA, 15 nt, Homo sapiens
uccccugucccacca

SEQ ID NO: 2124706 - RNA, 19 nt, Homo sapiens
guccucuggggccuucggg

SEQ ID NO: 2124707 - RNA, 16 nt, Homo sapiens
uggggccugugcacug

SEQ ID NO: 2124708 - RNA, 18 nt, Homo sapiens
cuacaugggccagcccuu

SEQ ID NO: 2124709 - RNA, 20 nt, Homo sapiens
ccuguauucuucaaccagug

SEQ ID NO: 2124710 - RNA, 16 nt, Homo sapiens
cuuagugaucauuuaa

SEQ ID NO: 2124711 - RNA, 15 nt, Homo sapiens
ucuuaaaucugugaa

SEQ ID NO: 2124712 - RNA, 22 nt, Homo sapiens
guuuuauuuucaaaaccagguc

SEQ ID NO: 2124713 - RNA, 21 nt, Homo sapiens
cccagagaggggacauuuccc

SEQ ID NO: 2124714 - RNA, 13 nt, Homo sapiens
uuucuacacuuua

SEQ ID NO: 2124715 - RNA, 14 nt, Homo sapiens
caaauaauuuguau

SEQ ID NO: 2124716 - RNA, 21 nt, Homo sapiens
cucaaacggcaacauuccuca

SEQ ID NO: 2124717 - RNA, 12 nt, Homo sapiens
uuugguacuaau

SEQ ID NO: 2124718 - RNA, 17 nt, Homo sapiens
acacaaugccuacuuca

SEQ ID NO: 2124719 - RNA, 15 nt, Homo sapiens
ugaacucuuaggcac

SEQ ID NO: 2124720 - RNA, 17 nt, Homo sapiens
ggcucagaucucauggg

SEQ ID NO: 2124721 - RNA, 19 nt, Homo sapiens
uugugaauagaacucugaa

SEQ ID NO: 2124722 - RNA, 14 nt, Homo sapiens
aaggccacacuggc

SEQ ID NO: 2124723 - RNA, 16 nt, Homo sapiens
gcccucaggcaccugc

SEQ ID NO: 2124724 - RNA, 17 nt, Homo sapiens
augguagacaauuugcc

SEQ ID NO: 2124725 - RNA, 18 nt, Homo sapiens
cuagggccuuuuguggau

SEQ ID NO: 2124726 - RNA, 20 nt, Homo sapiens
ugcacaaauggaacucccca

SEQ ID NO: 2124727 - RNA, 18 nt, Homo sapiens
uccauaaauccuugauga

SEQ ID NO: 2124728 - RNA, 16 nt, Homo sapiens
ccaugcuagacaagcu

SEQ ID NO: 2124729 - RNA, 16 nt, Homo sapiens
uguaaaggucacuuuu

SEQ ID NO: 2124730 - RNA, 19 nt, Homo sapiens
ucaauuccaucagcacaaa

SEQ ID NO: 2124731 - RNA, 23 nt, Homo sapiens
uagccaucccaugaacacacugu

SEQ ID NO: 2124732 - RNA, 15 nt, Homo sapiens
ggcgguggaccaaag

SEQ ID NO: 2124733 - RNA, 19 nt, Homo sapiens
agucuggccacugucaagg

SEQ ID NO: 2124734 - RNA, 20 nt, Homo sapiens
guuggcuagacuagucucaa

SEQ ID NO: 2124735 - RNA, 12 nt, Homo sapiens
cccccagcacuu

SEQ ID NO: 2124736 - RNA, 13 nt, Homo sapiens
cagguuugcugug

SEQ ID NO: 2124737 - RNA, 20 nt, Homo sapiens
ucgacguuugacuagccauc

SEQ ID NO: 2124738 - RNA, 18 nt, Homo sapiens
aacugaaggcuaaaaagc

SEQ ID NO: 2124739 - RNA, 13 nt, Homo sapiens
agcugcacccuca

SEQ ID NO: 2124740 - RNA, 20 nt, Homo sapiens
gcgcacagcaugagaggcuc

SEQ ID NO: 2124741 - RNA, 21 nt, Homo sapiens
cuuaugguuuuaaugcaauga

SEQ ID NO: 2124742 - RNA, 14 nt, Homo sapiens
gaaacaaaugaaau

SEQ ID NO: 2124743 - RNA, 18 nt, Homo sapiens
ucuuucugcuuacaaaga

SEQ ID NO: 2124744 - RNA, 15 nt, Homo sapiens
gcuuaacccuggaaa

SEQ ID NO: 2124745 - RNA, 17 nt, Homo sapiens
aagaaacuaaacagaaa

SEQ ID NO: 2124746 - RNA, 22 nt, Homo sapiens
ggaugacauagccaauggacaa

SEQ ID NO: 2124747 - RNA, 11 nt, Homo sapiens
ccacaucuaag

SEQ ID NO: 2124748 - RNA, 14 nt, Homo sapiens
ccccaucugguccu

SEQ ID NO: 2124749 - RNA, 14 nt, Homo sapiens
ggguaucuggugac

SEQ ID NO: 2124750 - RNA, 16 nt, Homo sapiens
cuuuuauugugaauua

SEQ ID NO: 2124751 - RNA, 17 nt, Homo sapiens
uauuggauuuguccaaa

SEQ ID NO: 2124752 - RNA, 18 nt, Homo sapiens
acugucuguuguuuaccu

SEQ ID NO: 2124753 - RNA, 14 nt, Homo sapiens
auuuggguccagga

SEQ ID NO: 2124754 - RNA, 15 nt, Homo sapiens
caacuacugugauca

SEQ ID NO: 2124755 - RNA, 19 nt, Homo sapiens
uagcuucuucagagaucaa

SEQ ID NO: 2124756 - RNA, 14 nt, Homo sapiens
aacucauacagugg

SEQ ID NO: 2124757 - RNA, 18 nt, Homo sapiens
cucaucuacaagcauuug

SEQ ID NO: 2124758 - RNA, 16 nt, Homo sapiens
ggaggaaagcuugaag

SEQ ID NO: 2124759 - RNA, 14 nt, Homo sapiens
uguaagccaaguca

SEQ ID NO: 2124760 - RNA, 21 nt, Homo sapiens
cauauugauacaaacugugac

SEQ ID NO: 2124761 - RNA, 14 nt, Homo sapiens
gacgggacugcgga

SEQ ID NO: 2124762 - RNA, 17 nt, Homo sapiens
uuaucugagcugagcca

SEQ ID NO: 2124763 - RNA, 20 nt, Homo sapiens
agauuacuaacuguggacaa

SEQ ID NO: 2124764 - RNA, 15 nt, Homo sapiens
caauguggcaugacu

SEQ ID NO: 2124765 - RNA, 15 nt, Homo sapiens
ccacgcagugccugg

SEQ ID NO: 2124766 - RNA, 13 nt, Homo sapiens
cuugacauguaau

SEQ ID NO: 2124767 - RNA, 16 nt, Homo sapiens
cauucugcauugagaa

SEQ ID NO: 2124768 - RNA, 13 nt, Homo sapiens
cuuucucuuugcc

SEQ ID NO: 2124769 - RNA, 17 nt, Homo sapiens
ugugucauugacaaagc

SEQ ID NO: 2124770 - RNA, 14 nt, Homo sapiens
gcuggcagccaccc

SEQ ID NO: 2124771 - RNA, 15 nt, Homo sapiens
aaagaauucucuugc

SEQ ID NO: 2124772 - RNA, 17 nt, Homo sapiens
cucagaaaagugacagu

SEQ ID NO: 2124773 - RNA, 19 nt, Homo sapiens
gcauucucuauagagccaa

SEQ ID NO: 2124774 - RNA, 18 nt, Homo sapiens
uuuaauacaggaacacac

SEQ ID NO: 2124775 - RNA, 13 nt, Homo sapiens
ccuccugcugcag

SEQ ID NO: 2124776 - RNA, 18 nt, Homo sapiens
uuucacuuaaaaguauca

SEQ ID NO: 2124777 - RNA, 19 nt, Homo sapiens
cucacucugcaaccuccac

SEQ ID NO: 2124778 - RNA, 13 nt, Homo sapiens
aagaagagacugc

SEQ ID NO: 2124779 - RNA, 21 nt, Homo sapiens
uacggauugcugcaaaccaca

SEQ ID NO: 2124780 - RNA, 15 nt, Homo sapiens
aaagaaacacgcacu

SEQ ID NO: 2124781 - RNA, 16 nt, Homo sapiens
cugcaaucacugugcu

SEQ ID NO: 2124782 - RNA, 19 nt, Homo sapiens
ccuggagggggaauggcag

SEQ ID NO: 2124783 - RNA, 17 nt, Homo sapiens
aaguucaacuuccagaa

SEQ ID NO: 2124784 - RNA, 18 nt, Homo sapiens
cugucaaaugucacagau

SEQ ID NO: 2124785 - RNA, 18 nt, Homo sapiens
cuucugcuuucucgggaa

SEQ ID NO: 2124786 - RNA, 22 nt, Homo sapiens
acauccuuucuuuuaaugaugc

SEQ ID NO: 2124787 - RNA, 17 nt, Homo sapiens
aacugcacacucagugg

SEQ ID NO: 2124788 - RNA, 16 nt, Homo sapiens
auuuugaaccauguga

SEQ ID NO: 2124789 - RNA, 18 nt, Homo sapiens
ugucccccaacuugagau

SEQ ID NO: 2124790 - RNA, 20 nt, Homo sapiens
agggcuaguuaauccaaaca

SEQ ID NO: 2124791 - RNA, 19 nt, Homo sapiens
agagggugggguacuggag

SEQ ID NO: 2124792 - RNA, 13 nt, Homo sapiens
ucugaagauguca

SEQ ID NO: 2124793 - RNA, 21 nt, Homo sapiens
gagccaugauuucccacugca

SEQ ID NO: 2124794 - RNA, 18 nt, Homo sapiens
augccaaacacuagcucu

SEQ ID NO: 2124795 - RNA, 19 nt, Homo sapiens
cauuccugaagaaccaguc

SEQ ID NO: 2124796 - RNA, 21 nt, Homo sapiens
cauuucaccauucaaacaggu

SEQ ID NO: 2124797 - RNA, 15 nt, Homo sapiens
ccaauccucacuccc

SEQ ID NO: 2124798 - RNA, 23 nt, Homo sapiens
ucaccauccuggaaggaaacugu

SEQ ID NO: 2124799 - RNA, 16 nt, Homo sapiens
augcuucugagagcaa

SEQ ID NO: 2124800 - RNA, 15 nt, Homo sapiens
aaauugauguuacug

SEQ ID NO: 2124801 - RNA, 13 nt, Homo sapiens
uccaggaagccuu

SEQ ID NO: 2124802 - RNA, 23 nt, Homo sapiens
ucacaagaacaaauacacuuuau

SEQ ID NO: 2124803 - RNA, 17 nt, Homo sapiens
uggugauugucauguaa

SEQ ID NO: 2124804 - RNA, 16 nt, Homo sapiens
gagauggggguguauu

SEQ ID NO: 2124805 - RNA, 19 nt, Homo sapiens
uccccucagcgggggccuu

SEQ ID NO: 2124806 - RNA, 14 nt, Homo sapiens
gaaguaggcauaua

SEQ ID NO: 2124807 - RNA, 20 nt, Homo sapiens
aaaauguugcucugggagac

SEQ ID NO: 2124808 - RNA, 20 nt, Homo sapiens
agggcauucgggccacaggg

SEQ ID NO: 2124809 - RNA, 21 nt, Homo sapiens
guggacaugcgugaccagcag

SEQ ID NO: 2124810 - RNA, 23 nt, Homo sapiens
auggcugccaaugggagcucaug

SEQ ID NO: 2124811 - RNA, 19 nt, Homo sapiens
guuugauucugaguauuca

SEQ ID NO: 2124812 - RNA, 16 nt, Homo sapiens
agguugaaaauguuau

SEQ ID NO: 2124813 - RNA, 22 nt, Homo sapiens
ggaggagcugccgcaaggcccu

SEQ ID NO: 2124814 - RNA, 18 nt, Homo sapiens
uaaggggcaccugggaaa

SEQ ID NO: 2124815 - RNA, 21 nt, Homo sapiens
ucaccugcgcagggcccucug

SEQ ID NO: 2124816 - RNA, 15 nt, Homo sapiens
cucuaaaagaaaaag

SEQ ID NO: 2124817 - RNA, 19 nt, Homo sapiens
uggugaauuugaaucucaa

SEQ ID NO: 2124818 - RNA, 23 nt, Homo sapiens
acacagcucuuuaacaugguuca

SEQ ID NO: 2124819 - RNA, 18 nt, Homo sapiens
caacgcuauuccagcugu

SEQ ID NO: 2124820 - RNA, 23 nt, Homo sapiens
ggugggcggcacagccuucucca

SEQ ID NO: 2124821 - RNA, 13 nt, Homo sapiens
aauggucaaugcu

SEQ ID NO: 2124822 - RNA, 14 nt, Homo sapiens
aacauuugcucugg

SEQ ID NO: 2124823 - RNA, 15 nt, Homo sapiens
ggaagguauuuaaua

SEQ ID NO: 2124824 - RNA, 14 nt, Homo sapiens
guagaaugcuguag

SEQ ID NO: 2124825 - RNA, 13 nt, Homo sapiens
ccagucacagcca

SEQ ID NO: 2124826 - RNA, 23 nt, Homo sapiens
uucugucugggcucagacaucca

SEQ ID NO: 2124827 - RNA, 11 nt, Homo sapiens
gaggggagcag

SEQ ID NO: 2124828 - RNA, 17 nt, Homo sapiens
auuggguaugaacuaaa

SEQ ID NO: 2124829 - RNA, 20 nt, Homo sapiens
cauucugauucgaaugacac

SEQ ID NO: 2124830 - RNA, 18 nt, Homo sapiens
gccuugguaaaaacugca

SEQ ID NO: 2124831 - RNA, 13 nt, Homo sapiens
gagaaagucaccu

SEQ ID NO: 2124832 - RNA, 19 nt, Homo sapiens
aaaacuacaaccaauggaa

SEQ ID NO: 2124833 - RNA, 22 nt, Homo sapiens
uuugccuucucuaaacauuuca

SEQ ID NO: 2124834 - RNA, 16 nt, Homo sapiens
cauuuucucuaccuuc

SEQ ID NO: 2124835 - RNA, 17 nt, Homo sapiens
gacagagagaggcauuu

SEQ ID NO: 2124836 - RNA, 22 nt, Homo sapiens
augcauggugccccaggaccag

SEQ ID NO: 2124837 - RNA, 15 nt, Homo sapiens
guccugaggccaaga

SEQ ID NO: 2124838 - RNA, 21 nt, Homo sapiens
ccaucaagggucauggcagug

SEQ ID NO: 2124839 - RNA, 19 nt, Homo sapiens
uuuauguguugaugacuca

SEQ ID NO: 2124840 - RNA, 15 nt, Homo sapiens
cccgauagugacaca

SEQ ID NO: 2124841 - RNA, 15 nt, Homo sapiens
ccagauugugccacu

SEQ ID NO: 2124842 - RNA, 13 nt, Homo sapiens
ggugguaccugag

SEQ ID NO: 2124843 - RNA, 15 nt, Homo sapiens
gcacauuucuuugca

SEQ ID NO: 2124844 - RNA, 23 nt, Homo sapiens
ugggaauacaggggugaaagggg

SEQ ID NO: 2124845 - RNA, 19 nt, Homo sapiens
gauguacaaaacaguuuga

SEQ ID NO: 2124846 - RNA, 17 nt, Homo sapiens
aacaauuuuuuccccaa

SEQ ID NO: 2124847 - RNA, 20 nt, Homo sapiens
ugccaggcuggagugcagug

SEQ ID NO: 2124848 - RNA, 24 nt, Homo sapiens
aaugggaauauuuuauacugacag

SEQ ID NO: 2124849 - RNA, 19 nt, Homo sapiens
auaucauaacuauacuuga

SEQ ID NO: 2124850 - RNA, 22 nt, Homo sapiens
ucucaggaccgugcccucguca

SEQ ID NO: 2124851 - RNA, 16 nt, Homo sapiens
cccccuuuccaaaaac

SEQ ID NO: 2124852 - RNA, 23 nt, Homo sapiens
acccuccugcgcaggccaugcau

SEQ ID NO: 2124853 - RNA, 17 nt, Homo sapiens
ccacacucagauccucc

SEQ ID NO: 2124854 - RNA, 20 nt, Homo sapiens
cauccuggccaacaugguga

SEQ ID NO: 2124855 - RNA, 15 nt, Homo sapiens
uggggagucagggac

SEQ ID NO: 2124856 - RNA, 17 nt, Homo sapiens
cugugcguggaaaaaga

SEQ ID NO: 2124857 - RNA, 14 nt, Homo sapiens
aggggacacuggcc

SEQ ID NO: 2124858 - RNA, 23 nt, Homo sapiens
ucaccuauguuauuuuguguaca

SEQ ID NO: 2124859 - RNA, 14 nt, Homo sapiens
ugcagucacugcac

SEQ ID NO: 2124860 - RNA, 20 nt, Homo sapiens
caaccgaacaugaccaaaaa

SEQ ID NO: 2124861 - RNA, 15 nt, Homo sapiens
cauggugaugcaagu

SEQ ID NO: 2124862 - RNA, 14 nt, Homo sapiens
aggaacugguccag

SEQ ID NO: 2124863 - RNA, 22 nt, Homo sapiens
agaaaaccauucuggacacugu

SEQ ID NO: 2124864 - RNA, 23 nt, Homo sapiens
acugaguccucguagccaucucu

SEQ ID NO: 2124865 - RNA, 16 nt, Homo sapiens
ccauacucaugcaugc

SEQ ID NO: 2124866 - RNA, 14 nt, Homo sapiens
uguaaugcugcaca

SEQ ID NO: 2124867 - RNA, 14 nt, Homo sapiens
accuaagcacuucu

SEQ ID NO: 2124868 - RNA, 14 nt, Homo sapiens
auuuaucucaaaaa

SEQ ID NO: 2124869 - RNA, 22 nt, Homo sapiens
auuacagauuaaagaagaaaag

SEQ ID NO: 2124870 - RNA, 21 nt, Homo sapiens
uguaugauccuaaugaaugca

SEQ ID NO: 2124871 - RNA, 12 nt, Homo sapiens
guaugugcucuu

SEQ ID NO: 2124872 - RNA, 17 nt, Homo sapiens
gauggccgggacaugca

SEQ ID NO: 2124873 - RNA, 12 nt, Homo sapiens
caaacuacugug

SEQ ID NO: 2124874 - RNA, 16 nt, Homo sapiens
augcauggugccccag

SEQ ID NO: 2124875 - RNA, 22 nt, Homo sapiens
guuuagaucugucccuuaauaa

SEQ ID NO: 2124876 - RNA, 13 nt, Homo sapiens
ucagauaugcuua

SEQ ID NO: 2124877 - RNA, 18 nt, Homo sapiens
uuguuauucuguaguuuc

SEQ ID NO: 2124878 - RNA, 18 nt, Homo sapiens
cuccagucccccuauccu

SEQ ID NO: 2124879 - RNA, 23 nt, Homo sapiens
ugucuugaguagacuuggaccca

SEQ ID NO: 2124880 - RNA, 15 nt, Homo sapiens
gccaaauaaaaucua

SEQ ID NO: 2124881 - RNA, 21 nt, Homo sapiens
auguguauuuuucaaggcauu

SEQ ID NO: 2124882 - RNA, 19 nt, Homo sapiens
ugggaauugcaugccaucu

SEQ ID NO: 2124883 - RNA, 13 nt, Homo sapiens
uuaguaauuguca

SEQ ID NO: 2124884 - RNA, 22 nt, Homo sapiens
aaaggagacaaguuccauggga

SEQ ID NO: 2124885 - RNA, 12 nt, Homo sapiens
ugggcacaacca

SEQ ID NO: 2124886 - RNA, 11 nt, Homo sapiens
aaagacaaauu

SEQ ID NO: 2124887 - RNA, 14 nt, Homo sapiens
uaggugugccaaac

SEQ ID NO: 2124888 - RNA, 11 nt, Homo sapiens
accccuaccuc

SEQ ID NO: 2124889 - RNA, 22 nt, Homo sapiens
caacuggugauuguuucagaga

SEQ ID NO: 2124890 - RNA, 13 nt, Homo sapiens
cagugauacucac

SEQ ID NO: 2124891 - RNA, 16 nt, Homo sapiens
gcgugugccugugugc

SEQ ID NO: 2124892 - RNA, 22 nt, Homo sapiens
acggcccuccugggaaccuccu

SEQ ID NO: 2124893 - RNA, 13 nt, Homo sapiens
cauccaggcugcc

SEQ ID NO: 2124894 - RNA, 14 nt, Homo sapiens
cucaauccuaucac

SEQ ID NO: 2124895 - RNA, 12 nt, Homo sapiens
acauacucccau

SEQ ID NO: 2124896 - RNA, 23 nt, Homo sapiens
auagaugcuggcccagggcccag

SEQ ID NO: 2124897 - RNA, 22 nt, Homo sapiens
ggcuucuuaaucuuuucacaaa

SEQ ID NO: 2124898 - RNA, 22 nt, Homo sapiens
cuuuccugaucaaggugcucuu

SEQ ID NO: 2124899 - RNA, 15 nt, Homo sapiens
agggcacacacugug

SEQ ID NO: 2124900 - RNA, 16 nt, Homo sapiens
acacaugggcuuguga

SEQ ID NO: 2124901 - RNA, 15 nt, Homo sapiens
uguucacccacaucu

SEQ ID NO: 2124902 - RNA, 14 nt, Homo sapiens
ugaaugaugccuuu

SEQ ID NO: 2124903 - RNA, 22 nt, Homo sapiens
caguaacacagugcagugcuca

SEQ ID NO: 2124904 - RNA, 22 nt, Homo sapiens
ugaaagguuggccuuacuguug

SEQ ID NO: 2124905 - RNA, 12 nt, Homo sapiens
ccagcaaagagu

SEQ ID NO: 2124906 - RNA, 19 nt, Homo sapiens
uacugcuaucuacuacaaa

SEQ ID NO: 2124907 - RNA, 18 nt, Homo sapiens
caguucucugccacccau

SEQ ID NO: 2124908 - RNA, 17 nt, Homo sapiens
cucaauaaagugcuuua

SEQ ID NO: 2124909 - RNA, 14 nt, Homo sapiens
uggcugcacagccc

SEQ ID NO: 2124910 - RNA, 18 nt, Homo sapiens
gugaauugaauggugcau

SEQ ID NO: 2124911 - RNA, 16 nt, Homo sapiens
cuuugcucucuggcca

SEQ ID NO: 2124912 - RNA, 19 nt, Homo sapiens
aagaaguuuuucuuugugu

SEQ ID NO: 2124913 - RNA, 17 nt, Homo sapiens
auucaucauagggauaa

SEQ ID NO: 2124914 - RNA, 19 nt, Homo sapiens
aauguucuuuugacugaag

SEQ ID NO: 2124915 - RNA, 17 nt, Homo sapiens
ccaaauugacauguugu

SEQ ID NO: 2124916 - RNA, 19 nt, Homo sapiens
acagcaacaugugacaaca

SEQ ID NO: 2124917 - RNA, 12 nt, Homo sapiens
gagcacuacaga

SEQ ID NO: 2124918 - RNA, 13 nt, Homo sapiens
uaaaaacugagug

SEQ ID NO: 2124919 - RNA, 13 nt, Homo sapiens
uuaugacugugaa

SEQ ID NO: 2124920 - RNA, 16 nt, Homo sapiens
uuaccaaacgauuccg

SEQ ID NO: 2124921 - RNA, 16 nt, Homo sapiens
ccagccaggggaacuc

SEQ ID NO: 2124922 - RNA, 13 nt, Homo sapiens
caugaugacucaa

SEQ ID NO: 2124923 - RNA, 17 nt, Homo sapiens
cugguccugcacugucc

SEQ ID NO: 2124924 - RNA, 13 nt, Homo sapiens
cucuugugcugag

SEQ ID NO: 2124925 - RNA, 16 nt, Homo sapiens
cuguaacagacuaauu

SEQ ID NO: 2124926 - RNA, 22 nt, Homo sapiens
uuaaaguggucugaacugcuug

SEQ ID NO: 2124927 - RNA, 22 nt, Homo sapiens
agagagucuuccagguacugau

SEQ ID NO: 2124928 - RNA, 19 nt, Homo sapiens
cgaaacccggugcaucugg

SEQ ID NO: 2124929 - RNA, 15 nt, Homo sapiens
ugcaguuaauacuua

SEQ ID NO: 2124930 - RNA, 13 nt, Homo sapiens
agacaaaaagcua

SEQ ID NO: 2124931 - RNA, 13 nt, Homo sapiens
uccuaaaaucaca

SEQ ID NO: 2124932 - RNA, 12 nt, Homo sapiens
ugcaaaggugag

SEQ ID NO: 2124933 - RNA, 14 nt, Homo sapiens
agguucaagcgauu

SEQ ID NO: 2124934 - RNA, 16 nt, Homo sapiens
aaagcuucacaguacc

SEQ ID NO: 2124935 - RNA, 17 nt, Homo sapiens
cagcaauggcgcugugc

SEQ ID NO: 2124936 - RNA, 16 nt, Homo sapiens
ccagcuuuaucuguca

SEQ ID NO: 2124937 - RNA, 20 nt, Homo sapiens
uagaguaaacuauucuauaa

SEQ ID NO: 2124938 - RNA, 16 nt, Homo sapiens
gaacauuauucaucuc

SEQ ID NO: 2124939 - RNA, 13 nt, Homo sapiens
gcaaauugcaauc

SEQ ID NO: 2124940 - RNA, 19 nt, Homo sapiens
uucaugugcagauugcagu

SEQ ID NO: 2124941 - RNA, 15 nt, Homo sapiens
ucaggacgccuggag

SEQ ID NO: 2124942 - RNA, 13 nt, Homo sapiens
cugggauggggca

SEQ ID NO: 2124943 - RNA, 14 nt, Homo sapiens
uccacacacaguaa

SEQ ID NO: 2124944 - RNA, 18 nt, Homo sapiens
aagacuugauacugcaau

SEQ ID NO: 2124945 - RNA, 21 nt, Homo sapiens
ucauauuaagaaacaccugua

SEQ ID NO: 2124946 - RNA, 17 nt, Homo sapiens
agggaaguaguuaucau

SEQ ID NO: 2124947 - RNA, 19 nt, Homo sapiens
ugaauacagcauuuagcuu

SEQ ID NO: 2124948 - RNA, 18 nt, Homo sapiens
cugcaucccgauaccuca

SEQ ID NO: 2124949 - RNA, 19 nt, Homo sapiens
aauguaauagccaaaccca

SEQ ID NO: 2124950 - RNA, 15 nt, Homo sapiens
acagcacuaauucaa

SEQ ID NO: 2124951 - RNA, 18 nt, Homo sapiens
cucugugggcuccaugua

SEQ ID NO: 2124952 - RNA, 15 nt, Homo sapiens
uauuauuugcagauu

SEQ ID NO: 2124953 - RNA, 18 nt, Homo sapiens
cuauaaaucaacaccuua

SEQ ID NO: 2124954 - RNA, 20 nt, Homo sapiens
aguuauuaccuuuacauauu

SEQ ID NO: 2124955 - RNA, 13 nt, Homo sapiens
acaaacacaagca

SEQ ID NO: 2124956 - RNA, 16 nt, Homo sapiens
cuuccacuucaggguu

SEQ ID NO: 2124957 - RNA, 17 nt, Homo sapiens
gaaggaaggagccagcu

SEQ ID NO: 2124958 - RNA, 23 nt, Homo sapiens
aaccaccuuuucugcuucaauau

SEQ ID NO: 2124959 - RNA, 17 nt, Homo sapiens
auaaacagucuaaagaa

SEQ ID NO: 2124960 - RNA, 16 nt, Homo sapiens
caaauucauggugcac

SEQ ID NO: 2124961 - RNA, 13 nt, Homo sapiens
gagacaaagcagg

SEQ ID NO: 2124962 - RNA, 15 nt, Homo sapiens
uccuugcuuguuaca

SEQ ID NO: 2124963 - RNA, 20 nt, Homo sapiens
ccuccaaaagcccugaguuu

SEQ ID NO: 2124964 - RNA, 20 nt, Homo sapiens
ggucagagagggaagcugag

SEQ ID NO: 2124965 - RNA, 16 nt, Homo sapiens
ugacaagggcccuucu

SEQ ID NO: 2124966 - RNA, 17 nt, Homo sapiens
aaaggcugcuguacuga

SEQ ID NO: 2124967 - RNA, 21 nt, Homo sapiens
caacucuccccugaccuguga

SEQ ID NO: 2124968 - RNA, 22 nt, Homo sapiens
gaaaucuaccaagcuugcaaga

SEQ ID NO: 2124969 - RNA, 15 nt, Homo sapiens
gugggaggaugugaa

SEQ ID NO: 2124970 - RNA, 23 nt, Homo sapiens
uggaucugcccccuuuacuccuc

SEQ ID NO: 2124971 - RNA, 15 nt, Homo sapiens
gucucauuugggcua

SEQ ID NO: 2124972 - RNA, 15 nt, Homo sapiens
uuuuguauaauugua

SEQ ID NO: 2124973 - RNA, 20 nt, Homo sapiens
ccaucuuuaaucaaugugac

SEQ ID NO: 2124974 - RNA, 23 nt, Homo sapiens
gaacucaaaaggagaacugugcu

SEQ ID NO: 2124975 - RNA, 14 nt, Homo sapiens
uugauccaggagau

SEQ ID NO: 2124976 - RNA, 22 nt, Homo sapiens
gucuucuuuuguggugucuucc

SEQ ID NO: 2124977 - RNA, 22 nt, Homo sapiens
ggccuccuguggccugccaguc

SEQ ID NO: 2124978 - RNA, 18 nt, Homo sapiens
uaugaaaaucuccaucuc

SEQ ID NO: 2124979 - RNA, 19 nt, Homo sapiens
acuguuugauauaccaaau

SEQ ID NO: 2124980 - RNA, 18 nt, Homo sapiens
acaccagagccucaguga

SEQ ID NO: 2124981 - RNA, 17 nt, Homo sapiens
aauuuuauuacauauga

SEQ ID NO: 2124982 - RNA, 16 nt, Homo sapiens
ccaggcacugcccuuu

SEQ ID NO: 2124983 - RNA, 18 nt, Homo sapiens
ccugcagccucaucauuu

SEQ ID NO: 2124984 - RNA, 14 nt, Homo sapiens
gauggggcucccag

SEQ ID NO: 2124985 - RNA, 22 nt, Homo sapiens
cccugcuugcuggaaaacugcc

SEQ ID NO: 2124986 - RNA, 20 nt, Homo sapiens
gucauaaugguuuuuaacac

SEQ ID NO: 2124987 - RNA, 18 nt, Homo sapiens
aaccuguccauaaaguaa

SEQ ID NO: 2124988 - RNA, 22 nt, Homo sapiens
uauaaauauccugcucacaucu

SEQ ID NO: 2124989 - RNA, 19 nt, Homo sapiens
augggccuuuaagaaccuu

SEQ ID NO: 2124990 - RNA, 13 nt, Homo sapiens
acucuuaagccau

SEQ ID NO: 2124991 - RNA, 15 nt, Homo sapiens
acaggacuagcugga

SEQ ID NO: 2124992 - RNA, 22 nt, Homo sapiens
cauacaacuucauauaacugag

SEQ ID NO: 2124993 - RNA, 21 nt, Homo sapiens
ggaacaugacccagccugaaa

SEQ ID NO: 2124994 - RNA, 20 nt, Homo sapiens
cugagugaggaguggacgcu

SEQ ID NO: 2124995 - RNA, 13 nt, Homo sapiens
ugucagauccagg

SEQ ID NO: 2124996 - RNA, 17 nt, Homo sapiens
accaaaaauguucuuca

SEQ ID NO: 2124997 - RNA, 17 nt, Homo sapiens
uuggaggaaaugugcuc

SEQ ID NO: 2124998 - RNA, 18 nt, Homo sapiens
ugcagcagggaugcccug

SEQ ID NO: 2124999 - RNA, 22 nt, Homo sapiens
gauauaaucuuucaaaccagcu

SEQ ID NO: 2125000 - RNA, 22 nt, Homo sapiens
ccuguuuucgcaccuaccauca

SEQ ID NO: 2125001 - RNA, 15 nt, Homo sapiens
cugccuucuggaaua

SEQ ID NO: 2125002 - RNA, 14 nt, Homo sapiens
caaaugaaacuuua

SEQ ID NO: 2125003 - RNA, 13 nt, Homo sapiens
ugauuugucuuac

SEQ ID NO: 2125004 - RNA, 21 nt, Homo sapiens
gucgcuggguccucugcagug

SEQ ID NO: 2125005 - RNA, 16 nt, Homo sapiens
uauaagcagcaagaca

SEQ ID NO: 2125006 - RNA, 18 nt, Homo sapiens
agggcagagaauggcugg

SEQ ID NO: 2125007 - RNA, 18 nt, Homo sapiens
guagauuuuaaaagauaa

SEQ ID NO: 2125008 - RNA, 14 nt, Homo sapiens
agguccaaauucac

SEQ ID NO: 2125009 - RNA, 16 nt, Homo sapiens
cugucuagacuggccu

SEQ ID NO: 2125010 - RNA, 17 nt, Homo sapiens
gccagcuuuuccagaaa

SEQ ID NO: 2125011 - RNA, 20 nt, Homo sapiens
aauaaaagcuauuacuuggc

SEQ ID NO: 2125012 - RNA, 24 nt, Homo sapiens
uuaauaaauuaaaacaugcacaaa

SEQ ID NO: 2125013 - RNA, 18 nt, Homo sapiens
ucaaaacuguacugucuu

SEQ ID NO: 2125014 - RNA, 16 nt, Homo sapiens
aauugcaguucaguuc

SEQ ID NO: 2125015 - RNA, 16 nt, Homo sapiens
gcuacauauaugcaau

SEQ ID NO: 2125016 - RNA, 15 nt, Homo sapiens
uccucaaaacuggag

SEQ ID NO: 2125017 - RNA, 17 nt, Homo sapiens
ggucaggggugacacag

SEQ ID NO: 2125018 - RNA, 14 nt, Homo sapiens
ucccaccccuccau

SEQ ID NO: 2125019 - RNA, 18 nt, Homo sapiens
ccguuugcuuaaugccag

SEQ ID NO: 2125020 - RNA, 17 nt, Homo sapiens
aaaaaucugagaaacuc

SEQ ID NO: 2125021 - RNA, 20 nt, Homo sapiens
auguuaaucacauuccuacc

SEQ ID NO: 2125022 - RNA, 12 nt, Homo sapiens
ugguucaugccu

SEQ ID NO: 2125023 - RNA, 16 nt, Homo sapiens
aaugaaacacuuucag

SEQ ID NO: 2125024 - RNA, 16 nt, Homo sapiens
cuaaaauaaacaugaa

SEQ ID NO: 2125025 - RNA, 16 nt, Homo sapiens
aaaccaauagcuuuaa

SEQ ID NO: 2125026 - RNA, 19 nt, Homo sapiens
auguauuuugaaaacacuu

SEQ ID NO: 2125027 - RNA, 14 nt, Homo sapiens
ccccuguugugugg

SEQ ID NO: 2125028 - RNA, 14 nt, Homo sapiens
ugaacauaaagccu

SEQ ID NO: 2125029 - RNA, 19 nt, Homo sapiens
gcccaggucaacaucuaag

SEQ ID NO: 2125030 - RNA, 19 nt, Homo sapiens
aaauuuucucuaaacuguu

SEQ ID NO: 2125031 - RNA, 13 nt, Homo sapiens
uuugucaaaaagc

SEQ ID NO: 2125032 - RNA, 22 nt, Homo sapiens
gaucagcuuucaaagcauuuac

SEQ ID NO: 2125033 - RNA, 18 nt, Homo sapiens
acaugcauacauacacau

SEQ ID NO: 2125034 - RNA, 18 nt, Homo sapiens
auugacucuguggcuuug

SEQ ID NO: 2125035 - RNA, 19 nt, Homo sapiens
guugaggccaggaguuuaa

SEQ ID NO: 2125036 - RNA, 15 nt, Homo sapiens
aacaaagcauuugac

SEQ ID NO: 2125037 - RNA, 17 nt, Homo sapiens
ccucuggcccccugaag

SEQ ID NO: 2125038 - RNA, 12 nt, Homo sapiens
gucugucuucaa

SEQ ID NO: 2125039 - RNA, 14 nt, Homo sapiens
gauaaaucauuuca

SEQ ID NO: 2125040 - RNA, 19 nt, Homo sapiens
caacuuugaaacuggaaua

SEQ ID NO: 2125041 - RNA, 20 nt, Homo sapiens
gacuugacagaacacugucu

SEQ ID NO: 2125042 - RNA, 12 nt, Homo sapiens
gcauagugccug

SEQ ID NO: 2125043 - RNA, 19 nt, Homo sapiens
guaaaguguaacauaugca

SEQ ID NO: 2125044 - RNA, 19 nt, Homo sapiens
gugcauuuugugugaugca

SEQ ID NO: 2125045 - RNA, 22 nt, Homo sapiens
cguuuguccuuuuucacuuuga

SEQ ID NO: 2125046 - RNA, 18 nt, Homo sapiens
gagcucauuuggggacca

SEQ ID NO: 2125047 - RNA, 15 nt, Homo sapiens
aaaggaaaagccaag

SEQ ID NO: 2125048 - RNA, 14 nt, Homo sapiens
cagagacucugaaa

SEQ ID NO: 2125049 - RNA, 14 nt, Homo sapiens
caggggcucuggag

SEQ ID NO: 2125050 - RNA, 14 nt, Homo sapiens
cauaggcucuuaag

SEQ ID NO: 2125051 - RNA, 15 nt, Homo sapiens
ccuguggugaagugu

SEQ ID NO: 2125052 - RNA, 11 nt, Homo sapiens
cgcucaggcau

SEQ ID NO: 2125053 - RNA, 11 nt, Homo sapiens
gacaacuggaa

SEQ ID NO: 2125054 - RNA, 12 nt, Homo sapiens
cgaugcauuuaa

SEQ ID NO: 2125055 - RNA, 19 nt, Homo sapiens
ugucaugaggaaacuacug

SEQ ID NO: 2125056 - RNA, 12 nt, Homo sapiens
uaggaacagcuc

SEQ ID NO: 2125057 - RNA, 17 nt, Homo sapiens
cggacuauacugcugag

SEQ ID NO: 2125058 - RNA, 17 nt, Homo sapiens
uuauagaaucuacuuua

SEQ ID NO: 2125059 - RNA, 21 nt, Homo sapiens
uucaauaaaacgcaguugcaa

SEQ ID NO: 2125060 - RNA, 16 nt, Homo sapiens
cagugaggcaucucuc

SEQ ID NO: 2125061 - RNA, 18 nt, Homo sapiens
uugagcugcugacugcca

SEQ ID NO: 2125062 - RNA, 19 nt, Homo sapiens
cugaacucugacaacagac

SEQ ID NO: 2125063 - RNA, 19 nt, Homo sapiens
uugccucaacuccaggauu

SEQ ID NO: 2125064 - RNA, 19 nt, Homo sapiens
gaacaaguuguuucauuga

SEQ ID NO: 2125065 - RNA, 22 nt, Homo sapiens
uggacuuccagugcucagaggg

SEQ ID NO: 2125066 - RNA, 23 nt, Homo sapiens
ggaacugccuuauuaaagcaaaa

SEQ ID NO: 2125067 - RNA, 22 nt, Homo sapiens
uaaaugugguacaagcauucug

SEQ ID NO: 2125068 - RNA, 18 nt, Homo sapiens
ucagagaaauacuuucag

SEQ ID NO: 2125069 - RNA, 15 nt, Homo sapiens
ucacuguucuaucuc

SEQ ID NO: 2125070 - RNA, 22 nt, Homo sapiens
caagguggccacagugucacug

SEQ ID NO: 2125071 - RNA, 18 nt, Homo sapiens
cagucccuaaaaacacag

SEQ ID NO: 2125072 - RNA, 15 nt, Homo sapiens
aguucggcucugggu

SEQ ID NO: 2125073 - RNA, 14 nt, Homo sapiens
uaauggaauuuaga

SEQ ID NO: 2125074 - RNA, 21 nt, Homo sapiens
ccauggauacccaucacuuug

SEQ ID NO: 2125075 - RNA, 10 nt, Homo sapiens
agccauaaau

SEQ ID NO: 2125076 - RNA, 17 nt, Homo sapiens
gcaaugcaauguggaaa

SEQ ID NO: 2125077 - RNA, 13 nt, Homo sapiens
uagaacaaaaacu

SEQ ID NO: 2125078 - RNA, 19 nt, Homo sapiens
uuuaaauggagacuggaaa

SEQ ID NO: 2125079 - RNA, 21 nt, Homo sapiens
aauuuaauuucuucaugugau

SEQ ID NO: 2125080 - RNA, 21 nt, Homo sapiens
uauauaaagacaacaaaagaa

SEQ ID NO: 2125081 - RNA, 17 nt, Homo sapiens
cguggccgcugcuguga

SEQ ID NO: 2125082 - RNA, 12 nt, Homo sapiens
ccacugccagac

SEQ ID NO: 2125083 - RNA, 14 nt, Homo sapiens
cagaaaauaccuua

SEQ ID NO: 2125084 - RNA, 20 nt, Homo sapiens
gucuuucacagcuccuccca

SEQ ID NO: 2125085 - RNA, 15 nt, Homo sapiens
accacugcacccacc

SEQ ID NO: 2125086 - RNA, 18 nt, Homo sapiens
uguuaucuucacuuuuau

SEQ ID NO: 2125087 - RNA, 20 nt, Homo sapiens
ugaguacucauaaaggacac

SEQ ID NO: 2125088 - RNA, 19 nt, Homo sapiens
aacaacuuucucuuguaaa

SEQ ID NO: 2125089 - RNA, 19 nt, Homo sapiens
aaucaccucuaaaaaccaa

SEQ ID NO: 2125090 - RNA, 16 nt, Homo sapiens
cacuauucucugccuu

SEQ ID NO: 2125091 - RNA, 17 nt, Homo sapiens
cggcggagauugcagug

SEQ ID NO: 2125092 - RNA, 12 nt, Homo sapiens
ccagauguggug

SEQ ID NO: 2125093 - RNA, 22 nt, Homo sapiens
cacacagcacuaacacaugcac

SEQ ID NO: 2125094 - RNA, 12 nt, Homo sapiens
aaaaguaauauu

SEQ ID NO: 2125095 - RNA, 14 nt, Homo sapiens
cgagugacagaagg

SEQ ID NO: 2125096 - RNA, 18 nt, Homo sapiens
gaaacagaagacaaaauu

SEQ ID NO: 2125097 - RNA, 14 nt, Homo sapiens
uucuagagacaaca

SEQ ID NO: 2125098 - RNA, 13 nt, Homo sapiens
guucagaccuuca

SEQ ID NO: 2125099 - RNA, 17 nt, Homo sapiens
uguuucagcuaaaugca

SEQ ID NO: 2125100 - RNA, 18 nt, Homo sapiens
uaagacagagaaacagac

SEQ ID NO: 2125101 - RNA, 21 nt, Homo sapiens
cauuaggguaauaucaucuca

SEQ ID NO: 2125102 - RNA, 20 nt, Homo sapiens
uugacaucagcaucaccuag

SEQ ID NO: 2125103 - RNA, 13 nt, Homo sapiens
cucugaccuuuca

SEQ ID NO: 2125104 - RNA, 23 nt, Homo sapiens
gcauuacucugcacuauagccau

SEQ ID NO: 2125105 - RNA, 16 nt, Homo sapiens
cuuucuugaagaacaa

SEQ ID NO: 2125106 - RNA, 19 nt, Homo sapiens
gucccaccccuaccucuag

SEQ ID NO: 2125107 - RNA, 14 nt, Homo sapiens
gcaacggcccucca

SEQ ID NO: 2125108 - RNA, 19 nt, Homo sapiens
cggaggacgcuggggaaau

SEQ ID NO: 2125109 - RNA, 14 nt, Homo sapiens
agaggggggcugcc

SEQ ID NO: 2125110 - RNA, 20 nt, Homo sapiens
uauucccuucugaucuugga

SEQ ID NO: 2125111 - RNA, 19 nt, Homo sapiens
ugcauacuguaggucauuu

SEQ ID NO: 2125112 - RNA, 22 nt, Homo sapiens
guacuuguuucaccauacuuca

SEQ ID NO: 2125113 - RNA, 14 nt, Homo sapiens
cauaaaucuauuca

SEQ ID NO: 2125114 - RNA, 19 nt, Homo sapiens
uacauucgugugugucugc

SEQ ID NO: 2125115 - RNA, 22 nt, Homo sapiens
ugugcuaaccucacugccucau

SEQ ID NO: 2125116 - RNA, 20 nt, Homo sapiens
gaaugcuggguaugcucugu

SEQ ID NO: 2125117 - RNA, 22 nt, Homo sapiens
aagucccuuccuauucuccugc

SEQ ID NO: 2125118 - RNA, 16 nt, Homo sapiens
cccagacaaaaagcua

SEQ ID NO: 2125119 - RNA, 13 nt, Homo sapiens
aaggaacuggaac

SEQ ID NO: 2125120 - RNA, 13 nt, Homo sapiens
ucaggggugcaca

SEQ ID NO: 2125121 - RNA, 15 nt, Homo sapiens
aaguuaacucuucaa

SEQ ID NO: 2125122 - RNA, 23 nt, Homo sapiens
ugcauuggcuaauaaauguugcc

SEQ ID NO: 2125123 - RNA, 16 nt, Homo sapiens
cccgcccucccggaga

SEQ ID NO: 2125124 - RNA, 19 nt, Homo sapiens
agccuggggaacagagcaa

SEQ ID NO: 2125125 - RNA, 20 nt, Homo sapiens
uaaacuuacuuaguguuaug

SEQ ID NO: 2125126 - RNA, 23 nt, Homo sapiens
uccuguuuucuuaggcacugagg

SEQ ID NO: 2125127 - RNA, 16 nt, Homo sapiens
cagcagaaaaucuuuu

SEQ ID NO: 2125128 - RNA, 23 nt, Homo sapiens
ggaaagaggcucuggacagcaga

SEQ ID NO: 2125129 - RNA, 14 nt, Homo sapiens
gcccagcgcggcca

SEQ ID NO: 2125130 - RNA, 24 nt, Homo sapiens
uccauacguucagaggugcagcug

SEQ ID NO: 2125131 - RNA, 18 nt, Homo sapiens
cuauccuaugccuucaaa

SEQ ID NO: 2125132 - RNA, 15 nt, Homo sapiens
cacauuaacucccuc

SEQ ID NO: 2125133 - RNA, 15 nt, Homo sapiens
caagugucaccuccu

SEQ ID NO: 2125134 - RNA, 13 nt, Homo sapiens
ccccacuccuccg

SEQ ID NO: 2125135 - RNA, 22 nt, Homo sapiens
caaagacauaauuuaauuccuu

SEQ ID NO: 2125136 - RNA, 16 nt, Homo sapiens
gauggauagucugucc

SEQ ID NO: 2125137 - RNA, 22 nt, Homo sapiens
acccuuccuacagauagucaaa

SEQ ID NO: 2125138 - RNA, 12 nt, Homo sapiens
uuaagaauucca

SEQ ID NO: 2125139 - RNA, 16 nt, Homo sapiens
acaggugaugcucugg

SEQ ID NO: 2125140 - RNA, 14 nt, Homo sapiens
uguuugucuuccau

SEQ ID NO: 2125141 - RNA, 13 nt, Homo sapiens
ucuuucauggggu

SEQ ID NO: 2125142 - RNA, 20 nt, Homo sapiens
uucagaguagaaccacuugu

SEQ ID NO: 2125143 - RNA, 13 nt, Homo sapiens
auaacuuguguua

SEQ ID NO: 2125144 - RNA, 11 nt, Homo sapiens
guuugccaugu

SEQ ID NO: 2125145 - RNA, 23 nt, Homo sapiens
uagcagcuuuagccaagugcagg

SEQ ID NO: 2125146 - RNA, 18 nt, Homo sapiens
ccuuaaauuauaccaaag

SEQ ID NO: 2125147 - RNA, 15 nt, Homo sapiens
agagaugacagggaa

SEQ ID NO: 2125148 - RNA, 13 nt, Homo sapiens
gaaacaucagcuu

SEQ ID NO: 2125149 - RNA, 13 nt, Homo sapiens
cugggaggacauu

SEQ ID NO: 2125150 - RNA, 21 nt, Homo sapiens
gcuccacacccucucccagga

SEQ ID NO: 2125151 - RNA, 17 nt, Homo sapiens
auccuggggaaggugga

SEQ ID NO: 2125152 - RNA, 14 nt, Homo sapiens
auaaacacugugua

SEQ ID NO: 2125153 - RNA, 19 nt, Homo sapiens
ugaugaaaaauaugugcuu

SEQ ID NO: 2125154 - RNA, 21 nt, Homo sapiens
cauucgcaccccuacuucaca

SEQ ID NO: 2125155 - RNA, 16 nt, Homo sapiens
gcuaguaaaagccauc

SEQ ID NO: 2125156 - RNA, 16 nt, Homo sapiens
gauucucuccuacugu

SEQ ID NO: 2125157 - RNA, 15 nt, Homo sapiens
caggggcagccacac

SEQ ID NO: 2125158 - RNA, 22 nt, Homo sapiens
cuucuuccucaagucuugacaa

SEQ ID NO: 2125159 - RNA, 17 nt, Homo sapiens
cuucuggcaugggacag

SEQ ID NO: 2125160 - RNA, 19 nt, Homo sapiens
gauacacuaaaaaucugag

SEQ ID NO: 2125161 - RNA, 14 nt, Homo sapiens
agcagggcucugcc

SEQ ID NO: 2125162 - RNA, 20 nt, Homo sapiens
uaugccuauauuuuuccuca

SEQ ID NO: 2125163 - RNA, 20 nt, Homo sapiens
ugucuuuggcagucugucau

SEQ ID NO: 2125164 - RNA, 18 nt, Homo sapiens
aaagaucauaguugcaaa

SEQ ID NO: 2125165 - RNA, 23 nt, Homo sapiens
uagaaguguuaacuuagcuugaa

SEQ ID NO: 2125166 - RNA, 16 nt, Homo sapiens
uccaaaccaccuuccc

SEQ ID NO: 2125167 - RNA, 15 nt, Homo sapiens
aagcaaaaaacugca

SEQ ID NO: 2125168 - RNA, 15 nt, Homo sapiens
guuuuguuuccucug

SEQ ID NO: 2125169 - RNA, 22 nt, Homo sapiens
guagguuaaaaaaauggcagug

SEQ ID NO: 2125170 - RNA, 16 nt, Homo sapiens
caacagaccuggugcu

SEQ ID NO: 2125171 - RNA, 13 nt, Homo sapiens
ugaugacacacca

SEQ ID NO: 2125172 - RNA, 23 nt, Homo sapiens
cucuugucacauggaaucuacau

SEQ ID NO: 2125173 - RNA, 19 nt, Homo sapiens
uguguggggcccaagcaug

SEQ ID NO: 2125174 - RNA, 16 nt, Homo sapiens
ggggacaaccuuggcu

SEQ ID NO: 2125175 - RNA, 20 nt, Homo sapiens
ugagacuuuucugcgugaug

SEQ ID NO: 2125176 - RNA, 17 nt, Homo sapiens
ucauucauacucaaaga

SEQ ID NO: 2125177 - RNA, 14 nt, Homo sapiens
aaacaucauucuac

SEQ ID NO: 2125178 - RNA, 18 nt, Homo sapiens
aaaucuaugaaauaucau

SEQ ID NO: 2125179 - RNA, 23 nt, Homo sapiens
cagcuguuuggccaaugugcaua

SEQ ID NO: 2125180 - RNA, 20 nt, Homo sapiens
ccagagggugggcuucaggg

SEQ ID NO: 2125181 - RNA, 13 nt, Homo sapiens
gucucgcuuuguu

SEQ ID NO: 2125182 - RNA, 18 nt, Homo sapiens
caggaauccuuacugaua

SEQ ID NO: 2125183 - RNA, 13 nt, Homo sapiens
acucaaacucaag

SEQ ID NO: 2125184 - RNA, 13 nt, Homo sapiens
ugauuaacaaaua

SEQ ID NO: 2125185 - RNA, 21 nt, Homo sapiens
gucacccagggcgucccugac

SEQ ID NO: 2125186 - RNA, 15 nt, Homo sapiens
uagaucgaagccaaa

SEQ ID NO: 2125187 - RNA, 16 nt, Homo sapiens
ccugcuagcacagagg

SEQ ID NO: 2125188 - RNA, 23 nt, Homo sapiens
auccccacuagguucuuuuccau

SEQ ID NO: 2125189 - RNA, 13 nt, Homo sapiens
augucgcacaaug

SEQ ID NO: 2125190 - RNA, 14 nt, Homo sapiens
uccgaggccaaagu

SEQ ID NO: 2125191 - RNA, 22 nt, Homo sapiens
guggcccaucuuacuggaagag

SEQ ID NO: 2125192 - RNA, 19 nt, Homo sapiens
cuagaucuuugugccaaac

SEQ ID NO: 2125193 - RNA, 15 nt, Homo sapiens
aacauaaucuaguuu

SEQ ID NO: 2125194 - RNA, 18 nt, Homo sapiens
acuauaauuuauugucua

SEQ ID NO: 2125195 - RNA, 17 nt, Homo sapiens
ccagaauaucugggauu

SEQ ID NO: 2125196 - RNA, 13 nt, Homo sapiens
gagacugaucucg

SEQ ID NO: 2125197 - RNA, 17 nt, Homo sapiens
caggccgccugccauac

SEQ ID NO: 2125198 - RNA, 17 nt, Homo sapiens
ucauguaaaugcucaaa

SEQ ID NO: 2125199 - RNA, 17 nt, Homo sapiens
agcagaguugcucuuca

SEQ ID NO: 2125200 - RNA, 15 nt, Homo sapiens
ucugagcccagcuca

SEQ ID NO: 2125201 - RNA, 17 nt, Homo sapiens
uguuaaaggucauaugc

SEQ ID NO: 2125202 - RNA, 17 nt, Homo sapiens
auuagcaaggucauuuc

SEQ ID NO: 2125203 - RNA, 12 nt, Homo sapiens
aaaaaguuuaca

SEQ ID NO: 2125204 - RNA, 16 nt, Homo sapiens
cuccaaggaguggaaa

SEQ ID NO: 2125205 - RNA, 14 nt, Homo sapiens
uguagcaauggcca

SEQ ID NO: 2125206 - RNA, 14 nt, Homo sapiens
cuguaagauugucc

SEQ ID NO: 2125207 - RNA, 19 nt, Homo sapiens
uauucucauuauuucauca

SEQ ID NO: 2125208 - RNA, 14 nt, Homo sapiens
aauucauuuugcag

SEQ ID NO: 2125209 - RNA, 13 nt, Homo sapiens
aauauuaacauau

SEQ ID NO: 2125210 - RNA, 12 nt, Homo sapiens
ccauuguuccug

SEQ ID NO: 2125211 - RNA, 14 nt, Homo sapiens
uuuucaucugaaaa

SEQ ID NO: 2125212 - RNA, 10 nt, Homo sapiens
agagacuggu

SEQ ID NO: 2125213 - RNA, 15 nt, Homo sapiens
acccagcuccagggg

SEQ ID NO: 2125214 - RNA, 13 nt, Homo sapiens
cuaugugccccag

SEQ ID NO: 2125215 - RNA, 16 nt, Homo sapiens
cccacacacacacccg

SEQ ID NO: 2125216 - RNA, 15 nt, Homo sapiens
ugucugaccagagaa

SEQ ID NO: 2125217 - RNA, 14 nt, Homo sapiens
auugucugcaaugg

SEQ ID NO: 2125218 - RNA, 15 nt, Homo sapiens
gcccgcauagcacuu

SEQ ID NO: 2125219 - RNA, 18 nt, Homo sapiens
gugauguaugccucccac

SEQ ID NO: 2125220 - RNA, 22 nt, Homo sapiens
gcauugaauauauuauaaucuu

SEQ ID NO: 2125221 - RNA, 18 nt, Homo sapiens
auaaaaaauaaaguacca

SEQ ID NO: 2125222 - RNA, 23 nt, Homo sapiens
uuguaaauuauauuugugcuaua

SEQ ID NO: 2125223 - RNA, 21 nt, Homo sapiens
gguauaaugguugacuggguu

SEQ ID NO: 2125224 - RNA, 21 nt, Homo sapiens
ccuucuauguauuagugucaa

SEQ ID NO: 2125225 - RNA, 14 nt, Homo sapiens
agccagguggcacc

SEQ ID NO: 2125226 - RNA, 14 nt, Homo sapiens
agccuaaggcugua

SEQ ID NO: 2125227 - RNA, 20 nt, Homo sapiens
ccagugaggcucugcccuug

SEQ ID NO: 2125228 - RNA, 20 nt, Homo sapiens
cuccuaucuugauuucacug

SEQ ID NO: 2125229 - RNA, 14 nt, Homo sapiens
uuacaaugugcaau

SEQ ID NO: 2125230 - RNA, 12 nt, Homo sapiens
gauuccagagag

SEQ ID NO: 2125231 - RNA, 20 nt, Homo sapiens
aauccaugugaccauucugc

SEQ ID NO: 2125232 - RNA, 17 nt, Homo sapiens
ugugcggagcagccuuu

SEQ ID NO: 2125233 - RNA, 23 nt, Homo sapiens
auaaaauauuuuuuuccuaugga

SEQ ID NO: 2125234 - RNA, 14 nt, Homo sapiens
auguccaccacuuc

SEQ ID NO: 2125235 - RNA, 12 nt, Homo sapiens
uggaaucuggag

SEQ ID NO: 2125236 - RNA, 17 nt, Homo sapiens
guaaaucuaaagaaaua

SEQ ID NO: 2125237 - RNA, 14 nt, Homo sapiens
uuugaauaucauua

SEQ ID NO: 2125238 - RNA, 18 nt, Homo sapiens
guucucucguaacugguu

SEQ ID NO: 2125239 - RNA, 14 nt, Homo sapiens
cguaguaacacaua

SEQ ID NO: 2125240 - RNA, 15 nt, Homo sapiens
caauauuuauuucca

SEQ ID NO: 2125241 - RNA, 18 nt, Homo sapiens
cuuucugacucuaaaaua

SEQ ID NO: 2125242 - RNA, 18 nt, Homo sapiens
ggagaagaaagaggugac

SEQ ID NO: 2125243 - RNA, 20 nt, Homo sapiens
gugccaaauuauucuccuau

SEQ ID NO: 2125244 - RNA, 18 nt, Homo sapiens
cugggccaccaugcacuc

SEQ ID NO: 2125245 - RNA, 23 nt, Homo sapiens
uacucagaggcugacacugacau

SEQ ID NO: 2125246 - RNA, 17 nt, Homo sapiens
aaggacuaggucuuccc

SEQ ID NO: 2125247 - RNA, 22 nt, Homo sapiens
uugucaacacaaagacauggaa

SEQ ID NO: 2125248 - RNA, 19 nt, Homo sapiens
auauuucugauacugcuga

SEQ ID NO: 2125249 - RNA, 23 nt, Homo sapiens
ugaaaauuaccuuuaaugcaaug

SEQ ID NO: 2125250 - RNA, 18 nt, Homo sapiens
acagcaggaugcccuguu

SEQ ID NO: 2125251 - RNA, 16 nt, Homo sapiens
aacagacucuucuugc

SEQ ID NO: 2125252 - RNA, 21 nt, Homo sapiens
ggauuacaggcacaugcacca

SEQ ID NO: 2125253 - RNA, 18 nt, Homo sapiens
cccaugaacacacugugu

SEQ ID NO: 2125254 - RNA, 11 nt, Homo sapiens
ugugugguggg

SEQ ID NO: 2125255 - RNA, 23 nt, Homo sapiens
cauauuuuaggacagguaaaaua

SEQ ID NO: 2125256 - RNA, 16 nt, Homo sapiens
gacagagugaauuuca

SEQ ID NO: 2125257 - RNA, 21 nt, Homo sapiens
gucauucuuuuaacaaaagga

SEQ ID NO: 2125258 - RNA, 15 nt, Homo sapiens
cccaaaacgugcaug

SEQ ID NO: 2125259 - RNA, 17 nt, Homo sapiens
uauucauccuaaaaagu

SEQ ID NO: 2125260 - RNA, 15 nt, Homo sapiens
uucacugaaggugau

SEQ ID NO: 2125261 - RNA, 16 nt, Homo sapiens
agcaucuacuacucug

SEQ ID NO: 2125262 - RNA, 19 nt, Homo sapiens
uaauuuuggguggggagaa

SEQ ID NO: 2125263 - RNA, 19 nt, Homo sapiens
guugcuucaaacugagaca

SEQ ID NO: 2125264 - RNA, 21 nt, Homo sapiens
uguggaaaauuggcaguguaa

SEQ ID NO: 2125265 - RNA, 23 nt, Homo sapiens
uugaagaauguugauggugcuag

SEQ ID NO: 2125266 - RNA, 15 nt, Homo sapiens
uaaguaauaugcuua

SEQ ID NO: 2125267 - RNA, 21 nt, Homo sapiens
aauuaacagagauugaacucc

SEQ ID NO: 2125268 - RNA, 21 nt, Homo sapiens
ucuaacauauucaaugcaagu

SEQ ID NO: 2125269 - RNA, 16 nt, Homo sapiens
aaggcaagacuugaac

SEQ ID NO: 2125270 - RNA, 17 nt, Homo sapiens
gguguuguaugccuuua

SEQ ID NO: 2125271 - RNA, 14 nt, Homo sapiens
gaucccccaagugu

SEQ ID NO: 2125272 - RNA, 21 nt, Homo sapiens
uuauuugcuaaucaaagccag

SEQ ID NO: 2125273 - RNA, 15 nt, Homo sapiens
gaaaauguccucccu

SEQ ID NO: 2125274 - RNA, 19 nt, Homo sapiens
gaccgcccccugucucuca

SEQ ID NO: 2125275 - RNA, 13 nt, Homo sapiens
ucguauaccuuau

SEQ ID NO: 2125276 - RNA, 19 nt, Homo sapiens
ucugacaauuaacauacau

SEQ ID NO: 2125277 - RNA, 18 nt, Homo sapiens
uugauauuuaauuaugaa

SEQ ID NO: 2125278 - RNA, 23 nt, Homo sapiens
ccagagcuguggagaggggaccc

SEQ ID NO: 2125279 - RNA, 16 nt, Homo sapiens
uuauaaagcuguucuu

SEQ ID NO: 2125280 - RNA, 15 nt, Homo sapiens
cagcuccacucaggg

SEQ ID NO: 2125281 - RNA, 16 nt, Homo sapiens
acgucauuacaagcug

SEQ ID NO: 2125282 - RNA, 21 nt, Homo sapiens
ucagaaggcucuucugacuac

SEQ ID NO: 2125283 - RNA, 16 nt, Homo sapiens
gauaucaaaagcaaau

SEQ ID NO: 2125284 - RNA, 20 nt, Homo sapiens
ugaugaacuguggugccaca

SEQ ID NO: 2125285 - RNA, 13 nt, Homo sapiens
cuacaugaugacu

SEQ ID NO: 2125286 - RNA, 11 nt, Homo sapiens
agaagugcaga

SEQ ID NO: 2125287 - RNA, 22 nt, Homo sapiens
cucgcccggcccgaucuuucua

SEQ ID NO: 2125288 - RNA, 14 nt, Homo sapiens
gaaagaugacaaaa

SEQ ID NO: 2125289 - RNA, 15 nt, Homo sapiens
uagauuaauacucua

SEQ ID NO: 2125290 - RNA, 15 nt, Homo sapiens
cucuucaacugacca

SEQ ID NO: 2125291 - RNA, 17 nt, Homo sapiens
cagaugcugaauccccu

SEQ ID NO: 2125292 - RNA, 13 nt, Homo sapiens
uccacagugacuc

SEQ ID NO: 2125293 - RNA, 18 nt, Homo sapiens
guaaaacuaaauguugcg

SEQ ID NO: 2125294 - RNA, 22 nt, Homo sapiens
ucccagccaggggaacucgcca

SEQ ID NO: 2125295 - RNA, 17 nt, Homo sapiens
aucuuaacaaagccuuu

SEQ ID NO: 2125296 - RNA, 22 nt, Homo sapiens
aguggcagcuccccaaaccagg

SEQ ID NO: 2125297 - RNA, 13 nt, Homo sapiens
acacgcacugcac

SEQ ID NO: 2125298 - RNA, 16 nt, Homo sapiens
uaauauuuuagauuac

SEQ ID NO: 2125299 - RNA, 12 nt, Homo sapiens
guuuucagugga

SEQ ID NO: 2125300 - RNA, 23 nt, Homo sapiens
gccaaaacaagggauuaucacau

SEQ ID NO: 2125301 - RNA, 15 nt, Homo sapiens
gacggaaggcaaaga

SEQ ID NO: 2125302 - RNA, 15 nt, Homo sapiens
uccaucuaccuucca

SEQ ID NO: 2125303 - RNA, 16 nt, Homo sapiens
aguuacauugugcuug

SEQ ID NO: 2125304 - RNA, 19 nt, Homo sapiens
cucugcagauagugccucu

SEQ ID NO: 2125305 - RNA, 22 nt, Homo sapiens
cuguaauagccucaccuucccu

SEQ ID NO: 2125306 - RNA, 23 nt, Homo sapiens
ucuugaauucauguacaugguau

SEQ ID NO: 2125307 - RNA, 15 nt, Homo sapiens
uguuucagacuuuug

SEQ ID NO: 2125308 - RNA, 20 nt, Homo sapiens
aacugguaguguucaguaaa

SEQ ID NO: 2125309 - RNA, 17 nt, Homo sapiens
ugcccggugccaucuuc

SEQ ID NO: 2125310 - RNA, 22 nt, Homo sapiens
uguaagacaaauauguucugac

SEQ ID NO: 2125311 - RNA, 14 nt, Homo sapiens
aaauucaugcugcu

SEQ ID NO: 2125312 - RNA, 22 nt, Homo sapiens
ucugacauaaacccaucuguaa

SEQ ID NO: 2125313 - RNA, 18 nt, Homo sapiens
ugcugucuucgaggacag

SEQ ID NO: 2125314 - RNA, 11 nt, Homo sapiens
uucuuuaguuu

SEQ ID NO: 2125315 - RNA, 21 nt, Homo sapiens
cuguauaaucuauuuacauaa

SEQ ID NO: 2125316 - RNA, 17 nt, Homo sapiens
uauaauuguaccaaccu

SEQ ID NO: 2125317 - RNA, 12 nt, Homo sapiens
accucggcugug

SEQ ID NO: 2125318 - RNA, 13 nt, Homo sapiens
aucaugugcuuca

SEQ ID NO: 2125319 - RNA, 13 nt, Homo sapiens
uuuaugugcaaua

SEQ ID NO: 2125320 - RNA, 15 nt, Homo sapiens
uuggaaugaauucuc

SEQ ID NO: 2125321 - RNA, 17 nt, Homo sapiens
ugcuaaaauucagguau

SEQ ID NO: 2125322 - RNA, 13 nt, Homo sapiens
cccuguggaugag

SEQ ID NO: 2125323 - RNA, 11 nt, Homo sapiens
accacaugcca

SEQ ID NO: 2125324 - RNA, 16 nt, Homo sapiens
cugcccagacugauga

SEQ ID NO: 2125325 - RNA, 15 nt, Homo sapiens
uggcucccaccugua

SEQ ID NO: 2125326 - RNA, 12 nt, Homo sapiens
cacuugugcacc

SEQ ID NO: 2125327 - RNA, 12 nt, Homo sapiens
gaacuguggaau

SEQ ID NO: 2125328 - RNA, 22 nt, Homo sapiens
gcacugcaaauacuuccaaaga

SEQ ID NO: 2125329 - RNA, 17 nt, Homo sapiens
uaggguaguuugcaaac

SEQ ID NO: 2125330 - RNA, 19 nt, Homo sapiens
acuggaauucagaugcaag

SEQ ID NO: 2125331 - RNA, 21 nt, Homo sapiens
ugaaaucuuguuuguuacugu

SEQ ID NO: 2125332 - RNA, 15 nt, Homo sapiens
aucugucugugcaca

SEQ ID NO: 2125333 - RNA, 15 nt, Homo sapiens
ccgcuuucucugagg

SEQ ID NO: 2125334 - RNA, 15 nt, Homo sapiens
aaagcucacuguagc

SEQ ID NO: 2125335 - RNA, 22 nt, Homo sapiens
auccuuuuccaucccacuccac

SEQ ID NO: 2125336 - RNA, 21 nt, Homo sapiens
cugaucugacauccccacuca

SEQ ID NO: 2125337 - RNA, 18 nt, Homo sapiens
ccuuccucuguccucuca

SEQ ID NO: 2125338 - RNA, 21 nt, Homo sapiens
gaaauuguugcuuuguuucuc

SEQ ID NO: 2125339 - RNA, 21 nt, Homo sapiens
augugaagucaccaguggccu

SEQ ID NO: 2125340 - RNA, 18 nt, Homo sapiens
aaggauuuaagcaaaggc

SEQ ID NO: 2125341 - RNA, 15 nt, Homo sapiens
agaagaaagggcaag

SEQ ID NO: 2125342 - RNA, 17 nt, Homo sapiens
cuaaguguuuucaaaua

SEQ ID NO: 2125343 - RNA, 17 nt, Homo sapiens
gaagcgagauguguggc

SEQ ID NO: 2125344 - RNA, 20 nt, Homo sapiens
ugcgaucucggcucagugca

SEQ ID NO: 2125345 - RNA, 21 nt, Homo sapiens
aagccaccaacagccacucag

SEQ ID NO: 2125346 - RNA, 17 nt, Homo sapiens
uguuuauaucacugucu

SEQ ID NO: 2125347 - RNA, 13 nt, Homo sapiens
gacaugcccugug

SEQ ID NO: 2125348 - RNA, 22 nt, Homo sapiens
auuucucucuccagucuuccac

SEQ ID NO: 2125349 - RNA, 15 nt, Homo sapiens
ucaucggaguugaca

SEQ ID NO: 2125350 - RNA, 16 nt, Homo sapiens
acacaccacgcgucac

SEQ ID NO: 2125351 - RNA, 13 nt, Homo sapiens
acuuuuuacauua

SEQ ID NO: 2125352 - RNA, 14 nt, Homo sapiens
aacuacucagggaa

SEQ ID NO: 2125353 - RNA, 17 nt, Homo sapiens
cgcuagagcagcccaaa

SEQ ID NO: 2125354 - RNA, 15 nt, Homo sapiens
ucugcuacuguguca

SEQ ID NO: 2125355 - RNA, 20 nt, Homo sapiens
uaauucuuaccucauuugca

SEQ ID NO: 2125356 - RNA, 13 nt, Homo sapiens
aucucaagcaagu

SEQ ID NO: 2125357 - RNA, 12 nt, Homo sapiens
augcaagcacaa

SEQ ID NO: 2125358 - RNA, 21 nt, Homo sapiens
cuuugaaaauauuucuaugua

SEQ ID NO: 2125359 - RNA, 18 nt, Homo sapiens
uaagagcuuaagaaccau

SEQ ID NO: 2125360 - RNA, 17 nt, Homo sapiens
agaaagugacaagcuca

SEQ ID NO: 2125361 - RNA, 11 nt, Homo sapiens
acacugugaac

SEQ ID NO: 2125362 - RNA, 17 nt, Homo sapiens
aauuuugcuugcugaag

SEQ ID NO: 2125363 - RNA, 19 nt, Homo sapiens
auguguauguacguuugua

SEQ ID NO: 2125364 - RNA, 21 nt, Homo sapiens
ggcuaccccuucauggugacu

SEQ ID NO: 2125365 - RNA, 20 nt, Homo sapiens
acagaugcuggccucuuggc

SEQ ID NO: 2125366 - RNA, 16 nt, Homo sapiens
agccccggcaagccac

SEQ ID NO: 2125367 - RNA, 14 nt, Homo sapiens
acugagagugaagu

SEQ ID NO: 2125368 - RNA, 22 nt, Homo sapiens
guagaacucacucugggcugua

SEQ ID NO: 2125369 - RNA, 14 nt, Homo sapiens
auauagaacagugc

SEQ ID NO: 2125370 - RNA, 16 nt, Homo sapiens
gccuccuuauuuauca

SEQ ID NO: 2125371 - RNA, 14 nt, Homo sapiens
uggcagauuuuaca

SEQ ID NO: 2125372 - RNA, 23 nt, Homo sapiens
gacuucuccuccaguggaccuga

SEQ ID NO: 2125373 - RNA, 19 nt, Homo sapiens
ccucauuugggguagcuag

SEQ ID NO: 2125374 - RNA, 19 nt, Homo sapiens
gucagucaugucacugaaa

SEQ ID NO: 2125375 - RNA, 13 nt, Homo sapiens
aaauuaauaucac

SEQ ID NO: 2125376 - RNA, 22 nt, Homo sapiens
uguaaaauauuuauaaaugaag

SEQ ID NO: 2125377 - RNA, 18 nt, Homo sapiens
cagagagacuguuaucag

SEQ ID NO: 2125378 - RNA, 22 nt, Homo sapiens
guagccuuagugucaccuuucu

SEQ ID NO: 2125379 - RNA, 16 nt, Homo sapiens
cagaccucccagagag

SEQ ID NO: 2125380 - RNA, 12 nt, Homo sapiens
aaaagaugaagu

SEQ ID NO: 2125381 - RNA, 21 nt, Homo sapiens
agugaccgaaagguuauguua

SEQ ID NO: 2125382 - RNA, 21 nt, Homo sapiens
cucagaguggcugagacuugu

SEQ ID NO: 2125383 - RNA, 14 nt, Homo sapiens
caucucagugcagg

SEQ ID NO: 2125384 - RNA, 13 nt, Homo sapiens
agccaccugcaag

SEQ ID NO: 2125385 - RNA, 14 nt, Homo sapiens
uuggacaaccucau

SEQ ID NO: 2125386 - RNA, 22 nt, Homo sapiens
gaaaguaccaggugaacaaagu

SEQ ID NO: 2125387 - RNA, 21 nt, Homo sapiens
uggauaagucacuuaaacuca

SEQ ID NO: 2125388 - RNA, 18 nt, Homo sapiens
caagaggauuguaaaaug

SEQ ID NO: 2125389 - RNA, 12 nt, Homo sapiens
aguaugcaaaag

SEQ ID NO: 2125390 - RNA, 16 nt, Homo sapiens
ccuugcccaugugaaa

SEQ ID NO: 2125391 - RNA, 18 nt, Homo sapiens
uagaaaaaugcuguucag

SEQ ID NO: 2125392 - RNA, 14 nt, Homo sapiens
accuaauaucauuu

SEQ ID NO: 2125393 - RNA, 12 nt, Homo sapiens
guugcuauaaua

SEQ ID NO: 2125394 - RNA, 19 nt, Homo sapiens
uacccaaauacucaauuua

SEQ ID NO: 2125395 - RNA, 16 nt, Homo sapiens
ccugaacauccuuccu

SEQ ID NO: 2125396 - RNA, 21 nt, Homo sapiens
gacauuucauauaaauggaau

SEQ ID NO: 2125397 - RNA, 22 nt, Homo sapiens
uggguaauaaccaagauggagu

SEQ ID NO: 2125398 - RNA, 16 nt, Homo sapiens
ugaauaaauaccucuu

SEQ ID NO: 2125399 - RNA, 16 nt, Homo sapiens
ugggaccccagcugcu

SEQ ID NO: 2125400 - RNA, 23 nt, Homo sapiens
aggcugggccauguccaaagagg

SEQ ID NO: 2125401 - RNA, 15 nt, Homo sapiens
gaagcacuugcucaa

SEQ ID NO: 2125402 - RNA, 14 nt, Homo sapiens
aaaauaaagcacaa

SEQ ID NO: 2125403 - RNA, 15 nt, Homo sapiens
uauggauucauuuau

SEQ ID NO: 2125404 - RNA, 18 nt, Homo sapiens
aauguuuacaguggaauu

SEQ ID NO: 2125405 - RNA, 15 nt, Homo sapiens
ccaccguggggagcc

SEQ ID NO: 2125406 - RNA, 22 nt, Homo sapiens
auguauuuuguauuugcauaug

SEQ ID NO: 2125407 - RNA, 19 nt, Homo sapiens
acuuggcuggggaggacca

SEQ ID NO: 2125408 - RNA, 21 nt, Homo sapiens
uccuggcugugcacauucucc

SEQ ID NO: 2125409 - RNA, 15 nt, Homo sapiens
gccaggcgugguggc

SEQ ID NO: 2125410 - RNA, 13 nt, Homo sapiens
aucccgggagcag

SEQ ID NO: 2125411 - RNA, 15 nt, Homo sapiens
guaaugcacuccugc

SEQ ID NO: 2125412 - RNA, 14 nt, Homo sapiens
caguagauuuucca

SEQ ID NO: 2125413 - RNA, 10 nt, Homo sapiens
ugcauuccau

SEQ ID NO: 2125414 - RNA, 20 nt, Homo sapiens
gaccucauuuacaaagcaaa

SEQ ID NO: 2125415 - RNA, 16 nt, Homo sapiens
uaccuucuauguauua

SEQ ID NO: 2125416 - RNA, 15 nt, Homo sapiens
uaagaaaaaaagcac

SEQ ID NO: 2125417 - RNA, 17 nt, Homo sapiens
aggucacguguggaauu

SEQ ID NO: 2125418 - RNA, 17 nt, Homo sapiens
cugcaggcuuugccauu

SEQ ID NO: 2125419 - RNA, 18 nt, Homo sapiens
ccuagcggaguuccagca

SEQ ID NO: 2125420 - RNA, 16 nt, Homo sapiens
auucauaccugacuag

SEQ ID NO: 2125421 - RNA, 14 nt, Homo sapiens
ugauucugaaucaa

SEQ ID NO: 2125422 - RNA, 22 nt, Homo sapiens
ccugggcauacuaauaaaguau

SEQ ID NO: 2125423 - RNA, 17 nt, Homo sapiens
aucagaaucauugaagu

SEQ ID NO: 2125424 - RNA, 21 nt, Homo sapiens
agaagcaaugggucuuagcuc

SEQ ID NO: 2125425 - RNA, 17 nt, Homo sapiens
cauuuuacuuccaugau

SEQ ID NO: 2125426 - RNA, 14 nt, Homo sapiens
uauuuugcuguuac

SEQ ID NO: 2125427 - RNA, 16 nt, Homo sapiens
aaauugcuuuacaguu

SEQ ID NO: 2125428 - RNA, 16 nt, Homo sapiens
aaucauggcauucaca

SEQ ID NO: 2125429 - RNA, 18 nt, Homo sapiens
auaaacgaauucugucuc

SEQ ID NO: 2125430 - RNA, 20 nt, Homo sapiens
aaauacacuuccugcuuaaa

SEQ ID NO: 2125431 - RNA, 22 nt, Homo sapiens
cacaagauacacgucacaaaga

SEQ ID NO: 2125432 - RNA, 16 nt, Homo sapiens
gagcuguuaugcuguu

SEQ ID NO: 2125433 - RNA, 17 nt, Homo sapiens
auucuggucuucacugc

SEQ ID NO: 2125434 - RNA, 22 nt, Homo sapiens
uaaacgaggaaaagguccuugc

SEQ ID NO: 2125435 - RNA, 18 nt, Homo sapiens
uuugaacuauauuuacug

SEQ ID NO: 2125436 - RNA, 24 nt, Homo sapiens
auacaaaucaaagauuugucacau

SEQ ID NO: 2125437 - RNA, 13 nt, Homo sapiens
uggccauauauca

SEQ ID NO: 2125438 - RNA, 15 nt, Homo sapiens
aaagcacuacaauca

SEQ ID NO: 2125439 - RNA, 21 nt, Homo sapiens
aaaugcacgucacaggcucag

SEQ ID NO: 2125440 - RNA, 13 nt, Homo sapiens
ucuaaagcugccc

SEQ ID NO: 2125441 - RNA, 15 nt, Homo sapiens
ugggaggccgaggca

SEQ ID NO: 2125442 - RNA, 14 nt, Homo sapiens
uuucagcacauucu

SEQ ID NO: 2125443 - RNA, 13 nt, Homo sapiens
gaugagguugcuu

SEQ ID NO: 2125444 - RNA, 20 nt, Homo sapiens
gaaaaagucauccaaucuaa

SEQ ID NO: 2125445 - RNA, 16 nt, Homo sapiens
accgcaauaugggagg

SEQ ID NO: 2125446 - RNA, 22 nt, Homo sapiens
agaggccuuggggcaugaccca

SEQ ID NO: 2125447 - RNA, 17 nt, Homo sapiens
ccaacaaaaaaaauuua

SEQ ID NO: 2125448 - RNA, 13 nt, Homo sapiens
uuacaucuuucac

SEQ ID NO: 2125449 - RNA, 18 nt, Homo sapiens
cugcuggaaggggcagca

SEQ ID NO: 2125450 - RNA, 14 nt, Homo sapiens
gccuaugagggccu

SEQ ID NO: 2125451 - RNA, 14 nt, Homo sapiens
cucauuuguucuca

SEQ ID NO: 2125452 - RNA, 18 nt, Homo sapiens
ugcagcgagcugagauca

SEQ ID NO: 2125453 - RNA, 18 nt, Homo sapiens
agguauucaauacuguag

SEQ ID NO: 2125454 - RNA, 15 nt, Homo sapiens
aaaauaaaguuacau

SEQ ID NO: 2125455 - RNA, 18 nt, Homo sapiens
uacugguuagauucauua

SEQ ID NO: 2125456 - RNA, 18 nt, Homo sapiens
ccugggucacagagugag

SEQ ID NO: 2125457 - RNA, 15 nt, Homo sapiens
guuaguaaugcucug

SEQ ID NO: 2125458 - RNA, 15 nt, Homo sapiens
ccacauuuugcuuua

SEQ ID NO: 2125459 - RNA, 15 nt, Homo sapiens
ccacucuuugcuaca

SEQ ID NO: 2125460 - RNA, 15 nt, Homo sapiens
gccuggccaucugua

SEQ ID NO: 2125461 - RNA, 17 nt, Homo sapiens
ugauuuuagccaugccu

SEQ ID NO: 2125462 - RNA, 13 nt, Homo sapiens
ucaugacgugcau

SEQ ID NO: 2125463 - RNA, 19 nt, Homo sapiens
gcaaaccuaauugcacaac

SEQ ID NO: 2125464 - RNA, 19 nt, Homo sapiens
caaaaauaaauuguaauaa

SEQ ID NO: 2125465 - RNA, 18 nt, Homo sapiens
cugcagaggaaagacagg

SEQ ID NO: 2125466 - RNA, 20 nt, Homo sapiens
auaucaguuugcuagcagaa

SEQ ID NO: 2125467 - RNA, 17 nt, Homo sapiens
cucgucuuggcacaauc

SEQ ID NO: 2125468 - RNA, 15 nt, Homo sapiens
gucauggcaccaaag

SEQ ID NO: 2125469 - RNA, 17 nt, Homo sapiens
uugauucacaaugaaau

SEQ ID NO: 2125470 - RNA, 16 nt, Homo sapiens
caaaacagaucugaau

SEQ ID NO: 2125471 - RNA, 23 nt, Homo sapiens
uacuugaaggauggaugagucag

SEQ ID NO: 2125472 - RNA, 21 nt, Homo sapiens
acuugggagcugcugggcuag

SEQ ID NO: 2125473 - RNA, 19 nt, Homo sapiens
cagaauucucccagcguua

SEQ ID NO: 2125474 - RNA, 18 nt, Homo sapiens
acagcgcaugcuggugca

SEQ ID NO: 2125475 - RNA, 15 nt, Homo sapiens
aauaaauaaucugua

SEQ ID NO: 2125476 - RNA, 19 nt, Homo sapiens
uauauauaguagcauuuca

SEQ ID NO: 2125477 - RNA, 21 nt, Homo sapiens
ggcaaaaacuguacuguguuu

SEQ ID NO: 2125478 - RNA, 19 nt, Homo sapiens
cagugagggcuauacaugg

SEQ ID NO: 2125479 - RNA, 17 nt, Homo sapiens
ccagcccagcaccccuu

SEQ ID NO: 2125480 - RNA, 13 nt, Homo sapiens
cauccuugcccag

SEQ ID NO: 2125481 - RNA, 18 nt, Homo sapiens
ugaaugaugccaugagga

SEQ ID NO: 2125482 - RNA, 20 nt, Homo sapiens
cugagaauauaauacuguau

SEQ ID NO: 2125483 - RNA, 18 nt, Homo sapiens
uugguuuaaagaaagugu

SEQ ID NO: 2125484 - RNA, 15 nt, Homo sapiens
cuuuuggaaggugac

SEQ ID NO: 2125485 - RNA, 17 nt, Homo sapiens
cuccacaucugccuuaa

SEQ ID NO: 2125486 - RNA, 15 nt, Homo sapiens
acccuggacagugcc

SEQ ID NO: 2125487 - RNA, 18 nt, Homo sapiens
uagaaucuagaaauguuc

SEQ ID NO: 2125488 - RNA, 20 nt, Homo sapiens
gcugaaccacagaaaucaca

SEQ ID NO: 2125489 - RNA, 17 nt, Homo sapiens
caagaaguggcugccaa

SEQ ID NO: 2125490 - RNA, 17 nt, Homo sapiens
aguugaggccacugugu

SEQ ID NO: 2125491 - RNA, 16 nt, Homo sapiens
aaagacagucaaagga

SEQ ID NO: 2125492 - RNA, 14 nt, Homo sapiens
aaugucgaugcuac

SEQ ID NO: 2125493 - RNA, 21 nt, Homo sapiens
auuuacagcucuguaaccucc

SEQ ID NO: 2125494 - RNA, 16 nt, Homo sapiens
ccugcaggucacugaa

SEQ ID NO: 2125495 - RNA, 16 nt, Homo sapiens
cucccaguccauuucc

SEQ ID NO: 2125496 - RNA, 18 nt, Homo sapiens
cugaucauggucagcuca

SEQ ID NO: 2125497 - RNA, 18 nt, Homo sapiens
aucccaccugacaugucc

SEQ ID NO: 2125498 - RNA, 15 nt, Homo sapiens
aauagcccuguaaca

SEQ ID NO: 2125499 - RNA, 14 nt, Homo sapiens
aaugucacuuaaag

SEQ ID NO: 2125500 - RNA, 18 nt, Homo sapiens
gucuccaagaccacccuc

SEQ ID NO: 2125501 - RNA, 13 nt, Homo sapiens
aguuuugaugcug

SEQ ID NO: 2125502 - RNA, 17 nt, Homo sapiens
uccccugccucaccagc

SEQ ID NO: 2125503 - RNA, 16 nt, Homo sapiens
ugugcagacaguguca

SEQ ID NO: 2125504 - RNA, 19 nt, Homo sapiens
ugaaauugcauacuuugua

SEQ ID NO: 2125505 - RNA, 23 nt, Homo sapiens
cuugggacucaggagcugcuaaa

SEQ ID NO: 2125506 - RNA, 20 nt, Homo sapiens
caggguuucaccauguugcc

SEQ ID NO: 2125507 - RNA, 14 nt, Homo sapiens
ugcacacaccugca

SEQ ID NO: 2125508 - RNA, 19 nt, Homo sapiens
uuucuucucuccagugcac

SEQ ID NO: 2125509 - RNA, 19 nt, Homo sapiens
uguaugcagggagcacugu

SEQ ID NO: 2125510 - RNA, 19 nt, Homo sapiens
aaaaucacucucagugcuu

SEQ ID NO: 2125511 - RNA, 19 nt, Homo sapiens
ugaaaaaggaaugauauau

SEQ ID NO: 2125512 - RNA, 16 nt, Homo sapiens
agcaugguaguggcaa

SEQ ID NO: 2125513 - RNA, 21 nt, Homo sapiens
ugaccuuguaaaagacagugu

SEQ ID NO: 2125514 - RNA, 20 nt, Homo sapiens
caaaccaugagaauuugcaa

SEQ ID NO: 2125515 - RNA, 18 nt, Homo sapiens
acacaguauuaugacacu

SEQ ID NO: 2125516 - RNA, 14 nt, Homo sapiens
ucccacuuggccaa

SEQ ID NO: 2125517 - RNA, 23 nt, Homo sapiens
caauuuuaaugauaaaauagcca

SEQ ID NO: 2125518 - RNA, 18 nt, Homo sapiens
uucucaccugucaucuca

SEQ ID NO: 2125519 - RNA, 23 nt, Homo sapiens
uuagaaaauaaaauuuaacucac

SEQ ID NO: 2125520 - RNA, 21 nt, Homo sapiens
auaccauuuuauauuucauca

SEQ ID NO: 2125521 - RNA, 19 nt, Homo sapiens
gccaaucccgccaugcuca

SEQ ID NO: 2125522 - RNA, 17 nt, Homo sapiens
uaaucauacaccagaag

SEQ ID NO: 2125523 - RNA, 18 nt, Homo sapiens
gagcuaggaacccuggag

SEQ ID NO: 2125524 - RNA, 15 nt, Homo sapiens
uaacagaacagucac

SEQ ID NO: 2125525 - RNA, 14 nt, Homo sapiens
agcucuuccuaucc

SEQ ID NO: 2125526 - RNA, 18 nt, Homo sapiens
cucaacaauaaagacuga

SEQ ID NO: 2125527 - RNA, 21 nt, Homo sapiens
caacugccggggguucagggu

SEQ ID NO: 2125528 - RNA, 13 nt, Homo sapiens
uggacgcaugcag

SEQ ID NO: 2125529 - RNA, 14 nt, Homo sapiens
uuagccuugcugua

SEQ ID NO: 2125530 - RNA, 17 nt, Homo sapiens
gcuuuggguggcucacu

SEQ ID NO: 2125531 - RNA, 16 nt, Homo sapiens
cugagcagaacugaaa

SEQ ID NO: 2125532 - RNA, 18 nt, Homo sapiens
aucugcuuucauccagcc

SEQ ID NO: 2125533 - RNA, 14 nt, Homo sapiens
uaaaauugguauau

SEQ ID NO: 2125534 - RNA, 17 nt, Homo sapiens
ccuuuggcaauaucaua

SEQ ID NO: 2125535 - RNA, 21 nt, Homo sapiens
aacuccugccuaugacacaga

SEQ ID NO: 2125536 - RNA, 20 nt, Homo sapiens
uuucuuuuuugagacagggu

SEQ ID NO: 2125537 - RNA, 14 nt, Homo sapiens
agaucaucagucac

SEQ ID NO: 2125538 - RNA, 14 nt, Homo sapiens
ugaccuugaucaag

SEQ ID NO: 2125539 - RNA, 22 nt, Homo sapiens
cacaggacgaaugcauauucaa

SEQ ID NO: 2125540 - RNA, 13 nt, Homo sapiens
uuaaaggaccuuc

SEQ ID NO: 2125541 - RNA, 19 nt, Homo sapiens
cacuucuuuccucaaagaa

SEQ ID NO: 2125542 - RNA, 17 nt, Homo sapiens
uuaaauuuuaauucuuc

SEQ ID NO: 2125543 - RNA, 15 nt, Homo sapiens
cuuuccagccguguu

SEQ ID NO: 2125544 - RNA, 20 nt, Homo sapiens
ucauagauguuuccuugccu

SEQ ID NO: 2125545 - RNA, 21 nt, Homo sapiens
ugcccaucagccauuugccau

SEQ ID NO: 2125546 - RNA, 18 nt, Homo sapiens
aucggccaucaagggaag

SEQ ID NO: 2125547 - RNA, 22 nt, Homo sapiens
ucuucacugcuacaugugcugg

SEQ ID NO: 2125548 - RNA, 21 nt, Homo sapiens
auuguucuuauccucaauuca

SEQ ID NO: 2125549 - RNA, 17 nt, Homo sapiens
aaauguaccggcuucca

SEQ ID NO: 2125550 - RNA, 22 nt, Homo sapiens
agugguucuauguccauucuca

SEQ ID NO: 2125551 - RNA, 13 nt, Homo sapiens
ucaaggugcucaa

SEQ ID NO: 2125552 - RNA, 19 nt, Homo sapiens
uaaguaaucaucuaaguca

SEQ ID NO: 2125553 - RNA, 19 nt, Homo sapiens
cuugacuuccccacugcuc

SEQ ID NO: 2125554 - RNA, 19 nt, Homo sapiens
cuuguuuucuacuuugcca

SEQ ID NO: 2125555 - RNA, 20 nt, Homo sapiens
auucauguucaucaauaccu

SEQ ID NO: 2125556 - RNA, 15 nt, Homo sapiens
uacagagaaucugaa

SEQ ID NO: 2125557 - RNA, 23 nt, Homo sapiens
ugugugacuuugggcaagccaag

SEQ ID NO: 2125558 - RNA, 14 nt, Homo sapiens
ugcaggacacuggu

SEQ ID NO: 2125559 - RNA, 14 nt, Homo sapiens
ugcuggacacuaca

SEQ ID NO: 2125560 - RNA, 14 nt, Homo sapiens
gcuguaaauuacau

SEQ ID NO: 2125561 - RNA, 18 nt, Homo sapiens
cauagguugagcaauuuc

SEQ ID NO: 2125562 - RNA, 13 nt, Homo sapiens
cucugggugagaa

SEQ ID NO: 2125563 - RNA, 21 nt, Homo sapiens
uuauguuugugguuuugggaa

SEQ ID NO: 2125564 - RNA, 17 nt, Homo sapiens
cugcagaugaucaggga

SEQ ID NO: 2125565 - RNA, 20 nt, Homo sapiens
ggucgaagcaaucagcaaac

SEQ ID NO: 2125566 - RNA, 21 nt, Homo sapiens
gucucucaugaaccucaagcu

SEQ ID NO: 2125567 - RNA, 18 nt, Homo sapiens
ggccucgaaaaccaucac

SEQ ID NO: 2125568 - RNA, 15 nt, Homo sapiens
cauuacauugccauu

SEQ ID NO: 2125569 - RNA, 21 nt, Homo sapiens
ugugcacacacacacacaugc

SEQ ID NO: 2125570 - RNA, 19 nt, Homo sapiens
gcuucucuccuaucugugc

SEQ ID NO: 2125571 - RNA, 17 nt, Homo sapiens
cagccuggggcucucug

SEQ ID NO: 2125572 - RNA, 13 nt, Homo sapiens
cgcaaaaccugca

SEQ ID NO: 2125573 - RNA, 20 nt, Homo sapiens
gaacccauuucuccagacuu

SEQ ID NO: 2125574 - RNA, 12 nt, Homo sapiens
cacaccaucucc

SEQ ID NO: 2125575 - RNA, 20 nt, Homo sapiens
ccuucccugacacugucugc

SEQ ID NO: 2125576 - RNA, 17 nt, Homo sapiens
auucuucugaccaucua

SEQ ID NO: 2125577 - RNA, 15 nt, Homo sapiens
cugacugacuuagca

SEQ ID NO: 2125578 - RNA, 14 nt, Homo sapiens
acauuacaagguca

SEQ ID NO: 2125579 - RNA, 16 nt, Homo sapiens
ugauuccgcagcucag

SEQ ID NO: 2125580 - RNA, 14 nt, Homo sapiens
aguauaaaaccaug

SEQ ID NO: 2125581 - RNA, 14 nt, Homo sapiens
acucagaaagccaa

SEQ ID NO: 2125582 - RNA, 20 nt, Homo sapiens
ggucccacuaauuauuagaa

SEQ ID NO: 2125583 - RNA, 17 nt, Homo sapiens
gaaccacauucagggaa

SEQ ID NO: 2125584 - RNA, 17 nt, Homo sapiens
uucuuggagucuuccaa

SEQ ID NO: 2125585 - RNA, 18 nt, Homo sapiens
gcuuucgaugcguguguu

SEQ ID NO: 2125586 - RNA, 19 nt, Homo sapiens
cugaccucaggugauccac

SEQ ID NO: 2125587 - RNA, 23 nt, Homo sapiens
acaggcccggcccagccuaggcc

SEQ ID NO: 2125588 - RNA, 14 nt, Homo sapiens
aauuauuaaaggaa

SEQ ID NO: 2125589 - RNA, 14 nt, Homo sapiens
aaugaauaaaguau

SEQ ID NO: 2125590 - RNA, 14 nt, Homo sapiens
uuauguaaucucac

SEQ ID NO: 2125591 - RNA, 19 nt, Homo sapiens
ggcuggcccucucauucuc

SEQ ID NO: 2125592 - RNA, 17 nt, Homo sapiens
cuacuugaggcugcaau

SEQ ID NO: 2125593 - RNA, 12 nt, Homo sapiens
agucacauuugc

SEQ ID NO: 2125594 - RNA, 18 nt, Homo sapiens
cauggaaguuuauuucca

SEQ ID NO: 2125595 - RNA, 21 nt, Homo sapiens
ugccuguuuugagaccagaag

SEQ ID NO: 2125596 - RNA, 14 nt, Homo sapiens
caguaauggaauga

SEQ ID NO: 2125597 - RNA, 18 nt, Homo sapiens
gaugccagagggccagca

SEQ ID NO: 2125598 - RNA, 17 nt, Homo sapiens
ccacugucacaggcaua

SEQ ID NO: 2125599 - RNA, 17 nt, Homo sapiens
guaaucuuuggcuguaa

SEQ ID NO: 2125600 - RNA, 13 nt, Homo sapiens
aaucaucuaaguc

SEQ ID NO: 2125601 - RNA, 22 nt, Homo sapiens
uuuugaccaaauaaaguaccau

SEQ ID NO: 2125602 - RNA, 20 nt, Homo sapiens
gagcccccacccgggagcag

SEQ ID NO: 2125603 - RNA, 19 nt, Homo sapiens
agcccuccucucccaguga

SEQ ID NO: 2125604 - RNA, 23 nt, Homo sapiens
caaguuaaaaccugcaaagcuaa

SEQ ID NO: 2125605 - RNA, 13 nt, Homo sapiens
agccaaucuccag

SEQ ID NO: 2125606 - RNA, 17 nt, Homo sapiens
gccuguagccccaguga

SEQ ID NO: 2125607 - RNA, 14 nt, Homo sapiens
aagaaauucuguca

SEQ ID NO: 2125608 - RNA, 14 nt, Homo sapiens
aacuaauucucaca

SEQ ID NO: 2125609 - RNA, 16 nt, Homo sapiens
acaucaaaugcucaag

SEQ ID NO: 2125610 - RNA, 14 nt, Homo sapiens
ggaggcuucagaag

SEQ ID NO: 2125611 - RNA, 15 nt, Homo sapiens
gcccuguaacaggcu

SEQ ID NO: 2125612 - RNA, 21 nt, Homo sapiens
gaggaaaaguaaggugcaguu

SEQ ID NO: 2125613 - RNA, 20 nt, Homo sapiens
agguguuguggggaugguga

SEQ ID NO: 2125614 - RNA, 16 nt, Homo sapiens
uuuuaaauaauugcau

SEQ ID NO: 2125615 - RNA, 23 nt, Homo sapiens
gagaaagccgggggaggggcccu

SEQ ID NO: 2125616 - RNA, 13 nt, Homo sapiens
cuucccaccucag

SEQ ID NO: 2125617 - RNA, 13 nt, Homo sapiens
accagcacacucc

SEQ ID NO: 2125618 - RNA, 13 nt, Homo sapiens
uucagccagguga

SEQ ID NO: 2125619 - RNA, 14 nt, Homo sapiens
ccaagucacuagaa

SEQ ID NO: 2125620 - RNA, 14 nt, Homo sapiens
ugaaagaaaaaugg

SEQ ID NO: 2125621 - RNA, 13 nt, Homo sapiens
cagcuuuagccga

SEQ ID NO: 2125622 - RNA, 21 nt, Homo sapiens
gaacacuggcaacaacaaagc

SEQ ID NO: 2125623 - RNA, 13 nt, Homo sapiens
auuugcuaucaaa

SEQ ID NO: 2125624 - RNA, 13 nt, Homo sapiens
cagacgaaggcaa

SEQ ID NO: 2125625 - RNA, 15 nt, Homo sapiens
uaagucucugugaau

SEQ ID NO: 2125626 - RNA, 16 nt, Homo sapiens
gcuucaguguuuugaa

SEQ ID NO: 2125627 - RNA, 14 nt, Homo sapiens
agauaugcacacac

SEQ ID NO: 2125628 - RNA, 16 nt, Homo sapiens
aucaagagaaacuuca

SEQ ID NO: 2125629 - RNA, 19 nt, Homo sapiens
caccuucgccuuugcugaa

SEQ ID NO: 2125630 - RNA, 23 nt, Homo sapiens
ugaagagagagcugagugagcug

SEQ ID NO: 2125631 - RNA, 19 nt, Homo sapiens
gauuuaugaucacuuggaa

SEQ ID NO: 2125632 - RNA, 18 nt, Homo sapiens
ucagaguguggauuguau

SEQ ID NO: 2125633 - RNA, 18 nt, Homo sapiens
gcuucuauaauuuugccu

SEQ ID NO: 2125634 - RNA, 22 nt, Homo sapiens
ccaauaaagccuucaaacuccc

SEQ ID NO: 2125635 - RNA, 18 nt, Homo sapiens
ugcuucacagguuuuaug

SEQ ID NO: 2125636 - RNA, 17 nt, Homo sapiens
ugcuguaaaaacugugg

SEQ ID NO: 2125637 - RNA, 15 nt, Homo sapiens
agaacaggcaaguga

SEQ ID NO: 2125638 - RNA, 20 nt, Homo sapiens
guugcaaauacauggauaac

SEQ ID NO: 2125639 - RNA, 20 nt, Homo sapiens
uuagaaggacucaguauuau

SEQ ID NO: 2125640 - RNA, 13 nt, Homo sapiens
cucuaagucaugu

SEQ ID NO: 2125641 - RNA, 16 nt, Homo sapiens
agaaaguggucuuaag

SEQ ID NO: 2125642 - RNA, 20 nt, Homo sapiens
uuccuggcccacucuguaau

SEQ ID NO: 2125643 - RNA, 19 nt, Homo sapiens
acacuugguuagacgccuu

SEQ ID NO: 2125644 - RNA, 23 nt, Homo sapiens
aggcaccaccaggagcagcagcc

SEQ ID NO: 2125645 - RNA, 22 nt, Homo sapiens
ucugucuguagagccgcauggc

SEQ ID NO: 2125646 - RNA, 21 nt, Homo sapiens
cuuuggcuuuuuccaucucaa

SEQ ID NO: 2125647 - RNA, 17 nt, Homo sapiens
uaggacucaaaguuuca

SEQ ID NO: 2125648 - RNA, 20 nt, Homo sapiens
aaaaggcauauauguacuag

SEQ ID NO: 2125649 - RNA, 15 nt, Homo sapiens
ucuugaaggugcugc

SEQ ID NO: 2125650 - RNA, 14 nt, Homo sapiens
aacagucucuucua

SEQ ID NO: 2125651 - RNA, 20 nt, Homo sapiens
ucaaauacaugcacagucau

SEQ ID NO: 2125652 - RNA, 19 nt, Homo sapiens
acugaauuggcuuccagau

SEQ ID NO: 2125653 - RNA, 21 nt, Homo sapiens
cuaaucccgugccccuuuccu

SEQ ID NO: 2125654 - RNA, 20 nt, Homo sapiens
gccacugggcccugagccag

SEQ ID NO: 2125655 - RNA, 14 nt, Homo sapiens
ucccugggccucag

SEQ ID NO: 2125656 - RNA, 23 nt, Homo sapiens
aaucacagcccucaugaucauuc

SEQ ID NO: 2125657 - RNA, 14 nt, Homo sapiens
agaaaucuuuccag

SEQ ID NO: 2125658 - RNA, 19 nt, Homo sapiens
aaaagagauggccugagaa

SEQ ID NO: 2125659 - RNA, 22 nt, Homo sapiens
agcuuccucuaaacuucucacc

SEQ ID NO: 2125660 - RNA, 11 nt, Homo sapiens
ggcauuugcag

SEQ ID NO: 2125661 - RNA, 13 nt, Homo sapiens
aauugacugccua

SEQ ID NO: 2125662 - RNA, 12 nt, Homo sapiens
acacagcacuuc

SEQ ID NO: 2125663 - RNA, 23 nt, Homo sapiens
gcauacuggacucuucaaaaacu

SEQ ID NO: 2125664 - RNA, 12 nt, Homo sapiens
agagaccucaaa

SEQ ID NO: 2125665 - RNA, 20 nt, Homo sapiens
uccuagauuacaucugccuu

SEQ ID NO: 2125666 - RNA, 14 nt, Homo sapiens
caacuacuacuggu

SEQ ID NO: 2125667 - RNA, 22 nt, Homo sapiens
ccucacuuucccugauccugca

SEQ ID NO: 2125668 - RNA, 18 nt, Homo sapiens
caaccaggaacauguaac

SEQ ID NO: 2125669 - RNA, 16 nt, Homo sapiens
gaacauacuguucacu

SEQ ID NO: 2125670 - RNA, 11 nt, Homo sapiens
gcuuuguccug

SEQ ID NO: 2125671 - RNA, 12 nt, Homo sapiens
cuugauuccugu

SEQ ID NO: 2125672 - RNA, 14 nt, Homo sapiens
uacccucugcagaa

SEQ ID NO: 2125673 - RNA, 19 nt, Homo sapiens
cugaaaacacugugcacau

SEQ ID NO: 2125674 - RNA, 21 nt, Homo sapiens
auugaauuauugggcuuaaua

SEQ ID NO: 2125675 - RNA, 15 nt, Homo sapiens
ucagucucuaaggaa

SEQ ID NO: 2125676 - RNA, 20 nt, Homo sapiens
cagcuggucuucagcaaaaa

SEQ ID NO: 2125677 - RNA, 18 nt, Homo sapiens
ugaugacugcuuaacucc

SEQ ID NO: 2125678 - RNA, 17 nt, Homo sapiens
cagugagauauuuggua

SEQ ID NO: 2125679 - RNA, 22 nt, Homo sapiens
uagagacaggguuucacugugu

SEQ ID NO: 2125680 - RNA, 15 nt, Homo sapiens
aaacuugcaguaucu

SEQ ID NO: 2125681 - RNA, 17 nt, Homo sapiens
caggcuggagacuggac

SEQ ID NO: 2125682 - RNA, 16 nt, Homo sapiens
ugacaauagagggcca

SEQ ID NO: 2125683 - RNA, 19 nt, Homo sapiens
gaugcacacacagaugcac

SEQ ID NO: 2125684 - RNA, 14 nt, Homo sapiens
acccaucaggacca

SEQ ID NO: 2125685 - RNA, 23 nt, Homo sapiens
uuuaagauccgcaauguggagca

SEQ ID NO: 2125686 - RNA, 14 nt, Homo sapiens
uaaaggugccagag

SEQ ID NO: 2125687 - RNA, 14 nt, Homo sapiens
cgaacugugcaguu

SEQ ID NO: 2125688 - RNA, 20 nt, Homo sapiens
ccucaaucuauucuguaaaa

SEQ ID NO: 2125689 - RNA, 17 nt, Homo sapiens
gagcguuugcccaaauc

SEQ ID NO: 2125690 - RNA, 17 nt, Homo sapiens
gccauugggcuacugua

SEQ ID NO: 2125691 - RNA, 14 nt, Homo sapiens
uuugauccuuuuga

SEQ ID NO: 2125692 - RNA, 14 nt, Homo sapiens
aaaugaccaaagau

SEQ ID NO: 2125693 - RNA, 13 nt, Homo sapiens
ggagccacacaga

SEQ ID NO: 2125694 - RNA, 13 nt, Homo sapiens
uccagaaguguga

SEQ ID NO: 2125695 - RNA, 15 nt, Homo sapiens
cauccccagggccau

SEQ ID NO: 2125696 - RNA, 18 nt, Homo sapiens
cugugcagaugcuuugcc

SEQ ID NO: 2125697 - RNA, 16 nt, Homo sapiens
aggauuugaacacuug

SEQ ID NO: 2125698 - RNA, 23 nt, Homo sapiens
cuuccuaggaacgucugguccua

SEQ ID NO: 2125699 - RNA, 11 nt, Homo sapiens
uugccagugau

SEQ ID NO: 2125700 - RNA, 14 nt, Homo sapiens
agggagcucacucc

SEQ ID NO: 2125701 - RNA, 18 nt, Homo sapiens
ucuacugacuuuucccau

SEQ ID NO: 2125702 - RNA, 23 nt, Homo sapiens
ucccuccuuccuuuuacuaccau

SEQ ID NO: 2125703 - RNA, 20 nt, Homo sapiens
ccuugcccagacuacagggc

SEQ ID NO: 2125704 - RNA, 12 nt, Homo sapiens
auguauucaccu

SEQ ID NO: 2125705 - RNA, 15 nt, Homo sapiens
aaaguuaaaagcaaa

SEQ ID NO: 2125706 - RNA, 22 nt, Homo sapiens
accuguugguuagauucaaggc

SEQ ID NO: 2125707 - RNA, 17 nt, Homo sapiens
gcaggcucucaggccag

SEQ ID NO: 2125708 - RNA, 21 nt, Homo sapiens
uuccuaaggcccagcugccag

SEQ ID NO: 2125709 - RNA, 22 nt, Homo sapiens
agagaagggaagaaggggccau

SEQ ID NO: 2125710 - RNA, 15 nt, Homo sapiens
acccugcugaccucc

SEQ ID NO: 2125711 - RNA, 11 nt, Homo sapiens
cauucauaucc

SEQ ID NO: 2125712 - RNA, 16 nt, Homo sapiens
uguuggaaaguaucau

SEQ ID NO: 2125713 - RNA, 20 nt, Homo sapiens
gaaaaguccacaagaacaau

SEQ ID NO: 2125714 - RNA, 11 nt, Homo sapiens
acuaugaccuu

SEQ ID NO: 2125715 - RNA, 23 nt, Homo sapiens
cauaggcugacuuuugcagaugg

SEQ ID NO: 2125716 - RNA, 20 nt, Homo sapiens
auggauccgugacagcacuu

SEQ ID NO: 2125717 - RNA, 19 nt, Homo sapiens
cauauguuaauaaacugca

SEQ ID NO: 2125718 - RNA, 17 nt, Homo sapiens
caguaacuaaagcuuua

SEQ ID NO: 2125719 - RNA, 18 nt, Homo sapiens
ccuuccagaucacugcca

SEQ ID NO: 2125720 - RNA, 19 nt, Homo sapiens
cuguaacuacaaugauggu

SEQ ID NO: 2125721 - RNA, 21 nt, Homo sapiens
acuccauuuggaaaauguuca

SEQ ID NO: 2125722 - RNA, 16 nt, Homo sapiens
ugaaaucugugcaaua

SEQ ID NO: 2125723 - RNA, 16 nt, Homo sapiens
cccgguguaugccaag

SEQ ID NO: 2125724 - RNA, 14 nt, Homo sapiens
acagcaucagcuca

SEQ ID NO: 2125725 - RNA, 12 nt, Homo sapiens
acacacagcucu

SEQ ID NO: 2125726 - RNA, 19 nt, Homo sapiens
agcucugguauauaaucca

SEQ ID NO: 2125727 - RNA, 17 nt, Homo sapiens
gaacauaaaucaguuaa

SEQ ID NO: 2125728 - RNA, 23 nt, Homo sapiens
uggaagggccaaggucugagcac

SEQ ID NO: 2125729 - RNA, 21 nt, Homo sapiens
cagggcucacccacugcugca

SEQ ID NO: 2125730 - RNA, 19 nt, Homo sapiens
cuccaccuugaaccuguca

SEQ ID NO: 2125731 - RNA, 19 nt, Homo sapiens
cagugagcugagaucaugc

SEQ ID NO: 2125732 - RNA, 17 nt, Homo sapiens
uugguagaaggacugaa

SEQ ID NO: 2125733 - RNA, 13 nt, Homo sapiens
ccaggccaaagau

SEQ ID NO: 2125734 - RNA, 18 nt, Homo sapiens
gcauggcaaaucaggggc

SEQ ID NO: 2125735 - RNA, 19 nt, Homo sapiens
ccuugcucucuucaauaaa

SEQ ID NO: 2125736 - RNA, 18 nt, Homo sapiens
cugcaagcugcuugccca

SEQ ID NO: 2125737 - RNA, 11 nt, Homo sapiens
cagaaaugcaa

SEQ ID NO: 2125738 - RNA, 18 nt, Homo sapiens
cugagagacaggacuagc

SEQ ID NO: 2125739 - RNA, 17 nt, Homo sapiens
auuguaaaacauucaca

SEQ ID NO: 2125740 - RNA, 23 nt, Homo sapiens
uuggacuaugauuaucuacagaa

SEQ ID NO: 2125741 - RNA, 15 nt, Homo sapiens
aauauacuugaauga

SEQ ID NO: 2125742 - RNA, 19 nt, Homo sapiens
cagguggccagaagagcuu

SEQ ID NO: 2125743 - RNA, 15 nt, Homo sapiens
cuuuuggccuugugg

SEQ ID NO: 2125744 - RNA, 15 nt, Homo sapiens
ucaugcacucaggca

SEQ ID NO: 2125745 - RNA, 18 nt, Homo sapiens
cauuugugccgacacugu

SEQ ID NO: 2125746 - RNA, 23 nt, Homo sapiens
cugaacaucuggcccaagugaag

SEQ ID NO: 2125747 - RNA, 22 nt, Homo sapiens
ccugggggcaggccagggcagu

SEQ ID NO: 2125748 - RNA, 15 nt, Homo sapiens
uaagggucuguugua

SEQ ID NO: 2125749 - RNA, 20 nt, Homo sapiens
agaggccaggaaucugccau

SEQ ID NO: 2125750 - RNA, 11 nt, Homo sapiens
ucaggaaaaug

SEQ ID NO: 2125751 - RNA, 17 nt, Homo sapiens
gccucuagaacagccag

SEQ ID NO: 2125752 - RNA, 16 nt, Homo sapiens
ucugcacauaggcagu

SEQ ID NO: 2125753 - RNA, 17 nt, Homo sapiens
aaagccucgccuuccau

SEQ ID NO: 2125754 - RNA, 14 nt, Homo sapiens
uguaccaguguacu

SEQ ID NO: 2125755 - RNA, 20 nt, Homo sapiens
caugaauacacaacuccacu

SEQ ID NO: 2125756 - RNA, 14 nt, Homo sapiens
gauggcaccagagg

SEQ ID NO: 2125757 - RNA, 19 nt, Homo sapiens
cacgugauggaccaaagcc

SEQ ID NO: 2125758 - RNA, 21 nt, Homo sapiens
ucgccaaggcuggagugcagu

SEQ ID NO: 2125759 - RNA, 13 nt, Homo sapiens
uuucccuuccagu

SEQ ID NO: 2125760 - RNA, 12 nt, Homo sapiens
ugugaccaaagc

SEQ ID NO: 2125761 - RNA, 17 nt, Homo sapiens
uuuuuaaacagugucau

SEQ ID NO: 2125762 - RNA, 13 nt, Homo sapiens
aagauccaggcag

SEQ ID NO: 2125763 - RNA, 14 nt, Homo sapiens
aacugucucucuuc

SEQ ID NO: 2125764 - RNA, 16 nt, Homo sapiens
uguguguucuguagag

SEQ ID NO: 2125765 - RNA, 18 nt, Homo sapiens
aauuccauuuccaguuca

SEQ ID NO: 2125766 - RNA, 11 nt, Homo sapiens
ugcacauuguu

SEQ ID NO: 2125767 - RNA, 19 nt, Homo sapiens
aaauggcccggacaugucu

SEQ ID NO: 2125768 - RNA, 22 nt, Homo sapiens
aaauaauaggauauaaaacaca

SEQ ID NO: 2125769 - RNA, 16 nt, Homo sapiens
guggauuggauuuguc

SEQ ID NO: 2125770 - RNA, 23 nt, Homo sapiens
ccaccaggagggaguggcagcua

SEQ ID NO: 2125771 - RNA, 19 nt, Homo sapiens
ugagcugacccaacacuua

SEQ ID NO: 2125772 - RNA, 12 nt, Homo sapiens
uugcuagauuuc

SEQ ID NO: 2125773 - RNA, 17 nt, Homo sapiens
accuaacgagaaauaga

SEQ ID NO: 2125774 - RNA, 16 nt, Homo sapiens
uucaccuguguacuga

SEQ ID NO: 2125775 - RNA, 23 nt, Homo sapiens
auauuuaauucuaguuucucuca

SEQ ID NO: 2125776 - RNA, 23 nt, Homo sapiens
agagaaaauuugaaaauguccuu

SEQ ID NO: 2125777 - RNA, 17 nt, Homo sapiens
cuuccccaaugcuccau

SEQ ID NO: 2125778 - RNA, 21 nt, Homo sapiens
aagagaaaaagcagaggccaa

SEQ ID NO: 2125779 - RNA, 15 nt, Homo sapiens
cuuaucucucaaaac

SEQ ID NO: 2125780 - RNA, 16 nt, Homo sapiens
caagcuggacuauggc

SEQ ID NO: 2125781 - RNA, 14 nt, Homo sapiens
agucccaguauucu

SEQ ID NO: 2125782 - RNA, 18 nt, Homo sapiens
ucuauaaaacacaucauc

SEQ ID NO: 2125783 - RNA, 16 nt, Homo sapiens
acaguauuuguacaaa

SEQ ID NO: 2125784 - RNA, 23 nt, Homo sapiens
uuuaaaaaaauacaguauucugu

SEQ ID NO: 2125785 - RNA, 14 nt, Homo sapiens
auuuuuacacaacu

SEQ ID NO: 2125786 - RNA, 12 nt, Homo sapiens
agccaaacccac

SEQ ID NO: 2125787 - RNA, 16 nt, Homo sapiens
caaaauuucagcauua

SEQ ID NO: 2125788 - RNA, 21 nt, Homo sapiens
acuaauuuuccauaagcuauu

SEQ ID NO: 2125789 - RNA, 21 nt, Homo sapiens
cagcauccuccacuuguucag

SEQ ID NO: 2125790 - RNA, 13 nt, Homo sapiens
uccugcugcauga

SEQ ID NO: 2125791 - RNA, 22 nt, Homo sapiens
augaggggaggggggcacaugc

SEQ ID NO: 2125792 - RNA, 20 nt, Homo sapiens
cucagguggcccuacuggga

SEQ ID NO: 2125793 - RNA, 17 nt, Homo sapiens
auagaugauacauguca

SEQ ID NO: 2125794 - RNA, 21 nt, Homo sapiens
auuucacugaauuucaaacau

SEQ ID NO: 2125795 - RNA, 12 nt, Homo sapiens
cucuuucuugga

SEQ ID NO: 2125796 - RNA, 13 nt, Homo sapiens
gcugggcuccccc

SEQ ID NO: 2125797 - RNA, 20 nt, Homo sapiens
uugcaccccuccuauaccau

SEQ ID NO: 2125798 - RNA, 13 nt, Homo sapiens
aguuguaaugugu

SEQ ID NO: 2125799 - RNA, 21 nt, Homo sapiens
gccaccucuugggcaugcuca

SEQ ID NO: 2125800 - RNA, 19 nt, Homo sapiens
cagcagugugagggugcag

SEQ ID NO: 2125801 - RNA, 19 nt, Homo sapiens
uggccuucauaucauccac

SEQ ID NO: 2125802 - RNA, 21 nt, Homo sapiens
uaaauguagaaagugauccau

SEQ ID NO: 2125803 - RNA, 17 nt, Homo sapiens
cacgcgugcaugcacac

SEQ ID NO: 2125804 - RNA, 17 nt, Homo sapiens
auaaagaaauccagauc

SEQ ID NO: 2125805 - RNA, 17 nt, Homo sapiens
guuaccauuguaauauu

SEQ ID NO: 2125806 - RNA, 20 nt, Homo sapiens
uguucucuuuaaucagcuua

SEQ ID NO: 2125807 - RNA, 16 nt, Homo sapiens
ccuuauugaacauucu

SEQ ID NO: 2125808 - RNA, 23 nt, Homo sapiens
ucuuacccgguaaguaaacaguc

SEQ ID NO: 2125809 - RNA, 18 nt, Homo sapiens
cuguugccgagcccagcu

SEQ ID NO: 2125810 - RNA, 13 nt, Homo sapiens
gaaauauuuccau

SEQ ID NO: 2125811 - RNA, 20 nt, Homo sapiens
guauauucaaccaaauacuu

SEQ ID NO: 2125812 - RNA, 23 nt, Homo sapiens
cucaccauacucccuuucagggc

SEQ ID NO: 2125813 - RNA, 17 nt, Homo sapiens
acuucuggaacauucca

SEQ ID NO: 2125814 - RNA, 19 nt, Homo sapiens
gaggcggagaauugcuuga

SEQ ID NO: 2125815 - RNA, 15 nt, Homo sapiens
uuuuccccauuguau

SEQ ID NO: 2125816 - RNA, 18 nt, Homo sapiens
gaauaaugcuguuuuaua

SEQ ID NO: 2125817 - RNA, 17 nt, Homo sapiens
ccuuaaaaugcauugaa

SEQ ID NO: 2125818 - RNA, 18 nt, Homo sapiens
augggaagcagacaauaa

SEQ ID NO: 2125819 - RNA, 23 nt, Homo sapiens
ucugggccucucuuggacccugg

SEQ ID NO: 2125820 - RNA, 17 nt, Homo sapiens
ggcgaggagagggcgcu

SEQ ID NO: 2125821 - RNA, 15 nt, Homo sapiens
cucauucuagcaccu

SEQ ID NO: 2125822 - RNA, 19 nt, Homo sapiens
acuucuccagauagcugaa

SEQ ID NO: 2125823 - RNA, 16 nt, Homo sapiens
gguccuggugggucag

SEQ ID NO: 2125824 - RNA, 23 nt, Homo sapiens
gaaggauugaucagagcauugug

SEQ ID NO: 2125825 - RNA, 19 nt, Homo sapiens
auagauaaagcugauuugu

SEQ ID NO: 2125826 - RNA, 21 nt, Homo sapiens
aagaacuuggcacacucucca

SEQ ID NO: 2125827 - RNA, 18 nt, Homo sapiens
aggcggguggaucaccug

SEQ ID NO: 2125828 - RNA, 20 nt, Homo sapiens
agacauucaaaacgugaugu

SEQ ID NO: 2125829 - RNA, 20 nt, Homo sapiens
ucaccagaauaaacccagcu

SEQ ID NO: 2125830 - RNA, 16 nt, Homo sapiens
uccuaugucaccuuga

SEQ ID NO: 2125831 - RNA, 15 nt, Homo sapiens
uggguaucagcaucu

SEQ ID NO: 2125832 - RNA, 15 nt, Homo sapiens
agggccccugcacac

SEQ ID NO: 2125833 - RNA, 14 nt, Homo sapiens
uccuaagaauguga

SEQ ID NO: 2125834 - RNA, 14 nt, Homo sapiens
uugaaagaaccaga

SEQ ID NO: 2125835 - RNA, 22 nt, Homo sapiens
cucuauuuuacuuuucugccaa

SEQ ID NO: 2125836 - RNA, 19 nt, Homo sapiens
gcuguguugucagcacugu

SEQ ID NO: 2125837 - RNA, 20 nt, Homo sapiens
augguagaaguuuggcugcu

SEQ ID NO: 2125838 - RNA, 12 nt, Homo sapiens
ggccaaguguac

SEQ ID NO: 2125839 - RNA, 11 nt, Homo sapiens
gagaagccauu

SEQ ID NO: 2125840 - RNA, 23 nt, Homo sapiens
gauggccacccgcccacagccag

SEQ ID NO: 2125841 - RNA, 18 nt, Homo sapiens
cagagguugcagugagcc

SEQ ID NO: 2125842 - RNA, 18 nt, Homo sapiens
ucaguucuuacacauucc

SEQ ID NO: 2125843 - RNA, 18 nt, Homo sapiens
uugagaaauaaagcacau

SEQ ID NO: 2125844 - RNA, 23 nt, Homo sapiens
auaaugcugaagaccccaaagau

SEQ ID NO: 2125845 - RNA, 19 nt, Homo sapiens
ccaucuuaacugaggcuca

SEQ ID NO: 2125846 - RNA, 13 nt, Homo sapiens
uaauccucuaugu

SEQ ID NO: 2125847 - RNA, 13 nt, Homo sapiens
cagaaaggugcag

SEQ ID NO: 2125848 - RNA, 15 nt, Homo sapiens
cauucuauuuuagaa

SEQ ID NO: 2125849 - RNA, 16 nt, Homo sapiens
ugcccccagggcacuu

SEQ ID NO: 2125850 - RNA, 19 nt, Homo sapiens
ugagauguugagaggaaca

SEQ ID NO: 2125851 - RNA, 19 nt, Homo sapiens
gccucaaaaacgcccucaa

SEQ ID NO: 2125852 - RNA, 22 nt, Homo sapiens
uuugacuggcuugcucccgccc

SEQ ID NO: 2125853 - RNA, 21 nt, Homo sapiens
ccacaaaugggaaaaccagac

SEQ ID NO: 2125854 - RNA, 16 nt, Homo sapiens
aggcuuggcuggugua

SEQ ID NO: 2125855 - RNA, 17 nt, Homo sapiens
uuuauaaaagacaugaa

SEQ ID NO: 2125856 - RNA, 17 nt, Homo sapiens
uaaauaaagguacacau

SEQ ID NO: 2125857 - RNA, 16 nt, Homo sapiens
agugaaaaggcugccu

SEQ ID NO: 2125858 - RNA, 14 nt, Homo sapiens
gacacacucaccau

SEQ ID NO: 2125859 - RNA, 20 nt, Homo sapiens
accaugcaggcaacauuacc

SEQ ID NO: 2125860 - RNA, 19 nt, Homo sapiens
uggucuaauuauuuacuca

SEQ ID NO: 2125861 - RNA, 12 nt, Homo sapiens
cuuccaccucag

SEQ ID NO: 2125862 - RNA, 13 nt, Homo sapiens
cauauuguagcuc

SEQ ID NO: 2125863 - RNA, 22 nt, Homo sapiens
caauuuagaaaaagaacaugca

SEQ ID NO: 2125864 - RNA, 16 nt, Homo sapiens
ugagguuucuucaggg

SEQ ID NO: 2125865 - RNA, 14 nt, Homo sapiens
agacuccgucucaa

SEQ ID NO: 2125866 - RNA, 17 nt, Homo sapiens
agcugaaaugcaggaag

SEQ ID NO: 2125867 - RNA, 22 nt, Homo sapiens
acugggguggaacugagugugc

SEQ ID NO: 2125868 - RNA, 20 nt, Homo sapiens
caucaggcuaagacccugug

SEQ ID NO: 2125869 - RNA, 19 nt, Homo sapiens
agucaaccaccacagauag

SEQ ID NO: 2125870 - RNA, 21 nt, Homo sapiens
auugaaaggcauucucugaag

SEQ ID NO: 2125871 - RNA, 17 nt, Homo sapiens
aacaaagccuuauccag

SEQ ID NO: 2125872 - RNA, 17 nt, Homo sapiens
ugaggagcgaucucagc

SEQ ID NO: 2125873 - RNA, 20 nt, Homo sapiens
auugacuuaauaaagcuuuu

SEQ ID NO: 2125874 - RNA, 15 nt, Homo sapiens
aguuaugacagccau

SEQ ID NO: 2125875 - RNA, 17 nt, Homo sapiens
caguuuuagauacucau

SEQ ID NO: 2125876 - RNA, 15 nt, Homo sapiens
acacacagauaugca

SEQ ID NO: 2125877 - RNA, 11 nt, Homo sapiens
cuguaccucaa

SEQ ID NO: 2125878 - RNA, 21 nt, Homo sapiens
uguaaacuaguuacuaaacau

SEQ ID NO: 2125879 - RNA, 19 nt, Homo sapiens
agggagccgcaccuuguca

SEQ ID NO: 2125880 - RNA, 20 nt, Homo sapiens
ugacuucacagcagccacuu

SEQ ID NO: 2125881 - RNA, 18 nt, Homo sapiens
gaacguaaguuguacaaa

SEQ ID NO: 2125882 - RNA, 16 nt, Homo sapiens
cccuggcugugcucua

SEQ ID NO: 2125883 - RNA, 16 nt, Homo sapiens
cagcggagaggacccc

SEQ ID NO: 2125884 - RNA, 13 nt, Homo sapiens
uuguuguuugcca

SEQ ID NO: 2125885 - RNA, 21 nt, Homo sapiens
ugacaugugcuggacacuguc

SEQ ID NO: 2125886 - RNA, 14 nt, Homo sapiens
ugcagaagaagcug

SEQ ID NO: 2125887 - RNA, 17 nt, Homo sapiens
cuagaggccuuuaguua

SEQ ID NO: 2125888 - RNA, 13 nt, Homo sapiens
cugcuuucacucu

SEQ ID NO: 2125889 - RNA, 13 nt, Homo sapiens
cuguauucacuua

SEQ ID NO: 2125890 - RNA, 21 nt, Homo sapiens
agaaguggcugccaaagagac

SEQ ID NO: 2125891 - RNA, 23 nt, Homo sapiens
ucagauuccacacaaaaugucac

SEQ ID NO: 2125892 - RNA, 15 nt, Homo sapiens
caauauggucccaaa

SEQ ID NO: 2125893 - RNA, 24 nt, Homo sapiens
gcccccagcuucugccacgcuuua

SEQ ID NO: 2125894 - RNA, 22 nt, Homo sapiens
aauaugaguaauacaucaaaga

SEQ ID NO: 2125895 - RNA, 17 nt, Homo sapiens
ugaccucugugaccaac

SEQ ID NO: 2125896 - RNA, 19 nt, Homo sapiens
caggaaauaaauuguaaaa

SEQ ID NO: 2125897 - RNA, 14 nt, Homo sapiens
cagaggcugcagga

SEQ ID NO: 2125898 - RNA, 18 nt, Homo sapiens
cuugcucacagcugugcu

SEQ ID NO: 2125899 - RNA, 19 nt, Homo sapiens
uccaucccccguggccauu

SEQ ID NO: 2125900 - RNA, 19 nt, Homo sapiens
ccuuugcuuuacagcacug

SEQ ID NO: 2125901 - RNA, 14 nt, Homo sapiens
acagaauuugucag

SEQ ID NO: 2125902 - RNA, 15 nt, Homo sapiens
uauucuagccugcau

SEQ ID NO: 2125903 - RNA, 18 nt, Homo sapiens
aguaguucuguauuugaa

SEQ ID NO: 2125904 - RNA, 19 nt, Homo sapiens
aaacacaaaauccauucca

SEQ ID NO: 2125905 - RNA, 22 nt, Homo sapiens
uccugucaauggggguguagua

SEQ ID NO: 2125906 - RNA, 16 nt, Homo sapiens
aguacuauuacuagua

SEQ ID NO: 2125907 - RNA, 16 nt, Homo sapiens
ggaaagauuugugaac

SEQ ID NO: 2125908 - RNA, 16 nt, Homo sapiens
uaacauguuaaaccau

SEQ ID NO: 2125909 - RNA, 18 nt, Homo sapiens
cccacucccuuccccaua

SEQ ID NO: 2125910 - RNA, 18 nt, Homo sapiens
uuaauauacuugaaugaa

SEQ ID NO: 2125911 - RNA, 14 nt, Homo sapiens
cuuaaaauagccau

SEQ ID NO: 2125912 - RNA, 17 nt, Homo sapiens
cacaagaaguagcuuca

SEQ ID NO: 2125913 - RNA, 14 nt, Homo sapiens
cagaucgagucaca

SEQ ID NO: 2125914 - RNA, 19 nt, Homo sapiens
cgagucucuucuccacugg

SEQ ID NO: 2125915 - RNA, 15 nt, Homo sapiens
cauucucuuguuauu

SEQ ID NO: 2125916 - RNA, 21 nt, Homo sapiens
cuuugcauuccuuacuugcac

SEQ ID NO: 2125917 - RNA, 19 nt, Homo sapiens
cccuguagugaccuguaaa

SEQ ID NO: 2125918 - RNA, 14 nt, Homo sapiens
ugaaagaggccaaa

SEQ ID NO: 2125919 - RNA, 12 nt, Homo sapiens
agguauaauuca

SEQ ID NO: 2125920 - RNA, 16 nt, Homo sapiens
acagucaauucugauu

SEQ ID NO: 2125921 - RNA, 15 nt, Homo sapiens
cagaggucaucccuu

SEQ ID NO: 2125922 - RNA, 15 nt, Homo sapiens
cacagggcaugccug

SEQ ID NO: 2125923 - RNA, 18 nt, Homo sapiens
auaaauacucagugauga

SEQ ID NO: 2125924 - RNA, 17 nt, Homo sapiens
caaaaauugucccuuaa

SEQ ID NO: 2125925 - RNA, 19 nt, Homo sapiens
gcccugaggcucagucucu

SEQ ID NO: 2125926 - RNA, 16 nt, Homo sapiens
cauauuguuacuggua

SEQ ID NO: 2125927 - RNA, 17 nt, Homo sapiens
cccuccacaccuccggc

SEQ ID NO: 2125928 - RNA, 23 nt, Homo sapiens
agggcagggcaucuccugugcau

SEQ ID NO: 2125929 - RNA, 12 nt, Homo sapiens
acugcauuauuu

SEQ ID NO: 2125930 - RNA, 12 nt, Homo sapiens
guugcauugcuu

SEQ ID NO: 2125931 - RNA, 20 nt, Homo sapiens
ucucugaaauauagguuuaa

SEQ ID NO: 2125932 - RNA, 15 nt, Homo sapiens
gccagagaaagcaaa

SEQ ID NO: 2125933 - RNA, 19 nt, Homo sapiens
uggaagguuagguuuguca

SEQ ID NO: 2125934 - RNA, 16 nt, Homo sapiens
cuuuucugaggacuca

SEQ ID NO: 2125935 - RNA, 21 nt, Homo sapiens
caguggcgcgaucucagcuca

SEQ ID NO: 2125936 - RNA, 22 nt, Homo sapiens
cagccgccuggagaugacuuga

SEQ ID NO: 2125937 - RNA, 15 nt, Homo sapiens
uguuucaccauacuu

SEQ ID NO: 2125938 - RNA, 18 nt, Homo sapiens
gaucuugcucucggugcu

SEQ ID NO: 2125939 - RNA, 13 nt, Homo sapiens
gcaguucuacuca

SEQ ID NO: 2125940 - RNA, 21 nt, Homo sapiens
cuccaauauccguuauuuucc

SEQ ID NO: 2125941 - RNA, 14 nt, Homo sapiens
uaaaaagcauuauu

SEQ ID NO: 2125942 - RNA, 14 nt, Homo sapiens
acacuaaacuucau

SEQ ID NO: 2125943 - RNA, 19 nt, Homo sapiens
cagaggggcccuggcugua

SEQ ID NO: 2125944 - RNA, 17 nt, Homo sapiens
gagaucuuaugucaagu

SEQ ID NO: 2125945 - RNA, 19 nt, Homo sapiens
ggugucuggauucccagga

SEQ ID NO: 2125946 - RNA, 14 nt, Homo sapiens
agaaauaauaugca

SEQ ID NO: 2125947 - RNA, 15 nt, Homo sapiens
ggugcagagugcaga

SEQ ID NO: 2125948 - RNA, 14 nt, Homo sapiens
ucuaauuucugaaa

SEQ ID NO: 2125949 - RNA, 14 nt, Homo sapiens
cuacaccacacaca

SEQ ID NO: 2125950 - RNA, 13 nt, Homo sapiens
accauacauuuaa

SEQ ID NO: 2125951 - RNA, 14 nt, Homo sapiens
gaugugcacugcau

SEQ ID NO: 2125952 - RNA, 22 nt, Homo sapiens
aucucaaguauaugucauuuac

SEQ ID NO: 2125953 - RNA, 22 nt, Homo sapiens
ccuccagagaccccaggaacaa

SEQ ID NO: 2125954 - RNA, 21 nt, Homo sapiens
auuguacaagguauuuacaca

SEQ ID NO: 2125955 - RNA, 22 nt, Homo sapiens
ucaacagcauuuucaagcaguu

SEQ ID NO: 2125956 - RNA, 12 nt, Homo sapiens
auuauuacuguu

SEQ ID NO: 2125957 - RNA, 12 nt, Homo sapiens
ugauuuacauaa

SEQ ID NO: 2125958 - RNA, 13 nt, Homo sapiens
cccaccagcuuua

SEQ ID NO: 2125959 - RNA, 22 nt, Homo sapiens
aaagugcugggauuacaggcgu

SEQ ID NO: 2125960 - RNA, 15 nt, Homo sapiens
gacuuacugccugac

SEQ ID NO: 2125961 - RNA, 20 nt, Homo sapiens
aauuugugugguaugucacu

SEQ ID NO: 2125962 - RNA, 15 nt, Homo sapiens
auuuccuccugggca

SEQ ID NO: 2125963 - RNA, 20 nt, Homo sapiens
ggaaacuggcgaucucccag

SEQ ID NO: 2125964 - RNA, 12 nt, Homo sapiens
uuauuaccucug

SEQ ID NO: 2125965 - RNA, 21 nt, Homo sapiens
acaaucuuaagagcuugaucu

SEQ ID NO: 2125966 - RNA, 22 nt, Homo sapiens
cuugaaucaagucagcaacaga

SEQ ID NO: 2125967 - RNA, 15 nt, Homo sapiens
cacugcacuccagcu

SEQ ID NO: 2125968 - RNA, 19 nt, Homo sapiens
guaaucccccuugccaaau

SEQ ID NO: 2125969 - RNA, 20 nt, Homo sapiens
ucuaaauuuuauaucuugua

SEQ ID NO: 2125970 - RNA, 20 nt, Homo sapiens
uauaaaugggaaaucagugu

SEQ ID NO: 2125971 - RNA, 21 nt, Homo sapiens
uggcauauauguucaaauuca

SEQ ID NO: 2125972 - RNA, 17 nt, Homo sapiens
ugcuuguacagugucag

SEQ ID NO: 2125973 - RNA, 19 nt, Homo sapiens
uccuacuucucuuguaaaa

SEQ ID NO: 2125974 - RNA, 18 nt, Homo sapiens
cucacugaaaccaggugg

SEQ ID NO: 2125975 - RNA, 17 nt, Homo sapiens
acagaugcccccgugaa

SEQ ID NO: 2125976 - RNA, 13 nt, Homo sapiens
auuuuguuucaaa

SEQ ID NO: 2125977 - RNA, 13 nt, Homo sapiens
ccuccuacuccag

SEQ ID NO: 2125978 - RNA, 21 nt, Homo sapiens
uuucuucauuucucuugcuca

SEQ ID NO: 2125979 - RNA, 23 nt, Homo sapiens
agcaauauuuauggaugcaacac

SEQ ID NO: 2125980 - RNA, 18 nt, Homo sapiens
auucaggaagcagcuuuc

SEQ ID NO: 2125981 - RNA, 22 nt, Homo sapiens
cuuaguguuuggguauauucau

SEQ ID NO: 2125982 - RNA, 16 nt, Homo sapiens
aagggaaagauaauaa

SEQ ID NO: 2125983 - RNA, 19 nt, Homo sapiens
aaaaguccuugauuuagca

SEQ ID NO: 2125984 - RNA, 13 nt, Homo sapiens
gcucccccugucc

SEQ ID NO: 2125985 - RNA, 22 nt, Homo sapiens
aaguugcccaccaaaacacaga

SEQ ID NO: 2125986 - RNA, 15 nt, Homo sapiens
cugaaagaagacauc

SEQ ID NO: 2125987 - RNA, 19 nt, Homo sapiens
uucucaaucagugcaguga

SEQ ID NO: 2125988 - RNA, 15 nt, Homo sapiens
accuugagacagcuu

SEQ ID NO: 2125989 - RNA, 18 nt, Homo sapiens
gacauaccccacugggca

SEQ ID NO: 2125990 - RNA, 22 nt, Homo sapiens
acaagaauuucuugguaagaag

SEQ ID NO: 2125991 - RNA, 16 nt, Homo sapiens
ugucuguccuuuauga

SEQ ID NO: 2125992 - RNA, 12 nt, Homo sapiens
ccucucugaguc

SEQ ID NO: 2125993 - RNA, 17 nt, Homo sapiens
agucucacucugucacc

SEQ ID NO: 2125994 - RNA, 17 nt, Homo sapiens
auuauuacguggcaaaa

SEQ ID NO: 2125995 - RNA, 17 nt, Homo sapiens
gcugugccaccaagcau

SEQ ID NO: 2125996 - RNA, 20 nt, Homo sapiens
ucaacagaaacuaaaugaac

SEQ ID NO: 2125997 - RNA, 18 nt, Homo sapiens
cuuauaacaaaaaagccc

SEQ ID NO: 2125998 - RNA, 21 nt, Homo sapiens
aaauguuuuuaaaaaggucau

SEQ ID NO: 2125999 - RNA, 13 nt, Homo sapiens
gagccucuggaag

SEQ ID NO: 2126000 - RNA, 19 nt, Homo sapiens
gaagaaccauuuacaugca

SEQ ID NO: 2126001 - RNA, 18 nt, Homo sapiens
gcccccauuuccucgggu

SEQ ID NO: 2126002 - RNA, 23 nt, Homo sapiens
guuuuggguagcugccacuugaa

SEQ ID NO: 2126003 - RNA, 14 nt, Homo sapiens
uguuaagauuuauc

SEQ ID NO: 2126004 - RNA, 21 nt, Homo sapiens
uaaacauucaucaagcuguac

SEQ ID NO: 2126005 - RNA, 20 nt, Homo sapiens
ugagagcccuucaugcauuu

SEQ ID NO: 2126006 - RNA, 16 nt, Homo sapiens
aaagcaguguuuucac

SEQ ID NO: 2126007 - RNA, 18 nt, Homo sapiens
uacugcauuucacucugg

SEQ ID NO: 2126008 - RNA, 18 nt, Homo sapiens
agccagaauucacuagga

SEQ ID NO: 2126009 - RNA, 22 nt, Homo sapiens
cagcccugaacaaagcaccuca

SEQ ID NO: 2126010 - RNA, 13 nt, Homo sapiens
aaaagccagccag

SEQ ID NO: 2126011 - RNA, 16 nt, Homo sapiens
uucugggaaaggugcu

SEQ ID NO: 2126012 - RNA, 19 nt, Homo sapiens
cauuuaccagcagcccugg

SEQ ID NO: 2126013 - RNA, 16 nt, Homo sapiens
caugcuacacacugca

SEQ ID NO: 2126014 - RNA, 21 nt, Homo sapiens
acugcagccuuucacaggacu

SEQ ID NO: 2126015 - RNA, 23 nt, Homo sapiens
auaaaauuuaacuuuugagcaua

SEQ ID NO: 2126016 - RNA, 23 nt, Homo sapiens
ucucauagccucgaauaucuuaa

SEQ ID NO: 2126017 - RNA, 13 nt, Homo sapiens
cugggaccacugg

SEQ ID NO: 2126018 - RNA, 13 nt, Homo sapiens
caccaccacuuac

SEQ ID NO: 2126019 - RNA, 16 nt, Homo sapiens
agugaauuacagacaa

SEQ ID NO: 2126020 - RNA, 21 nt, Homo sapiens
auaaaaaucauucuacugaac

SEQ ID NO: 2126021 - RNA, 13 nt, Homo sapiens
gaggaagccucua

SEQ ID NO: 2126022 - RNA, 15 nt, Homo sapiens
agcuuggagugccac

SEQ ID NO: 2126023 - RNA, 19 nt, Homo sapiens
uaaguacacaauaagcaaa

SEQ ID NO: 2126024 - RNA, 22 nt, Homo sapiens
cucccucucucuucugcuccac

SEQ ID NO: 2126025 - RNA, 12 nt, Homo sapiens
uaucuccuccaa

SEQ ID NO: 2126026 - RNA, 15 nt, Homo sapiens
uaaccccaaaccucc

SEQ ID NO: 2126027 - RNA, 19 nt, Homo sapiens
aaaaucagagucuauaaca

SEQ ID NO: 2126028 - RNA, 16 nt, Homo sapiens
accaaugcauuaccuu

SEQ ID NO: 2126029 - RNA, 11 nt, Homo sapiens
ccccaacagca

SEQ ID NO: 2126030 - RNA, 19 nt, Homo sapiens
cucccuaaggaaucugaaa

SEQ ID NO: 2126031 - RNA, 15 nt, Homo sapiens
uacaucugcugugug

SEQ ID NO: 2126032 - RNA, 18 nt, Homo sapiens
aggaccuuggaagagcaa

SEQ ID NO: 2126033 - RNA, 16 nt, Homo sapiens
ucacugaaacuucaag

SEQ ID NO: 2126034 - RNA, 16 nt, Homo sapiens
cugcuuuaucagggga

SEQ ID NO: 2126035 - RNA, 23 nt, Homo sapiens
ggauauguguaaauguuaugacu

SEQ ID NO: 2126036 - RNA, 21 nt, Homo sapiens
gucuuacguuuuucuggugcu

SEQ ID NO: 2126037 - RNA, 16 nt, Homo sapiens
auggucuuuccacuuu

SEQ ID NO: 2126038 - RNA, 14 nt, Homo sapiens
aaauguauuuuaca

SEQ ID NO: 2126039 - RNA, 15 nt, Homo sapiens
caagcuuacuacagu

SEQ ID NO: 2126040 - RNA, 20 nt, Homo sapiens
cuccucccaaggcauucucc

SEQ ID NO: 2126041 - RNA, 16 nt, Homo sapiens
uccauggcaaaugggc

SEQ ID NO: 2126042 - RNA, 21 nt, Homo sapiens
aagucaaggacgaauuugcac

SEQ ID NO: 2126043 - RNA, 18 nt, Homo sapiens
auucaucaagaaugagga

SEQ ID NO: 2126044 - RNA, 16 nt, Homo sapiens
cgaccugcgccaaucc

SEQ ID NO: 2126045 - RNA, 23 nt, Homo sapiens
augauguggguguccugcagaag

SEQ ID NO: 2126046 - RNA, 16 nt, Homo sapiens
aaguaaaagucuaccu

SEQ ID NO: 2126047 - RNA, 21 nt, Homo sapiens
uugcagugagccgagauugca

SEQ ID NO: 2126048 - RNA, 15 nt, Homo sapiens
uuuaaaguguggaag

SEQ ID NO: 2126049 - RNA, 21 nt, Homo sapiens
aagaggcuauuuaaaaguaua

SEQ ID NO: 2126050 - RNA, 12 nt, Homo sapiens
uuuaaacuaaga

SEQ ID NO: 2126051 - RNA, 18 nt, Homo sapiens
cauuauaaauaauguuca

SEQ ID NO: 2126052 - RNA, 18 nt, Homo sapiens
ccuugacuugaaaugcuc

SEQ ID NO: 2126053 - RNA, 13 nt, Homo sapiens
cuguaucuccagc

SEQ ID NO: 2126054 - RNA, 20 nt, Homo sapiens
ugugugacucuuuagcaaaa

SEQ ID NO: 2126055 - RNA, 13 nt, Homo sapiens
cuuuaggccaggc

SEQ ID NO: 2126056 - RNA, 18 nt, Homo sapiens
cuggggcuuccaucccaa

SEQ ID NO: 2126057 - RNA, 18 nt, Homo sapiens
uaauaucaucaguauuga

SEQ ID NO: 2126058 - RNA, 17 nt, Homo sapiens
cccggggccagcacuuc

SEQ ID NO: 2126059 - RNA, 20 nt, Homo sapiens
uagcccaucugaugcuucua

SEQ ID NO: 2126060 - RNA, 20 nt, Homo sapiens
aagauuguauagugcauguu

SEQ ID NO: 2126061 - RNA, 13 nt, Homo sapiens
aguucaccaucuc

SEQ ID NO: 2126062 - RNA, 17 nt, Homo sapiens
agccuggccccaagcau

SEQ ID NO: 2126063 - RNA, 17 nt, Homo sapiens
auuuauggauaucacac

SEQ ID NO: 2126064 - RNA, 21 nt, Homo sapiens
uccaaggaaaccacagcugcu

SEQ ID NO: 2126065 - RNA, 19 nt, Homo sapiens
ugcucugcuggucuucaau

SEQ ID NO: 2126066 - RNA, 23 nt, Homo sapiens
guauuuccugcuucccuguugaa

SEQ ID NO: 2126067 - RNA, 13 nt, Homo sapiens
caauggugcgauc

SEQ ID NO: 2126068 - RNA, 20 nt, Homo sapiens
agaaaacacccaauaccuua

SEQ ID NO: 2126069 - RNA, 16 nt, Homo sapiens
auauuccagaccaaaa

SEQ ID NO: 2126070 - RNA, 15 nt, Homo sapiens
gcaggcgugaccuga

SEQ ID NO: 2126071 - RNA, 20 nt, Homo sapiens
uagauaaucucuccauuccc

SEQ ID NO: 2126072 - RNA, 13 nt, Homo sapiens
uaacaaaugacug

SEQ ID NO: 2126073 - RNA, 15 nt, Homo sapiens
uguagauucagguaa

SEQ ID NO: 2126074 - RNA, 13 nt, Homo sapiens
auuaaauuuggcu

SEQ ID NO: 2126075 - RNA, 20 nt, Homo sapiens
guagugaaauuauacagaua

SEQ ID NO: 2126076 - RNA, 23 nt, Homo sapiens
uuuucaauaaugugaacugcuga

SEQ ID NO: 2126077 - RNA, 15 nt, Homo sapiens
augauccuugcacag

SEQ ID NO: 2126078 - RNA, 22 nt, Homo sapiens
acccaauucaaaacauugugcc

SEQ ID NO: 2126079 - RNA, 20 nt, Homo sapiens
caagauaccuuugcguggau

SEQ ID NO: 2126080 - RNA, 16 nt, Homo sapiens
aauuaaaaccaauuua

SEQ ID NO: 2126081 - RNA, 17 nt, Homo sapiens
cugggcuggacuggcca

SEQ ID NO: 2126082 - RNA, 14 nt, Homo sapiens
cuugggaacuacag

SEQ ID NO: 2126083 - RNA, 18 nt, Homo sapiens
acagauuuuuucuuuaaa

SEQ ID NO: 2126084 - RNA, 18 nt, Homo sapiens
uuaugaaaggucauuaaa

SEQ ID NO: 2126085 - RNA, 18 nt, Homo sapiens
gaaguuuauacaguacag

SEQ ID NO: 2126086 - RNA, 16 nt, Homo sapiens
caucauuaaacgggcu

SEQ ID NO: 2126087 - RNA, 20 nt, Homo sapiens
uaucauauuauuauccuccu

SEQ ID NO: 2126088 - RNA, 22 nt, Homo sapiens
acccuauaucuauaaacacugu

SEQ ID NO: 2126089 - RNA, 19 nt, Homo sapiens
uaugugaccucacgugcaa

SEQ ID NO: 2126090 - RNA, 15 nt, Homo sapiens
ucccauggaaccacu

SEQ ID NO: 2126091 - RNA, 18 nt, Homo sapiens
uaauauauccacaucuaa

SEQ ID NO: 2126092 - RNA, 16 nt, Homo sapiens
cacacacaguuugaga

SEQ ID NO: 2126093 - RNA, 22 nt, Homo sapiens
caauauuuccauguuucauuaa

SEQ ID NO: 2126094 - RNA, 19 nt, Homo sapiens
caguucccuccuucuuaca

SEQ ID NO: 2126095 - RNA, 17 nt, Homo sapiens
aaagggcuaaacaugug

SEQ ID NO: 2126096 - RNA, 16 nt, Homo sapiens
gcccaacccacugucu

SEQ ID NO: 2126097 - RNA, 14 nt, Homo sapiens
acaucuucagcucc

SEQ ID NO: 2126098 - RNA, 19 nt, Homo sapiens
ugcccagccuggaugccau

SEQ ID NO: 2126099 - RNA, 17 nt, Homo sapiens
cucagguucccugccac

SEQ ID NO: 2126100 - RNA, 19 nt, Homo sapiens
agauauauagauauauauc

SEQ ID NO: 2126101 - RNA, 23 nt, Homo sapiens
acucuggccaggaacucuaaggu

SEQ ID NO: 2126102 - RNA, 20 nt, Homo sapiens
ccugaacagcauggcacucc

SEQ ID NO: 2126103 - RNA, 21 nt, Homo sapiens
aguaaucuguugacagugcca

SEQ ID NO: 2126104 - RNA, 14 nt, Homo sapiens
ugugugugugcaca

SEQ ID NO: 2126105 - RNA, 16 nt, Homo sapiens
uauaucuuaaugcaga

SEQ ID NO: 2126106 - RNA, 22 nt, Homo sapiens
cugugaggguagaaaaccucac

SEQ ID NO: 2126107 - RNA, 23 nt, Homo sapiens
agcaggcagcgccaagugcgugc

SEQ ID NO: 2126108 - RNA, 16 nt, Homo sapiens
auaacugaacauccaa

SEQ ID NO: 2126109 - RNA, 15 nt, Homo sapiens
cuaucccucuccuaa

SEQ ID NO: 2126110 - RNA, 14 nt, Homo sapiens
aaaugcaugauaau

SEQ ID NO: 2126111 - RNA, 22 nt, Homo sapiens
cuccugcugggcgugugugaca

SEQ ID NO: 2126112 - RNA, 16 nt, Homo sapiens
acgguggucacuggaa

SEQ ID NO: 2126113 - RNA, 20 nt, Homo sapiens
uagauuuuuagauuccuacu

SEQ ID NO: 2126114 - RNA, 20 nt, Homo sapiens
agauguggcaaagugcugua

SEQ ID NO: 2126115 - RNA, 23 nt, Homo sapiens
caugagaccuugcuaagcacucu

SEQ ID NO: 2126116 - RNA, 16 nt, Homo sapiens
cugcacaggcacuguc

SEQ ID NO: 2126117 - RNA, 20 nt, Homo sapiens
guccugaaccgacugacccu

SEQ ID NO: 2126118 - RNA, 18 nt, Homo sapiens
agguuagggugugugcca

SEQ ID NO: 2126119 - RNA, 22 nt, Homo sapiens
cuucaaauuagaagacauuuau

SEQ ID NO: 2126120 - RNA, 22 nt, Homo sapiens
ugaagaaguuuuuggugucaca

SEQ ID NO: 2126121 - RNA, 22 nt, Homo sapiens
ggccagagagggcgugggcgcu

SEQ ID NO: 2126122 - RNA, 21 nt, Homo sapiens
uucauuauagacaacgaugaa

SEQ ID NO: 2126123 - RNA, 14 nt, Homo sapiens
caaugaauccccaa

SEQ ID NO: 2126124 - RNA, 19 nt, Homo sapiens
gugucaccuuuucuugccu

SEQ ID NO: 2126125 - RNA, 23 nt, Homo sapiens
ccgacugccccugcugugcugcu

SEQ ID NO: 2126126 - RNA, 16 nt, Homo sapiens
ugugcaucaaccagga

SEQ ID NO: 2126127 - RNA, 18 nt, Homo sapiens
auucugauucgaaugaca

SEQ ID NO: 2126128 - RNA, 21 nt, Homo sapiens
ccauuuguuggggcaguggua

SEQ ID NO: 2126129 - RNA, 23 nt, Homo sapiens
uucguggggaacugcguggugcu

SEQ ID NO: 2126130 - RNA, 15 nt, Homo sapiens
guggaauauguuacc

SEQ ID NO: 2126131 - RNA, 21 nt, Homo sapiens
uuccagcaaaauggaagcaaa

SEQ ID NO: 2126132 - RNA, 22 nt, Homo sapiens
cagaccaguuucagagaaauac

SEQ ID NO: 2126133 - RNA, 13 nt, Homo sapiens
cacacacaugcau

SEQ ID NO: 2126134 - RNA, 17 nt, Homo sapiens
uuacucagagcagauga

SEQ ID NO: 2126135 - RNA, 22 nt, Homo sapiens
gaauaaugcuaccaggaugcua

SEQ ID NO: 2126136 - RNA, 14 nt, Homo sapiens
aguguauguauaca

SEQ ID NO: 2126137 - RNA, 21 nt, Homo sapiens
ugccccagauggcuuugugau

SEQ ID NO: 2126138 - RNA, 15 nt, Homo sapiens
ugggaauaauugcuu

SEQ ID NO: 2126139 - RNA, 15 nt, Homo sapiens
uguccuaaaugcaaa

SEQ ID NO: 2126140 - RNA, 23 nt, Homo sapiens
ugcacugacugugaaaccuuuac

SEQ ID NO: 2126141 - RNA, 17 nt, Homo sapiens
ugacugcugcuccccac

SEQ ID NO: 2126142 - RNA, 19 nt, Homo sapiens
gccagacgugguggcucac

SEQ ID NO: 2126143 - RNA, 14 nt, Homo sapiens
gcugcccugugaga

SEQ ID NO: 2126144 - RNA, 16 nt, Homo sapiens
auggcagaggugcaag

SEQ ID NO: 2126145 - RNA, 19 nt, Homo sapiens
guuaaaaguguacaaguug

SEQ ID NO: 2126146 - RNA, 20 nt, Homo sapiens
ucaggaauuuuguaaucuca

SEQ ID NO: 2126147 - RNA, 12 nt, Homo sapiens
cggaacaguauc

SEQ ID NO: 2126148 - RNA, 16 nt, Homo sapiens
aacguacauuugugcu

SEQ ID NO: 2126149 - RNA, 18 nt, Homo sapiens
acaaacauucuaauuaaa

SEQ ID NO: 2126150 - RNA, 22 nt, Homo sapiens
ugaacauccccucccaucauua

SEQ ID NO: 2126151 - RNA, 17 nt, Homo sapiens
gcuggaggaugugggca

SEQ ID NO: 2126152 - RNA, 13 nt, Homo sapiens
auuauuauuguga

SEQ ID NO: 2126153 - RNA, 18 nt, Homo sapiens
ucaaggaggcccacugug

SEQ ID NO: 2126154 - RNA, 19 nt, Homo sapiens
gucagagacagauaccucc

SEQ ID NO: 2126155 - RNA, 22 nt, Homo sapiens
ucuuacguggagagugcacuga

SEQ ID NO: 2126156 - RNA, 13 nt, Homo sapiens
ggccauggcaauu

SEQ ID NO: 2126157 - RNA, 14 nt, Homo sapiens
uacaacucacauua

SEQ ID NO: 2126158 - RNA, 22 nt, Homo sapiens
cugauuaaaaaaucucccaaag

SEQ ID NO: 2126159 - RNA, 19 nt, Homo sapiens
cuugugcucuuuucaagaa

SEQ ID NO: 2126160 - RNA, 13 nt, Homo sapiens
uguuugugccaua

SEQ ID NO: 2126161 - RNA, 14 nt, Homo sapiens
agcaaugccauuuc

SEQ ID NO: 2126162 - RNA, 20 nt, Homo sapiens
cucuaguaagaugcacugaa

SEQ ID NO: 2126163 - RNA, 18 nt, Homo sapiens
uagaacuaaaguaucuga

SEQ ID NO: 2126164 - RNA, 22 nt, Homo sapiens
uuuccccuuuuaaaaacucaga

SEQ ID NO: 2126165 - RNA, 18 nt, Homo sapiens
cuaauguuauuucuuaaa

SEQ ID NO: 2126166 - RNA, 14 nt, Homo sapiens
uuucaaaacauaca

SEQ ID NO: 2126167 - RNA, 21 nt, Homo sapiens
uggucccaaguaguagugucu

SEQ ID NO: 2126168 - RNA, 19 nt, Homo sapiens
ccaguagcuaaagugcaag

SEQ ID NO: 2126169 - RNA, 13 nt, Homo sapiens
ucucucuggcuuc

SEQ ID NO: 2126170 - RNA, 22 nt, Homo sapiens
ucucaccaugugacacacuggc

SEQ ID NO: 2126171 - RNA, 22 nt, Homo sapiens
uguguaaauacuucaauaaagc

SEQ ID NO: 2126172 - RNA, 15 nt, Homo sapiens
aucuugagggaccaa

SEQ ID NO: 2126173 - RNA, 17 nt, Homo sapiens
auaaagcccuugaacca

SEQ ID NO: 2126174 - RNA, 15 nt, Homo sapiens
uggaccugccuccug

SEQ ID NO: 2126175 - RNA, 20 nt, Homo sapiens
ucauagugauagagugcagu

SEQ ID NO: 2126176 - RNA, 17 nt, Homo sapiens
ccuuucuaaaccucucu

SEQ ID NO: 2126177 - RNA, 14 nt, Homo sapiens
uuugaugauugcua

SEQ ID NO: 2126178 - RNA, 22 nt, Homo sapiens
cccaucugugcaguaagccugu

SEQ ID NO: 2126179 - RNA, 21 nt, Homo sapiens
ucccacccacaugugacacau

SEQ ID NO: 2126180 - RNA, 17 nt, Homo sapiens
agaacagaggcauuuaa

SEQ ID NO: 2126181 - RNA, 22 nt, Homo sapiens
auguugauccauccagcuugcc

SEQ ID NO: 2126182 - RNA, 13 nt, Homo sapiens
aacuaacacuauu

SEQ ID NO: 2126183 - RNA, 20 nt, Homo sapiens
ucagcagcgugcacaucugc

SEQ ID NO: 2126184 - RNA, 23 nt, Homo sapiens
cuuuauaaauucauaacugguag

SEQ ID NO: 2126185 - RNA, 12 nt, Homo sapiens
cugguuuuaaca

SEQ ID NO: 2126186 - RNA, 20 nt, Homo sapiens
agucuucagcagagaaguuu

SEQ ID NO: 2126187 - RNA, 13 nt, Homo sapiens
uaucccauuugcc

SEQ ID NO: 2126188 - RNA, 13 nt, Homo sapiens
aacuuacacugua

SEQ ID NO: 2126189 - RNA, 15 nt, Homo sapiens
ucuaucccaaccucu

SEQ ID NO: 2126190 - RNA, 17 nt, Homo sapiens
gaaaguauucuguacuc

SEQ ID NO: 2126191 - RNA, 12 nt, Homo sapiens
caaguacuucau

SEQ ID NO: 2126192 - RNA, 16 nt, Homo sapiens
ggagugguaacagcuc

SEQ ID NO: 2126193 - RNA, 16 nt, Homo sapiens
guuccacagaggacac

SEQ ID NO: 2126194 - RNA, 19 nt, Homo sapiens
cuuugcgccucuuggcucc

SEQ ID NO: 2126195 - RNA, 19 nt, Homo sapiens
agacggcaagacuccaucu

SEQ ID NO: 2126196 - RNA, 15 nt, Homo sapiens
guuacacagugugaa

SEQ ID NO: 2126197 - RNA, 19 nt, Homo sapiens
cauccuguaagugcuuaau

SEQ ID NO: 2126198 - RNA, 16 nt, Homo sapiens
gcuguugcuugaauag

SEQ ID NO: 2126199 - RNA, 19 nt, Homo sapiens
accccuggaagagcccagu

SEQ ID NO: 2126200 - RNA, 13 nt, Homo sapiens
accaagguauaca

SEQ ID NO: 2126201 - RNA, 19 nt, Homo sapiens
aaacauguuuaaauagccu

SEQ ID NO: 2126202 - RNA, 18 nt, Homo sapiens
aaacuugaauucauagaa

SEQ ID NO: 2126203 - RNA, 15 nt, Homo sapiens
caagguuauaugcac

SEQ ID NO: 2126204 - RNA, 17 nt, Homo sapiens
cugccgcccugcuccac

SEQ ID NO: 2126205 - RNA, 14 nt, Homo sapiens
acuuaaccuugcaa

SEQ ID NO: 2126206 - RNA, 16 nt, Homo sapiens
uuaauaaagcauucuu

SEQ ID NO: 2126207 - RNA, 17 nt, Homo sapiens
gugggagguugugcaug

SEQ ID NO: 2126208 - RNA, 18 nt, Homo sapiens
accagaugcuacuggacu

SEQ ID NO: 2126209 - RNA, 14 nt, Homo sapiens
aucuguccaaggaa

SEQ ID NO: 2126210 - RNA, 17 nt, Homo sapiens
aucuuaguagagauuuc

SEQ ID NO: 2126211 - RNA, 21 nt, Homo sapiens
gcagaggcuuugcugcuguga

SEQ ID NO: 2126212 - RNA, 19 nt, Homo sapiens
gcaagaccaaaucauugua

SEQ ID NO: 2126213 - RNA, 11 nt, Homo sapiens
ggcugugccaa

SEQ ID NO: 2126214 - RNA, 21 nt, Homo sapiens
aacauguuuaucguauuugau

SEQ ID NO: 2126215 - RNA, 19 nt, Homo sapiens
uaaucgaaguaauuuuggg

SEQ ID NO: 2126216 - RNA, 16 nt, Homo sapiens
caguaaucugagcagu

SEQ ID NO: 2126217 - RNA, 13 nt, Homo sapiens
ccgaggcccucaa

SEQ ID NO: 2126218 - RNA, 21 nt, Homo sapiens
aucuauuuugaugcagcauuu

SEQ ID NO: 2126219 - RNA, 18 nt, Homo sapiens
acaggaugaugacuaugg

SEQ ID NO: 2126220 - RNA, 24 nt, Homo sapiens
gguagaauucuggcugguagagca

SEQ ID NO: 2126221 - RNA, 14 nt, Homo sapiens
uccucaaacacugc

SEQ ID NO: 2126222 - RNA, 16 nt, Homo sapiens
ucaucucagcucacug

SEQ ID NO: 2126223 - RNA, 20 nt, Homo sapiens
augaguuuuugauagcuuua

SEQ ID NO: 2126224 - RNA, 14 nt, Homo sapiens
agugcaguuuaaaa

SEQ ID NO: 2126225 - RNA, 19 nt, Homo sapiens
ucggcagcuacucagagga

SEQ ID NO: 2126226 - RNA, 20 nt, Homo sapiens
aguguggaggagaggggugg

SEQ ID NO: 2126227 - RNA, 23 nt, Homo sapiens
ucauugucaaaauuaauaugauu

SEQ ID NO: 2126228 - RNA, 23 nt, Homo sapiens
aaugaugaaugaaugaaugagcc

SEQ ID NO: 2126229 - RNA, 14 nt, Homo sapiens
aauaguucuauaca

SEQ ID NO: 2126230 - RNA, 22 nt, Homo sapiens
aguucaucuauggcaguccagc

SEQ ID NO: 2126231 - RNA, 19 nt, Homo sapiens
aaauauauuguuaaucucu

SEQ ID NO: 2126232 - RNA, 13 nt, Homo sapiens
gcugcagauuucc

SEQ ID NO: 2126233 - RNA, 16 nt, Homo sapiens
acauaugaucaaauac

SEQ ID NO: 2126234 - RNA, 14 nt, Homo sapiens
ucccaacucuugca

SEQ ID NO: 2126235 - RNA, 19 nt, Homo sapiens
cagguguugggaccugcug

SEQ ID NO: 2126236 - RNA, 17 nt, Homo sapiens
agaaugucauggaagag

SEQ ID NO: 2126237 - RNA, 23 nt, Homo sapiens
gcagucuccucuuuaaaacaaaa

SEQ ID NO: 2126238 - RNA, 19 nt, Homo sapiens
agcacugggaaccuagcua

SEQ ID NO: 2126239 - RNA, 18 nt, Homo sapiens
aaggauuuuaccaaagca

SEQ ID NO: 2126240 - RNA, 22 nt, Homo sapiens
aucaucccacagacaauacguu

SEQ ID NO: 2126241 - RNA, 21 nt, Homo sapiens
cauggagagagacucaaagag

SEQ ID NO: 2126242 - RNA, 23 nt, Homo sapiens
augguuuuccugaaauccucaau

SEQ ID NO: 2126243 - RNA, 19 nt, Homo sapiens
aaggauuacacauuucacu

SEQ ID NO: 2126244 - RNA, 15 nt, Homo sapiens
ccucaccuucaaaaa

SEQ ID NO: 2126245 - RNA, 17 nt, Homo sapiens
uguuuauucuugaugaa

SEQ ID NO: 2126246 - RNA, 22 nt, Homo sapiens
caaaagcaaagaugcauuuuca

SEQ ID NO: 2126247 - RNA, 15 nt, Homo sapiens
uguguucaccuucaa

SEQ ID NO: 2126248 - RNA, 13 nt, Homo sapiens
cccacacuccaug

SEQ ID NO: 2126249 - RNA, 13 nt, Homo sapiens
ccuacccuuccag

SEQ ID NO: 2126250 - RNA, 18 nt, Homo sapiens
cccucaaaagccaaaaaa

SEQ ID NO: 2126251 - RNA, 21 nt, Homo sapiens
caguuccuguagaacugagaa

SEQ ID NO: 2126252 - RNA, 13 nt, Homo sapiens
gcauuauguacua

SEQ ID NO: 2126253 - RNA, 19 nt, Homo sapiens
gaagggccccacucaggga

SEQ ID NO: 2126254 - RNA, 15 nt, Homo sapiens
ucauccaccuucaca

SEQ ID NO: 2126255 - RNA, 17 nt, Homo sapiens
ucuaaaagguucaggga

SEQ ID NO: 2126256 - RNA, 22 nt, Homo sapiens
ugaugucuucuggugucauggu

SEQ ID NO: 2126257 - RNA, 16 nt, Homo sapiens
guuucaguuuccccau

SEQ ID NO: 2126258 - RNA, 16 nt, Homo sapiens
cauaaauccuugauga

SEQ ID NO: 2126259 - RNA, 22 nt, Homo sapiens
uccuccaugaauaucaguuauu

SEQ ID NO: 2126260 - RNA, 19 nt, Homo sapiens
caauaacaaagcacauaac

SEQ ID NO: 2126261 - RNA, 22 nt, Homo sapiens
agaggaagacaucuguagggaa

SEQ ID NO: 2126262 - RNA, 19 nt, Homo sapiens
aucauugcaggagccauau

SEQ ID NO: 2126263 - RNA, 18 nt, Homo sapiens
ugcauuaugcacgugucu

SEQ ID NO: 2126264 - RNA, 15 nt, Homo sapiens
uggggcaacugagag

SEQ ID NO: 2126265 - RNA, 12 nt, Homo sapiens
agagaugcugcu

SEQ ID NO: 2126266 - RNA, 20 nt, Homo sapiens
ucccuaaaauaaaaaccaga

SEQ ID NO: 2126267 - RNA, 17 nt, Homo sapiens
aaauucacuaaugauug

SEQ ID NO: 2126268 - RNA, 19 nt, Homo sapiens
aaaccauaaacauuugcac

SEQ ID NO: 2126269 - RNA, 23 nt, Homo sapiens
uuuacugcucugagaauuguuga

SEQ ID NO: 2126270 - RNA, 16 nt, Homo sapiens
cucuagaggcuggcaa

SEQ ID NO: 2126271 - RNA, 21 nt, Homo sapiens
ugagacuuacuucucugcuau

SEQ ID NO: 2126272 - RNA, 15 nt, Homo sapiens
acugucuccuaccuc

SEQ ID NO: 2126273 - RNA, 11 nt, Homo sapiens
gauaauauuca

SEQ ID NO: 2126274 - RNA, 18 nt, Homo sapiens
cugcucggagcucagugc

SEQ ID NO: 2126275 - RNA, 19 nt, Homo sapiens
auaguuacugcugcacuuu

SEQ ID NO: 2126276 - RNA, 21 nt, Homo sapiens
auuaaaucauacuccuaugcu

SEQ ID NO: 2126277 - RNA, 13 nt, Homo sapiens
aagucucucaccc

SEQ ID NO: 2126278 - RNA, 20 nt, Homo sapiens
caguuucuccuuuauugcuc

SEQ ID NO: 2126279 - RNA, 19 nt, Homo sapiens
ucucuuaaaguuggaauuu

SEQ ID NO: 2126280 - RNA, 19 nt, Homo sapiens
cgaguuccggaaagccuuc

SEQ ID NO: 2126281 - RNA, 16 nt, Homo sapiens
guuugccucugcacgu

SEQ ID NO: 2126282 - RNA, 21 nt, Homo sapiens
gugaaaugcuuuuauauucua

SEQ ID NO: 2126283 - RNA, 18 nt, Homo sapiens
auucagacagagacuuua

SEQ ID NO: 2126284 - RNA, 19 nt, Homo sapiens
uaccuugcuuuugcuucua

SEQ ID NO: 2126285 - RNA, 20 nt, Homo sapiens
gagcuuuuccugauguucca

SEQ ID NO: 2126286 - RNA, 16 nt, Homo sapiens
uuaugaauugucuaaa

SEQ ID NO: 2126287 - RNA, 18 nt, Homo sapiens
aaugugcagaugcaauug

SEQ ID NO: 2126288 - RNA, 14 nt, Homo sapiens
guuggcucugccag

SEQ ID NO: 2126289 - RNA, 15 nt, Homo sapiens
uauggagagcccugg

SEQ ID NO: 2126290 - RNA, 22 nt, Homo sapiens
gauugcagguggaacucaguca

SEQ ID NO: 2126291 - RNA, 20 nt, Homo sapiens
aacagccaagugugacccca

SEQ ID NO: 2126292 - RNA, 22 nt, Homo sapiens
cgcugucgugacuacacagagu

SEQ ID NO: 2126293 - RNA, 14 nt, Homo sapiens
aaaugaacugacuu

SEQ ID NO: 2126294 - RNA, 19 nt, Homo sapiens
agacacacacgcauacaca

SEQ ID NO: 2126295 - RNA, 19 nt, Homo sapiens
aggaauuucuuaacuucuu

SEQ ID NO: 2126296 - RNA, 13 nt, Homo sapiens
ccugcaagugccc

SEQ ID NO: 2126297 - RNA, 20 nt, Homo sapiens
aaacacagaacucagccuua

SEQ ID NO: 2126298 - RNA, 22 nt, Homo sapiens
acuuuaccugaaagacaguaug

SEQ ID NO: 2126299 - RNA, 13 nt, Homo sapiens
uguugcuuuucac

SEQ ID NO: 2126300 - RNA, 11 nt, Homo sapiens
cucuugucucc

SEQ ID NO: 2126301 - RNA, 20 nt, Homo sapiens
cacacuggagaaaaggcagu

SEQ ID NO: 2126302 - RNA, 21 nt, Homo sapiens
ugauuauccauauugagucaa

SEQ ID NO: 2126303 - RNA, 15 nt, Homo sapiens
uagaagucucuucca

SEQ ID NO: 2126304 - RNA, 23 nt, Homo sapiens
agccucagaaggacccuguugag

SEQ ID NO: 2126305 - RNA, 17 nt, Homo sapiens
gaaaugaauccaucaua

SEQ ID NO: 2126306 - RNA, 18 nt, Homo sapiens
caugaguuacugugcauu

SEQ ID NO: 2126307 - RNA, 23 nt, Homo sapiens
ugauuaaaacacacauaaaccaa

SEQ ID NO: 2126308 - RNA, 14 nt, Homo sapiens
caggccacugaccu

SEQ ID NO: 2126309 - RNA, 16 nt, Homo sapiens
uuugcaaagugcaagg

SEQ ID NO: 2126310 - RNA, 12 nt, Homo sapiens
ucccaagaucug

SEQ ID NO: 2126311 - RNA, 17 nt, Homo sapiens
agaaauacuacugugua

SEQ ID NO: 2126312 - RNA, 14 nt, Homo sapiens
uguauuucaucuca

SEQ ID NO: 2126313 - RNA, 16 nt, Homo sapiens
caagacuugguguccu

SEQ ID NO: 2126314 - RNA, 16 nt, Homo sapiens
cuccugugaacacugg

SEQ ID NO: 2126315 - RNA, 21 nt, Homo sapiens
auuaggauggugaaccagcag

SEQ ID NO: 2126316 - RNA, 16 nt, Homo sapiens
gccuucccaugaaucu

SEQ ID NO: 2126317 - RNA, 18 nt, Homo sapiens
acaguugcauuuagcuuc

SEQ ID NO: 2126318 - RNA, 10 nt, Homo sapiens
gagucuucac

SEQ ID NO: 2126319 - RNA, 19 nt, Homo sapiens
agcuacuugcaauucaaaa

SEQ ID NO: 2126320 - RNA, 14 nt, Homo sapiens
ucaccuaacuagag

SEQ ID NO: 2126321 - RNA, 17 nt, Homo sapiens
uaugagaaaaauauuca

SEQ ID NO: 2126322 - RNA, 22 nt, Homo sapiens
acagcagcacccacccaugcac

SEQ ID NO: 2126323 - RNA, 12 nt, Homo sapiens
gcugggugggcc

SEQ ID NO: 2126324 - RNA, 15 nt, Homo sapiens
cuggaccaggucuca

SEQ ID NO: 2126325 - RNA, 21 nt, Homo sapiens
aaggacaucagcaaacaggau

SEQ ID NO: 2126326 - RNA, 19 nt, Homo sapiens
ucuuuccuacacacucuga

SEQ ID NO: 2126327 - RNA, 18 nt, Homo sapiens
caaggucucacacuccuc

SEQ ID NO: 2126328 - RNA, 12 nt, Homo sapiens
ugggaguguccu

SEQ ID NO: 2126329 - RNA, 18 nt, Homo sapiens
ucagccccuucauggaag

SEQ ID NO: 2126330 - RNA, 21 nt, Homo sapiens
acagcacuaacacaugcacac

SEQ ID NO: 2126331 - RNA, 11 nt, Homo sapiens
gagccaguucu

SEQ ID NO: 2126332 - RNA, 14 nt, Homo sapiens
uccucuguccucau

SEQ ID NO: 2126333 - RNA, 14 nt, Homo sapiens
uucuaagucuucca

SEQ ID NO: 2126334 - RNA, 16 nt, Homo sapiens
ugaauguuaaacuacu

SEQ ID NO: 2126335 - RNA, 17 nt, Homo sapiens
uggcaacagaaaacaau

SEQ ID NO: 2126336 - RNA, 18 nt, Homo sapiens
uacagaaacaacugccaa

SEQ ID NO: 2126337 - RNA, 18 nt, Homo sapiens
aaaauuuaaaaaacugug

SEQ ID NO: 2126338 - RNA, 13 nt, Homo sapiens
ccaagauguguuc

SEQ ID NO: 2126339 - RNA, 17 nt, Homo sapiens
uagucaauccugucaua

SEQ ID NO: 2126340 - RNA, 21 nt, Homo sapiens
caggaagggcaggaaggagag

SEQ ID NO: 2126341 - RNA, 16 nt, Homo sapiens
ucucagugugcccuuc

SEQ ID NO: 2126342 - RNA, 16 nt, Homo sapiens
gggcgaguacugggac

SEQ ID NO: 2126343 - RNA, 16 nt, Homo sapiens
ucaaagcaaagcucuu

SEQ ID NO: 2126344 - RNA, 18 nt, Homo sapiens
gcucuccuccuaccagag

SEQ ID NO: 2126345 - RNA, 16 nt, Homo sapiens
ugcugucccugucagg

SEQ ID NO: 2126346 - RNA, 17 nt, Homo sapiens
gggcuccaaaucugccu

SEQ ID NO: 2126347 - RNA, 18 nt, Homo sapiens
ugucuuaguugaugagug

SEQ ID NO: 2126348 - RNA, 14 nt, Homo sapiens
gguauaaaaccuaa

SEQ ID NO: 2126349 - RNA, 21 nt, Homo sapiens
ccugagauucagaugucauuu

SEQ ID NO: 2126350 - RNA, 18 nt, Homo sapiens
aggcgauggccaccccag

SEQ ID NO: 2126351 - RNA, 18 nt, Homo sapiens
aaguauauauucuacaca

SEQ ID NO: 2126352 - RNA, 16 nt, Homo sapiens
cuuguucuaaaaucuu

SEQ ID NO: 2126353 - RNA, 18 nt, Homo sapiens
cguuugugagcucccagc

SEQ ID NO: 2126354 - RNA, 16 nt, Homo sapiens
ucacagaugugugauu

SEQ ID NO: 2126355 - RNA, 16 nt, Homo sapiens
ucaugaucaagauaua

SEQ ID NO: 2126356 - RNA, 15 nt, Homo sapiens
cacagacacuaacga

SEQ ID NO: 2126357 - RNA, 21 nt, Homo sapiens
cagagagugaauacacuggaa

SEQ ID NO: 2126358 - RNA, 16 nt, Homo sapiens
auauccagcugaguga

SEQ ID NO: 2126359 - RNA, 21 nt, Homo sapiens
uggagauguuuaguaaucaua

SEQ ID NO: 2126360 - RNA, 19 nt, Homo sapiens
agcccgccugccgugcaug

SEQ ID NO: 2126361 - RNA, 15 nt, Homo sapiens
aguuucaaguuuuaa

SEQ ID NO: 2126362 - RNA, 17 nt, Homo sapiens
ggcuucuccccacugua

SEQ ID NO: 2126363 - RNA, 19 nt, Homo sapiens
ugaacagucacgccugaaa

SEQ ID NO: 2126364 - RNA, 13 nt, Homo sapiens
uccaaacauucuc

SEQ ID NO: 2126365 - RNA, 15 nt, Homo sapiens
ugugacacugcagca

SEQ ID NO: 2126366 - RNA, 14 nt, Homo sapiens
aagacuauucaaac

SEQ ID NO: 2126367 - RNA, 14 nt, Homo sapiens
aacucacugagggu

SEQ ID NO: 2126368 - RNA, 13 nt, Homo sapiens
acuuggcaaaaag

SEQ ID NO: 2126369 - RNA, 20 nt, Homo sapiens
cuggcacuguggagaccaca

SEQ ID NO: 2126370 - RNA, 12 nt, Homo sapiens
cucacuuuggaa

SEQ ID NO: 2126371 - RNA, 18 nt, Homo sapiens
ugggcaggguacagacac

SEQ ID NO: 2126372 - RNA, 14 nt, Homo sapiens
agagucacugauac

SEQ ID NO: 2126373 - RNA, 14 nt, Homo sapiens
cugccccaccugcc

SEQ ID NO: 2126374 - RNA, 20 nt, Homo sapiens
gauaaaccugucuaagcaau

SEQ ID NO: 2126375 - RNA, 16 nt, Homo sapiens
caaaaagaccaagaag

SEQ ID NO: 2126376 - RNA, 16 nt, Homo sapiens
auuuuguucugcaaau

SEQ ID NO: 2126377 - RNA, 19 nt, Homo sapiens
acccaaaucacaucucacc

SEQ ID NO: 2126378 - RNA, 22 nt, Homo sapiens
acugccucugccacacucugac

SEQ ID NO: 2126379 - RNA, 22 nt, Homo sapiens
uuuuccaauuuuagaaaaucaa

SEQ ID NO: 2126380 - RNA, 15 nt, Homo sapiens
gucugggauguauuc

SEQ ID NO: 2126381 - RNA, 22 nt, Homo sapiens
auuaagugacuguucaagagca

SEQ ID NO: 2126382 - RNA, 19 nt, Homo sapiens
acgaggcuuggaccugcug

SEQ ID NO: 2126383 - RNA, 15 nt, Homo sapiens
cagugacccuggcuc

SEQ ID NO: 2126384 - RNA, 18 nt, Homo sapiens
auuuuauucccuuucaca

SEQ ID NO: 2126385 - RNA, 19 nt, Homo sapiens
ccccuaaaaagauugccaa

SEQ ID NO: 2126386 - RNA, 10 nt, Homo sapiens
ccuucaguga

SEQ ID NO: 2126387 - RNA, 22 nt, Homo sapiens
cuucacaggcagugcaugugaa

SEQ ID NO: 2126388 - RNA, 14 nt, Homo sapiens
aaaacauuccccaa

SEQ ID NO: 2126389 - RNA, 16 nt, Homo sapiens
ucuguagccuccuuug

SEQ ID NO: 2126390 - RNA, 14 nt, Homo sapiens
auggcucacuauga

SEQ ID NO: 2126391 - RNA, 23 nt, Homo sapiens
gaaagcuuugaaauaaaauaaca

SEQ ID NO: 2126392 - RNA, 19 nt, Homo sapiens
cacugucaagauuaaguua

SEQ ID NO: 2126393 - RNA, 19 nt, Homo sapiens
ucaguugagaaacaguucc

SEQ ID NO: 2126394 - RNA, 22 nt, Homo sapiens
accuugacuugauuagugccuu

SEQ ID NO: 2126395 - RNA, 20 nt, Homo sapiens
ugauccuggaggcccaguuc

SEQ ID NO: 2126396 - RNA, 15 nt, Homo sapiens
gcagcuccuuuggac

SEQ ID NO: 2126397 - RNA, 20 nt, Homo sapiens
uuccuggaaacagcaugaau

SEQ ID NO: 2126398 - RNA, 18 nt, Homo sapiens
aucugggacugugccugg

SEQ ID NO: 2126399 - RNA, 21 nt, Homo sapiens
acuguucaguuuagcauuaaa

SEQ ID NO: 2126400 - RNA, 15 nt, Homo sapiens
ucuccguuaaucucu

SEQ ID NO: 2126401 - RNA, 22 nt, Homo sapiens
gcuuacuuccuagucuacuuga

SEQ ID NO: 2126402 - RNA, 19 nt, Homo sapiens
uuggaacaggguuggcauu

SEQ ID NO: 2126403 - RNA, 16 nt, Homo sapiens
guaugauaagcuuuau

SEQ ID NO: 2126404 - RNA, 22 nt, Homo sapiens
cuaaauuuugugauucuauaaa

SEQ ID NO: 2126405 - RNA, 17 nt, Homo sapiens
acuguggcucuugccuu

SEQ ID NO: 2126406 - RNA, 15 nt, Homo sapiens
ucucaggcuguccca

SEQ ID NO: 2126407 - RNA, 21 nt, Homo sapiens
cugggccuuuccugugccaac

SEQ ID NO: 2126408 - RNA, 20 nt, Homo sapiens
augugcaaagcaguauguac

SEQ ID NO: 2126409 - RNA, 14 nt, Homo sapiens
gucucacacuguuu

SEQ ID NO: 2126410 - RNA, 16 nt, Homo sapiens
cuucagcacauuccac

SEQ ID NO: 2126411 - RNA, 23 nt, Homo sapiens
aaccuuggagaggagaguggcag

SEQ ID NO: 2126412 - RNA, 21 nt, Homo sapiens
gauggcugacuuugcucuuuc

SEQ ID NO: 2126413 - RNA, 22 nt, Homo sapiens
acucaguuaggcagugcaguac

SEQ ID NO: 2126414 - RNA, 22 nt, Homo sapiens
aagguuuccugguccaucucau

SEQ ID NO: 2126415 - RNA, 19 nt, Homo sapiens
cuaaauaaagacgacuaca

SEQ ID NO: 2126416 - RNA, 21 nt, Homo sapiens
uggacauccuguauaagcacu

SEQ ID NO: 2126417 - RNA, 20 nt, Homo sapiens
uagcgggacucagugagcug

SEQ ID NO: 2126418 - RNA, 20 nt, Homo sapiens
guguguugucugugcagcug

SEQ ID NO: 2126419 - RNA, 14 nt, Homo sapiens
ucuugguugccagu

SEQ ID NO: 2126420 - RNA, 18 nt, Homo sapiens
acgcgagaggcucugagg

SEQ ID NO: 2126421 - RNA, 17 nt, Homo sapiens
aagagacccaaccacuu

SEQ ID NO: 2126422 - RNA, 14 nt, Homo sapiens
uuuuugguaucuuc

SEQ ID NO: 2126423 - RNA, 19 nt, Homo sapiens
agcauaccugucucagcug

SEQ ID NO: 2126424 - RNA, 13 nt, Homo sapiens
ggcuuuuucccag

SEQ ID NO: 2126425 - RNA, 13 nt, Homo sapiens
uggagcugucauc

SEQ ID NO: 2126426 - RNA, 12 nt, Homo sapiens
guaacugcauua

SEQ ID NO: 2126427 - RNA, 19 nt, Homo sapiens
auuuuagaacaguccagca

SEQ ID NO: 2126428 - RNA, 18 nt, Homo sapiens
ccacauacaggugcucaa

SEQ ID NO: 2126429 - RNA, 23 nt, Homo sapiens
gaaguaaaacaaacaauaccuga

SEQ ID NO: 2126430 - RNA, 20 nt, Homo sapiens
aaaucccuauuuaauuuucc

SEQ ID NO: 2126431 - RNA, 14 nt, Homo sapiens
cagggaggugaccc

SEQ ID NO: 2126432 - RNA, 18 nt, Homo sapiens
gugacagcuuuccucaaa

SEQ ID NO: 2126433 - RNA, 15 nt, Homo sapiens
cccauccaguucucu

SEQ ID NO: 2126434 - RNA, 20 nt, Homo sapiens
acuggagcuggcgucugcau

SEQ ID NO: 2126435 - RNA, 22 nt, Homo sapiens
cagcuucuaaucccagcacuuu

SEQ ID NO: 2126436 - RNA, 15 nt, Homo sapiens
uuguaaugaauuccu

SEQ ID NO: 2126437 - RNA, 22 nt, Homo sapiens
auccuuguuuucuaacuuuaug

SEQ ID NO: 2126438 - RNA, 17 nt, Homo sapiens
gcaugcagaagugcaug

SEQ ID NO: 2126439 - RNA, 20 nt, Homo sapiens
caagugguguuuauugcaau

SEQ ID NO: 2126440 - RNA, 16 nt, Homo sapiens
agccaugggaaccuca

SEQ ID NO: 2126441 - RNA, 15 nt, Homo sapiens
gaaggggacaauggc

SEQ ID NO: 2126442 - RNA, 22 nt, Homo sapiens
cacuguguuggaggauggcacu

SEQ ID NO: 2126443 - RNA, 17 nt, Homo sapiens
cuaggcaacauggugaa

SEQ ID NO: 2126444 - RNA, 17 nt, Homo sapiens
cauguuggauagucagc

SEQ ID NO: 2126445 - RNA, 18 nt, Homo sapiens
uagaauccugcuuuacag

SEQ ID NO: 2126446 - RNA, 23 nt, Homo sapiens
cacagcucccggcgggugcucug

SEQ ID NO: 2126447 - RNA, 16 nt, Homo sapiens
uuaaauucucuuucac

SEQ ID NO: 2126448 - RNA, 21 nt, Homo sapiens
gccccucaccugguaccugga

SEQ ID NO: 2126449 - RNA, 21 nt, Homo sapiens
gcauuuaaaauaccacuguaa

SEQ ID NO: 2126450 - RNA, 22 nt, Homo sapiens
acuuauaauuacaaugcacaau

SEQ ID NO: 2126451 - RNA, 20 nt, Homo sapiens
auauuuucccucucuugccu

SEQ ID NO: 2126452 - RNA, 20 nt, Homo sapiens
gcaaaaucacuuagcagcaa

SEQ ID NO: 2126453 - RNA, 22 nt, Homo sapiens
gggcuaggguaggggcaaggaa

SEQ ID NO: 2126454 - RNA, 13 nt, Homo sapiens
ccagcacuaccaa

SEQ ID NO: 2126455 - RNA, 20 nt, Homo sapiens
uaaugcuuuucuaauuaaua

SEQ ID NO: 2126456 - RNA, 22 nt, Homo sapiens
ccaggcuggcgugcagcaucag

SEQ ID NO: 2126457 - RNA, 22 nt, Homo sapiens
ccggggaagagauccaaagacu

SEQ ID NO: 2126458 - RNA, 14 nt, Homo sapiens
cagcagacuaugaa

SEQ ID NO: 2126459 - RNA, 13 nt, Homo sapiens
ucccccaguuccu

SEQ ID NO: 2126460 - RNA, 14 nt, Homo sapiens
agcuauuacugucc

SEQ ID NO: 2126461 - RNA, 20 nt, Homo sapiens
gugaacucagccaagcacag

SEQ ID NO: 2126462 - RNA, 17 nt, Homo sapiens
gaugccaaaaacaaaaa

SEQ ID NO: 2126463 - RNA, 13 nt, Homo sapiens
aucuguccagaca

SEQ ID NO: 2126464 - RNA, 21 nt, Homo sapiens
caaguccacuguccuccuugg

SEQ ID NO: 2126465 - RNA, 12 nt, Homo sapiens
caaggaaauaca

SEQ ID NO: 2126466 - RNA, 19 nt, Homo sapiens
uaguuacaaaauacaaaag

SEQ ID NO: 2126467 - RNA, 21 nt, Homo sapiens
uagcugagccuucugaugaga

SEQ ID NO: 2126468 - RNA, 13 nt, Homo sapiens
aacugauacaucu

SEQ ID NO: 2126469 - RNA, 16 nt, Homo sapiens
agcuaccuuccugugu

SEQ ID NO: 2126470 - RNA, 23 nt, Homo sapiens
agcuucgucuuguguuugcugca

SEQ ID NO: 2126471 - RNA, 15 nt, Homo sapiens
uucaccuauccagag

SEQ ID NO: 2126472 - RNA, 20 nt, Homo sapiens
ucccaggccaacaguagcca

SEQ ID NO: 2126473 - RNA, 14 nt, Homo sapiens
uaaauggcaugaca

SEQ ID NO: 2126474 - RNA, 21 nt, Homo sapiens
uguacauaggcagcacuagcg

SEQ ID NO: 2126475 - RNA, 12 nt, Homo sapiens
agugaccuggaa

SEQ ID NO: 2126476 - RNA, 21 nt, Homo sapiens
guuucuuggucucagcuucau

SEQ ID NO: 2126477 - RNA, 16 nt, Homo sapiens
aagcuacccaucugcc

SEQ ID NO: 2126478 - RNA, 23 nt, Homo sapiens
aaaaaagcaaauuucaugcacug

SEQ ID NO: 2126479 - RNA, 13 nt, Homo sapiens
aguucuuccugua

SEQ ID NO: 2126480 - RNA, 16 nt, Homo sapiens
cagaugcacacacaga

SEQ ID NO: 2126481 - RNA, 15 nt, Homo sapiens
uaaaaagaucuacau

SEQ ID NO: 2126482 - RNA, 15 nt, Homo sapiens
augccaaauguucca

SEQ ID NO: 2126483 - RNA, 18 nt, Homo sapiens
uaggaaggugugauguca

SEQ ID NO: 2126484 - RNA, 21 nt, Homo sapiens
auagaaagcuucaauagaacu

SEQ ID NO: 2126485 - RNA, 15 nt, Homo sapiens
gaggcuguucccacc

SEQ ID NO: 2126486 - RNA, 16 nt, Homo sapiens
cugcauccucacugug

SEQ ID NO: 2126487 - RNA, 16 nt, Homo sapiens
guuuuagaaccagccg

SEQ ID NO: 2126488 - RNA, 15 nt, Homo sapiens
uugggcaccagcuca

SEQ ID NO: 2126489 - RNA, 17 nt, Homo sapiens
gacaguguuuucuggga

SEQ ID NO: 2126490 - RNA, 22 nt, Homo sapiens
uuguuaagaggauagauuucau

SEQ ID NO: 2126491 - RNA, 14 nt, Homo sapiens
uguccccccugugg

SEQ ID NO: 2126492 - RNA, 17 nt, Homo sapiens
accuguaauaaauauga

SEQ ID NO: 2126493 - RNA, 16 nt, Homo sapiens
uguccucaugugagaa

SEQ ID NO: 2126494 - RNA, 17 nt, Homo sapiens
aaagcugcuugacuauc

SEQ ID NO: 2126495 - RNA, 23 nt, Homo sapiens
agcacauuccaaacuuuagcaac

SEQ ID NO: 2126496 - RNA, 22 nt, Homo sapiens
ugcauuuaaaauaccacuguaa

SEQ ID NO: 2126497 - RNA, 23 nt, Homo sapiens
uggccuggccauacuguguccca

SEQ ID NO: 2126498 - RNA, 14 nt, Homo sapiens
acgguggccagaga

SEQ ID NO: 2126499 - RNA, 21 nt, Homo sapiens
ccuccugaguagcugggacca

SEQ ID NO: 2126500 - RNA, 15 nt, Homo sapiens
guaaaguugccuuua

SEQ ID NO: 2126501 - RNA, 22 nt, Homo sapiens
ccagaagcaagauucaaaucuc

SEQ ID NO: 2126502 - RNA, 12 nt, Homo sapiens
ucuucacaggca

SEQ ID NO: 2126503 - RNA, 23 nt, Homo sapiens
acgagugcuuccgcugcggugau

SEQ ID NO: 2126504 - RNA, 14 nt, Homo sapiens
uaagcuuccacuua

SEQ ID NO: 2126505 - RNA, 22 nt, Homo sapiens
uucccuuaacucaaaccaugca

SEQ ID NO: 2126506 - RNA, 20 nt, Homo sapiens
caaagauuugacaugcucca

SEQ ID NO: 2126507 - RNA, 13 nt, Homo sapiens
aagguuauguaga

SEQ ID NO: 2126508 - RNA, 22 nt, Homo sapiens
gguuccgggaaugaugcaacug

SEQ ID NO: 2126509 - RNA, 22 nt, Homo sapiens
agugagaaaauccuaggugcua

SEQ ID NO: 2126510 - RNA, 17 nt, Homo sapiens
gugauuuggaagagagg

SEQ ID NO: 2126511 - RNA, 19 nt, Homo sapiens
gcucacacaaucagaccaa

SEQ ID NO: 2126512 - RNA, 22 nt, Homo sapiens
ucccacugggagcacuuuguag

SEQ ID NO: 2126513 - RNA, 15 nt, Homo sapiens
gggaccgaaagcaaa

SEQ ID NO: 2126514 - RNA, 16 nt, Homo sapiens
acaaacaagagaagcu

SEQ ID NO: 2126515 - RNA, 22 nt, Homo sapiens
uaaaaguugcauguuaugugag

SEQ ID NO: 2126516 - RNA, 17 nt, Homo sapiens
uauugaugugcaaaaau

SEQ ID NO: 2126517 - RNA, 23 nt, Homo sapiens
ccaacguucgauuucuaccucag

SEQ ID NO: 2126518 - RNA, 23 nt, Homo sapiens
cgcacacacccauguaaccacug

SEQ ID NO: 2126519 - RNA, 19 nt, Homo sapiens
acagagccccacccucaga

SEQ ID NO: 2126520 - RNA, 22 nt, Homo sapiens
aucccaggaggggccucugaaa

SEQ ID NO: 2126521 - RNA, 19 nt, Homo sapiens
uuccauuugaagcagugau

SEQ ID NO: 2126522 - RNA, 15 nt, Homo sapiens
accaaauaauuucau

SEQ ID NO: 2126523 - RNA, 22 nt, Homo sapiens
ucuugccugaauccaucaggac

SEQ ID NO: 2126524 - RNA, 14 nt, Homo sapiens
aagugucuaaugca

SEQ ID NO: 2126525 - RNA, 23 nt, Homo sapiens
aauuacacacuugcaugacaaag

SEQ ID NO: 2126526 - RNA, 18 nt, Homo sapiens
auauaaaacugagacugu

SEQ ID NO: 2126527 - RNA, 18 nt, Homo sapiens
caggaaauaucugugaag

SEQ ID NO: 2126528 - RNA, 21 nt, Homo sapiens
agccuucuuccaucccaggac

SEQ ID NO: 2126529 - RNA, 16 nt, Homo sapiens
gaauuugccuguaaca

SEQ ID NO: 2126530 - RNA, 21 nt, Homo sapiens
gaaaaugcuaucaaauaacua

SEQ ID NO: 2126531 - RNA, 16 nt, Homo sapiens
augccauauacaaaaa

SEQ ID NO: 2126532 - RNA, 13 nt, Homo sapiens
accuuggaccuca

SEQ ID NO: 2126533 - RNA, 19 nt, Homo sapiens
acuccugaguucaagcaau

SEQ ID NO: 2126534 - RNA, 18 nt, Homo sapiens
ggggagugaggcagguga

SEQ ID NO: 2126535 - RNA, 20 nt, Homo sapiens
ugaauuucaaacauuuguca

SEQ ID NO: 2126536 - RNA, 16 nt, Homo sapiens
cuuguugcugcaucuc

SEQ ID NO: 2126537 - RNA, 22 nt, Homo sapiens
auagucaaaccauaaacuucau

SEQ ID NO: 2126538 - RNA, 21 nt, Homo sapiens
aggccggugugggcugugucg

SEQ ID NO: 2126539 - RNA, 22 nt, Homo sapiens
uuccaacaagaagggacugaga

SEQ ID NO: 2126540 - RNA, 18 nt, Homo sapiens
acguuaguucuacauuau

SEQ ID NO: 2126541 - RNA, 17 nt, Homo sapiens
gaaaaugucacauucua

SEQ ID NO: 2126542 - RNA, 17 nt, Homo sapiens
gccugcgccaucuucac

SEQ ID NO: 2126543 - RNA, 15 nt, Homo sapiens
gaaucaaauugcuac

SEQ ID NO: 2126544 - RNA, 14 nt, Homo sapiens
gggcccucagagga

SEQ ID NO: 2126545 - RNA, 19 nt, Homo sapiens
caaggaacaaaaaaaccac

SEQ ID NO: 2126546 - RNA, 17 nt, Homo sapiens
caggguuugauagcacu

SEQ ID NO: 2126547 - RNA, 17 nt, Homo sapiens
uaaaaauaaacaaaaag

SEQ ID NO: 2126548 - RNA, 15 nt, Homo sapiens
auaucagugggcucu

SEQ ID NO: 2126549 - RNA, 18 nt, Homo sapiens
ucauugagggaccaaaaa

SEQ ID NO: 2126550 - RNA, 13 nt, Homo sapiens
aaggagacacaga

SEQ ID NO: 2126551 - RNA, 13 nt, Homo sapiens
caggagacccaga

SEQ ID NO: 2126552 - RNA, 18 nt, Homo sapiens
gaaaaggucuuggugccu

SEQ ID NO: 2126553 - RNA, 16 nt, Homo sapiens
guuccuuaucugucac

SEQ ID NO: 2126554 - RNA, 18 nt, Homo sapiens
auagaauaaaggcaguuu

SEQ ID NO: 2126555 - RNA, 19 nt, Homo sapiens
auuguuucaagacugacau

SEQ ID NO: 2126556 - RNA, 12 nt, Homo sapiens
agaggagcacua

SEQ ID NO: 2126557 - RNA, 21 nt, Homo sapiens
aauuugugguugcaugucugu

SEQ ID NO: 2126558 - RNA, 20 nt, Homo sapiens
aggguuuugcuauuuccaaa

SEQ ID NO: 2126559 - RNA, 14 nt, Homo sapiens
auucggacggccaa

SEQ ID NO: 2126560 - RNA, 17 nt, Homo sapiens
uuuugggaagucucagc

SEQ ID NO: 2126561 - RNA, 14 nt, Homo sapiens
ugccuuaauucuua

SEQ ID NO: 2126562 - RNA, 15 nt, Homo sapiens
acgcuaguuccaucc

SEQ ID NO: 2126563 - RNA, 17 nt, Homo sapiens
ugcuuaccuacuuucuu

SEQ ID NO: 2126564 - RNA, 12 nt, Homo sapiens
uaaauagcuuuu

SEQ ID NO: 2126565 - RNA, 14 nt, Homo sapiens
uccaucagaugugu

SEQ ID NO: 2126566 - RNA, 17 nt, Homo sapiens
gcagaagagaaaagcug

SEQ ID NO: 2126567 - RNA, 16 nt, Homo sapiens
auacauaacauucaau

SEQ ID NO: 2126568 - RNA, 23 nt, Homo sapiens
agggagagaucaaguugagacag

SEQ ID NO: 2126569 - RNA, 19 nt, Homo sapiens
caggugaccccuaggagca

SEQ ID NO: 2126570 - RNA, 20 nt, Homo sapiens
uucuuuagagcauugccauu

SEQ ID NO: 2126571 - RNA, 17 nt, Homo sapiens
acccucauuucucaucu

SEQ ID NO: 2126572 - RNA, 14 nt, Homo sapiens
cucccccauugugu

SEQ ID NO: 2126573 - RNA, 22 nt, Homo sapiens
guccacccucauguuucuguag

SEQ ID NO: 2126574 - RNA, 15 nt, Homo sapiens
gccaccagggagcuu

SEQ ID NO: 2126575 - RNA, 16 nt, Homo sapiens
augucauguacuuccu

SEQ ID NO: 2126576 - RNA, 23 nt, Homo sapiens
aaauuguagcccaguuggucaaa

SEQ ID NO: 2126577 - RNA, 14 nt, Homo sapiens
gcaaauagccacaa

SEQ ID NO: 2126578 - RNA, 13 nt, Homo sapiens
ggccccaucucca

SEQ ID NO: 2126579 - RNA, 20 nt, Homo sapiens
augcuggacggcauuccugc

SEQ ID NO: 2126580 - RNA, 14 nt, Homo sapiens
gccuuuuuugccag

SEQ ID NO: 2126581 - RNA, 12 nt, Homo sapiens
agucacgcuggg

SEQ ID NO: 2126582 - RNA, 19 nt, Homo sapiens
uuuggagcauuaacuaaau

SEQ ID NO: 2126583 - RNA, 21 nt, Homo sapiens
ugcagacuguucuuacuguaa

SEQ ID NO: 2126584 - RNA, 14 nt, Homo sapiens
gucuaaugacagau

SEQ ID NO: 2126585 - RNA, 19 nt, Homo sapiens
uaauuaaguaaaccaaaaa

SEQ ID NO: 2126586 - RNA, 17 nt, Homo sapiens
gaaacuguaugugcugu

SEQ ID NO: 2126587 - RNA, 18 nt, Homo sapiens
cuuguaauucuaaaugaa

SEQ ID NO: 2126588 - RNA, 12 nt, Homo sapiens
aucuauuccugc

SEQ ID NO: 2126589 - RNA, 22 nt, Homo sapiens
cucauuucaaauuugugcagug

SEQ ID NO: 2126590 - RNA, 21 nt, Homo sapiens
gccaagauucuacucuuguca

SEQ ID NO: 2126591 - RNA, 13 nt, Homo sapiens
uccccucaaccca

SEQ ID NO: 2126592 - RNA, 13 nt, Homo sapiens
acugaucaucugc

SEQ ID NO: 2126593 - RNA, 17 nt, Homo sapiens
uucccuacaguugaaaa

SEQ ID NO: 2126594 - RNA, 18 nt, Homo sapiens
ccauucuauucuccagac

SEQ ID NO: 2126595 - RNA, 22 nt, Homo sapiens
agauuauugugacuucacugua

SEQ ID NO: 2126596 - RNA, 18 nt, Homo sapiens
gauguaugaucucucuag

SEQ ID NO: 2126597 - RNA, 23 nt, Homo sapiens
accuucugccaaggccagcccac

SEQ ID NO: 2126598 - RNA, 15 nt, Homo sapiens
guaggggcaaggaaa

SEQ ID NO: 2126599 - RNA, 21 nt, Homo sapiens
cucucuaaaucuuccuuguga

SEQ ID NO: 2126600 - RNA, 19 nt, Homo sapiens
auuagccuaugugcaugca

SEQ ID NO: 2126601 - RNA, 16 nt, Homo sapiens
gacuugaaucaaguca

SEQ ID NO: 2126602 - RNA, 20 nt, Homo sapiens
caggccuggccucaucucag

SEQ ID NO: 2126603 - RNA, 16 nt, Homo sapiens
gaaguuuuaaaggccg

SEQ ID NO: 2126604 - RNA, 17 nt, Homo sapiens
aacuccuagguucacuu

SEQ ID NO: 2126605 - RNA, 22 nt, Homo sapiens
aggaaauuaucaacauaccuug

SEQ ID NO: 2126606 - RNA, 20 nt, Homo sapiens
ccccagagcuuuacagugcc

SEQ ID NO: 2126607 - RNA, 16 nt, Homo sapiens
caaauuagccauuuca

SEQ ID NO: 2126608 - RNA, 15 nt, Homo sapiens
gcaagaggaggacag

SEQ ID NO: 2126609 - RNA, 16 nt, Homo sapiens
accccagcucaugccc

SEQ ID NO: 2126610 - RNA, 17 nt, Homo sapiens
cauauaaauggaauuac

SEQ ID NO: 2126611 - RNA, 23 nt, Homo sapiens
uauaauucuguacauagccuaua

SEQ ID NO: 2126612 - RNA, 22 nt, Homo sapiens
ugccucugggaggggugcugcc

SEQ ID NO: 2126613 - RNA, 21 nt, Homo sapiens
gccuuggugggggagccucug

SEQ ID NO: 2126614 - RNA, 14 nt, Homo sapiens
uuuauugacucuug

SEQ ID NO: 2126615 - RNA, 19 nt, Homo sapiens
cugaauguuagauaguuac

SEQ ID NO: 2126616 - RNA, 20 nt, Homo sapiens
auuucauaaauaaaggugua

SEQ ID NO: 2126617 - RNA, 18 nt, Homo sapiens
ggagaaucguuugaacuc

SEQ ID NO: 2126618 - RNA, 20 nt, Homo sapiens
gacagcgucuccaauuauga

SEQ ID NO: 2126619 - RNA, 16 nt, Homo sapiens
caucuagucucagugc

SEQ ID NO: 2126620 - RNA, 22 nt, Homo sapiens
uaacagaaagccugggugacau

SEQ ID NO: 2126621 - RNA, 11 nt, Homo sapiens
gaagaccagcu

SEQ ID NO: 2126622 - RNA, 12 nt, Homo sapiens
guauccaaagga

SEQ ID NO: 2126623 - RNA, 14 nt, Homo sapiens
ggaaaaauguuugu

SEQ ID NO: 2126624 - RNA, 17 nt, Homo sapiens
accugcccccacagcuc

SEQ ID NO: 2126625 - RNA, 17 nt, Homo sapiens
ugaugaugauagucauc

SEQ ID NO: 2126626 - RNA, 16 nt, Homo sapiens
caucuuuuugugugca

SEQ ID NO: 2126627 - RNA, 15 nt, Homo sapiens
ccuggauaacuguaa

SEQ ID NO: 2126628 - RNA, 20 nt, Homo sapiens
agaacguggugaccuuucac

SEQ ID NO: 2126629 - RNA, 16 nt, Homo sapiens
cccaaucccauuccug

SEQ ID NO: 2126630 - RNA, 15 nt, Homo sapiens
uggaaaacacuuuca

SEQ ID NO: 2126631 - RNA, 18 nt, Homo sapiens
ugcucuccuccaccucaa

SEQ ID NO: 2126632 - RNA, 13 nt, Homo sapiens
acuucauacaucc

SEQ ID NO: 2126633 - RNA, 16 nt, Homo sapiens
cagaaacugaugccaa

SEQ ID NO: 2126634 - RNA, 18 nt, Homo sapiens
gcacauagcccuguugac

SEQ ID NO: 2126635 - RNA, 12 nt, Homo sapiens
aacagacggaca

SEQ ID NO: 2126636 - RNA, 21 nt, Homo sapiens
uguuugcuucaugugucccag

SEQ ID NO: 2126637 - RNA, 21 nt, Homo sapiens
cuuggcaguugcagugcugcu

SEQ ID NO: 2126638 - RNA, 19 nt, Homo sapiens
uagugcacagcacaaauua

SEQ ID NO: 2126639 - RNA, 22 nt, Homo sapiens
cgcugcagcuguguguccuucu

SEQ ID NO: 2126640 - RNA, 14 nt, Homo sapiens
cuguauuugugcaa

SEQ ID NO: 2126641 - RNA, 17 nt, Homo sapiens
uaggcaccuuaacugga

SEQ ID NO: 2126642 - RNA, 13 nt, Homo sapiens
caguucauacuga

SEQ ID NO: 2126643 - RNA, 14 nt, Homo sapiens
aguccuguacugua

SEQ ID NO: 2126644 - RNA, 11 nt, Homo sapiens
ucaugcugcuc

SEQ ID NO: 2126645 - RNA, 13 nt, Homo sapiens
ccugaacuggcca

SEQ ID NO: 2126646 - RNA, 21 nt, Homo sapiens
uaccuaaacuauaugccauaa

SEQ ID NO: 2126647 - RNA, 16 nt, Homo sapiens
agcccaccagacguca

SEQ ID NO: 2126648 - RNA, 19 nt, Homo sapiens
uuuugcccuggagccucag

SEQ ID NO: 2126649 - RNA, 14 nt, Homo sapiens
gcaaguucagggaa

SEQ ID NO: 2126650 - RNA, 13 nt, Homo sapiens
ugguggcacugag

SEQ ID NO: 2126651 - RNA, 23 nt, Homo sapiens
auauucuaaccuacuaagucugu

SEQ ID NO: 2126652 - RNA, 21 nt, Homo sapiens
ucugugcauuguggcugucaa

SEQ ID NO: 2126653 - RNA, 16 nt, Homo sapiens
uuagggaugacuguga

SEQ ID NO: 2126654 - RNA, 15 nt, Homo sapiens
gcagaaauguacuua

SEQ ID NO: 2126655 - RNA, 20 nt, Homo sapiens
uguuauuguugaacauacuu

SEQ ID NO: 2126656 - RNA, 17 nt, Homo sapiens
caaugacuaauucuugc

SEQ ID NO: 2126657 - RNA, 16 nt, Homo sapiens
gucuaauaauguuaag

SEQ ID NO: 2126658 - RNA, 19 nt, Homo sapiens
uaggugcugaccuagacag

SEQ ID NO: 2126659 - RNA, 23 nt, Homo sapiens
gauuuauuguuauauuacuugcc

SEQ ID NO: 2126660 - RNA, 15 nt, Homo sapiens
cacccaggcugcacu

SEQ ID NO: 2126661 - RNA, 14 nt, Homo sapiens
acauggcguccugc

SEQ ID NO: 2126662 - RNA, 20 nt, Homo sapiens
gaucucccuuaauaaacuca

SEQ ID NO: 2126663 - RNA, 16 nt, Homo sapiens
uccucacccagaucag

SEQ ID NO: 2126664 - RNA, 21 nt, Homo sapiens
auugaagccaacaaaccuucc

SEQ ID NO: 2126665 - RNA, 15 nt, Homo sapiens
acacaccguggccua

SEQ ID NO: 2126666 - RNA, 16 nt, Homo sapiens
cucagagaguugucug

SEQ ID NO: 2126667 - RNA, 18 nt, Homo sapiens
uuagacacuuuaccucuu

SEQ ID NO: 2126668 - RNA, 14 nt, Homo sapiens
ucacugcugucagc

SEQ ID NO: 2126669 - RNA, 15 nt, Homo sapiens
gauuuaacacuaaaa

SEQ ID NO: 2126670 - RNA, 12 nt, Homo sapiens
guuuuucuuauc

SEQ ID NO: 2126671 - RNA, 20 nt, Homo sapiens
uugggcuccgugugggagac

SEQ ID NO: 2126672 - RNA, 21 nt, Homo sapiens
cugcagcccaggccagucaga

SEQ ID NO: 2126673 - RNA, 14 nt, Homo sapiens
guuuggcugggaua

SEQ ID NO: 2126674 - RNA, 22 nt, Homo sapiens
uggcaaugccacagcccuguca

SEQ ID NO: 2126675 - RNA, 17 nt, Homo sapiens
ggggacuaacccaaugc

SEQ ID NO: 2126676 - RNA, 14 nt, Homo sapiens
cuauaauuuugccu

SEQ ID NO: 2126677 - RNA, 18 nt, Homo sapiens
auccuuguagcaaagcac

SEQ ID NO: 2126678 - RNA, 19 nt, Homo sapiens
gugucuggaaaagcacuuu

SEQ ID NO: 2126679 - RNA, 17 nt, Homo sapiens
uuuacggccuaugagau

SEQ ID NO: 2126680 - RNA, 11 nt, Homo sapiens
cauccaaauaa

SEQ ID NO: 2126681 - RNA, 21 nt, Homo sapiens
gcccaggaaaggcuccaggag

SEQ ID NO: 2126682 - RNA, 22 nt, Homo sapiens
aaaaucucuccacuuucagcug

SEQ ID NO: 2126683 - RNA, 18 nt, Homo sapiens
ccuguuuauucauaugca

SEQ ID NO: 2126684 - RNA, 13 nt, Homo sapiens
cuaucaguucccu

SEQ ID NO: 2126685 - RNA, 14 nt, Homo sapiens
uuaccgagcacugu

SEQ ID NO: 2126686 - RNA, 16 nt, Homo sapiens
aauaaauauuuagucu

SEQ ID NO: 2126687 - RNA, 13 nt, Homo sapiens
acaaagucauccc

SEQ ID NO: 2126688 - RNA, 19 nt, Homo sapiens
cuucuuacaugcauuugag

SEQ ID NO: 2126689 - RNA, 13 nt, Homo sapiens
augagggggcuca

SEQ ID NO: 2126690 - RNA, 20 nt, Homo sapiens
agaagccuaaaaaaagcuaa

SEQ ID NO: 2126691 - RNA, 15 nt, Homo sapiens
gccucugccugacag

SEQ ID NO: 2126692 - RNA, 12 nt, Homo sapiens
aucccuguucau

SEQ ID NO: 2126693 - RNA, 21 nt, Homo sapiens
uaaucucuguuauguacugua

SEQ ID NO: 2126694 - RNA, 17 nt, Homo sapiens
gcucagaauucaucuga

SEQ ID NO: 2126695 - RNA, 23 nt, Homo sapiens
gaaaaguucuuucaaccuauaca

SEQ ID NO: 2126696 - RNA, 20 nt, Homo sapiens
uacauuugauuugauauaca

SEQ ID NO: 2126697 - RNA, 19 nt, Homo sapiens
aaauacagucuuccacaaa

SEQ ID NO: 2126698 - RNA, 14 nt, Homo sapiens
ucacaugaccugau

SEQ ID NO: 2126699 - RNA, 16 nt, Homo sapiens
ccuccuucaccaaaga

SEQ ID NO: 2126700 - RNA, 22 nt, Homo sapiens
cuuugaaagaaauguacuacua

SEQ ID NO: 2126701 - RNA, 18 nt, Homo sapiens
ugacacuuugacauuucc

SEQ ID NO: 2126702 - RNA, 21 nt, Homo sapiens
ugcuaagccccagcaagcaau

SEQ ID NO: 2126703 - RNA, 17 nt, Homo sapiens
gaauaaaaugcagugaa

SEQ ID NO: 2126704 - RNA, 21 nt, Homo sapiens
aauuuuucucuaacucagaaa

SEQ ID NO: 2126705 - RNA, 18 nt, Homo sapiens
agugcacuaauucugcau

SEQ ID NO: 2126706 - RNA, 11 nt, Homo sapiens
ugauacauuuu

SEQ ID NO: 2126707 - RNA, 17 nt, Homo sapiens
accugagucccaaagcu

SEQ ID NO: 2126708 - RNA, 20 nt, Homo sapiens
caauuagacaaacagcauca

SEQ ID NO: 2126709 - RNA, 17 nt, Homo sapiens
aaccuuaaauauauaau

SEQ ID NO: 2126710 - RNA, 20 nt, Homo sapiens
gacccaggccuggccaguca

SEQ ID NO: 2126711 - RNA, 21 nt, Homo sapiens
cuuccucccaacaagcagcug

SEQ ID NO: 2126712 - RNA, 18 nt, Homo sapiens
ccacugccacuccagucc

SEQ ID NO: 2126713 - RNA, 21 nt, Homo sapiens
cucuagaacaugcacauuuau

SEQ ID NO: 2126714 - RNA, 15 nt, Homo sapiens
uaacaagucauuuca

SEQ ID NO: 2126715 - RNA, 18 nt, Homo sapiens
cagccuggccaccagcuu

SEQ ID NO: 2126716 - RNA, 14 nt, Homo sapiens
ugcuccagggcuuu

SEQ ID NO: 2126717 - RNA, 21 nt, Homo sapiens
ccuaguagcuuuccucccaaa

SEQ ID NO: 2126718 - RNA, 23 nt, Homo sapiens
gcacggagccgcgggacagccaa

SEQ ID NO: 2126719 - RNA, 19 nt, Homo sapiens
aaagacauucuuccaaaaa

SEQ ID NO: 2126720 - RNA, 22 nt, Homo sapiens
aacugaguuuaagggggacuua

SEQ ID NO: 2126721 - RNA, 14 nt, Homo sapiens
ggaagaaggggcca

SEQ ID NO: 2126722 - RNA, 14 nt, Homo sapiens
uguauuaccuauuc

SEQ ID NO: 2126723 - RNA, 13 nt, Homo sapiens
uaauuuccagggu

SEQ ID NO: 2126724 - RNA, 12 nt, Homo sapiens
ucaccauucaaa

SEQ ID NO: 2126725 - RNA, 19 nt, Homo sapiens
uaguauauuaaagugcuau

SEQ ID NO: 2126726 - RNA, 15 nt, Homo sapiens
cccaggucuccagca

SEQ ID NO: 2126727 - RNA, 14 nt, Homo sapiens
auaaggcauuccac

SEQ ID NO: 2126728 - RNA, 14 nt, Homo sapiens
ugcucccacagggg

SEQ ID NO: 2126729 - RNA, 20 nt, Homo sapiens
uuuggaaucccacuuaucaa

SEQ ID NO: 2126730 - RNA, 22 nt, Homo sapiens
agcaaguguucacaacagugaa

SEQ ID NO: 2126731 - RNA, 20 nt, Homo sapiens
gauucuacccuuauugcccc

SEQ ID NO: 2126732 - RNA, 11 nt, Homo sapiens
gauaccaaaug

SEQ ID NO: 2126733 - RNA, 13 nt, Homo sapiens
auuuugaagaaua

SEQ ID NO: 2126734 - RNA, 16 nt, Homo sapiens
cuucccucauguucuc

SEQ ID NO: 2126735 - RNA, 22 nt, Homo sapiens
cccaaccucuguggucacccau

SEQ ID NO: 2126736 - RNA, 16 nt, Homo sapiens
cagcagguguuuuccu

SEQ ID NO: 2126737 - RNA, 22 nt, Homo sapiens
guaugcaugcacaaacaugugu

SEQ ID NO: 2126738 - RNA, 21 nt, Homo sapiens
cugcccaaagcagcacuuaua

SEQ ID NO: 2126739 - RNA, 14 nt, Homo sapiens
aacugacacaggaa

SEQ ID NO: 2126740 - RNA, 14 nt, Homo sapiens
auuacuuucagaau

SEQ ID NO: 2126741 - RNA, 14 nt, Homo sapiens
aauaccuucugaac

SEQ ID NO: 2126742 - RNA, 18 nt, Homo sapiens
cuucgcugaagugugacu

SEQ ID NO: 2126743 - RNA, 19 nt, Homo sapiens
aagcucaguucaaugagca

SEQ ID NO: 2126744 - RNA, 22 nt, Homo sapiens
aauaagcacuccuugcagagag

SEQ ID NO: 2126745 - RNA, 11 nt, Homo sapiens
cauauuugcuu

SEQ ID NO: 2126746 - RNA, 16 nt, Homo sapiens
agugagaugcauucuu

SEQ ID NO: 2126747 - RNA, 14 nt, Homo sapiens
ccagguggcgugag

SEQ ID NO: 2126748 - RNA, 14 nt, Homo sapiens
uccccggcaugaga

SEQ ID NO: 2126749 - RNA, 17 nt, Homo sapiens
cauguguugccuggaag

SEQ ID NO: 2126750 - RNA, 21 nt, Homo sapiens
gaauauggaacauaugcacag

SEQ ID NO: 2126751 - RNA, 17 nt, Homo sapiens
gaacauagacuagagaa

SEQ ID NO: 2126752 - RNA, 13 nt, Homo sapiens
cuucaaauaaaga

SEQ ID NO: 2126753 - RNA, 22 nt, Homo sapiens
gacauccaggaggaauaagcuc

SEQ ID NO: 2126754 - RNA, 12 nt, Homo sapiens
cagccugccucg

SEQ ID NO: 2126755 - RNA, 21 nt, Homo sapiens
aggcaucaguaugucacucug

SEQ ID NO: 2126756 - RNA, 18 nt, Homo sapiens
auauagauaacugcauaa

SEQ ID NO: 2126757 - RNA, 21 nt, Homo sapiens
cagcuaccucuucuauggacu

SEQ ID NO: 2126758 - RNA, 18 nt, Homo sapiens
ggggcaguggugcccuuc

SEQ ID NO: 2126759 - RNA, 21 nt, Homo sapiens
auuaaucauuccauuuauccu

SEQ ID NO: 2126760 - RNA, 20 nt, Homo sapiens
uucggacagugcccaugcaa

SEQ ID NO: 2126761 - RNA, 23 nt, Homo sapiens
cacaagccuccuguaccucagug

SEQ ID NO: 2126762 - RNA, 16 nt, Homo sapiens
acauguaugcuuccag

SEQ ID NO: 2126763 - RNA, 16 nt, Homo sapiens
uaacuaagagauucuu

SEQ ID NO: 2126764 - RNA, 13 nt, Homo sapiens
agugggcucucuu

SEQ ID NO: 2126765 - RNA, 17 nt, Homo sapiens
uuauacuagguuaacau

SEQ ID NO: 2126766 - RNA, 19 nt, Homo sapiens
ccuccuuggagacagggcc

SEQ ID NO: 2126767 - RNA, 15 nt, Homo sapiens
gcuccuagcccagca

SEQ ID NO: 2126768 - RNA, 13 nt, Homo sapiens
cgugcugugcucu

SEQ ID NO: 2126769 - RNA, 13 nt, Homo sapiens
uuguuguuauuaa

SEQ ID NO: 2126770 - RNA, 23 nt, Homo sapiens
uggccaguuggaaccacggagau

SEQ ID NO: 2126771 - RNA, 17 nt, Homo sapiens
cucugccaugaacugga

SEQ ID NO: 2126772 - RNA, 15 nt, Homo sapiens
uggccagugcccuga

SEQ ID NO: 2126773 - RNA, 16 nt, Homo sapiens
ucuauggcucaugucu

SEQ ID NO: 2126774 - RNA, 17 nt, Homo sapiens
aggaccacagagcuccu

SEQ ID NO: 2126775 - RNA, 20 nt, Homo sapiens
cagaccagccccaccaugca

SEQ ID NO: 2126776 - RNA, 22 nt, Homo sapiens
uuucaccauauugcccagggug

SEQ ID NO: 2126777 - RNA, 17 nt, Homo sapiens
augaaguaucuuugaca

SEQ ID NO: 2126778 - RNA, 15 nt, Homo sapiens
uaaugaacugugaca

SEQ ID NO: 2126779 - RNA, 16 nt, Homo sapiens
agaugcaaugugcuac

SEQ ID NO: 2126780 - RNA, 15 nt, Homo sapiens
gaugcagcacugcgc

SEQ ID NO: 2126781 - RNA, 14 nt, Homo sapiens
aauaaagcauuuca

SEQ ID NO: 2126782 - RNA, 13 nt, Homo sapiens
ucuauaccugccu

SEQ ID NO: 2126783 - RNA, 13 nt, Homo sapiens
ucuccaccugcac

SEQ ID NO: 2126784 - RNA, 10 nt, Homo sapiens
guuacauuuc

SEQ ID NO: 2126785 - RNA, 13 nt, Homo sapiens
gcaaucacuugag

SEQ ID NO: 2126786 - RNA, 22 nt, Homo sapiens
gauccuuccaccucagucuccc

SEQ ID NO: 2126787 - RNA, 13 nt, Homo sapiens
gaaaugagccagc

SEQ ID NO: 2126788 - RNA, 17 nt, Homo sapiens
agucacuggaucaagaa

SEQ ID NO: 2126789 - RNA, 18 nt, Homo sapiens
gaugguugaauacaguua

SEQ ID NO: 2126790 - RNA, 21 nt, Homo sapiens
caagacucuggggaugggaau

SEQ ID NO: 2126791 - RNA, 13 nt, Homo sapiens
acugaaaagccau

SEQ ID NO: 2126792 - RNA, 13 nt, Homo sapiens
aauguaaagacaa

SEQ ID NO: 2126793 - RNA, 21 nt, Homo sapiens
aaccuggagagcuagaaccua

SEQ ID NO: 2126794 - RNA, 16 nt, Homo sapiens
agguguuaccuucucu

SEQ ID NO: 2126795 - RNA, 17 nt, Homo sapiens
caaugagaucauuguga

SEQ ID NO: 2126796 - RNA, 18 nt, Homo sapiens
ucuggcaucuuagaccuc

SEQ ID NO: 2126797 - RNA, 14 nt, Homo sapiens
ucugucucaaaaca

SEQ ID NO: 2126798 - RNA, 21 nt, Homo sapiens
uguuaaccaggauggucucga

SEQ ID NO: 2126799 - RNA, 17 nt, Homo sapiens
auguuuuaauaccacaa

SEQ ID NO: 2126800 - RNA, 22 nt, Homo sapiens
ggagacccauguaaauaccaga

SEQ ID NO: 2126801 - RNA, 12 nt, Homo sapiens
aaaucacugcau

SEQ ID NO: 2126802 - RNA, 17 nt, Homo sapiens
uuauuccuuucagcaau

SEQ ID NO: 2126803 - RNA, 19 nt, Homo sapiens
ccagagcuccugaguggaa

SEQ ID NO: 2126804 - RNA, 22 nt, Homo sapiens
aucucuguucuguuuggcacuu

SEQ ID NO: 2126805 - RNA, 16 nt, Homo sapiens
augccugguauuuuca

SEQ ID NO: 2126806 - RNA, 21 nt, Homo sapiens
agcaacucugagaucuaagga

SEQ ID NO: 2126807 - RNA, 14 nt, Homo sapiens
caaagaacuacccc

SEQ ID NO: 2126808 - RNA, 21 nt, Homo sapiens
gcugcagccugccccuagaca

SEQ ID NO: 2126809 - RNA, 19 nt, Homo sapiens
cguccauauuuaacaugua

SEQ ID NO: 2126810 - RNA, 15 nt, Homo sapiens
uuaaaaaaacugaag

SEQ ID NO: 2126811 - RNA, 20 nt, Homo sapiens
ccaaaaagaguuacacugga

SEQ ID NO: 2126812 - RNA, 16 nt, Homo sapiens
aaaggagcagagcucc

SEQ ID NO: 2126813 - RNA, 20 nt, Homo sapiens
caagcuagcaaaaaaacucu

SEQ ID NO: 2126814 - RNA, 11 nt, Homo sapiens
cgccuuggccu

SEQ ID NO: 2126815 - RNA, 18 nt, Homo sapiens
ggcucaggccauggcucc

SEQ ID NO: 2126816 - RNA, 21 nt, Homo sapiens
aauacugguuauccugugcua

SEQ ID NO: 2126817 - RNA, 18 nt, Homo sapiens
agacaauucuuuauacaa

SEQ ID NO: 2126818 - RNA, 14 nt, Homo sapiens
cacgugaugugaua

SEQ ID NO: 2126819 - RNA, 16 nt, Homo sapiens
ugaggacaaaaucaca

SEQ ID NO: 2126820 - RNA, 22 nt, Homo sapiens
ggcuucagugagccaugaucau

SEQ ID NO: 2126821 - RNA, 14 nt, Homo sapiens
ucaagaugugacau

SEQ ID NO: 2126822 - RNA, 17 nt, Homo sapiens
uuuguaacccacugaga

SEQ ID NO: 2126823 - RNA, 23 nt, Homo sapiens
auccccaacuaugcaugccaagg

SEQ ID NO: 2126824 - RNA, 15 nt, Homo sapiens
agaugauacauccaa

SEQ ID NO: 2126825 - RNA, 17 nt, Homo sapiens
ggaccaggccauucugc

SEQ ID NO: 2126826 - RNA, 14 nt, Homo sapiens
cagaucacuugagc

SEQ ID NO: 2126827 - RNA, 11 nt, Homo sapiens
aaaacacugug

SEQ ID NO: 2126828 - RNA, 18 nt, Homo sapiens
guaaucccagcacuuugg

SEQ ID NO: 2126829 - RNA, 14 nt, Homo sapiens
aaaagauuauagaa

SEQ ID NO: 2126830 - RNA, 13 nt, Homo sapiens
ucccggcccucac

SEQ ID NO: 2126831 - RNA, 16 nt, Homo sapiens
acagcuuauuauccaa

SEQ ID NO: 2126832 - RNA, 12 nt, Homo sapiens
guuuucauuugu

SEQ ID NO: 2126833 - RNA, 21 nt, Homo sapiens
uaaaaaucccagacuacuuca

SEQ ID NO: 2126834 - RNA, 23 nt, Homo sapiens
ugcaaagucaaaacuauagccau

SEQ ID NO: 2126835 - RNA, 12 nt, Homo sapiens
agaaaauaucuu

SEQ ID NO: 2126836 - RNA, 22 nt, Homo sapiens
ugcgucccaugaggucuucccg

SEQ ID NO: 2126837 - RNA, 14 nt, Homo sapiens
cagccaacugcccc

SEQ ID NO: 2126838 - RNA, 13 nt, Homo sapiens
aacaccacuuaau

SEQ ID NO: 2126839 - RNA, 21 nt, Homo sapiens
aguucauacauuguacgaaga

SEQ ID NO: 2126840 - RNA, 19 nt, Homo sapiens
ugacuguccaagugccaca

SEQ ID NO: 2126841 - RNA, 16 nt, Homo sapiens
ccaucccaguguccua

SEQ ID NO: 2126842 - RNA, 18 nt, Homo sapiens
gucccccuucguggagcu

SEQ ID NO: 2126843 - RNA, 18 nt, Homo sapiens
aagucaccggagcuuuca

SEQ ID NO: 2126844 - RNA, 14 nt, Homo sapiens
gugaaucagacccu

SEQ ID NO: 2126845 - RNA, 14 nt, Homo sapiens
aacaaacaaugcca

SEQ ID NO: 2126846 - RNA, 12 nt, Homo sapiens
ucuaauccuuua

SEQ ID NO: 2126847 - RNA, 20 nt, Homo sapiens
uagacuguuucacauugcac

SEQ ID NO: 2126848 - RNA, 21 nt, Homo sapiens
aguacccaccugagcuuugga

SEQ ID NO: 2126849 - RNA, 19 nt, Homo sapiens
agauggaaugcuguguuaa

SEQ ID NO: 2126850 - RNA, 23 nt, Homo sapiens
auccagccagaccccacgcugac

SEQ ID NO: 2126851 - RNA, 22 nt, Homo sapiens
auuccuucuggccucugcugaa

SEQ ID NO: 2126852 - RNA, 14 nt, Homo sapiens
agaauuggaaucac

SEQ ID NO: 2126853 - RNA, 22 nt, Homo sapiens
uucaaaauacagauuugaauag

SEQ ID NO: 2126854 - RNA, 23 nt, Homo sapiens
cacuccacccuguuaguuuugua

SEQ ID NO: 2126855 - RNA, 22 nt, Homo sapiens
gccaucugacugccaagccaga

SEQ ID NO: 2126856 - RNA, 17 nt, Homo sapiens
guucccauuucagcuga

SEQ ID NO: 2126857 - RNA, 13 nt, Homo sapiens
ugcuuuucagggu

SEQ ID NO: 2126858 - RNA, 18 nt, Homo sapiens
agaaugaaauguaugugc

SEQ ID NO: 2126859 - RNA, 17 nt, Homo sapiens
gccacugcagcacagga

SEQ ID NO: 2126860 - RNA, 17 nt, Homo sapiens
uagcgccgugcuguaaa

SEQ ID NO: 2126861 - RNA, 16 nt, Homo sapiens
aaauggucaguauuau

SEQ ID NO: 2126862 - RNA, 18 nt, Homo sapiens
agacaaaauaaacauuuu

SEQ ID NO: 2126863 - RNA, 19 nt, Homo sapiens
ucccaaucagcacugaaaa

SEQ ID NO: 2126864 - RNA, 16 nt, Homo sapiens
auuagaugaacucaac

SEQ ID NO: 2126865 - RNA, 15 nt, Homo sapiens
aaugaauacaauuaa

SEQ ID NO: 2126866 - RNA, 19 nt, Homo sapiens
ugucaguaguggacauugu

SEQ ID NO: 2126867 - RNA, 22 nt, Homo sapiens
ccugcggcucagccuugcacac

SEQ ID NO: 2126868 - RNA, 15 nt, Homo sapiens
agaauuuaucucuuu

SEQ ID NO: 2126869 - RNA, 22 nt, Homo sapiens
accacauugagaucacuacuca

SEQ ID NO: 2126870 - RNA, 22 nt, Homo sapiens
cuuggugaaacuacaucuccaa

SEQ ID NO: 2126871 - RNA, 19 nt, Homo sapiens
ccucuucuuugugccuuug

SEQ ID NO: 2126872 - RNA, 22 nt, Homo sapiens
agcguggggguggccacuccug

SEQ ID NO: 2126873 - RNA, 15 nt, Homo sapiens
cccuccuccaugcug

SEQ ID NO: 2126874 - RNA, 24 nt, Homo sapiens
caauauaaaccguggucucaugua

SEQ ID NO: 2126875 - RNA, 15 nt, Homo sapiens
aucuucauguacuca

SEQ ID NO: 2126876 - RNA, 15 nt, Homo sapiens
aaugcaagcuuauaa

SEQ ID NO: 2126877 - RNA, 18 nt, Homo sapiens
guuucgacguuugacuag

SEQ ID NO: 2126878 - RNA, 21 nt, Homo sapiens
gaaaaguugaaauguguaauu

SEQ ID NO: 2126879 - RNA, 15 nt, Homo sapiens
gucuccuguuucaga

SEQ ID NO: 2126880 - RNA, 22 nt, Homo sapiens
cucagucaugcacucacaaaga

SEQ ID NO: 2126881 - RNA, 22 nt, Homo sapiens
guggcugcugaaacucauuuga

SEQ ID NO: 2126882 - RNA, 14 nt, Homo sapiens
uaaaagaauauuca

SEQ ID NO: 2126883 - RNA, 15 nt, Homo sapiens
auucaaauugcugcu

SEQ ID NO: 2126884 - RNA, 13 nt, Homo sapiens
ugauguacuguaa

SEQ ID NO: 2126885 - RNA, 12 nt, Homo sapiens
uuggaaauggag

SEQ ID NO: 2126886 - RNA, 14 nt, Homo sapiens
uggccuuguuucaa

SEQ ID NO: 2126887 - RNA, 19 nt, Homo sapiens
ugcagggauguggguucca

SEQ ID NO: 2126888 - RNA, 23 nt, Homo sapiens
aaacuaagagcucucaagucaag

SEQ ID NO: 2126889 - RNA, 16 nt, Homo sapiens
agggcacaaccagaaa

SEQ ID NO: 2126890 - RNA, 21 nt, Homo sapiens
cauccuguguuaucugugguu

SEQ ID NO: 2126891 - RNA, 18 nt, Homo sapiens
uuuaaauaaaagcacaag

SEQ ID NO: 2126892 - RNA, 13 nt, Homo sapiens
agaggaaaacccu

SEQ ID NO: 2126893 - RNA, 15 nt, Homo sapiens
agaaauuauaaacaa

SEQ ID NO: 2126894 - RNA, 18 nt, Homo sapiens
uacucaggcagugcagua

SEQ ID NO: 2126895 - RNA, 20 nt, Homo sapiens
ucaaaauuaccaaacaaagc

SEQ ID NO: 2126896 - RNA, 19 nt, Homo sapiens
ccagguguucuacacucau

SEQ ID NO: 2126897 - RNA, 20 nt, Homo sapiens
uuuaucugguucuauaugaa

SEQ ID NO: 2126898 - RNA, 18 nt, Homo sapiens
gcggccauaagaggugau

SEQ ID NO: 2126899 - RNA, 12 nt, Homo sapiens
accccauucuca

SEQ ID NO: 2126900 - RNA, 17 nt, Homo sapiens
caacaauuuuugaucaa

SEQ ID NO: 2126901 - RNA, 18 nt, Homo sapiens
caucuuauagcacuuuga

SEQ ID NO: 2126902 - RNA, 21 nt, Homo sapiens
ugcuuaaguucuuaaguauug

SEQ ID NO: 2126903 - RNA, 20 nt, Homo sapiens
cauuaguugcacuaacugcu

SEQ ID NO: 2126904 - RNA, 14 nt, Homo sapiens
agagaccuguguga

SEQ ID NO: 2126905 - RNA, 14 nt, Homo sapiens
aguagaaucucagu

SEQ ID NO: 2126906 - RNA, 14 nt, Homo sapiens
cccugggcaucaga

SEQ ID NO: 2126907 - RNA, 11 nt, Homo sapiens
uccuugucauu

SEQ ID NO: 2126908 - RNA, 16 nt, Homo sapiens
gagaccaggcaaagca

SEQ ID NO: 2126909 - RNA, 13 nt, Homo sapiens
aucuagucaguau

SEQ ID NO: 2126910 - RNA, 12 nt, Homo sapiens
uuagucugcauu

SEQ ID NO: 2126911 - RNA, 17 nt, Homo sapiens
uugguauucgcuugaga

SEQ ID NO: 2126912 - RNA, 19 nt, Homo sapiens
cauguucccagcucagugc

SEQ ID NO: 2126913 - RNA, 14 nt, Homo sapiens
gggucacacaaagg

SEQ ID NO: 2126914 - RNA, 17 nt, Homo sapiens
uugauaauccaaagcga

SEQ ID NO: 2126915 - RNA, 17 nt, Homo sapiens
aauguaauagaagcuua

SEQ ID NO: 2126916 - RNA, 15 nt, Homo sapiens
cacaaugaccagcag

SEQ ID NO: 2126917 - RNA, 16 nt, Homo sapiens
cgugaccagugcugcu

SEQ ID NO: 2126918 - RNA, 15 nt, Homo sapiens
aaguuauugugauaa

SEQ ID NO: 2126919 - RNA, 17 nt, Homo sapiens
cuucacagugacacugg

SEQ ID NO: 2126920 - RNA, 19 nt, Homo sapiens
gacacagaucccacuggaa

SEQ ID NO: 2126921 - RNA, 14 nt, Homo sapiens
caguguacagucuu

SEQ ID NO: 2126922 - RNA, 20 nt, Homo sapiens
uaugaauaaauauuacaaau

SEQ ID NO: 2126923 - RNA, 21 nt, Homo sapiens
cgggaagcaagaugugaaaga

SEQ ID NO: 2126924 - RNA, 21 nt, Homo sapiens
cugccugugggcuggggagcc

SEQ ID NO: 2126925 - RNA, 17 nt, Homo sapiens
ggcgauggacuacugaa

SEQ ID NO: 2126926 - RNA, 17 nt, Homo sapiens
gaagaagcccuguucuc

SEQ ID NO: 2126927 - RNA, 18 nt, Homo sapiens
uugucuugccccuaggaa

SEQ ID NO: 2126928 - RNA, 16 nt, Homo sapiens
gaaaaugcuuucucau

SEQ ID NO: 2126929 - RNA, 17 nt, Homo sapiens
aggaucagauucuugcu

SEQ ID NO: 2126930 - RNA, 14 nt, Homo sapiens
uaguaaauguccac

SEQ ID NO: 2126931 - RNA, 17 nt, Homo sapiens
cauuucuccauggaguu

SEQ ID NO: 2126932 - RNA, 19 nt, Homo sapiens
cacuugggauugucuuacu

SEQ ID NO: 2126933 - RNA, 21 nt, Homo sapiens
gaauguguuucaaacuguaaa

SEQ ID NO: 2126934 - RNA, 15 nt, Homo sapiens
aagaaauaugugaga

SEQ ID NO: 2126935 - RNA, 18 nt, Homo sapiens
uguaauggaacuuagcca

SEQ ID NO: 2126936 - RNA, 12 nt, Homo sapiens
acuuuuaaugaa

SEQ ID NO: 2126937 - RNA, 12 nt, Homo sapiens
agaauuaaucuu

SEQ ID NO: 2126938 - RNA, 16 nt, Homo sapiens
agaacugcaauuucca

SEQ ID NO: 2126939 - RNA, 15 nt, Homo sapiens
cauaaucucuuucca

SEQ ID NO: 2126940 - RNA, 17 nt, Homo sapiens
gguaaaaaguggcugcg

SEQ ID NO: 2126941 - RNA, 17 nt, Homo sapiens
caugcguauaugugcgu

SEQ ID NO: 2126942 - RNA, 24 nt, Homo sapiens
ugacacaaauugaagcauguacaa

SEQ ID NO: 2126943 - RNA, 21 nt, Homo sapiens
gccauaaacgguuccugguga

SEQ ID NO: 2126944 - RNA, 18 nt, Homo sapiens
aggcaugagccacugugc

SEQ ID NO: 2126945 - RNA, 22 nt, Homo sapiens
auuccagcaguuguuccaggga

SEQ ID NO: 2126946 - RNA, 23 nt, Homo sapiens
ugcugagugaaugaacaaaugaa

SEQ ID NO: 2126947 - RNA, 19 nt, Homo sapiens
gaggcucccaaucagcuuu

SEQ ID NO: 2126948 - RNA, 17 nt, Homo sapiens
auaaucaaaagcuauuu

SEQ ID NO: 2126949 - RNA, 15 nt, Homo sapiens
uccuauguuucacug

SEQ ID NO: 2126950 - RNA, 14 nt, Homo sapiens
uuauuacuugugca

SEQ ID NO: 2126951 - RNA, 22 nt, Homo sapiens
auccauagauuucgaagccaca

SEQ ID NO: 2126952 - RNA, 17 nt, Homo sapiens
cgucccuccuguuguga

SEQ ID NO: 2126953 - RNA, 20 nt, Homo sapiens
uuggggaugagaaagguuga

SEQ ID NO: 2126954 - RNA, 14 nt, Homo sapiens
ccaagccauucacu

SEQ ID NO: 2126955 - RNA, 17 nt, Homo sapiens
uucuccuccugucuuua

SEQ ID NO: 2126956 - RNA, 12 nt, Homo sapiens
cauauguggaau

SEQ ID NO: 2126957 - RNA, 21 nt, Homo sapiens
caaaaccucauuuaaguaaaa

SEQ ID NO: 2126958 - RNA, 23 nt, Homo sapiens
cauauguccauccauauauauuc

SEQ ID NO: 2126959 - RNA, 15 nt, Homo sapiens
gguggucugaauguu

SEQ ID NO: 2126960 - RNA, 17 nt, Homo sapiens
uucuggauucuuggccc

SEQ ID NO: 2126961 - RNA, 14 nt, Homo sapiens
gaagcguugccauu

SEQ ID NO: 2126962 - RNA, 15 nt, Homo sapiens
ucaagaggcugagac

SEQ ID NO: 2126963 - RNA, 20 nt, Homo sapiens
ugaggguggugggugggaug

SEQ ID NO: 2126964 - RNA, 20 nt, Homo sapiens
cagagcaagaccccaucuca

SEQ ID NO: 2126965 - RNA, 20 nt, Homo sapiens
cagagugagacccugucuca

SEQ ID NO: 2126966 - RNA, 18 nt, Homo sapiens
uagaccuggauguuauau

SEQ ID NO: 2126967 - RNA, 20 nt, Homo sapiens
uuucaaggaaaaaugcugcu

SEQ ID NO: 2126968 - RNA, 20 nt, Homo sapiens
agaaauaggacaauucacuu

SEQ ID NO: 2126969 - RNA, 17 nt, Homo sapiens
agcaggugucccugaga

SEQ ID NO: 2126970 - RNA, 22 nt, Homo sapiens
ucucugcagggccgccagggag

SEQ ID NO: 2126971 - RNA, 15 nt, Homo sapiens
caggcagaaaacugg

SEQ ID NO: 2126972 - RNA, 15 nt, Homo sapiens
auauucaaugcauuu

SEQ ID NO: 2126973 - RNA, 18 nt, Homo sapiens
cuugccugcagggccaug

SEQ ID NO: 2126974 - RNA, 19 nt, Homo sapiens
cuauuaauuccaugugaua

SEQ ID NO: 2126975 - RNA, 12 nt, Homo sapiens
caacagcacugg

SEQ ID NO: 2126976 - RNA, 20 nt, Homo sapiens
gaggcaagagaauugcuuga

SEQ ID NO: 2126977 - RNA, 20 nt, Homo sapiens
gaggcaggagaauuacuuga

SEQ ID NO: 2126978 - RNA, 18 nt, Homo sapiens
ugacuguaacgauugaca

SEQ ID NO: 2126979 - RNA, 21 nt, Homo sapiens
cuuugucagggaguguucccu

SEQ ID NO: 2126980 - RNA, 20 nt, Homo sapiens
auaugauuguccgugauaau

SEQ ID NO: 2126981 - RNA, 18 nt, Homo sapiens
gaauauauucuauuccau

SEQ ID NO: 2126982 - RNA, 22 nt, Homo sapiens
ccaagccuucgggcgucugugu

SEQ ID NO: 2126983 - RNA, 13 nt, Homo sapiens
acuauugcugcuu

SEQ ID NO: 2126984 - RNA, 12 nt, Homo sapiens
aaaagugcuccc

SEQ ID NO: 2126985 - RNA, 21 nt, Homo sapiens
agacagacuagaaguuccuag

SEQ ID NO: 2126986 - RNA, 13 nt, Homo sapiens
ugcggaagcccag

SEQ ID NO: 2126987 - RNA, 17 nt, Homo sapiens
ucagcaacaaccagcau

SEQ ID NO: 2126988 - RNA, 15 nt, Homo sapiens
ccagaaagcugccag

SEQ ID NO: 2126989 - RNA, 15 nt, Homo sapiens
aacuugcauauguca

SEQ ID NO: 2126990 - RNA, 17 nt, Homo sapiens
agagugacggcuggcau

SEQ ID NO: 2126991 - RNA, 20 nt, Homo sapiens
uuaaagaaguccaugugaua

SEQ ID NO: 2126992 - RNA, 16 nt, Homo sapiens
aggauaucgggucacu

SEQ ID NO: 2126993 - RNA, 16 nt, Homo sapiens
ggcagagcucugggaa

SEQ ID NO: 2126994 - RNA, 19 nt, Homo sapiens
gguagacuuuuaauaucac

SEQ ID NO: 2126995 - RNA, 15 nt, Homo sapiens
aaagaauguacauua

SEQ ID NO: 2126996 - RNA, 14 nt, Homo sapiens
gucccaccugcaca

SEQ ID NO: 2126997 - RNA, 22 nt, Homo sapiens
agagagggccugcuggagagca

SEQ ID NO: 2126998 - RNA, 16 nt, Homo sapiens
ugucacaugaugaaua

SEQ ID NO: 2126999 - RNA, 16 nt, Homo sapiens
ucccuccccagugcaa

SEQ ID NO: 2127000 - RNA, 21 nt, Homo sapiens
ccuagaaauauauccugugua

SEQ ID NO: 2127001 - RNA, 20 nt, Homo sapiens
ccagagccggggcacuuuca

SEQ ID NO: 2127002 - RNA, 17 nt, Homo sapiens
uaaaauacaucucaggu

SEQ ID NO: 2127003 - RNA, 13 nt, Homo sapiens
gcuacagggccaa

SEQ ID NO: 2127004 - RNA, 17 nt, Homo sapiens
uagaacguaaccacgga

SEQ ID NO: 2127005 - RNA, 16 nt, Homo sapiens
uuuuaaauuagaucau

SEQ ID NO: 2127006 - RNA, 19 nt, Homo sapiens
ggcgcaccccacagcuggg

SEQ ID NO: 2127007 - RNA, 16 nt, Homo sapiens
caugcccuguguggcu

SEQ ID NO: 2127008 - RNA, 15 nt, Homo sapiens
acaguguacaaugcc

SEQ ID NO: 2127009 - RNA, 18 nt, Homo sapiens
aauauuucuuucaugucu

SEQ ID NO: 2127010 - RNA, 12 nt, Homo sapiens
acacgagauuuc

SEQ ID NO: 2127011 - RNA, 12 nt, Homo sapiens
ucaauucauuaa

SEQ ID NO: 2127012 - RNA, 23 nt, Homo sapiens
agucuugguuucucucuacagug

SEQ ID NO: 2127013 - RNA, 14 nt, Homo sapiens
ccuauuucaugcag

SEQ ID NO: 2127014 - RNA, 15 nt, Homo sapiens
uccugauguacuuua

SEQ ID NO: 2127015 - RNA, 23 nt, Homo sapiens
cauaacgguuaagaaagcacuua

SEQ ID NO: 2127016 - RNA, 21 nt, Homo sapiens
ccacauggggcguacuauuuu

SEQ ID NO: 2127017 - RNA, 13 nt, Homo sapiens
uuaucugauacuu

SEQ ID NO: 2127018 - RNA, 16 nt, Homo sapiens
agaccccaaaaagagu

SEQ ID NO: 2127019 - RNA, 15 nt, Homo sapiens
uaaucccagcacuuu

SEQ ID NO: 2127020 - RNA, 14 nt, Homo sapiens
agcagcccugucac

SEQ ID NO: 2127021 - RNA, 13 nt, Homo sapiens
ucaguauuaucua

SEQ ID NO: 2127022 - RNA, 19 nt, Homo sapiens
cguuucucuauuguaucca

SEQ ID NO: 2127023 - RNA, 16 nt, Homo sapiens
agaaaaaggaugcauu

SEQ ID NO: 2127024 - RNA, 22 nt, Homo sapiens
cauuuagaaaauguucaccuag

SEQ ID NO: 2127025 - RNA, 23 nt, Homo sapiens
ucccaaucugagaaaaggcaaaa

SEQ ID NO: 2127026 - RNA, 22 nt, Homo sapiens
ucaaaugucaguucauaauaua

SEQ ID NO: 2127027 - RNA, 10 nt, Homo sapiens
uugucucaag

SEQ ID NO: 2127028 - RNA, 15 nt, Homo sapiens
caagagauugcuaau

SEQ ID NO: 2127029 - RNA, 22 nt, Homo sapiens
caucacaggcucugcauacaca

SEQ ID NO: 2127030 - RNA, 14 nt, Homo sapiens
ggugucaccccaga

SEQ ID NO: 2127031 - RNA, 18 nt, Homo sapiens
ccugaaagcccugcgcua

SEQ ID NO: 2127032 - RNA, 22 nt, Homo sapiens
cacaacucccuuaaggucucca

SEQ ID NO: 2127033 - RNA, 23 nt, Homo sapiens
aaggcuaaaaagcaacaggccau

SEQ ID NO: 2127034 - RNA, 20 nt, Homo sapiens
gugugacaccaccacugugu

SEQ ID NO: 2127035 - RNA, 13 nt, Homo sapiens
uucaccaagccaa

SEQ ID NO: 2127036 - RNA, 17 nt, Homo sapiens
acauguggggccagguc

SEQ ID NO: 2127037 - RNA, 17 nt, Homo sapiens
cagagaaaaaugcuccc

SEQ ID NO: 2127038 - RNA, 13 nt, Homo sapiens
auucauaaucaca

SEQ ID NO: 2127039 - RNA, 16 nt, Homo sapiens
ccacaguuuugccuua

SEQ ID NO: 2127040 - RNA, 19 nt, Homo sapiens
gaguaccuacugugugcca

SEQ ID NO: 2127041 - RNA, 19 nt, Homo sapiens
ugaaauuugugauggaauc

SEQ ID NO: 2127042 - RNA, 11 nt, Homo sapiens
accaaauaaga

SEQ ID NO: 2127043 - RNA, 23 nt, Homo sapiens
cugcccguaaaaccugagccauu

SEQ ID NO: 2127044 - RNA, 15 nt, Homo sapiens
ugcaggguccccaag

SEQ ID NO: 2127045 - RNA, 12 nt, Homo sapiens
uugacucuugaa

SEQ ID NO: 2127046 - RNA, 19 nt, Homo sapiens
gcagaucacguugcaaugg

SEQ ID NO: 2127047 - RNA, 22 nt, Homo sapiens
cagauuggguuggaaugcuuuc

SEQ ID NO: 2127048 - RNA, 23 nt, Homo sapiens
gauuccuuuccacuccaaccaga

SEQ ID NO: 2127049 - RNA, 17 nt, Homo sapiens
ggcugggacguggcuca

SEQ ID NO: 2127050 - RNA, 17 nt, Homo sapiens
uaugagaaaguucucau

SEQ ID NO: 2127051 - RNA, 13 nt, Homo sapiens
ccacaucagggcg

SEQ ID NO: 2127052 - RNA, 23 nt, Homo sapiens
gcugagggugagugggugaauaa

SEQ ID NO: 2127053 - RNA, 18 nt, Homo sapiens
ugaaaaauaucugguuau

SEQ ID NO: 2127054 - RNA, 19 nt, Homo sapiens
agauaugaagaaucugcuc

SEQ ID NO: 2127055 - RNA, 22 nt, Homo sapiens
auagcgugagcuaacugagaga

SEQ ID NO: 2127056 - RNA, 15 nt, Homo sapiens
uagauaacugcauaa

SEQ ID NO: 2127057 - RNA, 20 nt, Homo sapiens
aauggcuaagauaccaaaac

SEQ ID NO: 2127058 - RNA, 18 nt, Homo sapiens
ucagggaagcugccaaag

SEQ ID NO: 2127059 - RNA, 20 nt, Homo sapiens
acuaaccaguaccucuguau

SEQ ID NO: 2127060 - RNA, 13 nt, Homo sapiens
ccuucugugggga

SEQ ID NO: 2127061 - RNA, 20 nt, Homo sapiens
ucaaguggcaugugcuguga

SEQ ID NO: 2127062 - RNA, 15 nt, Homo sapiens
aagccagaccagaag

SEQ ID NO: 2127063 - RNA, 15 nt, Homo sapiens
ggcugaaagaugacg

SEQ ID NO: 2127064 - RNA, 19 nt, Homo sapiens
acgugcuauuuuacauauc

SEQ ID NO: 2127065 - RNA, 13 nt, Homo sapiens
agaacugagcucc

SEQ ID NO: 2127066 - RNA, 18 nt, Homo sapiens
caugcaugucugccuaug

SEQ ID NO: 2127067 - RNA, 11 nt, Homo sapiens
ucagcagcuau

SEQ ID NO: 2127068 - RNA, 14 nt, Homo sapiens
uccaauuaaugaag

SEQ ID NO: 2127069 - RNA, 20 nt, Homo sapiens
gccaccggggcaagagggaa

SEQ ID NO: 2127070 - RNA, 22 nt, Homo sapiens
cagggaaccgugauaagccuuu

SEQ ID NO: 2127071 - RNA, 14 nt, Homo sapiens
acagaaccugcaaa

SEQ ID NO: 2127072 - RNA, 16 nt, Homo sapiens
uaacgagaaauagaaa

SEQ ID NO: 2127073 - RNA, 21 nt, Homo sapiens
cucaaaagaaaauauagucac

SEQ ID NO: 2127074 - RNA, 16 nt, Homo sapiens
cuagcauuuucuugaa

SEQ ID NO: 2127075 - RNA, 17 nt, Homo sapiens
ucuguuggccaguguga

SEQ ID NO: 2127076 - RNA, 17 nt, Homo sapiens
uuucauaccacuugaau

SEQ ID NO: 2127077 - RNA, 21 nt, Homo sapiens
aguacaccccaacagcacccu

SEQ ID NO: 2127078 - RNA, 21 nt, Homo sapiens
uagggcuguagacuuacuuuc

SEQ ID NO: 2127079 - RNA, 21 nt, Homo sapiens
guaucuuucauccuugacuaa

SEQ ID NO: 2127080 - RNA, 14 nt, Homo sapiens
gggacccuguugau

SEQ ID NO: 2127081 - RNA, 22 nt, Homo sapiens
guuaugccguauaggaugucag

SEQ ID NO: 2127082 - RNA, 22 nt, Homo sapiens
cuagccaccgccuccuacagcc

SEQ ID NO: 2127083 - RNA, 15 nt, Homo sapiens
uguaauuguauuuca

SEQ ID NO: 2127084 - RNA, 17 nt, Homo sapiens
uguucaauguuccauuc

SEQ ID NO: 2127085 - RNA, 18 nt, Homo sapiens
uaggcagcaucucagauc

SEQ ID NO: 2127086 - RNA, 12 nt, Homo sapiens
accugacuucca

SEQ ID NO: 2127087 - RNA, 20 nt, Homo sapiens
augcuggucauccugggcau

SEQ ID NO: 2127088 - RNA, 18 nt, Homo sapiens
gccuugggggugugaugu

SEQ ID NO: 2127089 - RNA, 15 nt, Homo sapiens
gcauucacaucucau

SEQ ID NO: 2127090 - RNA, 14 nt, Homo sapiens
auggaaccucagga

SEQ ID NO: 2127091 - RNA, 20 nt, Homo sapiens
cacauuugggauguuccuuu

SEQ ID NO: 2127092 - RNA, 14 nt, Homo sapiens
acagcuaccaaagu

SEQ ID NO: 2127093 - RNA, 19 nt, Homo sapiens
aaagcagcccccauuuccu

SEQ ID NO: 2127094 - RNA, 20 nt, Homo sapiens
uaggacuccaaccucaggga

SEQ ID NO: 2127095 - RNA, 16 nt, Homo sapiens
caggugaugcacccac

SEQ ID NO: 2127096 - RNA, 19 nt, Homo sapiens
ucaaggcaguagaacucca

SEQ ID NO: 2127097 - RNA, 23 nt, Homo sapiens
agggaaaauagaaaagaaccuac

SEQ ID NO: 2127098 - RNA, 14 nt, Homo sapiens
caagaucaaaccca

SEQ ID NO: 2127099 - RNA, 15 nt, Homo sapiens
cuacauuccaaagaa

SEQ ID NO: 2127100 - RNA, 15 nt, Homo sapiens
aucgcuccucuccag

SEQ ID NO: 2127101 - RNA, 18 nt, Homo sapiens
acucucccuuguccuucu

SEQ ID NO: 2127102 - RNA, 18 nt, Homo sapiens
cucauaacuugagaccua

SEQ ID NO: 2127103 - RNA, 13 nt, Homo sapiens
cugaagcaguuca

SEQ ID NO: 2127104 - RNA, 21 nt, Homo sapiens
cugaguuugcuguuugcaauu

SEQ ID NO: 2127105 - RNA, 18 nt, Homo sapiens
uccgaggccuaccugcuc

SEQ ID NO: 2127106 - RNA, 10 nt, Homo sapiens
gcaagcaaaa

SEQ ID NO: 2127107 - RNA, 21 nt, Homo sapiens
uucacccauccaugagcugcu

SEQ ID NO: 2127108 - RNA, 13 nt, Homo sapiens
cagcuugccaaau

SEQ ID NO: 2127109 - RNA, 19 nt, Homo sapiens
ccagucccgucgugcaguc

SEQ ID NO: 2127110 - RNA, 18 nt, Homo sapiens
gccaccagacugacaaau

SEQ ID NO: 2127111 - RNA, 13 nt, Homo sapiens
uaaauuucuuccu

SEQ ID NO: 2127112 - RNA, 15 nt, Homo sapiens
gugcugauguuuaca

SEQ ID NO: 2127113 - RNA, 19 nt, Homo sapiens
ucagcaagacauaaagccu

SEQ ID NO: 2127114 - RNA, 13 nt, Homo sapiens
caggcccacuguc

SEQ ID NO: 2127115 - RNA, 13 nt, Homo sapiens
aauuccaauacau

SEQ ID NO: 2127116 - RNA, 15 nt, Homo sapiens
cuauuugaacaagug

SEQ ID NO: 2127117 - RNA, 12 nt, Homo sapiens
aaaaaaacguau

SEQ ID NO: 2127118 - RNA, 15 nt, Homo sapiens
aguuugaaauaagcu

SEQ ID NO: 2127119 - RNA, 21 nt, Homo sapiens
ucacggagacagcaaccagaa

SEQ ID NO: 2127120 - RNA, 22 nt, Homo sapiens
caguucuguguggauuugucug

SEQ ID NO: 2127121 - RNA, 22 nt, Homo sapiens
uggagggaaggauaaagccacu

SEQ ID NO: 2127122 - RNA, 15 nt, Homo sapiens
cuugagccaguaauu

SEQ ID NO: 2127123 - RNA, 12 nt, Homo sapiens
aagucugugagu

SEQ ID NO: 2127124 - RNA, 12 nt, Homo sapiens
gaaacuguaaaa

SEQ ID NO: 2127125 - RNA, 17 nt, Homo sapiens
aauaauacaacuccuau

SEQ ID NO: 2127126 - RNA, 17 nt, Homo sapiens
uuaaaccuuuaaugaga

SEQ ID NO: 2127127 - RNA, 13 nt, Homo sapiens
agacacuguugca

SEQ ID NO: 2127128 - RNA, 12 nt, Homo sapiens
aauggcauuugc

SEQ ID NO: 2127129 - RNA, 11 nt, Homo sapiens
cuugaagccaa

SEQ ID NO: 2127130 - RNA, 19 nt, Homo sapiens
agguuccugaaauauccag

SEQ ID NO: 2127131 - RNA, 22 nt, Homo sapiens
ggagcacauuaaaauucucaga

SEQ ID NO: 2127132 - RNA, 13 nt, Homo sapiens
uucagggcuuuaa

SEQ ID NO: 2127133 - RNA, 20 nt, Homo sapiens
cuaguagaacuggaucccaa

SEQ ID NO: 2127134 - RNA, 14 nt, Homo sapiens
caucuucacagcac

SEQ ID NO: 2127135 - RNA, 21 nt, Homo sapiens
uacugaucaucugcugugacu

SEQ ID NO: 2127136 - RNA, 22 nt, Homo sapiens
caaaaugugauucuaugugauu

SEQ ID NO: 2127137 - RNA, 15 nt, Homo sapiens
ucuagaacaugcaca

SEQ ID NO: 2127138 - RNA, 19 nt, Homo sapiens
uaaauaaacacacuauggc

SEQ ID NO: 2127139 - RNA, 13 nt, Homo sapiens
aaugaagguuucu

SEQ ID NO: 2127140 - RNA, 21 nt, Homo sapiens
aagcuguucugucuucccacc

SEQ ID NO: 2127141 - RNA, 20 nt, Homo sapiens
cacccaaguuggagugcagu

SEQ ID NO: 2127142 - RNA, 13 nt, Homo sapiens
ggacucagcccac

SEQ ID NO: 2127143 - RNA, 20 nt, Homo sapiens
cacucccagggacccaggga

SEQ ID NO: 2127144 - RNA, 20 nt, Homo sapiens
aagacagucgagaagccagg

SEQ ID NO: 2127145 - RNA, 20 nt, Homo sapiens
cuggaguacaauggcgugau

SEQ ID NO: 2127146 - RNA, 19 nt, Homo sapiens
agauaagugcucaguauug

SEQ ID NO: 2127147 - RNA, 14 nt, Homo sapiens
accuacaguguaca

SEQ ID NO: 2127148 - RNA, 17 nt, Homo sapiens
ucugcuucagugcagug

SEQ ID NO: 2127149 - RNA, 18 nt, Homo sapiens
ucaccaccaccccuacca

SEQ ID NO: 2127150 - RNA, 11 nt, Homo sapiens
augaauucuuu

SEQ ID NO: 2127151 - RNA, 21 nt, Homo sapiens
gacuacaggcaccugccacca

SEQ ID NO: 2127152 - RNA, 22 nt, Homo sapiens
acccugccccaccccaccucca

SEQ ID NO: 2127153 - RNA, 23 nt, Homo sapiens
auugaucuguuuuaaguaugaga

SEQ ID NO: 2127154 - RNA, 21 nt, Homo sapiens
cagaauaauggaaacauuaca

SEQ ID NO: 2127155 - RNA, 18 nt, Homo sapiens
uuuuuauuaugcauuaua

SEQ ID NO: 2127156 - RNA, 14 nt, Homo sapiens
ucccccuacccaua

SEQ ID NO: 2127157 - RNA, 17 nt, Homo sapiens
agcuccgcaagcaucau

SEQ ID NO: 2127158 - RNA, 22 nt, Homo sapiens
acucaaaaucugucauaagcau

SEQ ID NO: 2127159 - RNA, 22 nt, Homo sapiens
uaacuguuugauuauaacugug

SEQ ID NO: 2127160 - RNA, 17 nt, Homo sapiens
guaaaaccugagccauu

SEQ ID NO: 2127161 - RNA, 15 nt, Homo sapiens
aauuaagauuaugug

SEQ ID NO: 2127162 - RNA, 15 nt, Homo sapiens
uaccuauacaaugua

SEQ ID NO: 2127163 - RNA, 17 nt, Homo sapiens
gccaggcaugguggcac

SEQ ID NO: 2127164 - RNA, 23 nt, Homo sapiens
uaaauuuguuauuguguauuaug

SEQ ID NO: 2127165 - RNA, 12 nt, Homo sapiens
agccaaagggac

SEQ ID NO: 2127166 - RNA, 15 nt, Homo sapiens
acacgucacaaagac

SEQ ID NO: 2127167 - RNA, 15 nt, Homo sapiens
agggggcugcuccca

SEQ ID NO: 2127168 - RNA, 14 nt, Homo sapiens
cuacaugacugggc

SEQ ID NO: 2127169 - RNA, 19 nt, Homo sapiens
gcaccuguugugugccuga

SEQ ID NO: 2127170 - RNA, 21 nt, Homo sapiens
agaaaccuauauuucaauacu

SEQ ID NO: 2127171 - RNA, 23 nt, Homo sapiens
cuauguaauuguaacuauaccuc

SEQ ID NO: 2127172 - RNA, 12 nt, Homo sapiens
ggucuccaggga

SEQ ID NO: 2127173 - RNA, 15 nt, Homo sapiens
ucugucauuauauuc

SEQ ID NO: 2127174 - RNA, 17 nt, Homo sapiens
auaauugcaucaguuca

SEQ ID NO: 2127175 - RNA, 17 nt, Homo sapiens
cagacggaaaugaaauu

SEQ ID NO: 2127176 - RNA, 12 nt, Homo sapiens
gucucagugaag

SEQ ID NO: 2127177 - RNA, 13 nt, Homo sapiens
acaguuugagacu

SEQ ID NO: 2127178 - RNA, 18 nt, Homo sapiens
ugaauguaauagucuugc

SEQ ID NO: 2127179 - RNA, 20 nt, Homo sapiens
aucauaauggauucacugag

SEQ ID NO: 2127180 - RNA, 14 nt, Homo sapiens
cauucugacaucuu

SEQ ID NO: 2127181 - RNA, 16 nt, Homo sapiens
agggucuuugguguuu

SEQ ID NO: 2127182 - RNA, 14 nt, Homo sapiens
auauaacugugaug

SEQ ID NO: 2127183 - RNA, 20 nt, Homo sapiens
auuaacucaccagauuuacu

SEQ ID NO: 2127184 - RNA, 22 nt, Homo sapiens
augaaaggugacaaaaggcaga

SEQ ID NO: 2127185 - RNA, 20 nt, Homo sapiens
ccuauucccugugucugcca

SEQ ID NO: 2127186 - RNA, 23 nt, Homo sapiens
aggcuucucacggcgaccaauaa

SEQ ID NO: 2127187 - RNA, 15 nt, Homo sapiens
guuggcugcacuuga

SEQ ID NO: 2127188 - RNA, 22 nt, Homo sapiens
cugaugcccugaggcacugaaa

SEQ ID NO: 2127189 - RNA, 19 nt, Homo sapiens
aauuguugacuugcauuca

SEQ ID NO: 2127190 - RNA, 15 nt, Homo sapiens
aauugguagaaggau

SEQ ID NO: 2127191 - RNA, 23 nt, Homo sapiens
cccugcccaccaagaagcacugg

SEQ ID NO: 2127192 - RNA, 20 nt, Homo sapiens
acucuauguccggcuuuaac

SEQ ID NO: 2127193 - RNA, 16 nt, Homo sapiens
auauggaaauucugcu

SEQ ID NO: 2127194 - RNA, 17 nt, Homo sapiens
uggggauucagauuucu

SEQ ID NO: 2127195 - RNA, 15 nt, Homo sapiens
ccuuuuuaaaacaca

SEQ ID NO: 2127196 - RNA, 18 nt, Homo sapiens
ucucauuuagaacuugca

SEQ ID NO: 2127197 - RNA, 19 nt, Homo sapiens
uagguuugauauguaguua

SEQ ID NO: 2127198 - RNA, 16 nt, Homo sapiens
gagcuaaacuccuucc

SEQ ID NO: 2127199 - RNA, 13 nt, Homo sapiens
agccaccugaguu

SEQ ID NO: 2127200 - RNA, 17 nt, Homo sapiens
augucuguaucuacuua

SEQ ID NO: 2127201 - RNA, 14 nt, Homo sapiens
gugaugacauuccc

SEQ ID NO: 2127202 - RNA, 18 nt, Homo sapiens
ccgaaggguuuugcuaca

SEQ ID NO: 2127203 - RNA, 20 nt, Homo sapiens
ugcaccccaaagcuuuccug

SEQ ID NO: 2127204 - RNA, 11 nt, Homo sapiens
aggugcucaga

SEQ ID NO: 2127205 - RNA, 19 nt, Homo sapiens
ccuaagagagagagacaga

SEQ ID NO: 2127206 - RNA, 20 nt, Homo sapiens
aacaguuugaugcugaguca

SEQ ID NO: 2127207 - RNA, 21 nt, Homo sapiens
cucccagggaggcugugcaca

SEQ ID NO: 2127208 - RNA, 21 nt, Homo sapiens
uccuuccuugaacugucuacc

SEQ ID NO: 2127209 - RNA, 14 nt, Homo sapiens
agauaauuggcaac

SEQ ID NO: 2127210 - RNA, 15 nt, Homo sapiens
uagcauagauuugca

SEQ ID NO: 2127211 - RNA, 21 nt, Homo sapiens
ugaaguucuggcaagauugaa

SEQ ID NO: 2127212 - RNA, 15 nt, Homo sapiens
uccaggcccaucuca

SEQ ID NO: 2127213 - RNA, 18 nt, Homo sapiens
uacugaacacauguguau

SEQ ID NO: 2127214 - RNA, 16 nt, Homo sapiens
cagguagccaccaccg

SEQ ID NO: 2127215 - RNA, 22 nt, Homo sapiens
cagaauaauucuuccagugcaa

SEQ ID NO: 2127216 - RNA, 14 nt, Homo sapiens
guacacuuccugug

SEQ ID NO: 2127217 - RNA, 20 nt, Homo sapiens
gcagccagaacuuguuucuc

SEQ ID NO: 2127218 - RNA, 23 nt, Homo sapiens
aguuuucucaacagagagcaaag

SEQ ID NO: 2127219 - RNA, 13 nt, Homo sapiens
cuaccagauuuga

SEQ ID NO: 2127220 - RNA, 16 nt, Homo sapiens
cucccucugaccugca

SEQ ID NO: 2127221 - RNA, 18 nt, Homo sapiens
augcgagugcucauuuca

SEQ ID NO: 2127222 - RNA, 18 nt, Homo sapiens
uagauccccccacugagc

SEQ ID NO: 2127223 - RNA, 18 nt, Homo sapiens
ucccgccuuugaccugac

SEQ ID NO: 2127224 - RNA, 18 nt, Homo sapiens
gcagagcgcaaagugcua

SEQ ID NO: 2127225 - RNA, 16 nt, Homo sapiens
accugucaucugggcc

SEQ ID NO: 2127226 - RNA, 18 nt, Homo sapiens
uaauugggaacugaaauc

SEQ ID NO: 2127227 - RNA, 20 nt, Homo sapiens
ucuagaaagcuuugaaugca

SEQ ID NO: 2127228 - RNA, 20 nt, Homo sapiens
auccccgcagugugcacuaa

SEQ ID NO: 2127229 - RNA, 22 nt, Homo sapiens
ugugucucaggcaccucauccc

SEQ ID NO: 2127230 - RNA, 17 nt, Homo sapiens
uuuuaacaguguucuca

SEQ ID NO: 2127231 - RNA, 19 nt, Homo sapiens
cuuuuaguaaagucaagga

SEQ ID NO: 2127232 - RNA, 19 nt, Homo sapiens
agaugcauuaucuaugaua

SEQ ID NO: 2127233 - RNA, 23 nt, Homo sapiens
acgucgcgguguguccucugugc

SEQ ID NO: 2127234 - RNA, 21 nt, Homo sapiens
cuaaggaauaugagcuuuaug

SEQ ID NO: 2127235 - RNA, 18 nt, Homo sapiens
ucaucuaugcucuuuccu

SEQ ID NO: 2127236 - RNA, 17 nt, Homo sapiens
agaacuauaugugaauc

SEQ ID NO: 2127237 - RNA, 23 nt, Homo sapiens
auuggcaccccuuucuaguucaa

SEQ ID NO: 2127238 - RNA, 14 nt, Homo sapiens
agggaauugcucag

SEQ ID NO: 2127239 - RNA, 15 nt, Homo sapiens
uuucacuguucauga

SEQ ID NO: 2127240 - RNA, 12 nt, Homo sapiens
accauucucacc

SEQ ID NO: 2127241 - RNA, 18 nt, Homo sapiens
ccaagcaggaagaacauu

SEQ ID NO: 2127242 - RNA, 19 nt, Homo sapiens
gugggaucagcccugccag

SEQ ID NO: 2127243 - RNA, 15 nt, Homo sapiens
gcucagugcucucuc

SEQ ID NO: 2127244 - RNA, 18 nt, Homo sapiens
gcaccagugccucagugc

SEQ ID NO: 2127245 - RNA, 20 nt, Homo sapiens
agacauuucaaaucuguagc

SEQ ID NO: 2127246 - RNA, 15 nt, Homo sapiens
aguguguacuucuuc

SEQ ID NO: 2127247 - RNA, 21 nt, Homo sapiens
cuacucugugccagagccugg

SEQ ID NO: 2127248 - RNA, 21 nt, Homo sapiens
uucaagaaugcaguacuaaca

SEQ ID NO: 2127249 - RNA, 14 nt, Homo sapiens
gcacacagaauuau

SEQ ID NO: 2127250 - RNA, 18 nt, Homo sapiens
uuucuaaaaagcuaugua

SEQ ID NO: 2127251 - RNA, 20 nt, Homo sapiens
uacaagauugaaaaucuugu

SEQ ID NO: 2127252 - RNA, 22 nt, Homo sapiens
ucaccccaaguagucugcucac

SEQ ID NO: 2127253 - RNA, 15 nt, Homo sapiens
acaugcacaccuccc

SEQ ID NO: 2127254 - RNA, 22 nt, Homo sapiens
ugacuauccagugauccucaaa

SEQ ID NO: 2127255 - RNA, 21 nt, Homo sapiens
aauucaacccagccaugcaau

SEQ ID NO: 2127256 - RNA, 11 nt, Homo sapiens
acaugcauugu

SEQ ID NO: 2127257 - RNA, 22 nt, Homo sapiens
aaagcuuggugcuaaaccacaa

SEQ ID NO: 2127258 - RNA, 12 nt, Homo sapiens
aucagccagguc

SEQ ID NO: 2127259 - RNA, 18 nt, Homo sapiens
caggcagagcagcuccac

SEQ ID NO: 2127260 - RNA, 20 nt, Homo sapiens
caugaacagacacuuuucaa

SEQ ID NO: 2127261 - RNA, 22 nt, Homo sapiens
ccauaucuugcgaauccaagcu

SEQ ID NO: 2127262 - RNA, 14 nt, Homo sapiens
ucuaacaguauuug

SEQ ID NO: 2127263 - RNA, 19 nt, Homo sapiens
aacacaauucuucuuccaa

SEQ ID NO: 2127264 - RNA, 16 nt, Homo sapiens
cugccacgucccgcug

SEQ ID NO: 2127265 - RNA, 13 nt, Homo sapiens
cccuuaacccaag

SEQ ID NO: 2127266 - RNA, 13 nt, Homo sapiens
auuccuguguaau

SEQ ID NO: 2127267 - RNA, 22 nt, Homo sapiens
aagggcaguacaguggcuucaa

SEQ ID NO: 2127268 - RNA, 16 nt, Homo sapiens
cuccuugaggucuuga

SEQ ID NO: 2127269 - RNA, 15 nt, Homo sapiens
gccauuggcuacuga

SEQ ID NO: 2127270 - RNA, 17 nt, Homo sapiens
cggccagccuugcacug

SEQ ID NO: 2127271 - RNA, 19 nt, Homo sapiens
cagcgaaccaauauuugua

SEQ ID NO: 2127272 - RNA, 24 nt, Homo sapiens
accuuugguacaugccuguuaaua

SEQ ID NO: 2127273 - RNA, 19 nt, Homo sapiens
auuagaaagauuagugauu

SEQ ID NO: 2127274 - RNA, 18 nt, Homo sapiens
ugcugucccaaacaugca

SEQ ID NO: 2127275 - RNA, 17 nt, Homo sapiens
gcccuuacccaccuguc

SEQ ID NO: 2127276 - RNA, 14 nt, Homo sapiens
caacagacaaguga

SEQ ID NO: 2127277 - RNA, 18 nt, Homo sapiens
aacuauguguucaaugaa

SEQ ID NO: 2127278 - RNA, 23 nt, Homo sapiens
cuguaacucacauucucuuccca

SEQ ID NO: 2127279 - RNA, 22 nt, Homo sapiens
uaaccuugaaaaaaaacagugg

SEQ ID NO: 2127280 - RNA, 14 nt, Homo sapiens
uuuugauaauggcu

SEQ ID NO: 2127281 - RNA, 18 nt, Homo sapiens
aagggugggaagcuugcu

SEQ ID NO: 2127282 - RNA, 12 nt, Homo sapiens
acaguuuagccc

SEQ ID NO: 2127283 - RNA, 18 nt, Homo sapiens
cugggccauaugugcuau

SEQ ID NO: 2127284 - RNA, 21 nt, Homo sapiens
acagacaaaaauauuucagca

SEQ ID NO: 2127285 - RNA, 15 nt, Homo sapiens
uagugcaauaccugg

SEQ ID NO: 2127286 - RNA, 19 nt, Homo sapiens
uugaucuuaacaaagccuu

SEQ ID NO: 2127287 - RNA, 21 nt, Homo sapiens
guccuuuugacacugcucuaa

SEQ ID NO: 2127288 - RNA, 20 nt, Homo sapiens
cugaaugugauacaugccga

SEQ ID NO: 2127289 - RNA, 11 nt, Homo sapiens
uuacucugaag

SEQ ID NO: 2127290 - RNA, 11 nt, Homo sapiens
uauaccuaucu

SEQ ID NO: 2127291 - RNA, 23 nt, Homo sapiens
uucauaauuaaaauuuaucuuaa

SEQ ID NO: 2127292 - RNA, 17 nt, Homo sapiens
gccggagggagcccuga

SEQ ID NO: 2127293 - RNA, 14 nt, Homo sapiens
uaugacaagacaau

SEQ ID NO: 2127294 - RNA, 13 nt, Homo sapiens
acauguugucaca

SEQ ID NO: 2127295 - RNA, 13 nt, Homo sapiens
ucuuguugacuca

SEQ ID NO: 2127296 - RNA, 18 nt, Homo sapiens
auacuaaaaaucaugaga

SEQ ID NO: 2127297 - RNA, 19 nt, Homo sapiens
ugaaauggugaaaugcaga

SEQ ID NO: 2127298 - RNA, 22 nt, Homo sapiens
gaaaaaugccugcugcugccaa

SEQ ID NO: 2127299 - RNA, 20 nt, Homo sapiens
auuugcggcgucagucuuuu

SEQ ID NO: 2127300 - RNA, 18 nt, Homo sapiens
acuggaaaaguguaauag

SEQ ID NO: 2127301 - RNA, 20 nt, Homo sapiens
ccuuuuaguuaagcaugacu

SEQ ID NO: 2127302 - RNA, 21 nt, Homo sapiens
gagcuugcagugaaguguucu

SEQ ID NO: 2127303 - RNA, 12 nt, Homo sapiens
cucaacagccaa

SEQ ID NO: 2127304 - RNA, 14 nt, Homo sapiens
augccagcuacuuc

SEQ ID NO: 2127305 - RNA, 21 nt, Homo sapiens
ugcccguaaacacgccugcaa

SEQ ID NO: 2127306 - RNA, 15 nt, Homo sapiens
gcccgccccaagccc

SEQ ID NO: 2127307 - RNA, 22 nt, Homo sapiens
accugucgguggcugccuuuga

SEQ ID NO: 2127308 - RNA, 16 nt, Homo sapiens
cagcucaugacacugu

SEQ ID NO: 2127309 - RNA, 18 nt, Homo sapiens
acaccaaguaaaucuauc

SEQ ID NO: 2127310 - RNA, 16 nt, Homo sapiens
ucucccauaaacacug

SEQ ID NO: 2127311 - RNA, 21 nt, Homo sapiens
ucuuuugaaaauaaccaugaa

SEQ ID NO: 2127312 - RNA, 17 nt, Homo sapiens
aaaggguucuguaaaau

SEQ ID NO: 2127313 - RNA, 11 nt, Homo sapiens
gucuauuccau

SEQ ID NO: 2127314 - RNA, 22 nt, Homo sapiens
gucuuucuuagauuaaaucucu

SEQ ID NO: 2127315 - RNA, 16 nt, Homo sapiens
uaauaaaaaauuucag

SEQ ID NO: 2127316 - RNA, 19 nt, Homo sapiens
auucuuuuggcaguucuga

SEQ ID NO: 2127317 - RNA, 23 nt, Homo sapiens
cuaaagugcuugaggcuaccucu

SEQ ID NO: 2127318 - RNA, 19 nt, Homo sapiens
ucaggcuggcuugagugaa

SEQ ID NO: 2127319 - RNA, 23 nt, Homo sapiens
gcuguaaauauaaauuuuguccc

SEQ ID NO: 2127320 - RNA, 13 nt, Homo sapiens
aaugaugugauac

SEQ ID NO: 2127321 - RNA, 14 nt, Homo sapiens
uuauuguugcauua

SEQ ID NO: 2127322 - RNA, 14 nt, Homo sapiens
uuuuccaacuacua

SEQ ID NO: 2127323 - RNA, 15 nt, Homo sapiens
uugauaaugaucuga

SEQ ID NO: 2127324 - RNA, 17 nt, Homo sapiens
gaacuuugcacacuuca

SEQ ID NO: 2127325 - RNA, 23 nt, Homo sapiens
gaucuuaauuuacuuuaagcauu

SEQ ID NO: 2127326 - RNA, 14 nt, Homo sapiens
agggcccuaccuga

SEQ ID NO: 2127327 - RNA, 15 nt, Homo sapiens
aaaguaccgcuuaaa

SEQ ID NO: 2127328 - RNA, 13 nt, Homo sapiens
uggcgcuuccagc

SEQ ID NO: 2127329 - RNA, 19 nt, Homo sapiens
auauagcuugaaacauaga

SEQ ID NO: 2127330 - RNA, 16 nt, Homo sapiens
gagagggugacaagau

SEQ ID NO: 2127331 - RNA, 22 nt, Homo sapiens
ccugcccccuccagucccccac

SEQ ID NO: 2127332 - RNA, 13 nt, Homo sapiens
ugaaauucuuccu

SEQ ID NO: 2127333 - RNA, 15 nt, Homo sapiens
auguugguguuggca

SEQ ID NO: 2127334 - RNA, 24 nt, Homo sapiens
cggagucuccucucuuggcaucga

SEQ ID NO: 2127335 - RNA, 21 nt, Homo sapiens
gcucuucucauuuuuuccuga

SEQ ID NO: 2127336 - RNA, 12 nt, Homo sapiens
aagggggugaca

SEQ ID NO: 2127337 - RNA, 22 nt, Homo sapiens
aaaauguucguauucuauucaa

SEQ ID NO: 2127338 - RNA, 23 nt, Homo sapiens
uccagggaugauucaagccauuc

SEQ ID NO: 2127339 - RNA, 14 nt, Homo sapiens
gaaucuaaaccuua

SEQ ID NO: 2127340 - RNA, 20 nt, Homo sapiens
acagcagcauuuuuauuuca

SEQ ID NO: 2127341 - RNA, 20 nt, Homo sapiens
uuccacacuucugggcccua

SEQ ID NO: 2127342 - RNA, 20 nt, Homo sapiens
aaaucaagugguauuuucca

SEQ ID NO: 2127343 - RNA, 15 nt, Homo sapiens
cuaaacaauguauuu

SEQ ID NO: 2127344 - RNA, 20 nt, Homo sapiens
gcccaggccagagugcagug

SEQ ID NO: 2127345 - RNA, 19 nt, Homo sapiens
uauaaagcaaauuacucca

SEQ ID NO: 2127346 - RNA, 21 nt, Homo sapiens
cuuuaaccccaaauuuggcua

SEQ ID NO: 2127347 - RNA, 16 nt, Homo sapiens
uuauuuuacagcucau

SEQ ID NO: 2127348 - RNA, 16 nt, Homo sapiens
ggggcgugggauugaa

SEQ ID NO: 2127349 - RNA, 22 nt, Homo sapiens
agaaacgucuauguguacagau

SEQ ID NO: 2127350 - RNA, 16 nt, Homo sapiens
cuuuaaacucagggac

SEQ ID NO: 2127351 - RNA, 16 nt, Homo sapiens
ugcauuaccugggaau

SEQ ID NO: 2127352 - RNA, 20 nt, Homo sapiens
auucuccugccucagccucc

SEQ ID NO: 2127353 - RNA, 14 nt, Homo sapiens
ucagcauccaaaag

SEQ ID NO: 2127354 - RNA, 17 nt, Homo sapiens
gagccagugagggcagu

SEQ ID NO: 2127355 - RNA, 13 nt, Homo sapiens
ccagccaucacaa

SEQ ID NO: 2127356 - RNA, 21 nt, Homo sapiens
cucacucuuaugaaaugggcu

SEQ ID NO: 2127357 - RNA, 13 nt, Homo sapiens
uccacccuuggcc

SEQ ID NO: 2127358 - RNA, 15 nt, Homo sapiens
uauuagaugugauuu

SEQ ID NO: 2127359 - RNA, 17 nt, Homo sapiens
cugucuaucucuaauaa

SEQ ID NO: 2127360 - RNA, 16 nt, Homo sapiens
guacacugccuucuca

SEQ ID NO: 2127361 - RNA, 23 nt, Homo sapiens
uuaauaggugcagucuuugagau

SEQ ID NO: 2127362 - RNA, 19 nt, Homo sapiens
gaguguuucuuccacaaca

SEQ ID NO: 2127363 - RNA, 16 nt, Homo sapiens
uuuccucccugcuuaa

SEQ ID NO: 2127364 - RNA, 23 nt, Homo sapiens
agacaacagcccaggcaucuccu

SEQ ID NO: 2127365 - RNA, 13 nt, Homo sapiens
guacaggggccau

SEQ ID NO: 2127366 - RNA, 20 nt, Homo sapiens
uggcuuucagaaaacgggaa

SEQ ID NO: 2127367 - RNA, 20 nt, Homo sapiens
gcagaaauuaaaucuuaaua

SEQ ID NO: 2127368 - RNA, 14 nt, Homo sapiens
gccucccagccacc

SEQ ID NO: 2127369 - RNA, 14 nt, Homo sapiens
cacacacacacuca

SEQ ID NO: 2127370 - RNA, 19 nt, Homo sapiens
cuuccucuaaacuucucac

SEQ ID NO: 2127371 - RNA, 21 nt, Homo sapiens
agaaaauaaaauuuaacucac

SEQ ID NO: 2127372 - RNA, 13 nt, Homo sapiens
uaaccugcuggau

SEQ ID NO: 2127373 - RNA, 12 nt, Homo sapiens
auuaucaugugu

SEQ ID NO: 2127374 - RNA, 22 nt, Homo sapiens
gcauugucccugugccuaacac

SEQ ID NO: 2127375 - RNA, 23 nt, Homo sapiens
acaguauuuccauacgugcccau

SEQ ID NO: 2127376 - RNA, 16 nt, Homo sapiens
ugaaggagcagcauug

SEQ ID NO: 2127377 - RNA, 22 nt, Homo sapiens
caaaucuucuugauccacuucu

SEQ ID NO: 2127378 - RNA, 14 nt, Homo sapiens
ugaauucaccaagu

SEQ ID NO: 2127379 - RNA, 15 nt, Homo sapiens
uacuuugagacuaaa

SEQ ID NO: 2127380 - RNA, 14 nt, Homo sapiens
cagccgcagcugua

SEQ ID NO: 2127381 - RNA, 13 nt, Homo sapiens
ucuguggcuuuca

SEQ ID NO: 2127382 - RNA, 14 nt, Homo sapiens
gagcggcaaaggcc

SEQ ID NO: 2127383 - RNA, 16 nt, Homo sapiens
agaugugucuuaccag

SEQ ID NO: 2127384 - RNA, 15 nt, Homo sapiens
cuaaaugcaccaaga

SEQ ID NO: 2127385 - RNA, 15 nt, Homo sapiens
aaaauauauucuuuc

SEQ ID NO: 2127386 - RNA, 18 nt, Homo sapiens
uuuauauaagucuguuau

SEQ ID NO: 2127387 - RNA, 23 nt, Homo sapiens
cucuggucaaguagaucauggca

SEQ ID NO: 2127388 - RNA, 14 nt, Homo sapiens
uauucacauauguc

SEQ ID NO: 2127389 - RNA, 21 nt, Homo sapiens
cauuuaaagaaagaaugcauu

SEQ ID NO: 2127390 - RNA, 14 nt, Homo sapiens
uuggcuuuaugcaa

SEQ ID NO: 2127391 - RNA, 23 nt, Homo sapiens
guccacugugagaggugacacug

SEQ ID NO: 2127392 - RNA, 22 nt, Homo sapiens
aguuaaguuuuucccuucaucu

SEQ ID NO: 2127393 - RNA, 15 nt, Homo sapiens
caccuggcacaccag

SEQ ID NO: 2127394 - RNA, 18 nt, Homo sapiens
gaacaauauaauuuucac

SEQ ID NO: 2127395 - RNA, 18 nt, Homo sapiens
guucuuuaagaauuacag

SEQ ID NO: 2127396 - RNA, 21 nt, Homo sapiens
auaaaauauauaauauacaau

SEQ ID NO: 2127397 - RNA, 22 nt, Homo sapiens
aagggauuuuuacauccuugau

SEQ ID NO: 2127398 - RNA, 14 nt, Homo sapiens
ugugaauacuggaa

SEQ ID NO: 2127399 - RNA, 17 nt, Homo sapiens
acuaaaagucuccaaaa

SEQ ID NO: 2127400 - RNA, 16 nt, Homo sapiens
auguuuccuccaaauc

SEQ ID NO: 2127401 - RNA, 20 nt, Homo sapiens
gaguucccuaaacaaaagca

SEQ ID NO: 2127402 - RNA, 15 nt, Homo sapiens
uacuaaaaauugugg

SEQ ID NO: 2127403 - RNA, 13 nt, Homo sapiens
aguaagugaacua

SEQ ID NO: 2127404 - RNA, 19 nt, Homo sapiens
gaaagcugagaacuccuga

SEQ ID NO: 2127405 - RNA, 15 nt, Homo sapiens
aacacagcugcuucc

SEQ ID NO: 2127406 - RNA, 13 nt, Homo sapiens
acccuucaacgcu

SEQ ID NO: 2127407 - RNA, 13 nt, Homo sapiens
agaaccucuccau

SEQ ID NO: 2127408 - RNA, 13 nt, Homo sapiens
ugcccucauggcc

SEQ ID NO: 2127409 - RNA, 12 nt, Homo sapiens
ccugguucucau

SEQ ID NO: 2127410 - RNA, 19 nt, Homo sapiens
uuucucuugaagaacugac

SEQ ID NO: 2127411 - RNA, 20 nt, Homo sapiens
cucacagaugugacuguaua

SEQ ID NO: 2127412 - RNA, 15 nt, Homo sapiens
uaaacagguggugag

SEQ ID NO: 2127413 - RNA, 13 nt, Homo sapiens
ucuauaugcuuuc

SEQ ID NO: 2127414 - RNA, 19 nt, Homo sapiens
uucacuucgaaauucugag

SEQ ID NO: 2127415 - RNA, 16 nt, Homo sapiens
guuuggccagugacau

SEQ ID NO: 2127416 - RNA, 13 nt, Homo sapiens
aguucccuuggcc

SEQ ID NO: 2127417 - RNA, 13 nt, Homo sapiens
cuugccaggcucc

SEQ ID NO: 2127418 - RNA, 15 nt, Homo sapiens
gcuuuccugcccugg

SEQ ID NO: 2127419 - RNA, 16 nt, Homo sapiens
acucucuuccuuucau

SEQ ID NO: 2127420 - RNA, 23 nt, Homo sapiens
uauaaaauguuuuuaaacagugu

SEQ ID NO: 2127421 - RNA, 16 nt, Homo sapiens
aaggggaggacacugg

SEQ ID NO: 2127422 - RNA, 18 nt, Homo sapiens
acacgcguccacauacac

SEQ ID NO: 2127423 - RNA, 20 nt, Homo sapiens
ccuacuguuggauguaugug

SEQ ID NO: 2127424 - RNA, 19 nt, Homo sapiens
accucaugagucuaccuga

SEQ ID NO: 2127425 - RNA, 17 nt, Homo sapiens
gucuugcaacagugcca

SEQ ID NO: 2127426 - RNA, 17 nt, Homo sapiens
aaggcugcuguguagcu

SEQ ID NO: 2127427 - RNA, 17 nt, Homo sapiens
aguccagacagcuugac

SEQ ID NO: 2127428 - RNA, 14 nt, Homo sapiens
ggagcuuuguaaug

SEQ ID NO: 2127429 - RNA, 17 nt, Homo sapiens
augcauacucugugcaa

SEQ ID NO: 2127430 - RNA, 17 nt, Homo sapiens
aucagcaggaguaauaa

SEQ ID NO: 2127431 - RNA, 21 nt, Homo sapiens
uuagaaaauucaagcauuuag

SEQ ID NO: 2127432 - RNA, 16 nt, Homo sapiens
cagcagcuacuaggga

SEQ ID NO: 2127433 - RNA, 15 nt, Homo sapiens
uucgaagccuugccu

SEQ ID NO: 2127434 - RNA, 21 nt, Homo sapiens
uguuccacuggaaacuuagag

SEQ ID NO: 2127435 - RNA, 19 nt, Homo sapiens
cauaucuccuuuaaugaca

SEQ ID NO: 2127436 - RNA, 18 nt, Homo sapiens
augcuggcugguggaaca

SEQ ID NO: 2127437 - RNA, 21 nt, Homo sapiens
auacugacuccagguguaguu

SEQ ID NO: 2127438 - RNA, 16 nt, Homo sapiens
ugcgucgucaccaaau

SEQ ID NO: 2127439 - RNA, 15 nt, Homo sapiens
ccuaccccucuucca

SEQ ID NO: 2127440 - RNA, 15 nt, Homo sapiens
cccugcacuccagcc

SEQ ID NO: 2127441 - RNA, 19 nt, Homo sapiens
ucuuccuuccuaauaggca

SEQ ID NO: 2127442 - RNA, 21 nt, Homo sapiens
uugcugucccauagucccugc

SEQ ID NO: 2127443 - RNA, 16 nt, Homo sapiens
auguguguucaugcac

SEQ ID NO: 2127444 - RNA, 21 nt, Homo sapiens
guaucaggacugugaccaaag

SEQ ID NO: 2127445 - RNA, 20 nt, Homo sapiens
agaacucguuaaagcaaagc

SEQ ID NO: 2127446 - RNA, 19 nt, Homo sapiens
ucaccaggguuucucugaa

SEQ ID NO: 2127447 - RNA, 15 nt, Homo sapiens
aacuucuacauucaa

SEQ ID NO: 2127448 - RNA, 16 nt, Homo sapiens
aacacaauacaguacu

SEQ ID NO: 2127449 - RNA, 18 nt, Homo sapiens
gaauaaaagaugauuucu

SEQ ID NO: 2127450 - RNA, 23 nt, Homo sapiens
ggguuuuuguucuggaagccaua

SEQ ID NO: 2127451 - RNA, 17 nt, Homo sapiens
aaaaucccuuaaucuau

SEQ ID NO: 2127452 - RNA, 22 nt, Homo sapiens
cuaaggcagcugauccaggcaa

SEQ ID NO: 2127453 - RNA, 16 nt, Homo sapiens
cugggcuuucacgggc

SEQ ID NO: 2127454 - RNA, 17 nt, Homo sapiens
agguucuucagggccag

SEQ ID NO: 2127455 - RNA, 23 nt, Homo sapiens
cacaggauauuaaacguguaaau

SEQ ID NO: 2127456 - RNA, 20 nt, Homo sapiens
cuccccaguagcugggauua

SEQ ID NO: 2127457 - RNA, 15 nt, Homo sapiens
ucaugacugcaugac

SEQ ID NO: 2127458 - RNA, 13 nt, Homo sapiens
ccagcuacuugau

SEQ ID NO: 2127459 - RNA, 18 nt, Homo sapiens
agccccaggagcccguca

SEQ ID NO: 2127460 - RNA, 14 nt, Homo sapiens
acaggcaagcaccu

SEQ ID NO: 2127461 - RNA, 22 nt, Homo sapiens
agagcuuuccuacuugcacucu

SEQ ID NO: 2127462 - RNA, 14 nt, Homo sapiens
cccagcggaugcug

SEQ ID NO: 2127463 - RNA, 17 nt, Homo sapiens
guugcugugugguuugg

SEQ ID NO: 2127464 - RNA, 22 nt, Homo sapiens
ucuagacuugggaucugcaaga

SEQ ID NO: 2127465 - RNA, 14 nt, Homo sapiens
accccacucagggg

SEQ ID NO: 2127466 - RNA, 22 nt, Homo sapiens
gcaauggcgccugcucccucca

SEQ ID NO: 2127467 - RNA, 12 nt, Homo sapiens
ccagcacagggg

SEQ ID NO: 2127468 - RNA, 17 nt, Homo sapiens
ccucuguucauuucaca

SEQ ID NO: 2127469 - RNA, 16 nt, Homo sapiens
acuguauuuucuuuca

SEQ ID NO: 2127470 - RNA, 22 nt, Homo sapiens
augugucuuaccagaucuaaua

SEQ ID NO: 2127471 - RNA, 18 nt, Homo sapiens
uaucuguguuauuuggac

SEQ ID NO: 2127472 - RNA, 13 nt, Homo sapiens
cugacacugugac

SEQ ID NO: 2127473 - RNA, 14 nt, Homo sapiens
gacuguaaaaccac

SEQ ID NO: 2127474 - RNA, 19 nt, Homo sapiens
caauaaacuccuacuaaau

SEQ ID NO: 2127475 - RNA, 11 nt, Homo sapiens
uuccuguaaag

SEQ ID NO: 2127476 - RNA, 18 nt, Homo sapiens
gcacucucauguugcaua

SEQ ID NO: 2127477 - RNA, 20 nt, Homo sapiens
acuuguuuggccuauuccau

SEQ ID NO: 2127478 - RNA, 15 nt, Homo sapiens
gagacauaggccaug

SEQ ID NO: 2127479 - RNA, 20 nt, Homo sapiens
cagcuaucugucaucucucu

SEQ ID NO: 2127480 - RNA, 23 nt, Homo sapiens
cgagggcugauggaggaaaaagg

SEQ ID NO: 2127481 - RNA, 22 nt, Homo sapiens
agcuuucccugugccacuuuga

SEQ ID NO: 2127482 - RNA, 19 nt, Homo sapiens
acaguaauaagaauggaaa

SEQ ID NO: 2127483 - RNA, 13 nt, Homo sapiens
acaaggucaucau

SEQ ID NO: 2127484 - RNA, 17 nt, Homo sapiens
caucuaccccuuccuuu

SEQ ID NO: 2127485 - RNA, 15 nt, Homo sapiens
augugauguggugcg

SEQ ID NO: 2127486 - RNA, 13 nt, Homo sapiens
uugcacacaugca

SEQ ID NO: 2127487 - RNA, 17 nt, Homo sapiens
uuaagguucaagacaga

SEQ ID NO: 2127488 - RNA, 12 nt, Homo sapiens
auauuuaucucu

SEQ ID NO: 2127489 - RNA, 19 nt, Homo sapiens
acugaagucuuuucuguca

SEQ ID NO: 2127490 - RNA, 21 nt, Homo sapiens
cuugugguugaaaaccacagu

SEQ ID NO: 2127491 - RNA, 13 nt, Homo sapiens
uuaaugucugcca

SEQ ID NO: 2127492 - RNA, 18 nt, Homo sapiens
aguugcuaggaacaugug

SEQ ID NO: 2127493 - RNA, 18 nt, Homo sapiens
gggacagggucuugcaag

SEQ ID NO: 2127494 - RNA, 15 nt, Homo sapiens
uuaucauuuacugug

SEQ ID NO: 2127495 - RNA, 14 nt, Homo sapiens
gcugaauccccuau

SEQ ID NO: 2127496 - RNA, 16 nt, Homo sapiens
acuuugaaucugcaac

SEQ ID NO: 2127497 - RNA, 21 nt, Homo sapiens
uucuguuuauaaugaagaaca

SEQ ID NO: 2127498 - RNA, 21 nt, Homo sapiens
uugcuugaagcaaacaguuga

SEQ ID NO: 2127499 - RNA, 13 nt, Homo sapiens
cagaacuucugaa

SEQ ID NO: 2127500 - RNA, 18 nt, Homo sapiens
gugagaugcuagaacucc

SEQ ID NO: 2127501 - RNA, 13 nt, Homo sapiens
gacugaccacugg

SEQ ID NO: 2127502 - RNA, 13 nt, Homo sapiens
ucugcggaucuca

SEQ ID NO: 2127503 - RNA, 18 nt, Homo sapiens
ucauaaaaagacaacuca

SEQ ID NO: 2127504 - RNA, 18 nt, Homo sapiens
cuccaggcuuucaauguu

SEQ ID NO: 2127505 - RNA, 13 nt, Homo sapiens
gagcucaagggac

SEQ ID NO: 2127506 - RNA, 14 nt, Homo sapiens
ugaugucuaugaua

SEQ ID NO: 2127507 - RNA, 14 nt, Homo sapiens
caggcauuuuuaca

SEQ ID NO: 2127508 - RNA, 12 nt, Homo sapiens
auaauacuugac

SEQ ID NO: 2127509 - RNA, 14 nt, Homo sapiens
ggugaaagugcagu

SEQ ID NO: 2127510 - RNA, 19 nt, Homo sapiens
caguaaauauuuacuauuu

SEQ ID NO: 2127511 - RNA, 20 nt, Homo sapiens
cagcuucccugaacacucau

SEQ ID NO: 2127512 - RNA, 16 nt, Homo sapiens
ugugccaaugugacaa

SEQ ID NO: 2127513 - RNA, 18 nt, Homo sapiens
augcugaaaacuacacaa

SEQ ID NO: 2127514 - RNA, 18 nt, Homo sapiens
accucugauagacuuugu

SEQ ID NO: 2127515 - RNA, 17 nt, Homo sapiens
ucaaaugcgaacacuau

SEQ ID NO: 2127516 - RNA, 22 nt, Homo sapiens
ucauuuaaaacaagacuucaga

SEQ ID NO: 2127517 - RNA, 18 nt, Homo sapiens
gcauuaaaaauaagccaa

SEQ ID NO: 2127518 - RNA, 17 nt, Homo sapiens
cacauccaucccuccau

SEQ ID NO: 2127519 - RNA, 17 nt, Homo sapiens
acucaucaaauaaucac

SEQ ID NO: 2127520 - RNA, 17 nt, Homo sapiens
cagagagggccuuuccu

SEQ ID NO: 2127521 - RNA, 15 nt, Homo sapiens
cccaggaccuggcug

SEQ ID NO: 2127522 - RNA, 15 nt, Homo sapiens
gaaaauaauagccau

SEQ ID NO: 2127523 - RNA, 20 nt, Homo sapiens
uaaauguaucuuauucacau

SEQ ID NO: 2127524 - RNA, 21 nt, Homo sapiens
cugguguuuuacuacacucca

SEQ ID NO: 2127525 - RNA, 16 nt, Homo sapiens
guaacuccaccaaccc

SEQ ID NO: 2127526 - RNA, 15 nt, Homo sapiens
auccgggaucaaagu

SEQ ID NO: 2127527 - RNA, 20 nt, Homo sapiens
aucugaguuagguuccagca

SEQ ID NO: 2127528 - RNA, 21 nt, Homo sapiens
ggcaagguuuacacugcggaa

SEQ ID NO: 2127529 - RNA, 13 nt, Homo sapiens
ccugagcucugac

SEQ ID NO: 2127530 - RNA, 18 nt, Homo sapiens
accuuuagagaaagagaa

SEQ ID NO: 2127531 - RNA, 23 nt, Homo sapiens
cucagacagaaccccuacaugaa

SEQ ID NO: 2127532 - RNA, 17 nt, Homo sapiens
uaaauauugaaacacug

SEQ ID NO: 2127533 - RNA, 17 nt, Homo sapiens
cacauacauacacauac

SEQ ID NO: 2127534 - RNA, 22 nt, Homo sapiens
aagagaaugaacuguggaauuu

SEQ ID NO: 2127535 - RNA, 12 nt, Homo sapiens
gcccuuuccucc

SEQ ID NO: 2127536 - RNA, 14 nt, Homo sapiens
aggauaaugagaug

SEQ ID NO: 2127537 - RNA, 23 nt, Homo sapiens
auuuauaucgcuggccagcauua

SEQ ID NO: 2127538 - RNA, 12 nt, Homo sapiens
cuguuggaugau

SEQ ID NO: 2127539 - RNA, 19 nt, Homo sapiens
gauagaaaagguccaaaac

SEQ ID NO: 2127540 - RNA, 20 nt, Homo sapiens
gcauucuggcaguuuugaca

SEQ ID NO: 2127541 - RNA, 16 nt, Homo sapiens
caguggcgugaucucg

SEQ ID NO: 2127542 - RNA, 14 nt, Homo sapiens
guaacauagacaaa

SEQ ID NO: 2127543 - RNA, 13 nt, Homo sapiens
cuucuugcuccug

SEQ ID NO: 2127544 - RNA, 15 nt, Homo sapiens
uggcuaaucaguaua

SEQ ID NO: 2127545 - RNA, 17 nt, Homo sapiens
cauucuuguuggcuuuu

SEQ ID NO: 2127546 - RNA, 14 nt, Homo sapiens
uuggauugauaucg

SEQ ID NO: 2127547 - RNA, 20 nt, Homo sapiens
uuccuggucagaaccggccu

SEQ ID NO: 2127548 - RNA, 18 nt, Homo sapiens
uccccaaaucaguuuuuc

SEQ ID NO: 2127549 - RNA, 23 nt, Homo sapiens
ugcuagcuuuccuuuacagcugu

SEQ ID NO: 2127550 - RNA, 22 nt, Homo sapiens
uucugcucuaaauaaagacgac

SEQ ID NO: 2127551 - RNA, 17 nt, Homo sapiens
gcccaggcaggucugca

SEQ ID NO: 2127552 - RNA, 18 nt, Homo sapiens
agcccucucccucagucc

SEQ ID NO: 2127553 - RNA, 16 nt, Homo sapiens
aacaagaaaguggucu

SEQ ID NO: 2127554 - RNA, 22 nt, Homo sapiens
agauggcuuccgugagacacaa

SEQ ID NO: 2127555 - RNA, 15 nt, Homo sapiens
uacuauuacuaguac

SEQ ID NO: 2127556 - RNA, 14 nt, Homo sapiens
gccugccucuucuc

SEQ ID NO: 2127557 - RNA, 19 nt, Homo sapiens
cauaaggaguuagaaccac

SEQ ID NO: 2127558 - RNA, 18 nt, Homo sapiens
aaaaauuugcuucacuca

SEQ ID NO: 2127559 - RNA, 23 nt, Homo sapiens
ucuucaccacuguaguucucuca

SEQ ID NO: 2127560 - RNA, 12 nt, Homo sapiens
uggguguucaag

SEQ ID NO: 2127561 - RNA, 20 nt, Homo sapiens
guaguuggcaggagcuccug

SEQ ID NO: 2127562 - RNA, 18 nt, Homo sapiens
cccaguuccuagcacugc

SEQ ID NO: 2127563 - RNA, 20 nt, Homo sapiens
uauaaucccagcauuuuggg

SEQ ID NO: 2127564 - RNA, 20 nt, Homo sapiens
cuuuggcacucucugccauu

SEQ ID NO: 2127565 - RNA, 23 nt, Homo sapiens
ccaguuucagagaaauacuuuca

SEQ ID NO: 2127566 - RNA, 18 nt, Homo sapiens
guuaggaaauaaaaccuu

SEQ ID NO: 2127567 - RNA, 13 nt, Homo sapiens
guugccauuauuc

SEQ ID NO: 2127568 - RNA, 11 nt, Homo sapiens
uuauacuccuc

SEQ ID NO: 2127569 - RNA, 14 nt, Homo sapiens
caacugacuuccaa

SEQ ID NO: 2127570 - RNA, 16 nt, Homo sapiens
agguaugugucagcca

SEQ ID NO: 2127571 - RNA, 16 nt, Homo sapiens
uauagaugucugugua

SEQ ID NO: 2127572 - RNA, 18 nt, Homo sapiens
gagugaaacauugaacuc

SEQ ID NO: 2127573 - RNA, 17 nt, Homo sapiens
gacaaauacucaugugu

SEQ ID NO: 2127574 - RNA, 16 nt, Homo sapiens
cagugcccucauuuua

SEQ ID NO: 2127575 - RNA, 20 nt, Homo sapiens
uuugaagugaaaaaguacau

SEQ ID NO: 2127576 - RNA, 19 nt, Homo sapiens
cuccuuugguauuucacug

SEQ ID NO: 2127577 - RNA, 18 nt, Homo sapiens
gaggggccacaccaccua

SEQ ID NO: 2127578 - RNA, 13 nt, Homo sapiens
caucugcucugag

SEQ ID NO: 2127579 - RNA, 22 nt, Homo sapiens
cuuucuauugaaaaaucaccac

SEQ ID NO: 2127580 - RNA, 17 nt, Homo sapiens
ugagcacccaagccagg

SEQ ID NO: 2127581 - RNA, 20 nt, Homo sapiens
ugcuuuucaaacugauacag

SEQ ID NO: 2127582 - RNA, 19 nt, Homo sapiens
acauuggacagugagguca

SEQ ID NO: 2127583 - RNA, 17 nt, Homo sapiens
acgcaacccacguguaa

SEQ ID NO: 2127584 - RNA, 15 nt, Homo sapiens
cuucccugacacugu

SEQ ID NO: 2127585 - RNA, 15 nt, Homo sapiens
aagugaugugauuua

SEQ ID NO: 2127586 - RNA, 20 nt, Homo sapiens
gcucagcuagacauugcaau

SEQ ID NO: 2127587 - RNA, 15 nt, Homo sapiens
cuacacacacccagg

SEQ ID NO: 2127588 - RNA, 20 nt, Homo sapiens
caccucuuucuacagccuaa

SEQ ID NO: 2127589 - RNA, 17 nt, Homo sapiens
gauccagccucauaccu

SEQ ID NO: 2127590 - RNA, 11 nt, Homo sapiens
uguacauauau

SEQ ID NO: 2127591 - RNA, 20 nt, Homo sapiens
uuguugcuacauuuacuuua

SEQ ID NO: 2127592 - RNA, 15 nt, Homo sapiens
caucaaaaacaaccu

SEQ ID NO: 2127593 - RNA, 22 nt, Homo sapiens
cucuacccuauacaacuggaca

SEQ ID NO: 2127594 - RNA, 11 nt, Homo sapiens
aaugggagaau

SEQ ID NO: 2127595 - RNA, 19 nt, Homo sapiens
gccuggcaagugggugaaa

SEQ ID NO: 2127596 - RNA, 18 nt, Homo sapiens
cccuuggcuuuagccaua

SEQ ID NO: 2127597 - RNA, 15 nt, Homo sapiens
uuguuaagcucagga

SEQ ID NO: 2127598 - RNA, 19 nt, Homo sapiens
aaagcauccucuaccucuc

SEQ ID NO: 2127599 - RNA, 20 nt, Homo sapiens
acagacaagugacuguaucu

SEQ ID NO: 2127600 - RNA, 16 nt, Homo sapiens
gcugccugugccugcc

SEQ ID NO: 2127601 - RNA, 19 nt, Homo sapiens
agcaccacacccaguggga

SEQ ID NO: 2127602 - RNA, 18 nt, Homo sapiens
gaucauuuggagcucuug

SEQ ID NO: 2127603 - RNA, 18 nt, Homo sapiens
cauaacauuauacacaaa

SEQ ID NO: 2127604 - RNA, 13 nt, Homo sapiens
acuuccucaugaa

SEQ ID NO: 2127605 - RNA, 22 nt, Homo sapiens
ucuuugcucccuccaaucuuga

SEQ ID NO: 2127606 - RNA, 21 nt, Homo sapiens
ucugaaaauagcaacccagaa

SEQ ID NO: 2127607 - RNA, 17 nt, Homo sapiens
gaauuacauaacaggca

SEQ ID NO: 2127608 - RNA, 19 nt, Homo sapiens
auuugaagacaaaaauacu

SEQ ID NO: 2127609 - RNA, 19 nt, Homo sapiens
auuuucaagauacauuuca

SEQ ID NO: 2127610 - RNA, 18 nt, Homo sapiens
uccccuuccuggcacauu

SEQ ID NO: 2127611 - RNA, 22 nt, Homo sapiens
aacccuggaucaguccuuugau

SEQ ID NO: 2127612 - RNA, 22 nt, Homo sapiens
aauugugaaaggaaguguaguu

SEQ ID NO: 2127613 - RNA, 22 nt, Homo sapiens
aggccucuccaguuugcaccug

SEQ ID NO: 2127614 - RNA, 18 nt, Homo sapiens
accucccauuacuuugau

SEQ ID NO: 2127615 - RNA, 13 nt, Homo sapiens
ugcagcccaagga

SEQ ID NO: 2127616 - RNA, 20 nt, Homo sapiens
auagaugucuguguauacau

SEQ ID NO: 2127617 - RNA, 21 nt, Homo sapiens
aucugagcacgcuaccaaauc

SEQ ID NO: 2127618 - RNA, 16 nt, Homo sapiens
caguaaacaacuugua

SEQ ID NO: 2127619 - RNA, 17 nt, Homo sapiens
cuaucccuaggcacuua

SEQ ID NO: 2127620 - RNA, 14 nt, Homo sapiens
ugugagcagggauu

SEQ ID NO: 2127621 - RNA, 16 nt, Homo sapiens
gucauuccucuccuag

SEQ ID NO: 2127622 - RNA, 14 nt, Homo sapiens
acacccauguguac

SEQ ID NO: 2127623 - RNA, 19 nt, Homo sapiens
aaaacuuuuaacuuauaca

SEQ ID NO: 2127624 - RNA, 15 nt, Homo sapiens
cucccaacgucccua

SEQ ID NO: 2127625 - RNA, 22 nt, Homo sapiens
agagguacaaguaaagcccaga

SEQ ID NO: 2127626 - RNA, 22 nt, Homo sapiens
gaacugaucauguuuaugagaa

SEQ ID NO: 2127627 - RNA, 17 nt, Homo sapiens
cuaaacccucugugaaa

SEQ ID NO: 2127628 - RNA, 16 nt, Homo sapiens
aaguaaaucuaucucu

SEQ ID NO: 2127629 - RNA, 15 nt, Homo sapiens
gacgcuugugacagu

SEQ ID NO: 2127630 - RNA, 14 nt, Homo sapiens
aggccacauugaca

SEQ ID NO: 2127631 - RNA, 22 nt, Homo sapiens
uauuagcucacugaaucuucac

SEQ ID NO: 2127632 - RNA, 17 nt, Homo sapiens
augcagcgaauucagaa

SEQ ID NO: 2127633 - RNA, 20 nt, Homo sapiens
cuaaaugcagacaacaccuu

SEQ ID NO: 2127634 - RNA, 19 nt, Homo sapiens
uuuggauacgaagaccaua

SEQ ID NO: 2127635 - RNA, 16 nt, Homo sapiens
cacaguaaaauauuca

SEQ ID NO: 2127636 - RNA, 14 nt, Homo sapiens
cacacauauugcac

SEQ ID NO: 2127637 - RNA, 16 nt, Homo sapiens
uuuuacuuccaugaua

SEQ ID NO: 2127638 - RNA, 22 nt, Homo sapiens
uggaaucuaacgggcauucaca

SEQ ID NO: 2127639 - RNA, 17 nt, Homo sapiens
gagguugcagugagcug

SEQ ID NO: 2127640 - RNA, 18 nt, Homo sapiens
ccucacugccucuuugca

SEQ ID NO: 2127641 - RNA, 20 nt, Homo sapiens
uccgguccccugccuggaac

SEQ ID NO: 2127642 - RNA, 18 nt, Homo sapiens
acacauuacuugcacaag

SEQ ID NO: 2127643 - RNA, 14 nt, Homo sapiens
uacuuguggacaca

SEQ ID NO: 2127644 - RNA, 14 nt, Homo sapiens
cagggccgugagca

SEQ ID NO: 2127645 - RNA, 16 nt, Homo sapiens
auuuucuucacagugc

SEQ ID NO: 2127646 - RNA, 18 nt, Homo sapiens
gaggguggcaagggaugu

SEQ ID NO: 2127647 - RNA, 16 nt, Homo sapiens
agcaaugucugugcua

SEQ ID NO: 2127648 - RNA, 15 nt, Homo sapiens
cuuaauaacacuuca

SEQ ID NO: 2127649 - RNA, 13 nt, Homo sapiens
auuguaugguggg

SEQ ID NO: 2127650 - RNA, 22 nt, Homo sapiens
agucuuuccgucucccuaaaau

SEQ ID NO: 2127651 - RNA, 13 nt, Homo sapiens
auaaaauggacag

SEQ ID NO: 2127652 - RNA, 22 nt, Homo sapiens
aagcgaaaaaaaaaaaugcacu

SEQ ID NO: 2127653 - RNA, 15 nt, Homo sapiens
cuuaaaacuauaaca

SEQ ID NO: 2127654 - RNA, 13 nt, Homo sapiens
aaaugguugucac

SEQ ID NO: 2127655 - RNA, 16 nt, Homo sapiens
cagggugcuaguggug

SEQ ID NO: 2127656 - RNA, 20 nt, Homo sapiens
accccuugugggcaaaggca

SEQ ID NO: 2127657 - RNA, 23 nt, Homo sapiens
uagaguucugucuggacuuucca

SEQ ID NO: 2127658 - RNA, 23 nt, Homo sapiens
gcagccucugucgcccuuaguca

SEQ ID NO: 2127659 - RNA, 12 nt, Homo sapiens
uggacuucuuag

SEQ ID NO: 2127660 - RNA, 12 nt, Homo sapiens
auagcuucagga

SEQ ID NO: 2127661 - RNA, 18 nt, Homo sapiens
ugcaguuuccucaucugu

SEQ ID NO: 2127662 - RNA, 15 nt, Homo sapiens
auguaauacuggaau

SEQ ID NO: 2127663 - RNA, 15 nt, Homo sapiens
cauucugcuucucau

SEQ ID NO: 2127664 - RNA, 18 nt, Homo sapiens
augggacuaaaugaacua

SEQ ID NO: 2127665 - RNA, 16 nt, Homo sapiens
ugucagaagacacuaa

SEQ ID NO: 2127666 - RNA, 19 nt, Homo sapiens
uguguuuuguuuuguauca

SEQ ID NO: 2127667 - RNA, 21 nt, Homo sapiens
aggaggccugcaccaaauguc

SEQ ID NO: 2127668 - RNA, 16 nt, Homo sapiens
agaugagaacaaagcu

SEQ ID NO: 2127669 - RNA, 15 nt, Homo sapiens
cuuggcagcaccugu

SEQ ID NO: 2127670 - RNA, 22 nt, Homo sapiens
uaaguguuguauguaccguuga

SEQ ID NO: 2127671 - RNA, 19 nt, Homo sapiens
uuuacacuacauuguacaa

SEQ ID NO: 2127672 - RNA, 17 nt, Homo sapiens
agauguggcuacugaca

SEQ ID NO: 2127673 - RNA, 12 nt, Homo sapiens
aaccaagacaag

SEQ ID NO: 2127674 - RNA, 14 nt, Homo sapiens
ggugugugaagcug

SEQ ID NO: 2127675 - RNA, 13 nt, Homo sapiens
cugagaaacuucc

SEQ ID NO: 2127676 - RNA, 15 nt, Homo sapiens
acccccgccaggcug

SEQ ID NO: 2127677 - RNA, 17 nt, Homo sapiens
ugguuucuuagauauga

SEQ ID NO: 2127678 - RNA, 21 nt, Homo sapiens
guaaagacucuaucuugaaag

SEQ ID NO: 2127679 - RNA, 11 nt, Homo sapiens
ccaucaaacac

SEQ ID NO: 2127680 - RNA, 14 nt, Homo sapiens
cggaugaggucauu

SEQ ID NO: 2127681 - RNA, 17 nt, Homo sapiens
cucaagcaauccucuca

SEQ ID NO: 2127682 - RNA, 18 nt, Homo sapiens
uauguauauagaugugca

SEQ ID NO: 2127683 - RNA, 18 nt, Homo sapiens
uaugucuuacuacuuuaa

SEQ ID NO: 2127684 - RNA, 19 nt, Homo sapiens
ccugcagaccucaagccau

SEQ ID NO: 2127685 - RNA, 20 nt, Homo sapiens
cccguccuuucugaagaaga

SEQ ID NO: 2127686 - RNA, 14 nt, Homo sapiens
ggauuacaggugua

SEQ ID NO: 2127687 - RNA, 14 nt, Homo sapiens
ccuucucaccagcu

SEQ ID NO: 2127688 - RNA, 18 nt, Homo sapiens
cucucacccccacacugg

SEQ ID NO: 2127689 - RNA, 17 nt, Homo sapiens
guucuugaaauaggugu

SEQ ID NO: 2127690 - RNA, 20 nt, Homo sapiens
cucccccuccagccagagac

SEQ ID NO: 2127691 - RNA, 20 nt, Homo sapiens
gggacuaaguguaccagaga

SEQ ID NO: 2127692 - RNA, 18 nt, Homo sapiens
aagggccacgacaaagca

SEQ ID NO: 2127693 - RNA, 18 nt, Homo sapiens
uuugggagaguucauuca

SEQ ID NO: 2127694 - RNA, 12 nt, Homo sapiens
cuaaucuuguca

SEQ ID NO: 2127695 - RNA, 22 nt, Homo sapiens
caaaggccguuagggaaaucca

SEQ ID NO: 2127696 - RNA, 19 nt, Homo sapiens
ugaagcuuuuuguugccuu

SEQ ID NO: 2127697 - RNA, 15 nt, Homo sapiens
aagacaugacauucu

SEQ ID NO: 2127698 - RNA, 21 nt, Homo sapiens
acgucuuacauuuucucugau

SEQ ID NO: 2127699 - RNA, 22 nt, Homo sapiens
ugccucagcugcucgcacagau

SEQ ID NO: 2127700 - RNA, 19 nt, Homo sapiens
ucaguguuuuaaauucuga

SEQ ID NO: 2127701 - RNA, 18 nt, Homo sapiens
aggcgucugcugucucau

SEQ ID NO: 2127702 - RNA, 13 nt, Homo sapiens
uagaccugagcug

SEQ ID NO: 2127703 - RNA, 22 nt, Homo sapiens
cgggcuaggaagaucucugcag

SEQ ID NO: 2127704 - RNA, 16 nt, Homo sapiens
cauuugggcaccuuaa

SEQ ID NO: 2127705 - RNA, 16 nt, Homo sapiens
aauguaucuuggugcu

SEQ ID NO: 2127706 - RNA, 14 nt, Homo sapiens
gucugauguggcaa

SEQ ID NO: 2127707 - RNA, 21 nt, Homo sapiens
cugucaccggccuugugacau

SEQ ID NO: 2127708 - RNA, 12 nt, Homo sapiens
uucucacucugg

SEQ ID NO: 2127709 - RNA, 12 nt, Homo sapiens
cucucacuuugg

SEQ ID NO: 2127710 - RNA, 22 nt, Homo sapiens
aguguucuccuuuuaagggugg

SEQ ID NO: 2127711 - RNA, 18 nt, Homo sapiens
agccagcuccugcacaaa

SEQ ID NO: 2127712 - RNA, 13 nt, Homo sapiens
uucuuuugcucuu

SEQ ID NO: 2127713 - RNA, 13 nt, Homo sapiens
uaaauuugcaaau

SEQ ID NO: 2127714 - RNA, 13 nt, Homo sapiens
ccuccuguacaua

SEQ ID NO: 2127715 - RNA, 19 nt, Homo sapiens
cucaggcauggaugaauaa

SEQ ID NO: 2127716 - RNA, 12 nt, Homo sapiens
agcacucaacca

SEQ ID NO: 2127717 - RNA, 23 nt, Homo sapiens
aggcagaacugcuugaacccagg

SEQ ID NO: 2127718 - RNA, 15 nt, Homo sapiens
ugcuuugccaaaaua

SEQ ID NO: 2127719 - RNA, 17 nt, Homo sapiens
agcauggccccagucca

SEQ ID NO: 2127720 - RNA, 15 nt, Homo sapiens
aauuaaagcagcaaa

SEQ ID NO: 2127721 - RNA, 22 nt, Homo sapiens
acauuuauuuuucucaugaauc

SEQ ID NO: 2127722 - RNA, 13 nt, Homo sapiens
guguaacgaugca

SEQ ID NO: 2127723 - RNA, 14 nt, Homo sapiens
gugcaugugcugug

SEQ ID NO: 2127724 - RNA, 18 nt, Homo sapiens
ugaugaaauguaaauacu

SEQ ID NO: 2127725 - RNA, 14 nt, Homo sapiens
cugauuuuacacac

SEQ ID NO: 2127726 - RNA, 22 nt, Homo sapiens
cuuuuuuucuugcuaguauucg

SEQ ID NO: 2127727 - RNA, 22 nt, Homo sapiens
ugagugguguguguuaucagau

SEQ ID NO: 2127728 - RNA, 19 nt, Homo sapiens
ccauguaccaguguacugc

SEQ ID NO: 2127729 - RNA, 19 nt, Homo sapiens
auucuuuacaaacugaaga

SEQ ID NO: 2127730 - RNA, 20 nt, Homo sapiens
caaaguuugcucaaggagaa

SEQ ID NO: 2127731 - RNA, 23 nt, Homo sapiens
auaguuguuuuuuaaaauccaaa

SEQ ID NO: 2127732 - RNA, 19 nt, Homo sapiens
uucccuacuuccugugacu

SEQ ID NO: 2127733 - RNA, 23 nt, Homo sapiens
acacagaauuguuccaguacuau

SEQ ID NO: 2127734 - RNA, 20 nt, Homo sapiens
guuuggcuauaagugcucaa

SEQ ID NO: 2127735 - RNA, 14 nt, Homo sapiens
uaaaacuggcccug

SEQ ID NO: 2127736 - RNA, 21 nt, Homo sapiens
aaacagaggaaucuaccugug

SEQ ID NO: 2127737 - RNA, 14 nt, Homo sapiens
gcccaggugccagc

SEQ ID NO: 2127738 - RNA, 20 nt, Homo sapiens
ggaucaaaguugaugaaaua

SEQ ID NO: 2127739 - RNA, 16 nt, Homo sapiens
cuauuuuaguuaacua

SEQ ID NO: 2127740 - RNA, 18 nt, Homo sapiens
auggaauuuuugaaucua

SEQ ID NO: 2127741 - RNA, 16 nt, Homo sapiens
cauauacaauugucau

SEQ ID NO: 2127742 - RNA, 13 nt, Homo sapiens
auccuuuuaucuc

SEQ ID NO: 2127743 - RNA, 17 nt, Homo sapiens
gcccuugcuuaccucuc

SEQ ID NO: 2127744 - RNA, 18 nt, Homo sapiens
aaucucuuuucuacauac

SEQ ID NO: 2127745 - RNA, 12 nt, Homo sapiens
gcugcaacaggu

SEQ ID NO: 2127746 - RNA, 17 nt, Homo sapiens
ugcagccuugacuucuc

SEQ ID NO: 2127747 - RNA, 14 nt, Homo sapiens
uccccgcuggcuca

SEQ ID NO: 2127748 - RNA, 22 nt, Homo sapiens
gggacaugggucgcccaugaga

SEQ ID NO: 2127749 - RNA, 19 nt, Homo sapiens
uagcugugugaacguguau

SEQ ID NO: 2127750 - RNA, 16 nt, Homo sapiens
gcgccucuccacuguu

SEQ ID NO: 2127751 - RNA, 18 nt, Homo sapiens
cucaguuucucuggagac

SEQ ID NO: 2127752 - RNA, 18 nt, Homo sapiens
ccauuuagaaaauguuca

SEQ ID NO: 2127753 - RNA, 22 nt, Homo sapiens
acgcaguaaacagcuuucccac

SEQ ID NO: 2127754 - RNA, 21 nt, Homo sapiens
aauaugcauugucugcaaugg

SEQ ID NO: 2127755 - RNA, 16 nt, Homo sapiens
cacaauuaaugaaaua

SEQ ID NO: 2127756 - RNA, 15 nt, Homo sapiens
guaggugucugcacc

SEQ ID NO: 2127757 - RNA, 14 nt, Homo sapiens
uuaauaaacagcuc

SEQ ID NO: 2127758 - RNA, 11 nt, Homo sapiens
ucaugccugua

SEQ ID NO: 2127759 - RNA, 14 nt, Homo sapiens
caagagacugaguc

SEQ ID NO: 2127760 - RNA, 16 nt, Homo sapiens
aaacuauguguucaau

SEQ ID NO: 2127761 - RNA, 14 nt, Homo sapiens
gcaggcaaaggccc

SEQ ID NO: 2127762 - RNA, 22 nt, Homo sapiens
caagauuccuuuccacuccaac

SEQ ID NO: 2127763 - RNA, 13 nt, Homo sapiens
gaagcuuauagag

SEQ ID NO: 2127764 - RNA, 14 nt, Homo sapiens
cagugauauucuuu

SEQ ID NO: 2127765 - RNA, 15 nt, Homo sapiens
acccucaggacaaug

SEQ ID NO: 2127766 - RNA, 14 nt, Homo sapiens
guguauuugcuaau

SEQ ID NO: 2127767 - RNA, 22 nt, Homo sapiens
acuauauugcuguaugguauau

SEQ ID NO: 2127768 - RNA, 17 nt, Homo sapiens
ugaugcuggucaucgca

SEQ ID NO: 2127769 - RNA, 16 nt, Homo sapiens
ugaaggcaucaaauaa

SEQ ID NO: 2127770 - RNA, 18 nt, Homo sapiens
cagccucccaaaguucug

SEQ ID NO: 2127771 - RNA, 13 nt, Homo sapiens
caaaguauuaagu

SEQ ID NO: 2127772 - RNA, 21 nt, Homo sapiens
acacuccacuugaagcacuua

SEQ ID NO: 2127773 - RNA, 14 nt, Homo sapiens
uccacccuaucccu

SEQ ID NO: 2127774 - RNA, 15 nt, Homo sapiens
cccagcgagccacag

SEQ ID NO: 2127775 - RNA, 15 nt, Homo sapiens
gaaugaaacaaucca

SEQ ID NO: 2127776 - RNA, 22 nt, Homo sapiens
gacuaauuucaaaaugcuuuuu

SEQ ID NO: 2127777 - RNA, 16 nt, Homo sapiens
ugguuauuaugaauaa

SEQ ID NO: 2127778 - RNA, 19 nt, Homo sapiens
auugucaccccaagccaua

SEQ ID NO: 2127779 - RNA, 19 nt, Homo sapiens
acaaggaaauuccucagca

SEQ ID NO: 2127780 - RNA, 14 nt, Homo sapiens
cgccaugugcugug

SEQ ID NO: 2127781 - RNA, 21 nt, Homo sapiens
uucacgaacuguucacacugc

SEQ ID NO: 2127782 - RNA, 16 nt, Homo sapiens
auaaaaagaaggaaaa

SEQ ID NO: 2127783 - RNA, 22 nt, Homo sapiens
caucuguuuuauuuuuguaaaa

SEQ ID NO: 2127784 - RNA, 21 nt, Homo sapiens
accacacacacccuuccccac

SEQ ID NO: 2127785 - RNA, 12 nt, Homo sapiens
aaguugcagcug

SEQ ID NO: 2127786 - RNA, 19 nt, Homo sapiens
uucagagugacacccaaga

SEQ ID NO: 2127787 - RNA, 13 nt, Homo sapiens
gcucugucuccca

SEQ ID NO: 2127788 - RNA, 17 nt, Homo sapiens
agcaacacacaugcucc

SEQ ID NO: 2127789 - RNA, 13 nt, Homo sapiens
gcugugccccuga

SEQ ID NO: 2127790 - RNA, 19 nt, Homo sapiens
auagcuccucaaagccuca

SEQ ID NO: 2127791 - RNA, 14 nt, Homo sapiens
aaggaacacugaca

SEQ ID NO: 2127792 - RNA, 14 nt, Homo sapiens
caggagaucaucug

SEQ ID NO: 2127793 - RNA, 13 nt, Homo sapiens
cucagcccugugc

SEQ ID NO: 2127794 - RNA, 18 nt, Homo sapiens
gucaucaugaacuggcuu

SEQ ID NO: 2127795 - RNA, 20 nt, Homo sapiens
gaauguagcuuccaccucau

SEQ ID NO: 2127796 - RNA, 22 nt, Homo sapiens
agauguccuuguaauauucccu

SEQ ID NO: 2127797 - RNA, 13 nt, Homo sapiens
cuagcuugcagaa

SEQ ID NO: 2127798 - RNA, 14 nt, Homo sapiens
cagauaccugugag

SEQ ID NO: 2127799 - RNA, 14 nt, Homo sapiens
caggauccagugac

SEQ ID NO: 2127800 - RNA, 20 nt, Homo sapiens
guugcccaacuacuaucuca

SEQ ID NO: 2127801 - RNA, 22 nt, Homo sapiens
cuuggcugcaggaaucuuuaaa

SEQ ID NO: 2127802 - RNA, 17 nt, Homo sapiens
ccaacuggcuucaugcg

SEQ ID NO: 2127803 - RNA, 16 nt, Homo sapiens
acuaauacuacugugu

SEQ ID NO: 2127804 - RNA, 20 nt, Homo sapiens
uaauuuugcgauacacugca

SEQ ID NO: 2127805 - RNA, 19 nt, Homo sapiens
gacaaucaugaaauaugca

SEQ ID NO: 2127806 - RNA, 23 nt, Homo sapiens
cuuggagagagaggcugccucag

SEQ ID NO: 2127807 - RNA, 18 nt, Homo sapiens
guuacaucucagugcugu

SEQ ID NO: 2127808 - RNA, 16 nt, Homo sapiens
caaagaggcuacugua

SEQ ID NO: 2127809 - RNA, 20 nt, Homo sapiens
gaagacuccaguaugaaaau

SEQ ID NO: 2127810 - RNA, 13 nt, Homo sapiens
agauaaguguucu

SEQ ID NO: 2127811 - RNA, 22 nt, Homo sapiens
gagucagucucuuucuguacaa

SEQ ID NO: 2127812 - RNA, 24 nt, Homo sapiens
cuguauuuaacaaaaagugcuuca

SEQ ID NO: 2127813 - RNA, 16 nt, Homo sapiens
acuugugcacccucua

SEQ ID NO: 2127814 - RNA, 11 nt, Homo sapiens
aaaucauagaa

SEQ ID NO: 2127815 - RNA, 19 nt, Homo sapiens
cagggagaccgagcgcuuu

SEQ ID NO: 2127816 - RNA, 17 nt, Homo sapiens
ucaagaacaaacacugc

SEQ ID NO: 2127817 - RNA, 18 nt, Homo sapiens
gaacaccccgcucuggca

SEQ ID NO: 2127818 - RNA, 15 nt, Homo sapiens
aaugcacacuuauuu

SEQ ID NO: 2127819 - RNA, 23 nt, Homo sapiens
aaugcaaagcuugagcugcucug

SEQ ID NO: 2127820 - RNA, 16 nt, Homo sapiens
ccucauuuauagaugu

SEQ ID NO: 2127821 - RNA, 14 nt, Homo sapiens
gucaaaugccaaac

SEQ ID NO: 2127822 - RNA, 18 nt, Homo sapiens
caaagcgugguggacaug

SEQ ID NO: 2127823 - RNA, 22 nt, Homo sapiens
ucacgaguaagauuaagagcaa

SEQ ID NO: 2127824 - RNA, 15 nt, Homo sapiens
acuaccggggcuccg

SEQ ID NO: 2127825 - RNA, 10 nt, Homo sapiens
caugaucucg

SEQ ID NO: 2127826 - RNA, 16 nt, Homo sapiens
auacugagugccugca

SEQ ID NO: 2127827 - RNA, 23 nt, Homo sapiens
gugaccuguaguguaccauucuc

SEQ ID NO: 2127828 - RNA, 19 nt, Homo sapiens
cugucugucaccagcuauc

SEQ ID NO: 2127829 - RNA, 16 nt, Homo sapiens
aauguagccauuguag

SEQ ID NO: 2127830 - RNA, 15 nt, Homo sapiens
ucuacccuauacaac

SEQ ID NO: 2127831 - RNA, 21 nt, Homo sapiens
gccagaagaccucccuucagg

SEQ ID NO: 2127832 - RNA, 18 nt, Homo sapiens
gagggaaaagauugacug

SEQ ID NO: 2127833 - RNA, 14 nt, Homo sapiens
gcuacaaucugugu

SEQ ID NO: 2127834 - RNA, 11 nt, Homo sapiens
uagcuccacuc

SEQ ID NO: 2127835 - RNA, 21 nt, Homo sapiens
caugaccucaccccuccuugg

SEQ ID NO: 2127836 - RNA, 17 nt, Homo sapiens
aacugccugaaagcaac

SEQ ID NO: 2127837 - RNA, 21 nt, Homo sapiens
ugcugcuuuguuguucugccu

SEQ ID NO: 2127838 - RNA, 18 nt, Homo sapiens
cugucugaguaguggcca

SEQ ID NO: 2127839 - RNA, 23 nt, Homo sapiens
guauuucuaauuccacaggucau

SEQ ID NO: 2127840 - RNA, 14 nt, Homo sapiens
aaugcauugucaau

SEQ ID NO: 2127841 - RNA, 17 nt, Homo sapiens
ccgagaaacaggcgaua

SEQ ID NO: 2127842 - RNA, 18 nt, Homo sapiens
uuuuaaauguauacuaua

SEQ ID NO: 2127843 - RNA, 22 nt, Homo sapiens
auccuggguacugaaagccuua

SEQ ID NO: 2127844 - RNA, 17 nt, Homo sapiens
gcuggccagcugugcga

SEQ ID NO: 2127845 - RNA, 23 nt, Homo sapiens
gaagauacuuuguauuguccuau

SEQ ID NO: 2127846 - RNA, 17 nt, Homo sapiens
ugaccgagaacuuuuaa

SEQ ID NO: 2127847 - RNA, 14 nt, Homo sapiens
uugccgagcccagc

SEQ ID NO: 2127848 - RNA, 18 nt, Homo sapiens
agccaggcugagugagcc

SEQ ID NO: 2127849 - RNA, 22 nt, Homo sapiens
ugaaaacaaacaagaggacugu

SEQ ID NO: 2127850 - RNA, 17 nt, Homo sapiens
cacaaacccccacucca

SEQ ID NO: 2127851 - RNA, 18 nt, Homo sapiens
agaugauuuuuuaaggag

SEQ ID NO: 2127852 - RNA, 14 nt, Homo sapiens
gcacgguugccuga

SEQ ID NO: 2127853 - RNA, 17 nt, Homo sapiens
cuguucuuguauuguau

SEQ ID NO: 2127854 - RNA, 16 nt, Homo sapiens
cagagacugaauagau

SEQ ID NO: 2127855 - RNA, 21 nt, Homo sapiens
aaagacguucuuuugcauaaa

SEQ ID NO: 2127856 - RNA, 19 nt, Homo sapiens
cagcaugcagaagugcaug

SEQ ID NO: 2127857 - RNA, 17 nt, Homo sapiens
gcuuuucccacucucau

SEQ ID NO: 2127858 - RNA, 17 nt, Homo sapiens
acucuccaaaacacuua

SEQ ID NO: 2127859 - RNA, 13 nt, Homo sapiens
ccugggcacaaac

SEQ ID NO: 2127860 - RNA, 12 nt, Homo sapiens
ugucacaucuca

SEQ ID NO: 2127861 - RNA, 15 nt, Homo sapiens
agauaggguggcaca

SEQ ID NO: 2127862 - RNA, 12 nt, Homo sapiens
aaguauuuugcc

SEQ ID NO: 2127863 - RNA, 15 nt, Homo sapiens
accaagacucugaaa

SEQ ID NO: 2127864 - RNA, 21 nt, Homo sapiens
cuagagcuagaugugucuuac

SEQ ID NO: 2127865 - RNA, 14 nt, Homo sapiens
gccucgaucaucaa

SEQ ID NO: 2127866 - RNA, 20 nt, Homo sapiens
aaaaaacaggaggaguauga

SEQ ID NO: 2127867 - RNA, 12 nt, Homo sapiens
cacucaguuucu

SEQ ID NO: 2127868 - RNA, 20 nt, Homo sapiens
uucaccagcccugagccaug

SEQ ID NO: 2127869 - RNA, 15 nt, Homo sapiens
aauucucacaucccu

SEQ ID NO: 2127870 - RNA, 22 nt, Homo sapiens
cuggagagagagcaagauuccu

SEQ ID NO: 2127871 - RNA, 20 nt, Homo sapiens
agcaccuaaaugaugccuuu

SEQ ID NO: 2127872 - RNA, 16 nt, Homo sapiens
auguaaaacccuuuaa

SEQ ID NO: 2127873 - RNA, 18 nt, Homo sapiens
gacuacuugauauaauua

SEQ ID NO: 2127874 - RNA, 14 nt, Homo sapiens
cucagaauaaaaga

SEQ ID NO: 2127875 - RNA, 13 nt, Homo sapiens
aacaucaccacug

SEQ ID NO: 2127876 - RNA, 13 nt, Homo sapiens
aucuucaccucag

SEQ ID NO: 2127877 - RNA, 16 nt, Homo sapiens
auuuuuagagcauuaa

SEQ ID NO: 2127878 - RNA, 21 nt, Homo sapiens
gcauaauacuugcuuuggaaa

SEQ ID NO: 2127879 - RNA, 14 nt, Homo sapiens
gaauucaauuuggc

SEQ ID NO: 2127880 - RNA, 15 nt, Homo sapiens
guccugccuccucau

SEQ ID NO: 2127881 - RNA, 21 nt, Homo sapiens
aucucaaacaauugaagucaa

SEQ ID NO: 2127882 - RNA, 20 nt, Homo sapiens
uuuaaaaaagcauagucuua

SEQ ID NO: 2127883 - RNA, 15 nt, Homo sapiens
uguguacagaccucc

SEQ ID NO: 2127884 - RNA, 17 nt, Homo sapiens
agauuacuaacugugga

SEQ ID NO: 2127885 - RNA, 23 nt, Homo sapiens
aggcaaugcucaaacacccaagu

SEQ ID NO: 2127886 - RNA, 22 nt, Homo sapiens
gcgccugacauucacacagaga

SEQ ID NO: 2127887 - RNA, 23 nt, Homo sapiens
gaagaccuucguauccccucuca

SEQ ID NO: 2127888 - RNA, 12 nt, Homo sapiens
uaacauuugccu

SEQ ID NO: 2127889 - RNA, 19 nt, Homo sapiens
agagagcaacucugagauc

SEQ ID NO: 2127890 - RNA, 16 nt, Homo sapiens
uagaauaccacaggaa

SEQ ID NO: 2127891 - RNA, 15 nt, Homo sapiens
cugcuuuuccugucu

SEQ ID NO: 2127892 - RNA, 18 nt, Homo sapiens
ugcagaagguuacuaccu

SEQ ID NO: 2127893 - RNA, 16 nt, Homo sapiens
agccugagucacuggu

SEQ ID NO: 2127894 - RNA, 19 nt, Homo sapiens
uacuguaauaauaccucaa

SEQ ID NO: 2127895 - RNA, 13 nt, Homo sapiens
uucauauuuucca

SEQ ID NO: 2127896 - RNA, 13 nt, Homo sapiens
ucacaauuucaau

SEQ ID NO: 2127897 - RNA, 18 nt, Homo sapiens
gucuauguaaaugcaucu

SEQ ID NO: 2127898 - RNA, 17 nt, Homo sapiens
ugcuggauuguccuugg

SEQ ID NO: 2127899 - RNA, 20 nt, Homo sapiens
ucucgaacuccugaccccaa

SEQ ID NO: 2127900 - RNA, 12 nt, Homo sapiens
caccaugccaau

SEQ ID NO: 2127901 - RNA, 11 nt, Homo sapiens
uauacaucucu

SEQ ID NO: 2127902 - RNA, 20 nt, Homo sapiens
uagcucuuaauuguucauuu

SEQ ID NO: 2127903 - RNA, 20 nt, Homo sapiens
gaaaugccugcuuugaauaa

SEQ ID NO: 2127904 - RNA, 19 nt, Homo sapiens
aggagcagagggcaggggu

SEQ ID NO: 2127905 - RNA, 16 nt, Homo sapiens
gacaugagacuaagag

SEQ ID NO: 2127906 - RNA, 12 nt, Homo sapiens
gauagucugucc

SEQ ID NO: 2127907 - RNA, 23 nt, Homo sapiens
augaauuuuguaucugcuuccau

SEQ ID NO: 2127908 - RNA, 20 nt, Homo sapiens
uacagacgucucaagacuga

SEQ ID NO: 2127909 - RNA, 13 nt, Homo sapiens
ucuugacuccacu

SEQ ID NO: 2127910 - RNA, 18 nt, Homo sapiens
gucacacacuuuggcuau

SEQ ID NO: 2127911 - RNA, 13 nt, Homo sapiens
cagacauugcucu

SEQ ID NO: 2127912 - RNA, 22 nt, Homo sapiens
guugcuucaccuuggagccuga

SEQ ID NO: 2127913 - RNA, 14 nt, Homo sapiens
cauauggucccugg

SEQ ID NO: 2127914 - RNA, 14 nt, Homo sapiens
guuugcuuauaugu

SEQ ID NO: 2127915 - RNA, 19 nt, Homo sapiens
cucuuuuaggaggcacaac

SEQ ID NO: 2127916 - RNA, 13 nt, Homo sapiens
guaaauacugcuu

SEQ ID NO: 2127917 - RNA, 18 nt, Homo sapiens
cugcuaaauaaacaugug

SEQ ID NO: 2127918 - RNA, 22 nt, Homo sapiens
aggggcagcuccugaccaaaga

SEQ ID NO: 2127919 - RNA, 13 nt, Homo sapiens
aaaauucccauuu

SEQ ID NO: 2127920 - RNA, 22 nt, Homo sapiens
aaugcacccaucagcacucugu

SEQ ID NO: 2127921 - RNA, 21 nt, Homo sapiens
accucggccucccaaagugcu

SEQ ID NO: 2127922 - RNA, 23 nt, Homo sapiens
cagaacuuucucuuuugaauguu

SEQ ID NO: 2127923 - RNA, 12 nt, Homo sapiens
cuucacauuuaa

SEQ ID NO: 2127924 - RNA, 12 nt, Homo sapiens
ccaaacauucuc

SEQ ID NO: 2127925 - RNA, 17 nt, Homo sapiens
cagaaaauaugauauau

SEQ ID NO: 2127926 - RNA, 20 nt, Homo sapiens
caauacuuacauaucugacu

SEQ ID NO: 2127927 - RNA, 13 nt, Homo sapiens
uacuuugugcugg

SEQ ID NO: 2127928 - RNA, 14 nt, Homo sapiens
ugcuuaaaauugcu

SEQ ID NO: 2127929 - RNA, 11 nt, Homo sapiens
uucugagacag

SEQ ID NO: 2127930 - RNA, 14 nt, Homo sapiens
cacagagugcauug

SEQ ID NO: 2127931 - RNA, 23 nt, Homo sapiens
cuggcggguggcugcaagcccac

SEQ ID NO: 2127932 - RNA, 17 nt, Homo sapiens
ggaauaaaaaauacugu

SEQ ID NO: 2127933 - RNA, 20 nt, Homo sapiens
caggauggcacuguuggcac

SEQ ID NO: 2127934 - RNA, 14 nt, Homo sapiens
agguagcucccagc

SEQ ID NO: 2127935 - RNA, 17 nt, Homo sapiens
aaccauaugaacauaua

SEQ ID NO: 2127936 - RNA, 19 nt, Homo sapiens
cucagugagggcucuggau

SEQ ID NO: 2127937 - RNA, 17 nt, Homo sapiens
cauguaaaaagugcagu

SEQ ID NO: 2127938 - RNA, 21 nt, Homo sapiens
gacggaaacaacguugcuauu

SEQ ID NO: 2127939 - RNA, 22 nt, Homo sapiens
gcaguucgaccagccagggaaa

SEQ ID NO: 2127940 - RNA, 10 nt, Homo sapiens
uagcacugag

SEQ ID NO: 2127941 - RNA, 13 nt, Homo sapiens
uuaaaagcuuuau

SEQ ID NO: 2127942 - RNA, 17 nt, Homo sapiens
cacaauggaaacuuuag

SEQ ID NO: 2127943 - RNA, 12 nt, Homo sapiens
uguauagcauau

SEQ ID NO: 2127944 - RNA, 13 nt, Homo sapiens
caugucuagagaa

SEQ ID NO: 2127945 - RNA, 21 nt, Homo sapiens
aauucauugagcaguuagcuc

SEQ ID NO: 2127946 - RNA, 18 nt, Homo sapiens
ugaaccauucauugcagc

SEQ ID NO: 2127947 - RNA, 21 nt, Homo sapiens
uacccuuuggccccacuuuga

SEQ ID NO: 2127948 - RNA, 20 nt, Homo sapiens
cagcuauuuucugaccaaaa

SEQ ID NO: 2127949 - RNA, 22 nt, Homo sapiens
acuauccuaugccuucaaauag

SEQ ID NO: 2127950 - RNA, 13 nt, Homo sapiens
cagggcgugggac

SEQ ID NO: 2127951 - RNA, 23 nt, Homo sapiens
agccaugacaagaacaaagccac

SEQ ID NO: 2127952 - RNA, 16 nt, Homo sapiens
cuguucugcacugaaa

SEQ ID NO: 2127953 - RNA, 21 nt, Homo sapiens
uuuuaccaaagcaucaauaca

SEQ ID NO: 2127954 - RNA, 15 nt, Homo sapiens
uagucuuuuccucua

SEQ ID NO: 2127955 - RNA, 17 nt, Homo sapiens
ugcccccuccaggagag

SEQ ID NO: 2127956 - RNA, 17 nt, Homo sapiens
aucuaaaucgguaaaua

SEQ ID NO: 2127957 - RNA, 17 nt, Homo sapiens
uaaacccuuaaccuaaa

SEQ ID NO: 2127958 - RNA, 21 nt, Homo sapiens
gccugaaacccgcccucaggg

SEQ ID NO: 2127959 - RNA, 22 nt, Homo sapiens
uaaugaauuauaacaguuauau

SEQ ID NO: 2127960 - RNA, 20 nt, Homo sapiens
guuaaguguuugaaaacguu

SEQ ID NO: 2127961 - RNA, 18 nt, Homo sapiens
aggcacccauccuagaga

SEQ ID NO: 2127962 - RNA, 18 nt, Homo sapiens
uaucaauuacaacaguga

SEQ ID NO: 2127963 - RNA, 22 nt, Homo sapiens
agaucaaaauaaaaagugacac

SEQ ID NO: 2127964 - RNA, 19 nt, Homo sapiens
cuucucgugacaccaccaa

SEQ ID NO: 2127965 - RNA, 13 nt, Homo sapiens
augaggacagagg

SEQ ID NO: 2127966 - RNA, 16 nt, Homo sapiens
aauguaaauuuacuga

SEQ ID NO: 2127967 - RNA, 16 nt, Homo sapiens
uauauuuuagccuuua

SEQ ID NO: 2127968 - RNA, 14 nt, Homo sapiens
agcuagaggccacc

SEQ ID NO: 2127969 - RNA, 12 nt, Homo sapiens
ugccaccucaga

SEQ ID NO: 2127970 - RNA, 20 nt, Homo sapiens
aguacccaccugagcuuugg

SEQ ID NO: 2127971 - RNA, 13 nt, Homo sapiens
cugacaagugaag

SEQ ID NO: 2127972 - RNA, 14 nt, Homo sapiens
cacagggacuugaa

SEQ ID NO: 2127973 - RNA, 15 nt, Homo sapiens
uuucacucugucauc

SEQ ID NO: 2127974 - RNA, 18 nt, Homo sapiens
ugaagcaggagaaucacu

SEQ ID NO: 2127975 - RNA, 20 nt, Homo sapiens
uuaaggucuaaucagugauu

SEQ ID NO: 2127976 - RNA, 12 nt, Homo sapiens
uaguaaagacau

SEQ ID NO: 2127977 - RNA, 16 nt, Homo sapiens
gugccccagcaccaac

SEQ ID NO: 2127978 - RNA, 17 nt, Homo sapiens
uacagugcagagccuuc

SEQ ID NO: 2127979 - RNA, 21 nt, Homo sapiens
caucacuggggcugggagcag

SEQ ID NO: 2127980 - RNA, 16 nt, Homo sapiens
acagagggccacacag

SEQ ID NO: 2127981 - RNA, 14 nt, Homo sapiens
cuaaaggugcuauu

SEQ ID NO: 2127982 - RNA, 19 nt, Homo sapiens
ugcgccaccucacugcagu

SEQ ID NO: 2127983 - RNA, 21 nt, Homo sapiens
auauguauauugucuaguaau

SEQ ID NO: 2127984 - RNA, 22 nt, Homo sapiens
uuggaguaaauauauaugucaa

SEQ ID NO: 2127985 - RNA, 14 nt, Homo sapiens
ugaauaguacauuu

SEQ ID NO: 2127986 - RNA, 13 nt, Homo sapiens
gcuaucugugcag

SEQ ID NO: 2127987 - RNA, 15 nt, Homo sapiens
ucacaugauuccagc

SEQ ID NO: 2127988 - RNA, 17 nt, Homo sapiens
uuagaagacagccuaca

SEQ ID NO: 2127989 - RNA, 17 nt, Homo sapiens
ccuaggcaacaugguga

SEQ ID NO: 2127990 - RNA, 18 nt, Homo sapiens
auauuguaaaagggauuu

SEQ ID NO: 2127991 - RNA, 19 nt, Homo sapiens
ccauuauacuuuauaucug

SEQ ID NO: 2127992 - RNA, 15 nt, Homo sapiens
agcuauaacuuacuu

SEQ ID NO: 2127993 - RNA, 18 nt, Homo sapiens
gcuaugccuugcacacag

SEQ ID NO: 2127994 - RNA, 18 nt, Homo sapiens
auaauccaaauccaucaa

SEQ ID NO: 2127995 - RNA, 16 nt, Homo sapiens
auaauuuaacuguguu

SEQ ID NO: 2127996 - RNA, 13 nt, Homo sapiens
agaaacaucucaa

SEQ ID NO: 2127997 - RNA, 15 nt, Homo sapiens
cacuggucacaggca

SEQ ID NO: 2127998 - RNA, 16 nt, Homo sapiens
gugccugccauagcca

SEQ ID NO: 2127999 - RNA, 13 nt, Homo sapiens
uagcauccacuga

SEQ ID NO: 2128000 - RNA, 23 nt, Homo sapiens
uaaacguuaaaaacaguuuucca

SEQ ID NO: 2128001 - RNA, 21 nt, Homo sapiens
auagcuauggaaucaauucaa

SEQ ID NO: 2128002 - RNA, 21 nt, Homo sapiens
uuugaccuuucuagguucaaa

SEQ ID NO: 2128003 - RNA, 15 nt, Homo sapiens
caggguuaucugcaa

SEQ ID NO: 2128004 - RNA, 19 nt, Homo sapiens
aagggagcgcucucuugau

SEQ ID NO: 2128005 - RNA, 17 nt, Homo sapiens
acaacgccugucacaga

SEQ ID NO: 2128006 - RNA, 12 nt, Homo sapiens
caggaaauacca

SEQ ID NO: 2128007 - RNA, 18 nt, Homo sapiens
cccccuccccaacaugcc

SEQ ID NO: 2128008 - RNA, 19 nt, Homo sapiens
cuccuagacucaagugauc

SEQ ID NO: 2128009 - RNA, 19 nt, Homo sapiens
uggacaaaccgagugcaau

SEQ ID NO: 2128010 - RNA, 18 nt, Homo sapiens
caaagagguuuuaugaaa

SEQ ID NO: 2128011 - RNA, 18 nt, Homo sapiens
cagggagcccccagagga

SEQ ID NO: 2128012 - RNA, 16 nt, Homo sapiens
ucuccgcacuuggaaa

SEQ ID NO: 2128013 - RNA, 16 nt, Homo sapiens
uuucuucgugaugaca

SEQ ID NO: 2128014 - RNA, 14 nt, Homo sapiens
gccucucuugcccc

SEQ ID NO: 2128015 - RNA, 18 nt, Homo sapiens
aacacggacccauagaca

SEQ ID NO: 2128016 - RNA, 12 nt, Homo sapiens
uuccuguaagau

SEQ ID NO: 2128017 - RNA, 14 nt, Homo sapiens
aaaagacauccuca

SEQ ID NO: 2128018 - RNA, 16 nt, Homo sapiens
uuggaaaauaauaucc

SEQ ID NO: 2128019 - RNA, 12 nt, Homo sapiens
uguauacuucaa

SEQ ID NO: 2128020 - RNA, 14 nt, Homo sapiens
caguauguuacaug

SEQ ID NO: 2128021 - RNA, 15 nt, Homo sapiens
auuacauucacgaca

SEQ ID NO: 2128022 - RNA, 12 nt, Homo sapiens
caagagaucuac

SEQ ID NO: 2128023 - RNA, 18 nt, Homo sapiens
auuauagaaucuacuuua

SEQ ID NO: 2128024 - RNA, 10 nt, Homo sapiens
cuccaucucc

SEQ ID NO: 2128025 - RNA, 15 nt, Homo sapiens
ccgaacaugaccaaa

SEQ ID NO: 2128026 - RNA, 19 nt, Homo sapiens
ugcauagagcccuggccag

SEQ ID NO: 2128027 - RNA, 16 nt, Homo sapiens
uucaccaggaagaagg

SEQ ID NO: 2128028 - RNA, 14 nt, Homo sapiens
cuucauuaauacug

SEQ ID NO: 2128029 - RNA, 23 nt, Homo sapiens
aggacgccacucauuucaucuca

SEQ ID NO: 2128030 - RNA, 15 nt, Homo sapiens
ucucuucuucucaua

SEQ ID NO: 2128031 - RNA, 17 nt, Homo sapiens
cauauauuggcacugcu

SEQ ID NO: 2128032 - RNA, 12 nt, Homo sapiens
aaagcacuguuu

SEQ ID NO: 2128033 - RNA, 20 nt, Homo sapiens
aauaaaggaugugauugugg

SEQ ID NO: 2128034 - RNA, 13 nt, Homo sapiens
uaaaugagcccac

SEQ ID NO: 2128035 - RNA, 15 nt, Homo sapiens
gccuugcuguuuaaa

SEQ ID NO: 2128036 - RNA, 15 nt, Homo sapiens
cacuucccaagaagg

SEQ ID NO: 2128037 - RNA, 12 nt, Homo sapiens
cucccaugaagc

SEQ ID NO: 2128038 - RNA, 22 nt, Homo sapiens
auuugagaauaaguucauacaa

SEQ ID NO: 2128039 - RNA, 14 nt, Homo sapiens
gagcagacagagaa

SEQ ID NO: 2128040 - RNA, 14 nt, Homo sapiens
acuuaaagugaauu

SEQ ID NO: 2128041 - RNA, 18 nt, Homo sapiens
gcacguuaugguguuucu

SEQ ID NO: 2128042 - RNA, 16 nt, Homo sapiens
gggcgguccugcacag

SEQ ID NO: 2128043 - RNA, 20 nt, Homo sapiens
aggcuggaguacaguggcac

SEQ ID NO: 2128044 - RNA, 20 nt, Homo sapiens
agguuggagugcaguggcgu

SEQ ID NO: 2128045 - RNA, 20 nt, Homo sapiens
aggcuggagugcaguggcgc

SEQ ID NO: 2128046 - RNA, 19 nt, Homo sapiens
aguauguuuguacaguaug

SEQ ID NO: 2128047 - RNA, 15 nt, Homo sapiens
auuauacuguauuaa

SEQ ID NO: 2128048 - RNA, 14 nt, Homo sapiens
gccaagguccugcu

SEQ ID NO: 2128049 - RNA, 18 nt, Homo sapiens
cuaaaaaacggauuuccu

SEQ ID NO: 2128050 - RNA, 18 nt, Homo sapiens
cuccaacuuuauuuugaa

SEQ ID NO: 2128051 - RNA, 17 nt, Homo sapiens
cuguuauuuguccucau

SEQ ID NO: 2128052 - RNA, 23 nt, Homo sapiens
uuuagaacauggacuacacacaa

SEQ ID NO: 2128053 - RNA, 15 nt, Homo sapiens
ugcaccaccaugccc

SEQ ID NO: 2128054 - RNA, 18 nt, Homo sapiens
ucacuguguauauuugau

SEQ ID NO: 2128055 - RNA, 19 nt, Homo sapiens
gagaauaaggaugaaauaa

SEQ ID NO: 2128056 - RNA, 22 nt, Homo sapiens
ucccggacgcguccugggaucu

SEQ ID NO: 2128057 - RNA, 11 nt, Homo sapiens
gcuuuaugcaa

SEQ ID NO: 2128058 - RNA, 16 nt, Homo sapiens
cuugaaauuauaucug

SEQ ID NO: 2128059 - RNA, 13 nt, Homo sapiens
ccucuuagcugag

SEQ ID NO: 2128060 - RNA, 17 nt, Homo sapiens
acaccagcagcacugga

SEQ ID NO: 2128061 - RNA, 19 nt, Homo sapiens
uauugacagcgauauaauu

SEQ ID NO: 2128062 - RNA, 13 nt, Homo sapiens
acguccacuuuca

SEQ ID NO: 2128063 - RNA, 22 nt, Homo sapiens
uguccuuuucuuuucuugaggc

SEQ ID NO: 2128064 - RNA, 21 nt, Homo sapiens
cuugggaugaugccucaugau

SEQ ID NO: 2128065 - RNA, 19 nt, Homo sapiens
guacacacugguacuuaga

SEQ ID NO: 2128066 - RNA, 17 nt, Homo sapiens
acucccuuugccagugc

SEQ ID NO: 2128067 - RNA, 15 nt, Homo sapiens
cagaaccugcuccug

SEQ ID NO: 2128068 - RNA, 16 nt, Homo sapiens
uauugagugaagccuu

SEQ ID NO: 2128069 - RNA, 18 nt, Homo sapiens
acauagagauaugcacac

SEQ ID NO: 2128070 - RNA, 21 nt, Homo sapiens
cccuugguccuggaacauuua

SEQ ID NO: 2128071 - RNA, 23 nt, Homo sapiens
cuucaccagucugucuacugugg

SEQ ID NO: 2128072 - RNA, 23 nt, Homo sapiens
ccacagccuucggacagacauau

SEQ ID NO: 2128073 - RNA, 15 nt, Homo sapiens
gacagucaaggugau

SEQ ID NO: 2128074 - RNA, 18 nt, Homo sapiens
agugcaucuuugccucaa

SEQ ID NO: 2128075 - RNA, 12 nt, Homo sapiens
ccccacccaguu

SEQ ID NO: 2128076 - RNA, 22 nt, Homo sapiens
aaauuucucauuagugguacug

SEQ ID NO: 2128077 - RNA, 13 nt, Homo sapiens
agcaggguggccu

SEQ ID NO: 2128078 - RNA, 21 nt, Homo sapiens
ccaggcucucccucucugcac

SEQ ID NO: 2128079 - RNA, 22 nt, Homo sapiens
cccagugcccccacugaccaga

SEQ ID NO: 2128080 - RNA, 23 nt, Homo sapiens
acauaccuggcccugugccuugg

SEQ ID NO: 2128081 - RNA, 20 nt, Homo sapiens
gccggugugccugacugccc

SEQ ID NO: 2128082 - RNA, 16 nt, Homo sapiens
ucuguaguuacugugg

SEQ ID NO: 2128083 - RNA, 15 nt, Homo sapiens
gccacgcacugggcc

SEQ ID NO: 2128084 - RNA, 21 nt, Homo sapiens
uagcgcugcucuuaugccauu

SEQ ID NO: 2128085 - RNA, 15 nt, Homo sapiens
cccaggaaguggcca

SEQ ID NO: 2128086 - RNA, 15 nt, Homo sapiens
gucccuggacacagc

SEQ ID NO: 2128087 - RNA, 23 nt, Homo sapiens
gagaauugaaaugaggugccacc

SEQ ID NO: 2128088 - RNA, 11 nt, Homo sapiens
aauacaguauu

SEQ ID NO: 2128089 - RNA, 20 nt, Homo sapiens
gugucauauauggggggcca

SEQ ID NO: 2128090 - RNA, 16 nt, Homo sapiens
cugcccaaucuccauc

SEQ ID NO: 2128091 - RNA, 20 nt, Homo sapiens
aguagaagugucacagccau

SEQ ID NO: 2128092 - RNA, 20 nt, Homo sapiens
ggacuaugcugaugggccag

SEQ ID NO: 2128093 - RNA, 19 nt, Homo sapiens
guuuauuuaucagugacag

SEQ ID NO: 2128094 - RNA, 15 nt, Homo sapiens
gcauggccacccuca

SEQ ID NO: 2128095 - RNA, 22 nt, Homo sapiens
uguuuaaaauucucuuugguca

SEQ ID NO: 2128096 - RNA, 13 nt, Homo sapiens
gccuggugugauu

SEQ ID NO: 2128097 - RNA, 19 nt, Homo sapiens
aagggcagcuuugcucaua

SEQ ID NO: 2128098 - RNA, 23 nt, Homo sapiens
acauaggugcucuuccucaucuc

SEQ ID NO: 2128099 - RNA, 18 nt, Homo sapiens
ucaaggucccuucaugcg

SEQ ID NO: 2128100 - RNA, 16 nt, Homo sapiens
auugcgccacugcacu

SEQ ID NO: 2128101 - RNA, 22 nt, Homo sapiens
cguaauuaaauccaacuuucac

SEQ ID NO: 2128102 - RNA, 16 nt, Homo sapiens
aaaugcugcuuucugc

SEQ ID NO: 2128103 - RNA, 13 nt, Homo sapiens
uaucuccaagugg

SEQ ID NO: 2128104 - RNA, 21 nt, Homo sapiens
cugggaaaaucuauuccugcc

SEQ ID NO: 2128105 - RNA, 20 nt, Homo sapiens
guuauuccccccuacuugag

SEQ ID NO: 2128106 - RNA, 21 nt, Homo sapiens
ggccacauucaccaaccaaag

SEQ ID NO: 2128107 - RNA, 14 nt, Homo sapiens
uagauuaaaucucu

SEQ ID NO: 2128108 - RNA, 21 nt, Homo sapiens
uaaauccuuguuaccuaucuc

SEQ ID NO: 2128109 - RNA, 20 nt, Homo sapiens
uucagauaaaucaugggcau

SEQ ID NO: 2128110 - RNA, 23 nt, Homo sapiens
aacuagcaauugguuguuuaaca

SEQ ID NO: 2128111 - RNA, 16 nt, Homo sapiens
ucugcugcugaaacug

SEQ ID NO: 2128112 - RNA, 16 nt, Homo sapiens
gaaauggcauaaucuu

SEQ ID NO: 2128113 - RNA, 17 nt, Homo sapiens
auaaaaguugcguuuaa

SEQ ID NO: 2128114 - RNA, 19 nt, Homo sapiens
aaaauaaugcaccacuuuu

SEQ ID NO: 2128115 - RNA, 14 nt, Homo sapiens
acgcaccugccuca

SEQ ID NO: 2128116 - RNA, 15 nt, Homo sapiens
gcguucaacaaugcu

SEQ ID NO: 2128117 - RNA, 23 nt, Homo sapiens
cugcacaaaagcagauacuugag

SEQ ID NO: 2128118 - RNA, 20 nt, Homo sapiens
ucagcauuuguucuuugcca

SEQ ID NO: 2128119 - RNA, 23 nt, Homo sapiens
aucauuuccccucccgucuuccu

SEQ ID NO: 2128120 - RNA, 13 nt, Homo sapiens
gugacauuuugcc

SEQ ID NO: 2128121 - RNA, 23 nt, Homo sapiens
acuuagaucaucagucaccgaag

SEQ ID NO: 2128122 - RNA, 21 nt, Homo sapiens
cuggggugcauccuccucagc

SEQ ID NO: 2128123 - RNA, 20 nt, Homo sapiens
ucacgaggucaggaguucaa

SEQ ID NO: 2128124 - RNA, 14 nt, Homo sapiens
aguucuggaccugg

SEQ ID NO: 2128125 - RNA, 23 nt, Homo sapiens
uauuguuaggaaaugucaucaaa

SEQ ID NO: 2128126 - RNA, 21 nt, Homo sapiens
uaccuucaggcagccagugug

SEQ ID NO: 2128127 - RNA, 23 nt, Homo sapiens
cuggccacccaaacaggacaaga

SEQ ID NO: 2128128 - RNA, 14 nt, Homo sapiens
acucuagugcuaca

SEQ ID NO: 2128129 - RNA, 20 nt, Homo sapiens
uuuuccccucauugcauuua

SEQ ID NO: 2128130 - RNA, 16 nt, Homo sapiens
caaaaugguuuacuua

SEQ ID NO: 2128131 - RNA, 21 nt, Homo sapiens
auggcaguccagccagcuccu

SEQ ID NO: 2128132 - RNA, 15 nt, Homo sapiens
auuucauacuguaac

SEQ ID NO: 2128133 - RNA, 20 nt, Homo sapiens
ccaaagugaccuacccagag

SEQ ID NO: 2128134 - RNA, 12 nt, Homo sapiens
ccuuauacauca

SEQ ID NO: 2128135 - RNA, 21 nt, Homo sapiens
acaccauaggucaccuuuauu

SEQ ID NO: 2128136 - RNA, 19 nt, Homo sapiens
uagugucaccaauuccacc

SEQ ID NO: 2128137 - RNA, 18 nt, Homo sapiens
ucagccaagaccaucucu

SEQ ID NO: 2128138 - RNA, 19 nt, Homo sapiens
ugaacaccacuuugucucu

SEQ ID NO: 2128139 - RNA, 13 nt, Homo sapiens
ggcuuguugacuu

SEQ ID NO: 2128140 - RNA, 14 nt, Homo sapiens
cuccuuccuugaac

SEQ ID NO: 2128141 - RNA, 20 nt, Homo sapiens
ccacugaaaccucuguucuc

SEQ ID NO: 2128142 - RNA, 16 nt, Homo sapiens
ccaaagggaguguuga

SEQ ID NO: 2128143 - RNA, 14 nt, Homo sapiens
uccuuuccuuucau

SEQ ID NO: 2128144 - RNA, 17 nt, Homo sapiens
aggccgagccaauagac

SEQ ID NO: 2128145 - RNA, 13 nt, Homo sapiens
ucagaacuaacca

SEQ ID NO: 2128146 - RNA, 17 nt, Homo sapiens
acauauaaauugucuua

SEQ ID NO: 2128147 - RNA, 22 nt, Homo sapiens
ucaugcauuucaagcagcugaa

SEQ ID NO: 2128148 - RNA, 18 nt, Homo sapiens
cugcucuuuggaaauggc

SEQ ID NO: 2128149 - RNA, 21 nt, Homo sapiens
cucugacccugaugcuuaaua

SEQ ID NO: 2128150 - RNA, 12 nt, Homo sapiens
gugacaccucac

SEQ ID NO: 2128151 - RNA, 14 nt, Homo sapiens
agguuggagugcag

SEQ ID NO: 2128152 - RNA, 19 nt, Homo sapiens
gucugucucuuggcuauuu

SEQ ID NO: 2128153 - RNA, 16 nt, Homo sapiens
cuucaguaacaagugu

SEQ ID NO: 2128154 - RNA, 16 nt, Homo sapiens
cucaggcuggugggag

SEQ ID NO: 2128155 - RNA, 13 nt, Homo sapiens
caucuacaccagu

SEQ ID NO: 2128156 - RNA, 18 nt, Homo sapiens
aaaauuuauaagccaaag

SEQ ID NO: 2128157 - RNA, 11 nt, Homo sapiens
caugcacacac

SEQ ID NO: 2128158 - RNA, 20 nt, Homo sapiens
ugaucuuggcaguggaacau

SEQ ID NO: 2128159 - RNA, 16 nt, Homo sapiens
uaccaaaugcuuuaaa

SEQ ID NO: 2128160 - RNA, 21 nt, Homo sapiens
aaucuuuuuugauaugauaau

SEQ ID NO: 2128161 - RNA, 20 nt, Homo sapiens
acaccgugggucauuacaaa

SEQ ID NO: 2128162 - RNA, 12 nt, Homo sapiens
cugcaacagugg

SEQ ID NO: 2128163 - RNA, 21 nt, Homo sapiens
agagcaucugucccacuggga

SEQ ID NO: 2128164 - RNA, 16 nt, Homo sapiens
uacccccccuccugcu

SEQ ID NO: 2128165 - RNA, 18 nt, Homo sapiens
aaugguguaauuuugucc

SEQ ID NO: 2128166 - RNA, 21 nt, Homo sapiens
ucugucguccccagaccagua

SEQ ID NO: 2128167 - RNA, 13 nt, Homo sapiens
caaucaugugcuu

SEQ ID NO: 2128168 - RNA, 21 nt, Homo sapiens
cagaccuugcaaucacaaaag

SEQ ID NO: 2128169 - RNA, 19 nt, Homo sapiens
acacaggaggcugaggcag

SEQ ID NO: 2128170 - RNA, 22 nt, Homo sapiens
agguaauguuaguaaauccaug

SEQ ID NO: 2128171 - RNA, 16 nt, Homo sapiens
ggccuggaccuaugca

SEQ ID NO: 2128172 - RNA, 15 nt, Homo sapiens
agguagugggcucac

SEQ ID NO: 2128173 - RNA, 14 nt, Homo sapiens
agccacgugaaugg

SEQ ID NO: 2128174 - RNA, 17 nt, Homo sapiens
uccagggccccccaaau

SEQ ID NO: 2128175 - RNA, 22 nt, Homo sapiens
uugggggcacuuagguaccaua

SEQ ID NO: 2128176 - RNA, 15 nt, Homo sapiens
ccagauggcauccuu

SEQ ID NO: 2128177 - RNA, 22 nt, Homo sapiens
aacagcagucccaguauucuca

SEQ ID NO: 2128178 - RNA, 12 nt, Homo sapiens
aaccacugcacu

SEQ ID NO: 2128179 - RNA, 14 nt, Homo sapiens
acauugccuugcau

SEQ ID NO: 2128180 - RNA, 20 nt, Homo sapiens
uucaucccguaucacagugu

SEQ ID NO: 2128181 - RNA, 22 nt, Homo sapiens
uuccuuaggagaugucaugaca

SEQ ID NO: 2128182 - RNA, 20 nt, Homo sapiens
cugcucgaagaacaauguca

SEQ ID NO: 2128183 - RNA, 14 nt, Homo sapiens
uagaugauguauuu

SEQ ID NO: 2128184 - RNA, 21 nt, Homo sapiens
ugccguccccuagagucccag

SEQ ID NO: 2128185 - RNA, 21 nt, Homo sapiens
uaaaaccccaucucuacuaaa

SEQ ID NO: 2128186 - RNA, 13 nt, Homo sapiens
auauggugcaaaa

SEQ ID NO: 2128187 - RNA, 18 nt, Homo sapiens
cugauccuuauugcauug

SEQ ID NO: 2128188 - RNA, 15 nt, Homo sapiens
uggagagaacugaau

SEQ ID NO: 2128189 - RNA, 20 nt, Homo sapiens
agcugcccuuccugccugau

SEQ ID NO: 2128190 - RNA, 21 nt, Homo sapiens
uucuuaauccaguucugcaaa

SEQ ID NO: 2128191 - RNA, 11 nt, Homo sapiens
agucaucucau

SEQ ID NO: 2128192 - RNA, 20 nt, Homo sapiens
cauggacagcugagcacuaa

SEQ ID NO: 2128193 - RNA, 22 nt, Homo sapiens
guucuucuucucuucucugcaa

SEQ ID NO: 2128194 - RNA, 17 nt, Homo sapiens
uauaccagccuacugua

SEQ ID NO: 2128195 - RNA, 16 nt, Homo sapiens
caccaaguacaaggac

SEQ ID NO: 2128196 - RNA, 15 nt, Homo sapiens
ugcacuuauucucaa

SEQ ID NO: 2128197 - RNA, 18 nt, Homo sapiens
accaugacgcacugcuca

SEQ ID NO: 2128198 - RNA, 21 nt, Homo sapiens
gaggauacgacaguacacugu

SEQ ID NO: 2128199 - RNA, 15 nt, Homo sapiens
ugcccagagcacuuu

SEQ ID NO: 2128200 - RNA, 22 nt, Homo sapiens
gcuugugauuuuugaacaauac

SEQ ID NO: 2128201 - RNA, 21 nt, Homo sapiens
ccaacaccugccuccacuucu

SEQ ID NO: 2128202 - RNA, 12 nt, Homo sapiens
uccugugcuacu

SEQ ID NO: 2128203 - RNA, 13 nt, Homo sapiens
agccuccaagaaa

SEQ ID NO: 2128204 - RNA, 18 nt, Homo sapiens
agaucuuucauuuugcac

SEQ ID NO: 2128205 - RNA, 22 nt, Homo sapiens
ccaguacccuugggugcagauc

SEQ ID NO: 2128206 - RNA, 12 nt, Homo sapiens
uggugcugagaa

SEQ ID NO: 2128207 - RNA, 22 nt, Homo sapiens
aucaguauaauucuguacugau

SEQ ID NO: 2128208 - RNA, 16 nt, Homo sapiens
gucauaauugcauuga

SEQ ID NO: 2128209 - RNA, 23 nt, Homo sapiens
ucuaugaacuagagacucuguga

SEQ ID NO: 2128210 - RNA, 15 nt, Homo sapiens
aggacuucaaaaggu

SEQ ID NO: 2128211 - RNA, 15 nt, Homo sapiens
cuaggauuacaggcc

SEQ ID NO: 2128212 - RNA, 17 nt, Homo sapiens
ccuauuuuaggcuauua

SEQ ID NO: 2128213 - RNA, 18 nt, Homo sapiens
gagcagggagaagccaga

SEQ ID NO: 2128214 - RNA, 15 nt, Homo sapiens
caagggcugcuucca

SEQ ID NO: 2128215 - RNA, 15 nt, Homo sapiens
agacuguuagacaaa

SEQ ID NO: 2128216 - RNA, 17 nt, Homo sapiens
aaccuuuuaucaauaaa

SEQ ID NO: 2128217 - RNA, 19 nt, Homo sapiens
cuguuuauucauaugcaua

SEQ ID NO: 2128218 - RNA, 21 nt, Homo sapiens
gggaggaggaaguaguccagc

SEQ ID NO: 2128219 - RNA, 14 nt, Homo sapiens
agcacauucgggac

SEQ ID NO: 2128220 - RNA, 14 nt, Homo sapiens
caggacuuaacaca

SEQ ID NO: 2128221 - RNA, 12 nt, Homo sapiens
uuccauggugcc

SEQ ID NO: 2128222 - RNA, 20 nt, Homo sapiens
accguauuucagccaugaua

SEQ ID NO: 2128223 - RNA, 17 nt, Homo sapiens
cuuguuugucagcaucu

SEQ ID NO: 2128224 - RNA, 21 nt, Homo sapiens
cauaugauugugcacauacuu

SEQ ID NO: 2128225 - RNA, 18 nt, Homo sapiens
caauguaccguuuccuua

SEQ ID NO: 2128226 - RNA, 16 nt, Homo sapiens
aguaagaugcacugaa

SEQ ID NO: 2128227 - RNA, 15 nt, Homo sapiens
agugccaggccagug

SEQ ID NO: 2128228 - RNA, 13 nt, Homo sapiens
gcugggccauguc

SEQ ID NO: 2128229 - RNA, 14 nt, Homo sapiens
caauaaaaguguga

SEQ ID NO: 2128230 - RNA, 16 nt, Homo sapiens
cauggcccaucagggg

SEQ ID NO: 2128231 - RNA, 15 nt, Homo sapiens
aaggugggcagauca

SEQ ID NO: 2128232 - RNA, 13 nt, Homo sapiens
ugaaaauuucaac

SEQ ID NO: 2128233 - RNA, 17 nt, Homo sapiens
gauacacaggacugaaa

SEQ ID NO: 2128234 - RNA, 17 nt, Homo sapiens
aacuuucugcaguuuuu

SEQ ID NO: 2128235 - RNA, 16 nt, Homo sapiens
aaacaggaccacaaaa

SEQ ID NO: 2128236 - RNA, 20 nt, Homo sapiens
agauguugaauucuuuugcc

SEQ ID NO: 2128237 - RNA, 15 nt, Homo sapiens
ggguccuugguguga

SEQ ID NO: 2128238 - RNA, 16 nt, Homo sapiens
ggucccuuccaugccc

SEQ ID NO: 2128239 - RNA, 16 nt, Homo sapiens
uuauuacaucuuucac

SEQ ID NO: 2128240 - RNA, 22 nt, Homo sapiens
aguacuuugucuugauccucac

SEQ ID NO: 2128241 - RNA, 15 nt, Homo sapiens
aaaggugguuuuauu

SEQ ID NO: 2128242 - RNA, 17 nt, Homo sapiens
uaaagaaaaauaugaua

SEQ ID NO: 2128243 - RNA, 13 nt, Homo sapiens
uguuuaacauaua

SEQ ID NO: 2128244 - RNA, 17 nt, Homo sapiens
uucacguaaauauucau

SEQ ID NO: 2128245 - RNA, 16 nt, Homo sapiens
guuguauaaagcaaaa

SEQ ID NO: 2128246 - RNA, 19 nt, Homo sapiens
uuauuguggauaacaaaga

SEQ ID NO: 2128247 - RNA, 17 nt, Homo sapiens
agaggcccggccucuca

SEQ ID NO: 2128248 - RNA, 22 nt, Homo sapiens
gacuggccaagguuuggggaag

SEQ ID NO: 2128249 - RNA, 17 nt, Homo sapiens
cuucuuacaacagagau

SEQ ID NO: 2128250 - RNA, 14 nt, Homo sapiens
ucuccucauccauu

SEQ ID NO: 2128251 - RNA, 15 nt, Homo sapiens
ugcacccguguuugu

SEQ ID NO: 2128252 - RNA, 18 nt, Homo sapiens
uggagaggaggggaccca

SEQ ID NO: 2128253 - RNA, 19 nt, Homo sapiens
caaguacuuuccaaucuca

SEQ ID NO: 2128254 - RNA, 16 nt, Homo sapiens
gggcauggguccaggg

SEQ ID NO: 2128255 - RNA, 22 nt, Homo sapiens
caugacaacccugugguuucca

SEQ ID NO: 2128256 - RNA, 13 nt, Homo sapiens
gggauggguccuc

SEQ ID NO: 2128257 - RNA, 14 nt, Homo sapiens
ugauuaacugugaa

SEQ ID NO: 2128258 - RNA, 16 nt, Homo sapiens
uaaguacaacuaccua

SEQ ID NO: 2128259 - RNA, 22 nt, Homo sapiens
cacuccaacucuacacagcuca

SEQ ID NO: 2128260 - RNA, 17 nt, Homo sapiens
ccuucacccagagcugc

SEQ ID NO: 2128261 - RNA, 20 nt, Homo sapiens
aaguuucuuuuuacauucau

SEQ ID NO: 2128262 - RNA, 17 nt, Homo sapiens
gcacccuccacccuguc

SEQ ID NO: 2128263 - RNA, 16 nt, Homo sapiens
aagauuaagacagaga

SEQ ID NO: 2128264 - RNA, 15 nt, Homo sapiens
cuaguugaggaguag

SEQ ID NO: 2128265 - RNA, 19 nt, Homo sapiens
gaccucaaugaagcagaaa

SEQ ID NO: 2128266 - RNA, 16 nt, Homo sapiens
cugagggggugggggu

SEQ ID NO: 2128267 - RNA, 18 nt, Homo sapiens
ucuuuauacuuaaacagc

SEQ ID NO: 2128268 - RNA, 17 nt, Homo sapiens
augauuuuuuaugauca

SEQ ID NO: 2128269 - RNA, 20 nt, Homo sapiens
caggaccuuuuggucuucag

SEQ ID NO: 2128270 - RNA, 15 nt, Homo sapiens
auuuauauuccacuu

SEQ ID NO: 2128271 - RNA, 14 nt, Homo sapiens
augaugaugaucuu

SEQ ID NO: 2128272 - RNA, 15 nt, Homo sapiens
caugugcugacuccc

SEQ ID NO: 2128273 - RNA, 19 nt, Homo sapiens
acuugaaagcauccaugug

SEQ ID NO: 2128274 - RNA, 22 nt, Homo sapiens
ccuccaccugugagauccguga

SEQ ID NO: 2128275 - RNA, 17 nt, Homo sapiens
aguggcaggacccuuag

SEQ ID NO: 2128276 - RNA, 11 nt, Homo sapiens
aauugauucaa

SEQ ID NO: 2128277 - RNA, 22 nt, Homo sapiens
cuugucaagguuccaacuggaa

SEQ ID NO: 2128278 - RNA, 16 nt, Homo sapiens
ccuggggacauuggga

SEQ ID NO: 2128279 - RNA, 16 nt, Homo sapiens
aaauguguacaggugu

SEQ ID NO: 2128280 - RNA, 13 nt, Homo sapiens
ccaguauguccuu

SEQ ID NO: 2128281 - RNA, 14 nt, Homo sapiens
agaacaguaugaau

SEQ ID NO: 2128282 - RNA, 19 nt, Homo sapiens
ugacaggcagacacaugcu

SEQ ID NO: 2128283 - RNA, 15 nt, Homo sapiens
ccacaucuaacaaag

SEQ ID NO: 2128284 - RNA, 13 nt, Homo sapiens
uaacagauuagua

SEQ ID NO: 2128285 - RNA, 17 nt, Homo sapiens
gcugccuggaggccaga

SEQ ID NO: 2128286 - RNA, 15 nt, Homo sapiens
uccaugaagcacuga

SEQ ID NO: 2128287 - RNA, 20 nt, Homo sapiens
gccaaccauaccuuccuucc

SEQ ID NO: 2128288 - RNA, 20 nt, Homo sapiens
gcugcuagagugacucacua

SEQ ID NO: 2128289 - RNA, 20 nt, Homo sapiens
ucaccaggcuggagugcagu

SEQ ID NO: 2128290 - RNA, 15 nt, Homo sapiens
aaacacgugucuaua

SEQ ID NO: 2128291 - RNA, 17 nt, Homo sapiens
agcuugcucuucagugg

SEQ ID NO: 2128292 - RNA, 18 nt, Homo sapiens
gugaagcagucagcccuu

SEQ ID NO: 2128293 - RNA, 17 nt, Homo sapiens
uauuccucuuugcccaa

SEQ ID NO: 2128294 - RNA, 20 nt, Homo sapiens
gacagauuuggaugcacuca

SEQ ID NO: 2128295 - RNA, 12 nt, Homo sapiens
acuccacaccag

SEQ ID NO: 2128296 - RNA, 17 nt, Homo sapiens
uucagcagcagcucaca

SEQ ID NO: 2128297 - RNA, 14 nt, Homo sapiens
gccucagaagugca

SEQ ID NO: 2128298 - RNA, 14 nt, Homo sapiens
cagugcugcucucc

SEQ ID NO: 2128299 - RNA, 22 nt, Homo sapiens
auuuguauuuucaagacuuuaa

SEQ ID NO: 2128300 - RNA, 18 nt, Homo sapiens
ugaaagaucucugucaca

SEQ ID NO: 2128301 - RNA, 21 nt, Homo sapiens
cauuccugugcggacagcccu

SEQ ID NO: 2128302 - RNA, 15 nt, Homo sapiens
gagaaaugacuuuga

SEQ ID NO: 2128303 - RNA, 22 nt, Homo sapiens
uaaaguguuaauaccauaccca

SEQ ID NO: 2128304 - RNA, 16 nt, Homo sapiens
acccaaguagcugcua

SEQ ID NO: 2128305 - RNA, 14 nt, Homo sapiens
gauaaaugccucau

SEQ ID NO: 2128306 - RNA, 16 nt, Homo sapiens
uucaucacacacugag

SEQ ID NO: 2128307 - RNA, 20 nt, Homo sapiens
gagcaucugucccacuggga

SEQ ID NO: 2128308 - RNA, 17 nt, Homo sapiens
ggaagagugauguuuca

SEQ ID NO: 2128309 - RNA, 23 nt, Homo sapiens
aagaaaccccuguccccagucag

SEQ ID NO: 2128310 - RNA, 16 nt, Homo sapiens
caguucagaaucacuu

SEQ ID NO: 2128311 - RNA, 17 nt, Homo sapiens
uggcagugagaugucag

SEQ ID NO: 2128312 - RNA, 15 nt, Homo sapiens
uccuccaagcucacg

SEQ ID NO: 2128313 - RNA, 19 nt, Homo sapiens
uucagugcaccuacugcuu

SEQ ID NO: 2128314 - RNA, 22 nt, Homo sapiens
cuuuuaaaaacuagagcacaga

SEQ ID NO: 2128315 - RNA, 22 nt, Homo sapiens
uucuggaaucuuugagaccaag

SEQ ID NO: 2128316 - RNA, 14 nt, Homo sapiens
uggaagacaaauac

SEQ ID NO: 2128317 - RNA, 21 nt, Homo sapiens
aauauuuuacuuuuacaguca

SEQ ID NO: 2128318 - RNA, 10 nt, Homo sapiens
cauuccacau

SEQ ID NO: 2128319 - RNA, 18 nt, Homo sapiens
cuuacauggccacaaagg

SEQ ID NO: 2128320 - RNA, 17 nt, Homo sapiens
cucacaacuguuuuuga

SEQ ID NO: 2128321 - RNA, 16 nt, Homo sapiens
aacuucaccuacauua

SEQ ID NO: 2128322 - RNA, 21 nt, Homo sapiens
ccgggucugcuucugcauuca

SEQ ID NO: 2128323 - RNA, 18 nt, Homo sapiens
ugagugcuugucauggaa

SEQ ID NO: 2128324 - RNA, 19 nt, Homo sapiens
acugauucuguuguguuca

SEQ ID NO: 2128325 - RNA, 19 nt, Homo sapiens
cagaugggccuggccuuga

SEQ ID NO: 2128326 - RNA, 18 nt, Homo sapiens
agcauguggaugacacaa

SEQ ID NO: 2128327 - RNA, 17 nt, Homo sapiens
agcuagagcucaguaua

SEQ ID NO: 2128328 - RNA, 19 nt, Homo sapiens
gugcaaauggaagacaaaa

SEQ ID NO: 2128329 - RNA, 16 nt, Homo sapiens
accuugucgacaaaga

SEQ ID NO: 2128330 - RNA, 12 nt, Homo sapiens
aaugucuaguuc

SEQ ID NO: 2128331 - RNA, 12 nt, Homo sapiens
aaucucuaguug

SEQ ID NO: 2128332 - RNA, 14 nt, Homo sapiens
caugucuugugcau

SEQ ID NO: 2128333 - RNA, 22 nt, Homo sapiens
aggcaauuagagaaaguccauu

SEQ ID NO: 2128334 - RNA, 18 nt, Homo sapiens
uggcagcuggaccaucuc

SEQ ID NO: 2128335 - RNA, 20 nt, Homo sapiens
ugucccauucacaugcccuc

SEQ ID NO: 2128336 - RNA, 11 nt, Homo sapiens
uaaaucaugca

SEQ ID NO: 2128337 - RNA, 22 nt, Homo sapiens
gaaaaagagguagcacuacaaa

SEQ ID NO: 2128338 - RNA, 19 nt, Homo sapiens
gaugauuucccuuaacuca

SEQ ID NO: 2128339 - RNA, 16 nt, Homo sapiens
cugcagccaggccacu

SEQ ID NO: 2128340 - RNA, 13 nt, Homo sapiens
gcuaccaggaaag

SEQ ID NO: 2128341 - RNA, 15 nt, Homo sapiens
cucgcccacuuccuc

SEQ ID NO: 2128342 - RNA, 12 nt, Homo sapiens
gcaaugucacaa

SEQ ID NO: 2128343 - RNA, 12 nt, Homo sapiens
gugcugucaugc

SEQ ID NO: 2128344 - RNA, 20 nt, Homo sapiens
aacuucuguggcaaaugcca

SEQ ID NO: 2128345 - RNA, 13 nt, Homo sapiens
uuccaugauacuu

SEQ ID NO: 2128346 - RNA, 17 nt, Homo sapiens
uugugaauuauucugau

SEQ ID NO: 2128347 - RNA, 14 nt, Homo sapiens
auguuuccugcucu

SEQ ID NO: 2128348 - RNA, 14 nt, Homo sapiens
aguugccacaucac

SEQ ID NO: 2128349 - RNA, 23 nt, Homo sapiens
acucugaggcucuuucugggcca

SEQ ID NO: 2128350 - RNA, 23 nt, Homo sapiens
ccuuaaaguauaaauaaacacac

SEQ ID NO: 2128351 - RNA, 13 nt, Homo sapiens
cacauugauguaa

SEQ ID NO: 2128352 - RNA, 14 nt, Homo sapiens
aucuggucuuccag

SEQ ID NO: 2128353 - RNA, 14 nt, Homo sapiens
aaccauucuacugu

SEQ ID NO: 2128354 - RNA, 14 nt, Homo sapiens
agcuggucugccag

SEQ ID NO: 2128355 - RNA, 14 nt, Homo sapiens
ucaggacacaagaa

SEQ ID NO: 2128356 - RNA, 13 nt, Homo sapiens
uucaccacuccuc

SEQ ID NO: 2128357 - RNA, 12 nt, Homo sapiens
acuaagucagaa

SEQ ID NO: 2128358 - RNA, 14 nt, Homo sapiens
ccuuaagaccugaa

SEQ ID NO: 2128359 - RNA, 12 nt, Homo sapiens
uacuucucacca

SEQ ID NO: 2128360 - RNA, 23 nt, Homo sapiens
guauuauuuuuuaauaaacugca

SEQ ID NO: 2128361 - RNA, 23 nt, Homo sapiens
agaacugaagguugcgaugccuu

SEQ ID NO: 2128362 - RNA, 18 nt, Homo sapiens
cuuagaauugaccaaaua

SEQ ID NO: 2128363 - RNA, 15 nt, Homo sapiens
aggagggcccugagg

SEQ ID NO: 2128364 - RNA, 19 nt, Homo sapiens
ccaaagguuucaacuguaa

SEQ ID NO: 2128365 - RNA, 21 nt, Homo sapiens
auaaauuuacucuguugaaua

SEQ ID NO: 2128366 - RNA, 18 nt, Homo sapiens
ucucacagagaagcuccu

SEQ ID NO: 2128367 - RNA, 17 nt, Homo sapiens
gaaaaagaaagaacugu

SEQ ID NO: 2128368 - RNA, 13 nt, Homo sapiens
agcauuugcaaca

SEQ ID NO: 2128369 - RNA, 14 nt, Homo sapiens
caugccagaaggaa

SEQ ID NO: 2128370 - RNA, 17 nt, Homo sapiens
cagccucgcaugccaga

SEQ ID NO: 2128371 - RNA, 19 nt, Homo sapiens
aauaggugcuuauucucaa

SEQ ID NO: 2128372 - RNA, 14 nt, Homo sapiens
acaaagcagauuca

SEQ ID NO: 2128373 - RNA, 21 nt, Homo sapiens
uggacacuacacccagcaaua

SEQ ID NO: 2128374 - RNA, 13 nt, Homo sapiens
ucauucucucuuc

SEQ ID NO: 2128375 - RNA, 18 nt, Homo sapiens
cagaaccucaagucuaga

SEQ ID NO: 2128376 - RNA, 19 nt, Homo sapiens
gcuaccucacuaugcugcu

SEQ ID NO: 2128377 - RNA, 15 nt, Homo sapiens
caagaggcuccugaa

SEQ ID NO: 2128378 - RNA, 21 nt, Homo sapiens
cugcucccaaauaaacuccag

SEQ ID NO: 2128379 - RNA, 19 nt, Homo sapiens
aguccagauuuacacuggg

SEQ ID NO: 2128380 - RNA, 17 nt, Homo sapiens
uuuauucacaguaucug

SEQ ID NO: 2128381 - RNA, 14 nt, Homo sapiens
ccucuagaauccca

SEQ ID NO: 2128382 - RNA, 17 nt, Homo sapiens
ugccagacauugcucuc

SEQ ID NO: 2128383 - RNA, 19 nt, Homo sapiens
acccaggcuggagugcagu

SEQ ID NO: 2128384 - RNA, 19 nt, Homo sapiens
acccaggcuagagugcaau

SEQ ID NO: 2128385 - RNA, 19 nt, Homo sapiens
cacugugccaugugccagg

SEQ ID NO: 2128386 - RNA, 23 nt, Homo sapiens
cagcagcacagucacccauggaa

SEQ ID NO: 2128387 - RNA, 16 nt, Homo sapiens
guccagcacccaggua

SEQ ID NO: 2128388 - RNA, 19 nt, Homo sapiens
acucagaagaaagcucaga

SEQ ID NO: 2128389 - RNA, 16 nt, Homo sapiens
guggcaacaaugcccc

SEQ ID NO: 2128390 - RNA, 15 nt, Homo sapiens
caaucuuaacucauu

SEQ ID NO: 2128391 - RNA, 13 nt, Homo sapiens
acuggagugcagu

SEQ ID NO: 2128392 - RNA, 12 nt, Homo sapiens
accaguuuaccu

SEQ ID NO: 2128393 - RNA, 21 nt, Homo sapiens
gcuaccuguucuugggccuca

SEQ ID NO: 2128394 - RNA, 16 nt, Homo sapiens
aucagaauaucacaga

SEQ ID NO: 2128395 - RNA, 23 nt, Homo sapiens
gcugaggcggguggaucaccuga

SEQ ID NO: 2128396 - RNA, 13 nt, Homo sapiens
agguuuacauuca

SEQ ID NO: 2128397 - RNA, 14 nt, Homo sapiens
ucuucuucauugca

SEQ ID NO: 2128398 - RNA, 19 nt, Homo sapiens
cugugggaagagaagggaa

SEQ ID NO: 2128399 - RNA, 15 nt, Homo sapiens
ugugcuauuugcaaa

SEQ ID NO: 2128400 - RNA, 21 nt, Homo sapiens
ccucuggauucucugggucua

SEQ ID NO: 2128401 - RNA, 18 nt, Homo sapiens
aaagagcuuugugauaua

SEQ ID NO: 2128402 - RNA, 16 nt, Homo sapiens
uggucagcuugcucag

SEQ ID NO: 2128403 - RNA, 22 nt, Homo sapiens
acaccagagcagaugcagagag

SEQ ID NO: 2128404 - RNA, 18 nt, Homo sapiens
caaaaucaacaugacugg

SEQ ID NO: 2128405 - RNA, 23 nt, Homo sapiens
cgucugcacuucuguuccagguu

SEQ ID NO: 2128406 - RNA, 12 nt, Homo sapiens
ugguagcacuug

SEQ ID NO: 2128407 - RNA, 19 nt, Homo sapiens
uaagcugauuugauaccau

SEQ ID NO: 2128408 - RNA, 16 nt, Homo sapiens
uacacucaagugccau

SEQ ID NO: 2128409 - RNA, 16 nt, Homo sapiens
auuuguucuuugccag

SEQ ID NO: 2128410 - RNA, 23 nt, Homo sapiens
aguuuaugagcugauuuggucac

SEQ ID NO: 2128411 - RNA, 15 nt, Homo sapiens
uaaauugauguugcu

SEQ ID NO: 2128412 - RNA, 19 nt, Homo sapiens
uccuuuuuuauacaggaaa

SEQ ID NO: 2128413 - RNA, 14 nt, Homo sapiens
aaggcacacuguua

SEQ ID NO: 2128414 - RNA, 21 nt, Homo sapiens
cuuucucgugguagaagccag

SEQ ID NO: 2128415 - RNA, 21 nt, Homo sapiens
uacuauaugaaaagagcaaaa

SEQ ID NO: 2128416 - RNA, 19 nt, Homo sapiens
gcaauaaaagacaaaugca

SEQ ID NO: 2128417 - RNA, 17 nt, Homo sapiens
aaauuaugaccauggua

SEQ ID NO: 2128418 - RNA, 12 nt, Homo sapiens
ccggcucugcac

SEQ ID NO: 2128419 - RNA, 16 nt, Homo sapiens
gcaaaucgugccuugu

SEQ ID NO: 2128420 - RNA, 18 nt, Homo sapiens
augaugcccagaugcucu

SEQ ID NO: 2128421 - RNA, 20 nt, Homo sapiens
aagugaggaugagacccagc

SEQ ID NO: 2128422 - RNA, 17 nt, Homo sapiens
aucauugggccaguucc

SEQ ID NO: 2128423 - RNA, 23 nt, Homo sapiens
agaccaggcuggccagcauggug

SEQ ID NO: 2128424 - RNA, 14 nt, Homo sapiens
uguuucccaccuca

SEQ ID NO: 2128425 - RNA, 17 nt, Homo sapiens
uuugauaaugacacugu

SEQ ID NO: 2128426 - RNA, 19 nt, Homo sapiens
cacagggcuagaagcacag

SEQ ID NO: 2128427 - RNA, 20 nt, Homo sapiens
aagauccccaacugcuccag

SEQ ID NO: 2128428 - RNA, 19 nt, Homo sapiens
aaaauuaucaaaaagcuaa

SEQ ID NO: 2128429 - RNA, 18 nt, Homo sapiens
acaguggacucagcagug

SEQ ID NO: 2128430 - RNA, 11 nt, Homo sapiens
ucuccuuccau

SEQ ID NO: 2128431 - RNA, 15 nt, Homo sapiens
uugucugguuucccu

SEQ ID NO: 2128432 - RNA, 17 nt, Homo sapiens
uguagaugaacaucucu

SEQ ID NO: 2128433 - RNA, 21 nt, Homo sapiens
uagccuagaagauacaauaau

SEQ ID NO: 2128434 - RNA, 19 nt, Homo sapiens
agcaucgggguggcccacu

SEQ ID NO: 2128435 - RNA, 23 nt, Homo sapiens
uggucaggauuccuguugccuuu

SEQ ID NO: 2128436 - RNA, 13 nt, Homo sapiens
gugcacggggcca

SEQ ID NO: 2128437 - RNA, 18 nt, Homo sapiens
ucccagacggucaggaaa

SEQ ID NO: 2128438 - RNA, 23 nt, Homo sapiens
gacaccuuuuguauuuaaaaccu

SEQ ID NO: 2128439 - RNA, 21 nt, Homo sapiens
cugacauauuucauaagcaca

SEQ ID NO: 2128440 - RNA, 22 nt, Homo sapiens
aggcauccaguaucuugaagac

SEQ ID NO: 2128441 - RNA, 14 nt, Homo sapiens
gaaucuacauucac

SEQ ID NO: 2128442 - RNA, 17 nt, Homo sapiens
ucaggaccaugugauaa

SEQ ID NO: 2128443 - RNA, 20 nt, Homo sapiens
accaauauuaccaucuuaau

SEQ ID NO: 2128444 - RNA, 21 nt, Homo sapiens
augaaccauucacagugcaag

SEQ ID NO: 2128445 - RNA, 11 nt, Homo sapiens
cugucaggcag

SEQ ID NO: 2128446 - RNA, 15 nt, Homo sapiens
ucuuggauuaccaau

SEQ ID NO: 2128447 - RNA, 23 nt, Homo sapiens
gcccucaccagaagcagaugcca

SEQ ID NO: 2128448 - RNA, 19 nt, Homo sapiens
gaaucaaaugguuagcuua

SEQ ID NO: 2128449 - RNA, 22 nt, Homo sapiens
ccucugccggucccccaugcca

SEQ ID NO: 2128450 - RNA, 18 nt, Homo sapiens
ucaggaauucgagaccag

SEQ ID NO: 2128451 - RNA, 17 nt, Homo sapiens
auaauagaagacaaaga

SEQ ID NO: 2128452 - RNA, 16 nt, Homo sapiens
cgcauccucacugggc

SEQ ID NO: 2128453 - RNA, 23 nt, Homo sapiens
guacuuccucccagcauugcuac

SEQ ID NO: 2128454 - RNA, 21 nt, Homo sapiens
ccuuguguuuaggaucaucuc

SEQ ID NO: 2128455 - RNA, 18 nt, Homo sapiens
accugcuggggaccucac

SEQ ID NO: 2128456 - RNA, 11 nt, Homo sapiens
auuuaccacag

SEQ ID NO: 2128457 - RNA, 21 nt, Homo sapiens
aaacuugugaaugcuucucac

SEQ ID NO: 2128458 - RNA, 23 nt, Homo sapiens
aaccaaauuuguauuuaagguau

SEQ ID NO: 2128459 - RNA, 16 nt, Homo sapiens
ugaagccccuuguccu

SEQ ID NO: 2128460 - RNA, 20 nt, Homo sapiens
ucauacaaagcgugcacaag

SEQ ID NO: 2128461 - RNA, 19 nt, Homo sapiens
aucauuguagaaacacagu

SEQ ID NO: 2128462 - RNA, 22 nt, Homo sapiens
aggugaccuggccagagccaag

SEQ ID NO: 2128463 - RNA, 15 nt, Homo sapiens
cagauuuacauccca

SEQ ID NO: 2128464 - RNA, 15 nt, Homo sapiens
aguuuauccugacau

SEQ ID NO: 2128465 - RNA, 16 nt, Homo sapiens
augaguuucugaggau

SEQ ID NO: 2128466 - RNA, 22 nt, Homo sapiens
cugcugggggcagcaguaccau

SEQ ID NO: 2128467 - RNA, 10 nt, Homo sapiens
ggcuugacuc

SEQ ID NO: 2128468 - RNA, 18 nt, Homo sapiens
aacagaaaccuauccuca

SEQ ID NO: 2128469 - RNA, 22 nt, Homo sapiens
acgugucuuccacuuugcauau

SEQ ID NO: 2128470 - RNA, 14 nt, Homo sapiens
gucuaaucucucac

SEQ ID NO: 2128471 - RNA, 19 nt, Homo sapiens
gcacucuaacccuaggcau

SEQ ID NO: 2128472 - RNA, 22 nt, Homo sapiens
aguuuugccugagaaggggcag

SEQ ID NO: 2128473 - RNA, 13 nt, Homo sapiens
aaaggaugaucaa

SEQ ID NO: 2128474 - RNA, 22 nt, Homo sapiens
acaucuggccuugaaaccaccu

SEQ ID NO: 2128475 - RNA, 19 nt, Homo sapiens
aauuaaguaaacuaaugag

SEQ ID NO: 2128476 - RNA, 13 nt, Homo sapiens
ccuagaggugcuc

SEQ ID NO: 2128477 - RNA, 12 nt, Homo sapiens
aauauauggucu

SEQ ID NO: 2128478 - RNA, 19 nt, Homo sapiens
acaaaaugggccucaugga

SEQ ID NO: 2128479 - RNA, 19 nt, Homo sapiens
cuggccuugguaugugcca

SEQ ID NO: 2128480 - RNA, 22 nt, Homo sapiens
gagaacgcggggaccccagaaa

SEQ ID NO: 2128481 - RNA, 17 nt, Homo sapiens
uggaacugcugccauga

SEQ ID NO: 2128482 - RNA, 15 nt, Homo sapiens
uuguggccaaugcau

SEQ ID NO: 2128483 - RNA, 16 nt, Homo sapiens
accucuguucauuuca

SEQ ID NO: 2128484 - RNA, 21 nt, Homo sapiens
auaauccaaagcgaucauguc

SEQ ID NO: 2128485 - RNA, 16 nt, Homo sapiens
ucauauguuuauucaa

SEQ ID NO: 2128486 - RNA, 16 nt, Homo sapiens
agucagagacagauac

SEQ ID NO: 2128487 - RNA, 15 nt, Homo sapiens
gagugaccuccuucu

SEQ ID NO: 2128488 - RNA, 17 nt, Homo sapiens
ucugccagaucaccaau

SEQ ID NO: 2128489 - RNA, 17 nt, Homo sapiens
uuaccgcccacccagca

SEQ ID NO: 2128490 - RNA, 15 nt, Homo sapiens
gccuacacacacagc

SEQ ID NO: 2128491 - RNA, 12 nt, Homo sapiens
guuucuguucug

SEQ ID NO: 2128492 - RNA, 16 nt, Homo sapiens
gggaccacaccucccu

SEQ ID NO: 2128493 - RNA, 21 nt, Homo sapiens
cagugauaaugccccaaggac

SEQ ID NO: 2128494 - RNA, 23 nt, Homo sapiens
agccacugugcccagcccggaua

SEQ ID NO: 2128495 - RNA, 16 nt, Homo sapiens
ugucauuuugcacugu

SEQ ID NO: 2128496 - RNA, 21 nt, Homo sapiens
aagauccacccucaaauguca

SEQ ID NO: 2128497 - RNA, 17 nt, Homo sapiens
ucaaauccauagauuuc

SEQ ID NO: 2128498 - RNA, 12 nt, Homo sapiens
gccugcucugca

SEQ ID NO: 2128499 - RNA, 17 nt, Homo sapiens
gcaauccuccugccuca

SEQ ID NO: 2128500 - RNA, 18 nt, Homo sapiens
cacaagcguguuucuaga

SEQ ID NO: 2128501 - RNA, 15 nt, Homo sapiens
cucacucaccaucug

SEQ ID NO: 2128502 - RNA, 16 nt, Homo sapiens
ucaucuuugccaagua

SEQ ID NO: 2128503 - RNA, 18 nt, Homo sapiens
augcccugcggcucugga

SEQ ID NO: 2128504 - RNA, 20 nt, Homo sapiens
ucuccaagcccaguucagcu

SEQ ID NO: 2128505 - RNA, 15 nt, Homo sapiens
guuugaacucaggga

SEQ ID NO: 2128506 - RNA, 22 nt, Homo sapiens
ucuccaucucuaggaugucguc

SEQ ID NO: 2128507 - RNA, 17 nt, Homo sapiens
aucaucaagaaauacuu

SEQ ID NO: 2128508 - RNA, 22 nt, Homo sapiens
aagaccuaccuccagacuucaa

SEQ ID NO: 2128509 - RNA, 12 nt, Homo sapiens
aaaaaacugcau

SEQ ID NO: 2128510 - RNA, 15 nt, Homo sapiens
agucaaaacagagau

SEQ ID NO: 2128511 - RNA, 18 nt, Homo sapiens
augaacucugcuguuuag

SEQ ID NO: 2128512 - RNA, 19 nt, Homo sapiens
ucaucaccccgugaagcaa

SEQ ID NO: 2128513 - RNA, 21 nt, Homo sapiens
ugacuccacuacuuuacuguu

SEQ ID NO: 2128514 - RNA, 19 nt, Homo sapiens
ccuucucaccccuuugcug

SEQ ID NO: 2128515 - RNA, 18 nt, Homo sapiens
gcacauaucuccucuugg

SEQ ID NO: 2128516 - RNA, 13 nt, Homo sapiens
acaaaugcaucau

SEQ ID NO: 2128517 - RNA, 15 nt, Homo sapiens
ugaccuucucuuaga

SEQ ID NO: 2128518 - RNA, 23 nt, Homo sapiens
ucaaccuucuuauuaaugucauu

SEQ ID NO: 2128519 - RNA, 14 nt, Homo sapiens
uugaccguagggga

SEQ ID NO: 2128520 - RNA, 15 nt, Homo sapiens
ccugcacucuuuaag

SEQ ID NO: 2128521 - RNA, 15 nt, Homo sapiens
guuuaacugcugcag

SEQ ID NO: 2128522 - RNA, 18 nt, Homo sapiens
caucgucuuuaaccccaa

SEQ ID NO: 2128523 - RNA, 17 nt, Homo sapiens
acuagcuaaaccagaaa

SEQ ID NO: 2128524 - RNA, 17 nt, Homo sapiens
ggcucauuuugcucaac

SEQ ID NO: 2128525 - RNA, 22 nt, Homo sapiens
ugaugaugggaauugugugaug

SEQ ID NO: 2128526 - RNA, 14 nt, Homo sapiens
caaggugacuggga

SEQ ID NO: 2128527 - RNA, 16 nt, Homo sapiens
cuucuggcacugugac

SEQ ID NO: 2128528 - RNA, 24 nt, Homo sapiens
uaaccagcccgucuucucucucug

SEQ ID NO: 2128529 - RNA, 23 nt, Homo sapiens
cacuggggaggaauccuggacca

SEQ ID NO: 2128530 - RNA, 14 nt, Homo sapiens
cuuuauuugcaaau

SEQ ID NO: 2128531 - RNA, 14 nt, Homo sapiens
guuauuuuccauuu

SEQ ID NO: 2128532 - RNA, 16 nt, Homo sapiens
auuccuacaaguuuaa

SEQ ID NO: 2128533 - RNA, 20 nt, Homo sapiens
ugguugaguguugcucucua

SEQ ID NO: 2128534 - RNA, 14 nt, Homo sapiens
auauauaagcucau

SEQ ID NO: 2128535 - RNA, 14 nt, Homo sapiens
auuucuucaaauaa

SEQ ID NO: 2128536 - RNA, 17 nt, Homo sapiens
gcagcuuaggauggcua

SEQ ID NO: 2128537 - RNA, 15 nt, Homo sapiens
auuuagcaaacuguu

SEQ ID NO: 2128538 - RNA, 15 nt, Homo sapiens
caaguggcagacaua

SEQ ID NO: 2128539 - RNA, 15 nt, Homo sapiens
caucaggcaguguua

SEQ ID NO: 2128540 - RNA, 17 nt, Homo sapiens
caagagccugagaguga

SEQ ID NO: 2128541 - RNA, 22 nt, Homo sapiens
auaacaauucccccauccuuca

SEQ ID NO: 2128542 - RNA, 14 nt, Homo sapiens
cuuaaccuuuccag

SEQ ID NO: 2128543 - RNA, 23 nt, Homo sapiens
ucggacaugaaaggacccuguga

SEQ ID NO: 2128544 - RNA, 20 nt, Homo sapiens
aacuugaggacacaugucca

SEQ ID NO: 2128545 - RNA, 20 nt, Homo sapiens
ucuauuuuaauuacugcuau

SEQ ID NO: 2128546 - RNA, 16 nt, Homo sapiens
ucguccugcugcugcu

SEQ ID NO: 2128547 - RNA, 16 nt, Homo sapiens
gggccccaaagcccag

SEQ ID NO: 2128548 - RNA, 15 nt, Homo sapiens
cuauuagacaugaaa

SEQ ID NO: 2128549 - RNA, 15 nt, Homo sapiens
caauuagacuugaaa

SEQ ID NO: 2128550 - RNA, 14 nt, Homo sapiens
cccugucugaagga

SEQ ID NO: 2128551 - RNA, 21 nt, Homo sapiens
aguugcaaauuuuagcguuaa

SEQ ID NO: 2128552 - RNA, 22 nt, Homo sapiens
uguuugaggcaaauuaacugua

SEQ ID NO: 2128553 - RNA, 20 nt, Homo sapiens
acugcuuuuuccuuagcuua

SEQ ID NO: 2128554 - RNA, 15 nt, Homo sapiens
accucugaucaaagc

SEQ ID NO: 2128555 - RNA, 16 nt, Homo sapiens
auaaauuacaugcaug

SEQ ID NO: 2128556 - RNA, 19 nt, Homo sapiens
caugaggccaucucaggag

SEQ ID NO: 2128557 - RNA, 12 nt, Homo sapiens
auucuacuauac

SEQ ID NO: 2128558 - RNA, 12 nt, Homo sapiens
aaauuacuaauu

SEQ ID NO: 2128559 - RNA, 22 nt, Homo sapiens
accaggguccgcaccagcugcu

SEQ ID NO: 2128560 - RNA, 17 nt, Homo sapiens
gaccuuagcguucugga

SEQ ID NO: 2128561 - RNA, 16 nt, Homo sapiens
auucgggccauuuccg

SEQ ID NO: 2128562 - RNA, 22 nt, Homo sapiens
aaugagauuucuuugaauguau

SEQ ID NO: 2128563 - RNA, 14 nt, Homo sapiens
gucuuugcagagaa

SEQ ID NO: 2128564 - RNA, 18 nt, Homo sapiens
aaugcacauuucagaaau

SEQ ID NO: 2128565 - RNA, 19 nt, Homo sapiens
ugaacuaauuucugugucu

SEQ ID NO: 2128566 - RNA, 19 nt, Homo sapiens
acuacaggagaugcuguca

SEQ ID NO: 2128567 - RNA, 21 nt, Homo sapiens
caaacuugagaaaauaucuug

SEQ ID NO: 2128568 - RNA, 17 nt, Homo sapiens
uccuaauuccacagcug

SEQ ID NO: 2128569 - RNA, 12 nt, Homo sapiens
cacacacuggac

SEQ ID NO: 2128570 - RNA, 22 nt, Homo sapiens
aaaggaaagauuugccaauuga

SEQ ID NO: 2128571 - RNA, 14 nt, Homo sapiens
aaaggucagacuga

SEQ ID NO: 2128572 - RNA, 14 nt, Homo sapiens
ucccgcgcuccaug

SEQ ID NO: 2128573 - RNA, 22 nt, Homo sapiens
ggaggaccauuggcuugccaag

SEQ ID NO: 2128574 - RNA, 16 nt, Homo sapiens
cucuggguugugcaca

SEQ ID NO: 2128575 - RNA, 12 nt, Homo sapiens
ggaauaauucaa

SEQ ID NO: 2128576 - RNA, 14 nt, Homo sapiens
ucacccacaccaua

SEQ ID NO: 2128577 - RNA, 22 nt, Homo sapiens
ugaccuggccagagccaagaaa

SEQ ID NO: 2128578 - RNA, 19 nt, Homo sapiens
aggguaugauaagcuuuau

SEQ ID NO: 2128579 - RNA, 20 nt, Homo sapiens
aggagagcucuuugugaaug

SEQ ID NO: 2128580 - RNA, 21 nt, Homo sapiens
ucuagcaaauguuaugcauaa

SEQ ID NO: 2128581 - RNA, 22 nt, Homo sapiens
uaguaccaugucguaguuacuc

SEQ ID NO: 2128582 - RNA, 18 nt, Homo sapiens
ucacaggaaacuacuuca

SEQ ID NO: 2128583 - RNA, 17 nt, Homo sapiens
caggcacugaagcugcg

SEQ ID NO: 2128584 - RNA, 22 nt, Homo sapiens
ugcaggucugauucccagaaau

SEQ ID NO: 2128585 - RNA, 12 nt, Homo sapiens
auugccagcaaa

SEQ ID NO: 2128586 - RNA, 18 nt, Homo sapiens
uauaaauguguggugcua

SEQ ID NO: 2128587 - RNA, 14 nt, Homo sapiens
aaaacacacuccuu

SEQ ID NO: 2128588 - RNA, 20 nt, Homo sapiens
aggcucagggaaaggccagu

SEQ ID NO: 2128589 - RNA, 15 nt, Homo sapiens
cucgaggugccuucu

SEQ ID NO: 2128590 - RNA, 19 nt, Homo sapiens
ugcuuugcccagcauuuua

SEQ ID NO: 2128591 - RNA, 14 nt, Homo sapiens
caaacaaugguguc

SEQ ID NO: 2128592 - RNA, 19 nt, Homo sapiens
aucaguucuguguggugca

SEQ ID NO: 2128593 - RNA, 19 nt, Homo sapiens
ucacucuucauucuuugaa

SEQ ID NO: 2128594 - RNA, 21 nt, Homo sapiens
ugcuuaaaauuaauaaaucau

SEQ ID NO: 2128595 - RNA, 13 nt, Homo sapiens
ugcagguauuuca

SEQ ID NO: 2128596 - RNA, 15 nt, Homo sapiens
cucaagugccauuca

SEQ ID NO: 2128597 - RNA, 20 nt, Homo sapiens
gaaggaacucuggcuuccag

SEQ ID NO: 2128598 - RNA, 12 nt, Homo sapiens
acacacuggcca

SEQ ID NO: 2128599 - RNA, 20 nt, Homo sapiens
uuuaccuuuggaauugugcu

SEQ ID NO: 2128600 - RNA, 16 nt, Homo sapiens
aaaggacaucagcaaa

SEQ ID NO: 2128601 - RNA, 18 nt, Homo sapiens
auuuuguaucaccucuuc

SEQ ID NO: 2128602 - RNA, 15 nt, Homo sapiens
aauugaacuuccagg

SEQ ID NO: 2128603 - RNA, 14 nt, Homo sapiens
acccuguuuuacaa

SEQ ID NO: 2128604 - RNA, 13 nt, Homo sapiens
uguccuucuacuc

SEQ ID NO: 2128605 - RNA, 16 nt, Homo sapiens
aagcuuacuacaguga

SEQ ID NO: 2128606 - RNA, 17 nt, Homo sapiens
gagcuugauccagaccu

SEQ ID NO: 2128607 - RNA, 15 nt, Homo sapiens
ugaauaaaguaugua

SEQ ID NO: 2128608 - RNA, 15 nt, Homo sapiens
cuuuaugcaaauaca

SEQ ID NO: 2128609 - RNA, 22 nt, Homo sapiens
aucacucuagguuuuacagauu

SEQ ID NO: 2128610 - RNA, 19 nt, Homo sapiens
uggaugagggccaccagga

SEQ ID NO: 2128611 - RNA, 18 nt, Homo sapiens
guaaacuugaaagcaaga

SEQ ID NO: 2128612 - RNA, 16 nt, Homo sapiens
uugaaagagauccagg

SEQ ID NO: 2128613 - RNA, 20 nt, Homo sapiens
auguaucaauauucacuuga

SEQ ID NO: 2128614 - RNA, 11 nt, Homo sapiens
uucuucacugg

SEQ ID NO: 2128615 - RNA, 13 nt, Homo sapiens
uggccuguggcag

SEQ ID NO: 2128616 - RNA, 15 nt, Homo sapiens
cugcaaacccuuuca

SEQ ID NO: 2128617 - RNA, 18 nt, Homo sapiens
cugaccuggagaugcugc

SEQ ID NO: 2128618 - RNA, 15 nt, Homo sapiens
uuguuguucuuucag

SEQ ID NO: 2128619 - RNA, 22 nt, Homo sapiens
ccacaccgucuuccuucaggga

SEQ ID NO: 2128620 - RNA, 15 nt, Homo sapiens
acagcaguuugagcu

SEQ ID NO: 2128621 - RNA, 15 nt, Homo sapiens
gacuuugagcugagu

SEQ ID NO: 2128622 - RNA, 19 nt, Homo sapiens
gccagaaaacauaugcauu

SEQ ID NO: 2128623 - RNA, 20 nt, Homo sapiens
uucaaagagcaauauuccag

SEQ ID NO: 2128624 - RNA, 15 nt, Homo sapiens
uguacuaguccucua

SEQ ID NO: 2128625 - RNA, 22 nt, Homo sapiens
caacagagaggaccaacaucca

SEQ ID NO: 2128626 - RNA, 18 nt, Homo sapiens
caagcagccaagcuccuu

SEQ ID NO: 2128627 - RNA, 20 nt, Homo sapiens
uugguaagaugacucugaga

SEQ ID NO: 2128628 - RNA, 22 nt, Homo sapiens
ccuuuccugaucaaggugcucu

SEQ ID NO: 2128629 - RNA, 15 nt, Homo sapiens
ccagagcugccugcu

SEQ ID NO: 2128630 - RNA, 20 nt, Homo sapiens
cauuuaaaguauuuuauucu

SEQ ID NO: 2128631 - RNA, 15 nt, Homo sapiens
uccuggggucacuca

SEQ ID NO: 2128632 - RNA, 13 nt, Homo sapiens
ggagccucagaag

SEQ ID NO: 2128633 - RNA, 23 nt, Homo sapiens
uauuuauuucuuuuuugccaaau

SEQ ID NO: 2128634 - RNA, 23 nt, Homo sapiens
agauuccuuuccacuccaaccag

SEQ ID NO: 2128635 - RNA, 15 nt, Homo sapiens
aacaaagcacauaac

SEQ ID NO: 2128636 - RNA, 15 nt, Homo sapiens
ccuuuauccacuuuu

SEQ ID NO: 2128637 - RNA, 22 nt, Homo sapiens
gagucuuccaaaccaccuuccc

SEQ ID NO: 2128638 - RNA, 20 nt, Homo sapiens
uacugaagccaaaugaaacu

SEQ ID NO: 2128639 - RNA, 21 nt, Homo sapiens
aaaauuuugcuccccagugaa

SEQ ID NO: 2128640 - RNA, 16 nt, Homo sapiens
cacacacaaggugcuc

SEQ ID NO: 2128641 - RNA, 20 nt, Homo sapiens
gaccucugaaugucccagag

SEQ ID NO: 2128642 - RNA, 17 nt, Homo sapiens
uauaaggacacugaagc

SEQ ID NO: 2128643 - RNA, 17 nt, Homo sapiens
uuaaagcagucacuuca

SEQ ID NO: 2128644 - RNA, 12 nt, Homo sapiens
gccguggcugcg

SEQ ID NO: 2128645 - RNA, 16 nt, Homo sapiens
uuucuaaagacuugua

SEQ ID NO: 2128646 - RNA, 15 nt, Homo sapiens
auucauauucaagca

SEQ ID NO: 2128647 - RNA, 23 nt, Homo sapiens
gacucacauucgacauaccccac

SEQ ID NO: 2128648 - RNA, 18 nt, Homo sapiens
uugcccagacuacagggc

SEQ ID NO: 2128649 - RNA, 21 nt, Homo sapiens
agcuauaccucauucacagcu

SEQ ID NO: 2128650 - RNA, 22 nt, Homo sapiens
ccaggucaggaugcacauuucu

SEQ ID NO: 2128651 - RNA, 16 nt, Homo sapiens
acgucccaugugcaug

SEQ ID NO: 2128652 - RNA, 18 nt, Homo sapiens
gaggcauugcacagggag

SEQ ID NO: 2128653 - RNA, 16 nt, Homo sapiens
uaaagcauuuugcaaa

SEQ ID NO: 2128654 - RNA, 20 nt, Homo sapiens
acaugggugaacuuacuugc

SEQ ID NO: 2128655 - RNA, 16 nt, Homo sapiens
uucuucaucuugacau

SEQ ID NO: 2128656 - RNA, 22 nt, Homo sapiens
aucccgccucuucuucuucaga

SEQ ID NO: 2128657 - RNA, 17 nt, Homo sapiens
gagggagacuuguucua

SEQ ID NO: 2128658 - RNA, 15 nt, Homo sapiens
aaucauuucuauuaa

SEQ ID NO: 2128659 - RNA, 14 nt, Homo sapiens
uauuucacagagca

SEQ ID NO: 2128660 - RNA, 16 nt, Homo sapiens
uugguaccauggugua

SEQ ID NO: 2128661 - RNA, 14 nt, Homo sapiens
cuacgcacauaccu

SEQ ID NO: 2128662 - RNA, 21 nt, Homo sapiens
aacuagggauauuuaacugga

SEQ ID NO: 2128663 - RNA, 15 nt, Homo sapiens
aauaaauuugcaaau

SEQ ID NO: 2128664 - RNA, 19 nt, Homo sapiens
augguuccacagaagcuuu

SEQ ID NO: 2128665 - RNA, 12 nt, Homo sapiens
uaauggguauau

SEQ ID NO: 2128666 - RNA, 17 nt, Homo sapiens
uugugugugggcuguga

SEQ ID NO: 2128667 - RNA, 21 nt, Homo sapiens
ugccacaaauuguauggugau

SEQ ID NO: 2128668 - RNA, 17 nt, Homo sapiens
agcccugcagagcacaa

SEQ ID NO: 2128669 - RNA, 15 nt, Homo sapiens
caggagagugugcaa

SEQ ID NO: 2128670 - RNA, 21 nt, Homo sapiens
cugugaaaguacauuuggaga

SEQ ID NO: 2128671 - RNA, 12 nt, Homo sapiens
uuacaaacaaag

SEQ ID NO: 2128672 - RNA, 14 nt, Homo sapiens
aaugaaguguuaga

SEQ ID NO: 2128673 - RNA, 14 nt, Homo sapiens
auuugacuaauaau

SEQ ID NO: 2128674 - RNA, 16 nt, Homo sapiens
ugcuacuagaaauaaa

SEQ ID NO: 2128675 - RNA, 13 nt, Homo sapiens
ccagccaacgaga

SEQ ID NO: 2128676 - RNA, 20 nt, Homo sapiens
uuaaugucuucacucuauac

SEQ ID NO: 2128677 - RNA, 19 nt, Homo sapiens
augugggugggaccacaga

SEQ ID NO: 2128678 - RNA, 15 nt, Homo sapiens
ggcucaggcucugcu

SEQ ID NO: 2128679 - RNA, 15 nt, Homo sapiens
cuaagaggggaaccu

SEQ ID NO: 2128680 - RNA, 15 nt, Homo sapiens
ugugcggagucauuu

SEQ ID NO: 2128681 - RNA, 16 nt, Homo sapiens
guaaacauguguuuua

SEQ ID NO: 2128682 - RNA, 20 nt, Homo sapiens
gccucgacacagaguggacu

SEQ ID NO: 2128683 - RNA, 18 nt, Homo sapiens
gcacccagaucagacucu

SEQ ID NO: 2128684 - RNA, 13 nt, Homo sapiens
acuuccaugacau

SEQ ID NO: 2128685 - RNA, 19 nt, Homo sapiens
caacagccauuuaggcaaa

SEQ ID NO: 2128686 - RNA, 14 nt, Homo sapiens
aucuuaagauccac

SEQ ID NO: 2128687 - RNA, 15 nt, Homo sapiens
agcagucgugccugu

SEQ ID NO: 2128688 - RNA, 17 nt, Homo sapiens
ugcccccucagugagga

SEQ ID NO: 2128689 - RNA, 20 nt, Homo sapiens
caaggguucuuggugaugcu

SEQ ID NO: 2128690 - RNA, 22 nt, Homo sapiens
ggccagugggaccccacagagu

SEQ ID NO: 2128691 - RNA, 15 nt, Homo sapiens
guuuuuaacuuuuaa

SEQ ID NO: 2128692 - RNA, 22 nt, Homo sapiens
ugucuuccacagccgccugaaa

SEQ ID NO: 2128693 - RNA, 13 nt, Homo sapiens
agugccugcugaa

SEQ ID NO: 2128694 - RNA, 16 nt, Homo sapiens
cuucucacgggcucua

SEQ ID NO: 2128695 - RNA, 23 nt, Homo sapiens
uuaggaugaguuucuauguugua

SEQ ID NO: 2128696 - RNA, 16 nt, Homo sapiens
gauggcauccugugaa

SEQ ID NO: 2128697 - RNA, 17 nt, Homo sapiens
uggaagcuuguuuucca

SEQ ID NO: 2128698 - RNA, 17 nt, Homo sapiens
cuuuugcaacuuaauac

SEQ ID NO: 2128699 - RNA, 14 nt, Homo sapiens
uaccaaugcuuuga

SEQ ID NO: 2128700 - RNA, 22 nt, Homo sapiens
auuucagaggggaggcucagga

SEQ ID NO: 2128701 - RNA, 16 nt, Homo sapiens
caacuugucacaaagu

SEQ ID NO: 2128702 - RNA, 20 nt, Homo sapiens
cugcuacugucuuacuauua

SEQ ID NO: 2128703 - RNA, 16 nt, Homo sapiens
ugaugccccagggauu

SEQ ID NO: 2128704 - RNA, 18 nt, Homo sapiens
uccacagauucacuuugu

SEQ ID NO: 2128705 - RNA, 16 nt, Homo sapiens
uaaaagaaucauuugc

SEQ ID NO: 2128706 - RNA, 19 nt, Homo sapiens
uugaggggcuggccuuccu

SEQ ID NO: 2128707 - RNA, 21 nt, Homo sapiens
gcccaucagggcccagggagc

SEQ ID NO: 2128708 - RNA, 18 nt, Homo sapiens
uaucugagucaacuccuu

SEQ ID NO: 2128709 - RNA, 17 nt, Homo sapiens
aauuuaauugcuuugaa

SEQ ID NO: 2128710 - RNA, 16 nt, Homo sapiens
gaggucucuugaggga

SEQ ID NO: 2128711 - RNA, 18 nt, Homo sapiens
caacuuaaaugaaaugca

SEQ ID NO: 2128712 - RNA, 20 nt, Homo sapiens
uguguccaugugugugcaag

SEQ ID NO: 2128713 - RNA, 14 nt, Homo sapiens
uucauaccaaauau

SEQ ID NO: 2128714 - RNA, 14 nt, Homo sapiens
ucuccuaucuugau

SEQ ID NO: 2128715 - RNA, 15 nt, Homo sapiens
gcgcggccacagggg

SEQ ID NO: 2128716 - RNA, 14 nt, Homo sapiens
gccuggcaucgcau

SEQ ID NO: 2128717 - RNA, 17 nt, Homo sapiens
gaucuaucaauagucaa

SEQ ID NO: 2128718 - RNA, 17 nt, Homo sapiens
uucuaagucacaggaug

SEQ ID NO: 2128719 - RNA, 19 nt, Homo sapiens
uauacauuagacacacaua

SEQ ID NO: 2128720 - RNA, 21 nt, Homo sapiens
cucaugagggcuggaugcucu

SEQ ID NO: 2128721 - RNA, 23 nt, Homo sapiens
aaccaaugcuuucucaugucuca

SEQ ID NO: 2128722 - RNA, 15 nt, Homo sapiens
auguuugccaaaaac

SEQ ID NO: 2128723 - RNA, 21 nt, Homo sapiens
ucaggccgggugcaguggcuc

SEQ ID NO: 2128724 - RNA, 13 nt, Homo sapiens
cuguauaagugga

SEQ ID NO: 2128725 - RNA, 12 nt, Homo sapiens
acucugguggcc

SEQ ID NO: 2128726 - RNA, 16 nt, Homo sapiens
guaaagaaagcuguaa

SEQ ID NO: 2128727 - RNA, 15 nt, Homo sapiens
ucuuaaauauuucca

SEQ ID NO: 2128728 - RNA, 17 nt, Homo sapiens
caccugcucacagggau

SEQ ID NO: 2128729 - RNA, 18 nt, Homo sapiens
ugguucucugggccucag

SEQ ID NO: 2128730 - RNA, 14 nt, Homo sapiens
aagaaugugucuug

SEQ ID NO: 2128731 - RNA, 20 nt, Homo sapiens
aauuuucacaaaaugucuca

SEQ ID NO: 2128732 - RNA, 14 nt, Homo sapiens
uucaucugcuacaa

SEQ ID NO: 2128733 - RNA, 15 nt, Homo sapiens
aguagaaagcuaaag

SEQ ID NO: 2128734 - RNA, 22 nt, Homo sapiens
cuggauauaaauuaauugugcc

SEQ ID NO: 2128735 - RNA, 19 nt, Homo sapiens
auauguggaagcaaccaag

SEQ ID NO: 2128736 - RNA, 12 nt, Homo sapiens
aauauuccugaa

SEQ ID NO: 2128737 - RNA, 11 nt, Homo sapiens
gcccugucauu

SEQ ID NO: 2128738 - RNA, 20 nt, Homo sapiens
agggaacaccuggcauucug

SEQ ID NO: 2128739 - RNA, 11 nt, Homo sapiens
agcaucagaaa

SEQ ID NO: 2128740 - RNA, 16 nt, Homo sapiens
guuucagugaauaugc

SEQ ID NO: 2128741 - RNA, 21 nt, Homo sapiens
gagcagugcuugaaugaaguu

SEQ ID NO: 2128742 - RNA, 21 nt, Homo sapiens
caggcugccucggacuccaug

SEQ ID NO: 2128743 - RNA, 19 nt, Homo sapiens
cacaccccucugcugcaac

SEQ ID NO: 2128744 - RNA, 14 nt, Homo sapiens
caggccagcuccuu

SEQ ID NO: 2128745 - RNA, 17 nt, Homo sapiens
cucugcagucaagcccu

SEQ ID NO: 2128746 - RNA, 22 nt, Homo sapiens
uagcucaguuucccuccuuccc

SEQ ID NO: 2128747 - RNA, 16 nt, Homo sapiens
ucagugaucucacuua

SEQ ID NO: 2128748 - RNA, 13 nt, Homo sapiens
ggaaaacuacuuu

SEQ ID NO: 2128749 - RNA, 19 nt, Homo sapiens
agagaggaguucaaugauc

SEQ ID NO: 2128750 - RNA, 15 nt, Homo sapiens
uuuaaaacauuucau

SEQ ID NO: 2128751 - RNA, 18 nt, Homo sapiens
uggauaccagcucagggg

SEQ ID NO: 2128752 - RNA, 13 nt, Homo sapiens
ucuguugcugcuc

SEQ ID NO: 2128753 - RNA, 18 nt, Homo sapiens
caguuucuuuuucacuug

SEQ ID NO: 2128754 - RNA, 14 nt, Homo sapiens
cagaugggaucaca

SEQ ID NO: 2128755 - RNA, 19 nt, Homo sapiens
cuguuccacacccaaugcu

SEQ ID NO: 2128756 - RNA, 20 nt, Homo sapiens
cuuucuuuuuaaucuuccau

SEQ ID NO: 2128757 - RNA, 21 nt, Homo sapiens
aaaaacauagaaaaauucagc

SEQ ID NO: 2128758 - RNA, 19 nt, Homo sapiens
uugaagugaucauuucaca

SEQ ID NO: 2128759 - RNA, 15 nt, Homo sapiens
caugagaauaaagau

SEQ ID NO: 2128760 - RNA, 13 nt, Homo sapiens
ucaugcaggugaa

SEQ ID NO: 2128761 - RNA, 17 nt, Homo sapiens
ccuuuacucugcucuau

SEQ ID NO: 2128762 - RNA, 17 nt, Homo sapiens
agcuguauuuugaugau

SEQ ID NO: 2128763 - RNA, 20 nt, Homo sapiens
uuguuccccaagacauucua

SEQ ID NO: 2128764 - RNA, 22 nt, Homo sapiens
uguuaaugucccauuucacgac

SEQ ID NO: 2128765 - RNA, 22 nt, Homo sapiens
auagagccccuccugguugaua

SEQ ID NO: 2128766 - RNA, 16 nt, Homo sapiens
ugccuuuaagccaaag

SEQ ID NO: 2128767 - RNA, 19 nt, Homo sapiens
auuaaauucucucuaacau

SEQ ID NO: 2128768 - RNA, 14 nt, Homo sapiens
uaguauacaaaaag

SEQ ID NO: 2128769 - RNA, 22 nt, Homo sapiens
cagagccacucuucaaguagau

SEQ ID NO: 2128770 - RNA, 19 nt, Homo sapiens
aaaaggcugauuacugaaa

SEQ ID NO: 2128771 - RNA, 17 nt, Homo sapiens
cuuaaaagcuguucuca

SEQ ID NO: 2128772 - RNA, 21 nt, Homo sapiens
auucuuauaacucaacauuug

SEQ ID NO: 2128773 - RNA, 19 nt, Homo sapiens
gaugcacagagauaugcac

SEQ ID NO: 2128774 - RNA, 17 nt, Homo sapiens
caugcacuuuaauugaa

SEQ ID NO: 2128775 - RNA, 15 nt, Homo sapiens
agacaaacacugcca

SEQ ID NO: 2128776 - RNA, 16 nt, Homo sapiens
ggaauggagauuucau

SEQ ID NO: 2128777 - RNA, 13 nt, Homo sapiens
cuacaugcauguu

SEQ ID NO: 2128778 - RNA, 18 nt, Homo sapiens
cacuuugagaaccugugc

SEQ ID NO: 2128779 - RNA, 15 nt, Homo sapiens
uauaauauuguacag

SEQ ID NO: 2128780 - RNA, 16 nt, Homo sapiens
aaauaagcacuauucu

SEQ ID NO: 2128781 - RNA, 15 nt, Homo sapiens
auuaaguacaaccaa

SEQ ID NO: 2128782 - RNA, 19 nt, Homo sapiens
ugccuucccaggaguacac

SEQ ID NO: 2128783 - RNA, 16 nt, Homo sapiens
uauaaagccuucagag

SEQ ID NO: 2128784 - RNA, 12 nt, Homo sapiens
cugaaaugccuc

SEQ ID NO: 2128785 - RNA, 19 nt, Homo sapiens
aucucaccuuuuuaaaucc

SEQ ID NO: 2128786 - RNA, 16 nt, Homo sapiens
aauacauuaauacuuc

SEQ ID NO: 2128787 - RNA, 12 nt, Homo sapiens
agccuguaagag

SEQ ID NO: 2128788 - RNA, 21 nt, Homo sapiens
cacccaccagaaauuccagua

SEQ ID NO: 2128789 - RNA, 16 nt, Homo sapiens
aaugugaaauguaacu

SEQ ID NO: 2128790 - RNA, 18 nt, Homo sapiens
ucauugacugauggugaa

SEQ ID NO: 2128791 - RNA, 22 nt, Homo sapiens
uugcuaagaagcgagcacugac

SEQ ID NO: 2128792 - RNA, 13 nt, Homo sapiens
ccagucgaacugg

SEQ ID NO: 2128793 - RNA, 15 nt, Homo sapiens
uauuuaaagcuuuca

SEQ ID NO: 2128794 - RNA, 14 nt, Homo sapiens
caugccuugugcug

SEQ ID NO: 2128795 - RNA, 14 nt, Homo sapiens
uuauaaacugagag

SEQ ID NO: 2128796 - RNA, 18 nt, Homo sapiens
cucuugccugccacugug

SEQ ID NO: 2128797 - RNA, 22 nt, Homo sapiens
aaaaagugggcaaaggacauga

SEQ ID NO: 2128798 - RNA, 16 nt, Homo sapiens
auugaguuuucagugg

SEQ ID NO: 2128799 - RNA, 14 nt, Homo sapiens
cacaaguuacacug

SEQ ID NO: 2128800 - RNA, 16 nt, Homo sapiens
ccccauucucacugcu

SEQ ID NO: 2128801 - RNA, 19 nt, Homo sapiens
uucacgaaguguugcaugg

SEQ ID NO: 2128802 - RNA, 14 nt, Homo sapiens
cagggaggaugcca

SEQ ID NO: 2128803 - RNA, 15 nt, Homo sapiens
cugcaugcucuggaa

SEQ ID NO: 2128804 - RNA, 13 nt, Homo sapiens
cuguacacugcac

SEQ ID NO: 2128805 - RNA, 16 nt, Homo sapiens
agagaaaguacuucuc

SEQ ID NO: 2128806 - RNA, 20 nt, Homo sapiens
cuagccuuaagacauuugaa

SEQ ID NO: 2128807 - RNA, 12 nt, Homo sapiens
acuuaggggugc

SEQ ID NO: 2128808 - RNA, 22 nt, Homo sapiens
ccauagccaggagcgcaucuca

SEQ ID NO: 2128809 - RNA, 17 nt, Homo sapiens
aaggugaauagcacagg

SEQ ID NO: 2128810 - RNA, 19 nt, Homo sapiens
uggagaaaaaaauugcucu

SEQ ID NO: 2128811 - RNA, 16 nt, Homo sapiens
uccugucagaugacac

SEQ ID NO: 2128812 - RNA, 20 nt, Homo sapiens
uaucccccaccaaaaacaca

SEQ ID NO: 2128813 - RNA, 20 nt, Homo sapiens
ggcaacagagcgagauucca

SEQ ID NO: 2128814 - RNA, 22 nt, Homo sapiens
uguggcauaaauugcaucacug

SEQ ID NO: 2128815 - RNA, 21 nt, Homo sapiens
gcagaaaaccuaccacauuca

SEQ ID NO: 2128816 - RNA, 14 nt, Homo sapiens
ugucagucagggac

SEQ ID NO: 2128817 - RNA, 23 nt, Homo sapiens
gcguagagggugcugccccauga

SEQ ID NO: 2128818 - RNA, 14 nt, Homo sapiens
augggucuaggaca

SEQ ID NO: 2128819 - RNA, 13 nt, Homo sapiens
guauuugggauau

SEQ ID NO: 2128820 - RNA, 17 nt, Homo sapiens
uaccaaauuuaagcaag

SEQ ID NO: 2128821 - RNA, 18 nt, Homo sapiens
uggcucguuugggcucaa

SEQ ID NO: 2128822 - RNA, 16 nt, Homo sapiens
ggaacccagacucaga

SEQ ID NO: 2128823 - RNA, 16 nt, Homo sapiens
ggcacccagaaucaga

SEQ ID NO: 2128824 - RNA, 13 nt, Homo sapiens
auaguauuucaga

SEQ ID NO: 2128825 - RNA, 16 nt, Homo sapiens
caggagaccuuccaca

SEQ ID NO: 2128826 - RNA, 18 nt, Homo sapiens
auuugggguuugcuugua

SEQ ID NO: 2128827 - RNA, 22 nt, Homo sapiens
acuguaagucauuuauggguua

SEQ ID NO: 2128828 - RNA, 14 nt, Homo sapiens
gagccaagcuucaa

SEQ ID NO: 2128829 - RNA, 14 nt, Homo sapiens
aagaaugaugcuau

SEQ ID NO: 2128830 - RNA, 18 nt, Homo sapiens
aggagcagauuuuugcaa

SEQ ID NO: 2128831 - RNA, 19 nt, Homo sapiens
gguugcugguccugcacau

SEQ ID NO: 2128832 - RNA, 23 nt, Homo sapiens
cucuguaguuccuaauggauuca

SEQ ID NO: 2128833 - RNA, 19 nt, Homo sapiens
gccacccugccucuaccca

SEQ ID NO: 2128834 - RNA, 20 nt, Homo sapiens
aguccucuuugucauaccuu

SEQ ID NO: 2128835 - RNA, 13 nt, Homo sapiens
auauaaucaagaa

SEQ ID NO: 2128836 - RNA, 22 nt, Homo sapiens
cuuaaugauuuacagacugaug

SEQ ID NO: 2128837 - RNA, 14 nt, Homo sapiens
ccagggaacagcca

SEQ ID NO: 2128838 - RNA, 15 nt, Homo sapiens
uuugaauucugugau

SEQ ID NO: 2128839 - RNA, 18 nt, Homo sapiens
cuuuuggauuauuccuca

SEQ ID NO: 2128840 - RNA, 17 nt, Homo sapiens
uaaucauaaaggacaag

SEQ ID NO: 2128841 - RNA, 15 nt, Homo sapiens
agaucuagugaacau

SEQ ID NO: 2128842 - RNA, 18 nt, Homo sapiens
uauacauuuaguuaacac

SEQ ID NO: 2128843 - RNA, 22 nt, Homo sapiens
ccuugggcucucaccacuucag

SEQ ID NO: 2128844 - RNA, 21 nt, Homo sapiens
auucucaucuacucauugucu

SEQ ID NO: 2128845 - RNA, 21 nt, Homo sapiens
auuuccucaugugaucacaau

SEQ ID NO: 2128846 - RNA, 15 nt, Homo sapiens
auacagcugcacuga

SEQ ID NO: 2128847 - RNA, 19 nt, Homo sapiens
cagagagaccucauccugc

SEQ ID NO: 2128848 - RNA, 21 nt, Homo sapiens
ugcacuuuuagaaaugcauau

SEQ ID NO: 2128849 - RNA, 15 nt, Homo sapiens
cuucuuccugcugga

SEQ ID NO: 2128850 - RNA, 21 nt, Homo sapiens
uacuugauaauauuagugauu

SEQ ID NO: 2128851 - RNA, 14 nt, Homo sapiens
cugucacacaggga

SEQ ID NO: 2128852 - RNA, 21 nt, Homo sapiens
gcggcgugggggcacugacca

SEQ ID NO: 2128853 - RNA, 14 nt, Homo sapiens
auuucgcacuguau

SEQ ID NO: 2128854 - RNA, 21 nt, Homo sapiens
uuagcauaaaauuuucuacuc

SEQ ID NO: 2128855 - RNA, 14 nt, Homo sapiens
gcugggcaccugac

SEQ ID NO: 2128856 - RNA, 20 nt, Homo sapiens
aggaaaacucaccauuucau

SEQ ID NO: 2128857 - RNA, 18 nt, Homo sapiens
uagauauggaguggaggu

SEQ ID NO: 2128858 - RNA, 16 nt, Homo sapiens
cugcaccuaaagccua

SEQ ID NO: 2128859 - RNA, 21 nt, Homo sapiens
aaaacacacuccuuugcuuaa

SEQ ID NO: 2128860 - RNA, 23 nt, Homo sapiens
uuuucucuccuaagacaccugca

SEQ ID NO: 2128861 - RNA, 15 nt, Homo sapiens
agauuucucugagau

SEQ ID NO: 2128862 - RNA, 18 nt, Homo sapiens
uacuggcacaaaaacaca

SEQ ID NO: 2128863 - RNA, 24 nt, Homo sapiens
acuguggcuucuuaaucuuuucac

SEQ ID NO: 2128864 - RNA, 19 nt, Homo sapiens
guugagaaucacugcucca

SEQ ID NO: 2128865 - RNA, 13 nt, Homo sapiens
acuagcuucccag

SEQ ID NO: 2128866 - RNA, 13 nt, Homo sapiens
ccuuccuuaccuc

SEQ ID NO: 2128867 - RNA, 16 nt, Homo sapiens
ucccuguucuuugaag

SEQ ID NO: 2128868 - RNA, 13 nt, Homo sapiens
auaaaagcacuua

SEQ ID NO: 2128869 - RNA, 23 nt, Homo sapiens
uucugaaauuaaaguaugcaaaa

SEQ ID NO: 2128870 - RNA, 18 nt, Homo sapiens
aaaaccuucuauguucau

SEQ ID NO: 2128871 - RNA, 23 nt, Homo sapiens
acacagcuaacaaguagcacacu

SEQ ID NO: 2128872 - RNA, 18 nt, Homo sapiens
gauaauauuguggugcca

SEQ ID NO: 2128873 - RNA, 19 nt, Homo sapiens
gaaacuaacacagccauca

SEQ ID NO: 2128874 - RNA, 12 nt, Homo sapiens
auugugccugua

SEQ ID NO: 2128875 - RNA, 16 nt, Homo sapiens
uuuucucaguguccag

SEQ ID NO: 2128876 - RNA, 16 nt, Homo sapiens
cuaccucaucucugaa

SEQ ID NO: 2128877 - RNA, 12 nt, Homo sapiens
aaggaagcagaa

SEQ ID NO: 2128878 - RNA, 16 nt, Homo sapiens
gauuuaagcaaaggcu

SEQ ID NO: 2128879 - RNA, 22 nt, Homo sapiens
uucuuauaccacguuccacgga

SEQ ID NO: 2128880 - RNA, 14 nt, Homo sapiens
guaaauauaaacua

SEQ ID NO: 2128881 - RNA, 19 nt, Homo sapiens
auauuuauuuaugcuaaua

SEQ ID NO: 2128882 - RNA, 17 nt, Homo sapiens
ucuggccugaacugagg

SEQ ID NO: 2128883 - RNA, 20 nt, Homo sapiens
cuuccauaaugcuacugucu

SEQ ID NO: 2128884 - RNA, 15 nt, Homo sapiens
gcagugauuguuaug

SEQ ID NO: 2128885 - RNA, 17 nt, Homo sapiens
uuugugccaucacugag

SEQ ID NO: 2128886 - RNA, 22 nt, Homo sapiens
cuggacaggcuucgucucagaa

SEQ ID NO: 2128887 - RNA, 14 nt, Homo sapiens
aaaaauaaaagauc

SEQ ID NO: 2128888 - RNA, 21 nt, Homo sapiens
acaaucucagcucacugcaac

SEQ ID NO: 2128889 - RNA, 18 nt, Homo sapiens
agcacauggccauagagg

SEQ ID NO: 2128890 - RNA, 16 nt, Homo sapiens
agcccucuuucucucu

SEQ ID NO: 2128891 - RNA, 21 nt, Homo sapiens
ccaaggcaggaggaucacuug

SEQ ID NO: 2128892 - RNA, 18 nt, Homo sapiens
guggaccugugcugugag

SEQ ID NO: 2128893 - RNA, 18 nt, Homo sapiens
agggacugucgcugcuuc

SEQ ID NO: 2128894 - RNA, 18 nt, Homo sapiens
cacaccaaggcccugcau

SEQ ID NO: 2128895 - RNA, 15 nt, Homo sapiens
uacugugaccaugga

SEQ ID NO: 2128896 - RNA, 22 nt, Homo sapiens
ucaggaccuccaagccacugag

SEQ ID NO: 2128897 - RNA, 13 nt, Homo sapiens
aaaugcuaucaga

SEQ ID NO: 2128898 - RNA, 21 nt, Homo sapiens
uaaaaguaaugcaauauguga

SEQ ID NO: 2128899 - RNA, 12 nt, Homo sapiens
uuugccacugga

SEQ ID NO: 2128900 - RNA, 22 nt, Homo sapiens
gcauccaucugggcuaccccac

SEQ ID NO: 2128901 - RNA, 16 nt, Homo sapiens
auuaugcaccaccucc

SEQ ID NO: 2128902 - RNA, 16 nt, Homo sapiens
uccgccaaacacucca

SEQ ID NO: 2128903 - RNA, 16 nt, Homo sapiens
uguaguaaacuauuua

SEQ ID NO: 2128904 - RNA, 16 nt, Homo sapiens
ugcaucugaccagcag

SEQ ID NO: 2128905 - RNA, 22 nt, Homo sapiens
gacaagccaacuuguaaauaca

SEQ ID NO: 2128906 - RNA, 22 nt, Homo sapiens
cucaugcaagacuucacugcag

SEQ ID NO: 2128907 - RNA, 15 nt, Homo sapiens
ugguguauuugccag

SEQ ID NO: 2128908 - RNA, 22 nt, Homo sapiens
gauccaaaagaagcccccagcu

SEQ ID NO: 2128909 - RNA, 20 nt, Homo sapiens
ucaaaagcugggaaccagca

SEQ ID NO: 2128910 - RNA, 22 nt, Homo sapiens
cugagcccccugaccuuccaaa

SEQ ID NO: 2128911 - RNA, 15 nt, Homo sapiens
agcaagggcacuuaa

SEQ ID NO: 2128912 - RNA, 15 nt, Homo sapiens
caacaagaauauugu

SEQ ID NO: 2128913 - RNA, 22 nt, Homo sapiens
uuccuaugcugcaauacauuaa

SEQ ID NO: 2128914 - RNA, 20 nt, Homo sapiens
aaucagagaccuuccagaaa

SEQ ID NO: 2128915 - RNA, 18 nt, Homo sapiens
aaagacugugcugagaag

SEQ ID NO: 2128916 - RNA, 22 nt, Homo sapiens
agagcuuacaagacccuaugaa

SEQ ID NO: 2128917 - RNA, 23 nt, Homo sapiens
ugggaaccccuuucccaccccaa

SEQ ID NO: 2128918 - RNA, 11 nt, Homo sapiens
ccuuuugcccg

SEQ ID NO: 2128919 - RNA, 18 nt, Homo sapiens
uccuugggcuuuagccuu

SEQ ID NO: 2128920 - RNA, 19 nt, Homo sapiens
ucuagaucacugugcuuau

SEQ ID NO: 2128921 - RNA, 16 nt, Homo sapiens
gauggccuuguuucaa

SEQ ID NO: 2128922 - RNA, 16 nt, Homo sapiens
agcaggcuacacugac

SEQ ID NO: 2128923 - RNA, 13 nt, Homo sapiens
gagaaucacugga

SEQ ID NO: 2128924 - RNA, 12 nt, Homo sapiens
acgcgugcacac

SEQ ID NO: 2128925 - RNA, 22 nt, Homo sapiens
ccuuucuuugcuguuugcaauc

SEQ ID NO: 2128926 - RNA, 13 nt, Homo sapiens
cuuggaggccacc

SEQ ID NO: 2128927 - RNA, 21 nt, Homo sapiens
agccuaagaaacacucauggg

SEQ ID NO: 2128928 - RNA, 16 nt, Homo sapiens
guucuuugccagagac

SEQ ID NO: 2128929 - RNA, 20 nt, Homo sapiens
uugcauugugacuauccagu

SEQ ID NO: 2128930 - RNA, 13 nt, Homo sapiens
agaaucagccugg

SEQ ID NO: 2128931 - RNA, 22 nt, Homo sapiens
aagcagacaggugugcagauuu

SEQ ID NO: 2128932 - RNA, 20 nt, Homo sapiens
cauagaauucacaaugcauu

SEQ ID NO: 2128933 - RNA, 16 nt, Homo sapiens
agauuauuugcccaaa

SEQ ID NO: 2128934 - RNA, 19 nt, Homo sapiens
gaaacaaacuacuguguca

SEQ ID NO: 2128935 - RNA, 15 nt, Homo sapiens
gcucaauuuggugcu

SEQ ID NO: 2128936 - RNA, 19 nt, Homo sapiens
auacauacggucagguuua

SEQ ID NO: 2128937 - RNA, 15 nt, Homo sapiens
aauuauuucucucac

SEQ ID NO: 2128938 - RNA, 13 nt, Homo sapiens
agucugcucugcu

SEQ ID NO: 2128939 - RNA, 12 nt, Homo sapiens
auaccagucacc

SEQ ID NO: 2128940 - RNA, 20 nt, Homo sapiens
gaagaccuaaggcagacagg

SEQ ID NO: 2128941 - RNA, 18 nt, Homo sapiens
auuucuaagaaguuacuu

SEQ ID NO: 2128942 - RNA, 21 nt, Homo sapiens
ugucacaauaaaacaaucucu

SEQ ID NO: 2128943 - RNA, 19 nt, Homo sapiens
augaacacuggcugcaagu

SEQ ID NO: 2128944 - RNA, 14 nt, Homo sapiens
ugguuuuccagaag

SEQ ID NO: 2128945 - RNA, 14 nt, Homo sapiens
cacuuuucugcaag

SEQ ID NO: 2128946 - RNA, 16 nt, Homo sapiens
uaaaauuuaacucaca

SEQ ID NO: 2128947 - RNA, 23 nt, Homo sapiens
caaaguguacaauuuucauccca

SEQ ID NO: 2128948 - RNA, 13 nt, Homo sapiens
cucuucccgggau

SEQ ID NO: 2128949 - RNA, 13 nt, Homo sapiens
cucugcccgggag

SEQ ID NO: 2128950 - RNA, 22 nt, Homo sapiens
ccaugccgacggggacugcuuc

SEQ ID NO: 2128951 - RNA, 17 nt, Homo sapiens
accucaucuacaagcau

SEQ ID NO: 2128952 - RNA, 15 nt, Homo sapiens
acaaauaaaauacuu

SEQ ID NO: 2128953 - RNA, 20 nt, Homo sapiens
cuuuaagaacaaacucugaa

SEQ ID NO: 2128954 - RNA, 16 nt, Homo sapiens
gccaagggccacggga

SEQ ID NO: 2128955 - RNA, 15 nt, Homo sapiens
uccugaaacuauauu

SEQ ID NO: 2128956 - RNA, 15 nt, Homo sapiens
uucaauuaccaagaa

SEQ ID NO: 2128957 - RNA, 14 nt, Homo sapiens
cuugauucauucug

SEQ ID NO: 2128958 - RNA, 17 nt, Homo sapiens
agccagcucauuucacu

SEQ ID NO: 2128959 - RNA, 14 nt, Homo sapiens
cuagagcacugcca

SEQ ID NO: 2128960 - RNA, 14 nt, Homo sapiens
ugagcgcauggcaa

SEQ ID NO: 2128961 - RNA, 13 nt, Homo sapiens
aggcaagcagcug

SEQ ID NO: 2128962 - RNA, 18 nt, Homo sapiens
uaggaaagcauaugcagc

SEQ ID NO: 2128963 - RNA, 19 nt, Homo sapiens
gucaacuuuugaccaaaaa

SEQ ID NO: 2128964 - RNA, 21 nt, Homo sapiens
uguccccugacagggccagug

SEQ ID NO: 2128965 - RNA, 23 nt, Homo sapiens
aauugaccauacaauuucauccu

SEQ ID NO: 2128966 - RNA, 18 nt, Homo sapiens
aacuccuguuucacuugg

SEQ ID NO: 2128967 - RNA, 21 nt, Homo sapiens
agggagagacuaaccuugagu

SEQ ID NO: 2128968 - RNA, 14 nt, Homo sapiens
uuaccuccauccau

SEQ ID NO: 2128969 - RNA, 15 nt, Homo sapiens
aaaccaaaacccuac

SEQ ID NO: 2128970 - RNA, 20 nt, Homo sapiens
uugcacaaguucagugagaa

SEQ ID NO: 2128971 - RNA, 17 nt, Homo sapiens
aaugucacguacugucu

SEQ ID NO: 2128972 - RNA, 15 nt, Homo sapiens
cuucuauuuggggcu

SEQ ID NO: 2128973 - RNA, 23 nt, Homo sapiens
cauuaaaagcaaggcucaaggga

SEQ ID NO: 2128974 - RNA, 14 nt, Homo sapiens
gccauggcuuucau

SEQ ID NO: 2128975 - RNA, 19 nt, Homo sapiens
uauacagaacucacaguac

SEQ ID NO: 2128976 - RNA, 16 nt, Homo sapiens
auguagauaaagcacu

SEQ ID NO: 2128977 - RNA, 16 nt, Homo sapiens
guuaacagacacugua

SEQ ID NO: 2128978 - RNA, 17 nt, Homo sapiens
ccccauuguucuggaaa

SEQ ID NO: 2128979 - RNA, 17 nt, Homo sapiens
acagacuacagccagaa

SEQ ID NO: 2128980 - RNA, 21 nt, Homo sapiens
cagccugugagggagugcaga

SEQ ID NO: 2128981 - RNA, 18 nt, Homo sapiens
ccuaaacauuaaugacag

SEQ ID NO: 2128982 - RNA, 13 nt, Homo sapiens
gagacagugcaca

SEQ ID NO: 2128983 - RNA, 14 nt, Homo sapiens
uuccagaccugcuu

SEQ ID NO: 2128984 - RNA, 19 nt, Homo sapiens
agcagccaaaccuuuccug

SEQ ID NO: 2128985 - RNA, 20 nt, Homo sapiens
aaaagauuguauagugcaug

SEQ ID NO: 2128986 - RNA, 23 nt, Homo sapiens
uacacaaugugauuuuaugguga

SEQ ID NO: 2128987 - RNA, 11 nt, Homo sapiens
aaagccaguga

SEQ ID NO: 2128988 - RNA, 21 nt, Homo sapiens
cccuccucagauggggcacca

SEQ ID NO: 2128989 - RNA, 19 nt, Homo sapiens
agccuccuauccaccacug

SEQ ID NO: 2128990 - RNA, 16 nt, Homo sapiens
gacuuuuauuaugggu

SEQ ID NO: 2128991 - RNA, 19 nt, Homo sapiens
ucaauaaaguacugcaaaa

SEQ ID NO: 2128992 - RNA, 12 nt, Homo sapiens
acuggcacuauu

SEQ ID NO: 2128993 - RNA, 21 nt, Homo sapiens
cugagaacuggacaguggcag

SEQ ID NO: 2128994 - RNA, 15 nt, Homo sapiens
agugcacugacugug

SEQ ID NO: 2128995 - RNA, 17 nt, Homo sapiens
uacuacagcuucaguga

SEQ ID NO: 2128996 - RNA, 16 nt, Homo sapiens
ucagucugauccaucc

SEQ ID NO: 2128997 - RNA, 13 nt, Homo sapiens
guauagcauuaau

SEQ ID NO: 2128998 - RNA, 19 nt, Homo sapiens
gcugcuuugcuucuucaau

SEQ ID NO: 2128999 - RNA, 13 nt, Homo sapiens
agcugcucuggaa

SEQ ID NO: 2129000 - RNA, 18 nt, Homo sapiens
cccuaaaaagauugccaa

SEQ ID NO: 2129001 - RNA, 20 nt, Homo sapiens
augccacaaauaacaucuca

SEQ ID NO: 2129002 - RNA, 13 nt, Homo sapiens
ggaaauacuuugc

SEQ ID NO: 2129003 - RNA, 13 nt, Homo sapiens
ucuuauuugcuca

SEQ ID NO: 2129004 - RNA, 14 nt, Homo sapiens
uguuuaaaaaguau

SEQ ID NO: 2129005 - RNA, 22 nt, Homo sapiens
cuuccuuuugaaguuucauugg

SEQ ID NO: 2129006 - RNA, 17 nt, Homo sapiens
acaauuaaguaaaguca

SEQ ID NO: 2129007 - RNA, 21 nt, Homo sapiens
gacacugaaaguuuuguaaaa

SEQ ID NO: 2129008 - RNA, 14 nt, Homo sapiens
agaaacaaaugaca

SEQ ID NO: 2129009 - RNA, 21 nt, Homo sapiens
gccaggggauugucucagggc

SEQ ID NO: 2129010 - RNA, 16 nt, Homo sapiens
uuuuccacauaggaaa

SEQ ID NO: 2129011 - RNA, 22 nt, Homo sapiens
aaaaggauauuaucuaccuguu

SEQ ID NO: 2129012 - RNA, 22 nt, Homo sapiens
gucaacuccaacguaugugguu

SEQ ID NO: 2129013 - RNA, 17 nt, Homo sapiens
cucucugccuguaaaug

SEQ ID NO: 2129014 - RNA, 21 nt, Homo sapiens
uauuaggucgguacuaagaaa

SEQ ID NO: 2129015 - RNA, 16 nt, Homo sapiens
cucugcccccuccuuu

SEQ ID NO: 2129016 - RNA, 14 nt, Homo sapiens
uuuacagaauuuua

SEQ ID NO: 2129017 - RNA, 20 nt, Homo sapiens
gugcacuguugcguccaugc

SEQ ID NO: 2129018 - RNA, 17 nt, Homo sapiens
ggacugcauaaaccaau

SEQ ID NO: 2129019 - RNA, 14 nt, Homo sapiens
uaggcuaaaaacau

SEQ ID NO: 2129020 - RNA, 17 nt, Homo sapiens
ucauugucuuuccugaa

SEQ ID NO: 2129021 - RNA, 13 nt, Homo sapiens
uugugccaaccua

SEQ ID NO: 2129022 - RNA, 20 nt, Homo sapiens
uuuccauuaaacuacuuuug

SEQ ID NO: 2129023 - RNA, 18 nt, Homo sapiens
gagucagcugcugacccu

SEQ ID NO: 2129024 - RNA, 15 nt, Homo sapiens
aguuuccucagugau

SEQ ID NO: 2129025 - RNA, 22 nt, Homo sapiens
gaguucagagggugucguccug

SEQ ID NO: 2129026 - RNA, 22 nt, Homo sapiens
gcagcaaguucauacaacaugc

SEQ ID NO: 2129027 - RNA, 15 nt, Homo sapiens
guuucuuaaacaauu

SEQ ID NO: 2129028 - RNA, 22 nt, Homo sapiens
gaauaaagccuuugaugcacaa

SEQ ID NO: 2129029 - RNA, 18 nt, Homo sapiens
uguacacaucuauucuca

SEQ ID NO: 2129030 - RNA, 11 nt, Homo sapiens
auaaagucaac

SEQ ID NO: 2129031 - RNA, 17 nt, Homo sapiens
uuaauuaauauguucau

SEQ ID NO: 2129032 - RNA, 16 nt, Homo sapiens
agaaugucugaucuaa

SEQ ID NO: 2129033 - RNA, 17 nt, Homo sapiens
gcugaucguuucuucca

SEQ ID NO: 2129034 - RNA, 16 nt, Homo sapiens
cuagagcuaugcacac

SEQ ID NO: 2129035 - RNA, 16 nt, Homo sapiens
accauucccaccagcu

SEQ ID NO: 2129036 - RNA, 13 nt, Homo sapiens
auucuuccagaau

SEQ ID NO: 2129037 - RNA, 15 nt, Homo sapiens
auucuuucacuugau

SEQ ID NO: 2129038 - RNA, 17 nt, Homo sapiens
gcccaggccacagagaa

SEQ ID NO: 2129039 - RNA, 19 nt, Homo sapiens
agcuacacagaucacagcu

SEQ ID NO: 2129040 - RNA, 16 nt, Homo sapiens
acuaaaaaaaagauga

SEQ ID NO: 2129041 - RNA, 11 nt, Homo sapiens
uaauagcuuuu

SEQ ID NO: 2129042 - RNA, 11 nt, Homo sapiens
gauuagcugua

SEQ ID NO: 2129043 - RNA, 18 nt, Homo sapiens
agcgaugaauuuggagac

SEQ ID NO: 2129044 - RNA, 19 nt, Homo sapiens
aagcaguguguacuucuuc

SEQ ID NO: 2129045 - RNA, 19 nt, Homo sapiens
uuaauuucugucaaaugca

SEQ ID NO: 2129046 - RNA, 21 nt, Homo sapiens
cuuguaauaccugauugauca

SEQ ID NO: 2129047 - RNA, 20 nt, Homo sapiens
ggcuggaaaagucacacaga

SEQ ID NO: 2129048 - RNA, 19 nt, Homo sapiens
agccugacugcacacagcu

SEQ ID NO: 2129049 - RNA, 17 nt, Homo sapiens
auuuucuuccccaagcu

SEQ ID NO: 2129050 - RNA, 13 nt, Homo sapiens
cuggaaauaaccu

SEQ ID NO: 2129051 - RNA, 13 nt, Homo sapiens
aaggaaaucuccu

SEQ ID NO: 2129052 - RNA, 20 nt, Homo sapiens
cugcccacucccaggaccaa

SEQ ID NO: 2129053 - RNA, 16 nt, Homo sapiens
gaaaauguacauacua

SEQ ID NO: 2129054 - RNA, 13 nt, Homo sapiens
uauacacauaauu

SEQ ID NO: 2129055 - RNA, 13 nt, Homo sapiens
ccuuuacaccaac

SEQ ID NO: 2129056 - RNA, 22 nt, Homo sapiens
gcacuggguugacuuucaggua

SEQ ID NO: 2129057 - RNA, 21 nt, Homo sapiens
cccagagugugaaacuuccua

SEQ ID NO: 2129058 - RNA, 18 nt, Homo sapiens
augccaagcacugugcuc

SEQ ID NO: 2129059 - RNA, 13 nt, Homo sapiens
cucauccaaaguu

SEQ ID NO: 2129060 - RNA, 16 nt, Homo sapiens
agauagucaugcugcu

SEQ ID NO: 2129061 - RNA, 15 nt, Homo sapiens
augaaacaauuugag

SEQ ID NO: 2129062 - RNA, 22 nt, Homo sapiens
gccacuugaagauuucucugag

SEQ ID NO: 2129063 - RNA, 18 nt, Homo sapiens
uggccaaggagcugcuau

SEQ ID NO: 2129064 - RNA, 19 nt, Homo sapiens
cuuuuauacucagcuuucu

SEQ ID NO: 2129065 - RNA, 21 nt, Homo sapiens
auauugagcagaauucauuca

SEQ ID NO: 2129066 - RNA, 16 nt, Homo sapiens
cauugauggggaagga

SEQ ID NO: 2129067 - RNA, 16 nt, Homo sapiens
auguaccccaauuuac

SEQ ID NO: 2129068 - RNA, 11 nt, Homo sapiens
acauugugccc

SEQ ID NO: 2129069 - RNA, 21 nt, Homo sapiens
agcuauuuuaagccaucucag

SEQ ID NO: 2129070 - RNA, 20 nt, Homo sapiens
augucaccguggaccuuccu

SEQ ID NO: 2129071 - RNA, 19 nt, Homo sapiens
ucccucucaugacuugcag

SEQ ID NO: 2129072 - RNA, 20 nt, Homo sapiens
agcugcucagcaaccuuuca

SEQ ID NO: 2129073 - RNA, 13 nt, Homo sapiens
cuuucaugcucca

SEQ ID NO: 2129074 - RNA, 13 nt, Homo sapiens
cagaauccaaaga

SEQ ID NO: 2129075 - RNA, 21 nt, Homo sapiens
cuguauuaguuuuugaucaag

SEQ ID NO: 2129076 - RNA, 16 nt, Homo sapiens
uguugagcaucugucc

SEQ ID NO: 2129077 - RNA, 22 nt, Homo sapiens
uggaggcccagauacagcacau

SEQ ID NO: 2129078 - RNA, 17 nt, Homo sapiens
accaccauccaccgcug

SEQ ID NO: 2129079 - RNA, 22 nt, Homo sapiens
cuuaaacgaagaguucccuuga

SEQ ID NO: 2129080 - RNA, 12 nt, Homo sapiens
caaagaauucca

SEQ ID NO: 2129081 - RNA, 21 nt, Homo sapiens
auugccuuuggcaauucuucu

SEQ ID NO: 2129082 - RNA, 14 nt, Homo sapiens
aacuuuggugcauu

SEQ ID NO: 2129083 - RNA, 17 nt, Homo sapiens
aauugcagcaguugcua

SEQ ID NO: 2129084 - RNA, 22 nt, Homo sapiens
acagggagaagggauaacccua

SEQ ID NO: 2129085 - RNA, 13 nt, Homo sapiens
aaaauaaauucuc

SEQ ID NO: 2129086 - RNA, 24 nt, Homo sapiens
cauggauucaaccaacugcaaaug

SEQ ID NO: 2129087 - RNA, 22 nt, Homo sapiens
cuggcgagccucugguuuuccu

SEQ ID NO: 2129088 - RNA, 21 nt, Homo sapiens
caagcuauagcuaaugugcug

SEQ ID NO: 2129089 - RNA, 17 nt, Homo sapiens
uuaaauaaaugugagaa

SEQ ID NO: 2129090 - RNA, 23 nt, Homo sapiens
acagaugcuuuucugucucugcc

SEQ ID NO: 2129091 - RNA, 16 nt, Homo sapiens
cccaacucuugcacag

SEQ ID NO: 2129092 - RNA, 17 nt, Homo sapiens
aaccaauuuacacugcc

SEQ ID NO: 2129093 - RNA, 18 nt, Homo sapiens
uuaaagacucaagguggu

SEQ ID NO: 2129094 - RNA, 14 nt, Homo sapiens
uccucccuugggaa

SEQ ID NO: 2129095 - RNA, 16 nt, Homo sapiens
ugguuggcagcauucc

SEQ ID NO: 2129096 - RNA, 19 nt, Homo sapiens
uacuccuuaauacuagauu

SEQ ID NO: 2129097 - RNA, 21 nt, Homo sapiens
cauuaaaaaugaaagccaaau

SEQ ID NO: 2129098 - RNA, 21 nt, Homo sapiens
uaacaaauauauugcaaaaac

SEQ ID NO: 2129099 - RNA, 20 nt, Homo sapiens
cggaugggcccuaugucuca

SEQ ID NO: 2129100 - RNA, 18 nt, Homo sapiens
cuucugcuaugugacuug

SEQ ID NO: 2129101 - RNA, 16 nt, Homo sapiens
auccuggcuaacacgg

SEQ ID NO: 2129102 - RNA, 16 nt, Homo sapiens
uuucacuauaauguga

SEQ ID NO: 2129103 - RNA, 16 nt, Homo sapiens
auggaccagaagccaa

SEQ ID NO: 2129104 - RNA, 13 nt, Homo sapiens
auuuuaaggcaau

SEQ ID NO: 2129105 - RNA, 16 nt, Homo sapiens
cugacagccuugccca

SEQ ID NO: 2129106 - RNA, 20 nt, Homo sapiens
cugcgacaaaacauuuugaa

SEQ ID NO: 2129107 - RNA, 22 nt, Homo sapiens
uaauacugucuuaucugcuaua

SEQ ID NO: 2129108 - RNA, 21 nt, Homo sapiens
auacugcauuagcccaagaga

SEQ ID NO: 2129109 - RNA, 16 nt, Homo sapiens
ggcuccuggcugccag

SEQ ID NO: 2129110 - RNA, 14 nt, Homo sapiens
uuguaacucuauga

SEQ ID NO: 2129111 - RNA, 23 nt, Homo sapiens
gggaagagagccugcaggaucuc

SEQ ID NO: 2129112 - RNA, 21 nt, Homo sapiens
auacaggggccaaagccaggc

SEQ ID NO: 2129113 - RNA, 22 nt, Homo sapiens
aucagaagcgcugauggucaua

SEQ ID NO: 2129114 - RNA, 16 nt, Homo sapiens
uuaaaaaaacacauaa

SEQ ID NO: 2129115 - RNA, 17 nt, Homo sapiens
ugcaguaauuugcaauu

SEQ ID NO: 2129116 - RNA, 22 nt, Homo sapiens
gcagcugugcugggugagcucu

SEQ ID NO: 2129117 - RNA, 17 nt, Homo sapiens
uaagucaaccugccuga

SEQ ID NO: 2129118 - RNA, 17 nt, Homo sapiens
cugaggcuccugugcua

SEQ ID NO: 2129119 - RNA, 15 nt, Homo sapiens
gucguccugcagugu

SEQ ID NO: 2129120 - RNA, 20 nt, Homo sapiens
cacaguuuaaacacaucaau

SEQ ID NO: 2129121 - RNA, 16 nt, Homo sapiens
cauuucugaguguucu

SEQ ID NO: 2129122 - RNA, 15 nt, Homo sapiens
cagacucaguagcca

SEQ ID NO: 2129123 - RNA, 14 nt, Homo sapiens
aaauuguauuauca

SEQ ID NO: 2129124 - RNA, 22 nt, Homo sapiens
ccuacgguacaagcuacauaug

SEQ ID NO: 2129125 - RNA, 21 nt, Homo sapiens
uccaaauaaaaauaacaucau

SEQ ID NO: 2129126 - RNA, 21 nt, Homo sapiens
ccuaucuguguggugaugaau

SEQ ID NO: 2129127 - RNA, 20 nt, Homo sapiens
uggagggguguggcuccuuc

SEQ ID NO: 2129128 - RNA, 18 nt, Homo sapiens
gagcguuuguucccccau

SEQ ID NO: 2129129 - RNA, 20 nt, Homo sapiens
caguagacugcaguggacag

SEQ ID NO: 2129130 - RNA, 18 nt, Homo sapiens
gguaaauaaaauuuaacu

SEQ ID NO: 2129131 - RNA, 13 nt, Homo sapiens
gaagaagccagac

SEQ ID NO: 2129132 - RNA, 20 nt, Homo sapiens
acagccucuucugucccaag

SEQ ID NO: 2129133 - RNA, 21 nt, Homo sapiens
gucccaggccgacccaaggga

SEQ ID NO: 2129134 - RNA, 16 nt, Homo sapiens
aggcaaggaagggugu

SEQ ID NO: 2129135 - RNA, 20 nt, Homo sapiens
aaauaaaaucuaauuaauuc

SEQ ID NO: 2129136 - RNA, 13 nt, Homo sapiens
accaguugcccua

SEQ ID NO: 2129137 - RNA, 13 nt, Homo sapiens
cuauguugauaaa

SEQ ID NO: 2129138 - RNA, 22 nt, Homo sapiens
uuggagagcagcuggcucucca

SEQ ID NO: 2129139 - RNA, 23 nt, Homo sapiens
cccccaccgccgggguccuggga

SEQ ID NO: 2129140 - RNA, 15 nt, Homo sapiens
uuauuaccucugaua

SEQ ID NO: 2129141 - RNA, 19 nt, Homo sapiens
uugaauguuuauguucuca

SEQ ID NO: 2129142 - RNA, 14 nt, Homo sapiens
agccucagggacga

SEQ ID NO: 2129143 - RNA, 17 nt, Homo sapiens
auuuggugacuguguaa

SEQ ID NO: 2129144 - RNA, 21 nt, Homo sapiens
agucugcuacccucauuucuc

SEQ ID NO: 2129145 - RNA, 22 nt, Homo sapiens
gcaggggcuggagggaggcggg

SEQ ID NO: 2129146 - RNA, 14 nt, Homo sapiens
uuaagucagugaca

SEQ ID NO: 2129147 - RNA, 13 nt, Homo sapiens
uaaacuuuaacuu

SEQ ID NO: 2129148 - RNA, 22 nt, Homo sapiens
aggaaacaaagauuugugguaa

SEQ ID NO: 2129149 - RNA, 13 nt, Homo sapiens
guuugcacuccac

SEQ ID NO: 2129150 - RNA, 22 nt, Homo sapiens
uauguauaaacauaaguugcau

SEQ ID NO: 2129151 - RNA, 13 nt, Homo sapiens
agugugcaagugu

SEQ ID NO: 2129152 - RNA, 13 nt, Homo sapiens
auagugcaauagu

SEQ ID NO: 2129153 - RNA, 17 nt, Homo sapiens
uaaagagaguuugccac

SEQ ID NO: 2129154 - RNA, 21 nt, Homo sapiens
gaaauuuuaguuauaguguuu

SEQ ID NO: 2129155 - RNA, 21 nt, Homo sapiens
auguaauugaauaaaguugaa

SEQ ID NO: 2129156 - RNA, 20 nt, Homo sapiens
gcaugggauggggaugaagu

SEQ ID NO: 2129157 - RNA, 12 nt, Homo sapiens
ugcugcaucuua

SEQ ID NO: 2129158 - RNA, 16 nt, Homo sapiens
ccggaaccacagggcc

SEQ ID NO: 2129159 - RNA, 15 nt, Homo sapiens
cugcaggcugcaguc

SEQ ID NO: 2129160 - RNA, 22 nt, Homo sapiens
cauucugguuuugacaucagca

SEQ ID NO: 2129161 - RNA, 16 nt, Homo sapiens
agaaccuacaaaagcu

SEQ ID NO: 2129162 - RNA, 21 nt, Homo sapiens
cucauggaugcuuuggcaaug

SEQ ID NO: 2129163 - RNA, 17 nt, Homo sapiens
aggaucccuuugcugug

SEQ ID NO: 2129164 - RNA, 17 nt, Homo sapiens
aaaugucauagcuuaua

SEQ ID NO: 2129165 - RNA, 16 nt, Homo sapiens
ugguuguauuguggaa

SEQ ID NO: 2129166 - RNA, 19 nt, Homo sapiens
auacaaaugggaauucacu

SEQ ID NO: 2129167 - RNA, 19 nt, Homo sapiens
gucagcagggccacugagu

SEQ ID NO: 2129168 - RNA, 15 nt, Homo sapiens
cuuuaaacaugauua

SEQ ID NO: 2129169 - RNA, 14 nt, Homo sapiens
cugauguaaguaaa

SEQ ID NO: 2129170 - RNA, 14 nt, Homo sapiens
aggccaccuggauu

SEQ ID NO: 2129171 - RNA, 15 nt, Homo sapiens
cugaggcccagagag

SEQ ID NO: 2129172 - RNA, 12 nt, Homo sapiens
agcaugugccaa

SEQ ID NO: 2129173 - RNA, 12 nt, Homo sapiens
agccugugccac

SEQ ID NO: 2129174 - RNA, 14 nt, Homo sapiens
ucugagcugugcag

SEQ ID NO: 2129175 - RNA, 12 nt, Homo sapiens
uacugcauuuau

SEQ ID NO: 2129176 - RNA, 21 nt, Homo sapiens
uuaacuugaggguguagaggu

SEQ ID NO: 2129177 - RNA, 16 nt, Homo sapiens
agucaagggcauuaca

SEQ ID NO: 2129178 - RNA, 16 nt, Homo sapiens
acauaacggaaaguuu

SEQ ID NO: 2129179 - RNA, 17 nt, Homo sapiens
agacuuugucacuuauu

SEQ ID NO: 2129180 - RNA, 18 nt, Homo sapiens
auguggaaaaaugagaga

SEQ ID NO: 2129181 - RNA, 14 nt, Homo sapiens
gcaacucuguaaau

SEQ ID NO: 2129182 - RNA, 13 nt, Homo sapiens
uuagacucagcau

SEQ ID NO: 2129183 - RNA, 20 nt, Homo sapiens
agauauuauuuuagcuucag

SEQ ID NO: 2129184 - RNA, 16 nt, Homo sapiens
aggucaugcaugccaa

SEQ ID NO: 2129185 - RNA, 15 nt, Homo sapiens
cugucucuccaguga

SEQ ID NO: 2129186 - RNA, 15 nt, Homo sapiens
gucgacuuugagcug

SEQ ID NO: 2129187 - RNA, 15 nt, Homo sapiens
agauauagaaacucu

SEQ ID NO: 2129188 - RNA, 15 nt, Homo sapiens
aacaguuguuacuua

SEQ ID NO: 2129189 - RNA, 20 nt, Homo sapiens
uaccccagggcccuggccag

SEQ ID NO: 2129190 - RNA, 15 nt, Homo sapiens
acaaagugccaaaga

SEQ ID NO: 2129191 - RNA, 21 nt, Homo sapiens
aguggaaucaaguucuugucu

SEQ ID NO: 2129192 - RNA, 23 nt, Homo sapiens
ucccuugggcacgugugcuggga

SEQ ID NO: 2129193 - RNA, 14 nt, Homo sapiens
aagauaaaugugcu

SEQ ID NO: 2129194 - RNA, 18 nt, Homo sapiens
aacuaaagauacauaccu

SEQ ID NO: 2129195 - RNA, 18 nt, Homo sapiens
gaaaugaggccuacucua

SEQ ID NO: 2129196 - RNA, 12 nt, Homo sapiens
cagcuaacaugg

SEQ ID NO: 2129197 - RNA, 18 nt, Homo sapiens
gaauauuagcauugccaa

SEQ ID NO: 2129198 - RNA, 14 nt, Homo sapiens
aauuucuacuuuga

SEQ ID NO: 2129199 - RNA, 16 nt, Homo sapiens
acaaucagaccaagga

SEQ ID NO: 2129200 - RNA, 21 nt, Homo sapiens
aaagcaugucucugcuuccau

SEQ ID NO: 2129201 - RNA, 14 nt, Homo sapiens
agaacaaauguguu

SEQ ID NO: 2129202 - RNA, 13 nt, Homo sapiens
ggcagcucuccag

SEQ ID NO: 2129203 - RNA, 23 nt, Homo sapiens
uaaaugugaauggaaacuuggaa

SEQ ID NO: 2129204 - RNA, 18 nt, Homo sapiens
uuccugcaucucugugaa

SEQ ID NO: 2129205 - RNA, 18 nt, Homo sapiens
agacuccccaauaccuaa

SEQ ID NO: 2129206 - RNA, 20 nt, Homo sapiens
aaagcugagaacuccugacu

SEQ ID NO: 2129207 - RNA, 22 nt, Homo sapiens
cuacacuggguucugcuacucc

SEQ ID NO: 2129208 - RNA, 16 nt, Homo sapiens
aauaaaaaaagacaaa

SEQ ID NO: 2129209 - RNA, 16 nt, Homo sapiens
cauugcacuccagcug

SEQ ID NO: 2129210 - RNA, 21 nt, Homo sapiens
uuaaauuuauuugaaaaugca

SEQ ID NO: 2129211 - RNA, 20 nt, Homo sapiens
caggaguucaagaccagccu

SEQ ID NO: 2129212 - RNA, 16 nt, Homo sapiens
uccuuuccugugugaa

SEQ ID NO: 2129213 - RNA, 17 nt, Homo sapiens
ccuuggugccugaucca

SEQ ID NO: 2129214 - RNA, 21 nt, Homo sapiens
ucucauuuuucauuucuuuuc

SEQ ID NO: 2129215 - RNA, 20 nt, Homo sapiens
ugccuuuugcaccccuccca

SEQ ID NO: 2129216 - RNA, 22 nt, Homo sapiens
uaaccuaugauaauuauuuaca

SEQ ID NO: 2129217 - RNA, 16 nt, Homo sapiens
cuaaucagcauucuca

SEQ ID NO: 2129218 - RNA, 17 nt, Homo sapiens
ggcgccaucgccaagua

SEQ ID NO: 2129219 - RNA, 16 nt, Homo sapiens
cugcucccauccucac

SEQ ID NO: 2129220 - RNA, 16 nt, Homo sapiens
gcaaaggaaaccaaag

SEQ ID NO: 2129221 - RNA, 15 nt, Homo sapiens
ccaugcacuguaaau

SEQ ID NO: 2129222 - RNA, 15 nt, Homo sapiens
aauauauuuuaucuu

SEQ ID NO: 2129223 - RNA, 22 nt, Homo sapiens
acauaugugcauagauacacaa

SEQ ID NO: 2129224 - RNA, 17 nt, Homo sapiens
uggagaacagcaugaca

SEQ ID NO: 2129225 - RNA, 22 nt, Homo sapiens
cuguccuugaaugccauaguca

SEQ ID NO: 2129226 - RNA, 14 nt, Homo sapiens
cauucaugcaagag

SEQ ID NO: 2129227 - RNA, 14 nt, Homo sapiens
agcuccccugccuu

SEQ ID NO: 2129228 - RNA, 12 nt, Homo sapiens
auuucucaaaaa

SEQ ID NO: 2129229 - RNA, 16 nt, Homo sapiens
cuuuguauauuacaua

SEQ ID NO: 2129230 - RNA, 17 nt, Homo sapiens
auuuugguuagggauau

SEQ ID NO: 2129231 - RNA, 17 nt, Homo sapiens
cugcuucccauugagua

SEQ ID NO: 2129232 - RNA, 21 nt, Homo sapiens
agcuauggugagaugcagcug

SEQ ID NO: 2129233 - RNA, 13 nt, Homo sapiens
auuuauaauugca

SEQ ID NO: 2129234 - RNA, 17 nt, Homo sapiens
ucacaaguacuaucugu

SEQ ID NO: 2129235 - RNA, 13 nt, Homo sapiens
accccuaacaaag

SEQ ID NO: 2129236 - RNA, 15 nt, Homo sapiens
acuugaggccaguga

SEQ ID NO: 2129237 - RNA, 19 nt, Homo sapiens
ucccucuuugccuguguga

SEQ ID NO: 2129238 - RNA, 22 nt, Homo sapiens
cuaaaaugauuuuaucugugaa

SEQ ID NO: 2129239 - RNA, 14 nt, Homo sapiens
aaagccccucacac

SEQ ID NO: 2129240 - RNA, 14 nt, Homo sapiens
auggccugagacag

SEQ ID NO: 2129241 - RNA, 22 nt, Homo sapiens
aaaugcauauuugcaaagugua

SEQ ID NO: 2129242 - RNA, 21 nt, Homo sapiens
gguuucuggcagccaguaccu

SEQ ID NO: 2129243 - RNA, 14 nt, Homo sapiens
accuacagugcugu

SEQ ID NO: 2129244 - RNA, 21 nt, Homo sapiens
uuuccuaggaggaaaauucca

SEQ ID NO: 2129245 - RNA, 14 nt, Homo sapiens
ugcagauggcagug

SEQ ID NO: 2129246 - RNA, 17 nt, Homo sapiens
aaguuacaugcuguaua

SEQ ID NO: 2129247 - RNA, 18 nt, Homo sapiens
auacaacagugcauuuac

SEQ ID NO: 2129248 - RNA, 17 nt, Homo sapiens
ccacaggagcauguccu

SEQ ID NO: 2129249 - RNA, 20 nt, Homo sapiens
aaaucauguuuuuucugcaa

SEQ ID NO: 2129250 - RNA, 21 nt, Homo sapiens
uuguugaugcucacauaugau

SEQ ID NO: 2129251 - RNA, 18 nt, Homo sapiens
agauaaauucaugcacuu

SEQ ID NO: 2129252 - RNA, 17 nt, Homo sapiens
ugaugaacgggcuggag

SEQ ID NO: 2129253 - RNA, 19 nt, Homo sapiens
guaaaacagauuuguucau

SEQ ID NO: 2129254 - RNA, 21 nt, Homo sapiens
aucaaacacggacccauagac

SEQ ID NO: 2129255 - RNA, 22 nt, Homo sapiens
acuaauagaauaaaggcaguuu

SEQ ID NO: 2129256 - RNA, 15 nt, Homo sapiens
uagagugcaguggca

SEQ ID NO: 2129257 - RNA, 16 nt, Homo sapiens
aguugugauacagagu

SEQ ID NO: 2129258 - RNA, 12 nt, Homo sapiens
auuaauaugcaa

SEQ ID NO: 2129259 - RNA, 19 nt, Homo sapiens
gaucuuggggugcagcacu

SEQ ID NO: 2129260 - RNA, 14 nt, Homo sapiens
cuggaacaucauca

SEQ ID NO: 2129261 - RNA, 16 nt, Homo sapiens
aaguuuucagcuuuaa

SEQ ID NO: 2129262 - RNA, 22 nt, Homo sapiens
ucugaacacaggcagcuuucua

SEQ ID NO: 2129263 - RNA, 18 nt, Homo sapiens
guauuuuaauaguacaua

SEQ ID NO: 2129264 - RNA, 14 nt, Homo sapiens
uuauugagauucau

SEQ ID NO: 2129265 - RNA, 15 nt, Homo sapiens
uacuaucaugucaaa

SEQ ID NO: 2129266 - RNA, 16 nt, Homo sapiens
agagaucagaauugaa

SEQ ID NO: 2129267 - RNA, 16 nt, Homo sapiens
caggaauguguggccu

SEQ ID NO: 2129268 - RNA, 16 nt, Homo sapiens
aucuucguacaugaau

SEQ ID NO: 2129269 - RNA, 18 nt, Homo sapiens
acucuucgaagccuugcc

SEQ ID NO: 2129270 - RNA, 20 nt, Homo sapiens
aguucaaacccuguauccaa

SEQ ID NO: 2129271 - RNA, 17 nt, Homo sapiens
uccgcagcuucagggga

SEQ ID NO: 2129272 - RNA, 18 nt, Homo sapiens
gaacaaauacaauucagu

SEQ ID NO: 2129273 - RNA, 15 nt, Homo sapiens
ggucucucagggaug

SEQ ID NO: 2129274 - RNA, 15 nt, Homo sapiens
caagucuacuucacu

SEQ ID NO: 2129275 - RNA, 19 nt, Homo sapiens
uccaguguuucuacaauca

SEQ ID NO: 2129276 - RNA, 18 nt, Homo sapiens
cagaaaaaugguggucau

SEQ ID NO: 2129277 - RNA, 21 nt, Homo sapiens
auaccaaagcugcugcacagc

SEQ ID NO: 2129278 - RNA, 24 nt, Homo sapiens
ugguggcacaggaguguccucuuc

SEQ ID NO: 2129279 - RNA, 20 nt, Homo sapiens
gcuaacuauauuugcuuuuu

SEQ ID NO: 2129280 - RNA, 19 nt, Homo sapiens
ugguaccagaggaugguga

SEQ ID NO: 2129281 - RNA, 19 nt, Homo sapiens
agagucuccaguuacugaa

SEQ ID NO: 2129282 - RNA, 21 nt, Homo sapiens
cuguuuuuucagucugugaaa

SEQ ID NO: 2129283 - RNA, 20 nt, Homo sapiens
caggaaggaacaaagacagg

SEQ ID NO: 2129284 - RNA, 16 nt, Homo sapiens
auauauuuauaacuca

SEQ ID NO: 2129285 - RNA, 20 nt, Homo sapiens
uugggcuauaaaagauuccu

SEQ ID NO: 2129286 - RNA, 13 nt, Homo sapiens
gaauaggcauuug

SEQ ID NO: 2129287 - RNA, 17 nt, Homo sapiens
ccugaaucagcuggaca

SEQ ID NO: 2129288 - RNA, 19 nt, Homo sapiens
aguuauuuguucauuauuu

SEQ ID NO: 2129289 - RNA, 22 nt, Homo sapiens
agcuacagggcugauacauccu

SEQ ID NO: 2129290 - RNA, 13 nt, Homo sapiens
agcuaauauacag

SEQ ID NO: 2129291 - RNA, 19 nt, Homo sapiens
uguaaaaucugacauaaaa

SEQ ID NO: 2129292 - RNA, 16 nt, Homo sapiens
caccauguauucaucc

SEQ ID NO: 2129293 - RNA, 20 nt, Homo sapiens
aggccucugcuggcucagga

SEQ ID NO: 2129294 - RNA, 21 nt, Homo sapiens
gauucacuuuguuuaugcaua

SEQ ID NO: 2129295 - RNA, 18 nt, Homo sapiens
uucaaaaguaaugccucu

SEQ ID NO: 2129296 - RNA, 16 nt, Homo sapiens
caggccagagugcagu

SEQ ID NO: 2129297 - RNA, 19 nt, Homo sapiens
uguguaugcugaugaucaa

SEQ ID NO: 2129298 - RNA, 12 nt, Homo sapiens
ccuucucuucuc

SEQ ID NO: 2129299 - RNA, 23 nt, Homo sapiens
cauguauuuaauaaguacaacua

SEQ ID NO: 2129300 - RNA, 18 nt, Homo sapiens
cuccaaaccuuacucuga

SEQ ID NO: 2129301 - RNA, 14 nt, Homo sapiens
aaacauaauaucuu

SEQ ID NO: 2129302 - RNA, 15 nt, Homo sapiens
aagugcucuuuccac

SEQ ID NO: 2129303 - RNA, 12 nt, Homo sapiens
gaccaagguaua

SEQ ID NO: 2129304 - RNA, 22 nt, Homo sapiens
ccuaugaaguuggcacauuuca

SEQ ID NO: 2129305 - RNA, 16 nt, Homo sapiens
aggagagccaaccucg

SEQ ID NO: 2129306 - RNA, 15 nt, Homo sapiens
ugaaauuuauucaca

SEQ ID NO: 2129307 - RNA, 22 nt, Homo sapiens
caugaaugaaugaaccaugaau

SEQ ID NO: 2129308 - RNA, 17 nt, Homo sapiens
caaguagguugcugucu

SEQ ID NO: 2129309 - RNA, 15 nt, Homo sapiens
uaagcugugcaauua

SEQ ID NO: 2129310 - RNA, 14 nt, Homo sapiens
uguuccccacugga

SEQ ID NO: 2129311 - RNA, 19 nt, Homo sapiens
cucagggcugacacgucca

SEQ ID NO: 2129312 - RNA, 15 nt, Homo sapiens
gccugcaccccagga

SEQ ID NO: 2129313 - RNA, 23 nt, Homo sapiens
uugcucagugcaaaacugaugau

SEQ ID NO: 2129314 - RNA, 16 nt, Homo sapiens
ugucagcuuccaaaca

SEQ ID NO: 2129315 - RNA, 11 nt, Homo sapiens
cugucuuccaa

SEQ ID NO: 2129316 - RNA, 18 nt, Homo sapiens
uacuaaugccucuucauu

SEQ ID NO: 2129317 - RNA, 19 nt, Homo sapiens
uaaaauaacuaguacaaaa

SEQ ID NO: 2129318 - RNA, 14 nt, Homo sapiens
aggcaaauacaaua

SEQ ID NO: 2129319 - RNA, 16 nt, Homo sapiens
gagggaacagugccca

SEQ ID NO: 2129320 - RNA, 14 nt, Homo sapiens
aaauauauuauuca

SEQ ID NO: 2129321 - RNA, 23 nt, Homo sapiens
gaagcaaagacaaaagaaacuua

SEQ ID NO: 2129322 - RNA, 13 nt, Homo sapiens
aaauaggagucuu

SEQ ID NO: 2129323 - RNA, 13 nt, Homo sapiens
aacauggaguaaa

SEQ ID NO: 2129324 - RNA, 18 nt, Homo sapiens
agcaguuauggugaugac

SEQ ID NO: 2129325 - RNA, 20 nt, Homo sapiens
accuguagucccagcacuuu

SEQ ID NO: 2129326 - RNA, 18 nt, Homo sapiens
uguccuccaccugccuuc

SEQ ID NO: 2129327 - RNA, 20 nt, Homo sapiens
ugagaauguauuaguacaaa

SEQ ID NO: 2129328 - RNA, 17 nt, Homo sapiens
cucauucugaggccuga

SEQ ID NO: 2129329 - RNA, 12 nt, Homo sapiens
ucauacauuaua

SEQ ID NO: 2129330 - RNA, 20 nt, Homo sapiens
ugagacagaccgccaaauaa

SEQ ID NO: 2129331 - RNA, 13 nt, Homo sapiens
accagucacuguc

SEQ ID NO: 2129332 - RNA, 16 nt, Homo sapiens
guucuugcugcuagaa

SEQ ID NO: 2129333 - RNA, 20 nt, Homo sapiens
cuuuugcccauuuugaauca

SEQ ID NO: 2129334 - RNA, 20 nt, Homo sapiens
cuggguuaauggcuaguacu

SEQ ID NO: 2129335 - RNA, 15 nt, Homo sapiens
uccuugggaccugaa

SEQ ID NO: 2129336 - RNA, 15 nt, Homo sapiens
cuugucucaagaaga

SEQ ID NO: 2129337 - RNA, 14 nt, Homo sapiens
uguuugaacagggc

SEQ ID NO: 2129338 - RNA, 14 nt, Homo sapiens
ucuguuuugcauau

SEQ ID NO: 2129339 - RNA, 17 nt, Homo sapiens
gaguccagaucuugccu

SEQ ID NO: 2129340 - RNA, 16 nt, Homo sapiens
cugacaagauggucca

SEQ ID NO: 2129341 - RNA, 18 nt, Homo sapiens
cauguuuuguauguuaaa

SEQ ID NO: 2129342 - RNA, 13 nt, Homo sapiens
gagugugaugaac

SEQ ID NO: 2129343 - RNA, 18 nt, Homo sapiens
guguuauuauuuugcacu

SEQ ID NO: 2129344 - RNA, 12 nt, Homo sapiens
ggagucagggac

SEQ ID NO: 2129345 - RNA, 23 nt, Homo sapiens
accagagggacacuaggaaucaa

SEQ ID NO: 2129346 - RNA, 20 nt, Homo sapiens
ggccuccuggcccaggugag

SEQ ID NO: 2129347 - RNA, 19 nt, Homo sapiens
ccccaggccuuuuccacuu

SEQ ID NO: 2129348 - RNA, 13 nt, Homo sapiens
cagcugguacuga

SEQ ID NO: 2129349 - RNA, 17 nt, Homo sapiens
auuucaccugugacaaa

SEQ ID NO: 2129350 - RNA, 20 nt, Homo sapiens
ugcagggacuguaaaaccac

SEQ ID NO: 2129351 - RNA, 20 nt, Homo sapiens
gguaggcugucugugccaug

SEQ ID NO: 2129352 - RNA, 14 nt, Homo sapiens
aauccuuguagauc

SEQ ID NO: 2129353 - RNA, 21 nt, Homo sapiens
gaaauauuugucuucucaggc

SEQ ID NO: 2129354 - RNA, 17 nt, Homo sapiens
gcaguuguaccaaguga

SEQ ID NO: 2129355 - RNA, 21 nt, Homo sapiens
ccaguuccucccccaguuccu

SEQ ID NO: 2129356 - RNA, 21 nt, Homo sapiens
aacauuucuagauacuuuuca

SEQ ID NO: 2129357 - RNA, 23 nt, Homo sapiens
ugucccacgugucuuccacuuug

SEQ ID NO: 2129358 - RNA, 14 nt, Homo sapiens
ugcuugauguuaca

SEQ ID NO: 2129359 - RNA, 20 nt, Homo sapiens
accuuuugagcuucauuuca

SEQ ID NO: 2129360 - RNA, 15 nt, Homo sapiens
ggaugggcauggugu

SEQ ID NO: 2129361 - RNA, 13 nt, Homo sapiens
cccuucuuugcag

SEQ ID NO: 2129362 - RNA, 21 nt, Homo sapiens
agcuucuauuagccagucuuu

SEQ ID NO: 2129363 - RNA, 14 nt, Homo sapiens
cuuuagacuaaaga

SEQ ID NO: 2129364 - RNA, 12 nt, Homo sapiens
cuguaaauaucc

SEQ ID NO: 2129365 - RNA, 22 nt, Homo sapiens
ccugggccccucuuauuccucu

SEQ ID NO: 2129366 - RNA, 19 nt, Homo sapiens
auucaaagcccaacugugg

SEQ ID NO: 2129367 - RNA, 15 nt, Homo sapiens
guuaccaaguaugaa

SEQ ID NO: 2129368 - RNA, 15 nt, Homo sapiens
uguaccaaugaugaa

SEQ ID NO: 2129369 - RNA, 15 nt, Homo sapiens
acaagacacauuugu

SEQ ID NO: 2129370 - RNA, 20 nt, Homo sapiens
uugaaagaucaaaagguuaa

SEQ ID NO: 2129371 - RNA, 15 nt, Homo sapiens
gccaggagcugucac

SEQ ID NO: 2129372 - RNA, 23 nt, Homo sapiens
augcuuuugcuaauaccaaaauu

SEQ ID NO: 2129373 - RNA, 23 nt, Homo sapiens
accaugugauuauggacaucgau

SEQ ID NO: 2129374 - RNA, 11 nt, Homo sapiens
caaaauuccaa

SEQ ID NO: 2129375 - RNA, 18 nt, Homo sapiens
uaucacaguauuaucugu

SEQ ID NO: 2129376 - RNA, 17 nt, Homo sapiens
uauucacuaaggacuua

SEQ ID NO: 2129377 - RNA, 23 nt, Homo sapiens
gggggaagacuuuaaaccaccua

SEQ ID NO: 2129378 - RNA, 15 nt, Homo sapiens
uggagguugcaguga

SEQ ID NO: 2129379 - RNA, 21 nt, Homo sapiens
ucaaauauuaucuuuguucuc

SEQ ID NO: 2129380 - RNA, 13 nt, Homo sapiens
auguucuuuggaa

SEQ ID NO: 2129381 - RNA, 18 nt, Homo sapiens
gcuguagaugacuacuug

SEQ ID NO: 2129382 - RNA, 20 nt, Homo sapiens
augccuuccgacaccacugg

SEQ ID NO: 2129383 - RNA, 12 nt, Homo sapiens
ugaaugauuucc

SEQ ID NO: 2129384 - RNA, 23 nt, Homo sapiens
ggucugugagaugcuagaacucc

SEQ ID NO: 2129385 - RNA, 15 nt, Homo sapiens
caaccgccugcagga

SEQ ID NO: 2129386 - RNA, 22 nt, Homo sapiens
agaaggauccuccaaagucaca

SEQ ID NO: 2129387 - RNA, 23 nt, Homo sapiens
uugagaguguuccugagacagaa

SEQ ID NO: 2129388 - RNA, 17 nt, Homo sapiens
uauacuuuuucaugaaa

SEQ ID NO: 2129389 - RNA, 18 nt, Homo sapiens
gggaaggaggguacagcu

SEQ ID NO: 2129390 - RNA, 14 nt, Homo sapiens
ucagggaguuacag

SEQ ID NO: 2129391 - RNA, 13 nt, Homo sapiens
aggauuggggacc

SEQ ID NO: 2129392 - RNA, 17 nt, Homo sapiens
caggcccgcuaggucca

SEQ ID NO: 2129393 - RNA, 17 nt, Homo sapiens
uaaauauuucaggcaua

SEQ ID NO: 2129394 - RNA, 14 nt, Homo sapiens
gcaccuucagacuu

SEQ ID NO: 2129395 - RNA, 16 nt, Homo sapiens
ugggucaauuccuuag

SEQ ID NO: 2129396 - RNA, 19 nt, Homo sapiens
cuacuuuaaauuguggaug

SEQ ID NO: 2129397 - RNA, 23 nt, Homo sapiens
agaagcccuucuaccuuccugca

SEQ ID NO: 2129398 - RNA, 14 nt, Homo sapiens
gcucauaagcaaua

SEQ ID NO: 2129399 - RNA, 18 nt, Homo sapiens
cagcaagugagagcuggg

SEQ ID NO: 2129400 - RNA, 23 nt, Homo sapiens
cacuuuuuuuuuuucugccugag

SEQ ID NO: 2129401 - RNA, 18 nt, Homo sapiens
aaggaaaggcacauguca

SEQ ID NO: 2129402 - RNA, 13 nt, Homo sapiens
ucaugccucugag

SEQ ID NO: 2129403 - RNA, 17 nt, Homo sapiens
ugaucuaccugccucag

SEQ ID NO: 2129404 - RNA, 15 nt, Homo sapiens
ggcacuguccagggc

SEQ ID NO: 2129405 - RNA, 14 nt, Homo sapiens
aauugacugucacg

SEQ ID NO: 2129406 - RNA, 19 nt, Homo sapiens
aucaacauucuugugucug

SEQ ID NO: 2129407 - RNA, 19 nt, Homo sapiens
uauauuccgcacucaagga

SEQ ID NO: 2129408 - RNA, 22 nt, Homo sapiens
cagagcagaugcagagagccau

SEQ ID NO: 2129409 - RNA, 14 nt, Homo sapiens
cuagaggcgagcca

SEQ ID NO: 2129410 - RNA, 23 nt, Homo sapiens
gaaggagcgugcucuacccugug

SEQ ID NO: 2129411 - RNA, 15 nt, Homo sapiens
agaaagcugugggac

SEQ ID NO: 2129412 - RNA, 17 nt, Homo sapiens
caauguuugcuuuucac

SEQ ID NO: 2129413 - RNA, 16 nt, Homo sapiens
auauugaaugccuuau

SEQ ID NO: 2129414 - RNA, 24 nt, Homo sapiens
cucuuccaaguccuuuaucugcac

SEQ ID NO: 2129415 - RNA, 20 nt, Homo sapiens
uccccaacccugagcacucu

SEQ ID NO: 2129416 - RNA, 12 nt, Homo sapiens
ugaccucaagga

SEQ ID NO: 2129417 - RNA, 15 nt, Homo sapiens
uacauucuugcuaau

SEQ ID NO: 2129418 - RNA, 13 nt, Homo sapiens
cuacaaguauuau

SEQ ID NO: 2129419 - RNA, 16 nt, Homo sapiens
uugcauaugucuauau

SEQ ID NO: 2129420 - RNA, 19 nt, Homo sapiens
uugcaguaauuugcaauuu

SEQ ID NO: 2129421 - RNA, 15 nt, Homo sapiens
cuuugccucccucag

SEQ ID NO: 2129422 - RNA, 22 nt, Homo sapiens
auagaauacauggaaacgcaaa

SEQ ID NO: 2129423 - RNA, 20 nt, Homo sapiens
aaugucuuguguauuucucu

SEQ ID NO: 2129424 - RNA, 13 nt, Homo sapiens
agucagcucuucu

SEQ ID NO: 2129425 - RNA, 18 nt, Homo sapiens
aagaguccucugaaugaa

SEQ ID NO: 2129426 - RNA, 23 nt, Homo sapiens
uauaucuuaaugcagacaaacaa

SEQ ID NO: 2129427 - RNA, 22 nt, Homo sapiens
gugaccuuccaagagccugaga

SEQ ID NO: 2129428 - RNA, 19 nt, Homo sapiens
ccacagaaagcuccuucca

SEQ ID NO: 2129429 - RNA, 23 nt, Homo sapiens
gaggacagggcccccacagggga

SEQ ID NO: 2129430 - RNA, 21 nt, Homo sapiens
aucccauuuuuaaagaauuag

SEQ ID NO: 2129431 - RNA, 18 nt, Homo sapiens
acaaauggcuacaucucc

SEQ ID NO: 2129432 - RNA, 15 nt, Homo sapiens
ugaauaggaugauuc

SEQ ID NO: 2129433 - RNA, 23 nt, Homo sapiens
cuuuaaaauaaaaaagcaaaaac

SEQ ID NO: 2129434 - RNA, 12 nt, Homo sapiens
uggaaaccaaau

SEQ ID NO: 2129435 - RNA, 18 nt, Homo sapiens
gcuuggauuucgugugcc

SEQ ID NO: 2129436 - RNA, 15 nt, Homo sapiens
agaaugaacacuccc

SEQ ID NO: 2129437 - RNA, 20 nt, Homo sapiens
ucagccccagcuuaucuccu

SEQ ID NO: 2129438 - RNA, 23 nt, Homo sapiens
cucuaauguacaauaaagcaaug

SEQ ID NO: 2129439 - RNA, 19 nt, Homo sapiens
ucaguacaugccuagaccu

SEQ ID NO: 2129440 - RNA, 12 nt, Homo sapiens
aacuuccaguca

SEQ ID NO: 2129441 - RNA, 20 nt, Homo sapiens
cuucuauuuauuuauuauua

SEQ ID NO: 2129442 - RNA, 19 nt, Homo sapiens
ccaaagcagacagcuccac

SEQ ID NO: 2129443 - RNA, 15 nt, Homo sapiens
uuuccacuccauugu

SEQ ID NO: 2129444 - RNA, 23 nt, Homo sapiens
caguuuaaaagcacgacagugga

SEQ ID NO: 2129445 - RNA, 18 nt, Homo sapiens
augcugggaaugagacau

SEQ ID NO: 2129446 - RNA, 17 nt, Homo sapiens
uuccuugugguuagcaa

SEQ ID NO: 2129447 - RNA, 23 nt, Homo sapiens
cgugcugguccccuccucaguga

SEQ ID NO: 2129448 - RNA, 22 nt, Homo sapiens
cauagggauugucccuguguug

SEQ ID NO: 2129449 - RNA, 19 nt, Homo sapiens
agcucucaauuuuauguau

SEQ ID NO: 2129450 - RNA, 21 nt, Homo sapiens
acauucagugaaaaacuugua

SEQ ID NO: 2129451 - RNA, 16 nt, Homo sapiens
acuuguuccagcucuu

SEQ ID NO: 2129452 - RNA, 23 nt, Homo sapiens
gaggaauuucuugauuaauguug

SEQ ID NO: 2129453 - RNA, 17 nt, Homo sapiens
cacagguagacaguaua

SEQ ID NO: 2129454 - RNA, 17 nt, Homo sapiens
cuacagauguacauuaa

SEQ ID NO: 2129455 - RNA, 20 nt, Homo sapiens
ugcucuuaaaauaucuuccu

SEQ ID NO: 2129456 - RNA, 20 nt, Homo sapiens
agugggaucugucacaccag

SEQ ID NO: 2129457 - RNA, 14 nt, Homo sapiens
ugucaggugugaua

SEQ ID NO: 2129458 - RNA, 15 nt, Homo sapiens
gccccuucucucaau

SEQ ID NO: 2129459 - RNA, 21 nt, Homo sapiens
ucaaggggcuggaaucucaug

SEQ ID NO: 2129460 - RNA, 15 nt, Homo sapiens
aucccaucucuccca

SEQ ID NO: 2129461 - RNA, 13 nt, Homo sapiens
cauuacucugaaa

SEQ ID NO: 2129462 - RNA, 19 nt, Homo sapiens
caaagcacuguuucucuca

SEQ ID NO: 2129463 - RNA, 17 nt, Homo sapiens
agccuauugugccucug

SEQ ID NO: 2129464 - RNA, 15 nt, Homo sapiens
auucuuuugccacau

SEQ ID NO: 2129465 - RNA, 13 nt, Homo sapiens
gcaaacuuauuug

SEQ ID NO: 2129466 - RNA, 12 nt, Homo sapiens
aagcugcuccuu

SEQ ID NO: 2129467 - RNA, 13 nt, Homo sapiens
acaucacagcagc

SEQ ID NO: 2129468 - RNA, 23 nt, Homo sapiens
gcagcucuccccucagagugcaa

SEQ ID NO: 2129469 - RNA, 18 nt, Homo sapiens
agaucuugccuccagaga

SEQ ID NO: 2129470 - RNA, 13 nt, Homo sapiens
cauuccaugguga

SEQ ID NO: 2129471 - RNA, 16 nt, Homo sapiens
ucaagcuuacuacagu

SEQ ID NO: 2129472 - RNA, 20 nt, Homo sapiens
gaggcagguggauugcuuga

SEQ ID NO: 2129473 - RNA, 15 nt, Homo sapiens
aggcuguacauaguc

SEQ ID NO: 2129474 - RNA, 20 nt, Homo sapiens
acccuccugcugagcugccc

SEQ ID NO: 2129475 - RNA, 18 nt, Homo sapiens
auggaaauguagugcucg

SEQ ID NO: 2129476 - RNA, 23 nt, Homo sapiens
ccagagcuuuacagugccacgac

SEQ ID NO: 2129477 - RNA, 23 nt, Homo sapiens
gugggauggggacauuugaacau

SEQ ID NO: 2129478 - RNA, 13 nt, Homo sapiens
aggaggaggacac

SEQ ID NO: 2129479 - RNA, 19 nt, Homo sapiens
agcuuguaaauacuccauu

SEQ ID NO: 2129480 - RNA, 14 nt, Homo sapiens
gcaguacuugcuca

SEQ ID NO: 2129481 - RNA, 16 nt, Homo sapiens
uggggccccucucauc

SEQ ID NO: 2129482 - RNA, 19 nt, Homo sapiens
cagacuuuguguucauuuc

SEQ ID NO: 2129483 - RNA, 19 nt, Homo sapiens
cccagauuccccuguguca

SEQ ID NO: 2129484 - RNA, 15 nt, Homo sapiens
gccagagcaccucag

SEQ ID NO: 2129485 - RNA, 15 nt, Homo sapiens
caaucuuauguuucc

SEQ ID NO: 2129486 - RNA, 14 nt, Homo sapiens
cuaaauguaagaau

SEQ ID NO: 2129487 - RNA, 16 nt, Homo sapiens
guacuuauguugcaca

SEQ ID NO: 2129488 - RNA, 21 nt, Homo sapiens
cuuguaacauccaauaggaau

SEQ ID NO: 2129489 - RNA, 15 nt, Homo sapiens
caggacaggaaaaac

SEQ ID NO: 2129490 - RNA, 19 nt, Homo sapiens
uuccauccugucaccauga

SEQ ID NO: 2129491 - RNA, 14 nt, Homo sapiens
cuuugcauggauuu

SEQ ID NO: 2129492 - RNA, 18 nt, Homo sapiens
auucagggagaauguugu

SEQ ID NO: 2129493 - RNA, 23 nt, Homo sapiens
aacuuuccugacuuacaauacca

SEQ ID NO: 2129494 - RNA, 18 nt, Homo sapiens
aaacuuaccuacugggga

SEQ ID NO: 2129495 - RNA, 20 nt, Homo sapiens
ugguaagaccucugagacca

SEQ ID NO: 2129496 - RNA, 24 nt, Homo sapiens
auaaauuuuuuugcaauccuuucc

SEQ ID NO: 2129497 - RNA, 17 nt, Homo sapiens
gucacagaagcagcuaa

SEQ ID NO: 2129498 - RNA, 14 nt, Homo sapiens
gccgcacccuggcu

SEQ ID NO: 2129499 - RNA, 18 nt, Homo sapiens
guccucauuuacuggauu

SEQ ID NO: 2129500 - RNA, 21 nt, Homo sapiens
auauuuauaaauaugugauua

SEQ ID NO: 2129501 - RNA, 15 nt, Homo sapiens
aaucccaucagguca

SEQ ID NO: 2129502 - RNA, 13 nt, Homo sapiens
ugcaacagcuuuc

SEQ ID NO: 2129503 - RNA, 13 nt, Homo sapiens
cucgagaucccaa

SEQ ID NO: 2129504 - RNA, 14 nt, Homo sapiens
cuguuuuuucucca

SEQ ID NO: 2129505 - RNA, 15 nt, Homo sapiens
agugucccugagcag

SEQ ID NO: 2129506 - RNA, 22 nt, Homo sapiens
uaaacuaagagaaacuguguau

SEQ ID NO: 2129507 - RNA, 17 nt, Homo sapiens
ggagcccagaaaaccuc

SEQ ID NO: 2129508 - RNA, 16 nt, Homo sapiens
cuccuccucagcugca

SEQ ID NO: 2129509 - RNA, 14 nt, Homo sapiens
uauauuuauacucu

SEQ ID NO: 2129510 - RNA, 21 nt, Homo sapiens
aggccugggccgcugccacgu

SEQ ID NO: 2129511 - RNA, 15 nt, Homo sapiens
ccaguauuuaacuuc

SEQ ID NO: 2129512 - RNA, 21 nt, Homo sapiens
aucaaccaacugcacaaucag

SEQ ID NO: 2129513 - RNA, 20 nt, Homo sapiens
cucaaaucaaauacauacaa

SEQ ID NO: 2129514 - RNA, 22 nt, Homo sapiens
ccacuguguuucugugcuccaa

SEQ ID NO: 2129515 - RNA, 12 nt, Homo sapiens
ugcagaaguauu

SEQ ID NO: 2129516 - RNA, 17 nt, Homo sapiens
cuauuuuuaaccaaaua

SEQ ID NO: 2129517 - RNA, 20 nt, Homo sapiens
aguaccaugggcuacagugu

SEQ ID NO: 2129518 - RNA, 23 nt, Homo sapiens
cuguugacaauuugccauagcag

SEQ ID NO: 2129519 - RNA, 15 nt, Homo sapiens
acagccuuuucccuu

SEQ ID NO: 2129520 - RNA, 14 nt, Homo sapiens
uuaaacaacagcuc

SEQ ID NO: 2129521 - RNA, 21 nt, Homo sapiens
acauuuggaaauguggucauc

SEQ ID NO: 2129522 - RNA, 21 nt, Homo sapiens
auuaauauccaauugcugcuu

SEQ ID NO: 2129523 - RNA, 22 nt, Homo sapiens
guagauguauuuucaauaaaga

SEQ ID NO: 2129524 - RNA, 17 nt, Homo sapiens
auggcaaaugcugugaa

SEQ ID NO: 2129525 - RNA, 17 nt, Homo sapiens
uuacaggcgugauccac

SEQ ID NO: 2129526 - RNA, 14 nt, Homo sapiens
uaguguggcugugg

SEQ ID NO: 2129527 - RNA, 13 nt, Homo sapiens
auuccucuuugcc

SEQ ID NO: 2129528 - RNA, 15 nt, Homo sapiens
acuugcaucguggag

SEQ ID NO: 2129529 - RNA, 18 nt, Homo sapiens
uauuucugaaacaauuaa

SEQ ID NO: 2129530 - RNA, 18 nt, Homo sapiens
uauuaaaccuuuccauuu

SEQ ID NO: 2129531 - RNA, 21 nt, Homo sapiens
aauguacugaauucuuuaucc

SEQ ID NO: 2129532 - RNA, 23 nt, Homo sapiens
aaaaaugguuaaugacaauucag

SEQ ID NO: 2129533 - RNA, 20 nt, Homo sapiens
ucagggagaggucaccagcu

SEQ ID NO: 2129534 - RNA, 16 nt, Homo sapiens
auucuuaaaaugcaau

SEQ ID NO: 2129535 - RNA, 19 nt, Homo sapiens
gaauacaaacaccuggacu

SEQ ID NO: 2129536 - RNA, 16 nt, Homo sapiens
caggaggaauacugaa

SEQ ID NO: 2129537 - RNA, 17 nt, Homo sapiens
gaucccaauaacccagc

SEQ ID NO: 2129538 - RNA, 18 nt, Homo sapiens
ggaacccaucacuguguc

SEQ ID NO: 2129539 - RNA, 15 nt, Homo sapiens
gauugcacuagagaa

SEQ ID NO: 2129540 - RNA, 15 nt, Homo sapiens
gauuuugucuaccau

SEQ ID NO: 2129541 - RNA, 15 nt, Homo sapiens
uuuuuguaucagaau

SEQ ID NO: 2129542 - RNA, 12 nt, Homo sapiens
auagcugcauuu

SEQ ID NO: 2129543 - RNA, 23 nt, Homo sapiens
ccccuaggacucaggccugccaa

SEQ ID NO: 2129544 - RNA, 16 nt, Homo sapiens
guguuucuugccucau

SEQ ID NO: 2129545 - RNA, 13 nt, Homo sapiens
agaaaaauacuuu

SEQ ID NO: 2129546 - RNA, 21 nt, Homo sapiens
cauuuaauacagauaaguguu

SEQ ID NO: 2129547 - RNA, 15 nt, Homo sapiens
cuugcccuaagcaga

SEQ ID NO: 2129548 - RNA, 23 nt, Homo sapiens
augacuccaccuucucaccugcu

SEQ ID NO: 2129549 - RNA, 15 nt, Homo sapiens
acaaugcaugugcug

SEQ ID NO: 2129550 - RNA, 16 nt, Homo sapiens
cagugagcugcacuga

SEQ ID NO: 2129551 - RNA, 15 nt, Homo sapiens
uuuuagcugguguca

SEQ ID NO: 2129552 - RNA, 15 nt, Homo sapiens
cuuucugcuuugcac

SEQ ID NO: 2129553 - RNA, 15 nt, Homo sapiens
gagccggagcucaug

SEQ ID NO: 2129554 - RNA, 21 nt, Homo sapiens
uaucucaugccagugccuuau

SEQ ID NO: 2129555 - RNA, 13 nt, Homo sapiens
ggcauuugcagga

SEQ ID NO: 2129556 - RNA, 17 nt, Homo sapiens
ugugacugccaggauaa

SEQ ID NO: 2129557 - RNA, 20 nt, Homo sapiens
uugucucgcuauacugcacu

SEQ ID NO: 2129558 - RNA, 15 nt, Homo sapiens
ucacaccaguccaaa

SEQ ID NO: 2129559 - RNA, 19 nt, Homo sapiens
ugugguucgaaggauaugg

SEQ ID NO: 2129560 - RNA, 17 nt, Homo sapiens
uuuaaucccagcacuuu

SEQ ID NO: 2129561 - RNA, 20 nt, Homo sapiens
uuuacauuacugauuuccag

SEQ ID NO: 2129562 - RNA, 21 nt, Homo sapiens
ucagcaggcacuguacugggu

SEQ ID NO: 2129563 - RNA, 23 nt, Homo sapiens
aauugguaaaaacagcagcucau

SEQ ID NO: 2129564 - RNA, 16 nt, Homo sapiens
cugcaggcggggcucc

SEQ ID NO: 2129565 - RNA, 23 nt, Homo sapiens
gaaaucaaaagauaguugauucu

SEQ ID NO: 2129566 - RNA, 16 nt, Homo sapiens
uuccauucacaccagc

SEQ ID NO: 2129567 - RNA, 16 nt, Homo sapiens
auacuccacugcucau

SEQ ID NO: 2129568 - RNA, 16 nt, Homo sapiens
cuaagcugugugcagg

SEQ ID NO: 2129569 - RNA, 18 nt, Homo sapiens
acuccuacuuuucauccu

SEQ ID NO: 2129570 - RNA, 16 nt, Homo sapiens
cucccagcguguguau

SEQ ID NO: 2129571 - RNA, 15 nt, Homo sapiens
ucacucauagccacu

SEQ ID NO: 2129572 - RNA, 15 nt, Homo sapiens
ggguggcccacugag

SEQ ID NO: 2129573 - RNA, 14 nt, Homo sapiens
gaauguuugccucu

SEQ ID NO: 2129574 - RNA, 13 nt, Homo sapiens
uucuuaaccaucu

SEQ ID NO: 2129575 - RNA, 15 nt, Homo sapiens
acauuggugcaaaga

SEQ ID NO: 2129576 - RNA, 14 nt, Homo sapiens
aucuuguuaauguc

SEQ ID NO: 2129577 - RNA, 23 nt, Homo sapiens
acagccccuuaagcaugcuucua

SEQ ID NO: 2129578 - RNA, 16 nt, Homo sapiens
cuuuuaaacucuagau

SEQ ID NO: 2129579 - RNA, 16 nt, Homo sapiens
cauuaaaucacuugaa

SEQ ID NO: 2129580 - RNA, 17 nt, Homo sapiens
gggagaggugauucuca

SEQ ID NO: 2129581 - RNA, 17 nt, Homo sapiens
ucaagaucccauuugaa

SEQ ID NO: 2129582 - RNA, 22 nt, Homo sapiens
uccccuuguguuugaacagggc

SEQ ID NO: 2129583 - RNA, 16 nt, Homo sapiens
acuauuaaagugccau

SEQ ID NO: 2129584 - RNA, 14 nt, Homo sapiens
aaggagacuucugu

SEQ ID NO: 2129585 - RNA, 19 nt, Homo sapiens
cuauucccacuuucauuca

SEQ ID NO: 2129586 - RNA, 23 nt, Homo sapiens
cgcacauguauugcuguuuuucu

SEQ ID NO: 2129587 - RNA, 13 nt, Homo sapiens
caagucaccugca

SEQ ID NO: 2129588 - RNA, 17 nt, Homo sapiens
aguucuuugggccagac

SEQ ID NO: 2129589 - RNA, 22 nt, Homo sapiens
cauagugaccaacauagugaaa

SEQ ID NO: 2129590 - RNA, 19 nt, Homo sapiens
guugcaggcagugucuuaa

SEQ ID NO: 2129591 - RNA, 15 nt, Homo sapiens
aaaaugcaccaauca

SEQ ID NO: 2129592 - RNA, 16 nt, Homo sapiens
gucuccagacucucac

SEQ ID NO: 2129593 - RNA, 15 nt, Homo sapiens
accuuccagucuuuu

SEQ ID NO: 2129594 - RNA, 21 nt, Homo sapiens
uaugggaaaugagaggcauuu

SEQ ID NO: 2129595 - RNA, 15 nt, Homo sapiens
gcaaguuaugaaaua

SEQ ID NO: 2129596 - RNA, 20 nt, Homo sapiens
acacagguggggacugggca

SEQ ID NO: 2129597 - RNA, 22 nt, Homo sapiens
aaucuauaacuacauauugaau

SEQ ID NO: 2129598 - RNA, 20 nt, Homo sapiens
cucaaaauagggacuaucua

SEQ ID NO: 2129599 - RNA, 14 nt, Homo sapiens
aaacugaggugcaa

SEQ ID NO: 2129600 - RNA, 21 nt, Homo sapiens
auauauggaccuagcuugagg

SEQ ID NO: 2129601 - RNA, 23 nt, Homo sapiens
cagaccuaauaucauuuuauuca

SEQ ID NO: 2129602 - RNA, 14 nt, Homo sapiens
aaacuuugucaugg

SEQ ID NO: 2129603 - RNA, 19 nt, Homo sapiens
agccuccagggcauugcuc

SEQ ID NO: 2129604 - RNA, 14 nt, Homo sapiens
ugauccauuaucua

SEQ ID NO: 2129605 - RNA, 22 nt, Homo sapiens
cagaugggcauaugugucagug

SEQ ID NO: 2129606 - RNA, 14 nt, Homo sapiens
guauauauaaucua

SEQ ID NO: 2129607 - RNA, 13 nt, Homo sapiens
aaacuccuuguua

SEQ ID NO: 2129608 - RNA, 12 nt, Homo sapiens
cuggccaucucc

SEQ ID NO: 2129609 - RNA, 16 nt, Homo sapiens
cauaauaaaaaggcaa

SEQ ID NO: 2129610 - RNA, 15 nt, Homo sapiens
gcuuugguaaucucu

SEQ ID NO: 2129611 - RNA, 14 nt, Homo sapiens
aaggacuccaaagc

SEQ ID NO: 2129612 - RNA, 17 nt, Homo sapiens
uauugccuugugaauuu

SEQ ID NO: 2129613 - RNA, 18 nt, Homo sapiens
acacgccuucaugccagu

SEQ ID NO: 2129614 - RNA, 18 nt, Homo sapiens
acuuaugauuucaugugc

SEQ ID NO: 2129615 - RNA, 17 nt, Homo sapiens
aucuuccaaaugcaauu

SEQ ID NO: 2129616 - RNA, 12 nt, Homo sapiens
uaugaacacuug

SEQ ID NO: 2129617 - RNA, 17 nt, Homo sapiens
gaugauuucucaaaaau

SEQ ID NO: 2129618 - RNA, 17 nt, Homo sapiens
accucaaggccuacuga

SEQ ID NO: 2129619 - RNA, 13 nt, Homo sapiens
uaauucuaauaau

SEQ ID NO: 2129620 - RNA, 13 nt, Homo sapiens
aacuccuauucac

SEQ ID NO: 2129621 - RNA, 20 nt, Homo sapiens
caccuaccugccggacacag

SEQ ID NO: 2129622 - RNA, 21 nt, Homo sapiens
agaauuaugauggaagacagg

SEQ ID NO: 2129623 - RNA, 14 nt, Homo sapiens
aaguuuuacauugu

SEQ ID NO: 2129624 - RNA, 14 nt, Homo sapiens
aauuaaaucugaau

SEQ ID NO: 2129625 - RNA, 14 nt, Homo sapiens
uacaguuauguggu

SEQ ID NO: 2129626 - RNA, 20 nt, Homo sapiens
augggaaggugccacuggua

SEQ ID NO: 2129627 - RNA, 16 nt, Homo sapiens
ucuaccauuugaauuu

SEQ ID NO: 2129628 - RNA, 22 nt, Homo sapiens
ggccucuuccuugcugugucau

SEQ ID NO: 2129629 - RNA, 14 nt, Homo sapiens
ugaccuugcugaug

SEQ ID NO: 2129630 - RNA, 19 nt, Homo sapiens
cagguucaagcgauucuca

SEQ ID NO: 2129631 - RNA, 19 nt, Homo sapiens
gcauugucccugugccuaa

SEQ ID NO: 2129632 - RNA, 23 nt, Homo sapiens
uauucuaaaaaaauaaacaaagu

SEQ ID NO: 2129633 - RNA, 14 nt, Homo sapiens
ucaggggacucagc

SEQ ID NO: 2129634 - RNA, 18 nt, Homo sapiens
caucaugaagaagcucuu

SEQ ID NO: 2129635 - RNA, 22 nt, Homo sapiens
uagagcagaacugaacuuauua

SEQ ID NO: 2129636 - RNA, 13 nt, Homo sapiens
guucuucauuugg

SEQ ID NO: 2129637 - RNA, 16 nt, Homo sapiens
aaaugaaauacuugac

SEQ ID NO: 2129638 - RNA, 20 nt, Homo sapiens
cagcccaccccugugcccac

SEQ ID NO: 2129639 - RNA, 19 nt, Homo sapiens
caggaaacgagacuuucca

SEQ ID NO: 2129640 - RNA, 21 nt, Homo sapiens
agccaggguggucuugaucuc

SEQ ID NO: 2129641 - RNA, 15 nt, Homo sapiens
uuauccacaaaguac

SEQ ID NO: 2129642 - RNA, 18 nt, Homo sapiens
uaaacacggggcuugcaa

SEQ ID NO: 2129643 - RNA, 17 nt, Homo sapiens
uuaaacuuugaagcaac

SEQ ID NO: 2129644 - RNA, 15 nt, Homo sapiens
uuaaagcugcuguca

SEQ ID NO: 2129645 - RNA, 12 nt, Homo sapiens
caguucuacuca

SEQ ID NO: 2129646 - RNA, 16 nt, Homo sapiens
gauggaggaugcugcc

SEQ ID NO: 2129647 - RNA, 14 nt, Homo sapiens
ccucucaacugccu

SEQ ID NO: 2129648 - RNA, 13 nt, Homo sapiens
cguucguauuuau

SEQ ID NO: 2129649 - RNA, 19 nt, Homo sapiens
cccaucccaccccuccauu

SEQ ID NO: 2129650 - RNA, 15 nt, Homo sapiens
caguccggugccuuc

SEQ ID NO: 2129651 - RNA, 20 nt, Homo sapiens
uuugaggaacauuauuuaau

SEQ ID NO: 2129652 - RNA, 15 nt, Homo sapiens
aucacaaaccaagcc

SEQ ID NO: 2129653 - RNA, 14 nt, Homo sapiens
uaauguugaugaau

SEQ ID NO: 2129654 - RNA, 15 nt, Homo sapiens
uauaacuggaaagaa

SEQ ID NO: 2129655 - RNA, 14 nt, Homo sapiens
ugcauggacucgua

SEQ ID NO: 2129656 - RNA, 13 nt, Homo sapiens
aaaagugaaucuu

SEQ ID NO: 2129657 - RNA, 16 nt, Homo sapiens
ucaaguugugcuuguu

SEQ ID NO: 2129658 - RNA, 23 nt, Homo sapiens
cuaaaaaucaaauaagcuaauaa

SEQ ID NO: 2129659 - RNA, 15 nt, Homo sapiens
ucagugauggaauau

SEQ ID NO: 2129660 - RNA, 21 nt, Homo sapiens
gcccagcuuucaaaggacaaa

SEQ ID NO: 2129661 - RNA, 22 nt, Homo sapiens
gagccucagaagaaaacaaagu

SEQ ID NO: 2129662 - RNA, 21 nt, Homo sapiens
gagagcuuaagugacuuccuc

SEQ ID NO: 2129663 - RNA, 15 nt, Homo sapiens
cuucuuuugaacugu

SEQ ID NO: 2129664 - RNA, 13 nt, Homo sapiens
cccaguguuccau

SEQ ID NO: 2129665 - RNA, 19 nt, Homo sapiens
gccaggacagcagcacucc

SEQ ID NO: 2129666 - RNA, 22 nt, Homo sapiens
uuaaauaaaccuuuuuggacac

SEQ ID NO: 2129667 - RNA, 21 nt, Homo sapiens
cuggagucgggacuaacccag

SEQ ID NO: 2129668 - RNA, 14 nt, Homo sapiens
cucaggucccugca

SEQ ID NO: 2129669 - RNA, 18 nt, Homo sapiens
gaaauuugauaaacugaa

SEQ ID NO: 2129670 - RNA, 19 nt, Homo sapiens
ucuauccaaagaacuugau

SEQ ID NO: 2129671 - RNA, 23 nt, Homo sapiens
ccuuccccacaauaggcuuagug

SEQ ID NO: 2129672 - RNA, 14 nt, Homo sapiens
ccaauaaaacaaga

SEQ ID NO: 2129673 - RNA, 13 nt, Homo sapiens
gaaagggacugag

SEQ ID NO: 2129674 - RNA, 17 nt, Homo sapiens
acacaacacacaauuua

SEQ ID NO: 2129675 - RNA, 20 nt, Homo sapiens
uguuuuacccuauacaucca

SEQ ID NO: 2129676 - RNA, 14 nt, Homo sapiens
acaucucuguagau

SEQ ID NO: 2129677 - RNA, 14 nt, Homo sapiens
ucagcagaugccag

SEQ ID NO: 2129678 - RNA, 20 nt, Homo sapiens
ucauuuagugacuuaauucu

SEQ ID NO: 2129679 - RNA, 14 nt, Homo sapiens
caaaaagcauguga

SEQ ID NO: 2129680 - RNA, 13 nt, Homo sapiens
augaauugucuuc

SEQ ID NO: 2129681 - RNA, 21 nt, Homo sapiens
uuuaagcacccuagaggacua

SEQ ID NO: 2129682 - RNA, 15 nt, Homo sapiens
ugccugggacacugc

SEQ ID NO: 2129683 - RNA, 15 nt, Homo sapiens
ugcuugggacauugc

SEQ ID NO: 2129684 - RNA, 12 nt, Homo sapiens
cugucacaccca

SEQ ID NO: 2129685 - RNA, 16 nt, Homo sapiens
ucauucuguaugugac

SEQ ID NO: 2129686 - RNA, 12 nt, Homo sapiens
auugacucugca

SEQ ID NO: 2129687 - RNA, 20 nt, Homo sapiens
aucagugaagccaaagggac

SEQ ID NO: 2129688 - RNA, 20 nt, Homo sapiens
gcccaagguccccguggaug

SEQ ID NO: 2129689 - RNA, 23 nt, Homo sapiens
uaguucaaaugaugaagaccaaa

SEQ ID NO: 2129690 - RNA, 21 nt, Homo sapiens
uccacaccagcugcugcugga

SEQ ID NO: 2129691 - RNA, 15 nt, Homo sapiens
caccuuuagguucuu

SEQ ID NO: 2129692 - RNA, 14 nt, Homo sapiens
guaauauuacuuua

SEQ ID NO: 2129693 - RNA, 18 nt, Homo sapiens
auagaauccaguuugcaa

SEQ ID NO: 2129694 - RNA, 15 nt, Homo sapiens
ugacagucuccccca

SEQ ID NO: 2129695 - RNA, 16 nt, Homo sapiens
uggugucauuuaguaa

SEQ ID NO: 2129696 - RNA, 14 nt, Homo sapiens
caguaugauaucau

SEQ ID NO: 2129697 - RNA, 12 nt, Homo sapiens
ucagacaaauuc

SEQ ID NO: 2129698 - RNA, 19 nt, Homo sapiens
uggucacagccaugaaguc

SEQ ID NO: 2129699 - RNA, 18 nt, Homo sapiens
agccuggggcaucccaga

SEQ ID NO: 2129700 - RNA, 20 nt, Homo sapiens
aguuagcauaauacagaagu

SEQ ID NO: 2129701 - RNA, 21 nt, Homo sapiens
aaacauugaaguaaugaauuu

SEQ ID NO: 2129702 - RNA, 21 nt, Homo sapiens
aaugaaacaagcuuacaaaga

SEQ ID NO: 2129703 - RNA, 17 nt, Homo sapiens
cugaggguguuucuucc

SEQ ID NO: 2129704 - RNA, 14 nt, Homo sapiens
uuuucagcaaagaa

SEQ ID NO: 2129705 - RNA, 16 nt, Homo sapiens
uuauacuccauacaua

SEQ ID NO: 2129706 - RNA, 23 nt, Homo sapiens
uccuuugucauuauuagucuuca

SEQ ID NO: 2129707 - RNA, 20 nt, Homo sapiens
uucuuugcugcagucaucua

SEQ ID NO: 2129708 - RNA, 18 nt, Homo sapiens
uuugaucuuuguuuaaau

SEQ ID NO: 2129709 - RNA, 16 nt, Homo sapiens
gccuugccacacucuu

SEQ ID NO: 2129710 - RNA, 11 nt, Homo sapiens
ucacucaggcu

SEQ ID NO: 2129711 - RNA, 16 nt, Homo sapiens
caucuugcauuaugca

SEQ ID NO: 2129712 - RNA, 22 nt, Homo sapiens
aaaauaaaaaagaucuccaagc

SEQ ID NO: 2129713 - RNA, 21 nt, Homo sapiens
gaaaaaucggcuuaccauuaa

SEQ ID NO: 2129714 - RNA, 23 nt, Homo sapiens
gcacaacacacuuuggucauuuc

SEQ ID NO: 2129715 - RNA, 16 nt, Homo sapiens
gucauuauguagcugu

SEQ ID NO: 2129716 - RNA, 16 nt, Homo sapiens
gaguugcgcugggaga

SEQ ID NO: 2129717 - RNA, 18 nt, Homo sapiens
auacccaguggaauucca

SEQ ID NO: 2129718 - RNA, 22 nt, Homo sapiens
aauaugcagaauggcauuugca

SEQ ID NO: 2129719 - RNA, 20 nt, Homo sapiens
uucuuuauugcaucuguuau

SEQ ID NO: 2129720 - RNA, 23 nt, Homo sapiens
cagugaguuggggcgacugugaa

SEQ ID NO: 2129721 - RNA, 13 nt, Homo sapiens
ggcauugaaugac

SEQ ID NO: 2129722 - RNA, 22 nt, Homo sapiens
ugcagucuuuugcugugcugua

SEQ ID NO: 2129723 - RNA, 23 nt, Homo sapiens
cguuuccuuucauuuacuguggc

SEQ ID NO: 2129724 - RNA, 15 nt, Homo sapiens
accacccaaaaucau

SEQ ID NO: 2129725 - RNA, 16 nt, Homo sapiens
aauauaaaaugaguag

SEQ ID NO: 2129726 - RNA, 17 nt, Homo sapiens
ggcugaagucagcucag

SEQ ID NO: 2129727 - RNA, 17 nt, Homo sapiens
ggccugaccuggcacag

SEQ ID NO: 2129728 - RNA, 20 nt, Homo sapiens
uggugaaaccguaucucuaa

SEQ ID NO: 2129729 - RNA, 20 nt, Homo sapiens
cuuuauguuacuacaugcac

SEQ ID NO: 2129730 - RNA, 14 nt, Homo sapiens
gaaauagaacuaca

SEQ ID NO: 2129731 - RNA, 19 nt, Homo sapiens
cucaacaauaaaacauuau

SEQ ID NO: 2129732 - RNA, 22 nt, Homo sapiens
cuggcaacaaaaaguaaugaag

SEQ ID NO: 2129733 - RNA, 13 nt, Homo sapiens
caaaagaagacaa

SEQ ID NO: 2129734 - RNA, 23 nt, Homo sapiens
cuacaauucacauccccaaaggu

SEQ ID NO: 2129735 - RNA, 21 nt, Homo sapiens
cuguagcaccagagaauccau

SEQ ID NO: 2129736 - RNA, 10 nt, Homo sapiens
agcaccucau

SEQ ID NO: 2129737 - RNA, 11 nt, Homo sapiens
agcccuaggcu

SEQ ID NO: 2129738 - RNA, 20 nt, Homo sapiens
uauaccuuuuguuaccacag

SEQ ID NO: 2129739 - RNA, 16 nt, Homo sapiens
guuguguucuguugaa

SEQ ID NO: 2129740 - RNA, 18 nt, Homo sapiens
guccucaucucuacccau

SEQ ID NO: 2129741 - RNA, 19 nt, Homo sapiens
ggauagaggguacuugaau

SEQ ID NO: 2129742 - RNA, 13 nt, Homo sapiens
gccugacaggcug

SEQ ID NO: 2129743 - RNA, 22 nt, Homo sapiens
acucuuccaucagagaugggaa

SEQ ID NO: 2129744 - RNA, 16 nt, Homo sapiens
uugagcaccuacugug

SEQ ID NO: 2129745 - RNA, 19 nt, Homo sapiens
uggagcuugaaauaguguc

SEQ ID NO: 2129746 - RNA, 22 nt, Homo sapiens
gcuuguccccuccucacucccu

SEQ ID NO: 2129747 - RNA, 21 nt, Homo sapiens
cucaacugggaaaccccugaa

SEQ ID NO: 2129748 - RNA, 14 nt, Homo sapiens
ugccgauaucuuca

SEQ ID NO: 2129749 - RNA, 16 nt, Homo sapiens
cauuuucaucacuggg

SEQ ID NO: 2129750 - RNA, 22 nt, Homo sapiens
augccgauauacucuagaugaa

SEQ ID NO: 2129751 - RNA, 18 nt, Homo sapiens
ugcaucccugcagcucaa

SEQ ID NO: 2129752 - RNA, 14 nt, Homo sapiens
ugaaacaucauuuc

SEQ ID NO: 2129753 - RNA, 15 nt, Homo sapiens
uaugcagauacuuau

SEQ ID NO: 2129754 - RNA, 23 nt, Homo sapiens
augugaauuauuuuaaaggcaaa

SEQ ID NO: 2129755 - RNA, 21 nt, Homo sapiens
agccuggaucuguguguaugu

SEQ ID NO: 2129756 - RNA, 14 nt, Homo sapiens
uggacccauugcca

SEQ ID NO: 2129757 - RNA, 21 nt, Homo sapiens
ucuuugggacaccucagaaaa

SEQ ID NO: 2129758 - RNA, 16 nt, Homo sapiens
aggauguuuuucauga

SEQ ID NO: 2129759 - RNA, 14 nt, Homo sapiens
uccuguaagaccuu

SEQ ID NO: 2129760 - RNA, 22 nt, Homo sapiens
uuaaucaaucuuugugccucaa

SEQ ID NO: 2129761 - RNA, 22 nt, Homo sapiens
gaacagauggggucugugacug

SEQ ID NO: 2129762 - RNA, 18 nt, Homo sapiens
cucccuggaugacauuaa

SEQ ID NO: 2129763 - RNA, 22 nt, Homo sapiens
agccuaaugagagugcacugcu

SEQ ID NO: 2129764 - RNA, 12 nt, Homo sapiens
ggaggcaccugg

SEQ ID NO: 2129765 - RNA, 14 nt, Homo sapiens
cuccacaaagcaaa

SEQ ID NO: 2129766 - RNA, 22 nt, Homo sapiens
cuuuaaucuguuuuauaccuug

SEQ ID NO: 2129767 - RNA, 18 nt, Homo sapiens
gagcaccuggacauguca

SEQ ID NO: 2129768 - RNA, 21 nt, Homo sapiens
augcccacaacuugucaccca

SEQ ID NO: 2129769 - RNA, 16 nt, Homo sapiens
uugacuugaaggcagu

SEQ ID NO: 2129770 - RNA, 16 nt, Homo sapiens
cucuuaguaacauaga

SEQ ID NO: 2129771 - RNA, 21 nt, Homo sapiens
agguaucaguugcaauaauac

SEQ ID NO: 2129772 - RNA, 16 nt, Homo sapiens
caaaugcuauauugca

SEQ ID NO: 2129773 - RNA, 17 nt, Homo sapiens
uaauuuuaaccaaucag

SEQ ID NO: 2129774 - RNA, 13 nt, Homo sapiens
ugaaacagcugcc

SEQ ID NO: 2129775 - RNA, 23 nt, Homo sapiens
cauuucucaucaguaguucacau

SEQ ID NO: 2129776 - RNA, 16 nt, Homo sapiens
caggcacccucaggga

SEQ ID NO: 2129777 - RNA, 20 nt, Homo sapiens
cucagcugguuacucagggu

SEQ ID NO: 2129778 - RNA, 15 nt, Homo sapiens
ugacucaguauaggu

SEQ ID NO: 2129779 - RNA, 20 nt, Homo sapiens
agcagggaguuagcacugaa

SEQ ID NO: 2129780 - RNA, 18 nt, Homo sapiens
ucauucuaacugcacuuu

SEQ ID NO: 2129781 - RNA, 15 nt, Homo sapiens
aaagacuacacuguu

SEQ ID NO: 2129782 - RNA, 15 nt, Homo sapiens
gugggcauugcaaag

SEQ ID NO: 2129783 - RNA, 20 nt, Homo sapiens
auucaggaugguuucuuuaa

SEQ ID NO: 2129784 - RNA, 18 nt, Homo sapiens
agaauuaaaaaagcauac

SEQ ID NO: 2129785 - RNA, 16 nt, Homo sapiens
gaucuuucuuuuccca

SEQ ID NO: 2129786 - RNA, 19 nt, Homo sapiens
caucuaccugagucccaaa

SEQ ID NO: 2129787 - RNA, 14 nt, Homo sapiens
agcaaucaagcacc

SEQ ID NO: 2129788 - RNA, 14 nt, Homo sapiens
ccugaucaccugcc

SEQ ID NO: 2129789 - RNA, 15 nt, Homo sapiens
acauucacucagaga

SEQ ID NO: 2129790 - RNA, 14 nt, Homo sapiens
ccucugacaaagcc

SEQ ID NO: 2129791 - RNA, 17 nt, Homo sapiens
ucaucaggcagcccaaa

SEQ ID NO: 2129792 - RNA, 14 nt, Homo sapiens
acaaaugacaucaa

SEQ ID NO: 2129793 - RNA, 19 nt, Homo sapiens
ugccuacuuuuggccucau

SEQ ID NO: 2129794 - RNA, 22 nt, Homo sapiens
uuaauaaagcgaaaaacucaac

SEQ ID NO: 2129795 - RNA, 19 nt, Homo sapiens
uuugcagucaguucauccc

SEQ ID NO: 2129796 - RNA, 15 nt, Homo sapiens
uggggaggacaggga

SEQ ID NO: 2129797 - RNA, 14 nt, Homo sapiens
aguaugcuugcucu

SEQ ID NO: 2129798 - RNA, 16 nt, Homo sapiens
acacauaaacaccauu

SEQ ID NO: 2129799 - RNA, 17 nt, Homo sapiens
cuccauugcauucaugu

SEQ ID NO: 2129800 - RNA, 21 nt, Homo sapiens
auggcauaggccuuagcagua

SEQ ID NO: 2129801 - RNA, 16 nt, Homo sapiens
aucaaccugccagcug

SEQ ID NO: 2129802 - RNA, 18 nt, Homo sapiens
uaugucauauuuugccac

SEQ ID NO: 2129803 - RNA, 17 nt, Homo sapiens
cauguugcccagaauuu

SEQ ID NO: 2129804 - RNA, 12 nt, Homo sapiens
ugguagcucuga

SEQ ID NO: 2129805 - RNA, 17 nt, Homo sapiens
ggacagcaucaaagaga

SEQ ID NO: 2129806 - RNA, 12 nt, Homo sapiens
acugucaugccc

SEQ ID NO: 2129807 - RNA, 12 nt, Homo sapiens
acccucaugcug

SEQ ID NO: 2129808 - RNA, 13 nt, Homo sapiens
agucugauuuaau

SEQ ID NO: 2129809 - RNA, 21 nt, Homo sapiens
gggcccaggucagccacuguu

SEQ ID NO: 2129810 - RNA, 21 nt, Homo sapiens
ucuucaagaucccauuugaau

SEQ ID NO: 2129811 - RNA, 20 nt, Homo sapiens
acaauuuauaauuacaauau

SEQ ID NO: 2129812 - RNA, 13 nt, Homo sapiens
aaggaaagccagg

SEQ ID NO: 2129813 - RNA, 19 nt, Homo sapiens
acugcggucagauguggcu

SEQ ID NO: 2129814 - RNA, 14 nt, Homo sapiens
caggguagugcagg

SEQ ID NO: 2129815 - RNA, 23 nt, Homo sapiens
uuuaaccuuccaagacugaagac

SEQ ID NO: 2129816 - RNA, 19 nt, Homo sapiens
agugaacaccguccucgau

SEQ ID NO: 2129817 - RNA, 21 nt, Homo sapiens
uggcccgagagcugggacuca

SEQ ID NO: 2129818 - RNA, 17 nt, Homo sapiens
aauaaaguuuccauuag

SEQ ID NO: 2129819 - RNA, 13 nt, Homo sapiens
uacauggugcugg

SEQ ID NO: 2129820 - RNA, 18 nt, Homo sapiens
uggcccccaccgcugugg

SEQ ID NO: 2129821 - RNA, 21 nt, Homo sapiens
ugcccacgucccgggcacugu

SEQ ID NO: 2129822 - RNA, 23 nt, Homo sapiens
ggacgccugcaggagagagcagc

SEQ ID NO: 2129823 - RNA, 14 nt, Homo sapiens
aauucuucugucaa

SEQ ID NO: 2129824 - RNA, 14 nt, Homo sapiens
uaacuauaaucucu

SEQ ID NO: 2129825 - RNA, 13 nt, Homo sapiens
uaaaugaacaaga

SEQ ID NO: 2129826 - RNA, 12 nt, Homo sapiens
gaucccaugagc

SEQ ID NO: 2129827 - RNA, 16 nt, Homo sapiens
ucuaacaaaaacuaca

SEQ ID NO: 2129828 - RNA, 12 nt, Homo sapiens
aaaaauaguaaa

SEQ ID NO: 2129829 - RNA, 16 nt, Homo sapiens
caggagguacugugag

SEQ ID NO: 2129830 - RNA, 19 nt, Homo sapiens
uaguugggauuacagguga

SEQ ID NO: 2129831 - RNA, 14 nt, Homo sapiens
uauaggucauggga

SEQ ID NO: 2129832 - RNA, 10 nt, Homo sapiens
uauacuguaa

SEQ ID NO: 2129833 - RNA, 12 nt, Homo sapiens
auguccuauuac

SEQ ID NO: 2129834 - RNA, 19 nt, Homo sapiens
uaauuuucuacaaccuaag

SEQ ID NO: 2129835 - RNA, 19 nt, Homo sapiens
uggauuucuuagagauuaa

SEQ ID NO: 2129836 - RNA, 19 nt, Homo sapiens
uauggagugcaccaaagag

SEQ ID NO: 2129837 - RNA, 19 nt, Homo sapiens
aggggcguucucccaaaga

SEQ ID NO: 2129838 - RNA, 14 nt, Homo sapiens
uaagcccagcauuu

SEQ ID NO: 2129839 - RNA, 15 nt, Homo sapiens
agcaaagcaaugcac

SEQ ID NO: 2129840 - RNA, 13 nt, Homo sapiens
ucaucuguacaua

SEQ ID NO: 2129841 - RNA, 21 nt, Homo sapiens
aacuaauaaucaccauaugcu

SEQ ID NO: 2129842 - RNA, 12 nt, Homo sapiens
uguagcucucug

SEQ ID NO: 2129843 - RNA, 16 nt, Homo sapiens
ucagauggcaaugggu

SEQ ID NO: 2129844 - RNA, 13 nt, Homo sapiens
uuuuaacuuucua

SEQ ID NO: 2129845 - RNA, 13 nt, Homo sapiens
gcuuuacugccuu

SEQ ID NO: 2129846 - RNA, 14 nt, Homo sapiens
ucagagcagugacc

SEQ ID NO: 2129847 - RNA, 13 nt, Homo sapiens
cuguuucagaaau

SEQ ID NO: 2129848 - RNA, 20 nt, Homo sapiens
uuugagaaaugcauagcauu

SEQ ID NO: 2129849 - RNA, 14 nt, Homo sapiens
cucaaugcaugaug

SEQ ID NO: 2129850 - RNA, 20 nt, Homo sapiens
cuauagggugugaugaaguc

SEQ ID NO: 2129851 - RNA, 17 nt, Homo sapiens
caccucccugcaauaaa

SEQ ID NO: 2129852 - RNA, 15 nt, Homo sapiens
acuucuauccuguua

SEQ ID NO: 2129853 - RNA, 20 nt, Homo sapiens
cagcacuguauuccugucau

SEQ ID NO: 2129854 - RNA, 16 nt, Homo sapiens
aagauacuugaugcac

SEQ ID NO: 2129855 - RNA, 19 nt, Homo sapiens
agaggucugauuggcugcu

SEQ ID NO: 2129856 - RNA, 17 nt, Homo sapiens
gaccagccugagcaaca

SEQ ID NO: 2129857 - RNA, 15 nt, Homo sapiens
cugugugagacccac

SEQ ID NO: 2129858 - RNA, 17 nt, Homo sapiens
aaccuggagaugaugau

SEQ ID NO: 2129859 - RNA, 11 nt, Homo sapiens
uuaaaauggaa

SEQ ID NO: 2129860 - RNA, 20 nt, Homo sapiens
ggguccucuagcccacuccc

SEQ ID NO: 2129861 - RNA, 21 nt, Homo sapiens
agcuucuuccguuucuucccc

SEQ ID NO: 2129862 - RNA, 20 nt, Homo sapiens
uaaaucugagccuaaaucua

SEQ ID NO: 2129863 - RNA, 13 nt, Homo sapiens
gaguucuggucug

SEQ ID NO: 2129864 - RNA, 12 nt, Homo sapiens
cauaucuaguca

SEQ ID NO: 2129865 - RNA, 20 nt, Homo sapiens
uguauaaagcaacuguuaug

SEQ ID NO: 2129866 - RNA, 14 nt, Homo sapiens
acaaaguaagccau

SEQ ID NO: 2129867 - RNA, 14 nt, Homo sapiens
caguggaucuucag

SEQ ID NO: 2129868 - RNA, 21 nt, Homo sapiens
aauaaagcuucucucugagcu

SEQ ID NO: 2129869 - RNA, 13 nt, Homo sapiens
guaaugcaaaagg

SEQ ID NO: 2129870 - RNA, 16 nt, Homo sapiens
aauccaaaagacaaaa

SEQ ID NO: 2129871 - RNA, 22 nt, Homo sapiens
aauuaacuauaacaaucacugg

SEQ ID NO: 2129872 - RNA, 18 nt, Homo sapiens
agaggggagugcauuuag

SEQ ID NO: 2129873 - RNA, 17 nt, Homo sapiens
acacauagauauaauua

SEQ ID NO: 2129874 - RNA, 16 nt, Homo sapiens
cccugacgucugccac

SEQ ID NO: 2129875 - RNA, 16 nt, Homo sapiens
cugucuggacuuucca

SEQ ID NO: 2129876 - RNA, 21 nt, Homo sapiens
cauggaugcgaggaccacuuu

SEQ ID NO: 2129877 - RNA, 13 nt, Homo sapiens
caaggggucaaug

SEQ ID NO: 2129878 - RNA, 20 nt, Homo sapiens
caacgcaccagacacucaca

SEQ ID NO: 2129879 - RNA, 21 nt, Homo sapiens
gaggcacaagaaucacuugaa

SEQ ID NO: 2129880 - RNA, 21 nt, Homo sapiens
cauuaacaguuuuccaugaaa

SEQ ID NO: 2129881 - RNA, 18 nt, Homo sapiens
cagaaccccuacaugaaa

SEQ ID NO: 2129882 - RNA, 22 nt, Homo sapiens
gcccgggacagggucuugcaag

SEQ ID NO: 2129883 - RNA, 14 nt, Homo sapiens
guccucuagugaau

SEQ ID NO: 2129884 - RNA, 20 nt, Homo sapiens
caaaaggaaggguggcuuug

SEQ ID NO: 2129885 - RNA, 16 nt, Homo sapiens
uuaauaauaccaagac

SEQ ID NO: 2129886 - RNA, 14 nt, Homo sapiens
uauauuugcauuau

SEQ ID NO: 2129887 - RNA, 16 nt, Homo sapiens
gcgauuacaggcauga

SEQ ID NO: 2129888 - RNA, 18 nt, Homo sapiens
uauaaacauuuaaagaca

SEQ ID NO: 2129889 - RNA, 13 nt, Homo sapiens
uauaaaaacagac

SEQ ID NO: 2129890 - RNA, 13 nt, Homo sapiens
gacagaaugucac

SEQ ID NO: 2129891 - RNA, 18 nt, Homo sapiens
ucuuguuuacaauaaaga

SEQ ID NO: 2129892 - RNA, 15 nt, Homo sapiens
ccagccacacccaga

SEQ ID NO: 2129893 - RNA, 13 nt, Homo sapiens
aaucgcauuuccu

SEQ ID NO: 2129894 - RNA, 19 nt, Homo sapiens
cucugugguccagagucaa

SEQ ID NO: 2129895 - RNA, 16 nt, Homo sapiens
uugcauugacugucac

SEQ ID NO: 2129896 - RNA, 16 nt, Homo sapiens
acauggcauugagaca

SEQ ID NO: 2129897 - RNA, 16 nt, Homo sapiens
ugaaacaacucauguc

SEQ ID NO: 2129898 - RNA, 22 nt, Homo sapiens
gaagcucaccuguugcuuacaa

SEQ ID NO: 2129899 - RNA, 12 nt, Homo sapiens
aggugggugcug

SEQ ID NO: 2129900 - RNA, 19 nt, Homo sapiens
aggugagcagaacaccuga

SEQ ID NO: 2129901 - RNA, 16 nt, Homo sapiens
caaauugauagucaau

SEQ ID NO: 2129902 - RNA, 16 nt, Homo sapiens
ugcagagagcaccugg

SEQ ID NO: 2129903 - RNA, 20 nt, Homo sapiens
cuugcauuugugguaaucua

SEQ ID NO: 2129904 - RNA, 18 nt, Homo sapiens
agggcuggcaccucucaa

SEQ ID NO: 2129905 - RNA, 19 nt, Homo sapiens
gcuauuuacaaaugaagua

SEQ ID NO: 2129906 - RNA, 21 nt, Homo sapiens
gccagccuggagaaggugaca

SEQ ID NO: 2129907 - RNA, 17 nt, Homo sapiens
ugucucuauuuaugaga

SEQ ID NO: 2129908 - RNA, 18 nt, Homo sapiens
cugagcaguccuuggccu

SEQ ID NO: 2129909 - RNA, 15 nt, Homo sapiens
ccuucuuugucuugc

SEQ ID NO: 2129910 - RNA, 21 nt, Homo sapiens
uauagaaggguaccuugaaca

SEQ ID NO: 2129911 - RNA, 13 nt, Homo sapiens
agaccugaacugg

SEQ ID NO: 2129912 - RNA, 23 nt, Homo sapiens
gauucaccaaaauagucuucuca

SEQ ID NO: 2129913 - RNA, 16 nt, Homo sapiens
cuuucucuuucuaaaa

SEQ ID NO: 2129914 - RNA, 20 nt, Homo sapiens
gcagcucuucuggcuguguu

SEQ ID NO: 2129915 - RNA, 11 nt, Homo sapiens
ugucucugagg

SEQ ID NO: 2129916 - RNA, 11 nt, Homo sapiens
ccuacagugaa

SEQ ID NO: 2129917 - RNA, 14 nt, Homo sapiens
acuaauacuacugu

SEQ ID NO: 2129918 - RNA, 18 nt, Homo sapiens
cccagcccugaacaaagc

SEQ ID NO: 2129919 - RNA, 17 nt, Homo sapiens
cauucuauuuuggguau

SEQ ID NO: 2129920 - RNA, 17 nt, Homo sapiens
auaguauccagcacaga

SEQ ID NO: 2129921 - RNA, 15 nt, Homo sapiens
aacccauuuuagaga

SEQ ID NO: 2129922 - RNA, 22 nt, Homo sapiens
agcaguaggauauuggcauuug

SEQ ID NO: 2129923 - RNA, 17 nt, Homo sapiens
ucaaguaggaguuuuau

SEQ ID NO: 2129924 - RNA, 18 nt, Homo sapiens
agcuggcacugccacugu

SEQ ID NO: 2129925 - RNA, 17 nt, Homo sapiens
agcuauccacagcuuac

SEQ ID NO: 2129926 - RNA, 17 nt, Homo sapiens
gaaaaaauuaaaaccug

SEQ ID NO: 2129927 - RNA, 15 nt, Homo sapiens
aauccccacccuggg

SEQ ID NO: 2129928 - RNA, 18 nt, Homo sapiens
cuguuuuggaauguuggc

SEQ ID NO: 2129929 - RNA, 17 nt, Homo sapiens
cagugacgugcaccugu

SEQ ID NO: 2129930 - RNA, 13 nt, Homo sapiens
cuauggaaaaaag

SEQ ID NO: 2129931 - RNA, 20 nt, Homo sapiens
ucaaagggagagagugcuau

SEQ ID NO: 2129932 - RNA, 21 nt, Homo sapiens
ucacuggagguugaagccaag

SEQ ID NO: 2129933 - RNA, 14 nt, Homo sapiens
uuuguuuacaacac

SEQ ID NO: 2129934 - RNA, 17 nt, Homo sapiens
aaauuuuuuaaaaagca

SEQ ID NO: 2129935 - RNA, 16 nt, Homo sapiens
uccuguccuuuaccaa

SEQ ID NO: 2129936 - RNA, 19 nt, Homo sapiens
agacuuuugacacuuuuaa

SEQ ID NO: 2129937 - RNA, 17 nt, Homo sapiens
uuuaguucugacuuuga

SEQ ID NO: 2129938 - RNA, 20 nt, Homo sapiens
ucacagccuuucugaacuga

SEQ ID NO: 2129939 - RNA, 21 nt, Homo sapiens
augaaagugaugauacuguaa

SEQ ID NO: 2129940 - RNA, 22 nt, Homo sapiens
gcuccuccccuuccucuugucu

SEQ ID NO: 2129941 - RNA, 13 nt, Homo sapiens
cugcgccugggau

SEQ ID NO: 2129942 - RNA, 19 nt, Homo sapiens
uauugcaugcucaacuuag

SEQ ID NO: 2129943 - RNA, 14 nt, Homo sapiens
aacacucucugaga

SEQ ID NO: 2129944 - RNA, 15 nt, Homo sapiens
cuagcugggccaacu

SEQ ID NO: 2129945 - RNA, 16 nt, Homo sapiens
caaggucauggucuga

SEQ ID NO: 2129946 - RNA, 21 nt, Homo sapiens
aaaccuuucuauaauuuuaca

SEQ ID NO: 2129947 - RNA, 19 nt, Homo sapiens
uucuguccaccagacccac

SEQ ID NO: 2129948 - RNA, 20 nt, Homo sapiens
aguuagagcuggcaccagaa

SEQ ID NO: 2129949 - RNA, 13 nt, Homo sapiens
acuguaagaaaca

SEQ ID NO: 2129950 - RNA, 13 nt, Homo sapiens
aaugaaagacacu

SEQ ID NO: 2129951 - RNA, 21 nt, Homo sapiens
cugaguagcagugauuguuau

SEQ ID NO: 2129952 - RNA, 16 nt, Homo sapiens
uuucuucagggcugcu

SEQ ID NO: 2129953 - RNA, 15 nt, Homo sapiens
cagucccaucagaga

SEQ ID NO: 2129954 - RNA, 20 nt, Homo sapiens
cuagcuauuacugcagacua

SEQ ID NO: 2129955 - RNA, 18 nt, Homo sapiens
auuuccugauaacauuau

SEQ ID NO: 2129956 - RNA, 17 nt, Homo sapiens
uugcggggauaaagaga

SEQ ID NO: 2129957 - RNA, 20 nt, Homo sapiens
gaacaucaauuccaguggaa

SEQ ID NO: 2129958 - RNA, 20 nt, Homo sapiens
ugcaggguguguacugcaca

SEQ ID NO: 2129959 - RNA, 15 nt, Homo sapiens
uauucacaguaucug

SEQ ID NO: 2129960 - RNA, 16 nt, Homo sapiens
caucuucauagaugaa

SEQ ID NO: 2129961 - RNA, 11 nt, Homo sapiens
cauguacaaaa

SEQ ID NO: 2129962 - RNA, 15 nt, Homo sapiens
gaauucaugugagaa

SEQ ID NO: 2129963 - RNA, 15 nt, Homo sapiens
cuguuaaauucucag

SEQ ID NO: 2129964 - RNA, 17 nt, Homo sapiens
ucaacaucacacaguau

SEQ ID NO: 2129965 - RNA, 15 nt, Homo sapiens
aaauaagaucucuuu

SEQ ID NO: 2129966 - RNA, 16 nt, Homo sapiens
cagggugaaguguaca

SEQ ID NO: 2129967 - RNA, 16 nt, Homo sapiens
agaaguguuccuucau

SEQ ID NO: 2129968 - RNA, 22 nt, Homo sapiens
aucucaaacuacuggcaauuug

SEQ ID NO: 2129969 - RNA, 12 nt, Homo sapiens
auugucccugaa

SEQ ID NO: 2129970 - RNA, 20 nt, Homo sapiens
ccaacuuaggcuacagaaug

SEQ ID NO: 2129971 - RNA, 12 nt, Homo sapiens
gcucacuucuaa

SEQ ID NO: 2129972 - RNA, 18 nt, Homo sapiens
aguauggccccaccugcu

SEQ ID NO: 2129973 - RNA, 17 nt, Homo sapiens
agaaaucauaguuuaaa

SEQ ID NO: 2129974 - RNA, 16 nt, Homo sapiens
aaaagcaucuauguga

SEQ ID NO: 2129975 - RNA, 19 nt, Homo sapiens
cacuuugagauguguuccu

SEQ ID NO: 2129976 - RNA, 20 nt, Homo sapiens
ucucacgauuccagugcagu

SEQ ID NO: 2129977 - RNA, 15 nt, Homo sapiens
aggaaaauuucacau

SEQ ID NO: 2129978 - RNA, 14 nt, Homo sapiens
ccccacacgugcuc

SEQ ID NO: 2129979 - RNA, 18 nt, Homo sapiens
gcagagguggcgauuugu

SEQ ID NO: 2129980 - RNA, 14 nt, Homo sapiens
acguugaauugaug

SEQ ID NO: 2129981 - RNA, 14 nt, Homo sapiens
accaugaauucuug

SEQ ID NO: 2129982 - RNA, 17 nt, Homo sapiens
uguguugagauccagug

SEQ ID NO: 2129983 - RNA, 22 nt, Homo sapiens
aaaagaaauucccuggaccaga

SEQ ID NO: 2129984 - RNA, 19 nt, Homo sapiens
gcgggcccuggagcucaag

SEQ ID NO: 2129985 - RNA, 17 nt, Homo sapiens
ccaagaacuugcaauac

SEQ ID NO: 2129986 - RNA, 22 nt, Homo sapiens
aggggugggagagccagcucuc

SEQ ID NO: 2129987 - RNA, 23 nt, Homo sapiens
cccuccugugacuuauucccuga

SEQ ID NO: 2129988 - RNA, 18 nt, Homo sapiens
uccugacuaagccuuuga

SEQ ID NO: 2129989 - RNA, 13 nt, Homo sapiens
aaaaauaaugugc

SEQ ID NO: 2129990 - RNA, 17 nt, Homo sapiens
ggggacucagggaccgg

SEQ ID NO: 2129991 - RNA, 20 nt, Homo sapiens
uucuugauuaaagugauuga

SEQ ID NO: 2129992 - RNA, 21 nt, Homo sapiens
uacauguuugguaccaagaaa

SEQ ID NO: 2129993 - RNA, 18 nt, Homo sapiens
uuucccaucacuguaucc

SEQ ID NO: 2129994 - RNA, 13 nt, Homo sapiens
gucuugucuuuga

SEQ ID NO: 2129995 - RNA, 21 nt, Homo sapiens
ggccagggaaagcccguguca

SEQ ID NO: 2129996 - RNA, 18 nt, Homo sapiens
gaaggacgugucucagga

SEQ ID NO: 2129997 - RNA, 14 nt, Homo sapiens
uugaauacaaguuu

SEQ ID NO: 2129998 - RNA, 20 nt, Homo sapiens
ugugagcuucagauggugaa

SEQ ID NO: 2129999 - RNA, 14 nt, Homo sapiens
uugaacacaaguuc

SEQ ID NO: 2130000 - RNA, 14 nt, Homo sapiens
aacaaaacuucuua

SEQ ID NO: 2130001 - RNA, 14 nt, Homo sapiens
caaguuuuaagaga

SEQ ID NO: 2130002 - RNA, 16 nt, Homo sapiens
uccaccacugcuuaag

SEQ ID NO: 2130003 - RNA, 22 nt, Homo sapiens
gaaaucuaaaagaauuuuacca

SEQ ID NO: 2130004 - RNA, 19 nt, Homo sapiens
cagccucuagaacagccag

SEQ ID NO: 2130005 - RNA, 14 nt, Homo sapiens
caucucuguagaua

SEQ ID NO: 2130006 - RNA, 15 nt, Homo sapiens
auuuuaucugcuaug

SEQ ID NO: 2130007 - RNA, 18 nt, Homo sapiens
uggaaauucugaaaacug

SEQ ID NO: 2130008 - RNA, 23 nt, Homo sapiens
aacuuccuaaugauuagcacuua

SEQ ID NO: 2130009 - RNA, 20 nt, Homo sapiens
accuuggcugcugagccagg

SEQ ID NO: 2130010 - RNA, 20 nt, Homo sapiens
ggaucaauaggaaagcauau

SEQ ID NO: 2130011 - RNA, 23 nt, Homo sapiens
ugaaauuuugccugcaacagaga

SEQ ID NO: 2130012 - RNA, 15 nt, Homo sapiens
caccugucaucucac

SEQ ID NO: 2130013 - RNA, 22 nt, Homo sapiens
cucuccaguguuucuacaauca

SEQ ID NO: 2130014 - RNA, 19 nt, Homo sapiens
ucugcagcacucuuaucua

SEQ ID NO: 2130015 - RNA, 17 nt, Homo sapiens
gcacgaccuacauuaau

SEQ ID NO: 2130016 - RNA, 15 nt, Homo sapiens
gcacccugcccucau

SEQ ID NO: 2130017 - RNA, 21 nt, Homo sapiens
gccucuggaaaacucaggauu

SEQ ID NO: 2130018 - RNA, 14 nt, Homo sapiens
gacccucuaaccuc

SEQ ID NO: 2130019 - RNA, 22 nt, Homo sapiens
ugaauaauguaguuuugugaug

SEQ ID NO: 2130020 - RNA, 22 nt, Homo sapiens
uaauaaugccuaccuugugagg

SEQ ID NO: 2130021 - RNA, 14 nt, Homo sapiens
ccagguguggaaca

SEQ ID NO: 2130022 - RNA, 13 nt, Homo sapiens
ugggcuuacaggc

SEQ ID NO: 2130023 - RNA, 12 nt, Homo sapiens
auauauucccaa

SEQ ID NO: 2130024 - RNA, 14 nt, Homo sapiens
ugcucuucagacuu

SEQ ID NO: 2130025 - RNA, 14 nt, Homo sapiens
agcucuucugacuu

SEQ ID NO: 2130026 - RNA, 18 nt, Homo sapiens
cucaugccuguaaucuca

SEQ ID NO: 2130027 - RNA, 18 nt, Homo sapiens
uuuaagccugcauucuua

SEQ ID NO: 2130028 - RNA, 18 nt, Homo sapiens
ccaguguuauuaaugaca

SEQ ID NO: 2130029 - RNA, 17 nt, Homo sapiens
cuuaaguuuuacuugag

SEQ ID NO: 2130030 - RNA, 16 nt, Homo sapiens
aagagcuucaugugac

SEQ ID NO: 2130031 - RNA, 22 nt, Homo sapiens
cugcagccccagaagaaauuag

SEQ ID NO: 2130032 - RNA, 13 nt, Homo sapiens
agaggaugcugug

SEQ ID NO: 2130033 - RNA, 18 nt, Homo sapiens
cucuaaugagacugacca

SEQ ID NO: 2130034 - RNA, 19 nt, Homo sapiens
cccacuggagacgccucuc

SEQ ID NO: 2130035 - RNA, 17 nt, Homo sapiens
acguucauuugugugcu

SEQ ID NO: 2130036 - RNA, 13 nt, Homo sapiens
aaggucccugggg

SEQ ID NO: 2130037 - RNA, 11 nt, Homo sapiens
uuugauuuagc

SEQ ID NO: 2130038 - RNA, 12 nt, Homo sapiens
ucacacauuuac

SEQ ID NO: 2130039 - RNA, 12 nt, Homo sapiens
acauacauauau

SEQ ID NO: 2130040 - RNA, 16 nt, Homo sapiens
ugacagcuucuacuug

SEQ ID NO: 2130041 - RNA, 16 nt, Homo sapiens
uagcauugagugcuuu

SEQ ID NO: 2130042 - RNA, 17 nt, Homo sapiens
aauuugcuuuaucuacu

SEQ ID NO: 2130043 - RNA, 17 nt, Homo sapiens
uuccuuucacuggccac

SEQ ID NO: 2130044 - RNA, 17 nt, Homo sapiens
uccaccuaccuauucau

SEQ ID NO: 2130045 - RNA, 16 nt, Homo sapiens
aaaguuacuacugauu

SEQ ID NO: 2130046 - RNA, 15 nt, Homo sapiens
ccaaacugugaugaa

SEQ ID NO: 2130047 - RNA, 17 nt, Homo sapiens
gccaauccacuccuucc

SEQ ID NO: 2130048 - RNA, 16 nt, Homo sapiens
augugucaugcaugaa

SEQ ID NO: 2130049 - RNA, 15 nt, Homo sapiens
ggccaggauggcacu

SEQ ID NO: 2130050 - RNA, 22 nt, Homo sapiens
auguaauaaaucugagccuaaa

SEQ ID NO: 2130051 - RNA, 21 nt, Homo sapiens
auuacagaaacugaugccaag

SEQ ID NO: 2130052 - RNA, 21 nt, Homo sapiens
ucagaauaggaaaacauugca

SEQ ID NO: 2130053 - RNA, 18 nt, Homo sapiens
agaacccaccaaccagaa

SEQ ID NO: 2130054 - RNA, 16 nt, Homo sapiens
aggcggaagaaucacu

SEQ ID NO: 2130055 - RNA, 23 nt, Homo sapiens
uguggaauauaaagauggcugac

SEQ ID NO: 2130056 - RNA, 18 nt, Homo sapiens
agaacucaucacuguggc

SEQ ID NO: 2130057 - RNA, 13 nt, Homo sapiens
uucuuuuugccag

SEQ ID NO: 2130058 - RNA, 23 nt, Homo sapiens
ccaagaacuuuucccccaaagau

SEQ ID NO: 2130059 - RNA, 15 nt, Homo sapiens
caugcuguguaauau

SEQ ID NO: 2130060 - RNA, 14 nt, Homo sapiens
gccacaauucuguc

SEQ ID NO: 2130061 - RNA, 16 nt, Homo sapiens
cuugaacauacuuggu

SEQ ID NO: 2130062 - RNA, 12 nt, Homo sapiens
gccccucuccca

SEQ ID NO: 2130063 - RNA, 13 nt, Homo sapiens
gcacaaagacaua

SEQ ID NO: 2130064 - RNA, 18 nt, Homo sapiens
aaauauuacucaguuuau

SEQ ID NO: 2130065 - RNA, 16 nt, Homo sapiens
ccaaggccuaccccag

SEQ ID NO: 2130066 - RNA, 14 nt, Homo sapiens
uucauguacugcau

SEQ ID NO: 2130067 - RNA, 20 nt, Homo sapiens
cacuguacuucugugugcaa

SEQ ID NO: 2130068 - RNA, 14 nt, Homo sapiens
aaacccuuccccaa

SEQ ID NO: 2130069 - RNA, 20 nt, Homo sapiens
ucagcuucaaauaaaguaaa

SEQ ID NO: 2130070 - RNA, 21 nt, Homo sapiens
cuaccagggggucagagggau

SEQ ID NO: 2130071 - RNA, 22 nt, Homo sapiens
acuugcugcuucugcacuucau

SEQ ID NO: 2130072 - RNA, 15 nt, Homo sapiens
agguagaacacugcu

SEQ ID NO: 2130073 - RNA, 16 nt, Homo sapiens
uccaggcgaugugcaa

SEQ ID NO: 2130074 - RNA, 16 nt, Homo sapiens
gggaggcugugcacag

SEQ ID NO: 2130075 - RNA, 16 nt, Homo sapiens
ccucccccaugggcug

SEQ ID NO: 2130076 - RNA, 11 nt, Homo sapiens
augacugccuu

SEQ ID NO: 2130077 - RNA, 20 nt, Homo sapiens
agaacaaaagcgacccauuc

SEQ ID NO: 2130078 - RNA, 22 nt, Homo sapiens
acccaugggcucugacagaaag

SEQ ID NO: 2130079 - RNA, 18 nt, Homo sapiens
uucuuuuucugucuugua

SEQ ID NO: 2130080 - RNA, 16 nt, Homo sapiens
acagccauuuuucaau

SEQ ID NO: 2130081 - RNA, 21 nt, Homo sapiens
gcuccagccugacaucaaaaa

SEQ ID NO: 2130082 - RNA, 20 nt, Homo sapiens
aauguuggacagacacuguu

SEQ ID NO: 2130083 - RNA, 13 nt, Homo sapiens
uaacaaaaguaua

SEQ ID NO: 2130084 - RNA, 16 nt, Homo sapiens
ucaaaggguacuucca

SEQ ID NO: 2130085 - RNA, 22 nt, Homo sapiens
cgucccaggccacccccaugga

SEQ ID NO: 2130086 - RNA, 23 nt, Homo sapiens
auggcggcccccccagcugucau

SEQ ID NO: 2130087 - RNA, 17 nt, Homo sapiens
guccucuucugcaucuu

SEQ ID NO: 2130088 - RNA, 23 nt, Homo sapiens
cuuuuaggcguuuucuggcuuga

SEQ ID NO: 2130089 - RNA, 15 nt, Homo sapiens
uagagcuagucuuuc

SEQ ID NO: 2130090 - RNA, 15 nt, Homo sapiens
caccaguuauuccuu

SEQ ID NO: 2130091 - RNA, 22 nt, Homo sapiens
gcacuuuauacacuucuggcuc

SEQ ID NO: 2130092 - RNA, 21 nt, Homo sapiens
ugguuaaaaaccaacugugaa

SEQ ID NO: 2130093 - RNA, 20 nt, Homo sapiens
gccuuuuuuccugggccaga

SEQ ID NO: 2130094 - RNA, 22 nt, Homo sapiens
uucaauaaaucgugcugggaua

SEQ ID NO: 2130095 - RNA, 12 nt, Homo sapiens
agccaggugcug

SEQ ID NO: 2130096 - RNA, 14 nt, Homo sapiens
uggcccuguuucuc

SEQ ID NO: 2130097 - RNA, 20 nt, Homo sapiens
cugggugaguggggagacac

SEQ ID NO: 2130098 - RNA, 14 nt, Homo sapiens
cuaagucaauucca

SEQ ID NO: 2130099 - RNA, 20 nt, Homo sapiens
accuuuaggucaaacucccu

SEQ ID NO: 2130100 - RNA, 16 nt, Homo sapiens
uguuaauuacaccaua

SEQ ID NO: 2130101 - RNA, 12 nt, Homo sapiens
uuugaaccauaa

SEQ ID NO: 2130102 - RNA, 24 nt, Homo sapiens
gcuagaaccaagcacuaccaguau

SEQ ID NO: 2130103 - RNA, 15 nt, Homo sapiens
agccuccuccugacc

SEQ ID NO: 2130104 - RNA, 18 nt, Homo sapiens
guccccuccuucccucac

SEQ ID NO: 2130105 - RNA, 23 nt, Homo sapiens
cuuaaucacuacuguauguaaua

SEQ ID NO: 2130106 - RNA, 18 nt, Homo sapiens
agcaaauggcagaaccaa

SEQ ID NO: 2130107 - RNA, 20 nt, Homo sapiens
cggccggagaacaucugccu

SEQ ID NO: 2130108 - RNA, 17 nt, Homo sapiens
agauaucuaugacugug

SEQ ID NO: 2130109 - RNA, 13 nt, Homo sapiens
ggggagaauggcu

SEQ ID NO: 2130110 - RNA, 21 nt, Homo sapiens
aaauuauuugaaaacauauaa

SEQ ID NO: 2130111 - RNA, 22 nt, Homo sapiens
aauaauuuauaugcaugcacag

SEQ ID NO: 2130112 - RNA, 18 nt, Homo sapiens
ugaauucauguacauggu

SEQ ID NO: 2130113 - RNA, 15 nt, Homo sapiens
cuggccccagacaag

SEQ ID NO: 2130114 - RNA, 14 nt, Homo sapiens
uggagcugccugau

SEQ ID NO: 2130115 - RNA, 21 nt, Homo sapiens
ucagcucagcuucgugccugg

SEQ ID NO: 2130116 - RNA, 20 nt, Homo sapiens
gacaguugaacagagcuaga

SEQ ID NO: 2130117 - RNA, 12 nt, Homo sapiens
agcuaaccauca

SEQ ID NO: 2130118 - RNA, 15 nt, Homo sapiens
gcagaccucuggauu

SEQ ID NO: 2130119 - RNA, 20 nt, Homo sapiens
uuaggccuccggaugacugc

SEQ ID NO: 2130120 - RNA, 22 nt, Homo sapiens
auaaaaugacaucccauuaauu

SEQ ID NO: 2130121 - RNA, 17 nt, Homo sapiens
ccucugaccugcacugg

SEQ ID NO: 2130122 - RNA, 18 nt, Homo sapiens
uagcaccuccacauaccu

SEQ ID NO: 2130123 - RNA, 14 nt, Homo sapiens
guggcgugaucuca

SEQ ID NO: 2130124 - RNA, 19 nt, Homo sapiens
cccagagacauacuugaag

SEQ ID NO: 2130125 - RNA, 14 nt, Homo sapiens
cauuuuacuuccau

SEQ ID NO: 2130126 - RNA, 13 nt, Homo sapiens
cuagccaaauggu

SEQ ID NO: 2130127 - RNA, 20 nt, Homo sapiens
gaaagcuuugaacaauugug

SEQ ID NO: 2130128 - RNA, 21 nt, Homo sapiens
uguccacccacuuaguccacu

SEQ ID NO: 2130129 - RNA, 16 nt, Homo sapiens
gaauuccugggcucaa

SEQ ID NO: 2130130 - RNA, 21 nt, Homo sapiens
auuucuaucccaaacuaagcu

SEQ ID NO: 2130131 - RNA, 16 nt, Homo sapiens
uaacucaggcauuuca

SEQ ID NO: 2130132 - RNA, 16 nt, Homo sapiens
ucacccaggaaucuca

SEQ ID NO: 2130133 - RNA, 17 nt, Homo sapiens
aucuugcacauauuuga

SEQ ID NO: 2130134 - RNA, 24 nt, Homo sapiens
ggcaaagaucucagcagccagcuc

SEQ ID NO: 2130135 - RNA, 21 nt, Homo sapiens
cauguggagaaaggagugaaa

SEQ ID NO: 2130136 - RNA, 20 nt, Homo sapiens
uaaaugcagacaacaccuuc

SEQ ID NO: 2130137 - RNA, 17 nt, Homo sapiens
gcacuguuuauggaaau

SEQ ID NO: 2130138 - RNA, 15 nt, Homo sapiens
agaaaauaaauucca

SEQ ID NO: 2130139 - RNA, 22 nt, Homo sapiens
uccucucccgcgggccuggaca

SEQ ID NO: 2130140 - RNA, 16 nt, Homo sapiens
ugcaccucagggccaa

SEQ ID NO: 2130141 - RNA, 17 nt, Homo sapiens
ucucacauauacaagua

SEQ ID NO: 2130142 - RNA, 17 nt, Homo sapiens
gucccaccccuaccucu

SEQ ID NO: 2130143 - RNA, 20 nt, Homo sapiens
ugcaccccccugugccugcu

SEQ ID NO: 2130144 - RNA, 21 nt, Homo sapiens
uauagcgauugaaagggcaau

SEQ ID NO: 2130145 - RNA, 14 nt, Homo sapiens
auuugauugcagau

SEQ ID NO: 2130146 - RNA, 21 nt, Homo sapiens
uaaaagguuaauuucugucaa

SEQ ID NO: 2130147 - RNA, 15 nt, Homo sapiens
cucuuaaguguaaau

SEQ ID NO: 2130148 - RNA, 14 nt, Homo sapiens
auugugacuguguu

SEQ ID NO: 2130149 - RNA, 22 nt, Homo sapiens
cuugacaacuguggacuccagu

SEQ ID NO: 2130150 - RNA, 17 nt, Homo sapiens
guuugagacuauggaau

SEQ ID NO: 2130151 - RNA, 12 nt, Homo sapiens
uuacgugcaaua

SEQ ID NO: 2130152 - RNA, 16 nt, Homo sapiens
ugggccccaccaccua

SEQ ID NO: 2130153 - RNA, 22 nt, Homo sapiens
cuuuggacauagcgaauacaaa

SEQ ID NO: 2130154 - RNA, 20 nt, Homo sapiens
ucaccacguggggcucacuu

SEQ ID NO: 2130155 - RNA, 17 nt, Homo sapiens
uacucuuccaggacucu

SEQ ID NO: 2130156 - RNA, 21 nt, Homo sapiens
cccauggaaagagacugucau

SEQ ID NO: 2130157 - RNA, 15 nt, Homo sapiens
guaaauguuuagguu

SEQ ID NO: 2130158 - RNA, 16 nt, Homo sapiens
uuccaacguggcccag

SEQ ID NO: 2130159 - RNA, 16 nt, Homo sapiens
cagugucaggcacugg

SEQ ID NO: 2130160 - RNA, 14 nt, Homo sapiens
acauuaaaucacuu

SEQ ID NO: 2130161 - RNA, 21 nt, Homo sapiens
ucucauuauuucaucaugacu

SEQ ID NO: 2130162 - RNA, 17 nt, Homo sapiens
ugccccaugccugucca

SEQ ID NO: 2130163 - RNA, 16 nt, Homo sapiens
gucuccaccugagacc

SEQ ID NO: 2130164 - RNA, 19 nt, Homo sapiens
gacauaaagccauguuucc

SEQ ID NO: 2130165 - RNA, 10 nt, Homo sapiens
uugucuuccc

SEQ ID NO: 2130166 - RNA, 16 nt, Homo sapiens
acaauugcaacagaag

SEQ ID NO: 2130167 - RNA, 19 nt, Homo sapiens
ucuuugauauuggcuuaaa

SEQ ID NO: 2130168 - RNA, 23 nt, Homo sapiens
auuucugguuguuaugugaucau

SEQ ID NO: 2130169 - RNA, 20 nt, Homo sapiens
agguaccagcugcgcuugcu

SEQ ID NO: 2130170 - RNA, 17 nt, Homo sapiens
guuuauacacuguguaa

SEQ ID NO: 2130171 - RNA, 17 nt, Homo sapiens
aauguaaaauauaucau

SEQ ID NO: 2130172 - RNA, 22 nt, Homo sapiens
uggaguguaauuaccugucauc

SEQ ID NO: 2130173 - RNA, 17 nt, Homo sapiens
ugaaucuaacacauuuc

SEQ ID NO: 2130174 - RNA, 14 nt, Homo sapiens
ccuguucuucuauc

SEQ ID NO: 2130175 - RNA, 23 nt, Homo sapiens
aagaacaaacacuuagcauccca

SEQ ID NO: 2130176 - RNA, 23 nt, Homo sapiens
acccugaagcuuaggacuaccag

SEQ ID NO: 2130177 - RNA, 21 nt, Homo sapiens
cacuugugcaguguugacagu

SEQ ID NO: 2130178 - RNA, 15 nt, Homo sapiens
cagcugaguuaugau

SEQ ID NO: 2130179 - RNA, 13 nt, Homo sapiens
uucacugaugcuu

SEQ ID NO: 2130180 - RNA, 20 nt, Homo sapiens
agauuggaccagugcucuuc

SEQ ID NO: 2130181 - RNA, 17 nt, Homo sapiens
aagugagaguagucaga

SEQ ID NO: 2130182 - RNA, 17 nt, Homo sapiens
auggugcccgugccucu

SEQ ID NO: 2130183 - RNA, 16 nt, Homo sapiens
caacucugcacuccau

SEQ ID NO: 2130184 - RNA, 22 nt, Homo sapiens
cugccuuaggguagugcuaaga

SEQ ID NO: 2130185 - RNA, 16 nt, Homo sapiens
aauucagaugcaagag

SEQ ID NO: 2130186 - RNA, 18 nt, Homo sapiens
caguuguggugugccaug

SEQ ID NO: 2130187 - RNA, 19 nt, Homo sapiens
agcagcaccugcccuaccu

SEQ ID NO: 2130188 - RNA, 11 nt, Homo sapiens
agggcacaaag

SEQ ID NO: 2130189 - RNA, 18 nt, Homo sapiens
uuucuaguuuuauacaaa

SEQ ID NO: 2130190 - RNA, 12 nt, Homo sapiens
ugcagucacugg

SEQ ID NO: 2130191 - RNA, 11 nt, Homo sapiens
cgcgcacacac

SEQ ID NO: 2130192 - RNA, 12 nt, Homo sapiens
uggggucacuca

SEQ ID NO: 2130193 - RNA, 17 nt, Homo sapiens
ccgucuccucuccagcc

SEQ ID NO: 2130194 - RNA, 16 nt, Homo sapiens
uaacuagaaagugagu

SEQ ID NO: 2130195 - RNA, 14 nt, Homo sapiens
auuuauauaucagu

SEQ ID NO: 2130196 - RNA, 18 nt, Homo sapiens
aaucucaagauucuacuu

SEQ ID NO: 2130197 - RNA, 21 nt, Homo sapiens
gcagugugcauaauuuugcca

SEQ ID NO: 2130198 - RNA, 21 nt, Homo sapiens
uauuuuuguacugaaucucau

SEQ ID NO: 2130199 - RNA, 17 nt, Homo sapiens
uuuucaguauacugugu

SEQ ID NO: 2130200 - RNA, 15 nt, Homo sapiens
ggcccggcaugaggc

SEQ ID NO: 2130201 - RNA, 14 nt, Homo sapiens
caugagcaucccca

SEQ ID NO: 2130202 - RNA, 16 nt, Homo sapiens
caccucuggaucccug

SEQ ID NO: 2130203 - RNA, 19 nt, Homo sapiens
uaaaacuaggugcugcagc

SEQ ID NO: 2130204 - RNA, 17 nt, Homo sapiens
cauguucagucacaugu

SEQ ID NO: 2130205 - RNA, 13 nt, Homo sapiens
aaugccaggugga

SEQ ID NO: 2130206 - RNA, 22 nt, Homo sapiens
uuccauuugugugugugcaagu

SEQ ID NO: 2130207 - RNA, 19 nt, Homo sapiens
aaggcauuccucaucacca

SEQ ID NO: 2130208 - RNA, 21 nt, Homo sapiens
uacacacccugcauaucauaa

SEQ ID NO: 2130209 - RNA, 19 nt, Homo sapiens
aauucauaaaaacugcuua

SEQ ID NO: 2130210 - RNA, 16 nt, Homo sapiens
cuccagugugaauaua

SEQ ID NO: 2130211 - RNA, 17 nt, Homo sapiens
auucaaaugucaguuca

SEQ ID NO: 2130212 - RNA, 18 nt, Homo sapiens
guguucauauauggacau

SEQ ID NO: 2130213 - RNA, 17 nt, Homo sapiens
cccaaggaagagccaau

SEQ ID NO: 2130214 - RNA, 14 nt, Homo sapiens
cugggucagugguc

SEQ ID NO: 2130215 - RNA, 19 nt, Homo sapiens
uucuguuuaucaagccaua

SEQ ID NO: 2130216 - RNA, 23 nt, Homo sapiens
ugcaagaaggccaauugccuaaa

SEQ ID NO: 2130217 - RNA, 19 nt, Homo sapiens
ggguacucagucagcccag

SEQ ID NO: 2130218 - RNA, 15 nt, Homo sapiens
uggguccaccaugca

SEQ ID NO: 2130219 - RNA, 20 nt, Homo sapiens
ucacaaacucauccauuaau

SEQ ID NO: 2130220 - RNA, 21 nt, Homo sapiens
cacuuuaauuaccaaccuguu

SEQ ID NO: 2130221 - RNA, 21 nt, Homo sapiens
aaaccaaauucuauacaugua

SEQ ID NO: 2130222 - RNA, 16 nt, Homo sapiens
cuaaucccagcacuuu

SEQ ID NO: 2130223 - RNA, 16 nt, Homo sapiens
agaucuuucucuuccc

SEQ ID NO: 2130224 - RNA, 23 nt, Homo sapiens
uccuccuauuccaguguccaugu

SEQ ID NO: 2130225 - RNA, 20 nt, Homo sapiens
aaggcugcccccuuccucac

SEQ ID NO: 2130226 - RNA, 20 nt, Homo sapiens
ccaagggggcugcugcuccu

SEQ ID NO: 2130227 - RNA, 21 nt, Homo sapiens
ucacuuaagaaguaagcaacu

SEQ ID NO: 2130228 - RNA, 19 nt, Homo sapiens
gacagugcccuuggugcga

SEQ ID NO: 2130229 - RNA, 21 nt, Homo sapiens
gcacuuggccugacucaggaa

SEQ ID NO: 2130230 - RNA, 22 nt, Homo sapiens
ccuggccuuguccccagcucca

SEQ ID NO: 2130231 - RNA, 13 nt, Homo sapiens
gaaauuaaccaua

SEQ ID NO: 2130232 - RNA, 16 nt, Homo sapiens
auuaagccuuccacac

SEQ ID NO: 2130233 - RNA, 15 nt, Homo sapiens
gucuugaaaagccua

SEQ ID NO: 2130234 - RNA, 22 nt, Homo sapiens
guuguauguaaaucugcuuugu

SEQ ID NO: 2130235 - RNA, 17 nt, Homo sapiens
acgugguugccgucucu

SEQ ID NO: 2130236 - RNA, 13 nt, Homo sapiens
auuugacuauucu

SEQ ID NO: 2130237 - RNA, 13 nt, Homo sapiens
uccugacuucccu

SEQ ID NO: 2130238 - RNA, 13 nt, Homo sapiens
ccuuuacuccucg

SEQ ID NO: 2130239 - RNA, 20 nt, Homo sapiens
uccccuggggagucugggca

SEQ ID NO: 2130240 - RNA, 15 nt, Homo sapiens
auaccuuuuuguguc

SEQ ID NO: 2130241 - RNA, 21 nt, Homo sapiens
gcucuagggcccuuucuugca

SEQ ID NO: 2130242 - RNA, 12 nt, Homo sapiens
gcuuuucagggu

SEQ ID NO: 2130243 - RNA, 12 nt, Homo sapiens
acuuuaccugcu

SEQ ID NO: 2130244 - RNA, 21 nt, Homo sapiens
aagagcuuacaagacccuaug

SEQ ID NO: 2130245 - RNA, 15 nt, Homo sapiens
ucuuuauaauggcuc

SEQ ID NO: 2130246 - RNA, 19 nt, Homo sapiens
auggucugcaucagcuuuu

SEQ ID NO: 2130247 - RNA, 18 nt, Homo sapiens
gcugaggccaagccacuc

SEQ ID NO: 2130248 - RNA, 15 nt, Homo sapiens
cacaggaucugaacu

SEQ ID NO: 2130249 - RNA, 19 nt, Homo sapiens
guuuggauuauuccucuac

SEQ ID NO: 2130250 - RNA, 14 nt, Homo sapiens
ccuucaacccgaga

SEQ ID NO: 2130251 - RNA, 14 nt, Homo sapiens
aucuacuacagagu

SEQ ID NO: 2130252 - RNA, 21 nt, Homo sapiens
gaaauucacuuccccucuagg

SEQ ID NO: 2130253 - RNA, 19 nt, Homo sapiens
gaugacucuucuuaucaca

SEQ ID NO: 2130254 - RNA, 19 nt, Homo sapiens
aucccugaaacaucucaac

SEQ ID NO: 2130255 - RNA, 18 nt, Homo sapiens
uguggcaaacaaaaccaa

SEQ ID NO: 2130256 - RNA, 21 nt, Homo sapiens
aagacugggcuagggagaaug

SEQ ID NO: 2130257 - RNA, 19 nt, Homo sapiens
aucacuggcuggccugagc

SEQ ID NO: 2130258 - RNA, 22 nt, Homo sapiens
gacugacauuuuuuccuaagga

SEQ ID NO: 2130259 - RNA, 20 nt, Homo sapiens
gugcagaggcagacaggugu

SEQ ID NO: 2130260 - RNA, 20 nt, Homo sapiens
cagaaauaccugucuaggaa

SEQ ID NO: 2130261 - RNA, 16 nt, Homo sapiens
aaaggacauacauuua

SEQ ID NO: 2130262 - RNA, 13 nt, Homo sapiens
ucaauuuaaagga

SEQ ID NO: 2130263 - RNA, 11 nt, Homo sapiens
uaauacuguau

SEQ ID NO: 2130264 - RNA, 22 nt, Homo sapiens
ccgaauugucuuuggugcuuuu

SEQ ID NO: 2130265 - RNA, 13 nt, Homo sapiens
ccuacacugaugc

SEQ ID NO: 2130266 - RNA, 18 nt, Homo sapiens
uaaguaagugucugugau

SEQ ID NO: 2130267 - RNA, 22 nt, Homo sapiens
agacucaugguguguuacacaa

SEQ ID NO: 2130268 - RNA, 22 nt, Homo sapiens
gccguuagggaaauccaacucc

SEQ ID NO: 2130269 - RNA, 19 nt, Homo sapiens
auuuacuuaacagaacagu

SEQ ID NO: 2130270 - RNA, 14 nt, Homo sapiens
auuuauugauuuca

SEQ ID NO: 2130271 - RNA, 15 nt, Homo sapiens
ucagauaaauuguau

SEQ ID NO: 2130272 - RNA, 23 nt, Homo sapiens
uccauauauuuagccccauuaca

SEQ ID NO: 2130273 - RNA, 13 nt, Homo sapiens
aaugacaguaguc

SEQ ID NO: 2130274 - RNA, 18 nt, Homo sapiens
ggugucaaugaauuuugc

SEQ ID NO: 2130275 - RNA, 12 nt, Homo sapiens
uaggacacagug

SEQ ID NO: 2130276 - RNA, 12 nt, Homo sapiens
aauaacacugga

SEQ ID NO: 2130277 - RNA, 20 nt, Homo sapiens
uggacugaguuuauacucac

SEQ ID NO: 2130278 - RNA, 16 nt, Homo sapiens
uggaagauccugugag

SEQ ID NO: 2130279 - RNA, 11 nt, Homo sapiens
ugacagaugau

SEQ ID NO: 2130280 - RNA, 18 nt, Homo sapiens
aauacauuaagccucuug

SEQ ID NO: 2130281 - RNA, 21 nt, Homo sapiens
ucccaggccgacccaagggag

SEQ ID NO: 2130282 - RNA, 20 nt, Homo sapiens
caggccuaggaccucaggcg

SEQ ID NO: 2130283 - RNA, 12 nt, Homo sapiens
ugcugcucucuc

SEQ ID NO: 2130284 - RNA, 14 nt, Homo sapiens
augccaacuuguga

SEQ ID NO: 2130285 - RNA, 20 nt, Homo sapiens
uuuaaucuccucugaaaugu

SEQ ID NO: 2130286 - RNA, 19 nt, Homo sapiens
augucaacagaagggauac

SEQ ID NO: 2130287 - RNA, 14 nt, Homo sapiens
cagccuccaagaaa

SEQ ID NO: 2130288 - RNA, 14 nt, Homo sapiens
uaguagucucugug

SEQ ID NO: 2130289 - RNA, 15 nt, Homo sapiens
agaagaagugaccaa

SEQ ID NO: 2130290 - RNA, 21 nt, Homo sapiens
cuaagcgaggcaugccugaga

SEQ ID NO: 2130291 - RNA, 13 nt, Homo sapiens
ucaagcucagggc

SEQ ID NO: 2130292 - RNA, 16 nt, Homo sapiens
gcacagaucugcuuga

SEQ ID NO: 2130293 - RNA, 16 nt, Homo sapiens
aguauacacacuuucc

SEQ ID NO: 2130294 - RNA, 22 nt, Homo sapiens
caugaacugcggcagcaguuug

SEQ ID NO: 2130295 - RNA, 23 nt, Homo sapiens
uagauuuguuuugagaguucuuc

SEQ ID NO: 2130296 - RNA, 16 nt, Homo sapiens
ugccccucccaaccca

SEQ ID NO: 2130297 - RNA, 16 nt, Homo sapiens
gcgcccgggauccagc

SEQ ID NO: 2130298 - RNA, 18 nt, Homo sapiens
uaccuguguuucuugccu

SEQ ID NO: 2130299 - RNA, 18 nt, Homo sapiens
agauugaagccuuugcca

SEQ ID NO: 2130300 - RNA, 18 nt, Homo sapiens
agcugucaggcugauuau

SEQ ID NO: 2130301 - RNA, 19 nt, Homo sapiens
gucacagagugagacucca

SEQ ID NO: 2130302 - RNA, 13 nt, Homo sapiens
gguaguguaucau

SEQ ID NO: 2130303 - RNA, 11 nt, Homo sapiens
aaguguguuca

SEQ ID NO: 2130304 - RNA, 13 nt, Homo sapiens
uacaggaaguacu

SEQ ID NO: 2130305 - RNA, 15 nt, Homo sapiens
aaauguaaaagcaca

SEQ ID NO: 2130306 - RNA, 17 nt, Homo sapiens
ucaucucuguauuccca

SEQ ID NO: 2130307 - RNA, 13 nt, Homo sapiens
ggcccccaaagag

SEQ ID NO: 2130308 - RNA, 16 nt, Homo sapiens
gguagugaaacagcuu

SEQ ID NO: 2130309 - RNA, 23 nt, Homo sapiens
cuaggacuuuagggaucugggga

SEQ ID NO: 2130310 - RNA, 14 nt, Homo sapiens
aggaggccaugccc

SEQ ID NO: 2130311 - RNA, 17 nt, Homo sapiens
cuaggaaaagaccaucu

SEQ ID NO: 2130312 - RNA, 18 nt, Homo sapiens
guuuauuauaaacuguau

SEQ ID NO: 2130313 - RNA, 23 nt, Homo sapiens
augacucaauaaauacauguuaa

SEQ ID NO: 2130314 - RNA, 17 nt, Homo sapiens
ucuaauucaguucugaa

SEQ ID NO: 2130315 - RNA, 12 nt, Homo sapiens
gagaagaaccau

SEQ ID NO: 2130316 - RNA, 14 nt, Homo sapiens
gaacaaacaaugaa

SEQ ID NO: 2130317 - RNA, 24 nt, Homo sapiens
cuaagguucuugcuuucucucuca

SEQ ID NO: 2130318 - RNA, 21 nt, Homo sapiens
acaagaggccacucccaggga

SEQ ID NO: 2130319 - RNA, 22 nt, Homo sapiens
aauauugcuuuggucauaugag

SEQ ID NO: 2130320 - RNA, 16 nt, Homo sapiens
uccagcaugugugugu

SEQ ID NO: 2130321 - RNA, 11 nt, Homo sapiens
uccaugcacau

SEQ ID NO: 2130322 - RNA, 12 nt, Homo sapiens
uggagcauugau

SEQ ID NO: 2130323 - RNA, 12 nt, Homo sapiens
uuaagcauuugu

SEQ ID NO: 2130324 - RNA, 17 nt, Homo sapiens
gacaggcgcaacuccuc

SEQ ID NO: 2130325 - RNA, 22 nt, Homo sapiens
aagaacuauugugcucagagac

SEQ ID NO: 2130326 - RNA, 12 nt, Homo sapiens
aguaaaagcaac

SEQ ID NO: 2130327 - RNA, 13 nt, Homo sapiens
cacacacgaugca

SEQ ID NO: 2130328 - RNA, 16 nt, Homo sapiens
ucaucuauaacaugca

SEQ ID NO: 2130329 - RNA, 13 nt, Homo sapiens
aggcagugucccu

SEQ ID NO: 2130330 - RNA, 17 nt, Homo sapiens
uuguaacauaaugcacu

SEQ ID NO: 2130331 - RNA, 15 nt, Homo sapiens
aaagagaacaccucc

SEQ ID NO: 2130332 - RNA, 15 nt, Homo sapiens
uuccuugaccuuccu

SEQ ID NO: 2130333 - RNA, 11 nt, Homo sapiens
ugugacuuuuu

SEQ ID NO: 2130334 - RNA, 15 nt, Homo sapiens
gucauccagcucacu

SEQ ID NO: 2130335 - RNA, 18 nt, Homo sapiens
uguaguucugccaggcaa

SEQ ID NO: 2130336 - RNA, 17 nt, Homo sapiens
ucaauucccucucucag

SEQ ID NO: 2130337 - RNA, 15 nt, Homo sapiens
cccaggacccaucac

SEQ ID NO: 2130338 - RNA, 17 nt, Homo sapiens
augugacaugcccaagg

SEQ ID NO: 2130339 - RNA, 22 nt, Homo sapiens
aacaugaauuuagaaauauuca

SEQ ID NO: 2130340 - RNA, 17 nt, Homo sapiens
gccugagaaugaccugc

SEQ ID NO: 2130341 - RNA, 21 nt, Homo sapiens
agcagaacugaaaaauuacuu

SEQ ID NO: 2130342 - RNA, 16 nt, Homo sapiens
ggcaccuaauccaggc

SEQ ID NO: 2130343 - RNA, 22 nt, Homo sapiens
uccucccuguaacuugauccau

SEQ ID NO: 2130344 - RNA, 21 nt, Homo sapiens
uuugcagauaacaaacaagaa

SEQ ID NO: 2130345 - RNA, 14 nt, Homo sapiens
gacuaggauaacag

SEQ ID NO: 2130346 - RNA, 14 nt, Homo sapiens
ugaguucaaauacu

SEQ ID NO: 2130347 - RNA, 22 nt, Homo sapiens
aguuugaggcugcaaugagcca

SEQ ID NO: 2130348 - RNA, 22 nt, Homo sapiens
aagaagcccaggaaaggcucca

SEQ ID NO: 2130349 - RNA, 21 nt, Homo sapiens
acccagucagaguugugcaca

SEQ ID NO: 2130350 - RNA, 12 nt, Homo sapiens
acagggucucac

SEQ ID NO: 2130351 - RNA, 13 nt, Homo sapiens
ucuuacaaagugu

SEQ ID NO: 2130352 - RNA, 17 nt, Homo sapiens
ugucucucucacauuaa

SEQ ID NO: 2130353 - RNA, 23 nt, Homo sapiens
cuuagagccaggcacacacugug

SEQ ID NO: 2130354 - RNA, 20 nt, Homo sapiens
uggacaguucacacccugca

SEQ ID NO: 2130355 - RNA, 15 nt, Homo sapiens
agaaaucaugugcau

SEQ ID NO: 2130356 - RNA, 12 nt, Homo sapiens
ucucaauagcuc

SEQ ID NO: 2130357 - RNA, 18 nt, Homo sapiens
agggaaugccuggagggu

SEQ ID NO: 2130358 - RNA, 18 nt, Homo sapiens
acuucaaugcacauggug

SEQ ID NO: 2130359 - RNA, 15 nt, Homo sapiens
cauuucuaaaccaga

SEQ ID NO: 2130360 - RNA, 19 nt, Homo sapiens
aucuuuuccagaguaugca

SEQ ID NO: 2130361 - RNA, 17 nt, Homo sapiens
caaaucccucucacaag

SEQ ID NO: 2130362 - RNA, 14 nt, Homo sapiens
cagggcacuacaua

SEQ ID NO: 2130363 - RNA, 22 nt, Homo sapiens
uguuacauuauuccaaugauac

SEQ ID NO: 2130364 - RNA, 22 nt, Homo sapiens
uacuuaaauuugguuuguuaau

SEQ ID NO: 2130365 - RNA, 19 nt, Homo sapiens
gaaaccucuacauauuuau

SEQ ID NO: 2130366 - RNA, 12 nt, Homo sapiens
cccggcccagug

SEQ ID NO: 2130367 - RNA, 21 nt, Homo sapiens
uaauaaaagaguuaacauccc

SEQ ID NO: 2130368 - RNA, 23 nt, Homo sapiens
aaugacuggcuacagaguaacaa

SEQ ID NO: 2130369 - RNA, 20 nt, Homo sapiens
uguguaaauaauuugcacug

SEQ ID NO: 2130370 - RNA, 13 nt, Homo sapiens
caccaucaacuua

SEQ ID NO: 2130371 - RNA, 15 nt, Homo sapiens
gcuuuacagcacugu

SEQ ID NO: 2130372 - RNA, 22 nt, Homo sapiens
ccuguccagauuauuggcugcu

SEQ ID NO: 2130373 - RNA, 22 nt, Homo sapiens
cuucaucgaaucuacuaauucc

SEQ ID NO: 2130374 - RNA, 14 nt, Homo sapiens
gacagaaccacagg

SEQ ID NO: 2130375 - RNA, 14 nt, Homo sapiens
cugaaaccaaaaca

SEQ ID NO: 2130376 - RNA, 18 nt, Homo sapiens
gcacaaauugaaaacaca

SEQ ID NO: 2130377 - RNA, 20 nt, Homo sapiens
uuaauaaucaagagccuuaa

SEQ ID NO: 2130378 - RNA, 19 nt, Homo sapiens
guccuaaccagugagcacu

SEQ ID NO: 2130379 - RNA, 20 nt, Homo sapiens
cucuaugagagauagcuuau

SEQ ID NO: 2130380 - RNA, 19 nt, Homo sapiens
acugugcccugggagcucu

SEQ ID NO: 2130381 - RNA, 23 nt, Homo sapiens
acauuggguccugggucuuucau

SEQ ID NO: 2130382 - RNA, 24 nt, Homo sapiens
gucucucuugcuuuguucuuuauu

SEQ ID NO: 2130383 - RNA, 18 nt, Homo sapiens
ucagugaagaugcaauca

SEQ ID NO: 2130384 - RNA, 16 nt, Homo sapiens
cuguguaucauuaaaa

SEQ ID NO: 2130385 - RNA, 19 nt, Homo sapiens
uucugaagccucuaacaaa

SEQ ID NO: 2130386 - RNA, 21 nt, Homo sapiens
aacuccugucuucuuucucca

SEQ ID NO: 2130387 - RNA, 15 nt, Homo sapiens
ucaauguacauagac

SEQ ID NO: 2130388 - RNA, 22 nt, Homo sapiens
ccagcauuuaagugaccuucug

SEQ ID NO: 2130389 - RNA, 16 nt, Homo sapiens
caagaacugccauaaa

SEQ ID NO: 2130390 - RNA, 18 nt, Homo sapiens
caguuuuuucaccuccau

SEQ ID NO: 2130391 - RNA, 16 nt, Homo sapiens
aauugacccaaaacgu

SEQ ID NO: 2130392 - RNA, 21 nt, Homo sapiens
aggaagaaagaagacaaacuu

SEQ ID NO: 2130393 - RNA, 20 nt, Homo sapiens
cugccagagaagucugguca

SEQ ID NO: 2130394 - RNA, 19 nt, Homo sapiens
agaacuuuaaagcucagga

SEQ ID NO: 2130395 - RNA, 16 nt, Homo sapiens
uacaucaaaugcucaa

SEQ ID NO: 2130396 - RNA, 16 nt, Homo sapiens
uugcgagaaacagaga

SEQ ID NO: 2130397 - RNA, 19 nt, Homo sapiens
ucagauauuguaagcauuc

SEQ ID NO: 2130398 - RNA, 15 nt, Homo sapiens
gaaaagccaugugua

SEQ ID NO: 2130399 - RNA, 14 nt, Homo sapiens
ggaccucaguuucu

SEQ ID NO: 2130400 - RNA, 17 nt, Homo sapiens
accucugccugaaguca

SEQ ID NO: 2130401 - RNA, 20 nt, Homo sapiens
uccuagcgcagccaugugau

SEQ ID NO: 2130402 - RNA, 19 nt, Homo sapiens
acacaguauuaagugacag

SEQ ID NO: 2130403 - RNA, 17 nt, Homo sapiens
ucaaccccagacacugg

SEQ ID NO: 2130404 - RNA, 15 nt, Homo sapiens
uauacaaugcacuuu

SEQ ID NO: 2130405 - RNA, 15 nt, Homo sapiens
cccguccacagggca

SEQ ID NO: 2130406 - RNA, 12 nt, Homo sapiens
gcacaucucugc

SEQ ID NO: 2130407 - RNA, 13 nt, Homo sapiens
uccgugcuaugac

SEQ ID NO: 2130408 - RNA, 20 nt, Homo sapiens
aagacuuuaguuaccgagac

SEQ ID NO: 2130409 - RNA, 17 nt, Homo sapiens
uaaaauacaaacccaug

SEQ ID NO: 2130410 - RNA, 22 nt, Homo sapiens
agcuuaggggcugcugaccucc

SEQ ID NO: 2130411 - RNA, 20 nt, Homo sapiens
caugcagaagccugagcuca

SEQ ID NO: 2130412 - RNA, 22 nt, Homo sapiens
gggggcuggguaagagcacagg

SEQ ID NO: 2130413 - RNA, 23 nt, Homo sapiens
caucgauauacauuuauuuacac

SEQ ID NO: 2130414 - RNA, 20 nt, Homo sapiens
ugguauugaacugcagguga

SEQ ID NO: 2130415 - RNA, 10 nt, Homo sapiens
guccacaggg

SEQ ID NO: 2130416 - RNA, 15 nt, Homo sapiens
aggagcuccaguguc

SEQ ID NO: 2130417 - RNA, 17 nt, Homo sapiens
gacuucagucuugccua

SEQ ID NO: 2130418 - RNA, 20 nt, Homo sapiens
uucacuguacugcaugugac

SEQ ID NO: 2130419 - RNA, 12 nt, Homo sapiens
uaauacagauaa

SEQ ID NO: 2130420 - RNA, 11 nt, Homo sapiens
cugccauguca

SEQ ID NO: 2130421 - RNA, 14 nt, Homo sapiens
gacaaaaccaaaac

SEQ ID NO: 2130422 - RNA, 14 nt, Homo sapiens
gaaugaaccacugc

SEQ ID NO: 2130423 - RNA, 15 nt, Homo sapiens
auuucggagcaugaa

SEQ ID NO: 2130424 - RNA, 19 nt, Homo sapiens
ugggguugcaaccacugca

SEQ ID NO: 2130425 - RNA, 20 nt, Homo sapiens
guaaaaugcacccaucagca

SEQ ID NO: 2130426 - RNA, 16 nt, Homo sapiens
gacaucuguagggaau

SEQ ID NO: 2130427 - RNA, 23 nt, Homo sapiens
uagagagauuggccagcaaaaac

SEQ ID NO: 2130428 - RNA, 16 nt, Homo sapiens
accucagaaagucacc

SEQ ID NO: 2130429 - RNA, 14 nt, Homo sapiens
ucucaacauggaaa

SEQ ID NO: 2130430 - RNA, 23 nt, Homo sapiens
cugcagauacuuugaagugcagc

SEQ ID NO: 2130431 - RNA, 14 nt, Homo sapiens
cuaaaaccaaauau

SEQ ID NO: 2130432 - RNA, 19 nt, Homo sapiens
ucaauaccgcucaguauuu

SEQ ID NO: 2130433 - RNA, 16 nt, Homo sapiens
agcaauaacucucuac

SEQ ID NO: 2130434 - RNA, 22 nt, Homo sapiens
acgccccucccuccucuggccc

SEQ ID NO: 2130435 - RNA, 14 nt, Homo sapiens
aguuugagggagaa

SEQ ID NO: 2130436 - RNA, 18 nt, Homo sapiens
uuaaauaaacacagucca

SEQ ID NO: 2130437 - RNA, 18 nt, Homo sapiens
agaccauuuguauuacca

SEQ ID NO: 2130438 - RNA, 14 nt, Homo sapiens
ggcacuauccagaa

SEQ ID NO: 2130439 - RNA, 14 nt, Homo sapiens
augcugugcucaau

SEQ ID NO: 2130440 - RNA, 21 nt, Homo sapiens
uaacuucaauguaguuuucca

SEQ ID NO: 2130441 - RNA, 15 nt, Homo sapiens
uggcugccuuuggaa

SEQ ID NO: 2130442 - RNA, 14 nt, Homo sapiens
aauuccagugccag

SEQ ID NO: 2130443 - RNA, 12 nt, Homo sapiens
auacacugugac

SEQ ID NO: 2130444 - RNA, 23 nt, Homo sapiens
cuuacuuuggugaccccauacau

SEQ ID NO: 2130445 - RNA, 19 nt, Homo sapiens
cagaggcucuaauguacaa

SEQ ID NO: 2130446 - RNA, 15 nt, Homo sapiens
cuauggguuguacug

SEQ ID NO: 2130447 - RNA, 17 nt, Homo sapiens
ugggaccugaugaccug

SEQ ID NO: 2130448 - RNA, 22 nt, Homo sapiens
uuuaagaauaugaaacuuucau

SEQ ID NO: 2130449 - RNA, 21 nt, Homo sapiens
ccuugagcugccugcucugca

SEQ ID NO: 2130450 - RNA, 18 nt, Homo sapiens
guuaaauauuuugcuaac

SEQ ID NO: 2130451 - RNA, 13 nt, Homo sapiens
gggugucuugucu

SEQ ID NO: 2130452 - RNA, 18 nt, Homo sapiens
uucccauuaaagagccag

SEQ ID NO: 2130453 - RNA, 21 nt, Homo sapiens
agaaaauauuuuuguggacau

SEQ ID NO: 2130454 - RNA, 18 nt, Homo sapiens
uccaaaaauguguaagaa

SEQ ID NO: 2130455 - RNA, 13 nt, Homo sapiens
aaagcuagucaac

SEQ ID NO: 2130456 - RNA, 19 nt, Homo sapiens
gaagacccacgugcuaggg

SEQ ID NO: 2130457 - RNA, 16 nt, Homo sapiens
uucaucugcucuccuu

SEQ ID NO: 2130458 - RNA, 14 nt, Homo sapiens
ugcgcacugcauuc

SEQ ID NO: 2130459 - RNA, 20 nt, Homo sapiens
augcugcugggccucugccu

SEQ ID NO: 2130460 - RNA, 18 nt, Homo sapiens
aguuccugcugccugggu

SEQ ID NO: 2130461 - RNA, 20 nt, Homo sapiens
guauguguguagacuguaac

SEQ ID NO: 2130462 - RNA, 23 nt, Homo sapiens
agguccuuggagugcugcagcuu

SEQ ID NO: 2130463 - RNA, 18 nt, Homo sapiens
ccuaagagaugggacuag

SEQ ID NO: 2130464 - RNA, 14 nt, Homo sapiens
auauguacagcucu

SEQ ID NO: 2130465 - RNA, 14 nt, Homo sapiens
gccuggacacagag

SEQ ID NO: 2130466 - RNA, 20 nt, Homo sapiens
ggacagccaaguuauaccca

SEQ ID NO: 2130467 - RNA, 22 nt, Homo sapiens
uuguccaggcuggagugcaaug

SEQ ID NO: 2130468 - RNA, 13 nt, Homo sapiens
uuuugacucugcc

SEQ ID NO: 2130469 - RNA, 14 nt, Homo sapiens
agcagauucuagca

SEQ ID NO: 2130470 - RNA, 13 nt, Homo sapiens
gucccaucaggac

SEQ ID NO: 2130471 - RNA, 23 nt, Homo sapiens
aggacaucucugcccucuucuca

SEQ ID NO: 2130472 - RNA, 14 nt, Homo sapiens
aguauguaaguauc

SEQ ID NO: 2130473 - RNA, 16 nt, Homo sapiens
ucuaacaaaugaucua

SEQ ID NO: 2130474 - RNA, 18 nt, Homo sapiens
gcuauuuuacauauccca

SEQ ID NO: 2130475 - RNA, 13 nt, Homo sapiens
cccuacacacaca

SEQ ID NO: 2130476 - RNA, 19 nt, Homo sapiens
acucuuugaaugacaaaga

SEQ ID NO: 2130477 - RNA, 19 nt, Homo sapiens
agcuacuucaaauguggua

SEQ ID NO: 2130478 - RNA, 15 nt, Homo sapiens
gcuuagcauaucuga

SEQ ID NO: 2130479 - RNA, 24 nt, Homo sapiens
caaagaagauuuugccacauuuga

SEQ ID NO: 2130480 - RNA, 15 nt, Homo sapiens
aagacagagugaauu

SEQ ID NO: 2130481 - RNA, 21 nt, Homo sapiens
aagcuaguugaauacuugaac

SEQ ID NO: 2130482 - RNA, 19 nt, Homo sapiens
uaaacaucuuuguugaugu

SEQ ID NO: 2130483 - RNA, 18 nt, Homo sapiens
ccugggggauaccagcug

SEQ ID NO: 2130484 - RNA, 18 nt, Homo sapiens
acaggucaggggugacac

SEQ ID NO: 2130485 - RNA, 15 nt, Homo sapiens
ccagguuccauccac

SEQ ID NO: 2130486 - RNA, 19 nt, Homo sapiens
ugcccacgcuggagugcag

SEQ ID NO: 2130487 - RNA, 23 nt, Homo sapiens
aucaauuccaucagcacaaagac

SEQ ID NO: 2130488 - RNA, 17 nt, Homo sapiens
gccuucccuaagucaca

SEQ ID NO: 2130489 - RNA, 16 nt, Homo sapiens
aaucaagagcuuccag

SEQ ID NO: 2130490 - RNA, 16 nt, Homo sapiens
uuaagacuggcuuuag

SEQ ID NO: 2130491 - RNA, 13 nt, Homo sapiens
uccccacaaucug

SEQ ID NO: 2130492 - RNA, 13 nt, Homo sapiens
agcaucuccagug

SEQ ID NO: 2130493 - RNA, 19 nt, Homo sapiens
uaguguucacaaacuguga

SEQ ID NO: 2130494 - RNA, 19 nt, Homo sapiens
gccuccccccacaagaacu

SEQ ID NO: 2130495 - RNA, 15 nt, Homo sapiens
ugaagacaacagcau

SEQ ID NO: 2130496 - RNA, 18 nt, Homo sapiens
agaugcuaaaaucccugg

SEQ ID NO: 2130497 - RNA, 22 nt, Homo sapiens
gcaagucuggacaaauguauag

SEQ ID NO: 2130498 - RNA, 13 nt, Homo sapiens
uuuugcucuacuu

SEQ ID NO: 2130499 - RNA, 15 nt, Homo sapiens
caggagccaccagca

SEQ ID NO: 2130500 - RNA, 12 nt, Homo sapiens
acucagcugcca

SEQ ID NO: 2130501 - RNA, 15 nt, Homo sapiens
gcugagccucagucu

SEQ ID NO: 2130502 - RNA, 18 nt, Homo sapiens
agcauggucccuugucac

SEQ ID NO: 2130503 - RNA, 19 nt, Homo sapiens
accccugucucccaaaaau

SEQ ID NO: 2130504 - RNA, 16 nt, Homo sapiens
ccagcacugcccaaag

SEQ ID NO: 2130505 - RNA, 16 nt, Homo sapiens
cuacggagaaacucau

SEQ ID NO: 2130506 - RNA, 14 nt, Homo sapiens
aauguuuauucaaa

SEQ ID NO: 2130507 - RNA, 18 nt, Homo sapiens
aaugcuuucccacucuca

SEQ ID NO: 2130508 - RNA, 16 nt, Homo sapiens
ccaaaccuuaucucca

SEQ ID NO: 2130509 - RNA, 17 nt, Homo sapiens
augcauugucugcaaug

SEQ ID NO: 2130510 - RNA, 16 nt, Homo sapiens
uuuaauccuaccucaa

SEQ ID NO: 2130511 - RNA, 23 nt, Homo sapiens
ugcagacuggcagucgcacacac

SEQ ID NO: 2130512 - RNA, 18 nt, Homo sapiens
cuuuucagugauacucac

SEQ ID NO: 2130513 - RNA, 15 nt, Homo sapiens
ggcaggaaagccaca

SEQ ID NO: 2130514 - RNA, 16 nt, Homo sapiens
agccuccccuucccag

SEQ ID NO: 2130515 - RNA, 16 nt, Homo sapiens
agauaaaccaguugaa

SEQ ID NO: 2130516 - RNA, 20 nt, Homo sapiens
aagaaguugaacuaugacug

SEQ ID NO: 2130517 - RNA, 14 nt, Homo sapiens
gcucuuuugcacaa

SEQ ID NO: 2130518 - RNA, 13 nt, Homo sapiens
ccuagccuauguc

SEQ ID NO: 2130519 - RNA, 13 nt, Homo sapiens
cauccuuucugcc

SEQ ID NO: 2130520 - RNA, 23 nt, Homo sapiens
agugaggacucggccacuguguc

SEQ ID NO: 2130521 - RNA, 13 nt, Homo sapiens
caggaugcccacc

SEQ ID NO: 2130522 - RNA, 19 nt, Homo sapiens
ccagcuguacuagugccau

SEQ ID NO: 2130523 - RNA, 11 nt, Homo sapiens
auuaaagggua

SEQ ID NO: 2130524 - RNA, 16 nt, Homo sapiens
agcaccccucucugca

SEQ ID NO: 2130525 - RNA, 14 nt, Homo sapiens
uacagucaucugcc

SEQ ID NO: 2130526 - RNA, 16 nt, Homo sapiens
acaccgcugcacucaa

SEQ ID NO: 2130527 - RNA, 22 nt, Homo sapiens
auuuuuuccuuaagagcuauuu

SEQ ID NO: 2130528 - RNA, 13 nt, Homo sapiens
ccagcuguuucau

SEQ ID NO: 2130529 - RNA, 14 nt, Homo sapiens
cacuauucagaaga

SEQ ID NO: 2130530 - RNA, 19 nt, Homo sapiens
uaaagucacaucccuguaa

SEQ ID NO: 2130531 - RNA, 20 nt, Homo sapiens
uucauacacguaaaugcaga

SEQ ID NO: 2130532 - RNA, 21 nt, Homo sapiens
guccucccaucucacacauga

SEQ ID NO: 2130533 - RNA, 15 nt, Homo sapiens
uaaaguucagugugc

SEQ ID NO: 2130534 - RNA, 21 nt, Homo sapiens
ccacaaagaagauucuuacca

SEQ ID NO: 2130535 - RNA, 20 nt, Homo sapiens
auuuguuuuuauuugguucu

SEQ ID NO: 2130536 - RNA, 22 nt, Homo sapiens
agcugggauaaucacauuauca

SEQ ID NO: 2130537 - RNA, 23 nt, Homo sapiens
aaggagcucacuguggugucugu

SEQ ID NO: 2130538 - RNA, 11 nt, Homo sapiens
aaaaccacagu

SEQ ID NO: 2130539 - RNA, 13 nt, Homo sapiens
acuugaacaaaga

SEQ ID NO: 2130540 - RNA, 13 nt, Homo sapiens
acugaaacaaaug

SEQ ID NO: 2130541 - RNA, 13 nt, Homo sapiens
ucugaaacuaaug

SEQ ID NO: 2130542 - RNA, 17 nt, Homo sapiens
gacugccccagaauugg

SEQ ID NO: 2130543 - RNA, 21 nt, Homo sapiens
ggaauggaaagcggaguuccu

SEQ ID NO: 2130544 - RNA, 19 nt, Homo sapiens
cuugucaggauaguugcuc

SEQ ID NO: 2130545 - RNA, 12 nt, Homo sapiens
auuguaugucaa

SEQ ID NO: 2130546 - RNA, 21 nt, Homo sapiens
ugccuuuuaucuauuugagau

SEQ ID NO: 2130547 - RNA, 15 nt, Homo sapiens
ccuugccugaugaca

SEQ ID NO: 2130548 - RNA, 19 nt, Homo sapiens
aaauauuggcugauuuaga

SEQ ID NO: 2130549 - RNA, 15 nt, Homo sapiens
cuaacaguaguugca

SEQ ID NO: 2130550 - RNA, 20 nt, Homo sapiens
ucauaccuuaugcuacacag

SEQ ID NO: 2130551 - RNA, 22 nt, Homo sapiens
uaagauauauaugugcucuuaa

SEQ ID NO: 2130552 - RNA, 22 nt, Homo sapiens
gaagguauuccuuuuguguaca

SEQ ID NO: 2130553 - RNA, 19 nt, Homo sapiens
ggucaguuuggcugggcaa

SEQ ID NO: 2130554 - RNA, 18 nt, Homo sapiens
cagcacuuaaacugccuc

SEQ ID NO: 2130555 - RNA, 22 nt, Homo sapiens
acaugccccccagauugcugca

SEQ ID NO: 2130556 - RNA, 14 nt, Homo sapiens
ccuccacccaguga

SEQ ID NO: 2130557 - RNA, 18 nt, Homo sapiens
uucuuuguauuaccaaag

SEQ ID NO: 2130558 - RNA, 22 nt, Homo sapiens
acuucacugugcucaucaagaa

SEQ ID NO: 2130559 - RNA, 23 nt, Homo sapiens
aacucagaauauugucugccuua

SEQ ID NO: 2130560 - RNA, 21 nt, Homo sapiens
uggaggaccuuaaaugcuacu

SEQ ID NO: 2130561 - RNA, 18 nt, Homo sapiens
aaaaugaugcaaccaaaa

SEQ ID NO: 2130562 - RNA, 20 nt, Homo sapiens
uugucuguacauacuggccu

SEQ ID NO: 2130563 - RNA, 22 nt, Homo sapiens
uagaauggagggcaacauucca

SEQ ID NO: 2130564 - RNA, 14 nt, Homo sapiens
uucacagugaccau

SEQ ID NO: 2130565 - RNA, 13 nt, Homo sapiens
guccccagacucc

SEQ ID NO: 2130566 - RNA, 23 nt, Homo sapiens
uuccaacccagccacgacugcca

SEQ ID NO: 2130567 - RNA, 19 nt, Homo sapiens
gcuuaugguuuuaaugcaa

SEQ ID NO: 2130568 - RNA, 18 nt, Homo sapiens
acaauaccugaaugcucu

SEQ ID NO: 2130569 - RNA, 24 nt, Homo sapiens
acuucuuaccccagccuacccuuc

SEQ ID NO: 2130570 - RNA, 20 nt, Homo sapiens
accucggccucccaaagugc

SEQ ID NO: 2130571 - RNA, 15 nt, Homo sapiens
agcuaucugccugac

SEQ ID NO: 2130572 - RNA, 15 nt, Homo sapiens
uacaagcauuugccc

SEQ ID NO: 2130573 - RNA, 20 nt, Homo sapiens
uaggaggggaacuagguuac

SEQ ID NO: 2130574 - RNA, 21 nt, Homo sapiens
augaucauaauguuaacuaaa

SEQ ID NO: 2130575 - RNA, 21 nt, Homo sapiens
uauuccuguuucugaaccauu

SEQ ID NO: 2130576 - RNA, 18 nt, Homo sapiens
aacagucugaaauaccuu

SEQ ID NO: 2130577 - RNA, 14 nt, Homo sapiens
uauaagugcagaga

SEQ ID NO: 2130578 - RNA, 14 nt, Homo sapiens
uuguagugcuuuga

SEQ ID NO: 2130579 - RNA, 19 nt, Homo sapiens
ucgagaucaucacuuccuu

SEQ ID NO: 2130580 - RNA, 17 nt, Homo sapiens
uguugccuucaucuuca

SEQ ID NO: 2130581 - RNA, 20 nt, Homo sapiens
gaccgugaccguuugcuaua

SEQ ID NO: 2130582 - RNA, 22 nt, Homo sapiens
ugacucuuccauucaguuuuau

SEQ ID NO: 2130583 - RNA, 12 nt, Homo sapiens
auuaaagagcca

SEQ ID NO: 2130584 - RNA, 16 nt, Homo sapiens
agacaggacaggugug

SEQ ID NO: 2130585 - RNA, 23 nt, Homo sapiens
caugagcauuggauacagcagua

SEQ ID NO: 2130586 - RNA, 23 nt, Homo sapiens
uacaaaccauuuuguuauugacu

SEQ ID NO: 2130587 - RNA, 20 nt, Homo sapiens
ccucaucugcagaaugggga

SEQ ID NO: 2130588 - RNA, 16 nt, Homo sapiens
uccgccagauccugca

SEQ ID NO: 2130589 - RNA, 18 nt, Homo sapiens
auauguaaggaagucaga

SEQ ID NO: 2130590 - RNA, 16 nt, Homo sapiens
augcuguacacauauu

SEQ ID NO: 2130591 - RNA, 15 nt, Homo sapiens
acagucauaaugugu

SEQ ID NO: 2130592 - RNA, 13 nt, Homo sapiens
guauagugucuau

SEQ ID NO: 2130593 - RNA, 18 nt, Homo sapiens
aagaucaggccaacccca

SEQ ID NO: 2130594 - RNA, 23 nt, Homo sapiens
accccucccucccucuuucccac

SEQ ID NO: 2130595 - RNA, 17 nt, Homo sapiens
auagaaacaugacacug

SEQ ID NO: 2130596 - RNA, 18 nt, Homo sapiens
ugaccaccccucucgccu

SEQ ID NO: 2130597 - RNA, 22 nt, Homo sapiens
acagcccgggugugccugcccu

SEQ ID NO: 2130598 - RNA, 20 nt, Homo sapiens
ggguaauuuucuuugacucu

SEQ ID NO: 2130599 - RNA, 15 nt, Homo sapiens
gacaccagccuagcc

SEQ ID NO: 2130600 - RNA, 21 nt, Homo sapiens
cccuguggccaacugcaaaaa

SEQ ID NO: 2130601 - RNA, 21 nt, Homo sapiens
cacagcuucuccaagcaucac

SEQ ID NO: 2130602 - RNA, 23 nt, Homo sapiens
uacugcagagggacagaugacca

SEQ ID NO: 2130603 - RNA, 16 nt, Homo sapiens
cuuauagaaagcacua

SEQ ID NO: 2130604 - RNA, 23 nt, Homo sapiens
uaaaaauaugcuaauucucagaa

SEQ ID NO: 2130605 - RNA, 14 nt, Homo sapiens
ccuggcacauuuca

SEQ ID NO: 2130606 - RNA, 17 nt, Homo sapiens
gcccagaaaguccagcu

SEQ ID NO: 2130607 - RNA, 21 nt, Homo sapiens
aaaaggcuugagucuggauaa

SEQ ID NO: 2130608 - RNA, 15 nt, Homo sapiens
ggauuuauauucaag

SEQ ID NO: 2130609 - RNA, 20 nt, Homo sapiens
auccuauccuccuaccucca

SEQ ID NO: 2130610 - RNA, 20 nt, Homo sapiens
ucccucaaaugacccaaaga

SEQ ID NO: 2130611 - RNA, 15 nt, Homo sapiens
uguucacaccacagg

SEQ ID NO: 2130612 - RNA, 22 nt, Homo sapiens
ucaagcuuuggauaacgaugaa

SEQ ID NO: 2130613 - RNA, 20 nt, Homo sapiens
uuaucugugcgugaaacaca

SEQ ID NO: 2130614 - RNA, 22 nt, Homo sapiens
acagauuccaggcgaugugcaa

SEQ ID NO: 2130615 - RNA, 22 nt, Homo sapiens
aauuaagggagcugagccaguc

SEQ ID NO: 2130616 - RNA, 19 nt, Homo sapiens
acaauccacaaaugaugca

SEQ ID NO: 2130617 - RNA, 18 nt, Homo sapiens
cuguguugucagcacugu

SEQ ID NO: 2130618 - RNA, 19 nt, Homo sapiens
caagaacuugcaauaccaa

SEQ ID NO: 2130619 - RNA, 15 nt, Homo sapiens
uagguagcaacaaca

SEQ ID NO: 2130620 - RNA, 15 nt, Homo sapiens
caaguacaaccugaa

SEQ ID NO: 2130621 - RNA, 22 nt, Homo sapiens
acgugauaaaccugcuccaagg

SEQ ID NO: 2130622 - RNA, 14 nt, Homo sapiens
ccaacauucuuggc

SEQ ID NO: 2130623 - RNA, 22 nt, Homo sapiens
gcuggagcggggaucugaugaa

SEQ ID NO: 2130624 - RNA, 14 nt, Homo sapiens
caggccggccuuuc

SEQ ID NO: 2130625 - RNA, 19 nt, Homo sapiens
cuccccugccacuccucaa

SEQ ID NO: 2130626 - RNA, 19 nt, Homo sapiens
cacacauaaaagcacaaag

SEQ ID NO: 2130627 - RNA, 14 nt, Homo sapiens
guuacauaagauaa

SEQ ID NO: 2130628 - RNA, 12 nt, Homo sapiens
ucuauucauuau

SEQ ID NO: 2130629 - RNA, 14 nt, Homo sapiens
ccaggcugggcuga

SEQ ID NO: 2130630 - RNA, 15 nt, Homo sapiens
gacuguggugacuuc

SEQ ID NO: 2130631 - RNA, 16 nt, Homo sapiens
cugauguuacugagau

SEQ ID NO: 2130632 - RNA, 22 nt, Homo sapiens
uccacugaggaugugagccuga

SEQ ID NO: 2130633 - RNA, 21 nt, Homo sapiens
acaucucagggaacugacccu

SEQ ID NO: 2130634 - RNA, 15 nt, Homo sapiens
cuuuuaccaacccaa

SEQ ID NO: 2130635 - RNA, 13 nt, Homo sapiens
aucaaauucaaua

SEQ ID NO: 2130636 - RNA, 13 nt, Homo sapiens
aaauaauucucaa

SEQ ID NO: 2130637 - RNA, 16 nt, Homo sapiens
gaagacuucuuugcaa

SEQ ID NO: 2130638 - RNA, 17 nt, Homo sapiens
auugauuuucuuucuaa

SEQ ID NO: 2130639 - RNA, 14 nt, Homo sapiens
aacaaauaauuugu

SEQ ID NO: 2130640 - RNA, 20 nt, Homo sapiens
uuauuauuucuguucuuaca

SEQ ID NO: 2130641 - RNA, 20 nt, Homo sapiens
acugucuucuucaugucauc

SEQ ID NO: 2130642 - RNA, 14 nt, Homo sapiens
gcacaguuagcaaa

SEQ ID NO: 2130643 - RNA, 13 nt, Homo sapiens
uauagguguuugc

SEQ ID NO: 2130644 - RNA, 19 nt, Homo sapiens
gcaaacuguuuugacaaau

SEQ ID NO: 2130645 - RNA, 20 nt, Homo sapiens
uuguuuagauaugacauuua

SEQ ID NO: 2130646 - RNA, 14 nt, Homo sapiens
uguagccugugcau

SEQ ID NO: 2130647 - RNA, 23 nt, Homo sapiens
gcagggauguuccuuaccaagga

SEQ ID NO: 2130648 - RNA, 19 nt, Homo sapiens
auagaaacguaaacuauga

SEQ ID NO: 2130649 - RNA, 16 nt, Homo sapiens
aggccaaaccucuguu

SEQ ID NO: 2130650 - RNA, 16 nt, Homo sapiens
gcauauggugcuuaaa

SEQ ID NO: 2130651 - RNA, 14 nt, Homo sapiens
acucacugugggaa

SEQ ID NO: 2130652 - RNA, 18 nt, Homo sapiens
cuuuacucaaauugguga

SEQ ID NO: 2130653 - RNA, 17 nt, Homo sapiens
ccccaaauuuggcuaaa

SEQ ID NO: 2130654 - RNA, 21 nt, Homo sapiens
aacuauacauuuauuguuacg

SEQ ID NO: 2130655 - RNA, 19 nt, Homo sapiens
aauauauccccacuacuca

SEQ ID NO: 2130656 - RNA, 19 nt, Homo sapiens
ucucaaaguacugggauua

SEQ ID NO: 2130657 - RNA, 23 nt, Homo sapiens
uauuuaagccuuauaaaccaauc

SEQ ID NO: 2130658 - RNA, 19 nt, Homo sapiens
ugugaugugcaugggagca

SEQ ID NO: 2130659 - RNA, 19 nt, Homo sapiens
aggggcuucuaaugaccca

SEQ ID NO: 2130660 - RNA, 14 nt, Homo sapiens
cuacucucuugcca

SEQ ID NO: 2130661 - RNA, 23 nt, Homo sapiens
auugugaaaguauucuaagccaa

SEQ ID NO: 2130662 - RNA, 18 nt, Homo sapiens
agcccugccccacaccuc

SEQ ID NO: 2130663 - RNA, 17 nt, Homo sapiens
uuuagacuaacuuccau

SEQ ID NO: 2130664 - RNA, 14 nt, Homo sapiens
cuaaccacuaaugu

SEQ ID NO: 2130665 - RNA, 13 nt, Homo sapiens
cucaguccuguac

SEQ ID NO: 2130666 - RNA, 17 nt, Homo sapiens
cacaaagcaaaggcagu

SEQ ID NO: 2130667 - RNA, 15 nt, Homo sapiens
caauuaugcugugaa

SEQ ID NO: 2130668 - RNA, 14 nt, Homo sapiens
auuucugugccuag

SEQ ID NO: 2130669 - RNA, 19 nt, Homo sapiens
aaauuacguuuauguacua

SEQ ID NO: 2130670 - RNA, 20 nt, Homo sapiens
ugagaugguaacagauuugc

SEQ ID NO: 2130671 - RNA, 22 nt, Homo sapiens
gaacuagagcuugcagugaagu

SEQ ID NO: 2130672 - RNA, 22 nt, Homo sapiens
caaagaacaaacauccuugcaa

SEQ ID NO: 2130673 - RNA, 20 nt, Homo sapiens
cugcaccccucugcccucau

SEQ ID NO: 2130674 - RNA, 20 nt, Homo sapiens
cucugugggauaucacauca

SEQ ID NO: 2130675 - RNA, 17 nt, Homo sapiens
auggccaaauguucaau

SEQ ID NO: 2130676 - RNA, 19 nt, Homo sapiens
acugcugguugacaucaga

SEQ ID NO: 2130677 - RNA, 21 nt, Homo sapiens
uaguugaucuacaaaggccau

SEQ ID NO: 2130678 - RNA, 22 nt, Homo sapiens
aauugcuucacagccuuggcca

SEQ ID NO: 2130679 - RNA, 18 nt, Homo sapiens
gaggacuuugauugcaca

SEQ ID NO: 2130680 - RNA, 18 nt, Homo sapiens
uccucacucccaguuccc

SEQ ID NO: 2130681 - RNA, 17 nt, Homo sapiens
uuggaaaguacuaugaa

SEQ ID NO: 2130682 - RNA, 19 nt, Homo sapiens
caucaugggggauuuuuca

SEQ ID NO: 2130683 - RNA, 15 nt, Homo sapiens
ucauaggcuaaguca

SEQ ID NO: 2130684 - RNA, 20 nt, Homo sapiens
gacaaauaaauaguugcucu

SEQ ID NO: 2130685 - RNA, 22 nt, Homo sapiens
uuaaugcagagcuagaggacuu

SEQ ID NO: 2130686 - RNA, 12 nt, Homo sapiens
auucaguguuaa

SEQ ID NO: 2130687 - RNA, 18 nt, Homo sapiens
uagauuuuguugaccuca

SEQ ID NO: 2130688 - RNA, 15 nt, Homo sapiens
cagcagugccuugug

SEQ ID NO: 2130689 - RNA, 17 nt, Homo sapiens
ucuacuaaaaaugaaaa

SEQ ID NO: 2130690 - RNA, 12 nt, Homo sapiens
uauaaccccagc

SEQ ID NO: 2130691 - RNA, 19 nt, Homo sapiens
auaauuucuauuaauauca

SEQ ID NO: 2130692 - RNA, 14 nt, Homo sapiens
gggcuaaacaugug

SEQ ID NO: 2130693 - RNA, 19 nt, Homo sapiens
cuuugagaccuuuccucuc

SEQ ID NO: 2130694 - RNA, 21 nt, Homo sapiens
cuggguaccaaauuuaagcaa

SEQ ID NO: 2130695 - RNA, 22 nt, Homo sapiens
uugaguuaaugugcugagcauu

SEQ ID NO: 2130696 - RNA, 22 nt, Homo sapiens
ugggucaggaggaaaagacuaa

SEQ ID NO: 2130697 - RNA, 20 nt, Homo sapiens
ccaauuauuacaguccuuca

SEQ ID NO: 2130698 - RNA, 22 nt, Homo sapiens
uuggccaaacaucagaccuguc

SEQ ID NO: 2130699 - RNA, 14 nt, Homo sapiens
ugagucgcucucau

SEQ ID NO: 2130700 - RNA, 22 nt, Homo sapiens
ggcccugggcugggugcuggga

SEQ ID NO: 2130701 - RNA, 18 nt, Homo sapiens
aguacacccaguugccaa

SEQ ID NO: 2130702 - RNA, 14 nt, Homo sapiens
ccccuguaccuuuu

SEQ ID NO: 2130703 - RNA, 21 nt, Homo sapiens
aggcccugcgucaggcagugu

SEQ ID NO: 2130704 - RNA, 23 nt, Homo sapiens
cuccuugaguuuuccugcugcga

SEQ ID NO: 2130705 - RNA, 21 nt, Homo sapiens
aggugacugaaggcugucagg

SEQ ID NO: 2130706 - RNA, 16 nt, Homo sapiens
uagccagguaccuucu

SEQ ID NO: 2130707 - RNA, 14 nt, Homo sapiens
uuuauaaagauaua

SEQ ID NO: 2130708 - RNA, 21 nt, Homo sapiens
accgugcccggcccauucuaa

SEQ ID NO: 2130709 - RNA, 13 nt, Homo sapiens
cugucaaaugugu

SEQ ID NO: 2130710 - RNA, 21 nt, Homo sapiens
agcgugggccagaggcagcuc

SEQ ID NO: 2130711 - RNA, 13 nt, Homo sapiens
ugugguugcucac

SEQ ID NO: 2130712 - RNA, 21 nt, Homo sapiens
ucagccaauccgauugccuua

SEQ ID NO: 2130713 - RNA, 16 nt, Homo sapiens
auuccaggaaaacugg

SEQ ID NO: 2130714 - RNA, 23 nt, Homo sapiens
gguauccuucauuauccacccca

SEQ ID NO: 2130715 - RNA, 20 nt, Homo sapiens
uugagaaauuaaguaucuga

SEQ ID NO: 2130716 - RNA, 15 nt, Homo sapiens
aauuugucuuucaag

SEQ ID NO: 2130717 - RNA, 20 nt, Homo sapiens
uugaauuaauccacacauca

SEQ ID NO: 2130718 - RNA, 15 nt, Homo sapiens
ccuuuuucacugugg

SEQ ID NO: 2130719 - RNA, 20 nt, Homo sapiens
cucugaugagagagugcuga

SEQ ID NO: 2130720 - RNA, 19 nt, Homo sapiens
ucccugaacauaguuuuca

SEQ ID NO: 2130721 - RNA, 14 nt, Homo sapiens
uuucaacauaucau

SEQ ID NO: 2130722 - RNA, 22 nt, Homo sapiens
ggaugggacagaauguggcgug

SEQ ID NO: 2130723 - RNA, 14 nt, Homo sapiens
gugccacucauucc

SEQ ID NO: 2130724 - RNA, 15 nt, Homo sapiens
gaaggucccucagac

SEQ ID NO: 2130725 - RNA, 20 nt, Homo sapiens
uuccgcacccucccuagcuc

SEQ ID NO: 2130726 - RNA, 20 nt, Homo sapiens
acugcugaaacagacaugaa

SEQ ID NO: 2130727 - RNA, 21 nt, Homo sapiens
ggacggcaaggcugagguggc

SEQ ID NO: 2130728 - RNA, 19 nt, Homo sapiens
aguucagcuccuuccacca

SEQ ID NO: 2130729 - RNA, 14 nt, Homo sapiens
caccacugggcaaa

SEQ ID NO: 2130730 - RNA, 23 nt, Homo sapiens
caccaccuggggagagccugcuu

SEQ ID NO: 2130731 - RNA, 22 nt, Homo sapiens
ccucuugacguggcacuuaccc

SEQ ID NO: 2130732 - RNA, 20 nt, Homo sapiens
auauugcaagcuccaucucu

SEQ ID NO: 2130733 - RNA, 12 nt, Homo sapiens
auaccaagagau

SEQ ID NO: 2130734 - RNA, 21 nt, Homo sapiens
uuuacaaagcaucucauucau

SEQ ID NO: 2130735 - RNA, 15 nt, Homo sapiens
cuggcuugcacuuuc

SEQ ID NO: 2130736 - RNA, 12 nt, Homo sapiens
gauucaccuuuu

SEQ ID NO: 2130737 - RNA, 18 nt, Homo sapiens
auggucagaaugggugca

SEQ ID NO: 2130738 - RNA, 23 nt, Homo sapiens
ucugacuuaagcugccucaagga

SEQ ID NO: 2130739 - RNA, 12 nt, Homo sapiens
guauauguauaa

SEQ ID NO: 2130740 - RNA, 12 nt, Homo sapiens
aaauaugugaaa

SEQ ID NO: 2130741 - RNA, 18 nt, Homo sapiens
aaaugaauugccuuugau

SEQ ID NO: 2130742 - RNA, 14 nt, Homo sapiens
auucacagccagga

SEQ ID NO: 2130743 - RNA, 12 nt, Homo sapiens
uggaaacuaaua

SEQ ID NO: 2130744 - RNA, 19 nt, Homo sapiens
accuguagccaucugcaca

SEQ ID NO: 2130745 - RNA, 16 nt, Homo sapiens
uccaaugccaauucau

SEQ ID NO: 2130746 - RNA, 23 nt, Homo sapiens
ugccucucacaaugaaggaaguu

SEQ ID NO: 2130747 - RNA, 21 nt, Homo sapiens
uaucucuguaaucucugucaa

SEQ ID NO: 2130748 - RNA, 23 nt, Homo sapiens
cccguuucuuaaaaaacauauau

SEQ ID NO: 2130749 - RNA, 23 nt, Homo sapiens
acugagucuguggacacugugga

SEQ ID NO: 2130750 - RNA, 22 nt, Homo sapiens
ucucaaagcauaaaauggaaua

SEQ ID NO: 2130751 - RNA, 22 nt, Homo sapiens
gggaagcucacacauccuguca

SEQ ID NO: 2130752 - RNA, 15 nt, Homo sapiens
cacucaaaagacaaa

SEQ ID NO: 2130753 - RNA, 18 nt, Homo sapiens
ugaagagggagaagggau

SEQ ID NO: 2130754 - RNA, 14 nt, Homo sapiens
aauaggcaucucca

SEQ ID NO: 2130755 - RNA, 17 nt, Homo sapiens
aagaugugcucccacca

SEQ ID NO: 2130756 - RNA, 17 nt, Homo sapiens
ggcuguccauguauuca

SEQ ID NO: 2130757 - RNA, 12 nt, Homo sapiens
gacuagaucaca

SEQ ID NO: 2130758 - RNA, 12 nt, Homo sapiens
cuuguguacaaa

SEQ ID NO: 2130759 - RNA, 13 nt, Homo sapiens
uauucuuuacuau

SEQ ID NO: 2130760 - RNA, 22 nt, Homo sapiens
uaaauucccauuccaccacagu

SEQ ID NO: 2130761 - RNA, 18 nt, Homo sapiens
ugcgaauaagcuuuuaau

SEQ ID NO: 2130762 - RNA, 22 nt, Homo sapiens
caaugcuauaacuauguugaua

SEQ ID NO: 2130763 - RNA, 12 nt, Homo sapiens
acaaaaggcaga

SEQ ID NO: 2130764 - RNA, 15 nt, Homo sapiens
auccaggcagaucca

SEQ ID NO: 2130765 - RNA, 19 nt, Homo sapiens
ucuacugcaauguaaauag

SEQ ID NO: 2130766 - RNA, 17 nt, Homo sapiens
aacacuuaaucauuuua

SEQ ID NO: 2130767 - RNA, 12 nt, Homo sapiens
gaaaacacuguu

SEQ ID NO: 2130768 - RNA, 16 nt, Homo sapiens
ccccugauccagacaa

SEQ ID NO: 2130769 - RNA, 19 nt, Homo sapiens
guucacacucagaacccag

SEQ ID NO: 2130770 - RNA, 19 nt, Homo sapiens
uaaaauaaaagcacuuaug

SEQ ID NO: 2130771 - RNA, 22 nt, Homo sapiens
uggaucugcuuguugcauuucc

SEQ ID NO: 2130772 - RNA, 14 nt, Homo sapiens
ccucccaccagagc

SEQ ID NO: 2130773 - RNA, 18 nt, Homo sapiens
uucccucucccaguccau

SEQ ID NO: 2130774 - RNA, 16 nt, Homo sapiens
aaccguguccagcaca

SEQ ID NO: 2130775 - RNA, 15 nt, Homo sapiens
ccagcugacucccua

SEQ ID NO: 2130776 - RNA, 18 nt, Homo sapiens
gacucauacaccagguca

SEQ ID NO: 2130777 - RNA, 22 nt, Homo sapiens
gcuugucauauucgauguacuu

SEQ ID NO: 2130778 - RNA, 13 nt, Homo sapiens
agagaagccaugg

SEQ ID NO: 2130779 - RNA, 20 nt, Homo sapiens
gcaaggauuacacauuucac

SEQ ID NO: 2130780 - RNA, 13 nt, Homo sapiens
uuugcccagagag

SEQ ID NO: 2130781 - RNA, 21 nt, Homo sapiens
uccaucucuuguuuaaauuca

SEQ ID NO: 2130782 - RNA, 23 nt, Homo sapiens
uuaacuauuuuauuuucuaaugu

SEQ ID NO: 2130783 - RNA, 15 nt, Homo sapiens
ugugcucauuuugca

SEQ ID NO: 2130784 - RNA, 20 nt, Homo sapiens
guguuuauauauaagccaaa

SEQ ID NO: 2130785 - RNA, 17 nt, Homo sapiens
auaggcaaaaucugaca

SEQ ID NO: 2130786 - RNA, 14 nt, Homo sapiens
ugaagaaacauuua

SEQ ID NO: 2130787 - RNA, 14 nt, Homo sapiens
cgcugcgugccauc

SEQ ID NO: 2130788 - RNA, 16 nt, Homo sapiens
caaaguaaagacugag

SEQ ID NO: 2130789 - RNA, 19 nt, Homo sapiens
ugaauuucauuaaauggaa

SEQ ID NO: 2130790 - RNA, 15 nt, Homo sapiens
uauaagcugccauau

SEQ ID NO: 2130791 - RNA, 16 nt, Homo sapiens
cuagaagugugaagug

SEQ ID NO: 2130792 - RNA, 19 nt, Homo sapiens
cuccaugcugccuccagaa

SEQ ID NO: 2130793 - RNA, 22 nt, Homo sapiens
acuuuucacucuauagacuguu

SEQ ID NO: 2130794 - RNA, 11 nt, Homo sapiens
aaaaccaggcu

SEQ ID NO: 2130795 - RNA, 11 nt, Homo sapiens
acaaccaggau

SEQ ID NO: 2130796 - RNA, 20 nt, Homo sapiens
ugaggcaggagaagaacaag

SEQ ID NO: 2130797 - RNA, 14 nt, Homo sapiens
aacaacuugcuacu

SEQ ID NO: 2130798 - RNA, 11 nt, Homo sapiens
cucuuucacaa

SEQ ID NO: 2130799 - RNA, 15 nt, Homo sapiens
aaaugguaccaagga

SEQ ID NO: 2130800 - RNA, 22 nt, Homo sapiens
aauaguuuaacugaaaguuuaa

SEQ ID NO: 2130801 - RNA, 15 nt, Homo sapiens
gacuagguacaggca

SEQ ID NO: 2130802 - RNA, 14 nt, Homo sapiens
agcucacaguacaa

SEQ ID NO: 2130803 - RNA, 20 nt, Homo sapiens
ggcccucccccagcuccuug

SEQ ID NO: 2130804 - RNA, 14 nt, Homo sapiens
gcugcacagcaaaa

SEQ ID NO: 2130805 - RNA, 16 nt, Homo sapiens
caugucugaaacagag

SEQ ID NO: 2130806 - RNA, 15 nt, Homo sapiens
aauuuugccaaauaa

SEQ ID NO: 2130807 - RNA, 21 nt, Homo sapiens
aagcaguguuuucaccucaua

SEQ ID NO: 2130808 - RNA, 23 nt, Homo sapiens
auugaagcccuccaaaagcacuu

SEQ ID NO: 2130809 - RNA, 22 nt, Homo sapiens
aaaguuguguaggcaccaccuc

SEQ ID NO: 2130810 - RNA, 17 nt, Homo sapiens
aguauuuacacuaugau

SEQ ID NO: 2130811 - RNA, 13 nt, Homo sapiens
cagcuaaauuuuc

SEQ ID NO: 2130812 - RNA, 22 nt, Homo sapiens
gaggcuccacuuggucugugag

SEQ ID NO: 2130813 - RNA, 22 nt, Homo sapiens
agauacacaaucugaaacagcu

SEQ ID NO: 2130814 - RNA, 16 nt, Homo sapiens
ugagaagugcacuuua

SEQ ID NO: 2130815 - RNA, 14 nt, Homo sapiens
ccacugaaauggac

SEQ ID NO: 2130816 - RNA, 21 nt, Homo sapiens
uggauuuuacauguggcccaa

SEQ ID NO: 2130817 - RNA, 14 nt, Homo sapiens
cucaaauauugaau

SEQ ID NO: 2130818 - RNA, 10 nt, Homo sapiens
ccaucccucc

SEQ ID NO: 2130819 - RNA, 10 nt, Homo sapiens
caaucccuca

SEQ ID NO: 2130820 - RNA, 15 nt, Homo sapiens
auggaguguuugaaa

SEQ ID NO: 2130821 - RNA, 17 nt, Homo sapiens
uauaacuuuggaggaaa

SEQ ID NO: 2130822 - RNA, 18 nt, Homo sapiens
cuaaaaaggccccugugg

SEQ ID NO: 2130823 - RNA, 16 nt, Homo sapiens
aaaaggggggugggag

SEQ ID NO: 2130824 - RNA, 16 nt, Homo sapiens
ugagcuauaacuuacu

SEQ ID NO: 2130825 - RNA, 22 nt, Homo sapiens
accugccaagagucaacagguc

SEQ ID NO: 2130826 - RNA, 18 nt, Homo sapiens
caguuuguccacacaaga

SEQ ID NO: 2130827 - RNA, 17 nt, Homo sapiens
aagcaugccucuucccu

SEQ ID NO: 2130828 - RNA, 14 nt, Homo sapiens
gaacgcacaugaca

SEQ ID NO: 2130829 - RNA, 16 nt, Homo sapiens
gaaaguacagaacaaa

SEQ ID NO: 2130830 - RNA, 22 nt, Homo sapiens
aauaaaaguugaucauaauuaa

SEQ ID NO: 2130831 - RNA, 16 nt, Homo sapiens
caguugcccucaggcc

SEQ ID NO: 2130832 - RNA, 18 nt, Homo sapiens
cagcuguccccccacucc

SEQ ID NO: 2130833 - RNA, 20 nt, Homo sapiens
cucuugaauuccugggcuca

SEQ ID NO: 2130834 - RNA, 14 nt, Homo sapiens
aauguugcauuaau

SEQ ID NO: 2130835 - RNA, 20 nt, Homo sapiens
ugcuaacuuaaaaaacugca

SEQ ID NO: 2130836 - RNA, 16 nt, Homo sapiens
aaccugaauuauucca

SEQ ID NO: 2130837 - RNA, 19 nt, Homo sapiens
caguagguugaacuaugaa

SEQ ID NO: 2130838 - RNA, 15 nt, Homo sapiens
acagauuuguucauu

SEQ ID NO: 2130839 - RNA, 15 nt, Homo sapiens
guacuguuacugugu

SEQ ID NO: 2130840 - RNA, 11 nt, Homo sapiens
gcagcugugag

SEQ ID NO: 2130841 - RNA, 11 nt, Homo sapiens
gaagcugugcg

SEQ ID NO: 2130842 - RNA, 18 nt, Homo sapiens
gcccaggacccaucuuuc

SEQ ID NO: 2130843 - RNA, 19 nt, Homo sapiens
caggaggagcugauaauga

SEQ ID NO: 2130844 - RNA, 19 nt, Homo sapiens
gaaaggagccuaggccagg

SEQ ID NO: 2130845 - RNA, 16 nt, Homo sapiens
uuggggcuucugugaa

SEQ ID NO: 2130846 - RNA, 12 nt, Homo sapiens
auuuuauggcaa

SEQ ID NO: 2130847 - RNA, 16 nt, Homo sapiens
ccgaguaaugacgugu

SEQ ID NO: 2130848 - RNA, 22 nt, Homo sapiens
aaacuuucccuuggcuguuaag

SEQ ID NO: 2130849 - RNA, 18 nt, Homo sapiens
ucaauccugucauauaau

SEQ ID NO: 2130850 - RNA, 15 nt, Homo sapiens
aauucccuucaucug

SEQ ID NO: 2130851 - RNA, 13 nt, Homo sapiens
ccuccuguaaaug

SEQ ID NO: 2130852 - RNA, 21 nt, Homo sapiens
uggccagcgucuugcucuguu

SEQ ID NO: 2130853 - RNA, 13 nt, Homo sapiens
gcagucacuucca

SEQ ID NO: 2130854 - RNA, 21 nt, Homo sapiens
ccaaggaugacacugccaguc

SEQ ID NO: 2130855 - RNA, 17 nt, Homo sapiens
uuguccugccagcugcc

SEQ ID NO: 2130856 - RNA, 16 nt, Homo sapiens
ucacuguugccugcau

SEQ ID NO: 2130857 - RNA, 13 nt, Homo sapiens
ggcacucaggggg

SEQ ID NO: 2130858 - RNA, 13 nt, Homo sapiens
uauuugguacugu

SEQ ID NO: 2130859 - RNA, 19 nt, Homo sapiens
cuaguagcugggauuacag

SEQ ID NO: 2130860 - RNA, 15 nt, Homo sapiens
gucuuauuuguucau

SEQ ID NO: 2130861 - RNA, 20 nt, Homo sapiens
ugcuuuaaaucuuaagcaau

SEQ ID NO: 2130862 - RNA, 17 nt, Homo sapiens
auggcacugcaggugag

SEQ ID NO: 2130863 - RNA, 16 nt, Homo sapiens
uuuugaaaagaacaaa

SEQ ID NO: 2130864 - RNA, 11 nt, Homo sapiens
uggaaagucaa

SEQ ID NO: 2130865 - RNA, 16 nt, Homo sapiens
ugugaccacaguugua

SEQ ID NO: 2130866 - RNA, 15 nt, Homo sapiens
cuugggggucagggg

SEQ ID NO: 2130867 - RNA, 20 nt, Homo sapiens
agaaauucaacguuaauaau

SEQ ID NO: 2130868 - RNA, 16 nt, Homo sapiens
aagcagccugccauau

SEQ ID NO: 2130869 - RNA, 14 nt, Homo sapiens
uugcugcaaagaga

SEQ ID NO: 2130870 - RNA, 13 nt, Homo sapiens
gaugcaaccaaaa

SEQ ID NO: 2130871 - RNA, 17 nt, Homo sapiens
cauaaagacaaucacug

SEQ ID NO: 2130872 - RNA, 22 nt, Homo sapiens
agucuuuauguccauaagcuac

SEQ ID NO: 2130873 - RNA, 23 nt, Homo sapiens
cacaagaggaauaagaauggagc

SEQ ID NO: 2130874 - RNA, 14 nt, Homo sapiens
ccuccccacccucc

SEQ ID NO: 2130875 - RNA, 19 nt, Homo sapiens
guuguucuaguaacaauac

SEQ ID NO: 2130876 - RNA, 14 nt, Homo sapiens
uaauagacacugga

SEQ ID NO: 2130877 - RNA, 16 nt, Homo sapiens
caagucuauaauccua

SEQ ID NO: 2130878 - RNA, 14 nt, Homo sapiens
uuuucaacauugua

SEQ ID NO: 2130879 - RNA, 15 nt, Homo sapiens
uggccuuuaucucaa

SEQ ID NO: 2130880 - RNA, 21 nt, Homo sapiens
gcuuaacuccccacugccugu

SEQ ID NO: 2130881 - RNA, 17 nt, Homo sapiens
ucucaaauuuguggucc

SEQ ID NO: 2130882 - RNA, 17 nt, Homo sapiens
ggaagccuccugcugag

SEQ ID NO: 2130883 - RNA, 20 nt, Homo sapiens
ccccacuuccaucauuuccu

SEQ ID NO: 2130884 - RNA, 19 nt, Homo sapiens
augaagagaagcugagaag

SEQ ID NO: 2130885 - RNA, 23 nt, Homo sapiens
aacauggcugaacgcguguguac

SEQ ID NO: 2130886 - RNA, 21 nt, Homo sapiens
cauuucgaagucaucauuccu

SEQ ID NO: 2130887 - RNA, 20 nt, Homo sapiens
ugccgaagaugagacugccc

SEQ ID NO: 2130888 - RNA, 14 nt, Homo sapiens
agacuaucaaagac

SEQ ID NO: 2130889 - RNA, 17 nt, Homo sapiens
ugagauggagugagcug

SEQ ID NO: 2130890 - RNA, 16 nt, Homo sapiens
ccccaagaucugccag

SEQ ID NO: 2130891 - RNA, 22 nt, Homo sapiens
cugccuggucaauaaaccacug

SEQ ID NO: 2130892 - RNA, 17 nt, Homo sapiens
aggcugucugugccaug

SEQ ID NO: 2130893 - RNA, 15 nt, Homo sapiens
ugcugucacaaagga

SEQ ID NO: 2130894 - RNA, 15 nt, Homo sapiens
cacuugcaugaauua

SEQ ID NO: 2130895 - RNA, 22 nt, Homo sapiens
acagcuuucugaccuucagcuc

SEQ ID NO: 2130896 - RNA, 22 nt, Homo sapiens
cagauacuaugguucuccacua

SEQ ID NO: 2130897 - RNA, 21 nt, Homo sapiens
acgugcccagccacaucaucu

SEQ ID NO: 2130898 - RNA, 16 nt, Homo sapiens
aagugucuaaugcauu

SEQ ID NO: 2130899 - RNA, 15 nt, Homo sapiens
ccgggcccugcugag

SEQ ID NO: 2130900 - RNA, 13 nt, Homo sapiens
caucagcuuuauu

SEQ ID NO: 2130901 - RNA, 19 nt, Homo sapiens
aggcugaucgacgacauuu

SEQ ID NO: 2130902 - RNA, 22 nt, Homo sapiens
cagaaauuuaucuuucaaagag

SEQ ID NO: 2130903 - RNA, 16 nt, Homo sapiens
gcuguccccacugccc

SEQ ID NO: 2130904 - RNA, 14 nt, Homo sapiens
cuucuaacacaaaa

SEQ ID NO: 2130905 - RNA, 17 nt, Homo sapiens
cucugcuccccugugaa

SEQ ID NO: 2130906 - RNA, 19 nt, Homo sapiens
ucaaagucaacauuugaga

SEQ ID NO: 2130907 - RNA, 12 nt, Homo sapiens
aaggaucuuuca

SEQ ID NO: 2130908 - RNA, 21 nt, Homo sapiens
aacuucagguaaaaacuucau

SEQ ID NO: 2130909 - RNA, 21 nt, Homo sapiens
caucuuuaucaugaagcacau

SEQ ID NO: 2130910 - RNA, 18 nt, Homo sapiens
agcacuaauuagugucca

SEQ ID NO: 2130911 - RNA, 21 nt, Homo sapiens
gcugcucacuuuccacccucu

SEQ ID NO: 2130912 - RNA, 15 nt, Homo sapiens
aguuuaccucaucca

SEQ ID NO: 2130913 - RNA, 21 nt, Homo sapiens
cuugccugugcuacaauucau

SEQ ID NO: 2130914 - RNA, 12 nt, Homo sapiens
cccuugcucuca

SEQ ID NO: 2130915 - RNA, 17 nt, Homo sapiens
agggacaucaucucuuc

SEQ ID NO: 2130916 - RNA, 10 nt, Homo sapiens
agcauugugu

SEQ ID NO: 2130917 - RNA, 17 nt, Homo sapiens
gaucuggucccuugcag

SEQ ID NO: 2130918 - RNA, 14 nt, Homo sapiens
acuguacucugcac

SEQ ID NO: 2130919 - RNA, 19 nt, Homo sapiens
cuaaaccauucaccaagag

SEQ ID NO: 2130920 - RNA, 21 nt, Homo sapiens
gcccaaucauuugcaaugccc

SEQ ID NO: 2130921 - RNA, 15 nt, Homo sapiens
uaaauuucccaguua

SEQ ID NO: 2130922 - RNA, 19 nt, Homo sapiens
cucuaggacucugcacuga

SEQ ID NO: 2130923 - RNA, 18 nt, Homo sapiens
ggagucugucucugcuau

SEQ ID NO: 2130924 - RNA, 22 nt, Homo sapiens
uaauaugugaugauuaauacaa

SEQ ID NO: 2130925 - RNA, 15 nt, Homo sapiens
aggaaaaaugcugcu

SEQ ID NO: 2130926 - RNA, 21 nt, Homo sapiens
agguuggccuuacgaaauccu

SEQ ID NO: 2130927 - RNA, 19 nt, Homo sapiens
ccugcguggggacagggcu

SEQ ID NO: 2130928 - RNA, 13 nt, Homo sapiens
ccauugagacuau

SEQ ID NO: 2130929 - RNA, 18 nt, Homo sapiens
ugcaccaaagacaucagu

SEQ ID NO: 2130930 - RNA, 19 nt, Homo sapiens
gagaaagagagaagccagc

SEQ ID NO: 2130931 - RNA, 15 nt, Homo sapiens
ugggcacagagguca

SEQ ID NO: 2130932 - RNA, 15 nt, Homo sapiens
cgucuccucccucag

SEQ ID NO: 2130933 - RNA, 19 nt, Homo sapiens
cuucugacacugaaacuuc

SEQ ID NO: 2130934 - RNA, 17 nt, Homo sapiens
agcaucuguuuaccugg

SEQ ID NO: 2130935 - RNA, 21 nt, Homo sapiens
uucccuuuuuuggcugcugaa

SEQ ID NO: 2130936 - RNA, 18 nt, Homo sapiens
guggugaucgcacaagga

SEQ ID NO: 2130937 - RNA, 18 nt, Homo sapiens
aagggcagcuucagucuc

SEQ ID NO: 2130938 - RNA, 21 nt, Homo sapiens
aguaaaauauuaacauauuau

SEQ ID NO: 2130939 - RNA, 18 nt, Homo sapiens
acugccugucugcuugca

SEQ ID NO: 2130940 - RNA, 17 nt, Homo sapiens
aaauauuuaagugcagu

SEQ ID NO: 2130941 - RNA, 16 nt, Homo sapiens
cauuaaagugcacugu

SEQ ID NO: 2130942 - RNA, 20 nt, Homo sapiens
aaguuauguguuaaauuuag

SEQ ID NO: 2130943 - RNA, 21 nt, Homo sapiens
uucaaauggacaaacugccag

SEQ ID NO: 2130944 - RNA, 16 nt, Homo sapiens
uaaucaguguuuccaa

SEQ ID NO: 2130945 - RNA, 23 nt, Homo sapiens
uccaaacaguguguuggugcuuu

SEQ ID NO: 2130946 - RNA, 16 nt, Homo sapiens
ggugacaguucccaga

SEQ ID NO: 2130947 - RNA, 14 nt, Homo sapiens
cauguuuugagauu

SEQ ID NO: 2130948 - RNA, 23 nt, Homo sapiens
uuuuaugagaaaugccagugugc

SEQ ID NO: 2130949 - RNA, 21 nt, Homo sapiens
cagauuugcccuccuccugcu

SEQ ID NO: 2130950 - RNA, 22 nt, Homo sapiens
aaugaagacaaaacauacauuu

SEQ ID NO: 2130951 - RNA, 14 nt, Homo sapiens
aauugaaguacuua

SEQ ID NO: 2130952 - RNA, 19 nt, Homo sapiens
ucucgguugaaaccuguau

SEQ ID NO: 2130953 - RNA, 14 nt, Homo sapiens
gaggagguucacug

SEQ ID NO: 2130954 - RNA, 21 nt, Homo sapiens
ugacugauccugaacaagaaa

SEQ ID NO: 2130955 - RNA, 17 nt, Homo sapiens
aguucuguguggugcau

SEQ ID NO: 2130956 - RNA, 23 nt, Homo sapiens
gaauguucccugcacccuggaaa

SEQ ID NO: 2130957 - RNA, 14 nt, Homo sapiens
gguguauguaugag

SEQ ID NO: 2130958 - RNA, 20 nt, Homo sapiens
guucgagaccagccuggcca

SEQ ID NO: 2130959 - RNA, 20 nt, Homo sapiens
gcuuagauuucuagcaguau

SEQ ID NO: 2130960 - RNA, 15 nt, Homo sapiens
uacaauuagccaggu

SEQ ID NO: 2130961 - RNA, 15 nt, Homo sapiens
cauugccccaugaga

SEQ ID NO: 2130962 - RNA, 21 nt, Homo sapiens
cugcucguucaacagugugag

SEQ ID NO: 2130963 - RNA, 13 nt, Homo sapiens
acuguaaacauuc

SEQ ID NO: 2130964 - RNA, 19 nt, Homo sapiens
auaucaauggugcugaggu

SEQ ID NO: 2130965 - RNA, 16 nt, Homo sapiens
ucugggcaaauagauu

SEQ ID NO: 2130966 - RNA, 19 nt, Homo sapiens
agcauugccagcucuucca

SEQ ID NO: 2130967 - RNA, 13 nt, Homo sapiens
cuuuagaugcuga

SEQ ID NO: 2130968 - RNA, 14 nt, Homo sapiens
acccacuucuccca

SEQ ID NO: 2130969 - RNA, 18 nt, Homo sapiens
accaaggaagcagccuca

SEQ ID NO: 2130970 - RNA, 13 nt, Homo sapiens
cuucggauaugau

SEQ ID NO: 2130971 - RNA, 23 nt, Homo sapiens
aagagauugagauguaagucuca

SEQ ID NO: 2130972 - RNA, 18 nt, Homo sapiens
gcuggccuccuaugccuc

SEQ ID NO: 2130973 - RNA, 15 nt, Homo sapiens
ucuacugaggugcua

SEQ ID NO: 2130974 - RNA, 20 nt, Homo sapiens
acaaagccccccagcuccca

SEQ ID NO: 2130975 - RNA, 21 nt, Homo sapiens
augaguuuuacauuacaaauu

SEQ ID NO: 2130976 - RNA, 21 nt, Homo sapiens
cauauuuuccuuuaugugaug

SEQ ID NO: 2130977 - RNA, 20 nt, Homo sapiens
aaaucauuugaggucagaag

SEQ ID NO: 2130978 - RNA, 14 nt, Homo sapiens
accuacuagacaau

SEQ ID NO: 2130979 - RNA, 13 nt, Homo sapiens
cucuucuacuucu

SEQ ID NO: 2130980 - RNA, 16 nt, Homo sapiens
cuccccgucccugucc

SEQ ID NO: 2130981 - RNA, 22 nt, Homo sapiens
cuucauuccuuccacuaacuca

SEQ ID NO: 2130982 - RNA, 15 nt, Homo sapiens
gauguuuccaaugcu

SEQ ID NO: 2130983 - RNA, 16 nt, Homo sapiens
agugguaggucagcua

SEQ ID NO: 2130984 - RNA, 16 nt, Homo sapiens
accacauagacuuuau

SEQ ID NO: 2130985 - RNA, 13 nt, Homo sapiens
acuugaaauacca

SEQ ID NO: 2130986 - RNA, 13 nt, Homo sapiens
cccaaucccucuc

SEQ ID NO: 2130987 - RNA, 19 nt, Homo sapiens
uugaaccgucaaugugaaa

SEQ ID NO: 2130988 - RNA, 17 nt, Homo sapiens
caccguacaucugcaau

SEQ ID NO: 2130989 - RNA, 21 nt, Homo sapiens
acacuguaaucuuaaaagugu

SEQ ID NO: 2130990 - RNA, 17 nt, Homo sapiens
ugacaacaauccaaaaa

SEQ ID NO: 2130991 - RNA, 16 nt, Homo sapiens
ucacaucucagggaac

SEQ ID NO: 2130992 - RNA, 20 nt, Homo sapiens
cuuuaggaaaaaaagcaugu

SEQ ID NO: 2130993 - RNA, 16 nt, Homo sapiens
cuuauccuagccuuug

SEQ ID NO: 2130994 - RNA, 19 nt, Homo sapiens
aucuguugauaaauccauc

SEQ ID NO: 2130995 - RNA, 13 nt, Homo sapiens
aagcaaucugccc

SEQ ID NO: 2130996 - RNA, 10 nt, Homo sapiens
ugcugagcaa

SEQ ID NO: 2130997 - RNA, 22 nt, Homo sapiens
uaaagaaaaagucauccaaucu

SEQ ID NO: 2130998 - RNA, 20 nt, Homo sapiens
gcguuacuguagaccuuucu

SEQ ID NO: 2130999 - RNA, 19 nt, Homo sapiens
gcucccugagguaccuuuc

SEQ ID NO: 2131000 - RNA, 12 nt, Homo sapiens
ggacaagugauc

SEQ ID NO: 2131001 - RNA, 13 nt, Homo sapiens
cuuuauguaucuc

SEQ ID NO: 2131002 - RNA, 17 nt, Homo sapiens
caaagaugguggcugug

SEQ ID NO: 2131003 - RNA, 15 nt, Homo sapiens
uugcuguuaaucuga

SEQ ID NO: 2131004 - RNA, 14 nt, Homo sapiens
ucacacagagugcc

SEQ ID NO: 2131005 - RNA, 11 nt, Homo sapiens
agcuacuguaa

SEQ ID NO: 2131006 - RNA, 21 nt, Homo sapiens
gcccccugggcuggggccuca

SEQ ID NO: 2131007 - RNA, 20 nt, Homo sapiens
cacuguggcauugucuguaa

SEQ ID NO: 2131008 - RNA, 16 nt, Homo sapiens
auggaguggcugccau

SEQ ID NO: 2131009 - RNA, 16 nt, Homo sapiens
cacacguuugugagcu

SEQ ID NO: 2131010 - RNA, 22 nt, Homo sapiens
uagucuguuguucuugaaaacu

SEQ ID NO: 2131011 - RNA, 18 nt, Homo sapiens
cccagcagacaucaagcu

SEQ ID NO: 2131012 - RNA, 19 nt, Homo sapiens
agauuccauuuuauaucca

SEQ ID NO: 2131013 - RNA, 21 nt, Homo sapiens
cauucccguggaacguuuuuc

SEQ ID NO: 2131014 - RNA, 23 nt, Homo sapiens
uacaugugauugugauucaucau

SEQ ID NO: 2131015 - RNA, 22 nt, Homo sapiens
ucacccaaaacuuuuggcaaau

SEQ ID NO: 2131016 - RNA, 17 nt, Homo sapiens
ugauuuuugcccagaaa

SEQ ID NO: 2131017 - RNA, 21 nt, Homo sapiens
aacucaaccuggacacucucu

SEQ ID NO: 2131018 - RNA, 18 nt, Homo sapiens
ccucaguguccucaucua

SEQ ID NO: 2131019 - RNA, 20 nt, Homo sapiens
cucuguagcuuaaaccaaca

SEQ ID NO: 2131020 - RNA, 17 nt, Homo sapiens
aauaauaucccacuggg

SEQ ID NO: 2131021 - RNA, 14 nt, Homo sapiens
uaaauuugauccca

SEQ ID NO: 2131022 - RNA, 22 nt, Homo sapiens
cacuaccauugcuguucuacuu

SEQ ID NO: 2131023 - RNA, 20 nt, Homo sapiens
aguuguuuuggugccugccu

SEQ ID NO: 2131024 - RNA, 23 nt, Homo sapiens
acuaugauuuaauuugaaauaug

SEQ ID NO: 2131025 - RNA, 15 nt, Homo sapiens
agcuaugauaugugc

SEQ ID NO: 2131026 - RNA, 15 nt, Homo sapiens
acaacaggauuuuca

SEQ ID NO: 2131027 - RNA, 23 nt, Homo sapiens
cuagagacgcugauccauaaaga

SEQ ID NO: 2131028 - RNA, 14 nt, Homo sapiens
guccccacagacug

SEQ ID NO: 2131029 - RNA, 11 nt, Homo sapiens
gguggggcuuc

SEQ ID NO: 2131030 - RNA, 15 nt, Homo sapiens
auaaauuuuggucag

SEQ ID NO: 2131031 - RNA, 19 nt, Homo sapiens
aguauaaaugaauuugcau

SEQ ID NO: 2131032 - RNA, 17 nt, Homo sapiens
aaguagaaauggugaga

SEQ ID NO: 2131033 - RNA, 15 nt, Homo sapiens
auggcucaugaccug

SEQ ID NO: 2131034 - RNA, 13 nt, Homo sapiens
cauuuucucugau

SEQ ID NO: 2131035 - RNA, 18 nt, Homo sapiens
aauuuuagaagacagccu

SEQ ID NO: 2131036 - RNA, 17 nt, Homo sapiens
uacucauauguggaauc

SEQ ID NO: 2131037 - RNA, 12 nt, Homo sapiens
acccuacagcag

SEQ ID NO: 2131038 - RNA, 18 nt, Homo sapiens
uuugaauucauacuagaa

SEQ ID NO: 2131039 - RNA, 13 nt, Homo sapiens
acugaucacccaa

SEQ ID NO: 2131040 - RNA, 15 nt, Homo sapiens
accauguauucccuu

SEQ ID NO: 2131041 - RNA, 17 nt, Homo sapiens
uuuccuguauugcuuua

SEQ ID NO: 2131042 - RNA, 14 nt, Homo sapiens
gccugugcuaaaga

SEQ ID NO: 2131043 - RNA, 18 nt, Homo sapiens
cagauuggcucacacuga

SEQ ID NO: 2131044 - RNA, 15 nt, Homo sapiens
ugaucuguaccauga

SEQ ID NO: 2131045 - RNA, 13 nt, Homo sapiens
uacucugcacuau

SEQ ID NO: 2131046 - RNA, 17 nt, Homo sapiens
ugcugaaaaccaucugg

SEQ ID NO: 2131047 - RNA, 15 nt, Homo sapiens
caccccacagacucc

SEQ ID NO: 2131048 - RNA, 19 nt, Homo sapiens
gcugcugccauccaugugc

SEQ ID NO: 2131049 - RNA, 18 nt, Homo sapiens
gaacuccggaaugaccag

SEQ ID NO: 2131050 - RNA, 19 nt, Homo sapiens
acuaagauaaauucaugca

SEQ ID NO: 2131051 - RNA, 16 nt, Homo sapiens
aguaaaggcaaacuua

SEQ ID NO: 2131052 - RNA, 14 nt, Homo sapiens
aaugcuaaguccau

SEQ ID NO: 2131053 - RNA, 17 nt, Homo sapiens
acucaguucgaccaaac

SEQ ID NO: 2131054 - RNA, 22 nt, Homo sapiens
gacagauugccuguuucugauu

SEQ ID NO: 2131055 - RNA, 18 nt, Homo sapiens
auuuauaaugaagacauc

SEQ ID NO: 2131056 - RNA, 13 nt, Homo sapiens
cuagaugcaaaua

SEQ ID NO: 2131057 - RNA, 13 nt, Homo sapiens
acaggcacaaaau

SEQ ID NO: 2131058 - RNA, 20 nt, Homo sapiens
caaucguucuguguuugaua

SEQ ID NO: 2131059 - RNA, 19 nt, Homo sapiens
aguuccuuauaagaauuaa

SEQ ID NO: 2131060 - RNA, 22 nt, Homo sapiens
uugaggagcauguuuuguauac

SEQ ID NO: 2131061 - RNA, 12 nt, Homo sapiens
gcauaucugccu

SEQ ID NO: 2131062 - RNA, 12 nt, Homo sapiens
ucauaucuuccu

SEQ ID NO: 2131063 - RNA, 23 nt, Homo sapiens
cuaccuaacccagaaaaucugaa

SEQ ID NO: 2131064 - RNA, 16 nt, Homo sapiens
uggaguggacauucaa

SEQ ID NO: 2131065 - RNA, 21 nt, Homo sapiens
aaaugugucuugucuccauuu

SEQ ID NO: 2131066 - RNA, 24 nt, Homo sapiens
ugccaccucugacgcaccacugcc

SEQ ID NO: 2131067 - RNA, 12 nt, Homo sapiens
gauuucagccau

SEQ ID NO: 2131068 - RNA, 20 nt, Homo sapiens
cuggagggcuagaaucugga

SEQ ID NO: 2131069 - RNA, 17 nt, Homo sapiens
accugcggcugcugugu

SEQ ID NO: 2131070 - RNA, 14 nt, Homo sapiens
cugccacauccagc

SEQ ID NO: 2131071 - RNA, 13 nt, Homo sapiens
guaauaacauuua

SEQ ID NO: 2131072 - RNA, 15 nt, Homo sapiens
uaaaccuaugaauaa

SEQ ID NO: 2131073 - RNA, 18 nt, Homo sapiens
gaccaucugcugcaguua

SEQ ID NO: 2131074 - RNA, 14 nt, Homo sapiens
gaggagggcccuga

SEQ ID NO: 2131075 - RNA, 22 nt, Homo sapiens
accaggcagugugccaguuuaa

SEQ ID NO: 2131076 - RNA, 18 nt, Homo sapiens
aguucuauuaucuggguu

SEQ ID NO: 2131077 - RNA, 23 nt, Homo sapiens
augugaggguuuguaauggugcu

SEQ ID NO: 2131078 - RNA, 18 nt, Homo sapiens
uuuucaggggucguccca

SEQ ID NO: 2131079 - RNA, 18 nt, Homo sapiens
cuagacuuguguguucua

SEQ ID NO: 2131080 - RNA, 15 nt, Homo sapiens
ucuucaagguuugga

SEQ ID NO: 2131081 - RNA, 22 nt, Homo sapiens
cuuccuucuuuaucuauagcaa

SEQ ID NO: 2131082 - RNA, 19 nt, Homo sapiens
aacccuccaccccuacccc

SEQ ID NO: 2131083 - RNA, 22 nt, Homo sapiens
gaagauguuuaacuuaaucaau

SEQ ID NO: 2131084 - RNA, 18 nt, Homo sapiens
aucaaauauuaccaaaaa

SEQ ID NO: 2131085 - RNA, 16 nt, Homo sapiens
aaacuucaaagcugaa

SEQ ID NO: 2131086 - RNA, 15 nt, Homo sapiens
uuguaagugcugcua

SEQ ID NO: 2131087 - RNA, 16 nt, Homo sapiens
aauuuuacaugucuca

SEQ ID NO: 2131088 - RNA, 22 nt, Homo sapiens
gaauuuuuuuuuuuaagcucaa

SEQ ID NO: 2131089 - RNA, 19 nt, Homo sapiens
auuuaaaauaacacuugcc

SEQ ID NO: 2131090 - RNA, 17 nt, Homo sapiens
ccaaccuguaauaaaua

SEQ ID NO: 2131091 - RNA, 21 nt, Homo sapiens
auuaucccuuacagacuugaa

SEQ ID NO: 2131092 - RNA, 18 nt, Homo sapiens
caugcauacuuacagacu

SEQ ID NO: 2131093 - RNA, 21 nt, Homo sapiens
uguaggcuaaaaggcuuccag

SEQ ID NO: 2131094 - RNA, 11 nt, Homo sapiens
cuuaggugcca

SEQ ID NO: 2131095 - RNA, 13 nt, Homo sapiens
gguuuagaaucaa

SEQ ID NO: 2131096 - RNA, 17 nt, Homo sapiens
ucccgagucaugcacuc

SEQ ID NO: 2131097 - RNA, 22 nt, Homo sapiens
gcccaggaucaagucacucauc

SEQ ID NO: 2131098 - RNA, 19 nt, Homo sapiens
augaggauuauugauagua

SEQ ID NO: 2131099 - RNA, 14 nt, Homo sapiens
ucaaaaaguacaau

SEQ ID NO: 2131100 - RNA, 15 nt, Homo sapiens
cccuguuggcagcuc

SEQ ID NO: 2131101 - RNA, 13 nt, Homo sapiens
augguucuuacag

SEQ ID NO: 2131102 - RNA, 19 nt, Homo sapiens
cggcuucccaaagugcuga

SEQ ID NO: 2131103 - RNA, 16 nt, Homo sapiens
aggcucaaccuuccaa

SEQ ID NO: 2131104 - RNA, 22 nt, Homo sapiens
ugagguaauucuagccuuuuaa

SEQ ID NO: 2131105 - RNA, 22 nt, Homo sapiens
uuacauguguuuauucauccag

SEQ ID NO: 2131106 - RNA, 12 nt, Homo sapiens
aaaaccaaagag

SEQ ID NO: 2131107 - RNA, 17 nt, Homo sapiens
aggccagugccauuuca

SEQ ID NO: 2131108 - RNA, 18 nt, Homo sapiens
agugauuugggggugcaa

SEQ ID NO: 2131109 - RNA, 22 nt, Homo sapiens
gaaacaauguauugucugccca

SEQ ID NO: 2131110 - RNA, 20 nt, Homo sapiens
guguauauuuuugguggugg

SEQ ID NO: 2131111 - RNA, 21 nt, Homo sapiens
gugaucgcacaaccugcaucu

SEQ ID NO: 2131112 - RNA, 16 nt, Homo sapiens
aggagaccagcucaga

SEQ ID NO: 2131113 - RNA, 14 nt, Homo sapiens
guugcauuugucaa

SEQ ID NO: 2131114 - RNA, 22 nt, Homo sapiens
agguaucauuuucugcauuuaa

SEQ ID NO: 2131115 - RNA, 15 nt, Homo sapiens
gaauuuuauaaucug

SEQ ID NO: 2131116 - RNA, 21 nt, Homo sapiens
agccugaauaaaccaagacaa

SEQ ID NO: 2131117 - RNA, 22 nt, Homo sapiens
augguuggaagacggauuugcu

SEQ ID NO: 2131118 - RNA, 12 nt, Homo sapiens
auguagcaaaau

SEQ ID NO: 2131119 - RNA, 21 nt, Homo sapiens
gagcccgcuuuuguucuuccc

SEQ ID NO: 2131120 - RNA, 13 nt, Homo sapiens
uuauggacacugc

SEQ ID NO: 2131121 - RNA, 16 nt, Homo sapiens
ugaguacguugugcau

SEQ ID NO: 2131122 - RNA, 22 nt, Homo sapiens
aucucuuguuuacgauuucacu

SEQ ID NO: 2131123 - RNA, 19 nt, Homo sapiens
uaaccauccuuaaauuauu

SEQ ID NO: 2131124 - RNA, 18 nt, Homo sapiens
ccugcacuccagaaucca

SEQ ID NO: 2131125 - RNA, 20 nt, Homo sapiens
acugucaaggcugcuuagaa

SEQ ID NO: 2131126 - RNA, 21 nt, Homo sapiens
uuagacuuaauagaaacauug

SEQ ID NO: 2131127 - RNA, 18 nt, Homo sapiens
cucugaaggauccuggaa

SEQ ID NO: 2131128 - RNA, 17 nt, Homo sapiens
guggcacccaccacucu

SEQ ID NO: 2131129 - RNA, 22 nt, Homo sapiens
uucacuuuagaagguuguauua

SEQ ID NO: 2131130 - RNA, 20 nt, Homo sapiens
uuaacgaaaauaguauuuca

SEQ ID NO: 2131131 - RNA, 18 nt, Homo sapiens
aaccgaacaugaccaaaa

SEQ ID NO: 2131132 - RNA, 13 nt, Homo sapiens
ccccagcagggaa

SEQ ID NO: 2131133 - RNA, 15 nt, Homo sapiens
acucaaaagacaaac

SEQ ID NO: 2131134 - RNA, 20 nt, Homo sapiens
uaaaucugugaugauccuca

SEQ ID NO: 2131135 - RNA, 14 nt, Homo sapiens
uggucaucauggcc

SEQ ID NO: 2131136 - RNA, 15 nt, Homo sapiens
cuaaccauuaaguca

SEQ ID NO: 2131137 - RNA, 15 nt, Homo sapiens
aauaaaguaccacac

SEQ ID NO: 2131138 - RNA, 18 nt, Homo sapiens
gaucaugauguagagugu

SEQ ID NO: 2131139 - RNA, 13 nt, Homo sapiens
aaaugucaucuca

SEQ ID NO: 2131140 - RNA, 17 nt, Homo sapiens
uugagcuaguuacauaa

SEQ ID NO: 2131141 - RNA, 18 nt, Homo sapiens
agcuuaaaaacuacccau

SEQ ID NO: 2131142 - RNA, 21 nt, Homo sapiens
uagcacaauuuauauuuuccc

SEQ ID NO: 2131143 - RNA, 17 nt, Homo sapiens
acuaaugaaauuuacag

SEQ ID NO: 2131144 - RNA, 19 nt, Homo sapiens
cuucauauacuaaggagcc

SEQ ID NO: 2131145 - RNA, 21 nt, Homo sapiens
caaguguaugcacgugugcac

SEQ ID NO: 2131146 - RNA, 17 nt, Homo sapiens
aagaugugaaaauuaca

SEQ ID NO: 2131147 - RNA, 22 nt, Homo sapiens
agcuguaaucccagcacuuuga

SEQ ID NO: 2131148 - RNA, 19 nt, Homo sapiens
gccaaggagucacugagac

SEQ ID NO: 2131149 - RNA, 16 nt, Homo sapiens
cucaggugaccaaaac

SEQ ID NO: 2131150 - RNA, 19 nt, Homo sapiens
gaguacuuacuauugguca

SEQ ID NO: 2131151 - RNA, 16 nt, Homo sapiens
ucccuugcuguaugcu

SEQ ID NO: 2131152 - RNA, 18 nt, Homo sapiens
gaucagagcgcacaggga

SEQ ID NO: 2131153 - RNA, 10 nt, Homo sapiens
ugugccuaac

SEQ ID NO: 2131154 - RNA, 17 nt, Homo sapiens
ccagcaagaugaaacag

SEQ ID NO: 2131155 - RNA, 22 nt, Homo sapiens
gaacguuacuuugugucgugau

SEQ ID NO: 2131156 - RNA, 17 nt, Homo sapiens
gucuagccacugaucau

SEQ ID NO: 2131157 - RNA, 16 nt, Homo sapiens
cuccagccugcuguau

SEQ ID NO: 2131158 - RNA, 21 nt, Homo sapiens
cagcacacgaguuccagaccc

SEQ ID NO: 2131159 - RNA, 22 nt, Homo sapiens
ugaggcugcuuuccaaagccaa

SEQ ID NO: 2131160 - RNA, 16 nt, Homo sapiens
cuguagccuggucugu

SEQ ID NO: 2131161 - RNA, 20 nt, Homo sapiens
ggggccacauuucaccuccu

SEQ ID NO: 2131162 - RNA, 22 nt, Homo sapiens
aguauuuauuuuuucaaaaaca

SEQ ID NO: 2131163 - RNA, 17 nt, Homo sapiens
aaggccugcccucccau

SEQ ID NO: 2131164 - RNA, 13 nt, Homo sapiens
ucagguugcaaaa

SEQ ID NO: 2131165 - RNA, 20 nt, Homo sapiens
auuacaauuucuuuaaauca

SEQ ID NO: 2131166 - RNA, 17 nt, Homo sapiens
agcccugggguuuccac

SEQ ID NO: 2131167 - RNA, 19 nt, Homo sapiens
ucccuuguguuccuucugu

SEQ ID NO: 2131168 - RNA, 13 nt, Homo sapiens
uaauaaagugaac

SEQ ID NO: 2131169 - RNA, 13 nt, Homo sapiens
uauguguauagua

SEQ ID NO: 2131170 - RNA, 21 nt, Homo sapiens
cagacuauuuaacuugagggu

SEQ ID NO: 2131171 - RNA, 18 nt, Homo sapiens
ugcccuucuuucuacccu

SEQ ID NO: 2131172 - RNA, 19 nt, Homo sapiens
acaguggggcugcaggcag

SEQ ID NO: 2131173 - RNA, 18 nt, Homo sapiens
ugguuaccaccagccuuu

SEQ ID NO: 2131174 - RNA, 19 nt, Homo sapiens
uggacucgcguucccaaag

SEQ ID NO: 2131175 - RNA, 13 nt, Homo sapiens
acucaaaugcuua

SEQ ID NO: 2131176 - RNA, 19 nt, Homo sapiens
cuugugaaacacagcuguu

SEQ ID NO: 2131177 - RNA, 13 nt, Homo sapiens
augcuugugauuu

SEQ ID NO: 2131178 - RNA, 15 nt, Homo sapiens
cuuguucuacugaga

SEQ ID NO: 2131179 - RNA, 18 nt, Homo sapiens
cccacuaaaacugcauuu

SEQ ID NO: 2131180 - RNA, 18 nt, Homo sapiens
gcauaugguccuagacaa

SEQ ID NO: 2131181 - RNA, 12 nt, Homo sapiens
cagggucugcuc

SEQ ID NO: 2131182 - RNA, 17 nt, Homo sapiens
aucugguguucuugcua

SEQ ID NO: 2131183 - RNA, 15 nt, Homo sapiens
cucuuggcugacccc

SEQ ID NO: 2131184 - RNA, 23 nt, Homo sapiens
acugggacuaaguguaccagaga

SEQ ID NO: 2131185 - RNA, 22 nt, Homo sapiens
cuuuaaaaauaugcaccaaauc

SEQ ID NO: 2131186 - RNA, 19 nt, Homo sapiens
cauugccauaccauuccca

SEQ ID NO: 2131187 - RNA, 22 nt, Homo sapiens
uuauggaauggggcaaaguaaa

SEQ ID NO: 2131188 - RNA, 22 nt, Homo sapiens
uaaaguaccacacauauugcac

SEQ ID NO: 2131189 - RNA, 21 nt, Homo sapiens
uuauaaaaaacucacaggugu

SEQ ID NO: 2131190 - RNA, 22 nt, Homo sapiens
uguuguacuuuuuauucaauuc

SEQ ID NO: 2131191 - RNA, 18 nt, Homo sapiens
gagccaaaaugacuuuga

SEQ ID NO: 2131192 - RNA, 13 nt, Homo sapiens
uggcuucauuuua

SEQ ID NO: 2131193 - RNA, 17 nt, Homo sapiens
agacgguguuuugccau

SEQ ID NO: 2131194 - RNA, 23 nt, Homo sapiens
ugggggcgcccucucugcuccuu

SEQ ID NO: 2131195 - RNA, 21 nt, Homo sapiens
agcugguguagcuacagagaa

SEQ ID NO: 2131196 - RNA, 12 nt, Homo sapiens
uagagaggacag

SEQ ID NO: 2131197 - RNA, 12 nt, Homo sapiens
auggaugucaag

SEQ ID NO: 2131198 - RNA, 19 nt, Homo sapiens
ccuacccaccgauggagcc

SEQ ID NO: 2131199 - RNA, 14 nt, Homo sapiens
gcucccagacauaa

SEQ ID NO: 2131200 - RNA, 18 nt, Homo sapiens
cugugcucauuuugcaau

SEQ ID NO: 2131201 - RNA, 22 nt, Homo sapiens
ugacuuucugauuggugauuca

SEQ ID NO: 2131202 - RNA, 15 nt, Homo sapiens
ucaucccuucuucca

SEQ ID NO: 2131203 - RNA, 23 nt, Homo sapiens
uaugcaaaagucagcgugacaau

SEQ ID NO: 2131204 - RNA, 18 nt, Homo sapiens
ggagggguauuuuugccc

SEQ ID NO: 2131205 - RNA, 14 nt, Homo sapiens
agcuagaaggccac

SEQ ID NO: 2131206 - RNA, 17 nt, Homo sapiens
gcuguggccaggaggug

SEQ ID NO: 2131207 - RNA, 13 nt, Homo sapiens
aaucaagucucac

SEQ ID NO: 2131208 - RNA, 15 nt, Homo sapiens
guccuguaaccucau

SEQ ID NO: 2131209 - RNA, 19 nt, Homo sapiens
ucugcuagacuccucagga

SEQ ID NO: 2131210 - RNA, 14 nt, Homo sapiens
ggauugucacucca

SEQ ID NO: 2131211 - RNA, 18 nt, Homo sapiens
aaauaaaaggucuaugcu

SEQ ID NO: 2131212 - RNA, 17 nt, Homo sapiens
aucaaauguuuaaucau

SEQ ID NO: 2131213 - RNA, 17 nt, Homo sapiens
uccuuaugacuuuucau

SEQ ID NO: 2131214 - RNA, 14 nt, Homo sapiens
aaauuuguccaaug

SEQ ID NO: 2131215 - RNA, 21 nt, Homo sapiens
gaagucaucucauuccacugu

SEQ ID NO: 2131216 - RNA, 22 nt, Homo sapiens
gcccuuaaacauuggacaguga

SEQ ID NO: 2131217 - RNA, 13 nt, Homo sapiens
aaaauaaugcacc

SEQ ID NO: 2131218 - RNA, 19 nt, Homo sapiens
caaucccaacuacguaaua

SEQ ID NO: 2131219 - RNA, 22 nt, Homo sapiens
uucagagacagcugauacuuca

SEQ ID NO: 2131220 - RNA, 17 nt, Homo sapiens
gcaccaacaucuacaag

SEQ ID NO: 2131221 - RNA, 17 nt, Homo sapiens
ugcagcccuuugccaag

SEQ ID NO: 2131222 - RNA, 16 nt, Homo sapiens
ugaaggcagggcuccu

SEQ ID NO: 2131223 - RNA, 16 nt, Homo sapiens
uugucaaaaagucauu

SEQ ID NO: 2131224 - RNA, 17 nt, Homo sapiens
agccagacaugguggca

SEQ ID NO: 2131225 - RNA, 16 nt, Homo sapiens
ggcccucccccagcuc

SEQ ID NO: 2131226 - RNA, 14 nt, Homo sapiens
auuacagacaugag

SEQ ID NO: 2131227 - RNA, 21 nt, Homo sapiens
cauuuuacucuuaugaucaau

SEQ ID NO: 2131228 - RNA, 17 nt, Homo sapiens
uucacacaguaaaagca

SEQ ID NO: 2131229 - RNA, 19 nt, Homo sapiens
accuuguauaaauuauuca

SEQ ID NO: 2131230 - RNA, 17 nt, Homo sapiens
ucacauauucaucagca

SEQ ID NO: 2131231 - RNA, 21 nt, Homo sapiens
ccacugaggaugugagccuga

SEQ ID NO: 2131232 - RNA, 14 nt, Homo sapiens
cauacucaaauggu

SEQ ID NO: 2131233 - RNA, 20 nt, Homo sapiens
guucucacuauguuucucag

SEQ ID NO: 2131234 - RNA, 18 nt, Homo sapiens
caccaaagagaaugcccu

SEQ ID NO: 2131235 - RNA, 18 nt, Homo sapiens
cugcccuuucaaagcacu

SEQ ID NO: 2131236 - RNA, 18 nt, Homo sapiens
cuguaacuucuuaaucua

SEQ ID NO: 2131237 - RNA, 15 nt, Homo sapiens
cuucucaugauccaa

SEQ ID NO: 2131238 - RNA, 15 nt, Homo sapiens
agcugagauggaacc

SEQ ID NO: 2131239 - RNA, 17 nt, Homo sapiens
caacagagcgagauucc

SEQ ID NO: 2131240 - RNA, 19 nt, Homo sapiens
acuaaggcagcuaagacau

SEQ ID NO: 2131241 - RNA, 15 nt, Homo sapiens
auuaaaguacaacca

SEQ ID NO: 2131242 - RNA, 11 nt, Homo sapiens
uuuugugaauc

SEQ ID NO: 2131243 - RNA, 22 nt, Homo sapiens
cuacaccuuagcagcucuuccc

SEQ ID NO: 2131244 - RNA, 22 nt, Homo sapiens
aguguuuacaaggugacaaaug

SEQ ID NO: 2131245 - RNA, 14 nt, Homo sapiens
aaugaaaugcauuu

SEQ ID NO: 2131246 - RNA, 19 nt, Homo sapiens
aaacuuccacuaccuuuaa

SEQ ID NO: 2131247 - RNA, 13 nt, Homo sapiens
aggggucauucau

SEQ ID NO: 2131248 - RNA, 19 nt, Homo sapiens
ggccaaggugaauagcaca

SEQ ID NO: 2131249 - RNA, 13 nt, Homo sapiens
uauauguacuugu

SEQ ID NO: 2131250 - RNA, 13 nt, Homo sapiens
uuaauguacaagu

SEQ ID NO: 2131251 - RNA, 14 nt, Homo sapiens
ggccacaccacagc

SEQ ID NO: 2131252 - RNA, 19 nt, Homo sapiens
gcucccuugauggggucca

SEQ ID NO: 2131253 - RNA, 22 nt, Homo sapiens
cacacuuugagaaccugugcuc

SEQ ID NO: 2131254 - RNA, 10 nt, Homo sapiens
agcacuguaa

SEQ ID NO: 2131255 - RNA, 22 nt, Homo sapiens
agacagguccugauuucuagaa

SEQ ID NO: 2131256 - RNA, 15 nt, Homo sapiens
gaggggcaacgaaga

SEQ ID NO: 2131257 - RNA, 17 nt, Homo sapiens
aaaagaaaacaccacua

SEQ ID NO: 2131258 - RNA, 17 nt, Homo sapiens
ggguugugcacauuucu

SEQ ID NO: 2131259 - RNA, 19 nt, Homo sapiens
auuagaaaaauagcaacuu

SEQ ID NO: 2131260 - RNA, 13 nt, Homo sapiens
aauuaaacuaaaa

SEQ ID NO: 2131261 - RNA, 14 nt, Homo sapiens
auacauguaauucu

SEQ ID NO: 2131262 - RNA, 20 nt, Homo sapiens
cucaguuucuuuuucacuug

SEQ ID NO: 2131263 - RNA, 16 nt, Homo sapiens
gaauguuggcaaauca

SEQ ID NO: 2131264 - RNA, 21 nt, Homo sapiens
gccucaucugcuccuagccca

SEQ ID NO: 2131265 - RNA, 21 nt, Homo sapiens
gauuuuucucaaaguuuugaa

SEQ ID NO: 2131266 - RNA, 21 nt, Homo sapiens
caggccugaacucaccauaga

SEQ ID NO: 2131267 - RNA, 15 nt, Homo sapiens
cacacaguauaugau

SEQ ID NO: 2131268 - RNA, 17 nt, Homo sapiens
augugucuuaccagauc

SEQ ID NO: 2131269 - RNA, 14 nt, Homo sapiens
cuaucaacacugca

SEQ ID NO: 2131270 - RNA, 16 nt, Homo sapiens
ccgccacuggggcuca

SEQ ID NO: 2131271 - RNA, 19 nt, Homo sapiens
uggcagggauaacaaagaa

SEQ ID NO: 2131272 - RNA, 20 nt, Homo sapiens
aagcaugcauucuagcacaa

SEQ ID NO: 2131273 - RNA, 19 nt, Homo sapiens
cucaaguaggaguuuuaua

SEQ ID NO: 2131274 - RNA, 19 nt, Homo sapiens
ucacuaaacucucauuucu

SEQ ID NO: 2131275 - RNA, 23 nt, Homo sapiens
ucucccugguugccucucuugcc

SEQ ID NO: 2131276 - RNA, 21 nt, Homo sapiens
uaaguaaucuuuuuacaguug

SEQ ID NO: 2131277 - RNA, 22 nt, Homo sapiens
ugagagucauucaggugaccuc

SEQ ID NO: 2131278 - RNA, 16 nt, Homo sapiens
ccugucagcaugaauu

SEQ ID NO: 2131279 - RNA, 23 nt, Homo sapiens
cugggauuacuggcaugagccac

SEQ ID NO: 2131280 - RNA, 14 nt, Homo sapiens
auguaugugugcuu

SEQ ID NO: 2131281 - RNA, 20 nt, Homo sapiens
cagcacucugaaacugagaa

SEQ ID NO: 2131282 - RNA, 15 nt, Homo sapiens
gcucaccuuuaucac

SEQ ID NO: 2131283 - RNA, 14 nt, Homo sapiens
ucuuccuuuuauca

SEQ ID NO: 2131284 - RNA, 21 nt, Homo sapiens
gucacauggaaucuacaugug

SEQ ID NO: 2131285 - RNA, 22 nt, Homo sapiens
acauauauauauacacauacau

SEQ ID NO: 2131286 - RNA, 14 nt, Homo sapiens
cacuguuucuugcu

SEQ ID NO: 2131287 - RNA, 18 nt, Homo sapiens
cugagcccccacauucuc

SEQ ID NO: 2131288 - RNA, 19 nt, Homo sapiens
ggggcuaggguaggggcaa

SEQ ID NO: 2131289 - RNA, 21 nt, Homo sapiens
uaaucccgugccccuuuccuu

SEQ ID NO: 2131290 - RNA, 15 nt, Homo sapiens
acaaaaugauuuuga

SEQ ID NO: 2131291 - RNA, 15 nt, Homo sapiens
gacugccaagccaga

SEQ ID NO: 2131292 - RNA, 18 nt, Homo sapiens
ugggaggagggagaggga

SEQ ID NO: 2131293 - RNA, 15 nt, Homo sapiens
ccacccgggggagcc

SEQ ID NO: 2131294 - RNA, 17 nt, Homo sapiens
ccaggugcugugacacc

SEQ ID NO: 2131295 - RNA, 21 nt, Homo sapiens
uuucaagacuugauacugcaa

SEQ ID NO: 2131296 - RNA, 14 nt, Homo sapiens
gaaucacuugacuu

SEQ ID NO: 2131297 - RNA, 16 nt, Homo sapiens
aacagcugcauuagaa

SEQ ID NO: 2131298 - RNA, 23 nt, Homo sapiens
cugugaggguagaaaaccucacc

SEQ ID NO: 2131299 - RNA, 12 nt, Homo sapiens
acucagcaucac

SEQ ID NO: 2131300 - RNA, 12 nt, Homo sapiens
auaaagcauuua

SEQ ID NO: 2131301 - RNA, 14 nt, Homo sapiens
gcacuuuaaugaua

SEQ ID NO: 2131302 - RNA, 22 nt, Homo sapiens
caguuguugauaaccacuaaga

SEQ ID NO: 2131303 - RNA, 15 nt, Homo sapiens
cagugaaauaugaua

SEQ ID NO: 2131304 - RNA, 16 nt, Homo sapiens
ugcauacuacucucaa

SEQ ID NO: 2131305 - RNA, 14 nt, Homo sapiens
cucugcuucuccaa

SEQ ID NO: 2131306 - RNA, 14 nt, Homo sapiens
ccacacuuccauga

SEQ ID NO: 2131307 - RNA, 13 nt, Homo sapiens
cuccguggcacau

SEQ ID NO: 2131308 - RNA, 17 nt, Homo sapiens
ggcucuugcaacaucuc

SEQ ID NO: 2131309 - RNA, 16 nt, Homo sapiens
cagggcagccugucac

SEQ ID NO: 2131310 - RNA, 12 nt, Homo sapiens
acaagugcacag

SEQ ID NO: 2131311 - RNA, 12 nt, Homo sapiens
ucaggugcucaa

SEQ ID NO: 2131312 - RNA, 12 nt, Homo sapiens
ccuggugcccua

SEQ ID NO: 2131313 - RNA, 20 nt, Homo sapiens
ccuuccuaaauuaugacugc

SEQ ID NO: 2131314 - RNA, 12 nt, Homo sapiens
ccaggugcaaaa

SEQ ID NO: 2131315 - RNA, 14 nt, Homo sapiens
cuguacaugcauug

SEQ ID NO: 2131316 - RNA, 12 nt, Homo sapiens
uaaaaaaaucau

SEQ ID NO: 2131317 - RNA, 12 nt, Homo sapiens
cuucccaaagca

SEQ ID NO: 2131318 - RNA, 17 nt, Homo sapiens
ugagagaccucagggau

SEQ ID NO: 2131319 - RNA, 23 nt, Homo sapiens
uauuauggcaagugauaucaccu

SEQ ID NO: 2131320 - RNA, 14 nt, Homo sapiens
auucuucucucuca

SEQ ID NO: 2131321 - RNA, 23 nt, Homo sapiens
agagccaggcacacacugugcuu

SEQ ID NO: 2131322 - RNA, 18 nt, Homo sapiens
auuugaauccaggccacu

SEQ ID NO: 2131323 - RNA, 16 nt, Homo sapiens
acuaauuuauaaucca

SEQ ID NO: 2131324 - RNA, 21 nt, Homo sapiens
caggagucucugccacccacu

SEQ ID NO: 2131325 - RNA, 21 nt, Homo sapiens
uguucuguccaguuuccaaag

SEQ ID NO: 2131326 - RNA, 16 nt, Homo sapiens
auuuuucaccugagaa

SEQ ID NO: 2131327 - RNA, 18 nt, Homo sapiens
agguagcuuuagggcaau

SEQ ID NO: 2131328 - RNA, 22 nt, Homo sapiens
auuuuugaaacccauuaggcau

SEQ ID NO: 2131329 - RNA, 18 nt, Homo sapiens
uuuccuggaauugccagc

SEQ ID NO: 2131330 - RNA, 21 nt, Homo sapiens
aaguuccaaaauaaagcauaa

SEQ ID NO: 2131331 - RNA, 19 nt, Homo sapiens
uggccccaguccaugcuuc

SEQ ID NO: 2131332 - RNA, 14 nt, Homo sapiens
ucuaguugucaaua

SEQ ID NO: 2131333 - RNA, 17 nt, Homo sapiens
cugaaguuugugggggc

SEQ ID NO: 2131334 - RNA, 16 nt, Homo sapiens
gaaacauuuucucccu

SEQ ID NO: 2131335 - RNA, 15 nt, Homo sapiens
gaagcugcacaugug

SEQ ID NO: 2131336 - RNA, 16 nt, Homo sapiens
auaagcacugugcuaa

SEQ ID NO: 2131337 - RNA, 17 nt, Homo sapiens
ggcugccccgugacaca

SEQ ID NO: 2131338 - RNA, 17 nt, Homo sapiens
uuaaaaauucauaacag

SEQ ID NO: 2131339 - RNA, 13 nt, Homo sapiens
agucucugugaau

SEQ ID NO: 2131340 - RNA, 19 nt, Homo sapiens
aauauugauguuaacaaga

SEQ ID NO: 2131341 - RNA, 19 nt, Homo sapiens
gauaaugaguuuuacauua

SEQ ID NO: 2131342 - RNA, 20 nt, Homo sapiens
uacuugggaggcugagauag

SEQ ID NO: 2131343 - RNA, 15 nt, Homo sapiens
agaaggugcuuugua

SEQ ID NO: 2131344 - RNA, 14 nt, Homo sapiens
auuuugcacuguaa

SEQ ID NO: 2131345 - RNA, 14 nt, Homo sapiens
cucaacuccaggau

SEQ ID NO: 2131346 - RNA, 18 nt, Homo sapiens
gcccugacccccaucgcu

SEQ ID NO: 2131347 - RNA, 19 nt, Homo sapiens
agccagugcugucugggau

SEQ ID NO: 2131348 - RNA, 22 nt, Homo sapiens
aacaagguggugugaucuuaau

SEQ ID NO: 2131349 - RNA, 17 nt, Homo sapiens
caguauuuucaguguca

SEQ ID NO: 2131350 - RNA, 23 nt, Homo sapiens
agaacguuuuuuccucagugcau

SEQ ID NO: 2131351 - RNA, 19 nt, Homo sapiens
uuucauguuuuugaucaaa

SEQ ID NO: 2131352 - RNA, 18 nt, Homo sapiens
gaagcccccagcccuaau

SEQ ID NO: 2131353 - RNA, 21 nt, Homo sapiens
ccuucuuaggugacaaugucc

SEQ ID NO: 2131354 - RNA, 14 nt, Homo sapiens
gcauccacuagcuu

SEQ ID NO: 2131355 - RNA, 23 nt, Homo sapiens
uguuugacgacagugcauuugcc

SEQ ID NO: 2131356 - RNA, 12 nt, Homo sapiens
gacuucaucugg

SEQ ID NO: 2131357 - RNA, 14 nt, Homo sapiens
ggcucucugugcaa

SEQ ID NO: 2131358 - RNA, 15 nt, Homo sapiens
ugacuuaaggugaag

SEQ ID NO: 2131359 - RNA, 21 nt, Homo sapiens
guugauguaaccgauucaucu

SEQ ID NO: 2131360 - RNA, 11 nt, Homo sapiens
cgaucuuggcu

SEQ ID NO: 2131361 - RNA, 20 nt, Homo sapiens
guaaauuuuauaaugucaua

SEQ ID NO: 2131362 - RNA, 18 nt, Homo sapiens
cccuccuccuugcugauu

SEQ ID NO: 2131363 - RNA, 14 nt, Homo sapiens
cuugacacauuaca

SEQ ID NO: 2131364 - RNA, 18 nt, Homo sapiens
agauccuggaaacagcag

SEQ ID NO: 2131365 - RNA, 23 nt, Homo sapiens
guuggacuucagucuugccuagg

SEQ ID NO: 2131366 - RNA, 22 nt, Homo sapiens
ucagauaaagcacccuguauca

SEQ ID NO: 2131367 - RNA, 13 nt, Homo sapiens
agaagacacgugu

SEQ ID NO: 2131368 - RNA, 16 nt, Homo sapiens
ccccacugcugagcug

SEQ ID NO: 2131369 - RNA, 22 nt, Homo sapiens
ccucgagagugagaaauggcag

SEQ ID NO: 2131370 - RNA, 21 nt, Homo sapiens
gaccauaugcacaauuccaug

SEQ ID NO: 2131371 - RNA, 16 nt, Homo sapiens
agaaccagggcucuuc

SEQ ID NO: 2131372 - RNA, 23 nt, Homo sapiens
uacuuuauagaagaaugcaugcu

SEQ ID NO: 2131373 - RNA, 19 nt, Homo sapiens
gcuguccuccuggcaccug

SEQ ID NO: 2131374 - RNA, 15 nt, Homo sapiens
cacacacaguuugag

SEQ ID NO: 2131375 - RNA, 15 nt, Homo sapiens
ucaacaaguaccuga

SEQ ID NO: 2131376 - RNA, 19 nt, Homo sapiens
cuggugcucaucuucucuu

SEQ ID NO: 2131377 - RNA, 17 nt, Homo sapiens
uaucggcucacaaagag

SEQ ID NO: 2131378 - RNA, 15 nt, Homo sapiens
ugacuaucaccccua

SEQ ID NO: 2131379 - RNA, 14 nt, Homo sapiens
gacuggcacacugg

SEQ ID NO: 2131380 - RNA, 14 nt, Homo sapiens
gcugcccaccugcc

SEQ ID NO: 2131381 - RNA, 14 nt, Homo sapiens
gcuccacaccucca

SEQ ID NO: 2131382 - RNA, 14 nt, Homo sapiens
guugaacacuugaa

SEQ ID NO: 2131383 - RNA, 18 nt, Homo sapiens
aauccuuuguacugauga

SEQ ID NO: 2131384 - RNA, 22 nt, Homo sapiens
ccaucuuucaagggaccucucc

SEQ ID NO: 2131385 - RNA, 16 nt, Homo sapiens
ccaacauuucucacug

SEQ ID NO: 2131386 - RNA, 19 nt, Homo sapiens
aggcuccccagggcucccu

SEQ ID NO: 2131387 - RNA, 14 nt, Homo sapiens
cagugacaaacaua

SEQ ID NO: 2131388 - RNA, 13 nt, Homo sapiens
agccaucgcauca

SEQ ID NO: 2131389 - RNA, 14 nt, Homo sapiens
guuggcaugcaucc

SEQ ID NO: 2131390 - RNA, 21 nt, Homo sapiens
caauauggggcagcuuaccaa

SEQ ID NO: 2131391 - RNA, 16 nt, Homo sapiens
auagaaaaugcauuau

SEQ ID NO: 2131392 - RNA, 22 nt, Homo sapiens
aaacuuuauuuguaaaccauug

SEQ ID NO: 2131393 - RNA, 12 nt, Homo sapiens
uaagaauuucac

SEQ ID NO: 2131394 - RNA, 19 nt, Homo sapiens
cauguucaaagugugacau

SEQ ID NO: 2131395 - RNA, 21 nt, Homo sapiens
uccaguagggcaggcagucag

SEQ ID NO: 2131396 - RNA, 23 nt, Homo sapiens
aauaucugugaaggacuugguga

SEQ ID NO: 2131397 - RNA, 14 nt, Homo sapiens
gugauuguggcauu

SEQ ID NO: 2131398 - RNA, 17 nt, Homo sapiens
cuggaaucagcucagga

SEQ ID NO: 2131399 - RNA, 20 nt, Homo sapiens
agucagcacccccaccaaac

SEQ ID NO: 2131400 - RNA, 18 nt, Homo sapiens
uuaacucuaucugucaua

SEQ ID NO: 2131401 - RNA, 17 nt, Homo sapiens
ccuccugaacuggccac

SEQ ID NO: 2131402 - RNA, 18 nt, Homo sapiens
ccucaucaacacagugaa

SEQ ID NO: 2131403 - RNA, 14 nt, Homo sapiens
aguugaagaucuuu

SEQ ID NO: 2131404 - RNA, 19 nt, Homo sapiens
ucaguaguuugcauuucag

SEQ ID NO: 2131405 - RNA, 20 nt, Homo sapiens
aagggcuuaucuagccaaag

SEQ ID NO: 2131406 - RNA, 13 nt, Homo sapiens
auucagaaauccu

SEQ ID NO: 2131407 - RNA, 12 nt, Homo sapiens
aaaacauuccau

SEQ ID NO: 2131408 - RNA, 15 nt, Homo sapiens
ucgucuaaacuuuag

SEQ ID NO: 2131409 - RNA, 15 nt, Homo sapiens
ucugggccagaauuu

SEQ ID NO: 2131410 - RNA, 18 nt, Homo sapiens
caguguuaauacugagaa

SEQ ID NO: 2131411 - RNA, 15 nt, Homo sapiens
ccacauuuauggacc

SEQ ID NO: 2131412 - RNA, 19 nt, Homo sapiens
caaggaaauaaagcguccu

SEQ ID NO: 2131413 - RNA, 16 nt, Homo sapiens
ugagcucaaaguacua

SEQ ID NO: 2131414 - RNA, 18 nt, Homo sapiens
caaauuuauacacugauu

SEQ ID NO: 2131415 - RNA, 22 nt, Homo sapiens
aguggagugagagcaauuguaa

SEQ ID NO: 2131416 - RNA, 14 nt, Homo sapiens
aaucguagguguug

SEQ ID NO: 2131417 - RNA, 19 nt, Homo sapiens
aguuguacuucugcuccau

SEQ ID NO: 2131418 - RNA, 17 nt, Homo sapiens
uuaccugggaccucaca

SEQ ID NO: 2131419 - RNA, 21 nt, Homo sapiens
ucuuaauuuacuuuaagcauu

SEQ ID NO: 2131420 - RNA, 22 nt, Homo sapiens
aaguggguggggacagaccagc

SEQ ID NO: 2131421 - RNA, 20 nt, Homo sapiens
auggaacagcauuacccucc

SEQ ID NO: 2131422 - RNA, 17 nt, Homo sapiens
ucauauuguugcauugc

SEQ ID NO: 2131423 - RNA, 20 nt, Homo sapiens
ugcagagucacucacaccgu

SEQ ID NO: 2131424 - RNA, 20 nt, Homo sapiens
accagcuaacuccagucucc

SEQ ID NO: 2131425 - RNA, 20 nt, Homo sapiens
uugcugcacaaacaugaaaa

SEQ ID NO: 2131426 - RNA, 22 nt, Homo sapiens
cucuuuuggguaaaaucuguaa

SEQ ID NO: 2131427 - RNA, 12 nt, Homo sapiens
acaccaccaauc

SEQ ID NO: 2131428 - RNA, 17 nt, Homo sapiens
augggcccuaugucuca

SEQ ID NO: 2131429 - RNA, 16 nt, Homo sapiens
agguccuuucuccuga

SEQ ID NO: 2131430 - RNA, 18 nt, Homo sapiens
ugauacaacugagucucg

SEQ ID NO: 2131431 - RNA, 17 nt, Homo sapiens
ucuuagaaaagcuaaga

SEQ ID NO: 2131432 - RNA, 17 nt, Homo sapiens
acacuuacaguauacau

SEQ ID NO: 2131433 - RNA, 16 nt, Homo sapiens
acuauaaauauguaca

SEQ ID NO: 2131434 - RNA, 18 nt, Homo sapiens
agcaacuccccuacauca

SEQ ID NO: 2131435 - RNA, 18 nt, Homo sapiens
aauauuuuacuuuuacag

SEQ ID NO: 2131436 - RNA, 15 nt, Homo sapiens
uauuauaucauuaac

SEQ ID NO: 2131437 - RNA, 23 nt, Homo sapiens
cuacggaacugcacacucagugg

SEQ ID NO: 2131438 - RNA, 16 nt, Homo sapiens
uucuauuuucuauaau

SEQ ID NO: 2131439 - RNA, 20 nt, Homo sapiens
gcuuuauuuuuuugaacucu

SEQ ID NO: 2131440 - RNA, 17 nt, Homo sapiens
gagaccccuuguugcac

SEQ ID NO: 2131441 - RNA, 20 nt, Homo sapiens
auauuuauuuaacuauucau

SEQ ID NO: 2131442 - RNA, 16 nt, Homo sapiens
caugaccccugcugau

SEQ ID NO: 2131443 - RNA, 20 nt, Homo sapiens
uagagaguccugguccucag

SEQ ID NO: 2131444 - RNA, 18 nt, Homo sapiens
ucuaaugagacugaccau

SEQ ID NO: 2131445 - RNA, 22 nt, Homo sapiens
guuuauuuagcucugaagcaag

SEQ ID NO: 2131446 - RNA, 15 nt, Homo sapiens
uagaggcgagccagg

SEQ ID NO: 2131447 - RNA, 19 nt, Homo sapiens
cugccagcuggccuuguga

SEQ ID NO: 2131448 - RNA, 14 nt, Homo sapiens
guuuucccuguucu

SEQ ID NO: 2131449 - RNA, 13 nt, Homo sapiens
auuagucuaucaa

SEQ ID NO: 2131450 - RNA, 14 nt, Homo sapiens
uucaaugaaaugga

SEQ ID NO: 2131451 - RNA, 22 nt, Homo sapiens
cugaaggcacagcuaaccacuu

SEQ ID NO: 2131452 - RNA, 14 nt, Homo sapiens
cuauacaugaauca

SEQ ID NO: 2131453 - RNA, 18 nt, Homo sapiens
uguuuaugcacacagaga

SEQ ID NO: 2131454 - RNA, 16 nt, Homo sapiens
gaaggaaaaugugaac

SEQ ID NO: 2131455 - RNA, 20 nt, Homo sapiens
aagcagacccaccucccagc

SEQ ID NO: 2131456 - RNA, 18 nt, Homo sapiens
cccccucccagacaggcc

SEQ ID NO: 2131457 - RNA, 15 nt, Homo sapiens
acacccuagcccuua

SEQ ID NO: 2131458 - RNA, 19 nt, Homo sapiens
guccuucaccucacugaaa

SEQ ID NO: 2131459 - RNA, 19 nt, Homo sapiens
uagacucuggucauagaaa

SEQ ID NO: 2131460 - RNA, 18 nt, Homo sapiens
aaggccuacugaccaaau

SEQ ID NO: 2131461 - RNA, 15 nt, Homo sapiens
cucuucaugagcacu

SEQ ID NO: 2131462 - RNA, 17 nt, Homo sapiens
gcagugcuaaagccugu

SEQ ID NO: 2131463 - RNA, 16 nt, Homo sapiens
gucucuggaacccagg

SEQ ID NO: 2131464 - RNA, 20 nt, Homo sapiens
ugaguagaaaagucggggau

SEQ ID NO: 2131465 - RNA, 23 nt, Homo sapiens
acgugugugugugugcacaucua

SEQ ID NO: 2131466 - RNA, 19 nt, Homo sapiens
agccugcaucuagcuggag

SEQ ID NO: 2131467 - RNA, 14 nt, Homo sapiens
caucuccuugauca

SEQ ID NO: 2131468 - RNA, 11 nt, Homo sapiens
ccauugcauca

SEQ ID NO: 2131469 - RNA, 11 nt, Homo sapiens
caguugcauag

SEQ ID NO: 2131470 - RNA, 19 nt, Homo sapiens
cuuuagucucccacuaaaa

SEQ ID NO: 2131471 - RNA, 17 nt, Homo sapiens
gaaauaaauuuauuuca

SEQ ID NO: 2131472 - RNA, 14 nt, Homo sapiens
aaagaagucuugga

SEQ ID NO: 2131473 - RNA, 21 nt, Homo sapiens
aaggcuggugguaacuuuuga

SEQ ID NO: 2131474 - RNA, 15 nt, Homo sapiens
guuuacuaccugggg

SEQ ID NO: 2131475 - RNA, 23 nt, Homo sapiens
aauuguguguuaaugucuucacu

SEQ ID NO: 2131476 - RNA, 15 nt, Homo sapiens
auuuucuccaugucu

SEQ ID NO: 2131477 - RNA, 12 nt, Homo sapiens
agaaugcucagg

SEQ ID NO: 2131478 - RNA, 14 nt, Homo sapiens
cuggucaccagagg

SEQ ID NO: 2131479 - RNA, 13 nt, Homo sapiens
auuugccaaaaac

SEQ ID NO: 2131480 - RNA, 18 nt, Homo sapiens
cacugucacuacggugau

SEQ ID NO: 2131481 - RNA, 18 nt, Homo sapiens
ucccugugucauuucaaa

SEQ ID NO: 2131482 - RNA, 16 nt, Homo sapiens
guuucuuaaauggaau

SEQ ID NO: 2131483 - RNA, 14 nt, Homo sapiens
caccucuguucauu

SEQ ID NO: 2131484 - RNA, 16 nt, Homo sapiens
aaacuuaaagaggaau

SEQ ID NO: 2131485 - RNA, 20 nt, Homo sapiens
ugcuacacuuacaaguaaug

SEQ ID NO: 2131486 - RNA, 18 nt, Homo sapiens
uccagauaacuuagcuua

SEQ ID NO: 2131487 - RNA, 14 nt, Homo sapiens
agcaaaaaacugca

SEQ ID NO: 2131488 - RNA, 12 nt, Homo sapiens
aauuaguggcac

SEQ ID NO: 2131489 - RNA, 17 nt, Homo sapiens
gaaucagacugacaguu

SEQ ID NO: 2131490 - RNA, 17 nt, Homo sapiens
ggacaaaacacuguguc

SEQ ID NO: 2131491 - RNA, 19 nt, Homo sapiens
auccuaugguaacugauga

SEQ ID NO: 2131492 - RNA, 24 nt, Homo sapiens
ucaccuguuauaauaaauguaccu

SEQ ID NO: 2131493 - RNA, 14 nt, Homo sapiens
auaccgcucaguau

SEQ ID NO: 2131494 - RNA, 16 nt, Homo sapiens
auuuugcucugugaac

SEQ ID NO: 2131495 - RNA, 14 nt, Homo sapiens
ccuucuacaaaaga

SEQ ID NO: 2131496 - RNA, 14 nt, Homo sapiens
uaauuguagcacau

SEQ ID NO: 2131497 - RNA, 19 nt, Homo sapiens
cugucucaugugugcucuu

SEQ ID NO: 2131498 - RNA, 21 nt, Homo sapiens
agcagcgccccucccaagagg

SEQ ID NO: 2131499 - RNA, 18 nt, Homo sapiens
gaucacagcucacuacag

SEQ ID NO: 2131500 - RNA, 15 nt, Homo sapiens
uugcuaaaagauuau

SEQ ID NO: 2131501 - RNA, 19 nt, Homo sapiens
cuuuuuuguuguuguuggc

SEQ ID NO: 2131502 - RNA, 11 nt, Homo sapiens
aagcauuguaa

SEQ ID NO: 2131503 - RNA, 15 nt, Homo sapiens
gucucagucauugcu

SEQ ID NO: 2131504 - RNA, 14 nt, Homo sapiens
aaaauaguuuuaaa

SEQ ID NO: 2131505 - RNA, 23 nt, Homo sapiens
ccuacaaggcuggcagugacaga

SEQ ID NO: 2131506 - RNA, 21 nt, Homo sapiens
agagaaguuguaaaguaugua

SEQ ID NO: 2131507 - RNA, 16 nt, Homo sapiens
agccacgugcucucug

SEQ ID NO: 2131508 - RNA, 16 nt, Homo sapiens
uaggacaauucacuuc

SEQ ID NO: 2131509 - RNA, 22 nt, Homo sapiens
cccaggucucucaacuucauca

SEQ ID NO: 2131510 - RNA, 15 nt, Homo sapiens
cucuuugcugacacu

SEQ ID NO: 2131511 - RNA, 22 nt, Homo sapiens
ucuacauuaaaucacuugaauc

SEQ ID NO: 2131512 - RNA, 17 nt, Homo sapiens
aaacauaccaacauguu

SEQ ID NO: 2131513 - RNA, 13 nt, Homo sapiens
caccacugagucc

SEQ ID NO: 2131514 - RNA, 21 nt, Homo sapiens
ccacagccgccugaaagccac

SEQ ID NO: 2131515 - RNA, 19 nt, Homo sapiens
cuucaauauuaaaugacuu

SEQ ID NO: 2131516 - RNA, 15 nt, Homo sapiens
cuuucucuggcucca

SEQ ID NO: 2131517 - RNA, 20 nt, Homo sapiens
ucuuuugcuaaugcaauuag

SEQ ID NO: 2131518 - RNA, 13 nt, Homo sapiens
ucaaaaagcaauc

SEQ ID NO: 2131519 - RNA, 21 nt, Homo sapiens
cauuuggaccaauagcccaca

SEQ ID NO: 2131520 - RNA, 16 nt, Homo sapiens
uccagguacgcacaga

SEQ ID NO: 2131521 - RNA, 22 nt, Homo sapiens
aacauggagaaaccccgucucu

SEQ ID NO: 2131522 - RNA, 22 nt, Homo sapiens
ccuugcacaggccacuugcuca

SEQ ID NO: 2131523 - RNA, 16 nt, Homo sapiens
uuccaguaaugagcuu

SEQ ID NO: 2131524 - RNA, 21 nt, Homo sapiens
uucauguugcaaagaacucca

SEQ ID NO: 2131525 - RNA, 17 nt, Homo sapiens
gccgcgauggucagggc

SEQ ID NO: 2131526 - RNA, 15 nt, Homo sapiens
acacacaacaccuua

SEQ ID NO: 2131527 - RNA, 23 nt, Homo sapiens
ggucuccccuccugcacacaggg

SEQ ID NO: 2131528 - RNA, 19 nt, Homo sapiens
acuccuggguugagcuguu

SEQ ID NO: 2131529 - RNA, 18 nt, Homo sapiens
auucugauaaugcucacu

SEQ ID NO: 2131530 - RNA, 16 nt, Homo sapiens
acaguauaucuaauaa

SEQ ID NO: 2131531 - RNA, 16 nt, Homo sapiens
uugccaucccaaaaau

SEQ ID NO: 2131532 - RNA, 17 nt, Homo sapiens
aacagguugggauggga

SEQ ID NO: 2131533 - RNA, 17 nt, Homo sapiens
gcuaauuaacuaacuca

SEQ ID NO: 2131534 - RNA, 14 nt, Homo sapiens
cucggcuugaucac

SEQ ID NO: 2131535 - RNA, 18 nt, Homo sapiens
aagagguuuuucagcucu

SEQ ID NO: 2131536 - RNA, 19 nt, Homo sapiens
gguuccuacgccuugucau

SEQ ID NO: 2131537 - RNA, 15 nt, Homo sapiens
cacagaugugaaaug

SEQ ID NO: 2131538 - RNA, 16 nt, Homo sapiens
gaggaaaaaacccagc

SEQ ID NO: 2131539 - RNA, 21 nt, Homo sapiens
gagaggagggaugcugccuga

SEQ ID NO: 2131540 - RNA, 18 nt, Homo sapiens
cagguucucacuagauga

SEQ ID NO: 2131541 - RNA, 12 nt, Homo sapiens
auaaauugccuc

SEQ ID NO: 2131542 - RNA, 23 nt, Homo sapiens
uucagucucuauaccaauaaagu

SEQ ID NO: 2131543 - RNA, 16 nt, Homo sapiens
gcccgagagcucuuag

SEQ ID NO: 2131544 - RNA, 21 nt, Homo sapiens
ggcuaauucccagagugugaa

SEQ ID NO: 2131545 - RNA, 15 nt, Homo sapiens
aauacaacacugaua

SEQ ID NO: 2131546 - RNA, 20 nt, Homo sapiens
aaucaugguuguagugaugu

SEQ ID NO: 2131547 - RNA, 19 nt, Homo sapiens
acaagacaccaaauugaac

SEQ ID NO: 2131548 - RNA, 23 nt, Homo sapiens
cuuuuaaugcuccaaaugcugac

SEQ ID NO: 2131549 - RNA, 18 nt, Homo sapiens
agcccuguccccuacccc

SEQ ID NO: 2131550 - RNA, 15 nt, Homo sapiens
ccagaaauguacuuu

SEQ ID NO: 2131551 - RNA, 18 nt, Homo sapiens
cccagcuugguuccagga

SEQ ID NO: 2131552 - RNA, 15 nt, Homo sapiens
ccagugaaaauaagc

SEQ ID NO: 2131553 - RNA, 15 nt, Homo sapiens
cucuuauauugccau

SEQ ID NO: 2131554 - RNA, 21 nt, Homo sapiens
cauauuugcuucuaauguucc

SEQ ID NO: 2131555 - RNA, 20 nt, Homo sapiens
ucucaaacucccgaccucag

SEQ ID NO: 2131556 - RNA, 23 nt, Homo sapiens
ucccaggcugagccucagucucc

SEQ ID NO: 2131557 - RNA, 17 nt, Homo sapiens
gcaaugaugacccacua

SEQ ID NO: 2131558 - RNA, 16 nt, Homo sapiens
caauacuaauugagaa

SEQ ID NO: 2131559 - RNA, 13 nt, Homo sapiens
auagguuagauuc

SEQ ID NO: 2131560 - RNA, 18 nt, Homo sapiens
aggccuucugauuucaag

SEQ ID NO: 2131561 - RNA, 20 nt, Homo sapiens
gaucuaccugcaacacaaca

SEQ ID NO: 2131562 - RNA, 16 nt, Homo sapiens
gguuaaccacuguggu

SEQ ID NO: 2131563 - RNA, 18 nt, Homo sapiens
agugaaaggucaucucau

SEQ ID NO: 2131564 - RNA, 17 nt, Homo sapiens
aguuucuauucugucag

SEQ ID NO: 2131565 - RNA, 14 nt, Homo sapiens
gaggucaugcauug

SEQ ID NO: 2131566 - RNA, 15 nt, Homo sapiens
cuagaaaucugccaa

SEQ ID NO: 2131567 - RNA, 17 nt, Homo sapiens
cuuucuauuuaugcaac

SEQ ID NO: 2131568 - RNA, 13 nt, Homo sapiens
gagcagccugaac

SEQ ID NO: 2131569 - RNA, 20 nt, Homo sapiens
ucugcuuuucccauugccau

SEQ ID NO: 2131570 - RNA, 22 nt, Homo sapiens
agcacuuuuaacaaaaaaggaa

SEQ ID NO: 2131571 - RNA, 14 nt, Homo sapiens
acagugugggaggc

SEQ ID NO: 2131572 - RNA, 16 nt, Homo sapiens
ucaguuuacuaaaggu

SEQ ID NO: 2131573 - RNA, 15 nt, Homo sapiens
aagauuugagcacaa

SEQ ID NO: 2131574 - RNA, 17 nt, Homo sapiens
gucuaggaaucaugugc

SEQ ID NO: 2131575 - RNA, 14 nt, Homo sapiens
ucuuacauguauaa

SEQ ID NO: 2131576 - RNA, 14 nt, Homo sapiens
gcaaucauuuuaua

SEQ ID NO: 2131577 - RNA, 19 nt, Homo sapiens
ccuaucccagagaccuuga

SEQ ID NO: 2131578 - RNA, 16 nt, Homo sapiens
gucaacauaugugauu

SEQ ID NO: 2131579 - RNA, 21 nt, Homo sapiens
ggguuuugcuuuagagugcaa

SEQ ID NO: 2131580 - RNA, 22 nt, Homo sapiens
ccugaagacugaggacaaagug

SEQ ID NO: 2131581 - RNA, 18 nt, Homo sapiens
ccaccacgcaugcucagu

SEQ ID NO: 2131582 - RNA, 23 nt, Homo sapiens
cuuccaauaguuagaucuacccu

SEQ ID NO: 2131583 - RNA, 21 nt, Homo sapiens
ccaccuggaaggggcaaagaa

SEQ ID NO: 2131584 - RNA, 13 nt, Homo sapiens
cucuacucuuccu

SEQ ID NO: 2131585 - RNA, 14 nt, Homo sapiens
uucuuuuaugauug

SEQ ID NO: 2131586 - RNA, 14 nt, Homo sapiens
gucccagccaguga

SEQ ID NO: 2131587 - RNA, 14 nt, Homo sapiens
gucccugccagugu

SEQ ID NO: 2131588 - RNA, 18 nt, Homo sapiens
acauggcuguguuugcag

SEQ ID NO: 2131589 - RNA, 14 nt, Homo sapiens
gaacucaccauaga

SEQ ID NO: 2131590 - RNA, 18 nt, Homo sapiens
gaaagaaguuauuuucca

SEQ ID NO: 2131591 - RNA, 22 nt, Homo sapiens
ugggacuacaggugugagucac

SEQ ID NO: 2131592 - RNA, 22 nt, Homo sapiens
ggccuuugcuuuacagcacugu

SEQ ID NO: 2131593 - RNA, 13 nt, Homo sapiens
aaggcaguccaga

SEQ ID NO: 2131594 - RNA, 23 nt, Homo sapiens
agcaacuccccuacaucaaaugc

SEQ ID NO: 2131595 - RNA, 19 nt, Homo sapiens
uuuaauuaaaaacuuuaaa

SEQ ID NO: 2131596 - RNA, 15 nt, Homo sapiens
ugaucugcugcugag

SEQ ID NO: 2131597 - RNA, 18 nt, Homo sapiens
auagcaacauuauuugua

SEQ ID NO: 2131598 - RNA, 21 nt, Homo sapiens
acccuaucaagaaggugaaaa

SEQ ID NO: 2131599 - RNA, 23 nt, Homo sapiens
accaagugcggguccggcagcuu

SEQ ID NO: 2131600 - RNA, 19 nt, Homo sapiens
augacauccaauacagagu

SEQ ID NO: 2131601 - RNA, 13 nt, Homo sapiens
gacuucugcugaa

SEQ ID NO: 2131602 - RNA, 11 nt, Homo sapiens
ugugagccagc

SEQ ID NO: 2131603 - RNA, 13 nt, Homo sapiens
cuccucugcucuu

SEQ ID NO: 2131604 - RNA, 13 nt, Homo sapiens
ugaagcaaaugug

SEQ ID NO: 2131605 - RNA, 22 nt, Homo sapiens
cguuucacacggacuaaucuuu

SEQ ID NO: 2131606 - RNA, 17 nt, Homo sapiens
gagcuggagaacaggau

SEQ ID NO: 2131607 - RNA, 16 nt, Homo sapiens
gucugugcacaugccu

SEQ ID NO: 2131608 - RNA, 17 nt, Homo sapiens
caucacgcuacccagcu

SEQ ID NO: 2131609 - RNA, 14 nt, Homo sapiens
agagaaucauacuu

SEQ ID NO: 2131610 - RNA, 22 nt, Homo sapiens
cugagucccucacguuucuucc

SEQ ID NO: 2131611 - RNA, 17 nt, Homo sapiens
aaacaccgcuucugccu

SEQ ID NO: 2131612 - RNA, 16 nt, Homo sapiens
gcccugaccuucuggg

SEQ ID NO: 2131613 - RNA, 22 nt, Homo sapiens
caauaaguuccauguuaaaaua

SEQ ID NO: 2131614 - RNA, 12 nt, Homo sapiens
ccaccuggagag

SEQ ID NO: 2131615 - RNA, 17 nt, Homo sapiens
caaagauguggguggca

SEQ ID NO: 2131616 - RNA, 19 nt, Homo sapiens
acauugaaacuacacuaaa

SEQ ID NO: 2131617 - RNA, 19 nt, Homo sapiens
uaucauuuacugugugauc

SEQ ID NO: 2131618 - RNA, 16 nt, Homo sapiens
cugacaggugaugcuc

SEQ ID NO: 2131619 - RNA, 16 nt, Homo sapiens
cugaaacaacuuggaa

SEQ ID NO: 2131620 - RNA, 14 nt, Homo sapiens
gucucuacuaaaaa

SEQ ID NO: 2131621 - RNA, 14 nt, Homo sapiens
gcccacaauggagu

SEQ ID NO: 2131622 - RNA, 14 nt, Homo sapiens
caaacuggcuuaau

SEQ ID NO: 2131623 - RNA, 22 nt, Homo sapiens
aguaggaaucguuuuugcugca

SEQ ID NO: 2131624 - RNA, 15 nt, Homo sapiens
cuugcccaguuucag

SEQ ID NO: 2131625 - RNA, 15 nt, Homo sapiens
acucacauugccuug

SEQ ID NO: 2131626 - RNA, 22 nt, Homo sapiens
agcugcagucaacaguucaaag

SEQ ID NO: 2131627 - RNA, 23 nt, Homo sapiens
cugauagguagcauuuuccagca

SEQ ID NO: 2131628 - RNA, 13 nt, Homo sapiens
cccagugugugcu

SEQ ID NO: 2131629 - RNA, 21 nt, Homo sapiens
cugauguaguuaaguauuuac

SEQ ID NO: 2131630 - RNA, 19 nt, Homo sapiens
cagugacucaucuucucac

SEQ ID NO: 2131631 - RNA, 16 nt, Homo sapiens
ucugagaaaaugcgag

SEQ ID NO: 2131632 - RNA, 15 nt, Homo sapiens
agaaauuaacaaaug

SEQ ID NO: 2131633 - RNA, 13 nt, Homo sapiens
uccugugaccaca

SEQ ID NO: 2131634 - RNA, 16 nt, Homo sapiens
ugcaaagcugcuugaa

SEQ ID NO: 2131635 - RNA, 14 nt, Homo sapiens
ccuagcaugaacuu

SEQ ID NO: 2131636 - RNA, 19 nt, Homo sapiens
uguccucaucagucuccau

SEQ ID NO: 2131637 - RNA, 15 nt, Homo sapiens
cuccaggcugagggc

SEQ ID NO: 2131638 - RNA, 22 nt, Homo sapiens
ccugaauucuuuuucauuugag

SEQ ID NO: 2131639 - RNA, 15 nt, Homo sapiens
uuauagcucaucacu

SEQ ID NO: 2131640 - RNA, 21 nt, Homo sapiens
ggccccugaugcuccaaccuc

SEQ ID NO: 2131641 - RNA, 23 nt, Homo sapiens
aucggaucuggggcucugggaua

SEQ ID NO: 2131642 - RNA, 12 nt, Homo sapiens
uucaaaagugga

SEQ ID NO: 2131643 - RNA, 23 nt, Homo sapiens
acugagugugggagugcagagaa

SEQ ID NO: 2131644 - RNA, 23 nt, Homo sapiens
ugcacuacucccucaaagcacac

SEQ ID NO: 2131645 - RNA, 19 nt, Homo sapiens
gcuggcuccugaagggugc

SEQ ID NO: 2131646 - RNA, 19 nt, Homo sapiens
uccagcccaucuccgggga

SEQ ID NO: 2131647 - RNA, 16 nt, Homo sapiens
ggagugggugucucug

SEQ ID NO: 2131648 - RNA, 23 nt, Homo sapiens
gcagacuuaagcguacaaaguga

SEQ ID NO: 2131649 - RNA, 23 nt, Homo sapiens
ucuggcuagauuaccuagcuuag

SEQ ID NO: 2131650 - RNA, 23 nt, Homo sapiens
cugauacaauuugcccaagguaa

SEQ ID NO: 2131651 - RNA, 19 nt, Homo sapiens
uccuaacaggaauuuucau

SEQ ID NO: 2131652 - RNA, 16 nt, Homo sapiens
ucaaaucaaaccucag

SEQ ID NO: 2131653 - RNA, 19 nt, Homo sapiens
aucugggggaguggaauag

SEQ ID NO: 2131654 - RNA, 15 nt, Homo sapiens
uucaacuugugccug

SEQ ID NO: 2131655 - RNA, 24 nt, Homo sapiens
gaccagucacugacccugugcaga

SEQ ID NO: 2131656 - RNA, 15 nt, Homo sapiens
ggauguguguaaauu

SEQ ID NO: 2131657 - RNA, 16 nt, Homo sapiens
gauagguggugccagu

SEQ ID NO: 2131658 - RNA, 19 nt, Homo sapiens
acaccugagacaugcugaa

SEQ ID NO: 2131659 - RNA, 18 nt, Homo sapiens
aagauuaugaugaguaaa

SEQ ID NO: 2131660 - RNA, 16 nt, Homo sapiens
aauacugccagaugcu

SEQ ID NO: 2131661 - RNA, 17 nt, Homo sapiens
uggcuuuaugugcaaaa

SEQ ID NO: 2131662 - RNA, 16 nt, Homo sapiens
caucagaaacaucuga

SEQ ID NO: 2131663 - RNA, 15 nt, Homo sapiens
ugccaaauguuccau

SEQ ID NO: 2131664 - RNA, 20 nt, Homo sapiens
ugaagcugagcuagaauucu

SEQ ID NO: 2131665 - RNA, 13 nt, Homo sapiens
cuugucagacaua

SEQ ID NO: 2131666 - RNA, 16 nt, Homo sapiens
cacagaaacauuuuca

SEQ ID NO: 2131667 - RNA, 16 nt, Homo sapiens
acaaggcuccaagacc

SEQ ID NO: 2131668 - RNA, 22 nt, Homo sapiens
cuuuccaugccacgagaucaac

SEQ ID NO: 2131669 - RNA, 14 nt, Homo sapiens
acuaggaugaauua

SEQ ID NO: 2131670 - RNA, 16 nt, Homo sapiens
aaaucuccagucucau

SEQ ID NO: 2131671 - RNA, 22 nt, Homo sapiens
cuccaucgccaucuucuucccu

SEQ ID NO: 2131672 - RNA, 21 nt, Homo sapiens
gaaaaauccgcuuuucugcca

SEQ ID NO: 2131673 - RNA, 15 nt, Homo sapiens
auuugaugcaaaaug

SEQ ID NO: 2131674 - RNA, 15 nt, Homo sapiens
cagcuucaaaacaga

SEQ ID NO: 2131675 - RNA, 21 nt, Homo sapiens
ccaaagcucugaauaguuaaa

SEQ ID NO: 2131676 - RNA, 14 nt, Homo sapiens
ggaguccagccccu

SEQ ID NO: 2131677 - RNA, 15 nt, Homo sapiens
uacuagaaucagaua

SEQ ID NO: 2131678 - RNA, 19 nt, Homo sapiens
uccauaaagguaacaaagg

SEQ ID NO: 2131679 - RNA, 22 nt, Homo sapiens
uaccuuugucucacgauuccag

SEQ ID NO: 2131680 - RNA, 19 nt, Homo sapiens
augcacagcuaacauggaa

SEQ ID NO: 2131681 - RNA, 19 nt, Homo sapiens
guaacgccuguuacacaca

SEQ ID NO: 2131682 - RNA, 14 nt, Homo sapiens
caguguacagugaa

SEQ ID NO: 2131683 - RNA, 17 nt, Homo sapiens
acuccacuggucugucu

SEQ ID NO: 2131684 - RNA, 14 nt, Homo sapiens
caaaccagacagag

SEQ ID NO: 2131685 - RNA, 22 nt, Homo sapiens
aguuguugguuuauacuguaua

SEQ ID NO: 2131686 - RNA, 12 nt, Homo sapiens
cuccuuccucuu

SEQ ID NO: 2131687 - RNA, 23 nt, Homo sapiens
ugauccugcaauuccacuuauag

SEQ ID NO: 2131688 - RNA, 19 nt, Homo sapiens
auagcaggucccuauagca

SEQ ID NO: 2131689 - RNA, 20 nt, Homo sapiens
auaaauuuuuugugaucagu

SEQ ID NO: 2131690 - RNA, 23 nt, Homo sapiens
uaaaacuucugauuucucuucag

SEQ ID NO: 2131691 - RNA, 15 nt, Homo sapiens
caauaaaccuaauaa

SEQ ID NO: 2131692 - RNA, 9 nt, Homo sapiens
guuccugug

SEQ ID NO: 2131693 - RNA, 17 nt, Homo sapiens
ugaccaacuauauugcg

SEQ ID NO: 2131694 - RNA, 15 nt, Homo sapiens
caucucugaaaacaa

SEQ ID NO: 2131695 - RNA, 21 nt, Homo sapiens
acccuguccucccgagcuccu

SEQ ID NO: 2131696 - RNA, 20 nt, Homo sapiens
caaucuaauuaaauggcauc

SEQ ID NO: 2131697 - RNA, 14 nt, Homo sapiens
gcccagacugauga

SEQ ID NO: 2131698 - RNA, 14 nt, Homo sapiens
acagguggccauca

SEQ ID NO: 2131699 - RNA, 21 nt, Homo sapiens
ugaaaucugguuagauaauga

SEQ ID NO: 2131700 - RNA, 14 nt, Homo sapiens
cuagauacuguuga

SEQ ID NO: 2131701 - RNA, 22 nt, Homo sapiens
aaucuaaauagauacuuuugau

SEQ ID NO: 2131702 - RNA, 17 nt, Homo sapiens
uccaggcuggagugcaa

SEQ ID NO: 2131703 - RNA, 13 nt, Homo sapiens
gauugaacuuucc

SEQ ID NO: 2131704 - RNA, 13 nt, Homo sapiens
auauucuugucaa

SEQ ID NO: 2131705 - RNA, 23 nt, Homo sapiens
gugcucugaguaucacaucacac

SEQ ID NO: 2131706 - RNA, 22 nt, Homo sapiens
gacucaaaaauagggaaguaac

SEQ ID NO: 2131707 - RNA, 15 nt, Homo sapiens
aacacugcagcauuu

SEQ ID NO: 2131708 - RNA, 18 nt, Homo sapiens
uccugguucagugccacg

SEQ ID NO: 2131709 - RNA, 22 nt, Homo sapiens
ccugacuguccuacaauaucau

SEQ ID NO: 2131710 - RNA, 15 nt, Homo sapiens
acaggaaaaugacuu

SEQ ID NO: 2131711 - RNA, 12 nt, Homo sapiens
uuaaaaugugua

SEQ ID NO: 2131712 - RNA, 23 nt, Homo sapiens
ccagcugacacgcucaguugaaa

SEQ ID NO: 2131713 - RNA, 18 nt, Homo sapiens
acuuccuucaaucuucau

SEQ ID NO: 2131714 - RNA, 13 nt, Homo sapiens
ccuggccaucuca

SEQ ID NO: 2131715 - RNA, 17 nt, Homo sapiens
uuuaccuggugcucuca

SEQ ID NO: 2131716 - RNA, 21 nt, Homo sapiens
guaauagcuguaaacuuccaa

SEQ ID NO: 2131717 - RNA, 21 nt, Homo sapiens
aggagcagccugaacccgggg

SEQ ID NO: 2131718 - RNA, 17 nt, Homo sapiens
ggacaagauacauauga

SEQ ID NO: 2131719 - RNA, 20 nt, Homo sapiens
acuuccuccacaguccccca

SEQ ID NO: 2131720 - RNA, 13 nt, Homo sapiens
aagcucuaauaga

SEQ ID NO: 2131721 - RNA, 23 nt, Homo sapiens
auuagccgggcaugguggugcac

SEQ ID NO: 2131722 - RNA, 17 nt, Homo sapiens
acccauguaaccacugc

SEQ ID NO: 2131723 - RNA, 13 nt, Homo sapiens
caggaagcuguga

SEQ ID NO: 2131724 - RNA, 14 nt, Homo sapiens
cccuccacuccuca

SEQ ID NO: 2131725 - RNA, 17 nt, Homo sapiens
cuugugaaacgucugga

SEQ ID NO: 2131726 - RNA, 21 nt, Homo sapiens
cgaauaaaggaugggaccaac

SEQ ID NO: 2131727 - RNA, 21 nt, Homo sapiens
auagggcaugauuaacaaagc

SEQ ID NO: 2131728 - RNA, 17 nt, Homo sapiens
gaugcggccucagagag

SEQ ID NO: 2131729 - RNA, 22 nt, Homo sapiens
ccuguuucugaaccauuacugu

SEQ ID NO: 2131730 - RNA, 14 nt, Homo sapiens
uauacaucugugua

SEQ ID NO: 2131731 - RNA, 19 nt, Homo sapiens
gcuacagagaaaccagcuu

SEQ ID NO: 2131732 - RNA, 13 nt, Homo sapiens
ucuuugugugauu

SEQ ID NO: 2131733 - RNA, 21 nt, Homo sapiens
auuguacuguugaauuuggcu

SEQ ID NO: 2131734 - RNA, 20 nt, Homo sapiens
gcagaaauacauauuuccaa

SEQ ID NO: 2131735 - RNA, 18 nt, Homo sapiens
ugcuccagcaacugcccu

SEQ ID NO: 2131736 - RNA, 22 nt, Homo sapiens
uguucaaauagagcuguucaac

SEQ ID NO: 2131737 - RNA, 17 nt, Homo sapiens
cucaguuucuguuguuu

SEQ ID NO: 2131738 - RNA, 18 nt, Homo sapiens
agacuugaaauacuacuu

SEQ ID NO: 2131739 - RNA, 14 nt, Homo sapiens
uucucaagucccuu

SEQ ID NO: 2131740 - RNA, 12 nt, Homo sapiens
aacucauuugau

SEQ ID NO: 2131741 - RNA, 18 nt, Homo sapiens
aaccuaauaaauauuuag

SEQ ID NO: 2131742 - RNA, 19 nt, Homo sapiens
caguccaugcuucuagccu

SEQ ID NO: 2131743 - RNA, 20 nt, Homo sapiens
gguauguuuuaccaucugca

SEQ ID NO: 2131744 - RNA, 17 nt, Homo sapiens
uagucaaggugcucaau

SEQ ID NO: 2131745 - RNA, 22 nt, Homo sapiens
aacuacuuuuuggucaugaaau

SEQ ID NO: 2131746 - RNA, 14 nt, Homo sapiens
ccuguagcacaaag

SEQ ID NO: 2131747 - RNA, 13 nt, Homo sapiens
cuguauuaccucc

SEQ ID NO: 2131748 - RNA, 13 nt, Homo sapiens
acagaauucacuu

SEQ ID NO: 2131749 - RNA, 13 nt, Homo sapiens
uccaaggucucau

SEQ ID NO: 2131750 - RNA, 11 nt, Homo sapiens
aauuagcucac

SEQ ID NO: 2131751 - RNA, 17 nt, Homo sapiens
auauuuucaacaauuag

SEQ ID NO: 2131752 - RNA, 17 nt, Homo sapiens
gaugugcaguuuggaau

SEQ ID NO: 2131753 - RNA, 17 nt, Homo sapiens
aaagauuugagcacaaa

SEQ ID NO: 2131754 - RNA, 13 nt, Homo sapiens
cauacugcaugua

SEQ ID NO: 2131755 - RNA, 23 nt, Homo sapiens
acgccccacacuuuguacagacc

SEQ ID NO: 2131756 - RNA, 15 nt, Homo sapiens
ccagcuaaggggugg

SEQ ID NO: 2131757 - RNA, 13 nt, Homo sapiens
aaugaacacucau

SEQ ID NO: 2131758 - RNA, 15 nt, Homo sapiens
auuuugagaucaguc

SEQ ID NO: 2131759 - RNA, 13 nt, Homo sapiens
acuaaaugaucug

SEQ ID NO: 2131760 - RNA, 16 nt, Homo sapiens
aauuuguaggaaaaag

SEQ ID NO: 2131761 - RNA, 22 nt, Homo sapiens
ggaaaacgaagcucauucccaa

SEQ ID NO: 2131762 - RNA, 18 nt, Homo sapiens
ccaacucucgacuuuucc

SEQ ID NO: 2131763 - RNA, 14 nt, Homo sapiens
agcccaacaucucc

SEQ ID NO: 2131764 - RNA, 16 nt, Homo sapiens
cagggcccucuggggc

SEQ ID NO: 2131765 - RNA, 23 nt, Homo sapiens
ugaaaugacauuucacuaaaagu

SEQ ID NO: 2131766 - RNA, 19 nt, Homo sapiens
cccaugacuugaugcaguu

SEQ ID NO: 2131767 - RNA, 18 nt, Homo sapiens
gaccaggccaagacucaa

SEQ ID NO: 2131768 - RNA, 19 nt, Homo sapiens
aauuuuuuuuccuugccug

SEQ ID NO: 2131769 - RNA, 17 nt, Homo sapiens
ggagaaggagugccaua

SEQ ID NO: 2131770 - RNA, 15 nt, Homo sapiens
agcaugcagcuuugc

SEQ ID NO: 2131771 - RNA, 14 nt, Homo sapiens
cgauaaagggauuu

SEQ ID NO: 2131772 - RNA, 11 nt, Homo sapiens
uaaaacaaaga

SEQ ID NO: 2131773 - RNA, 15 nt, Homo sapiens
gagcaauucaaaaaa

SEQ ID NO: 2131774 - RNA, 17 nt, Homo sapiens
aacuugaggucugacuu

SEQ ID NO: 2131775 - RNA, 14 nt, Homo sapiens
gccaggacaucucu

SEQ ID NO: 2131776 - RNA, 18 nt, Homo sapiens
ccucaguccuauucugua

SEQ ID NO: 2131777 - RNA, 18 nt, Homo sapiens
cagaacaguaugaauuug

SEQ ID NO: 2131778 - RNA, 14 nt, Homo sapiens
uucuuuucuuuaua

SEQ ID NO: 2131779 - RNA, 16 nt, Homo sapiens
guauauuuugcaauag

SEQ ID NO: 2131780 - RNA, 13 nt, Homo sapiens
aaucuccaugugu

SEQ ID NO: 2131781 - RNA, 20 nt, Homo sapiens
ugucauucagaaaccugaag

SEQ ID NO: 2131782 - RNA, 20 nt, Homo sapiens
ccuagcaaccuccacauguu

SEQ ID NO: 2131783 - RNA, 17 nt, Homo sapiens
agagcccgguacagggc

SEQ ID NO: 2131784 - RNA, 23 nt, Homo sapiens
gacuaagccccgucugaccccag

SEQ ID NO: 2131785 - RNA, 22 nt, Homo sapiens
cuggggaaacauaacuccaucu

SEQ ID NO: 2131786 - RNA, 18 nt, Homo sapiens
cugaguauuaaguaguaa

SEQ ID NO: 2131787 - RNA, 16 nt, Homo sapiens
gucacuucuccaucac

SEQ ID NO: 2131788 - RNA, 22 nt, Homo sapiens
acucuccagaaagcucaucuca

SEQ ID NO: 2131789 - RNA, 13 nt, Homo sapiens
agaaaucucagaa

SEQ ID NO: 2131790 - RNA, 16 nt, Homo sapiens
acuguuuuuaaguaac

SEQ ID NO: 2131791 - RNA, 15 nt, Homo sapiens
acacacuuccagugu

SEQ ID NO: 2131792 - RNA, 19 nt, Homo sapiens
agaugcaaggaccaggacu

SEQ ID NO: 2131793 - RNA, 23 nt, Homo sapiens
aacuggacucauuaucacaguga

SEQ ID NO: 2131794 - RNA, 19 nt, Homo sapiens
ccuccacugccucuggaau

SEQ ID NO: 2131795 - RNA, 23 nt, Homo sapiens
ucuucccuuuuacauacugcugu

SEQ ID NO: 2131796 - RNA, 15 nt, Homo sapiens
cucuccaagugccag

SEQ ID NO: 2131797 - RNA, 21 nt, Homo sapiens
uaaagacaaagacauuucaaa

SEQ ID NO: 2131798 - RNA, 14 nt, Homo sapiens
gcagaagaucaaaa

SEQ ID NO: 2131799 - RNA, 12 nt, Homo sapiens
auuuuccaauua

SEQ ID NO: 2131800 - RNA, 20 nt, Homo sapiens
acuaugguaaauaacuguga

SEQ ID NO: 2131801 - RNA, 23 nt, Homo sapiens
aagacccuuucagaaucuuuuca

SEQ ID NO: 2131802 - RNA, 22 nt, Homo sapiens
ugaucugcccccacuguccugu

SEQ ID NO: 2131803 - RNA, 16 nt, Homo sapiens
ccucucagcauuuccu

SEQ ID NO: 2131804 - RNA, 16 nt, Homo sapiens
uacaauauacuuguau

SEQ ID NO: 2131805 - RNA, 14 nt, Homo sapiens
gucaggagagugca

SEQ ID NO: 2131806 - RNA, 15 nt, Homo sapiens
cacagcuggacaggu

SEQ ID NO: 2131807 - RNA, 17 nt, Homo sapiens
uauagcuaaguacacaa

SEQ ID NO: 2131808 - RNA, 14 nt, Homo sapiens
caggacauucucau

SEQ ID NO: 2131809 - RNA, 14 nt, Homo sapiens
gaaaagaagcaagg

SEQ ID NO: 2131810 - RNA, 21 nt, Homo sapiens
agccucagcaaacccaaagau

SEQ ID NO: 2131811 - RNA, 23 nt, Homo sapiens
auguguguagauacuuccugccc

SEQ ID NO: 2131812 - RNA, 18 nt, Homo sapiens
ucccaggacccugaaggg

SEQ ID NO: 2131813 - RNA, 18 nt, Homo sapiens
aaaugggacugaugucau

SEQ ID NO: 2131814 - RNA, 23 nt, Homo sapiens
cagaaaguucaacuuccaaaggg

SEQ ID NO: 2131815 - RNA, 14 nt, Homo sapiens
cucccucaccagcc

SEQ ID NO: 2131816 - RNA, 22 nt, Homo sapiens
ucuuaacaaguuagaaaauuca

SEQ ID NO: 2131817 - RNA, 19 nt, Homo sapiens
uccauaaugauggauuuaa

SEQ ID NO: 2131818 - RNA, 12 nt, Homo sapiens
augaaacauauc

SEQ ID NO: 2131819 - RNA, 22 nt, Homo sapiens
caacuuuucuaagaaaagcauu

SEQ ID NO: 2131820 - RNA, 13 nt, Homo sapiens
cagcugaacccug

SEQ ID NO: 2131821 - RNA, 16 nt, Homo sapiens
guugggaccugugauc

SEQ ID NO: 2131822 - RNA, 20 nt, Homo sapiens
gcgugauucggccucuccac

SEQ ID NO: 2131823 - RNA, 17 nt, Homo sapiens
uuucugcauagagucuu

SEQ ID NO: 2131824 - RNA, 19 nt, Homo sapiens
gugcaguggcgugaucuca

SEQ ID NO: 2131825 - RNA, 18 nt, Homo sapiens
gagaaagggacaaugaua

SEQ ID NO: 2131826 - RNA, 16 nt, Homo sapiens
uauucccaacugcucu

SEQ ID NO: 2131827 - RNA, 22 nt, Homo sapiens
ccacccucauucuacugaaaag

SEQ ID NO: 2131828 - RNA, 16 nt, Homo sapiens
ugauucaaauaucaaa

SEQ ID NO: 2131829 - RNA, 13 nt, Homo sapiens
acacauacacaca

SEQ ID NO: 2131830 - RNA, 13 nt, Homo sapiens
auacauacauaca

SEQ ID NO: 2131831 - RNA, 13 nt, Homo sapiens
uucccuacuuccc

SEQ ID NO: 2131832 - RNA, 13 nt, Homo sapiens
auauauacauaua

SEQ ID NO: 2131833 - RNA, 20 nt, Homo sapiens
acucugcugcugguggaaac

SEQ ID NO: 2131834 - RNA, 19 nt, Homo sapiens
uaugcaggggcaaacaccu

SEQ ID NO: 2131835 - RNA, 14 nt, Homo sapiens
uaccuagcacuuua

SEQ ID NO: 2131836 - RNA, 18 nt, Homo sapiens
cguacuuucuguuaucaa

SEQ ID NO: 2131837 - RNA, 20 nt, Homo sapiens
accagaagggcuucaaagau

SEQ ID NO: 2131838 - RNA, 12 nt, Homo sapiens
gagucacauccu

SEQ ID NO: 2131839 - RNA, 18 nt, Homo sapiens
ucagccccucucuacugu

SEQ ID NO: 2131840 - RNA, 23 nt, Homo sapiens
aacauguuccccaucuggugcuc

SEQ ID NO: 2131841 - RNA, 20 nt, Homo sapiens
acuuucucacugcugucagc

SEQ ID NO: 2131842 - RNA, 20 nt, Homo sapiens
uugccaauuuuuguuuuccc

SEQ ID NO: 2131843 - RNA, 13 nt, Homo sapiens
cucuugugcucag

SEQ ID NO: 2131844 - RNA, 22 nt, Homo sapiens
guaaaauggaggccagugccau

SEQ ID NO: 2131845 - RNA, 22 nt, Homo sapiens
ucugagcugcuaggaaccucau

SEQ ID NO: 2131846 - RNA, 13 nt, Homo sapiens
gcaaggagaaaaa

SEQ ID NO: 2131847 - RNA, 19 nt, Homo sapiens
cacacucacugcggagaac

SEQ ID NO: 2131848 - RNA, 23 nt, Homo sapiens
gaagcacuccucgguacucccau

SEQ ID NO: 2131849 - RNA, 14 nt, Homo sapiens
ggaucucaagccag

SEQ ID NO: 2131850 - RNA, 14 nt, Homo sapiens
agcucaagggacaa

SEQ ID NO: 2131851 - RNA, 22 nt, Homo sapiens
guauucuuaaauucauuuuaau

SEQ ID NO: 2131852 - RNA, 20 nt, Homo sapiens
ccaguguuuagaagagccug

SEQ ID NO: 2131853 - RNA, 17 nt, Homo sapiens
acacuuagcaucccaca

SEQ ID NO: 2131854 - RNA, 23 nt, Homo sapiens
cuugggcguuugaacucagggag

SEQ ID NO: 2131855 - RNA, 16 nt, Homo sapiens
uauugcaagaguuuaa

SEQ ID NO: 2131856 - RNA, 19 nt, Homo sapiens
ugccccuugggagacucca

SEQ ID NO: 2131857 - RNA, 20 nt, Homo sapiens
uauacacuuaaacuugcaca

SEQ ID NO: 2131858 - RNA, 18 nt, Homo sapiens
uaacuauaucauccuuua

SEQ ID NO: 2131859 - RNA, 23 nt, Homo sapiens
aacagccaaaacuccacagucaa

SEQ ID NO: 2131860 - RNA, 15 nt, Homo sapiens
ucugugaaauucuca

SEQ ID NO: 2131861 - RNA, 12 nt, Homo sapiens
ugaggacugugg

SEQ ID NO: 2131862 - RNA, 18 nt, Homo sapiens
ugaagaccuaaaugaccu

SEQ ID NO: 2131863 - RNA, 17 nt, Homo sapiens
uccugcaaguccauagc

SEQ ID NO: 2131864 - RNA, 13 nt, Homo sapiens
cuugacugcauug

SEQ ID NO: 2131865 - RNA, 19 nt, Homo sapiens
cucacgcccuaagcgcaca

SEQ ID NO: 2131866 - RNA, 12 nt, Homo sapiens
uugcaccugcaa

SEQ ID NO: 2131867 - RNA, 19 nt, Homo sapiens
gugggagcacagcuuuccu

SEQ ID NO: 2131868 - RNA, 21 nt, Homo sapiens
cagcacagcgaagacugcuaa

SEQ ID NO: 2131869 - RNA, 22 nt, Homo sapiens
acccuugugagagcccauuccc

SEQ ID NO: 2131870 - RNA, 15 nt, Homo sapiens
auuuuacucacucac

SEQ ID NO: 2131871 - RNA, 14 nt, Homo sapiens
agaauguaacuguu

SEQ ID NO: 2131872 - RNA, 16 nt, Homo sapiens
ucaauucgcuauucgc

SEQ ID NO: 2131873 - RNA, 22 nt, Homo sapiens
gcucucaccgggcuacuaccug

SEQ ID NO: 2131874 - RNA, 14 nt, Homo sapiens
gaauuaaucacuuu

SEQ ID NO: 2131875 - RNA, 17 nt, Homo sapiens
uccaccccacucacaga

SEQ ID NO: 2131876 - RNA, 22 nt, Homo sapiens
accauuaaucagaaacaucaug

SEQ ID NO: 2131877 - RNA, 21 nt, Homo sapiens
ugcugaacugaaggcucagau

SEQ ID NO: 2131878 - RNA, 16 nt, Homo sapiens
cuucugcaacugaaau

SEQ ID NO: 2131879 - RNA, 18 nt, Homo sapiens
ggcuccucggacucugcu

SEQ ID NO: 2131880 - RNA, 21 nt, Homo sapiens
uggcugccuuugaucacagga

SEQ ID NO: 2131881 - RNA, 21 nt, Homo sapiens
gcuucuggggguagaucucaa

SEQ ID NO: 2131882 - RNA, 16 nt, Homo sapiens
auaccaagcaugugga

SEQ ID NO: 2131883 - RNA, 20 nt, Homo sapiens
cagaguuucaccauguuggc

SEQ ID NO: 2131884 - RNA, 22 nt, Homo sapiens
caucucaacaaccugaaugucc

SEQ ID NO: 2131885 - RNA, 19 nt, Homo sapiens
cucaaacuccugaguucaa

SEQ ID NO: 2131886 - RNA, 19 nt, Homo sapiens
cauaaacuuuccucuuccu

SEQ ID NO: 2131887 - RNA, 14 nt, Homo sapiens
acucagguggugcc

SEQ ID NO: 2131888 - RNA, 17 nt, Homo sapiens
ucaagaacugccauaaa

SEQ ID NO: 2131889 - RNA, 17 nt, Homo sapiens
aggagaugaggcuggau

SEQ ID NO: 2131890 - RNA, 16 nt, Homo sapiens
aagcgucaucugugua

SEQ ID NO: 2131891 - RNA, 16 nt, Homo sapiens
cuuugguaauguguca

SEQ ID NO: 2131892 - RNA, 13 nt, Homo sapiens
uuuaguagccuca

SEQ ID NO: 2131893 - RNA, 20 nt, Homo sapiens
gcggagaaccuugugccugg

SEQ ID NO: 2131894 - RNA, 16 nt, Homo sapiens
ccuggcacguccucca

SEQ ID NO: 2131895 - RNA, 17 nt, Homo sapiens
auuuuccuaauggucuc

SEQ ID NO: 2131896 - RNA, 23 nt, Homo sapiens
uggaaaaaagagaaaaaccaaug

SEQ ID NO: 2131897 - RNA, 16 nt, Homo sapiens
gaugaaaugcacugua

SEQ ID NO: 2131898 - RNA, 18 nt, Homo sapiens
cuccgugagccucagcca

SEQ ID NO: 2131899 - RNA, 13 nt, Homo sapiens
caugaugugcaac

SEQ ID NO: 2131900 - RNA, 15 nt, Homo sapiens
caccgcauccucacu

SEQ ID NO: 2131901 - RNA, 17 nt, Homo sapiens
aaaauaacugaaccaaa

SEQ ID NO: 2131902 - RNA, 17 nt, Homo sapiens
cagaacauuucucaugu

SEQ ID NO: 2131903 - RNA, 16 nt, Homo sapiens
ggccaaggcuccuaug

SEQ ID NO: 2131904 - RNA, 15 nt, Homo sapiens
agucacauucagagu

SEQ ID NO: 2131905 - RNA, 20 nt, Homo sapiens
ccagagaggguggugaccuc

SEQ ID NO: 2131906 - RNA, 21 nt, Homo sapiens
uaugcaauuuuuaaacuagua

SEQ ID NO: 2131907 - RNA, 18 nt, Homo sapiens
aagaguuggagugagaug

SEQ ID NO: 2131908 - RNA, 17 nt, Homo sapiens
cuguuucuuccacagug

SEQ ID NO: 2131909 - RNA, 22 nt, Homo sapiens
gacacuuaauacuaccuugaaa

SEQ ID NO: 2131910 - RNA, 20 nt, Homo sapiens
auggauuuauugagugccaa

SEQ ID NO: 2131911 - RNA, 12 nt, Homo sapiens
ucagcaaugauu

SEQ ID NO: 2131912 - RNA, 22 nt, Homo sapiens
ucuuucauucucucuuccugca

SEQ ID NO: 2131913 - RNA, 16 nt, Homo sapiens
cuuccuguucugugac

SEQ ID NO: 2131914 - RNA, 20 nt, Homo sapiens
gcccuauucuuucuauucag

SEQ ID NO: 2131915 - RNA, 19 nt, Homo sapiens
gugugcauuaccacacuca

SEQ ID NO: 2131916 - RNA, 15 nt, Homo sapiens
caguggcucaaugca

SEQ ID NO: 2131917 - RNA, 17 nt, Homo sapiens
uuuguaauauaagacaa

SEQ ID NO: 2131918 - RNA, 11 nt, Homo sapiens
aaaccaaauac

SEQ ID NO: 2131919 - RNA, 11 nt, Homo sapiens
aacccaaauaa

SEQ ID NO: 2131920 - RNA, 23 nt, Homo sapiens
uaagggcuuuuccaaacaugcau

SEQ ID NO: 2131921 - RNA, 15 nt, Homo sapiens
gccaauaggcagcuu

SEQ ID NO: 2131922 - RNA, 15 nt, Homo sapiens
uacaaauguaagcaa

SEQ ID NO: 2131923 - RNA, 22 nt, Homo sapiens
cuguuuuucagauacacuguga

SEQ ID NO: 2131924 - RNA, 21 nt, Homo sapiens
gagaauuuacgagcagggaug

SEQ ID NO: 2131925 - RNA, 19 nt, Homo sapiens
gucagaaagagauuuucac

SEQ ID NO: 2131926 - RNA, 17 nt, Homo sapiens
ugugggcccucuuucaa

SEQ ID NO: 2131927 - RNA, 20 nt, Homo sapiens
auuuggagccugccaagagg

SEQ ID NO: 2131928 - RNA, 18 nt, Homo sapiens
aguagaauagaaaaucuc

SEQ ID NO: 2131929 - RNA, 14 nt, Homo sapiens
agaugagacugccc

SEQ ID NO: 2131930 - RNA, 9 nt, Homo sapiens
gcaucucau

SEQ ID NO: 2131931 - RNA, 19 nt, Homo sapiens
auguguaggugaacaguca

SEQ ID NO: 2131932 - RNA, 12 nt, Homo sapiens
ugaauguugcau

SEQ ID NO: 2131933 - RNA, 13 nt, Homo sapiens
accccucuuccca

SEQ ID NO: 2131934 - RNA, 12 nt, Homo sapiens
caaucucaaaaa

SEQ ID NO: 2131935 - RNA, 22 nt, Homo sapiens
caauuguugacaguucugaaga

SEQ ID NO: 2131936 - RNA, 19 nt, Homo sapiens
gcucuggugcugcaguaug

SEQ ID NO: 2131937 - RNA, 14 nt, Homo sapiens
aucuuuuagcacau

SEQ ID NO: 2131938 - RNA, 17 nt, Homo sapiens
cuccaauccccacuccu

SEQ ID NO: 2131939 - RNA, 13 nt, Homo sapiens
ccagaagugcaga

SEQ ID NO: 2131940 - RNA, 14 nt, Homo sapiens
gagaugcagccagc

SEQ ID NO: 2131941 - RNA, 13 nt, Homo sapiens
acagauauuccag

SEQ ID NO: 2131942 - RNA, 19 nt, Homo sapiens
uuuuugaaaaaaguauagg

SEQ ID NO: 2131943 - RNA, 16 nt, Homo sapiens
caugcuucuacuguga

SEQ ID NO: 2131944 - RNA, 18 nt, Homo sapiens
ucuucaaggagaaugaau

SEQ ID NO: 2131945 - RNA, 23 nt, Homo sapiens
uuuuaacuucuuucuauuugacu

SEQ ID NO: 2131946 - RNA, 13 nt, Homo sapiens
caguguucucaca

SEQ ID NO: 2131947 - RNA, 13 nt, Homo sapiens
cucauucuuguga

SEQ ID NO: 2131948 - RNA, 12 nt, Homo sapiens
acguggccucuu

SEQ ID NO: 2131949 - RNA, 14 nt, Homo sapiens
ucuuccucuuaccu

SEQ ID NO: 2131950 - RNA, 18 nt, Homo sapiens
aagccgucucaugcagaa

SEQ ID NO: 2131951 - RNA, 23 nt, Homo sapiens
gaucacagggccccagaaggcag

SEQ ID NO: 2131952 - RNA, 15 nt, Homo sapiens
ccuccauucugacca

SEQ ID NO: 2131953 - RNA, 16 nt, Homo sapiens
agaucgcaguuugccu

SEQ ID NO: 2131954 - RNA, 19 nt, Homo sapiens
cucgaguacuaauaugcaa

SEQ ID NO: 2131955 - RNA, 21 nt, Homo sapiens
ccuggcaaaugccugacucag

SEQ ID NO: 2131956 - RNA, 22 nt, Homo sapiens
gucuuccuccucagucuucuca

SEQ ID NO: 2131957 - RNA, 17 nt, Homo sapiens
caguagaagcucacaaa

SEQ ID NO: 2131958 - RNA, 23 nt, Homo sapiens
uaaaaagaaaaucaguugauuaa

SEQ ID NO: 2131959 - RNA, 16 nt, Homo sapiens
auccagcaauuccuga

SEQ ID NO: 2131960 - RNA, 13 nt, Homo sapiens
cauuugugucugc

SEQ ID NO: 2131961 - RNA, 17 nt, Homo sapiens
aauucaauuaaaaccau

SEQ ID NO: 2131962 - RNA, 15 nt, Homo sapiens
ccaaggccaccccac

SEQ ID NO: 2131963 - RNA, 20 nt, Homo sapiens
uguagaaucucuucaugcuu

SEQ ID NO: 2131964 - RNA, 19 nt, Homo sapiens
acgcauggugcaggaggga

SEQ ID NO: 2131965 - RNA, 18 nt, Homo sapiens
agaaggaacauugcagag

SEQ ID NO: 2131966 - RNA, 15 nt, Homo sapiens
uaaaacaauacucaa

SEQ ID NO: 2131967 - RNA, 13 nt, Homo sapiens
gucugacuaggca

SEQ ID NO: 2131968 - RNA, 14 nt, Homo sapiens
cugaagaggcauuu

SEQ ID NO: 2131969 - RNA, 18 nt, Homo sapiens
uucuccuuguacuugaau

SEQ ID NO: 2131970 - RNA, 14 nt, Homo sapiens
guaaaauauaucau

SEQ ID NO: 2131971 - RNA, 22 nt, Homo sapiens
augccaaguggcccucagauua

SEQ ID NO: 2131972 - RNA, 15 nt, Homo sapiens
uguuccccaccgcug

SEQ ID NO: 2131973 - RNA, 22 nt, Homo sapiens
ucaauguauaguuagcuuuauu

SEQ ID NO: 2131974 - RNA, 20 nt, Homo sapiens
cuuguuuagagagccuguca

SEQ ID NO: 2131975 - RNA, 17 nt, Homo sapiens
cuuaccccgagaccuca

SEQ ID NO: 2131976 - RNA, 11 nt, Homo sapiens
gagagcucacu

SEQ ID NO: 2131977 - RNA, 16 nt, Homo sapiens
agggggucucuguuaa

SEQ ID NO: 2131978 - RNA, 22 nt, Homo sapiens
ugccaaaccuguguaggcauuu

SEQ ID NO: 2131979 - RNA, 16 nt, Homo sapiens
acacagcacaagggca

SEQ ID NO: 2131980 - RNA, 21 nt, Homo sapiens
uaaacuaggauugacauucua

SEQ ID NO: 2131981 - RNA, 20 nt, Homo sapiens
aaggaaucuuuaagcagaga

SEQ ID NO: 2131982 - RNA, 18 nt, Homo sapiens
caccauaaaucacaucau

SEQ ID NO: 2131983 - RNA, 13 nt, Homo sapiens
aagcacaccucau

SEQ ID NO: 2131984 - RNA, 16 nt, Homo sapiens
caguugcacuacauaa

SEQ ID NO: 2131985 - RNA, 14 nt, Homo sapiens
ugcugagcugugau

SEQ ID NO: 2131986 - RNA, 16 nt, Homo sapiens
ugggaacacgugugca

SEQ ID NO: 2131987 - RNA, 21 nt, Homo sapiens
gcgauggcaggccugacccac

SEQ ID NO: 2131988 - RNA, 24 nt, Homo sapiens
acaggccccugaguccuggcucau

SEQ ID NO: 2131989 - RNA, 15 nt, Homo sapiens
uucccccaguaccuc

SEQ ID NO: 2131990 - RNA, 15 nt, Homo sapiens
uacccacacauucca

SEQ ID NO: 2131991 - RNA, 17 nt, Homo sapiens
uggagcccacaaccuuc

SEQ ID NO: 2131992 - RNA, 23 nt, Homo sapiens
ugugcaguccugggauguggcug

SEQ ID NO: 2131993 - RNA, 21 nt, Homo sapiens
acauuuggugagagaaguaca

SEQ ID NO: 2131994 - RNA, 15 nt, Homo sapiens
aggaagcacaggcca

SEQ ID NO: 2131995 - RNA, 15 nt, Homo sapiens
gacucuccacuguua

SEQ ID NO: 2131996 - RNA, 20 nt, Homo sapiens
ggugaacaaagcagccacga

SEQ ID NO: 2131997 - RNA, 16 nt, Homo sapiens
aauguuucacuaguua

SEQ ID NO: 2131998 - RNA, 14 nt, Homo sapiens
gaauauuaagcaca

SEQ ID NO: 2131999 - RNA, 13 nt, Homo sapiens
cagauaugcacac

SEQ ID NO: 2132000 - RNA, 23 nt, Homo sapiens
caggaaaccacaaccuugcagua

SEQ ID NO: 2132001 - RNA, 16 nt, Homo sapiens
gucacucaaaugaauu

SEQ ID NO: 2132002 - RNA, 15 nt, Homo sapiens
auaaauugacauaac

SEQ ID NO: 2132003 - RNA, 13 nt, Homo sapiens
auauaagcucaau

SEQ ID NO: 2132004 - RNA, 14 nt, Homo sapiens
gaggacagugcuga

SEQ ID NO: 2132005 - RNA, 16 nt, Homo sapiens
auaaaagagaagccaa

SEQ ID NO: 2132006 - RNA, 15 nt, Homo sapiens
acagagucugugucc

SEQ ID NO: 2132007 - RNA, 20 nt, Homo sapiens
cucccuuaauaaacucacaa

SEQ ID NO: 2132008 - RNA, 20 nt, Homo sapiens
acuuugacgagucaccuucc

SEQ ID NO: 2132009 - RNA, 17 nt, Homo sapiens
uuuacagcaaguagaua

SEQ ID NO: 2132010 - RNA, 11 nt, Homo sapiens
uaagauuuauu

SEQ ID NO: 2132011 - RNA, 16 nt, Homo sapiens
agcuccaguguccuga

SEQ ID NO: 2132012 - RNA, 21 nt, Homo sapiens
caauaaugugcaaauuuugca

SEQ ID NO: 2132013 - RNA, 11 nt, Homo sapiens
ccucacugaga

SEQ ID NO: 2132014 - RNA, 14 nt, Homo sapiens
agaaaaucugggca

SEQ ID NO: 2132015 - RNA, 16 nt, Homo sapiens
gccaccagccacuuua

SEQ ID NO: 2132016 - RNA, 10 nt, Homo sapiens
caugaaggug

SEQ ID NO: 2132017 - RNA, 20 nt, Homo sapiens
ucucccaucaggguccccag

SEQ ID NO: 2132018 - RNA, 17 nt, Homo sapiens
augcaaaaaaucuucca

SEQ ID NO: 2132019 - RNA, 21 nt, Homo sapiens
ccuagagugacucuaccugca

SEQ ID NO: 2132020 - RNA, 22 nt, Homo sapiens
gaagguccccuggcagugcuga

SEQ ID NO: 2132021 - RNA, 23 nt, Homo sapiens
agaauuuuauauuuaaauaaagg

SEQ ID NO: 2132022 - RNA, 15 nt, Homo sapiens
acuguuaacacugcu

SEQ ID NO: 2132023 - RNA, 16 nt, Homo sapiens
uaacauuuugagcuau

SEQ ID NO: 2132024 - RNA, 22 nt, Homo sapiens
ugcaaugccaguccugcaggag

SEQ ID NO: 2132025 - RNA, 16 nt, Homo sapiens
aaacggcuuuucuugg

SEQ ID NO: 2132026 - RNA, 17 nt, Homo sapiens
uacacugaggagagauu

SEQ ID NO: 2132027 - RNA, 14 nt, Homo sapiens
aggcaagccacaga

SEQ ID NO: 2132028 - RNA, 14 nt, Homo sapiens
uggaaugaaugaca

SEQ ID NO: 2132029 - RNA, 22 nt, Homo sapiens
aauuucuucuuuagaugccaaa

SEQ ID NO: 2132030 - RNA, 18 nt, Homo sapiens
gaugaccauuuucugcca

SEQ ID NO: 2132031 - RNA, 20 nt, Homo sapiens
agcaaaacaauaaacuagca

SEQ ID NO: 2132032 - RNA, 20 nt, Homo sapiens
aauucuggaaaugucuuucu

SEQ ID NO: 2132033 - RNA, 22 nt, Homo sapiens
cacacaagugcaguagugcagu

SEQ ID NO: 2132034 - RNA, 17 nt, Homo sapiens
auuaugaugaaaaccua

SEQ ID NO: 2132035 - RNA, 13 nt, Homo sapiens
ccuccuacuguau

SEQ ID NO: 2132036 - RNA, 16 nt, Homo sapiens
cagaacgucucucacc

SEQ ID NO: 2132037 - RNA, 21 nt, Homo sapiens
ugucucaacuacucagcucuc

SEQ ID NO: 2132038 - RNA, 17 nt, Homo sapiens
uauuuaggcaugagcuc

SEQ ID NO: 2132039 - RNA, 21 nt, Homo sapiens
gcccacugcccaaugccugcu

SEQ ID NO: 2132040 - RNA, 16 nt, Homo sapiens
cuuacucccuccuucu

SEQ ID NO: 2132041 - RNA, 13 nt, Homo sapiens
uugcuuuggucac

SEQ ID NO: 2132042 - RNA, 13 nt, Homo sapiens
acucgcagcaccc

SEQ ID NO: 2132043 - RNA, 13 nt, Homo sapiens
uggggaggacaaa

SEQ ID NO: 2132044 - RNA, 15 nt, Homo sapiens
uccucgcagagaaug

SEQ ID NO: 2132045 - RNA, 18 nt, Homo sapiens
agccuacagaagggcagu

SEQ ID NO: 2132046 - RNA, 12 nt, Homo sapiens
ucuccagugcac

SEQ ID NO: 2132047 - RNA, 17 nt, Homo sapiens
auaaagaagaaaauaac

SEQ ID NO: 2132048 - RNA, 16 nt, Homo sapiens
ccagcccaaugccaag

SEQ ID NO: 2132049 - RNA, 21 nt, Homo sapiens
aagagccccuccuaacccagc

SEQ ID NO: 2132050 - RNA, 15 nt, Homo sapiens
ugaugcccuuuggaa

SEQ ID NO: 2132051 - RNA, 16 nt, Homo sapiens
ugggccaguuccucca

SEQ ID NO: 2132052 - RNA, 16 nt, Homo sapiens
uaggucauuggccacu

SEQ ID NO: 2132053 - RNA, 14 nt, Homo sapiens
cauuaaaccaucuc

SEQ ID NO: 2132054 - RNA, 21 nt, Homo sapiens
cugcagguuccuuaucuguca

SEQ ID NO: 2132055 - RNA, 21 nt, Homo sapiens
aaaggcuggaugugcuuucau

SEQ ID NO: 2132056 - RNA, 21 nt, Homo sapiens
gaccacgcuuucuagcuguug

SEQ ID NO: 2132057 - RNA, 21 nt, Homo sapiens
acaaguuagaaaauucagcuc

SEQ ID NO: 2132058 - RNA, 17 nt, Homo sapiens
agggaaagagcuuuccu

SEQ ID NO: 2132059 - RNA, 12 nt, Homo sapiens
auuuuucacugu

SEQ ID NO: 2132060 - RNA, 21 nt, Homo sapiens
cacaugcuuuagccauacaca

SEQ ID NO: 2132061 - RNA, 14 nt, Homo sapiens
acacagcucccaua

SEQ ID NO: 2132062 - RNA, 16 nt, Homo sapiens
ugacgcacugcucaag

SEQ ID NO: 2132063 - RNA, 20 nt, Homo sapiens
aacuuuaguuuguguuauua

SEQ ID NO: 2132064 - RNA, 17 nt, Homo sapiens
gcaguggucccaauagg

SEQ ID NO: 2132065 - RNA, 20 nt, Homo sapiens
aaaacugauuuuuagcuuua

SEQ ID NO: 2132066 - RNA, 19 nt, Homo sapiens
cccagaaaaggcggugcuc

SEQ ID NO: 2132067 - RNA, 14 nt, Homo sapiens
guccuaggcucugg

SEQ ID NO: 2132068 - RNA, 14 nt, Homo sapiens
cauugccggcaaug

SEQ ID NO: 2132069 - RNA, 14 nt, Homo sapiens
aaucagcacucugu

SEQ ID NO: 2132070 - RNA, 16 nt, Homo sapiens
uaugaacuucucucag

SEQ ID NO: 2132071 - RNA, 13 nt, Homo sapiens
uguaaacugccau

SEQ ID NO: 2132072 - RNA, 20 nt, Homo sapiens
cuuaaaaugacaaagccauu

SEQ ID NO: 2132073 - RNA, 12 nt, Homo sapiens
uaaucugcauuu

SEQ ID NO: 2132074 - RNA, 22 nt, Homo sapiens
aauuccuauauccugugacugu

SEQ ID NO: 2132075 - RNA, 21 nt, Homo sapiens
uucagcaguccuuaucaccag

SEQ ID NO: 2132076 - RNA, 19 nt, Homo sapiens
ggccugcugccagugcagc

SEQ ID NO: 2132077 - RNA, 20 nt, Homo sapiens
acaccuccuccugcugcuca

SEQ ID NO: 2132078 - RNA, 17 nt, Homo sapiens
uaggaaagcauaugcag

SEQ ID NO: 2132079 - RNA, 16 nt, Homo sapiens
ccagaacccaaaucca

SEQ ID NO: 2132080 - RNA, 14 nt, Homo sapiens
gcaacaaccaucuc

SEQ ID NO: 2132081 - RNA, 11 nt, Homo sapiens
ccugacugugg

SEQ ID NO: 2132082 - RNA, 23 nt, Homo sapiens
cacucuccccucccucuuccuuc

SEQ ID NO: 2132083 - RNA, 20 nt, Homo sapiens
ccagaggcagcucgugugcc

SEQ ID NO: 2132084 - RNA, 19 nt, Homo sapiens
aauggaggaagaacaacaa

SEQ ID NO: 2132085 - RNA, 19 nt, Homo sapiens
gugguuugcuccagaauua

SEQ ID NO: 2132086 - RNA, 22 nt, Homo sapiens
agccugucaccagagcuucucu

SEQ ID NO: 2132087 - RNA, 12 nt, Homo sapiens
agccaaggcagg

SEQ ID NO: 2132088 - RNA, 15 nt, Homo sapiens
acugauuaacaaaua

SEQ ID NO: 2132089 - RNA, 15 nt, Homo sapiens
cuaauauacuuguaa

SEQ ID NO: 2132090 - RNA, 14 nt, Homo sapiens
aauacuuugaacac

SEQ ID NO: 2132091 - RNA, 17 nt, Homo sapiens
aauaaaauuaacuggug

SEQ ID NO: 2132092 - RNA, 16 nt, Homo sapiens
caccacugcacuccag

SEQ ID NO: 2132093 - RNA, 23 nt, Homo sapiens
caugaauauuucauaucuauaaa

SEQ ID NO: 2132094 - RNA, 14 nt, Homo sapiens
agggugaaccaagc

SEQ ID NO: 2132095 - RNA, 15 nt, Homo sapiens
auuaacaaaagauuc

SEQ ID NO: 2132096 - RNA, 17 nt, Homo sapiens
uccugagaagcauguaa

SEQ ID NO: 2132097 - RNA, 15 nt, Homo sapiens
auauaccaaugacuu

SEQ ID NO: 2132098 - RNA, 23 nt, Homo sapiens
augguguagcccucccacuuugc

SEQ ID NO: 2132099 - RNA, 20 nt, Homo sapiens
gccuguuggauaaagaccuu

SEQ ID NO: 2132100 - RNA, 20 nt, Homo sapiens
aucaagguagaacaaagaaa

SEQ ID NO: 2132101 - RNA, 11 nt, Homo sapiens
aagugaccuau

SEQ ID NO: 2132102 - RNA, 22 nt, Homo sapiens
guuuuauuuaacugugcaguga

SEQ ID NO: 2132103 - RNA, 13 nt, Homo sapiens
cacaguacaggau

SEQ ID NO: 2132104 - RNA, 12 nt, Homo sapiens
cuuccaccacuc

SEQ ID NO: 2132105 - RNA, 12 nt, Homo sapiens
agcuaucacugu

SEQ ID NO: 2132106 - RNA, 21 nt, Homo sapiens
ugcguaggagagaacagggau

SEQ ID NO: 2132107 - RNA, 20 nt, Homo sapiens
uuuuuauaucaugcaaaaua

SEQ ID NO: 2132108 - RNA, 22 nt, Homo sapiens
cucaccuuuuuaaauccuaaaa

SEQ ID NO: 2132109 - RNA, 18 nt, Homo sapiens
ccgagccuggcuccaaac

SEQ ID NO: 2132110 - RNA, 19 nt, Homo sapiens
uugccauuacgcuaguuau

SEQ ID NO: 2132111 - RNA, 20 nt, Homo sapiens
acugcugugggcugcucacu

SEQ ID NO: 2132112 - RNA, 17 nt, Homo sapiens
aagucacucacacuggc

SEQ ID NO: 2132113 - RNA, 20 nt, Homo sapiens
gcuaaaccauucaugaugaa

SEQ ID NO: 2132114 - RNA, 17 nt, Homo sapiens
ucacuugaggucaggag

SEQ ID NO: 2132115 - RNA, 16 nt, Homo sapiens
aguaggcuaaaaacau

SEQ ID NO: 2132116 - RNA, 15 nt, Homo sapiens
agccugcucugccac

SEQ ID NO: 2132117 - RNA, 17 nt, Homo sapiens
uaccuuguuaagacaaa

SEQ ID NO: 2132118 - RNA, 19 nt, Homo sapiens
gccgaaccaggagcugcuc

SEQ ID NO: 2132119 - RNA, 16 nt, Homo sapiens
cuucaucugugaaaug

SEQ ID NO: 2132120 - RNA, 17 nt, Homo sapiens
uggaugcuuacagugac

SEQ ID NO: 2132121 - RNA, 16 nt, Homo sapiens
ugcucucauaggaguu

SEQ ID NO: 2132122 - RNA, 19 nt, Homo sapiens
ugcuucuccaagcuuucag

SEQ ID NO: 2132123 - RNA, 17 nt, Homo sapiens
accagagccagaugcag

SEQ ID NO: 2132124 - RNA, 12 nt, Homo sapiens
ucacugcaauuu

SEQ ID NO: 2132125 - RNA, 12 nt, Homo sapiens
acuuugcauuac

SEQ ID NO: 2132126 - RNA, 22 nt, Homo sapiens
ugaguuccggcaccaguagcag

SEQ ID NO: 2132127 - RNA, 11 nt, Homo sapiens
augccaaaaaa

SEQ ID NO: 2132128 - RNA, 18 nt, Homo sapiens
ugaccuuggguauuugca

SEQ ID NO: 2132129 - RNA, 18 nt, Homo sapiens
ucauugacaagaacugaa

SEQ ID NO: 2132130 - RNA, 15 nt, Homo sapiens
aacaagugaaauaac

SEQ ID NO: 2132131 - RNA, 19 nt, Homo sapiens
cccaaggaccuuacaggcc

SEQ ID NO: 2132132 - RNA, 14 nt, Homo sapiens
acuaaacauaugaa

SEQ ID NO: 2132133 - RNA, 16 nt, Homo sapiens
ugcaacagggggcaaa

SEQ ID NO: 2132134 - RNA, 15 nt, Homo sapiens
ccaacggcaacagca

SEQ ID NO: 2132135 - RNA, 20 nt, Homo sapiens
cuggucucaaacuccugacc

SEQ ID NO: 2132136 - RNA, 17 nt, Homo sapiens
auacaaaccuaccaaaa

SEQ ID NO: 2132137 - RNA, 19 nt, Homo sapiens
uuggagacccgccuggcua

SEQ ID NO: 2132138 - RNA, 17 nt, Homo sapiens
uguaguugaugacuguu

SEQ ID NO: 2132139 - RNA, 20 nt, Homo sapiens
uuacugugagcuuuugccug

SEQ ID NO: 2132140 - RNA, 20 nt, Homo sapiens
uguacccuccauguaccuug

SEQ ID NO: 2132141 - RNA, 16 nt, Homo sapiens
ccauagacacaguauu

SEQ ID NO: 2132142 - RNA, 15 nt, Homo sapiens
cuagcagcugcaguc

SEQ ID NO: 2132143 - RNA, 14 nt, Homo sapiens
caauauacuuguau

SEQ ID NO: 2132144 - RNA, 20 nt, Homo sapiens
aagucauccucccaccucag

SEQ ID NO: 2132145 - RNA, 17 nt, Homo sapiens
aaagacuuccucuggcu

SEQ ID NO: 2132146 - RNA, 19 nt, Homo sapiens
gaauauaauacuguauuug

SEQ ID NO: 2132147 - RNA, 22 nt, Homo sapiens
aauaugucuucuguauaacuag

SEQ ID NO: 2132148 - RNA, 20 nt, Homo sapiens
auccugccuugcugugaaau

SEQ ID NO: 2132149 - RNA, 23 nt, Homo sapiens
uuauuuagauccccccuuuccuu

SEQ ID NO: 2132150 - RNA, 15 nt, Homo sapiens
aacucuagccaaaug

SEQ ID NO: 2132151 - RNA, 14 nt, Homo sapiens
cugagugaggaaug

SEQ ID NO: 2132152 - RNA, 21 nt, Homo sapiens
ucagcacguaguuugcauucc

SEQ ID NO: 2132153 - RNA, 17 nt, Homo sapiens
auuagaggauguggcag

SEQ ID NO: 2132154 - RNA, 15 nt, Homo sapiens
ccuccacccacugug

SEQ ID NO: 2132155 - RNA, 17 nt, Homo sapiens
caggcaugcaugugcuu

SEQ ID NO: 2132156 - RNA, 19 nt, Homo sapiens
agggggaggugaaaagggc

SEQ ID NO: 2132157 - RNA, 17 nt, Homo sapiens
acuaugcaaaaguacaa

SEQ ID NO: 2132158 - RNA, 17 nt, Homo sapiens
gguugagcucuucuuaa

SEQ ID NO: 2132159 - RNA, 19 nt, Homo sapiens
cugccaaguccugccuuug

SEQ ID NO: 2132160 - RNA, 17 nt, Homo sapiens
ucuggggugagggaguu

SEQ ID NO: 2132161 - RNA, 19 nt, Homo sapiens
auagggugcaguuuuccag

SEQ ID NO: 2132162 - RNA, 23 nt, Homo sapiens
auacauauaugaguugccuauau

SEQ ID NO: 2132163 - RNA, 20 nt, Homo sapiens
ucccucagaaaaaggcagug

SEQ ID NO: 2132164 - RNA, 15 nt, Homo sapiens
gaaaaguauucucaa

SEQ ID NO: 2132165 - RNA, 16 nt, Homo sapiens
ugggcagauuugcaac

SEQ ID NO: 2132166 - RNA, 15 nt, Homo sapiens
aacaaccugcucaca

SEQ ID NO: 2132167 - RNA, 13 nt, Homo sapiens
aguuguauaaaag

SEQ ID NO: 2132168 - RNA, 20 nt, Homo sapiens
aaauagacuaaccucuacca

SEQ ID NO: 2132169 - RNA, 22 nt, Homo sapiens
augccaaagugucuacaugugc

SEQ ID NO: 2132170 - RNA, 15 nt, Homo sapiens
auuucuucugcacau

SEQ ID NO: 2132171 - RNA, 17 nt, Homo sapiens
aucucuugcuguuaaau

SEQ ID NO: 2132172 - RNA, 20 nt, Homo sapiens
cucugaaguugguugugauu

SEQ ID NO: 2132173 - RNA, 17 nt, Homo sapiens
aucacgcgcacagccug

SEQ ID NO: 2132174 - RNA, 17 nt, Homo sapiens
cauugacugucacauaa

SEQ ID NO: 2132175 - RNA, 12 nt, Homo sapiens
agucuacacugc

SEQ ID NO: 2132176 - RNA, 14 nt, Homo sapiens
ucucgaugcugcug

SEQ ID NO: 2132177 - RNA, 12 nt, Homo sapiens
uggcacucucag

SEQ ID NO: 2132178 - RNA, 11 nt, Homo sapiens
ccaucuacccc

SEQ ID NO: 2132179 - RNA, 23 nt, Homo sapiens
ccauaaacacccaugaaucaaag

SEQ ID NO: 2132180 - RNA, 14 nt, Homo sapiens
ucuaauuuucacac

SEQ ID NO: 2132181 - RNA, 16 nt, Homo sapiens
agcuauacauaugugc

SEQ ID NO: 2132182 - RNA, 15 nt, Homo sapiens
accuuccucugccuu

SEQ ID NO: 2132183 - RNA, 21 nt, Homo sapiens
ugugacuaggaaaaaauugcu

SEQ ID NO: 2132184 - RNA, 17 nt, Homo sapiens
auuuuguagaugugauu

SEQ ID NO: 2132185 - RNA, 22 nt, Homo sapiens
aaaaucugcucuuuguaugaca

SEQ ID NO: 2132186 - RNA, 20 nt, Homo sapiens
cuaucauuuauuuacaucua

SEQ ID NO: 2132187 - RNA, 18 nt, Homo sapiens
uaauuuguaucugaagga

SEQ ID NO: 2132188 - RNA, 21 nt, Homo sapiens
acugaugguuaaauaauguga

SEQ ID NO: 2132189 - RNA, 15 nt, Homo sapiens
cacccagugcugaau

SEQ ID NO: 2132190 - RNA, 17 nt, Homo sapiens
gauucaguuuugcuuau

SEQ ID NO: 2132191 - RNA, 19 nt, Homo sapiens
aauugcccaaaaugucaau

SEQ ID NO: 2132192 - RNA, 19 nt, Homo sapiens
cacugagcccuugcacagg

SEQ ID NO: 2132193 - RNA, 17 nt, Homo sapiens
auugugcuuucaccaga

SEQ ID NO: 2132194 - RNA, 18 nt, Homo sapiens
uguauaacuggauugcag

SEQ ID NO: 2132195 - RNA, 15 nt, Homo sapiens
gacgugugaggaugu

SEQ ID NO: 2132196 - RNA, 17 nt, Homo sapiens
aggaagcagccuccacu

SEQ ID NO: 2132197 - RNA, 16 nt, Homo sapiens
gaauccaaagaucaca

SEQ ID NO: 2132198 - RNA, 19 nt, Homo sapiens
ucuagagggagaagacugu

SEQ ID NO: 2132199 - RNA, 18 nt, Homo sapiens
cacauuuuuacaaauagg

SEQ ID NO: 2132200 - RNA, 14 nt, Homo sapiens
caccugcacacucc

SEQ ID NO: 2132201 - RNA, 16 nt, Homo sapiens
acaugucagccacugu

SEQ ID NO: 2132202 - RNA, 23 nt, Homo sapiens
aagcaggggucguaccuugcuuu

SEQ ID NO: 2132203 - RNA, 14 nt, Homo sapiens
gcuccccacucugc

SEQ ID NO: 2132204 - RNA, 19 nt, Homo sapiens
gagauucauuuucuagaua

SEQ ID NO: 2132205 - RNA, 20 nt, Homo sapiens
uguaaaaugcaccaaucagc

SEQ ID NO: 2132206 - RNA, 18 nt, Homo sapiens
cacccaggcuggagugca

SEQ ID NO: 2132207 - RNA, 20 nt, Homo sapiens
ggacugcauggggaggcagc

SEQ ID NO: 2132208 - RNA, 12 nt, Homo sapiens
caguuguaauaa

SEQ ID NO: 2132209 - RNA, 14 nt, Homo sapiens
gucaacaauaaaaa

SEQ ID NO: 2132210 - RNA, 19 nt, Homo sapiens
caguuagggcuccuauuca

SEQ ID NO: 2132211 - RNA, 14 nt, Homo sapiens
gccaagcaggcacu

SEQ ID NO: 2132212 - RNA, 18 nt, Homo sapiens
cagcuggagguugagcuc

SEQ ID NO: 2132213 - RNA, 18 nt, Homo sapiens
ccuucucccucgacauuu

SEQ ID NO: 2132214 - RNA, 19 nt, Homo sapiens
ugaaagaguaaaaccaaag

SEQ ID NO: 2132215 - RNA, 17 nt, Homo sapiens
uacucuauguaugcauc

SEQ ID NO: 2132216 - RNA, 20 nt, Homo sapiens
acuuggagccccagugccaa

SEQ ID NO: 2132217 - RNA, 13 nt, Homo sapiens
guaauaaagugaa

SEQ ID NO: 2132218 - RNA, 19 nt, Homo sapiens
uggagagagcaaucuugcu

SEQ ID NO: 2132219 - RNA, 16 nt, Homo sapiens
uggcauaugccuguaa

SEQ ID NO: 2132220 - RNA, 13 nt, Homo sapiens
aggcagaggaauu

SEQ ID NO: 2132221 - RNA, 15 nt, Homo sapiens
gaaaggacuguggac

SEQ ID NO: 2132222 - RNA, 17 nt, Homo sapiens
acaggguccucagcuca

SEQ ID NO: 2132223 - RNA, 12 nt, Homo sapiens
aaccgacaggcc

SEQ ID NO: 2132224 - RNA, 21 nt, Homo sapiens
uggaggacaaauaagaaauga

SEQ ID NO: 2132225 - RNA, 18 nt, Homo sapiens
aaaagaguuaacauccca

SEQ ID NO: 2132226 - RNA, 18 nt, Homo sapiens
cugucccccaacacugag

SEQ ID NO: 2132227 - RNA, 15 nt, Homo sapiens
uguggccucaagcaa

SEQ ID NO: 2132228 - RNA, 18 nt, Homo sapiens
cugaacauuaguugcacu

SEQ ID NO: 2132229 - RNA, 19 nt, Homo sapiens
ggccugauggagaggagaa

SEQ ID NO: 2132230 - RNA, 20 nt, Homo sapiens
ucaacucuuaaagacaucuu

SEQ ID NO: 2132231 - RNA, 22 nt, Homo sapiens
acaugaagcuucaugcacuuaa

SEQ ID NO: 2132232 - RNA, 11 nt, Homo sapiens
cauuuuugcug

SEQ ID NO: 2132233 - RNA, 16 nt, Homo sapiens
gaaggagccagugaac

SEQ ID NO: 2132234 - RNA, 21 nt, Homo sapiens
agcuccauggcgaaaggagug

SEQ ID NO: 2132235 - RNA, 13 nt, Homo sapiens
ugugaaguuacau

SEQ ID NO: 2132236 - RNA, 19 nt, Homo sapiens
uuccaggcagccucuguca

SEQ ID NO: 2132237 - RNA, 17 nt, Homo sapiens
cacacuacgcagaagag

SEQ ID NO: 2132238 - RNA, 23 nt, Homo sapiens
cauagaggagaggaaaaggugua

SEQ ID NO: 2132239 - RNA, 14 nt, Homo sapiens
cuugagaguguucc

SEQ ID NO: 2132240 - RNA, 22 nt, Homo sapiens
acuuuccauagggccuccuuag

SEQ ID NO: 2132241 - RNA, 20 nt, Homo sapiens
cuuggagacaaaaucuuaaa

SEQ ID NO: 2132242 - RNA, 13 nt, Homo sapiens
gagauaaagcuua

SEQ ID NO: 2132243 - RNA, 16 nt, Homo sapiens
ccagcaacacaagcug

SEQ ID NO: 2132244 - RNA, 21 nt, Homo sapiens
aggcuuccauugagaccaagg

SEQ ID NO: 2132245 - RNA, 22 nt, Homo sapiens
cugucucuggcauuuguuuccu

SEQ ID NO: 2132246 - RNA, 19 nt, Homo sapiens
cauguuuauuauguucaau

SEQ ID NO: 2132247 - RNA, 19 nt, Homo sapiens
acaauaagacaugcuuacu

SEQ ID NO: 2132248 - RNA, 23 nt, Homo sapiens
ggucaggaaggaugagcauuuag

SEQ ID NO: 2132249 - RNA, 16 nt, Homo sapiens
agguaaagaaaccaug

SEQ ID NO: 2132250 - RNA, 14 nt, Homo sapiens
cuuucuacagccua

SEQ ID NO: 2132251 - RNA, 13 nt, Homo sapiens
aucagaccaugaa

SEQ ID NO: 2132252 - RNA, 15 nt, Homo sapiens
uaguucauaaagguu

SEQ ID NO: 2132253 - RNA, 15 nt, Homo sapiens
auucuguauugccau

SEQ ID NO: 2132254 - RNA, 14 nt, Homo sapiens
caguuuguggcauc

SEQ ID NO: 2132255 - RNA, 22 nt, Homo sapiens
auccacauuuuaacaguaccug

SEQ ID NO: 2132256 - RNA, 17 nt, Homo sapiens
gguguggcucugcccug

SEQ ID NO: 2132257 - RNA, 21 nt, Homo sapiens
aauuccuuauccuagccuuug

SEQ ID NO: 2132258 - RNA, 21 nt, Homo sapiens
ucagaagagguugggcuucca

SEQ ID NO: 2132259 - RNA, 15 nt, Homo sapiens
cauuuugacacaaaa

SEQ ID NO: 2132260 - RNA, 19 nt, Homo sapiens
uuaaaaagauguauguucc

SEQ ID NO: 2132261 - RNA, 14 nt, Homo sapiens
accauguugccaau

SEQ ID NO: 2132262 - RNA, 19 nt, Homo sapiens
uuguauauaguuaguaucu

SEQ ID NO: 2132263 - RNA, 15 nt, Homo sapiens
cccucauugcugucu

SEQ ID NO: 2132264 - RNA, 13 nt, Homo sapiens
cccagggggcaug

SEQ ID NO: 2132265 - RNA, 13 nt, Homo sapiens
uccugacugggaa

SEQ ID NO: 2132266 - RNA, 16 nt, Homo sapiens
aucugcugcauuucac

SEQ ID NO: 2132267 - RNA, 14 nt, Homo sapiens
gaauuuggaaaucc

SEQ ID NO: 2132268 - RNA, 17 nt, Homo sapiens
ucuugaauuccucucaa

SEQ ID NO: 2132269 - RNA, 19 nt, Homo sapiens
caaccagagaagcugcuac

SEQ ID NO: 2132270 - RNA, 14 nt, Homo sapiens
cacagaagccagga

SEQ ID NO: 2132271 - RNA, 19 nt, Homo sapiens
ccuguuggcucacagggcu

SEQ ID NO: 2132272 - RNA, 18 nt, Homo sapiens
aguguggccugugccagc

SEQ ID NO: 2132273 - RNA, 19 nt, Homo sapiens
agagauagggaugucauag

SEQ ID NO: 2132274 - RNA, 14 nt, Homo sapiens
cucagugagcccau

SEQ ID NO: 2132275 - RNA, 23 nt, Homo sapiens
uguccgguggagaucccacccga

SEQ ID NO: 2132276 - RNA, 20 nt, Homo sapiens
ugcuuuuuauggccugugag

SEQ ID NO: 2132277 - RNA, 21 nt, Homo sapiens
cuugacaaaauugugaaguua

SEQ ID NO: 2132278 - RNA, 15 nt, Homo sapiens
gaggagaaacuggaa

SEQ ID NO: 2132279 - RNA, 23 nt, Homo sapiens
ccugcuccuagcacccuggagag

SEQ ID NO: 2132280 - RNA, 15 nt, Homo sapiens
cacacagugccugua

SEQ ID NO: 2132281 - RNA, 19 nt, Homo sapiens
agguacuucaggggcacuu

SEQ ID NO: 2132282 - RNA, 17 nt, Homo sapiens
cuaagggccacauccca

SEQ ID NO: 2132283 - RNA, 17 nt, Homo sapiens
gacuuaacauagccaaa

SEQ ID NO: 2132284 - RNA, 14 nt, Homo sapiens
accguggaccuucc

SEQ ID NO: 2132285 - RNA, 16 nt, Homo sapiens
uacagcuaacccucac

SEQ ID NO: 2132286 - RNA, 22 nt, Homo sapiens
ggcaucuauuuccucugugcaa

SEQ ID NO: 2132287 - RNA, 17 nt, Homo sapiens
guccuuggcucguuuga

SEQ ID NO: 2132288 - RNA, 18 nt, Homo sapiens
cacgacugcaacauacag

SEQ ID NO: 2132289 - RNA, 22 nt, Homo sapiens
ugaagccagcugcaggaaucaa

SEQ ID NO: 2132290 - RNA, 17 nt, Homo sapiens
auaaagaacagcugagg

SEQ ID NO: 2132291 - RNA, 21 nt, Homo sapiens
cagcaugugcucagccccaga

SEQ ID NO: 2132292 - RNA, 17 nt, Homo sapiens
ucuaagauaguaacaau

SEQ ID NO: 2132293 - RNA, 14 nt, Homo sapiens
auguaagauuucau

SEQ ID NO: 2132294 - RNA, 20 nt, Homo sapiens
ccauguucauuauaaucuca

SEQ ID NO: 2132295 - RNA, 21 nt, Homo sapiens
gcagagccugagucacugguc

SEQ ID NO: 2132296 - RNA, 17 nt, Homo sapiens
cccggacucugaucucu

SEQ ID NO: 2132297 - RNA, 16 nt, Homo sapiens
ccugccuagucucaca

SEQ ID NO: 2132298 - RNA, 15 nt, Homo sapiens
agaguuggagugaga

SEQ ID NO: 2132299 - RNA, 15 nt, Homo sapiens
cccuucccugcacua

SEQ ID NO: 2132300 - RNA, 21 nt, Homo sapiens
auucucuagucaguuggcuaa

SEQ ID NO: 2132301 - RNA, 13 nt, Homo sapiens
aaugaaauaguua

SEQ ID NO: 2132302 - RNA, 22 nt, Homo sapiens
guaauuguagaccuguuucaua

SEQ ID NO: 2132303 - RNA, 22 nt, Homo sapiens
acacgaauugcucaaugcauga

SEQ ID NO: 2132304 - RNA, 16 nt, Homo sapiens
agguccugcuguggaa

SEQ ID NO: 2132305 - RNA, 22 nt, Homo sapiens
guuuuugggggguuuucuugcc

SEQ ID NO: 2132306 - RNA, 12 nt, Homo sapiens
cccgaaaacccc

SEQ ID NO: 2132307 - RNA, 16 nt, Homo sapiens
ggcaaagggaugagcc

SEQ ID NO: 2132308 - RNA, 15 nt, Homo sapiens
uuguguccuguaacc

SEQ ID NO: 2132309 - RNA, 13 nt, Homo sapiens
aaugucucaaaau

SEQ ID NO: 2132310 - RNA, 20 nt, Homo sapiens
uuguccaggaacugccuggg

SEQ ID NO: 2132311 - RNA, 13 nt, Homo sapiens
uucaugucucacg

SEQ ID NO: 2132312 - RNA, 19 nt, Homo sapiens
cuuuucaaaacugcuaaau

SEQ ID NO: 2132313 - RNA, 13 nt, Homo sapiens
aaaguacuugacu

SEQ ID NO: 2132314 - RNA, 15 nt, Homo sapiens
aggucacguguggaa

SEQ ID NO: 2132315 - RNA, 20 nt, Homo sapiens
uuacuacaugugggagcuuu

SEQ ID NO: 2132316 - RNA, 14 nt, Homo sapiens
ugugguuccucugc

SEQ ID NO: 2132317 - RNA, 17 nt, Homo sapiens
cagggcagcauuuucau

SEQ ID NO: 2132318 - RNA, 20 nt, Homo sapiens
uggaucuaucaccugucauc

SEQ ID NO: 2132319 - RNA, 16 nt, Homo sapiens
cccauggggguaauaa

SEQ ID NO: 2132320 - RNA, 21 nt, Homo sapiens
aaaggaacauugguugcuuug

SEQ ID NO: 2132321 - RNA, 12 nt, Homo sapiens
caaggaaaaaga

SEQ ID NO: 2132322 - RNA, 12 nt, Homo sapiens
caaagaaaaagg

SEQ ID NO: 2132323 - RNA, 17 nt, Homo sapiens
gcacccccacccaccuc

SEQ ID NO: 2132324 - RNA, 15 nt, Homo sapiens
aagugaucaaacuac

SEQ ID NO: 2132325 - RNA, 20 nt, Homo sapiens
agguggccacagugucacug

SEQ ID NO: 2132326 - RNA, 17 nt, Homo sapiens
agagagugaguacaugc

SEQ ID NO: 2132327 - RNA, 20 nt, Homo sapiens
gccaaggcuggagugcagug

SEQ ID NO: 2132328 - RNA, 20 nt, Homo sapiens
gcccaggcuggcgugcagug

SEQ ID NO: 2132329 - RNA, 11 nt, Homo sapiens
uucugacuguu

SEQ ID NO: 2132330 - RNA, 19 nt, Homo sapiens
gguggaaacuccugugucu

SEQ ID NO: 2132331 - RNA, 19 nt, Homo sapiens
ugcguccaccaggccucac

SEQ ID NO: 2132332 - RNA, 17 nt, Homo sapiens
aaagcaugggaaaaaga

SEQ ID NO: 2132333 - RNA, 21 nt, Homo sapiens
gaacauccuccacugacuucc

SEQ ID NO: 2132334 - RNA, 12 nt, Homo sapiens
uaauccuaaaca

SEQ ID NO: 2132335 - RNA, 21 nt, Homo sapiens
ugcacgcggagcgaaacaguu

SEQ ID NO: 2132336 - RNA, 20 nt, Homo sapiens
ugggacauuugcucauggaa

SEQ ID NO: 2132337 - RNA, 23 nt, Homo sapiens
uaucaaaugaaagugaugauacu

SEQ ID NO: 2132338 - RNA, 15 nt, Homo sapiens
ccuuuuggauuuaga

SEQ ID NO: 2132339 - RNA, 16 nt, Homo sapiens
gaauuuuugcaauaau

SEQ ID NO: 2132340 - RNA, 14 nt, Homo sapiens
gcuuauccuuccac

SEQ ID NO: 2132341 - RNA, 16 nt, Homo sapiens
cuugcucacucacuca

SEQ ID NO: 2132342 - RNA, 20 nt, Homo sapiens
uaauuaguuaugacagccau

SEQ ID NO: 2132343 - RNA, 14 nt, Homo sapiens
ccucaccugguccu

SEQ ID NO: 2132344 - RNA, 15 nt, Homo sapiens
ugucuaagauucuag

SEQ ID NO: 2132345 - RNA, 19 nt, Homo sapiens
gccauuuuguuguguguau

SEQ ID NO: 2132346 - RNA, 19 nt, Homo sapiens
caggagcugcucacuaccu

SEQ ID NO: 2132347 - RNA, 19 nt, Homo sapiens
agagucccggcguuuaccu

SEQ ID NO: 2132348 - RNA, 17 nt, Homo sapiens
accugcaugaacacagu

SEQ ID NO: 2132349 - RNA, 15 nt, Homo sapiens
uaauuuucucuuuag

SEQ ID NO: 2132350 - RNA, 13 nt, Homo sapiens
agagauacccucu

SEQ ID NO: 2132351 - RNA, 17 nt, Homo sapiens
ugagaaugucauuugcu

SEQ ID NO: 2132352 - RNA, 15 nt, Homo sapiens
gcugccucaugaccc

SEQ ID NO: 2132353 - RNA, 17 nt, Homo sapiens
ugaaguucuuuuacugu

SEQ ID NO: 2132354 - RNA, 17 nt, Homo sapiens
gacuuccacaaaccugg

SEQ ID NO: 2132355 - RNA, 21 nt, Homo sapiens
aaugagugugauccaguuuuu

SEQ ID NO: 2132356 - RNA, 14 nt, Homo sapiens
ucaaguaguuugac

SEQ ID NO: 2132357 - RNA, 21 nt, Homo sapiens
gagcugacccccugcugccau

SEQ ID NO: 2132358 - RNA, 13 nt, Homo sapiens
aaaguaagccaug

SEQ ID NO: 2132359 - RNA, 15 nt, Homo sapiens
gucagccacacuggg

SEQ ID NO: 2132360 - RNA, 23 nt, Homo sapiens
caaaugaccgcacguucucugcc

SEQ ID NO: 2132361 - RNA, 18 nt, Homo sapiens
ucuuaggcaaaauaccag

SEQ ID NO: 2132362 - RNA, 13 nt, Homo sapiens
aaaaaacuuugac

SEQ ID NO: 2132363 - RNA, 16 nt, Homo sapiens
ggagggugagugcaag

SEQ ID NO: 2132364 - RNA, 21 nt, Homo sapiens
gcccgaguccccgggcaucuu

SEQ ID NO: 2132365 - RNA, 16 nt, Homo sapiens
caaccagccacacaga

SEQ ID NO: 2132366 - RNA, 15 nt, Homo sapiens
uacacacacagaugc

SEQ ID NO: 2132367 - RNA, 22 nt, Homo sapiens
cucaggccacaccggccuugca

SEQ ID NO: 2132368 - RNA, 18 nt, Homo sapiens
acuaaaacuggaaaugua

SEQ ID NO: 2132369 - RNA, 15 nt, Homo sapiens
aauaaaggcauuuca

SEQ ID NO: 2132370 - RNA, 16 nt, Homo sapiens
cuugacaggguuucac

SEQ ID NO: 2132371 - RNA, 13 nt, Homo sapiens
gcaaugacucagg

SEQ ID NO: 2132372 - RNA, 19 nt, Homo sapiens
aaagguuuucuucauucau

SEQ ID NO: 2132373 - RNA, 12 nt, Homo sapiens
cucccacuuugc

SEQ ID NO: 2132374 - RNA, 14 nt, Homo sapiens
uaaagucaacauau

SEQ ID NO: 2132375 - RNA, 12 nt, Homo sapiens
accaucauagcu

SEQ ID NO: 2132376 - RNA, 15 nt, Homo sapiens
acuuuacugucccca

SEQ ID NO: 2132377 - RNA, 15 nt, Homo sapiens
aagaagcuuuauuuc

SEQ ID NO: 2132378 - RNA, 16 nt, Homo sapiens
cagggcaggugcccaa

SEQ ID NO: 2132379 - RNA, 22 nt, Homo sapiens
acuuugguggccacauaagcca

SEQ ID NO: 2132380 - RNA, 18 nt, Homo sapiens
ccuucacgcuggcuucca

SEQ ID NO: 2132381 - RNA, 18 nt, Homo sapiens
gcugaucgggcaauggga

SEQ ID NO: 2132382 - RNA, 14 nt, Homo sapiens
uuuaagugcaauua

SEQ ID NO: 2132383 - RNA, 13 nt, Homo sapiens
gauaccccaaagu

SEQ ID NO: 2132384 - RNA, 18 nt, Homo sapiens
cacccaguggaaccaaaa

SEQ ID NO: 2132385 - RNA, 16 nt, Homo sapiens
aucucucuacugcugg

SEQ ID NO: 2132386 - RNA, 17 nt, Homo sapiens
uccacuccacucagguu

SEQ ID NO: 2132387 - RNA, 21 nt, Homo sapiens
accaggggugauuucagagag

SEQ ID NO: 2132388 - RNA, 12 nt, Homo sapiens
agccauuccaaa

SEQ ID NO: 2132389 - RNA, 18 nt, Homo sapiens
uaaugcuugccaagaaau

SEQ ID NO: 2132390 - RNA, 21 nt, Homo sapiens
acuauuuuugauagcacacau

SEQ ID NO: 2132391 - RNA, 16 nt, Homo sapiens
acaaaauauauuuugu

SEQ ID NO: 2132392 - RNA, 23 nt, Homo sapiens
aggagaggcaacaggaggcauuc

SEQ ID NO: 2132393 - RNA, 19 nt, Homo sapiens
aaagggaaguaguccuugg

SEQ ID NO: 2132394 - RNA, 15 nt, Homo sapiens
caugcagcucuucaa

SEQ ID NO: 2132395 - RNA, 21 nt, Homo sapiens
augcaggguagcacugggaac

SEQ ID NO: 2132396 - RNA, 18 nt, Homo sapiens
uuuuuaucgccauuccag

SEQ ID NO: 2132397 - RNA, 19 nt, Homo sapiens
cuuauuuguaaaaugcaga

SEQ ID NO: 2132398 - RNA, 17 nt, Homo sapiens
uguggcggcguaauccc

SEQ ID NO: 2132399 - RNA, 16 nt, Homo sapiens
aaacaaaaucacagca

SEQ ID NO: 2132400 - RNA, 23 nt, Homo sapiens
guaaaugugacauugauuugcuc

SEQ ID NO: 2132401 - RNA, 13 nt, Homo sapiens
cauuuacuguggc

SEQ ID NO: 2132402 - RNA, 20 nt, Homo sapiens
acauacacaaaugggcauac

SEQ ID NO: 2132403 - RNA, 13 nt, Homo sapiens
guuauuguggaaa

SEQ ID NO: 2132404 - RNA, 24 nt, Homo sapiens
cugauacagccuuacaauacaaua

SEQ ID NO: 2132405 - RNA, 22 nt, Homo sapiens
ucaacuuuagcuaguaucuuca

SEQ ID NO: 2132406 - RNA, 23 nt, Homo sapiens
gccaacaucuggaucaauguaau

SEQ ID NO: 2132407 - RNA, 20 nt, Homo sapiens
agaagcuguuguacauuuau

SEQ ID NO: 2132408 - RNA, 15 nt, Homo sapiens
ugugugccaucaugc

SEQ ID NO: 2132409 - RNA, 13 nt, Homo sapiens
aguuuguagcuca

SEQ ID NO: 2132410 - RNA, 18 nt, Homo sapiens
uaaccccaggcaucccau

SEQ ID NO: 2132411 - RNA, 20 nt, Homo sapiens
aggcagagaaucauacuuag

SEQ ID NO: 2132412 - RNA, 19 nt, Homo sapiens
uucuacauacuauggaauu

SEQ ID NO: 2132413 - RNA, 21 nt, Homo sapiens
uucuuaaccuggaacuggagu

SEQ ID NO: 2132414 - RNA, 17 nt, Homo sapiens
guccuuggaaguuucau

SEQ ID NO: 2132415 - RNA, 14 nt, Homo sapiens
augaaacaacaaaa

SEQ ID NO: 2132416 - RNA, 16 nt, Homo sapiens
guaaauguuaagccau

SEQ ID NO: 2132417 - RNA, 20 nt, Homo sapiens
ccaacauucuguguucacau

SEQ ID NO: 2132418 - RNA, 18 nt, Homo sapiens
auuaucuacuuacuugag

SEQ ID NO: 2132419 - RNA, 16 nt, Homo sapiens
aggggacccagcuccu

SEQ ID NO: 2132420 - RNA, 16 nt, Homo sapiens
gcgaggccucucucag

SEQ ID NO: 2132421 - RNA, 13 nt, Homo sapiens
ccagguucacuuu

SEQ ID NO: 2132422 - RNA, 23 nt, Homo sapiens
uguuuuuugccacagcuuuugca

SEQ ID NO: 2132423 - RNA, 15 nt, Homo sapiens
agaugacaaaccaua

SEQ ID NO: 2132424 - RNA, 20 nt, Homo sapiens
aaccucugccuuccagguuc

SEQ ID NO: 2132425 - RNA, 16 nt, Homo sapiens
ggccaggcugagugca

SEQ ID NO: 2132426 - RNA, 14 nt, Homo sapiens
uauuucaaagggaa

SEQ ID NO: 2132427 - RNA, 14 nt, Homo sapiens
cagguacccaugaa

SEQ ID NO: 2132428 - RNA, 13 nt, Homo sapiens
cccucucagugcc

SEQ ID NO: 2132429 - RNA, 13 nt, Homo sapiens
cacaggggcccca

SEQ ID NO: 2132430 - RNA, 18 nt, Homo sapiens
uaaaugaaaaucuauccu

SEQ ID NO: 2132431 - RNA, 19 nt, Homo sapiens
cuacugcuggaaaaagccc

SEQ ID NO: 2132432 - RNA, 21 nt, Homo sapiens
aggaauccucugugucuucaa

SEQ ID NO: 2132433 - RNA, 18 nt, Homo sapiens
gaaggaaucauauuccuu

SEQ ID NO: 2132434 - RNA, 14 nt, Homo sapiens
aagggauggagcug

SEQ ID NO: 2132435 - RNA, 17 nt, Homo sapiens
uucccauucuacauacu

SEQ ID NO: 2132436 - RNA, 14 nt, Homo sapiens
ugcaagaauggaga

SEQ ID NO: 2132437 - RNA, 23 nt, Homo sapiens
gaagcaauuugaaauaauuuuca

SEQ ID NO: 2132438 - RNA, 16 nt, Homo sapiens
gacgauggguguugcu

SEQ ID NO: 2132439 - RNA, 14 nt, Homo sapiens
gugcacacauauac

SEQ ID NO: 2132440 - RNA, 21 nt, Homo sapiens
aguccuugcggccccuggaau

SEQ ID NO: 2132441 - RNA, 16 nt, Homo sapiens
uagaagaagaggaaga

SEQ ID NO: 2132442 - RNA, 17 nt, Homo sapiens
ucuuuagcaugcuacag

SEQ ID NO: 2132443 - RNA, 19 nt, Homo sapiens
aauguaacacugaugauag

SEQ ID NO: 2132444 - RNA, 13 nt, Homo sapiens
ugcaaggucauuu

SEQ ID NO: 2132445 - RNA, 13 nt, Homo sapiens
caaauguauuuca

SEQ ID NO: 2132446 - RNA, 16 nt, Homo sapiens
aauaaguuacuugaaa

SEQ ID NO: 2132447 - RNA, 12 nt, Homo sapiens
cuuccuugcucu

SEQ ID NO: 2132448 - RNA, 12 nt, Homo sapiens
cuuucuugcucc

SEQ ID NO: 2132449 - RNA, 14 nt, Homo sapiens
cgcccaucagugcc

SEQ ID NO: 2132450 - RNA, 18 nt, Homo sapiens
caggcugggccaugucca

SEQ ID NO: 2132451 - RNA, 17 nt, Homo sapiens
uuaacacucauuuccaa

SEQ ID NO: 2132452 - RNA, 16 nt, Homo sapiens
acgggaaaggagcugc

SEQ ID NO: 2132453 - RNA, 15 nt, Homo sapiens
uacagcucccuuccc

SEQ ID NO: 2132454 - RNA, 15 nt, Homo sapiens
ggaguagcugggauc

SEQ ID NO: 2132455 - RNA, 17 nt, Homo sapiens
ucuaaguguggguuuau

SEQ ID NO: 2132456 - RNA, 13 nt, Homo sapiens
gugccccacaaaa

SEQ ID NO: 2132457 - RNA, 16 nt, Homo sapiens
agggagaagucugcaa

SEQ ID NO: 2132458 - RNA, 18 nt, Homo sapiens
acuucuacauccaaugua

SEQ ID NO: 2132459 - RNA, 19 nt, Homo sapiens
agaauaauggaaacauuac

SEQ ID NO: 2132460 - RNA, 22 nt, Homo sapiens
aggcugcagugagccaugagua

SEQ ID NO: 2132461 - RNA, 17 nt, Homo sapiens
aggcggucacugcccac

SEQ ID NO: 2132462 - RNA, 14 nt, Homo sapiens
aacacaguguuucc

SEQ ID NO: 2132463 - RNA, 16 nt, Homo sapiens
acaauauucucucuua

SEQ ID NO: 2132464 - RNA, 18 nt, Homo sapiens
cgcugcccgcucagccca

SEQ ID NO: 2132465 - RNA, 20 nt, Homo sapiens
augagaagaaaaauggaaaa

SEQ ID NO: 2132466 - RNA, 14 nt, Homo sapiens
agauuguguucuuc

SEQ ID NO: 2132467 - RNA, 13 nt, Homo sapiens
uuccaugugccuu

SEQ ID NO: 2132468 - RNA, 21 nt, Homo sapiens
gccaguuucagcucacuuccu

SEQ ID NO: 2132469 - RNA, 18 nt, Homo sapiens
accaucaaaaauauucca

SEQ ID NO: 2132470 - RNA, 19 nt, Homo sapiens
uaagcccccuacugagaaa

SEQ ID NO: 2132471 - RNA, 23 nt, Homo sapiens
uagcagaaaccaagucuacuuca

SEQ ID NO: 2132472 - RNA, 20 nt, Homo sapiens
ccuguguuccugugaucucg

SEQ ID NO: 2132473 - RNA, 22 nt, Homo sapiens
cacaucuggagcugaagcguua

SEQ ID NO: 2132474 - RNA, 12 nt, Homo sapiens
ugugugccauca

SEQ ID NO: 2132475 - RNA, 19 nt, Homo sapiens
gcauugcagucacuuugac

SEQ ID NO: 2132476 - RNA, 22 nt, Homo sapiens
cggugaaaccccaucucuacua

SEQ ID NO: 2132477 - RNA, 20 nt, Homo sapiens
cagacgagacaacagcacac

SEQ ID NO: 2132478 - RNA, 15 nt, Homo sapiens
accuuuuuggacaca

SEQ ID NO: 2132479 - RNA, 14 nt, Homo sapiens
caauuccucugaua

SEQ ID NO: 2132480 - RNA, 14 nt, Homo sapiens
caaaacuucagugu

SEQ ID NO: 2132481 - RNA, 20 nt, Homo sapiens
uaaggugggaggguggcaag

SEQ ID NO: 2132482 - RNA, 15 nt, Homo sapiens
ucuguuaucuaguau

SEQ ID NO: 2132483 - RNA, 15 nt, Homo sapiens
uuuugacuugccacu

SEQ ID NO: 2132484 - RNA, 23 nt, Homo sapiens
ugcaagugugugcacaugugugc

SEQ ID NO: 2132485 - RNA, 15 nt, Homo sapiens
ugcauuaaugccaca

SEQ ID NO: 2132486 - RNA, 20 nt, Homo sapiens
accucgcucgaugacuguga

SEQ ID NO: 2132487 - RNA, 20 nt, Homo sapiens
auccacccucaaaugucaga

SEQ ID NO: 2132488 - RNA, 20 nt, Homo sapiens
cagaagcaguagacagaugu

SEQ ID NO: 2132489 - RNA, 13 nt, Homo sapiens
gauuauaaacuga

SEQ ID NO: 2132490 - RNA, 20 nt, Homo sapiens
ccuguccugcagucccacac

SEQ ID NO: 2132491 - RNA, 22 nt, Homo sapiens
gaugggucacuuguccucaguu

SEQ ID NO: 2132492 - RNA, 20 nt, Homo sapiens
ucugaacuaggugaucucag

SEQ ID NO: 2132493 - RNA, 18 nt, Homo sapiens
cagggguuaagagcucag

SEQ ID NO: 2132494 - RNA, 12 nt, Homo sapiens
cccugugcaacc

SEQ ID NO: 2132495 - RNA, 18 nt, Homo sapiens
cuuccagugcaacacuga

SEQ ID NO: 2132496 - RNA, 18 nt, Homo sapiens
gcuaggccggccagcucc

SEQ ID NO: 2132497 - RNA, 13 nt, Homo sapiens
uugucaccaugau

SEQ ID NO: 2132498 - RNA, 21 nt, Homo sapiens
cagagacccaacagcagugau

SEQ ID NO: 2132499 - RNA, 21 nt, Homo sapiens
augugugugugugcauaugca

SEQ ID NO: 2132500 - RNA, 20 nt, Homo sapiens
gaauuugggcagcuaccacg

SEQ ID NO: 2132501 - RNA, 18 nt, Homo sapiens
augaugggcuuuuguucu

SEQ ID NO: 2132502 - RNA, 19 nt, Homo sapiens
gagaggaaaggacaugggu

SEQ ID NO: 2132503 - RNA, 18 nt, Homo sapiens
cuuuaaaauuacauucua

SEQ ID NO: 2132504 - RNA, 15 nt, Homo sapiens
ugaagacacacucag

SEQ ID NO: 2132505 - RNA, 20 nt, Homo sapiens
ugauucccagccuguggcag

SEQ ID NO: 2132506 - RNA, 16 nt, Homo sapiens
gggacgaucuuugaau

SEQ ID NO: 2132507 - RNA, 15 nt, Homo sapiens
gccuguuaacuggua

SEQ ID NO: 2132508 - RNA, 12 nt, Homo sapiens
agcgcacuugau

SEQ ID NO: 2132509 - RNA, 17 nt, Homo sapiens
acucuuguguaccuuug

SEQ ID NO: 2132510 - RNA, 16 nt, Homo sapiens
agaauuggaaucacau

SEQ ID NO: 2132511 - RNA, 18 nt, Homo sapiens
acuuaguuauuuaccaaa

SEQ ID NO: 2132512 - RNA, 14 nt, Homo sapiens
caagguugcacagc

SEQ ID NO: 2132513 - RNA, 21 nt, Homo sapiens
agagauacccucugagacaga

SEQ ID NO: 2132514 - RNA, 16 nt, Homo sapiens
ucuugaauaagaguga

SEQ ID NO: 2132515 - RNA, 21 nt, Homo sapiens
accccucaaacugcacaucua

SEQ ID NO: 2132516 - RNA, 17 nt, Homo sapiens
acaauuguugacuaaaa

SEQ ID NO: 2132517 - RNA, 15 nt, Homo sapiens
uggugcucagagcag

SEQ ID NO: 2132518 - RNA, 17 nt, Homo sapiens
agcagagucuugcuacc

SEQ ID NO: 2132519 - RNA, 22 nt, Homo sapiens
uggccucugggcaguguggccu

SEQ ID NO: 2132520 - RNA, 19 nt, Homo sapiens
ucauacaaauacuauccaa

SEQ ID NO: 2132521 - RNA, 18 nt, Homo sapiens
gugcguggaaguguuccu

SEQ ID NO: 2132522 - RNA, 21 nt, Homo sapiens
cauacauuuaugcacauucac

SEQ ID NO: 2132523 - RNA, 15 nt, Homo sapiens
guaaauagaugacaa

SEQ ID NO: 2132524 - RNA, 23 nt, Homo sapiens
cagucacugugguguaauaugaa

SEQ ID NO: 2132525 - RNA, 17 nt, Homo sapiens
uauugcuucaccauggc

SEQ ID NO: 2132526 - RNA, 17 nt, Homo sapiens
gcuggccacacagcagc

SEQ ID NO: 2132527 - RNA, 19 nt, Homo sapiens
ucccucagccucagaggag

SEQ ID NO: 2132528 - RNA, 18 nt, Homo sapiens
augaaaaacaggugacau

SEQ ID NO: 2132529 - RNA, 16 nt, Homo sapiens
gcuuuguuuaagcauc

SEQ ID NO: 2132530 - RNA, 21 nt, Homo sapiens
uuucaaggaaaaaugcugcuu

SEQ ID NO: 2132531 - RNA, 19 nt, Homo sapiens
uuuacaaagaaacaaaaua

SEQ ID NO: 2132532 - RNA, 18 nt, Homo sapiens
augggagcugaggccaca

SEQ ID NO: 2132533 - RNA, 17 nt, Homo sapiens
uacucagaauagcuguu

SEQ ID NO: 2132534 - RNA, 15 nt, Homo sapiens
gacauuuccaagcug

SEQ ID NO: 2132535 - RNA, 21 nt, Homo sapiens
gaacaccuuuguuuugcacug

SEQ ID NO: 2132536 - RNA, 19 nt, Homo sapiens
ucagcugacccggccucuc

SEQ ID NO: 2132537 - RNA, 22 nt, Homo sapiens
cauuauucucugaugcacuguu

SEQ ID NO: 2132538 - RNA, 12 nt, Homo sapiens
cguaucugucac

SEQ ID NO: 2132539 - RNA, 14 nt, Homo sapiens
aaggccuucaaccc

SEQ ID NO: 2132540 - RNA, 16 nt, Homo sapiens
ucuuucaauucuucau

SEQ ID NO: 2132541 - RNA, 21 nt, Homo sapiens
aguccagagcuggaucucuca

SEQ ID NO: 2132542 - RNA, 17 nt, Homo sapiens
aacuuuaccaugcucaa

SEQ ID NO: 2132543 - RNA, 19 nt, Homo sapiens
accccccugggcugagaga

SEQ ID NO: 2132544 - RNA, 13 nt, Homo sapiens
gaauuauuuugca

SEQ ID NO: 2132545 - RNA, 13 nt, Homo sapiens
ugucuucuugggg

SEQ ID NO: 2132546 - RNA, 22 nt, Homo sapiens
ugugacccacacccacacccua

SEQ ID NO: 2132547 - RNA, 21 nt, Homo sapiens
agaguuuucagggaguacaca

SEQ ID NO: 2132548 - RNA, 13 nt, Homo sapiens
guaucaacacugu

SEQ ID NO: 2132549 - RNA, 21 nt, Homo sapiens
caaacaggguuugauagcacu

SEQ ID NO: 2132550 - RNA, 15 nt, Homo sapiens
aauaaauguauucaa

SEQ ID NO: 2132551 - RNA, 22 nt, Homo sapiens
uuuuaaguuugaaacuaacuca

SEQ ID NO: 2132552 - RNA, 22 nt, Homo sapiens
gagaccccaucuuccagccacc

SEQ ID NO: 2132553 - RNA, 23 nt, Homo sapiens
uuaaaaaagugguggcaaaagac

SEQ ID NO: 2132554 - RNA, 16 nt, Homo sapiens
ccugggccuccugaca

SEQ ID NO: 2132555 - RNA, 12 nt, Homo sapiens
uucguauuucaa

SEQ ID NO: 2132556 - RNA, 14 nt, Homo sapiens
aauauggacuucca

SEQ ID NO: 2132557 - RNA, 16 nt, Homo sapiens
auccucccaaucucaa

SEQ ID NO: 2132558 - RNA, 17 nt, Homo sapiens
guaggugugacuugaac

SEQ ID NO: 2132559 - RNA, 18 nt, Homo sapiens
ccgucagccaagucgcca

SEQ ID NO: 2132560 - RNA, 20 nt, Homo sapiens
aggauccagacucucauucc

SEQ ID NO: 2132561 - RNA, 19 nt, Homo sapiens
uucaacaugguuaccucug

SEQ ID NO: 2132562 - RNA, 21 nt, Homo sapiens
guaucagaggugaaugcacag

SEQ ID NO: 2132563 - RNA, 15 nt, Homo sapiens
aggccucaccuucaa

SEQ ID NO: 2132564 - RNA, 19 nt, Homo sapiens
ccuucauugcuggagacag

SEQ ID NO: 2132565 - RNA, 12 nt, Homo sapiens
ucuagauucaaa

SEQ ID NO: 2132566 - RNA, 20 nt, Homo sapiens
uagcacuuucuacaauguga

SEQ ID NO: 2132567 - RNA, 18 nt, Homo sapiens
augugaaaggaacauuuu

SEQ ID NO: 2132568 - RNA, 19 nt, Homo sapiens
ucugaccccugccuguggg

SEQ ID NO: 2132569 - RNA, 18 nt, Homo sapiens
ccucagaagccuucuugc

SEQ ID NO: 2132570 - RNA, 21 nt, Homo sapiens
ugcccccucaaacacuaaagg

SEQ ID NO: 2132571 - RNA, 21 nt, Homo sapiens
gcaaggacauugccccaagau

SEQ ID NO: 2132572 - RNA, 17 nt, Homo sapiens
aacagcaacacaaagcu

SEQ ID NO: 2132573 - RNA, 17 nt, Homo sapiens
gucuguugaacagcuau

SEQ ID NO: 2132574 - RNA, 23 nt, Homo sapiens
agaagaaauuaggagugcugaua

SEQ ID NO: 2132575 - RNA, 13 nt, Homo sapiens
cuguccccugaaa

SEQ ID NO: 2132576 - RNA, 15 nt, Homo sapiens
guuuggccaucucug

SEQ ID NO: 2132577 - RNA, 15 nt, Homo sapiens
aaggcauuccagggu

SEQ ID NO: 2132578 - RNA, 19 nt, Homo sapiens
auucuacaaaaaaccagga

SEQ ID NO: 2132579 - RNA, 16 nt, Homo sapiens
agccaaccaagaugca

SEQ ID NO: 2132580 - RNA, 11 nt, Homo sapiens
aauuuccacua

SEQ ID NO: 2132581 - RNA, 15 nt, Homo sapiens
ugcacagaagacagc

SEQ ID NO: 2132582 - RNA, 19 nt, Homo sapiens
cgcuagacgcuucauccca

SEQ ID NO: 2132583 - RNA, 15 nt, Homo sapiens
ccguggaaaauuuca

SEQ ID NO: 2132584 - RNA, 15 nt, Homo sapiens
augguccucuuacca

SEQ ID NO: 2132585 - RNA, 12 nt, Homo sapiens
ugugcauauaaa

SEQ ID NO: 2132586 - RNA, 17 nt, Homo sapiens
ccaguauuuaagcuuua

SEQ ID NO: 2132587 - RNA, 19 nt, Homo sapiens
ccugcacuguccugaccau

SEQ ID NO: 2132588 - RNA, 13 nt, Homo sapiens
acugguucuugcc

SEQ ID NO: 2132589 - RNA, 13 nt, Homo sapiens
aacagauaauccc

SEQ ID NO: 2132590 - RNA, 18 nt, Homo sapiens
uucacccuuaacccaagg

SEQ ID NO: 2132591 - RNA, 15 nt, Homo sapiens
cuguuaauaguacua

SEQ ID NO: 2132592 - RNA, 18 nt, Homo sapiens
uagauugaaaccauucca

SEQ ID NO: 2132593 - RNA, 13 nt, Homo sapiens
agucuguuggcaa

SEQ ID NO: 2132594 - RNA, 20 nt, Homo sapiens
uuaacauaaacuuguacuua

SEQ ID NO: 2132595 - RNA, 14 nt, Homo sapiens
aauaaagcauaaaa

SEQ ID NO: 2132596 - RNA, 14 nt, Homo sapiens
uggugaauuucaca

SEQ ID NO: 2132597 - RNA, 17 nt, Homo sapiens
acacauuaaaagacaaa

SEQ ID NO: 2132598 - RNA, 18 nt, Homo sapiens
uaagauuguaaaaauaau

SEQ ID NO: 2132599 - RNA, 12 nt, Homo sapiens
cuuaacauucau

SEQ ID NO: 2132600 - RNA, 23 nt, Homo sapiens
ugagauaccacaaacccugcuga

SEQ ID NO: 2132601 - RNA, 19 nt, Homo sapiens
auccugagugugaugaacg

SEQ ID NO: 2132602 - RNA, 17 nt, Homo sapiens
auuguauaaaacagugu

SEQ ID NO: 2132603 - RNA, 20 nt, Homo sapiens
uuugaacaaugaaguugaaa

SEQ ID NO: 2132604 - RNA, 17 nt, Homo sapiens
aucucugccauaucagu

SEQ ID NO: 2132605 - RNA, 20 nt, Homo sapiens
acacggaggucucuguaaaa

SEQ ID NO: 2132606 - RNA, 13 nt, Homo sapiens
uaaugccacggca

SEQ ID NO: 2132607 - RNA, 20 nt, Homo sapiens
aggugacaugucuacuuuuu

SEQ ID NO: 2132608 - RNA, 14 nt, Homo sapiens
gucucugcagcucu

SEQ ID NO: 2132609 - RNA, 13 nt, Homo sapiens
uugaagucuauaa

SEQ ID NO: 2132610 - RNA, 16 nt, Homo sapiens
cuggcccaggcuccag

SEQ ID NO: 2132611 - RNA, 19 nt, Homo sapiens
uuauuaguauucuaauaaa

SEQ ID NO: 2132612 - RNA, 13 nt, Homo sapiens
gauuguauugcaa

SEQ ID NO: 2132613 - RNA, 17 nt, Homo sapiens
ugcauugagcugagauc

SEQ ID NO: 2132614 - RNA, 16 nt, Homo sapiens
aguggcucacuggcug

SEQ ID NO: 2132615 - RNA, 19 nt, Homo sapiens
acuauuccuuacaacugga

SEQ ID NO: 2132616 - RNA, 13 nt, Homo sapiens
uuccuacuucauu

SEQ ID NO: 2132617 - RNA, 15 nt, Homo sapiens
gcuucugcaauauua

SEQ ID NO: 2132618 - RNA, 12 nt, Homo sapiens
cugacccugugc

SEQ ID NO: 2132619 - RNA, 18 nt, Homo sapiens
ugacaucauucaugacaa

SEQ ID NO: 2132620 - RNA, 20 nt, Homo sapiens
uuuccagaauuugaauauua

SEQ ID NO: 2132621 - RNA, 16 nt, Homo sapiens
uauagcuuugccaugu

SEQ ID NO: 2132622 - RNA, 12 nt, Homo sapiens
uauaaaucuuuc

SEQ ID NO: 2132623 - RNA, 14 nt, Homo sapiens
gaucaagcuccauc

SEQ ID NO: 2132624 - RNA, 11 nt, Homo sapiens
caaaaaaccca

SEQ ID NO: 2132625 - RNA, 19 nt, Homo sapiens
cuaaagggagaaaugccag

SEQ ID NO: 2132626 - RNA, 20 nt, Homo sapiens
cgggcgguccuacugcugug

SEQ ID NO: 2132627 - RNA, 20 nt, Homo sapiens
gauuugcacccaugccauag

SEQ ID NO: 2132628 - RNA, 17 nt, Homo sapiens
gugcacacguguguaug

SEQ ID NO: 2132629 - RNA, 18 nt, Homo sapiens
gaauucccuuucauuuga

SEQ ID NO: 2132630 - RNA, 12 nt, Homo sapiens
uugggaccucag

SEQ ID NO: 2132631 - RNA, 18 nt, Homo sapiens
cagcccugccgggcacau

SEQ ID NO: 2132632 - RNA, 16 nt, Homo sapiens
cuccaguguccugagc

SEQ ID NO: 2132633 - RNA, 15 nt, Homo sapiens
caggcacugcugccc

SEQ ID NO: 2132634 - RNA, 12 nt, Homo sapiens
uuguauugcaag

SEQ ID NO: 2132635 - RNA, 22 nt, Homo sapiens
guccaggagaugaggcuggaua

SEQ ID NO: 2132636 - RNA, 13 nt, Homo sapiens
aaauagacaugua

SEQ ID NO: 2132637 - RNA, 21 nt, Homo sapiens
caaugcuguuuggguuuccaa

SEQ ID NO: 2132638 - RNA, 14 nt, Homo sapiens
cacacacacauaua

SEQ ID NO: 2132639 - RNA, 14 nt, Homo sapiens
cucccucacuucuu

SEQ ID NO: 2132640 - RNA, 17 nt, Homo sapiens
ucaucauuuugugauuc

SEQ ID NO: 2132641 - RNA, 18 nt, Homo sapiens
uguguaccaaucgucuca

SEQ ID NO: 2132642 - RNA, 17 nt, Homo sapiens
cuuaccugaccucuugc

SEQ ID NO: 2132643 - RNA, 13 nt, Homo sapiens
aucauauuucaaa

SEQ ID NO: 2132644 - RNA, 13 nt, Homo sapiens
agugcaccaaaga

SEQ ID NO: 2132645 - RNA, 20 nt, Homo sapiens
aguuccagauuguucugucc

SEQ ID NO: 2132646 - RNA, 16 nt, Homo sapiens
ucucuccacauuccaa

SEQ ID NO: 2132647 - RNA, 22 nt, Homo sapiens
agcgaaauauuacaguagugca

SEQ ID NO: 2132648 - RNA, 16 nt, Homo sapiens
auucacaagacccaaa

SEQ ID NO: 2132649 - RNA, 14 nt, Homo sapiens
cacacccugcuuca

SEQ ID NO: 2132650 - RNA, 17 nt, Homo sapiens
cacuucucacaucuuau

SEQ ID NO: 2132651 - RNA, 20 nt, Homo sapiens
caacucaaugaaaauuuaaa

SEQ ID NO: 2132652 - RNA, 19 nt, Homo sapiens
cacacccacagaaggacac

SEQ ID NO: 2132653 - RNA, 12 nt, Homo sapiens
gagcagcaucua

SEQ ID NO: 2132654 - RNA, 23 nt, Homo sapiens
uaagcucacguccugagaaagcu

SEQ ID NO: 2132655 - RNA, 18 nt, Homo sapiens
uuuaguguuuugcaaggg

SEQ ID NO: 2132656 - RNA, 20 nt, Homo sapiens
gaugguguguucugcaauau

SEQ ID NO: 2132657 - RNA, 11 nt, Homo sapiens
cuguggcauga

SEQ ID NO: 2132658 - RNA, 18 nt, Homo sapiens
gcaugugcagacacucaa

SEQ ID NO: 2132659 - RNA, 14 nt, Homo sapiens
ccaaaaacaguaaa

SEQ ID NO: 2132660 - RNA, 20 nt, Homo sapiens
aucauuggauccuacucaac

SEQ ID NO: 2132661 - RNA, 14 nt, Homo sapiens
caagauuguuuuca

SEQ ID NO: 2132662 - RNA, 16 nt, Homo sapiens
cuuugccuccaccauu

SEQ ID NO: 2132663 - RNA, 19 nt, Homo sapiens
auauuuuuaugugcaauaa

SEQ ID NO: 2132664 - RNA, 16 nt, Homo sapiens
caguagcuguggugag

SEQ ID NO: 2132665 - RNA, 21 nt, Homo sapiens
cagagggcaguggcccuccac

SEQ ID NO: 2132666 - RNA, 22 nt, Homo sapiens
cuggcuggagucucagagcaca

SEQ ID NO: 2132667 - RNA, 20 nt, Homo sapiens
uucugugcccagaauacuga

SEQ ID NO: 2132668 - RNA, 10 nt, Homo sapiens
cacacacucc

SEQ ID NO: 2132669 - RNA, 14 nt, Homo sapiens
ccacucugcucuga

SEQ ID NO: 2132670 - RNA, 19 nt, Homo sapiens
gccccaccuugucugcuaa

SEQ ID NO: 2132671 - RNA, 14 nt, Homo sapiens
cuguauauuuugca

SEQ ID NO: 2132672 - RNA, 18 nt, Homo sapiens
acagaaaauauggugcug

SEQ ID NO: 2132673 - RNA, 15 nt, Homo sapiens
aauagaauauagcau

SEQ ID NO: 2132674 - RNA, 18 nt, Homo sapiens
uugacaaggcucugcuau

SEQ ID NO: 2132675 - RNA, 17 nt, Homo sapiens
ugccacuagguuucacc

SEQ ID NO: 2132676 - RNA, 18 nt, Homo sapiens
uccugagaggaagccuga

SEQ ID NO: 2132677 - RNA, 17 nt, Homo sapiens
auggugguaacugauaa

SEQ ID NO: 2132678 - RNA, 16 nt, Homo sapiens
gcauaggucucuuugc

SEQ ID NO: 2132679 - RNA, 14 nt, Homo sapiens
auccaaagacugua

SEQ ID NO: 2132680 - RNA, 16 nt, Homo sapiens
cugugggccugggaua

SEQ ID NO: 2132681 - RNA, 14 nt, Homo sapiens
uguuauuauauaau

SEQ ID NO: 2132682 - RNA, 14 nt, Homo sapiens
uugaaccuaaacau

SEQ ID NO: 2132683 - RNA, 18 nt, Homo sapiens
gccuugaugccauaugcc

SEQ ID NO: 2132684 - RNA, 22 nt, Homo sapiens
agccacccugaggagucugagg

SEQ ID NO: 2132685 - RNA, 11 nt, Homo sapiens
uuccuggugac

SEQ ID NO: 2132686 - RNA, 22 nt, Homo sapiens
acuguuugucucaccuacccau

SEQ ID NO: 2132687 - RNA, 15 nt, Homo sapiens
augggcucuaccucu

SEQ ID NO: 2132688 - RNA, 20 nt, Homo sapiens
gcacccccugcuccaccagc

SEQ ID NO: 2132689 - RNA, 14 nt, Homo sapiens
gaaagaggaaugaa

SEQ ID NO: 2132690 - RNA, 22 nt, Homo sapiens
aaguaaauuuucuuuaagucag

SEQ ID NO: 2132691 - RNA, 22 nt, Homo sapiens
gcauaacagcaggguaccugaa

SEQ ID NO: 2132692 - RNA, 21 nt, Homo sapiens
agucuuacucugucacccagg

SEQ ID NO: 2132693 - RNA, 23 nt, Homo sapiens
ugaggccuguccucuacauacca

SEQ ID NO: 2132694 - RNA, 20 nt, Homo sapiens
ggccagccccagcaccucau

SEQ ID NO: 2132695 - RNA, 15 nt, Homo sapiens
acuccaucucaaauu

SEQ ID NO: 2132696 - RNA, 13 nt, Homo sapiens
aaggauggaccac

SEQ ID NO: 2132697 - RNA, 19 nt, Homo sapiens
ggugcuugagagacacugg

SEQ ID NO: 2132698 - RNA, 15 nt, Homo sapiens
ggacaccacuaggug

SEQ ID NO: 2132699 - RNA, 23 nt, Homo sapiens
ucucaaagaaauauuaagcaugu

SEQ ID NO: 2132700 - RNA, 15 nt, Homo sapiens
aaaaacuagagcaca

SEQ ID NO: 2132701 - RNA, 13 nt, Homo sapiens
ugacaagugccuu

SEQ ID NO: 2132702 - RNA, 23 nt, Homo sapiens
gagaacaaaacaguccuuuaaau

SEQ ID NO: 2132703 - RNA, 21 nt, Homo sapiens
uacugcuuuuccaaacauucu

SEQ ID NO: 2132704 - RNA, 20 nt, Homo sapiens
ccauucuccuccauacaucc

SEQ ID NO: 2132705 - RNA, 20 nt, Homo sapiens
caaccugcucuccucuugcc

SEQ ID NO: 2132706 - RNA, 17 nt, Homo sapiens
gcaguuucuaagcaugu

SEQ ID NO: 2132707 - RNA, 9 nt, Homo sapiens
augcaaaac

SEQ ID NO: 2132708 - RNA, 11 nt, Homo sapiens
caucuauguga

SEQ ID NO: 2132709 - RNA, 13 nt, Homo sapiens
uguuucacagugg

SEQ ID NO: 2132710 - RNA, 16 nt, Homo sapiens
cucacuccccaacccc

SEQ ID NO: 2132711 - RNA, 11 nt, Homo sapiens
cucuacuacuu

SEQ ID NO: 2132712 - RNA, 22 nt, Homo sapiens
augaggucauagcagugcuuga

SEQ ID NO: 2132713 - RNA, 19 nt, Homo sapiens
uaggagugaguguaugugu

SEQ ID NO: 2132714 - RNA, 21 nt, Homo sapiens
ccaucccguaagaccaccuuc

SEQ ID NO: 2132715 - RNA, 14 nt, Homo sapiens
auuuucaaggccuu

SEQ ID NO: 2132716 - RNA, 16 nt, Homo sapiens
gaccccuaaugcugca

SEQ ID NO: 2132717 - RNA, 15 nt, Homo sapiens
uggcuuuaugugcaa

SEQ ID NO: 2132718 - RNA, 18 nt, Homo sapiens
agacuggaacuugaacug

SEQ ID NO: 2132719 - RNA, 16 nt, Homo sapiens
caaucucgcaguacau

SEQ ID NO: 2132720 - RNA, 18 nt, Homo sapiens
caggccauauuaucaaug

SEQ ID NO: 2132721 - RNA, 23 nt, Homo sapiens
cuccccauggggcagcaucagga

SEQ ID NO: 2132722 - RNA, 22 nt, Homo sapiens
acugaaaacuagaguccuacuu

SEQ ID NO: 2132723 - RNA, 23 nt, Homo sapiens
uggaaagaggagaaggagaggga

SEQ ID NO: 2132724 - RNA, 15 nt, Homo sapiens
ccagaaacagggaca

SEQ ID NO: 2132725 - RNA, 23 nt, Homo sapiens
uugaagaugucaucccauugucu

SEQ ID NO: 2132726 - RNA, 20 nt, Homo sapiens
ucaugugguucagugccuuc

SEQ ID NO: 2132727 - RNA, 18 nt, Homo sapiens
guuuccaugguuaccuga

SEQ ID NO: 2132728 - RNA, 23 nt, Homo sapiens
aauaugaucauguaaaugauuau

SEQ ID NO: 2132729 - RNA, 21 nt, Homo sapiens
aaauugggcuggauugugcuu

SEQ ID NO: 2132730 - RNA, 15 nt, Homo sapiens
gucucagauugggau

SEQ ID NO: 2132731 - RNA, 19 nt, Homo sapiens
acucuccuuuugacuccuu

SEQ ID NO: 2132732 - RNA, 16 nt, Homo sapiens
cagauuaucuacuuag

SEQ ID NO: 2132733 - RNA, 15 nt, Homo sapiens
acccaugccagagag

SEQ ID NO: 2132734 - RNA, 16 nt, Homo sapiens
cuguugcauuguaaua

SEQ ID NO: 2132735 - RNA, 17 nt, Homo sapiens
gaucuacacccaccaga

SEQ ID NO: 2132736 - RNA, 15 nt, Homo sapiens
gacccacaaggccag

SEQ ID NO: 2132737 - RNA, 23 nt, Homo sapiens
auccagcacuggugaacugagcu

SEQ ID NO: 2132738 - RNA, 20 nt, Homo sapiens
gaaucacaaaccaagccaug

SEQ ID NO: 2132739 - RNA, 17 nt, Homo sapiens
acucauauguucccaau

SEQ ID NO: 2132740 - RNA, 15 nt, Homo sapiens
caagaggguggauca

SEQ ID NO: 2132741 - RNA, 21 nt, Homo sapiens
cauauuggacugauaaucucu

SEQ ID NO: 2132742 - RNA, 19 nt, Homo sapiens
ccaaggugaauagcacagg

SEQ ID NO: 2132743 - RNA, 21 nt, Homo sapiens
ugcacauacgcaccacaucuc

SEQ ID NO: 2132744 - RNA, 17 nt, Homo sapiens
uuauaagaugucauccc

SEQ ID NO: 2132745 - RNA, 22 nt, Homo sapiens
ucaggcuacugcuucaaucuca

SEQ ID NO: 2132746 - RNA, 22 nt, Homo sapiens
gagugagaauaauuguguacaa

SEQ ID NO: 2132747 - RNA, 20 nt, Homo sapiens
cccauuugugccagaggaau

SEQ ID NO: 2132748 - RNA, 19 nt, Homo sapiens
uuaaugugaugcuugauau

SEQ ID NO: 2132749 - RNA, 16 nt, Homo sapiens
ugcaguugauuugaga

SEQ ID NO: 2132750 - RNA, 14 nt, Homo sapiens
aagaacuuaccccc

SEQ ID NO: 2132751 - RNA, 22 nt, Homo sapiens
cagucuucuuccaugucuauua

SEQ ID NO: 2132752 - RNA, 21 nt, Homo sapiens
aguguugaugcuuucgucucc

SEQ ID NO: 2132753 - RNA, 17 nt, Homo sapiens
acacacccuacaaguug

SEQ ID NO: 2132754 - RNA, 22 nt, Homo sapiens
uccugggagagaaggagaucag

SEQ ID NO: 2132755 - RNA, 22 nt, Homo sapiens
caugcugcuggggaagacagug

SEQ ID NO: 2132756 - RNA, 16 nt, Homo sapiens
cucagcucacugcaac

SEQ ID NO: 2132757 - RNA, 22 nt, Homo sapiens
ucuucuguacuucucucuucca

SEQ ID NO: 2132758 - RNA, 16 nt, Homo sapiens
acugcagguccagugc

SEQ ID NO: 2132759 - RNA, 15 nt, Homo sapiens
cccgcggugcucugg

SEQ ID NO: 2132760 - RNA, 18 nt, Homo sapiens
uggaaccaggcuugccug

SEQ ID NO: 2132761 - RNA, 10 nt, Homo sapiens
ccaccucucc

SEQ ID NO: 2132762 - RNA, 20 nt, Homo sapiens
cccacauuccaaaagggggc

SEQ ID NO: 2132763 - RNA, 17 nt, Homo sapiens
ugaauacugggaaucaa

SEQ ID NO: 2132764 - RNA, 23 nt, Homo sapiens
cacggugcccaaacaccagucac

SEQ ID NO: 2132765 - RNA, 18 nt, Homo sapiens
gcuuguuauugccucuac

SEQ ID NO: 2132766 - RNA, 17 nt, Homo sapiens
ccccaucucauucaggu

SEQ ID NO: 2132767 - RNA, 15 nt, Homo sapiens
gaagggguuccucaa

SEQ ID NO: 2132768 - RNA, 22 nt, Homo sapiens
ucaagugcgugacuguaugugu

SEQ ID NO: 2132769 - RNA, 21 nt, Homo sapiens
augcugucccuauacacuaga

SEQ ID NO: 2132770 - RNA, 12 nt, Homo sapiens
uuuaaacugcau

SEQ ID NO: 2132771 - RNA, 14 nt, Homo sapiens
ucaucuuugccaag

SEQ ID NO: 2132772 - RNA, 23 nt, Homo sapiens
aucucagaggcucagagacugca

SEQ ID NO: 2132773 - RNA, 20 nt, Homo sapiens
guccucaugggucccuugaa

SEQ ID NO: 2132774 - RNA, 15 nt, Homo sapiens
ugaggaggucccacu

SEQ ID NO: 2132775 - RNA, 17 nt, Homo sapiens
uugucucugaugcagcu

SEQ ID NO: 2132776 - RNA, 9 nt, Homo sapiens
caaaaccac

SEQ ID NO: 2132777 - RNA, 16 nt, Homo sapiens
gaccugccuccugccu

SEQ ID NO: 2132778 - RNA, 12 nt, Homo sapiens
uguaaaaugggg

SEQ ID NO: 2132779 - RNA, 20 nt, Homo sapiens
gguuccugugauacauuucu

SEQ ID NO: 2132780 - RNA, 14 nt, Homo sapiens
aaaaauucacaaau

SEQ ID NO: 2132781 - RNA, 16 nt, Homo sapiens
caauauguuagcaaga

SEQ ID NO: 2132782 - RNA, 18 nt, Homo sapiens
auuguuuugguuugcuac

SEQ ID NO: 2132783 - RNA, 17 nt, Homo sapiens
aguaccuucaauacuua

SEQ ID NO: 2132784 - RNA, 14 nt, Homo sapiens
cagccuuggugcca

SEQ ID NO: 2132785 - RNA, 18 nt, Homo sapiens
auuugauuaauuuaauuc

SEQ ID NO: 2132786 - RNA, 13 nt, Homo sapiens
caaagaauauucc

SEQ ID NO: 2132787 - RNA, 21 nt, Homo sapiens
aguaaguaccacucaggccaa

SEQ ID NO: 2132788 - RNA, 10 nt, Homo sapiens
agguucaagc

SEQ ID NO: 2132789 - RNA, 13 nt, Homo sapiens
ucuaaaaacuuag

SEQ ID NO: 2132790 - RNA, 13 nt, Homo sapiens
uccuaaaacucug

SEQ ID NO: 2132791 - RNA, 19 nt, Homo sapiens
uggugggggugcagaugag

SEQ ID NO: 2132792 - RNA, 15 nt, Homo sapiens
cuaacaucaugcauu

SEQ ID NO: 2132793 - RNA, 15 nt, Homo sapiens
cagaaagcaaaccug

SEQ ID NO: 2132794 - RNA, 17 nt, Homo sapiens
caggcugcugcauggca

SEQ ID NO: 2132795 - RNA, 14 nt, Homo sapiens
ccaggguuuugccc

SEQ ID NO: 2132796 - RNA, 20 nt, Homo sapiens
cacuguauauaaacauauca

SEQ ID NO: 2132797 - RNA, 14 nt, Homo sapiens
cucaguguugacug

SEQ ID NO: 2132798 - RNA, 18 nt, Homo sapiens
acuagccaucucaagcaa

SEQ ID NO: 2132799 - RNA, 22 nt, Homo sapiens
ccuucccgcagcaccagccuga

SEQ ID NO: 2132800 - RNA, 19 nt, Homo sapiens
gcuccuugaccuaugagcc

SEQ ID NO: 2132801 - RNA, 14 nt, Homo sapiens
gcuuuacagugcca

SEQ ID NO: 2132802 - RNA, 16 nt, Homo sapiens
uguugaaucuugcaca

SEQ ID NO: 2132803 - RNA, 13 nt, Homo sapiens
ccacuacagugag

SEQ ID NO: 2132804 - RNA, 18 nt, Homo sapiens
aagaguuaaaacauuucu

SEQ ID NO: 2132805 - RNA, 18 nt, Homo sapiens
auaugugaagacagagca

SEQ ID NO: 2132806 - RNA, 14 nt, Homo sapiens
aguagcuuugcacu

SEQ ID NO: 2132807 - RNA, 15 nt, Homo sapiens
cguaaaugaccccac

SEQ ID NO: 2132808 - RNA, 23 nt, Homo sapiens
gagccaccgcgcccuccugccca

SEQ ID NO: 2132809 - RNA, 23 nt, Homo sapiens
ugggcgaaagggugagacuccau

SEQ ID NO: 2132810 - RNA, 18 nt, Homo sapiens
cacugggccuccaaccau

SEQ ID NO: 2132811 - RNA, 19 nt, Homo sapiens
uccguggucagagugccac

SEQ ID NO: 2132812 - RNA, 18 nt, Homo sapiens
uacagacaaagcauaauc

SEQ ID NO: 2132813 - RNA, 20 nt, Homo sapiens
auguaccuuguguacuuucu

SEQ ID NO: 2132814 - RNA, 23 nt, Homo sapiens
uagauuuaaagaauaugaaguuc

SEQ ID NO: 2132815 - RNA, 22 nt, Homo sapiens
ccuguucugggugcagcugaga

SEQ ID NO: 2132816 - RNA, 14 nt, Homo sapiens
acagcuuauauuaa

SEQ ID NO: 2132817 - RNA, 19 nt, Homo sapiens
uuuggggacuuguagggau

SEQ ID NO: 2132818 - RNA, 22 nt, Homo sapiens
gcugucagcccaugugcaccug

SEQ ID NO: 2132819 - RNA, 17 nt, Homo sapiens
uagguaccaggugucag

SEQ ID NO: 2132820 - RNA, 20 nt, Homo sapiens
cguuaggaaaaccagagccu

SEQ ID NO: 2132821 - RNA, 12 nt, Homo sapiens
auccuuugccag

SEQ ID NO: 2132822 - RNA, 18 nt, Homo sapiens
uagaagauuuuaugcugc

SEQ ID NO: 2132823 - RNA, 17 nt, Homo sapiens
accuccgccccugcccc

SEQ ID NO: 2132824 - RNA, 12 nt, Homo sapiens
ccuuuugugcaa

SEQ ID NO: 2132825 - RNA, 17 nt, Homo sapiens
ggaccuaaacauuauuu

SEQ ID NO: 2132826 - RNA, 23 nt, Homo sapiens
uggaccugucacgauugucauca

SEQ ID NO: 2132827 - RNA, 20 nt, Homo sapiens
gaaggggguggggaagaaga

SEQ ID NO: 2132828 - RNA, 18 nt, Homo sapiens
ugcagggguuauguggaa

SEQ ID NO: 2132829 - RNA, 16 nt, Homo sapiens
ucccuuaaagauuuuc

SEQ ID NO: 2132830 - RNA, 22 nt, Homo sapiens
gccugguucaaaguaaagcaga

SEQ ID NO: 2132831 - RNA, 15 nt, Homo sapiens
aagcagugcacauuu

SEQ ID NO: 2132832 - RNA, 14 nt, Homo sapiens
aaucuguaucugua

SEQ ID NO: 2132833 - RNA, 13 nt, Homo sapiens
uagcauauuacca

SEQ ID NO: 2132834 - RNA, 13 nt, Homo sapiens
cagauuaucacau

SEQ ID NO: 2132835 - RNA, 20 nt, Homo sapiens
auaaacuccuacuaaauccc

SEQ ID NO: 2132836 - RNA, 12 nt, Homo sapiens
acugcacugagu

SEQ ID NO: 2132837 - RNA, 14 nt, Homo sapiens
cagacaaaauuacu

SEQ ID NO: 2132838 - RNA, 13 nt, Homo sapiens
gcuucuucugccc

SEQ ID NO: 2132839 - RNA, 14 nt, Homo sapiens
agaggagagccaga

SEQ ID NO: 2132840 - RNA, 20 nt, Homo sapiens
cuuuuaaaacuuugccauuu

SEQ ID NO: 2132841 - RNA, 13 nt, Homo sapiens
cuugcaugaauca

SEQ ID NO: 2132842 - RNA, 18 nt, Homo sapiens
caaaaguagaacuuugua

SEQ ID NO: 2132843 - RNA, 23 nt, Homo sapiens
uauaaaacccuaggaugugcuag

SEQ ID NO: 2132844 - RNA, 20 nt, Homo sapiens
uauuuaggagugugugacau

SEQ ID NO: 2132845 - RNA, 13 nt, Homo sapiens
cuuaccaacaucu

SEQ ID NO: 2132846 - RNA, 14 nt, Homo sapiens
uaguugaacaagau

SEQ ID NO: 2132847 - RNA, 17 nt, Homo sapiens
aauaaaagcuauuacuu

SEQ ID NO: 2132848 - RNA, 17 nt, Homo sapiens
uggcaaagugacaaagc

SEQ ID NO: 2132849 - RNA, 17 nt, Homo sapiens
gugccgauguugaacuu

SEQ ID NO: 2132850 - RNA, 18 nt, Homo sapiens
cagauaccucaucaucca

SEQ ID NO: 2132851 - RNA, 11 nt, Homo sapiens
gaaaugccaag

SEQ ID NO: 2132852 - RNA, 21 nt, Homo sapiens
aaugucauaaaugucacaaua

SEQ ID NO: 2132853 - RNA, 20 nt, Homo sapiens
ugucuuauggucuugauccu

SEQ ID NO: 2132854 - RNA, 16 nt, Homo sapiens
cuaauaaucaccauau

SEQ ID NO: 2132855 - RNA, 16 nt, Homo sapiens
aacauuuuauacaauu

SEQ ID NO: 2132856 - RNA, 16 nt, Homo sapiens
cuccugcucauugugg

SEQ ID NO: 2132857 - RNA, 16 nt, Homo sapiens
augaaugaaugagcca

SEQ ID NO: 2132858 - RNA, 23 nt, Homo sapiens
aucucaggacccgcccaagagug

SEQ ID NO: 2132859 - RNA, 23 nt, Homo sapiens
aaauaauugaagagacaauagca

SEQ ID NO: 2132860 - RNA, 12 nt, Homo sapiens
uguucauuucac

SEQ ID NO: 2132861 - RNA, 19 nt, Homo sapiens
uggcaaaagguugacucau

SEQ ID NO: 2132862 - RNA, 15 nt, Homo sapiens
ugaguaugaacuuga

SEQ ID NO: 2132863 - RNA, 18 nt, Homo sapiens
cuuucauccucaagcuca

SEQ ID NO: 2132864 - RNA, 14 nt, Homo sapiens
acagacaugaacca

SEQ ID NO: 2132865 - RNA, 11 nt, Homo sapiens
uucacuguggc

SEQ ID NO: 2132866 - RNA, 15 nt, Homo sapiens
ucaauucugauucca

SEQ ID NO: 2132867 - RNA, 19 nt, Homo sapiens
cuuauucugucuggcauua

SEQ ID NO: 2132868 - RNA, 22 nt, Homo sapiens
cucggggacgcccccaccagcu

SEQ ID NO: 2132869 - RNA, 17 nt, Homo sapiens
uaaugcuugaauauuac

SEQ ID NO: 2132870 - RNA, 23 nt, Homo sapiens
uuagcucucuuggguucccaaau

SEQ ID NO: 2132871 - RNA, 16 nt, Homo sapiens
aaucaacaaaccacaa

SEQ ID NO: 2132872 - RNA, 12 nt, Homo sapiens
aagagcuguuau

SEQ ID NO: 2132873 - RNA, 15 nt, Homo sapiens
uggaagauggcauaa

SEQ ID NO: 2132874 - RNA, 15 nt, Homo sapiens
gcccaagauaucagc

SEQ ID NO: 2132875 - RNA, 21 nt, Homo sapiens
gaaaucaucuuuguuggcuca

SEQ ID NO: 2132876 - RNA, 15 nt, Homo sapiens
ucaauuuugugcuau

SEQ ID NO: 2132877 - RNA, 15 nt, Homo sapiens
uugcuaaugcaauua

SEQ ID NO: 2132878 - RNA, 21 nt, Homo sapiens
agaaauuuuuuuccagaauug

SEQ ID NO: 2132879 - RNA, 23 nt, Homo sapiens
aagaugaaauuugauaaacugaa

SEQ ID NO: 2132880 - RNA, 14 nt, Homo sapiens
ccgaggacagccug

SEQ ID NO: 2132881 - RNA, 19 nt, Homo sapiens
aaggaauuaucaauuacaa

SEQ ID NO: 2132882 - RNA, 16 nt, Homo sapiens
ucauccacugugccau

SEQ ID NO: 2132883 - RNA, 18 nt, Homo sapiens
auaauaugaugccacuuu

SEQ ID NO: 2132884 - RNA, 15 nt, Homo sapiens
cucaucacugaaauc

SEQ ID NO: 2132885 - RNA, 21 nt, Homo sapiens
gcccagaucgcaccacugcac

SEQ ID NO: 2132886 - RNA, 18 nt, Homo sapiens
ggguucaccauguugccc

SEQ ID NO: 2132887 - RNA, 17 nt, Homo sapiens
aaacuuaaagcuacugu

SEQ ID NO: 2132888 - RNA, 20 nt, Homo sapiens
cuguuuuuuucccagguguu

SEQ ID NO: 2132889 - RNA, 18 nt, Homo sapiens
cuuguuuuaagauuguaa

SEQ ID NO: 2132890 - RNA, 15 nt, Homo sapiens
uaacaaugaccuuua

SEQ ID NO: 2132891 - RNA, 16 nt, Homo sapiens
cuuuuacauacugcug

SEQ ID NO: 2132892 - RNA, 13 nt, Homo sapiens
caaaguggaggag

SEQ ID NO: 2132893 - RNA, 14 nt, Homo sapiens
gcaccuuugcacgu

SEQ ID NO: 2132894 - RNA, 16 nt, Homo sapiens
cuaggccugggcagug

SEQ ID NO: 2132895 - RNA, 20 nt, Homo sapiens
ugguaugaacuugaggacac

SEQ ID NO: 2132896 - RNA, 22 nt, Homo sapiens
caacuccaggguuaaagaaagg

SEQ ID NO: 2132897 - RNA, 14 nt, Homo sapiens
uaacucaugccauu

SEQ ID NO: 2132898 - RNA, 11 nt, Homo sapiens
aacacagugag

SEQ ID NO: 2132899 - RNA, 21 nt, Homo sapiens
cagaaggacugaagaccagcu

SEQ ID NO: 2132900 - RNA, 17 nt, Homo sapiens
guucuggccaccccaga

SEQ ID NO: 2132901 - RNA, 15 nt, Homo sapiens
cacuaugugcaaaaa

SEQ ID NO: 2132902 - RNA, 22 nt, Homo sapiens
uaauguuccugaaaauugcaau

SEQ ID NO: 2132903 - RNA, 18 nt, Homo sapiens
ucagccuccugaguagcu

SEQ ID NO: 2132904 - RNA, 21 nt, Homo sapiens
aggcccugagcuuuguccuga

SEQ ID NO: 2132905 - RNA, 15 nt, Homo sapiens
aaagaggcagcuuga

SEQ ID NO: 2132906 - RNA, 14 nt, Homo sapiens
auaagcccaguuca

SEQ ID NO: 2132907 - RNA, 16 nt, Homo sapiens
gaagugagaacccagc

SEQ ID NO: 2132908 - RNA, 16 nt, Homo sapiens
cacacuccccacuuca

SEQ ID NO: 2132909 - RNA, 16 nt, Homo sapiens
aguagauaagugcuca

SEQ ID NO: 2132910 - RNA, 17 nt, Homo sapiens
cuuugucuaauuaauua

SEQ ID NO: 2132911 - RNA, 15 nt, Homo sapiens
uaauauuauuacugu

SEQ ID NO: 2132912 - RNA, 19 nt, Homo sapiens
cucccacacugaaaccaaa

SEQ ID NO: 2132913 - RNA, 17 nt, Homo sapiens
accuccuguggaaccca

SEQ ID NO: 2132914 - RNA, 15 nt, Homo sapiens
cuccuggcugugaca

SEQ ID NO: 2132915 - RNA, 12 nt, Homo sapiens
ugcagggguccc

SEQ ID NO: 2132916 - RNA, 16 nt, Homo sapiens
accuccuccuccaguu

SEQ ID NO: 2132917 - RNA, 21 nt, Homo sapiens
agucaccccucuguccagcca

SEQ ID NO: 2132918 - RNA, 22 nt, Homo sapiens
gggaaugaaugucagugugacu

SEQ ID NO: 2132919 - RNA, 13 nt, Homo sapiens
aaauccaggucau

SEQ ID NO: 2132920 - RNA, 13 nt, Homo sapiens
augagucauuugu

SEQ ID NO: 2132921 - RNA, 21 nt, Homo sapiens
ucaaggucagcaugaggacag

SEQ ID NO: 2132922 - RNA, 20 nt, Homo sapiens
uguaucagcucucugcuggg

SEQ ID NO: 2132923 - RNA, 17 nt, Homo sapiens
ucuuguauucaugaaaa

SEQ ID NO: 2132924 - RNA, 14 nt, Homo sapiens
acuccucuuuacac

SEQ ID NO: 2132925 - RNA, 21 nt, Homo sapiens
uaaacaacuaaauaacuguau

SEQ ID NO: 2132926 - RNA, 23 nt, Homo sapiens
cuccaucaccugaaacacuggac

SEQ ID NO: 2132927 - RNA, 14 nt, Homo sapiens
ugacaaauauuuca

SEQ ID NO: 2132928 - RNA, 20 nt, Homo sapiens
caggcaaggggcauuucaca

SEQ ID NO: 2132929 - RNA, 16 nt, Homo sapiens
ucucucuaggugucag

SEQ ID NO: 2132930 - RNA, 13 nt, Homo sapiens
aaucaugugccag

SEQ ID NO: 2132931 - RNA, 13 nt, Homo sapiens
aacagugugcuca

SEQ ID NO: 2132932 - RNA, 15 nt, Homo sapiens
ucauagcugagauuc

SEQ ID NO: 2132933 - RNA, 13 nt, Homo sapiens
aggugucauauga

SEQ ID NO: 2132934 - RNA, 24 nt, Homo sapiens
ccuuugcuacacugcugacagcua

SEQ ID NO: 2132935 - RNA, 19 nt, Homo sapiens
augaccaaggacugcuaca

SEQ ID NO: 2132936 - RNA, 17 nt, Homo sapiens
ggcacaaauacauuccu

SEQ ID NO: 2132937 - RNA, 15 nt, Homo sapiens
gccucagccagagaa

SEQ ID NO: 2132938 - RNA, 16 nt, Homo sapiens
ggaacgcucuaggcag

SEQ ID NO: 2132939 - RNA, 16 nt, Homo sapiens
ccuggacaaggucucu

SEQ ID NO: 2132940 - RNA, 15 nt, Homo sapiens
acagcgucugcucau

SEQ ID NO: 2132941 - RNA, 13 nt, Homo sapiens
aaacaccauucau

SEQ ID NO: 2132942 - RNA, 17 nt, Homo sapiens
guacuuguuugcuauga

SEQ ID NO: 2132943 - RNA, 21 nt, Homo sapiens
cuggccuuuccugguuuucau

SEQ ID NO: 2132944 - RNA, 16 nt, Homo sapiens
uuaacacugcaaauaa

SEQ ID NO: 2132945 - RNA, 21 nt, Homo sapiens
agagcgggguccccucugugc

SEQ ID NO: 2132946 - RNA, 14 nt, Homo sapiens
gacauuccugggca

SEQ ID NO: 2132947 - RNA, 22 nt, Homo sapiens
cagacgaaacacaaacugaagu

SEQ ID NO: 2132948 - RNA, 21 nt, Homo sapiens
uaugcaagccuugcuagacag

SEQ ID NO: 2132949 - RNA, 16 nt, Homo sapiens
gcagaguucuccugga

SEQ ID NO: 2132950 - RNA, 23 nt, Homo sapiens
ugugaaacuggauuaaacuuaau

SEQ ID NO: 2132951 - RNA, 15 nt, Homo sapiens
agacuuuccauuaaa

SEQ ID NO: 2132952 - RNA, 18 nt, Homo sapiens
aaaagcuucagggaacaa

SEQ ID NO: 2132953 - RNA, 17 nt, Homo sapiens
cagcuccgccucugcca

SEQ ID NO: 2132954 - RNA, 12 nt, Homo sapiens
uagaaugauaaa

SEQ ID NO: 2132955 - RNA, 16 nt, Homo sapiens
uuguuuagagcccucc

SEQ ID NO: 2132956 - RNA, 16 nt, Homo sapiens
uaguucucuugguguu

SEQ ID NO: 2132957 - RNA, 18 nt, Homo sapiens
aaaacaugcuuuuccaaa

SEQ ID NO: 2132958 - RNA, 19 nt, Homo sapiens
aaauucuucuaauugcugu

SEQ ID NO: 2132959 - RNA, 14 nt, Homo sapiens
acauuugacacaua

SEQ ID NO: 2132960 - RNA, 19 nt, Homo sapiens
auaaaccaaugagcuguau

SEQ ID NO: 2132961 - RNA, 18 nt, Homo sapiens
cgcacugggggacauggg

SEQ ID NO: 2132962 - RNA, 16 nt, Homo sapiens
uccacgucuuuucuca

SEQ ID NO: 2132963 - RNA, 15 nt, Homo sapiens
agggaauacuauaca

SEQ ID NO: 2132964 - RNA, 14 nt, Homo sapiens
acgcauuaagggcc

SEQ ID NO: 2132965 - RNA, 16 nt, Homo sapiens
gcauuucaccugugac

SEQ ID NO: 2132966 - RNA, 17 nt, Homo sapiens
acagacucuucuugcaa

SEQ ID NO: 2132967 - RNA, 23 nt, Homo sapiens
uugccuuccuaaauuaugacugc

SEQ ID NO: 2132968 - RNA, 18 nt, Homo sapiens
cgaagcccaccacuggcc

SEQ ID NO: 2132969 - RNA, 18 nt, Homo sapiens
cuucuacagcagcacugu

SEQ ID NO: 2132970 - RNA, 18 nt, Homo sapiens
cauauauauaaaauacac

SEQ ID NO: 2132971 - RNA, 22 nt, Homo sapiens
ccacucacaaccccugcuccag

SEQ ID NO: 2132972 - RNA, 21 nt, Homo sapiens
cagagcacuguagcacuuaac

SEQ ID NO: 2132973 - RNA, 13 nt, Homo sapiens
cauauacaauaau

SEQ ID NO: 2132974 - RNA, 16 nt, Homo sapiens
ugcgcaaaacugaaag

SEQ ID NO: 2132975 - RNA, 19 nt, Homo sapiens
aaucuuugguggccaaaga

SEQ ID NO: 2132976 - RNA, 19 nt, Homo sapiens
auauuuauuagauagcccu

SEQ ID NO: 2132977 - RNA, 21 nt, Homo sapiens
gucauauauuuuuugcuacuu

SEQ ID NO: 2132978 - RNA, 22 nt, Homo sapiens
uauagauuguccuuuugcaaag

SEQ ID NO: 2132979 - RNA, 16 nt, Homo sapiens
gagcgaggucagagga

SEQ ID NO: 2132980 - RNA, 19 nt, Homo sapiens
ccucagaaagucaccagga

SEQ ID NO: 2132981 - RNA, 14 nt, Homo sapiens
aacaggauacaggu

SEQ ID NO: 2132982 - RNA, 12 nt, Homo sapiens
auuuaaagcaua

SEQ ID NO: 2132983 - RNA, 19 nt, Homo sapiens
auuguacuuuuuuuuacuu

SEQ ID NO: 2132984 - RNA, 22 nt, Homo sapiens
uuggcacuuauagguaacguga

SEQ ID NO: 2132985 - RNA, 17 nt, Homo sapiens
uauguaugaaggccaca

SEQ ID NO: 2132986 - RNA, 22 nt, Homo sapiens
cagagcaauuccaggcugagcc

SEQ ID NO: 2132987 - RNA, 16 nt, Homo sapiens
aguugccaggcacuuu

SEQ ID NO: 2132988 - RNA, 20 nt, Homo sapiens
cuuccccuccaaaaccucca

SEQ ID NO: 2132989 - RNA, 17 nt, Homo sapiens
gaccuuccaaaccucaa

SEQ ID NO: 2132990 - RNA, 22 nt, Homo sapiens
ugcuggccaggguagacuugga

SEQ ID NO: 2132991 - RNA, 18 nt, Homo sapiens
cacccucuuccugugauc

SEQ ID NO: 2132992 - RNA, 20 nt, Homo sapiens
aggaaccaaaaaaccccagc

SEQ ID NO: 2132993 - RNA, 23 nt, Homo sapiens
ugaggaaaagaaaaucuuuuuaa

SEQ ID NO: 2132994 - RNA, 20 nt, Homo sapiens
ccaucguuuucuucacuguc

SEQ ID NO: 2132995 - RNA, 21 nt, Homo sapiens
ccaucaaguaccucaucugca

SEQ ID NO: 2132996 - RNA, 13 nt, Homo sapiens
gauuugcugugua

SEQ ID NO: 2132997 - RNA, 22 nt, Homo sapiens
uuaauggcucaucaacaaucac

SEQ ID NO: 2132998 - RNA, 20 nt, Homo sapiens
cuuuugaccuguggugcaaa

SEQ ID NO: 2132999 - RNA, 22 nt, Homo sapiens
aagugugaguagagcaugacuu

SEQ ID NO: 2133000 - RNA, 16 nt, Homo sapiens
gcgcuucaucucauga

SEQ ID NO: 2133001 - RNA, 18 nt, Homo sapiens
aagucacaggaugagaca

SEQ ID NO: 2133002 - RNA, 13 nt, Homo sapiens
aaaauuauucaaa

SEQ ID NO: 2133003 - RNA, 14 nt, Homo sapiens
cuuaauucagucuc

SEQ ID NO: 2133004 - RNA, 20 nt, Homo sapiens
cuuuaucaagggccuacuuu

SEQ ID NO: 2133005 - RNA, 19 nt, Homo sapiens
cuaauuaggguacauuuau

SEQ ID NO: 2133006 - RNA, 12 nt, Homo sapiens
gucaucugucag

SEQ ID NO: 2133007 - RNA, 15 nt, Homo sapiens
aggacaaaggugauu

SEQ ID NO: 2133008 - RNA, 15 nt, Homo sapiens
cauaaagaauucaca

SEQ ID NO: 2133009 - RNA, 16 nt, Homo sapiens
auuaguuccccuacua

SEQ ID NO: 2133010 - RNA, 14 nt, Homo sapiens
cuguuaauagucau

SEQ ID NO: 2133011 - RNA, 17 nt, Homo sapiens
uuuucauagugcucaga

SEQ ID NO: 2133012 - RNA, 20 nt, Homo sapiens
cugcuggaugucaccaagaa

SEQ ID NO: 2133013 - RNA, 19 nt, Homo sapiens
aaacuuugaggaacauuca

SEQ ID NO: 2133014 - RNA, 15 nt, Homo sapiens
ucccccuccaccugc

SEQ ID NO: 2133015 - RNA, 20 nt, Homo sapiens
cauagaauggcacaugucau

SEQ ID NO: 2133016 - RNA, 11 nt, Homo sapiens
auaggcuuuau

SEQ ID NO: 2133017 - RNA, 22 nt, Homo sapiens
gacagaaaaauugaacuacagc

SEQ ID NO: 2133018 - RNA, 16 nt, Homo sapiens
uauaguaccacugcac

SEQ ID NO: 2133019 - RNA, 23 nt, Homo sapiens
cuuaagugcaugcauugagcugc

SEQ ID NO: 2133020 - RNA, 15 nt, Homo sapiens
acaaguuaaccaguu

SEQ ID NO: 2133021 - RNA, 15 nt, Homo sapiens
gaaugaaagacugaa

SEQ ID NO: 2133022 - RNA, 14 nt, Homo sapiens
uuuucuucaccucu

SEQ ID NO: 2133023 - RNA, 14 nt, Homo sapiens
acuucaucuucuca

SEQ ID NO: 2133024 - RNA, 14 nt, Homo sapiens
cuggaaaaugugac

SEQ ID NO: 2133025 - RNA, 22 nt, Homo sapiens
uaucccacauccaacuccagca

SEQ ID NO: 2133026 - RNA, 14 nt, Homo sapiens
cauggaugagcaca

SEQ ID NO: 2133027 - RNA, 21 nt, Homo sapiens
uuauugauauuuaauuaugaa

SEQ ID NO: 2133028 - RNA, 17 nt, Homo sapiens
gacccggcggcccugcu

SEQ ID NO: 2133029 - RNA, 17 nt, Homo sapiens
uauauuuguguaugugu

SEQ ID NO: 2133030 - RNA, 19 nt, Homo sapiens
cuaaaguacagacauccua

SEQ ID NO: 2133031 - RNA, 17 nt, Homo sapiens
ccucagccccacugaca

SEQ ID NO: 2133032 - RNA, 17 nt, Homo sapiens
auucauauuuacuucuu

SEQ ID NO: 2133033 - RNA, 15 nt, Homo sapiens
uccuaggucaugccu

SEQ ID NO: 2133034 - RNA, 14 nt, Homo sapiens
acuuucucaaugcu

SEQ ID NO: 2133035 - RNA, 14 nt, Homo sapiens
uaacuguacauuuc

SEQ ID NO: 2133036 - RNA, 14 nt, Homo sapiens
uguccaaacugucg

SEQ ID NO: 2133037 - RNA, 15 nt, Homo sapiens
aaucauauaccagag

SEQ ID NO: 2133038 - RNA, 18 nt, Homo sapiens
uggagcagggacagauca

SEQ ID NO: 2133039 - RNA, 18 nt, Homo sapiens
uagaagaugcaguucaaa

SEQ ID NO: 2133040 - RNA, 17 nt, Homo sapiens
aaguugugacagucacu

SEQ ID NO: 2133041 - RNA, 17 nt, Homo sapiens
agcuguugcggacauca

SEQ ID NO: 2133042 - RNA, 18 nt, Homo sapiens
uaucuuaucccuugacaa

SEQ ID NO: 2133043 - RNA, 16 nt, Homo sapiens
uauuuagucaacauau

SEQ ID NO: 2133044 - RNA, 17 nt, Homo sapiens
auugcagcuaagcucaa

SEQ ID NO: 2133045 - RNA, 15 nt, Homo sapiens
cuuguccuaugucaa

SEQ ID NO: 2133046 - RNA, 13 nt, Homo sapiens
aaaugaguagaca

SEQ ID NO: 2133047 - RNA, 21 nt, Homo sapiens
uuuggagccaggaugggucuc

SEQ ID NO: 2133048 - RNA, 15 nt, Homo sapiens
guaugcaaaccucau

SEQ ID NO: 2133049 - RNA, 18 nt, Homo sapiens
ugucguauaggcauguaa

SEQ ID NO: 2133050 - RNA, 20 nt, Homo sapiens
ggggucccauagaggugagg

SEQ ID NO: 2133051 - RNA, 13 nt, Homo sapiens
uguagcccggggu

SEQ ID NO: 2133052 - RNA, 21 nt, Homo sapiens
gcaucucggggaccugcuuca

SEQ ID NO: 2133053 - RNA, 15 nt, Homo sapiens
uccaaguaacauuuu

SEQ ID NO: 2133054 - RNA, 23 nt, Homo sapiens
auaaauaugugauuaucauuuau

SEQ ID NO: 2133055 - RNA, 15 nt, Homo sapiens
ucuucuuuuacugga

SEQ ID NO: 2133056 - RNA, 15 nt, Homo sapiens
uaaaaacagauucug

SEQ ID NO: 2133057 - RNA, 19 nt, Homo sapiens
aauauauauaaagaauaua

SEQ ID NO: 2133058 - RNA, 15 nt, Homo sapiens
caugcagaagugcau

SEQ ID NO: 2133059 - RNA, 20 nt, Homo sapiens
auucugcuaccucacugggg

SEQ ID NO: 2133060 - RNA, 23 nt, Homo sapiens
ggaaauaguacuuacaaaugacu

SEQ ID NO: 2133061 - RNA, 21 nt, Homo sapiens
ucacacccacccccugccugg

SEQ ID NO: 2133062 - RNA, 14 nt, Homo sapiens
guuagguccauuuu

SEQ ID NO: 2133063 - RNA, 23 nt, Homo sapiens
ugcuagaacaacgccugucacag

SEQ ID NO: 2133064 - RNA, 18 nt, Homo sapiens
cugcuuucccuuuuccau

SEQ ID NO: 2133065 - RNA, 15 nt, Homo sapiens
cccaguuuggggugc

SEQ ID NO: 2133066 - RNA, 14 nt, Homo sapiens
agagacaaaaucuc

SEQ ID NO: 2133067 - RNA, 16 nt, Homo sapiens
auacuaguagucauac

SEQ ID NO: 2133068 - RNA, 17 nt, Homo sapiens
uaaugaauacauuucca

SEQ ID NO: 2133069 - RNA, 20 nt, Homo sapiens
ucugaaauuuuaauugaacu

SEQ ID NO: 2133070 - RNA, 18 nt, Homo sapiens
ucagcagcucugagacag

SEQ ID NO: 2133071 - RNA, 15 nt, Homo sapiens
acauuugaacagggc

SEQ ID NO: 2133072 - RNA, 11 nt, Homo sapiens
gacuugccucc

SEQ ID NO: 2133073 - RNA, 12 nt, Homo sapiens
caaguaccaaaa

SEQ ID NO: 2133074 - RNA, 21 nt, Homo sapiens
cccagggucugaaaggggugu

SEQ ID NO: 2133075 - RNA, 15 nt, Homo sapiens
acaacccuguccuca

SEQ ID NO: 2133076 - RNA, 16 nt, Homo sapiens
ugagauuucccaguuu

SEQ ID NO: 2133077 - RNA, 24 nt, Homo sapiens
ggcaaagaaaaugaaaugcauauu

SEQ ID NO: 2133078 - RNA, 15 nt, Homo sapiens
uagauguaacauucc

SEQ ID NO: 2133079 - RNA, 14 nt, Homo sapiens
uagcugugcucaga

SEQ ID NO: 2133080 - RNA, 22 nt, Homo sapiens
caauuaggcuucauugcacuga

SEQ ID NO: 2133081 - RNA, 21 nt, Homo sapiens
cucugcaucccccaaagccau

SEQ ID NO: 2133082 - RNA, 12 nt, Homo sapiens
agauucaccucc

SEQ ID NO: 2133083 - RNA, 15 nt, Homo sapiens
ugcgccgagccucag

SEQ ID NO: 2133084 - RNA, 14 nt, Homo sapiens
guaaauaugaaucu

SEQ ID NO: 2133085 - RNA, 12 nt, Homo sapiens
cuucuccaggga

SEQ ID NO: 2133086 - RNA, 13 nt, Homo sapiens
uguagucucagga

SEQ ID NO: 2133087 - RNA, 18 nt, Homo sapiens
aguagagggcacuggguc

SEQ ID NO: 2133088 - RNA, 14 nt, Homo sapiens
ugaagacaaugacu

SEQ ID NO: 2133089 - RNA, 15 nt, Homo sapiens
guuucuuccuuuccu

SEQ ID NO: 2133090 - RNA, 20 nt, Homo sapiens
cuagaaauaagcccaacaga

SEQ ID NO: 2133091 - RNA, 14 nt, Homo sapiens
ucuccuccauuccc

SEQ ID NO: 2133092 - RNA, 21 nt, Homo sapiens
ugcacaaguucccuggagaaa

SEQ ID NO: 2133093 - RNA, 21 nt, Homo sapiens
cacccaaguugaagacuuugu

SEQ ID NO: 2133094 - RNA, 21 nt, Homo sapiens
gaaccuaaugggaaucauucc

SEQ ID NO: 2133095 - RNA, 19 nt, Homo sapiens
auaucaugcuaaaauucua

SEQ ID NO: 2133096 - RNA, 9 nt, Homo sapiens
gagaaccac

SEQ ID NO: 2133097 - RNA, 14 nt, Homo sapiens
aacagugcgccagg

SEQ ID NO: 2133098 - RNA, 17 nt, Homo sapiens
aaacuggauuaucuacu

SEQ ID NO: 2133099 - RNA, 14 nt, Homo sapiens
acuauucaucaaga

SEQ ID NO: 2133100 - RNA, 20 nt, Homo sapiens
gguaauguuaguaaauccau

SEQ ID NO: 2133101 - RNA, 14 nt, Homo sapiens
uuaaaauaggauua

SEQ ID NO: 2133102 - RNA, 17 nt, Homo sapiens
ggaccuuggcugcugga

SEQ ID NO: 2133103 - RNA, 16 nt, Homo sapiens
acccagacaaccaaaa

SEQ ID NO: 2133104 - RNA, 16 nt, Homo sapiens
aguuguuugaggcaaa

SEQ ID NO: 2133105 - RNA, 19 nt, Homo sapiens
cuuucuguuuggacccaug

SEQ ID NO: 2133106 - RNA, 15 nt, Homo sapiens
ugacuuuuccauucu

SEQ ID NO: 2133107 - RNA, 20 nt, Homo sapiens
auacaaaaaugaauacugaa

SEQ ID NO: 2133108 - RNA, 21 nt, Homo sapiens
ucagcaacuuauuuugcuuua

SEQ ID NO: 2133109 - RNA, 13 nt, Homo sapiens
gcccugucuuucc

SEQ ID NO: 2133110 - RNA, 21 nt, Homo sapiens
gccaguuggucccccuuccau

SEQ ID NO: 2133111 - RNA, 15 nt, Homo sapiens
ucugcagaguucucc

SEQ ID NO: 2133112 - RNA, 17 nt, Homo sapiens
gacccuaaaucugagga

SEQ ID NO: 2133113 - RNA, 13 nt, Homo sapiens
ccuacuugcacuc

SEQ ID NO: 2133114 - RNA, 15 nt, Homo sapiens
aguggcauuugucag

SEQ ID NO: 2133115 - RNA, 15 nt, Homo sapiens
uaauguuaauucagc

SEQ ID NO: 2133116 - RNA, 20 nt, Homo sapiens
cuaccuucaagaaccaggca

SEQ ID NO: 2133117 - RNA, 12 nt, Homo sapiens
ccuuaaauauca

SEQ ID NO: 2133118 - RNA, 21 nt, Homo sapiens
auccugaucaagcauggaaca

SEQ ID NO: 2133119 - RNA, 18 nt, Homo sapiens
acuaaaggugcacugcuu

SEQ ID NO: 2133120 - RNA, 20 nt, Homo sapiens
gcggcuuugggacaccuggg

SEQ ID NO: 2133121 - RNA, 14 nt, Homo sapiens
uugcauuccagaau

SEQ ID NO: 2133122 - RNA, 14 nt, Homo sapiens
cacaagucuuccag

SEQ ID NO: 2133123 - RNA, 22 nt, Homo sapiens
ucuaucauuaaaguucuaguga

SEQ ID NO: 2133124 - RNA, 13 nt, Homo sapiens
gugcccccaugua

SEQ ID NO: 2133125 - RNA, 12 nt, Homo sapiens
caguaagcuggu

SEQ ID NO: 2133126 - RNA, 18 nt, Homo sapiens
gugcacguacacacacau

SEQ ID NO: 2133127 - RNA, 12 nt, Homo sapiens
ugaaaagccaaa

SEQ ID NO: 2133128 - RNA, 18 nt, Homo sapiens
agaucccagcucacguca

SEQ ID NO: 2133129 - RNA, 16 nt, Homo sapiens
caguaccuagcuggcu

SEQ ID NO: 2133130 - RNA, 14 nt, Homo sapiens
ccuucaaagccacu

SEQ ID NO: 2133131 - RNA, 23 nt, Homo sapiens
cuuucaagggaccucuccaugau

SEQ ID NO: 2133132 - RNA, 17 nt, Homo sapiens
caaaaaaaaaaauggau

SEQ ID NO: 2133133 - RNA, 19 nt, Homo sapiens
ucagugcugugucauucca

SEQ ID NO: 2133134 - RNA, 18 nt, Homo sapiens
cauuucauagccaaacag

SEQ ID NO: 2133135 - RNA, 11 nt, Homo sapiens
ggacugugcag

SEQ ID NO: 2133136 - RNA, 18 nt, Homo sapiens
uauagcauuuugcuaucu

SEQ ID NO: 2133137 - RNA, 18 nt, Homo sapiens
agacucuuuaugcuugca

SEQ ID NO: 2133138 - RNA, 13 nt, Homo sapiens
uuaagauaugcac

SEQ ID NO: 2133139 - RNA, 22 nt, Homo sapiens
gcugggauuacaggugugugcc

SEQ ID NO: 2133140 - RNA, 22 nt, Homo sapiens
cccguggaucugggcacaauca

SEQ ID NO: 2133141 - RNA, 15 nt, Homo sapiens
uggccacacacugag

SEQ ID NO: 2133142 - RNA, 14 nt, Homo sapiens
ccacuucauuccag

SEQ ID NO: 2133143 - RNA, 19 nt, Homo sapiens
gcccccucucaggagccau

SEQ ID NO: 2133144 - RNA, 13 nt, Homo sapiens
uccauugucuuau

SEQ ID NO: 2133145 - RNA, 14 nt, Homo sapiens
uuucauguacagca

SEQ ID NO: 2133146 - RNA, 22 nt, Homo sapiens
ucagcuccgacugccgcugaga

SEQ ID NO: 2133147 - RNA, 17 nt, Homo sapiens
aguucaguggugcaaac

SEQ ID NO: 2133148 - RNA, 16 nt, Homo sapiens
auugaaggauugugaa

SEQ ID NO: 2133149 - RNA, 21 nt, Homo sapiens
ccauuucccauuaaagagcca

SEQ ID NO: 2133150 - RNA, 14 nt, Homo sapiens
aagcaugucucucu

SEQ ID NO: 2133151 - RNA, 14 nt, Homo sapiens
gccucccuuucaua

SEQ ID NO: 2133152 - RNA, 22 nt, Homo sapiens
agaaaugcaugaguaugugcac

SEQ ID NO: 2133153 - RNA, 14 nt, Homo sapiens
accaccccccaugc

SEQ ID NO: 2133154 - RNA, 22 nt, Homo sapiens
aauuuacaacuuauaauuacaa

SEQ ID NO: 2133155 - RNA, 22 nt, Homo sapiens
cuauaucucauuucauucucac

SEQ ID NO: 2133156 - RNA, 14 nt, Homo sapiens
acuaguagagagag

SEQ ID NO: 2133157 - RNA, 16 nt, Homo sapiens
cagcaggaagccauag

SEQ ID NO: 2133158 - RNA, 17 nt, Homo sapiens
gguggagguugcaguga

SEQ ID NO: 2133159 - RNA, 18 nt, Homo sapiens
ggagcugcucucucauga

SEQ ID NO: 2133160 - RNA, 18 nt, Homo sapiens
uggaaauggacacagucu

SEQ ID NO: 2133161 - RNA, 20 nt, Homo sapiens
uuccuauuuggggcuugcau

SEQ ID NO: 2133162 - RNA, 22 nt, Homo sapiens
aggauuuacuuuuuguaaaaag

SEQ ID NO: 2133163 - RNA, 14 nt, Homo sapiens
ccaguucugaugag

SEQ ID NO: 2133164 - RNA, 22 nt, Homo sapiens
uccugugugugcgccuacagga

SEQ ID NO: 2133165 - RNA, 21 nt, Homo sapiens
gcuccaugagggcaggcacau

SEQ ID NO: 2133166 - RNA, 13 nt, Homo sapiens
agcugugcucaga

SEQ ID NO: 2133167 - RNA, 20 nt, Homo sapiens
ugguuccuccagccaccuca

SEQ ID NO: 2133168 - RNA, 17 nt, Homo sapiens
ugacuuuuuagaugugc

SEQ ID NO: 2133169 - RNA, 14 nt, Homo sapiens
cagcuccacucuga

SEQ ID NO: 2133170 - RNA, 18 nt, Homo sapiens
ccuaaugaaugcauaaaa

SEQ ID NO: 2133171 - RNA, 21 nt, Homo sapiens
gauauaggucagugaggccca

SEQ ID NO: 2133172 - RNA, 18 nt, Homo sapiens
uacagcuaagcuuccacu

SEQ ID NO: 2133173 - RNA, 19 nt, Homo sapiens
cgcaagaccagcuuuagcc

SEQ ID NO: 2133174 - RNA, 13 nt, Homo sapiens
ucauucaaauacu

SEQ ID NO: 2133175 - RNA, 18 nt, Homo sapiens
accgaccagacccuggca

SEQ ID NO: 2133176 - RNA, 22 nt, Homo sapiens
aguauguguauguacuuacaug

SEQ ID NO: 2133177 - RNA, 22 nt, Homo sapiens
ccuauguuguaauuuuacuuuu

SEQ ID NO: 2133178 - RNA, 16 nt, Homo sapiens
cccagaccaguaguga

SEQ ID NO: 2133179 - RNA, 22 nt, Homo sapiens
cucgaacuauuuucaaagacuu

SEQ ID NO: 2133180 - RNA, 14 nt, Homo sapiens
acacacacugucug

SEQ ID NO: 2133181 - RNA, 13 nt, Homo sapiens
gacccaccuucaa

SEQ ID NO: 2133182 - RNA, 19 nt, Homo sapiens
acaccagggacacauuucu

SEQ ID NO: 2133183 - RNA, 14 nt, Homo sapiens
aaacaaaucuucaa

SEQ ID NO: 2133184 - RNA, 13 nt, Homo sapiens
cuauuacugaccg

SEQ ID NO: 2133185 - RNA, 20 nt, Homo sapiens
ggauucaaaugucaguucau

SEQ ID NO: 2133186 - RNA, 19 nt, Homo sapiens
gacccagccuucagucaca

SEQ ID NO: 2133187 - RNA, 22 nt, Homo sapiens
cgauccauguaaucugacguca

SEQ ID NO: 2133188 - RNA, 15 nt, Homo sapiens
ugagaaaucaugccu

SEQ ID NO: 2133189 - RNA, 17 nt, Homo sapiens
augucacuaaacaagaa

SEQ ID NO: 2133190 - RNA, 14 nt, Homo sapiens
auuucagcauuauu

SEQ ID NO: 2133191 - RNA, 23 nt, Homo sapiens
cuuuccgacacauuuaccaaauu

SEQ ID NO: 2133192 - RNA, 21 nt, Homo sapiens
cuucaggguaaacuagcaaug

SEQ ID NO: 2133193 - RNA, 10 nt, Homo sapiens
uccuucccaa

SEQ ID NO: 2133194 - RNA, 14 nt, Homo sapiens
aucaaucugcaguu

SEQ ID NO: 2133195 - RNA, 12 nt, Homo sapiens
ggggaagccagu

SEQ ID NO: 2133196 - RNA, 20 nt, Homo sapiens
uugucccagggcugaugcug

SEQ ID NO: 2133197 - RNA, 19 nt, Homo sapiens
ucggcaggacacccugaua

SEQ ID NO: 2133198 - RNA, 17 nt, Homo sapiens
aaggggcaccugggaaa

SEQ ID NO: 2133199 - RNA, 22 nt, Homo sapiens
ugugcccaucaucucugccuuu

SEQ ID NO: 2133200 - RNA, 19 nt, Homo sapiens
gggagaaaaaaagggaucu

SEQ ID NO: 2133201 - RNA, 15 nt, Homo sapiens
acccccaguuccuau

SEQ ID NO: 2133202 - RNA, 19 nt, Homo sapiens
cauguggaaagccucagga

SEQ ID NO: 2133203 - RNA, 20 nt, Homo sapiens
uccucagcagccucacugca

SEQ ID NO: 2133204 - RNA, 15 nt, Homo sapiens
ucucgacaguaucca

SEQ ID NO: 2133205 - RNA, 12 nt, Homo sapiens
gaauucaaacaa

SEQ ID NO: 2133206 - RNA, 16 nt, Homo sapiens
uuugcuuuucaggguu

SEQ ID NO: 2133207 - RNA, 23 nt, Homo sapiens
gaaggccuggaagagcugagacc

SEQ ID NO: 2133208 - RNA, 14 nt, Homo sapiens
ucauauuugcacua

SEQ ID NO: 2133209 - RNA, 13 nt, Homo sapiens
gcugcccacuguu

SEQ ID NO: 2133210 - RNA, 15 nt, Homo sapiens
caagcaagcucucuu

SEQ ID NO: 2133211 - RNA, 13 nt, Homo sapiens
ccagccacagugu

SEQ ID NO: 2133212 - RNA, 18 nt, Homo sapiens
uaacuaaugucucuacaa

SEQ ID NO: 2133213 - RNA, 13 nt, Homo sapiens
uuuauauaugaag

SEQ ID NO: 2133214 - RNA, 21 nt, Homo sapiens
ggcucugugcagucacuggag

SEQ ID NO: 2133215 - RNA, 16 nt, Homo sapiens
aacucacuccacugua

SEQ ID NO: 2133216 - RNA, 13 nt, Homo sapiens
ccucagaaacccu

SEQ ID NO: 2133217 - RNA, 18 nt, Homo sapiens
ccaggagcgcagcugcau

SEQ ID NO: 2133218 - RNA, 14 nt, Homo sapiens
ugaaacuaaucaua

SEQ ID NO: 2133219 - RNA, 16 nt, Homo sapiens
cgcccugccuccugga

SEQ ID NO: 2133220 - RNA, 17 nt, Homo sapiens
ggagaugaguugcaguu

SEQ ID NO: 2133221 - RNA, 16 nt, Homo sapiens
gaaauuuacuauguaa

SEQ ID NO: 2133222 - RNA, 17 nt, Homo sapiens
gaaguuuaaaacccaaa

SEQ ID NO: 2133223 - RNA, 16 nt, Homo sapiens
ugaaugcuauguucug

SEQ ID NO: 2133224 - RNA, 23 nt, Homo sapiens
ugggagagucaagggaaggacaa

SEQ ID NO: 2133225 - RNA, 20 nt, Homo sapiens
caaaaauauaaccauuacau

SEQ ID NO: 2133226 - RNA, 18 nt, Homo sapiens
uagaauaacaacugcugg

SEQ ID NO: 2133227 - RNA, 22 nt, Homo sapiens
cauuuaggaaaaauaauucuau

SEQ ID NO: 2133228 - RNA, 19 nt, Homo sapiens
uguuucuuauucuuucuaa

SEQ ID NO: 2133229 - RNA, 15 nt, Homo sapiens
uaaauauuacaguga

SEQ ID NO: 2133230 - RNA, 15 nt, Homo sapiens
aaaauauuucaguga

SEQ ID NO: 2133231 - RNA, 15 nt, Homo sapiens
uaaaugauacaguau

SEQ ID NO: 2133232 - RNA, 20 nt, Homo sapiens
cuguucacacacacaguuug

SEQ ID NO: 2133233 - RNA, 17 nt, Homo sapiens
cuguuggccagcacguu

SEQ ID NO: 2133234 - RNA, 12 nt, Homo sapiens
cagcccaaaggc

SEQ ID NO: 2133235 - RNA, 16 nt, Homo sapiens
gcuucuuucacuuugc

SEQ ID NO: 2133236 - RNA, 22 nt, Homo sapiens
agaugcauguucaaaccaauca

SEQ ID NO: 2133237 - RNA, 22 nt, Homo sapiens
cacgugaauauuuugcuaaaaa

SEQ ID NO: 2133238 - RNA, 20 nt, Homo sapiens
guguaaauaauuugcacuga

SEQ ID NO: 2133239 - RNA, 21 nt, Homo sapiens
ucuuauaacacaacaauaagg

SEQ ID NO: 2133240 - RNA, 19 nt, Homo sapiens
gggaugagaaugaaagcuu

SEQ ID NO: 2133241 - RNA, 16 nt, Homo sapiens
gaaaaggauugcuuaa

SEQ ID NO: 2133242 - RNA, 18 nt, Homo sapiens
accuagggggacggggcu

SEQ ID NO: 2133243 - RNA, 13 nt, Homo sapiens
cccccacucugca

SEQ ID NO: 2133244 - RNA, 15 nt, Homo sapiens
cagaauuaguccuca

SEQ ID NO: 2133245 - RNA, 14 nt, Homo sapiens
ugagaugaucaaua

SEQ ID NO: 2133246 - RNA, 21 nt, Homo sapiens
ugccacgccgcccuaaaagca

SEQ ID NO: 2133247 - RNA, 15 nt, Homo sapiens
uaagaugaugaauga

SEQ ID NO: 2133248 - RNA, 22 nt, Homo sapiens
agacucauugcagcagguggua

SEQ ID NO: 2133249 - RNA, 20 nt, Homo sapiens
auggacucgauuuuaccaua

SEQ ID NO: 2133250 - RNA, 13 nt, Homo sapiens
aucuaaaucuuca

SEQ ID NO: 2133251 - RNA, 13 nt, Homo sapiens
acuaggcuguuaa

SEQ ID NO: 2133252 - RNA, 13 nt, Homo sapiens
aauucaguucugu

SEQ ID NO: 2133253 - RNA, 13 nt, Homo sapiens
caugugugacugc

SEQ ID NO: 2133254 - RNA, 13 nt, Homo sapiens
acuuugugcauuc

SEQ ID NO: 2133255 - RNA, 19 nt, Homo sapiens
ucucagccauaggugcagu

SEQ ID NO: 2133256 - RNA, 19 nt, Homo sapiens
gccacguggccgcugccca

SEQ ID NO: 2133257 - RNA, 18 nt, Homo sapiens
aaagagaucugggcauua

SEQ ID NO: 2133258 - RNA, 20 nt, Homo sapiens
uaacugugaaauaccacaag

SEQ ID NO: 2133259 - RNA, 16 nt, Homo sapiens
gcaccuguacucagga

SEQ ID NO: 2133260 - RNA, 14 nt, Homo sapiens
ugccaccauaccuc

SEQ ID NO: 2133261 - RNA, 23 nt, Homo sapiens
aggaaagcaaaauccaacuaaug

SEQ ID NO: 2133262 - RNA, 14 nt, Homo sapiens
aauucugccuugaa

SEQ ID NO: 2133263 - RNA, 16 nt, Homo sapiens
cuuuauguuacuacau

SEQ ID NO: 2133264 - RNA, 16 nt, Homo sapiens
uaccacaucuucaugu

SEQ ID NO: 2133265 - RNA, 18 nt, Homo sapiens
augaaauugauuugucaa

SEQ ID NO: 2133266 - RNA, 17 nt, Homo sapiens
gggcaguccuuacuccc

SEQ ID NO: 2133267 - RNA, 16 nt, Homo sapiens
ccagacuuggccucca

SEQ ID NO: 2133268 - RNA, 19 nt, Homo sapiens
cugucccucacagcacuag

SEQ ID NO: 2133269 - RNA, 13 nt, Homo sapiens
aagcacacuugac

SEQ ID NO: 2133270 - RNA, 22 nt, Homo sapiens
uucccuucacuccccuauccca

SEQ ID NO: 2133271 - RNA, 21 nt, Homo sapiens
aacuuccauagcuucauccac

SEQ ID NO: 2133272 - RNA, 19 nt, Homo sapiens
aguucauacccuguuacca

SEQ ID NO: 2133273 - RNA, 20 nt, Homo sapiens
auaguuuaaauucaauuaca

SEQ ID NO: 2133274 - RNA, 17 nt, Homo sapiens
cucaugggaagaugucu

SEQ ID NO: 2133275 - RNA, 14 nt, Homo sapiens
ccuuucugagggcc

SEQ ID NO: 2133276 - RNA, 15 nt, Homo sapiens
aacagacaucaugcu

SEQ ID NO: 2133277 - RNA, 14 nt, Homo sapiens
uaaagcguccucuc

SEQ ID NO: 2133278 - RNA, 20 nt, Homo sapiens
agcuggugccccacugaauu

SEQ ID NO: 2133279 - RNA, 14 nt, Homo sapiens
uccccaggggcaug

SEQ ID NO: 2133280 - RNA, 15 nt, Homo sapiens
acuuagaagcaucag

SEQ ID NO: 2133281 - RNA, 16 nt, Homo sapiens
ugacuccugaagguuu

SEQ ID NO: 2133282 - RNA, 16 nt, Homo sapiens
cagauucagucuugcc

SEQ ID NO: 2133283 - RNA, 14 nt, Homo sapiens
uccgagauagggug

SEQ ID NO: 2133284 - RNA, 11 nt, Homo sapiens
uaucacauuaa

SEQ ID NO: 2133285 - RNA, 15 nt, Homo sapiens
ucuucugaaaccaaa

SEQ ID NO: 2133286 - RNA, 16 nt, Homo sapiens
aaaugaagauacacau

SEQ ID NO: 2133287 - RNA, 11 nt, Homo sapiens
ugaaacugagu

SEQ ID NO: 2133288 - RNA, 14 nt, Homo sapiens
ccuguugguucuga

SEQ ID NO: 2133289 - RNA, 23 nt, Homo sapiens
cauaggugcucuuccucaucuca

SEQ ID NO: 2133290 - RNA, 15 nt, Homo sapiens
aaccuauccuuccag

SEQ ID NO: 2133291 - RNA, 20 nt, Homo sapiens
ccucugcgucuuuuuacuca

SEQ ID NO: 2133292 - RNA, 12 nt, Homo sapiens
aucagaguugcu

SEQ ID NO: 2133293 - RNA, 22 nt, Homo sapiens
cagaaucagaucugagcuucau

SEQ ID NO: 2133294 - RNA, 19 nt, Homo sapiens
auaagcuuuuaaugcucca

SEQ ID NO: 2133295 - RNA, 14 nt, Homo sapiens
gaaggaauggugcu

SEQ ID NO: 2133296 - RNA, 23 nt, Homo sapiens
agcuugucaccauuggacagucu

SEQ ID NO: 2133297 - RNA, 13 nt, Homo sapiens
agaagauucuucc

SEQ ID NO: 2133298 - RNA, 12 nt, Homo sapiens
cccagaaggcag

SEQ ID NO: 2133299 - RNA, 15 nt, Homo sapiens
caggaggaucacuuu

SEQ ID NO: 2133300 - RNA, 18 nt, Homo sapiens
gccuugccagagauccaa

SEQ ID NO: 2133301 - RNA, 18 nt, Homo sapiens
caugccacugcacucuag

SEQ ID NO: 2133302 - RNA, 18 nt, Homo sapiens
cacgccauuguacuccag

SEQ ID NO: 2133303 - RNA, 20 nt, Homo sapiens
aggaggaucauuugagcuca

SEQ ID NO: 2133304 - RNA, 16 nt, Homo sapiens
gacacaaauaaaggaa

SEQ ID NO: 2133305 - RNA, 15 nt, Homo sapiens
gcucauuuuaggccu

SEQ ID NO: 2133306 - RNA, 19 nt, Homo sapiens
aaucucguugaggccaagg

SEQ ID NO: 2133307 - RNA, 21 nt, Homo sapiens
augcacuuaaguuagccucca

SEQ ID NO: 2133308 - RNA, 17 nt, Homo sapiens
agccacaagucuuccag

SEQ ID NO: 2133309 - RNA, 15 nt, Homo sapiens
uguggccucauccaa

SEQ ID NO: 2133310 - RNA, 14 nt, Homo sapiens
uuaaugauuuagcu

SEQ ID NO: 2133311 - RNA, 13 nt, Homo sapiens
gaauaaagacuug

SEQ ID NO: 2133312 - RNA, 15 nt, Homo sapiens
ugaaaacaagugcug

SEQ ID NO: 2133313 - RNA, 18 nt, Homo sapiens
ucacuguuggauguuaca

SEQ ID NO: 2133314 - RNA, 18 nt, Homo sapiens
acuugucuuacauaauca

SEQ ID NO: 2133315 - RNA, 16 nt, Homo sapiens
gugcugugcugugcua

SEQ ID NO: 2133316 - RNA, 17 nt, Homo sapiens
aacuauaacauucaauu

SEQ ID NO: 2133317 - RNA, 20 nt, Homo sapiens
acuuuggaggcaaaaugugu

SEQ ID NO: 2133318 - RNA, 16 nt, Homo sapiens
caggaagucaggagcc

SEQ ID NO: 2133319 - RNA, 18 nt, Homo sapiens
cugcauuugugucaucuu

SEQ ID NO: 2133320 - RNA, 16 nt, Homo sapiens
acagacacuguugcaa

SEQ ID NO: 2133321 - RNA, 18 nt, Homo sapiens
gaguagaacccaggucug

SEQ ID NO: 2133322 - RNA, 16 nt, Homo sapiens
caguccgcucuuccaa

SEQ ID NO: 2133323 - RNA, 22 nt, Homo sapiens
uguuuauacuccaguguacaua

SEQ ID NO: 2133324 - RNA, 16 nt, Homo sapiens
uuuaugaugacugcuu

SEQ ID NO: 2133325 - RNA, 16 nt, Homo sapiens
agaaaaugacuuuauu

SEQ ID NO: 2133326 - RNA, 12 nt, Homo sapiens
acagcucaguuc

SEQ ID NO: 2133327 - RNA, 20 nt, Homo sapiens
aaccaguuugcccauucucu

SEQ ID NO: 2133328 - RNA, 16 nt, Homo sapiens
uuacugaugugugcaa

SEQ ID NO: 2133329 - RNA, 16 nt, Homo sapiens
uaagaaagcacuauua

SEQ ID NO: 2133330 - RNA, 23 nt, Homo sapiens
acugugcugaucgggaagcccuu

SEQ ID NO: 2133331 - RNA, 13 nt, Homo sapiens
gauaaugauuucc

SEQ ID NO: 2133332 - RNA, 19 nt, Homo sapiens
aaaccuccaaaacuccugc

SEQ ID NO: 2133333 - RNA, 13 nt, Homo sapiens
cagcugcacuuua

SEQ ID NO: 2133334 - RNA, 16 nt, Homo sapiens
gauauugucagucuuu

SEQ ID NO: 2133335 - RNA, 22 nt, Homo sapiens
aggcacaacgcaccagacacuc

SEQ ID NO: 2133336 - RNA, 19 nt, Homo sapiens
uucauuguuuccuucugac

SEQ ID NO: 2133337 - RNA, 19 nt, Homo sapiens
caaaaucuguacaugucuc

SEQ ID NO: 2133338 - RNA, 20 nt, Homo sapiens
gagguauggguuuuacugau

SEQ ID NO: 2133339 - RNA, 23 nt, Homo sapiens
aaucaagucugugaaagucuccu

SEQ ID NO: 2133340 - RNA, 15 nt, Homo sapiens
uguaaauacagugga

SEQ ID NO: 2133341 - RNA, 13 nt, Homo sapiens
cgugccugugauc

SEQ ID NO: 2133342 - RNA, 17 nt, Homo sapiens
agucugcagaguucucc

SEQ ID NO: 2133343 - RNA, 17 nt, Homo sapiens
aacuccugcauggcuca

SEQ ID NO: 2133344 - RNA, 16 nt, Homo sapiens
ucuccccaggguucag

SEQ ID NO: 2133345 - RNA, 14 nt, Homo sapiens
gccaccaugcacuc

SEQ ID NO: 2133346 - RNA, 22 nt, Homo sapiens
uccacacccacuuuguccauuu

SEQ ID NO: 2133347 - RNA, 21 nt, Homo sapiens
acaauagaauuauaacuggaa

SEQ ID NO: 2133348 - RNA, 20 nt, Homo sapiens
uuuggagacggccaagugaa

SEQ ID NO: 2133349 - RNA, 18 nt, Homo sapiens
gaaguguaguaugcugua

SEQ ID NO: 2133350 - RNA, 19 nt, Homo sapiens
accucacagaguaugaucu

SEQ ID NO: 2133351 - RNA, 23 nt, Homo sapiens
caagagcagcuaaaaccuacuca

SEQ ID NO: 2133352 - RNA, 15 nt, Homo sapiens
cagauguuugccuca

SEQ ID NO: 2133353 - RNA, 16 nt, Homo sapiens
aaucauuucugcauca

SEQ ID NO: 2133354 - RNA, 17 nt, Homo sapiens
cauacuaugguuuucau

SEQ ID NO: 2133355 - RNA, 17 nt, Homo sapiens
gaccacacgcaguauug

SEQ ID NO: 2133356 - RNA, 21 nt, Homo sapiens
ggucuuagcucuuucucuauu

SEQ ID NO: 2133357 - RNA, 13 nt, Homo sapiens
agcugagcgcuuu

SEQ ID NO: 2133358 - RNA, 15 nt, Homo sapiens
accuccauuucccaa

SEQ ID NO: 2133359 - RNA, 19 nt, Homo sapiens
cucggcagucacuuccacu

SEQ ID NO: 2133360 - RNA, 15 nt, Homo sapiens
cauuuccaagcacuu

SEQ ID NO: 2133361 - RNA, 23 nt, Homo sapiens
caggagaagccagugucuaggca

SEQ ID NO: 2133362 - RNA, 12 nt, Homo sapiens
auauugcuaaaa

SEQ ID NO: 2133363 - RNA, 19 nt, Homo sapiens
agugacuuguucugaguaa

SEQ ID NO: 2133364 - RNA, 23 nt, Homo sapiens
agccaaggagggagggucuuccu

SEQ ID NO: 2133365 - RNA, 15 nt, Homo sapiens
ugacugccaagccau

SEQ ID NO: 2133366 - RNA, 23 nt, Homo sapiens
acacauuaaaagacaaauaugua

SEQ ID NO: 2133367 - RNA, 19 nt, Homo sapiens
uagcauuucccaacacaaa

SEQ ID NO: 2133368 - RNA, 14 nt, Homo sapiens
cacacaucucauuu

SEQ ID NO: 2133369 - RNA, 23 nt, Homo sapiens
gcagauggccuuguugcuggcau

SEQ ID NO: 2133370 - RNA, 15 nt, Homo sapiens
ccagaucauguuccu

SEQ ID NO: 2133371 - RNA, 23 nt, Homo sapiens
auacccucacuuaaacuuuuauc

SEQ ID NO: 2133372 - RNA, 18 nt, Homo sapiens
aagauauagaaacucuca

SEQ ID NO: 2133373 - RNA, 20 nt, Homo sapiens
cauguuuaucugagcucuua

SEQ ID NO: 2133374 - RNA, 20 nt, Homo sapiens
auuugggagcugaaccaaag

SEQ ID NO: 2133375 - RNA, 22 nt, Homo sapiens
gaaauuaguuuaccucauccau

SEQ ID NO: 2133376 - RNA, 18 nt, Homo sapiens
acuccuguaaaauaugaa

SEQ ID NO: 2133377 - RNA, 16 nt, Homo sapiens
uaccuguagugagaaa

SEQ ID NO: 2133378 - RNA, 15 nt, Homo sapiens
agcuuuuggucauca

SEQ ID NO: 2133379 - RNA, 13 nt, Homo sapiens
cuucaaauucaaa

SEQ ID NO: 2133380 - RNA, 16 nt, Homo sapiens
ucaagagauucugccu

SEQ ID NO: 2133381 - RNA, 22 nt, Homo sapiens
gcucuguaaaacacaccaauca

SEQ ID NO: 2133382 - RNA, 12 nt, Homo sapiens
acccaacacuuu

SEQ ID NO: 2133383 - RNA, 19 nt, Homo sapiens
accauagugucacagagag

SEQ ID NO: 2133384 - RNA, 20 nt, Homo sapiens
cgugauucaaugaaccacaa

SEQ ID NO: 2133385 - RNA, 15 nt, Homo sapiens
ugaaaacaugacuca

SEQ ID NO: 2133386 - RNA, 15 nt, Homo sapiens
ccggccgcgcaccgc

SEQ ID NO: 2133387 - RNA, 16 nt, Homo sapiens
gagucaaugugcagug

SEQ ID NO: 2133388 - RNA, 16 nt, Homo sapiens
ggaucagaagauaucu

SEQ ID NO: 2133389 - RNA, 14 nt, Homo sapiens
ucaagauacacuug

SEQ ID NO: 2133390 - RNA, 20 nt, Homo sapiens
ggcagccacccccuccccca

SEQ ID NO: 2133391 - RNA, 16 nt, Homo sapiens
cuguacuguaauuucu

SEQ ID NO: 2133392 - RNA, 14 nt, Homo sapiens
gcaaagaugcauuu

SEQ ID NO: 2133393 - RNA, 14 nt, Homo sapiens
gaaaagaugaauuu

SEQ ID NO: 2133394 - RNA, 13 nt, Homo sapiens
ucccgaacacuga

SEQ ID NO: 2133395 - RNA, 19 nt, Homo sapiens
uuacgcugccuuaauguaa

SEQ ID NO: 2133396 - RNA, 21 nt, Homo sapiens
gauucuaugaagcccacccag

SEQ ID NO: 2133397 - RNA, 20 nt, Homo sapiens
ugcugaaugucauuauuuga

SEQ ID NO: 2133398 - RNA, 15 nt, Homo sapiens
agucucauucuguca

SEQ ID NO: 2133399 - RNA, 15 nt, Homo sapiens
aauaaugacauaaaa

SEQ ID NO: 2133400 - RNA, 18 nt, Homo sapiens
acacagacuccacccucc

SEQ ID NO: 2133401 - RNA, 17 nt, Homo sapiens
aaaagaccaagggccag

SEQ ID NO: 2133402 - RNA, 14 nt, Homo sapiens
uuaucaccagagag

SEQ ID NO: 2133403 - RNA, 16 nt, Homo sapiens
cuccaggaauacugaa

SEQ ID NO: 2133404 - RNA, 17 nt, Homo sapiens
gcagacaucaagcucaa

SEQ ID NO: 2133405 - RNA, 16 nt, Homo sapiens
agaugucuucuugcaa

SEQ ID NO: 2133406 - RNA, 15 nt, Homo sapiens
uggaacuguccuucc

SEQ ID NO: 2133407 - RNA, 17 nt, Homo sapiens
aaauaucuugcuuucaa

SEQ ID NO: 2133408 - RNA, 17 nt, Homo sapiens
aguuccuuucugggaag

SEQ ID NO: 2133409 - RNA, 21 nt, Homo sapiens
gccuggcaggccagugucugg

SEQ ID NO: 2133410 - RNA, 22 nt, Homo sapiens
aaauaccaaaccuucugacuuu

SEQ ID NO: 2133411 - RNA, 19 nt, Homo sapiens
cacaaacugaaugacuuga

SEQ ID NO: 2133412 - RNA, 22 nt, Homo sapiens
ugucauaagcgaucacuuccua

SEQ ID NO: 2133413 - RNA, 17 nt, Homo sapiens
cacuguaaagccaguug

SEQ ID NO: 2133414 - RNA, 12 nt, Homo sapiens
acauaugugcug

SEQ ID NO: 2133415 - RNA, 22 nt, Homo sapiens
agaaaauaauggagaaucacuu

SEQ ID NO: 2133416 - RNA, 14 nt, Homo sapiens
uucuuccguuucuu

SEQ ID NO: 2133417 - RNA, 14 nt, Homo sapiens
augccuccaaaaau

SEQ ID NO: 2133418 - RNA, 21 nt, Homo sapiens
ggagaugucugaauacugcag

SEQ ID NO: 2133419 - RNA, 19 nt, Homo sapiens
cucaucuguacauacuguu

SEQ ID NO: 2133420 - RNA, 20 nt, Homo sapiens
ugggaucaagaaggggacag

SEQ ID NO: 2133421 - RNA, 13 nt, Homo sapiens
cuaaaaguucuca

SEQ ID NO: 2133422 - RNA, 21 nt, Homo sapiens
agauggcaggaugggcacugc

SEQ ID NO: 2133423 - RNA, 18 nt, Homo sapiens
gaaaccuacacacuguca

SEQ ID NO: 2133424 - RNA, 22 nt, Homo sapiens
aaauacauaugcagauacuuau

SEQ ID NO: 2133425 - RNA, 20 nt, Homo sapiens
ccuaaauauccaaagacugu

SEQ ID NO: 2133426 - RNA, 15 nt, Homo sapiens
ugcucuuguguuucc

SEQ ID NO: 2133427 - RNA, 15 nt, Homo sapiens
augcugggagggcug

SEQ ID NO: 2133428 - RNA, 15 nt, Homo sapiens
aaauauguucugaca

SEQ ID NO: 2133429 - RNA, 15 nt, Homo sapiens
agauuggccagugag

SEQ ID NO: 2133430 - RNA, 17 nt, Homo sapiens
gauguauuuuucuugcu

SEQ ID NO: 2133431 - RNA, 14 nt, Homo sapiens
cucauagcauuaac

SEQ ID NO: 2133432 - RNA, 15 nt, Homo sapiens
aaaggaaaagccaac

SEQ ID NO: 2133433 - RNA, 22 nt, Homo sapiens
gaaauacaguauaccgcagugg

SEQ ID NO: 2133434 - RNA, 22 nt, Homo sapiens
auuguugccagaugcagcacau

SEQ ID NO: 2133435 - RNA, 19 nt, Homo sapiens
gaagcucuggccaaccaaa

SEQ ID NO: 2133436 - RNA, 21 nt, Homo sapiens
ccaagaucugccagaccugca

SEQ ID NO: 2133437 - RNA, 16 nt, Homo sapiens
aaaacacuaacuuaau

SEQ ID NO: 2133438 - RNA, 19 nt, Homo sapiens
gucccacccggacaggugg

SEQ ID NO: 2133439 - RNA, 21 nt, Homo sapiens
aguucgaccaaacucaguuca

SEQ ID NO: 2133440 - RNA, 14 nt, Homo sapiens
ucacuuuucagaag

SEQ ID NO: 2133441 - RNA, 19 nt, Homo sapiens
gcuaccuacaugcugaaaa

SEQ ID NO: 2133442 - RNA, 20 nt, Homo sapiens
gcuuguggccaaugcaucca

SEQ ID NO: 2133443 - RNA, 12 nt, Homo sapiens
uucagggccagg

SEQ ID NO: 2133444 - RNA, 19 nt, Homo sapiens
aaacuugggccgcugcacc

SEQ ID NO: 2133445 - RNA, 19 nt, Homo sapiens
aaacuccuguuucuccuua

SEQ ID NO: 2133446 - RNA, 17 nt, Homo sapiens
ugggccccacuggacaa

SEQ ID NO: 2133447 - RNA, 14 nt, Homo sapiens
ugggagccacuggg

SEQ ID NO: 2133448 - RNA, 18 nt, Homo sapiens
augacugccuugccuccu

SEQ ID NO: 2133449 - RNA, 17 nt, Homo sapiens
augccaccacacguguu

SEQ ID NO: 2133450 - RNA, 18 nt, Homo sapiens
cugccuagcugccuagca

SEQ ID NO: 2133451 - RNA, 19 nt, Homo sapiens
ugaucucggaugaccaaac

SEQ ID NO: 2133452 - RNA, 18 nt, Homo sapiens
caagugcaguagugcagu

SEQ ID NO: 2133453 - RNA, 14 nt, Homo sapiens
caggagcaauggga

SEQ ID NO: 2133454 - RNA, 12 nt, Homo sapiens
uacucauuacug

SEQ ID NO: 2133455 - RNA, 17 nt, Homo sapiens
gugcugaguguacagag

SEQ ID NO: 2133456 - RNA, 21 nt, Homo sapiens
augcucaguuggugcugcuuu

SEQ ID NO: 2133457 - RNA, 22 nt, Homo sapiens
cuauuuauuacugaacuauuau

SEQ ID NO: 2133458 - RNA, 15 nt, Homo sapiens
uccuuacuuuacugc

SEQ ID NO: 2133459 - RNA, 21 nt, Homo sapiens
ccacuuuggcugaacuacaag

SEQ ID NO: 2133460 - RNA, 13 nt, Homo sapiens
uaauccuaucugg

SEQ ID NO: 2133461 - RNA, 18 nt, Homo sapiens
ucuggcucccaucaccuc

SEQ ID NO: 2133462 - RNA, 17 nt, Homo sapiens
cccaggcuccagccaca

SEQ ID NO: 2133463 - RNA, 17 nt, Homo sapiens
ugaguagggacucaggg

SEQ ID NO: 2133464 - RNA, 12 nt, Homo sapiens
cccugcauucac

SEQ ID NO: 2133465 - RNA, 18 nt, Homo sapiens
agcgcaucaggccuggca

SEQ ID NO: 2133466 - RNA, 16 nt, Homo sapiens
gcugcuguggggacca

SEQ ID NO: 2133467 - RNA, 17 nt, Homo sapiens
ugcucauauugugauuc

SEQ ID NO: 2133468 - RNA, 14 nt, Homo sapiens
uaaacucucuaggg

SEQ ID NO: 2133469 - RNA, 19 nt, Homo sapiens
aaaguuaauaacagcuccu

SEQ ID NO: 2133470 - RNA, 18 nt, Homo sapiens
cuuccugauuccuuuaaa

SEQ ID NO: 2133471 - RNA, 16 nt, Homo sapiens
caacucacaccugccu

SEQ ID NO: 2133472 - RNA, 12 nt, Homo sapiens
gaaaaucacuug

SEQ ID NO: 2133473 - RNA, 13 nt, Homo sapiens
ucucauuccagag

SEQ ID NO: 2133474 - RNA, 10 nt, Homo sapiens
augcucuccu

SEQ ID NO: 2133475 - RNA, 16 nt, Homo sapiens
gacuuugauguguuuu

SEQ ID NO: 2133476 - RNA, 14 nt, Homo sapiens
gugcagacacucaa

SEQ ID NO: 2133477 - RNA, 20 nt, Homo sapiens
gaucaugccacuacacucca

SEQ ID NO: 2133478 - RNA, 20 nt, Homo sapiens
gaucgugccacugcacucca

SEQ ID NO: 2133479 - RNA, 15 nt, Homo sapiens
cacaugugacacaua

SEQ ID NO: 2133480 - RNA, 21 nt, Homo sapiens
cuauuguugaauaaauguauc

SEQ ID NO: 2133481 - RNA, 16 nt, Homo sapiens
cuaguagcggaucuca

SEQ ID NO: 2133482 - RNA, 13 nt, Homo sapiens
ucagaauaugauu

SEQ ID NO: 2133483 - RNA, 18 nt, Homo sapiens
ucacuucgggcuguguaa

SEQ ID NO: 2133484 - RNA, 15 nt, Homo sapiens
uaacugguuacucag

SEQ ID NO: 2133485 - RNA, 22 nt, Homo sapiens
cugcacaguggggagcauggag

SEQ ID NO: 2133486 - RNA, 12 nt, Homo sapiens
agucacauauca

SEQ ID NO: 2133487 - RNA, 22 nt, Homo sapiens
accauggugugucaugcucacu

SEQ ID NO: 2133488 - RNA, 15 nt, Homo sapiens
aaaggauaugcagua

SEQ ID NO: 2133489 - RNA, 22 nt, Homo sapiens
cugagcuagaauuauucucuua

SEQ ID NO: 2133490 - RNA, 14 nt, Homo sapiens
gagagcccauuccc

SEQ ID NO: 2133491 - RNA, 14 nt, Homo sapiens
uccauucacuccca

SEQ ID NO: 2133492 - RNA, 15 nt, Homo sapiens
aguauuaaguaguaa

SEQ ID NO: 2133493 - RNA, 17 nt, Homo sapiens
gcagugccccuagcuua

SEQ ID NO: 2133494 - RNA, 13 nt, Homo sapiens
cuggcagcaugac

SEQ ID NO: 2133495 - RNA, 11 nt, Homo sapiens
aaaucugugau

SEQ ID NO: 2133496 - RNA, 16 nt, Homo sapiens
aaacuauuugcgacuc

SEQ ID NO: 2133497 - RNA, 17 nt, Homo sapiens
gaauaggaggggaaaaa

SEQ ID NO: 2133498 - RNA, 14 nt, Homo sapiens
ggacuuugagcaca

SEQ ID NO: 2133499 - RNA, 23 nt, Homo sapiens
aacacuuuacaauguucauccca

SEQ ID NO: 2133500 - RNA, 19 nt, Homo sapiens
uucuuucccaaaaugugcc

SEQ ID NO: 2133501 - RNA, 18 nt, Homo sapiens
ucauccccucccagaugu

SEQ ID NO: 2133502 - RNA, 16 nt, Homo sapiens
agagcagcagcaccuu

SEQ ID NO: 2133503 - RNA, 21 nt, Homo sapiens
ggagguuuguuugugugaaag

SEQ ID NO: 2133504 - RNA, 22 nt, Homo sapiens
ccacuccaaccagaagugaaua

SEQ ID NO: 2133505 - RNA, 21 nt, Homo sapiens
acuugucacugacacaaagga

SEQ ID NO: 2133506 - RNA, 19 nt, Homo sapiens
uaucggcucuauucucuaa

SEQ ID NO: 2133507 - RNA, 22 nt, Homo sapiens
uggcuacacucaucugacucau

SEQ ID NO: 2133508 - RNA, 20 nt, Homo sapiens
ugcucagcccaggcacaacu

SEQ ID NO: 2133509 - RNA, 18 nt, Homo sapiens
guccagaagaauauucag

SEQ ID NO: 2133510 - RNA, 20 nt, Homo sapiens
gggccucuucugccucuuaa

SEQ ID NO: 2133511 - RNA, 21 nt, Homo sapiens
augugagggcaccaccaagaa

SEQ ID NO: 2133512 - RNA, 17 nt, Homo sapiens
ugagucaaugugcagug

SEQ ID NO: 2133513 - RNA, 20 nt, Homo sapiens
gauauaugacuuuuucucag

SEQ ID NO: 2133514 - RNA, 21 nt, Homo sapiens
uucagaaugucagaaguugau

SEQ ID NO: 2133515 - RNA, 13 nt, Homo sapiens
aaaauaacauaau

SEQ ID NO: 2133516 - RNA, 13 nt, Homo sapiens
aaauaaacauaua

SEQ ID NO: 2133517 - RNA, 20 nt, Homo sapiens
guauaagccaucaauauuca

SEQ ID NO: 2133518 - RNA, 22 nt, Homo sapiens
ucaaagcaccugaacaguuuau

SEQ ID NO: 2133519 - RNA, 19 nt, Homo sapiens
uaugcugaguuugugcugg

SEQ ID NO: 2133520 - RNA, 18 nt, Homo sapiens
ccuugacaaagucaagcc

SEQ ID NO: 2133521 - RNA, 19 nt, Homo sapiens
ccaauuuauccuugaccaa

SEQ ID NO: 2133522 - RNA, 14 nt, Homo sapiens
uuauaauauacuau

SEQ ID NO: 2133523 - RNA, 14 nt, Homo sapiens
uaaaauuauucaaa

SEQ ID NO: 2133524 - RNA, 23 nt, Homo sapiens
gaaaugggaauugcgcucagggg

SEQ ID NO: 2133525 - RNA, 15 nt, Homo sapiens
gcaauaaaggcaccu

SEQ ID NO: 2133526 - RNA, 14 nt, Homo sapiens
aagaaacauuucag

SEQ ID NO: 2133527 - RNA, 22 nt, Homo sapiens
gaaaaucugucaugagcauuug

SEQ ID NO: 2133528 - RNA, 19 nt, Homo sapiens
ccgaggagcuggggcgggc

SEQ ID NO: 2133529 - RNA, 20 nt, Homo sapiens
cugcagaauaaaaucucuau

SEQ ID NO: 2133530 - RNA, 17 nt, Homo sapiens
cuguuacugaaaguggu

SEQ ID NO: 2133531 - RNA, 23 nt, Homo sapiens
gacagcagucuucuucacccgcu

SEQ ID NO: 2133532 - RNA, 18 nt, Homo sapiens
agagacuauuuagacaaa

SEQ ID NO: 2133533 - RNA, 18 nt, Homo sapiens
ggccucauccaaacugua

SEQ ID NO: 2133534 - RNA, 18 nt, Homo sapiens
uuccagguguuacuguaa

SEQ ID NO: 2133535 - RNA, 13 nt, Homo sapiens
acauuuccaugca

SEQ ID NO: 2133536 - RNA, 15 nt, Homo sapiens
aguccccucucucug

SEQ ID NO: 2133537 - RNA, 15 nt, Homo sapiens
ucccuuuaugcaccc

SEQ ID NO: 2133538 - RNA, 17 nt, Homo sapiens
gcucugagcacagguga

SEQ ID NO: 2133539 - RNA, 14 nt, Homo sapiens
aaugagugaguucu

SEQ ID NO: 2133540 - RNA, 20 nt, Homo sapiens
acuuuaauuucucugcauca

SEQ ID NO: 2133541 - RNA, 14 nt, Homo sapiens
gguucagugccacg

SEQ ID NO: 2133542 - RNA, 16 nt, Homo sapiens
ccagagcagaugcaga

SEQ ID NO: 2133543 - RNA, 13 nt, Homo sapiens
ucugccagggaug

SEQ ID NO: 2133544 - RNA, 17 nt, Homo sapiens
aacaagcaaaaccaaag

SEQ ID NO: 2133545 - RNA, 17 nt, Homo sapiens
guaaauccuaaagaagg

SEQ ID NO: 2133546 - RNA, 22 nt, Homo sapiens
agcgcucgauggaccucagcaa

SEQ ID NO: 2133547 - RNA, 15 nt, Homo sapiens
cccagccauggugag

SEQ ID NO: 2133548 - RNA, 11 nt, Homo sapiens
gacaugcacac

SEQ ID NO: 2133549 - RNA, 11 nt, Homo sapiens
agaaaucacau

SEQ ID NO: 2133550 - RNA, 19 nt, Homo sapiens
caauacggcuaaucuuuca

SEQ ID NO: 2133551 - RNA, 14 nt, Homo sapiens
auaaguaacuuguc

SEQ ID NO: 2133552 - RNA, 19 nt, Homo sapiens
caguggauggauucaucau

SEQ ID NO: 2133553 - RNA, 22 nt, Homo sapiens
uucucgagcuacgagaccuuca

SEQ ID NO: 2133554 - RNA, 19 nt, Homo sapiens
cuggagccucagcagcaaa

SEQ ID NO: 2133555 - RNA, 22 nt, Homo sapiens
cauuuuauacccaaaacccuga

SEQ ID NO: 2133556 - RNA, 20 nt, Homo sapiens
gagggcaaacccaaaaccuc

SEQ ID NO: 2133557 - RNA, 12 nt, Homo sapiens
aguccagcacug

SEQ ID NO: 2133558 - RNA, 17 nt, Homo sapiens
uuggucucacuacuuga

SEQ ID NO: 2133559 - RNA, 23 nt, Homo sapiens
ccaauuggugucuguacucagcc

SEQ ID NO: 2133560 - RNA, 19 nt, Homo sapiens
cugaugagucuugaucuag

SEQ ID NO: 2133561 - RNA, 11 nt, Homo sapiens
cagucugaguc

SEQ ID NO: 2133562 - RNA, 15 nt, Homo sapiens
ccagacaauguugug

SEQ ID NO: 2133563 - RNA, 15 nt, Homo sapiens
uuuccaaagagccau

SEQ ID NO: 2133564 - RNA, 12 nt, Homo sapiens
acuaacacuggc

SEQ ID NO: 2133565 - RNA, 21 nt, Homo sapiens
agugcuucaacgaugugacug

SEQ ID NO: 2133566 - RNA, 18 nt, Homo sapiens
cagcaaagcagcaguguc

SEQ ID NO: 2133567 - RNA, 18 nt, Homo sapiens
aacagguaaacagaaauc

SEQ ID NO: 2133568 - RNA, 22 nt, Homo sapiens
aacgccacguguaguggcucau

SEQ ID NO: 2133569 - RNA, 23 nt, Homo sapiens
cucaguuggaaucauugcuaaua

SEQ ID NO: 2133570 - RNA, 15 nt, Homo sapiens
cuaggaggaaaaaga

SEQ ID NO: 2133571 - RNA, 23 nt, Homo sapiens
uaauuaguuuauauuacucucau

SEQ ID NO: 2133572 - RNA, 21 nt, Homo sapiens
aaauuucuguaaaacagguua

SEQ ID NO: 2133573 - RNA, 16 nt, Homo sapiens
agaacaccugcauucu

SEQ ID NO: 2133574 - RNA, 14 nt, Homo sapiens
augacauccagaaa

SEQ ID NO: 2133575 - RNA, 14 nt, Homo sapiens
aucacauccacaaa

SEQ ID NO: 2133576 - RNA, 16 nt, Homo sapiens
cccagugcuaccucuc

SEQ ID NO: 2133577 - RNA, 19 nt, Homo sapiens
ugcacacccaucgucuuua

SEQ ID NO: 2133578 - RNA, 17 nt, Homo sapiens
ggaaacucagaugucca

SEQ ID NO: 2133579 - RNA, 20 nt, Homo sapiens
aauuuaucuugucucugggc

SEQ ID NO: 2133580 - RNA, 22 nt, Homo sapiens
gaaaauaauaaaagaaucauuu

SEQ ID NO: 2133581 - RNA, 23 nt, Homo sapiens
caccccugcccugguuccugucu

SEQ ID NO: 2133582 - RNA, 16 nt, Homo sapiens
uguucuuggaccuuuu

SEQ ID NO: 2133583 - RNA, 17 nt, Homo sapiens
cuucugugcccagggug

SEQ ID NO: 2133584 - RNA, 11 nt, Homo sapiens
uauucagaaaa

SEQ ID NO: 2133585 - RNA, 15 nt, Homo sapiens
uguagaaacucagca

SEQ ID NO: 2133586 - RNA, 22 nt, Homo sapiens
auguuugccgcuuaagcuuuca

SEQ ID NO: 2133587 - RNA, 18 nt, Homo sapiens
cuuaagaacugcuuucuu

SEQ ID NO: 2133588 - RNA, 23 nt, Homo sapiens
uccaacuaacguacauucaacag

SEQ ID NO: 2133589 - RNA, 19 nt, Homo sapiens
cuacacgagauacagaauu

SEQ ID NO: 2133590 - RNA, 20 nt, Homo sapiens
cagacagccguuuguucuac

SEQ ID NO: 2133591 - RNA, 21 nt, Homo sapiens
aauauaugcaucccuggugaa

SEQ ID NO: 2133592 - RNA, 21 nt, Homo sapiens
uaaacugaaucuauggcuuua

SEQ ID NO: 2133593 - RNA, 20 nt, Homo sapiens
uuccaaugaagccauaugaa

SEQ ID NO: 2133594 - RNA, 23 nt, Homo sapiens
aaauucccucauuuaaacccaau

SEQ ID NO: 2133595 - RNA, 19 nt, Homo sapiens
cuaagcaaccacacugcuu

SEQ ID NO: 2133596 - RNA, 14 nt, Homo sapiens
aaaaucuagcacac

SEQ ID NO: 2133597 - RNA, 12 nt, Homo sapiens
cauugaugcuga

SEQ ID NO: 2133598 - RNA, 22 nt, Homo sapiens
gcagccaacccggcacugcccu

SEQ ID NO: 2133599 - RNA, 21 nt, Homo sapiens
uccugcagccuccuccugacc

SEQ ID NO: 2133600 - RNA, 15 nt, Homo sapiens
cugcccacagggaac

SEQ ID NO: 2133601 - RNA, 18 nt, Homo sapiens
agauuugcuguucaccca

SEQ ID NO: 2133602 - RNA, 18 nt, Homo sapiens
uucagggcagggcucuga

SEQ ID NO: 2133603 - RNA, 21 nt, Homo sapiens
uguuuucuaaaguuguucaca

SEQ ID NO: 2133604 - RNA, 18 nt, Homo sapiens
agggaggggcuggggcag

SEQ ID NO: 2133605 - RNA, 22 nt, Homo sapiens
ucaauguuugaaauaguucaaa

SEQ ID NO: 2133606 - RNA, 18 nt, Homo sapiens
uuacucuugcugagucag

SEQ ID NO: 2133607 - RNA, 17 nt, Homo sapiens
uagccaacucucccaaa

SEQ ID NO: 2133608 - RNA, 19 nt, Homo sapiens
gagaguuauccugauaaau

SEQ ID NO: 2133609 - RNA, 22 nt, Homo sapiens
gcaaucuguguucgauggcuca

SEQ ID NO: 2133610 - RNA, 12 nt, Homo sapiens
aguauaccucau

SEQ ID NO: 2133611 - RNA, 19 nt, Homo sapiens
acuccggccaccuccucca

SEQ ID NO: 2133612 - RNA, 16 nt, Homo sapiens
acuauaaacaugaugu

SEQ ID NO: 2133613 - RNA, 17 nt, Homo sapiens
ccaagagggacuccaag

SEQ ID NO: 2133614 - RNA, 17 nt, Homo sapiens
uccccaaaauguggaau

SEQ ID NO: 2133615 - RNA, 12 nt, Homo sapiens
ucuucaccucac

SEQ ID NO: 2133616 - RNA, 22 nt, Homo sapiens
uugaacugggccuuaacuguug

SEQ ID NO: 2133617 - RNA, 16 nt, Homo sapiens
gguauauacuuugcca

SEQ ID NO: 2133618 - RNA, 18 nt, Homo sapiens
ugggagguugugggcauu

SEQ ID NO: 2133619 - RNA, 16 nt, Homo sapiens
uauguguacgugugug

SEQ ID NO: 2133620 - RNA, 21 nt, Homo sapiens
cccuccucaugccuucccuga

SEQ ID NO: 2133621 - RNA, 22 nt, Homo sapiens
ggcaugcccagguucaggucac

SEQ ID NO: 2133622 - RNA, 23 nt, Homo sapiens
uuuacuugaaauuaaauuuggcu

SEQ ID NO: 2133623 - RNA, 22 nt, Homo sapiens
caaagagaaaaagaaaugcaaa

SEQ ID NO: 2133624 - RNA, 12 nt, Homo sapiens
uaaaggccucuu

SEQ ID NO: 2133625 - RNA, 14 nt, Homo sapiens
acuuuaguacaauu

SEQ ID NO: 2133626 - RNA, 14 nt, Homo sapiens
guaucuguguuaca

SEQ ID NO: 2133627 - RNA, 22 nt, Homo sapiens
ugccaaggccgcccaccugcau

SEQ ID NO: 2133628 - RNA, 13 nt, Homo sapiens
ugagaaaaucagu

SEQ ID NO: 2133629 - RNA, 18 nt, Homo sapiens
cugcaguguggcaagcaa

SEQ ID NO: 2133630 - RNA, 17 nt, Homo sapiens
cuguaauucccaaaacu

SEQ ID NO: 2133631 - RNA, 21 nt, Homo sapiens
ugggcaacagagcaagacucu

SEQ ID NO: 2133632 - RNA, 19 nt, Homo sapiens
uccaaaauaucgagugaau

SEQ ID NO: 2133633 - RNA, 19 nt, Homo sapiens
agggagaaguugagcaggu

SEQ ID NO: 2133634 - RNA, 15 nt, Homo sapiens
acugcaccccaggca

SEQ ID NO: 2133635 - RNA, 17 nt, Homo sapiens
augaaaauaaaacauuu

SEQ ID NO: 2133636 - RNA, 18 nt, Homo sapiens
aucucuuguuuaaauuca

SEQ ID NO: 2133637 - RNA, 16 nt, Homo sapiens
uccucauuuacuggau

SEQ ID NO: 2133638 - RNA, 13 nt, Homo sapiens
uguaaguuacuga

SEQ ID NO: 2133639 - RNA, 18 nt, Homo sapiens
cucagguucccugccaca

SEQ ID NO: 2133640 - RNA, 14 nt, Homo sapiens
aaauguaugugcuc

SEQ ID NO: 2133641 - RNA, 18 nt, Homo sapiens
aaagaaucgccaugccca

SEQ ID NO: 2133642 - RNA, 18 nt, Homo sapiens
ugagcgggagucagggac

SEQ ID NO: 2133643 - RNA, 23 nt, Homo sapiens
aaauauuguugacaacugugacu

SEQ ID NO: 2133644 - RNA, 20 nt, Homo sapiens
acuaauucugcaucugggca

SEQ ID NO: 2133645 - RNA, 16 nt, Homo sapiens
aauguacagacauauu

SEQ ID NO: 2133646 - RNA, 15 nt, Homo sapiens
cggagguccugcuac

SEQ ID NO: 2133647 - RNA, 13 nt, Homo sapiens
gaaaaauaaaucu

SEQ ID NO: 2133648 - RNA, 16 nt, Homo sapiens
ucuuugccaagggagg

SEQ ID NO: 2133649 - RNA, 14 nt, Homo sapiens
acaaaagccucuca

SEQ ID NO: 2133650 - RNA, 23 nt, Homo sapiens
caaucuuucaugucuugucauac

SEQ ID NO: 2133651 - RNA, 14 nt, Homo sapiens
ugaagaaaccuggc

SEQ ID NO: 2133652 - RNA, 18 nt, Homo sapiens
aucuuauagcacuuugaa

SEQ ID NO: 2133653 - RNA, 14 nt, Homo sapiens
ccacaugaccucca

SEQ ID NO: 2133654 - RNA, 19 nt, Homo sapiens
aaauuuucucucacugaug

SEQ ID NO: 2133655 - RNA, 16 nt, Homo sapiens
acuaaacuagcucuug

SEQ ID NO: 2133656 - RNA, 18 nt, Homo sapiens
gugcuaacuguguguaca

SEQ ID NO: 2133657 - RNA, 23 nt, Homo sapiens
caucuucuuucuuccacccacaa

SEQ ID NO: 2133658 - RNA, 19 nt, Homo sapiens
aauaugggcucaagucacu

SEQ ID NO: 2133659 - RNA, 14 nt, Homo sapiens
cugacgacacugaa

SEQ ID NO: 2133660 - RNA, 14 nt, Homo sapiens
acuagguuuaucuc

SEQ ID NO: 2133661 - RNA, 14 nt, Homo sapiens
ucacuggguucuag

SEQ ID NO: 2133662 - RNA, 21 nt, Homo sapiens
caaggcuuugguuuccaaguc

SEQ ID NO: 2133663 - RNA, 21 nt, Homo sapiens
ccagcagaaccagccucaaaa

SEQ ID NO: 2133664 - RNA, 21 nt, Homo sapiens
cugauggaaguaaagccucaa

SEQ ID NO: 2133665 - RNA, 22 nt, Homo sapiens
uucauaaucccaaucuaauuau

SEQ ID NO: 2133666 - RNA, 19 nt, Homo sapiens
ugauacauuuuuguacuaa

SEQ ID NO: 2133667 - RNA, 17 nt, Homo sapiens
caggcacuauaauuucu

SEQ ID NO: 2133668 - RNA, 17 nt, Homo sapiens
augacagaaaaguaaug

SEQ ID NO: 2133669 - RNA, 23 nt, Homo sapiens
uucauuuaggugaggaagcaaaa

SEQ ID NO: 2133670 - RNA, 16 nt, Homo sapiens
uuaaagaaagaagugu

SEQ ID NO: 2133671 - RNA, 18 nt, Homo sapiens
augauuuuaagaggcuuu

SEQ ID NO: 2133672 - RNA, 19 nt, Homo sapiens
gccaccccacagcucuuuc

SEQ ID NO: 2133673 - RNA, 13 nt, Homo sapiens
gugacacacuggc

SEQ ID NO: 2133674 - RNA, 22 nt, Homo sapiens
aauaaauugacauaaccaacau

SEQ ID NO: 2133675 - RNA, 23 nt, Homo sapiens
cugaggcuggggcuuuugugcca

SEQ ID NO: 2133676 - RNA, 12 nt, Homo sapiens
aacauugcccag

SEQ ID NO: 2133677 - RNA, 22 nt, Homo sapiens
aauggaccuccguggccaaaaa

SEQ ID NO: 2133678 - RNA, 14 nt, Homo sapiens
gacagcuguguacu

SEQ ID NO: 2133679 - RNA, 12 nt, Homo sapiens
aucaugcuuaug

SEQ ID NO: 2133680 - RNA, 13 nt, Homo sapiens
uaccugucucucu

SEQ ID NO: 2133681 - RNA, 14 nt, Homo sapiens
acguggaugaagca

SEQ ID NO: 2133682 - RNA, 15 nt, Homo sapiens
gaggucucucuggaa

SEQ ID NO: 2133683 - RNA, 14 nt, Homo sapiens
gaagcacaaccacu

SEQ ID NO: 2133684 - RNA, 22 nt, Homo sapiens
uaauauuuuauaccaaagccaa

SEQ ID NO: 2133685 - RNA, 18 nt, Homo sapiens
auauauacauauacacaa

SEQ ID NO: 2133686 - RNA, 13 nt, Homo sapiens
cuccugaccucaa

SEQ ID NO: 2133687 - RNA, 23 nt, Homo sapiens
uaaaguagcaggacucggaauuc

SEQ ID NO: 2133688 - RNA, 22 nt, Homo sapiens
aaucuuauuccgagcauuccag

SEQ ID NO: 2133689 - RNA, 14 nt, Homo sapiens
auccuccugccuca

SEQ ID NO: 2133690 - RNA, 13 nt, Homo sapiens
cucuauaaagggu

SEQ ID NO: 2133691 - RNA, 18 nt, Homo sapiens
agagacgguguuuugcca

SEQ ID NO: 2133692 - RNA, 14 nt, Homo sapiens
cacuagacaaaacu

SEQ ID NO: 2133693 - RNA, 20 nt, Homo sapiens
caacuacuagugugacuccu

SEQ ID NO: 2133694 - RNA, 23 nt, Homo sapiens
aaugauugguuaaaaugugauuu

SEQ ID NO: 2133695 - RNA, 14 nt, Homo sapiens
gucuugcuugggaa

SEQ ID NO: 2133696 - RNA, 22 nt, Homo sapiens
uaaaaugaaguggugagcuuaa

SEQ ID NO: 2133697 - RNA, 19 nt, Homo sapiens
cugacccaccaaggucuca

SEQ ID NO: 2133698 - RNA, 18 nt, Homo sapiens
gugaugaugcugugacaa

SEQ ID NO: 2133699 - RNA, 15 nt, Homo sapiens
acucaguagccauau

SEQ ID NO: 2133700 - RNA, 13 nt, Homo sapiens
aguucaaccuuua

SEQ ID NO: 2133701 - RNA, 17 nt, Homo sapiens
uauuaaagcuccauugg

SEQ ID NO: 2133702 - RNA, 14 nt, Homo sapiens
ccagccugccccag

SEQ ID NO: 2133703 - RNA, 18 nt, Homo sapiens
agccaggaggccugcuag

SEQ ID NO: 2133704 - RNA, 14 nt, Homo sapiens
gaagguuaccaaga

SEQ ID NO: 2133705 - RNA, 22 nt, Homo sapiens
gcuacuaccuagggcacuuuaa

SEQ ID NO: 2133706 - RNA, 17 nt, Homo sapiens
ugcugaggcucugaccc

SEQ ID NO: 2133707 - RNA, 18 nt, Homo sapiens
uucacaucgcagauucuc

SEQ ID NO: 2133708 - RNA, 16 nt, Homo sapiens
ugaagagccacugcca

SEQ ID NO: 2133709 - RNA, 16 nt, Homo sapiens
agugccugcauuccca

SEQ ID NO: 2133710 - RNA, 18 nt, Homo sapiens
agcacagcacccauggga

SEQ ID NO: 2133711 - RNA, 15 nt, Homo sapiens
uugaacuacuuggga

SEQ ID NO: 2133712 - RNA, 14 nt, Homo sapiens
aaaagcaucuugau

SEQ ID NO: 2133713 - RNA, 21 nt, Homo sapiens
ucacugccauauacucuucaa

SEQ ID NO: 2133714 - RNA, 13 nt, Homo sapiens
agggacaagcccu

SEQ ID NO: 2133715 - RNA, 19 nt, Homo sapiens
accaguguuccugaagcug

SEQ ID NO: 2133716 - RNA, 15 nt, Homo sapiens
uaacagaaguuguga

SEQ ID NO: 2133717 - RNA, 15 nt, Homo sapiens
auagcuuaaaacacu

SEQ ID NO: 2133718 - RNA, 21 nt, Homo sapiens
ucagaagagucccggagcuca

SEQ ID NO: 2133719 - RNA, 21 nt, Homo sapiens
auccuucaugucuuaaccuac

SEQ ID NO: 2133720 - RNA, 22 nt, Homo sapiens
ucuuucuuuacuuaacauaucu

SEQ ID NO: 2133721 - RNA, 11 nt, Homo sapiens
cugacacugcu

SEQ ID NO: 2133722 - RNA, 15 nt, Homo sapiens
cauaaaagagcccau

SEQ ID NO: 2133723 - RNA, 13 nt, Homo sapiens
aaaacacuuuccc

SEQ ID NO: 2133724 - RNA, 13 nt, Homo sapiens
uucauacuaaacu

SEQ ID NO: 2133725 - RNA, 12 nt, Homo sapiens
aguccaguuuau

SEQ ID NO: 2133726 - RNA, 16 nt, Homo sapiens
guaacacaugaacauu

SEQ ID NO: 2133727 - RNA, 14 nt, Homo sapiens
auaucgcugaugca

SEQ ID NO: 2133728 - RNA, 15 nt, Homo sapiens
aucaguugcagauag

SEQ ID NO: 2133729 - RNA, 16 nt, Homo sapiens
agaguuaaucaacuga

SEQ ID NO: 2133730 - RNA, 17 nt, Homo sapiens
aaguuaaacuuuaucuc

SEQ ID NO: 2133731 - RNA, 17 nt, Homo sapiens
uguacagaccaccuuuc

SEQ ID NO: 2133732 - RNA, 13 nt, Homo sapiens
uuguuaugaugug

SEQ ID NO: 2133733 - RNA, 15 nt, Homo sapiens
cugggggcugcaguu

SEQ ID NO: 2133734 - RNA, 13 nt, Homo sapiens
uaaucaguauaca

SEQ ID NO: 2133735 - RNA, 23 nt, Homo sapiens
ugauuauugcuucuuuccuugca

SEQ ID NO: 2133736 - RNA, 21 nt, Homo sapiens
gcacauagugaaagauuacuu

SEQ ID NO: 2133737 - RNA, 20 nt, Homo sapiens
auuaaaauagcauacugugu

SEQ ID NO: 2133738 - RNA, 19 nt, Homo sapiens
cagccucacugcaucuuuc

SEQ ID NO: 2133739 - RNA, 19 nt, Homo sapiens
uagcagaguuaaaucucaa

SEQ ID NO: 2133740 - RNA, 12 nt, Homo sapiens
cucugacagucc

SEQ ID NO: 2133741 - RNA, 18 nt, Homo sapiens
uuuuagggagaacgggaa

SEQ ID NO: 2133742 - RNA, 15 nt, Homo sapiens
ucuguaaaugaacac

SEQ ID NO: 2133743 - RNA, 19 nt, Homo sapiens
gcaaaauuuuuuuaaucuu

SEQ ID NO: 2133744 - RNA, 19 nt, Homo sapiens
caacuucuguuucuucucu

SEQ ID NO: 2133745 - RNA, 19 nt, Homo sapiens
cuguuuauuaaaguacaac

SEQ ID NO: 2133746 - RNA, 17 nt, Homo sapiens
cucgaacuaaaagccuu

SEQ ID NO: 2133747 - RNA, 10 nt, Homo sapiens
aucauuuaga

SEQ ID NO: 2133748 - RNA, 19 nt, Homo sapiens
gaggagcagaccagcacuu

SEQ ID NO: 2133749 - RNA, 18 nt, Homo sapiens
uuaacaaauuaaagaaua

SEQ ID NO: 2133750 - RNA, 23 nt, Homo sapiens
aaaugggaauuuauaacccagug

SEQ ID NO: 2133751 - RNA, 21 nt, Homo sapiens
gauggcauuuuuugcaaguua

SEQ ID NO: 2133752 - RNA, 12 nt, Homo sapiens
ucagucuugccu

SEQ ID NO: 2133753 - RNA, 15 nt, Homo sapiens
agacuauugagauau

SEQ ID NO: 2133754 - RNA, 23 nt, Homo sapiens
cuaguuaaucauagguuugauau

SEQ ID NO: 2133755 - RNA, 14 nt, Homo sapiens
aucaacauuccagg

SEQ ID NO: 2133756 - RNA, 23 nt, Homo sapiens
aagguaacaagaguauguggcaa

SEQ ID NO: 2133757 - RNA, 17 nt, Homo sapiens
uagcaguccccagugau

SEQ ID NO: 2133758 - RNA, 15 nt, Homo sapiens
auguaaaacaagaaa

SEQ ID NO: 2133759 - RNA, 17 nt, Homo sapiens
gcagagccugacgcuca

SEQ ID NO: 2133760 - RNA, 13 nt, Homo sapiens
augguugccaagc

SEQ ID NO: 2133761 - RNA, 15 nt, Homo sapiens
guacagcugcucuua

SEQ ID NO: 2133762 - RNA, 14 nt, Homo sapiens
agagaaaacacuuu

SEQ ID NO: 2133763 - RNA, 14 nt, Homo sapiens
cauagacaauuccu

SEQ ID NO: 2133764 - RNA, 22 nt, Homo sapiens
auacugagugccugcagcaucu

SEQ ID NO: 2133765 - RNA, 21 nt, Homo sapiens
cuggcaugggaaugaauguca

SEQ ID NO: 2133766 - RNA, 22 nt, Homo sapiens
agacacgauugagaacugacaa

SEQ ID NO: 2133767 - RNA, 18 nt, Homo sapiens
agugaauuuggucucucc

SEQ ID NO: 2133768 - RNA, 18 nt, Homo sapiens
cuuaaauauuuccaucag

SEQ ID NO: 2133769 - RNA, 19 nt, Homo sapiens
aggauaauaaacaauuuug

SEQ ID NO: 2133770 - RNA, 17 nt, Homo sapiens
gacaaguggucugggac

SEQ ID NO: 2133771 - RNA, 18 nt, Homo sapiens
auccugucuuuaaggaaa

SEQ ID NO: 2133772 - RNA, 17 nt, Homo sapiens
guagaugacauggugaa

SEQ ID NO: 2133773 - RNA, 14 nt, Homo sapiens
gaagcucaacuguu

SEQ ID NO: 2133774 - RNA, 20 nt, Homo sapiens
uauacugguucacauccuac

SEQ ID NO: 2133775 - RNA, 15 nt, Homo sapiens
ccaggcugugcagcg

SEQ ID NO: 2133776 - RNA, 18 nt, Homo sapiens
cccgaggacaguggcaga

SEQ ID NO: 2133777 - RNA, 15 nt, Homo sapiens
acaucaggaguucaa

SEQ ID NO: 2133778 - RNA, 12 nt, Homo sapiens
agaaagaaggcu

SEQ ID NO: 2133779 - RNA, 19 nt, Homo sapiens
gcugccuuuggacuugucc

SEQ ID NO: 2133780 - RNA, 18 nt, Homo sapiens
cacaaagcucaagaugac

SEQ ID NO: 2133781 - RNA, 18 nt, Homo sapiens
gagaagaaagaaccaacc

SEQ ID NO: 2133782 - RNA, 22 nt, Homo sapiens
ugccccccuccuuuccaaauaa

SEQ ID NO: 2133783 - RNA, 19 nt, Homo sapiens
cuuagaagccaugggaccu

SEQ ID NO: 2133784 - RNA, 13 nt, Homo sapiens
aguuuuaccucuu

SEQ ID NO: 2133785 - RNA, 13 nt, Homo sapiens
uccuucgcacacu

SEQ ID NO: 2133786 - RNA, 16 nt, Homo sapiens
aaguaacaaaugugca

SEQ ID NO: 2133787 - RNA, 13 nt, Homo sapiens
gcagaucaccuga

SEQ ID NO: 2133788 - RNA, 18 nt, Homo sapiens
caaugccuacagcugucu

SEQ ID NO: 2133789 - RNA, 16 nt, Homo sapiens
cuuggaauacguucuc

SEQ ID NO: 2133790 - RNA, 13 nt, Homo sapiens
acucagaaggcaa

SEQ ID NO: 2133791 - RNA, 19 nt, Homo sapiens
cauaggaaguauggcauga

SEQ ID NO: 2133792 - RNA, 11 nt, Homo sapiens
ggaauugccag

SEQ ID NO: 2133793 - RNA, 15 nt, Homo sapiens
ugauuuuagcauauu

SEQ ID NO: 2133794 - RNA, 16 nt, Homo sapiens
ccagacaggcucaggu

SEQ ID NO: 2133795 - RNA, 22 nt, Homo sapiens
accuggguuccagcaauucucc

SEQ ID NO: 2133796 - RNA, 16 nt, Homo sapiens
ugagucaaaagccugg

SEQ ID NO: 2133797 - RNA, 18 nt, Homo sapiens
ccuggauaguuaagggcu

SEQ ID NO: 2133798 - RNA, 18 nt, Homo sapiens
ucuggaguugcugaaugu

SEQ ID NO: 2133799 - RNA, 18 nt, Homo sapiens
ccuuuuuuuacauuucau

SEQ ID NO: 2133800 - RNA, 12 nt, Homo sapiens
cagaugcaauug

SEQ ID NO: 2133801 - RNA, 16 nt, Homo sapiens
uaaaguaccacacaua

SEQ ID NO: 2133802 - RNA, 18 nt, Homo sapiens
caauccagcgguucucaa

SEQ ID NO: 2133803 - RNA, 22 nt, Homo sapiens
gagccaccacauccagccuaac

SEQ ID NO: 2133804 - RNA, 20 nt, Homo sapiens
gcaacccagggcaaauggaa

SEQ ID NO: 2133805 - RNA, 14 nt, Homo sapiens
uuguccccaugcaa

SEQ ID NO: 2133806 - RNA, 14 nt, Homo sapiens
accccugucccaac

SEQ ID NO: 2133807 - RNA, 16 nt, Homo sapiens
acccacaagugucuaa

SEQ ID NO: 2133808 - RNA, 23 nt, Homo sapiens
cacuacauaauugcuguucugcu

SEQ ID NO: 2133809 - RNA, 22 nt, Homo sapiens
aaugccuggaggguaacugggg

SEQ ID NO: 2133810 - RNA, 15 nt, Homo sapiens
ccagcacccugcaaa

SEQ ID NO: 2133811 - RNA, 20 nt, Homo sapiens
gaccugcuuugagauuuccu

SEQ ID NO: 2133812 - RNA, 23 nt, Homo sapiens
gucacaggacgauuucacugaca

SEQ ID NO: 2133813 - RNA, 23 nt, Homo sapiens
acaguagagcacuuuucacuuau

SEQ ID NO: 2133814 - RNA, 15 nt, Homo sapiens
cuucugccccggagc

SEQ ID NO: 2133815 - RNA, 12 nt, Homo sapiens
aaaaagcaacac

SEQ ID NO: 2133816 - RNA, 14 nt, Homo sapiens
aaggaaaaaauaau

SEQ ID NO: 2133817 - RNA, 17 nt, Homo sapiens
aguugccguugaggguu

SEQ ID NO: 2133818 - RNA, 17 nt, Homo sapiens
acuguucgaguagcuca

SEQ ID NO: 2133819 - RNA, 23 nt, Homo sapiens
uggaaaaacaggaaaggagcaau

SEQ ID NO: 2133820 - RNA, 13 nt, Homo sapiens
uaaaaacuuguac

SEQ ID NO: 2133821 - RNA, 20 nt, Homo sapiens
aaggcugugccaucagcucc

SEQ ID NO: 2133822 - RNA, 19 nt, Homo sapiens
auaauaccccaacagauga

SEQ ID NO: 2133823 - RNA, 21 nt, Homo sapiens
acagaccagcauaguucugca

SEQ ID NO: 2133824 - RNA, 13 nt, Homo sapiens
gguuggauguccu

SEQ ID NO: 2133825 - RNA, 20 nt, Homo sapiens
agucuugggucuaugccuug

SEQ ID NO: 2133826 - RNA, 23 nt, Homo sapiens
ccucacagaagcugcuuaaccca

SEQ ID NO: 2133827 - RNA, 17 nt, Homo sapiens
uauuuugccaagggcau

SEQ ID NO: 2133828 - RNA, 16 nt, Homo sapiens
ucuuaaggaaauggug

SEQ ID NO: 2133829 - RNA, 13 nt, Homo sapiens
uggguuauuucaa

SEQ ID NO: 2133830 - RNA, 14 nt, Homo sapiens
acaauaaucucacu

SEQ ID NO: 2133831 - RNA, 16 nt, Homo sapiens
gacaagaagacuguca

SEQ ID NO: 2133832 - RNA, 17 nt, Homo sapiens
cauccaguucaugagaa

SEQ ID NO: 2133833 - RNA, 14 nt, Homo sapiens
ugcagagaugacug

SEQ ID NO: 2133834 - RNA, 21 nt, Homo sapiens
agggauaugugaaacaauguu

SEQ ID NO: 2133835 - RNA, 14 nt, Homo sapiens
aucacgacaggaaa

SEQ ID NO: 2133836 - RNA, 16 nt, Homo sapiens
ucauauuugucuuuga

SEQ ID NO: 2133837 - RNA, 23 nt, Homo sapiens
gccucaaaacagaagcagcuucu

SEQ ID NO: 2133838 - RNA, 19 nt, Homo sapiens
gcuggguggcccauccccc

SEQ ID NO: 2133839 - RNA, 13 nt, Homo sapiens
cagacuuaaauca

SEQ ID NO: 2133840 - RNA, 10 nt, Homo sapiens
gcaccaccuc

SEQ ID NO: 2133841 - RNA, 14 nt, Homo sapiens
uucucugcagucaa

SEQ ID NO: 2133842 - RNA, 17 nt, Homo sapiens
augcuaccggggaccgg

SEQ ID NO: 2133843 - RNA, 22 nt, Homo sapiens
uguagcagcuauauauuucccc

SEQ ID NO: 2133844 - RNA, 22 nt, Homo sapiens
cacucucuaccagauaacugag

SEQ ID NO: 2133845 - RNA, 18 nt, Homo sapiens
gccuggccaacaugguga

SEQ ID NO: 2133846 - RNA, 15 nt, Homo sapiens
ugguaaaaacugcag

SEQ ID NO: 2133847 - RNA, 20 nt, Homo sapiens
auaaauacuugccugugaca

SEQ ID NO: 2133848 - RNA, 15 nt, Homo sapiens
acuuugcagcuaaaa

SEQ ID NO: 2133849 - RNA, 16 nt, Homo sapiens
caccuuaguggcuuuu

SEQ ID NO: 2133850 - RNA, 13 nt, Homo sapiens
ugcucuguaaaac

SEQ ID NO: 2133851 - RNA, 18 nt, Homo sapiens
ugugacaacaugcaagaa

SEQ ID NO: 2133852 - RNA, 19 nt, Homo sapiens
gcuaucacuguacuuguag

SEQ ID NO: 2133853 - RNA, 16 nt, Homo sapiens
caagaccuaacuccug

SEQ ID NO: 2133854 - RNA, 19 nt, Homo sapiens
ugcuguggaaugugcauuc

SEQ ID NO: 2133855 - RNA, 12 nt, Homo sapiens
aaacacagagaa

SEQ ID NO: 2133856 - RNA, 13 nt, Homo sapiens
cuccuuguguuac

SEQ ID NO: 2133857 - RNA, 17 nt, Homo sapiens
uuccugaaaagauccua

SEQ ID NO: 2133858 - RNA, 21 nt, Homo sapiens
uuuuuguuuacaaacauggaa

SEQ ID NO: 2133859 - RNA, 15 nt, Homo sapiens
aauguguucuuaacu

SEQ ID NO: 2133860 - RNA, 18 nt, Homo sapiens
uuacauguuguaagcaug

SEQ ID NO: 2133861 - RNA, 13 nt, Homo sapiens
aacaagucuauaa

SEQ ID NO: 2133862 - RNA, 23 nt, Homo sapiens
aaauaaggccucauccuccacug

SEQ ID NO: 2133863 - RNA, 15 nt, Homo sapiens
ucucuuccucugcag

SEQ ID NO: 2133864 - RNA, 14 nt, Homo sapiens
aauaagacaagaga

SEQ ID NO: 2133865 - RNA, 15 nt, Homo sapiens
cacugccagugcaga

SEQ ID NO: 2133866 - RNA, 14 nt, Homo sapiens
cucuagugggacag

SEQ ID NO: 2133867 - RNA, 15 nt, Homo sapiens
ccacacguuugccaa

SEQ ID NO: 2133868 - RNA, 19 nt, Homo sapiens
gagcacuguguaaccagca

SEQ ID NO: 2133869 - RNA, 16 nt, Homo sapiens
ucuucugggaacuucc

SEQ ID NO: 2133870 - RNA, 18 nt, Homo sapiens
ugcuucaaccccaugaga

SEQ ID NO: 2133871 - RNA, 11 nt, Homo sapiens
caguacaugac

SEQ ID NO: 2133872 - RNA, 14 nt, Homo sapiens
uaauugcuuugcca

SEQ ID NO: 2133873 - RNA, 22 nt, Homo sapiens
ggaauacuucaccuuuccucuc

SEQ ID NO: 2133874 - RNA, 18 nt, Homo sapiens
ccgaacuuuaauuucagg

SEQ ID NO: 2133875 - RNA, 18 nt, Homo sapiens
agcccagaaagucucuca

SEQ ID NO: 2133876 - RNA, 13 nt, Homo sapiens
cuacaaguuuaag

SEQ ID NO: 2133877 - RNA, 13 nt, Homo sapiens
gagucaugaugaa

SEQ ID NO: 2133878 - RNA, 17 nt, Homo sapiens
cuggagaugcugccugg

SEQ ID NO: 2133879 - RNA, 15 nt, Homo sapiens
uaaaccaaacagaca

SEQ ID NO: 2133880 - RNA, 15 nt, Homo sapiens
auagcaaacacuggg

SEQ ID NO: 2133881 - RNA, 21 nt, Homo sapiens
uuuucagaaacucaucggaaa

SEQ ID NO: 2133882 - RNA, 23 nt, Homo sapiens
auuagauuucuauaggauuuuuc

SEQ ID NO: 2133883 - RNA, 16 nt, Homo sapiens
caaggcuacgcugaca

SEQ ID NO: 2133884 - RNA, 23 nt, Homo sapiens
aacaauguuucuucaguggcaaa

SEQ ID NO: 2133885 - RNA, 16 nt, Homo sapiens
uaaacugaaaauggac

SEQ ID NO: 2133886 - RNA, 19 nt, Homo sapiens
aggauggaugcaucacacu

SEQ ID NO: 2133887 - RNA, 22 nt, Homo sapiens
cgacugccugugaaguggaugg

SEQ ID NO: 2133888 - RNA, 22 nt, Homo sapiens
accagaaguuaaaccaugugac

SEQ ID NO: 2133889 - RNA, 13 nt, Homo sapiens
gaugcaugagcuc

SEQ ID NO: 2133890 - RNA, 15 nt, Homo sapiens
uccaaucugugauga

SEQ ID NO: 2133891 - RNA, 14 nt, Homo sapiens
gaaggcuucuugcu

SEQ ID NO: 2133892 - RNA, 20 nt, Homo sapiens
cacacccgccgccuccugca

SEQ ID NO: 2133893 - RNA, 17 nt, Homo sapiens
acgagguggcagucgca

SEQ ID NO: 2133894 - RNA, 18 nt, Homo sapiens
cugcacagcuuacacugu

SEQ ID NO: 2133895 - RNA, 12 nt, Homo sapiens
uuggcccaggau

SEQ ID NO: 2133896 - RNA, 22 nt, Homo sapiens
uuuugcauguaugacuuaauaa

SEQ ID NO: 2133897 - RNA, 20 nt, Homo sapiens
aguucccuuuuuauuugcag

SEQ ID NO: 2133898 - RNA, 23 nt, Homo sapiens
cuggaaaagggucuugggaaaua

SEQ ID NO: 2133899 - RNA, 12 nt, Homo sapiens
gcuccucacuca

SEQ ID NO: 2133900 - RNA, 21 nt, Homo sapiens
ggcucugagagccccaggacu

SEQ ID NO: 2133901 - RNA, 19 nt, Homo sapiens
ugccuccucccuggcugca

SEQ ID NO: 2133902 - RNA, 17 nt, Homo sapiens
auguaaauacucaugaa

SEQ ID NO: 2133903 - RNA, 16 nt, Homo sapiens
uucagugauguggggu

SEQ ID NO: 2133904 - RNA, 16 nt, Homo sapiens
gauagaagauguuugc

SEQ ID NO: 2133905 - RNA, 13 nt, Homo sapiens
ggcugucagccca

SEQ ID NO: 2133906 - RNA, 13 nt, Homo sapiens
aguccagauuuac

SEQ ID NO: 2133907 - RNA, 23 nt, Homo sapiens
cuaguaauugccuagaaauaucu

SEQ ID NO: 2133908 - RNA, 18 nt, Homo sapiens
ccgagcuagagugcagug

SEQ ID NO: 2133909 - RNA, 17 nt, Homo sapiens
aaaaauaaguacauaua

SEQ ID NO: 2133910 - RNA, 21 nt, Homo sapiens
uaaaucugcuuuucauguuga

SEQ ID NO: 2133911 - RNA, 16 nt, Homo sapiens
augccaaacacuagcu

SEQ ID NO: 2133912 - RNA, 21 nt, Homo sapiens
aaaauagagaucuuaugucaa

SEQ ID NO: 2133913 - RNA, 21 nt, Homo sapiens
gcuccuuucuccagccagcaa

SEQ ID NO: 2133914 - RNA, 12 nt, Homo sapiens
aucuccaaggac

SEQ ID NO: 2133915 - RNA, 21 nt, Homo sapiens
cugcauggacgccuggcucca

SEQ ID NO: 2133916 - RNA, 18 nt, Homo sapiens
ccauuauuuuauuuuaua

SEQ ID NO: 2133917 - RNA, 22 nt, Homo sapiens
uaggaagugcccucgagcacug

SEQ ID NO: 2133918 - RNA, 18 nt, Homo sapiens
cuuuaggcagcagcuuuu

SEQ ID NO: 2133919 - RNA, 17 nt, Homo sapiens
gccaagggggugacugg

SEQ ID NO: 2133920 - RNA, 19 nt, Homo sapiens
cacauuuuaacauaggcaa

SEQ ID NO: 2133921 - RNA, 17 nt, Homo sapiens
ucuugguuucagccaag

SEQ ID NO: 2133922 - RNA, 15 nt, Homo sapiens
gcuugugcacuggau

SEQ ID NO: 2133923 - RNA, 22 nt, Homo sapiens
aagcuguggugugaaaauguau

SEQ ID NO: 2133924 - RNA, 19 nt, Homo sapiens
aucuaggaagacuuuggaa

SEQ ID NO: 2133925 - RNA, 17 nt, Homo sapiens
gguaaaacucacuguga

SEQ ID NO: 2133926 - RNA, 22 nt, Homo sapiens
auguuuucucuggaguauucua

SEQ ID NO: 2133927 - RNA, 20 nt, Homo sapiens
acacauuucugccacguggu

SEQ ID NO: 2133928 - RNA, 14 nt, Homo sapiens
uugaugaagcacau

SEQ ID NO: 2133929 - RNA, 18 nt, Homo sapiens
aagcaguauauauucuuu

SEQ ID NO: 2133930 - RNA, 16 nt, Homo sapiens
cacagguucaugccac

SEQ ID NO: 2133931 - RNA, 20 nt, Homo sapiens
gauaugguucuuauucacug

SEQ ID NO: 2133932 - RNA, 18 nt, Homo sapiens
uucagaagaaaaagaagc

SEQ ID NO: 2133933 - RNA, 13 nt, Homo sapiens
cugauucaagaaa

SEQ ID NO: 2133934 - RNA, 17 nt, Homo sapiens
cagcagcaccugcccua

SEQ ID NO: 2133935 - RNA, 14 nt, Homo sapiens
accuaguaugcuca

SEQ ID NO: 2133936 - RNA, 18 nt, Homo sapiens
cccucaugcuguuccacc

SEQ ID NO: 2133937 - RNA, 16 nt, Homo sapiens
cugcacuggggccacc

SEQ ID NO: 2133938 - RNA, 17 nt, Homo sapiens
agccacaggcacugugu

SEQ ID NO: 2133939 - RNA, 18 nt, Homo sapiens
caacuggcuacugaguca

SEQ ID NO: 2133940 - RNA, 14 nt, Homo sapiens
cagagugcuuuaaa

SEQ ID NO: 2133941 - RNA, 18 nt, Homo sapiens
aggccaagaauauugcaa

SEQ ID NO: 2133942 - RNA, 16 nt, Homo sapiens
gccguccggcggcccc

SEQ ID NO: 2133943 - RNA, 20 nt, Homo sapiens
caggaugucccugaaacuuc

SEQ ID NO: 2133944 - RNA, 19 nt, Homo sapiens
gugaccgcaaguucugcac

SEQ ID NO: 2133945 - RNA, 16 nt, Homo sapiens
aaaucauggaauuuau

SEQ ID NO: 2133946 - RNA, 17 nt, Homo sapiens
ugccagggccaugucag

SEQ ID NO: 2133947 - RNA, 14 nt, Homo sapiens
aggucaugccacug

SEQ ID NO: 2133948 - RNA, 20 nt, Homo sapiens
aauauaaauauccccaggga

SEQ ID NO: 2133949 - RNA, 22 nt, Homo sapiens
aggauuacacauuucacuguga

SEQ ID NO: 2133950 - RNA, 21 nt, Homo sapiens
cagaucugguuucuaagaguu

SEQ ID NO: 2133951 - RNA, 15 nt, Homo sapiens
caaugaaccacaaaa

SEQ ID NO: 2133952 - RNA, 14 nt, Homo sapiens
aguggccuggccag

SEQ ID NO: 2133953 - RNA, 19 nt, Homo sapiens
caauucuccuguugcaaug

SEQ ID NO: 2133954 - RNA, 18 nt, Homo sapiens
cagaagcaguugcaauaa

SEQ ID NO: 2133955 - RNA, 16 nt, Homo sapiens
cagaauuggaaaagac

SEQ ID NO: 2133956 - RNA, 15 nt, Homo sapiens
ggcagccauggccau

SEQ ID NO: 2133957 - RNA, 18 nt, Homo sapiens
cagcucagcagacaucca

SEQ ID NO: 2133958 - RNA, 16 nt, Homo sapiens
agccuggccccugugc

SEQ ID NO: 2133959 - RNA, 17 nt, Homo sapiens
ccaggccugagcugcuu

SEQ ID NO: 2133960 - RNA, 19 nt, Homo sapiens
auauuucaagcucauguca

SEQ ID NO: 2133961 - RNA, 23 nt, Homo sapiens
uaaacaaauguaugauuacauca

SEQ ID NO: 2133962 - RNA, 19 nt, Homo sapiens
ggagcauuggggauguuuu

SEQ ID NO: 2133963 - RNA, 14 nt, Homo sapiens
augugugaggagcu

SEQ ID NO: 2133964 - RNA, 12 nt, Homo sapiens
aguaauaccucu

SEQ ID NO: 2133965 - RNA, 15 nt, Homo sapiens
gcuucaugugacaca

SEQ ID NO: 2133966 - RNA, 11 nt, Homo sapiens
cucccuuuacc

SEQ ID NO: 2133967 - RNA, 20 nt, Homo sapiens
aacuccugaccucaggugau

SEQ ID NO: 2133968 - RNA, 22 nt, Homo sapiens
caagcacaaaaacuuaacaaaa

SEQ ID NO: 2133969 - RNA, 16 nt, Homo sapiens
guuucuggaauugaua

SEQ ID NO: 2133970 - RNA, 15 nt, Homo sapiens
cuccccuacaucaaa

SEQ ID NO: 2133971 - RNA, 15 nt, Homo sapiens
cucuaauacauucca

SEQ ID NO: 2133972 - RNA, 20 nt, Homo sapiens
acauuccucaaaaugggaga

SEQ ID NO: 2133973 - RNA, 15 nt, Homo sapiens
ugagacaucuugccu

SEQ ID NO: 2133974 - RNA, 21 nt, Homo sapiens
acagugguauugcuaguuuaa

SEQ ID NO: 2133975 - RNA, 23 nt, Homo sapiens
uacagaaguccccucuacuuuaa

SEQ ID NO: 2133976 - RNA, 22 nt, Homo sapiens
ucaggaugaaguaacuaguguu

SEQ ID NO: 2133977 - RNA, 17 nt, Homo sapiens
ugcagauagccagacac

SEQ ID NO: 2133978 - RNA, 15 nt, Homo sapiens
agaugggacaagcag

SEQ ID NO: 2133979 - RNA, 13 nt, Homo sapiens
cauaaucauguaa

SEQ ID NO: 2133980 - RNA, 13 nt, Homo sapiens
cacugucaugcug

SEQ ID NO: 2133981 - RNA, 18 nt, Homo sapiens
gauguuccaccugccaca

SEQ ID NO: 2133982 - RNA, 17 nt, Homo sapiens
agaccuuuggagcaaag

SEQ ID NO: 2133983 - RNA, 14 nt, Homo sapiens
uacaaauaucuaua

SEQ ID NO: 2133984 - RNA, 14 nt, Homo sapiens
aauucccaccacua

SEQ ID NO: 2133985 - RNA, 14 nt, Homo sapiens
gacacucuccuugc

SEQ ID NO: 2133986 - RNA, 20 nt, Homo sapiens
uaugugaucauguguggaag

SEQ ID NO: 2133987 - RNA, 22 nt, Homo sapiens
aguccuuuugaauuaaacucga

SEQ ID NO: 2133988 - RNA, 18 nt, Homo sapiens
ugaaauuggaagacuugg

SEQ ID NO: 2133989 - RNA, 22 nt, Homo sapiens
ccugacucugugcugagcacag

SEQ ID NO: 2133990 - RNA, 20 nt, Homo sapiens
ucaccugcacagggcccucu

SEQ ID NO: 2133991 - RNA, 20 nt, Homo sapiens
gugcaguggcaccaucucag

SEQ ID NO: 2133992 - RNA, 14 nt, Homo sapiens
acaggagcaucucc

SEQ ID NO: 2133993 - RNA, 14 nt, Homo sapiens
auaauuaacacuua

SEQ ID NO: 2133994 - RNA, 14 nt, Homo sapiens
gugagcaucaucuu

SEQ ID NO: 2133995 - RNA, 13 nt, Homo sapiens
ucuuuucuuucaa

SEQ ID NO: 2133996 - RNA, 14 nt, Homo sapiens
uuuaaguacuugag

SEQ ID NO: 2133997 - RNA, 14 nt, Homo sapiens
cauguguauauaug

SEQ ID NO: 2133998 - RNA, 21 nt, Homo sapiens
cuucuaagaggauacaaauuu

SEQ ID NO: 2133999 - RNA, 13 nt, Homo sapiens
gacuucucuuaca

SEQ ID NO: 2134000 - RNA, 13 nt, Homo sapiens
cccuuguacaacc

SEQ ID NO: 2134001 - RNA, 17 nt, Homo sapiens
accucgaggucugcaca

SEQ ID NO: 2134002 - RNA, 18 nt, Homo sapiens
gaaauguuuucacuuuug

SEQ ID NO: 2134003 - RNA, 15 nt, Homo sapiens
uaggcugcugcugug

SEQ ID NO: 2134004 - RNA, 17 nt, Homo sapiens
ccucuaacaacaaauua

SEQ ID NO: 2134005 - RNA, 18 nt, Homo sapiens
caggaagaccccagcaca

SEQ ID NO: 2134006 - RNA, 12 nt, Homo sapiens
aagaaaaugccu

SEQ ID NO: 2134007 - RNA, 16 nt, Homo sapiens
cugccacauccagcuu

SEQ ID NO: 2134008 - RNA, 15 nt, Homo sapiens
cacaagaaugugcag

SEQ ID NO: 2134009 - RNA, 15 nt, Homo sapiens
uuaauuuucaguaua

SEQ ID NO: 2134010 - RNA, 24 nt, Homo sapiens
gaaauuugcaacucacugauucuc

SEQ ID NO: 2134011 - RNA, 21 nt, Homo sapiens
ucuccaauuggguugugaaau

SEQ ID NO: 2134012 - RNA, 22 nt, Homo sapiens
guuuuucuauuaaaagacucau

SEQ ID NO: 2134013 - RNA, 14 nt, Homo sapiens
agccggcacagggu

SEQ ID NO: 2134014 - RNA, 17 nt, Homo sapiens
ugaaaaggaaguuaaua

SEQ ID NO: 2134015 - RNA, 16 nt, Homo sapiens
agcucaugguagaaaa

SEQ ID NO: 2134016 - RNA, 14 nt, Homo sapiens
agcauggcugccaa

SEQ ID NO: 2134017 - RNA, 21 nt, Homo sapiens
ggcaacaagagugaaacucca

SEQ ID NO: 2134018 - RNA, 16 nt, Homo sapiens
ucugguaggaggcaaa

SEQ ID NO: 2134019 - RNA, 22 nt, Homo sapiens
uaaaaacagaaggaaauugaga

SEQ ID NO: 2134020 - RNA, 21 nt, Homo sapiens
uuuuuugcuguuccaccaaau

SEQ ID NO: 2134021 - RNA, 19 nt, Homo sapiens
acgugggccucacauucca

SEQ ID NO: 2134022 - RNA, 21 nt, Homo sapiens
cuuggcuugccugguggggga

SEQ ID NO: 2134023 - RNA, 18 nt, Homo sapiens
auguaaagucaucaucaa

SEQ ID NO: 2134024 - RNA, 21 nt, Homo sapiens
uggaguauagugcaaauucau

SEQ ID NO: 2134025 - RNA, 19 nt, Homo sapiens
aaacaucuccccucucacc

SEQ ID NO: 2134026 - RNA, 21 nt, Homo sapiens
gggaaauucugcugcuugaaa

SEQ ID NO: 2134027 - RNA, 17 nt, Homo sapiens
agcccaacagcacuuuu

SEQ ID NO: 2134028 - RNA, 20 nt, Homo sapiens
ggccagggucucgucaggag

SEQ ID NO: 2134029 - RNA, 23 nt, Homo sapiens
gaaaagaaaacauuuaacauaau

SEQ ID NO: 2134030 - RNA, 21 nt, Homo sapiens
ucucucccugcuuugcuguga

SEQ ID NO: 2134031 - RNA, 17 nt, Homo sapiens
agaaaucagcacauucc

SEQ ID NO: 2134032 - RNA, 19 nt, Homo sapiens
aggcccaggucaacaucua

SEQ ID NO: 2134033 - RNA, 17 nt, Homo sapiens
uugauuuguacagauuc

SEQ ID NO: 2134034 - RNA, 21 nt, Homo sapiens
uggccagcccuggaggguuga

SEQ ID NO: 2134035 - RNA, 22 nt, Homo sapiens
uccucacgcagacacacccaca

SEQ ID NO: 2134036 - RNA, 13 nt, Homo sapiens
aguucauaccuaa

SEQ ID NO: 2134037 - RNA, 20 nt, Homo sapiens
agggaaugggucugcacaga

SEQ ID NO: 2134038 - RNA, 20 nt, Homo sapiens
uggugcgcccugucucugug

SEQ ID NO: 2134039 - RNA, 22 nt, Homo sapiens
uuacuaaauuacaaaugcaauu

SEQ ID NO: 2134040 - RNA, 22 nt, Homo sapiens
guaaauauauuucaaaacuuca

SEQ ID NO: 2134041 - RNA, 16 nt, Homo sapiens
gcccaaggcacugaga

SEQ ID NO: 2134042 - RNA, 16 nt, Homo sapiens
gccacuuugacucaga

SEQ ID NO: 2134043 - RNA, 22 nt, Homo sapiens
gcugccaagccccauccugccg

SEQ ID NO: 2134044 - RNA, 22 nt, Homo sapiens
ucuuguaagucaucuacuuaau

SEQ ID NO: 2134045 - RNA, 14 nt, Homo sapiens
gcacacaacugugg

SEQ ID NO: 2134046 - RNA, 15 nt, Homo sapiens
acuuaaaauaucucu

SEQ ID NO: 2134047 - RNA, 12 nt, Homo sapiens
agaaaugauuca

SEQ ID NO: 2134048 - RNA, 18 nt, Homo sapiens
gguagguggcacacuggg

SEQ ID NO: 2134049 - RNA, 15 nt, Homo sapiens
aauaaagcacaaaac

SEQ ID NO: 2134050 - RNA, 19 nt, Homo sapiens
gcauccuguguaaauggaa

SEQ ID NO: 2134051 - RNA, 19 nt, Homo sapiens
uuccucgaaguucuaggaa

SEQ ID NO: 2134052 - RNA, 22 nt, Homo sapiens
cuugcagcggcuccugcaaaag

SEQ ID NO: 2134053 - RNA, 15 nt, Homo sapiens
aaagaaucagucuug

SEQ ID NO: 2134054 - RNA, 20 nt, Homo sapiens
auaccauggcacugacaaug

SEQ ID NO: 2134055 - RNA, 19 nt, Homo sapiens
ucauucauuggugaaguaa

SEQ ID NO: 2134056 - RNA, 19 nt, Homo sapiens
augaucaguccaacugaac

SEQ ID NO: 2134057 - RNA, 15 nt, Homo sapiens
aaugaugcugucuga

SEQ ID NO: 2134058 - RNA, 15 nt, Homo sapiens
uguagcaauauauca

SEQ ID NO: 2134059 - RNA, 15 nt, Homo sapiens
agcuugaaaacugga

SEQ ID NO: 2134060 - RNA, 20 nt, Homo sapiens
ugucacagaugaagacauca

SEQ ID NO: 2134061 - RNA, 22 nt, Homo sapiens
agguucuucagaagucacacau

SEQ ID NO: 2134062 - RNA, 19 nt, Homo sapiens
agaaccaaaaagaggcuau

SEQ ID NO: 2134063 - RNA, 13 nt, Homo sapiens
cagggaagaaggu

SEQ ID NO: 2134064 - RNA, 20 nt, Homo sapiens
uucucccuggggaugugcuu

SEQ ID NO: 2134065 - RNA, 21 nt, Homo sapiens
uugcucagagugaagagugaa

SEQ ID NO: 2134066 - RNA, 17 nt, Homo sapiens
uaugauucugcuuuuac

SEQ ID NO: 2134067 - RNA, 18 nt, Homo sapiens
auucuccagaaaaaucaa

SEQ ID NO: 2134068 - RNA, 16 nt, Homo sapiens
uacuucgaugaugaug

SEQ ID NO: 2134069 - RNA, 16 nt, Homo sapiens
augucauuuccuucaa

SEQ ID NO: 2134070 - RNA, 21 nt, Homo sapiens
gccuuaggaaaagcauuugcu

SEQ ID NO: 2134071 - RNA, 17 nt, Homo sapiens
uuggugcuuuccagaau

SEQ ID NO: 2134072 - RNA, 16 nt, Homo sapiens
cggacacuucucagga

SEQ ID NO: 2134073 - RNA, 19 nt, Homo sapiens
gucagaaacucgaugaaug

SEQ ID NO: 2134074 - RNA, 18 nt, Homo sapiens
gucuagagcagacccagc

SEQ ID NO: 2134075 - RNA, 20 nt, Homo sapiens
aaguugaagcuaagauuuag

SEQ ID NO: 2134076 - RNA, 20 nt, Homo sapiens
guagcucuguccacucugaa

SEQ ID NO: 2134077 - RNA, 17 nt, Homo sapiens
gcauugaauacucugaa

SEQ ID NO: 2134078 - RNA, 13 nt, Homo sapiens
caggcagugcagu

SEQ ID NO: 2134079 - RNA, 19 nt, Homo sapiens
aaaauuagagaucaugaau

SEQ ID NO: 2134080 - RNA, 16 nt, Homo sapiens
ugaguagccagaugaa

SEQ ID NO: 2134081 - RNA, 16 nt, Homo sapiens
cuucucaccccaggau

SEQ ID NO: 2134082 - RNA, 21 nt, Homo sapiens
uacucaguaaggcagugcagu

SEQ ID NO: 2134083 - RNA, 16 nt, Homo sapiens
gauacugaagugcagc

SEQ ID NO: 2134084 - RNA, 12 nt, Homo sapiens
aaucaacauuuc

SEQ ID NO: 2134085 - RNA, 22 nt, Homo sapiens
aaaauauucauauauuaucaaa

SEQ ID NO: 2134086 - RNA, 12 nt, Homo sapiens
agcacuguucca

SEQ ID NO: 2134087 - RNA, 12 nt, Homo sapiens
uguacuguacua

SEQ ID NO: 2134088 - RNA, 12 nt, Homo sapiens
aguccuguucuc

SEQ ID NO: 2134089 - RNA, 18 nt, Homo sapiens
ucuauaccuuacugcaau

SEQ ID NO: 2134090 - RNA, 19 nt, Homo sapiens
aggcagaguuugccuuccu

SEQ ID NO: 2134091 - RNA, 13 nt, Homo sapiens
uggugcuggauau

SEQ ID NO: 2134092 - RNA, 19 nt, Homo sapiens
guguaauggaaaccaagga

SEQ ID NO: 2134093 - RNA, 23 nt, Homo sapiens
cuacucucagguuuuugaggaaa

SEQ ID NO: 2134094 - RNA, 23 nt, Homo sapiens
aaucaaucuggcuucugcauuac

SEQ ID NO: 2134095 - RNA, 10 nt, Homo sapiens
acaugaauau

SEQ ID NO: 2134096 - RNA, 21 nt, Homo sapiens
aggucugaguuguuaccccaa

SEQ ID NO: 2134097 - RNA, 19 nt, Homo sapiens
cagaggaaggacuuuggca

SEQ ID NO: 2134098 - RNA, 15 nt, Homo sapiens
aaccaugcccaagaa

SEQ ID NO: 2134099 - RNA, 16 nt, Homo sapiens
aggaaacucaccugcu

SEQ ID NO: 2134100 - RNA, 15 nt, Homo sapiens
acacucaagugccau

SEQ ID NO: 2134101 - RNA, 19 nt, Homo sapiens
ugcuuugcagccccacaga

SEQ ID NO: 2134102 - RNA, 22 nt, Homo sapiens
caguccaaccagaaacaccccu

SEQ ID NO: 2134103 - RNA, 13 nt, Homo sapiens
guaaaaacagcau

SEQ ID NO: 2134104 - RNA, 14 nt, Homo sapiens
uccaucccacucca

SEQ ID NO: 2134105 - RNA, 18 nt, Homo sapiens
gccuaugauaaauucaca

SEQ ID NO: 2134106 - RNA, 22 nt, Homo sapiens
auauguuuccccaucucugucu

SEQ ID NO: 2134107 - RNA, 17 nt, Homo sapiens
gccacugucacaggcau

SEQ ID NO: 2134108 - RNA, 19 nt, Homo sapiens
agccgagaucaugccauug

SEQ ID NO: 2134109 - RNA, 16 nt, Homo sapiens
cagugcaaaugcaugc

SEQ ID NO: 2134110 - RNA, 22 nt, Homo sapiens
agcccaagggcaucauccucag

SEQ ID NO: 2134111 - RNA, 22 nt, Homo sapiens
aaugccagagacggaagccuuu

SEQ ID NO: 2134112 - RNA, 20 nt, Homo sapiens
aggcuggagugcaguggugu

SEQ ID NO: 2134113 - RNA, 18 nt, Homo sapiens
aacacccuuccucugauc

SEQ ID NO: 2134114 - RNA, 15 nt, Homo sapiens
aguaucuugguugug

SEQ ID NO: 2134115 - RNA, 19 nt, Homo sapiens
uaagagggcacacacugug

SEQ ID NO: 2134116 - RNA, 20 nt, Homo sapiens
ugugucuuuuuguaucucau

SEQ ID NO: 2134117 - RNA, 21 nt, Homo sapiens
gaaauguugacuggccaaaaa

SEQ ID NO: 2134118 - RNA, 16 nt, Homo sapiens
cacacauuucugccac

SEQ ID NO: 2134119 - RNA, 17 nt, Homo sapiens
uagggaugacugugauu

SEQ ID NO: 2134120 - RNA, 14 nt, Homo sapiens
uacacauugcauuu

SEQ ID NO: 2134121 - RNA, 14 nt, Homo sapiens
aaaccccauuucua

SEQ ID NO: 2134122 - RNA, 18 nt, Homo sapiens
auggggccagucaggccc

SEQ ID NO: 2134123 - RNA, 14 nt, Homo sapiens
auuuucuaguccau

SEQ ID NO: 2134124 - RNA, 20 nt, Homo sapiens
uccaaauaaguugcgcuuaa

SEQ ID NO: 2134125 - RNA, 16 nt, Homo sapiens
gaauggggacacggug

SEQ ID NO: 2134126 - RNA, 19 nt, Homo sapiens
agcgagcagucagcauucu

SEQ ID NO: 2134127 - RNA, 14 nt, Homo sapiens
uccuuccuucccug

SEQ ID NO: 2134128 - RNA, 20 nt, Homo sapiens
cugcagugaggggcccucca

SEQ ID NO: 2134129 - RNA, 20 nt, Homo sapiens
cucugcuuuuccugucugua

SEQ ID NO: 2134130 - RNA, 23 nt, Homo sapiens
ccucaaucacacugaagccacag

SEQ ID NO: 2134131 - RNA, 22 nt, Homo sapiens
acagagugcagcagcgagcaaa

SEQ ID NO: 2134132 - RNA, 22 nt, Homo sapiens
auccagcucuugcucagugaag

SEQ ID NO: 2134133 - RNA, 19 nt, Homo sapiens
cucacauaagcccaguuca

SEQ ID NO: 2134134 - RNA, 15 nt, Homo sapiens
gucacuuaaacucau

SEQ ID NO: 2134135 - RNA, 16 nt, Homo sapiens
ucccucgcaugucucc

SEQ ID NO: 2134136 - RNA, 17 nt, Homo sapiens
aauaacuccucccaggg

SEQ ID NO: 2134137 - RNA, 19 nt, Homo sapiens
guacuuuuaugauguauau

SEQ ID NO: 2134138 - RNA, 17 nt, Homo sapiens
ccagcaguucucugcca

SEQ ID NO: 2134139 - RNA, 12 nt, Homo sapiens
gucuuggcuuuu

SEQ ID NO: 2134140 - RNA, 18 nt, Homo sapiens
uuaaaauggugaaugaca

SEQ ID NO: 2134141 - RNA, 17 nt, Homo sapiens
uggcaucuuaggguagg

SEQ ID NO: 2134142 - RNA, 20 nt, Homo sapiens
uuagaauguugaaaaguaau

SEQ ID NO: 2134143 - RNA, 22 nt, Homo sapiens
agcuuuaauguuacauaguaaa

SEQ ID NO: 2134144 - RNA, 14 nt, Homo sapiens
cugcccaccaaagg

SEQ ID NO: 2134145 - RNA, 22 nt, Homo sapiens
acucagcaccacucaagaccaa

SEQ ID NO: 2134146 - RNA, 13 nt, Homo sapiens
cauuuugcaaaau

SEQ ID NO: 2134147 - RNA, 20 nt, Homo sapiens
auucuggcccagggaaucca

SEQ ID NO: 2134148 - RNA, 11 nt, Homo sapiens
uugcugaaugu

SEQ ID NO: 2134149 - RNA, 11 nt, Homo sapiens
uuucugaaugg

SEQ ID NO: 2134150 - RNA, 14 nt, Homo sapiens
uuucugaguuucau

SEQ ID NO: 2134151 - RNA, 14 nt, Homo sapiens
agacccacagcccu

SEQ ID NO: 2134152 - RNA, 16 nt, Homo sapiens
ccucuccaguuugcac

SEQ ID NO: 2134153 - RNA, 20 nt, Homo sapiens
cagagcuacaugguggagca

SEQ ID NO: 2134154 - RNA, 17 nt, Homo sapiens
uuauauaaaucauuuca

SEQ ID NO: 2134155 - RNA, 12 nt, Homo sapiens
ucuaaugucuuc

SEQ ID NO: 2134156 - RNA, 18 nt, Homo sapiens
cccauuuccuguacaauc

SEQ ID NO: 2134157 - RNA, 17 nt, Homo sapiens
gaaacgguauccucccu

SEQ ID NO: 2134158 - RNA, 20 nt, Homo sapiens
cucuucccuuccuccauugc

SEQ ID NO: 2134159 - RNA, 13 nt, Homo sapiens
accaaaccccacu

SEQ ID NO: 2134160 - RNA, 14 nt, Homo sapiens
cgaacacagugaca

SEQ ID NO: 2134161 - RNA, 16 nt, Homo sapiens
ggccagcccacacagc

SEQ ID NO: 2134162 - RNA, 18 nt, Homo sapiens
ugggggccuggccuugca

SEQ ID NO: 2134163 - RNA, 21 nt, Homo sapiens
cuccagccugacuuggggaga

SEQ ID NO: 2134164 - RNA, 15 nt, Homo sapiens
caauguggacgugca

SEQ ID NO: 2134165 - RNA, 16 nt, Homo sapiens
gaauaaaauuauggga

SEQ ID NO: 2134166 - RNA, 22 nt, Homo sapiens
gcauugucuuguucugucccuu

SEQ ID NO: 2134167 - RNA, 20 nt, Homo sapiens
gaccaguugaagcugacuca

SEQ ID NO: 2134168 - RNA, 21 nt, Homo sapiens
aucuuccaaggguacuaagga

SEQ ID NO: 2134169 - RNA, 22 nt, Homo sapiens
cugagguugggaaggcaccugc

SEQ ID NO: 2134170 - RNA, 21 nt, Homo sapiens
gcuuuguaaacuccacaggga

SEQ ID NO: 2134171 - RNA, 17 nt, Homo sapiens
acuugucaggagugugu

SEQ ID NO: 2134172 - RNA, 22 nt, Homo sapiens
auuauuuuccuuccaugcuccc

SEQ ID NO: 2134173 - RNA, 23 nt, Homo sapiens
cgucauaauuccugcuauuguua

SEQ ID NO: 2134174 - RNA, 16 nt, Homo sapiens
auuuaaaaauaucuga

SEQ ID NO: 2134175 - RNA, 12 nt, Homo sapiens
ugugauuuucag

SEQ ID NO: 2134176 - RNA, 14 nt, Homo sapiens
acauuucugcacau

SEQ ID NO: 2134177 - RNA, 19 nt, Homo sapiens
guuuaaaaguccacuuuua

SEQ ID NO: 2134178 - RNA, 20 nt, Homo sapiens
cugcaucuucccacaguggc

SEQ ID NO: 2134179 - RNA, 18 nt, Homo sapiens
aauaguguccuaugcaau

SEQ ID NO: 2134180 - RNA, 23 nt, Homo sapiens
uaaucuugcugcuuaugugccaa

SEQ ID NO: 2134181 - RNA, 19 nt, Homo sapiens
ucaaucaucugugugaaaa

SEQ ID NO: 2134182 - RNA, 22 nt, Homo sapiens
auaucaugcuuuaaaguguaau

SEQ ID NO: 2134183 - RNA, 21 nt, Homo sapiens
caagauucccggcuggacuuu

SEQ ID NO: 2134184 - RNA, 13 nt, Homo sapiens
ucaucaaguagua

SEQ ID NO: 2134185 - RNA, 17 nt, Homo sapiens
ccugcagaauccagcua

SEQ ID NO: 2134186 - RNA, 14 nt, Homo sapiens
ugagucgaggacag

SEQ ID NO: 2134187 - RNA, 23 nt, Homo sapiens
cagaagugcucuuuguggcagug

SEQ ID NO: 2134188 - RNA, 17 nt, Homo sapiens
aaaggaaaaauaaucaa

SEQ ID NO: 2134189 - RNA, 23 nt, Homo sapiens
agauuugggguauaggucucauc

SEQ ID NO: 2134190 - RNA, 15 nt, Homo sapiens
gcaacuugaggcuga

SEQ ID NO: 2134191 - RNA, 23 nt, Homo sapiens
agauagauauuccuauugugcaa

SEQ ID NO: 2134192 - RNA, 15 nt, Homo sapiens
uguuccccccauaga

SEQ ID NO: 2134193 - RNA, 18 nt, Homo sapiens
uacaugcauacacucuca

SEQ ID NO: 2134194 - RNA, 23 nt, Homo sapiens
cccaugaacuauaugacuggcca

SEQ ID NO: 2134195 - RNA, 23 nt, Homo sapiens
uuccuuuuauuuuuauaggaaua

SEQ ID NO: 2134196 - RNA, 15 nt, Homo sapiens
aacacauacuagaaa

SEQ ID NO: 2134197 - RNA, 23 nt, Homo sapiens
aggcuguggguagaugugcaaua

SEQ ID NO: 2134198 - RNA, 17 nt, Homo sapiens
acugaccguaugaugag

SEQ ID NO: 2134199 - RNA, 16 nt, Homo sapiens
uuggcuuuaugcaaau

SEQ ID NO: 2134200 - RNA, 11 nt, Homo sapiens
uaguugcaaag

SEQ ID NO: 2134201 - RNA, 13 nt, Homo sapiens
ggcuuucagcuga

SEQ ID NO: 2134202 - RNA, 21 nt, Homo sapiens
uaaaacugauuuuuagcuuua

SEQ ID NO: 2134203 - RNA, 17 nt, Homo sapiens
cucccugcugugccaug

SEQ ID NO: 2134204 - RNA, 13 nt, Homo sapiens
ccucagucuggca

SEQ ID NO: 2134205 - RNA, 14 nt, Homo sapiens
uaccugacaggggu

SEQ ID NO: 2134206 - RNA, 22 nt, Homo sapiens
accaugaagcuggaagcacugc

SEQ ID NO: 2134207 - RNA, 12 nt, Homo sapiens
ugucuacugugg

SEQ ID NO: 2134208 - RNA, 15 nt, Homo sapiens
uccugaccucaggua

SEQ ID NO: 2134209 - RNA, 20 nt, Homo sapiens
uuccuccaagcuauucaauu

SEQ ID NO: 2134210 - RNA, 23 nt, Homo sapiens
cuuagggcagucaguaguauucu

SEQ ID NO: 2134211 - RNA, 13 nt, Homo sapiens
cauaauaugcaua

SEQ ID NO: 2134212 - RNA, 17 nt, Homo sapiens
uuacucacucacucuga

SEQ ID NO: 2134213 - RNA, 16 nt, Homo sapiens
uagagacuucacccgg

SEQ ID NO: 2134214 - RNA, 16 nt, Homo sapiens
cuugacucaggauuua

SEQ ID NO: 2134215 - RNA, 19 nt, Homo sapiens
cccagguuucuucucugga

SEQ ID NO: 2134216 - RNA, 13 nt, Homo sapiens
cccugcucacugg

SEQ ID NO: 2134217 - RNA, 16 nt, Homo sapiens
uugcauuuccucaggu

SEQ ID NO: 2134218 - RNA, 19 nt, Homo sapiens
acgagggaugggauuucau

SEQ ID NO: 2134219 - RNA, 15 nt, Homo sapiens
aagaaugcuuugcca

SEQ ID NO: 2134220 - RNA, 21 nt, Homo sapiens
caugauuauagaaggcugucu

SEQ ID NO: 2134221 - RNA, 22 nt, Homo sapiens
gaauuuuugcaauaaugcagua

SEQ ID NO: 2134222 - RNA, 12 nt, Homo sapiens
guuaagugcagg

SEQ ID NO: 2134223 - RNA, 14 nt, Homo sapiens
uacaucuucauuaa

SEQ ID NO: 2134224 - RNA, 15 nt, Homo sapiens
caaggagaaaggcau

SEQ ID NO: 2134225 - RNA, 19 nt, Homo sapiens
aaauagggaagauggagac

SEQ ID NO: 2134226 - RNA, 21 nt, Homo sapiens
uuauggaaaaggggugaccua

SEQ ID NO: 2134227 - RNA, 16 nt, Homo sapiens
augcuauacuggaaau

SEQ ID NO: 2134228 - RNA, 15 nt, Homo sapiens
ugccuccgcaccuga

SEQ ID NO: 2134229 - RNA, 19 nt, Homo sapiens
aagacaugaaaagaguggu

SEQ ID NO: 2134230 - RNA, 20 nt, Homo sapiens
accuuuucccaaccauacaa

SEQ ID NO: 2134231 - RNA, 20 nt, Homo sapiens
aauguuccuuuuuguucaaa

SEQ ID NO: 2134232 - RNA, 23 nt, Homo sapiens
gcaggguauuaacgugucagggc

SEQ ID NO: 2134233 - RNA, 13 nt, Homo sapiens
aauacaacacuga

SEQ ID NO: 2134234 - RNA, 18 nt, Homo sapiens
agcacuguagcacuuaac

SEQ ID NO: 2134235 - RNA, 18 nt, Homo sapiens
ggacaccuuuuaacucac

SEQ ID NO: 2134236 - RNA, 15 nt, Homo sapiens
ucagaaagauaagcc

SEQ ID NO: 2134237 - RNA, 15 nt, Homo sapiens
aggcauacuuuucaa

SEQ ID NO: 2134238 - RNA, 12 nt, Homo sapiens
uaucaugugauu

SEQ ID NO: 2134239 - RNA, 17 nt, Homo sapiens
uaaaacuuaucugaguc

SEQ ID NO: 2134240 - RNA, 19 nt, Homo sapiens
gugauuucaccccacagac

SEQ ID NO: 2134241 - RNA, 22 nt, Homo sapiens
agcaacuggugacugucccuuc

SEQ ID NO: 2134242 - RNA, 17 nt, Homo sapiens
ugcaaugcuaucacugu

SEQ ID NO: 2134243 - RNA, 16 nt, Homo sapiens
aucuaaacaccaaaaa

SEQ ID NO: 2134244 - RNA, 13 nt, Homo sapiens
ucuacauguguuu

SEQ ID NO: 2134245 - RNA, 15 nt, Homo sapiens
uaaauggaacaaaca

SEQ ID NO: 2134246 - RNA, 17 nt, Homo sapiens
aguaauacauuccauug

SEQ ID NO: 2134247 - RNA, 17 nt, Homo sapiens
aacccaccaaaaccaag

SEQ ID NO: 2134248 - RNA, 18 nt, Homo sapiens
uaaacuuauuucaaguga

SEQ ID NO: 2134249 - RNA, 22 nt, Homo sapiens
agugaggagcccauacucagcc

SEQ ID NO: 2134250 - RNA, 13 nt, Homo sapiens
caggaacaaacag

SEQ ID NO: 2134251 - RNA, 19 nt, Homo sapiens
cauucagcaugagauuugg

SEQ ID NO: 2134252 - RNA, 22 nt, Homo sapiens
uccucugugaagcaggucuuuc

SEQ ID NO: 2134253 - RNA, 14 nt, Homo sapiens
ugugcccacucccu

SEQ ID NO: 2134254 - RNA, 20 nt, Homo sapiens
uucugcccugcuuuugcuag

SEQ ID NO: 2134255 - RNA, 21 nt, Homo sapiens
cucguaucccaaaucugucag

SEQ ID NO: 2134256 - RNA, 19 nt, Homo sapiens
gaaaucaauuuaaaggaaa

SEQ ID NO: 2134257 - RNA, 12 nt, Homo sapiens
acccuccaugua

SEQ ID NO: 2134258 - RNA, 17 nt, Homo sapiens
cuaguguuauacuugau

SEQ ID NO: 2134259 - RNA, 23 nt, Homo sapiens
agaagaccuucuagugagccugg

SEQ ID NO: 2134260 - RNA, 14 nt, Homo sapiens
gccucuagaacagc

SEQ ID NO: 2134261 - RNA, 22 nt, Homo sapiens
ggucuuuuccauuaaacuacuu

SEQ ID NO: 2134262 - RNA, 18 nt, Homo sapiens
ugcuucugcacacaaaac

SEQ ID NO: 2134263 - RNA, 11 nt, Homo sapiens
auuacagacau

SEQ ID NO: 2134264 - RNA, 15 nt, Homo sapiens
cucggagcucagugc

SEQ ID NO: 2134265 - RNA, 22 nt, Homo sapiens
uguuugguggggguagagcuga

SEQ ID NO: 2134266 - RNA, 15 nt, Homo sapiens
cccucccuggaugac

SEQ ID NO: 2134267 - RNA, 13 nt, Homo sapiens
cgcgcaccuguag

SEQ ID NO: 2134268 - RNA, 18 nt, Homo sapiens
cagaacuggacucaggau

SEQ ID NO: 2134269 - RNA, 13 nt, Homo sapiens
guucgggagcgaa

SEQ ID NO: 2134270 - RNA, 15 nt, Homo sapiens
auguuucacaacagg

SEQ ID NO: 2134271 - RNA, 18 nt, Homo sapiens
gcacugaugggcacugga

SEQ ID NO: 2134272 - RNA, 22 nt, Homo sapiens
gacuugugauuggcugcaggaa

SEQ ID NO: 2134273 - RNA, 21 nt, Homo sapiens
agccauauaggcagcaccuga

SEQ ID NO: 2134274 - RNA, 21 nt, Homo sapiens
acuugcccuucuauacuuucu

SEQ ID NO: 2134275 - RNA, 15 nt, Homo sapiens
ggauggugugccuuc

SEQ ID NO: 2134276 - RNA, 16 nt, Homo sapiens
cagguaaaacagggcc

SEQ ID NO: 2134277 - RNA, 18 nt, Homo sapiens
auaaaaugaaagggucaa

SEQ ID NO: 2134278 - RNA, 16 nt, Homo sapiens
augugaauacucuucc

SEQ ID NO: 2134279 - RNA, 13 nt, Homo sapiens
uuucccacucuca

SEQ ID NO: 2134280 - RNA, 13 nt, Homo sapiens
ccccccaccucca

SEQ ID NO: 2134281 - RNA, 12 nt, Homo sapiens
cuguuugucucg

SEQ ID NO: 2134282 - RNA, 23 nt, Homo sapiens
uuaagcugggauaaucacauuau

SEQ ID NO: 2134283 - RNA, 20 nt, Homo sapiens
uaggccaggaguucccaaau

SEQ ID NO: 2134284 - RNA, 17 nt, Homo sapiens
uuccccacccuugagaa

SEQ ID NO: 2134285 - RNA, 23 nt, Homo sapiens
uguaagucagccacugggacccg

SEQ ID NO: 2134286 - RNA, 15 nt, Homo sapiens
uugcuggaguacuua

SEQ ID NO: 2134287 - RNA, 14 nt, Homo sapiens
ccacgcccugucua

SEQ ID NO: 2134288 - RNA, 20 nt, Homo sapiens
cucagcaugcagaagugcau

SEQ ID NO: 2134289 - RNA, 22 nt, Homo sapiens
gagaagaagaaaaucaaccagc

SEQ ID NO: 2134290 - RNA, 21 nt, Homo sapiens
agcacagauuuuaauugucau

SEQ ID NO: 2134291 - RNA, 19 nt, Homo sapiens
uucugucccccaugcucug

SEQ ID NO: 2134292 - RNA, 13 nt, Homo sapiens
agagucagcugcu

SEQ ID NO: 2134293 - RNA, 16 nt, Homo sapiens
auuuucaaaaccaggu

SEQ ID NO: 2134294 - RNA, 23 nt, Homo sapiens
gagacaacuucccaaagcacaaa

SEQ ID NO: 2134295 - RNA, 15 nt, Homo sapiens
agaaaacaauaugag

SEQ ID NO: 2134296 - RNA, 21 nt, Homo sapiens
ugaauguuuguuucagugcca

SEQ ID NO: 2134297 - RNA, 16 nt, Homo sapiens
acaguuucuuccccaa

SEQ ID NO: 2134298 - RNA, 12 nt, Homo sapiens
aagcaacauuca

SEQ ID NO: 2134299 - RNA, 19 nt, Homo sapiens
acaggccgggcaguguccc

SEQ ID NO: 2134300 - RNA, 18 nt, Homo sapiens
acacaacccgucagagac

SEQ ID NO: 2134301 - RNA, 14 nt, Homo sapiens
caauaaauuugcuu

SEQ ID NO: 2134302 - RNA, 23 nt, Homo sapiens
augaaccugacaaaaacaagcaa

SEQ ID NO: 2134303 - RNA, 20 nt, Homo sapiens
agugggacauauuuuccuga

SEQ ID NO: 2134304 - RNA, 14 nt, Homo sapiens
uuucacagcacuac

SEQ ID NO: 2134305 - RNA, 13 nt, Homo sapiens
cauaaccaaagag

SEQ ID NO: 2134306 - RNA, 21 nt, Homo sapiens
agauagauuuucuucugagac

SEQ ID NO: 2134307 - RNA, 22 nt, Homo sapiens
ugcaauaaaacucccuuccuua

SEQ ID NO: 2134308 - RNA, 21 nt, Homo sapiens
aggcugcccaaucugagcaaa

SEQ ID NO: 2134309 - RNA, 21 nt, Homo sapiens
gugggaccucagacaaaaccc

SEQ ID NO: 2134310 - RNA, 19 nt, Homo sapiens
aacacucauuuccaaucau

SEQ ID NO: 2134311 - RNA, 17 nt, Homo sapiens
ccuugaucccaauccuu

SEQ ID NO: 2134312 - RNA, 18 nt, Homo sapiens
ugauucacugccuaugaa

SEQ ID NO: 2134313 - RNA, 12 nt, Homo sapiens
ccuucacagcua

SEQ ID NO: 2134314 - RNA, 20 nt, Homo sapiens
uaagaacaaaagaagcagca

SEQ ID NO: 2134315 - RNA, 17 nt, Homo sapiens
gguugucagcugcagcc

SEQ ID NO: 2134316 - RNA, 13 nt, Homo sapiens
aaauaaaacugag

SEQ ID NO: 2134317 - RNA, 18 nt, Homo sapiens
uaugagggucagggcagu

SEQ ID NO: 2134318 - RNA, 20 nt, Homo sapiens
agugugccugucacuacugg

SEQ ID NO: 2134319 - RNA, 17 nt, Homo sapiens
aucucggacuuugcagg

SEQ ID NO: 2134320 - RNA, 18 nt, Homo sapiens
uauuuuaaccuguauacu

SEQ ID NO: 2134321 - RNA, 18 nt, Homo sapiens
cauuucuaauguaugcau

SEQ ID NO: 2134322 - RNA, 12 nt, Homo sapiens
aggaugagcugg

SEQ ID NO: 2134323 - RNA, 20 nt, Homo sapiens
cuuacauuauuacuccuugc

SEQ ID NO: 2134324 - RNA, 19 nt, Homo sapiens
uuugccaauuuucuuugaa

SEQ ID NO: 2134325 - RNA, 11 nt, Homo sapiens
agucccggcuu

SEQ ID NO: 2134326 - RNA, 19 nt, Homo sapiens
ugaaaauguccauuuacac

SEQ ID NO: 2134327 - RNA, 15 nt, Homo sapiens
uggcuucucuccuca

SEQ ID NO: 2134328 - RNA, 18 nt, Homo sapiens
uggaagccuccaccugca

SEQ ID NO: 2134329 - RNA, 16 nt, Homo sapiens
aauuagcugcuucuau

SEQ ID NO: 2134330 - RNA, 16 nt, Homo sapiens
ugcucuucucugguuc

SEQ ID NO: 2134331 - RNA, 21 nt, Homo sapiens
cugggauauuuccauauggca

SEQ ID NO: 2134332 - RNA, 20 nt, Homo sapiens
uugugccauauuugugccau

SEQ ID NO: 2134333 - RNA, 16 nt, Homo sapiens
acuugcagaccugccu

SEQ ID NO: 2134334 - RNA, 21 nt, Homo sapiens
uauguccguucaucccugaga

SEQ ID NO: 2134335 - RNA, 18 nt, Homo sapiens
uuauaauguagcagcuca

SEQ ID NO: 2134336 - RNA, 18 nt, Homo sapiens
cugcuacuagauugugag

SEQ ID NO: 2134337 - RNA, 15 nt, Homo sapiens
uugccauugacuucu

SEQ ID NO: 2134338 - RNA, 12 nt, Homo sapiens
cagccccagugc

SEQ ID NO: 2134339 - RNA, 17 nt, Homo sapiens
cggagucuugcucugua

SEQ ID NO: 2134340 - RNA, 17 nt, Homo sapiens
aacauauuaaagguucu

SEQ ID NO: 2134341 - RNA, 13 nt, Homo sapiens
caggagauuacaa

SEQ ID NO: 2134342 - RNA, 22 nt, Homo sapiens
cugagaaaggucugaaauccag

SEQ ID NO: 2134343 - RNA, 18 nt, Homo sapiens
ugccccacauguggccau

SEQ ID NO: 2134344 - RNA, 17 nt, Homo sapiens
uucuauacuuucucaca

SEQ ID NO: 2134345 - RNA, 18 nt, Homo sapiens
uaaguuaaaacaaaggaa

SEQ ID NO: 2134346 - RNA, 13 nt, Homo sapiens
aaugcaaacuggg

SEQ ID NO: 2134347 - RNA, 15 nt, Homo sapiens
gaagaggaaagggag

SEQ ID NO: 2134348 - RNA, 17 nt, Homo sapiens
aagccaaaaacaaacga

SEQ ID NO: 2134349 - RNA, 18 nt, Homo sapiens
aacuacccaccuggggau

SEQ ID NO: 2134350 - RNA, 14 nt, Homo sapiens
ggcagccucaggag

SEQ ID NO: 2134351 - RNA, 16 nt, Homo sapiens
cauaauucagcacuua

SEQ ID NO: 2134352 - RNA, 14 nt, Homo sapiens
ucuggcgcccauga

SEQ ID NO: 2134353 - RNA, 16 nt, Homo sapiens
aauugcugcaucuuag

SEQ ID NO: 2134354 - RNA, 18 nt, Homo sapiens
ccuggccaggauaauaua

SEQ ID NO: 2134355 - RNA, 19 nt, Homo sapiens
ucacuauggacuuacccua

SEQ ID NO: 2134356 - RNA, 19 nt, Homo sapiens
augggcaaagcugugcacu

SEQ ID NO: 2134357 - RNA, 13 nt, Homo sapiens
cccucauuucaca

SEQ ID NO: 2134358 - RNA, 18 nt, Homo sapiens
auuuguuuaaacaaucuu

SEQ ID NO: 2134359 - RNA, 16 nt, Homo sapiens
cuuggccuuggggcca

SEQ ID NO: 2134360 - RNA, 21 nt, Homo sapiens
cugaaccuuucaaaauggaaa

SEQ ID NO: 2134361 - RNA, 15 nt, Homo sapiens
gacccagaauaucca

SEQ ID NO: 2134362 - RNA, 22 nt, Homo sapiens
aagagacagagacuggcauuuu

SEQ ID NO: 2134363 - RNA, 14 nt, Homo sapiens
ggguucaagugauu

SEQ ID NO: 2134364 - RNA, 20 nt, Homo sapiens
gagcaauucuccugccucag

SEQ ID NO: 2134365 - RNA, 24 nt, Homo sapiens
aaggcgugagucuucaucuuaggg

SEQ ID NO: 2134366 - RNA, 17 nt, Homo sapiens
gugaucacugagccauc

SEQ ID NO: 2134367 - RNA, 14 nt, Homo sapiens
acuggugagggcaa

SEQ ID NO: 2134368 - RNA, 23 nt, Homo sapiens
aggugaacugggagcagcucugu

SEQ ID NO: 2134369 - RNA, 16 nt, Homo sapiens
caacuuggcauuucua

SEQ ID NO: 2134370 - RNA, 20 nt, Homo sapiens
ccauauagucuauucauuaa

SEQ ID NO: 2134371 - RNA, 15 nt, Homo sapiens
uuauugucuguaaau

SEQ ID NO: 2134372 - RNA, 18 nt, Homo sapiens
accaaggcagugcaugca

SEQ ID NO: 2134373 - RNA, 18 nt, Homo sapiens
uucaucaccgaaguguga

SEQ ID NO: 2134374 - RNA, 14 nt, Homo sapiens
acauucaguuccca

SEQ ID NO: 2134375 - RNA, 18 nt, Homo sapiens
aaacuggauuaucuacua

SEQ ID NO: 2134376 - RNA, 17 nt, Homo sapiens
ccuucauuuuacauucu

SEQ ID NO: 2134377 - RNA, 12 nt, Homo sapiens
caccauggacaa

SEQ ID NO: 2134378 - RNA, 15 nt, Homo sapiens
acuugucacuugcau

SEQ ID NO: 2134379 - RNA, 21 nt, Homo sapiens
uggcuccuuaucagugccaug

SEQ ID NO: 2134380 - RNA, 21 nt, Homo sapiens
cacagugagaccccuucucaa

SEQ ID NO: 2134381 - RNA, 24 nt, Homo sapiens
ggagugauuuuggccacacuguca

SEQ ID NO: 2134382 - RNA, 13 nt, Homo sapiens
gcugcugcacacu

SEQ ID NO: 2134383 - RNA, 23 nt, Homo sapiens
acauuagaugaaguuacuguuga

SEQ ID NO: 2134384 - RNA, 18 nt, Homo sapiens
cucagcaagccaugcccc

SEQ ID NO: 2134385 - RNA, 15 nt, Homo sapiens
cuguggaaguaucuu

SEQ ID NO: 2134386 - RNA, 19 nt, Homo sapiens
cccauugcugccaaggugg

SEQ ID NO: 2134387 - RNA, 21 nt, Homo sapiens
gucuuuuuuuucuucaccuca

SEQ ID NO: 2134388 - RNA, 23 nt, Homo sapiens
acagcuuucugaccuucagcuca

SEQ ID NO: 2134389 - RNA, 13 nt, Homo sapiens
ugaggaccucauc

SEQ ID NO: 2134390 - RNA, 16 nt, Homo sapiens
cagguuuacuauguuu

SEQ ID NO: 2134391 - RNA, 13 nt, Homo sapiens
aggguccucuagc

SEQ ID NO: 2134392 - RNA, 18 nt, Homo sapiens
acagagcaggacugcaca

SEQ ID NO: 2134393 - RNA, 19 nt, Homo sapiens
agaaggggaagcacucgug

SEQ ID NO: 2134394 - RNA, 15 nt, Homo sapiens
uuaacucagccagaa

SEQ ID NO: 2134395 - RNA, 19 nt, Homo sapiens
acaguacaggcagcacaga

SEQ ID NO: 2134396 - RNA, 14 nt, Homo sapiens
gaggaaaugauuuc

SEQ ID NO: 2134397 - RNA, 17 nt, Homo sapiens
ggaaaugaguggccagc

SEQ ID NO: 2134398 - RNA, 18 nt, Homo sapiens
acaagaugguucuagcau

SEQ ID NO: 2134399 - RNA, 18 nt, Homo sapiens
ugcaucuggagagaacag

SEQ ID NO: 2134400 - RNA, 14 nt, Homo sapiens
ggucauagcauuca

SEQ ID NO: 2134401 - RNA, 21 nt, Homo sapiens
uucaaaggaaaauagacagaa

SEQ ID NO: 2134402 - RNA, 22 nt, Homo sapiens
ccaugauggcaacagaucugga

SEQ ID NO: 2134403 - RNA, 15 nt, Homo sapiens
aggaguacaggugaa

SEQ ID NO: 2134404 - RNA, 22 nt, Homo sapiens
aguaagauauugugugugugaa

SEQ ID NO: 2134405 - RNA, 15 nt, Homo sapiens
cugcauuuuacugua

SEQ ID NO: 2134406 - RNA, 17 nt, Homo sapiens
ucaccuuuguaagacau

SEQ ID NO: 2134407 - RNA, 23 nt, Homo sapiens
cacauucuucaguuuuucacuuc

SEQ ID NO: 2134408 - RNA, 13 nt, Homo sapiens
ucccaucugguca

SEQ ID NO: 2134409 - RNA, 19 nt, Homo sapiens
augacuucagcaguggcag

SEQ ID NO: 2134410 - RNA, 19 nt, Homo sapiens
aauggcagcaggaucugga

SEQ ID NO: 2134411 - RNA, 16 nt, Homo sapiens
uagcaaggucauuucu

SEQ ID NO: 2134412 - RNA, 16 nt, Homo sapiens
agauggguggcaccaa

SEQ ID NO: 2134413 - RNA, 21 nt, Homo sapiens
ugcauacuuucccucauccau

SEQ ID NO: 2134414 - RNA, 15 nt, Homo sapiens
uucaaggaacagcca

SEQ ID NO: 2134415 - RNA, 17 nt, Homo sapiens
caggaaaguaucucuac

SEQ ID NO: 2134416 - RNA, 16 nt, Homo sapiens
uauacaauacagauca

SEQ ID NO: 2134417 - RNA, 15 nt, Homo sapiens
ucacaccaacagugu

SEQ ID NO: 2134418 - RNA, 20 nt, Homo sapiens
uuaaaaauuagccuugauau

SEQ ID NO: 2134419 - RNA, 18 nt, Homo sapiens
uacaaaguacuagcuaaa

SEQ ID NO: 2134420 - RNA, 19 nt, Homo sapiens
cagaagaccccugacucau

SEQ ID NO: 2134421 - RNA, 21 nt, Homo sapiens
aaggaacauuccuuagucuca

SEQ ID NO: 2134422 - RNA, 18 nt, Homo sapiens
augccgcagggagggcug

SEQ ID NO: 2134423 - RNA, 15 nt, Homo sapiens
agcaacaggccauug

SEQ ID NO: 2134424 - RNA, 13 nt, Homo sapiens
uuuuuauaauauc

SEQ ID NO: 2134425 - RNA, 16 nt, Homo sapiens
cacuaaguuuacuucu

SEQ ID NO: 2134426 - RNA, 13 nt, Homo sapiens
auuauauauuaac

SEQ ID NO: 2134427 - RNA, 17 nt, Homo sapiens
aacaacuuuguuucuca

SEQ ID NO: 2134428 - RNA, 15 nt, Homo sapiens
auagaguucuaugag

SEQ ID NO: 2134429 - RNA, 20 nt, Homo sapiens
ccuucugugcuucagcucuu

SEQ ID NO: 2134430 - RNA, 23 nt, Homo sapiens
agcaggcccagcaugcagguggu

SEQ ID NO: 2134431 - RNA, 22 nt, Homo sapiens
auucuuuaaacaaauaugaaaa

SEQ ID NO: 2134432 - RNA, 19 nt, Homo sapiens
aaaguagguuuacauucau

SEQ ID NO: 2134433 - RNA, 20 nt, Homo sapiens
aggcucccugaccacccugc

SEQ ID NO: 2134434 - RNA, 19 nt, Homo sapiens
ucuaaugugccuaguucuu

SEQ ID NO: 2134435 - RNA, 17 nt, Homo sapiens
gcuagcuucugcaaugu

SEQ ID NO: 2134436 - RNA, 15 nt, Homo sapiens
ggaaggacagucccu

SEQ ID NO: 2134437 - RNA, 22 nt, Homo sapiens
agaccacgcccguccugccugu

SEQ ID NO: 2134438 - RNA, 18 nt, Homo sapiens
caucaggccuaaucucau

SEQ ID NO: 2134439 - RNA, 19 nt, Homo sapiens
ucauccacucugccugcuu

SEQ ID NO: 2134440 - RNA, 18 nt, Homo sapiens
ucccggggguguaucuga

SEQ ID NO: 2134441 - RNA, 22 nt, Homo sapiens
ccaguggggcccuucucugcag

SEQ ID NO: 2134442 - RNA, 12 nt, Homo sapiens
auuuuacuguga

SEQ ID NO: 2134443 - RNA, 14 nt, Homo sapiens
ucaguguugacaua

SEQ ID NO: 2134444 - RNA, 16 nt, Homo sapiens
ucucugacucuugccu

SEQ ID NO: 2134445 - RNA, 14 nt, Homo sapiens
cgccaggacugugu

SEQ ID NO: 2134446 - RNA, 19 nt, Homo sapiens
ccuugguggggagcacaga

SEQ ID NO: 2134447 - RNA, 21 nt, Homo sapiens
ccucccagagugcugggauua

SEQ ID NO: 2134448 - RNA, 18 nt, Homo sapiens
ucuuacagucagcacaga

SEQ ID NO: 2134449 - RNA, 23 nt, Homo sapiens
uguucaaagugugacauucagug

SEQ ID NO: 2134450 - RNA, 17 nt, Homo sapiens
gauaaaugacacaauga

SEQ ID NO: 2134451 - RNA, 17 nt, Homo sapiens
uagacuuaaacagcaga

SEQ ID NO: 2134452 - RNA, 23 nt, Homo sapiens
aucugcugaaggcagucauauca

SEQ ID NO: 2134453 - RNA, 14 nt, Homo sapiens
uguuauguacugua

SEQ ID NO: 2134454 - RNA, 18 nt, Homo sapiens
acaagugauaauacagau

SEQ ID NO: 2134455 - RNA, 18 nt, Homo sapiens
ggauaauguccaacuaaa

SEQ ID NO: 2134456 - RNA, 22 nt, Homo sapiens
guaccacccuucagaccccagu

SEQ ID NO: 2134457 - RNA, 12 nt, Homo sapiens
aacaugugccag

SEQ ID NO: 2134458 - RNA, 19 nt, Homo sapiens
ccuuauauuuguccaacaa

SEQ ID NO: 2134459 - RNA, 15 nt, Homo sapiens
cucacaccugcaauc

SEQ ID NO: 2134460 - RNA, 15 nt, Homo sapiens
cuccaccucaccucc

SEQ ID NO: 2134461 - RNA, 19 nt, Homo sapiens
uucaaagagaugggccuuu

SEQ ID NO: 2134462 - RNA, 15 nt, Homo sapiens
ccucgcccuccacaa

SEQ ID NO: 2134463 - RNA, 12 nt, Homo sapiens
ugcaaagccaua

SEQ ID NO: 2134464 - RNA, 18 nt, Homo sapiens
caaaccuuuccuguaaca

SEQ ID NO: 2134465 - RNA, 14 nt, Homo sapiens
agaauuaguggcac

SEQ ID NO: 2134466 - RNA, 15 nt, Homo sapiens
aaccauaugugcuac

SEQ ID NO: 2134467 - RNA, 23 nt, Homo sapiens
gcuguauuuucuuuuauaucugu

SEQ ID NO: 2134468 - RNA, 15 nt, Homo sapiens
uacauuuauaaucua

SEQ ID NO: 2134469 - RNA, 14 nt, Homo sapiens
cugaaauuacuuua

SEQ ID NO: 2134470 - RNA, 13 nt, Homo sapiens
aauuuauaucuua

SEQ ID NO: 2134471 - RNA, 13 nt, Homo sapiens
ugacucgguguaa

SEQ ID NO: 2134472 - RNA, 22 nt, Homo sapiens
cacaggacauuggcauuaucua

SEQ ID NO: 2134473 - RNA, 13 nt, Homo sapiens
ccauuccugggcu

SEQ ID NO: 2134474 - RNA, 19 nt, Homo sapiens
aucugggaaaauaccccau

SEQ ID NO: 2134475 - RNA, 17 nt, Homo sapiens
acacagcaacaaugacu

SEQ ID NO: 2134476 - RNA, 15 nt, Homo sapiens
cccuggaccagccuc

SEQ ID NO: 2134477 - RNA, 23 nt, Homo sapiens
aggggugcccccaggcucucaug

SEQ ID NO: 2134478 - RNA, 20 nt, Homo sapiens
cccccauagcagcagugcau

SEQ ID NO: 2134479 - RNA, 17 nt, Homo sapiens
aucucuggaugccugau

SEQ ID NO: 2134480 - RNA, 13 nt, Homo sapiens
acccagucucaga

SEQ ID NO: 2134481 - RNA, 22 nt, Homo sapiens
agcucuggccacaacagggcau

SEQ ID NO: 2134482 - RNA, 20 nt, Homo sapiens
accaugcaaauugugaaaua

SEQ ID NO: 2134483 - RNA, 23 nt, Homo sapiens
ugggaucacgaggaaaagagaag

SEQ ID NO: 2134484 - RNA, 16 nt, Homo sapiens
ugcauugugaggguua

SEQ ID NO: 2134485 - RNA, 22 nt, Homo sapiens
gcaucaugccucugaggccagc

SEQ ID NO: 2134486 - RNA, 16 nt, Homo sapiens
ccuggcuggcaggcac

SEQ ID NO: 2134487 - RNA, 23 nt, Homo sapiens
cagggcagcaagggaccugcuca

SEQ ID NO: 2134488 - RNA, 21 nt, Homo sapiens
gcuacucucuugccagcauuu

SEQ ID NO: 2134489 - RNA, 14 nt, Homo sapiens
gcuucuccaaauac

SEQ ID NO: 2134490 - RNA, 15 nt, Homo sapiens
guauuuucauuuaac

SEQ ID NO: 2134491 - RNA, 22 nt, Homo sapiens
uagaagggccaguccugccugg

SEQ ID NO: 2134492 - RNA, 18 nt, Homo sapiens
aagaguaaaggaaaugau

SEQ ID NO: 2134493 - RNA, 12 nt, Homo sapiens
ucccccaaagaa

SEQ ID NO: 2134494 - RNA, 17 nt, Homo sapiens
aauagugcacuccaaga

SEQ ID NO: 2134495 - RNA, 19 nt, Homo sapiens
uugccaaauugacugucac

SEQ ID NO: 2134496 - RNA, 18 nt, Homo sapiens
uggaaggacacagugaug

SEQ ID NO: 2134497 - RNA, 17 nt, Homo sapiens
gaaaucugugcaauaaa

SEQ ID NO: 2134498 - RNA, 21 nt, Homo sapiens
uuauuuucagaagcugaugag

SEQ ID NO: 2134499 - RNA, 12 nt, Homo sapiens
augaucucaggu

SEQ ID NO: 2134500 - RNA, 21 nt, Homo sapiens
accccuugcucucaacccagg

SEQ ID NO: 2134501 - RNA, 22 nt, Homo sapiens
caaacaucccccaaugaccuua

SEQ ID NO: 2134502 - RNA, 20 nt, Homo sapiens
aggagaaugaauacugggaa

SEQ ID NO: 2134503 - RNA, 17 nt, Homo sapiens
aaauuuuauaucuugua

SEQ ID NO: 2134504 - RNA, 22 nt, Homo sapiens
ugugcauuaaaacaaauccaua

SEQ ID NO: 2134505 - RNA, 18 nt, Homo sapiens
aaguggagaccuuucuag

SEQ ID NO: 2134506 - RNA, 22 nt, Homo sapiens
cuuguugaugcugucuaaggaa

SEQ ID NO: 2134507 - RNA, 14 nt, Homo sapiens
gagcggcugguuca

SEQ ID NO: 2134508 - RNA, 14 nt, Homo sapiens
ccucacuucaggua

SEQ ID NO: 2134509 - RNA, 13 nt, Homo sapiens
caaguuguuuaaa

SEQ ID NO: 2134510 - RNA, 19 nt, Homo sapiens
uucuuaacuaucauuauuu

SEQ ID NO: 2134511 - RNA, 22 nt, Homo sapiens
gagcuuggcugagggucuggga

SEQ ID NO: 2134512 - RNA, 15 nt, Homo sapiens
caacaaaaaccaaaa

SEQ ID NO: 2134513 - RNA, 14 nt, Homo sapiens
gugcccaccagccu

SEQ ID NO: 2134514 - RNA, 12 nt, Homo sapiens
agacuaugauuu

SEQ ID NO: 2134515 - RNA, 16 nt, Homo sapiens
ucuucgcagccuagau

SEQ ID NO: 2134516 - RNA, 18 nt, Homo sapiens
ggaaaaugcacacauuuc

SEQ ID NO: 2134517 - RNA, 15 nt, Homo sapiens
uuaaugagacaugaa

SEQ ID NO: 2134518 - RNA, 14 nt, Homo sapiens
ugauagcccagaac

SEQ ID NO: 2134519 - RNA, 23 nt, Homo sapiens
gacgaggcggagcgccaguggaa

SEQ ID NO: 2134520 - RNA, 20 nt, Homo sapiens
ucuacgaggccauccagucc

SEQ ID NO: 2134521 - RNA, 13 nt, Homo sapiens
gaugacauuucac

SEQ ID NO: 2134522 - RNA, 18 nt, Homo sapiens
cuguuuggaugcuucuga

SEQ ID NO: 2134523 - RNA, 13 nt, Homo sapiens
cagaguauaauuu

SEQ ID NO: 2134524 - RNA, 14 nt, Homo sapiens
ggcccuaccugggg

SEQ ID NO: 2134525 - RNA, 23 nt, Homo sapiens
gaugucaaggacuccugucuguc

SEQ ID NO: 2134526 - RNA, 22 nt, Homo sapiens
ccuccuccaccaccgcccgucu

SEQ ID NO: 2134527 - RNA, 22 nt, Homo sapiens
agcuuccuucugggacuggaca

SEQ ID NO: 2134528 - RNA, 16 nt, Homo sapiens
guuugccaaauaaaaa

SEQ ID NO: 2134529 - RNA, 15 nt, Homo sapiens
cuaucuguauaacac

SEQ ID NO: 2134530 - RNA, 15 nt, Homo sapiens
aauuuugucauauac

SEQ ID NO: 2134531 - RNA, 15 nt, Homo sapiens
uccucaguguccuca

SEQ ID NO: 2134532 - RNA, 16 nt, Homo sapiens
ccuuuccaaaaacugu

SEQ ID NO: 2134533 - RNA, 16 nt, Homo sapiens
uuuccacuuaucugau

SEQ ID NO: 2134534 - RNA, 21 nt, Homo sapiens
agcaguuuaugagacagcuga

SEQ ID NO: 2134535 - RNA, 16 nt, Homo sapiens
caguucucucccuucc

SEQ ID NO: 2134536 - RNA, 20 nt, Homo sapiens
aagaaaucuuucucccucaa

SEQ ID NO: 2134537 - RNA, 21 nt, Homo sapiens
agcccauaaagucugagaaau

SEQ ID NO: 2134538 - RNA, 22 nt, Homo sapiens
aguugugucuaggcuggaagag

SEQ ID NO: 2134539 - RNA, 19 nt, Homo sapiens
cugacuuguuugucuucca

SEQ ID NO: 2134540 - RNA, 23 nt, Homo sapiens
ggccugcagacagaccucaaggg

SEQ ID NO: 2134541 - RNA, 14 nt, Homo sapiens
cagagccacagggu

SEQ ID NO: 2134542 - RNA, 13 nt, Homo sapiens
uuuugacuugcca

SEQ ID NO: 2134543 - RNA, 15 nt, Homo sapiens
ucugcagacugcugc

SEQ ID NO: 2134544 - RNA, 17 nt, Homo sapiens
uaugcuuacucuugcuu

SEQ ID NO: 2134545 - RNA, 16 nt, Homo sapiens
gacccuuggcuaugaa

SEQ ID NO: 2134546 - RNA, 14 nt, Homo sapiens
uaaaggacaaacag

SEQ ID NO: 2134547 - RNA, 22 nt, Homo sapiens
agcaagaggaaggggugcugug

SEQ ID NO: 2134548 - RNA, 17 nt, Homo sapiens
aaaagcaaaacugcaaa

SEQ ID NO: 2134549 - RNA, 15 nt, Homo sapiens
aggcagguuacaguu

SEQ ID NO: 2134550 - RNA, 15 nt, Homo sapiens
agcagggucuggaag

SEQ ID NO: 2134551 - RNA, 16 nt, Homo sapiens
aagcuuuuuugccaca

SEQ ID NO: 2134552 - RNA, 22 nt, Homo sapiens
ucucaggaagcccccaaguuga

SEQ ID NO: 2134553 - RNA, 19 nt, Homo sapiens
gcagaaagguuaguaucau

SEQ ID NO: 2134554 - RNA, 19 nt, Homo sapiens
uaauuaucacaauguacua

SEQ ID NO: 2134555 - RNA, 15 nt, Homo sapiens
aguaauuaugcacua

SEQ ID NO: 2134556 - RNA, 15 nt, Homo sapiens
cccagcccaaagggg

SEQ ID NO: 2134557 - RNA, 15 nt, Homo sapiens
caugucuugucauac

SEQ ID NO: 2134558 - RNA, 14 nt, Homo sapiens
agagugcuugggau

SEQ ID NO: 2134559 - RNA, 18 nt, Homo sapiens
uggacuuucuccaaaggc

SEQ ID NO: 2134560 - RNA, 15 nt, Homo sapiens
gcacaauuccaugaa

SEQ ID NO: 2134561 - RNA, 23 nt, Homo sapiens
ggacucugcuagacuccucagga

SEQ ID NO: 2134562 - RNA, 20 nt, Homo sapiens
gauucuaggcggaagcgaua

SEQ ID NO: 2134563 - RNA, 21 nt, Homo sapiens
cacucaggagcacagccauag

SEQ ID NO: 2134564 - RNA, 13 nt, Homo sapiens
cacaaaagacaag

SEQ ID NO: 2134565 - RNA, 15 nt, Homo sapiens
ccagcugugcacuuu

SEQ ID NO: 2134566 - RNA, 17 nt, Homo sapiens
uucacggggucauacua

SEQ ID NO: 2134567 - RNA, 13 nt, Homo sapiens
cuguacacacccu

SEQ ID NO: 2134568 - RNA, 15 nt, Homo sapiens
ucauaaaaacuguga

SEQ ID NO: 2134569 - RNA, 16 nt, Homo sapiens
uccccacccugaacaa

SEQ ID NO: 2134570 - RNA, 16 nt, Homo sapiens
aauaaguuuguguuag

SEQ ID NO: 2134571 - RNA, 13 nt, Homo sapiens
ugucacucugccu

SEQ ID NO: 2134572 - RNA, 18 nt, Homo sapiens
ggcuuucacaaaaggcau

SEQ ID NO: 2134573 - RNA, 20 nt, Homo sapiens
gagaguggguaaaucaggga

SEQ ID NO: 2134574 - RNA, 21 nt, Homo sapiens
cuaugugcaugcagcaucuaa

SEQ ID NO: 2134575 - RNA, 15 nt, Homo sapiens
ugcucaccugaggau

SEQ ID NO: 2134576 - RNA, 17 nt, Homo sapiens
agccacuugacuggcac

SEQ ID NO: 2134577 - RNA, 15 nt, Homo sapiens
aggccacucuuagcc

SEQ ID NO: 2134578 - RNA, 16 nt, Homo sapiens
cccagucucccaccuu

SEQ ID NO: 2134579 - RNA, 16 nt, Homo sapiens
ugguuggucaaaucaa

SEQ ID NO: 2134580 - RNA, 22 nt, Homo sapiens
gggaagccugugccagcaccuu

SEQ ID NO: 2134581 - RNA, 15 nt, Homo sapiens
uaucaugugcacuuc

SEQ ID NO: 2134582 - RNA, 16 nt, Homo sapiens
guauugugcacuguau

SEQ ID NO: 2134583 - RNA, 14 nt, Homo sapiens
agacucuauucuca

SEQ ID NO: 2134584 - RNA, 16 nt, Homo sapiens
aaugccaaguuauaca

SEQ ID NO: 2134585 - RNA, 23 nt, Homo sapiens
cuccccugccugcccuggugaca

SEQ ID NO: 2134586 - RNA, 14 nt, Homo sapiens
cagauagagcuggg

SEQ ID NO: 2134587 - RNA, 17 nt, Homo sapiens
aacacagcaugugccaa

SEQ ID NO: 2134588 - RNA, 16 nt, Homo sapiens
cuucauagagacuugg

SEQ ID NO: 2134589 - RNA, 21 nt, Homo sapiens
auuugaagaauuaaugacaac

SEQ ID NO: 2134590 - RNA, 13 nt, Homo sapiens
ugcuuuuggcaga

SEQ ID NO: 2134591 - RNA, 23 nt, Homo sapiens
gcccccggcucggccucuugaga

SEQ ID NO: 2134592 - RNA, 12 nt, Homo sapiens
gaugauuucccu

SEQ ID NO: 2134593 - RNA, 17 nt, Homo sapiens
cagggcuggucaccucc

SEQ ID NO: 2134594 - RNA, 16 nt, Homo sapiens
auuccugaagccagau

SEQ ID NO: 2134595 - RNA, 15 nt, Homo sapiens
cgucucaagacugaa

SEQ ID NO: 2134596 - RNA, 16 nt, Homo sapiens
ggagccauaagggaca

SEQ ID NO: 2134597 - RNA, 19 nt, Homo sapiens
aguaccagcauguuaacuu

SEQ ID NO: 2134598 - RNA, 16 nt, Homo sapiens
agcaugccucuucccu

SEQ ID NO: 2134599 - RNA, 16 nt, Homo sapiens
ccacugaaaagcuuuc

SEQ ID NO: 2134600 - RNA, 15 nt, Homo sapiens
ccugagucagugcuc

SEQ ID NO: 2134601 - RNA, 14 nt, Homo sapiens
aagcaguuuagaca

SEQ ID NO: 2134602 - RNA, 22 nt, Homo sapiens
uuuauuccccagugacuccagg

SEQ ID NO: 2134603 - RNA, 14 nt, Homo sapiens
gggcccagagccca

SEQ ID NO: 2134604 - RNA, 17 nt, Homo sapiens
agacuaggauaaugucc

SEQ ID NO: 2134605 - RNA, 20 nt, Homo sapiens
ccugcuagcaccuccccaga

SEQ ID NO: 2134606 - RNA, 13 nt, Homo sapiens
aaugaauggcuaa

SEQ ID NO: 2134607 - RNA, 18 nt, Homo sapiens
gggacuaugguggccaag

SEQ ID NO: 2134608 - RNA, 18 nt, Homo sapiens
gccccccguguggcuuac

SEQ ID NO: 2134609 - RNA, 20 nt, Homo sapiens
gaccacuguuucuugcuugu

SEQ ID NO: 2134610 - RNA, 13 nt, Homo sapiens
ugcaguaagccaa

SEQ ID NO: 2134611 - RNA, 22 nt, Homo sapiens
aaaauguccuugugaugugcac

SEQ ID NO: 2134612 - RNA, 20 nt, Homo sapiens
guccucaucagucuccauac

SEQ ID NO: 2134613 - RNA, 14 nt, Homo sapiens
aaggagacagaaga

SEQ ID NO: 2134614 - RNA, 22 nt, Homo sapiens
uuuagaauaagaauuugcauac

SEQ ID NO: 2134615 - RNA, 20 nt, Homo sapiens
ccucccuuccccuuuuccca

SEQ ID NO: 2134616 - RNA, 13 nt, Homo sapiens
ugucaacuaccca

SEQ ID NO: 2134617 - RNA, 18 nt, Homo sapiens
auggggggggauguggau

SEQ ID NO: 2134618 - RNA, 17 nt, Homo sapiens
ccucccugcagcuuuga

SEQ ID NO: 2134619 - RNA, 20 nt, Homo sapiens
ugcauuuggauugggguccc

SEQ ID NO: 2134620 - RNA, 20 nt, Homo sapiens
uuaaaugcaauaauuuuacu

SEQ ID NO: 2134621 - RNA, 13 nt, Homo sapiens
aacacuuauuuuc

SEQ ID NO: 2134622 - RNA, 14 nt, Homo sapiens
ucaagguucccaga

SEQ ID NO: 2134623 - RNA, 17 nt, Homo sapiens
cacaaaauguacccagu

SEQ ID NO: 2134624 - RNA, 20 nt, Homo sapiens
caaugcacagggcugcaaca

SEQ ID NO: 2134625 - RNA, 14 nt, Homo sapiens
acaaguaugaugau

SEQ ID NO: 2134626 - RNA, 14 nt, Homo sapiens
ccccaauaccccau

SEQ ID NO: 2134627 - RNA, 14 nt, Homo sapiens
cuucaauacuucau

SEQ ID NO: 2134628 - RNA, 15 nt, Homo sapiens
uuggcuuaucauggg

SEQ ID NO: 2134629 - RNA, 17 nt, Homo sapiens
acucuuaggcacaucaa

SEQ ID NO: 2134630 - RNA, 20 nt, Homo sapiens
acugaaaucaagcuggagua

SEQ ID NO: 2134631 - RNA, 14 nt, Homo sapiens
agaaguucccugaa

SEQ ID NO: 2134632 - RNA, 13 nt, Homo sapiens
aauaauaccuuau

SEQ ID NO: 2134633 - RNA, 16 nt, Homo sapiens
gaacuuacuauucauu

SEQ ID NO: 2134634 - RNA, 18 nt, Homo sapiens
caugggaucuugagggac

SEQ ID NO: 2134635 - RNA, 21 nt, Homo sapiens
gaaauuacuggaaggcuucca

SEQ ID NO: 2134636 - RNA, 21 nt, Homo sapiens
guauguuauuugaugacugaa

SEQ ID NO: 2134637 - RNA, 23 nt, Homo sapiens
ggcagcucccagccucuucccau

SEQ ID NO: 2134638 - RNA, 15 nt, Homo sapiens
uaaugucucuucuaa

SEQ ID NO: 2134639 - RNA, 17 nt, Homo sapiens
ugugaauaaugauuugg

SEQ ID NO: 2134640 - RNA, 11 nt, Homo sapiens
ggcuguucuca

SEQ ID NO: 2134641 - RNA, 19 nt, Homo sapiens
gcuuacuauaaaugauauc

SEQ ID NO: 2134642 - RNA, 17 nt, Homo sapiens
uacacuugguguacugg

SEQ ID NO: 2134643 - RNA, 20 nt, Homo sapiens
aauguucccaaguaggcauu

SEQ ID NO: 2134644 - RNA, 17 nt, Homo sapiens
gcgccaauaaaccaaug

SEQ ID NO: 2134645 - RNA, 21 nt, Homo sapiens
cuccuagacacuccccacggg

SEQ ID NO: 2134646 - RNA, 16 nt, Homo sapiens
acagggcagugacaag

SEQ ID NO: 2134647 - RNA, 21 nt, Homo sapiens
uaaucagacaaaguaauuccu

SEQ ID NO: 2134648 - RNA, 16 nt, Homo sapiens
ugguccuagaacuuug

SEQ ID NO: 2134649 - RNA, 16 nt, Homo sapiens
cgacgcugacugcccu

SEQ ID NO: 2134650 - RNA, 13 nt, Homo sapiens
caacgaagccgga

SEQ ID NO: 2134651 - RNA, 23 nt, Homo sapiens
guacaugcuaugcugaagacauu

SEQ ID NO: 2134652 - RNA, 23 nt, Homo sapiens
ucacaauacaguggauagcuuga

SEQ ID NO: 2134653 - RNA, 14 nt, Homo sapiens
cauuauaugcaaau

SEQ ID NO: 2134654 - RNA, 14 nt, Homo sapiens
cauuaaaugcaaaa

SEQ ID NO: 2134655 - RNA, 13 nt, Homo sapiens
uaacaugugaaaa

SEQ ID NO: 2134656 - RNA, 12 nt, Homo sapiens
aagaagcuuuau

SEQ ID NO: 2134657 - RNA, 18 nt, Homo sapiens
aaugucacggcuacucua

SEQ ID NO: 2134658 - RNA, 18 nt, Homo sapiens
agcuuuacaaauauguca

SEQ ID NO: 2134659 - RNA, 23 nt, Homo sapiens
uugauuaaccuuuucaaauuaau

SEQ ID NO: 2134660 - RNA, 12 nt, Homo sapiens
cugccuacaucc

SEQ ID NO: 2134661 - RNA, 14 nt, Homo sapiens
uuaaaucucuccca

SEQ ID NO: 2134662 - RNA, 15 nt, Homo sapiens
ucuugucucuggugu

SEQ ID NO: 2134663 - RNA, 13 nt, Homo sapiens
auacuuugcauau

SEQ ID NO: 2134664 - RNA, 14 nt, Homo sapiens
ccuggagccuuuga

SEQ ID NO: 2134665 - RNA, 15 nt, Homo sapiens
aucuuaaagcacuua

SEQ ID NO: 2134666 - RNA, 19 nt, Homo sapiens
agacuucuuugcaacaaua

SEQ ID NO: 2134667 - RNA, 16 nt, Homo sapiens
agccucagaaagggau

SEQ ID NO: 2134668 - RNA, 15 nt, Homo sapiens
auaccagaucacuca

SEQ ID NO: 2134669 - RNA, 14 nt, Homo sapiens
augacauugcauuu

SEQ ID NO: 2134670 - RNA, 17 nt, Homo sapiens
agacaccaugugcaaua

SEQ ID NO: 2134671 - RNA, 19 nt, Homo sapiens
cuguuaaucugauguauaa

SEQ ID NO: 2134672 - RNA, 18 nt, Homo sapiens
cacagaggcaguggcagc

SEQ ID NO: 2134673 - RNA, 12 nt, Homo sapiens
agggagugucag

SEQ ID NO: 2134674 - RNA, 13 nt, Homo sapiens
uccucugcugcuc

SEQ ID NO: 2134675 - RNA, 13 nt, Homo sapiens
agucaugcacuca

SEQ ID NO: 2134676 - RNA, 18 nt, Homo sapiens
uugguuuguugagccuaa

SEQ ID NO: 2134677 - RNA, 15 nt, Homo sapiens
gcaaaacugcaaauu

SEQ ID NO: 2134678 - RNA, 15 nt, Homo sapiens
ugcccuuuugcccac

SEQ ID NO: 2134679 - RNA, 15 nt, Homo sapiens
uaccaauuauggaaa

SEQ ID NO: 2134680 - RNA, 18 nt, Homo sapiens
ccuugagggcgucuucua

SEQ ID NO: 2134681 - RNA, 18 nt, Homo sapiens
aaggguacagaugugcug

SEQ ID NO: 2134682 - RNA, 18 nt, Homo sapiens
ccaagcuggccacuauca

SEQ ID NO: 2134683 - RNA, 16 nt, Homo sapiens
gaagauuagcaugaaa

SEQ ID NO: 2134684 - RNA, 16 nt, Homo sapiens
caugauuuccuugaau

SEQ ID NO: 2134685 - RNA, 18 nt, Homo sapiens
agaaggggaggacacugg

SEQ ID NO: 2134686 - RNA, 15 nt, Homo sapiens
ugucccuuugcuccc

SEQ ID NO: 2134687 - RNA, 16 nt, Homo sapiens
uuuucccagcuuuuga

SEQ ID NO: 2134688 - RNA, 20 nt, Homo sapiens
agaugcaaaucaacucucuc

SEQ ID NO: 2134689 - RNA, 18 nt, Homo sapiens
caguaauuguguuuacau

SEQ ID NO: 2134690 - RNA, 21 nt, Homo sapiens
gaauaucuguucccagccccu

SEQ ID NO: 2134691 - RNA, 12 nt, Homo sapiens
caaaggugcuac

SEQ ID NO: 2134692 - RNA, 20 nt, Homo sapiens
aauucaguugcuuugcccaa

SEQ ID NO: 2134693 - RNA, 15 nt, Homo sapiens
uaucauuaccaucuc

SEQ ID NO: 2134694 - RNA, 18 nt, Homo sapiens
uucaccacaugugcacau

SEQ ID NO: 2134695 - RNA, 12 nt, Homo sapiens
gcuacucuugga

SEQ ID NO: 2134696 - RNA, 21 nt, Homo sapiens
gaaacguggauacagagccac

SEQ ID NO: 2134697 - RNA, 15 nt, Homo sapiens
cagagcaaccucuca

SEQ ID NO: 2134698 - RNA, 15 nt, Homo sapiens
gcccccucagggaug

SEQ ID NO: 2134699 - RNA, 18 nt, Homo sapiens
acacauuauuaagcaccg

SEQ ID NO: 2134700 - RNA, 17 nt, Homo sapiens
accaaguuggaauucca

SEQ ID NO: 2134701 - RNA, 16 nt, Homo sapiens
agaugugagggcacca

SEQ ID NO: 2134702 - RNA, 15 nt, Homo sapiens
acgugagaacaauca

SEQ ID NO: 2134703 - RNA, 12 nt, Homo sapiens
cccuugcugcaa

SEQ ID NO: 2134704 - RNA, 11 nt, Homo sapiens
uuaguauuuau

SEQ ID NO: 2134705 - RNA, 12 nt, Homo sapiens
ccauugcugcca

SEQ ID NO: 2134706 - RNA, 13 nt, Homo sapiens
uaaauaaucacac

SEQ ID NO: 2134707 - RNA, 13 nt, Homo sapiens
uuaauaaucucac

SEQ ID NO: 2134708 - RNA, 15 nt, Homo sapiens
agacacugaucuggc

SEQ ID NO: 2134709 - RNA, 17 nt, Homo sapiens
aaauauuacacaucaag

SEQ ID NO: 2134710 - RNA, 15 nt, Homo sapiens
cuuaccauugugauu

SEQ ID NO: 2134711 - RNA, 16 nt, Homo sapiens
guaaaucuaaacauaa

SEQ ID NO: 2134712 - RNA, 23 nt, Homo sapiens
guucaagcaauccuccuaccuca

SEQ ID NO: 2134713 - RNA, 15 nt, Homo sapiens
agccagcuguguuca

SEQ ID NO: 2134714 - RNA, 15 nt, Homo sapiens
agcuuccugugcaga

SEQ ID NO: 2134715 - RNA, 14 nt, Homo sapiens
uauuuaauuagcca

SEQ ID NO: 2134716 - RNA, 18 nt, Homo sapiens
ucucaaguaaaacaaaug

SEQ ID NO: 2134717 - RNA, 14 nt, Homo sapiens
uccaggacugagau

SEQ ID NO: 2134718 - RNA, 19 nt, Homo sapiens
auaaauccaauaucauguc

SEQ ID NO: 2134719 - RNA, 22 nt, Homo sapiens
cccaaaucuuguuuacaaaaua

SEQ ID NO: 2134720 - RNA, 21 nt, Homo sapiens
auaaauuggaacaccuccuca

SEQ ID NO: 2134721 - RNA, 22 nt, Homo sapiens
acuguauugcuguaugguauau

SEQ ID NO: 2134722 - RNA, 16 nt, Homo sapiens
aaagaaguuucuggag

SEQ ID NO: 2134723 - RNA, 17 nt, Homo sapiens
cagaauuuccacuguaa

SEQ ID NO: 2134724 - RNA, 16 nt, Homo sapiens
cuauccauuuuacacu

SEQ ID NO: 2134725 - RNA, 19 nt, Homo sapiens
gaugaaaauguaacuugaa

SEQ ID NO: 2134726 - RNA, 15 nt, Homo sapiens
aguauuaacuauuag

SEQ ID NO: 2134727 - RNA, 22 nt, Homo sapiens
cagcuccaaaacuggaccacca

SEQ ID NO: 2134728 - RNA, 23 nt, Homo sapiens
cuuaacuuaaaagaacauaggaa

SEQ ID NO: 2134729 - RNA, 22 nt, Homo sapiens
auucauuauuuuuccacuuugu

SEQ ID NO: 2134730 - RNA, 15 nt, Homo sapiens
cuaagaaauaagcau

SEQ ID NO: 2134731 - RNA, 19 nt, Homo sapiens
aguuuggcuuuuuucacau

SEQ ID NO: 2134732 - RNA, 16 nt, Homo sapiens
ggaauaauuauuuauu

SEQ ID NO: 2134733 - RNA, 20 nt, Homo sapiens
ccugcuuuuuaugggagcug

SEQ ID NO: 2134734 - RNA, 14 nt, Homo sapiens
auuaaaauacuuag

SEQ ID NO: 2134735 - RNA, 15 nt, Homo sapiens
ggagugcagaagcau

SEQ ID NO: 2134736 - RNA, 12 nt, Homo sapiens
ccagagcacugg

SEQ ID NO: 2134737 - RNA, 20 nt, Homo sapiens
ccaagugaaaagcaggcaaa

SEQ ID NO: 2134738 - RNA, 21 nt, Homo sapiens
ugagaugcuguaggugguaug

SEQ ID NO: 2134739 - RNA, 23 nt, Homo sapiens
guauuuaaaaaaacaaucccaag

SEQ ID NO: 2134740 - RNA, 17 nt, Homo sapiens
gacaaaagcagcacaag

SEQ ID NO: 2134741 - RNA, 15 nt, Homo sapiens
gccucugacaugacu

SEQ ID NO: 2134742 - RNA, 15 nt, Homo sapiens
cuuuugcauucuccc

SEQ ID NO: 2134743 - RNA, 21 nt, Homo sapiens
guauuagagcgccagcuccuu

SEQ ID NO: 2134744 - RNA, 18 nt, Homo sapiens
uuccuccaguuggaugaa

SEQ ID NO: 2134745 - RNA, 20 nt, Homo sapiens
gcuucccaaguagcugcaac

SEQ ID NO: 2134746 - RNA, 12 nt, Homo sapiens
uguaagaacaac

SEQ ID NO: 2134747 - RNA, 13 nt, Homo sapiens
gcccuaggugaga

SEQ ID NO: 2134748 - RNA, 17 nt, Homo sapiens
uaacuggugugagucaa

SEQ ID NO: 2134749 - RNA, 13 nt, Homo sapiens
uuaagcacacaca

SEQ ID NO: 2134750 - RNA, 19 nt, Homo sapiens
acuccagcgcugaguggga

SEQ ID NO: 2134751 - RNA, 21 nt, Homo sapiens
acuuuuacauuuuucugaugg

SEQ ID NO: 2134752 - RNA, 13 nt, Homo sapiens
cuccaacaccaag

SEQ ID NO: 2134753 - RNA, 15 nt, Homo sapiens
gucagagaugggcug

SEQ ID NO: 2134754 - RNA, 18 nt, Homo sapiens
ucaaguuuucagcuuuaa

SEQ ID NO: 2134755 - RNA, 14 nt, Homo sapiens
auuguauccaaagg

SEQ ID NO: 2134756 - RNA, 13 nt, Homo sapiens
ugaauuugcaugu

SEQ ID NO: 2134757 - RNA, 21 nt, Homo sapiens
guauuuauuuuuucaaaaaca

SEQ ID NO: 2134758 - RNA, 17 nt, Homo sapiens
uggucuggccacugucc

SEQ ID NO: 2134759 - RNA, 15 nt, Homo sapiens
uuagagacuguaaau

SEQ ID NO: 2134760 - RNA, 17 nt, Homo sapiens
auuauuuaaacucgcuc

SEQ ID NO: 2134761 - RNA, 21 nt, Homo sapiens
cagcuaugcacuguaaaugca

SEQ ID NO: 2134762 - RNA, 14 nt, Homo sapiens
ugcacacauuuaac

SEQ ID NO: 2134763 - RNA, 23 nt, Homo sapiens
ccccaagagcaggaggugccuga

SEQ ID NO: 2134764 - RNA, 20 nt, Homo sapiens
gggcuuuucaaaaucauuua

SEQ ID NO: 2134765 - RNA, 15 nt, Homo sapiens
guuuaccacuaacuc

SEQ ID NO: 2134766 - RNA, 16 nt, Homo sapiens
gacuguuuuuuuugca

SEQ ID NO: 2134767 - RNA, 18 nt, Homo sapiens
gucugggcugggcaccug

SEQ ID NO: 2134768 - RNA, 22 nt, Homo sapiens
caccauugcacuccacccuggg

SEQ ID NO: 2134769 - RNA, 13 nt, Homo sapiens
ccugccuguacuc

SEQ ID NO: 2134770 - RNA, 16 nt, Homo sapiens
cagaauccugauggua

SEQ ID NO: 2134771 - RNA, 17 nt, Homo sapiens
agacuccucaucaugau

SEQ ID NO: 2134772 - RNA, 14 nt, Homo sapiens
cucugcccauuccc

SEQ ID NO: 2134773 - RNA, 23 nt, Homo sapiens
gguuguucaaaguuuaagcaauu

SEQ ID NO: 2134774 - RNA, 17 nt, Homo sapiens
gcccagaauucugggca

SEQ ID NO: 2134775 - RNA, 16 nt, Homo sapiens
gcagccccacacccgc

SEQ ID NO: 2134776 - RNA, 14 nt, Homo sapiens
ggaaaauguauuua

SEQ ID NO: 2134777 - RNA, 19 nt, Homo sapiens
gaucuguaaggaacuggaa

SEQ ID NO: 2134778 - RNA, 19 nt, Homo sapiens
cuuuagugcuuucuuguca

SEQ ID NO: 2134779 - RNA, 21 nt, Homo sapiens
uggaugaaggacgugucucag

SEQ ID NO: 2134780 - RNA, 13 nt, Homo sapiens
aggcagagccuga

SEQ ID NO: 2134781 - RNA, 12 nt, Homo sapiens
aaagcauuugau

SEQ ID NO: 2134782 - RNA, 15 nt, Homo sapiens
aucuucacagcacau

SEQ ID NO: 2134783 - RNA, 20 nt, Homo sapiens
accucugccuccuaaguuca

SEQ ID NO: 2134784 - RNA, 17 nt, Homo sapiens
uacugggaaauuacuua

SEQ ID NO: 2134785 - RNA, 20 nt, Homo sapiens
agcaaauguuucugcaguag

SEQ ID NO: 2134786 - RNA, 18 nt, Homo sapiens
uuucauuuauccagauga

SEQ ID NO: 2134787 - RNA, 19 nt, Homo sapiens
guucuuagcugaacaauga

SEQ ID NO: 2134788 - RNA, 19 nt, Homo sapiens
ugugccugaguggccugua

SEQ ID NO: 2134789 - RNA, 22 nt, Homo sapiens
aggcugaugucuuaacugucac

SEQ ID NO: 2134790 - RNA, 15 nt, Homo sapiens
ccacggccacaguca

SEQ ID NO: 2134791 - RNA, 20 nt, Homo sapiens
guaccugguggauaucuagc

SEQ ID NO: 2134792 - RNA, 14 nt, Homo sapiens
uaccucacuggggu

SEQ ID NO: 2134793 - RNA, 12 nt, Homo sapiens
ccgucucaaaaa

SEQ ID NO: 2134794 - RNA, 15 nt, Homo sapiens
cguuagucucugaac

SEQ ID NO: 2134795 - RNA, 21 nt, Homo sapiens
cucaguucucuugcuuucaca

SEQ ID NO: 2134796 - RNA, 22 nt, Homo sapiens
guuuagcuuuuuccuuacuuuu

SEQ ID NO: 2134797 - RNA, 14 nt, Homo sapiens
uuaugaaaaagaag

SEQ ID NO: 2134798 - RNA, 16 nt, Homo sapiens
acucagcuauaccuca

SEQ ID NO: 2134799 - RNA, 12 nt, Homo sapiens
gaauguauauca

SEQ ID NO: 2134800 - RNA, 16 nt, Homo sapiens
cagagcacacuuauuu

SEQ ID NO: 2134801 - RNA, 17 nt, Homo sapiens
agguaguagaaucucag

SEQ ID NO: 2134802 - RNA, 13 nt, Homo sapiens
gaaaggagacaau

SEQ ID NO: 2134803 - RNA, 20 nt, Homo sapiens
aauagcaauagcauggauag

SEQ ID NO: 2134804 - RNA, 14 nt, Homo sapiens
aagaugaucagugg

SEQ ID NO: 2134805 - RNA, 12 nt, Homo sapiens
acaucaccuuuu

SEQ ID NO: 2134806 - RNA, 20 nt, Homo sapiens
gcugagaccacugaguacca

SEQ ID NO: 2134807 - RNA, 18 nt, Homo sapiens
ccugaaacagccaugucc

SEQ ID NO: 2134808 - RNA, 14 nt, Homo sapiens
uuuaaaguggcaau

SEQ ID NO: 2134809 - RNA, 12 nt, Homo sapiens
accccaggcuac

SEQ ID NO: 2134810 - RNA, 15 nt, Homo sapiens
aguggccagccagug

SEQ ID NO: 2134811 - RNA, 23 nt, Homo sapiens
uguccuauucccugucacuacac

SEQ ID NO: 2134812 - RNA, 16 nt, Homo sapiens
cagccccuccacguga

SEQ ID NO: 2134813 - RNA, 18 nt, Homo sapiens
caccccuaaagugccagg

SEQ ID NO: 2134814 - RNA, 18 nt, Homo sapiens
cuucccgaguaacugaga

SEQ ID NO: 2134815 - RNA, 17 nt, Homo sapiens
accacagcagagaccac

SEQ ID NO: 2134816 - RNA, 22 nt, Homo sapiens
uuugucacaaauaaacauaaua

SEQ ID NO: 2134817 - RNA, 21 nt, Homo sapiens
aucuaaaaagacuaaccugcc

SEQ ID NO: 2134818 - RNA, 17 nt, Homo sapiens
ccaggccugggugaucu

SEQ ID NO: 2134819 - RNA, 18 nt, Homo sapiens
cuacacagggccugcuau

SEQ ID NO: 2134820 - RNA, 19 nt, Homo sapiens
agccugucacccagcuccu

SEQ ID NO: 2134821 - RNA, 19 nt, Homo sapiens
ugggcaacaagagcaaaac

SEQ ID NO: 2134822 - RNA, 20 nt, Homo sapiens
aucuccaucugucaacaggg

SEQ ID NO: 2134823 - RNA, 20 nt, Homo sapiens
gauuuugcuugagcaggauu

SEQ ID NO: 2134824 - RNA, 20 nt, Homo sapiens
caagaaauaugaagcacuuu

SEQ ID NO: 2134825 - RNA, 15 nt, Homo sapiens
gaagcauucucccca

SEQ ID NO: 2134826 - RNA, 15 nt, Homo sapiens
gaaaacugugcaaug

SEQ ID NO: 2134827 - RNA, 16 nt, Homo sapiens
cuggaaggagcacaua

SEQ ID NO: 2134828 - RNA, 20 nt, Homo sapiens
guagaggggagacauuagaa

SEQ ID NO: 2134829 - RNA, 23 nt, Homo sapiens
uuaaucuuugaaaacucauacag

SEQ ID NO: 2134830 - RNA, 17 nt, Homo sapiens
cuaaguucacggcaaaa

SEQ ID NO: 2134831 - RNA, 12 nt, Homo sapiens
uuggagcucauu

SEQ ID NO: 2134832 - RNA, 13 nt, Homo sapiens
aauauauaauuga

SEQ ID NO: 2134833 - RNA, 21 nt, Homo sapiens
cgaacaauucauauauuugaa

SEQ ID NO: 2134834 - RNA, 13 nt, Homo sapiens
uuuauauauauga

SEQ ID NO: 2134835 - RNA, 13 nt, Homo sapiens
cauguauacuuaa

SEQ ID NO: 2134836 - RNA, 13 nt, Homo sapiens
caaauguuauuau

SEQ ID NO: 2134837 - RNA, 19 nt, Homo sapiens
uacuauggagugcucacaa

SEQ ID NO: 2134838 - RNA, 15 nt, Homo sapiens
auuuguauuugccau

SEQ ID NO: 2134839 - RNA, 23 nt, Homo sapiens
agaaauaacagaagaaaauagaa

SEQ ID NO: 2134840 - RNA, 16 nt, Homo sapiens
acuucuaguuuggcau

SEQ ID NO: 2134841 - RNA, 21 nt, Homo sapiens
uggucccucugcagucucuau

SEQ ID NO: 2134842 - RNA, 21 nt, Homo sapiens
gagcucgguggacccagggau

SEQ ID NO: 2134843 - RNA, 19 nt, Homo sapiens
auuuauuuuuaaugcagua

SEQ ID NO: 2134844 - RNA, 12 nt, Homo sapiens
ugacugcaugac

SEQ ID NO: 2134845 - RNA, 17 nt, Homo sapiens
cugcgagagaaagggag

SEQ ID NO: 2134846 - RNA, 14 nt, Homo sapiens
cuuauacaccuuau

SEQ ID NO: 2134847 - RNA, 21 nt, Homo sapiens
auaguuacugcugcacuuuca

SEQ ID NO: 2134848 - RNA, 21 nt, Homo sapiens
uugcaauuugucaguguauaa

SEQ ID NO: 2134849 - RNA, 14 nt, Homo sapiens
guguuugaggccaa

SEQ ID NO: 2134850 - RNA, 14 nt, Homo sapiens
agcuuagaaugcau

SEQ ID NO: 2134851 - RNA, 15 nt, Homo sapiens
auuccucuuugccca

SEQ ID NO: 2134852 - RNA, 16 nt, Homo sapiens
gagcacaggagcugcc

SEQ ID NO: 2134853 - RNA, 12 nt, Homo sapiens
auucacugugca

SEQ ID NO: 2134854 - RNA, 19 nt, Homo sapiens
acgugcauggauaugugcc

SEQ ID NO: 2134855 - RNA, 20 nt, Homo sapiens
uuggacauuuuaaacacuua

SEQ ID NO: 2134856 - RNA, 18 nt, Homo sapiens
ggccuauuguugaauaaa

SEQ ID NO: 2134857 - RNA, 11 nt, Homo sapiens
acuugcaauac

SEQ ID NO: 2134858 - RNA, 19 nt, Homo sapiens
uaugucacuagaauggaua

SEQ ID NO: 2134859 - RNA, 18 nt, Homo sapiens
augaacacuauauguaug

SEQ ID NO: 2134860 - RNA, 20 nt, Homo sapiens
caugugugucagcccauguc

SEQ ID NO: 2134861 - RNA, 15 nt, Homo sapiens
caguuguuauauuca

SEQ ID NO: 2134862 - RNA, 18 nt, Homo sapiens
gguuauucagaaccuaaa

SEQ ID NO: 2134863 - RNA, 13 nt, Homo sapiens
gaagccuugccua

SEQ ID NO: 2134864 - RNA, 22 nt, Homo sapiens
ugacaccccccuucugaaugaa

SEQ ID NO: 2134865 - RNA, 13 nt, Homo sapiens
uugaggagcucaa

SEQ ID NO: 2134866 - RNA, 18 nt, Homo sapiens
cagaucuuuuugugaaau

SEQ ID NO: 2134867 - RNA, 17 nt, Homo sapiens
cuuaaugagacuuuaaa

SEQ ID NO: 2134868 - RNA, 18 nt, Homo sapiens
ggguggagggaaggugag

SEQ ID NO: 2134869 - RNA, 13 nt, Homo sapiens
uggggguguagua

SEQ ID NO: 2134870 - RNA, 15 nt, Homo sapiens
aauugagcaccuacu

SEQ ID NO: 2134871 - RNA, 15 nt, Homo sapiens
uaacauaacacuaaa

SEQ ID NO: 2134872 - RNA, 14 nt, Homo sapiens
ucuucuuacuugau

SEQ ID NO: 2134873 - RNA, 20 nt, Homo sapiens
cucuucacagggaagcaugu

SEQ ID NO: 2134874 - RNA, 20 nt, Homo sapiens
ccuggcccccggguguaaau

SEQ ID NO: 2134875 - RNA, 22 nt, Homo sapiens
auucgcccuccucccugucaua

SEQ ID NO: 2134876 - RNA, 19 nt, Homo sapiens
uggcugcucccugcuccca

SEQ ID NO: 2134877 - RNA, 13 nt, Homo sapiens
ccuuaccuugaaa

SEQ ID NO: 2134878 - RNA, 13 nt, Homo sapiens
aaaacagaaagca

SEQ ID NO: 2134879 - RNA, 17 nt, Homo sapiens
acauccguuuucauugu

SEQ ID NO: 2134880 - RNA, 17 nt, Homo sapiens
auguuugggucuuuuau

SEQ ID NO: 2134881 - RNA, 23 nt, Homo sapiens
guguuuuacuaucucacugcugu

SEQ ID NO: 2134882 - RNA, 20 nt, Homo sapiens
agcaaucauuuuaugcuguu

SEQ ID NO: 2134883 - RNA, 13 nt, Homo sapiens
uugccgagcccag

SEQ ID NO: 2134884 - RNA, 17 nt, Homo sapiens
cuccuuuaucauuacca

SEQ ID NO: 2134885 - RNA, 20 nt, Homo sapiens
aauguuagauuccucuugcc

SEQ ID NO: 2134886 - RNA, 13 nt, Homo sapiens
caguggcugugaa

SEQ ID NO: 2134887 - RNA, 18 nt, Homo sapiens
aagaucuguccucagccu

SEQ ID NO: 2134888 - RNA, 11 nt, Homo sapiens
accaucugcau

SEQ ID NO: 2134889 - RNA, 14 nt, Homo sapiens
aagcugcauguuaa

SEQ ID NO: 2134890 - RNA, 16 nt, Homo sapiens
ggaccuucucccuccu

SEQ ID NO: 2134891 - RNA, 17 nt, Homo sapiens
agaccugcgauggacuu

SEQ ID NO: 2134892 - RNA, 22 nt, Homo sapiens
gcuaugugaagaguaagucaac

SEQ ID NO: 2134893 - RNA, 12 nt, Homo sapiens
ccuccagaguug

SEQ ID NO: 2134894 - RNA, 17 nt, Homo sapiens
ugagauuugggcugugc

SEQ ID NO: 2134895 - RNA, 14 nt, Homo sapiens
ggcucuccaagcac

SEQ ID NO: 2134896 - RNA, 16 nt, Homo sapiens
uguaugccaagugaga

SEQ ID NO: 2134897 - RNA, 15 nt, Homo sapiens
agagaauuaucucaa

SEQ ID NO: 2134898 - RNA, 21 nt, Homo sapiens
cugaacuggcugaaguucaag

SEQ ID NO: 2134899 - RNA, 18 nt, Homo sapiens
gauccugcagucaauguu

SEQ ID NO: 2134900 - RNA, 18 nt, Homo sapiens
cuuuauaggauaacugau

SEQ ID NO: 2134901 - RNA, 19 nt, Homo sapiens
cagcuacucaggaggcuaa

SEQ ID NO: 2134902 - RNA, 15 nt, Homo sapiens
acagaaaguucuuaa

SEQ ID NO: 2134903 - RNA, 21 nt, Homo sapiens
uaguccgugcugacagcugcu

SEQ ID NO: 2134904 - RNA, 18 nt, Homo sapiens
ccuaaaaguucucaaugu

SEQ ID NO: 2134905 - RNA, 18 nt, Homo sapiens
cuguccuucccacggcca

SEQ ID NO: 2134906 - RNA, 22 nt, Homo sapiens
guccugugcggugucaccauga

SEQ ID NO: 2134907 - RNA, 15 nt, Homo sapiens
guaaaucuaaacaua

SEQ ID NO: 2134908 - RNA, 19 nt, Homo sapiens
uauuuucuuggaauuuugu

SEQ ID NO: 2134909 - RNA, 18 nt, Homo sapiens
caccaauccccgccacag

SEQ ID NO: 2134910 - RNA, 18 nt, Homo sapiens
agugggccauuaaaaacu

SEQ ID NO: 2134911 - RNA, 17 nt, Homo sapiens
auuaggagacacaggga

SEQ ID NO: 2134912 - RNA, 13 nt, Homo sapiens
uucauggugacau

SEQ ID NO: 2134913 - RNA, 16 nt, Homo sapiens
uuaauccaauccacua

SEQ ID NO: 2134914 - RNA, 22 nt, Homo sapiens
uucacuuuuucugucuuuaugu

SEQ ID NO: 2134915 - RNA, 20 nt, Homo sapiens
cagguacccccugcacucuu

SEQ ID NO: 2134916 - RNA, 20 nt, Homo sapiens
gucgauccuggggcccucag

SEQ ID NO: 2134917 - RNA, 22 nt, Homo sapiens
ucauucuuacaauugcacugcu

SEQ ID NO: 2134918 - RNA, 15 nt, Homo sapiens
aggaguggggugguu

SEQ ID NO: 2134919 - RNA, 15 nt, Homo sapiens
cccagggacuuccuc

SEQ ID NO: 2134920 - RNA, 20 nt, Homo sapiens
agcacaugccucucucaggc

SEQ ID NO: 2134921 - RNA, 19 nt, Homo sapiens
caaaugcuggggucauaua

SEQ ID NO: 2134922 - RNA, 14 nt, Homo sapiens
ccaacauugagaug

SEQ ID NO: 2134923 - RNA, 20 nt, Homo sapiens
cuccugugggagaucuucac

SEQ ID NO: 2134924 - RNA, 15 nt, Homo sapiens
aggauugagcagcug

SEQ ID NO: 2134925 - RNA, 13 nt, Homo sapiens
gggaacaguccau

SEQ ID NO: 2134926 - RNA, 20 nt, Homo sapiens
gcccccagauacauggugau

SEQ ID NO: 2134927 - RNA, 16 nt, Homo sapiens
aauguuguacuugaaa

SEQ ID NO: 2134928 - RNA, 19 nt, Homo sapiens
aggguucuccauuacagug

SEQ ID NO: 2134929 - RNA, 19 nt, Homo sapiens
gccugcucgcccacuuccu

SEQ ID NO: 2134930 - RNA, 18 nt, Homo sapiens
uagaagaagcuaugucaa

SEQ ID NO: 2134931 - RNA, 20 nt, Homo sapiens
cgagcucccagcuccagcuu

SEQ ID NO: 2134932 - RNA, 17 nt, Homo sapiens
ugcucccugacagcacc

SEQ ID NO: 2134933 - RNA, 20 nt, Homo sapiens
ugaaugugcugaucauuuga

SEQ ID NO: 2134934 - RNA, 21 nt, Homo sapiens
acucagccuggcugauuauca

SEQ ID NO: 2134935 - RNA, 13 nt, Homo sapiens
cuggacacugggc

SEQ ID NO: 2134936 - RNA, 22 nt, Homo sapiens
ugaccauaaaggcauggcauuu

SEQ ID NO: 2134937 - RNA, 18 nt, Homo sapiens
gcuuucaucacuaccuuu

SEQ ID NO: 2134938 - RNA, 19 nt, Homo sapiens
ucuuacugaaguucaguga

SEQ ID NO: 2134939 - RNA, 16 nt, Homo sapiens
guugguuuauacugua

SEQ ID NO: 2134940 - RNA, 17 nt, Homo sapiens
augaugucuaccucaga

SEQ ID NO: 2134941 - RNA, 18 nt, Homo sapiens
ccaggacuccacuggaca

SEQ ID NO: 2134942 - RNA, 13 nt, Homo sapiens
auaugcgcuuaaa

SEQ ID NO: 2134943 - RNA, 14 nt, Homo sapiens
aaguccaauuccaa

SEQ ID NO: 2134944 - RNA, 12 nt, Homo sapiens
ucaagcauuuag

SEQ ID NO: 2134945 - RNA, 15 nt, Homo sapiens
uauuuuuaugugcaa

SEQ ID NO: 2134946 - RNA, 22 nt, Homo sapiens
uuccagaaggcaaaaagacauu

SEQ ID NO: 2134947 - RNA, 13 nt, Homo sapiens
ccaggacugggcc

SEQ ID NO: 2134948 - RNA, 14 nt, Homo sapiens
cucguguucacuca

SEQ ID NO: 2134949 - RNA, 18 nt, Homo sapiens
aucgcucauagaucagca

SEQ ID NO: 2134950 - RNA, 14 nt, Homo sapiens
cuggagagugcaca

SEQ ID NO: 2134951 - RNA, 15 nt, Homo sapiens
gaugcugagcuguga

SEQ ID NO: 2134952 - RNA, 14 nt, Homo sapiens
cagccaacugaaaa

SEQ ID NO: 2134953 - RNA, 21 nt, Homo sapiens
gggagcagaaacagccauugc

SEQ ID NO: 2134954 - RNA, 21 nt, Homo sapiens
auaagcuuucaauaguggcau

SEQ ID NO: 2134955 - RNA, 13 nt, Homo sapiens
acgcaguaacuaa

SEQ ID NO: 2134956 - RNA, 23 nt, Homo sapiens
ggagccauaagggacaugucuuu

SEQ ID NO: 2134957 - RNA, 14 nt, Homo sapiens
caguaacauuucau

SEQ ID NO: 2134958 - RNA, 17 nt, Homo sapiens
ccuggacuuuggcucag

SEQ ID NO: 2134959 - RNA, 22 nt, Homo sapiens
agagguacuaaaaacacuggau

SEQ ID NO: 2134960 - RNA, 21 nt, Homo sapiens
cugaagugguucagucuagaa

SEQ ID NO: 2134961 - RNA, 16 nt, Homo sapiens
agugauucccugcaca

SEQ ID NO: 2134962 - RNA, 13 nt, Homo sapiens
uccccugugggaa

SEQ ID NO: 2134963 - RNA, 18 nt, Homo sapiens
ugggaagcagucucuucc

SEQ ID NO: 2134964 - RNA, 17 nt, Homo sapiens
cuguacccuauguucac

SEQ ID NO: 2134965 - RNA, 17 nt, Homo sapiens
uauuuuguaauaaacuc

SEQ ID NO: 2134966 - RNA, 21 nt, Homo sapiens
uuguauauuccaccauucaca

SEQ ID NO: 2134967 - RNA, 17 nt, Homo sapiens
uuaaagaaacacuaaau

SEQ ID NO: 2134968 - RNA, 21 nt, Homo sapiens
cuucaggguuuaauagacuga

SEQ ID NO: 2134969 - RNA, 18 nt, Homo sapiens
cauagcugagguaaaaac

SEQ ID NO: 2134970 - RNA, 14 nt, Homo sapiens
auuaccuuuacaua

SEQ ID NO: 2134971 - RNA, 14 nt, Homo sapiens
ucuucauacuuaaa

SEQ ID NO: 2134972 - RNA, 20 nt, Homo sapiens
gcuggugugucauacugugc

SEQ ID NO: 2134973 - RNA, 23 nt, Homo sapiens
gauuauuaaaacugaacuugaag

SEQ ID NO: 2134974 - RNA, 16 nt, Homo sapiens
cugaaauaaacacugg

SEQ ID NO: 2134975 - RNA, 12 nt, Homo sapiens
aguuaagggaug

SEQ ID NO: 2134976 - RNA, 22 nt, Homo sapiens
cauguaaggucuucuugugucc

SEQ ID NO: 2134977 - RNA, 21 nt, Homo sapiens
gcuggugucugagcuucagua

SEQ ID NO: 2134978 - RNA, 18 nt, Homo sapiens
ucuacaucaauaucaucc

SEQ ID NO: 2134979 - RNA, 17 nt, Homo sapiens
gacagcagaagccucca

SEQ ID NO: 2134980 - RNA, 14 nt, Homo sapiens
ucuaaauagcacuu

SEQ ID NO: 2134981 - RNA, 14 nt, Homo sapiens
gccauaacuuuaug

SEQ ID NO: 2134982 - RNA, 15 nt, Homo sapiens
agccaagaucccauc

SEQ ID NO: 2134983 - RNA, 14 nt, Homo sapiens
cuauaacuaagcau

SEQ ID NO: 2134984 - RNA, 16 nt, Homo sapiens
cuuauauuucccuaaa

SEQ ID NO: 2134985 - RNA, 13 nt, Homo sapiens
uucaguuccaaga

SEQ ID NO: 2134986 - RNA, 18 nt, Homo sapiens
cucccucugcuacuccau

SEQ ID NO: 2134987 - RNA, 19 nt, Homo sapiens
cagccuggcugguccuccc

SEQ ID NO: 2134988 - RNA, 19 nt, Homo sapiens
agcuggcgggagcaguuug

SEQ ID NO: 2134989 - RNA, 12 nt, Homo sapiens
gccagcucagga

SEQ ID NO: 2134990 - RNA, 20 nt, Homo sapiens
gauaacuuggggaggcaaga

SEQ ID NO: 2134991 - RNA, 16 nt, Homo sapiens
agaaaauaacaauaaa

SEQ ID NO: 2134992 - RNA, 15 nt, Homo sapiens
aaccauggcacuuga

SEQ ID NO: 2134993 - RNA, 19 nt, Homo sapiens
cugcucuacagaaggacau

SEQ ID NO: 2134994 - RNA, 22 nt, Homo sapiens
gagaaaacuuauuugagugauu

SEQ ID NO: 2134995 - RNA, 15 nt, Homo sapiens
caagggagacugacc

SEQ ID NO: 2134996 - RNA, 23 nt, Homo sapiens
aguuuuccuucucaucugugauu

SEQ ID NO: 2134997 - RNA, 18 nt, Homo sapiens
cugggacaccauuaccaa

SEQ ID NO: 2134998 - RNA, 16 nt, Homo sapiens
gaaucauucuguaaag

SEQ ID NO: 2134999 - RNA, 19 nt, Homo sapiens
aaaccauugugcauucuag

SEQ ID NO: 2135000 - RNA, 15 nt, Homo sapiens
ggaaaaccagggaua

SEQ ID NO: 2135001 - RNA, 16 nt, Homo sapiens
ucacggccacacagcu

SEQ ID NO: 2135002 - RNA, 22 nt, Homo sapiens
cauacccgccuagcugcuguca

SEQ ID NO: 2135003 - RNA, 16 nt, Homo sapiens
gcaucaagaugugaca

SEQ ID NO: 2135004 - RNA, 21 nt, Homo sapiens
acugaguauguucauugccac

SEQ ID NO: 2135005 - RNA, 20 nt, Homo sapiens
auccugaaaggcaacauaau

SEQ ID NO: 2135006 - RNA, 16 nt, Homo sapiens
cuguccuagucuugau

SEQ ID NO: 2135007 - RNA, 18 nt, Homo sapiens
gaugacagugaugcugcc

SEQ ID NO: 2135008 - RNA, 20 nt, Homo sapiens
caccccugauguggcauaug

SEQ ID NO: 2135009 - RNA, 16 nt, Homo sapiens
uaugccuuaagccaau

SEQ ID NO: 2135010 - RNA, 19 nt, Homo sapiens
aggggcaccggcugcccac

SEQ ID NO: 2135011 - RNA, 13 nt, Homo sapiens
aacaaaauaucug

SEQ ID NO: 2135012 - RNA, 18 nt, Homo sapiens
caggguugaaucuugucc

SEQ ID NO: 2135013 - RNA, 19 nt, Homo sapiens
uaugcagagguccacaaca

SEQ ID NO: 2135014 - RNA, 15 nt, Homo sapiens
aaucccagcacuuug

SEQ ID NO: 2135015 - RNA, 20 nt, Homo sapiens
agcucaucccucucacccag

SEQ ID NO: 2135016 - RNA, 18 nt, Homo sapiens
ucagagcaagcacuggac

SEQ ID NO: 2135017 - RNA, 23 nt, Homo sapiens
cuuucagauacuggauuguacuu

SEQ ID NO: 2135018 - RNA, 19 nt, Homo sapiens
cugaagguaauacuauaaa

SEQ ID NO: 2135019 - RNA, 23 nt, Homo sapiens
uuuaacacccuuuagaaccuuaa

SEQ ID NO: 2135020 - RNA, 13 nt, Homo sapiens
ccuauucuuucua

SEQ ID NO: 2135021 - RNA, 19 nt, Homo sapiens
aagauguggccuuuagcaa

SEQ ID NO: 2135022 - RNA, 21 nt, Homo sapiens
cugucaguuguacuucugcuc

SEQ ID NO: 2135023 - RNA, 14 nt, Homo sapiens
aggauuuuaccaaa

SEQ ID NO: 2135024 - RNA, 22 nt, Homo sapiens
aaaagguagcuuaccugacaca

SEQ ID NO: 2135025 - RNA, 16 nt, Homo sapiens
cugauaauguauugca

SEQ ID NO: 2135026 - RNA, 12 nt, Homo sapiens
aauucagugucu

SEQ ID NO: 2135027 - RNA, 18 nt, Homo sapiens
cacaagguaaauauucau

SEQ ID NO: 2135028 - RNA, 20 nt, Homo sapiens
uguacagaaacaacugccaa

SEQ ID NO: 2135029 - RNA, 21 nt, Homo sapiens
uucccggguagccacuggacu

SEQ ID NO: 2135030 - RNA, 22 nt, Homo sapiens
aacugggccuguagcucaagag

SEQ ID NO: 2135031 - RNA, 15 nt, Homo sapiens
aauugacaacacagc

SEQ ID NO: 2135032 - RNA, 15 nt, Homo sapiens
ccucagaacaaugaa

SEQ ID NO: 2135033 - RNA, 15 nt, Homo sapiens
cuggggaucuaggga

SEQ ID NO: 2135034 - RNA, 15 nt, Homo sapiens
guauacauguguaca

SEQ ID NO: 2135035 - RNA, 16 nt, Homo sapiens
ggcagccaagagccau

SEQ ID NO: 2135036 - RNA, 22 nt, Homo sapiens
agaagaaaaaguugcagucuca

SEQ ID NO: 2135037 - RNA, 18 nt, Homo sapiens
acaaguauguugagaguu

SEQ ID NO: 2135038 - RNA, 18 nt, Homo sapiens
agccagcuuuuccagaaa

SEQ ID NO: 2135039 - RNA, 15 nt, Homo sapiens
gcaggaagggagaac

SEQ ID NO: 2135040 - RNA, 20 nt, Homo sapiens
gccccauccaacacuggaug

SEQ ID NO: 2135041 - RNA, 19 nt, Homo sapiens
gucccuuucgacuugcauu

SEQ ID NO: 2135042 - RNA, 13 nt, Homo sapiens
gugugggcacgug

SEQ ID NO: 2135043 - RNA, 21 nt, Homo sapiens
uacccaaauuuuaauauucca

SEQ ID NO: 2135044 - RNA, 12 nt, Homo sapiens
cccagagcacuu

SEQ ID NO: 2135045 - RNA, 18 nt, Homo sapiens
gcucaccgcccugcuuca

SEQ ID NO: 2135046 - RNA, 16 nt, Homo sapiens
cccccugcagcuugua

SEQ ID NO: 2135047 - RNA, 15 nt, Homo sapiens
cauucagacuuucag

SEQ ID NO: 2135048 - RNA, 15 nt, Homo sapiens
cuugcacacaugcac

SEQ ID NO: 2135049 - RNA, 21 nt, Homo sapiens
cucgaauaaaggaugggacca

SEQ ID NO: 2135050 - RNA, 21 nt, Homo sapiens
aaaccuuagauaucugguucu

SEQ ID NO: 2135051 - RNA, 19 nt, Homo sapiens
ggauauaagagggcuuuuu

SEQ ID NO: 2135052 - RNA, 14 nt, Homo sapiens
ucuggaaguggagu

SEQ ID NO: 2135053 - RNA, 22 nt, Homo sapiens
uuccugguuugacucaguucca

SEQ ID NO: 2135054 - RNA, 21 nt, Homo sapiens
cuuggaggcuuuuauggggcc

SEQ ID NO: 2135055 - RNA, 20 nt, Homo sapiens
agaaugagcacccauuccaa

SEQ ID NO: 2135056 - RNA, 19 nt, Homo sapiens
aacugaaaggcaugugaag

SEQ ID NO: 2135057 - RNA, 22 nt, Homo sapiens
accuaaaaacauuuacugacca

SEQ ID NO: 2135058 - RNA, 15 nt, Homo sapiens
uacaaucagcccagu

SEQ ID NO: 2135059 - RNA, 13 nt, Homo sapiens
aagcuucuucacu

SEQ ID NO: 2135060 - RNA, 18 nt, Homo sapiens
cccuuauguguuguguau

SEQ ID NO: 2135061 - RNA, 21 nt, Homo sapiens
ggagccgagggcgucagagag

SEQ ID NO: 2135062 - RNA, 15 nt, Homo sapiens
ugggcgacagagcca

SEQ ID NO: 2135063 - RNA, 17 nt, Homo sapiens
ugacuaaccauugauga

SEQ ID NO: 2135064 - RNA, 15 nt, Homo sapiens
gguauggccaaagau

SEQ ID NO: 2135065 - RNA, 16 nt, Homo sapiens
ccaggaauaggcauuu

SEQ ID NO: 2135066 - RNA, 17 nt, Homo sapiens
agcuacuguagaaacaa

SEQ ID NO: 2135067 - RNA, 23 nt, Homo sapiens
aucgauggaugggaugcacucuc

SEQ ID NO: 2135068 - RNA, 18 nt, Homo sapiens
uucagaguccuugcaaaa

SEQ ID NO: 2135069 - RNA, 15 nt, Homo sapiens
acuuuugaccaaaua

SEQ ID NO: 2135070 - RNA, 17 nt, Homo sapiens
gcuugugggacuagccu

SEQ ID NO: 2135071 - RNA, 12 nt, Homo sapiens
aguugcaaaggu

SEQ ID NO: 2135072 - RNA, 17 nt, Homo sapiens
ccuaauuccacacccuc

SEQ ID NO: 2135073 - RNA, 18 nt, Homo sapiens
caaguuuuucauacugua

SEQ ID NO: 2135074 - RNA, 20 nt, Homo sapiens
gaaaggaauuggcaugugua

SEQ ID NO: 2135075 - RNA, 18 nt, Homo sapiens
ugaaauuaguuuaccuca

SEQ ID NO: 2135076 - RNA, 18 nt, Homo sapiens
ugguuuuucaguuuucag

SEQ ID NO: 2135077 - RNA, 15 nt, Homo sapiens
aaguacaaagggcac

SEQ ID NO: 2135078 - RNA, 17 nt, Homo sapiens
accauucacagugcaag

SEQ ID NO: 2135079 - RNA, 23 nt, Homo sapiens
cucuaaaaugcuguucucaauca

SEQ ID NO: 2135080 - RNA, 23 nt, Homo sapiens
ccaagaaaaucacaucacuaccu

SEQ ID NO: 2135081 - RNA, 20 nt, Homo sapiens
gagaucgugccauugcacuc

SEQ ID NO: 2135082 - RNA, 14 nt, Homo sapiens
aaagaaaaugauga

SEQ ID NO: 2135083 - RNA, 15 nt, Homo sapiens
auugauccagcucag

SEQ ID NO: 2135084 - RNA, 14 nt, Homo sapiens
agacuuugggauag

SEQ ID NO: 2135085 - RNA, 15 nt, Homo sapiens
caaaacacucaucuc

SEQ ID NO: 2135086 - RNA, 20 nt, Homo sapiens
ccuggcacuggaugcagaaa

SEQ ID NO: 2135087 - RNA, 11 nt, Homo sapiens
guuuugcaaau

SEQ ID NO: 2135088 - RNA, 17 nt, Homo sapiens
agaauacuggucucagg

SEQ ID NO: 2135089 - RNA, 23 nt, Homo sapiens
uccagccuucuacugcucuccuc

SEQ ID NO: 2135090 - RNA, 15 nt, Homo sapiens
acacgaugcauuuaa

SEQ ID NO: 2135091 - RNA, 19 nt, Homo sapiens
cauauuuguaaaaugacaa

SEQ ID NO: 2135092 - RNA, 21 nt, Homo sapiens
aguacaaggucaucaugcucc

SEQ ID NO: 2135093 - RNA, 23 nt, Homo sapiens
gccgcugccaugcuuugagucca

SEQ ID NO: 2135094 - RNA, 16 nt, Homo sapiens
ucacugccuuugcucc

SEQ ID NO: 2135095 - RNA, 18 nt, Homo sapiens
caucacauuuuugugugg

SEQ ID NO: 2135096 - RNA, 16 nt, Homo sapiens
gaguggucacugucag

SEQ ID NO: 2135097 - RNA, 14 nt, Homo sapiens
uuccuguccagaga

SEQ ID NO: 2135098 - RNA, 14 nt, Homo sapiens
uccucuaaaacccu

SEQ ID NO: 2135099 - RNA, 19 nt, Homo sapiens
gggaggcuggggacccaga

SEQ ID NO: 2135100 - RNA, 15 nt, Homo sapiens
agacucuaguauuua

SEQ ID NO: 2135101 - RNA, 17 nt, Homo sapiens
uguugguuucacugaga

SEQ ID NO: 2135102 - RNA, 13 nt, Homo sapiens
uauauuuucacau

SEQ ID NO: 2135103 - RNA, 19 nt, Homo sapiens
uguaaaugaagggucauuu

SEQ ID NO: 2135104 - RNA, 20 nt, Homo sapiens
agcccaggggaggcacaaag

SEQ ID NO: 2135105 - RNA, 13 nt, Homo sapiens
acagaacuacuuc

SEQ ID NO: 2135106 - RNA, 15 nt, Homo sapiens
agagaauguagccau

SEQ ID NO: 2135107 - RNA, 18 nt, Homo sapiens
uguugccuaagcuggucu

SEQ ID NO: 2135108 - RNA, 20 nt, Homo sapiens
aacccagcucccuucuuccc

SEQ ID NO: 2135109 - RNA, 14 nt, Homo sapiens
cuuuaauguugccc

SEQ ID NO: 2135110 - RNA, 20 nt, Homo sapiens
uauucuuggagaauaucaaa

SEQ ID NO: 2135111 - RNA, 15 nt, Homo sapiens
uccccggacauacuc

SEQ ID NO: 2135112 - RNA, 17 nt, Homo sapiens
acagagaagaccaaagc

SEQ ID NO: 2135113 - RNA, 22 nt, Homo sapiens
cuccucuugguggguguggcca

SEQ ID NO: 2135114 - RNA, 13 nt, Homo sapiens
gaagugccaucuc

SEQ ID NO: 2135115 - RNA, 16 nt, Homo sapiens
ucgugaacugcaguga

SEQ ID NO: 2135116 - RNA, 15 nt, Homo sapiens
aauguaugauuacau

SEQ ID NO: 2135117 - RNA, 16 nt, Homo sapiens
auguacguuacagcuu

SEQ ID NO: 2135118 - RNA, 21 nt, Homo sapiens
agcaguugaaacaagaagcca

SEQ ID NO: 2135119 - RNA, 15 nt, Homo sapiens
ucaagugauagucuu

SEQ ID NO: 2135120 - RNA, 16 nt, Homo sapiens
ugcuaaugacagccuu

SEQ ID NO: 2135121 - RNA, 20 nt, Homo sapiens
agccaaacagagcccaggga

SEQ ID NO: 2135122 - RNA, 13 nt, Homo sapiens
auuaaagccucau

SEQ ID NO: 2135123 - RNA, 22 nt, Homo sapiens
gugcaggacaacaucagcucac

SEQ ID NO: 2135124 - RNA, 17 nt, Homo sapiens
guucaccuauuucaaaa

SEQ ID NO: 2135125 - RNA, 23 nt, Homo sapiens
augaugaaacccuaucucuacua

SEQ ID NO: 2135126 - RNA, 13 nt, Homo sapiens
auaauacaaauaa

SEQ ID NO: 2135127 - RNA, 15 nt, Homo sapiens
cuccaggaugucaac

SEQ ID NO: 2135128 - RNA, 17 nt, Homo sapiens
ucagugcucugcuuuua

SEQ ID NO: 2135129 - RNA, 22 nt, Homo sapiens
gcagugaugugaucauagcuca

SEQ ID NO: 2135130 - RNA, 20 nt, Homo sapiens
ugaucagagcauugugcaau

SEQ ID NO: 2135131 - RNA, 15 nt, Homo sapiens
ucacuguauaaacuu

SEQ ID NO: 2135132 - RNA, 14 nt, Homo sapiens
cuuuguuccagaag

SEQ ID NO: 2135133 - RNA, 15 nt, Homo sapiens
cuuuuucuauauucu

SEQ ID NO: 2135134 - RNA, 19 nt, Homo sapiens
cuggaaaagaucauugcug

SEQ ID NO: 2135135 - RNA, 22 nt, Homo sapiens
ccagacacguccugcaguuccu

SEQ ID NO: 2135136 - RNA, 20 nt, Homo sapiens
cacaggcuuggggguuuuca

SEQ ID NO: 2135137 - RNA, 21 nt, Homo sapiens
gugaaaacacucgugugccca

SEQ ID NO: 2135138 - RNA, 16 nt, Homo sapiens
ugaauguuaacaugcg

SEQ ID NO: 2135139 - RNA, 21 nt, Homo sapiens
uuuugaggaauuaucauggga

SEQ ID NO: 2135140 - RNA, 21 nt, Homo sapiens
gauacuuuuaaaguuuuguca

SEQ ID NO: 2135141 - RNA, 14 nt, Homo sapiens
auuuucuacaauua

SEQ ID NO: 2135142 - RNA, 14 nt, Homo sapiens
uguuccccacugac

SEQ ID NO: 2135143 - RNA, 17 nt, Homo sapiens
uccccacauaccaucug

SEQ ID NO: 2135144 - RNA, 14 nt, Homo sapiens
cgaggcgaugccac

SEQ ID NO: 2135145 - RNA, 13 nt, Homo sapiens
gagauccaaagac

SEQ ID NO: 2135146 - RNA, 13 nt, Homo sapiens
aggccccagggcu

SEQ ID NO: 2135147 - RNA, 19 nt, Homo sapiens
ugggaaaauccacuaugac

SEQ ID NO: 2135148 - RNA, 18 nt, Homo sapiens
uagugacccggaggccac

SEQ ID NO: 2135149 - RNA, 15 nt, Homo sapiens
cuguuaucugcuaga

SEQ ID NO: 2135150 - RNA, 20 nt, Homo sapiens
aaacccagguucaugaauau

SEQ ID NO: 2135151 - RNA, 14 nt, Homo sapiens
cagacccgcuggac

SEQ ID NO: 2135152 - RNA, 15 nt, Homo sapiens
cuuuuguaagguacu

SEQ ID NO: 2135153 - RNA, 24 nt, Homo sapiens
uguagcaaauuucgagcauaagaa

SEQ ID NO: 2135154 - RNA, 14 nt, Homo sapiens
uaaagaagcuuuau

SEQ ID NO: 2135155 - RNA, 13 nt, Homo sapiens
uccuucugcuuua

SEQ ID NO: 2135156 - RNA, 21 nt, Homo sapiens
ugucaguuccaaacagacaaa

SEQ ID NO: 2135157 - RNA, 19 nt, Homo sapiens
gauaucugcagggacagag

SEQ ID NO: 2135158 - RNA, 21 nt, Homo sapiens
aguucauaggucuccaagacc

SEQ ID NO: 2135159 - RNA, 17 nt, Homo sapiens
uguaaagcccuugcaca

SEQ ID NO: 2135160 - RNA, 19 nt, Homo sapiens
aggcaagccccucagcccu

SEQ ID NO: 2135161 - RNA, 15 nt, Homo sapiens
ucaccacagcugcag

SEQ ID NO: 2135162 - RNA, 16 nt, Homo sapiens
gcuuggcugugcccuc

SEQ ID NO: 2135163 - RNA, 21 nt, Homo sapiens
agccccugggacugcugcuuc

SEQ ID NO: 2135164 - RNA, 22 nt, Homo sapiens
uguuauuaauccacaaauaugc

SEQ ID NO: 2135165 - RNA, 15 nt, Homo sapiens
cucucccugcugcuc

SEQ ID NO: 2135166 - RNA, 14 nt, Homo sapiens
gaaaauaaacauca

SEQ ID NO: 2135167 - RNA, 21 nt, Homo sapiens
agaauccugggcccccagaga

SEQ ID NO: 2135168 - RNA, 19 nt, Homo sapiens
gaguggaacagaaggggug

SEQ ID NO: 2135169 - RNA, 14 nt, Homo sapiens
cauacauacauaua

SEQ ID NO: 2135170 - RNA, 20 nt, Homo sapiens
caguguucuaugaacaacuc

SEQ ID NO: 2135171 - RNA, 18 nt, Homo sapiens
aauucaaaugcuuuuugu

SEQ ID NO: 2135172 - RNA, 20 nt, Homo sapiens
acauuuuaauuuuaguuuca

SEQ ID NO: 2135173 - RNA, 17 nt, Homo sapiens
uccuuggucuccagugg

SEQ ID NO: 2135174 - RNA, 12 nt, Homo sapiens
acuugguccuaa

SEQ ID NO: 2135175 - RNA, 12 nt, Homo sapiens
agauagugccuc

SEQ ID NO: 2135176 - RNA, 19 nt, Homo sapiens
uuagaagcagcgagugcau

SEQ ID NO: 2135177 - RNA, 14 nt, Homo sapiens
ucgcuucagccaca

SEQ ID NO: 2135178 - RNA, 14 nt, Homo sapiens
cccucugcaaagcu

SEQ ID NO: 2135179 - RNA, 20 nt, Homo sapiens
auccccugccuaaugcugcg

SEQ ID NO: 2135180 - RNA, 22 nt, Homo sapiens
aguacaaacaugaaaaacaaac

SEQ ID NO: 2135181 - RNA, 14 nt, Homo sapiens
cgaccccaucccua

SEQ ID NO: 2135182 - RNA, 17 nt, Homo sapiens
auuuuaggaugcagugu

SEQ ID NO: 2135183 - RNA, 20 nt, Homo sapiens
gcuggagugaagugguguga

SEQ ID NO: 2135184 - RNA, 20 nt, Homo sapiens
gcuggagcauaguggcaaga

SEQ ID NO: 2135185 - RNA, 23 nt, Homo sapiens
acucugacaagcuggccaaaguc

SEQ ID NO: 2135186 - RNA, 21 nt, Homo sapiens
ugcugccggcacagcugggau

SEQ ID NO: 2135187 - RNA, 17 nt, Homo sapiens
aauaacuuggagacaga

SEQ ID NO: 2135188 - RNA, 12 nt, Homo sapiens
uaaauuacugau

SEQ ID NO: 2135189 - RNA, 16 nt, Homo sapiens
gcuauggguguuaacg

SEQ ID NO: 2135190 - RNA, 21 nt, Homo sapiens
ugguacugacuuugcuugcuu

SEQ ID NO: 2135191 - RNA, 15 nt, Homo sapiens
uaauuauuucacuuu

SEQ ID NO: 2135192 - RNA, 13 nt, Homo sapiens
uaggaaaaaaaga

SEQ ID NO: 2135193 - RNA, 22 nt, Homo sapiens
aaaccaucauaguacagguaag

SEQ ID NO: 2135194 - RNA, 22 nt, Homo sapiens
aguuugggguguauacuucuau

SEQ ID NO: 2135195 - RNA, 21 nt, Homo sapiens
aucucaaccccaucauccugc

SEQ ID NO: 2135196 - RNA, 15 nt, Homo sapiens
aaaauucuacuguau

SEQ ID NO: 2135197 - RNA, 20 nt, Homo sapiens
gcuggagugcaauggcagga

SEQ ID NO: 2135198 - RNA, 13 nt, Homo sapiens
gcccuaucaccca

SEQ ID NO: 2135199 - RNA, 17 nt, Homo sapiens
acuccuuugcauuccau

SEQ ID NO: 2135200 - RNA, 14 nt, Homo sapiens
cauugcaauuugca

SEQ ID NO: 2135201 - RNA, 13 nt, Homo sapiens
gaaggccacuggu

SEQ ID NO: 2135202 - RNA, 14 nt, Homo sapiens
agaaggcaagcacc

SEQ ID NO: 2135203 - RNA, 21 nt, Homo sapiens
ugcuggcaacaacagauucuc

SEQ ID NO: 2135204 - RNA, 12 nt, Homo sapiens
caauacuacuga

SEQ ID NO: 2135205 - RNA, 11 nt, Homo sapiens
ccuccccaugc

SEQ ID NO: 2135206 - RNA, 23 nt, Homo sapiens
auauucccugcacacacaugcau

SEQ ID NO: 2135207 - RNA, 15 nt, Homo sapiens
uucuucuguccugag

SEQ ID NO: 2135208 - RNA, 16 nt, Homo sapiens
ucagcaaacccaaaga

SEQ ID NO: 2135209 - RNA, 15 nt, Homo sapiens
acaauuucaucccag

SEQ ID NO: 2135210 - RNA, 16 nt, Homo sapiens
gcucaggaugagggaa

SEQ ID NO: 2135211 - RNA, 13 nt, Homo sapiens
cagcguguguauc

SEQ ID NO: 2135212 - RNA, 16 nt, Homo sapiens
ugaagggauuucuuaa

SEQ ID NO: 2135213 - RNA, 12 nt, Homo sapiens
aucucaggucuu

SEQ ID NO: 2135214 - RNA, 19 nt, Homo sapiens
aauucuauaugauccugaa

SEQ ID NO: 2135215 - RNA, 15 nt, Homo sapiens
ugccacugcacucca

SEQ ID NO: 2135216 - RNA, 19 nt, Homo sapiens
cgcccaggggcccgggaac

SEQ ID NO: 2135217 - RNA, 14 nt, Homo sapiens
ucccucccagcucc

SEQ ID NO: 2135218 - RNA, 15 nt, Homo sapiens
cucccagccaagucc

SEQ ID NO: 2135219 - RNA, 20 nt, Homo sapiens
uugcccacugucugcuacca

SEQ ID NO: 2135220 - RNA, 19 nt, Homo sapiens
cucaggacagaaccacuga

SEQ ID NO: 2135221 - RNA, 19 nt, Homo sapiens
uguuaaaauugcucaugau

SEQ ID NO: 2135222 - RNA, 20 nt, Homo sapiens
acgccugcuuuugcaaauaa

SEQ ID NO: 2135223 - RNA, 11 nt, Homo sapiens
acaagauuccu

SEQ ID NO: 2135224 - RNA, 15 nt, Homo sapiens
ugugcaacauaacaa

SEQ ID NO: 2135225 - RNA, 19 nt, Homo sapiens
gagucucagaaacuccccu

SEQ ID NO: 2135226 - RNA, 18 nt, Homo sapiens
cccucugggaaggugacc

SEQ ID NO: 2135227 - RNA, 18 nt, Homo sapiens
gaaacaaaaaaguguucc

SEQ ID NO: 2135228 - RNA, 21 nt, Homo sapiens
gcaucaauguaaggaccuuca

SEQ ID NO: 2135229 - RNA, 17 nt, Homo sapiens
acggcugccccuuccac

SEQ ID NO: 2135230 - RNA, 13 nt, Homo sapiens
ugcauaucugccu

SEQ ID NO: 2135231 - RNA, 22 nt, Homo sapiens
aacuucuuuaaaaaaacacaua

SEQ ID NO: 2135232 - RNA, 15 nt, Homo sapiens
uucucucauuuccaa

SEQ ID NO: 2135233 - RNA, 13 nt, Homo sapiens
cuggccuugccac

SEQ ID NO: 2135234 - RNA, 20 nt, Homo sapiens
cugguucuguacauguggaa

SEQ ID NO: 2135235 - RNA, 15 nt, Homo sapiens
ccaucagacugucaa

SEQ ID NO: 2135236 - RNA, 16 nt, Homo sapiens
ucccaauucauuucau

SEQ ID NO: 2135237 - RNA, 16 nt, Homo sapiens
gcaguacagccgagac

SEQ ID NO: 2135238 - RNA, 22 nt, Homo sapiens
ccauuagcauuugucaacaaag

SEQ ID NO: 2135239 - RNA, 22 nt, Homo sapiens
uuguagguuauuuuauauuuga

SEQ ID NO: 2135240 - RNA, 16 nt, Homo sapiens
cuuccuugccagugag

SEQ ID NO: 2135241 - RNA, 13 nt, Homo sapiens
gucacgcaccugg

SEQ ID NO: 2135242 - RNA, 18 nt, Homo sapiens
cccauuaaagagccaguu

SEQ ID NO: 2135243 - RNA, 23 nt, Homo sapiens
aacacgccugcaaacgcugccug

SEQ ID NO: 2135244 - RNA, 22 nt, Homo sapiens
cacugaucauuagagaaaugca

SEQ ID NO: 2135245 - RNA, 12 nt, Homo sapiens
uggaauuugcau

SEQ ID NO: 2135246 - RNA, 21 nt, Homo sapiens
gauggaauuauuguaccauuu

SEQ ID NO: 2135247 - RNA, 16 nt, Homo sapiens
cuugaaguauguguuu

SEQ ID NO: 2135248 - RNA, 20 nt, Homo sapiens
gcacaugucuuguacaugug

SEQ ID NO: 2135249 - RNA, 19 nt, Homo sapiens
cugauggccuuuggaccca

SEQ ID NO: 2135250 - RNA, 18 nt, Homo sapiens
ugcaaugggcacugggau

SEQ ID NO: 2135251 - RNA, 19 nt, Homo sapiens
cauaaugacuuaagcacac

SEQ ID NO: 2135252 - RNA, 22 nt, Homo sapiens
auuaaugcauucaaaguaauau

SEQ ID NO: 2135253 - RNA, 13 nt, Homo sapiens
acaugugccaugc

SEQ ID NO: 2135254 - RNA, 12 nt, Homo sapiens
gcgugcaugugc

SEQ ID NO: 2135255 - RNA, 16 nt, Homo sapiens
ugcagccucaaccucc

SEQ ID NO: 2135256 - RNA, 22 nt, Homo sapiens
cagauugauuuucucagcacaa

SEQ ID NO: 2135257 - RNA, 22 nt, Homo sapiens
uaacauaaauuuaucaucucga

SEQ ID NO: 2135258 - RNA, 17 nt, Homo sapiens
uaaaaaauaacugugca

SEQ ID NO: 2135259 - RNA, 21 nt, Homo sapiens
ccucuggcuuccuaaacccau

SEQ ID NO: 2135260 - RNA, 20 nt, Homo sapiens
cugaaauugaagaagaauga

SEQ ID NO: 2135261 - RNA, 22 nt, Homo sapiens
acuguuuuugauaaaguaauaa

SEQ ID NO: 2135262 - RNA, 14 nt, Homo sapiens
uuccucuugccucu

SEQ ID NO: 2135263 - RNA, 22 nt, Homo sapiens
uauuuacagaaaagacucugac

SEQ ID NO: 2135264 - RNA, 14 nt, Homo sapiens
ucuggguccuugca

SEQ ID NO: 2135265 - RNA, 19 nt, Homo sapiens
aacagggcaucuccaggaa

SEQ ID NO: 2135266 - RNA, 23 nt, Homo sapiens
caaauaaaugggaaaaaaaugaa

SEQ ID NO: 2135267 - RNA, 14 nt, Homo sapiens
ugccaccagcaaug

SEQ ID NO: 2135268 - RNA, 16 nt, Homo sapiens
ggcccaagucccuguu

SEQ ID NO: 2135269 - RNA, 12 nt, Homo sapiens
cagcuucaugaa

SEQ ID NO: 2135270 - RNA, 23 nt, Homo sapiens
cccuguguggucuccaugcucac

SEQ ID NO: 2135271 - RNA, 18 nt, Homo sapiens
auuuaaaacaagcugaua

SEQ ID NO: 2135272 - RNA, 23 nt, Homo sapiens
cucuccaaccacugugccacuga

SEQ ID NO: 2135273 - RNA, 14 nt, Homo sapiens
ccaggcuacaaucu

SEQ ID NO: 2135274 - RNA, 11 nt, Homo sapiens
acagcugucug

SEQ ID NO: 2135275 - RNA, 21 nt, Homo sapiens
ggcugucugucaccagcuauc

SEQ ID NO: 2135276 - RNA, 21 nt, Homo sapiens
augugauggacacuccaggga

SEQ ID NO: 2135277 - RNA, 13 nt, Homo sapiens
augcaucuuguuu

SEQ ID NO: 2135278 - RNA, 15 nt, Homo sapiens
agcucuguguugcca

SEQ ID NO: 2135279 - RNA, 12 nt, Homo sapiens
aaagaugguuua

SEQ ID NO: 2135280 - RNA, 20 nt, Homo sapiens
cuuaauucuaagacuuuuga

SEQ ID NO: 2135281 - RNA, 14 nt, Homo sapiens
auugauguacuuua

SEQ ID NO: 2135282 - RNA, 17 nt, Homo sapiens
uugcuuuugugaacuuu

SEQ ID NO: 2135283 - RNA, 14 nt, Homo sapiens
cacaaaagucucaa

SEQ ID NO: 2135284 - RNA, 16 nt, Homo sapiens
aguuuaaagauucuau

SEQ ID NO: 2135285 - RNA, 20 nt, Homo sapiens
uccagccugagcgacaguga

SEQ ID NO: 2135286 - RNA, 19 nt, Homo sapiens
acuuucauccugguuucca

SEQ ID NO: 2135287 - RNA, 11 nt, Homo sapiens
accaaaucauc

SEQ ID NO: 2135288 - RNA, 22 nt, Homo sapiens
ggcccaucacucggcuguggag

SEQ ID NO: 2135289 - RNA, 16 nt, Homo sapiens
agugcauuauguacac

SEQ ID NO: 2135290 - RNA, 14 nt, Homo sapiens
agaguuuuaucaac

SEQ ID NO: 2135291 - RNA, 19 nt, Homo sapiens
aaagaaccccccuccccaa

SEQ ID NO: 2135292 - RNA, 16 nt, Homo sapiens
aaaucagccauaagaa

SEQ ID NO: 2135293 - RNA, 22 nt, Homo sapiens
cagugcuaaagccuguggguuu

SEQ ID NO: 2135294 - RNA, 21 nt, Homo sapiens
ucagaaggaaaccgaaacuga

SEQ ID NO: 2135295 - RNA, 16 nt, Homo sapiens
auguacuauccaaucu

SEQ ID NO: 2135296 - RNA, 14 nt, Homo sapiens
ugauguauaaugua

SEQ ID NO: 2135297 - RNA, 10 nt, Homo sapiens
uugcauuugg

SEQ ID NO: 2135298 - RNA, 18 nt, Homo sapiens
gauaaacaucaaaauauu

SEQ ID NO: 2135299 - RNA, 14 nt, Homo sapiens
auguguugugauag

SEQ ID NO: 2135300 - RNA, 15 nt, Homo sapiens
acaguauauguugca

SEQ ID NO: 2135301 - RNA, 21 nt, Homo sapiens
cuuugauccuucugagcucca

SEQ ID NO: 2135302 - RNA, 13 nt, Homo sapiens
uguguccaugugu

SEQ ID NO: 2135303 - RNA, 13 nt, Homo sapiens
aagaaccaaagaa

SEQ ID NO: 2135304 - RNA, 15 nt, Homo sapiens
auacuguucacucac

SEQ ID NO: 2135305 - RNA, 22 nt, Homo sapiens
acggggucgcccuuugcucacg

SEQ ID NO: 2135306 - RNA, 16 nt, Homo sapiens
auccauauuaaguaag

SEQ ID NO: 2135307 - RNA, 12 nt, Homo sapiens
cucccuggcuca

SEQ ID NO: 2135308 - RNA, 17 nt, Homo sapiens
uuuaaggucaaacacaa

SEQ ID NO: 2135309 - RNA, 15 nt, Homo sapiens
aacacgccugcaaac

SEQ ID NO: 2135310 - RNA, 17 nt, Homo sapiens
aucacuugacuuugcca

SEQ ID NO: 2135311 - RNA, 15 nt, Homo sapiens
cuugaauguacaaag

SEQ ID NO: 2135312 - RNA, 20 nt, Homo sapiens
acaaaauggaauacucuuau

SEQ ID NO: 2135313 - RNA, 18 nt, Homo sapiens
ugaccuccggccaggugc

SEQ ID NO: 2135314 - RNA, 14 nt, Homo sapiens
ugcccagaauuuca

SEQ ID NO: 2135315 - RNA, 21 nt, Homo sapiens
acaguguuaccugacuuauga

SEQ ID NO: 2135316 - RNA, 14 nt, Homo sapiens
aaaacaauacuaaa

SEQ ID NO: 2135317 - RNA, 14 nt, Homo sapiens
cccaggcagccacu

SEQ ID NO: 2135318 - RNA, 18 nt, Homo sapiens
auuuguggaaaagaaaua

SEQ ID NO: 2135319 - RNA, 13 nt, Homo sapiens
cuuaguugcugua

SEQ ID NO: 2135320 - RNA, 12 nt, Homo sapiens
acuuugauacca

SEQ ID NO: 2135321 - RNA, 16 nt, Homo sapiens
uaaaugcuccagcacu

SEQ ID NO: 2135322 - RNA, 18 nt, Homo sapiens
cugggauggugacuccug

SEQ ID NO: 2135323 - RNA, 20 nt, Homo sapiens
aagguuggaggaucauuuga

SEQ ID NO: 2135324 - RNA, 17 nt, Homo sapiens
uguuucguagccauauu

SEQ ID NO: 2135325 - RNA, 15 nt, Homo sapiens
aaaagcaugugucau

SEQ ID NO: 2135326 - RNA, 19 nt, Homo sapiens
uuaguucugagauuccaga

SEQ ID NO: 2135327 - RNA, 22 nt, Homo sapiens
aguggccugggucccagggcug

SEQ ID NO: 2135328 - RNA, 13 nt, Homo sapiens
aaaugcaaaauaa

SEQ ID NO: 2135329 - RNA, 13 nt, Homo sapiens
ucugacuacuugu

SEQ ID NO: 2135330 - RNA, 16 nt, Homo sapiens
gacgggacagugagug

SEQ ID NO: 2135331 - RNA, 21 nt, Homo sapiens
cacuaccugccaugcauacau

SEQ ID NO: 2135332 - RNA, 18 nt, Homo sapiens
cuuuggaaacaauaugca

SEQ ID NO: 2135333 - RNA, 19 nt, Homo sapiens
aacugaaggcuaaaaagca

SEQ ID NO: 2135334 - RNA, 13 nt, Homo sapiens
uccacacugagag

SEQ ID NO: 2135335 - RNA, 23 nt, Homo sapiens
ucaauggaauacagucauuccaa

SEQ ID NO: 2135336 - RNA, 19 nt, Homo sapiens
ggaucuggggaaggaccaa

SEQ ID NO: 2135337 - RNA, 21 nt, Homo sapiens
gcuuugggauaauguuuauaa

SEQ ID NO: 2135338 - RNA, 20 nt, Homo sapiens
gcuuacuguugcuuuaguca

SEQ ID NO: 2135339 - RNA, 22 nt, Homo sapiens
cuuuuuaugaucugccauuuca

SEQ ID NO: 2135340 - RNA, 14 nt, Homo sapiens
uagaacagcucaua

SEQ ID NO: 2135341 - RNA, 17 nt, Homo sapiens
uuaacauuuaucuuuag

SEQ ID NO: 2135342 - RNA, 17 nt, Homo sapiens
ugauaccauggcacuga

SEQ ID NO: 2135343 - RNA, 23 nt, Homo sapiens
caccuuugcaaaguuacagaugc

SEQ ID NO: 2135344 - RNA, 23 nt, Homo sapiens
aagugagccaggaaagcagcaaa

SEQ ID NO: 2135345 - RNA, 17 nt, Homo sapiens
gaauugcuuaccaaagg

SEQ ID NO: 2135346 - RNA, 20 nt, Homo sapiens
aacguggauguuacuccaaa

SEQ ID NO: 2135347 - RNA, 18 nt, Homo sapiens
ucugccuaugcacugaag

SEQ ID NO: 2135348 - RNA, 19 nt, Homo sapiens
uugaaaguuguacaugaua

SEQ ID NO: 2135349 - RNA, 19 nt, Homo sapiens
acucuggcauaugauuuau

SEQ ID NO: 2135350 - RNA, 14 nt, Homo sapiens
auugucucaaagac

SEQ ID NO: 2135351 - RNA, 23 nt, Homo sapiens
ugcaagucaggacaucagucuga

SEQ ID NO: 2135352 - RNA, 14 nt, Homo sapiens
gagcaucuccucaa

SEQ ID NO: 2135353 - RNA, 14 nt, Homo sapiens
ucgaccaguuugaa

SEQ ID NO: 2135354 - RNA, 23 nt, Homo sapiens
uuucuuuguaaaggucagaguca

SEQ ID NO: 2135355 - RNA, 22 nt, Homo sapiens
ccucucugagucaaauccagug

SEQ ID NO: 2135356 - RNA, 19 nt, Homo sapiens
aagcccauagcacugggcu

SEQ ID NO: 2135357 - RNA, 22 nt, Homo sapiens
uaaaaacaacaaaaacaaacaa

SEQ ID NO: 2135358 - RNA, 22 nt, Homo sapiens
cacagcccugucagcaugaauu

SEQ ID NO: 2135359 - RNA, 21 nt, Homo sapiens
ccugcggcugcugugugccuu

SEQ ID NO: 2135360 - RNA, 22 nt, Homo sapiens
gcuaaauccucauguuacucag

SEQ ID NO: 2135361 - RNA, 13 nt, Homo sapiens
aagagaauucuau

SEQ ID NO: 2135362 - RNA, 18 nt, Homo sapiens
auuuauuggggugccuau

SEQ ID NO: 2135363 - RNA, 23 nt, Homo sapiens
cauuauucucuaacuauuacaca

SEQ ID NO: 2135364 - RNA, 16 nt, Homo sapiens
augucgaugacuucau

SEQ ID NO: 2135365 - RNA, 19 nt, Homo sapiens
ccugucccccacucucuca

SEQ ID NO: 2135366 - RNA, 20 nt, Homo sapiens
ccagaaucucauuacugcuu

SEQ ID NO: 2135367 - RNA, 20 nt, Homo sapiens
cuaaugagcuuuacagcaga

SEQ ID NO: 2135368 - RNA, 18 nt, Homo sapiens
accauaaauuuaaaugga

SEQ ID NO: 2135369 - RNA, 22 nt, Homo sapiens
uugacaaacuucuuucacucac

SEQ ID NO: 2135370 - RNA, 14 nt, Homo sapiens
aaacaacaugccau

SEQ ID NO: 2135371 - RNA, 15 nt, Homo sapiens
cuugaagaagggaga

SEQ ID NO: 2135372 - RNA, 21 nt, Homo sapiens
auacuucaaaugucauuucau

SEQ ID NO: 2135373 - RNA, 17 nt, Homo sapiens
ucaccagaauugugcaa

SEQ ID NO: 2135374 - RNA, 13 nt, Homo sapiens
cuucauccaggga

SEQ ID NO: 2135375 - RNA, 18 nt, Homo sapiens
gacauugcuggucauccu

SEQ ID NO: 2135376 - RNA, 14 nt, Homo sapiens
caguaucaucucca

SEQ ID NO: 2135377 - RNA, 21 nt, Homo sapiens
ucucauguaacacauaaacaa

SEQ ID NO: 2135378 - RNA, 16 nt, Homo sapiens
cauaaaugcagcccau

SEQ ID NO: 2135379 - RNA, 20 nt, Homo sapiens
augaguggagguuaaggcug

SEQ ID NO: 2135380 - RNA, 24 nt, Homo sapiens
uucuccuaaacugaacacaugacu

SEQ ID NO: 2135381 - RNA, 17 nt, Homo sapiens
aagauuuuuggcacuuu

SEQ ID NO: 2135382 - RNA, 17 nt, Homo sapiens
acaacagucaaguugau

SEQ ID NO: 2135383 - RNA, 14 nt, Homo sapiens
acaaaggcugagaa

SEQ ID NO: 2135384 - RNA, 13 nt, Homo sapiens
gcauguaugugca

SEQ ID NO: 2135385 - RNA, 16 nt, Homo sapiens
aacuugaaaauauaug

SEQ ID NO: 2135386 - RNA, 15 nt, Homo sapiens
gagcauccuuggcag

SEQ ID NO: 2135387 - RNA, 17 nt, Homo sapiens
auguggagaacauucaa

SEQ ID NO: 2135388 - RNA, 15 nt, Homo sapiens
uucuguacucaaaug

SEQ ID NO: 2135389 - RNA, 20 nt, Homo sapiens
ugcaaucgguuuaaacaugg

SEQ ID NO: 2135390 - RNA, 16 nt, Homo sapiens
cagacgggaggggaaa

SEQ ID NO: 2135391 - RNA, 20 nt, Homo sapiens
gguaccaagaucacaaauag

SEQ ID NO: 2135392 - RNA, 18 nt, Homo sapiens
agcaagaauaccaagaca

SEQ ID NO: 2135393 - RNA, 20 nt, Homo sapiens
ggaugcacagagauaugcac

SEQ ID NO: 2135394 - RNA, 16 nt, Homo sapiens
auaaauccaacucuga

SEQ ID NO: 2135395 - RNA, 15 nt, Homo sapiens
aagugcgaguccucc

SEQ ID NO: 2135396 - RNA, 16 nt, Homo sapiens
aucuauuccuguaaau

SEQ ID NO: 2135397 - RNA, 16 nt, Homo sapiens
gacucagggcauaaug

SEQ ID NO: 2135398 - RNA, 14 nt, Homo sapiens
gcacucacaugccg

SEQ ID NO: 2135399 - RNA, 15 nt, Homo sapiens
ucacuuaaacuuugu

SEQ ID NO: 2135400 - RNA, 13 nt, Homo sapiens
uuccuccuaggcg

SEQ ID NO: 2135401 - RNA, 18 nt, Homo sapiens
acuuucaugcagccuaaa

SEQ ID NO: 2135402 - RNA, 20 nt, Homo sapiens
ucugagccgucagagcagug

SEQ ID NO: 2135403 - RNA, 13 nt, Homo sapiens
ccugaaagccaca

SEQ ID NO: 2135404 - RNA, 17 nt, Homo sapiens
gacagugacgugacuca

SEQ ID NO: 2135405 - RNA, 13 nt, Homo sapiens
uacauagcauuug

SEQ ID NO: 2135406 - RNA, 11 nt, Homo sapiens
gagaaacugaa

SEQ ID NO: 2135407 - RNA, 19 nt, Homo sapiens
ccugaguuucaaguauccu

SEQ ID NO: 2135408 - RNA, 12 nt, Homo sapiens
agauugaaucug

SEQ ID NO: 2135409 - RNA, 21 nt, Homo sapiens
acacuccagugccagcaauga

SEQ ID NO: 2135410 - RNA, 20 nt, Homo sapiens
agcccuccgccuucacauuc

SEQ ID NO: 2135411 - RNA, 20 nt, Homo sapiens
aaugccacauuuugcuuuau

SEQ ID NO: 2135412 - RNA, 15 nt, Homo sapiens
gccucuggaucugcu

SEQ ID NO: 2135413 - RNA, 22 nt, Homo sapiens
ugguccugggagccacugggag

SEQ ID NO: 2135414 - RNA, 14 nt, Homo sapiens
guaagacucauucc

SEQ ID NO: 2135415 - RNA, 18 nt, Homo sapiens
cugagccauuugcugcau

SEQ ID NO: 2135416 - RNA, 22 nt, Homo sapiens
aguguucaugcuuuguaccaaa

SEQ ID NO: 2135417 - RNA, 23 nt, Homo sapiens
ugugaacuuucucagcauauaua

SEQ ID NO: 2135418 - RNA, 17 nt, Homo sapiens
aaaguuaccuuacugaa

SEQ ID NO: 2135419 - RNA, 18 nt, Homo sapiens
aaggaaguuucaguauua

SEQ ID NO: 2135420 - RNA, 20 nt, Homo sapiens
ccuccugauggagugugcag

SEQ ID NO: 2135421 - RNA, 23 nt, Homo sapiens
cuuuuucuuuuuugagacagggu

SEQ ID NO: 2135422 - RNA, 13 nt, Homo sapiens
gaacuacuaaagu

SEQ ID NO: 2135423 - RNA, 23 nt, Homo sapiens
uuauaggccugucccuugccucu

SEQ ID NO: 2135424 - RNA, 19 nt, Homo sapiens
auggagaggcggccucgug

SEQ ID NO: 2135425 - RNA, 14 nt, Homo sapiens
uguaccaggcucuc

SEQ ID NO: 2135426 - RNA, 12 nt, Homo sapiens
auuuucauuccu

SEQ ID NO: 2135427 - RNA, 13 nt, Homo sapiens
uacacauauaccu

SEQ ID NO: 2135428 - RNA, 17 nt, Homo sapiens
uugagcaguuagcucau

SEQ ID NO: 2135429 - RNA, 21 nt, Homo sapiens
aggucucacgggcaugggcac

SEQ ID NO: 2135430 - RNA, 21 nt, Homo sapiens
cuugggccuaggcugcauuga

SEQ ID NO: 2135431 - RNA, 15 nt, Homo sapiens
cuuccucacuccaaa

SEQ ID NO: 2135432 - RNA, 15 nt, Homo sapiens
acauucccccaacau

SEQ ID NO: 2135433 - RNA, 21 nt, Homo sapiens
gucuucgcagccuagauauga

SEQ ID NO: 2135434 - RNA, 15 nt, Homo sapiens
gaaacaaucuuccaa

SEQ ID NO: 2135435 - RNA, 22 nt, Homo sapiens
aacugaaugcuccagucaacaa

SEQ ID NO: 2135436 - RNA, 16 nt, Homo sapiens
aucucuuccacauggg

SEQ ID NO: 2135437 - RNA, 15 nt, Homo sapiens
ugcauuuaugaugca

SEQ ID NO: 2135438 - RNA, 13 nt, Homo sapiens
ccuggagcagcug

SEQ ID NO: 2135439 - RNA, 12 nt, Homo sapiens
aaagaaaugcau

SEQ ID NO: 2135440 - RNA, 15 nt, Homo sapiens
ugauuuaacacuauc

SEQ ID NO: 2135441 - RNA, 15 nt, Homo sapiens
gccaggagcaggcac

SEQ ID NO: 2135442 - RNA, 21 nt, Homo sapiens
uuaucaacuuccuaaauauua

SEQ ID NO: 2135443 - RNA, 18 nt, Homo sapiens
uucagguauguguguaua

SEQ ID NO: 2135444 - RNA, 13 nt, Homo sapiens
ggauuacaggcau

SEQ ID NO: 2135445 - RNA, 19 nt, Homo sapiens
aaaacugauugaaugauau

SEQ ID NO: 2135446 - RNA, 20 nt, Homo sapiens
ucaaggaauagaguuuuccu

SEQ ID NO: 2135447 - RNA, 16 nt, Homo sapiens
agaaccccucugggaa

SEQ ID NO: 2135448 - RNA, 16 nt, Homo sapiens
aggacaggcagaaaga

SEQ ID NO: 2135449 - RNA, 12 nt, Homo sapiens
aagcacaaaaga

SEQ ID NO: 2135450 - RNA, 23 nt, Homo sapiens
caaccuccccuguacuuaccugu

SEQ ID NO: 2135451 - RNA, 23 nt, Homo sapiens
ugaggcugucgugagcuaugauu

SEQ ID NO: 2135452 - RNA, 16 nt, Homo sapiens
aaugugaaucaugguu

SEQ ID NO: 2135453 - RNA, 15 nt, Homo sapiens
cuuaucccucuccau

SEQ ID NO: 2135454 - RNA, 21 nt, Homo sapiens
ccucagaauaaaagaugauuu

SEQ ID NO: 2135455 - RNA, 13 nt, Homo sapiens
caaucacaagcag

SEQ ID NO: 2135456 - RNA, 14 nt, Homo sapiens
gcaaacugcuuuau

SEQ ID NO: 2135457 - RNA, 22 nt, Homo sapiens
ggccauggaagguucucugugc

SEQ ID NO: 2135458 - RNA, 18 nt, Homo sapiens
aaaaccacagauacugaa

SEQ ID NO: 2135459 - RNA, 14 nt, Homo sapiens
aauguuaacuuuca

SEQ ID NO: 2135460 - RNA, 16 nt, Homo sapiens
uauuaagcaguacaaa

SEQ ID NO: 2135461 - RNA, 13 nt, Homo sapiens
cauuccaucacag

SEQ ID NO: 2135462 - RNA, 20 nt, Homo sapiens
agccugugaacccaggacaa

SEQ ID NO: 2135463 - RNA, 15 nt, Homo sapiens
ucaguauguccccau

SEQ ID NO: 2135464 - RNA, 16 nt, Homo sapiens
uccaauaaauugucaa

SEQ ID NO: 2135465 - RNA, 17 nt, Homo sapiens
gcucuagggaagcagug

SEQ ID NO: 2135466 - RNA, 18 nt, Homo sapiens
auggcucccaaauuccau

SEQ ID NO: 2135467 - RNA, 19 nt, Homo sapiens
cucuugaauuccucucaaa

SEQ ID NO: 2135468 - RNA, 18 nt, Homo sapiens
uuauaccagagaccugag

SEQ ID NO: 2135469 - RNA, 20 nt, Homo sapiens
cugccaggggauuuggggcu

SEQ ID NO: 2135470 - RNA, 15 nt, Homo sapiens
aucauuuugugauuc

SEQ ID NO: 2135471 - RNA, 14 nt, Homo sapiens
acacuaccaguuuc

SEQ ID NO: 2135472 - RNA, 17 nt, Homo sapiens
gccugacuuggggacaa

SEQ ID NO: 2135473 - RNA, 13 nt, Homo sapiens
uauacuauauuac

SEQ ID NO: 2135474 - RNA, 15 nt, Homo sapiens
ugucccucccaccuc

SEQ ID NO: 2135475 - RNA, 15 nt, Homo sapiens
ugaacuucccuaccc

SEQ ID NO: 2135476 - RNA, 15 nt, Homo sapiens
ucagaauagccacau

SEQ ID NO: 2135477 - RNA, 20 nt, Homo sapiens
ccuacuuuucuuuccucaga

SEQ ID NO: 2135478 - RNA, 17 nt, Homo sapiens
cuaauuuuaaguuauuu

SEQ ID NO: 2135479 - RNA, 15 nt, Homo sapiens
agcugguggcaauaa

SEQ ID NO: 2135480 - RNA, 19 nt, Homo sapiens
gcuguguugguguggccca

SEQ ID NO: 2135481 - RNA, 23 nt, Homo sapiens
cccaggugcagugugacauuauu

SEQ ID NO: 2135482 - RNA, 21 nt, Homo sapiens
ugugucccgaauccacagucg

SEQ ID NO: 2135483 - RNA, 19 nt, Homo sapiens
guuuuuggacacauuuaag

SEQ ID NO: 2135484 - RNA, 18 nt, Homo sapiens
auuccaucacagccagcc

SEQ ID NO: 2135485 - RNA, 23 nt, Homo sapiens
uucccccacuugggagcuuguau

SEQ ID NO: 2135486 - RNA, 14 nt, Homo sapiens
gcauagaaacugag

SEQ ID NO: 2135487 - RNA, 20 nt, Homo sapiens
uugauaaucaacugggcuga

SEQ ID NO: 2135488 - RNA, 13 nt, Homo sapiens
acccaaauccaag

SEQ ID NO: 2135489 - RNA, 18 nt, Homo sapiens
acuucagagcaugaaaau

SEQ ID NO: 2135490 - RNA, 15 nt, Homo sapiens
ggacuccagauacau

SEQ ID NO: 2135491 - RNA, 20 nt, Homo sapiens
uugcaguugucaccaaauac

SEQ ID NO: 2135492 - RNA, 21 nt, Homo sapiens
ugccuucuguccuggugucac

SEQ ID NO: 2135493 - RNA, 20 nt, Homo sapiens
caggacuaacaacugggaaa

SEQ ID NO: 2135494 - RNA, 14 nt, Homo sapiens
aaagaaaaccugga

SEQ ID NO: 2135495 - RNA, 19 nt, Homo sapiens
acacuugacaucaacugca

SEQ ID NO: 2135496 - RNA, 20 nt, Homo sapiens
caagggcccucacucaggaa

SEQ ID NO: 2135497 - RNA, 18 nt, Homo sapiens
guaugugcaggcaccuga

SEQ ID NO: 2135498 - RNA, 14 nt, Homo sapiens
ugaucacauucuuc

SEQ ID NO: 2135499 - RNA, 15 nt, Homo sapiens
uuuguuaacuguacu

SEQ ID NO: 2135500 - RNA, 16 nt, Homo sapiens
ggcugcagugagccau

SEQ ID NO: 2135501 - RNA, 16 nt, Homo sapiens
cuuguuugucuuccau

SEQ ID NO: 2135502 - RNA, 20 nt, Homo sapiens
uucugugugcauacuuauga

SEQ ID NO: 2135503 - RNA, 16 nt, Homo sapiens
cuggcuaugcauuuga

SEQ ID NO: 2135504 - RNA, 17 nt, Homo sapiens
gaggugaugaagacagc

SEQ ID NO: 2135505 - RNA, 20 nt, Homo sapiens
uucuccaggacaaccugcug

SEQ ID NO: 2135506 - RNA, 14 nt, Homo sapiens
uccugucugaaaag

SEQ ID NO: 2135507 - RNA, 19 nt, Homo sapiens
aaaggcgguacuaguucag

SEQ ID NO: 2135508 - RNA, 15 nt, Homo sapiens
ccaagcagagcucac

SEQ ID NO: 2135509 - RNA, 23 nt, Homo sapiens
uagcuauuacugcagacuauaaa

SEQ ID NO: 2135510 - RNA, 14 nt, Homo sapiens
uggggaauuacuuu

SEQ ID NO: 2135511 - RNA, 12 nt, Homo sapiens
acaaacugccau

SEQ ID NO: 2135512 - RNA, 15 nt, Homo sapiens
gaucgggagcaaacc

SEQ ID NO: 2135513 - RNA, 16 nt, Homo sapiens
ggacuuacuauuuauu

SEQ ID NO: 2135514 - RNA, 15 nt, Homo sapiens
uaauuccagcacuuu

SEQ ID NO: 2135515 - RNA, 20 nt, Homo sapiens
ucugaauccaagacagccac

SEQ ID NO: 2135516 - RNA, 22 nt, Homo sapiens
ccuacccugccucccuugacuu

SEQ ID NO: 2135517 - RNA, 23 nt, Homo sapiens
aacaucuggauuucauccuugac

SEQ ID NO: 2135518 - RNA, 17 nt, Homo sapiens
aaagaagcuuccacaaa

SEQ ID NO: 2135519 - RNA, 16 nt, Homo sapiens
uacuuaauacuaggau

SEQ ID NO: 2135520 - RNA, 13 nt, Homo sapiens
ugcucugccucag

SEQ ID NO: 2135521 - RNA, 13 nt, Homo sapiens
cucugugcugcac

SEQ ID NO: 2135522 - RNA, 16 nt, Homo sapiens
ugucaagcugaguauu

SEQ ID NO: 2135523 - RNA, 19 nt, Homo sapiens
cuuucagccaaaacagauc

SEQ ID NO: 2135524 - RNA, 13 nt, Homo sapiens
agacagaagcuua

SEQ ID NO: 2135525 - RNA, 18 nt, Homo sapiens
augagaaaaugucuuuau

SEQ ID NO: 2135526 - RNA, 15 nt, Homo sapiens
agagaccugcucagg

SEQ ID NO: 2135527 - RNA, 16 nt, Homo sapiens
cacuguccauuccaaa

SEQ ID NO: 2135528 - RNA, 23 nt, Homo sapiens
aaaaggauguuacaaguuugcua

SEQ ID NO: 2135529 - RNA, 16 nt, Homo sapiens
ugcuuuucacugcugc

SEQ ID NO: 2135530 - RNA, 23 nt, Homo sapiens
agaccuggguugagccucagaau

SEQ ID NO: 2135531 - RNA, 14 nt, Homo sapiens
gccuaggauuucag

SEQ ID NO: 2135532 - RNA, 11 nt, Homo sapiens
uaagugcuaug

SEQ ID NO: 2135533 - RNA, 21 nt, Homo sapiens
cacugaaaaauauuccaagcu

SEQ ID NO: 2135534 - RNA, 17 nt, Homo sapiens
agaugaacccuggcauu

SEQ ID NO: 2135535 - RNA, 16 nt, Homo sapiens
gagcaguaccggccaa

SEQ ID NO: 2135536 - RNA, 17 nt, Homo sapiens
gugugaagaaauggaau

SEQ ID NO: 2135537 - RNA, 22 nt, Homo sapiens
gcagagcaaaaugcucuugucc

SEQ ID NO: 2135538 - RNA, 14 nt, Homo sapiens
auagaaaaagcaca

SEQ ID NO: 2135539 - RNA, 14 nt, Homo sapiens
uuaaaugaacaaga

SEQ ID NO: 2135540 - RNA, 19 nt, Homo sapiens
auuuagaaaaaaguuuaca

SEQ ID NO: 2135541 - RNA, 17 nt, Homo sapiens
cgccccaguggcacuga

SEQ ID NO: 2135542 - RNA, 18 nt, Homo sapiens
ugcaucucuuuagaucca

SEQ ID NO: 2135543 - RNA, 13 nt, Homo sapiens
cugauaccacugc

SEQ ID NO: 2135544 - RNA, 19 nt, Homo sapiens
ugcccacggcaacugccuu

SEQ ID NO: 2135545 - RNA, 12 nt, Homo sapiens
cagccacauaug

SEQ ID NO: 2135546 - RNA, 24 nt, Homo sapiens
ugcuuuaaauggaaacagacucau

SEQ ID NO: 2135547 - RNA, 13 nt, Homo sapiens
aucaacagcauuu

SEQ ID NO: 2135548 - RNA, 16 nt, Homo sapiens
uugcccagucccgccc

SEQ ID NO: 2135549 - RNA, 16 nt, Homo sapiens
uuaaauuaugcaacgu

SEQ ID NO: 2135550 - RNA, 22 nt, Homo sapiens
ggcagcuggggggcaccggcuc

SEQ ID NO: 2135551 - RNA, 19 nt, Homo sapiens
aacucugugucagcaucuu

SEQ ID NO: 2135552 - RNA, 16 nt, Homo sapiens
cguuuauauuguagca

SEQ ID NO: 2135553 - RNA, 14 nt, Homo sapiens
auggagaggaagaa

SEQ ID NO: 2135554 - RNA, 18 nt, Homo sapiens
gcuuucuuaucccaguga

SEQ ID NO: 2135555 - RNA, 15 nt, Homo sapiens
agaaggaaggcuuug

SEQ ID NO: 2135556 - RNA, 21 nt, Homo sapiens
cuuggacuguguuuuuccucc

SEQ ID NO: 2135557 - RNA, 17 nt, Homo sapiens
aaugaaccuugcuauca

SEQ ID NO: 2135558 - RNA, 19 nt, Homo sapiens
auuccucuuugcccaaaau

SEQ ID NO: 2135559 - RNA, 18 nt, Homo sapiens
cuggauuucauacuguaa

SEQ ID NO: 2135560 - RNA, 16 nt, Homo sapiens
aaauucuccuccugaa

SEQ ID NO: 2135561 - RNA, 23 nt, Homo sapiens
uagggcuucaaggcccucagaga

SEQ ID NO: 2135562 - RNA, 13 nt, Homo sapiens
ccgaggacaugaa

SEQ ID NO: 2135563 - RNA, 21 nt, Homo sapiens
cccaugccuggucccaagaca

SEQ ID NO: 2135564 - RNA, 21 nt, Homo sapiens
aauccugcauuguuucaagac

SEQ ID NO: 2135565 - RNA, 18 nt, Homo sapiens
ccuccggcgucuugccca

SEQ ID NO: 2135566 - RNA, 13 nt, Homo sapiens
ugucacagucucu

SEQ ID NO: 2135567 - RNA, 17 nt, Homo sapiens
aguuagccaauaugcaa

SEQ ID NO: 2135568 - RNA, 18 nt, Homo sapiens
acauuuaaaagacagaca

SEQ ID NO: 2135569 - RNA, 22 nt, Homo sapiens
acuagaaauaaauaacuuugga

SEQ ID NO: 2135570 - RNA, 17 nt, Homo sapiens
gagggugcagggaccaa

SEQ ID NO: 2135571 - RNA, 14 nt, Homo sapiens
uaugaacaugcagu

SEQ ID NO: 2135572 - RNA, 23 nt, Homo sapiens
gccugccgaaaacaggagcaaau

SEQ ID NO: 2135573 - RNA, 20 nt, Homo sapiens
ccugacguagcugcaaagga

SEQ ID NO: 2135574 - RNA, 23 nt, Homo sapiens
cuccuuccugucuuccugcauuc

SEQ ID NO: 2135575 - RNA, 17 nt, Homo sapiens
caggguauuaauaugcu

SEQ ID NO: 2135576 - RNA, 16 nt, Homo sapiens
aaggcaggcauaucaa

SEQ ID NO: 2135577 - RNA, 16 nt, Homo sapiens
ucugccaggugagggu

SEQ ID NO: 2135578 - RNA, 17 nt, Homo sapiens
ccuggagugcugugcug

SEQ ID NO: 2135579 - RNA, 17 nt, Homo sapiens
uaaauacacaaagggau

SEQ ID NO: 2135580 - RNA, 18 nt, Homo sapiens
auguacccacuuagucau

SEQ ID NO: 2135581 - RNA, 23 nt, Homo sapiens
cucuggggguccucucugaguca

SEQ ID NO: 2135582 - RNA, 14 nt, Homo sapiens
accccuccucuagc

SEQ ID NO: 2135583 - RNA, 18 nt, Homo sapiens
ccccugucacacagggaa

SEQ ID NO: 2135584 - RNA, 20 nt, Homo sapiens
gguggcaaaguacuugucau

SEQ ID NO: 2135585 - RNA, 15 nt, Homo sapiens
uucucaucacagaag

SEQ ID NO: 2135586 - RNA, 21 nt, Homo sapiens
aaacagcaggacuuguuuaca

SEQ ID NO: 2135587 - RNA, 17 nt, Homo sapiens
guccaucagauucugug

SEQ ID NO: 2135588 - RNA, 19 nt, Homo sapiens
aagcuccugccucuuugug

SEQ ID NO: 2135589 - RNA, 20 nt, Homo sapiens
aaaugaaguauuucauguaa

SEQ ID NO: 2135590 - RNA, 19 nt, Homo sapiens
uccaggcuuccugcccuag

SEQ ID NO: 2135591 - RNA, 13 nt, Homo sapiens
cgucccaccagcu

SEQ ID NO: 2135592 - RNA, 14 nt, Homo sapiens
cucgcuacauuucc

SEQ ID NO: 2135593 - RNA, 13 nt, Homo sapiens
ggagcuggggucu

SEQ ID NO: 2135594 - RNA, 19 nt, Homo sapiens
uaucuuuauuaaucacuau

SEQ ID NO: 2135595 - RNA, 18 nt, Homo sapiens
ugcuuacuaugaccuucc

SEQ ID NO: 2135596 - RNA, 21 nt, Homo sapiens
caggagcuaccuguguggaca

SEQ ID NO: 2135597 - RNA, 18 nt, Homo sapiens
ucauuguucucccuccua

SEQ ID NO: 2135598 - RNA, 13 nt, Homo sapiens
aucuuaugcuauu

SEQ ID NO: 2135599 - RNA, 22 nt, Homo sapiens
cagcguguguauccgacucuaa

SEQ ID NO: 2135600 - RNA, 15 nt, Homo sapiens
cugcaugaucuuaca

SEQ ID NO: 2135601 - RNA, 15 nt, Homo sapiens
guuugauucagcaaa

SEQ ID NO: 2135602 - RNA, 17 nt, Homo sapiens
uuuccauguugcugcca

SEQ ID NO: 2135603 - RNA, 16 nt, Homo sapiens
acaggcaugugccaca

SEQ ID NO: 2135604 - RNA, 14 nt, Homo sapiens
acugugcugagaaa

SEQ ID NO: 2135605 - RNA, 23 nt, Homo sapiens
aaugaacuguauuauugcaauuu

SEQ ID NO: 2135606 - RNA, 14 nt, Homo sapiens
uaaccucugcacua

SEQ ID NO: 2135607 - RNA, 20 nt, Homo sapiens
ugccucccucugcuguguuc

SEQ ID NO: 2135608 - RNA, 22 nt, Homo sapiens
uucuuccccccagauacccauc

SEQ ID NO: 2135609 - RNA, 12 nt, Homo sapiens
acauuacauuaa

SEQ ID NO: 2135610 - RNA, 18 nt, Homo sapiens
cuucacugcaaguuuuag

SEQ ID NO: 2135611 - RNA, 22 nt, Homo sapiens
uauuaaagccauguuuauuaca

SEQ ID NO: 2135612 - RNA, 16 nt, Homo sapiens
uguaugaaaacaugga

SEQ ID NO: 2135613 - RNA, 16 nt, Homo sapiens
agggcuggcccgggga

SEQ ID NO: 2135614 - RNA, 19 nt, Homo sapiens
ggauuuauuuuuccauuua

SEQ ID NO: 2135615 - RNA, 17 nt, Homo sapiens
cugcccugcccaaguga

SEQ ID NO: 2135616 - RNA, 18 nt, Homo sapiens
guaaaaucaaaugugcau

SEQ ID NO: 2135617 - RNA, 17 nt, Homo sapiens
aacuugagcauguuacu

SEQ ID NO: 2135618 - RNA, 15 nt, Homo sapiens
gaacuugucacagau

SEQ ID NO: 2135619 - RNA, 11 nt, Homo sapiens
gagcaccucag

SEQ ID NO: 2135620 - RNA, 11 nt, Homo sapiens
ccucaccugcu

SEQ ID NO: 2135621 - RNA, 18 nt, Homo sapiens
aagcauaggaaggcucua

SEQ ID NO: 2135622 - RNA, 20 nt, Homo sapiens
gcaguuacuggggucaccca

SEQ ID NO: 2135623 - RNA, 24 nt, Homo sapiens
agcccauggcccccaauaaaggca

SEQ ID NO: 2135624 - RNA, 13 nt, Homo sapiens
cacaggcaaagau

SEQ ID NO: 2135625 - RNA, 15 nt, Homo sapiens
ucucgguuugccaaa

SEQ ID NO: 2135626 - RNA, 18 nt, Homo sapiens
aucauuuucugcauuuaa

SEQ ID NO: 2135627 - RNA, 21 nt, Homo sapiens
gcgaucccuccccucagccuc

SEQ ID NO: 2135628 - RNA, 16 nt, Homo sapiens
acuguccccugccugc

SEQ ID NO: 2135629 - RNA, 18 nt, Homo sapiens
cccagacuccaccaagcc

SEQ ID NO: 2135630 - RNA, 22 nt, Homo sapiens
cacagcccucaugaucauucuc

SEQ ID NO: 2135631 - RNA, 20 nt, Homo sapiens
caaccagagaugacugaaac

SEQ ID NO: 2135632 - RNA, 15 nt, Homo sapiens
ucuagauaacauuca

SEQ ID NO: 2135633 - RNA, 20 nt, Homo sapiens
aaagguuuggauuucuccaa

SEQ ID NO: 2135634 - RNA, 15 nt, Homo sapiens
ucaggaucaucugag

SEQ ID NO: 2135635 - RNA, 14 nt, Homo sapiens
uucuuucauucuaa

SEQ ID NO: 2135636 - RNA, 23 nt, Homo sapiens
cugcuggcagaaagcaaauguga

SEQ ID NO: 2135637 - RNA, 18 nt, Homo sapiens
ccucaaccuccugggcua

SEQ ID NO: 2135638 - RNA, 16 nt, Homo sapiens
uuuaaaagucacauaa

SEQ ID NO: 2135639 - RNA, 19 nt, Homo sapiens
uugacagaucaagcuguga

SEQ ID NO: 2135640 - RNA, 14 nt, Homo sapiens
agcaggcugugagu

SEQ ID NO: 2135641 - RNA, 14 nt, Homo sapiens
uaaaaaguucuuaa

SEQ ID NO: 2135642 - RNA, 18 nt, Homo sapiens
gguggauuccaugccgca

SEQ ID NO: 2135643 - RNA, 18 nt, Homo sapiens
uaaaugucuuuaaugcaa

SEQ ID NO: 2135644 - RNA, 14 nt, Homo sapiens
ucuuccuaccaaau

SEQ ID NO: 2135645 - RNA, 20 nt, Homo sapiens
uuguccuguuuucuacaggu

SEQ ID NO: 2135646 - RNA, 13 nt, Homo sapiens
gacuaauaauacu

SEQ ID NO: 2135647 - RNA, 13 nt, Homo sapiens
uggaggugaugaa

SEQ ID NO: 2135648 - RNA, 21 nt, Homo sapiens
guuagugucagccaugggaaa

SEQ ID NO: 2135649 - RNA, 13 nt, Homo sapiens
cccuucucuguau

SEQ ID NO: 2135650 - RNA, 18 nt, Homo sapiens
guuuuuuuuaaucaucaa

SEQ ID NO: 2135651 - RNA, 19 nt, Homo sapiens
aguccuuuuugucaugccc

SEQ ID NO: 2135652 - RNA, 23 nt, Homo sapiens
ccggcugaguguacuaguaguua

SEQ ID NO: 2135653 - RNA, 16 nt, Homo sapiens
gugugccacucagaga

SEQ ID NO: 2135654 - RNA, 13 nt, Homo sapiens
uaaaccauaaaau

SEQ ID NO: 2135655 - RNA, 18 nt, Homo sapiens
gcacgcuggcuugugauc

SEQ ID NO: 2135656 - RNA, 21 nt, Homo sapiens
acguggucuuucuuacaagga

SEQ ID NO: 2135657 - RNA, 15 nt, Homo sapiens
aagucaacaaacugc

SEQ ID NO: 2135658 - RNA, 15 nt, Homo sapiens
cugcugguaccugcc

SEQ ID NO: 2135659 - RNA, 24 nt, Homo sapiens
gcuguggaguucaaaugucgaugc

SEQ ID NO: 2135660 - RNA, 17 nt, Homo sapiens
gcccaggcaggucuuga

SEQ ID NO: 2135661 - RNA, 19 nt, Homo sapiens
uagagcauaccaguacuca

SEQ ID NO: 2135662 - RNA, 16 nt, Homo sapiens
uagccuuauccucuga

SEQ ID NO: 2135663 - RNA, 14 nt, Homo sapiens
uuggagacaggauu

SEQ ID NO: 2135664 - RNA, 23 nt, Homo sapiens
gugcuacuuugccuuuugcaaac

SEQ ID NO: 2135665 - RNA, 13 nt, Homo sapiens
ccuucuggugucu

SEQ ID NO: 2135666 - RNA, 16 nt, Homo sapiens
uaggguugccuguauc

SEQ ID NO: 2135667 - RNA, 18 nt, Homo sapiens
gucucacugaacuagaag

SEQ ID NO: 2135668 - RNA, 18 nt, Homo sapiens
acaacuuuggaauuugaa

SEQ ID NO: 2135669 - RNA, 16 nt, Homo sapiens
gcaucagguccuuugg

SEQ ID NO: 2135670 - RNA, 16 nt, Homo sapiens
ccaacuuuguuuucca

SEQ ID NO: 2135671 - RNA, 13 nt, Homo sapiens
cgccuuaaacucu

SEQ ID NO: 2135672 - RNA, 15 nt, Homo sapiens
acuaauuuuacaugu

SEQ ID NO: 2135673 - RNA, 15 nt, Homo sapiens
caaaaaaucagcaau

SEQ ID NO: 2135674 - RNA, 21 nt, Homo sapiens
cccaggccccagacagggugg

SEQ ID NO: 2135675 - RNA, 18 nt, Homo sapiens
cagacuccacacucagua

SEQ ID NO: 2135676 - RNA, 15 nt, Homo sapiens
agcugggguugugca

SEQ ID NO: 2135677 - RNA, 14 nt, Homo sapiens
ugcaaaauuaguac

SEQ ID NO: 2135678 - RNA, 16 nt, Homo sapiens
uguauuguucccagug

SEQ ID NO: 2135679 - RNA, 16 nt, Homo sapiens
cuugaccucuccagca

SEQ ID NO: 2135680 - RNA, 18 nt, Homo sapiens
ucaagcagggaagcccca

SEQ ID NO: 2135681 - RNA, 15 nt, Homo sapiens
uugggugaaucuuga

SEQ ID NO: 2135682 - RNA, 18 nt, Homo sapiens
auagugcaacaucucuga

SEQ ID NO: 2135683 - RNA, 20 nt, Homo sapiens
aagggcucagagaggacaaa

SEQ ID NO: 2135684 - RNA, 17 nt, Homo sapiens
cuccuuuauugcuccug

SEQ ID NO: 2135685 - RNA, 21 nt, Homo sapiens
aaugucacaauuaugugcaaa

SEQ ID NO: 2135686 - RNA, 16 nt, Homo sapiens
ugaauacaaagugaug

SEQ ID NO: 2135687 - RNA, 23 nt, Homo sapiens
gcuccugggaaggcuacucaccu

SEQ ID NO: 2135688 - RNA, 19 nt, Homo sapiens
cagcuuguggcaagugaau

SEQ ID NO: 2135689 - RNA, 15 nt, Homo sapiens
uucgcucgugcagua

SEQ ID NO: 2135690 - RNA, 13 nt, Homo sapiens
cccagauuguauc

SEQ ID NO: 2135691 - RNA, 14 nt, Homo sapiens
cacgugugauguau

SEQ ID NO: 2135692 - RNA, 11 nt, Homo sapiens
ugagaauguua

SEQ ID NO: 2135693 - RNA, 23 nt, Homo sapiens
uggucauuauuucagugugcaua

SEQ ID NO: 2135694 - RNA, 12 nt, Homo sapiens
ccacccacugac

SEQ ID NO: 2135695 - RNA, 12 nt, Homo sapiens
cagagcacuccc

SEQ ID NO: 2135696 - RNA, 18 nt, Homo sapiens
ucaggaccaggcaaugug

SEQ ID NO: 2135697 - RNA, 13 nt, Homo sapiens
ccuccuccaugca

SEQ ID NO: 2135698 - RNA, 17 nt, Homo sapiens
uucucagccacaaccaa

SEQ ID NO: 2135699 - RNA, 18 nt, Homo sapiens
cacuuagucuguacuuca

SEQ ID NO: 2135700 - RNA, 22 nt, Homo sapiens
cuugucgggagauugaaccacu

SEQ ID NO: 2135701 - RNA, 12 nt, Homo sapiens
gagauguguuca

SEQ ID NO: 2135702 - RNA, 15 nt, Homo sapiens
uacauuuuccaaauc

SEQ ID NO: 2135703 - RNA, 16 nt, Homo sapiens
cggugcagcugagguu

SEQ ID NO: 2135704 - RNA, 19 nt, Homo sapiens
uauggcccagccacugcag

SEQ ID NO: 2135705 - RNA, 24 nt, Homo sapiens
augucaacauuuuugauucuagcu

SEQ ID NO: 2135706 - RNA, 16 nt, Homo sapiens
aggcaacugaacaaaa

SEQ ID NO: 2135707 - RNA, 14 nt, Homo sapiens
aggaagccagguga

SEQ ID NO: 2135708 - RNA, 14 nt, Homo sapiens
ugcugcuccucuag

SEQ ID NO: 2135709 - RNA, 13 nt, Homo sapiens
uuguucacugcag

SEQ ID NO: 2135710 - RNA, 21 nt, Homo sapiens
uacagaguguuauaacaccau

SEQ ID NO: 2135711 - RNA, 15 nt, Homo sapiens
cuucauguacaucca

SEQ ID NO: 2135712 - RNA, 18 nt, Homo sapiens
uaacuguaugaagucaua

SEQ ID NO: 2135713 - RNA, 21 nt, Homo sapiens
agugacaugugcuggacacug

SEQ ID NO: 2135714 - RNA, 16 nt, Homo sapiens
gucccauugauguacu

SEQ ID NO: 2135715 - RNA, 17 nt, Homo sapiens
ucccaaugcacauccau

SEQ ID NO: 2135716 - RNA, 16 nt, Homo sapiens
ucuauaguugucagua

SEQ ID NO: 2135717 - RNA, 18 nt, Homo sapiens
ccuaguucccucugcuca

SEQ ID NO: 2135718 - RNA, 15 nt, Homo sapiens
gaaugcuauuuucaa

SEQ ID NO: 2135719 - RNA, 13 nt, Homo sapiens
cacauugccuucu

SEQ ID NO: 2135720 - RNA, 14 nt, Homo sapiens
ugaaccaacaucuu

SEQ ID NO: 2135721 - RNA, 17 nt, Homo sapiens
aucuguguggugaugaa

SEQ ID NO: 2135722 - RNA, 21 nt, Homo sapiens
gcuaaagcccgggcacccgcc

SEQ ID NO: 2135723 - RNA, 13 nt, Homo sapiens
ugccaggugcugg

SEQ ID NO: 2135724 - RNA, 22 nt, Homo sapiens
uccuuuaaagaugaacucugaa

SEQ ID NO: 2135725 - RNA, 15 nt, Homo sapiens
aagugcauaguuuag

SEQ ID NO: 2135726 - RNA, 13 nt, Homo sapiens
acagggcucgccu

SEQ ID NO: 2135727 - RNA, 16 nt, Homo sapiens
cuuuaugaacucccuc

SEQ ID NO: 2135728 - RNA, 13 nt, Homo sapiens
ccauuugagcucu

SEQ ID NO: 2135729 - RNA, 22 nt, Homo sapiens
uguuaccuguagauucagguaa

SEQ ID NO: 2135730 - RNA, 20 nt, Homo sapiens
cggccacagcacuagaguca

SEQ ID NO: 2135731 - RNA, 15 nt, Homo sapiens
gccaauucguucucu

SEQ ID NO: 2135732 - RNA, 22 nt, Homo sapiens
aucauuaaccacuuaucagugu

SEQ ID NO: 2135733 - RNA, 17 nt, Homo sapiens
gauaucaccucucuuca

SEQ ID NO: 2135734 - RNA, 23 nt, Homo sapiens
gauagcauggggccccuggccca

SEQ ID NO: 2135735 - RNA, 23 nt, Homo sapiens
acaauuccuccagagacacugag

SEQ ID NO: 2135736 - RNA, 16 nt, Homo sapiens
agaaauccuccaauca

SEQ ID NO: 2135737 - RNA, 14 nt, Homo sapiens
auuugagacagagu

SEQ ID NO: 2135738 - RNA, 13 nt, Homo sapiens
gccuccauggcuc

SEQ ID NO: 2135739 - RNA, 21 nt, Homo sapiens
cucaaucucagcuaacauucc

SEQ ID NO: 2135740 - RNA, 19 nt, Homo sapiens
agguggcaacaaugccccg

SEQ ID NO: 2135741 - RNA, 16 nt, Homo sapiens
agacucuccacuguua

SEQ ID NO: 2135742 - RNA, 16 nt, Homo sapiens
auguugauggugcuag

SEQ ID NO: 2135743 - RNA, 20 nt, Homo sapiens
aacaggucuuucaaaaagca

SEQ ID NO: 2135744 - RNA, 16 nt, Homo sapiens
cacaagcccacagcac

SEQ ID NO: 2135745 - RNA, 20 nt, Homo sapiens
agaccuguguuacuaaaaaa

SEQ ID NO: 2135746 - RNA, 16 nt, Homo sapiens
cuugaauguggcuuga

SEQ ID NO: 2135747 - RNA, 13 nt, Homo sapiens
gcacacacugugu

SEQ ID NO: 2135748 - RNA, 14 nt, Homo sapiens
cgugauacauuugg

SEQ ID NO: 2135749 - RNA, 16 nt, Homo sapiens
auggaguauaugucaa

SEQ ID NO: 2135750 - RNA, 22 nt, Homo sapiens
auucaagaaagccagucuuaac

SEQ ID NO: 2135751 - RNA, 21 nt, Homo sapiens
accagagaccguccucacccc

SEQ ID NO: 2135752 - RNA, 20 nt, Homo sapiens
aaugagguggcucaugccug

SEQ ID NO: 2135753 - RNA, 20 nt, Homo sapiens
augggcgcaggcccagugac

SEQ ID NO: 2135754 - RNA, 21 nt, Homo sapiens
gacaccgacucugagcugcua

SEQ ID NO: 2135755 - RNA, 18 nt, Homo sapiens
caguaugguacucaguaa

SEQ ID NO: 2135756 - RNA, 14 nt, Homo sapiens
caggcaaucuugcc

SEQ ID NO: 2135757 - RNA, 22 nt, Homo sapiens
ugaaaagcagccuuuuucacca

SEQ ID NO: 2135758 - RNA, 16 nt, Homo sapiens
uuaagagaucccuuaa

SEQ ID NO: 2135759 - RNA, 14 nt, Homo sapiens
uauuuguaucuguu

SEQ ID NO: 2135760 - RNA, 14 nt, Homo sapiens
guguagauugcgug

SEQ ID NO: 2135761 - RNA, 18 nt, Homo sapiens
ucuggaaugguuuacaga

SEQ ID NO: 2135762 - RNA, 19 nt, Homo sapiens
cuauguccuggaagugugu

SEQ ID NO: 2135763 - RNA, 15 nt, Homo sapiens
cucacugccauggaa

SEQ ID NO: 2135764 - RNA, 15 nt, Homo sapiens
gacagugcguugcaa

SEQ ID NO: 2135765 - RNA, 13 nt, Homo sapiens
uuucaacugccaa

SEQ ID NO: 2135766 - RNA, 14 nt, Homo sapiens
cacugcuugaggga

SEQ ID NO: 2135767 - RNA, 13 nt, Homo sapiens
ugaacugggaccu

SEQ ID NO: 2135768 - RNA, 15 nt, Homo sapiens
aagcccagugcacug

SEQ ID NO: 2135769 - RNA, 18 nt, Homo sapiens
aguuuccucuacugcaaa

SEQ ID NO: 2135770 - RNA, 21 nt, Homo sapiens
aauggaagaaauggcuaugaa

SEQ ID NO: 2135771 - RNA, 13 nt, Homo sapiens
ggcagagagccag

SEQ ID NO: 2135772 - RNA, 12 nt, Homo sapiens
aagcaucuucaa

SEQ ID NO: 2135773 - RNA, 15 nt, Homo sapiens
agcccaucucaacaa

SEQ ID NO: 2135774 - RNA, 22 nt, Homo sapiens
agaauaugaaugagaaugugcc

SEQ ID NO: 2135775 - RNA, 20 nt, Homo sapiens
gcucagcagguugaaugggu

SEQ ID NO: 2135776 - RNA, 23 nt, Homo sapiens
cuaugugggacaccucaaauaca

SEQ ID NO: 2135777 - RNA, 17 nt, Homo sapiens
ugucagucguguugcuu

SEQ ID NO: 2135778 - RNA, 20 nt, Homo sapiens
agggcgagagugcccagggc

SEQ ID NO: 2135779 - RNA, 14 nt, Homo sapiens
agcaguucagcucc

SEQ ID NO: 2135780 - RNA, 21 nt, Homo sapiens
gaugcuucuauaauuuugccu

SEQ ID NO: 2135781 - RNA, 18 nt, Homo sapiens
aagccaguuuccacaggc

SEQ ID NO: 2135782 - RNA, 15 nt, Homo sapiens
uuuuccuuaccuuua

SEQ ID NO: 2135783 - RNA, 17 nt, Homo sapiens
auccagguacgcacaga

SEQ ID NO: 2135784 - RNA, 21 nt, Homo sapiens
cuuccacgauggugcagugua

SEQ ID NO: 2135785 - RNA, 21 nt, Homo sapiens
aucuacauuaaaaugacaaac

SEQ ID NO: 2135786 - RNA, 21 nt, Homo sapiens
uauaugacuucagaaauguua

SEQ ID NO: 2135787 - RNA, 16 nt, Homo sapiens
cuucuagaacaccugc

SEQ ID NO: 2135788 - RNA, 15 nt, Homo sapiens
uugggacagccauuu

SEQ ID NO: 2135789 - RNA, 16 nt, Homo sapiens
auaaaucaacuccagc

SEQ ID NO: 2135790 - RNA, 13 nt, Homo sapiens
gauggugcugacc

SEQ ID NO: 2135791 - RNA, 14 nt, Homo sapiens
uguuguaauugcau

SEQ ID NO: 2135792 - RNA, 16 nt, Homo sapiens
ggguggggggaaugag

SEQ ID NO: 2135793 - RNA, 17 nt, Homo sapiens
gccaagcuggcacaaaa

SEQ ID NO: 2135794 - RNA, 14 nt, Homo sapiens
cacuguaguucuaa

SEQ ID NO: 2135795 - RNA, 14 nt, Homo sapiens
cauacacagccugg

SEQ ID NO: 2135796 - RNA, 19 nt, Homo sapiens
gcuacaaaacaauucaauu

SEQ ID NO: 2135797 - RNA, 22 nt, Homo sapiens
cccugcuuuuugcuucuugagu

SEQ ID NO: 2135798 - RNA, 20 nt, Homo sapiens
aaaugugucucacaucuaca

SEQ ID NO: 2135799 - RNA, 19 nt, Homo sapiens
auggccccugccuucccag

SEQ ID NO: 2135800 - RNA, 14 nt, Homo sapiens
aaaugaauguuguc

SEQ ID NO: 2135801 - RNA, 16 nt, Homo sapiens
cuauuucaucacaaga

SEQ ID NO: 2135802 - RNA, 21 nt, Homo sapiens
uagagucacugauacacagaa

SEQ ID NO: 2135803 - RNA, 23 nt, Homo sapiens
uaaaagccgcccagugggaccca

SEQ ID NO: 2135804 - RNA, 17 nt, Homo sapiens
uagaaguuacugaaugc

SEQ ID NO: 2135805 - RNA, 23 nt, Homo sapiens
accuucugacgcagccugagaau

SEQ ID NO: 2135806 - RNA, 19 nt, Homo sapiens
ugaaaacagugugaugcaa

SEQ ID NO: 2135807 - RNA, 23 nt, Homo sapiens
ugaagacaccaucuccaugugac

SEQ ID NO: 2135808 - RNA, 17 nt, Homo sapiens
acucggcgugcuccuuu

SEQ ID NO: 2135809 - RNA, 22 nt, Homo sapiens
caaucucccuggggcacuuuca

SEQ ID NO: 2135810 - RNA, 17 nt, Homo sapiens
aggggaaggcaacauac

SEQ ID NO: 2135811 - RNA, 20 nt, Homo sapiens
agcuccaggugcccuguggg

SEQ ID NO: 2135812 - RNA, 14 nt, Homo sapiens
ucucuuuguaaaac

SEQ ID NO: 2135813 - RNA, 20 nt, Homo sapiens
ugcuagauuuagcacaguau

SEQ ID NO: 2135814 - RNA, 15 nt, Homo sapiens
aaaucuucuaauucc

SEQ ID NO: 2135815 - RNA, 15 nt, Homo sapiens
uccacuucaccaucc

SEQ ID NO: 2135816 - RNA, 18 nt, Homo sapiens
gcaggaaauacuuuguaa

SEQ ID NO: 2135817 - RNA, 18 nt, Homo sapiens
gaggcugaggcgggugga

SEQ ID NO: 2135818 - RNA, 15 nt, Homo sapiens
augcacacacacgga

SEQ ID NO: 2135819 - RNA, 18 nt, Homo sapiens
cagcgucaggccuaccuc

SEQ ID NO: 2135820 - RNA, 21 nt, Homo sapiens
gcuucauguuugccuucugca

SEQ ID NO: 2135821 - RNA, 23 nt, Homo sapiens
caaggacacccucccuccagggu

SEQ ID NO: 2135822 - RNA, 19 nt, Homo sapiens
auggcaagugcaccaagga

SEQ ID NO: 2135823 - RNA, 17 nt, Homo sapiens
ucacaucuaaagcuuua

SEQ ID NO: 2135824 - RNA, 14 nt, Homo sapiens
acuuuccaaaaccu

SEQ ID NO: 2135825 - RNA, 15 nt, Homo sapiens
auauucaacucauaa

SEQ ID NO: 2135826 - RNA, 14 nt, Homo sapiens
gcuauucaccucag

SEQ ID NO: 2135827 - RNA, 22 nt, Homo sapiens
auggacuggagcucaucugcaa

SEQ ID NO: 2135828 - RNA, 14 nt, Homo sapiens
ccaaagcagcacuu

SEQ ID NO: 2135829 - RNA, 20 nt, Homo sapiens
ugggaagaaagauucaauua

SEQ ID NO: 2135830 - RNA, 23 nt, Homo sapiens
cuugaucggaaagcucuuccuaa

SEQ ID NO: 2135831 - RNA, 13 nt, Homo sapiens
cugugugagcugc

SEQ ID NO: 2135832 - RNA, 13 nt, Homo sapiens
agaaaugcuuuga

SEQ ID NO: 2135833 - RNA, 20 nt, Homo sapiens
ugcaugugugugcucagggg

SEQ ID NO: 2135834 - RNA, 18 nt, Homo sapiens
uauaaauguauauacaca

SEQ ID NO: 2135835 - RNA, 14 nt, Homo sapiens
gccccuccagcaca

SEQ ID NO: 2135836 - RNA, 22 nt, Homo sapiens
gcugugagccccugguccugag

SEQ ID NO: 2135837 - RNA, 20 nt, Homo sapiens
gaggccuuacuuaaacccag

SEQ ID NO: 2135838 - RNA, 13 nt, Homo sapiens
acacacaauaaag

SEQ ID NO: 2135839 - RNA, 15 nt, Homo sapiens
uauauggggcuuuag

SEQ ID NO: 2135840 - RNA, 22 nt, Homo sapiens
cucagaaaacaaggaugaauua

SEQ ID NO: 2135841 - RNA, 14 nt, Homo sapiens
ucacacacauggaa

SEQ ID NO: 2135842 - RNA, 14 nt, Homo sapiens
augccaacucagcc

SEQ ID NO: 2135843 - RNA, 18 nt, Homo sapiens
caggcuggagugcaaugg

SEQ ID NO: 2135844 - RNA, 14 nt, Homo sapiens
cauauaugcaauau

SEQ ID NO: 2135845 - RNA, 16 nt, Homo sapiens
ucuguaaacuguguau

SEQ ID NO: 2135846 - RNA, 14 nt, Homo sapiens
auugauuauucuga

SEQ ID NO: 2135847 - RNA, 19 nt, Homo sapiens
uucaacauaaagagcaaua

SEQ ID NO: 2135848 - RNA, 16 nt, Homo sapiens
caggcucacucacaga

SEQ ID NO: 2135849 - RNA, 16 nt, Homo sapiens
ucaaaauauuucucau

SEQ ID NO: 2135850 - RNA, 23 nt, Homo sapiens
guucuucaggagaugaugugaug

SEQ ID NO: 2135851 - RNA, 20 nt, Homo sapiens
uaccauagcuuaagaaguau

SEQ ID NO: 2135852 - RNA, 20 nt, Homo sapiens
auucucauaaguagcauuca

SEQ ID NO: 2135853 - RNA, 21 nt, Homo sapiens
auacugccacuaaccuuccaa

SEQ ID NO: 2135854 - RNA, 20 nt, Homo sapiens
ucuugggaauuuucuuccaa

SEQ ID NO: 2135855 - RNA, 22 nt, Homo sapiens
caucucugagcccgugucacag

SEQ ID NO: 2135856 - RNA, 15 nt, Homo sapiens
auuuuucaaguauac

SEQ ID NO: 2135857 - RNA, 20 nt, Homo sapiens
aaccugggaaagccaugacc

SEQ ID NO: 2135858 - RNA, 17 nt, Homo sapiens
ggguguggcaguguaug

SEQ ID NO: 2135859 - RNA, 16 nt, Homo sapiens
aaaacaugcagaacaa

SEQ ID NO: 2135860 - RNA, 17 nt, Homo sapiens
ucucagugaaauaacua

SEQ ID NO: 2135861 - RNA, 19 nt, Homo sapiens
cuaugaacucuugauaaca

SEQ ID NO: 2135862 - RNA, 12 nt, Homo sapiens
cagcuacccagg

SEQ ID NO: 2135863 - RNA, 20 nt, Homo sapiens
ccggcacuuccgagauccac

SEQ ID NO: 2135864 - RNA, 14 nt, Homo sapiens
gagaggcaugugau

SEQ ID NO: 2135865 - RNA, 18 nt, Homo sapiens
ucccacaugggcccaggc

SEQ ID NO: 2135866 - RNA, 15 nt, Homo sapiens
ccuggcugcacucuu

SEQ ID NO: 2135867 - RNA, 17 nt, Homo sapiens
ccaaaaaaauacuugag

SEQ ID NO: 2135868 - RNA, 15 nt, Homo sapiens
cuaagugcccaaagu

SEQ ID NO: 2135869 - RNA, 18 nt, Homo sapiens
cauaaagagcuucagcag

SEQ ID NO: 2135870 - RNA, 14 nt, Homo sapiens
ugaacuguccuucc

SEQ ID NO: 2135871 - RNA, 19 nt, Homo sapiens
cagagauuuuccucuccaa

SEQ ID NO: 2135872 - RNA, 13 nt, Homo sapiens
uucuuuugauaaa

SEQ ID NO: 2135873 - RNA, 16 nt, Homo sapiens
aacuggcaugucauuu

SEQ ID NO: 2135874 - RNA, 14 nt, Homo sapiens
gccaaacacagagc

SEQ ID NO: 2135875 - RNA, 13 nt, Homo sapiens
augccauuugggc

SEQ ID NO: 2135876 - RNA, 15 nt, Homo sapiens
gcgcaagcugggagc

SEQ ID NO: 2135877 - RNA, 20 nt, Homo sapiens
gaacaugcccccugcagaca

SEQ ID NO: 2135878 - RNA, 15 nt, Homo sapiens
acguaugaaugauau

SEQ ID NO: 2135879 - RNA, 16 nt, Homo sapiens
caccccugcacaguug

SEQ ID NO: 2135880 - RNA, 24 nt, Homo sapiens
aaaaugaaauaauuugaguuguau

SEQ ID NO: 2135881 - RNA, 14 nt, Homo sapiens
guuuagaccaagga

SEQ ID NO: 2135882 - RNA, 23 nt, Homo sapiens
cagaggaggggaaaguccagggc

SEQ ID NO: 2135883 - RNA, 22 nt, Homo sapiens
uacaaugauaggaaaaauccau

SEQ ID NO: 2135884 - RNA, 15 nt, Homo sapiens
aggcaggcacuucac

SEQ ID NO: 2135885 - RNA, 19 nt, Homo sapiens
ugggcaggugguggcacug

SEQ ID NO: 2135886 - RNA, 23 nt, Homo sapiens
gcacuugauguguagacauguca

SEQ ID NO: 2135887 - RNA, 15 nt, Homo sapiens
uggaaaauaccuaau

SEQ ID NO: 2135888 - RNA, 19 nt, Homo sapiens
agcuaagugaaaaggucau

SEQ ID NO: 2135889 - RNA, 15 nt, Homo sapiens
auuaaucaaguaccu

SEQ ID NO: 2135890 - RNA, 22 nt, Homo sapiens
ugcaggacuugagaagaccuca

SEQ ID NO: 2135891 - RNA, 13 nt, Homo sapiens
cauauguagcuaa

SEQ ID NO: 2135892 - RNA, 20 nt, Homo sapiens
auggggauuccacuaucuca

SEQ ID NO: 2135893 - RNA, 21 nt, Homo sapiens
aaugccauaauacaaaaggcu

SEQ ID NO: 2135894 - RNA, 14 nt, Homo sapiens
uauuaaaacacaaa

SEQ ID NO: 2135895 - RNA, 21 nt, Homo sapiens
cccuuguaaauagaaccagcc

SEQ ID NO: 2135896 - RNA, 13 nt, Homo sapiens
uuuaaacuguaca

SEQ ID NO: 2135897 - RNA, 17 nt, Homo sapiens
gcgcccgccaccaugcc

SEQ ID NO: 2135898 - RNA, 18 nt, Homo sapiens
gaccuccuuacauaugca

SEQ ID NO: 2135899 - RNA, 12 nt, Homo sapiens
acaguuucuuca

SEQ ID NO: 2135900 - RNA, 16 nt, Homo sapiens
gccuugguaugugcca

SEQ ID NO: 2135901 - RNA, 13 nt, Homo sapiens
uacuguacuuaau

SEQ ID NO: 2135902 - RNA, 17 nt, Homo sapiens
uaaaaggucuaugcuca

SEQ ID NO: 2135903 - RNA, 22 nt, Homo sapiens
auguugauuucuuguaacaucc

SEQ ID NO: 2135904 - RNA, 19 nt, Homo sapiens
agaaagauaauucacugua

SEQ ID NO: 2135905 - RNA, 23 nt, Homo sapiens
gaauguaaaaaagaaaaaacugg

SEQ ID NO: 2135906 - RNA, 22 nt, Homo sapiens
uugugugcucauguaugugcga

SEQ ID NO: 2135907 - RNA, 15 nt, Homo sapiens
aauugacgacuucac

SEQ ID NO: 2135908 - RNA, 14 nt, Homo sapiens
ucuauugauguaca

SEQ ID NO: 2135909 - RNA, 21 nt, Homo sapiens
ucaggugccuuugaguucuag

SEQ ID NO: 2135910 - RNA, 19 nt, Homo sapiens
ucuuggggacuaacccaau

SEQ ID NO: 2135911 - RNA, 15 nt, Homo sapiens
aauguuuuaguaaaa

SEQ ID NO: 2135912 - RNA, 12 nt, Homo sapiens
uggaauaaggca

SEQ ID NO: 2135913 - RNA, 22 nt, Homo sapiens
guuauaauaauguuaacaugga

SEQ ID NO: 2135914 - RNA, 11 nt, Homo sapiens
cacacugaacu

SEQ ID NO: 2135915 - RNA, 17 nt, Homo sapiens
accuuucacccucauga

SEQ ID NO: 2135916 - RNA, 14 nt, Homo sapiens
aauaauaccuaagc

SEQ ID NO: 2135917 - RNA, 19 nt, Homo sapiens
aggcuaagagaugugacua

SEQ ID NO: 2135918 - RNA, 18 nt, Homo sapiens
agucacuucaccaucaac

SEQ ID NO: 2135919 - RNA, 13 nt, Homo sapiens
cauguauguggua

SEQ ID NO: 2135920 - RNA, 15 nt, Homo sapiens
uguaauucuaauaau

SEQ ID NO: 2135921 - RNA, 18 nt, Homo sapiens
auuuguuuguauacauau

SEQ ID NO: 2135922 - RNA, 21 nt, Homo sapiens
aggaaauccagccccauagaa

SEQ ID NO: 2135923 - RNA, 14 nt, Homo sapiens
gggguucaugagga

SEQ ID NO: 2135924 - RNA, 17 nt, Homo sapiens
acaaacaggugcuaaca

SEQ ID NO: 2135925 - RNA, 14 nt, Homo sapiens
accguaggacccaa

SEQ ID NO: 2135926 - RNA, 23 nt, Homo sapiens
agagaacaguuuuacaauagaca

SEQ ID NO: 2135927 - RNA, 21 nt, Homo sapiens
ucacaguuuugguugcuuuaa

SEQ ID NO: 2135928 - RNA, 13 nt, Homo sapiens
gcugaguggcgca

SEQ ID NO: 2135929 - RNA, 17 nt, Homo sapiens
ugagggaucacugccaa

SEQ ID NO: 2135930 - RNA, 22 nt, Homo sapiens
ugcaauaaaucugacccagugc

SEQ ID NO: 2135931 - RNA, 19 nt, Homo sapiens
ggauuccgucuucucucau

SEQ ID NO: 2135932 - RNA, 21 nt, Homo sapiens
ucugccacccacucaggauug

SEQ ID NO: 2135933 - RNA, 20 nt, Homo sapiens
cucugucucaaaacaaacaa

SEQ ID NO: 2135934 - RNA, 14 nt, Homo sapiens
ucuuugaaagggcu

SEQ ID NO: 2135935 - RNA, 18 nt, Homo sapiens
auacuuucuguucuccag

SEQ ID NO: 2135936 - RNA, 20 nt, Homo sapiens
uggcagaaucccccaaagaa

SEQ ID NO: 2135937 - RNA, 19 nt, Homo sapiens
aagaugcuuuucaaacuga

SEQ ID NO: 2135938 - RNA, 18 nt, Homo sapiens
agccuccccgugccaaaa

SEQ ID NO: 2135939 - RNA, 22 nt, Homo sapiens
auagccugaggugggagaauca

SEQ ID NO: 2135940 - RNA, 19 nt, Homo sapiens
auuauuccacucaauaugu

SEQ ID NO: 2135941 - RNA, 17 nt, Homo sapiens
ugaaagaggccaaacag

SEQ ID NO: 2135942 - RNA, 16 nt, Homo sapiens
ggaugugcauucucca

SEQ ID NO: 2135943 - RNA, 23 nt, Homo sapiens
aauuuuuauuguuguacauacga

SEQ ID NO: 2135944 - RNA, 14 nt, Homo sapiens
auugcugaacucuu

SEQ ID NO: 2135945 - RNA, 16 nt, Homo sapiens
aguuguaccacugcua

SEQ ID NO: 2135946 - RNA, 14 nt, Homo sapiens
cuccugcccagcuc

SEQ ID NO: 2135947 - RNA, 14 nt, Homo sapiens
guuauagacugcca

SEQ ID NO: 2135948 - RNA, 16 nt, Homo sapiens
ucaguuugacuacucu

SEQ ID NO: 2135949 - RNA, 23 nt, Homo sapiens
ggaugauguuauucacagccccu

SEQ ID NO: 2135950 - RNA, 19 nt, Homo sapiens
gucuuuacuuuaaucuccu

SEQ ID NO: 2135951 - RNA, 19 nt, Homo sapiens
ccuguaucuauuguauauu

SEQ ID NO: 2135952 - RNA, 19 nt, Homo sapiens
ccagacccuccuuccccac

SEQ ID NO: 2135953 - RNA, 21 nt, Homo sapiens
cagcccaaguagguuauuugu

SEQ ID NO: 2135954 - RNA, 20 nt, Homo sapiens
gugugacucgccagcucauu

SEQ ID NO: 2135955 - RNA, 19 nt, Homo sapiens
gucaagacagugucauggu

SEQ ID NO: 2135956 - RNA, 22 nt, Homo sapiens
cucauggaugagacuacuucag

SEQ ID NO: 2135957 - RNA, 14 nt, Homo sapiens
aaucuguccagaca

SEQ ID NO: 2135958 - RNA, 14 nt, Homo sapiens
ucuguagugucacu

SEQ ID NO: 2135959 - RNA, 21 nt, Homo sapiens
uggaaauacuuuaucugugac

SEQ ID NO: 2135960 - RNA, 17 nt, Homo sapiens
auccagagaccaaauaa

SEQ ID NO: 2135961 - RNA, 20 nt, Homo sapiens
cucagaacuugcugcugucu

SEQ ID NO: 2135962 - RNA, 22 nt, Homo sapiens
aaaccacagcugggcaggguga

SEQ ID NO: 2135963 - RNA, 20 nt, Homo sapiens
aggugguauggagcugugcc

SEQ ID NO: 2135964 - RNA, 14 nt, Homo sapiens
uacaaguaguucug

SEQ ID NO: 2135965 - RNA, 13 nt, Homo sapiens
aaauaaacuguua

SEQ ID NO: 2135966 - RNA, 13 nt, Homo sapiens
uaaacaacaguac

SEQ ID NO: 2135967 - RNA, 18 nt, Homo sapiens
caagguccucugucaguc

SEQ ID NO: 2135968 - RNA, 15 nt, Homo sapiens
gaaaauaacacaaca

SEQ ID NO: 2135969 - RNA, 19 nt, Homo sapiens
acugcucacacugcugaug

SEQ ID NO: 2135970 - RNA, 21 nt, Homo sapiens
uuuaaaugaucuguacuaucu

SEQ ID NO: 2135971 - RNA, 14 nt, Homo sapiens
cuacugacccaacu

SEQ ID NO: 2135972 - RNA, 18 nt, Homo sapiens
uucaaaguuaauuuuccc

SEQ ID NO: 2135973 - RNA, 16 nt, Homo sapiens
augcaacucaucuuca

SEQ ID NO: 2135974 - RNA, 18 nt, Homo sapiens
gguuaagugacuugccca

SEQ ID NO: 2135975 - RNA, 22 nt, Homo sapiens
caacaaccggccaccagauguc

SEQ ID NO: 2135976 - RNA, 17 nt, Homo sapiens
ucagccuuggaagcaaa

SEQ ID NO: 2135977 - RNA, 16 nt, Homo sapiens
uugucauauacugcuu

SEQ ID NO: 2135978 - RNA, 18 nt, Homo sapiens
gcccugcagagcaauaac

SEQ ID NO: 2135979 - RNA, 14 nt, Homo sapiens
agaauggagcagua

SEQ ID NO: 2135980 - RNA, 21 nt, Homo sapiens
augguugcacaaaaccacuuu

SEQ ID NO: 2135981 - RNA, 17 nt, Homo sapiens
cugggcucgucuuugca

SEQ ID NO: 2135982 - RNA, 19 nt, Homo sapiens
gugcuaaagauuguuaaau

SEQ ID NO: 2135983 - RNA, 20 nt, Homo sapiens
auauauggggcuuuagcaag

SEQ ID NO: 2135984 - RNA, 19 nt, Homo sapiens
guuauagaaacugauauau

SEQ ID NO: 2135985 - RNA, 21 nt, Homo sapiens
gcaauugaagguuguauguaa

SEQ ID NO: 2135986 - RNA, 17 nt, Homo sapiens
uauuucacuugccaagu

SEQ ID NO: 2135987 - RNA, 20 nt, Homo sapiens
uaguccaccucccauuacuu

SEQ ID NO: 2135988 - RNA, 14 nt, Homo sapiens
uucccccacuacuu

SEQ ID NO: 2135989 - RNA, 13 nt, Homo sapiens
ucucaagagugcu

SEQ ID NO: 2135990 - RNA, 20 nt, Homo sapiens
cuauucugcugagagaucac

SEQ ID NO: 2135991 - RNA, 17 nt, Homo sapiens
cauuuuaugucauuaaa

SEQ ID NO: 2135992 - RNA, 16 nt, Homo sapiens
uuacuaacuaaacucu

SEQ ID NO: 2135993 - RNA, 15 nt, Homo sapiens
accugcccacgcuag

SEQ ID NO: 2135994 - RNA, 16 nt, Homo sapiens
ugaagacuuaaaagag

SEQ ID NO: 2135995 - RNA, 14 nt, Homo sapiens
gcaaaucaucugca

SEQ ID NO: 2135996 - RNA, 20 nt, Homo sapiens
gaaagauuugaugggccaca

SEQ ID NO: 2135997 - RNA, 22 nt, Homo sapiens
acagcauuugauaaaauccaaa

SEQ ID NO: 2135998 - RNA, 16 nt, Homo sapiens
ucaacucuucccugaa

SEQ ID NO: 2135999 - RNA, 16 nt, Homo sapiens
uccagcagcugccaga

SEQ ID NO: 2136000 - RNA, 20 nt, Homo sapiens
gcuucucuuuggaaacaaua

SEQ ID NO: 2136001 - RNA, 14 nt, Homo sapiens
cccccaagcucagu

SEQ ID NO: 2136002 - RNA, 22 nt, Homo sapiens
ccucccagcuguaccggccacu

SEQ ID NO: 2136003 - RNA, 20 nt, Homo sapiens
cauaaaucacuucaacugcu

SEQ ID NO: 2136004 - RNA, 21 nt, Homo sapiens
acuuuaucaaagagaaguuac

SEQ ID NO: 2136005 - RNA, 18 nt, Homo sapiens
uccagaaggccacaggcc

SEQ ID NO: 2136006 - RNA, 16 nt, Homo sapiens
aauuagaaaguagcca

SEQ ID NO: 2136007 - RNA, 11 nt, Homo sapiens
ccagugccauu

SEQ ID NO: 2136008 - RNA, 16 nt, Homo sapiens
acccucccacugccaa

SEQ ID NO: 2136009 - RNA, 14 nt, Homo sapiens
gcaggcaggggcau

SEQ ID NO: 2136010 - RNA, 22 nt, Homo sapiens
cuccucacaguugccauguaga

SEQ ID NO: 2136011 - RNA, 12 nt, Homo sapiens
aucaaccaaaaa

SEQ ID NO: 2136012 - RNA, 17 nt, Homo sapiens
aaaacugugcugagaaa

SEQ ID NO: 2136013 - RNA, 16 nt, Homo sapiens
aaagacauaaucaugg

SEQ ID NO: 2136014 - RNA, 15 nt, Homo sapiens
cucggggugcacagg

SEQ ID NO: 2136015 - RNA, 14 nt, Homo sapiens
uuauaccuugccug

SEQ ID NO: 2136016 - RNA, 13 nt, Homo sapiens
aauuccgagugca

SEQ ID NO: 2136017 - RNA, 14 nt, Homo sapiens
uuuguagcacugag

SEQ ID NO: 2136018 - RNA, 15 nt, Homo sapiens
ccacaccgcagggac

SEQ ID NO: 2136019 - RNA, 15 nt, Homo sapiens
auccgaggcaggguc

SEQ ID NO: 2136020 - RNA, 11 nt, Homo sapiens
aggcuguaacu

SEQ ID NO: 2136021 - RNA, 15 nt, Homo sapiens
auuuugccugcaaca

SEQ ID NO: 2136022 - RNA, 13 nt, Homo sapiens
auaaaacucugca

SEQ ID NO: 2136023 - RNA, 15 nt, Homo sapiens
cuggacauucugggg

SEQ ID NO: 2136024 - RNA, 16 nt, Homo sapiens
guacuaucuagugucu

SEQ ID NO: 2136025 - RNA, 22 nt, Homo sapiens
uuugccacaggagcugaaguua

SEQ ID NO: 2136026 - RNA, 20 nt, Homo sapiens
cugacucacaagaagaccag

SEQ ID NO: 2136027 - RNA, 20 nt, Homo sapiens
ccuggauuugggaugaaaua

SEQ ID NO: 2136028 - RNA, 12 nt, Homo sapiens
cauuucuaacau

SEQ ID NO: 2136029 - RNA, 21 nt, Homo sapiens
aagguggggauugcccaucca

SEQ ID NO: 2136030 - RNA, 18 nt, Homo sapiens
cagaguggacuuguguuu

SEQ ID NO: 2136031 - RNA, 19 nt, Homo sapiens
aggaggccguggcucugau

SEQ ID NO: 2136032 - RNA, 16 nt, Homo sapiens
gccucccugagcacug

SEQ ID NO: 2136033 - RNA, 16 nt, Homo sapiens
ucccccgugaucuccc

SEQ ID NO: 2136034 - RNA, 20 nt, Homo sapiens
ucagaggagcggccagaaga

SEQ ID NO: 2136035 - RNA, 11 nt, Homo sapiens
ccacagccauc

SEQ ID NO: 2136036 - RNA, 18 nt, Homo sapiens
auggaugcaucacacuca

SEQ ID NO: 2136037 - RNA, 15 nt, Homo sapiens
ucccacuagcagcuu

SEQ ID NO: 2136038 - RNA, 15 nt, Homo sapiens
ggaaagcagugcagu

SEQ ID NO: 2136039 - RNA, 19 nt, Homo sapiens
ucucccuuugaagaaacua

SEQ ID NO: 2136040 - RNA, 21 nt, Homo sapiens
cuccuuuaccuuucagugcag

SEQ ID NO: 2136041 - RNA, 14 nt, Homo sapiens
aaauacuaccuaua

SEQ ID NO: 2136042 - RNA, 22 nt, Homo sapiens
acauuucuaagucaaacacuug

SEQ ID NO: 2136043 - RNA, 13 nt, Homo sapiens
gcccagccuggga

SEQ ID NO: 2136044 - RNA, 13 nt, Homo sapiens
gcgcacugcauuc

SEQ ID NO: 2136045 - RNA, 22 nt, Homo sapiens
aauacuuucugcauaguggccu

SEQ ID NO: 2136046 - RNA, 15 nt, Homo sapiens
auggaagaacacugu

SEQ ID NO: 2136047 - RNA, 15 nt, Homo sapiens
cuguggaugucccua

SEQ ID NO: 2136048 - RNA, 14 nt, Homo sapiens
uggcugacuggggc

SEQ ID NO: 2136049 - RNA, 15 nt, Homo sapiens
aagccccauccugcc

SEQ ID NO: 2136050 - RNA, 22 nt, Homo sapiens
cacugauggaaaauaccagugu

SEQ ID NO: 2136051 - RNA, 16 nt, Homo sapiens
gagaugcccauucucu

SEQ ID NO: 2136052 - RNA, 20 nt, Homo sapiens
accuuaguugcaugaccaca

SEQ ID NO: 2136053 - RNA, 20 nt, Homo sapiens
gauagcuguguguguuagcu

SEQ ID NO: 2136054 - RNA, 20 nt, Homo sapiens
auucagcacaccccaaggga

SEQ ID NO: 2136055 - RNA, 17 nt, Homo sapiens
acagaugugggcuuuga

SEQ ID NO: 2136056 - RNA, 14 nt, Homo sapiens
auggguacaaugaa

SEQ ID NO: 2136057 - RNA, 19 nt, Homo sapiens
ucagcugucaccugcucac

SEQ ID NO: 2136058 - RNA, 16 nt, Homo sapiens
caagcaagaucugcuc

SEQ ID NO: 2136059 - RNA, 14 nt, Homo sapiens
uauagauguugcua

SEQ ID NO: 2136060 - RNA, 17 nt, Homo sapiens
augcaaaauccugguga

SEQ ID NO: 2136061 - RNA, 19 nt, Homo sapiens
ugaaccauuauagccucag

SEQ ID NO: 2136062 - RNA, 23 nt, Homo sapiens
gcaccuccgcgggcugacugggc

SEQ ID NO: 2136063 - RNA, 20 nt, Homo sapiens
augcaagacuucacugcagc

SEQ ID NO: 2136064 - RNA, 18 nt, Homo sapiens
aagguugcagugcugagc

SEQ ID NO: 2136065 - RNA, 14 nt, Homo sapiens
agccuggccagaca

SEQ ID NO: 2136066 - RNA, 13 nt, Homo sapiens
ucacacccauuua

SEQ ID NO: 2136067 - RNA, 17 nt, Homo sapiens
uguacacacacagaugc

SEQ ID NO: 2136068 - RNA, 19 nt, Homo sapiens
uugccccacccaacaagcc

SEQ ID NO: 2136069 - RNA, 18 nt, Homo sapiens
gauaaccauauaaauucu

SEQ ID NO: 2136070 - RNA, 14 nt, Homo sapiens
cauccuccuucuuc

SEQ ID NO: 2136071 - RNA, 13 nt, Homo sapiens
agucucaaaaaua

SEQ ID NO: 2136072 - RNA, 17 nt, Homo sapiens
uaagaaaucauggcauu

SEQ ID NO: 2136073 - RNA, 21 nt, Homo sapiens
guaacaaaaauaaaaacucuu

SEQ ID NO: 2136074 - RNA, 18 nt, Homo sapiens
cuaacauuauauugcaau

SEQ ID NO: 2136075 - RNA, 20 nt, Homo sapiens
gaugugaagcucacacugau

SEQ ID NO: 2136076 - RNA, 17 nt, Homo sapiens
acugucucguacuagaa

SEQ ID NO: 2136077 - RNA, 22 nt, Homo sapiens
cccagcuguugggaacagcaug

SEQ ID NO: 2136078 - RNA, 20 nt, Homo sapiens
gaaccuagauugcaccauug

SEQ ID NO: 2136079 - RNA, 20 nt, Homo sapiens
ccugggguguuaguggcacc

SEQ ID NO: 2136080 - RNA, 22 nt, Homo sapiens
cugcagggcaggcacucgggaa

SEQ ID NO: 2136081 - RNA, 21 nt, Homo sapiens
gugaaccgaggggcucaggaa

SEQ ID NO: 2136082 - RNA, 15 nt, Homo sapiens
ggucccugccagugu

SEQ ID NO: 2136083 - RNA, 20 nt, Homo sapiens
ggaaacucggcagcccuucc

SEQ ID NO: 2136084 - RNA, 19 nt, Homo sapiens
cacugaaucucaccugcug

SEQ ID NO: 2136085 - RNA, 20 nt, Homo sapiens
acuaucuuucagcuccaguu

SEQ ID NO: 2136086 - RNA, 23 nt, Homo sapiens
agcuuucaggaaguugcugagaa

SEQ ID NO: 2136087 - RNA, 17 nt, Homo sapiens
uacuuuuaaacuuugau

SEQ ID NO: 2136088 - RNA, 23 nt, Homo sapiens
uacuuuuauuuuauucugaagga

SEQ ID NO: 2136089 - RNA, 17 nt, Homo sapiens
uuacaguggcaguauug

SEQ ID NO: 2136090 - RNA, 23 nt, Homo sapiens
gcccuuuauuuauaauacauuuc

SEQ ID NO: 2136091 - RNA, 14 nt, Homo sapiens
guguuuguggucaa

SEQ ID NO: 2136092 - RNA, 17 nt, Homo sapiens
gggagcacccugagggc

SEQ ID NO: 2136093 - RNA, 14 nt, Homo sapiens
cagaacuccuuucu

SEQ ID NO: 2136094 - RNA, 15 nt, Homo sapiens
agguucagccugaaa

SEQ ID NO: 2136095 - RNA, 23 nt, Homo sapiens
ugaacaaagagagcucaucauca

SEQ ID NO: 2136096 - RNA, 19 nt, Homo sapiens
aggaacccuccuccuguca

SEQ ID NO: 2136097 - RNA, 23 nt, Homo sapiens
gucuggagccccauccuguguua

SEQ ID NO: 2136098 - RNA, 13 nt, Homo sapiens
acaauaguaugca

SEQ ID NO: 2136099 - RNA, 18 nt, Homo sapiens
gcagaauaaugacugacu

SEQ ID NO: 2136100 - RNA, 22 nt, Homo sapiens
cgcuguuggggcugcucauguu

SEQ ID NO: 2136101 - RNA, 15 nt, Homo sapiens
ugaggcaaaggccag

SEQ ID NO: 2136102 - RNA, 16 nt, Homo sapiens
agugaaggagccagug

SEQ ID NO: 2136103 - RNA, 22 nt, Homo sapiens
uagauaaagcacuguuuggaua

SEQ ID NO: 2136104 - RNA, 14 nt, Homo sapiens
ugccauguuuagau

SEQ ID NO: 2136105 - RNA, 20 nt, Homo sapiens
cuuuaaaguuacugaucaca

SEQ ID NO: 2136106 - RNA, 22 nt, Homo sapiens
aggcggaucuuuggacagaagc

SEQ ID NO: 2136107 - RNA, 15 nt, Homo sapiens
cauauagacuauaua

SEQ ID NO: 2136108 - RNA, 21 nt, Homo sapiens
acaaucacguuauaguccaug

SEQ ID NO: 2136109 - RNA, 17 nt, Homo sapiens
ccaggguggagugcagu

SEQ ID NO: 2136110 - RNA, 17 nt, Homo sapiens
auucuaacauuugauaa

SEQ ID NO: 2136111 - RNA, 17 nt, Homo sapiens
cuguuuggcacuuguau

SEQ ID NO: 2136112 - RNA, 22 nt, Homo sapiens
caauaagccacgaggugcagua

SEQ ID NO: 2136113 - RNA, 16 nt, Homo sapiens
cauuuuuuagucugua

SEQ ID NO: 2136114 - RNA, 21 nt, Homo sapiens
aauuucaauuauagugucaug

SEQ ID NO: 2136115 - RNA, 17 nt, Homo sapiens
cauuugaaccagugauc

SEQ ID NO: 2136116 - RNA, 16 nt, Homo sapiens
gguaaaucacacugaa

SEQ ID NO: 2136117 - RNA, 21 nt, Homo sapiens
caacaaauuagguuuuguaca

SEQ ID NO: 2136118 - RNA, 15 nt, Homo sapiens
aggacuucuggcuau

SEQ ID NO: 2136119 - RNA, 23 nt, Homo sapiens
aagugaaaaugccacauuuugcu

SEQ ID NO: 2136120 - RNA, 14 nt, Homo sapiens
agaugcuguaguaa

SEQ ID NO: 2136121 - RNA, 22 nt, Homo sapiens
uugaccacgucaucgggccaga

SEQ ID NO: 2136122 - RNA, 17 nt, Homo sapiens
gccaugcgaggggccag

SEQ ID NO: 2136123 - RNA, 16 nt, Homo sapiens
aucaccaggugcaucu

SEQ ID NO: 2136124 - RNA, 14 nt, Homo sapiens
gucugucccaaaga

SEQ ID NO: 2136125 - RNA, 14 nt, Homo sapiens
cuaugccaagccau

SEQ ID NO: 2136126 - RNA, 15 nt, Homo sapiens
cccuuuccaaaggcc

SEQ ID NO: 2136127 - RNA, 19 nt, Homo sapiens
caccagccagaggaugcau

SEQ ID NO: 2136128 - RNA, 17 nt, Homo sapiens
cauaacuacaccugaca

SEQ ID NO: 2136129 - RNA, 23 nt, Homo sapiens
agucacuggagguugaagccaag

SEQ ID NO: 2136130 - RNA, 14 nt, Homo sapiens
cuagauuauaucaa

SEQ ID NO: 2136131 - RNA, 21 nt, Homo sapiens
gcccuggcggguggcugcaag

SEQ ID NO: 2136132 - RNA, 12 nt, Homo sapiens
ucacucuguugc

SEQ ID NO: 2136133 - RNA, 22 nt, Homo sapiens
aaauauuaccaggucaguacua

SEQ ID NO: 2136134 - RNA, 13 nt, Homo sapiens
uaaucaccuuucc

SEQ ID NO: 2136135 - RNA, 20 nt, Homo sapiens
ugcucccacacuugugccag

SEQ ID NO: 2136136 - RNA, 14 nt, Homo sapiens
acauguuacaggcu

SEQ ID NO: 2136137 - RNA, 17 nt, Homo sapiens
aaacuuauuuacaaaua

SEQ ID NO: 2136138 - RNA, 23 nt, Homo sapiens
gcuccuccucuuggagcugagau

SEQ ID NO: 2136139 - RNA, 19 nt, Homo sapiens
gccuaagaagaaggccaga

SEQ ID NO: 2136140 - RNA, 22 nt, Homo sapiens
acagaugugaaaauaaagcaga

SEQ ID NO: 2136141 - RNA, 18 nt, Homo sapiens
ccauuaggcaugccuaau

SEQ ID NO: 2136142 - RNA, 15 nt, Homo sapiens
aucuuauaguucuag

SEQ ID NO: 2136143 - RNA, 17 nt, Homo sapiens
agauccuccucauucac

SEQ ID NO: 2136144 - RNA, 16 nt, Homo sapiens
uucucacacuauggca

SEQ ID NO: 2136145 - RNA, 16 nt, Homo sapiens
cccugggcucaucagc

SEQ ID NO: 2136146 - RNA, 23 nt, Homo sapiens
ucagucuuuuccuguuuuuguua

SEQ ID NO: 2136147 - RNA, 14 nt, Homo sapiens
ggaccugcugugug

SEQ ID NO: 2136148 - RNA, 15 nt, Homo sapiens
ggaggaugcuaaaaa

SEQ ID NO: 2136149 - RNA, 20 nt, Homo sapiens
cauccugguuuccacugucu

SEQ ID NO: 2136150 - RNA, 13 nt, Homo sapiens
aaaucacuuguaa

SEQ ID NO: 2136151 - RNA, 14 nt, Homo sapiens
gacccacccagugu

SEQ ID NO: 2136152 - RNA, 14 nt, Homo sapiens
gacccucccaguga

SEQ ID NO: 2136153 - RNA, 15 nt, Homo sapiens
cuggcuccuacccac

SEQ ID NO: 2136154 - RNA, 18 nt, Homo sapiens
cuguguccuacuccuugc

SEQ ID NO: 2136155 - RNA, 21 nt, Homo sapiens
uuugccaugugcuucugccac

SEQ ID NO: 2136156 - RNA, 15 nt, Homo sapiens
uuauccuuccacgga

SEQ ID NO: 2136157 - RNA, 14 nt, Homo sapiens
cugcugcuggucac

SEQ ID NO: 2136158 - RNA, 17 nt, Homo sapiens
ucaaagagcuugaaaag

SEQ ID NO: 2136159 - RNA, 17 nt, Homo sapiens
cagagaggcucugagaa

SEQ ID NO: 2136160 - RNA, 21 nt, Homo sapiens
aaucaacaaaauggucaucca

SEQ ID NO: 2136161 - RNA, 13 nt, Homo sapiens
uccuaccacugga

SEQ ID NO: 2136162 - RNA, 16 nt, Homo sapiens
cuuguuagaaaugcaa

SEQ ID NO: 2136163 - RNA, 16 nt, Homo sapiens
gaaaacaacauuggau

SEQ ID NO: 2136164 - RNA, 14 nt, Homo sapiens
agugguuguugcca

SEQ ID NO: 2136165 - RNA, 16 nt, Homo sapiens
cucgaugaagcccaau

SEQ ID NO: 2136166 - RNA, 22 nt, Homo sapiens
acauuuacauguauuauuucau

SEQ ID NO: 2136167 - RNA, 12 nt, Homo sapiens
agauuguagcug

SEQ ID NO: 2136168 - RNA, 20 nt, Homo sapiens
auuagucaaaccacuguuau

SEQ ID NO: 2136169 - RNA, 17 nt, Homo sapiens
uaaccagaugguugugu

SEQ ID NO: 2136170 - RNA, 17 nt, Homo sapiens
guaaucuuggguuucua

SEQ ID NO: 2136171 - RNA, 22 nt, Homo sapiens
uuuaacuggcaugucauuugca

SEQ ID NO: 2136172 - RNA, 17 nt, Homo sapiens
aguccuagccacucagg

SEQ ID NO: 2136173 - RNA, 17 nt, Homo sapiens
aauauaagaacuugaua

SEQ ID NO: 2136174 - RNA, 16 nt, Homo sapiens
ugcucggggugcacag

SEQ ID NO: 2136175 - RNA, 15 nt, Homo sapiens
ugcucugaugcagug

SEQ ID NO: 2136176 - RNA, 15 nt, Homo sapiens
uucagaaauucucaa

SEQ ID NO: 2136177 - RNA, 15 nt, Homo sapiens
uucugaaauucacaa

SEQ ID NO: 2136178 - RNA, 13 nt, Homo sapiens
guuaaacagagaa

SEQ ID NO: 2136179 - RNA, 12 nt, Homo sapiens
gaaauaagcaug

SEQ ID NO: 2136180 - RNA, 23 nt, Homo sapiens
caguggaaaaaucagaagcacaa

SEQ ID NO: 2136181 - RNA, 20 nt, Homo sapiens
ucgcccuccucccugucaua

SEQ ID NO: 2136182 - RNA, 20 nt, Homo sapiens
uuaaaggaaaguucuauuau

SEQ ID NO: 2136183 - RNA, 19 nt, Homo sapiens
gcugacaguuggagggaaa

SEQ ID NO: 2136184 - RNA, 18 nt, Homo sapiens
cacucuucaaaugccuga

SEQ ID NO: 2136185 - RNA, 15 nt, Homo sapiens
ggagaaaaagcuuaa

SEQ ID NO: 2136186 - RNA, 12 nt, Homo sapiens
gacagcauuucc

SEQ ID NO: 2136187 - RNA, 12 nt, Homo sapiens
agucaguugcaa

SEQ ID NO: 2136188 - RNA, 19 nt, Homo sapiens
cauaggugcucuuccucau

SEQ ID NO: 2136189 - RNA, 23 nt, Homo sapiens
acugaaauuaaaacuauucaugc

SEQ ID NO: 2136190 - RNA, 20 nt, Homo sapiens
uguuaaacuuuuuaccaagu

SEQ ID NO: 2136191 - RNA, 18 nt, Homo sapiens
cuguccuugagaaguuga

SEQ ID NO: 2136192 - RNA, 14 nt, Homo sapiens
cuaagugccuccaa

SEQ ID NO: 2136193 - RNA, 24 nt, Homo sapiens
ucuuuaauauaauaaaaguuauua

SEQ ID NO: 2136194 - RNA, 24 nt, Homo sapiens
aagauggcacuguccagggcccau

SEQ ID NO: 2136195 - RNA, 22 nt, Homo sapiens
uucuuugucuugccccuaggaa

SEQ ID NO: 2136196 - RNA, 14 nt, Homo sapiens
agaaauaaagggac

SEQ ID NO: 2136197 - RNA, 22 nt, Homo sapiens
gaugcacuauauguuuacacaa

SEQ ID NO: 2136198 - RNA, 23 nt, Homo sapiens
uccauacguucagaggugcagcu

SEQ ID NO: 2136199 - RNA, 17 nt, Homo sapiens
aaacauuuauguuuaaa

SEQ ID NO: 2136200 - RNA, 17 nt, Homo sapiens
aaauauuuaugcuuaaa

SEQ ID NO: 2136201 - RNA, 19 nt, Homo sapiens
auaugcaaauggcuacuaa

SEQ ID NO: 2136202 - RNA, 12 nt, Homo sapiens
cugucaccaccc

SEQ ID NO: 2136203 - RNA, 22 nt, Homo sapiens
auauugaauagggcuaggaaua

SEQ ID NO: 2136204 - RNA, 13 nt, Homo sapiens
ugcccaggggcuu

SEQ ID NO: 2136205 - RNA, 19 nt, Homo sapiens
acugugguaaaugccacac

SEQ ID NO: 2136206 - RNA, 16 nt, Homo sapiens
acccaugaaacagcag

SEQ ID NO: 2136207 - RNA, 23 nt, Homo sapiens
uccugugaggcuuuuaauugcac

SEQ ID NO: 2136208 - RNA, 21 nt, Homo sapiens
cuugcuagacagccagguuag

SEQ ID NO: 2136209 - RNA, 23 nt, Homo sapiens
agaaaccaagugcgcuuugcaau

SEQ ID NO: 2136210 - RNA, 16 nt, Homo sapiens
auuugacacauaaaag

SEQ ID NO: 2136211 - RNA, 15 nt, Homo sapiens
ugguaaauuaguauu

SEQ ID NO: 2136212 - RNA, 22 nt, Homo sapiens
cugaggcaagagaauugcuuga

SEQ ID NO: 2136213 - RNA, 23 nt, Homo sapiens
uucucagugggacucugauccca

SEQ ID NO: 2136214 - RNA, 16 nt, Homo sapiens
cuucagagcugacaca

SEQ ID NO: 2136215 - RNA, 18 nt, Homo sapiens
uguccccguguugcauga

SEQ ID NO: 2136216 - RNA, 19 nt, Homo sapiens
caugaaacauuacaggaaa

SEQ ID NO: 2136217 - RNA, 15 nt, Homo sapiens
cagcacagcccaggg

SEQ ID NO: 2136218 - RNA, 18 nt, Homo sapiens
acaaaugacgucuucacc

SEQ ID NO: 2136219 - RNA, 20 nt, Homo sapiens
uuaggagagagaaaauaauu

SEQ ID NO: 2136220 - RNA, 16 nt, Homo sapiens
gcugucaguucccaau

SEQ ID NO: 2136221 - RNA, 16 nt, Homo sapiens
uguaauggacuaugca

SEQ ID NO: 2136222 - RNA, 20 nt, Homo sapiens
ccagagccagaaagggugcc

SEQ ID NO: 2136223 - RNA, 13 nt, Homo sapiens
gcacaacucccuu

SEQ ID NO: 2136224 - RNA, 15 nt, Homo sapiens
acacuggauggucau

SEQ ID NO: 2136225 - RNA, 14 nt, Homo sapiens
uucccaaucccauu

SEQ ID NO: 2136226 - RNA, 12 nt, Homo sapiens
ugauacugcuga

SEQ ID NO: 2136227 - RNA, 22 nt, Homo sapiens
uccaagugaaugaguuuccagc

SEQ ID NO: 2136228 - RNA, 14 nt, Homo sapiens
ucacaacagucacc

SEQ ID NO: 2136229 - RNA, 13 nt, Homo sapiens
uagucacaaagac

SEQ ID NO: 2136230 - RNA, 19 nt, Homo sapiens
agcaucgggagcacccaga

SEQ ID NO: 2136231 - RNA, 17 nt, Homo sapiens
uuggcucacacugagaa

SEQ ID NO: 2136232 - RNA, 22 nt, Homo sapiens
ucaccuaaacccucugugaaau

SEQ ID NO: 2136233 - RNA, 22 nt, Homo sapiens
gucaccacgugcaguaucucaa

SEQ ID NO: 2136234 - RNA, 17 nt, Homo sapiens
aaguaagagagcacagu

SEQ ID NO: 2136235 - RNA, 16 nt, Homo sapiens
uauugagcaccugcag

SEQ ID NO: 2136236 - RNA, 20 nt, Homo sapiens
acacgaugcauuuaauaaag

SEQ ID NO: 2136237 - RNA, 20 nt, Homo sapiens
aauuuucuaacaacuuuaag

SEQ ID NO: 2136238 - RNA, 23 nt, Homo sapiens
ugccauaccauucccauggaguu

SEQ ID NO: 2136239 - RNA, 17 nt, Homo sapiens
gaagcaucucugaccag

SEQ ID NO: 2136240 - RNA, 20 nt, Homo sapiens
aaucaacaaacguuucuuga

SEQ ID NO: 2136241 - RNA, 18 nt, Homo sapiens
ggaugaacucaaugcaug

SEQ ID NO: 2136242 - RNA, 19 nt, Homo sapiens
acacgugauggaccaaagc

SEQ ID NO: 2136243 - RNA, 23 nt, Homo sapiens
gaaguguguguuucuugcuuuga

SEQ ID NO: 2136244 - RNA, 16 nt, Homo sapiens
aauguaauaaagugaa

SEQ ID NO: 2136245 - RNA, 11 nt, Homo sapiens
aaguccacucu

SEQ ID NO: 2136246 - RNA, 18 nt, Homo sapiens
augcuuuaagugcacaac

SEQ ID NO: 2136247 - RNA, 17 nt, Homo sapiens
ggcucugacucugccag

SEQ ID NO: 2136248 - RNA, 21 nt, Homo sapiens
gucugucaugaacauguuccu

SEQ ID NO: 2136249 - RNA, 22 nt, Homo sapiens
guugcaaacccaaaggacccaa

SEQ ID NO: 2136250 - RNA, 19 nt, Homo sapiens
uggcggugaaaauuucaac

SEQ ID NO: 2136251 - RNA, 21 nt, Homo sapiens
auucaucucagcaaucacaag

SEQ ID NO: 2136252 - RNA, 13 nt, Homo sapiens
ccuaauacaacau

SEQ ID NO: 2136253 - RNA, 16 nt, Homo sapiens
gcuguggacacugaga

SEQ ID NO: 2136254 - RNA, 17 nt, Homo sapiens
uagaggcuagcuucugc

SEQ ID NO: 2136255 - RNA, 16 nt, Homo sapiens
uucuggauaucucagg

SEQ ID NO: 2136256 - RNA, 17 nt, Homo sapiens
cugauuuccuaauguca

SEQ ID NO: 2136257 - RNA, 15 nt, Homo sapiens
gcugccucuguggaa

SEQ ID NO: 2136258 - RNA, 17 nt, Homo sapiens
gauccacuaugccuuaa

SEQ ID NO: 2136259 - RNA, 20 nt, Homo sapiens
ucagcaccccugucucuagc

SEQ ID NO: 2136260 - RNA, 18 nt, Homo sapiens
agacucuguaauugaaua

SEQ ID NO: 2136261 - RNA, 14 nt, Homo sapiens
cucccuuccugucc

SEQ ID NO: 2136262 - RNA, 12 nt, Homo sapiens
uaaucacucuaa

SEQ ID NO: 2136263 - RNA, 16 nt, Homo sapiens
cuucguuagaccgcuc

SEQ ID NO: 2136264 - RNA, 17 nt, Homo sapiens
uggcucacuauggugcc

SEQ ID NO: 2136265 - RNA, 17 nt, Homo sapiens
ggcagcagccagggacc

SEQ ID NO: 2136266 - RNA, 20 nt, Homo sapiens
cuggggucauauaaaauaua

SEQ ID NO: 2136267 - RNA, 16 nt, Homo sapiens
agugcaccugccucca

SEQ ID NO: 2136268 - RNA, 14 nt, Homo sapiens
cuucugagcugucu

SEQ ID NO: 2136269 - RNA, 16 nt, Homo sapiens
gucucuaucuccugaa

SEQ ID NO: 2136270 - RNA, 18 nt, Homo sapiens
ucacuugccaugcaggaa

SEQ ID NO: 2136271 - RNA, 19 nt, Homo sapiens
uuguauuccuccugagaua

SEQ ID NO: 2136272 - RNA, 21 nt, Homo sapiens
cauuuaacucuuugaaacugu

SEQ ID NO: 2136273 - RNA, 16 nt, Homo sapiens
cauuucauuaaccaaa

SEQ ID NO: 2136274 - RNA, 15 nt, Homo sapiens
ggucggggaccaaag

SEQ ID NO: 2136275 - RNA, 18 nt, Homo sapiens
gaaaauaucuugcuuuca

SEQ ID NO: 2136276 - RNA, 15 nt, Homo sapiens
uaaaugaacuaauga

SEQ ID NO: 2136277 - RNA, 15 nt, Homo sapiens
cauugcaauuuugca

SEQ ID NO: 2136278 - RNA, 15 nt, Homo sapiens
uuuccaaacauccaa

SEQ ID NO: 2136279 - RNA, 17 nt, Homo sapiens
acuuggaagaucuaccu

SEQ ID NO: 2136280 - RNA, 15 nt, Homo sapiens
agaucgcaccacugc

SEQ ID NO: 2136281 - RNA, 13 nt, Homo sapiens
gaagcuuccauga

SEQ ID NO: 2136282 - RNA, 15 nt, Homo sapiens
aguacuggagugaaa

SEQ ID NO: 2136283 - RNA, 22 nt, Homo sapiens
aaaccucccccaagcagagcuu

SEQ ID NO: 2136284 - RNA, 23 nt, Homo sapiens
aacaccaaagaauuguaggcagu

SEQ ID NO: 2136285 - RNA, 12 nt, Homo sapiens
gucaacaucaaa

SEQ ID NO: 2136286 - RNA, 21 nt, Homo sapiens
cauauuuguauuccuuuucau

SEQ ID NO: 2136287 - RNA, 17 nt, Homo sapiens
cagacccccuccacggu

SEQ ID NO: 2136288 - RNA, 21 nt, Homo sapiens
cccaccagcaccgugacaguu

SEQ ID NO: 2136289 - RNA, 15 nt, Homo sapiens
aggcuuuaugauaau

SEQ ID NO: 2136290 - RNA, 15 nt, Homo sapiens
gagaaggaaagugau

SEQ ID NO: 2136291 - RNA, 21 nt, Homo sapiens
uauuucaacuaauauaucuau

SEQ ID NO: 2136292 - RNA, 12 nt, Homo sapiens
aguaucuuccau

SEQ ID NO: 2136293 - RNA, 19 nt, Homo sapiens
uggugagaucacaguucau

SEQ ID NO: 2136294 - RNA, 12 nt, Homo sapiens
aaaaaagccaaa

SEQ ID NO: 2136295 - RNA, 12 nt, Homo sapiens
ccacaagcacac

SEQ ID NO: 2136296 - RNA, 11 nt, Homo sapiens
agccacuggaa

SEQ ID NO: 2136297 - RNA, 20 nt, Homo sapiens
uccucagucuuugggggauu

SEQ ID NO: 2136298 - RNA, 18 nt, Homo sapiens
uugagguugugggccuuc

SEQ ID NO: 2136299 - RNA, 16 nt, Homo sapiens
uugugauaugcacaau

SEQ ID NO: 2136300 - RNA, 17 nt, Homo sapiens
cgcugccacucaugucg

SEQ ID NO: 2136301 - RNA, 16 nt, Homo sapiens
accaucggcaggcagu

SEQ ID NO: 2136302 - RNA, 23 nt, Homo sapiens
cccacuccaagcccagcccaugg

SEQ ID NO: 2136303 - RNA, 18 nt, Homo sapiens
ccagaggcucuaauguac

SEQ ID NO: 2136304 - RNA, 19 nt, Homo sapiens
ugaagaugggcuucaucca

SEQ ID NO: 2136305 - RNA, 20 nt, Homo sapiens
agaagcugcucaacuugcaa

SEQ ID NO: 2136306 - RNA, 12 nt, Homo sapiens
agcuucucuaca

SEQ ID NO: 2136307 - RNA, 19 nt, Homo sapiens
cuaaugagucgacuuugag

SEQ ID NO: 2136308 - RNA, 22 nt, Homo sapiens
uuaucaauaagugccauuaaau

SEQ ID NO: 2136309 - RNA, 16 nt, Homo sapiens
ccacacagaagcugaa

SEQ ID NO: 2136310 - RNA, 16 nt, Homo sapiens
uucaaggcccucagag

SEQ ID NO: 2136311 - RNA, 22 nt, Homo sapiens
ucacccaccucuggguccuugg

SEQ ID NO: 2136312 - RNA, 15 nt, Homo sapiens
agguuucaucauguu

SEQ ID NO: 2136313 - RNA, 15 nt, Homo sapiens
uuaaugacaacacuu

SEQ ID NO: 2136314 - RNA, 13 nt, Homo sapiens
cacugaauaucau

SEQ ID NO: 2136315 - RNA, 15 nt, Homo sapiens
cuuguuuacagugag

SEQ ID NO: 2136316 - RNA, 13 nt, Homo sapiens
aauuuaaccauaa

SEQ ID NO: 2136317 - RNA, 13 nt, Homo sapiens
aaauaaaccaaau

SEQ ID NO: 2136318 - RNA, 17 nt, Homo sapiens
gugguccagaaacaaaa

SEQ ID NO: 2136319 - RNA, 21 nt, Homo sapiens
accgccgguucauuuugcacc

SEQ ID NO: 2136320 - RNA, 12 nt, Homo sapiens
uuguuucuuaag

SEQ ID NO: 2136321 - RNA, 19 nt, Homo sapiens
ccagaugucgcccuacuca

SEQ ID NO: 2136322 - RNA, 16 nt, Homo sapiens
cagugcugcuguaaau

SEQ ID NO: 2136323 - RNA, 17 nt, Homo sapiens
uggaaauuuagcauugu

SEQ ID NO: 2136324 - RNA, 15 nt, Homo sapiens
ucauuagaauugaau

SEQ ID NO: 2136325 - RNA, 17 nt, Homo sapiens
uuguucuuaauugcacu

SEQ ID NO: 2136326 - RNA, 16 nt, Homo sapiens
cuaguagucauuucau

SEQ ID NO: 2136327 - RNA, 17 nt, Homo sapiens
aacacaauuuucacuuu

SEQ ID NO: 2136328 - RNA, 15 nt, Homo sapiens
gcgaugacacuugua

SEQ ID NO: 2136329 - RNA, 16 nt, Homo sapiens
cagggucugugugaau

SEQ ID NO: 2136330 - RNA, 18 nt, Homo sapiens
gaaaucucuaccugggug

SEQ ID NO: 2136331 - RNA, 20 nt, Homo sapiens
agcccgacagugccaucccc

SEQ ID NO: 2136332 - RNA, 18 nt, Homo sapiens
aaucaaggaaagccaggc

SEQ ID NO: 2136333 - RNA, 21 nt, Homo sapiens
uuuaauguacuugucaccuga

SEQ ID NO: 2136334 - RNA, 15 nt, Homo sapiens
ugguuuaaagccuuu

SEQ ID NO: 2136335 - RNA, 12 nt, Homo sapiens
aaguguaacaau

SEQ ID NO: 2136336 - RNA, 19 nt, Homo sapiens
caaagggauguucacugua

SEQ ID NO: 2136337 - RNA, 15 nt, Homo sapiens
uucuucaugauggug

SEQ ID NO: 2136338 - RNA, 23 nt, Homo sapiens
uguucccuauuuugccaguggga

SEQ ID NO: 2136339 - RNA, 23 nt, Homo sapiens
ugucuacgugcgcucugccauuc

SEQ ID NO: 2136340 - RNA, 20 nt, Homo sapiens
acauuagucguuauauuuga

SEQ ID NO: 2136341 - RNA, 13 nt, Homo sapiens
cccaagcgucauc

SEQ ID NO: 2136342 - RNA, 14 nt, Homo sapiens
gguacuuaaagcuu

SEQ ID NO: 2136343 - RNA, 17 nt, Homo sapiens
uugggagacaugugaca

SEQ ID NO: 2136344 - RNA, 15 nt, Homo sapiens
caauaaacccucaga

SEQ ID NO: 2136345 - RNA, 19 nt, Homo sapiens
acccucacaagcaugaagu

SEQ ID NO: 2136346 - RNA, 20 nt, Homo sapiens
ugacauauucaagugauagg

SEQ ID NO: 2136347 - RNA, 17 nt, Homo sapiens
agugguaaauacuguga

SEQ ID NO: 2136348 - RNA, 13 nt, Homo sapiens
ucuaucuugucaa

SEQ ID NO: 2136349 - RNA, 11 nt, Homo sapiens
gcucccggggc

SEQ ID NO: 2136350 - RNA, 13 nt, Homo sapiens
cuuguugcucaaa

SEQ ID NO: 2136351 - RNA, 15 nt, Homo sapiens
agaguaugugagaac

SEQ ID NO: 2136352 - RNA, 23 nt, Homo sapiens
auuagccaggugugguggugcac

SEQ ID NO: 2136353 - RNA, 14 nt, Homo sapiens
cacgagcaaaccca

SEQ ID NO: 2136354 - RNA, 22 nt, Homo sapiens
caucacuagaagaaaagcccau

SEQ ID NO: 2136355 - RNA, 20 nt, Homo sapiens
gcauaagagcuuaagaacca

SEQ ID NO: 2136356 - RNA, 23 nt, Homo sapiens
ccaggguccacugaagggacccu

SEQ ID NO: 2136357 - RNA, 21 nt, Homo sapiens
cccaggaguauccucuugcca

SEQ ID NO: 2136358 - RNA, 21 nt, Homo sapiens
ugucacuauaggucauacaau

SEQ ID NO: 2136359 - RNA, 21 nt, Homo sapiens
caggugugugggccaccgugc

SEQ ID NO: 2136360 - RNA, 22 nt, Homo sapiens
caccacaauuagagcuugaugc

SEQ ID NO: 2136361 - RNA, 14 nt, Homo sapiens
cacacaaaaacaga

SEQ ID NO: 2136362 - RNA, 17 nt, Homo sapiens
cugucauguaacacgac

SEQ ID NO: 2136363 - RNA, 21 nt, Homo sapiens
ccaggcugggaggcucggggc

SEQ ID NO: 2136364 - RNA, 22 nt, Homo sapiens
gaacccucaacugacaugaaau

SEQ ID NO: 2136365 - RNA, 22 nt, Homo sapiens
gagauguuuuagaguuaacaau

SEQ ID NO: 2136366 - RNA, 21 nt, Homo sapiens
caucaauucuuagaauaucua

SEQ ID NO: 2136367 - RNA, 14 nt, Homo sapiens
gaacucucuccacc

SEQ ID NO: 2136368 - RNA, 14 nt, Homo sapiens
guccugaagcugcu

SEQ ID NO: 2136369 - RNA, 20 nt, Homo sapiens
gcagcucccuuucucaggag

SEQ ID NO: 2136370 - RNA, 18 nt, Homo sapiens
uuagguugaaacauaucu

SEQ ID NO: 2136371 - RNA, 19 nt, Homo sapiens
cuggggguccucucugagu

SEQ ID NO: 2136372 - RNA, 14 nt, Homo sapiens
aaguaggaaaugaa

SEQ ID NO: 2136373 - RNA, 23 nt, Homo sapiens
ucuguuuugggaaacacuuugag

SEQ ID NO: 2136374 - RNA, 16 nt, Homo sapiens
ucauguagaacaagaa

SEQ ID NO: 2136375 - RNA, 18 nt, Homo sapiens
augggcucaagucacuuu

SEQ ID NO: 2136376 - RNA, 13 nt, Homo sapiens
caauaucauguga

SEQ ID NO: 2136377 - RNA, 19 nt, Homo sapiens
gugacucagaugucucugg

SEQ ID NO: 2136378 - RNA, 13 nt, Homo sapiens
acucugacuuuga

SEQ ID NO: 2136379 - RNA, 17 nt, Homo sapiens
agggauuacccaagcaa

SEQ ID NO: 2136380 - RNA, 13 nt, Homo sapiens
uaauauccaccuc

SEQ ID NO: 2136381 - RNA, 17 nt, Homo sapiens
cagggguccacugugag

SEQ ID NO: 2136382 - RNA, 16 nt, Homo sapiens
uggcaguuugaaguca

SEQ ID NO: 2136383 - RNA, 15 nt, Homo sapiens
guaaauguccauuua

SEQ ID NO: 2136384 - RNA, 15 nt, Homo sapiens
auuaacaaacaggau

SEQ ID NO: 2136385 - RNA, 23 nt, Homo sapiens
auuuuuggggaaaaaagcacaua

SEQ ID NO: 2136386 - RNA, 15 nt, Homo sapiens
uccccaccccuucca

SEQ ID NO: 2136387 - RNA, 21 nt, Homo sapiens
aaagaggcugaggcuggcaca

SEQ ID NO: 2136388 - RNA, 17 nt, Homo sapiens
cucaggcuuccuuggca

SEQ ID NO: 2136389 - RNA, 19 nt, Homo sapiens
aguaaaaauaaacuguuau

SEQ ID NO: 2136390 - RNA, 22 nt, Homo sapiens
auuacuuauuuauccuaguauu

SEQ ID NO: 2136391 - RNA, 11 nt, Homo sapiens
acuguugauaa

SEQ ID NO: 2136392 - RNA, 17 nt, Homo sapiens
uacaacuuguauuucca

SEQ ID NO: 2136393 - RNA, 15 nt, Homo sapiens
aacuccagguuccug

SEQ ID NO: 2136394 - RNA, 17 nt, Homo sapiens
gacccugauacaggcau

SEQ ID NO: 2136395 - RNA, 23 nt, Homo sapiens
aaaugcuguugguaaagcacaug

SEQ ID NO: 2136396 - RNA, 14 nt, Homo sapiens
guaaacauucucuc

SEQ ID NO: 2136397 - RNA, 15 nt, Homo sapiens
aaggauacaggcugg

SEQ ID NO: 2136398 - RNA, 15 nt, Homo sapiens
uacaauacaauguac

SEQ ID NO: 2136399 - RNA, 16 nt, Homo sapiens
uauuucuguaccaaag

SEQ ID NO: 2136400 - RNA, 14 nt, Homo sapiens
uaaugacuuacuua

SEQ ID NO: 2136401 - RNA, 14 nt, Homo sapiens
cuaaugcucucagg

SEQ ID NO: 2136402 - RNA, 20 nt, Homo sapiens
aacuuuguuaggccaaagac

SEQ ID NO: 2136403 - RNA, 14 nt, Homo sapiens
ucugucccaaagaa

SEQ ID NO: 2136404 - RNA, 21 nt, Homo sapiens
ucauuguuaaauacacauuau

SEQ ID NO: 2136405 - RNA, 14 nt, Homo sapiens
gaaaauaugauaua

SEQ ID NO: 2136406 - RNA, 14 nt, Homo sapiens
cuuaaaaucuaauu

SEQ ID NO: 2136407 - RNA, 17 nt, Homo sapiens
agcuacuuaugguugga

SEQ ID NO: 2136408 - RNA, 21 nt, Homo sapiens
uucagaguuaucaagagacac

SEQ ID NO: 2136409 - RNA, 19 nt, Homo sapiens
uugcccccgacggcuguga

SEQ ID NO: 2136410 - RNA, 22 nt, Homo sapiens
cugaggcaugaaaauuguguua

SEQ ID NO: 2136411 - RNA, 17 nt, Homo sapiens
aauaagcacagaaaauc

SEQ ID NO: 2136412 - RNA, 19 nt, Homo sapiens
ccuuucgauauaaaacucu

SEQ ID NO: 2136413 - RNA, 19 nt, Homo sapiens
aggagauuggccagugaga

SEQ ID NO: 2136414 - RNA, 15 nt, Homo sapiens
aggggguaaggcccc

SEQ ID NO: 2136415 - RNA, 13 nt, Homo sapiens
ugcuagagccucu

SEQ ID NO: 2136416 - RNA, 15 nt, Homo sapiens
gacugagcagacugg

SEQ ID NO: 2136417 - RNA, 21 nt, Homo sapiens
ucauggaagaaaaggauuuug

SEQ ID NO: 2136418 - RNA, 19 nt, Homo sapiens
aaugucuccacuucacucc

SEQ ID NO: 2136419 - RNA, 18 nt, Homo sapiens
ccuuagcuuagaccucag

SEQ ID NO: 2136420 - RNA, 24 nt, Homo sapiens
cacaguguuuccugaguagcagug

SEQ ID NO: 2136421 - RNA, 21 nt, Homo sapiens
agcacagcagguuuauccaga

SEQ ID NO: 2136422 - RNA, 21 nt, Homo sapiens
ugcauuuacgccuguaaaugu

SEQ ID NO: 2136423 - RNA, 16 nt, Homo sapiens
agcuauuuauguucau

SEQ ID NO: 2136424 - RNA, 21 nt, Homo sapiens
ggaugccaaccggucacccag

SEQ ID NO: 2136425 - RNA, 16 nt, Homo sapiens
ccaaggggcagucuug

SEQ ID NO: 2136426 - RNA, 17 nt, Homo sapiens
gccacugagcggcuaaa

SEQ ID NO: 2136427 - RNA, 17 nt, Homo sapiens
cacugggcccugagcca

SEQ ID NO: 2136428 - RNA, 16 nt, Homo sapiens
uauguuaauaucugau

SEQ ID NO: 2136429 - RNA, 20 nt, Homo sapiens
aagguagcccagcacuguga

SEQ ID NO: 2136430 - RNA, 21 nt, Homo sapiens
ucucugaacacaggcagcuuu

SEQ ID NO: 2136431 - RNA, 17 nt, Homo sapiens
uuauaagucuuacauaa

SEQ ID NO: 2136432 - RNA, 19 nt, Homo sapiens
ucaugugcugccugcaagc

SEQ ID NO: 2136433 - RNA, 17 nt, Homo sapiens
aaacauuuuuguggcuu

SEQ ID NO: 2136434 - RNA, 16 nt, Homo sapiens
ccaccugacucuugca

SEQ ID NO: 2136435 - RNA, 16 nt, Homo sapiens
guaaaauuuugucaua

SEQ ID NO: 2136436 - RNA, 13 nt, Homo sapiens
augcuccuuccaa

SEQ ID NO: 2136437 - RNA, 17 nt, Homo sapiens
cuaaaaggaaaucucac

SEQ ID NO: 2136438 - RNA, 19 nt, Homo sapiens
ucauggauucauuacagcu

SEQ ID NO: 2136439 - RNA, 20 nt, Homo sapiens
agggcauacauccacagauu

SEQ ID NO: 2136440 - RNA, 12 nt, Homo sapiens
ccacauaccucu

SEQ ID NO: 2136441 - RNA, 22 nt, Homo sapiens
uguuguaaaaagaaaaaccacu

SEQ ID NO: 2136442 - RNA, 21 nt, Homo sapiens
agcuucuguccucuucuguga

SEQ ID NO: 2136443 - RNA, 13 nt, Homo sapiens
uuccucauguaac

SEQ ID NO: 2136444 - RNA, 12 nt, Homo sapiens
ucucugccagug

SEQ ID NO: 2136445 - RNA, 18 nt, Homo sapiens
agucucugugcuuugacu

SEQ ID NO: 2136446 - RNA, 21 nt, Homo sapiens
gccuccucaguagcuaggacu

SEQ ID NO: 2136447 - RNA, 19 nt, Homo sapiens
cuucauuuuguauaaucac

SEQ ID NO: 2136448 - RNA, 20 nt, Homo sapiens
uugaaacauguucaucugga

SEQ ID NO: 2136449 - RNA, 13 nt, Homo sapiens
ggagagagccuug

SEQ ID NO: 2136450 - RNA, 14 nt, Homo sapiens
cccacugcucauuu

SEQ ID NO: 2136451 - RNA, 19 nt, Homo sapiens
agugacauaauauauucua

SEQ ID NO: 2136452 - RNA, 20 nt, Homo sapiens
auucuuguaguuuaccucuu

SEQ ID NO: 2136453 - RNA, 21 nt, Homo sapiens
acacacaguccaacucuucca

SEQ ID NO: 2136454 - RNA, 19 nt, Homo sapiens
cgugauucggccucuccac

SEQ ID NO: 2136455 - RNA, 17 nt, Homo sapiens
agaacuuuauuuuggau

SEQ ID NO: 2136456 - RNA, 12 nt, Homo sapiens
agaguuugcaaa

SEQ ID NO: 2136457 - RNA, 20 nt, Homo sapiens
aaggcagcugccucugcucc

SEQ ID NO: 2136458 - RNA, 19 nt, Homo sapiens
cacacucuccaaacaguca

SEQ ID NO: 2136459 - RNA, 18 nt, Homo sapiens
aacuuguggccucaagca

SEQ ID NO: 2136460 - RNA, 14 nt, Homo sapiens
aauuggaaucuuca

SEQ ID NO: 2136461 - RNA, 16 nt, Homo sapiens
ucagacaaauuacuga

SEQ ID NO: 2136462 - RNA, 22 nt, Homo sapiens
uguagacuguggcuagugacaa

SEQ ID NO: 2136463 - RNA, 15 nt, Homo sapiens
acgguguccaugccu

SEQ ID NO: 2136464 - RNA, 13 nt, Homo sapiens
acuaguagucaua

SEQ ID NO: 2136465 - RNA, 20 nt, Homo sapiens
auaaagaucauuuauaauac

SEQ ID NO: 2136466 - RNA, 21 nt, Homo sapiens
gcaaucccagcuacuuggaag

SEQ ID NO: 2136467 - RNA, 16 nt, Homo sapiens
ugccuugccacauuaa

SEQ ID NO: 2136468 - RNA, 20 nt, Homo sapiens
uaaaauaguuuugcuuuguu

SEQ ID NO: 2136469 - RNA, 21 nt, Homo sapiens
caagugugggccacuguggug

SEQ ID NO: 2136470 - RNA, 15 nt, Homo sapiens
ugugaacacaucagc

SEQ ID NO: 2136471 - RNA, 16 nt, Homo sapiens
uccacaguaaucuuuc

SEQ ID NO: 2136472 - RNA, 12 nt, Homo sapiens
cagauacuuggg

SEQ ID NO: 2136473 - RNA, 20 nt, Homo sapiens
caguguuuauccuuucauau

SEQ ID NO: 2136474 - RNA, 22 nt, Homo sapiens
gaggcaggagaaucgcuugaac

SEQ ID NO: 2136475 - RNA, 18 nt, Homo sapiens
auuuuuuguaugcuuaaa

SEQ ID NO: 2136476 - RNA, 20 nt, Homo sapiens
cugaacauuggagaaucuca

SEQ ID NO: 2136477 - RNA, 21 nt, Homo sapiens
auaagaaaauauauucuuuca

SEQ ID NO: 2136478 - RNA, 15 nt, Homo sapiens
cuaaauggcaugaca

SEQ ID NO: 2136479 - RNA, 16 nt, Homo sapiens
cuauacccagcagagg

SEQ ID NO: 2136480 - RNA, 15 nt, Homo sapiens
agugaccauagcucc

SEQ ID NO: 2136481 - RNA, 17 nt, Homo sapiens
guccuacuaucacugaa

SEQ ID NO: 2136482 - RNA, 16 nt, Homo sapiens
ucaccuguaaaccuga

SEQ ID NO: 2136483 - RNA, 16 nt, Homo sapiens
acacuguauaacuguu

SEQ ID NO: 2136484 - RNA, 16 nt, Homo sapiens
accuucaauacuucau

SEQ ID NO: 2136485 - RNA, 20 nt, Homo sapiens
ccggggcaggugcagcccuu

SEQ ID NO: 2136486 - RNA, 17 nt, Homo sapiens
caagcagcugggauuac

SEQ ID NO: 2136487 - RNA, 22 nt, Homo sapiens
uucuuucccuagaggcaaacau

SEQ ID NO: 2136488 - RNA, 14 nt, Homo sapiens
cuuuggucuccauu

SEQ ID NO: 2136489 - RNA, 23 nt, Homo sapiens
cuguaauggggacacuacaaaaa

SEQ ID NO: 2136490 - RNA, 17 nt, Homo sapiens
cuuuuauucauuagcug

SEQ ID NO: 2136491 - RNA, 21 nt, Homo sapiens
ccaccuuggccucccaaagug

SEQ ID NO: 2136492 - RNA, 16 nt, Homo sapiens
cugcacauggccugag

SEQ ID NO: 2136493 - RNA, 23 nt, Homo sapiens
ucuugaauauguauuaaaauauc

SEQ ID NO: 2136494 - RNA, 16 nt, Homo sapiens
uccucauucaaaggga

SEQ ID NO: 2136495 - RNA, 21 nt, Homo sapiens
aacaggcacccacaaccagag

SEQ ID NO: 2136496 - RNA, 16 nt, Homo sapiens
auucucuucacuccca

SEQ ID NO: 2136497 - RNA, 18 nt, Homo sapiens
cagaucuuggacucauga

SEQ ID NO: 2136498 - RNA, 18 nt, Homo sapiens
caaaaauucacaaauggg

SEQ ID NO: 2136499 - RNA, 14 nt, Homo sapiens
uuagaaaaugcagu

SEQ ID NO: 2136500 - RNA, 20 nt, Homo sapiens
gaaaauuuccuccacauuca

SEQ ID NO: 2136501 - RNA, 19 nt, Homo sapiens
gccuguugggaaaaguuua

SEQ ID NO: 2136502 - RNA, 17 nt, Homo sapiens
ccagcaccuguggcuga

SEQ ID NO: 2136503 - RNA, 16 nt, Homo sapiens
uuggcaguggacucag

SEQ ID NO: 2136504 - RNA, 18 nt, Homo sapiens
ugaauaagcuuucucuca

SEQ ID NO: 2136505 - RNA, 15 nt, Homo sapiens
cggcagcauggagcu

SEQ ID NO: 2136506 - RNA, 23 nt, Homo sapiens
ccuccagcacucccucccagaga

SEQ ID NO: 2136507 - RNA, 19 nt, Homo sapiens
uaugaaccgcaauauggga

SEQ ID NO: 2136508 - RNA, 18 nt, Homo sapiens
auccaaagaacaucugca

SEQ ID NO: 2136509 - RNA, 15 nt, Homo sapiens
aggcagcucugagcc

SEQ ID NO: 2136510 - RNA, 21 nt, Homo sapiens
cucagccagaaagaugcccua

SEQ ID NO: 2136511 - RNA, 16 nt, Homo sapiens
ggaaacauuuaacuca

SEQ ID NO: 2136512 - RNA, 11 nt, Homo sapiens
gcacagaauuu

SEQ ID NO: 2136513 - RNA, 17 nt, Homo sapiens
ccaccuucacaccacuu

SEQ ID NO: 2136514 - RNA, 19 nt, Homo sapiens
ugcaacuucuaaacacaaa

SEQ ID NO: 2136515 - RNA, 13 nt, Homo sapiens
aaacaaaucuuca

SEQ ID NO: 2136516 - RNA, 16 nt, Homo sapiens
aggagcuggaaccaug

SEQ ID NO: 2136517 - RNA, 23 nt, Homo sapiens
aauaaccuuauucuauacuuucu

SEQ ID NO: 2136518 - RNA, 15 nt, Homo sapiens
uccacaaauguccuc

SEQ ID NO: 2136519 - RNA, 21 nt, Homo sapiens
uucaaaugucauuucauacaa

SEQ ID NO: 2136520 - RNA, 22 nt, Homo sapiens
gaaauguugacuggccaaaaau

SEQ ID NO: 2136521 - RNA, 19 nt, Homo sapiens
cuucagugacaaacauauc

SEQ ID NO: 2136522 - RNA, 11 nt, Homo sapiens
ccaacaucuuu

SEQ ID NO: 2136523 - RNA, 14 nt, Homo sapiens
aaaacuucaauauc

SEQ ID NO: 2136524 - RNA, 22 nt, Homo sapiens
agagcucugagucuuagugguu

SEQ ID NO: 2136525 - RNA, 20 nt, Homo sapiens
uaccgcaucucccugcaguu

SEQ ID NO: 2136526 - RNA, 15 nt, Homo sapiens
agggggagaaugggu

SEQ ID NO: 2136527 - RNA, 13 nt, Homo sapiens
uuauucagaauuu

SEQ ID NO: 2136528 - RNA, 18 nt, Homo sapiens
auuuauuuuuucaucuca

SEQ ID NO: 2136529 - RNA, 21 nt, Homo sapiens
agugucaugucagcaucagcu

SEQ ID NO: 2136530 - RNA, 18 nt, Homo sapiens
aaccuugaccgacaugaa

SEQ ID NO: 2136531 - RNA, 22 nt, Homo sapiens
ugaaauaacccuuucuguggua

SEQ ID NO: 2136532 - RNA, 19 nt, Homo sapiens
gacagagcagaacuuucac

SEQ ID NO: 2136533 - RNA, 13 nt, Homo sapiens
ucccaucaauucu

SEQ ID NO: 2136534 - RNA, 17 nt, Homo sapiens
cauauguguuacuucaa

SEQ ID NO: 2136535 - RNA, 15 nt, Homo sapiens
augcauucacauauc

SEQ ID NO: 2136536 - RNA, 13 nt, Homo sapiens
gccccuuguccug

SEQ ID NO: 2136537 - RNA, 17 nt, Homo sapiens
cacaugcaaggucauuu

SEQ ID NO: 2136538 - RNA, 14 nt, Homo sapiens
ucaagugucuucca

SEQ ID NO: 2136539 - RNA, 12 nt, Homo sapiens
auaaugcagaua

SEQ ID NO: 2136540 - RNA, 13 nt, Homo sapiens
gagaaaaggcaaa

SEQ ID NO: 2136541 - RNA, 16 nt, Homo sapiens
ucucucuucucuccag

SEQ ID NO: 2136542 - RNA, 18 nt, Homo sapiens
gauuagugucucaugugg

SEQ ID NO: 2136543 - RNA, 18 nt, Homo sapiens
cuaucugacuucauacau

SEQ ID NO: 2136544 - RNA, 17 nt, Homo sapiens
uuggaaaaugugcaaua

SEQ ID NO: 2136545 - RNA, 12 nt, Homo sapiens
accaucugccaa

SEQ ID NO: 2136546 - RNA, 14 nt, Homo sapiens
cucuggauucccuu

SEQ ID NO: 2136547 - RNA, 16 nt, Homo sapiens
agcugugcccugacca

SEQ ID NO: 2136548 - RNA, 19 nt, Homo sapiens
uccauaccucgaacaucag

SEQ ID NO: 2136549 - RNA, 20 nt, Homo sapiens
aagauuuucauugaggauaa

SEQ ID NO: 2136550 - RNA, 18 nt, Homo sapiens
ugacgcacagcacuccug

SEQ ID NO: 2136551 - RNA, 22 nt, Homo sapiens
agcagagcggguaaagugcaau

SEQ ID NO: 2136552 - RNA, 14 nt, Homo sapiens
agacuauuugccau

SEQ ID NO: 2136553 - RNA, 15 nt, Homo sapiens
uuacuuuucugccaa

SEQ ID NO: 2136554 - RNA, 14 nt, Homo sapiens
gccuggagacauau

SEQ ID NO: 2136555 - RNA, 14 nt, Homo sapiens
gacaggagaaaaau

SEQ ID NO: 2136556 - RNA, 20 nt, Homo sapiens
cuugcuagcgguugaaucuu

SEQ ID NO: 2136557 - RNA, 15 nt, Homo sapiens
cagugagcccugcuc

SEQ ID NO: 2136558 - RNA, 21 nt, Homo sapiens
ccucuacuuuaacuuuuacaa

SEQ ID NO: 2136559 - RNA, 19 nt, Homo sapiens
guuucgauuuuugaucaau

SEQ ID NO: 2136560 - RNA, 12 nt, Homo sapiens
uguugaucccaa

SEQ ID NO: 2136561 - RNA, 18 nt, Homo sapiens
cuuuagaaagcugacauu

SEQ ID NO: 2136562 - RNA, 20 nt, Homo sapiens
gagccacugcgcccggccac

SEQ ID NO: 2136563 - RNA, 14 nt, Homo sapiens
aucugagcuuaaac

SEQ ID NO: 2136564 - RNA, 21 nt, Homo sapiens
uauguauaacaagccaaacau

SEQ ID NO: 2136565 - RNA, 22 nt, Homo sapiens
ugugaaacuugaaagagaauag

SEQ ID NO: 2136566 - RNA, 22 nt, Homo sapiens
gaaagauuuuaugugcuugaag

SEQ ID NO: 2136567 - RNA, 22 nt, Homo sapiens
cagguggugaauuuuccaagaa

SEQ ID NO: 2136568 - RNA, 17 nt, Homo sapiens
caugcugauuguuauug

SEQ ID NO: 2136569 - RNA, 12 nt, Homo sapiens
ugaaaaugugac

SEQ ID NO: 2136570 - RNA, 20 nt, Homo sapiens
gaacuucacagugacacugg

SEQ ID NO: 2136571 - RNA, 14 nt, Homo sapiens
cgcauggugcagug

SEQ ID NO: 2136572 - RNA, 21 nt, Homo sapiens
ccuacccaaugucucccacac

SEQ ID NO: 2136573 - RNA, 21 nt, Homo sapiens
gcuucuuccccucugcggcuu

SEQ ID NO: 2136574 - RNA, 22 nt, Homo sapiens
gccucaguuucuucaccuguaa

SEQ ID NO: 2136575 - RNA, 14 nt, Homo sapiens
uauacaaaaauucu

SEQ ID NO: 2136576 - RNA, 14 nt, Homo sapiens
aaaacuaauaauca

SEQ ID NO: 2136577 - RNA, 16 nt, Homo sapiens
aauaacauuuuauaca

SEQ ID NO: 2136578 - RNA, 12 nt, Homo sapiens
auaauaaccaaa

SEQ ID NO: 2136579 - RNA, 23 nt, Homo sapiens
cuacaucuccaaugugcuuucua

SEQ ID NO: 2136580 - RNA, 19 nt, Homo sapiens
uaauuuaguuccacaaaug

SEQ ID NO: 2136581 - RNA, 18 nt, Homo sapiens
gugagugaaaguugccau

SEQ ID NO: 2136582 - RNA, 13 nt, Homo sapiens
uaaaacuuuuuga

SEQ ID NO: 2136583 - RNA, 20 nt, Homo sapiens
agugccuucuaaagguguug

SEQ ID NO: 2136584 - RNA, 19 nt, Homo sapiens
aaggcacccaucugucugc

SEQ ID NO: 2136585 - RNA, 15 nt, Homo sapiens
cuuccccccaaaacu

SEQ ID NO: 2136586 - RNA, 14 nt, Homo sapiens
ugcaaaacauaucu

SEQ ID NO: 2136587 - RNA, 14 nt, Homo sapiens
uucaauacagauca

SEQ ID NO: 2136588 - RNA, 13 nt, Homo sapiens
gugagaacaucau

SEQ ID NO: 2136589 - RNA, 21 nt, Homo sapiens
ccuguguagcucucacaugca

SEQ ID NO: 2136590 - RNA, 15 nt, Homo sapiens
cuggggacuuccuca

SEQ ID NO: 2136591 - RNA, 19 nt, Homo sapiens
agaaugccagcccaaagcu

SEQ ID NO: 2136592 - RNA, 13 nt, Homo sapiens
gaaaaauuguuaa

SEQ ID NO: 2136593 - RNA, 17 nt, Homo sapiens
caaagugcugagauuau

SEQ ID NO: 2136594 - RNA, 23 nt, Homo sapiens
ugcccuccucucccgucucgccu

SEQ ID NO: 2136595 - RNA, 20 nt, Homo sapiens
ccuaauccaggcagauccag

SEQ ID NO: 2136596 - RNA, 20 nt, Homo sapiens
agcucaucuguuaugcauag

SEQ ID NO: 2136597 - RNA, 19 nt, Homo sapiens
uaguuccccuacuacacuu

SEQ ID NO: 2136598 - RNA, 19 nt, Homo sapiens
aggagucgggagcacagcu

SEQ ID NO: 2136599 - RNA, 22 nt, Homo sapiens
caaaccuggcgucuauaccaac

SEQ ID NO: 2136600 - RNA, 17 nt, Homo sapiens
uuauucacugagucuca

SEQ ID NO: 2136601 - RNA, 22 nt, Homo sapiens
uguuauaaucuuucacagggga

SEQ ID NO: 2136602 - RNA, 19 nt, Homo sapiens
aggacucccuccucaccuc

SEQ ID NO: 2136603 - RNA, 21 nt, Homo sapiens
ucagggcuggaaaagucacac

SEQ ID NO: 2136604 - RNA, 16 nt, Homo sapiens
aaucugggaccaaaac

SEQ ID NO: 2136605 - RNA, 16 nt, Homo sapiens
ccgcagguuaugucag

SEQ ID NO: 2136606 - RNA, 13 nt, Homo sapiens
gaaugagcucucu

SEQ ID NO: 2136607 - RNA, 17 nt, Homo sapiens
ccaggaagccgugcccu

SEQ ID NO: 2136608 - RNA, 22 nt, Homo sapiens
gcuacgaccagggugagaauaa

SEQ ID NO: 2136609 - RNA, 23 nt, Homo sapiens
acagaguucacaggaggccagug

SEQ ID NO: 2136610 - RNA, 18 nt, Homo sapiens
cauuccagaaucuugacu

SEQ ID NO: 2136611 - RNA, 14 nt, Homo sapiens
aggcuuuacagugu

SEQ ID NO: 2136612 - RNA, 20 nt, Homo sapiens
cuguaaaauuagaggauugc

SEQ ID NO: 2136613 - RNA, 12 nt, Homo sapiens
auugaacugcca

SEQ ID NO: 2136614 - RNA, 15 nt, Homo sapiens
aacuugaugccagug

SEQ ID NO: 2136615 - RNA, 22 nt, Homo sapiens
gcagauguggugauacugagau

SEQ ID NO: 2136616 - RNA, 17 nt, Homo sapiens
caaucuguccuguuaca

SEQ ID NO: 2136617 - RNA, 21 nt, Homo sapiens
acuugaaauuuggcuaauaac

SEQ ID NO: 2136618 - RNA, 17 nt, Homo sapiens
gaaaagagaaugaugcu

SEQ ID NO: 2136619 - RNA, 18 nt, Homo sapiens
aaggauccucuccacucc

SEQ ID NO: 2136620 - RNA, 16 nt, Homo sapiens
aaacugacuuuauccu

SEQ ID NO: 2136621 - RNA, 23 nt, Homo sapiens
aauaugguuacguugguuaaaua

SEQ ID NO: 2136622 - RNA, 16 nt, Homo sapiens
gagccuuccacccagg

SEQ ID NO: 2136623 - RNA, 15 nt, Homo sapiens
gugggaacugugcaa

SEQ ID NO: 2136624 - RNA, 15 nt, Homo sapiens
aauauuaauuccagg

SEQ ID NO: 2136625 - RNA, 16 nt, Homo sapiens
uaccugagaaauaacu

SEQ ID NO: 2136626 - RNA, 17 nt, Homo sapiens
aggcugagccugcucau

SEQ ID NO: 2136627 - RNA, 18 nt, Homo sapiens
augacaauggaccucuca

SEQ ID NO: 2136628 - RNA, 19 nt, Homo sapiens
augucuuuuaucauugcag

SEQ ID NO: 2136629 - RNA, 15 nt, Homo sapiens
ggucaugaacauggu

SEQ ID NO: 2136630 - RNA, 15 nt, Homo sapiens
aauauaguagcagga

SEQ ID NO: 2136631 - RNA, 16 nt, Homo sapiens
uauuugagacuccuca

SEQ ID NO: 2136632 - RNA, 18 nt, Homo sapiens
uggcaaagcucaccaucu

SEQ ID NO: 2136633 - RNA, 19 nt, Homo sapiens
ccacccaagcuuggcagcc

SEQ ID NO: 2136634 - RNA, 23 nt, Homo sapiens
agugggaagaauaaaaugcagug

SEQ ID NO: 2136635 - RNA, 18 nt, Homo sapiens
uuggaauuuuccuccuuu

SEQ ID NO: 2136636 - RNA, 18 nt, Homo sapiens
uuauagccgaaaugaucu

SEQ ID NO: 2136637 - RNA, 16 nt, Homo sapiens
gguuucuaaagcugcc

SEQ ID NO: 2136638 - RNA, 14 nt, Homo sapiens
auauguaguauaau

SEQ ID NO: 2136639 - RNA, 21 nt, Homo sapiens
gcucaagucacuuuuauuuga

SEQ ID NO: 2136640 - RNA, 18 nt, Homo sapiens
agcagccucaggcccaau

SEQ ID NO: 2136641 - RNA, 21 nt, Homo sapiens
auuccugcagggacggagcug

SEQ ID NO: 2136642 - RNA, 21 nt, Homo sapiens
acuccacaaaugauguuuuca

SEQ ID NO: 2136643 - RNA, 19 nt, Homo sapiens
uccagaugccuuccugucu

SEQ ID NO: 2136644 - RNA, 18 nt, Homo sapiens
uguguuuuaaacugguag

SEQ ID NO: 2136645 - RNA, 17 nt, Homo sapiens
auuuccuuguccugcuu

SEQ ID NO: 2136646 - RNA, 16 nt, Homo sapiens
uucaaaauccaaaaag

SEQ ID NO: 2136647 - RNA, 20 nt, Homo sapiens
uguauggauuuaaagauuuc

SEQ ID NO: 2136648 - RNA, 16 nt, Homo sapiens
ucauggacacuuugaa

SEQ ID NO: 2136649 - RNA, 16 nt, Homo sapiens
ccaucugacaaauuca

SEQ ID NO: 2136650 - RNA, 20 nt, Homo sapiens
aaaaacuuaaaaaaaugggg

SEQ ID NO: 2136651 - RNA, 20 nt, Homo sapiens
caacugaguguuauuugcac

SEQ ID NO: 2136652 - RNA, 20 nt, Homo sapiens
cuauguggcugaaaaugcaa

SEQ ID NO: 2136653 - RNA, 16 nt, Homo sapiens
aaucucuugucucaca

SEQ ID NO: 2136654 - RNA, 21 nt, Homo sapiens
acagugacuguacaguuauca

SEQ ID NO: 2136655 - RNA, 19 nt, Homo sapiens
uaaucccagcacuuuggca

SEQ ID NO: 2136656 - RNA, 17 nt, Homo sapiens
aucaugaaacaccuuaa

SEQ ID NO: 2136657 - RNA, 17 nt, Homo sapiens
cuucagggaacugcaua

SEQ ID NO: 2136658 - RNA, 17 nt, Homo sapiens
cuucacggcacuggauc

SEQ ID NO: 2136659 - RNA, 12 nt, Homo sapiens
uggccugugaug

SEQ ID NO: 2136660 - RNA, 12 nt, Homo sapiens
uguccugugagg

SEQ ID NO: 2136661 - RNA, 22 nt, Homo sapiens
uaucuacauuaaaaugacaaac

SEQ ID NO: 2136662 - RNA, 22 nt, Homo sapiens
gcauuuauuuaagacacuguua

SEQ ID NO: 2136663 - RNA, 13 nt, Homo sapiens
auacugcauaaaa

SEQ ID NO: 2136664 - RNA, 16 nt, Homo sapiens
cauuaccacacucagc

SEQ ID NO: 2136665 - RNA, 20 nt, Homo sapiens
aaagaggguaacaauaggaa

SEQ ID NO: 2136666 - RNA, 23 nt, Homo sapiens
gaugcugccaggggcagugaagu

SEQ ID NO: 2136667 - RNA, 19 nt, Homo sapiens
gaggaguguccugucugcu

SEQ ID NO: 2136668 - RNA, 18 nt, Homo sapiens
augcagaauggcauuugc

SEQ ID NO: 2136669 - RNA, 14 nt, Homo sapiens
caaaaaccccagug

SEQ ID NO: 2136670 - RNA, 18 nt, Homo sapiens
uucuugaagaaaggcaaa

SEQ ID NO: 2136671 - RNA, 16 nt, Homo sapiens
ccucaccauccagugg

SEQ ID NO: 2136672 - RNA, 21 nt, Homo sapiens
cuggcagggcccagugacaag

SEQ ID NO: 2136673 - RNA, 19 nt, Homo sapiens
uguuccuuugggucuguga

SEQ ID NO: 2136674 - RNA, 15 nt, Homo sapiens
gagcaggaugcccau

SEQ ID NO: 2136675 - RNA, 18 nt, Homo sapiens
ucacaccugacaaaugga

SEQ ID NO: 2136676 - RNA, 15 nt, Homo sapiens
augggccucagucac

SEQ ID NO: 2136677 - RNA, 15 nt, Homo sapiens
cauggaauauuucca

SEQ ID NO: 2136678 - RNA, 21 nt, Homo sapiens
auuuauaaauuugaaauccaa

SEQ ID NO: 2136679 - RNA, 12 nt, Homo sapiens
uguugcaaaaaa

SEQ ID NO: 2136680 - RNA, 12 nt, Homo sapiens
aguugcaauaaa

SEQ ID NO: 2136681 - RNA, 19 nt, Homo sapiens
acaccucccugggccucuu

SEQ ID NO: 2136682 - RNA, 22 nt, Homo sapiens
gcccuucucucauuauuucucu

SEQ ID NO: 2136683 - RNA, 22 nt, Homo sapiens
ucuccucuuccagagucaccuu

SEQ ID NO: 2136684 - RNA, 15 nt, Homo sapiens
aggccccagcuggag

SEQ ID NO: 2136685 - RNA, 14 nt, Homo sapiens
cccugagcucugga

SEQ ID NO: 2136686 - RNA, 14 nt, Homo sapiens
ccuguagcuccuua

SEQ ID NO: 2136687 - RNA, 22 nt, Homo sapiens
cauauguauuuuguauuugcau

SEQ ID NO: 2136688 - RNA, 13 nt, Homo sapiens
cugaaacuuaccu

SEQ ID NO: 2136689 - RNA, 18 nt, Homo sapiens
cuguuuucuaaagccagg

SEQ ID NO: 2136690 - RNA, 12 nt, Homo sapiens
gcuucacucucc

SEQ ID NO: 2136691 - RNA, 16 nt, Homo sapiens
aggugggggagccugg

SEQ ID NO: 2136692 - RNA, 17 nt, Homo sapiens
aucuugucuaacauucc

SEQ ID NO: 2136693 - RNA, 13 nt, Homo sapiens
acacuguacucug

SEQ ID NO: 2136694 - RNA, 17 nt, Homo sapiens
auaugccucauacacau

SEQ ID NO: 2136695 - RNA, 19 nt, Homo sapiens
ucaauacaaccagcccaac

SEQ ID NO: 2136696 - RNA, 16 nt, Homo sapiens
caaagaggggucacca

SEQ ID NO: 2136697 - RNA, 17 nt, Homo sapiens
gaggcagggcugcauug

SEQ ID NO: 2136698 - RNA, 22 nt, Homo sapiens
aggaacaaaaagguaaauccca

SEQ ID NO: 2136699 - RNA, 23 nt, Homo sapiens
acucacugcugcaaauacuguau

SEQ ID NO: 2136700 - RNA, 21 nt, Homo sapiens
cuccaccaacuggagcacuga

SEQ ID NO: 2136701 - RNA, 21 nt, Homo sapiens
uccugccccaucacuuacaga

SEQ ID NO: 2136702 - RNA, 22 nt, Homo sapiens
gauguaaugucccuuucagaga

SEQ ID NO: 2136703 - RNA, 19 nt, Homo sapiens
auuuucuggaauacaugaa

SEQ ID NO: 2136704 - RNA, 16 nt, Homo sapiens
cugcagagagcaccug

SEQ ID NO: 2136705 - RNA, 22 nt, Homo sapiens
ugaaagagcaagugacuuucua

SEQ ID NO: 2136706 - RNA, 15 nt, Homo sapiens
ggaccagcucacaca

SEQ ID NO: 2136707 - RNA, 18 nt, Homo sapiens
acuacuguuaacacugcu

SEQ ID NO: 2136708 - RNA, 18 nt, Homo sapiens
agcacccagaacugagga

SEQ ID NO: 2136709 - RNA, 21 nt, Homo sapiens
ggauacauaaugggccacuga

SEQ ID NO: 2136710 - RNA, 22 nt, Homo sapiens
ccucuuucuacauucucaucua

SEQ ID NO: 2136711 - RNA, 15 nt, Homo sapiens
aaccaaauuacaagu

SEQ ID NO: 2136712 - RNA, 15 nt, Homo sapiens
agcugcugacugcca

SEQ ID NO: 2136713 - RNA, 15 nt, Homo sapiens
auacugauauuucau

SEQ ID NO: 2136714 - RNA, 19 nt, Homo sapiens
acgugcagccacacacaga

SEQ ID NO: 2136715 - RNA, 13 nt, Homo sapiens
accagauuuacug

SEQ ID NO: 2136716 - RNA, 13 nt, Homo sapiens
uaaaaauuacaua

SEQ ID NO: 2136717 - RNA, 19 nt, Homo sapiens
agugcagaucugugcucau

SEQ ID NO: 2136718 - RNA, 14 nt, Homo sapiens
cugucgcccagugc

SEQ ID NO: 2136719 - RNA, 23 nt, Homo sapiens
gagacuuuagucuuuggggcaag

SEQ ID NO: 2136720 - RNA, 16 nt, Homo sapiens
gucaagcugcucugag

SEQ ID NO: 2136721 - RNA, 14 nt, Homo sapiens
ugcagagcaggaaa

SEQ ID NO: 2136722 - RNA, 21 nt, Homo sapiens
uggucuucaagacgacagcuc

SEQ ID NO: 2136723 - RNA, 21 nt, Homo sapiens
cacagguucucacuagaugac

SEQ ID NO: 2136724 - RNA, 17 nt, Homo sapiens
caguaaacaaauucuuu

SEQ ID NO: 2136725 - RNA, 16 nt, Homo sapiens
ucucuuaaucacuacu

SEQ ID NO: 2136726 - RNA, 10 nt, Homo sapiens
ugcauuucau

SEQ ID NO: 2136727 - RNA, 16 nt, Homo sapiens
gcugccagggcuuccu

SEQ ID NO: 2136728 - RNA, 15 nt, Homo sapiens
uagccauaauuuugc

SEQ ID NO: 2136729 - RNA, 17 nt, Homo sapiens
ucaaggggacuggugau

SEQ ID NO: 2136730 - RNA, 20 nt, Homo sapiens
guucaagacagaugggcaua

SEQ ID NO: 2136731 - RNA, 13 nt, Homo sapiens
caaugacaucuca

SEQ ID NO: 2136732 - RNA, 24 nt, Homo sapiens
uuaaccuuucaggaaaguaucucu

SEQ ID NO: 2136733 - RNA, 16 nt, Homo sapiens
uccagucaaguucccu

SEQ ID NO: 2136734 - RNA, 12 nt, Homo sapiens
uuuccuccuugu

SEQ ID NO: 2136735 - RNA, 12 nt, Homo sapiens
aguuucugugac

SEQ ID NO: 2136736 - RNA, 16 nt, Homo sapiens
ccagcaaaagugcagu

SEQ ID NO: 2136737 - RNA, 10 nt, Homo sapiens
ggacuauuau

SEQ ID NO: 2136738 - RNA, 21 nt, Homo sapiens
ugguagucacuaacauauaua

SEQ ID NO: 2136739 - RNA, 20 nt, Homo sapiens
augcuaaagaaaaagucauc

SEQ ID NO: 2136740 - RNA, 17 nt, Homo sapiens
cccagaucaaauucuau

SEQ ID NO: 2136741 - RNA, 15 nt, Homo sapiens
acaucgcaaccucca

SEQ ID NO: 2136742 - RNA, 17 nt, Homo sapiens
cuugucauauguguuga

SEQ ID NO: 2136743 - RNA, 18 nt, Homo sapiens
ugcugaaacucagugcaa

SEQ ID NO: 2136744 - RNA, 16 nt, Homo sapiens
aaaucuguaagcucuu

SEQ ID NO: 2136745 - RNA, 22 nt, Homo sapiens
gaaacagaggcgucucacauuu

SEQ ID NO: 2136746 - RNA, 19 nt, Homo sapiens
agacauuugcugaacucag

SEQ ID NO: 2136747 - RNA, 21 nt, Homo sapiens
cugcagcuuauuggcuuaaaa

SEQ ID NO: 2136748 - RNA, 15 nt, Homo sapiens
ugccauuucuuccca

SEQ ID NO: 2136749 - RNA, 17 nt, Homo sapiens
ugaacaggacaccuguu

SEQ ID NO: 2136750 - RNA, 21 nt, Homo sapiens
aaaggaugcacagucaggaag

SEQ ID NO: 2136751 - RNA, 20 nt, Homo sapiens
aaaauauuucagauaucaaa

SEQ ID NO: 2136752 - RNA, 14 nt, Homo sapiens
uccagaaaaacauu

SEQ ID NO: 2136753 - RNA, 17 nt, Homo sapiens
auauuugcuagauuucu

SEQ ID NO: 2136754 - RNA, 23 nt, Homo sapiens
cuccuggcuggggccuguugaag

SEQ ID NO: 2136755 - RNA, 19 nt, Homo sapiens
aacuuuagcagaaucaaaa

SEQ ID NO: 2136756 - RNA, 21 nt, Homo sapiens
aaccagagccugaguguugcc

SEQ ID NO: 2136757 - RNA, 23 nt, Homo sapiens
uaaguauuuagaagugugaauuc

SEQ ID NO: 2136758 - RNA, 17 nt, Homo sapiens
uggcugauuggaaaaua

SEQ ID NO: 2136759 - RNA, 17 nt, Homo sapiens
guauuacagcuuucaca

SEQ ID NO: 2136760 - RNA, 21 nt, Homo sapiens
uuaccagagggucaaaggaga

SEQ ID NO: 2136761 - RNA, 21 nt, Homo sapiens
caaugcucuggagugugcauu

SEQ ID NO: 2136762 - RNA, 18 nt, Homo sapiens
gcuagagaaggaguuaau

SEQ ID NO: 2136763 - RNA, 14 nt, Homo sapiens
gauguuccacucca

SEQ ID NO: 2136764 - RNA, 17 nt, Homo sapiens
gggauccguuuugacau

SEQ ID NO: 2136765 - RNA, 16 nt, Homo sapiens
guggaaaguagcugcu

SEQ ID NO: 2136766 - RNA, 16 nt, Homo sapiens
cuuucucgauuggugu

SEQ ID NO: 2136767 - RNA, 16 nt, Homo sapiens
cacucucaaagcaaau

SEQ ID NO: 2136768 - RNA, 12 nt, Homo sapiens
ccagcacuccau

SEQ ID NO: 2136769 - RNA, 14 nt, Homo sapiens
aggggacugccacc

SEQ ID NO: 2136770 - RNA, 14 nt, Homo sapiens
acagugcauuugcc

SEQ ID NO: 2136771 - RNA, 16 nt, Homo sapiens
aucugggauauuucca

SEQ ID NO: 2136772 - RNA, 21 nt, Homo sapiens
uuaucugugucaaaagccaga

SEQ ID NO: 2136773 - RNA, 12 nt, Homo sapiens
ugaucuguguuu

SEQ ID NO: 2136774 - RNA, 15 nt, Homo sapiens
gugccagaacccaaa

SEQ ID NO: 2136775 - RNA, 16 nt, Homo sapiens
cucuccagcugacuaa

SEQ ID NO: 2136776 - RNA, 14 nt, Homo sapiens
accaaauugcuucu

SEQ ID NO: 2136777 - RNA, 22 nt, Homo sapiens
ggcagguaggucggcacuugga

SEQ ID NO: 2136778 - RNA, 18 nt, Homo sapiens
uaccaacccugugcauga

SEQ ID NO: 2136779 - RNA, 21 nt, Homo sapiens
aaagugcugggauuacagaca

SEQ ID NO: 2136780 - RNA, 13 nt, Homo sapiens
accaaagcugccc

SEQ ID NO: 2136781 - RNA, 16 nt, Homo sapiens
uuacaaaccauuaccu

SEQ ID NO: 2136782 - RNA, 18 nt, Homo sapiens
agaacacacucuacaaaa

SEQ ID NO: 2136783 - RNA, 17 nt, Homo sapiens
uccagccucauaaagua

SEQ ID NO: 2136784 - RNA, 19 nt, Homo sapiens
uggccaagcaauuccucug

SEQ ID NO: 2136785 - RNA, 15 nt, Homo sapiens
uucugcuucuuauau

SEQ ID NO: 2136786 - RNA, 20 nt, Homo sapiens
ggaucgaggcauggggcaug

SEQ ID NO: 2136787 - RNA, 16 nt, Homo sapiens
uccccuccucagugac

SEQ ID NO: 2136788 - RNA, 23 nt, Homo sapiens
ucacauacauaagcagcauuuca

SEQ ID NO: 2136789 - RNA, 12 nt, Homo sapiens
ucacagugcaag

SEQ ID NO: 2136790 - RNA, 22 nt, Homo sapiens
uccugaucccagacccauuccu

SEQ ID NO: 2136791 - RNA, 21 nt, Homo sapiens
guaggaguuuuauauacugug

SEQ ID NO: 2136792 - RNA, 14 nt, Homo sapiens
caaccuaaccugug

SEQ ID NO: 2136793 - RNA, 20 nt, Homo sapiens
ccuggggcaggucacuuuac

SEQ ID NO: 2136794 - RNA, 21 nt, Homo sapiens
aggccgcccaugcugagcuca

SEQ ID NO: 2136795 - RNA, 16 nt, Homo sapiens
uccaauccguucccuu

SEQ ID NO: 2136796 - RNA, 17 nt, Homo sapiens
uccugguuccuuccuau

SEQ ID NO: 2136797 - RNA, 13 nt, Homo sapiens
uaguagaacugga

SEQ ID NO: 2136798 - RNA, 21 nt, Homo sapiens
uucuauaggcuuaugaucuga

SEQ ID NO: 2136799 - RNA, 17 nt, Homo sapiens
ccuaaaugcacagucau

SEQ ID NO: 2136800 - RNA, 18 nt, Homo sapiens
accaggggccaaccucag

SEQ ID NO: 2136801 - RNA, 18 nt, Homo sapiens
acuuuuuccagaauuuga

SEQ ID NO: 2136802 - RNA, 13 nt, Homo sapiens
aaguauguguuua

SEQ ID NO: 2136803 - RNA, 20 nt, Homo sapiens
gaauucauacucuguugccu

SEQ ID NO: 2136804 - RNA, 19 nt, Homo sapiens
cccagccccuuuucucugc

SEQ ID NO: 2136805 - RNA, 15 nt, Homo sapiens
gugugcgucacugug

SEQ ID NO: 2136806 - RNA, 13 nt, Homo sapiens
cugcugucuucca

SEQ ID NO: 2136807 - RNA, 13 nt, Homo sapiens
uugcuguccucca

SEQ ID NO: 2136808 - RNA, 21 nt, Homo sapiens
uauuaguuaggugugccaaac

SEQ ID NO: 2136809 - RNA, 19 nt, Homo sapiens
aucuagcccaaagccuuca

SEQ ID NO: 2136810 - RNA, 22 nt, Homo sapiens
cuuccugauacaugacugaaua

SEQ ID NO: 2136811 - RNA, 17 nt, Homo sapiens
uauauuuauugauuuca

SEQ ID NO: 2136812 - RNA, 17 nt, Homo sapiens
cccuugugugagggcaa

SEQ ID NO: 2136813 - RNA, 18 nt, Homo sapiens
cccuccaaaaccuccauu

SEQ ID NO: 2136814 - RNA, 15 nt, Homo sapiens
auuccagcaagacca

SEQ ID NO: 2136815 - RNA, 19 nt, Homo sapiens
acugaccuacucuugccug

SEQ ID NO: 2136816 - RNA, 22 nt, Homo sapiens
guccacccccauugugaauguu

SEQ ID NO: 2136817 - RNA, 23 nt, Homo sapiens
aauucugucccugucccugcccc

SEQ ID NO: 2136818 - RNA, 14 nt, Homo sapiens
cucacucauugcag

SEQ ID NO: 2136819 - RNA, 20 nt, Homo sapiens
augcaugauauuguauguac

SEQ ID NO: 2136820 - RNA, 22 nt, Homo sapiens
gagugaaaaaucuuaaguacca

SEQ ID NO: 2136821 - RNA, 18 nt, Homo sapiens
uauugcaguucauacuga

SEQ ID NO: 2136822 - RNA, 16 nt, Homo sapiens
uaacgcagcacuuaga

SEQ ID NO: 2136823 - RNA, 20 nt, Homo sapiens
uggaauuaguuggcagagaa

SEQ ID NO: 2136824 - RNA, 16 nt, Homo sapiens
uggaggaagagccacc

SEQ ID NO: 2136825 - RNA, 12 nt, Homo sapiens
cugccuguggag

SEQ ID NO: 2136826 - RNA, 19 nt, Homo sapiens
caguccuuuguugcuguug

SEQ ID NO: 2136827 - RNA, 16 nt, Homo sapiens
cuucuguugaucucag

SEQ ID NO: 2136828 - RNA, 18 nt, Homo sapiens
gaaagaaucagucuugca

SEQ ID NO: 2136829 - RNA, 19 nt, Homo sapiens
gcugucgccgcuagucuua

SEQ ID NO: 2136830 - RNA, 16 nt, Homo sapiens
gacccagggaugacau

SEQ ID NO: 2136831 - RNA, 22 nt, Homo sapiens
ggacucaggccugccaaugcca

SEQ ID NO: 2136832 - RNA, 22 nt, Homo sapiens
uuaucuucuagccacaguucua

SEQ ID NO: 2136833 - RNA, 18 nt, Homo sapiens
cuaacuguacauuucaca

SEQ ID NO: 2136834 - RNA, 22 nt, Homo sapiens
cagaaauacagucuuccacaaa

SEQ ID NO: 2136835 - RNA, 17 nt, Homo sapiens
aaaugcucucucaaauu

SEQ ID NO: 2136836 - RNA, 20 nt, Homo sapiens
cauaagacaaacacugccau

SEQ ID NO: 2136837 - RNA, 18 nt, Homo sapiens
aagcucaucucagcuccu

SEQ ID NO: 2136838 - RNA, 21 nt, Homo sapiens
acauccguugugcuugccugc

SEQ ID NO: 2136839 - RNA, 19 nt, Homo sapiens
aaaaauuaagcugaugacu

SEQ ID NO: 2136840 - RNA, 16 nt, Homo sapiens
uuaacuuaaucaauua

SEQ ID NO: 2136841 - RNA, 21 nt, Homo sapiens
ucucuaucauguugaagucaa

SEQ ID NO: 2136842 - RNA, 23 nt, Homo sapiens
cugaauagcagaagguugcaccu

SEQ ID NO: 2136843 - RNA, 22 nt, Homo sapiens
aggaugauggccacaacaugaa

SEQ ID NO: 2136844 - RNA, 16 nt, Homo sapiens
aggcagaaaagcacau

SEQ ID NO: 2136845 - RNA, 16 nt, Homo sapiens
cagugagaucaaugug

SEQ ID NO: 2136846 - RNA, 16 nt, Homo sapiens
aagcaaguuaaguguc

SEQ ID NO: 2136847 - RNA, 14 nt, Homo sapiens
ugcauuuuacuaaa

SEQ ID NO: 2136848 - RNA, 13 nt, Homo sapiens
aaacuccaucuca

SEQ ID NO: 2136849 - RNA, 13 nt, Homo sapiens
aaaaccacuuuuu

SEQ ID NO: 2136850 - RNA, 18 nt, Homo sapiens
gagcaagaccccaucuca

SEQ ID NO: 2136851 - RNA, 16 nt, Homo sapiens
uccugacaaaagggac

SEQ ID NO: 2136852 - RNA, 14 nt, Homo sapiens
aaguagcugggacu

SEQ ID NO: 2136853 - RNA, 22 nt, Homo sapiens
gugucuggagcgcuucaguuca

SEQ ID NO: 2136854 - RNA, 11 nt, Homo sapiens
uuaucaugugu

SEQ ID NO: 2136855 - RNA, 16 nt, Homo sapiens
uuagaaauacugcaag

SEQ ID NO: 2136856 - RNA, 18 nt, Homo sapiens
gcucugaaguguccuaaa

SEQ ID NO: 2136857 - RNA, 13 nt, Homo sapiens
cgugcuuccucag

SEQ ID NO: 2136858 - RNA, 14 nt, Homo sapiens
gcccaccagccagc

SEQ ID NO: 2136859 - RNA, 17 nt, Homo sapiens
acauuggccgcuucaga

SEQ ID NO: 2136860 - RNA, 16 nt, Homo sapiens
agauuuguuacuguau

SEQ ID NO: 2136861 - RNA, 17 nt, Homo sapiens
auucuuccaucaucacu

SEQ ID NO: 2136862 - RNA, 14 nt, Homo sapiens
cccuugccacccca

SEQ ID NO: 2136863 - RNA, 21 nt, Homo sapiens
acuugccugugcuacaauuca

SEQ ID NO: 2136864 - RNA, 18 nt, Homo sapiens
uucugcauuuagcuguau

SEQ ID NO: 2136865 - RNA, 13 nt, Homo sapiens
ggcugggugguau

SEQ ID NO: 2136866 - RNA, 12 nt, Homo sapiens
cuuuggucuauc

SEQ ID NO: 2136867 - RNA, 20 nt, Homo sapiens
ucugccuugguucuggccac

SEQ ID NO: 2136868 - RNA, 20 nt, Homo sapiens
uccagcuguuaccugagaua

SEQ ID NO: 2136869 - RNA, 16 nt, Homo sapiens
uuggccaucucuggau

SEQ ID NO: 2136870 - RNA, 17 nt, Homo sapiens
accuccccaagacuuua

SEQ ID NO: 2136871 - RNA, 22 nt, Homo sapiens
uacauauauauauacacauaca

SEQ ID NO: 2136872 - RNA, 19 nt, Homo sapiens
aauguuaaggaaacucuua

SEQ ID NO: 2136873 - RNA, 20 nt, Homo sapiens
ugucugcgucgucaccaaau

SEQ ID NO: 2136874 - RNA, 14 nt, Homo sapiens
ucuguagcuuuaac

SEQ ID NO: 2136875 - RNA, 21 nt, Homo sapiens
ugggccagccccagcaccuca

SEQ ID NO: 2136876 - RNA, 17 nt, Homo sapiens
ucugugcucauguuugg

SEQ ID NO: 2136877 - RNA, 13 nt, Homo sapiens
gcagccuccaggg

SEQ ID NO: 2136878 - RNA, 15 nt, Homo sapiens
acccuaucaucaguu

SEQ ID NO: 2136879 - RNA, 20 nt, Homo sapiens
cugcagugcucauucaucac

SEQ ID NO: 2136880 - RNA, 22 nt, Homo sapiens
uccaagaauguuguuagcuuuu

SEQ ID NO: 2136881 - RNA, 21 nt, Homo sapiens
cucugcacccagugaacacau

SEQ ID NO: 2136882 - RNA, 15 nt, Homo sapiens
cuugugaacccaaag

SEQ ID NO: 2136883 - RNA, 12 nt, Homo sapiens
uacaacauguga

SEQ ID NO: 2136884 - RNA, 17 nt, Homo sapiens
uggcucugggguccuca

SEQ ID NO: 2136885 - RNA, 16 nt, Homo sapiens
acucuugaacugggcg

SEQ ID NO: 2136886 - RNA, 13 nt, Homo sapiens
gcugucaauguuu

SEQ ID NO: 2136887 - RNA, 20 nt, Homo sapiens
uucccauacccagucuagga

SEQ ID NO: 2136888 - RNA, 13 nt, Homo sapiens
ccccuaacaaaga

SEQ ID NO: 2136889 - RNA, 11 nt, Homo sapiens
gccccagagac

SEQ ID NO: 2136890 - RNA, 16 nt, Homo sapiens
uguaaauguauauacc

SEQ ID NO: 2136891 - RNA, 18 nt, Homo sapiens
gaggaaaaaagaaccaaa

SEQ ID NO: 2136892 - RNA, 14 nt, Homo sapiens
aaaacaauacucaa

SEQ ID NO: 2136893 - RNA, 12 nt, Homo sapiens
cuguaaaugcag

SEQ ID NO: 2136894 - RNA, 18 nt, Homo sapiens
guauuauuuacaaugcag

SEQ ID NO: 2136895 - RNA, 22 nt, Homo sapiens
auaucuugcgaauccaagcucc

SEQ ID NO: 2136896 - RNA, 20 nt, Homo sapiens
cagguccaccgagccccuga

SEQ ID NO: 2136897 - RNA, 18 nt, Homo sapiens
acagaugauccauuugaa

SEQ ID NO: 2136898 - RNA, 23 nt, Homo sapiens
gggauggcuggggcucucuccau

SEQ ID NO: 2136899 - RNA, 15 nt, Homo sapiens
ccugggaugggcucc

SEQ ID NO: 2136900 - RNA, 14 nt, Homo sapiens
ccacaagucuucca

SEQ ID NO: 2136901 - RNA, 23 nt, Homo sapiens
uguucagaggcagcaccaccaca

SEQ ID NO: 2136902 - RNA, 15 nt, Homo sapiens
auguaaauaauugau

SEQ ID NO: 2136903 - RNA, 17 nt, Homo sapiens
acagaugauaauaugcu

SEQ ID NO: 2136904 - RNA, 14 nt, Homo sapiens
gcugcuacugcccc

SEQ ID NO: 2136905 - RNA, 20 nt, Homo sapiens
ccaggauggucucgaucucu

SEQ ID NO: 2136906 - RNA, 14 nt, Homo sapiens
caagaagcugaggc

SEQ ID NO: 2136907 - RNA, 16 nt, Homo sapiens
aacggaacaguaucca

SEQ ID NO: 2136908 - RNA, 17 nt, Homo sapiens
ugcagagcccauagcca

SEQ ID NO: 2136909 - RNA, 17 nt, Homo sapiens
uaccugcccccaucaua

SEQ ID NO: 2136910 - RNA, 15 nt, Homo sapiens
cugagagccacagga

SEQ ID NO: 2136911 - RNA, 14 nt, Homo sapiens
aaauaagucacuua

SEQ ID NO: 2136912 - RNA, 20 nt, Homo sapiens
aggaagccugaggcaaaaac

SEQ ID NO: 2136913 - RNA, 19 nt, Homo sapiens
cuacagccuccucggggga

SEQ ID NO: 2136914 - RNA, 14 nt, Homo sapiens
cugaauuaauguga

SEQ ID NO: 2136915 - RNA, 15 nt, Homo sapiens
uuauaaaaagaauga

SEQ ID NO: 2136916 - RNA, 11 nt, Homo sapiens
uuagucuccca

SEQ ID NO: 2136917 - RNA, 14 nt, Homo sapiens
acagcuuacugcag

SEQ ID NO: 2136918 - RNA, 10 nt, Homo sapiens
aaagguuuaa

SEQ ID NO: 2136919 - RNA, 17 nt, Homo sapiens
auuauauguuguaagca

SEQ ID NO: 2136920 - RNA, 19 nt, Homo sapiens
aacauaacaauucggcagu

SEQ ID NO: 2136921 - RNA, 19 nt, Homo sapiens
gagaagaacacaucaggca

SEQ ID NO: 2136922 - RNA, 16 nt, Homo sapiens
uaggaaaagcuguucc

SEQ ID NO: 2136923 - RNA, 18 nt, Homo sapiens
ugauagucaccugcuggu

SEQ ID NO: 2136924 - RNA, 22 nt, Homo sapiens
acuuauggggccaaaauagcau

SEQ ID NO: 2136925 - RNA, 16 nt, Homo sapiens
gagcugggauguuucu

SEQ ID NO: 2136926 - RNA, 14 nt, Homo sapiens
cagagacuaucuga

SEQ ID NO: 2136927 - RNA, 14 nt, Homo sapiens
aaaauaaauuauua

SEQ ID NO: 2136928 - RNA, 14 nt, Homo sapiens
uaaaucaaauauuc

SEQ ID NO: 2136929 - RNA, 19 nt, Homo sapiens
cuuguaggauaagugaaau

SEQ ID NO: 2136930 - RNA, 14 nt, Homo sapiens
cggaggccagagag

SEQ ID NO: 2136931 - RNA, 21 nt, Homo sapiens
auugaggauaaauugccauaa

SEQ ID NO: 2136932 - RNA, 12 nt, Homo sapiens
agcuucuugcca

SEQ ID NO: 2136933 - RNA, 17 nt, Homo sapiens
ggcugccccucucacca

SEQ ID NO: 2136934 - RNA, 17 nt, Homo sapiens
uuccaggggcacacaau

SEQ ID NO: 2136935 - RNA, 20 nt, Homo sapiens
cagaacacuuuuuaugacaa

SEQ ID NO: 2136936 - RNA, 21 nt, Homo sapiens
agacugaguaaaguguuaaua

SEQ ID NO: 2136937 - RNA, 14 nt, Homo sapiens
ccuuccuggccuga

SEQ ID NO: 2136938 - RNA, 19 nt, Homo sapiens
gggaggaauuuucauugcc

SEQ ID NO: 2136939 - RNA, 11 nt, Homo sapiens
cuggugcugcc

SEQ ID NO: 2136940 - RNA, 12 nt, Homo sapiens
ggcccuaccugg

SEQ ID NO: 2136941 - RNA, 16 nt, Homo sapiens
uacauucaacagauca

SEQ ID NO: 2136942 - RNA, 11 nt, Homo sapiens
ucuggcccacu

SEQ ID NO: 2136943 - RNA, 19 nt, Homo sapiens
cccccacccaguccgccaa

SEQ ID NO: 2136944 - RNA, 19 nt, Homo sapiens
agauggcaguugcuuccuc

SEQ ID NO: 2136945 - RNA, 21 nt, Homo sapiens
aauaucuacauucuauuucau

SEQ ID NO: 2136946 - RNA, 16 nt, Homo sapiens
uacacugcucucccca

SEQ ID NO: 2136947 - RNA, 23 nt, Homo sapiens
acacugacuuggugcaaggccau

SEQ ID NO: 2136948 - RNA, 16 nt, Homo sapiens
aaacguuugacaaaca

SEQ ID NO: 2136949 - RNA, 21 nt, Homo sapiens
agcccuggagaccccaccagc

SEQ ID NO: 2136950 - RNA, 21 nt, Homo sapiens
cuuggcaccagacacccagga

SEQ ID NO: 2136951 - RNA, 18 nt, Homo sapiens
uaauugguuuuaugcauu

SEQ ID NO: 2136952 - RNA, 20 nt, Homo sapiens
ucuaaagauacagugucuga

SEQ ID NO: 2136953 - RNA, 15 nt, Homo sapiens
cccuggaugacauua

SEQ ID NO: 2136954 - RNA, 15 nt, Homo sapiens
cagagagcacagccc

SEQ ID NO: 2136955 - RNA, 20 nt, Homo sapiens
ucacccuccacaaagcaaag

SEQ ID NO: 2136956 - RNA, 18 nt, Homo sapiens
ggacaaagugccaaagaa

SEQ ID NO: 2136957 - RNA, 22 nt, Homo sapiens
uucacauaugucuuacuacuuu

SEQ ID NO: 2136958 - RNA, 13 nt, Homo sapiens
auggaaaaaccau

SEQ ID NO: 2136959 - RNA, 20 nt, Homo sapiens
cuuugcgcagcccuaccuua

SEQ ID NO: 2136960 - RNA, 20 nt, Homo sapiens
cugucacaucagcaauuuca

SEQ ID NO: 2136961 - RNA, 19 nt, Homo sapiens
gacuuucaugcagccuaaa

SEQ ID NO: 2136962 - RNA, 17 nt, Homo sapiens
caucaguagcaucugua

SEQ ID NO: 2136963 - RNA, 20 nt, Homo sapiens
ccaaaauauaaucagagaua

SEQ ID NO: 2136964 - RNA, 19 nt, Homo sapiens
ccagucuguugaguuaguu

SEQ ID NO: 2136965 - RNA, 23 nt, Homo sapiens
auuuuaaugauaaaauagccaag

SEQ ID NO: 2136966 - RNA, 22 nt, Homo sapiens
uaauaccuuaguuuuuuccaca

SEQ ID NO: 2136967 - RNA, 16 nt, Homo sapiens
acauuucccugugcug

SEQ ID NO: 2136968 - RNA, 11 nt, Homo sapiens
aagaccaccuu

SEQ ID NO: 2136969 - RNA, 14 nt, Homo sapiens
ugguuacagcauaa

SEQ ID NO: 2136970 - RNA, 15 nt, Homo sapiens
caacugaucucauuu

SEQ ID NO: 2136971 - RNA, 23 nt, Homo sapiens
ccuucaguuuguaaagucgguga

SEQ ID NO: 2136972 - RNA, 14 nt, Homo sapiens
auuaacaguauaau

SEQ ID NO: 2136973 - RNA, 13 nt, Homo sapiens
cgcccuuccucag

SEQ ID NO: 2136974 - RNA, 18 nt, Homo sapiens
gucagcugugaaucuguu

SEQ ID NO: 2136975 - RNA, 12 nt, Homo sapiens
gagccaguuuau

SEQ ID NO: 2136976 - RNA, 20 nt, Homo sapiens
uuauagucaauauaccauga

SEQ ID NO: 2136977 - RNA, 14 nt, Homo sapiens
uccucugcugcauc

SEQ ID NO: 2136978 - RNA, 13 nt, Homo sapiens
gagccuccagcug

SEQ ID NO: 2136979 - RNA, 21 nt, Homo sapiens
cccuugaauauggguggcucu

SEQ ID NO: 2136980 - RNA, 16 nt, Homo sapiens
caacaggccauuguga

SEQ ID NO: 2136981 - RNA, 18 nt, Homo sapiens
auucauguugccuugcau

SEQ ID NO: 2136982 - RNA, 22 nt, Homo sapiens
uaugcagaacagugagccaaau

SEQ ID NO: 2136983 - RNA, 14 nt, Homo sapiens
agacagaaugucac

SEQ ID NO: 2136984 - RNA, 14 nt, Homo sapiens
aguaugacaaccuc

SEQ ID NO: 2136985 - RNA, 20 nt, Homo sapiens
caugucacuccagcagcaca

SEQ ID NO: 2136986 - RNA, 21 nt, Homo sapiens
ucacuaugaagguaaagggag

SEQ ID NO: 2136987 - RNA, 20 nt, Homo sapiens
aucuuuuucuauauucucau

SEQ ID NO: 2136988 - RNA, 17 nt, Homo sapiens
ccaagaaaugaacuugg

SEQ ID NO: 2136989 - RNA, 23 nt, Homo sapiens
ggaguccagaccccccagccccu

SEQ ID NO: 2136990 - RNA, 23 nt, Homo sapiens
acuccuguuaguagcagaaauau

SEQ ID NO: 2136991 - RNA, 14 nt, Homo sapiens
caagaaugcauucc

SEQ ID NO: 2136992 - RNA, 18 nt, Homo sapiens
ccaaccugaccagugucu

SEQ ID NO: 2136993 - RNA, 12 nt, Homo sapiens
gaauugcaaucu

SEQ ID NO: 2136994 - RNA, 22 nt, Homo sapiens
gaauugaaggagaaaaugcauu

SEQ ID NO: 2136995 - RNA, 20 nt, Homo sapiens
gccugcggaccagaugaaug

SEQ ID NO: 2136996 - RNA, 14 nt, Homo sapiens
ccucugcaacugca

SEQ ID NO: 2136997 - RNA, 21 nt, Homo sapiens
ugcagccccagcugacaccug

SEQ ID NO: 2136998 - RNA, 14 nt, Homo sapiens
aagaaaugcccaaa

SEQ ID NO: 2136999 - RNA, 21 nt, Homo sapiens
ugaaauaccagugaaccaaag

SEQ ID NO: 2137000 - RNA, 18 nt, Homo sapiens
uaaauuuguaacuuugca

SEQ ID NO: 2137001 - RNA, 13 nt, Homo sapiens
accugcacuucau

SEQ ID NO: 2137002 - RNA, 22 nt, Homo sapiens
cucaucaguguccucuugcuca

SEQ ID NO: 2137003 - RNA, 21 nt, Homo sapiens
aaacucaucucauuacccuuu

SEQ ID NO: 2137004 - RNA, 20 nt, Homo sapiens
aaccaggaauccacucucca

SEQ ID NO: 2137005 - RNA, 16 nt, Homo sapiens
aagacaccaaauucca

SEQ ID NO: 2137006 - RNA, 12 nt, Homo sapiens
ugacuuugccaa

SEQ ID NO: 2137007 - RNA, 22 nt, Homo sapiens
auuuacuacuuuaaagagcuua

SEQ ID NO: 2137008 - RNA, 16 nt, Homo sapiens
uuaucuagcuguccag

SEQ ID NO: 2137009 - RNA, 19 nt, Homo sapiens
guguccccucacucuguca

SEQ ID NO: 2137010 - RNA, 21 nt, Homo sapiens
agacgugauuuugcuguagaa

SEQ ID NO: 2137011 - RNA, 23 nt, Homo sapiens
gaauuaagcugugcaauuacugc

SEQ ID NO: 2137012 - RNA, 15 nt, Homo sapiens
ucuucuaccucagac

SEQ ID NO: 2137013 - RNA, 17 nt, Homo sapiens
ccuguuggggaccucac

SEQ ID NO: 2137014 - RNA, 17 nt, Homo sapiens
cgggauuugaagcugua

SEQ ID NO: 2137015 - RNA, 16 nt, Homo sapiens
agaaagugacaugcau

SEQ ID NO: 2137016 - RNA, 13 nt, Homo sapiens
cuguguggaccau

SEQ ID NO: 2137017 - RNA, 15 nt, Homo sapiens
aaccuccuuccaggg

SEQ ID NO: 2137018 - RNA, 20 nt, Homo sapiens
aaggcacuugucacuaugcu

SEQ ID NO: 2137019 - RNA, 13 nt, Homo sapiens
cugaauuaaggau

SEQ ID NO: 2137020 - RNA, 22 nt, Homo sapiens
aggauucuguucugcaacucca

SEQ ID NO: 2137021 - RNA, 16 nt, Homo sapiens
aacaugcuggugaaua

SEQ ID NO: 2137022 - RNA, 14 nt, Homo sapiens
uaaagguccaugaa

SEQ ID NO: 2137023 - RNA, 18 nt, Homo sapiens
caaguguugaggggacca

SEQ ID NO: 2137024 - RNA, 16 nt, Homo sapiens
aagcaacuacaacuuc

SEQ ID NO: 2137025 - RNA, 14 nt, Homo sapiens
uucucagcagagug

SEQ ID NO: 2137026 - RNA, 19 nt, Homo sapiens
aaaacgaaagcugaaccua

SEQ ID NO: 2137027 - RNA, 17 nt, Homo sapiens
agcuuagcugucucaga

SEQ ID NO: 2137028 - RNA, 18 nt, Homo sapiens
cauacaaagagguguaca

SEQ ID NO: 2137029 - RNA, 16 nt, Homo sapiens
cuccauuacugugauu

SEQ ID NO: 2137030 - RNA, 15 nt, Homo sapiens
aaauggcuguaaaau

SEQ ID NO: 2137031 - RNA, 20 nt, Homo sapiens
ggucucacaguguugcccag

SEQ ID NO: 2137032 - RNA, 19 nt, Homo sapiens
uaaaagauauaagacuuaa

SEQ ID NO: 2137033 - RNA, 18 nt, Homo sapiens
cauacauuuguggucuga

SEQ ID NO: 2137034 - RNA, 21 nt, Homo sapiens
gagcuacacucccacuucuuc

SEQ ID NO: 2137035 - RNA, 19 nt, Homo sapiens
auguugacaucacuggcau

SEQ ID NO: 2137036 - RNA, 18 nt, Homo sapiens
aauuuaaaguaucuugca

SEQ ID NO: 2137037 - RNA, 14 nt, Homo sapiens
cccuugugauuucu

SEQ ID NO: 2137038 - RNA, 21 nt, Homo sapiens
cacaccaggcccucucuccag

SEQ ID NO: 2137039 - RNA, 23 nt, Homo sapiens
cagucacuggcccaaccagaacu

SEQ ID NO: 2137040 - RNA, 20 nt, Homo sapiens
auucacaauaaaagcuuaaa

SEQ ID NO: 2137041 - RNA, 17 nt, Homo sapiens
uccacaguguugccaga

SEQ ID NO: 2137042 - RNA, 23 nt, Homo sapiens
uaguacucaauguuucuggacau

SEQ ID NO: 2137043 - RNA, 12 nt, Homo sapiens
ucuuguggucau

SEQ ID NO: 2137044 - RNA, 24 nt, Homo sapiens
cugcagccuccaccuccuaggcuc

SEQ ID NO: 2137045 - RNA, 15 nt, Homo sapiens
ucuaggugccccuga

SEQ ID NO: 2137046 - RNA, 14 nt, Homo sapiens
acauaacuaguuua

SEQ ID NO: 2137047 - RNA, 23 nt, Homo sapiens
auuuggacccugguugcuuugug

SEQ ID NO: 2137048 - RNA, 24 nt, Homo sapiens
cgacauggcuccggccucugccuu

SEQ ID NO: 2137049 - RNA, 13 nt, Homo sapiens
agaaccacuuccu

SEQ ID NO: 2137050 - RNA, 18 nt, Homo sapiens
uaguguaucaaaaugcuc

SEQ ID NO: 2137051 - RNA, 12 nt, Homo sapiens
ccccacacccau

SEQ ID NO: 2137052 - RNA, 12 nt, Homo sapiens
ucauacacuccc

SEQ ID NO: 2137053 - RNA, 19 nt, Homo sapiens
aaaauauugaaaugcugua

SEQ ID NO: 2137054 - RNA, 17 nt, Homo sapiens
cuaugacugcagaucau

SEQ ID NO: 2137055 - RNA, 17 nt, Homo sapiens
aggcacuguucaucuca

SEQ ID NO: 2137056 - RNA, 12 nt, Homo sapiens
accucaaaaagu

SEQ ID NO: 2137057 - RNA, 18 nt, Homo sapiens
uuggcagccuaccaaugc

SEQ ID NO: 2137058 - RNA, 17 nt, Homo sapiens
ucccaggaguacacccc

SEQ ID NO: 2137059 - RNA, 19 nt, Homo sapiens
ugaagacauuucugcucuc

SEQ ID NO: 2137060 - RNA, 20 nt, Homo sapiens
acugcucgucuaucaccagg

SEQ ID NO: 2137061 - RNA, 21 nt, Homo sapiens
aaagcuguguguuuggaagac

SEQ ID NO: 2137062 - RNA, 22 nt, Homo sapiens
cccauaucuacaguacuuccag

SEQ ID NO: 2137063 - RNA, 13 nt, Homo sapiens
agaaagcauuuga

SEQ ID NO: 2137064 - RNA, 14 nt, Homo sapiens
auauugcuguuuau

SEQ ID NO: 2137065 - RNA, 18 nt, Homo sapiens
agcugugugaacguguau

SEQ ID NO: 2137066 - RNA, 20 nt, Homo sapiens
acaacacccagccagucaca

SEQ ID NO: 2137067 - RNA, 14 nt, Homo sapiens
uccuaaauaucuca

SEQ ID NO: 2137068 - RNA, 13 nt, Homo sapiens
augccauaugccu

SEQ ID NO: 2137069 - RNA, 16 nt, Homo sapiens
acuguuuuguuuguua

SEQ ID NO: 2137070 - RNA, 12 nt, Homo sapiens
gaaaaaucucau

SEQ ID NO: 2137071 - RNA, 19 nt, Homo sapiens
aauccuuaguccuacccug

SEQ ID NO: 2137072 - RNA, 22 nt, Homo sapiens
auauuugucaugacagugcuug

SEQ ID NO: 2137073 - RNA, 19 nt, Homo sapiens
uaaaaugugcgaggauccu

SEQ ID NO: 2137074 - RNA, 20 nt, Homo sapiens
cagagguggcugcugugcua

SEQ ID NO: 2137075 - RNA, 15 nt, Homo sapiens
cagcaccuuucucug

SEQ ID NO: 2137076 - RNA, 17 nt, Homo sapiens
aacaacaccagaacugu

SEQ ID NO: 2137077 - RNA, 15 nt, Homo sapiens
auaguuacuguguaa

SEQ ID NO: 2137078 - RNA, 22 nt, Homo sapiens
ugaaugccucccccaucuccau

SEQ ID NO: 2137079 - RNA, 15 nt, Homo sapiens
ucgccacugcacucc

SEQ ID NO: 2137080 - RNA, 18 nt, Homo sapiens
ccuaguuaucaaggggau

SEQ ID NO: 2137081 - RNA, 14 nt, Homo sapiens
ggagcaaucugacc

SEQ ID NO: 2137082 - RNA, 20 nt, Homo sapiens
uccaucauggcagugaugaa

SEQ ID NO: 2137083 - RNA, 17 nt, Homo sapiens
cuggguucucuucauuc

SEQ ID NO: 2137084 - RNA, 22 nt, Homo sapiens
aaugaaccauucacagugcaag

SEQ ID NO: 2137085 - RNA, 13 nt, Homo sapiens
aauucccauucca

SEQ ID NO: 2137086 - RNA, 18 nt, Homo sapiens
uuaguaccucaaaguaaa

SEQ ID NO: 2137087 - RNA, 17 nt, Homo sapiens
aacaagucagucauuca

SEQ ID NO: 2137088 - RNA, 14 nt, Homo sapiens
uaccaaacaaggaa

SEQ ID NO: 2137089 - RNA, 13 nt, Homo sapiens
cucaguggcucug

SEQ ID NO: 2137090 - RNA, 17 nt, Homo sapiens
aguuguaccauucaccg

SEQ ID NO: 2137091 - RNA, 17 nt, Homo sapiens
cccaguugugacaauua

SEQ ID NO: 2137092 - RNA, 20 nt, Homo sapiens
uuuacagacaauaaaaugga

SEQ ID NO: 2137093 - RNA, 20 nt, Homo sapiens
ucacaacagaaaacccaaaa

SEQ ID NO: 2137094 - RNA, 18 nt, Homo sapiens
aaacuuacuaaauaucau

SEQ ID NO: 2137095 - RNA, 14 nt, Homo sapiens
ccaggauucagcua

SEQ ID NO: 2137096 - RNA, 15 nt, Homo sapiens
aagugccaugcucag

SEQ ID NO: 2137097 - RNA, 17 nt, Homo sapiens
gcagucagguccaugug

SEQ ID NO: 2137098 - RNA, 21 nt, Homo sapiens
uuaaagaaguaaauuugucca

SEQ ID NO: 2137099 - RNA, 17 nt, Homo sapiens
ugugaauaauggcacug

SEQ ID NO: 2137100 - RNA, 13 nt, Homo sapiens
cugccaccugcac

SEQ ID NO: 2137101 - RNA, 22 nt, Homo sapiens
gcaggcucaaaggcauaaguca

SEQ ID NO: 2137102 - RNA, 16 nt, Homo sapiens
uuugacucagcacugu

SEQ ID NO: 2137103 - RNA, 13 nt, Homo sapiens
aagauucuauuua

SEQ ID NO: 2137104 - RNA, 12 nt, Homo sapiens
gcucacaaagag

SEQ ID NO: 2137105 - RNA, 23 nt, Homo sapiens
cccuguuaaaugucaaccuagac

SEQ ID NO: 2137106 - RNA, 12 nt, Homo sapiens
aagugaucucug

SEQ ID NO: 2137107 - RNA, 16 nt, Homo sapiens
auguugauuucuugua

SEQ ID NO: 2137108 - RNA, 22 nt, Homo sapiens
caaaaauuacaaagaaccaugc

SEQ ID NO: 2137109 - RNA, 22 nt, Homo sapiens
gaaggcuuugggauaugcugua

SEQ ID NO: 2137110 - RNA, 18 nt, Homo sapiens
ugucuacacacagaugac

SEQ ID NO: 2137111 - RNA, 21 nt, Homo sapiens
gccaagaguccaggaggcccu

SEQ ID NO: 2137112 - RNA, 15 nt, Homo sapiens
ucucaacucacugca

SEQ ID NO: 2137113 - RNA, 20 nt, Homo sapiens
uagauuugugugcaucaggc

SEQ ID NO: 2137114 - RNA, 22 nt, Homo sapiens
acccauuuuuccuuuugccgac

SEQ ID NO: 2137115 - RNA, 19 nt, Homo sapiens
guguaucgcugccuugcca

SEQ ID NO: 2137116 - RNA, 20 nt, Homo sapiens
agccugguucagacacagcu

SEQ ID NO: 2137117 - RNA, 15 nt, Homo sapiens
auccaaagacuguac

SEQ ID NO: 2137118 - RNA, 16 nt, Homo sapiens
uaacaugcaauaacaa

SEQ ID NO: 2137119 - RNA, 19 nt, Homo sapiens
ccuccagaccucccagaga

SEQ ID NO: 2137120 - RNA, 15 nt, Homo sapiens
aaaucucuuccacau

SEQ ID NO: 2137121 - RNA, 16 nt, Homo sapiens
aauuauacuuacuucu

SEQ ID NO: 2137122 - RNA, 14 nt, Homo sapiens
ucuugucauuccag

SEQ ID NO: 2137123 - RNA, 20 nt, Homo sapiens
uuccauuugugugugugcaa

SEQ ID NO: 2137124 - RNA, 23 nt, Homo sapiens
aaucacuggcuguuaaucuuuca

SEQ ID NO: 2137125 - RNA, 15 nt, Homo sapiens
ugucacccaaugcau

SEQ ID NO: 2137126 - RNA, 22 nt, Homo sapiens
gcugaauagcuacuauauguca

SEQ ID NO: 2137127 - RNA, 19 nt, Homo sapiens
auaaugguguccagucuuu

SEQ ID NO: 2137128 - RNA, 16 nt, Homo sapiens
accuagugccccagac

SEQ ID NO: 2137129 - RNA, 15 nt, Homo sapiens
aacauaaaugcacaa

SEQ ID NO: 2137130 - RNA, 17 nt, Homo sapiens
aaauauuuuuaacaugg

SEQ ID NO: 2137131 - RNA, 22 nt, Homo sapiens
aacacuguguuuuauuguggua

SEQ ID NO: 2137132 - RNA, 13 nt, Homo sapiens
gaacaguacucca

SEQ ID NO: 2137133 - RNA, 15 nt, Homo sapiens
agacugaagauuuau

SEQ ID NO: 2137134 - RNA, 15 nt, Homo sapiens
gaccagccuggccaa

SEQ ID NO: 2137135 - RNA, 11 nt, Homo sapiens
ugcugcuguuc

SEQ ID NO: 2137136 - RNA, 18 nt, Homo sapiens
ucuuaaguguuucucaaa

SEQ ID NO: 2137137 - RNA, 22 nt, Homo sapiens
caugaugaacucacccccauga

SEQ ID NO: 2137138 - RNA, 11 nt, Homo sapiens
aacauugauuu

SEQ ID NO: 2137139 - RNA, 14 nt, Homo sapiens
auccuggaugauuu

SEQ ID NO: 2137140 - RNA, 22 nt, Homo sapiens
augucuagguccccacugccug

SEQ ID NO: 2137141 - RNA, 15 nt, Homo sapiens
uuccauuagaacaaa

SEQ ID NO: 2137142 - RNA, 13 nt, Homo sapiens
gucccgguuuguc

SEQ ID NO: 2137143 - RNA, 22 nt, Homo sapiens
cagcaagcccgucaucuucccu

SEQ ID NO: 2137144 - RNA, 19 nt, Homo sapiens
ccaggacgcccucacugca

SEQ ID NO: 2137145 - RNA, 14 nt, Homo sapiens
ucuuagaacucugc

SEQ ID NO: 2137146 - RNA, 21 nt, Homo sapiens
uggacaugugucccagccaca

SEQ ID NO: 2137147 - RNA, 20 nt, Homo sapiens
cacuucauccccucccagau

SEQ ID NO: 2137148 - RNA, 18 nt, Homo sapiens
uaucacucccacuuccuu

SEQ ID NO: 2137149 - RNA, 14 nt, Homo sapiens
uucgacuacugcuc

SEQ ID NO: 2137150 - RNA, 16 nt, Homo sapiens
uccuuugaagcuuuag

SEQ ID NO: 2137151 - RNA, 22 nt, Homo sapiens
caguaaaaauccacuauuucca

SEQ ID NO: 2137152 - RNA, 23 nt, Homo sapiens
agagcugggauguuucugucaca

SEQ ID NO: 2137153 - RNA, 13 nt, Homo sapiens
accuacaguguac

SEQ ID NO: 2137154 - RNA, 13 nt, Homo sapiens
acuuccagugcaa

SEQ ID NO: 2137155 - RNA, 18 nt, Homo sapiens
aaaucugauggccuuaau

SEQ ID NO: 2137156 - RNA, 20 nt, Homo sapiens
uuuccucacuuuauggaaga

SEQ ID NO: 2137157 - RNA, 22 nt, Homo sapiens
auuagguagaugagaaaacagg

SEQ ID NO: 2137158 - RNA, 16 nt, Homo sapiens
ucuauaccaauaaagu

SEQ ID NO: 2137159 - RNA, 11 nt, Homo sapiens
aaaaauuauca

SEQ ID NO: 2137160 - RNA, 15 nt, Homo sapiens
uuauagaaauucuga

SEQ ID NO: 2137161 - RNA, 15 nt, Homo sapiens
acacaccaucuuucc

SEQ ID NO: 2137162 - RNA, 18 nt, Homo sapiens
acggcuccaucaccagcc

SEQ ID NO: 2137163 - RNA, 20 nt, Homo sapiens
auauauagggagcacuuuaa

SEQ ID NO: 2137164 - RNA, 23 nt, Homo sapiens
aguugagaccuuugauuuuugcc

SEQ ID NO: 2137165 - RNA, 18 nt, Homo sapiens
gucaugcguuuaaucaca

SEQ ID NO: 2137166 - RNA, 22 nt, Homo sapiens
acaaacauguauguauacauga

SEQ ID NO: 2137167 - RNA, 15 nt, Homo sapiens
gugcugucauuauuu

SEQ ID NO: 2137168 - RNA, 17 nt, Homo sapiens
gcuauaacuauguugau

SEQ ID NO: 2137169 - RNA, 21 nt, Homo sapiens
ucaacuggggaauugaagcca

SEQ ID NO: 2137170 - RNA, 18 nt, Homo sapiens
auagaauauuuacaauaa

SEQ ID NO: 2137171 - RNA, 14 nt, Homo sapiens
ccagcacucaauaa

SEQ ID NO: 2137172 - RNA, 15 nt, Homo sapiens
ccucgagagugagaa

SEQ ID NO: 2137173 - RNA, 14 nt, Homo sapiens
ccacccugggagac

SEQ ID NO: 2137174 - RNA, 15 nt, Homo sapiens
aucuauggcaagcaa

SEQ ID NO: 2137175 - RNA, 21 nt, Homo sapiens
guucccuuguaaagacagagu

SEQ ID NO: 2137176 - RNA, 22 nt, Homo sapiens
uuuccaacuugucacuugccag

SEQ ID NO: 2137177 - RNA, 19 nt, Homo sapiens
ucaagaguccuuacugaag

SEQ ID NO: 2137178 - RNA, 13 nt, Homo sapiens
uuaccaaaacacu

SEQ ID NO: 2137179 - RNA, 16 nt, Homo sapiens
aaacaaauguguaauu

SEQ ID NO: 2137180 - RNA, 13 nt, Homo sapiens
uagucagauuuca

SEQ ID NO: 2137181 - RNA, 18 nt, Homo sapiens
uguguauuuaacagggag

SEQ ID NO: 2137182 - RNA, 16 nt, Homo sapiens
gagaguauacaguccu

SEQ ID NO: 2137183 - RNA, 15 nt, Homo sapiens
gcaugagaaugucau

SEQ ID NO: 2137184 - RNA, 15 nt, Homo sapiens
caggcgaugugcaag

SEQ ID NO: 2137185 - RNA, 23 nt, Homo sapiens
cuuugaugguaaccauaauggaa

SEQ ID NO: 2137186 - RNA, 20 nt, Homo sapiens
auaauguuaguagcacugag

SEQ ID NO: 2137187 - RNA, 17 nt, Homo sapiens
uauguaaaacucgcuuu

SEQ ID NO: 2137188 - RNA, 16 nt, Homo sapiens
acucuaacccuaggca

SEQ ID NO: 2137189 - RNA, 16 nt, Homo sapiens
acucaggccugccaau

SEQ ID NO: 2137190 - RNA, 17 nt, Homo sapiens
gagaugguuucuagaga

SEQ ID NO: 2137191 - RNA, 14 nt, Homo sapiens
cuuaagucauggaa

SEQ ID NO: 2137192 - RNA, 20 nt, Homo sapiens
ucugucacccuuguccuuga

SEQ ID NO: 2137193 - RNA, 19 nt, Homo sapiens
ucauuaucucaaaacugca

SEQ ID NO: 2137194 - RNA, 22 nt, Homo sapiens
ucagugauugcaauuugcacaa

SEQ ID NO: 2137195 - RNA, 14 nt, Homo sapiens
acucuaaugcugca

SEQ ID NO: 2137196 - RNA, 14 nt, Homo sapiens
accuaccugugaau

SEQ ID NO: 2137197 - RNA, 23 nt, Homo sapiens
ccuaaaugggcaagcaaggagcc

SEQ ID NO: 2137198 - RNA, 15 nt, Homo sapiens
caucguccugggacu

SEQ ID NO: 2137199 - RNA, 15 nt, Homo sapiens
aggacaagacacuga

SEQ ID NO: 2137200 - RNA, 12 nt, Homo sapiens
cuaaaacuuaac

SEQ ID NO: 2137201 - RNA, 22 nt, Homo sapiens
aucccgggccucagugccccau

SEQ ID NO: 2137202 - RNA, 23 nt, Homo sapiens
gauuaaaaaaaaauguaugcaac

SEQ ID NO: 2137203 - RNA, 16 nt, Homo sapiens
agucuuggcuaaggaa

SEQ ID NO: 2137204 - RNA, 18 nt, Homo sapiens
ggcuugagucaccaugcc

SEQ ID NO: 2137205 - RNA, 20 nt, Homo sapiens
cuauguauggaugaaagcaa

SEQ ID NO: 2137206 - RNA, 20 nt, Homo sapiens
ugaaaacaucuggaagggga

SEQ ID NO: 2137207 - RNA, 16 nt, Homo sapiens
ggaaauaucauaaugu

SEQ ID NO: 2137208 - RNA, 21 nt, Homo sapiens
aaccucgcucgaugacuguga

SEQ ID NO: 2137209 - RNA, 15 nt, Homo sapiens
aucaugaaaacuggg

SEQ ID NO: 2137210 - RNA, 12 nt, Homo sapiens
acaaggcuccaa

SEQ ID NO: 2137211 - RNA, 16 nt, Homo sapiens
caggcccuuuccucag

SEQ ID NO: 2137212 - RNA, 20 nt, Homo sapiens
cagccugaucaggcuuccug

SEQ ID NO: 2137213 - RNA, 13 nt, Homo sapiens
cuuuugcaauaau

SEQ ID NO: 2137214 - RNA, 12 nt, Homo sapiens
aacacccaugaa

SEQ ID NO: 2137215 - RNA, 18 nt, Homo sapiens
cugucaaaacacugugga

SEQ ID NO: 2137216 - RNA, 20 nt, Homo sapiens
cuacccucucaaauggacaa

SEQ ID NO: 2137217 - RNA, 17 nt, Homo sapiens
ucaguguaccauuugcc

SEQ ID NO: 2137218 - RNA, 16 nt, Homo sapiens
aaguaaauuacauuaa

SEQ ID NO: 2137219 - RNA, 17 nt, Homo sapiens
caagucaugauggaugg

SEQ ID NO: 2137220 - RNA, 15 nt, Homo sapiens
gugguuguuuuguca

SEQ ID NO: 2137221 - RNA, 14 nt, Homo sapiens
cagaaccacagggc

SEQ ID NO: 2137222 - RNA, 19 nt, Homo sapiens
gaaaagcggacaucagcug

SEQ ID NO: 2137223 - RNA, 18 nt, Homo sapiens
uagcucugccuuacccug

SEQ ID NO: 2137224 - RNA, 14 nt, Homo sapiens
acaauaucaauaug

SEQ ID NO: 2137225 - RNA, 19 nt, Homo sapiens
aauggacuauacauacuau

SEQ ID NO: 2137226 - RNA, 19 nt, Homo sapiens
auucucuuacccagaauau

SEQ ID NO: 2137227 - RNA, 18 nt, Homo sapiens
uuuugaaaucaguaaaca

SEQ ID NO: 2137228 - RNA, 23 nt, Homo sapiens
gcaggcuuucugggugugacuga

SEQ ID NO: 2137229 - RNA, 16 nt, Homo sapiens
aauugaagugucuucu

SEQ ID NO: 2137230 - RNA, 11 nt, Homo sapiens
ccugugcagcc

SEQ ID NO: 2137231 - RNA, 15 nt, Homo sapiens
cagacuuaaagcacu

SEQ ID NO: 2137232 - RNA, 18 nt, Homo sapiens
agaaagcaccaaggaaaa

SEQ ID NO: 2137233 - RNA, 20 nt, Homo sapiens
uugcaccuguccccacccuc

SEQ ID NO: 2137234 - RNA, 22 nt, Homo sapiens
aaccucgcucgaugacugugaa

SEQ ID NO: 2137235 - RNA, 16 nt, Homo sapiens
gaaugcaaaacauuuc

SEQ ID NO: 2137236 - RNA, 20 nt, Homo sapiens
agauuuggugauggaaaaag

SEQ ID NO: 2137237 - RNA, 15 nt, Homo sapiens
gguggaugaucucaa

SEQ ID NO: 2137238 - RNA, 13 nt, Homo sapiens
auuccucaggguu

SEQ ID NO: 2137239 - RNA, 16 nt, Homo sapiens
ccugcagucuggcuga

SEQ ID NO: 2137240 - RNA, 18 nt, Homo sapiens
agugagaaagacaucuga

SEQ ID NO: 2137241 - RNA, 21 nt, Homo sapiens
uccguagaugagaagcugccu

SEQ ID NO: 2137242 - RNA, 19 nt, Homo sapiens
agagaucuuucuuuccaaa

SEQ ID NO: 2137243 - RNA, 21 nt, Homo sapiens
guaccuucaaacuagggccaa

SEQ ID NO: 2137244 - RNA, 21 nt, Homo sapiens
cuuggaaauuggaagagcaca

SEQ ID NO: 2137245 - RNA, 23 nt, Homo sapiens
ugggggcuuccgcagcuucaggg

SEQ ID NO: 2137246 - RNA, 23 nt, Homo sapiens
acuuaaugaaaacaaugcaguac

SEQ ID NO: 2137247 - RNA, 13 nt, Homo sapiens
gagcuccacagaa

SEQ ID NO: 2137248 - RNA, 19 nt, Homo sapiens
gccacccaggccacugacc

SEQ ID NO: 2137249 - RNA, 14 nt, Homo sapiens
ucagacaacauuau

SEQ ID NO: 2137250 - RNA, 14 nt, Homo sapiens
ucagcuaacauucc

SEQ ID NO: 2137251 - RNA, 15 nt, Homo sapiens
augugccaaagucca

SEQ ID NO: 2137252 - RNA, 21 nt, Homo sapiens
gcccagaguugcugugccgug

SEQ ID NO: 2137253 - RNA, 21 nt, Homo sapiens
ugcugauucuuuaaaugguuu

SEQ ID NO: 2137254 - RNA, 19 nt, Homo sapiens
uaagaucauuuaauaucuu

SEQ ID NO: 2137255 - RNA, 14 nt, Homo sapiens
auaguaaacacagg

SEQ ID NO: 2137256 - RNA, 18 nt, Homo sapiens
ucccuuuuacguccaucu

SEQ ID NO: 2137257 - RNA, 16 nt, Homo sapiens
aguacucuucuagcau

SEQ ID NO: 2137258 - RNA, 17 nt, Homo sapiens
accuugguuaugacugc

SEQ ID NO: 2137259 - RNA, 18 nt, Homo sapiens
caagaagaggaaagggag

SEQ ID NO: 2137260 - RNA, 14 nt, Homo sapiens
cauggaaugacuga

SEQ ID NO: 2137261 - RNA, 13 nt, Homo sapiens
gccccucuaccca

SEQ ID NO: 2137262 - RNA, 21 nt, Homo sapiens
ccaauuucugcuguacauuau

SEQ ID NO: 2137263 - RNA, 13 nt, Homo sapiens
auuugccaccacu

SEQ ID NO: 2137264 - RNA, 12 nt, Homo sapiens
uccaucaccagc

SEQ ID NO: 2137265 - RNA, 13 nt, Homo sapiens
cucuauacugugg

SEQ ID NO: 2137266 - RNA, 13 nt, Homo sapiens
aucucugacuuaa

SEQ ID NO: 2137267 - RNA, 14 nt, Homo sapiens
caucuguaccucug

SEQ ID NO: 2137268 - RNA, 14 nt, Homo sapiens
gauaaauagcuaaa

SEQ ID NO: 2137269 - RNA, 14 nt, Homo sapiens
agaugguguaugcu

SEQ ID NO: 2137270 - RNA, 19 nt, Homo sapiens
aaauuccaaauucauggca

SEQ ID NO: 2137271 - RNA, 19 nt, Homo sapiens
ugccaguguggaagcugcc

SEQ ID NO: 2137272 - RNA, 14 nt, Homo sapiens
ucauacaaugacaa

SEQ ID NO: 2137273 - RNA, 17 nt, Homo sapiens
uaggccaccccaaccuc

SEQ ID NO: 2137274 - RNA, 20 nt, Homo sapiens
ugcauaagugcaugacauau

SEQ ID NO: 2137275 - RNA, 22 nt, Homo sapiens
cugcaauacauuaaaauaacua

SEQ ID NO: 2137276 - RNA, 20 nt, Homo sapiens
ggcccuggagaccuccaggc

SEQ ID NO: 2137277 - RNA, 14 nt, Homo sapiens
uaauccuagcacuu

SEQ ID NO: 2137278 - RNA, 14 nt, Homo sapiens
uauugguuggugug

SEQ ID NO: 2137279 - RNA, 21 nt, Homo sapiens
auaucuuuaaauaaaugugag

SEQ ID NO: 2137280 - RNA, 23 nt, Homo sapiens
uucagguccgugggccguaucug

SEQ ID NO: 2137281 - RNA, 15 nt, Homo sapiens
uaacuguacugaaua

SEQ ID NO: 2137282 - RNA, 21 nt, Homo sapiens
uaagauguauuugaacacuug

SEQ ID NO: 2137283 - RNA, 16 nt, Homo sapiens
guugcaggcagugucu

SEQ ID NO: 2137284 - RNA, 23 nt, Homo sapiens
aagcaugacuauuuccaccauca

SEQ ID NO: 2137285 - RNA, 18 nt, Homo sapiens
guguguuuggaagacuau

SEQ ID NO: 2137286 - RNA, 24 nt, Homo sapiens
aaggaaagaaaauaaaucuaucaa

SEQ ID NO: 2137287 - RNA, 21 nt, Homo sapiens
gcagucuaauuacauuucacu

SEQ ID NO: 2137288 - RNA, 18 nt, Homo sapiens
uuaaauuccugguggaua

SEQ ID NO: 2137289 - RNA, 20 nt, Homo sapiens
gaaaugcacauugauuugug

SEQ ID NO: 2137290 - RNA, 14 nt, Homo sapiens
uuugaaugaagugu

SEQ ID NO: 2137291 - RNA, 23 nt, Homo sapiens
uagauauuaaaaguuaagcaaau

SEQ ID NO: 2137292 - RNA, 18 nt, Homo sapiens
gcaacagguaaacagaaa

SEQ ID NO: 2137293 - RNA, 14 nt, Homo sapiens
uuaaaaaauuugau

SEQ ID NO: 2137294 - RNA, 19 nt, Homo sapiens
cugagccccagggugccca

SEQ ID NO: 2137295 - RNA, 23 nt, Homo sapiens
uacaugcccaucccaguguccua

SEQ ID NO: 2137296 - RNA, 13 nt, Homo sapiens
cugcauugcugag

SEQ ID NO: 2137297 - RNA, 21 nt, Homo sapiens
uauuagaaaggacuguaaaau

SEQ ID NO: 2137298 - RNA, 20 nt, Homo sapiens
accacugcugauauuuucuc

SEQ ID NO: 2137299 - RNA, 20 nt, Homo sapiens
aauuauauaaggcauucugu

SEQ ID NO: 2137300 - RNA, 18 nt, Homo sapiens
aaagaagugaaacuauau

SEQ ID NO: 2137301 - RNA, 15 nt, Homo sapiens
aaaaucuucagcugg

SEQ ID NO: 2137302 - RNA, 19 nt, Homo sapiens
uuugugcuugucauuccag

SEQ ID NO: 2137303 - RNA, 14 nt, Homo sapiens
cugucccaccugca

SEQ ID NO: 2137304 - RNA, 22 nt, Homo sapiens
gauuuuuagucuggcugcaccu

SEQ ID NO: 2137305 - RNA, 13 nt, Homo sapiens
aaauacaacacug

SEQ ID NO: 2137306 - RNA, 17 nt, Homo sapiens
gagacugccauacauaa

SEQ ID NO: 2137307 - RNA, 15 nt, Homo sapiens
aaaaaaaagugucuu

SEQ ID NO: 2137308 - RNA, 22 nt, Homo sapiens
cuugcugauggugacauugcac

SEQ ID NO: 2137309 - RNA, 23 nt, Homo sapiens
ccaggcugcugcauggcacugac

SEQ ID NO: 2137310 - RNA, 23 nt, Homo sapiens
ugaucagcuuauugucuagugaa

SEQ ID NO: 2137311 - RNA, 13 nt, Homo sapiens
cucaggagacuga

SEQ ID NO: 2137312 - RNA, 20 nt, Homo sapiens
gcagaacggguucaguuuua

SEQ ID NO: 2137313 - RNA, 19 nt, Homo sapiens
ugcccaaacaccagucacc

SEQ ID NO: 2137314 - RNA, 16 nt, Homo sapiens
caagcugcuuuggaca

SEQ ID NO: 2137315 - RNA, 20 nt, Homo sapiens
gaucacaccacugcacucca

SEQ ID NO: 2137316 - RNA, 18 nt, Homo sapiens
gacgaacaggggccaaac

SEQ ID NO: 2137317 - RNA, 17 nt, Homo sapiens
uuguucugaguaagugu

SEQ ID NO: 2137318 - RNA, 20 nt, Homo sapiens
guaaaauuacacuuugaacu

SEQ ID NO: 2137319 - RNA, 13 nt, Homo sapiens
aaacuacaccaca

SEQ ID NO: 2137320 - RNA, 23 nt, Homo sapiens
ggccucaguuucauuaacuggug

SEQ ID NO: 2137321 - RNA, 12 nt, Homo sapiens
cccucuucugag

SEQ ID NO: 2137322 - RNA, 17 nt, Homo sapiens
gcuccucaugaggccau

SEQ ID NO: 2137323 - RNA, 23 nt, Homo sapiens
cauauauuugaaguggagccaua

SEQ ID NO: 2137324 - RNA, 19 nt, Homo sapiens
uuucuugacuauuucacca

SEQ ID NO: 2137325 - RNA, 20 nt, Homo sapiens
agucauggcccaaauccagu

SEQ ID NO: 2137326 - RNA, 13 nt, Homo sapiens
aaaaguguuuaua

SEQ ID NO: 2137327 - RNA, 14 nt, Homo sapiens
cuaguuuucuuucc

SEQ ID NO: 2137328 - RNA, 17 nt, Homo sapiens
aaugggacccuguugau

SEQ ID NO: 2137329 - RNA, 19 nt, Homo sapiens
aaauaauaaacaguggaau

SEQ ID NO: 2137330 - RNA, 13 nt, Homo sapiens
ggcugcugacuca

SEQ ID NO: 2137331 - RNA, 22 nt, Homo sapiens
augccucuggaggccucuggcc

SEQ ID NO: 2137332 - RNA, 23 nt, Homo sapiens
gcagugacgugcaccuguacuca

SEQ ID NO: 2137333 - RNA, 23 nt, Homo sapiens
agugcagggaggaaaagugcaag

SEQ ID NO: 2137334 - RNA, 20 nt, Homo sapiens
gacgacucugaccucuuggc

SEQ ID NO: 2137335 - RNA, 20 nt, Homo sapiens
gaagauucucgccccuuccc

SEQ ID NO: 2137336 - RNA, 16 nt, Homo sapiens
uaccccucaaacugca

SEQ ID NO: 2137337 - RNA, 15 nt, Homo sapiens
ucugugaggugcuga

SEQ ID NO: 2137338 - RNA, 22 nt, Homo sapiens
uacuuuauuucugaucuauaca

SEQ ID NO: 2137339 - RNA, 18 nt, Homo sapiens
cuggggugcugccugaau

SEQ ID NO: 2137340 - RNA, 14 nt, Homo sapiens
gcgagcaccuguaa

SEQ ID NO: 2137341 - RNA, 21 nt, Homo sapiens
aaucacuuaacauuccuaaaa

SEQ ID NO: 2137342 - RNA, 16 nt, Homo sapiens
gccaucaugccugacu

SEQ ID NO: 2137343 - RNA, 22 nt, Homo sapiens
auucagcauuauuccuccagga

SEQ ID NO: 2137344 - RNA, 19 nt, Homo sapiens
gcugaucuuuaacuggaag

SEQ ID NO: 2137345 - RNA, 21 nt, Homo sapiens
cugccagagcccaagugccau

SEQ ID NO: 2137346 - RNA, 17 nt, Homo sapiens
gcacacaccuccgagac

SEQ ID NO: 2137347 - RNA, 15 nt, Homo sapiens
ccggaggacugagcc

SEQ ID NO: 2137348 - RNA, 17 nt, Homo sapiens
uaggaugucucuuggaa

SEQ ID NO: 2137349 - RNA, 14 nt, Homo sapiens
uuugucaacaaagu

SEQ ID NO: 2137350 - RNA, 14 nt, Homo sapiens
ccggagaaacugag

SEQ ID NO: 2137351 - RNA, 21 nt, Homo sapiens
guuucaccaucagucaaugaa

SEQ ID NO: 2137352 - RNA, 21 nt, Homo sapiens
uaaacuauaauuuauugucua

SEQ ID NO: 2137353 - RNA, 18 nt, Homo sapiens
cacaucaaguguuccauu

SEQ ID NO: 2137354 - RNA, 14 nt, Homo sapiens
ugugucaugccagu

SEQ ID NO: 2137355 - RNA, 17 nt, Homo sapiens
agcaggaugcucaguga

SEQ ID NO: 2137356 - RNA, 11 nt, Homo sapiens
ccuugcugcua

SEQ ID NO: 2137357 - RNA, 15 nt, Homo sapiens
uacaguaaacggugu

SEQ ID NO: 2137358 - RNA, 14 nt, Homo sapiens
uucagcuccaggga

SEQ ID NO: 2137359 - RNA, 19 nt, Homo sapiens
aaagcagauaaaaucuacu

SEQ ID NO: 2137360 - RNA, 16 nt, Homo sapiens
acaggugacagugaag

SEQ ID NO: 2137361 - RNA, 21 nt, Homo sapiens
cggggaggagguugugucacu

SEQ ID NO: 2137362 - RNA, 17 nt, Homo sapiens
ugagccgugaacugugc

SEQ ID NO: 2137363 - RNA, 22 nt, Homo sapiens
cccaugaccuugacgugugugg

SEQ ID NO: 2137364 - RNA, 20 nt, Homo sapiens
uccugaaauaaacacuggug

SEQ ID NO: 2137365 - RNA, 13 nt, Homo sapiens
acauuuacagcaa

SEQ ID NO: 2137366 - RNA, 18 nt, Homo sapiens
auccaguuucccaugcac

SEQ ID NO: 2137367 - RNA, 15 nt, Homo sapiens
cauaugacaauuuca

SEQ ID NO: 2137368 - RNA, 18 nt, Homo sapiens
gagaagaaagagccugaa

SEQ ID NO: 2137369 - RNA, 19 nt, Homo sapiens
uccugcccuuccugaagaa

SEQ ID NO: 2137370 - RNA, 14 nt, Homo sapiens
aauaaacuauacuu

SEQ ID NO: 2137371 - RNA, 16 nt, Homo sapiens
ucugacucacaagaag

SEQ ID NO: 2137372 - RNA, 22 nt, Homo sapiens
aauuuuaguucuuacugcuuaa

SEQ ID NO: 2137373 - RNA, 18 nt, Homo sapiens
cugagcuccccagaucuc

SEQ ID NO: 2137374 - RNA, 20 nt, Homo sapiens
ugacagacuuagaaccugag

SEQ ID NO: 2137375 - RNA, 14 nt, Homo sapiens
cuccugaucaggaa

SEQ ID NO: 2137376 - RNA, 17 nt, Homo sapiens
augcccuucacugucac

SEQ ID NO: 2137377 - RNA, 17 nt, Homo sapiens
aauucuccugccucagc

SEQ ID NO: 2137378 - RNA, 18 nt, Homo sapiens
auuugcuaucugaacuaa

SEQ ID NO: 2137379 - RNA, 13 nt, Homo sapiens
ccuggaugagaaa

SEQ ID NO: 2137380 - RNA, 15 nt, Homo sapiens
auaggaauaguccau

SEQ ID NO: 2137381 - RNA, 12 nt, Homo sapiens
ccucccaggaag

SEQ ID NO: 2137382 - RNA, 16 nt, Homo sapiens
gcaaucacugaucuca

SEQ ID NO: 2137383 - RNA, 14 nt, Homo sapiens
ucuccagugugcca

SEQ ID NO: 2137384 - RNA, 17 nt, Homo sapiens
uuucuuuuuuauacuca

SEQ ID NO: 2137385 - RNA, 19 nt, Homo sapiens
aucucuacugaaaauacaa

SEQ ID NO: 2137386 - RNA, 23 nt, Homo sapiens
acauauucuaguguaacacugca

SEQ ID NO: 2137387 - RNA, 18 nt, Homo sapiens
acguacguaucagcggcc

SEQ ID NO: 2137388 - RNA, 18 nt, Homo sapiens
gagcccagagaagcugga

SEQ ID NO: 2137389 - RNA, 21 nt, Homo sapiens
auuaaaauguaaaacuccauu

SEQ ID NO: 2137390 - RNA, 19 nt, Homo sapiens
aagcugcacaugugccaca

SEQ ID NO: 2137391 - RNA, 22 nt, Homo sapiens
uggguauaaaggcuaaaaggga

SEQ ID NO: 2137392 - RNA, 16 nt, Homo sapiens
cagcccucucuugcca

SEQ ID NO: 2137393 - RNA, 15 nt, Homo sapiens
uguaucaaguggcau

SEQ ID NO: 2137394 - RNA, 19 nt, Homo sapiens
uuuucccuccauaaguuua

SEQ ID NO: 2137395 - RNA, 14 nt, Homo sapiens
ugcagucacuggag

SEQ ID NO: 2137396 - RNA, 16 nt, Homo sapiens
aauguuggagcuuuag

SEQ ID NO: 2137397 - RNA, 15 nt, Homo sapiens
gugccagcuguuuca

SEQ ID NO: 2137398 - RNA, 16 nt, Homo sapiens
caagagggaaugucag

SEQ ID NO: 2137399 - RNA, 16 nt, Homo sapiens
acuauugagugaaaca

SEQ ID NO: 2137400 - RNA, 20 nt, Homo sapiens
cugaguaguggccacugggg

SEQ ID NO: 2137401 - RNA, 16 nt, Homo sapiens
ucagcgggagcacugc

SEQ ID NO: 2137402 - RNA, 18 nt, Homo sapiens
cagugccuucucucagcu

SEQ ID NO: 2137403 - RNA, 22 nt, Homo sapiens
gccaaaaacaacagccaaaaca

SEQ ID NO: 2137404 - RNA, 15 nt, Homo sapiens
uucucugccagugac

SEQ ID NO: 2137405 - RNA, 13 nt, Homo sapiens
uaaaaguugcaaa

SEQ ID NO: 2137406 - RNA, 17 nt, Homo sapiens
uggaagacuaucuuacu

SEQ ID NO: 2137407 - RNA, 17 nt, Homo sapiens
cuuguauuuccaaaccu

SEQ ID NO: 2137408 - RNA, 20 nt, Homo sapiens
gcuugacauaauuucacuga

SEQ ID NO: 2137409 - RNA, 14 nt, Homo sapiens
uucauuuacugugg

SEQ ID NO: 2137410 - RNA, 23 nt, Homo sapiens
guauccaugcaccuaccuuagaa

SEQ ID NO: 2137411 - RNA, 21 nt, Homo sapiens
accauuuugggguacccacug

SEQ ID NO: 2137412 - RNA, 23 nt, Homo sapiens
uacacacucaggccugugcccac

SEQ ID NO: 2137413 - RNA, 16 nt, Homo sapiens
ccagaccccauuccac

SEQ ID NO: 2137414 - RNA, 21 nt, Homo sapiens
gaauaaaagaauuacauauga

SEQ ID NO: 2137415 - RNA, 15 nt, Homo sapiens
ggcauuguaguuaau

SEQ ID NO: 2137416 - RNA, 17 nt, Homo sapiens
cucaagguuacugggag

SEQ ID NO: 2137417 - RNA, 23 nt, Homo sapiens
gggguagguagauaccaaaugaa

SEQ ID NO: 2137418 - RNA, 16 nt, Homo sapiens
uaugucuucuguauaa

SEQ ID NO: 2137419 - RNA, 15 nt, Homo sapiens
gaagucacugucaga

SEQ ID NO: 2137420 - RNA, 21 nt, Homo sapiens
ugaauacagcauuuagcuugu

SEQ ID NO: 2137421 - RNA, 21 nt, Homo sapiens
cugcauguaccauuugcaugg

SEQ ID NO: 2137422 - RNA, 17 nt, Homo sapiens
acgacugucuccauggc

SEQ ID NO: 2137423 - RNA, 18 nt, Homo sapiens
aucaggaggccaggccac

SEQ ID NO: 2137424 - RNA, 21 nt, Homo sapiens
acuuccuggcuccuucacuga

SEQ ID NO: 2137425 - RNA, 19 nt, Homo sapiens
ucuggaaagggcacgagag

SEQ ID NO: 2137426 - RNA, 16 nt, Homo sapiens
uggauuugauucauuu

SEQ ID NO: 2137427 - RNA, 21 nt, Homo sapiens
ucaguacacccaguugccaaa

SEQ ID NO: 2137428 - RNA, 22 nt, Homo sapiens
ucauguaagucuauaugacuuc

SEQ ID NO: 2137429 - RNA, 19 nt, Homo sapiens
guuccccugucugucccag

SEQ ID NO: 2137430 - RNA, 13 nt, Homo sapiens
cuggauccaucag

SEQ ID NO: 2137431 - RNA, 13 nt, Homo sapiens
caccacugcugag

SEQ ID NO: 2137432 - RNA, 13 nt, Homo sapiens
uucacaccuuauu

SEQ ID NO: 2137433 - RNA, 12 nt, Homo sapiens
gaagcugcuccu

SEQ ID NO: 2137434 - RNA, 17 nt, Homo sapiens
acaaagaagauucuuac

SEQ ID NO: 2137435 - RNA, 22 nt, Homo sapiens
aauccucaacaacaaaccaaaa

SEQ ID NO: 2137436 - RNA, 14 nt, Homo sapiens
gaacaugaccaaaa

SEQ ID NO: 2137437 - RNA, 23 nt, Homo sapiens
cuugauuuuuuucauuuugccaa

SEQ ID NO: 2137438 - RNA, 12 nt, Homo sapiens
auuacauagcuc

SEQ ID NO: 2137439 - RNA, 17 nt, Homo sapiens
aaagugugucacccuuu

SEQ ID NO: 2137440 - RNA, 17 nt, Homo sapiens
gacaaagaaacccaagu

SEQ ID NO: 2137441 - RNA, 16 nt, Homo sapiens
cagcuucaagugccuu

SEQ ID NO: 2137442 - RNA, 17 nt, Homo sapiens
cuucucugugaacuauu

SEQ ID NO: 2137443 - RNA, 17 nt, Homo sapiens
uggagcaugugugcaaa

SEQ ID NO: 2137444 - RNA, 21 nt, Homo sapiens
gaauauagaggagcacuauua

SEQ ID NO: 2137445 - RNA, 18 nt, Homo sapiens
ugaggcugcagauuucca

SEQ ID NO: 2137446 - RNA, 20 nt, Homo sapiens
uacuuaacugugugaagaaa

SEQ ID NO: 2137447 - RNA, 15 nt, Homo sapiens
aggcccccaucuccu

SEQ ID NO: 2137448 - RNA, 15 nt, Homo sapiens
aucccaucaggucac

SEQ ID NO: 2137449 - RNA, 16 nt, Homo sapiens
cuucuguaugugacaa

SEQ ID NO: 2137450 - RNA, 17 nt, Homo sapiens
ugguucccagccccgcg

SEQ ID NO: 2137451 - RNA, 16 nt, Homo sapiens
uccaggaagaaggugu

SEQ ID NO: 2137452 - RNA, 12 nt, Homo sapiens
uggaacacggcc

SEQ ID NO: 2137453 - RNA, 16 nt, Homo sapiens
ucauguuaugcaguga

SEQ ID NO: 2137454 - RNA, 14 nt, Homo sapiens
caggcccaaagccu

SEQ ID NO: 2137455 - RNA, 19 nt, Homo sapiens
uugcagaaauacaguauga

SEQ ID NO: 2137456 - RNA, 18 nt, Homo sapiens
gguuacucaauuucaaaa

SEQ ID NO: 2137457 - RNA, 19 nt, Homo sapiens
gcaguucccccaaccucag

SEQ ID NO: 2137458 - RNA, 14 nt, Homo sapiens
aacugugcucuccc

SEQ ID NO: 2137459 - RNA, 17 nt, Homo sapiens
uucugcauacuaaccua

SEQ ID NO: 2137460 - RNA, 19 nt, Homo sapiens
aauggacacuuuucaccuc

SEQ ID NO: 2137461 - RNA, 15 nt, Homo sapiens
auauauucuuucaaa

SEQ ID NO: 2137462 - RNA, 15 nt, Homo sapiens
auuuccuuuuugaca

SEQ ID NO: 2137463 - RNA, 21 nt, Homo sapiens
gaaugugcucaugcauugcuu

SEQ ID NO: 2137464 - RNA, 12 nt, Homo sapiens
agaacagcauuu

SEQ ID NO: 2137465 - RNA, 18 nt, Homo sapiens
aagcaugugaaagugcac

SEQ ID NO: 2137466 - RNA, 12 nt, Homo sapiens
uaguugccuuaa

SEQ ID NO: 2137467 - RNA, 15 nt, Homo sapiens
agcaguacucugaag

SEQ ID NO: 2137468 - RNA, 12 nt, Homo sapiens
aagcagcauuug

SEQ ID NO: 2137469 - RNA, 13 nt, Homo sapiens
ugccaaaccuacu

SEQ ID NO: 2137470 - RNA, 23 nt, Homo sapiens
agagcuuugugcuugucauucca

SEQ ID NO: 2137471 - RNA, 20 nt, Homo sapiens
acauaagcucagaauccaag

SEQ ID NO: 2137472 - RNA, 21 nt, Homo sapiens
gcagagaccuugcgaccaugu

SEQ ID NO: 2137473 - RNA, 23 nt, Homo sapiens
caauuaggauuuugaugugacaa

SEQ ID NO: 2137474 - RNA, 13 nt, Homo sapiens
caauaaacccuca

SEQ ID NO: 2137475 - RNA, 19 nt, Homo sapiens
uaaaaauguuaaagaacug

SEQ ID NO: 2137476 - RNA, 16 nt, Homo sapiens
ugcaugauaagagcau

SEQ ID NO: 2137477 - RNA, 18 nt, Homo sapiens
guaccucuucccaugacu

SEQ ID NO: 2137478 - RNA, 20 nt, Homo sapiens
auaaacaaaguuacuaggua

SEQ ID NO: 2137479 - RNA, 20 nt, Homo sapiens
gcuuaucucccugcuucaua

SEQ ID NO: 2137480 - RNA, 22 nt, Homo sapiens
cccgcugccucuuggcuucuca

SEQ ID NO: 2137481 - RNA, 20 nt, Homo sapiens
uguggucugcugccucagga

SEQ ID NO: 2137482 - RNA, 22 nt, Homo sapiens
guaaccuccacaguagcauuuc

SEQ ID NO: 2137483 - RNA, 20 nt, Homo sapiens
cacuuugguauucaauuuga

SEQ ID NO: 2137484 - RNA, 23 nt, Homo sapiens
aaauagagcuuuuaaaaaugucc

SEQ ID NO: 2137485 - RNA, 13 nt, Homo sapiens
ccucucucuguaa

SEQ ID NO: 2137486 - RNA, 12 nt, Homo sapiens
cccuuuccuaaa

SEQ ID NO: 2137487 - RNA, 12 nt, Homo sapiens
cagcaccacagu

SEQ ID NO: 2137488 - RNA, 15 nt, Homo sapiens
acaagagucuguauu

SEQ ID NO: 2137489 - RNA, 16 nt, Homo sapiens
cagauggugggacacc

SEQ ID NO: 2137490 - RNA, 13 nt, Homo sapiens
ugaggcaggagaa

SEQ ID NO: 2137491 - RNA, 13 nt, Homo sapiens
gaaauguuagguu

SEQ ID NO: 2137492 - RNA, 13 nt, Homo sapiens
cguccuuuggacu

SEQ ID NO: 2137493 - RNA, 12 nt, Homo sapiens
ggccuugcucug

SEQ ID NO: 2137494 - RNA, 20 nt, Homo sapiens
uugagaugggggucucacca

SEQ ID NO: 2137495 - RNA, 13 nt, Homo sapiens
ucucauugccaag

SEQ ID NO: 2137496 - RNA, 16 nt, Homo sapiens
gccauaaccacauuua

SEQ ID NO: 2137497 - RNA, 16 nt, Homo sapiens
uguccccugacagggc

SEQ ID NO: 2137498 - RNA, 17 nt, Homo sapiens
aauauaauauuuacugu

SEQ ID NO: 2137499 - RNA, 16 nt, Homo sapiens
guaaccucuacaggca

SEQ ID NO: 2137500 - RNA, 23 nt, Homo sapiens
cuuacaguggagugagaucuuac

SEQ ID NO: 2137501 - RNA, 14 nt, Homo sapiens
cuaacaacugggaa

SEQ ID NO: 2137502 - RNA, 13 nt, Homo sapiens
uaauugauuucaa

SEQ ID NO: 2137503 - RNA, 12 nt, Homo sapiens
ucucuugugcau

SEQ ID NO: 2137504 - RNA, 23 nt, Homo sapiens
cucucugaauacccaaaacacac

SEQ ID NO: 2137505 - RNA, 19 nt, Homo sapiens
aauggaaaacugccuguuc

SEQ ID NO: 2137506 - RNA, 22 nt, Homo sapiens
gggaacagaaaaaauaaacuga

SEQ ID NO: 2137507 - RNA, 21 nt, Homo sapiens
uacucacccagggacuccagu

SEQ ID NO: 2137508 - RNA, 24 nt, Homo sapiens
gagugugugugaugggaucuguaa

SEQ ID NO: 2137509 - RNA, 19 nt, Homo sapiens
gcuggagugcaguggugcg

SEQ ID NO: 2137510 - RNA, 18 nt, Homo sapiens
aagcugcccucagccaga

SEQ ID NO: 2137511 - RNA, 12 nt, Homo sapiens
aauaucuuucag

SEQ ID NO: 2137512 - RNA, 19 nt, Homo sapiens
uaucgucuuccuacacaua

SEQ ID NO: 2137513 - RNA, 17 nt, Homo sapiens
auauaccuagauuccau

SEQ ID NO: 2137514 - RNA, 14 nt, Homo sapiens
uaagauuugcucau

SEQ ID NO: 2137515 - RNA, 23 nt, Homo sapiens
cuauccugggaggguguggugcu

SEQ ID NO: 2137516 - RNA, 12 nt, Homo sapiens
auugagauucau

SEQ ID NO: 2137517 - RNA, 22 nt, Homo sapiens
cagaaucccggcugucaagggg

SEQ ID NO: 2137518 - RNA, 19 nt, Homo sapiens
auagcuaaguacacaauaa

SEQ ID NO: 2137519 - RNA, 12 nt, Homo sapiens
caucaacaacac

SEQ ID NO: 2137520 - RNA, 23 nt, Homo sapiens
acucaugaauaauccaccccuug

SEQ ID NO: 2137521 - RNA, 14 nt, Homo sapiens
aggcacaagucaua

SEQ ID NO: 2137522 - RNA, 20 nt, Homo sapiens
cugcuggaaaccucaugcca

SEQ ID NO: 2137523 - RNA, 21 nt, Homo sapiens
ucucaaggauccagacucuca

SEQ ID NO: 2137524 - RNA, 20 nt, Homo sapiens
aggaucccccuucuugcccu

SEQ ID NO: 2137525 - RNA, 21 nt, Homo sapiens
acucuccccaguccucaggca

SEQ ID NO: 2137526 - RNA, 23 nt, Homo sapiens
caguauacucagcuaacaaaccu

SEQ ID NO: 2137527 - RNA, 22 nt, Homo sapiens
guaacuuaauuuuaauaccacu

SEQ ID NO: 2137528 - RNA, 23 nt, Homo sapiens
caacacugcugcuccagugcagg

SEQ ID NO: 2137529 - RNA, 23 nt, Homo sapiens
gauaauaguacaugucaccuuag

SEQ ID NO: 2137530 - RNA, 12 nt, Homo sapiens
aaagcuuccuuc

SEQ ID NO: 2137531 - RNA, 17 nt, Homo sapiens
guggcaaacaagcacac

SEQ ID NO: 2137532 - RNA, 15 nt, Homo sapiens
gacagccugcagcag

SEQ ID NO: 2137533 - RNA, 17 nt, Homo sapiens
caaagaagauaugcaaa

SEQ ID NO: 2137534 - RNA, 14 nt, Homo sapiens
gcuggcccugauga

SEQ ID NO: 2137535 - RNA, 14 nt, Homo sapiens
aaugcucaaucuca

SEQ ID NO: 2137536 - RNA, 14 nt, Homo sapiens
ccauccugaacugg

SEQ ID NO: 2137537 - RNA, 16 nt, Homo sapiens
auucauuguguuaccu

SEQ ID NO: 2137538 - RNA, 14 nt, Homo sapiens
uccugauagccugu

SEQ ID NO: 2137539 - RNA, 12 nt, Homo sapiens
cuuuauuuuggc

SEQ ID NO: 2137540 - RNA, 12 nt, Homo sapiens
gaagauguuugc

SEQ ID NO: 2137541 - RNA, 20 nt, Homo sapiens
uucuaacucauauguuccca

SEQ ID NO: 2137542 - RNA, 15 nt, Homo sapiens
ccuggcaagugaccc

SEQ ID NO: 2137543 - RNA, 17 nt, Homo sapiens
cugaagauagccagaga

SEQ ID NO: 2137544 - RNA, 20 nt, Homo sapiens
ggacuuguuuuccuguguuc

SEQ ID NO: 2137545 - RNA, 22 nt, Homo sapiens
cuggacagugacgaggacucuc

SEQ ID NO: 2137546 - RNA, 12 nt, Homo sapiens
cuggguggugga

SEQ ID NO: 2137547 - RNA, 18 nt, Homo sapiens
caagagugagacuccguc

SEQ ID NO: 2137548 - RNA, 17 nt, Homo sapiens
cccacagcuaccugaga

SEQ ID NO: 2137549 - RNA, 12 nt, Homo sapiens
ucauuacugcuu

SEQ ID NO: 2137550 - RNA, 15 nt, Homo sapiens
ucuggagcugagcua

SEQ ID NO: 2137551 - RNA, 13 nt, Homo sapiens
auuucaagaccuc

SEQ ID NO: 2137552 - RNA, 21 nt, Homo sapiens
cucucuggcuaaggacaggca

SEQ ID NO: 2137553 - RNA, 20 nt, Homo sapiens
uuacacauuucacugugaug

SEQ ID NO: 2137554 - RNA, 21 nt, Homo sapiens
caaauuuccuuucauaccuug

SEQ ID NO: 2137555 - RNA, 17 nt, Homo sapiens
gaccucaucucuacuaa

SEQ ID NO: 2137556 - RNA, 23 nt, Homo sapiens
cacagucgcucacaccuguaauc

SEQ ID NO: 2137557 - RNA, 18 nt, Homo sapiens
gcuuccucuagaagccaa

SEQ ID NO: 2137558 - RNA, 21 nt, Homo sapiens
uaccgaguucaagugauuuuc

SEQ ID NO: 2137559 - RNA, 15 nt, Homo sapiens
aucaguuacuaagaa

SEQ ID NO: 2137560 - RNA, 14 nt, Homo sapiens
caauacccuuguga

SEQ ID NO: 2137561 - RNA, 17 nt, Homo sapiens
ugaacaucauggacuga

SEQ ID NO: 2137562 - RNA, 21 nt, Homo sapiens
ggcgagccuggccaacauggu

SEQ ID NO: 2137563 - RNA, 17 nt, Homo sapiens
uacccgaaagcaucacu

SEQ ID NO: 2137564 - RNA, 15 nt, Homo sapiens
gaucugccugccuug

SEQ ID NO: 2137565 - RNA, 20 nt, Homo sapiens
cuaaaucccaagugucucuu

SEQ ID NO: 2137566 - RNA, 22 nt, Homo sapiens
uaaagucuguuucugcuuccuu

SEQ ID NO: 2137567 - RNA, 20 nt, Homo sapiens
gcaauggaagcccucaaaga

SEQ ID NO: 2137568 - RNA, 22 nt, Homo sapiens
gcagagguuugcugacagguga

SEQ ID NO: 2137569 - RNA, 22 nt, Homo sapiens
ggaagcaacagauagauguugc

SEQ ID NO: 2137570 - RNA, 13 nt, Homo sapiens
uuuucugaagaca

SEQ ID NO: 2137571 - RNA, 17 nt, Homo sapiens
agugccauuaaauugaa

SEQ ID NO: 2137572 - RNA, 23 nt, Homo sapiens
ugauauucaggcuacucauucag

SEQ ID NO: 2137573 - RNA, 20 nt, Homo sapiens
gucacaggggugucuugucu

SEQ ID NO: 2137574 - RNA, 14 nt, Homo sapiens
cucugagaucuaag

SEQ ID NO: 2137575 - RNA, 13 nt, Homo sapiens
gacaggaagcugg

SEQ ID NO: 2137576 - RNA, 15 nt, Homo sapiens
uaaagauauuuccaa

SEQ ID NO: 2137577 - RNA, 13 nt, Homo sapiens
ccuugugccuugg

SEQ ID NO: 2137578 - RNA, 21 nt, Homo sapiens
aaggaaacuggguuccugcaa

SEQ ID NO: 2137579 - RNA, 18 nt, Homo sapiens
cugaguacaaauguguga

SEQ ID NO: 2137580 - RNA, 15 nt, Homo sapiens
cucagaauccaaaga

SEQ ID NO: 2137581 - RNA, 14 nt, Homo sapiens
cuuucuuaauauca

SEQ ID NO: 2137582 - RNA, 13 nt, Homo sapiens
agcuucaucuuug

SEQ ID NO: 2137583 - RNA, 11 nt, Homo sapiens
guggacaugcg

SEQ ID NO: 2137584 - RNA, 13 nt, Homo sapiens
aacuccugagaaa

SEQ ID NO: 2137585 - RNA, 16 nt, Homo sapiens
uguuuggauuccucac

SEQ ID NO: 2137586 - RNA, 14 nt, Homo sapiens
aacccuugcuugca

SEQ ID NO: 2137587 - RNA, 16 nt, Homo sapiens
ugaggcuuuggcaaau

SEQ ID NO: 2137588 - RNA, 15 nt, Homo sapiens
ugucauagagcugca

SEQ ID NO: 2137589 - RNA, 19 nt, Homo sapiens
uugggagaaagagaaauca

SEQ ID NO: 2137590 - RNA, 19 nt, Homo sapiens
acuuggagaauacugccaa

SEQ ID NO: 2137591 - RNA, 18 nt, Homo sapiens
cucuggacagccagugac

SEQ ID NO: 2137592 - RNA, 17 nt, Homo sapiens
cacauucugcuaugaau

SEQ ID NO: 2137593 - RNA, 18 nt, Homo sapiens
cugcagacucacuguggg

SEQ ID NO: 2137594 - RNA, 17 nt, Homo sapiens
ugaggucucuguggcag

SEQ ID NO: 2137595 - RNA, 22 nt, Homo sapiens
acucaaagggagaggucucagu

SEQ ID NO: 2137596 - RNA, 15 nt, Homo sapiens
accagaacagcaugg

SEQ ID NO: 2137597 - RNA, 21 nt, Homo sapiens
auaaugccauuuuaaggaaaa

SEQ ID NO: 2137598 - RNA, 13 nt, Homo sapiens
agaucagacucug

SEQ ID NO: 2137599 - RNA, 13 nt, Homo sapiens
cugcuucauggga

SEQ ID NO: 2137600 - RNA, 15 nt, Homo sapiens
uucuagaacaccugc

SEQ ID NO: 2137601 - RNA, 23 nt, Homo sapiens
ugcauuguaggauguugagcagc

SEQ ID NO: 2137602 - RNA, 14 nt, Homo sapiens
ccuaaguacuguaa

SEQ ID NO: 2137603 - RNA, 19 nt, Homo sapiens
uaacagcaggguaccugaa

SEQ ID NO: 2137604 - RNA, 18 nt, Homo sapiens
ccuuguguccacugugac

SEQ ID NO: 2137605 - RNA, 13 nt, Homo sapiens
uuguuauguacaa

SEQ ID NO: 2137606 - RNA, 18 nt, Homo sapiens
cuuaucuuacaauauuga

SEQ ID NO: 2137607 - RNA, 19 nt, Homo sapiens
cccucuggucuacucuaga

SEQ ID NO: 2137608 - RNA, 21 nt, Homo sapiens
acuucccagagaguaucugag

SEQ ID NO: 2137609 - RNA, 18 nt, Homo sapiens
agaaagugaagcaaauca

SEQ ID NO: 2137610 - RNA, 20 nt, Homo sapiens
agggcauuguguucacugua

SEQ ID NO: 2137611 - RNA, 21 nt, Homo sapiens
aaacuucuuuaaaaaaacaca

SEQ ID NO: 2137612 - RNA, 14 nt, Homo sapiens
cagauaacugagga

SEQ ID NO: 2137613 - RNA, 14 nt, Homo sapiens
cuaugcugugcucc

SEQ ID NO: 2137614 - RNA, 16 nt, Homo sapiens
uucaaaacugccauua

SEQ ID NO: 2137615 - RNA, 18 nt, Homo sapiens
cugugacuucuccagguc

SEQ ID NO: 2137616 - RNA, 13 nt, Homo sapiens
cucaagugagcca

SEQ ID NO: 2137617 - RNA, 15 nt, Homo sapiens
aaaaccuaggauuug

SEQ ID NO: 2137618 - RNA, 21 nt, Homo sapiens
auuuuagagcaucucauuuau

SEQ ID NO: 2137619 - RNA, 19 nt, Homo sapiens
ucaggcccaggaguccagg

SEQ ID NO: 2137620 - RNA, 21 nt, Homo sapiens
uuaguaagugcuuguuuuaca

SEQ ID NO: 2137621 - RNA, 17 nt, Homo sapiens
cgggcccuggagcucaa

SEQ ID NO: 2137622 - RNA, 17 nt, Homo sapiens
cauccuggccuggcaca

SEQ ID NO: 2137623 - RNA, 13 nt, Homo sapiens
ggaggguggcaag

SEQ ID NO: 2137624 - RNA, 17 nt, Homo sapiens
gauauaugacugcuuca

SEQ ID NO: 2137625 - RNA, 21 nt, Homo sapiens
aucacugauucccucucccac

SEQ ID NO: 2137626 - RNA, 15 nt, Homo sapiens
acauaaucacaauaa

SEQ ID NO: 2137627 - RNA, 18 nt, Homo sapiens
agauuuacacugggagag

SEQ ID NO: 2137628 - RNA, 16 nt, Homo sapiens
aaaugcaauauagaaa

SEQ ID NO: 2137629 - RNA, 15 nt, Homo sapiens
uacuuaaagcuucua

SEQ ID NO: 2137630 - RNA, 17 nt, Homo sapiens
uuuaagaguagauugau

SEQ ID NO: 2137631 - RNA, 22 nt, Homo sapiens
gucugugaaagucuccuguauc

SEQ ID NO: 2137632 - RNA, 12 nt, Homo sapiens
gggccugggauu

SEQ ID NO: 2137633 - RNA, 12 nt, Homo sapiens
gggucugggauc

SEQ ID NO: 2137634 - RNA, 17 nt, Homo sapiens
cuguaugccaagugaaa

SEQ ID NO: 2137635 - RNA, 22 nt, Homo sapiens
gcuuuaucaaaaaguacaauaa

SEQ ID NO: 2137636 - RNA, 19 nt, Homo sapiens
ucaaacacaguuacacuug

SEQ ID NO: 2137637 - RNA, 22 nt, Homo sapiens
agacuucaagauccucuugcca

SEQ ID NO: 2137638 - RNA, 22 nt, Homo sapiens
uugacugauuguuuuaaacaac

SEQ ID NO: 2137639 - RNA, 20 nt, Homo sapiens
ucugggcuuggggcuuccua

SEQ ID NO: 2137640 - RNA, 17 nt, Homo sapiens
agaaauaaaauauggac

SEQ ID NO: 2137641 - RNA, 23 nt, Homo sapiens
ccuaauucucuucgcugugaugc

SEQ ID NO: 2137642 - RNA, 17 nt, Homo sapiens
acaaauuuggccuuaag

SEQ ID NO: 2137643 - RNA, 14 nt, Homo sapiens
auacuccacuccaa

SEQ ID NO: 2137644 - RNA, 13 nt, Homo sapiens
ucuagagcaaagc

SEQ ID NO: 2137645 - RNA, 17 nt, Homo sapiens
agacuugauggacaaac

SEQ ID NO: 2137646 - RNA, 18 nt, Homo sapiens
agccuggccaacauggug

SEQ ID NO: 2137647 - RNA, 18 nt, Homo sapiens
uuaggauuuucacauucu

SEQ ID NO: 2137648 - RNA, 16 nt, Homo sapiens
cuagugauuucugggg

SEQ ID NO: 2137649 - RNA, 14 nt, Homo sapiens
gugugugcacaucc

SEQ ID NO: 2137650 - RNA, 20 nt, Homo sapiens
cauguugaagccacugccuu

SEQ ID NO: 2137651 - RNA, 22 nt, Homo sapiens
ggaguguugggcaugugaucac

SEQ ID NO: 2137652 - RNA, 23 nt, Homo sapiens
ucgauugaaauuuugcaccagcg

SEQ ID NO: 2137653 - RNA, 16 nt, Homo sapiens
guaaaauggagacacc

SEQ ID NO: 2137654 - RNA, 18 nt, Homo sapiens
guuucucugccuccaggu

SEQ ID NO: 2137655 - RNA, 22 nt, Homo sapiens
ucaaugaagauuuuuaauuaca

SEQ ID NO: 2137656 - RNA, 17 nt, Homo sapiens
agaauaaauguuuuaca

SEQ ID NO: 2137657 - RNA, 15 nt, Homo sapiens
cuugaggugaaaugg

SEQ ID NO: 2137658 - RNA, 23 nt, Homo sapiens
gaggucagggagugcuggcucac

SEQ ID NO: 2137659 - RNA, 12 nt, Homo sapiens
cuuuuuccucug

SEQ ID NO: 2137660 - RNA, 14 nt, Homo sapiens
gccaaagacuguaa

SEQ ID NO: 2137661 - RNA, 23 nt, Homo sapiens
guugauauauucuuuccaugcag

SEQ ID NO: 2137662 - RNA, 18 nt, Homo sapiens
aagagacaagaucuugaa

SEQ ID NO: 2137663 - RNA, 16 nt, Homo sapiens
cuuccccugggcaaga

SEQ ID NO: 2137664 - RNA, 15 nt, Homo sapiens
auggcgugaucucag

SEQ ID NO: 2137665 - RNA, 11 nt, Homo sapiens
ugaagccacac

SEQ ID NO: 2137666 - RNA, 13 nt, Homo sapiens
acuuuagcugcau

SEQ ID NO: 2137667 - RNA, 18 nt, Homo sapiens
uccaucucaagugccaua

SEQ ID NO: 2137668 - RNA, 13 nt, Homo sapiens
ugcagggacucca

SEQ ID NO: 2137669 - RNA, 13 nt, Homo sapiens
aaaaaaaauacuu

SEQ ID NO: 2137670 - RNA, 13 nt, Homo sapiens
ugaaaaaaagcuu

SEQ ID NO: 2137671 - RNA, 16 nt, Homo sapiens
cugucacagaguagaa

SEQ ID NO: 2137672 - RNA, 17 nt, Homo sapiens
gaauuaauuuucagcca

SEQ ID NO: 2137673 - RNA, 18 nt, Homo sapiens
aucacccagaugaugucc

SEQ ID NO: 2137674 - RNA, 17 nt, Homo sapiens
uauuuuuuuaagcugua

SEQ ID NO: 2137675 - RNA, 17 nt, Homo sapiens
cucuuuauucuggaguc

SEQ ID NO: 2137676 - RNA, 12 nt, Homo sapiens
acggggugucau

SEQ ID NO: 2137677 - RNA, 21 nt, Homo sapiens
agucaaggacgaauuugcaca

SEQ ID NO: 2137678 - RNA, 20 nt, Homo sapiens
guucuauuuaacaacugggu

SEQ ID NO: 2137679 - RNA, 16 nt, Homo sapiens
aauguucuaacagauc

SEQ ID NO: 2137680 - RNA, 15 nt, Homo sapiens
gacuuguuucuccau

SEQ ID NO: 2137681 - RNA, 17 nt, Homo sapiens
acacguuuagaaaugau

SEQ ID NO: 2137682 - RNA, 17 nt, Homo sapiens
caggagcauggggauaa

SEQ ID NO: 2137683 - RNA, 16 nt, Homo sapiens
accaaugagccuuagu

SEQ ID NO: 2137684 - RNA, 15 nt, Homo sapiens
uuagaauucugagau

SEQ ID NO: 2137685 - RNA, 17 nt, Homo sapiens
cuguuuaucaagccaua

SEQ ID NO: 2137686 - RNA, 19 nt, Homo sapiens
uucccaucgcugucacagg

SEQ ID NO: 2137687 - RNA, 18 nt, Homo sapiens
cuuaaguuuuacuugagg

SEQ ID NO: 2137688 - RNA, 21 nt, Homo sapiens
caugcucagcacauauuugca

SEQ ID NO: 2137689 - RNA, 15 nt, Homo sapiens
ccacucaggucugua

SEQ ID NO: 2137690 - RNA, 19 nt, Homo sapiens
uucugcuaccucacugggg

SEQ ID NO: 2137691 - RNA, 18 nt, Homo sapiens
aaucacuuuaagaucuuu

SEQ ID NO: 2137692 - RNA, 18 nt, Homo sapiens
cgacuuauuuuguugaaa

SEQ ID NO: 2137693 - RNA, 15 nt, Homo sapiens
aauccugcaaugaaa

SEQ ID NO: 2137694 - RNA, 17 nt, Homo sapiens
cauugauccagucauuu

SEQ ID NO: 2137695 - RNA, 18 nt, Homo sapiens
cuggaacuccuaaaccuu

SEQ ID NO: 2137696 - RNA, 15 nt, Homo sapiens
cccuggccaccccau

SEQ ID NO: 2137697 - RNA, 16 nt, Homo sapiens
uuacuauucccacuuu

SEQ ID NO: 2137698 - RNA, 13 nt, Homo sapiens
gugagaccaccuc

SEQ ID NO: 2137699 - RNA, 18 nt, Homo sapiens
auccucugggagcuucuu

SEQ ID NO: 2137700 - RNA, 17 nt, Homo sapiens
acugccaggcuguuuca

SEQ ID NO: 2137701 - RNA, 19 nt, Homo sapiens
gcacuaaauaaacuacuuu

SEQ ID NO: 2137702 - RNA, 14 nt, Homo sapiens
acccuccucaagaa

SEQ ID NO: 2137703 - RNA, 15 nt, Homo sapiens
aacauaaguuaucau

SEQ ID NO: 2137704 - RNA, 21 nt, Homo sapiens
ggagcugucaccucucagcug

SEQ ID NO: 2137705 - RNA, 18 nt, Homo sapiens
ucuuuggcuucagaauug

SEQ ID NO: 2137706 - RNA, 19 nt, Homo sapiens
cuggcccuguuucuggucu

SEQ ID NO: 2137707 - RNA, 12 nt, Homo sapiens
ucucaaacuuca

SEQ ID NO: 2137708 - RNA, 20 nt, Homo sapiens
uuuuuuauaaucaagccuaa

SEQ ID NO: 2137709 - RNA, 14 nt, Homo sapiens
cgggggaaagcaca

SEQ ID NO: 2137710 - RNA, 20 nt, Homo sapiens
ucauaauuguugaccuaaga

SEQ ID NO: 2137711 - RNA, 19 nt, Homo sapiens
acuauaucuguuuuacugc

SEQ ID NO: 2137712 - RNA, 18 nt, Homo sapiens
guaacucccaucaccucu

SEQ ID NO: 2137713 - RNA, 17 nt, Homo sapiens
ccagagaccaaauguca

SEQ ID NO: 2137714 - RNA, 21 nt, Homo sapiens
aacaaacauuguguugacauu

SEQ ID NO: 2137715 - RNA, 14 nt, Homo sapiens
gaaagcaauauuau

SEQ ID NO: 2137716 - RNA, 15 nt, Homo sapiens
uuguaacuugccauc

SEQ ID NO: 2137717 - RNA, 13 nt, Homo sapiens
uccuuacucugag

SEQ ID NO: 2137718 - RNA, 20 nt, Homo sapiens
agaggugacccaaugcuccu

SEQ ID NO: 2137719 - RNA, 19 nt, Homo sapiens
ugcauagcuuugcacuuca

SEQ ID NO: 2137720 - RNA, 17 nt, Homo sapiens
cuagacuuagauucauu

SEQ ID NO: 2137721 - RNA, 19 nt, Homo sapiens
aagcccauggcugguggca

SEQ ID NO: 2137722 - RNA, 11 nt, Homo sapiens
ccgaaggugac

SEQ ID NO: 2137723 - RNA, 16 nt, Homo sapiens
gugccaggugaucucc

SEQ ID NO: 2137724 - RNA, 20 nt, Homo sapiens
cagcaacggggaggccaagu

SEQ ID NO: 2137725 - RNA, 14 nt, Homo sapiens
gcacauguguucag

SEQ ID NO: 2137726 - RNA, 18 nt, Homo sapiens
gugagaaauuucugugaa

SEQ ID NO: 2137727 - RNA, 15 nt, Homo sapiens
uguucaucugugcac

SEQ ID NO: 2137728 - RNA, 15 nt, Homo sapiens
ucaucuucucagcuc

SEQ ID NO: 2137729 - RNA, 19 nt, Homo sapiens
acaccggcuuaacacuauc

SEQ ID NO: 2137730 - RNA, 18 nt, Homo sapiens
aaacuuaugcuaguuuau

SEQ ID NO: 2137731 - RNA, 19 nt, Homo sapiens
gccucaggccuggcccuuu

SEQ ID NO: 2137732 - RNA, 19 nt, Homo sapiens
augagcucugaacaaacac

SEQ ID NO: 2137733 - RNA, 21 nt, Homo sapiens
uugaauggagauucugauuca

SEQ ID NO: 2137734 - RNA, 19 nt, Homo sapiens
aucuuuuuuuuauuccaca

SEQ ID NO: 2137735 - RNA, 19 nt, Homo sapiens
ugccaauacagacaaagca

SEQ ID NO: 2137736 - RNA, 20 nt, Homo sapiens
ucccaaaguguuaggauuac

SEQ ID NO: 2137737 - RNA, 19 nt, Homo sapiens
gaugaagaggguagagugg

SEQ ID NO: 2137738 - RNA, 13 nt, Homo sapiens
auuacuaauuaau

SEQ ID NO: 2137739 - RNA, 13 nt, Homo sapiens
ucauuuaaacuuc

SEQ ID NO: 2137740 - RNA, 16 nt, Homo sapiens
caaggaaguagaaaca

SEQ ID NO: 2137741 - RNA, 20 nt, Homo sapiens
aacacuaccaauuucccauu

SEQ ID NO: 2137742 - RNA, 18 nt, Homo sapiens
gcccuuuggaaagccauu

SEQ ID NO: 2137743 - RNA, 12 nt, Homo sapiens
cuugugugcaaa

SEQ ID NO: 2137744 - RNA, 16 nt, Homo sapiens
uaauuggcccaaguca

SEQ ID NO: 2137745 - RNA, 15 nt, Homo sapiens
accuucccccaacua

SEQ ID NO: 2137746 - RNA, 12 nt, Homo sapiens
acuguggaauau

SEQ ID NO: 2137747 - RNA, 20 nt, Homo sapiens
uugugagcacucuacugcaa

SEQ ID NO: 2137748 - RNA, 13 nt, Homo sapiens
caagugucuucca

SEQ ID NO: 2137749 - RNA, 14 nt, Homo sapiens
cuaccugagcaaca

SEQ ID NO: 2137750 - RNA, 16 nt, Homo sapiens
ggagcagaggaauuau

SEQ ID NO: 2137751 - RNA, 14 nt, Homo sapiens
aguugccagucacc

SEQ ID NO: 2137752 - RNA, 23 nt, Homo sapiens
uucuccuuuuauucucuguauug

SEQ ID NO: 2137753 - RNA, 15 nt, Homo sapiens
auucuacuugcucug

SEQ ID NO: 2137754 - RNA, 22 nt, Homo sapiens
agcaaggggcugcuucuggggc

SEQ ID NO: 2137755 - RNA, 17 nt, Homo sapiens
gaacugaaucacuuaaa

SEQ ID NO: 2137756 - RNA, 16 nt, Homo sapiens
agauuuuguuagccaa

SEQ ID NO: 2137757 - RNA, 21 nt, Homo sapiens
augaaauccagugagcacuag

SEQ ID NO: 2137758 - RNA, 18 nt, Homo sapiens
gagccuccugacccugug

SEQ ID NO: 2137759 - RNA, 15 nt, Homo sapiens
ugagugugacuaugu

SEQ ID NO: 2137760 - RNA, 17 nt, Homo sapiens
gaauaaacuggcagcuc

SEQ ID NO: 2137761 - RNA, 14 nt, Homo sapiens
aaugucccagaggc

SEQ ID NO: 2137762 - RNA, 21 nt, Homo sapiens
aauuuuauuuuuuuucuguaa

SEQ ID NO: 2137763 - RNA, 12 nt, Homo sapiens
aauggaaaguug

SEQ ID NO: 2137764 - RNA, 11 nt, Homo sapiens
uugcaaccagg

SEQ ID NO: 2137765 - RNA, 20 nt, Homo sapiens
cccuggggagucugggcaca

SEQ ID NO: 2137766 - RNA, 16 nt, Homo sapiens
aagaaaauggauuuaa

SEQ ID NO: 2137767 - RNA, 16 nt, Homo sapiens
uauuguacugcacaaa

SEQ ID NO: 2137768 - RNA, 14 nt, Homo sapiens
caagcgugauuccu

SEQ ID NO: 2137769 - RNA, 19 nt, Homo sapiens
gugcaguggcgcauucuag

SEQ ID NO: 2137770 - RNA, 22 nt, Homo sapiens
uaaauguuauagcugcauuugu

SEQ ID NO: 2137771 - RNA, 13 nt, Homo sapiens
gaacuaacaugca

SEQ ID NO: 2137772 - RNA, 14 nt, Homo sapiens
ugaaguacauauua

SEQ ID NO: 2137773 - RNA, 15 nt, Homo sapiens
cauuccuucacauag

SEQ ID NO: 2137774 - RNA, 13 nt, Homo sapiens
ggcuacucugugc

SEQ ID NO: 2137775 - RNA, 22 nt, Homo sapiens
gaaacaacaauuucuacuuuga

SEQ ID NO: 2137776 - RNA, 23 nt, Homo sapiens
uccuagaaaguucuguguaaaca

SEQ ID NO: 2137777 - RNA, 22 nt, Homo sapiens
augccucagaggguagccuuga

SEQ ID NO: 2137778 - RNA, 22 nt, Homo sapiens
acccaguccgccaaacacucca

SEQ ID NO: 2137779 - RNA, 14 nt, Homo sapiens
cuuucaaugcaguu

SEQ ID NO: 2137780 - RNA, 20 nt, Homo sapiens
aagcgagaucccaucucuac

SEQ ID NO: 2137781 - RNA, 21 nt, Homo sapiens
gccaaucuggcccuuacacac

SEQ ID NO: 2137782 - RNA, 18 nt, Homo sapiens
auguauaccaaggcaaaa

SEQ ID NO: 2137783 - RNA, 15 nt, Homo sapiens
cuggccuuucacuuu

SEQ ID NO: 2137784 - RNA, 21 nt, Homo sapiens
agauuugcuguucacccacau

SEQ ID NO: 2137785 - RNA, 20 nt, Homo sapiens
aaaggggcccaagccccauc

SEQ ID NO: 2137786 - RNA, 19 nt, Homo sapiens
uaaaacuaugguucccaau

SEQ ID NO: 2137787 - RNA, 16 nt, Homo sapiens
ugaugggucccaaaag

SEQ ID NO: 2137788 - RNA, 19 nt, Homo sapiens
uccucaguuuacaucuugu

SEQ ID NO: 2137789 - RNA, 17 nt, Homo sapiens
caguaagucacaguuau

SEQ ID NO: 2137790 - RNA, 21 nt, Homo sapiens
cccuuuuccuccagacagaua

SEQ ID NO: 2137791 - RNA, 21 nt, Homo sapiens
cagaaagugugcuuuaugcug

SEQ ID NO: 2137792 - RNA, 16 nt, Homo sapiens
cuugccgaaacuggaa

SEQ ID NO: 2137793 - RNA, 22 nt, Homo sapiens
gaaagagcuggcaaacugugaa

SEQ ID NO: 2137794 - RNA, 16 nt, Homo sapiens
cagaccacugucucca

SEQ ID NO: 2137795 - RNA, 21 nt, Homo sapiens
acaucuccccucucaccucau

SEQ ID NO: 2137796 - RNA, 15 nt, Homo sapiens
uucggguuggcaaaa

SEQ ID NO: 2137797 - RNA, 13 nt, Homo sapiens
uaugacugauuac

SEQ ID NO: 2137798 - RNA, 21 nt, Homo sapiens
cauuuugcauuagacagauga

SEQ ID NO: 2137799 - RNA, 22 nt, Homo sapiens
uuugguuuuacauuuuaguuac

SEQ ID NO: 2137800 - RNA, 18 nt, Homo sapiens
uacuaaauaaacaucuga

SEQ ID NO: 2137801 - RNA, 21 nt, Homo sapiens
uauuuuaaaaauaaauucaaa

SEQ ID NO: 2137802 - RNA, 15 nt, Homo sapiens
uggccucccacagac

SEQ ID NO: 2137803 - RNA, 18 nt, Homo sapiens
aaagcagacccaccuccc

SEQ ID NO: 2137804 - RNA, 22 nt, Homo sapiens
agauguugaauucuuuugccaa

SEQ ID NO: 2137805 - RNA, 13 nt, Homo sapiens
guaaaggcauugu

SEQ ID NO: 2137806 - RNA, 20 nt, Homo sapiens
aauguaccuucuuucacucu

SEQ ID NO: 2137807 - RNA, 18 nt, Homo sapiens
ccuugugcuccugccagc

SEQ ID NO: 2137808 - RNA, 16 nt, Homo sapiens
uaccucuuauugcaaa

SEQ ID NO: 2137809 - RNA, 16 nt, Homo sapiens
agaaaugccccagugu

SEQ ID NO: 2137810 - RNA, 14 nt, Homo sapiens
accaggauggucuc

SEQ ID NO: 2137811 - RNA, 17 nt, Homo sapiens
caagcucaaaaggguuu

SEQ ID NO: 2137812 - RNA, 23 nt, Homo sapiens
ccuguucuuccuccagcugcacc

SEQ ID NO: 2137813 - RNA, 18 nt, Homo sapiens
cuucuuuacuuaguucaa

SEQ ID NO: 2137814 - RNA, 23 nt, Homo sapiens
uuuuuguuuuuaaauaaagcauc

SEQ ID NO: 2137815 - RNA, 19 nt, Homo sapiens
gacauuucuccaaagaaga

SEQ ID NO: 2137816 - RNA, 19 nt, Homo sapiens
cugaccaaagagaagcaaa

SEQ ID NO: 2137817 - RNA, 20 nt, Homo sapiens
cacucucccaccuccuggug

SEQ ID NO: 2137818 - RNA, 17 nt, Homo sapiens
cauuucccccaccccau

SEQ ID NO: 2137819 - RNA, 19 nt, Homo sapiens
uguggaauaauacauacua

SEQ ID NO: 2137820 - RNA, 19 nt, Homo sapiens
guaauggaacuuagccauu

SEQ ID NO: 2137821 - RNA, 20 nt, Homo sapiens
gagcuuuuaaaaauguccug

SEQ ID NO: 2137822 - RNA, 14 nt, Homo sapiens
uagccaggcucucu

SEQ ID NO: 2137823 - RNA, 22 nt, Homo sapiens
cuugcccagggccacagagcua

SEQ ID NO: 2137824 - RNA, 15 nt, Homo sapiens
aaugaccaaauccau

SEQ ID NO: 2137825 - RNA, 16 nt, Homo sapiens
acaaccuauguaauuu

SEQ ID NO: 2137826 - RNA, 21 nt, Homo sapiens
aagagaaugaaauugcugaaa

SEQ ID NO: 2137827 - RNA, 18 nt, Homo sapiens
gcaaugcuucugccucag

SEQ ID NO: 2137828 - RNA, 20 nt, Homo sapiens
uggucgucaacuuuccucaa

SEQ ID NO: 2137829 - RNA, 14 nt, Homo sapiens
uacaauuuaaugca

SEQ ID NO: 2137830 - RNA, 14 nt, Homo sapiens
ggcccuggcuuccc

SEQ ID NO: 2137831 - RNA, 19 nt, Homo sapiens
uuggaugcggccauucaag

SEQ ID NO: 2137832 - RNA, 12 nt, Homo sapiens
uaaaaaugcaaa

SEQ ID NO: 2137833 - RNA, 11 nt, Homo sapiens
uguaauacugu

SEQ ID NO: 2137834 - RNA, 21 nt, Homo sapiens
ccuccaccugcucugugccca

SEQ ID NO: 2137835 - RNA, 14 nt, Homo sapiens
auuccgcaccaaua

SEQ ID NO: 2137836 - RNA, 21 nt, Homo sapiens
cuccgcauccuccuccugcuu

SEQ ID NO: 2137837 - RNA, 17 nt, Homo sapiens
cauccauagcaccucca

SEQ ID NO: 2137838 - RNA, 19 nt, Homo sapiens
gacccuucccagcccucau

SEQ ID NO: 2137839 - RNA, 16 nt, Homo sapiens
aaacuaacaauucaag

SEQ ID NO: 2137840 - RNA, 13 nt, Homo sapiens
auacacacacaca

SEQ ID NO: 2137841 - RNA, 13 nt, Homo sapiens
auaaacacacaaa

SEQ ID NO: 2137842 - RNA, 21 nt, Homo sapiens
ugaauuauguuauuugcucua

SEQ ID NO: 2137843 - RNA, 18 nt, Homo sapiens
uggguugagccucagaau

SEQ ID NO: 2137844 - RNA, 23 nt, Homo sapiens
aaauuuccaguaccuuugucaca

SEQ ID NO: 2137845 - RNA, 13 nt, Homo sapiens
cuuuuccaaacac

SEQ ID NO: 2137846 - RNA, 18 nt, Homo sapiens
cagacuguaggauuugaa

SEQ ID NO: 2137847 - RNA, 16 nt, Homo sapiens
cucauuugaaugcuua

SEQ ID NO: 2137848 - RNA, 18 nt, Homo sapiens
auaagauuuaauucacau

SEQ ID NO: 2137849 - RNA, 14 nt, Homo sapiens
ugcucauguguaca

SEQ ID NO: 2137850 - RNA, 23 nt, Homo sapiens
gucagcacguaguuugcauucca

SEQ ID NO: 2137851 - RNA, 21 nt, Homo sapiens
uacagauagaaaauaugauau

SEQ ID NO: 2137852 - RNA, 19 nt, Homo sapiens
gaaaaauuuuuuucuuuga

SEQ ID NO: 2137853 - RNA, 22 nt, Homo sapiens
aaagaugguuuaugcauguaua

SEQ ID NO: 2137854 - RNA, 21 nt, Homo sapiens
aaaucauuguauggauaguaa

SEQ ID NO: 2137855 - RNA, 22 nt, Homo sapiens
aaauccagcuucauaauuucca

SEQ ID NO: 2137856 - RNA, 18 nt, Homo sapiens
cuugggaagacuccuagc

SEQ ID NO: 2137857 - RNA, 15 nt, Homo sapiens
ccaacuccaggguua

SEQ ID NO: 2137858 - RNA, 23 nt, Homo sapiens
ccuaaauguaaucacgaguaaga

SEQ ID NO: 2137859 - RNA, 21 nt, Homo sapiens
gauuuugcuuuucccuagugc

SEQ ID NO: 2137860 - RNA, 13 nt, Homo sapiens
cagcaucuuugcc

SEQ ID NO: 2137861 - RNA, 20 nt, Homo sapiens
gaaauauuuagaagugcuaa

SEQ ID NO: 2137862 - RNA, 20 nt, Homo sapiens
agaggaaaaaggcuucucca

SEQ ID NO: 2137863 - RNA, 21 nt, Homo sapiens
caaaaaagguaacuaacugcu

SEQ ID NO: 2137864 - RNA, 10 nt, Homo sapiens
ucaucuuccc

SEQ ID NO: 2137865 - RNA, 20 nt, Homo sapiens
ucugccuguggaguagccau

SEQ ID NO: 2137866 - RNA, 14 nt, Homo sapiens
ggcuuggaccacuu

SEQ ID NO: 2137867 - RNA, 14 nt, Homo sapiens
ucucauggcuuuga

SEQ ID NO: 2137868 - RNA, 16 nt, Homo sapiens
uugucauaaaaugcau

SEQ ID NO: 2137869 - RNA, 20 nt, Homo sapiens
ugauaacaacccaaggcaau

SEQ ID NO: 2137870 - RNA, 18 nt, Homo sapiens
cugagggucgugggaaag

SEQ ID NO: 2137871 - RNA, 14 nt, Homo sapiens
aauguuugcauaaa

SEQ ID NO: 2137872 - RNA, 14 nt, Homo sapiens
acuuuuauaaugaa

SEQ ID NO: 2137873 - RNA, 17 nt, Homo sapiens
ccucagagcuaacauaa

SEQ ID NO: 2137874 - RNA, 19 nt, Homo sapiens
agaaagcaccgacaaucuu

SEQ ID NO: 2137875 - RNA, 21 nt, Homo sapiens
cuagaaaauuagacugugauu

SEQ ID NO: 2137876 - RNA, 10 nt, Homo sapiens
agaagggaug

SEQ ID NO: 2137877 - RNA, 22 nt, Homo sapiens
acuggcuucucuuucucugagu

SEQ ID NO: 2137878 - RNA, 17 nt, Homo sapiens
aaaccaccgugaaccag

SEQ ID NO: 2137879 - RNA, 12 nt, Homo sapiens
ugguuaccucug

SEQ ID NO: 2137880 - RNA, 12 nt, Homo sapiens
agacuuacugca

SEQ ID NO: 2137881 - RNA, 14 nt, Homo sapiens
auuauccuugcuau

SEQ ID NO: 2137882 - RNA, 19 nt, Homo sapiens
cuggaugggacaacuguag

SEQ ID NO: 2137883 - RNA, 17 nt, Homo sapiens
auucagaauaaaugggu

SEQ ID NO: 2137884 - RNA, 14 nt, Homo sapiens
ucaccccugagcag

SEQ ID NO: 2137885 - RNA, 13 nt, Homo sapiens
ggacaucuguucu

SEQ ID NO: 2137886 - RNA, 22 nt, Homo sapiens
aacuucaccuacauuaucucac

SEQ ID NO: 2137887 - RNA, 15 nt, Homo sapiens
cugagcuuuccagcc

SEQ ID NO: 2137888 - RNA, 17 nt, Homo sapiens
auuucccccgagcucuu

SEQ ID NO: 2137889 - RNA, 20 nt, Homo sapiens
uaaugaguuuuacauuacaa

SEQ ID NO: 2137890 - RNA, 17 nt, Homo sapiens
gcuguuuguuccaggcu

SEQ ID NO: 2137891 - RNA, 22 nt, Homo sapiens
aggcuucauugcacugaucuua

SEQ ID NO: 2137892 - RNA, 15 nt, Homo sapiens
uacaaaguacagaaa

SEQ ID NO: 2137893 - RNA, 18 nt, Homo sapiens
cuagaggugagaccaaag

SEQ ID NO: 2137894 - RNA, 18 nt, Homo sapiens
gagguaaucgccaaauag

SEQ ID NO: 2137895 - RNA, 17 nt, Homo sapiens
ucaauuuaauucuuauu

SEQ ID NO: 2137896 - RNA, 12 nt, Homo sapiens
ugcagggcucag

SEQ ID NO: 2137897 - RNA, 14 nt, Homo sapiens
uguccucgcacugc

SEQ ID NO: 2137898 - RNA, 16 nt, Homo sapiens
acuuccuggacaagau

SEQ ID NO: 2137899 - RNA, 18 nt, Homo sapiens
aggaguauaccaugagau

SEQ ID NO: 2137900 - RNA, 17 nt, Homo sapiens
aacuaagaaauaugcac

SEQ ID NO: 2137901 - RNA, 17 nt, Homo sapiens
cacucuucccaccucag

SEQ ID NO: 2137902 - RNA, 13 nt, Homo sapiens
uaaacuacugauu

SEQ ID NO: 2137903 - RNA, 15 nt, Homo sapiens
cagucccaugcacaa

SEQ ID NO: 2137904 - RNA, 15 nt, Homo sapiens
uggugacacacagca

SEQ ID NO: 2137905 - RNA, 18 nt, Homo sapiens
acaauagugauugauaga

SEQ ID NO: 2137906 - RNA, 17 nt, Homo sapiens
ggagacacuguucccaa

SEQ ID NO: 2137907 - RNA, 13 nt, Homo sapiens
agaaugugauucc

SEQ ID NO: 2137908 - RNA, 14 nt, Homo sapiens
gcuauuugucaucu

SEQ ID NO: 2137909 - RNA, 22 nt, Homo sapiens
ucacaugaaggagacagcagca

SEQ ID NO: 2137910 - RNA, 21 nt, Homo sapiens
ggacagugauuuucaaaacca

SEQ ID NO: 2137911 - RNA, 13 nt, Homo sapiens
ccaaucugcauuu

SEQ ID NO: 2137912 - RNA, 13 nt, Homo sapiens
cauugcugccaag

SEQ ID NO: 2137913 - RNA, 14 nt, Homo sapiens
cucuuuguccccaa

SEQ ID NO: 2137914 - RNA, 17 nt, Homo sapiens
aauuuaucaacugucaa

SEQ ID NO: 2137915 - RNA, 14 nt, Homo sapiens
uccuaccacucuaa

SEQ ID NO: 2137916 - RNA, 23 nt, Homo sapiens
gaaaugccuaagaagaugacuuc

SEQ ID NO: 2137917 - RNA, 22 nt, Homo sapiens
gaaacugcuugagcaucaggau

SEQ ID NO: 2137918 - RNA, 15 nt, Homo sapiens
uauuacgugcaauac

SEQ ID NO: 2137919 - RNA, 11 nt, Homo sapiens
auuacugagag

SEQ ID NO: 2137920 - RNA, 20 nt, Homo sapiens
auguaccucuuuuagucauu

SEQ ID NO: 2137921 - RNA, 16 nt, Homo sapiens
ugcucuguagccuaaa

SEQ ID NO: 2137922 - RNA, 20 nt, Homo sapiens
uuugacuguccucgcagaga

SEQ ID NO: 2137923 - RNA, 19 nt, Homo sapiens
aaaauacaucagcuuggua

SEQ ID NO: 2137924 - RNA, 12 nt, Homo sapiens
aggaauacucuu

SEQ ID NO: 2137925 - RNA, 16 nt, Homo sapiens
ugcuguaaaagugaau

SEQ ID NO: 2137926 - RNA, 21 nt, Homo sapiens
agaaagauuaaauaugaucac

SEQ ID NO: 2137927 - RNA, 21 nt, Homo sapiens
agaaaugaauagacuaucuag

SEQ ID NO: 2137928 - RNA, 21 nt, Homo sapiens
ggcccuccacccccaccucaa

SEQ ID NO: 2137929 - RNA, 15 nt, Homo sapiens
uagacaguacucuua

SEQ ID NO: 2137930 - RNA, 20 nt, Homo sapiens
ggguuaaauuaaaagcccua

SEQ ID NO: 2137931 - RNA, 18 nt, Homo sapiens
gacacauuagccuugaac

SEQ ID NO: 2137932 - RNA, 20 nt, Homo sapiens
gccccagaugcgcugugcca

SEQ ID NO: 2137933 - RNA, 15 nt, Homo sapiens
cccuaucccagagac

SEQ ID NO: 2137934 - RNA, 22 nt, Homo sapiens
cacagcacaaauuaguuguaua

SEQ ID NO: 2137935 - RNA, 12 nt, Homo sapiens
cagagagucaau

SEQ ID NO: 2137936 - RNA, 13 nt, Homo sapiens
agaguuuagcacg

SEQ ID NO: 2137937 - RNA, 21 nt, Homo sapiens
aucucaccuucagucaagaaa

SEQ ID NO: 2137938 - RNA, 23 nt, Homo sapiens
gcucuaugggguucguuaugcca

SEQ ID NO: 2137939 - RNA, 18 nt, Homo sapiens
uagauuuuucucaucucc

SEQ ID NO: 2137940 - RNA, 12 nt, Homo sapiens
ccugggugacag

SEQ ID NO: 2137941 - RNA, 12 nt, Homo sapiens
aaagggugcaug

SEQ ID NO: 2137942 - RNA, 13 nt, Homo sapiens
ugauaagccuuuc

SEQ ID NO: 2137943 - RNA, 22 nt, Homo sapiens
guuggccagugugacaaggauu

SEQ ID NO: 2137944 - RNA, 14 nt, Homo sapiens
ccccucucagcuuu

SEQ ID NO: 2137945 - RNA, 21 nt, Homo sapiens
uggaguauuuucuaauaaucc

SEQ ID NO: 2137946 - RNA, 22 nt, Homo sapiens
acagauuuuaccuauccacaau

SEQ ID NO: 2137947 - RNA, 22 nt, Homo sapiens
auuuaugucucagaccacuauu

SEQ ID NO: 2137948 - RNA, 15 nt, Homo sapiens
accugacucuugcag

SEQ ID NO: 2137949 - RNA, 23 nt, Homo sapiens
gcaaugcuaagcuguuugcucac

SEQ ID NO: 2137950 - RNA, 20 nt, Homo sapiens
acaggccauggauggaaaac

SEQ ID NO: 2137951 - RNA, 14 nt, Homo sapiens
ccaguggugcguuu

SEQ ID NO: 2137952 - RNA, 15 nt, Homo sapiens
uaaaaaugcaacuuc

SEQ ID NO: 2137953 - RNA, 15 nt, Homo sapiens
caaaaacauggccuu

SEQ ID NO: 2137954 - RNA, 16 nt, Homo sapiens
auuuccuaaggcaugu

SEQ ID NO: 2137955 - RNA, 20 nt, Homo sapiens
uacaauauucucauuauuaa

SEQ ID NO: 2137956 - RNA, 20 nt, Homo sapiens
accccuacacacacacuccc

SEQ ID NO: 2137957 - RNA, 13 nt, Homo sapiens
acuggccaugccu

SEQ ID NO: 2137958 - RNA, 13 nt, Homo sapiens
ucccuccaagugg

SEQ ID NO: 2137959 - RNA, 18 nt, Homo sapiens
cugccuuaucuugcaccc

SEQ ID NO: 2137960 - RNA, 12 nt, Homo sapiens
ccgucauuucau

SEQ ID NO: 2137961 - RNA, 20 nt, Homo sapiens
agauauucacuaaggacuua

SEQ ID NO: 2137962 - RNA, 21 nt, Homo sapiens
gacauggaauuuaugaauggu

SEQ ID NO: 2137963 - RNA, 18 nt, Homo sapiens
ggacaaaacuucuuguca

SEQ ID NO: 2137964 - RNA, 23 nt, Homo sapiens
caaguuuuuuauacugcacuuau

SEQ ID NO: 2137965 - RNA, 19 nt, Homo sapiens
aaaucauuaauacucuucu

SEQ ID NO: 2137966 - RNA, 19 nt, Homo sapiens
agaaugcugcgcuuaccuu

SEQ ID NO: 2137967 - RNA, 16 nt, Homo sapiens
augugaaaaauguguc

SEQ ID NO: 2137968 - RNA, 13 nt, Homo sapiens
uuuucaaaacaca

SEQ ID NO: 2137969 - RNA, 17 nt, Homo sapiens
gagccaccccuaaagag

SEQ ID NO: 2137970 - RNA, 17 nt, Homo sapiens
gcaggaaagacuggccc

SEQ ID NO: 2137971 - RNA, 19 nt, Homo sapiens
uggacagagggagaaggga

SEQ ID NO: 2137972 - RNA, 16 nt, Homo sapiens
uuuauauuugugugag

SEQ ID NO: 2137973 - RNA, 16 nt, Homo sapiens
aaaaauaucugaauau

SEQ ID NO: 2137974 - RNA, 22 nt, Homo sapiens
aaacuuccaauuucuagccaua

SEQ ID NO: 2137975 - RNA, 14 nt, Homo sapiens
caggaacugagcca

SEQ ID NO: 2137976 - RNA, 15 nt, Homo sapiens
aaaaugacuguagaa

SEQ ID NO: 2137977 - RNA, 22 nt, Homo sapiens
gcaguggcacgaucucgacuca

SEQ ID NO: 2137978 - RNA, 18 nt, Homo sapiens
gagcaaagugcagguuau

SEQ ID NO: 2137979 - RNA, 23 nt, Homo sapiens
cucuggcuucccuaaacugcagc

SEQ ID NO: 2137980 - RNA, 14 nt, Homo sapiens
auuuucauucugaa

SEQ ID NO: 2137981 - RNA, 15 nt, Homo sapiens
gugaaaucugugcaa

SEQ ID NO: 2137982 - RNA, 18 nt, Homo sapiens
caaggcacuucauguaaa

SEQ ID NO: 2137983 - RNA, 18 nt, Homo sapiens
aucacuacucagugcaua

SEQ ID NO: 2137984 - RNA, 15 nt, Homo sapiens
aauugagacagugca

SEQ ID NO: 2137985 - RNA, 14 nt, Homo sapiens
gcaggaaggaggug

SEQ ID NO: 2137986 - RNA, 18 nt, Homo sapiens
gcagaauacaaugggaaa

SEQ ID NO: 2137987 - RNA, 14 nt, Homo sapiens
aauuagacauuuau

SEQ ID NO: 2137988 - RNA, 16 nt, Homo sapiens
ggacagcaacuaucag

SEQ ID NO: 2137989 - RNA, 23 nt, Homo sapiens
cugccucccgaguucaagcgauu

SEQ ID NO: 2137990 - RNA, 18 nt, Homo sapiens
cauugguuaagucugugu

SEQ ID NO: 2137991 - RNA, 14 nt, Homo sapiens
auauggaggccuca

SEQ ID NO: 2137992 - RNA, 15 nt, Homo sapiens
uggccuccugugcau

SEQ ID NO: 2137993 - RNA, 14 nt, Homo sapiens
aaagggaaugggaa

SEQ ID NO: 2137994 - RNA, 19 nt, Homo sapiens
uugugucuagggcagagua

SEQ ID NO: 2137995 - RNA, 15 nt, Homo sapiens
cuuucugaaauucac

SEQ ID NO: 2137996 - RNA, 18 nt, Homo sapiens
uuaaaaaccaacugugaa

SEQ ID NO: 2137997 - RNA, 16 nt, Homo sapiens
ccacugagaagucaaa

SEQ ID NO: 2137998 - RNA, 18 nt, Homo sapiens
gcaucugccucuauucaa

SEQ ID NO: 2137999 - RNA, 18 nt, Homo sapiens
uaggagaagggucucaug

SEQ ID NO: 2138000 - RNA, 17 nt, Homo sapiens
aagauacugcugaugcu

SEQ ID NO: 2138001 - RNA, 14 nt, Homo sapiens
cugacaccuuucau

SEQ ID NO: 2138002 - RNA, 16 nt, Homo sapiens
uguguuagcuuguaua

SEQ ID NO: 2138003 - RNA, 17 nt, Homo sapiens
aaguauauuuaacucau

SEQ ID NO: 2138004 - RNA, 14 nt, Homo sapiens
aucgcaguguucaa

SEQ ID NO: 2138005 - RNA, 21 nt, Homo sapiens
guuccuguccaaacucagugc

SEQ ID NO: 2138006 - RNA, 17 nt, Homo sapiens
agcuucuucacaggcac

SEQ ID NO: 2138007 - RNA, 17 nt, Homo sapiens
aguauguucauugccac

SEQ ID NO: 2138008 - RNA, 18 nt, Homo sapiens
gagaacggugaccgccuc

SEQ ID NO: 2138009 - RNA, 17 nt, Homo sapiens
cugcuuuccagacuuug

SEQ ID NO: 2138010 - RNA, 20 nt, Homo sapiens
ucaauccaagagucugauga

SEQ ID NO: 2138011 - RNA, 11 nt, Homo sapiens
ugucaauguuu

SEQ ID NO: 2138012 - RNA, 14 nt, Homo sapiens
cacugcaaacacac

SEQ ID NO: 2138013 - RNA, 17 nt, Homo sapiens
cuuguuaacugguuaaa

SEQ ID NO: 2138014 - RNA, 17 nt, Homo sapiens
uuuccuucuugccuuca

SEQ ID NO: 2138015 - RNA, 14 nt, Homo sapiens
ugugugcuuuccca

SEQ ID NO: 2138016 - RNA, 15 nt, Homo sapiens
gacggcaagacucca

SEQ ID NO: 2138017 - RNA, 15 nt, Homo sapiens
aaagcugaaaaugug

SEQ ID NO: 2138018 - RNA, 21 nt, Homo sapiens
aagugcugggaugacaggugu

SEQ ID NO: 2138019 - RNA, 17 nt, Homo sapiens
gccaccuuugugcagcu

SEQ ID NO: 2138020 - RNA, 22 nt, Homo sapiens
gacaugacgugguaaaauguga

SEQ ID NO: 2138021 - RNA, 15 nt, Homo sapiens
caaggagugaaaaac

SEQ ID NO: 2138022 - RNA, 21 nt, Homo sapiens
uuuguacacgaagaccaucca

SEQ ID NO: 2138023 - RNA, 15 nt, Homo sapiens
aggacaucaaaaaca

SEQ ID NO: 2138024 - RNA, 15 nt, Homo sapiens
uaacacacuggccau

SEQ ID NO: 2138025 - RNA, 14 nt, Homo sapiens
gacuuccuggugag

SEQ ID NO: 2138026 - RNA, 14 nt, Homo sapiens
ucaugauucacaac

SEQ ID NO: 2138027 - RNA, 17 nt, Homo sapiens
ccugucuugcuuacugu

SEQ ID NO: 2138028 - RNA, 20 nt, Homo sapiens
ucagugaccagugccuguga

SEQ ID NO: 2138029 - RNA, 13 nt, Homo sapiens
cuacuuuugccaa

SEQ ID NO: 2138030 - RNA, 13 nt, Homo sapiens
auuuaaguauaua

SEQ ID NO: 2138031 - RNA, 13 nt, Homo sapiens
ggaggaguggugg

SEQ ID NO: 2138032 - RNA, 13 nt, Homo sapiens
uaaaaaguuauaa

SEQ ID NO: 2138033 - RNA, 17 nt, Homo sapiens
gcuaggaaaagaaauca

SEQ ID NO: 2138034 - RNA, 14 nt, Homo sapiens
uacaaugugaauag

SEQ ID NO: 2138035 - RNA, 13 nt, Homo sapiens
aagucaugcaauc

SEQ ID NO: 2138036 - RNA, 20 nt, Homo sapiens
cuggagugcaguggugcgau

SEQ ID NO: 2138037 - RNA, 17 nt, Homo sapiens
caccagaugccauuaca

SEQ ID NO: 2138038 - RNA, 17 nt, Homo sapiens
ccugaccucaggugauc

SEQ ID NO: 2138039 - RNA, 18 nt, Homo sapiens
cuugacuucaugccagcu

SEQ ID NO: 2138040 - RNA, 16 nt, Homo sapiens
uagguagaacacugcu

SEQ ID NO: 2138041 - RNA, 19 nt, Homo sapiens
ugaggguccucuuccucaa

SEQ ID NO: 2138042 - RNA, 20 nt, Homo sapiens
ugguguuguauacuucauua

SEQ ID NO: 2138043 - RNA, 18 nt, Homo sapiens
cucuuuucccaccaacuc

SEQ ID NO: 2138044 - RNA, 22 nt, Homo sapiens
gcagccccucaugccuggagaa

SEQ ID NO: 2138045 - RNA, 14 nt, Homo sapiens
gcccuuggccagaa

SEQ ID NO: 2138046 - RNA, 16 nt, Homo sapiens
uucccugggguacuac

SEQ ID NO: 2138047 - RNA, 18 nt, Homo sapiens
ccuuuacuuucuuaauaa

SEQ ID NO: 2138048 - RNA, 19 nt, Homo sapiens
cacagaguuuguaguaaau

SEQ ID NO: 2138049 - RNA, 12 nt, Homo sapiens
cuguuggucugu

SEQ ID NO: 2138050 - RNA, 14 nt, Homo sapiens
cucgccaggccaaa

SEQ ID NO: 2138051 - RNA, 15 nt, Homo sapiens
uaccaucugcaucca

SEQ ID NO: 2138052 - RNA, 19 nt, Homo sapiens
cgcuaaagguguaagacuu

SEQ ID NO: 2138053 - RNA, 19 nt, Homo sapiens
aucuccaucggaacagaaa

SEQ ID NO: 2138054 - RNA, 17 nt, Homo sapiens
augucuugcaaagccuu

SEQ ID NO: 2138055 - RNA, 11 nt, Homo sapiens
aaugcacugug

SEQ ID NO: 2138056 - RNA, 17 nt, Homo sapiens
ugaacugcaacacugga

SEQ ID NO: 2138057 - RNA, 21 nt, Homo sapiens
uuguacuuuuuuuuacuuugg

SEQ ID NO: 2138058 - RNA, 22 nt, Homo sapiens
uuccaucccaggcuuuugaaaa

SEQ ID NO: 2138059 - RNA, 13 nt, Homo sapiens
guaugaaguauaa

SEQ ID NO: 2138060 - RNA, 20 nt, Homo sapiens
auaaaccuaugaauaaauuu

SEQ ID NO: 2138061 - RNA, 20 nt, Homo sapiens
uagcuuucccaaauaaacuc

SEQ ID NO: 2138062 - RNA, 21 nt, Homo sapiens
uaacgcaggagaaucacuuga

SEQ ID NO: 2138063 - RNA, 21 nt, Homo sapiens
aauaaauaagcaaaaugccaa

SEQ ID NO: 2138064 - RNA, 19 nt, Homo sapiens
ugccgcugucucugagggg

SEQ ID NO: 2138065 - RNA, 12 nt, Homo sapiens
caggauggucau

SEQ ID NO: 2138066 - RNA, 14 nt, Homo sapiens
accagagaagggaa

SEQ ID NO: 2138067 - RNA, 15 nt, Homo sapiens
uguauaacuaggcug

SEQ ID NO: 2138068 - RNA, 18 nt, Homo sapiens
guacuacaguccucccau

SEQ ID NO: 2138069 - RNA, 17 nt, Homo sapiens
aaaacuucaagacauca

SEQ ID NO: 2138070 - RNA, 15 nt, Homo sapiens
agccggccacuuugg

SEQ ID NO: 2138071 - RNA, 19 nt, Homo sapiens
uccacguucugcucaucau

SEQ ID NO: 2138072 - RNA, 14 nt, Homo sapiens
gcccuucgcugcca

SEQ ID NO: 2138073 - RNA, 16 nt, Homo sapiens
gaaaacaugacuuuau

SEQ ID NO: 2138074 - RNA, 15 nt, Homo sapiens
cuguuaccagaggac

SEQ ID NO: 2138075 - RNA, 22 nt, Homo sapiens
ggaucuuguaauccagugcccu

SEQ ID NO: 2138076 - RNA, 22 nt, Homo sapiens
accuuucuagccuuagacaaau

SEQ ID NO: 2138077 - RNA, 23 nt, Homo sapiens
acuuguaaauaaauagauuugau

SEQ ID NO: 2138078 - RNA, 14 nt, Homo sapiens
ugagaagcugccau

SEQ ID NO: 2138079 - RNA, 16 nt, Homo sapiens
aaggcugcacagcuca

SEQ ID NO: 2138080 - RNA, 17 nt, Homo sapiens
aauucucagaggacuug

SEQ ID NO: 2138081 - RNA, 14 nt, Homo sapiens
uguuuuugaucaaa

SEQ ID NO: 2138082 - RNA, 23 nt, Homo sapiens
cagaaccuagucuuguuguucau

SEQ ID NO: 2138083 - RNA, 20 nt, Homo sapiens
aacuuccaaaaagauuuauu

SEQ ID NO: 2138084 - RNA, 22 nt, Homo sapiens
aaauguuaacacucaugaagca

SEQ ID NO: 2138085 - RNA, 22 nt, Homo sapiens
auuggcggggcuuaugacugca

SEQ ID NO: 2138086 - RNA, 23 nt, Homo sapiens
ugcagcaaaauaauaaaauacuu

SEQ ID NO: 2138087 - RNA, 12 nt, Homo sapiens
guuauucuugca

SEQ ID NO: 2138088 - RNA, 11 nt, Homo sapiens
ggagccaaagc

SEQ ID NO: 2138089 - RNA, 15 nt, Homo sapiens
accuauacauuauau

SEQ ID NO: 2138090 - RNA, 21 nt, Homo sapiens
gcauaggaacaauaagaacaa

SEQ ID NO: 2138091 - RNA, 17 nt, Homo sapiens
gaacauggauuccacug

SEQ ID NO: 2138092 - RNA, 11 nt, Homo sapiens
ugaugcuugua

SEQ ID NO: 2138093 - RNA, 23 nt, Homo sapiens
auggcauuuggucucaggcagca

SEQ ID NO: 2138094 - RNA, 12 nt, Homo sapiens
acagagaagcuc

SEQ ID NO: 2138095 - RNA, 18 nt, Homo sapiens
accagagggggcgugccu

SEQ ID NO: 2138096 - RNA, 20 nt, Homo sapiens
gucauugcagaguucuuauu

SEQ ID NO: 2138097 - RNA, 19 nt, Homo sapiens
accuaguuuguuagugcau

SEQ ID NO: 2138098 - RNA, 13 nt, Homo sapiens
aaauugaacucuu

SEQ ID NO: 2138099 - RNA, 19 nt, Homo sapiens
cuggaaugcauucacucag

SEQ ID NO: 2138100 - RNA, 21 nt, Homo sapiens
gcuguuccauuacaccacagc

SEQ ID NO: 2138101 - RNA, 13 nt, Homo sapiens
gacagucuggaaa

SEQ ID NO: 2138102 - RNA, 17 nt, Homo sapiens
agauuggcucccaacuc

SEQ ID NO: 2138103 - RNA, 17 nt, Homo sapiens
cuaaauuauaucuguga

SEQ ID NO: 2138104 - RNA, 15 nt, Homo sapiens
aaggauucuguaugc

SEQ ID NO: 2138105 - RNA, 21 nt, Homo sapiens
cagaaugggggcuuucgggga

SEQ ID NO: 2138106 - RNA, 16 nt, Homo sapiens
cuucagcagcagcuca

SEQ ID NO: 2138107 - RNA, 14 nt, Homo sapiens
acagaaccucccaa

SEQ ID NO: 2138108 - RNA, 13 nt, Homo sapiens
agaguacagaugu

SEQ ID NO: 2138109 - RNA, 21 nt, Homo sapiens
cugagcagugccagcuuucuu

SEQ ID NO: 2138110 - RNA, 20 nt, Homo sapiens
agggcucugggggcagauuu

SEQ ID NO: 2138111 - RNA, 16 nt, Homo sapiens
uuuaacuuguauggag

SEQ ID NO: 2138112 - RNA, 22 nt, Homo sapiens
aauuuccaugaguuacacugga

SEQ ID NO: 2138113 - RNA, 16 nt, Homo sapiens
guugggcugugccugg

SEQ ID NO: 2138114 - RNA, 13 nt, Homo sapiens
cugugauuaugcc

SEQ ID NO: 2138115 - RNA, 12 nt, Homo sapiens
cacagugugaau

SEQ ID NO: 2138116 - RNA, 13 nt, Homo sapiens
agaguugugcaug

SEQ ID NO: 2138117 - RNA, 13 nt, Homo sapiens
cagggagcccuuu

SEQ ID NO: 2138118 - RNA, 19 nt, Homo sapiens
ggcugggaguccuuaccuc

SEQ ID NO: 2138119 - RNA, 18 nt, Homo sapiens
ggcuuuggguagugccau

SEQ ID NO: 2138120 - RNA, 14 nt, Homo sapiens
ccuucccaaagcaa

SEQ ID NO: 2138121 - RNA, 18 nt, Homo sapiens
uguuuucggcagccuuaa

SEQ ID NO: 2138122 - RNA, 14 nt, Homo sapiens
ugcuugaauugcaa

SEQ ID NO: 2138123 - RNA, 15 nt, Homo sapiens
cuuguaacuaaaaua

SEQ ID NO: 2138124 - RNA, 16 nt, Homo sapiens
uaaaaugcugugucca

SEQ ID NO: 2138125 - RNA, 17 nt, Homo sapiens
uaucuguuaaccaaaua

SEQ ID NO: 2138126 - RNA, 22 nt, Homo sapiens
ucuggaaguuucuggugccauu

SEQ ID NO: 2138127 - RNA, 22 nt, Homo sapiens
uuuguauucucuuccucaucca

SEQ ID NO: 2138128 - RNA, 21 nt, Homo sapiens
auuuuaugugcuucacauaau

SEQ ID NO: 2138129 - RNA, 14 nt, Homo sapiens
uucagcaacuuauu

SEQ ID NO: 2138130 - RNA, 19 nt, Homo sapiens
gaggcaggaggaucacuuu

SEQ ID NO: 2138131 - RNA, 19 nt, Homo sapiens
aucuccuauaaucugucaa

SEQ ID NO: 2138132 - RNA, 18 nt, Homo sapiens
aaaagcugcuauccaaug

SEQ ID NO: 2138133 - RNA, 15 nt, Homo sapiens
auuuacagcucugua

SEQ ID NO: 2138134 - RNA, 17 nt, Homo sapiens
ugggacuacaggcucau

SEQ ID NO: 2138135 - RNA, 20 nt, Homo sapiens
gcuguguguccuugcauggc

SEQ ID NO: 2138136 - RNA, 16 nt, Homo sapiens
aaggacagcuuugaua

SEQ ID NO: 2138137 - RNA, 18 nt, Homo sapiens
aaguucuuggaccaguuu

SEQ ID NO: 2138138 - RNA, 20 nt, Homo sapiens
auucuuaaaggaaaagucaa

SEQ ID NO: 2138139 - RNA, 17 nt, Homo sapiens
cuuuccuuaugucuccu

SEQ ID NO: 2138140 - RNA, 14 nt, Homo sapiens
cucuugaaccagaa

SEQ ID NO: 2138141 - RNA, 16 nt, Homo sapiens
ucccagccaugcccag

SEQ ID NO: 2138142 - RNA, 17 nt, Homo sapiens
uuuggggaggaguugau

SEQ ID NO: 2138143 - RNA, 16 nt, Homo sapiens
agacagcccuccaucu

SEQ ID NO: 2138144 - RNA, 16 nt, Homo sapiens
uccucacguccaucac

SEQ ID NO: 2138145 - RNA, 22 nt, Homo sapiens
uguucuauuuuuguuuacaaac

SEQ ID NO: 2138146 - RNA, 22 nt, Homo sapiens
uuaaucagaaaccccacuucca

SEQ ID NO: 2138147 - RNA, 19 nt, Homo sapiens
acaagaggaaagugaaagu

SEQ ID NO: 2138148 - RNA, 22 nt, Homo sapiens
acuugcaccugguacugcacau

SEQ ID NO: 2138149 - RNA, 15 nt, Homo sapiens
caugugugcuaauau

SEQ ID NO: 2138150 - RNA, 16 nt, Homo sapiens
cugagagcucacagua

SEQ ID NO: 2138151 - RNA, 16 nt, Homo sapiens
auuagaguauuuucca

SEQ ID NO: 2138152 - RNA, 14 nt, Homo sapiens
auaaaaacugugaa

SEQ ID NO: 2138153 - RNA, 22 nt, Homo sapiens
cccaauuaaaauacuaugcagu

SEQ ID NO: 2138154 - RNA, 23 nt, Homo sapiens
caucuuggucagauuugaacucu

SEQ ID NO: 2138155 - RNA, 23 nt, Homo sapiens
cucugcauguguguuguccuuca

SEQ ID NO: 2138156 - RNA, 15 nt, Homo sapiens
ccuccaaacacuggg

SEQ ID NO: 2138157 - RNA, 17 nt, Homo sapiens
aacuccuuguuaaucca

SEQ ID NO: 2138158 - RNA, 22 nt, Homo sapiens
uugugauuuauuucacuuuuaa

SEQ ID NO: 2138159 - RNA, 13 nt, Homo sapiens
auggaaaccaagc

SEQ ID NO: 2138160 - RNA, 23 nt, Homo sapiens
agugaacuauuucuacacagugg

SEQ ID NO: 2138161 - RNA, 13 nt, Homo sapiens
agcccggcaaaug

SEQ ID NO: 2138162 - RNA, 20 nt, Homo sapiens
cuacucuaaagaauucuuga

SEQ ID NO: 2138163 - RNA, 18 nt, Homo sapiens
augccuaaaaaguaucau

SEQ ID NO: 2138164 - RNA, 21 nt, Homo sapiens
cagcuaucacguugaaccacg

SEQ ID NO: 2138165 - RNA, 13 nt, Homo sapiens
acguuucuucccc

SEQ ID NO: 2138166 - RNA, 21 nt, Homo sapiens
cauuuacucuugagacuacuu

SEQ ID NO: 2138167 - RNA, 14 nt, Homo sapiens
guaagucauuuaac

SEQ ID NO: 2138168 - RNA, 14 nt, Homo sapiens
caccuuccaaagga

SEQ ID NO: 2138169 - RNA, 23 nt, Homo sapiens
gccaagggauggacaucuuguca

SEQ ID NO: 2138170 - RNA, 14 nt, Homo sapiens
aaugaaaauuguau

SEQ ID NO: 2138171 - RNA, 14 nt, Homo sapiens
uuauacaagagugu

SEQ ID NO: 2138172 - RNA, 15 nt, Homo sapiens
gccuggaacaccagc

SEQ ID NO: 2138173 - RNA, 14 nt, Homo sapiens
gagcugcuggccau

SEQ ID NO: 2138174 - RNA, 23 nt, Homo sapiens
uauuuaagaaaaguguuuucaca

SEQ ID NO: 2138175 - RNA, 16 nt, Homo sapiens
cccugaggguuuccac

SEQ ID NO: 2138176 - RNA, 22 nt, Homo sapiens
acccuucugucuguaagauuuu

SEQ ID NO: 2138177 - RNA, 16 nt, Homo sapiens
gaaauaaacuucacug

SEQ ID NO: 2138178 - RNA, 19 nt, Homo sapiens
acaaauagguagagucauu

SEQ ID NO: 2138179 - RNA, 19 nt, Homo sapiens
cagcuagggcuggacucug

SEQ ID NO: 2138180 - RNA, 22 nt, Homo sapiens
cuggaguacuuugaagauguca

SEQ ID NO: 2138181 - RNA, 13 nt, Homo sapiens
auacaguuuacug

SEQ ID NO: 2138182 - RNA, 14 nt, Homo sapiens
uugagcguuugcac

SEQ ID NO: 2138183 - RNA, 15 nt, Homo sapiens
cacaaauuaguugua

SEQ ID NO: 2138184 - RNA, 21 nt, Homo sapiens
uugagcucugcagcccaggga

SEQ ID NO: 2138185 - RNA, 22 nt, Homo sapiens
ccuuuccaagcuccucgugaua

SEQ ID NO: 2138186 - RNA, 21 nt, Homo sapiens
ccauucuucagacaucaguca

SEQ ID NO: 2138187 - RNA, 21 nt, Homo sapiens
acaguguauaaggaacaucuc

SEQ ID NO: 2138188 - RNA, 13 nt, Homo sapiens
uuaaauacuauua

SEQ ID NO: 2138189 - RNA, 13 nt, Homo sapiens
uaauauacuuuaa

SEQ ID NO: 2138190 - RNA, 22 nt, Homo sapiens
aucucggcucacugcauccucc

SEQ ID NO: 2138191 - RNA, 17 nt, Homo sapiens
gagcuggggggcgugga

SEQ ID NO: 2138192 - RNA, 15 nt, Homo sapiens
uuuuauaugcaacuu

SEQ ID NO: 2138193 - RNA, 12 nt, Homo sapiens
caguauucccuu

SEQ ID NO: 2138194 - RNA, 16 nt, Homo sapiens
ugagggaucugucuca

SEQ ID NO: 2138195 - RNA, 15 nt, Homo sapiens
gucucuuaaaucucu

SEQ ID NO: 2138196 - RNA, 18 nt, Homo sapiens
aaauccucauguuacuca

SEQ ID NO: 2138197 - RNA, 21 nt, Homo sapiens
acugguuugccaggccaaugu

SEQ ID NO: 2138198 - RNA, 14 nt, Homo sapiens
cuugaacacagucu

SEQ ID NO: 2138199 - RNA, 15 nt, Homo sapiens
ucuuugugugacaug

SEQ ID NO: 2138200 - RNA, 16 nt, Homo sapiens
ugaaccauuaaccaga

SEQ ID NO: 2138201 - RNA, 19 nt, Homo sapiens
cuuuaugcaaauacaauca

SEQ ID NO: 2138202 - RNA, 17 nt, Homo sapiens
uguauuaucauauaugc

SEQ ID NO: 2138203 - RNA, 19 nt, Homo sapiens
uuauauagcaagugcuauu

SEQ ID NO: 2138204 - RNA, 14 nt, Homo sapiens
uccuugacccuggg

SEQ ID NO: 2138205 - RNA, 14 nt, Homo sapiens
uuccuguagggggc

SEQ ID NO: 2138206 - RNA, 16 nt, Homo sapiens
cacugguugcacuuau

SEQ ID NO: 2138207 - RNA, 12 nt, Homo sapiens
aaaacacuuuca

SEQ ID NO: 2138208 - RNA, 23 nt, Homo sapiens
uccagauguuaauuuacuuucug

SEQ ID NO: 2138209 - RNA, 14 nt, Homo sapiens
uacauaacaagaaa

SEQ ID NO: 2138210 - RNA, 20 nt, Homo sapiens
auucauauuuauagccaggu

SEQ ID NO: 2138211 - RNA, 20 nt, Homo sapiens
gugugaugcaaaugcucaaa

SEQ ID NO: 2138212 - RNA, 16 nt, Homo sapiens
aaggucuaugcucaua

SEQ ID NO: 2138213 - RNA, 22 nt, Homo sapiens
uugacuugugucuguccaagaa

SEQ ID NO: 2138214 - RNA, 14 nt, Homo sapiens
ucaguaaacacugu

SEQ ID NO: 2138215 - RNA, 14 nt, Homo sapiens
cuuugcucccugag

SEQ ID NO: 2138216 - RNA, 18 nt, Homo sapiens
ucgcuccagacuugggaa

SEQ ID NO: 2138217 - RNA, 14 nt, Homo sapiens
cagcccccacugac

SEQ ID NO: 2138218 - RNA, 15 nt, Homo sapiens
uuaauuacaauggaa

SEQ ID NO: 2138219 - RNA, 14 nt, Homo sapiens
uuuuguuugucuga

SEQ ID NO: 2138220 - RNA, 14 nt, Homo sapiens
uauaauuugacaaa

SEQ ID NO: 2138221 - RNA, 20 nt, Homo sapiens
uaccuguuuuacuuuugggu

SEQ ID NO: 2138222 - RNA, 19 nt, Homo sapiens
caggaauccccaacaugca

SEQ ID NO: 2138223 - RNA, 14 nt, Homo sapiens
uuauaccaguguua

SEQ ID NO: 2138224 - RNA, 13 nt, Homo sapiens
gauggaacaucag

SEQ ID NO: 2138225 - RNA, 16 nt, Homo sapiens
gcuuucuucuuuccag

SEQ ID NO: 2138226 - RNA, 15 nt, Homo sapiens
cuagacauugcaauu

SEQ ID NO: 2138227 - RNA, 22 nt, Homo sapiens
ugcaugaaaaaacaucuuuauu

SEQ ID NO: 2138228 - RNA, 17 nt, Homo sapiens
acacaucuuucuugaau

SEQ ID NO: 2138229 - RNA, 22 nt, Homo sapiens
agcuacaggcuugagcuuuaaa

SEQ ID NO: 2138230 - RNA, 17 nt, Homo sapiens
uaaacagcuucaugccu

SEQ ID NO: 2138231 - RNA, 15 nt, Homo sapiens
cccaggccccagcug

SEQ ID NO: 2138232 - RNA, 15 nt, Homo sapiens
cucacccuccacaaa

SEQ ID NO: 2138233 - RNA, 19 nt, Homo sapiens
uccuugcaccugagccugu

SEQ ID NO: 2138234 - RNA, 17 nt, Homo sapiens
acucaaccaugaccuca

SEQ ID NO: 2138235 - RNA, 15 nt, Homo sapiens
ugcacaucuagugag

SEQ ID NO: 2138236 - RNA, 16 nt, Homo sapiens
ccuaaaacaguauucu

SEQ ID NO: 2138237 - RNA, 12 nt, Homo sapiens
cacaugccaagc

SEQ ID NO: 2138238 - RNA, 14 nt, Homo sapiens
auuuaguuccauaa

SEQ ID NO: 2138239 - RNA, 17 nt, Homo sapiens
aauuugcaaaguacugu

SEQ ID NO: 2138240 - RNA, 14 nt, Homo sapiens
cauaccaggugcua

SEQ ID NO: 2138241 - RNA, 14 nt, Homo sapiens
guuuugacauuuac

SEQ ID NO: 2138242 - RNA, 14 nt, Homo sapiens
agacauucuuccaa

SEQ ID NO: 2138243 - RNA, 22 nt, Homo sapiens
ucaccuugaaaaagcaccaaaa

SEQ ID NO: 2138244 - RNA, 18 nt, Homo sapiens
accuguuccugacuguuc

SEQ ID NO: 2138245 - RNA, 20 nt, Homo sapiens
aaguagcaaaaaguauugaa

SEQ ID NO: 2138246 - RNA, 19 nt, Homo sapiens
aggaaacaagugaaagcau

SEQ ID NO: 2138247 - RNA, 22 nt, Homo sapiens
cugccccucaugccaaccccgc

SEQ ID NO: 2138248 - RNA, 19 nt, Homo sapiens
cucggggaacccaaggccc

SEQ ID NO: 2138249 - RNA, 16 nt, Homo sapiens
aaccaagccaauguua

SEQ ID NO: 2138250 - RNA, 16 nt, Homo sapiens
ugacguuguugucauu

SEQ ID NO: 2138251 - RNA, 15 nt, Homo sapiens
augcuucagauauua

SEQ ID NO: 2138252 - RNA, 17 nt, Homo sapiens
ccaggcuggagugcaau

SEQ ID NO: 2138253 - RNA, 17 nt, Homo sapiens
ccaggcuagagugcagu

SEQ ID NO: 2138254 - RNA, 15 nt, Homo sapiens
aaauagauccagugc

SEQ ID NO: 2138255 - RNA, 16 nt, Homo sapiens
uauauaaagacugccu

SEQ ID NO: 2138256 - RNA, 19 nt, Homo sapiens
ccaaauauaaacuugugua

SEQ ID NO: 2138257 - RNA, 15 nt, Homo sapiens
accuugugagggaga

SEQ ID NO: 2138258 - RNA, 15 nt, Homo sapiens
gcagacgugguguga

SEQ ID NO: 2138259 - RNA, 18 nt, Homo sapiens
cgcaguugcaaacaccug

SEQ ID NO: 2138260 - RNA, 22 nt, Homo sapiens
agcacauauggaauuuugcaaa

SEQ ID NO: 2138261 - RNA, 22 nt, Homo sapiens
agucucagccugggccccucag

SEQ ID NO: 2138262 - RNA, 22 nt, Homo sapiens
cagaauaggaaaacauugcaau

SEQ ID NO: 2138263 - RNA, 22 nt, Homo sapiens
accuaaacggggcaguacuccu

SEQ ID NO: 2138264 - RNA, 15 nt, Homo sapiens
gcuucaggauacugu

SEQ ID NO: 2138265 - RNA, 13 nt, Homo sapiens
acucuacauuuaa

SEQ ID NO: 2138266 - RNA, 23 nt, Homo sapiens
aaguccugacacuauucauuuga

SEQ ID NO: 2138267 - RNA, 20 nt, Homo sapiens
gcugccaugucucagaugag

SEQ ID NO: 2138268 - RNA, 17 nt, Homo sapiens
gugcagcccucuugccc

SEQ ID NO: 2138269 - RNA, 19 nt, Homo sapiens
auuuuccaggacuguuuca

SEQ ID NO: 2138270 - RNA, 14 nt, Homo sapiens
aaucuucaccucag

SEQ ID NO: 2138271 - RNA, 21 nt, Homo sapiens
auuuacagaaaagacucugac

SEQ ID NO: 2138272 - RNA, 22 nt, Homo sapiens
aacaaaccuugugcucuuuuca

SEQ ID NO: 2138273 - RNA, 21 nt, Homo sapiens
ggaggacccuggaaauggacu

SEQ ID NO: 2138274 - RNA, 21 nt, Homo sapiens
cccagcuaauugagaccacag

SEQ ID NO: 2138275 - RNA, 11 nt, Homo sapiens
uggugauucuc

SEQ ID NO: 2138276 - RNA, 20 nt, Homo sapiens
gacaaauacuuagacaguau

SEQ ID NO: 2138277 - RNA, 21 nt, Homo sapiens
gguaacauuggcuacaaagac

SEQ ID NO: 2138278 - RNA, 17 nt, Homo sapiens
ccagcggacaguggcag

SEQ ID NO: 2138279 - RNA, 16 nt, Homo sapiens
cuugcagaguacauga

SEQ ID NO: 2138280 - RNA, 16 nt, Homo sapiens
uuuagccagaaucuca

SEQ ID NO: 2138281 - RNA, 24 nt, Homo sapiens
agugacuucuggagaaagcucaug

SEQ ID NO: 2138282 - RNA, 22 nt, Homo sapiens
auuaauaugcuacaguacuaug

SEQ ID NO: 2138283 - RNA, 20 nt, Homo sapiens
gaguuaguggauaaccacag

SEQ ID NO: 2138284 - RNA, 11 nt, Homo sapiens
uuauaccuucc

SEQ ID NO: 2138285 - RNA, 13 nt, Homo sapiens
aacacaauacagc

SEQ ID NO: 2138286 - RNA, 13 nt, Homo sapiens
gacaaaaugcaga

SEQ ID NO: 2138287 - RNA, 22 nt, Homo sapiens
gaucaacaugguggaacaaaau

SEQ ID NO: 2138288 - RNA, 16 nt, Homo sapiens
ccuguugaaaagccau

SEQ ID NO: 2138289 - RNA, 20 nt, Homo sapiens
agggaccuuggagagcucag

SEQ ID NO: 2138290 - RNA, 14 nt, Homo sapiens
gcuucuuucucuca

SEQ ID NO: 2138291 - RNA, 14 nt, Homo sapiens
acuucagccuuuaa

SEQ ID NO: 2138292 - RNA, 19 nt, Homo sapiens
acuggauucuuaaccaaga

SEQ ID NO: 2138293 - RNA, 18 nt, Homo sapiens
guucccuuuccccauuca

SEQ ID NO: 2138294 - RNA, 17 nt, Homo sapiens
acccuucagaccccagu

SEQ ID NO: 2138295 - RNA, 18 nt, Homo sapiens
cccaaaucuacugagcca

SEQ ID NO: 2138296 - RNA, 16 nt, Homo sapiens
gaagacucaguaugcu

SEQ ID NO: 2138297 - RNA, 12 nt, Homo sapiens
gaaguguuucac

SEQ ID NO: 2138298 - RNA, 15 nt, Homo sapiens
cugcacauggccuga

SEQ ID NO: 2138299 - RNA, 19 nt, Homo sapiens
uaaaaugauauuguuauau

SEQ ID NO: 2138300 - RNA, 19 nt, Homo sapiens
ucaagauacaagaucaaua

SEQ ID NO: 2138301 - RNA, 11 nt, Homo sapiens
aaaggugcuac

SEQ ID NO: 2138302 - RNA, 18 nt, Homo sapiens
ccccaccacaaacacagc

SEQ ID NO: 2138303 - RNA, 16 nt, Homo sapiens
ccucuucgcugaccuc

SEQ ID NO: 2138304 - RNA, 19 nt, Homo sapiens
auuuuccugcugguuucuu

SEQ ID NO: 2138305 - RNA, 19 nt, Homo sapiens
cauucagggauagcacuga

SEQ ID NO: 2138306 - RNA, 18 nt, Homo sapiens
gaaauaaauuuuguuuca

SEQ ID NO: 2138307 - RNA, 22 nt, Homo sapiens
auaaauucuauaggaacauaug

SEQ ID NO: 2138308 - RNA, 15 nt, Homo sapiens
ucugaacucucaaaa

SEQ ID NO: 2138309 - RNA, 18 nt, Homo sapiens
ugugauuuuugaacaaua

SEQ ID NO: 2138310 - RNA, 21 nt, Homo sapiens
acaggaccccaagaaugagcu

SEQ ID NO: 2138311 - RNA, 21 nt, Homo sapiens
ggugguggcgugcauauguaa

SEQ ID NO: 2138312 - RNA, 13 nt, Homo sapiens
uacugccuugaaa

SEQ ID NO: 2138313 - RNA, 19 nt, Homo sapiens
aaccuggccaacaugguga

SEQ ID NO: 2138314 - RNA, 16 nt, Homo sapiens
ucgggggugggcuccg

SEQ ID NO: 2138315 - RNA, 13 nt, Homo sapiens
acuugcuguccag

SEQ ID NO: 2138316 - RNA, 20 nt, Homo sapiens
uguaaauggaagcacugcca

SEQ ID NO: 2138317 - RNA, 16 nt, Homo sapiens
gaggacacaguuucua

SEQ ID NO: 2138318 - RNA, 21 nt, Homo sapiens
aguccagaccccccagccccu

SEQ ID NO: 2138319 - RNA, 14 nt, Homo sapiens
aaucuugagagugu

SEQ ID NO: 2138320 - RNA, 12 nt, Homo sapiens
ccuucaucggcc

SEQ ID NO: 2138321 - RNA, 21 nt, Homo sapiens
aaggcuucagugagccaugau

SEQ ID NO: 2138322 - RNA, 21 nt, Homo sapiens
ugcaucccaccagccugagca

SEQ ID NO: 2138323 - RNA, 14 nt, Homo sapiens
ccaggcuguucuca

SEQ ID NO: 2138324 - RNA, 16 nt, Homo sapiens
acaguguguaguuugu

SEQ ID NO: 2138325 - RNA, 14 nt, Homo sapiens
acucgcacuuauca

SEQ ID NO: 2138326 - RNA, 23 nt, Homo sapiens
ucccaccccugcccccuugcccu

SEQ ID NO: 2138327 - RNA, 21 nt, Homo sapiens
cugcauuucuuaccaguguga

SEQ ID NO: 2138328 - RNA, 19 nt, Homo sapiens
ugaccugucuauaagagaa

SEQ ID NO: 2138329 - RNA, 13 nt, Homo sapiens
cuuucaagaauga

SEQ ID NO: 2138330 - RNA, 21 nt, Homo sapiens
uccaagaacuauaaacuuaaa

SEQ ID NO: 2138331 - RNA, 20 nt, Homo sapiens
cagggggugugucugcucag

SEQ ID NO: 2138332 - RNA, 12 nt, Homo sapiens
aagaccaaagag

SEQ ID NO: 2138333 - RNA, 18 nt, Homo sapiens
auggcuuucccagugugu

SEQ ID NO: 2138334 - RNA, 15 nt, Homo sapiens
cccugccucaagaaa

SEQ ID NO: 2138335 - RNA, 13 nt, Homo sapiens
uuaacucccauua

SEQ ID NO: 2138336 - RNA, 21 nt, Homo sapiens
guuucuccuuuugaccaaaua

SEQ ID NO: 2138337 - RNA, 14 nt, Homo sapiens
ucugggugcagcug

SEQ ID NO: 2138338 - RNA, 20 nt, Homo sapiens
ucuccaugaauuaguucucc

SEQ ID NO: 2138339 - RNA, 13 nt, Homo sapiens
cagaagcacaaag

SEQ ID NO: 2138340 - RNA, 18 nt, Homo sapiens
uggauuuauaaaugcuau

SEQ ID NO: 2138341 - RNA, 19 nt, Homo sapiens
uaaacuuuauuccaaguca

SEQ ID NO: 2138342 - RNA, 17 nt, Homo sapiens
cuccuguuuacugaaaa

SEQ ID NO: 2138343 - RNA, 12 nt, Homo sapiens
cacaaccaaaaa

SEQ ID NO: 2138344 - RNA, 22 nt, Homo sapiens
cugugggucgcgugaugcgcau

SEQ ID NO: 2138345 - RNA, 17 nt, Homo sapiens
cacauggugugagucca

SEQ ID NO: 2138346 - RNA, 20 nt, Homo sapiens
uagucauaugugaagacaga

SEQ ID NO: 2138347 - RNA, 18 nt, Homo sapiens
agguggcagcaagcaauu

SEQ ID NO: 2138348 - RNA, 11 nt, Homo sapiens
ucucucugugg

SEQ ID NO: 2138349 - RNA, 16 nt, Homo sapiens
gaaugagaauggacgu

SEQ ID NO: 2138350 - RNA, 17 nt, Homo sapiens
agcaaccauuuguaaaa

SEQ ID NO: 2138351 - RNA, 11 nt, Homo sapiens
auucccugugu

SEQ ID NO: 2138352 - RNA, 18 nt, Homo sapiens
uuauuuuagagcaucuca

SEQ ID NO: 2138353 - RNA, 14 nt, Homo sapiens
ugaaauaacagccu

SEQ ID NO: 2138354 - RNA, 17 nt, Homo sapiens
acccuggucucaucagu

SEQ ID NO: 2138355 - RNA, 22 nt, Homo sapiens
uaacuaccaggaauaaugauac

SEQ ID NO: 2138356 - RNA, 22 nt, Homo sapiens
uagcuccauaaaguacaaauga

SEQ ID NO: 2138357 - RNA, 18 nt, Homo sapiens
ucugugccugucugucca

SEQ ID NO: 2138358 - RNA, 16 nt, Homo sapiens
caaagauuaaaugugu

SEQ ID NO: 2138359 - RNA, 11 nt, Homo sapiens
uacaaugggaa

SEQ ID NO: 2138360 - RNA, 18 nt, Homo sapiens
acuuauucauuccucaca

SEQ ID NO: 2138361 - RNA, 20 nt, Homo sapiens
gcugccuaguuaccaugaac

SEQ ID NO: 2138362 - RNA, 23 nt, Homo sapiens
uuuauuacugagggccaccaaau

SEQ ID NO: 2138363 - RNA, 22 nt, Homo sapiens
aagcuauuauaaaacuugaauu

SEQ ID NO: 2138364 - RNA, 17 nt, Homo sapiens
caacucgggagcauucu

SEQ ID NO: 2138365 - RNA, 20 nt, Homo sapiens
cuaaugccuuucaucuugaa

SEQ ID NO: 2138366 - RNA, 19 nt, Homo sapiens
aguuuuagaccucaucucc

SEQ ID NO: 2138367 - RNA, 13 nt, Homo sapiens
cugaaaccaaaac

SEQ ID NO: 2138368 - RNA, 16 nt, Homo sapiens
aaagguagauuuuaca

SEQ ID NO: 2138369 - RNA, 15 nt, Homo sapiens
aggacccacacugcu

SEQ ID NO: 2138370 - RNA, 17 nt, Homo sapiens
ucaauaauuguccauga

SEQ ID NO: 2138371 - RNA, 19 nt, Homo sapiens
agauggacagacagccacc

SEQ ID NO: 2138372 - RNA, 17 nt, Homo sapiens
uacacaggagucuucag

SEQ ID NO: 2138373 - RNA, 14 nt, Homo sapiens
uaccuucuuucacu

SEQ ID NO: 2138374 - RNA, 12 nt, Homo sapiens
aaguacauguau

SEQ ID NO: 2138375 - RNA, 12 nt, Homo sapiens
gaaaacauauga

SEQ ID NO: 2138376 - RNA, 12 nt, Homo sapiens
aaauacaugugu

SEQ ID NO: 2138377 - RNA, 19 nt, Homo sapiens
ccuggcaggccagugucug

SEQ ID NO: 2138378 - RNA, 19 nt, Homo sapiens
agcccuguccccuaccccc

SEQ ID NO: 2138379 - RNA, 19 nt, Homo sapiens
cucugggaggggugcugcc

SEQ ID NO: 2138380 - RNA, 16 nt, Homo sapiens
uuaaacucagggacag

SEQ ID NO: 2138381 - RNA, 12 nt, Homo sapiens
cuugggagcugc

SEQ ID NO: 2138382 - RNA, 21 nt, Homo sapiens
ugggcaagccuguuccgguga

SEQ ID NO: 2138383 - RNA, 19 nt, Homo sapiens
acaucugcuuccacugugu

SEQ ID NO: 2138384 - RNA, 20 nt, Homo sapiens
agauuucacaggucuugccc

SEQ ID NO: 2138385 - RNA, 16 nt, Homo sapiens
cacccuaccacagucc

SEQ ID NO: 2138386 - RNA, 23 nt, Homo sapiens
gccgucucaugcagaagagggaa

SEQ ID NO: 2138387 - RNA, 20 nt, Homo sapiens
uaaaacucacugugaucaau

SEQ ID NO: 2138388 - RNA, 20 nt, Homo sapiens
caguguguuucugaucugau

SEQ ID NO: 2138389 - RNA, 22 nt, Homo sapiens
uccaaaaggucuuuuuacauug

SEQ ID NO: 2138390 - RNA, 15 nt, Homo sapiens
uauuaguaucuucca

SEQ ID NO: 2138391 - RNA, 19 nt, Homo sapiens
cugcgcucucuuugcaacu

SEQ ID NO: 2138392 - RNA, 15 nt, Homo sapiens
guguaacuaugcugu

SEQ ID NO: 2138393 - RNA, 18 nt, Homo sapiens
auucuguuauacuucugu

SEQ ID NO: 2138394 - RNA, 16 nt, Homo sapiens
cugguuagauucauua

SEQ ID NO: 2138395 - RNA, 14 nt, Homo sapiens
uuuaaccauuccau

SEQ ID NO: 2138396 - RNA, 14 nt, Homo sapiens
cccacccaccuccu

SEQ ID NO: 2138397 - RNA, 18 nt, Homo sapiens
acugguuauccugugcua

SEQ ID NO: 2138398 - RNA, 21 nt, Homo sapiens
aauuauguguugccaaaacca

SEQ ID NO: 2138399 - RNA, 21 nt, Homo sapiens
cugucugggauuaagggcaaa

SEQ ID NO: 2138400 - RNA, 19 nt, Homo sapiens
uuggaaacauuuuugagau

SEQ ID NO: 2138401 - RNA, 22 nt, Homo sapiens
ugauuagagugcaaaagugaga

SEQ ID NO: 2138402 - RNA, 16 nt, Homo sapiens
ucaaaggaagacuuga

SEQ ID NO: 2138403 - RNA, 16 nt, Homo sapiens
cucauugcuaaccacu

SEQ ID NO: 2138404 - RNA, 15 nt, Homo sapiens
uugccucucugccag

SEQ ID NO: 2138405 - RNA, 16 nt, Homo sapiens
uaaucgagacugaaag

SEQ ID NO: 2138406 - RNA, 13 nt, Homo sapiens
uggccuaggcagu

SEQ ID NO: 2138407 - RNA, 12 nt, Homo sapiens
agaaaagacaug

SEQ ID NO: 2138408 - RNA, 15 nt, Homo sapiens
uuuguaagaugcugg

SEQ ID NO: 2138409 - RNA, 20 nt, Homo sapiens
cagauaaagguucaugcaaa

SEQ ID NO: 2138410 - RNA, 19 nt, Homo sapiens
gucgaauuccuacugacaa

SEQ ID NO: 2138411 - RNA, 14 nt, Homo sapiens
ggaaggaacaaaga

SEQ ID NO: 2138412 - RNA, 14 nt, Homo sapiens
ggcaggaacacaga

SEQ ID NO: 2138413 - RNA, 18 nt, Homo sapiens
cuugggccagagcucaac

SEQ ID NO: 2138414 - RNA, 15 nt, Homo sapiens
uguguuucugacaca

SEQ ID NO: 2138415 - RNA, 15 nt, Homo sapiens
cgagauuccgucuca

SEQ ID NO: 2138416 - RNA, 19 nt, Homo sapiens
cugcucgccuuagcacuac

SEQ ID NO: 2138417 - RNA, 13 nt, Homo sapiens
uccagaagcacug

SEQ ID NO: 2138418 - RNA, 15 nt, Homo sapiens
ugacauuuaggauuu

SEQ ID NO: 2138419 - RNA, 20 nt, Homo sapiens
gacuugaauagacacuucac

SEQ ID NO: 2138420 - RNA, 18 nt, Homo sapiens
uucauuuuaacaucugag

SEQ ID NO: 2138421 - RNA, 20 nt, Homo sapiens
agcagaauucauucauacuu

SEQ ID NO: 2138422 - RNA, 15 nt, Homo sapiens
aaccugauuuaccuc

SEQ ID NO: 2138423 - RNA, 20 nt, Homo sapiens
cugcacuaauuugauguuua

SEQ ID NO: 2138424 - RNA, 12 nt, Homo sapiens
auguuagugcaa

SEQ ID NO: 2138425 - RNA, 21 nt, Homo sapiens
uauaaaugcggauacagguua

SEQ ID NO: 2138426 - RNA, 16 nt, Homo sapiens
cacccuuccaucugau

SEQ ID NO: 2138427 - RNA, 15 nt, Homo sapiens
agguggcucaugccu

SEQ ID NO: 2138428 - RNA, 16 nt, Homo sapiens
acguuuauagccgaaa

SEQ ID NO: 2138429 - RNA, 21 nt, Homo sapiens
gaaguggcuacugacuacccu

SEQ ID NO: 2138430 - RNA, 16 nt, Homo sapiens
accacagaaagcacuc

SEQ ID NO: 2138431 - RNA, 23 nt, Homo sapiens
aaagaggagagaggaagcucucu

SEQ ID NO: 2138432 - RNA, 18 nt, Homo sapiens
uuaucuaaccuguuccau

SEQ ID NO: 2138433 - RNA, 14 nt, Homo sapiens
agggaacaguauuu

SEQ ID NO: 2138434 - RNA, 16 nt, Homo sapiens
uguaucugugggucuc

SEQ ID NO: 2138435 - RNA, 13 nt, Homo sapiens
uacaaaguacaga

SEQ ID NO: 2138436 - RNA, 11 nt, Homo sapiens
cagaugacaaa

SEQ ID NO: 2138437 - RNA, 12 nt, Homo sapiens
ggcaggugcaga

SEQ ID NO: 2138438 - RNA, 23 nt, Homo sapiens
aacauagacucacucuuccacau

SEQ ID NO: 2138439 - RNA, 18 nt, Homo sapiens
ggacccaggcaccugcau

SEQ ID NO: 2138440 - RNA, 18 nt, Homo sapiens
acaggcaguuaggugcug

SEQ ID NO: 2138441 - RNA, 13 nt, Homo sapiens
uauugauuucaaa

SEQ ID NO: 2138442 - RNA, 13 nt, Homo sapiens
auagggguugagu

SEQ ID NO: 2138443 - RNA, 15 nt, Homo sapiens
guucacgcucaccca

SEQ ID NO: 2138444 - RNA, 22 nt, Homo sapiens
aaucucccagugacaacaucgc

SEQ ID NO: 2138445 - RNA, 16 nt, Homo sapiens
cugagcagaauacugg

SEQ ID NO: 2138446 - RNA, 17 nt, Homo sapiens
ccuuaaagauacuugaa

SEQ ID NO: 2138447 - RNA, 20 nt, Homo sapiens
auuugguaaaaaugcugcuc

SEQ ID NO: 2138448 - RNA, 19 nt, Homo sapiens
cucuggaccagccuguugg

SEQ ID NO: 2138449 - RNA, 16 nt, Homo sapiens
caugaccacugcccug

SEQ ID NO: 2138450 - RNA, 17 nt, Homo sapiens
ugguaaaguguuaagga

SEQ ID NO: 2138451 - RNA, 17 nt, Homo sapiens
aggucaggaguucaaga

SEQ ID NO: 2138452 - RNA, 23 nt, Homo sapiens
auuaccuguggaguugcauaucc

SEQ ID NO: 2138453 - RNA, 13 nt, Homo sapiens
uuuccccagacac

SEQ ID NO: 2138454 - RNA, 13 nt, Homo sapiens
augguuucuccag

SEQ ID NO: 2138455 - RNA, 21 nt, Homo sapiens
uugggaucagcaggccaggca

SEQ ID NO: 2138456 - RNA, 16 nt, Homo sapiens
uuacagugcagacagg

SEQ ID NO: 2138457 - RNA, 12 nt, Homo sapiens
uuuccucaaaaa

SEQ ID NO: 2138458 - RNA, 14 nt, Homo sapiens
gggaccacaaggaa

SEQ ID NO: 2138459 - RNA, 12 nt, Homo sapiens
agccaaauucau

SEQ ID NO: 2138460 - RNA, 18 nt, Homo sapiens
gaaagagcaagugacuuu

SEQ ID NO: 2138461 - RNA, 15 nt, Homo sapiens
ucuauucuuucccua

SEQ ID NO: 2138462 - RNA, 14 nt, Homo sapiens
cuucuaacugaagg

SEQ ID NO: 2138463 - RNA, 21 nt, Homo sapiens
gugcuucacacaaagugaaau

SEQ ID NO: 2138464 - RNA, 16 nt, Homo sapiens
accuauauugauuuaa

SEQ ID NO: 2138465 - RNA, 13 nt, Homo sapiens
acuggcagaucau

SEQ ID NO: 2138466 - RNA, 12 nt, Homo sapiens
uacauaugcuga

SEQ ID NO: 2138467 - RNA, 20 nt, Homo sapiens
cggacacggcuucacugacc

SEQ ID NO: 2138468 - RNA, 13 nt, Homo sapiens
auuucacugaugu

SEQ ID NO: 2138469 - RNA, 18 nt, Homo sapiens
aaaaugguaauuguugcu

SEQ ID NO: 2138470 - RNA, 21 nt, Homo sapiens
uuucacuuucugucuagguua

SEQ ID NO: 2138471 - RNA, 23 nt, Homo sapiens
auuugcauugaggaaauauuaau

SEQ ID NO: 2138472 - RNA, 16 nt, Homo sapiens
ugucugaaacagagaa

SEQ ID NO: 2138473 - RNA, 18 nt, Homo sapiens
aguacuaagggaacaauc

SEQ ID NO: 2138474 - RNA, 23 nt, Homo sapiens
agaaggguggggauaucagggca

SEQ ID NO: 2138475 - RNA, 21 nt, Homo sapiens
acagcacccuguggucuuccu

SEQ ID NO: 2138476 - RNA, 15 nt, Homo sapiens
cucugcaucccccaa

SEQ ID NO: 2138477 - RNA, 18 nt, Homo sapiens
ugguaacuuuacaacugg

SEQ ID NO: 2138478 - RNA, 13 nt, Homo sapiens
gcuuagacucuug

SEQ ID NO: 2138479 - RNA, 21 nt, Homo sapiens
ccucuaugaagccuaacucuu

SEQ ID NO: 2138480 - RNA, 24 nt, Homo sapiens
auccagaauggaauuuugcuacau

SEQ ID NO: 2138481 - RNA, 19 nt, Homo sapiens
ggaaaugauugagagcagc

SEQ ID NO: 2138482 - RNA, 22 nt, Homo sapiens
ucaaaccugugcugaccaaaga

SEQ ID NO: 2138483 - RNA, 15 nt, Homo sapiens
gggacaggugccagg

SEQ ID NO: 2138484 - RNA, 18 nt, Homo sapiens
caucggucuaaagcuuug

SEQ ID NO: 2138485 - RNA, 22 nt, Homo sapiens
gagugaggguuucugagcugcu

SEQ ID NO: 2138486 - RNA, 13 nt, Homo sapiens
ccucacagguguc

SEQ ID NO: 2138487 - RNA, 17 nt, Homo sapiens
ugccuguaacagccacc

SEQ ID NO: 2138488 - RNA, 14 nt, Homo sapiens
gaacugcagugaug

SEQ ID NO: 2138489 - RNA, 17 nt, Homo sapiens
gaacaucugccuugcug

SEQ ID NO: 2138490 - RNA, 16 nt, Homo sapiens
aagcccaggagccuca

SEQ ID NO: 2138491 - RNA, 18 nt, Homo sapiens
caccuucagugcuggugg

SEQ ID NO: 2138492 - RNA, 15 nt, Homo sapiens
uacccucccaccaga

SEQ ID NO: 2138493 - RNA, 14 nt, Homo sapiens
augcuuucccugag

SEQ ID NO: 2138494 - RNA, 19 nt, Homo sapiens
auuauuacucuacacugaa

SEQ ID NO: 2138495 - RNA, 12 nt, Homo sapiens
cucaggcccaca

SEQ ID NO: 2138496 - RNA, 22 nt, Homo sapiens
gaccugccccggaccuaccucc

SEQ ID NO: 2138497 - RNA, 21 nt, Homo sapiens
ccuguagaugacauggugaaa

SEQ ID NO: 2138498 - RNA, 21 nt, Homo sapiens
agcugauugggcaccugacca

SEQ ID NO: 2138499 - RNA, 18 nt, Homo sapiens
ucucgguagcugugcgug

SEQ ID NO: 2138500 - RNA, 12 nt, Homo sapiens
gcagcacucccc

SEQ ID NO: 2138501 - RNA, 12 nt, Homo sapiens
ccagcacugccc

SEQ ID NO: 2138502 - RNA, 20 nt, Homo sapiens
gcaaauucccagauuugaag

SEQ ID NO: 2138503 - RNA, 14 nt, Homo sapiens
gugauugcugccau

SEQ ID NO: 2138504 - RNA, 17 nt, Homo sapiens
auguacauguacugauu

SEQ ID NO: 2138505 - RNA, 20 nt, Homo sapiens
gaucucagcagugaaguaua

SEQ ID NO: 2138506 - RNA, 18 nt, Homo sapiens
ugaauuuggggcuacuua

SEQ ID NO: 2138507 - RNA, 20 nt, Homo sapiens
aacuauuggggugaggauaa

SEQ ID NO: 2138508 - RNA, 17 nt, Homo sapiens
uuaagacaagcuguaua

SEQ ID NO: 2138509 - RNA, 15 nt, Homo sapiens
guuggauuucaguga

SEQ ID NO: 2138510 - RNA, 21 nt, Homo sapiens
ucaauaaaauaaugacauaaa

SEQ ID NO: 2138511 - RNA, 15 nt, Homo sapiens
aagcaucaccucagg

SEQ ID NO: 2138512 - RNA, 19 nt, Homo sapiens
cuugcuucucuagcucucu

SEQ ID NO: 2138513 - RNA, 22 nt, Homo sapiens
agcagugauuguuaugccuugc

SEQ ID NO: 2138514 - RNA, 16 nt, Homo sapiens
caaaguugauuaagaa

SEQ ID NO: 2138515 - RNA, 21 nt, Homo sapiens
ccaguaucucuucagucucua

SEQ ID NO: 2138516 - RNA, 22 nt, Homo sapiens
uaagcugcucccugucuaugua

SEQ ID NO: 2138517 - RNA, 19 nt, Homo sapiens
cucccaaguagcugagacu

SEQ ID NO: 2138518 - RNA, 12 nt, Homo sapiens
cugacaaagaca

SEQ ID NO: 2138519 - RNA, 13 nt, Homo sapiens
uuuauagcacaug

SEQ ID NO: 2138520 - RNA, 16 nt, Homo sapiens
aucucuuccuacccaa

SEQ ID NO: 2138521 - RNA, 18 nt, Homo sapiens
cugaccccugcaccagcc

SEQ ID NO: 2138522 - RNA, 18 nt, Homo sapiens
gguacgaguagagguuua

SEQ ID NO: 2138523 - RNA, 15 nt, Homo sapiens
aaagccaccacauuu

SEQ ID NO: 2138524 - RNA, 15 nt, Homo sapiens
acaagugcgccuugc

SEQ ID NO: 2138525 - RNA, 18 nt, Homo sapiens
aucaauaaaaaacaaaua

SEQ ID NO: 2138526 - RNA, 19 nt, Homo sapiens
ggaugcugacaucauuugu

SEQ ID NO: 2138527 - RNA, 23 nt, Homo sapiens
aauacuaacugcugauuuugaca

SEQ ID NO: 2138528 - RNA, 13 nt, Homo sapiens
uugcagggcagcc

SEQ ID NO: 2138529 - RNA, 20 nt, Homo sapiens
cagcuccuuuauuauaauca

SEQ ID NO: 2138530 - RNA, 17 nt, Homo sapiens
ugaagcagucuugcucu

SEQ ID NO: 2138531 - RNA, 16 nt, Homo sapiens
cccaguaucaugcgau

SEQ ID NO: 2138532 - RNA, 20 nt, Homo sapiens
uugcagugagccgagaucac

SEQ ID NO: 2138533 - RNA, 20 nt, Homo sapiens
uggggcagaaacacucaagu

SEQ ID NO: 2138534 - RNA, 18 nt, Homo sapiens
ugacggcgcccccagugu

SEQ ID NO: 2138535 - RNA, 16 nt, Homo sapiens
cagagaaaagacauaa

SEQ ID NO: 2138536 - RNA, 12 nt, Homo sapiens
ucagugugcaua

SEQ ID NO: 2138537 - RNA, 19 nt, Homo sapiens
cuaaaguaugguacaucua

SEQ ID NO: 2138538 - RNA, 17 nt, Homo sapiens
ucacuuucucucuuaua

SEQ ID NO: 2138539 - RNA, 16 nt, Homo sapiens
cucaaucuacaggcca

SEQ ID NO: 2138540 - RNA, 19 nt, Homo sapiens
ccuagaaagccauauucca

SEQ ID NO: 2138541 - RNA, 23 nt, Homo sapiens
guuuaauacccuguacauaucuu

SEQ ID NO: 2138542 - RNA, 20 nt, Homo sapiens
auuacuguugcauuuacuuu

SEQ ID NO: 2138543 - RNA, 18 nt, Homo sapiens
agagugauucuugcugcu

SEQ ID NO: 2138544 - RNA, 15 nt, Homo sapiens
auaauuguugauauu

SEQ ID NO: 2138545 - RNA, 16 nt, Homo sapiens
cuugggaugaugccuc

SEQ ID NO: 2138546 - RNA, 22 nt, Homo sapiens
uggucugucaaugagagcauaa

SEQ ID NO: 2138547 - RNA, 20 nt, Homo sapiens
cugcuaagucauuggcaaag

SEQ ID NO: 2138548 - RNA, 15 nt, Homo sapiens
acaucaaguguucca

SEQ ID NO: 2138549 - RNA, 23 nt, Homo sapiens
ucauaguuaaauguuaccucuga

SEQ ID NO: 2138550 - RNA, 12 nt, Homo sapiens
aauggcuauuaa

SEQ ID NO: 2138551 - RNA, 17 nt, Homo sapiens
cuccucugaaacagcug

SEQ ID NO: 2138552 - RNA, 21 nt, Homo sapiens
caaaggcugagaacacuguga

SEQ ID NO: 2138553 - RNA, 15 nt, Homo sapiens
gccauaaagugccag

SEQ ID NO: 2138554 - RNA, 21 nt, Homo sapiens
agaguucuccagacaggguuc

SEQ ID NO: 2138555 - RNA, 15 nt, Homo sapiens
cuuguggcacuccaa

SEQ ID NO: 2138556 - RNA, 16 nt, Homo sapiens
cuagaauuuuauauca

SEQ ID NO: 2138557 - RNA, 21 nt, Homo sapiens
ucaguaacaaguguuggcaaa

SEQ ID NO: 2138558 - RNA, 16 nt, Homo sapiens
ugggagaucagccacg

SEQ ID NO: 2138559 - RNA, 23 nt, Homo sapiens
cucaaaagcuucgugccaacaga

SEQ ID NO: 2138560 - RNA, 17 nt, Homo sapiens
ucuuggcaauuccucuu

SEQ ID NO: 2138561 - RNA, 21 nt, Homo sapiens
aaauuauuacuaaugaugcuu

SEQ ID NO: 2138562 - RNA, 15 nt, Homo sapiens
cucaucccaugagac

SEQ ID NO: 2138563 - RNA, 14 nt, Homo sapiens
agugucuaauuccc

SEQ ID NO: 2138564 - RNA, 21 nt, Homo sapiens
aaaucucuccacuuucagcug

SEQ ID NO: 2138565 - RNA, 20 nt, Homo sapiens
acuagaauagugcauuguau

SEQ ID NO: 2138566 - RNA, 18 nt, Homo sapiens
ucaacauggaaaaauccu

SEQ ID NO: 2138567 - RNA, 19 nt, Homo sapiens
uaagcuccaugugcauaua

SEQ ID NO: 2138568 - RNA, 23 nt, Homo sapiens
acugccuggagggcagggagugg

SEQ ID NO: 2138569 - RNA, 23 nt, Homo sapiens
agugaguuuguugaagugcacau

SEQ ID NO: 2138570 - RNA, 20 nt, Homo sapiens
uuuaaaaauaaaagcuauua

SEQ ID NO: 2138571 - RNA, 20 nt, Homo sapiens
ccagagaacugcagaccuca

SEQ ID NO: 2138572 - RNA, 20 nt, Homo sapiens
auaaaaccaagccucuggaa

SEQ ID NO: 2138573 - RNA, 14 nt, Homo sapiens
caugcgggugcaca

SEQ ID NO: 2138574 - RNA, 21 nt, Homo sapiens
aacaccuucucuggagccaag

SEQ ID NO: 2138575 - RNA, 23 nt, Homo sapiens
caccacuuccgucccauccuugc

SEQ ID NO: 2138576 - RNA, 11 nt, Homo sapiens
ucacaagcaau

SEQ ID NO: 2138577 - RNA, 19 nt, Homo sapiens
aguaggaggaggaugagcc

SEQ ID NO: 2138578 - RNA, 23 nt, Homo sapiens
uauguuguucuuacaaaccauac

SEQ ID NO: 2138579 - RNA, 16 nt, Homo sapiens
ucaucaccagacuuug

SEQ ID NO: 2138580 - RNA, 20 nt, Homo sapiens
cuuguauaaugaacauguua

SEQ ID NO: 2138581 - RNA, 20 nt, Homo sapiens
aggcagggagggaaacccgg

SEQ ID NO: 2138582 - RNA, 16 nt, Homo sapiens
aaagguuuaaacuacc

SEQ ID NO: 2138583 - RNA, 21 nt, Homo sapiens
uuuagaccuguguuacuaaaa

SEQ ID NO: 2138584 - RNA, 15 nt, Homo sapiens
ccaccggaacugggc

SEQ ID NO: 2138585 - RNA, 16 nt, Homo sapiens
cauccuaguaauaaag

SEQ ID NO: 2138586 - RNA, 23 nt, Homo sapiens
gccccagagcuguuuauggccuc

SEQ ID NO: 2138587 - RNA, 19 nt, Homo sapiens
gauauccuacuuggcagaa

SEQ ID NO: 2138588 - RNA, 16 nt, Homo sapiens
uacauuuuucugaugg

SEQ ID NO: 2138589 - RNA, 18 nt, Homo sapiens
ugcaugaaguaauaugca

SEQ ID NO: 2138590 - RNA, 13 nt, Homo sapiens
caggcucccugac

SEQ ID NO: 2138591 - RNA, 17 nt, Homo sapiens
aguaguuuuuaucugaa

SEQ ID NO: 2138592 - RNA, 14 nt, Homo sapiens
ucauguuacuuccc

SEQ ID NO: 2138593 - RNA, 18 nt, Homo sapiens
ccagugugggcuugacca

SEQ ID NO: 2138594 - RNA, 16 nt, Homo sapiens
uaugcuuauaaguuug

SEQ ID NO: 2138595 - RNA, 14 nt, Homo sapiens
cguucgcauggcag

SEQ ID NO: 2138596 - RNA, 20 nt, Homo sapiens
agauauuguuuggaucaaaa

SEQ ID NO: 2138597 - RNA, 11 nt, Homo sapiens
cacuacaggca

SEQ ID NO: 2138598 - RNA, 16 nt, Homo sapiens
gcaaauggaaaacagg

SEQ ID NO: 2138599 - RNA, 16 nt, Homo sapiens
aaugcugagcugaaga

SEQ ID NO: 2138600 - RNA, 23 nt, Homo sapiens
uuucaguccaugaucccacugac

SEQ ID NO: 2138601 - RNA, 14 nt, Homo sapiens
acgagcacgagcug

SEQ ID NO: 2138602 - RNA, 18 nt, Homo sapiens
accaugccuccuucccag

SEQ ID NO: 2138603 - RNA, 22 nt, Homo sapiens
ggacucaaugcacugacauugu

SEQ ID NO: 2138604 - RNA, 17 nt, Homo sapiens
gauguacacacacagau

SEQ ID NO: 2138605 - RNA, 18 nt, Homo sapiens
cgaccugcggcugcugug

SEQ ID NO: 2138606 - RNA, 16 nt, Homo sapiens
aucaaugcaagaguga

SEQ ID NO: 2138607 - RNA, 12 nt, Homo sapiens
gagggagugcag

SEQ ID NO: 2138608 - RNA, 20 nt, Homo sapiens
gaaacuuucaaauccuucau

SEQ ID NO: 2138609 - RNA, 18 nt, Homo sapiens
uucucaggccucugcucu

SEQ ID NO: 2138610 - RNA, 22 nt, Homo sapiens
uuauaggcaccuaccaccacgc

SEQ ID NO: 2138611 - RNA, 18 nt, Homo sapiens
caagcucaaggcaauggg

SEQ ID NO: 2138612 - RNA, 14 nt, Homo sapiens
uuguaaacuguugu

SEQ ID NO: 2138613 - RNA, 17 nt, Homo sapiens
caugaguuggcugggaa

SEQ ID NO: 2138614 - RNA, 22 nt, Homo sapiens
uaaaauucugauguuucuguga

SEQ ID NO: 2138615 - RNA, 13 nt, Homo sapiens
ugcggcaucucca

SEQ ID NO: 2138616 - RNA, 10 nt, Homo sapiens
aaauugcacg

SEQ ID NO: 2138617 - RNA, 16 nt, Homo sapiens
aggugcuagggugccu

SEQ ID NO: 2138618 - RNA, 13 nt, Homo sapiens
cagagcugggcua

SEQ ID NO: 2138619 - RNA, 16 nt, Homo sapiens
gaagcagcagaccucc

SEQ ID NO: 2138620 - RNA, 22 nt, Homo sapiens
gucuauguucaaagacugugaa

SEQ ID NO: 2138621 - RNA, 21 nt, Homo sapiens
ucuguagagguuauuucugca

SEQ ID NO: 2138622 - RNA, 19 nt, Homo sapiens
cagagacgggguuugccau

SEQ ID NO: 2138623 - RNA, 16 nt, Homo sapiens
ugcaagagaaacugca

SEQ ID NO: 2138624 - RNA, 13 nt, Homo sapiens
uggggcauuaucc

SEQ ID NO: 2138625 - RNA, 22 nt, Homo sapiens
auuaagggauuaguauuuuucc

SEQ ID NO: 2138626 - RNA, 16 nt, Homo sapiens
acugagaaugauagua

SEQ ID NO: 2138627 - RNA, 15 nt, Homo sapiens
cuauggccucccuau

SEQ ID NO: 2138628 - RNA, 16 nt, Homo sapiens
gcaggugucccugaga

SEQ ID NO: 2138629 - RNA, 18 nt, Homo sapiens
aauaacaaaucguccaaa

SEQ ID NO: 2138630 - RNA, 23 nt, Homo sapiens
gaggccgccuccucggggcucca

SEQ ID NO: 2138631 - RNA, 20 nt, Homo sapiens
uacccucccucuagccuuua

SEQ ID NO: 2138632 - RNA, 23 nt, Homo sapiens
uuuccaauccagaggaacaagca

SEQ ID NO: 2138633 - RNA, 23 nt, Homo sapiens
gaggcuggaggccggaaucucag

SEQ ID NO: 2138634 - RNA, 13 nt, Homo sapiens
auuaggcaugccu

SEQ ID NO: 2138635 - RNA, 14 nt, Homo sapiens
cagcacagccucac

SEQ ID NO: 2138636 - RNA, 11 nt, Homo sapiens
uuaaacuugua

SEQ ID NO: 2138637 - RNA, 18 nt, Homo sapiens
ucccgaguaacugagauu

SEQ ID NO: 2138638 - RNA, 15 nt, Homo sapiens
agccugggugcacag

SEQ ID NO: 2138639 - RNA, 21 nt, Homo sapiens
agcaaacccugucaaacauua

SEQ ID NO: 2138640 - RNA, 19 nt, Homo sapiens
uucuuugcccagacauuua

SEQ ID NO: 2138641 - RNA, 15 nt, Homo sapiens
cugucauaugcagaa

SEQ ID NO: 2138642 - RNA, 13 nt, Homo sapiens
uaaauauuaucua

SEQ ID NO: 2138643 - RNA, 14 nt, Homo sapiens
gaugaucaacauaa

SEQ ID NO: 2138644 - RNA, 20 nt, Homo sapiens
gaagcucaacuguugccagg

SEQ ID NO: 2138645 - RNA, 22 nt, Homo sapiens
ugcacacuaauaaaacaugugg

SEQ ID NO: 2138646 - RNA, 22 nt, Homo sapiens
uguaaaauggaggccauugugu

SEQ ID NO: 2138647 - RNA, 18 nt, Homo sapiens
cuugauaggacuuccuua

SEQ ID NO: 2138648 - RNA, 22 nt, Homo sapiens
cugugccgggaggcagccacag

SEQ ID NO: 2138649 - RNA, 13 nt, Homo sapiens
cuucuaaauuccc

SEQ ID NO: 2138650 - RNA, 14 nt, Homo sapiens
uuccacuacugcua

SEQ ID NO: 2138651 - RNA, 13 nt, Homo sapiens
agccauuucccau

SEQ ID NO: 2138652 - RNA, 20 nt, Homo sapiens
gaggaaucuaaacaaacagg

SEQ ID NO: 2138653 - RNA, 14 nt, Homo sapiens
ucauaugugcagua

SEQ ID NO: 2138654 - RNA, 23 nt, Homo sapiens
aaaaccuuaagaguucuaaccau

SEQ ID NO: 2138655 - RNA, 22 nt, Homo sapiens
uuucaagggaccucuccaugau

SEQ ID NO: 2138656 - RNA, 20 nt, Homo sapiens
gauuccacacugcacuguua

SEQ ID NO: 2138657 - RNA, 18 nt, Homo sapiens
ugcacaugaacauauguc

SEQ ID NO: 2138658 - RNA, 19 nt, Homo sapiens
gaaaauaacaaagcccuua

SEQ ID NO: 2138659 - RNA, 18 nt, Homo sapiens
ggagguuaggucuuagga

SEQ ID NO: 2138660 - RNA, 17 nt, Homo sapiens
uaauuauuucacuuuag

SEQ ID NO: 2138661 - RNA, 15 nt, Homo sapiens
cugguuugaaagccu

SEQ ID NO: 2138662 - RNA, 15 nt, Homo sapiens
cauacgcaugguccu

SEQ ID NO: 2138663 - RNA, 21 nt, Homo sapiens
cuaguaauugggaaaaaagca

SEQ ID NO: 2138664 - RNA, 13 nt, Homo sapiens
gcaggagugccag

SEQ ID NO: 2138665 - RNA, 20 nt, Homo sapiens
gaagugacuguuguaccaug

SEQ ID NO: 2138666 - RNA, 20 nt, Homo sapiens
caucagcaggaaugcucuga

SEQ ID NO: 2138667 - RNA, 15 nt, Homo sapiens
gacagacacguguga

SEQ ID NO: 2138668 - RNA, 19 nt, Homo sapiens
guaugugcaccaacaggca

SEQ ID NO: 2138669 - RNA, 14 nt, Homo sapiens
ggagaaacacuuga

SEQ ID NO: 2138670 - RNA, 15 nt, Homo sapiens
aguaaauuacauuaa

SEQ ID NO: 2138671 - RNA, 14 nt, Homo sapiens
auauagcaauacuu

SEQ ID NO: 2138672 - RNA, 14 nt, Homo sapiens
ggguacugacugag

SEQ ID NO: 2138673 - RNA, 19 nt, Homo sapiens
gccuccauguuuuaauauc

SEQ ID NO: 2138674 - RNA, 13 nt, Homo sapiens
gccagaggcagcu

SEQ ID NO: 2138675 - RNA, 20 nt, Homo sapiens
gcaaaaccaacucucuacua

SEQ ID NO: 2138676 - RNA, 16 nt, Homo sapiens
aaauuuugugaugaau

SEQ ID NO: 2138677 - RNA, 23 nt, Homo sapiens
gacugcuuuuaaaugaccaaaga

SEQ ID NO: 2138678 - RNA, 14 nt, Homo sapiens
guaagguguguacu

SEQ ID NO: 2138679 - RNA, 19 nt, Homo sapiens
gcaggaugauuguacagaa

SEQ ID NO: 2138680 - RNA, 20 nt, Homo sapiens
agaauagcuuuuacucuggu

SEQ ID NO: 2138681 - RNA, 15 nt, Homo sapiens
gaaaaucaaugcuuu

SEQ ID NO: 2138682 - RNA, 19 nt, Homo sapiens
ucaugcauucuagugcaga

SEQ ID NO: 2138683 - RNA, 14 nt, Homo sapiens
ugaagugcaugggu

SEQ ID NO: 2138684 - RNA, 22 nt, Homo sapiens
cacuaagggguauguucccucu

SEQ ID NO: 2138685 - RNA, 13 nt, Homo sapiens
acugcucugccca

SEQ ID NO: 2138686 - RNA, 15 nt, Homo sapiens
uugccuccauucucc

SEQ ID NO: 2138687 - RNA, 19 nt, Homo sapiens
ugguaugggggauuucaaa

SEQ ID NO: 2138688 - RNA, 16 nt, Homo sapiens
uaggcauucuaaguca

SEQ ID NO: 2138689 - RNA, 22 nt, Homo sapiens
aguagaagauuuuaugcugcug

SEQ ID NO: 2138690 - RNA, 19 nt, Homo sapiens
augggagaguuucuuuaca

SEQ ID NO: 2138691 - RNA, 20 nt, Homo sapiens
cacuaagaaguuccacuuaa

SEQ ID NO: 2138692 - RNA, 22 nt, Homo sapiens
gcggaucaucuaauucucugug

SEQ ID NO: 2138693 - RNA, 17 nt, Homo sapiens
ugaccuccauuucccaa

SEQ ID NO: 2138694 - RNA, 15 nt, Homo sapiens
cuccugcuacuuccc

SEQ ID NO: 2138695 - RNA, 14 nt, Homo sapiens
aacuuagugacaaa

SEQ ID NO: 2138696 - RNA, 15 nt, Homo sapiens
ccacuuucugccagc

SEQ ID NO: 2138697 - RNA, 13 nt, Homo sapiens
cauaauaauagca

SEQ ID NO: 2138698 - RNA, 12 nt, Homo sapiens
caggucuucucu

SEQ ID NO: 2138699 - RNA, 20 nt, Homo sapiens
acucccuccucaccucugga

SEQ ID NO: 2138700 - RNA, 21 nt, Homo sapiens
aaguaugaauauuacucucaa

SEQ ID NO: 2138701 - RNA, 23 nt, Homo sapiens
cugugauauuuucacacugguaa

SEQ ID NO: 2138702 - RNA, 21 nt, Homo sapiens
agcuauuuaaguggacuguau

SEQ ID NO: 2138703 - RNA, 17 nt, Homo sapiens
cuguagagccagccuug

SEQ ID NO: 2138704 - RNA, 15 nt, Homo sapiens
cagacagaucuggaa

SEQ ID NO: 2138705 - RNA, 18 nt, Homo sapiens
ccuuggcccaccugaggc

SEQ ID NO: 2138706 - RNA, 14 nt, Homo sapiens
aacaaaaaaaccac

SEQ ID NO: 2138707 - RNA, 14 nt, Homo sapiens
acucuaaaacuauc

SEQ ID NO: 2138708 - RNA, 14 nt, Homo sapiens
aaaacaaaaaaccc

SEQ ID NO: 2138709 - RNA, 21 nt, Homo sapiens
ccuuuguuuaaaaugucauuu

SEQ ID NO: 2138710 - RNA, 16 nt, Homo sapiens
uauccuagucauucuu

SEQ ID NO: 2138711 - RNA, 21 nt, Homo sapiens
aaaaagcaaagguuacaugug

SEQ ID NO: 2138712 - RNA, 23 nt, Homo sapiens
accauuuaauggggaggacaaaa

SEQ ID NO: 2138713 - RNA, 21 nt, Homo sapiens
agggucacgcuugccugguca

SEQ ID NO: 2138714 - RNA, 12 nt, Homo sapiens
aaaugcuacuga

SEQ ID NO: 2138715 - RNA, 20 nt, Homo sapiens
acggcugcgcacuguguccu

SEQ ID NO: 2138716 - RNA, 14 nt, Homo sapiens
cauaauguuccuua

SEQ ID NO: 2138717 - RNA, 14 nt, Homo sapiens
uauucuuccuugau

SEQ ID NO: 2138718 - RNA, 21 nt, Homo sapiens
gguccuguuaacgucaucuca

SEQ ID NO: 2138719 - RNA, 15 nt, Homo sapiens
gaugcuugguacugu

SEQ ID NO: 2138720 - RNA, 21 nt, Homo sapiens
cuaaaaucaagugcaccuaca

SEQ ID NO: 2138721 - RNA, 20 nt, Homo sapiens
cugucuuuauaaucuacucc

SEQ ID NO: 2138722 - RNA, 17 nt, Homo sapiens
ugaauuuuggcuguguc

SEQ ID NO: 2138723 - RNA, 21 nt, Homo sapiens
gagccccugggacugcugcuu

SEQ ID NO: 2138724 - RNA, 19 nt, Homo sapiens
cuuggccucucucuagggu

SEQ ID NO: 2138725 - RNA, 22 nt, Homo sapiens
accugagauacugaagugcagc

SEQ ID NO: 2138726 - RNA, 21 nt, Homo sapiens
guccauugauuuuaaccaaug

SEQ ID NO: 2138727 - RNA, 21 nt, Homo sapiens
acuuauaagaaagaucaaaga

SEQ ID NO: 2138728 - RNA, 18 nt, Homo sapiens
ccugcaauguggugacac

SEQ ID NO: 2138729 - RNA, 16 nt, Homo sapiens
caaaaugaauugccuu

SEQ ID NO: 2138730 - RNA, 17 nt, Homo sapiens
gcgacacccguccaugg

SEQ ID NO: 2138731 - RNA, 15 nt, Homo sapiens
agacggagucuugcu

SEQ ID NO: 2138732 - RNA, 14 nt, Homo sapiens
agugcauuuagacu

SEQ ID NO: 2138733 - RNA, 15 nt, Homo sapiens
aguaugaaaagcuau

SEQ ID NO: 2138734 - RNA, 17 nt, Homo sapiens
cccuuucagaugucuuc

SEQ ID NO: 2138735 - RNA, 14 nt, Homo sapiens
augcaaaagcacau

SEQ ID NO: 2138736 - RNA, 17 nt, Homo sapiens
uuaaaaccaaucaauaa

SEQ ID NO: 2138737 - RNA, 15 nt, Homo sapiens
acuggcugugagacg

SEQ ID NO: 2138738 - RNA, 15 nt, Homo sapiens
ucaaagcaagucaac

SEQ ID NO: 2138739 - RNA, 16 nt, Homo sapiens
ggccucacuccaggaa

SEQ ID NO: 2138740 - RNA, 15 nt, Homo sapiens
aggaccuagggaugu

SEQ ID NO: 2138741 - RNA, 21 nt, Homo sapiens
aauuacagacucaguagccau

SEQ ID NO: 2138742 - RNA, 20 nt, Homo sapiens
cuguuugagguccacacuga

SEQ ID NO: 2138743 - RNA, 9 nt, Homo sapiens
aaacauguu

SEQ ID NO: 2138744 - RNA, 13 nt, Homo sapiens
uauuuauacugua

SEQ ID NO: 2138745 - RNA, 22 nt, Homo sapiens
uaauuaaaaaaaaaacuucauu

SEQ ID NO: 2138746 - RNA, 12 nt, Homo sapiens
ucugccuuugag

SEQ ID NO: 2138747 - RNA, 22 nt, Homo sapiens
ccuugaucuuaacaaagccuuu

SEQ ID NO: 2138748 - RNA, 18 nt, Homo sapiens
cuggguauguuccuaagg

SEQ ID NO: 2138749 - RNA, 21 nt, Homo sapiens
cuaguaguucucuugguguua

SEQ ID NO: 2138750 - RNA, 16 nt, Homo sapiens
auguauuuuugucaau

SEQ ID NO: 2138751 - RNA, 19 nt, Homo sapiens
cagugacuuguucugagua

SEQ ID NO: 2138752 - RNA, 17 nt, Homo sapiens
aaauguauacuauagua

SEQ ID NO: 2138753 - RNA, 12 nt, Homo sapiens
gguagcuugucc

SEQ ID NO: 2138754 - RNA, 21 nt, Homo sapiens
agggaugcugcaauguaggaa

SEQ ID NO: 2138755 - RNA, 21 nt, Homo sapiens
ugugaaguguaguggcaucca

SEQ ID NO: 2138756 - RNA, 19 nt, Homo sapiens
agaagaggcuggugcugug

SEQ ID NO: 2138757 - RNA, 12 nt, Homo sapiens
uuuuauauguca

SEQ ID NO: 2138758 - RNA, 20 nt, Homo sapiens
cugagauacauacagaauua

SEQ ID NO: 2138759 - RNA, 22 nt, Homo sapiens
acaaaugucuaucaacuuuaau

SEQ ID NO: 2138760 - RNA, 20 nt, Homo sapiens
ccacaggcaggcucauuuca

SEQ ID NO: 2138761 - RNA, 19 nt, Homo sapiens
acaaaacugcuuugugcau

SEQ ID NO: 2138762 - RNA, 11 nt, Homo sapiens
agcauucugug

SEQ ID NO: 2138763 - RNA, 19 nt, Homo sapiens
gccuuuugugcaaagccaa

SEQ ID NO: 2138764 - RNA, 22 nt, Homo sapiens
gccuccaugauggaagaugaua

SEQ ID NO: 2138765 - RNA, 16 nt, Homo sapiens
ucugauaccacugcac

SEQ ID NO: 2138766 - RNA, 14 nt, Homo sapiens
gcccccacuccagu

SEQ ID NO: 2138767 - RNA, 14 nt, Homo sapiens
aagccguuggcacc

SEQ ID NO: 2138768 - RNA, 12 nt, Homo sapiens
gcaccuguggug

SEQ ID NO: 2138769 - RNA, 17 nt, Homo sapiens
gcucacaggagcuuaaa

SEQ ID NO: 2138770 - RNA, 23 nt, Homo sapiens
gaccuagugguuucuacucucac

SEQ ID NO: 2138771 - RNA, 15 nt, Homo sapiens
caucccacacuguau

SEQ ID NO: 2138772 - RNA, 13 nt, Homo sapiens
acuggccacugaa

SEQ ID NO: 2138773 - RNA, 18 nt, Homo sapiens
acuaguggcucucaguua

SEQ ID NO: 2138774 - RNA, 19 nt, Homo sapiens
ccugagcacccagaacucc

SEQ ID NO: 2138775 - RNA, 16 nt, Homo sapiens
caaagagcccaauuac

SEQ ID NO: 2138776 - RNA, 12 nt, Homo sapiens
ggcuggucucac

SEQ ID NO: 2138777 - RNA, 20 nt, Homo sapiens
agacacacacgcauacacac

SEQ ID NO: 2138778 - RNA, 22 nt, Homo sapiens
acauuuuguuuauguuacuuaa

SEQ ID NO: 2138779 - RNA, 13 nt, Homo sapiens
auguacuugucac

SEQ ID NO: 2138780 - RNA, 20 nt, Homo sapiens
ugagcuggggaugucucuca

SEQ ID NO: 2138781 - RNA, 18 nt, Homo sapiens
agcuggugacugguuggg

SEQ ID NO: 2138782 - RNA, 17 nt, Homo sapiens
ucaaaagugccucaaga

SEQ ID NO: 2138783 - RNA, 18 nt, Homo sapiens
gugucauauacaauuguc

SEQ ID NO: 2138784 - RNA, 16 nt, Homo sapiens
caugcaggcaccucuu

SEQ ID NO: 2138785 - RNA, 19 nt, Homo sapiens
augacaauguugcauuuau

SEQ ID NO: 2138786 - RNA, 18 nt, Homo sapiens
uccgauuccccuguagca

SEQ ID NO: 2138787 - RNA, 14 nt, Homo sapiens
caaaccuaccaaaa

SEQ ID NO: 2138788 - RNA, 22 nt, Homo sapiens
uuaacauuucaccccacucugu

SEQ ID NO: 2138789 - RNA, 14 nt, Homo sapiens
gcugggugugacca

SEQ ID NO: 2138790 - RNA, 22 nt, Homo sapiens
acauccaugcggaguccauuau

SEQ ID NO: 2138791 - RNA, 18 nt, Homo sapiens
ucagguauagcugacauc

SEQ ID NO: 2138792 - RNA, 15 nt, Homo sapiens
uuggagagacacagc

SEQ ID NO: 2138793 - RNA, 18 nt, Homo sapiens
gccuucagcuguugcaga

SEQ ID NO: 2138794 - RNA, 14 nt, Homo sapiens
ccaaauaccaugua

SEQ ID NO: 2138795 - RNA, 11 nt, Homo sapiens
agcacacugua

SEQ ID NO: 2138796 - RNA, 11 nt, Homo sapiens
auaacacuggc

SEQ ID NO: 2138797 - RNA, 11 nt, Homo sapiens
aggaaccuaau

SEQ ID NO: 2138798 - RNA, 16 nt, Homo sapiens
aaucuuccaguaacaa

SEQ ID NO: 2138799 - RNA, 21 nt, Homo sapiens
ggaucgugggccgcacugggg

SEQ ID NO: 2138800 - RNA, 17 nt, Homo sapiens
uauaaagauuguacuua

SEQ ID NO: 2138801 - RNA, 23 nt, Homo sapiens
uauuuuguguauaaugugcuuua

SEQ ID NO: 2138802 - RNA, 18 nt, Homo sapiens
uaaaugagcuguuggaag

SEQ ID NO: 2138803 - RNA, 12 nt, Homo sapiens
caacaugcugcc

SEQ ID NO: 2138804 - RNA, 13 nt, Homo sapiens
gaaaaaggcuucu

SEQ ID NO: 2138805 - RNA, 19 nt, Homo sapiens
caggcacuuugagaugugu

SEQ ID NO: 2138806 - RNA, 22 nt, Homo sapiens
caaaagaagacaacauuucuca

SEQ ID NO: 2138807 - RNA, 23 nt, Homo sapiens
guggugcagccccaggaccaagc

SEQ ID NO: 2138808 - RNA, 19 nt, Homo sapiens
uuuccagugacacaacuca

SEQ ID NO: 2138809 - RNA, 20 nt, Homo sapiens
ccugggcgcuucccuuuuaa

SEQ ID NO: 2138810 - RNA, 20 nt, Homo sapiens
uuccauuucuggacaugacg

SEQ ID NO: 2138811 - RNA, 20 nt, Homo sapiens
uugcauucguaaacaccaaa

SEQ ID NO: 2138812 - RNA, 12 nt, Homo sapiens
gaggcugugagc

SEQ ID NO: 2138813 - RNA, 12 nt, Homo sapiens
gcaccugugcag

SEQ ID NO: 2138814 - RNA, 19 nt, Homo sapiens
aagucuccaaaacauuucu

SEQ ID NO: 2138815 - RNA, 19 nt, Homo sapiens
uacaaggcuuuaucucagg

SEQ ID NO: 2138816 - RNA, 21 nt, Homo sapiens
agcuugcuugcagauggucug

SEQ ID NO: 2138817 - RNA, 12 nt, Homo sapiens
agucagugucaa

SEQ ID NO: 2138818 - RNA, 19 nt, Homo sapiens
ccuuggggaggacaaaacu

SEQ ID NO: 2138819 - RNA, 19 nt, Homo sapiens
gucccagcggccucagggu

SEQ ID NO: 2138820 - RNA, 20 nt, Homo sapiens
uugaagacauugcaccagau

SEQ ID NO: 2138821 - RNA, 18 nt, Homo sapiens
cccacaagccugagggaa

SEQ ID NO: 2138822 - RNA, 20 nt, Homo sapiens
aaguuaauucaccuauguua

SEQ ID NO: 2138823 - RNA, 12 nt, Homo sapiens
ucauagcacaug

SEQ ID NO: 2138824 - RNA, 22 nt, Homo sapiens
cccccauuguggucacaggaag

SEQ ID NO: 2138825 - RNA, 19 nt, Homo sapiens
ucacaaaucuuaacuugaa

SEQ ID NO: 2138826 - RNA, 20 nt, Homo sapiens
ugcuccaguauauaaccuca

SEQ ID NO: 2138827 - RNA, 21 nt, Homo sapiens
gaccaaaaugacaaugaugau

SEQ ID NO: 2138828 - RNA, 19 nt, Homo sapiens
agcuguggccagcuuguua

SEQ ID NO: 2138829 - RNA, 17 nt, Homo sapiens
cauucugaaacauaauu

SEQ ID NO: 2138830 - RNA, 16 nt, Homo sapiens
gaccagaggacauaag

SEQ ID NO: 2138831 - RNA, 21 nt, Homo sapiens
uuucauugcucagaaauguca

SEQ ID NO: 2138832 - RNA, 20 nt, Homo sapiens
auggcacuaaaugcacaaaa

SEQ ID NO: 2138833 - RNA, 14 nt, Homo sapiens
ccuagggcacuuua

SEQ ID NO: 2138834 - RNA, 22 nt, Homo sapiens
uguguuaaguaauauuggcuau

SEQ ID NO: 2138835 - RNA, 22 nt, Homo sapiens
ucauuguucuugugaacccaaa

SEQ ID NO: 2138836 - RNA, 18 nt, Homo sapiens
cugugaccaggaaggaag

SEQ ID NO: 2138837 - RNA, 20 nt, Homo sapiens
gcacuauuauaagugcuuca

SEQ ID NO: 2138838 - RNA, 17 nt, Homo sapiens
gcccucucuugccaaaa

SEQ ID NO: 2138839 - RNA, 23 nt, Homo sapiens
ucuaguugauugcgagaauuuuc

SEQ ID NO: 2138840 - RNA, 18 nt, Homo sapiens
uacaugccccguuuuuga

SEQ ID NO: 2138841 - RNA, 12 nt, Homo sapiens
cagaagcacugg

SEQ ID NO: 2138842 - RNA, 18 nt, Homo sapiens
ugccauucaacucggaaa

SEQ ID NO: 2138843 - RNA, 21 nt, Homo sapiens
guauuccuuuauacacagugg

SEQ ID NO: 2138844 - RNA, 12 nt, Homo sapiens
gaaggugccugg

SEQ ID NO: 2138845 - RNA, 21 nt, Homo sapiens
acgagguggcucgacugcuca

SEQ ID NO: 2138846 - RNA, 22 nt, Homo sapiens
aucaauuuaccuacucuaugua

SEQ ID NO: 2138847 - RNA, 15 nt, Homo sapiens
aaaccuaagcacgua

SEQ ID NO: 2138848 - RNA, 15 nt, Homo sapiens
uugauucagucacau

SEQ ID NO: 2138849 - RNA, 22 nt, Homo sapiens
uuaaaugguuggcccccaaaga

SEQ ID NO: 2138850 - RNA, 15 nt, Homo sapiens
uuuccuggaccagug

SEQ ID NO: 2138851 - RNA, 13 nt, Homo sapiens
gaagucccggcuu

SEQ ID NO: 2138852 - RNA, 18 nt, Homo sapiens
aaaaguaaguaccacuca

SEQ ID NO: 2138853 - RNA, 23 nt, Homo sapiens
cugucucaaauaaauaaauauga

SEQ ID NO: 2138854 - RNA, 16 nt, Homo sapiens
ucuuuggucuacucua

SEQ ID NO: 2138855 - RNA, 14 nt, Homo sapiens
uaauugauuucaag

SEQ ID NO: 2138856 - RNA, 14 nt, Homo sapiens
uaauuaauuucaaa

SEQ ID NO: 2138857 - RNA, 14 nt, Homo sapiens
gucauaaugaauaa

SEQ ID NO: 2138858 - RNA, 13 nt, Homo sapiens
gggaccacugggu

SEQ ID NO: 2138859 - RNA, 20 nt, Homo sapiens
auauacuugguucucuccac

SEQ ID NO: 2138860 - RNA, 13 nt, Homo sapiens
uuauuaauuugaa

SEQ ID NO: 2138861 - RNA, 20 nt, Homo sapiens
cacagacuauuuuuagauuu

SEQ ID NO: 2138862 - RNA, 16 nt, Homo sapiens
uuaaacuuuaucucac

SEQ ID NO: 2138863 - RNA, 19 nt, Homo sapiens
gauaugugcaccaauaccu

SEQ ID NO: 2138864 - RNA, 17 nt, Homo sapiens
caguugggacuacaggc

SEQ ID NO: 2138865 - RNA, 13 nt, Homo sapiens
gaaaaccaaacaa

SEQ ID NO: 2138866 - RNA, 18 nt, Homo sapiens
acuuacauaguugaaaua

SEQ ID NO: 2138867 - RNA, 16 nt, Homo sapiens
acuauauucucagugu

SEQ ID NO: 2138868 - RNA, 18 nt, Homo sapiens
gcaugaaugagacccagc

SEQ ID NO: 2138869 - RNA, 15 nt, Homo sapiens
aaccuugucaauaaa

SEQ ID NO: 2138870 - RNA, 23 nt, Homo sapiens
cauucuuguuuuaagugccuuua

SEQ ID NO: 2138871 - RNA, 20 nt, Homo sapiens
gaguccugucagcuucccca

SEQ ID NO: 2138872 - RNA, 18 nt, Homo sapiens
agggccaagaagucccaa

SEQ ID NO: 2138873 - RNA, 14 nt, Homo sapiens
aacugucacucauu

SEQ ID NO: 2138874 - RNA, 15 nt, Homo sapiens
gcggaaagcccugug

SEQ ID NO: 2138875 - RNA, 19 nt, Homo sapiens
agcuagcucgugacuacau

SEQ ID NO: 2138876 - RNA, 16 nt, Homo sapiens
cagaauuuuuaacugu

SEQ ID NO: 2138877 - RNA, 20 nt, Homo sapiens
cugucucagaaccacuccug

SEQ ID NO: 2138878 - RNA, 21 nt, Homo sapiens
aucguggugugucaaugccac

SEQ ID NO: 2138879 - RNA, 23 nt, Homo sapiens
ucagggauagcacugagcaaagc

SEQ ID NO: 2138880 - RNA, 23 nt, Homo sapiens
uauucccccaaacuuuuuguuca

SEQ ID NO: 2138881 - RNA, 17 nt, Homo sapiens
uuuaacugaacugugaa

SEQ ID NO: 2138882 - RNA, 17 nt, Homo sapiens
ccaugaggacaaagugu

SEQ ID NO: 2138883 - RNA, 13 nt, Homo sapiens
gauaaagccuaaa

SEQ ID NO: 2138884 - RNA, 17 nt, Homo sapiens
aauuuggaaaggaccaa

SEQ ID NO: 2138885 - RNA, 13 nt, Homo sapiens
acgaugcauuuaa

SEQ ID NO: 2138886 - RNA, 15 nt, Homo sapiens
uccugaccuugucau

SEQ ID NO: 2138887 - RNA, 18 nt, Homo sapiens
ucaaccccacaagcacca

SEQ ID NO: 2138888 - RNA, 15 nt, Homo sapiens
cugccccagauuuac

SEQ ID NO: 2138889 - RNA, 19 nt, Homo sapiens
uguagcuuuuaugugauau

SEQ ID NO: 2138890 - RNA, 19 nt, Homo sapiens
aaagcagggacugugaaca

SEQ ID NO: 2138891 - RNA, 16 nt, Homo sapiens
ugcccuccuaucccca

SEQ ID NO: 2138892 - RNA, 16 nt, Homo sapiens
uuaaauguguguaaaa

SEQ ID NO: 2138893 - RNA, 14 nt, Homo sapiens
uacuuaacauuuca

SEQ ID NO: 2138894 - RNA, 21 nt, Homo sapiens
uugccucugaagccuauguau

SEQ ID NO: 2138895 - RNA, 18 nt, Homo sapiens
cuaaaugaaugagccaaa

SEQ ID NO: 2138896 - RNA, 16 nt, Homo sapiens
ugugaagguguuucaa

SEQ ID NO: 2138897 - RNA, 19 nt, Homo sapiens
accacuuucaccugggaug

SEQ ID NO: 2138898 - RNA, 16 nt, Homo sapiens
uaccaugaugcaugga

SEQ ID NO: 2138899 - RNA, 19 nt, Homo sapiens
uagcccacucccugccuac

SEQ ID NO: 2138900 - RNA, 21 nt, Homo sapiens
cacugauuugauaccauggca

SEQ ID NO: 2138901 - RNA, 22 nt, Homo sapiens
ccugugcaauucagucugcucu

SEQ ID NO: 2138902 - RNA, 20 nt, Homo sapiens
gacauugaguucaaauugcc

SEQ ID NO: 2138903 - RNA, 14 nt, Homo sapiens
uguacuuacacuga

SEQ ID NO: 2138904 - RNA, 22 nt, Homo sapiens
cugacaauaugaauuaggugua

SEQ ID NO: 2138905 - RNA, 22 nt, Homo sapiens
gccaguucuccuucccugcaga

SEQ ID NO: 2138906 - RNA, 12 nt, Homo sapiens
gccgcucugauu

SEQ ID NO: 2138907 - RNA, 19 nt, Homo sapiens
acuguuggcaaggugacau

SEQ ID NO: 2138908 - RNA, 12 nt, Homo sapiens
cucacuaccugg

SEQ ID NO: 2138909 - RNA, 11 nt, Homo sapiens
accaggcuucu

SEQ ID NO: 2138910 - RNA, 18 nt, Homo sapiens
uagguuaaaaaaaaaagu

SEQ ID NO: 2138911 - RNA, 15 nt, Homo sapiens
gccccucggcauuca

SEQ ID NO: 2138912 - RNA, 10 nt, Homo sapiens
caaaaaccaa

SEQ ID NO: 2138913 - RNA, 14 nt, Homo sapiens
aauacucaccaaaa

SEQ ID NO: 2138914 - RNA, 21 nt, Homo sapiens
cuccaccuuacuucuucucau

SEQ ID NO: 2138915 - RNA, 16 nt, Homo sapiens
caaugcccuaccugcc

SEQ ID NO: 2138916 - RNA, 13 nt, Homo sapiens
cugugcuuuucag

SEQ ID NO: 2138917 - RNA, 22 nt, Homo sapiens
uuaugaauaaaguugcugugaa

SEQ ID NO: 2138918 - RNA, 21 nt, Homo sapiens
aggcuaugaagaaaacagcug

SEQ ID NO: 2138919 - RNA, 13 nt, Homo sapiens
uuuguaacuuuag

SEQ ID NO: 2138920 - RNA, 21 nt, Homo sapiens
aggcuuuguacagagugcuuu

SEQ ID NO: 2138921 - RNA, 23 nt, Homo sapiens
uuugucagaggcacaaaaggguu

SEQ ID NO: 2138922 - RNA, 22 nt, Homo sapiens
aucucuucuuugcugcagucau

SEQ ID NO: 2138923 - RNA, 17 nt, Homo sapiens
ucauguuaugcagugaa

SEQ ID NO: 2138924 - RNA, 19 nt, Homo sapiens
caaugaagugacacuuuga

SEQ ID NO: 2138925 - RNA, 19 nt, Homo sapiens
ggaaugggcagcucaucuc

SEQ ID NO: 2138926 - RNA, 12 nt, Homo sapiens
cccagugccuuc

SEQ ID NO: 2138927 - RNA, 16 nt, Homo sapiens
gacagccauuuuccaa

SEQ ID NO: 2138928 - RNA, 12 nt, Homo sapiens
cgggcuuuucac

SEQ ID NO: 2138929 - RNA, 14 nt, Homo sapiens
uccacagcugccuc

SEQ ID NO: 2138930 - RNA, 23 nt, Homo sapiens
uccucucaaccaccuuucagaua

SEQ ID NO: 2138931 - RNA, 19 nt, Homo sapiens
uacaagcaucauggaucaa

SEQ ID NO: 2138932 - RNA, 16 nt, Homo sapiens
aggcacagcauucgaa

SEQ ID NO: 2138933 - RNA, 23 nt, Homo sapiens
auagaugugcaagucuugucaga

SEQ ID NO: 2138934 - RNA, 14 nt, Homo sapiens
gccuguuugggagg

SEQ ID NO: 2138935 - RNA, 18 nt, Homo sapiens
ugaguaauacaucaaaga

SEQ ID NO: 2138936 - RNA, 21 nt, Homo sapiens
aucgcuggaaaugaauagcca

SEQ ID NO: 2138937 - RNA, 16 nt, Homo sapiens
auuuugugaauuguga

SEQ ID NO: 2138938 - RNA, 23 nt, Homo sapiens
gcugccaggcacuguucaucuca

SEQ ID NO: 2138939 - RNA, 20 nt, Homo sapiens
uccaccaggccucacuggcu

SEQ ID NO: 2138940 - RNA, 19 nt, Homo sapiens
ccaaguuucauaccaaaua

SEQ ID NO: 2138941 - RNA, 17 nt, Homo sapiens
auucugcaagcuuuuca

SEQ ID NO: 2138942 - RNA, 12 nt, Homo sapiens
gaguucauccca

SEQ ID NO: 2138943 - RNA, 20 nt, Homo sapiens
cucuuccuugaccugcauug

SEQ ID NO: 2138944 - RNA, 22 nt, Homo sapiens
uucacauuuuuaaaagaacaau

SEQ ID NO: 2138945 - RNA, 23 nt, Homo sapiens
caagguggugaaaucccaucucu

SEQ ID NO: 2138946 - RNA, 21 nt, Homo sapiens
ccccucgacagcucucugggc

SEQ ID NO: 2138947 - RNA, 19 nt, Homo sapiens
uugaaugacugacccaaaa

SEQ ID NO: 2138948 - RNA, 17 nt, Homo sapiens
cucuagggccucuccag

SEQ ID NO: 2138949 - RNA, 14 nt, Homo sapiens
ucccuguaaccucu

SEQ ID NO: 2138950 - RNA, 24 nt, Homo sapiens
cuuuucuagccuauuuaccugcag

SEQ ID NO: 2138951 - RNA, 24 nt, Homo sapiens
agagaauugacugggccucaugaa

SEQ ID NO: 2138952 - RNA, 21 nt, Homo sapiens
uuccugcccuugaacccccuc

SEQ ID NO: 2138953 - RNA, 20 nt, Homo sapiens
uaagaauucuguacuuccaa

SEQ ID NO: 2138954 - RNA, 20 nt, Homo sapiens
uaaaauuuuuugugauuuca

SEQ ID NO: 2138955 - RNA, 21 nt, Homo sapiens
aacagacgggucugagacuga

SEQ ID NO: 2138956 - RNA, 12 nt, Homo sapiens
uggccacagccc

SEQ ID NO: 2138957 - RNA, 15 nt, Homo sapiens
aauucauucuggucu

SEQ ID NO: 2138958 - RNA, 22 nt, Homo sapiens
auuucccauuuuggaaccuaau

SEQ ID NO: 2138959 - RNA, 16 nt, Homo sapiens
auucaaaaauuaucua

SEQ ID NO: 2138960 - RNA, 20 nt, Homo sapiens
caucucaacaggccucaggg

SEQ ID NO: 2138961 - RNA, 15 nt, Homo sapiens
acuuccucugcaaaa

SEQ ID NO: 2138962 - RNA, 18 nt, Homo sapiens
cuggcuacugucuauuaa

SEQ ID NO: 2138963 - RNA, 23 nt, Homo sapiens
caguugcagcuguuuuguugaca

SEQ ID NO: 2138964 - RNA, 22 nt, Homo sapiens
guucugucugggcucagacauc

SEQ ID NO: 2138965 - RNA, 20 nt, Homo sapiens
agaaaauccuaggugcuacu

SEQ ID NO: 2138966 - RNA, 20 nt, Homo sapiens
ccaggucuccggaggagaca

SEQ ID NO: 2138967 - RNA, 17 nt, Homo sapiens
uagaacaccugccuucu

SEQ ID NO: 2138968 - RNA, 15 nt, Homo sapiens
aagcuuaaauugcuu

SEQ ID NO: 2138969 - RNA, 13 nt, Homo sapiens
uaauaacuuugaa

SEQ ID NO: 2138970 - RNA, 17 nt, Homo sapiens
ugcaccaccacacccgg

SEQ ID NO: 2138971 - RNA, 22 nt, Homo sapiens
uagcccauaaagucugagaaau

SEQ ID NO: 2138972 - RNA, 17 nt, Homo sapiens
aaaauaauagauaauua

SEQ ID NO: 2138973 - RNA, 15 nt, Homo sapiens
ucuuuagaugccaaa

SEQ ID NO: 2138974 - RNA, 20 nt, Homo sapiens
accucuccacacagguguuc

SEQ ID NO: 2138975 - RNA, 16 nt, Homo sapiens
gauuugauuaaugaau

SEQ ID NO: 2138976 - RNA, 22 nt, Homo sapiens
gccauccuugacuuugaacuaa

SEQ ID NO: 2138977 - RNA, 16 nt, Homo sapiens
aauucaguccuaagaa

SEQ ID NO: 2138978 - RNA, 16 nt, Homo sapiens
cuguuacuuuggcaau

SEQ ID NO: 2138979 - RNA, 14 nt, Homo sapiens
acaaccaagcagaa

SEQ ID NO: 2138980 - RNA, 17 nt, Homo sapiens
acaguagguuggcagua

SEQ ID NO: 2138981 - RNA, 20 nt, Homo sapiens
acaguugugagauugugccc

SEQ ID NO: 2138982 - RNA, 15 nt, Homo sapiens
aguguuuaucuucag

SEQ ID NO: 2138983 - RNA, 16 nt, Homo sapiens
acugcccagagccaca

SEQ ID NO: 2138984 - RNA, 23 nt, Homo sapiens
cucacagaguuaaauaugcaucu

SEQ ID NO: 2138985 - RNA, 16 nt, Homo sapiens
aaacugucauuuagcu

SEQ ID NO: 2138986 - RNA, 20 nt, Homo sapiens
uugugaaauaaaauggugaa

SEQ ID NO: 2138987 - RNA, 18 nt, Homo sapiens
auuaugagagacugcuca

SEQ ID NO: 2138988 - RNA, 18 nt, Homo sapiens
gaaagcuccuagcagaga

SEQ ID NO: 2138989 - RNA, 16 nt, Homo sapiens
ggugacagcuccggga

SEQ ID NO: 2138990 - RNA, 21 nt, Homo sapiens
gcuggaaauaaaccuggagau

SEQ ID NO: 2138991 - RNA, 16 nt, Homo sapiens
ccacacucaccucuaa

SEQ ID NO: 2138992 - RNA, 21 nt, Homo sapiens
guauucuuugcgguauucuug

SEQ ID NO: 2138993 - RNA, 20 nt, Homo sapiens
aggcccaugcccuccguccu

SEQ ID NO: 2138994 - RNA, 14 nt, Homo sapiens
caaugcgcacacac

SEQ ID NO: 2138995 - RNA, 18 nt, Homo sapiens
gcccccauuguggucaca

SEQ ID NO: 2138996 - RNA, 14 nt, Homo sapiens
gccacugaccucac

SEQ ID NO: 2138997 - RNA, 13 nt, Homo sapiens
aauuccuuugugu

SEQ ID NO: 2138998 - RNA, 15 nt, Homo sapiens
aaauuaugauaagga

SEQ ID NO: 2138999 - RNA, 16 nt, Homo sapiens
aguauucuugucaaaa

SEQ ID NO: 2139000 - RNA, 14 nt, Homo sapiens
uacaucuaacucau

SEQ ID NO: 2139001 - RNA, 19 nt, Homo sapiens
aacagauauuuuuaacuua

SEQ ID NO: 2139002 - RNA, 21 nt, Homo sapiens
agggcacugagcccuucccag

SEQ ID NO: 2139003 - RNA, 23 nt, Homo sapiens
auacaccaccuuauuagcuaaaa

SEQ ID NO: 2139004 - RNA, 19 nt, Homo sapiens
acccucuccccacugcuca

SEQ ID NO: 2139005 - RNA, 20 nt, Homo sapiens
uucuacgggauggccagaga

SEQ ID NO: 2139006 - RNA, 16 nt, Homo sapiens
agggacucaucuuucc

SEQ ID NO: 2139007 - RNA, 21 nt, Homo sapiens
uucagaaaucaaacugcuuau

SEQ ID NO: 2139008 - RNA, 21 nt, Homo sapiens
cucaguguaccacuacuuaga

SEQ ID NO: 2139009 - RNA, 17 nt, Homo sapiens
ugauccggggguccagg

SEQ ID NO: 2139010 - RNA, 17 nt, Homo sapiens
cuacacacaccagaugg

SEQ ID NO: 2139011 - RNA, 14 nt, Homo sapiens
gcagaccuacagca

SEQ ID NO: 2139012 - RNA, 22 nt, Homo sapiens
cuuaagaaguuagaaggcuuaa

SEQ ID NO: 2139013 - RNA, 17 nt, Homo sapiens
acuuaacucucaagcua

SEQ ID NO: 2139014 - RNA, 16 nt, Homo sapiens
aggccccuguggucac

SEQ ID NO: 2139015 - RNA, 23 nt, Homo sapiens
agcugauugggcaccugaccaca

SEQ ID NO: 2139016 - RNA, 19 nt, Homo sapiens
augugaaacacaugccagu

SEQ ID NO: 2139017 - RNA, 19 nt, Homo sapiens
ggaaaaugccuccauggca

SEQ ID NO: 2139018 - RNA, 18 nt, Homo sapiens
acaauuaugaacauccaa

SEQ ID NO: 2139019 - RNA, 19 nt, Homo sapiens
cuuuccucaaagaagcaug

SEQ ID NO: 2139020 - RNA, 14 nt, Homo sapiens
uugagcgagcccau

SEQ ID NO: 2139021 - RNA, 18 nt, Homo sapiens
acugaagagcucuuggcc

SEQ ID NO: 2139022 - RNA, 14 nt, Homo sapiens
ccagggagucagag

SEQ ID NO: 2139023 - RNA, 14 nt, Homo sapiens
uaauuuuacauguu

SEQ ID NO: 2139024 - RNA, 12 nt, Homo sapiens
ccaauccaugcu

SEQ ID NO: 2139025 - RNA, 14 nt, Homo sapiens
uucagauuugccuu

SEQ ID NO: 2139026 - RNA, 16 nt, Homo sapiens
aagauauuuccaagaa

SEQ ID NO: 2139027 - RNA, 13 nt, Homo sapiens
gacccucucagaa

SEQ ID NO: 2139028 - RNA, 15 nt, Homo sapiens
uggugcauaggucug

SEQ ID NO: 2139029 - RNA, 21 nt, Homo sapiens
acacuucguucgcagagcuuu

SEQ ID NO: 2139030 - RNA, 13 nt, Homo sapiens
cugauuggcaugu

SEQ ID NO: 2139031 - RNA, 17 nt, Homo sapiens
uugauaugggcuuucuc

SEQ ID NO: 2139032 - RNA, 14 nt, Homo sapiens
ugaggcugcagcga

SEQ ID NO: 2139033 - RNA, 17 nt, Homo sapiens
agcaagaucgcugugcu

SEQ ID NO: 2139034 - RNA, 13 nt, Homo sapiens
ccaaaguugcuca

SEQ ID NO: 2139035 - RNA, 15 nt, Homo sapiens
aacuucuccaaggag

SEQ ID NO: 2139036 - RNA, 13 nt, Homo sapiens
uguaauauauuuc

SEQ ID NO: 2139037 - RNA, 23 nt, Homo sapiens
acugacugggcgugguggcucau

SEQ ID NO: 2139038 - RNA, 19 nt, Homo sapiens
auuucugguucugaugcca

SEQ ID NO: 2139039 - RNA, 15 nt, Homo sapiens
cauguccaaguccaa

SEQ ID NO: 2139040 - RNA, 13 nt, Homo sapiens
gugaaucuugucu

SEQ ID NO: 2139041 - RNA, 11 nt, Homo sapiens
acacacacagc

SEQ ID NO: 2139042 - RNA, 19 nt, Homo sapiens
agcccugggacagggcaaa

SEQ ID NO: 2139043 - RNA, 19 nt, Homo sapiens
uucuccgcaacagccaagu

SEQ ID NO: 2139044 - RNA, 20 nt, Homo sapiens
auuccucagaacaaugaaaa

SEQ ID NO: 2139045 - RNA, 14 nt, Homo sapiens
cugggaugucuccg

SEQ ID NO: 2139046 - RNA, 11 nt, Homo sapiens
uauugauccca

SEQ ID NO: 2139047 - RNA, 20 nt, Homo sapiens
ugugacucgggagcugcaca

SEQ ID NO: 2139048 - RNA, 19 nt, Homo sapiens
ugaagcugcucacugcuca

SEQ ID NO: 2139049 - RNA, 14 nt, Homo sapiens
gaucccuacugcug

SEQ ID NO: 2139050 - RNA, 13 nt, Homo sapiens
uauaggaauuugu

SEQ ID NO: 2139051 - RNA, 19 nt, Homo sapiens
cucuccccaggcauuugcc

SEQ ID NO: 2139052 - RNA, 15 nt, Homo sapiens
gcaaguuaaagaaaa

SEQ ID NO: 2139053 - RNA, 15 nt, Homo sapiens
aaaagucagcuuuac

SEQ ID NO: 2139054 - RNA, 22 nt, Homo sapiens
cuaagcgaauguguacaaagug

SEQ ID NO: 2139055 - RNA, 20 nt, Homo sapiens
ccaacacaaggcuccaagac

SEQ ID NO: 2139056 - RNA, 10 nt, Homo sapiens
uuugaucaug

SEQ ID NO: 2139057 - RNA, 16 nt, Homo sapiens
gaugcagucuccucuu

SEQ ID NO: 2139058 - RNA, 22 nt, Homo sapiens
gcagagcuugaacacagucuca

SEQ ID NO: 2139059 - RNA, 19 nt, Homo sapiens
ucucaugggaaggggagga

SEQ ID NO: 2139060 - RNA, 23 nt, Homo sapiens
agggaaggcuguuugagaaccau

SEQ ID NO: 2139061 - RNA, 12 nt, Homo sapiens
uggacucagaga

SEQ ID NO: 2139062 - RNA, 21 nt, Homo sapiens
ccaacauggugaaacccugua

SEQ ID NO: 2139063 - RNA, 14 nt, Homo sapiens
ccaaaugacuucau

SEQ ID NO: 2139064 - RNA, 18 nt, Homo sapiens
cacagaaggaaucugugc

SEQ ID NO: 2139065 - RNA, 12 nt, Homo sapiens
uacagccuucac

SEQ ID NO: 2139066 - RNA, 16 nt, Homo sapiens
aauggaaauguaauaa

SEQ ID NO: 2139067 - RNA, 15 nt, Homo sapiens
aucagcuaaguugca

SEQ ID NO: 2139068 - RNA, 22 nt, Homo sapiens
aaacacggaguuuccauuugga

SEQ ID NO: 2139069 - RNA, 15 nt, Homo sapiens
cugcaggaacaugac

SEQ ID NO: 2139070 - RNA, 14 nt, Homo sapiens
aacuuauccaucuu

SEQ ID NO: 2139071 - RNA, 21 nt, Homo sapiens
gccagcucuaaacaagucccu

SEQ ID NO: 2139072 - RNA, 16 nt, Homo sapiens
caaauaaguuacaucu

SEQ ID NO: 2139073 - RNA, 15 nt, Homo sapiens
ggugacguccaggag

SEQ ID NO: 2139074 - RNA, 23 nt, Homo sapiens
ucuuugauuauuugcauguuaug

SEQ ID NO: 2139075 - RNA, 17 nt, Homo sapiens
agaucacaucacugcac

SEQ ID NO: 2139076 - RNA, 14 nt, Homo sapiens
uaaaaguauaacuu

SEQ ID NO: 2139077 - RNA, 22 nt, Homo sapiens
aaccucuagagucacugauaca

SEQ ID NO: 2139078 - RNA, 14 nt, Homo sapiens
ccuaaucaaauggc

SEQ ID NO: 2139079 - RNA, 17 nt, Homo sapiens
caggccgggcagugucc

SEQ ID NO: 2139080 - RNA, 14 nt, Homo sapiens
aacacacugaggca

SEQ ID NO: 2139081 - RNA, 20 nt, Homo sapiens
gccccucagugguuuccucg

SEQ ID NO: 2139082 - RNA, 15 nt, Homo sapiens
cuggguguugaccac

SEQ ID NO: 2139083 - RNA, 16 nt, Homo sapiens
cuguuagucauuugcu

SEQ ID NO: 2139084 - RNA, 20 nt, Homo sapiens
ccaaauaacaucaacaacac

SEQ ID NO: 2139085 - RNA, 18 nt, Homo sapiens
gaugcacagagauaugca

SEQ ID NO: 2139086 - RNA, 20 nt, Homo sapiens
ugauuuuuuucauuuugcca

SEQ ID NO: 2139087 - RNA, 18 nt, Homo sapiens
uauugugugagugcaugu

SEQ ID NO: 2139088 - RNA, 13 nt, Homo sapiens
gaagacuugcccc

SEQ ID NO: 2139089 - RNA, 11 nt, Homo sapiens
ccucucuagca

SEQ ID NO: 2139090 - RNA, 20 nt, Homo sapiens
gaauuuugcacaguuaccug

SEQ ID NO: 2139091 - RNA, 16 nt, Homo sapiens
ugcgugugucagggau

SEQ ID NO: 2139092 - RNA, 19 nt, Homo sapiens
caaaaaagaacaagcucau

SEQ ID NO: 2139093 - RNA, 22 nt, Homo sapiens
ccagcugacgcgacuaucauuc

SEQ ID NO: 2139094 - RNA, 19 nt, Homo sapiens
cccaguucauguugcucag

SEQ ID NO: 2139095 - RNA, 20 nt, Homo sapiens
aucuaguguguccugugaca

SEQ ID NO: 2139096 - RNA, 15 nt, Homo sapiens
cauucaaaccaaaua

SEQ ID NO: 2139097 - RNA, 21 nt, Homo sapiens
agcaaagggcaaggaauccuc

SEQ ID NO: 2139098 - RNA, 21 nt, Homo sapiens
ugggcgugugugacacugaug

SEQ ID NO: 2139099 - RNA, 14 nt, Homo sapiens
ucuuggcguggcag

SEQ ID NO: 2139100 - RNA, 21 nt, Homo sapiens
ugcacagggcagcugggccca

SEQ ID NO: 2139101 - RNA, 15 nt, Homo sapiens
gauggauguuuguca

SEQ ID NO: 2139102 - RNA, 23 nt, Homo sapiens
acuccacccuccaccuuccauuu

SEQ ID NO: 2139103 - RNA, 21 nt, Homo sapiens
uaagugcuugguugggguggu

SEQ ID NO: 2139104 - RNA, 21 nt, Homo sapiens
gaaugggcacagcacagccag

SEQ ID NO: 2139105 - RNA, 18 nt, Homo sapiens
uguacuagugccauugga

SEQ ID NO: 2139106 - RNA, 12 nt, Homo sapiens
gaccuagggccu

SEQ ID NO: 2139107 - RNA, 23 nt, Homo sapiens
caagagagggaugcauggagaua

SEQ ID NO: 2139108 - RNA, 14 nt, Homo sapiens
accccucagugcuc

SEQ ID NO: 2139109 - RNA, 22 nt, Homo sapiens
acuuuaaaaaaaucauaugcua

SEQ ID NO: 2139110 - RNA, 13 nt, Homo sapiens
acaccaaaccaaa

SEQ ID NO: 2139111 - RNA, 20 nt, Homo sapiens
acucucagcagcuaugguag

SEQ ID NO: 2139112 - RNA, 18 nt, Homo sapiens
ugugaacauuccuaucaa

SEQ ID NO: 2139113 - RNA, 23 nt, Homo sapiens
ugucuuguugcggauggauggaa

SEQ ID NO: 2139114 - RNA, 17 nt, Homo sapiens
uuuuaucccaggaaaua

SEQ ID NO: 2139115 - RNA, 16 nt, Homo sapiens
agcaucuaaugaaugu

SEQ ID NO: 2139116 - RNA, 19 nt, Homo sapiens
uccaaauccagccuuugga

SEQ ID NO: 2139117 - RNA, 23 nt, Homo sapiens
aaucauaaauauaaucuaauaca

SEQ ID NO: 2139118 - RNA, 15 nt, Homo sapiens
uaaaacacaccaauc

SEQ ID NO: 2139119 - RNA, 16 nt, Homo sapiens
aguuuauaccaagaga

SEQ ID NO: 2139120 - RNA, 22 nt, Homo sapiens
ugacauccagaaagcugaggaa

SEQ ID NO: 2139121 - RNA, 19 nt, Homo sapiens
ggagcugccugcagcacau

SEQ ID NO: 2139122 - RNA, 22 nt, Homo sapiens
uaguucaaaugaugaagaccaa

SEQ ID NO: 2139123 - RNA, 16 nt, Homo sapiens
acauuuuuguacuaac

SEQ ID NO: 2139124 - RNA, 17 nt, Homo sapiens
aagauugcgguuuacag

SEQ ID NO: 2139125 - RNA, 15 nt, Homo sapiens
gcugguguagucuuu

SEQ ID NO: 2139126 - RNA, 18 nt, Homo sapiens
gaugacaaaaauucaacu

SEQ ID NO: 2139127 - RNA, 16 nt, Homo sapiens
aagugucgaaagcaac

SEQ ID NO: 2139128 - RNA, 13 nt, Homo sapiens
gaccuaaaauaaa

SEQ ID NO: 2139129 - RNA, 21 nt, Homo sapiens
uauacuguugucagguacagu

SEQ ID NO: 2139130 - RNA, 14 nt, Homo sapiens
uaauuucuguccag

SEQ ID NO: 2139131 - RNA, 16 nt, Homo sapiens
ucucuuguagcucucu

SEQ ID NO: 2139132 - RNA, 20 nt, Homo sapiens
aggaucuucccacuuugcca

SEQ ID NO: 2139133 - RNA, 19 nt, Homo sapiens
ucuucugggcuacugccac

SEQ ID NO: 2139134 - RNA, 15 nt, Homo sapiens
ccucagggacagaga

SEQ ID NO: 2139135 - RNA, 17 nt, Homo sapiens
cuccaggaaggggaguu

SEQ ID NO: 2139136 - RNA, 22 nt, Homo sapiens
caaggacauggugagucuauuu

SEQ ID NO: 2139137 - RNA, 17 nt, Homo sapiens
cacacgaugcauuuaau

SEQ ID NO: 2139138 - RNA, 17 nt, Homo sapiens
cccugcucuucagcacc

SEQ ID NO: 2139139 - RNA, 16 nt, Homo sapiens
aagcaagauuuuguca

SEQ ID NO: 2139140 - RNA, 13 nt, Homo sapiens
gaaauaggaaaua

SEQ ID NO: 2139141 - RNA, 19 nt, Homo sapiens
gucggucuccuuauccccc

SEQ ID NO: 2139142 - RNA, 15 nt, Homo sapiens
uacaugauaagacau

SEQ ID NO: 2139143 - RNA, 14 nt, Homo sapiens
gcauguuuguugua

SEQ ID NO: 2139144 - RNA, 14 nt, Homo sapiens
ugggaccugaugac

SEQ ID NO: 2139145 - RNA, 22 nt, Homo sapiens
auccuguauucuucaaccagug

SEQ ID NO: 2139146 - RNA, 18 nt, Homo sapiens
cucuacacagcucagcag

SEQ ID NO: 2139147 - RNA, 19 nt, Homo sapiens
gcccuccccaucccaugua

SEQ ID NO: 2139148 - RNA, 17 nt, Homo sapiens
gcuagaguucuccagac

SEQ ID NO: 2139149 - RNA, 21 nt, Homo sapiens
auaaacuaagagaaacugugu

SEQ ID NO: 2139150 - RNA, 20 nt, Homo sapiens
cuuuuaaauuauacaaugau

SEQ ID NO: 2139151 - RNA, 12 nt, Homo sapiens
uuuucaucugaa

SEQ ID NO: 2139152 - RNA, 12 nt, Homo sapiens
cgcaaaucacaa

SEQ ID NO: 2139153 - RNA, 19 nt, Homo sapiens
aauaguuguugaguauucc

SEQ ID NO: 2139154 - RNA, 14 nt, Homo sapiens
ugucacauaaugcu

SEQ ID NO: 2139155 - RNA, 22 nt, Homo sapiens
gcuagcaaagacuugugugaug

SEQ ID NO: 2139156 - RNA, 12 nt, Homo sapiens
uggcagccagga

SEQ ID NO: 2139157 - RNA, 16 nt, Homo sapiens
ccauaucugugaaaug

SEQ ID NO: 2139158 - RNA, 18 nt, Homo sapiens
gucauauuaauauauuuc

SEQ ID NO: 2139159 - RNA, 19 nt, Homo sapiens
gcuugcucaggcucagagg

SEQ ID NO: 2139160 - RNA, 22 nt, Homo sapiens
uuuuccauuuuugucagucuga

SEQ ID NO: 2139161 - RNA, 18 nt, Homo sapiens
uguugccuggaagcacau

SEQ ID NO: 2139162 - RNA, 19 nt, Homo sapiens
gagcaucaggauacucaaa

SEQ ID NO: 2139163 - RNA, 13 nt, Homo sapiens
aggccucccagca

SEQ ID NO: 2139164 - RNA, 13 nt, Homo sapiens
uacauaugugcug

SEQ ID NO: 2139165 - RNA, 15 nt, Homo sapiens
agcccucucucucac

SEQ ID NO: 2139166 - RNA, 14 nt, Homo sapiens
gccagugacacuaa

SEQ ID NO: 2139167 - RNA, 19 nt, Homo sapiens
agugcucugaugcaauagu

SEQ ID NO: 2139168 - RNA, 12 nt, Homo sapiens
agaugugguggc

SEQ ID NO: 2139169 - RNA, 12 nt, Homo sapiens
guaccacugcua

SEQ ID NO: 2139170 - RNA, 19 nt, Homo sapiens
gauugucauguaaggcuua

SEQ ID NO: 2139171 - RNA, 17 nt, Homo sapiens
aagcaguuugcacuuaa

SEQ ID NO: 2139172 - RNA, 14 nt, Homo sapiens
cuaccugagcauuc

SEQ ID NO: 2139173 - RNA, 18 nt, Homo sapiens
ccagaaggcaaaaaccag

SEQ ID NO: 2139174 - RNA, 16 nt, Homo sapiens
gauacgggggcuguga

SEQ ID NO: 2139175 - RNA, 14 nt, Homo sapiens
ugagauggacacac

SEQ ID NO: 2139176 - RNA, 13 nt, Homo sapiens
gugcagccacaca

SEQ ID NO: 2139177 - RNA, 14 nt, Homo sapiens
cugacucugccagg

SEQ ID NO: 2139178 - RNA, 22 nt, Homo sapiens
cugagugcaccacuucaaguga

SEQ ID NO: 2139179 - RNA, 22 nt, Homo sapiens
aaacaaccugccaccaaaagaa

SEQ ID NO: 2139180 - RNA, 13 nt, Homo sapiens
gaggccuaccucu

SEQ ID NO: 2139181 - RNA, 18 nt, Homo sapiens
uaccaaagaaacaccacu

SEQ ID NO: 2139182 - RNA, 18 nt, Homo sapiens
agugagacuccgucacaa

SEQ ID NO: 2139183 - RNA, 14 nt, Homo sapiens
guggcucacagugg

SEQ ID NO: 2139184 - RNA, 18 nt, Homo sapiens
uguugaagccacugccuu

SEQ ID NO: 2139185 - RNA, 22 nt, Homo sapiens
cagcugaccugguacugagguu

SEQ ID NO: 2139186 - RNA, 16 nt, Homo sapiens
ucuuuauucuuccuug

SEQ ID NO: 2139187 - RNA, 15 nt, Homo sapiens
uacauuuaauacagc

SEQ ID NO: 2139188 - RNA, 22 nt, Homo sapiens
aaauguguauuuuucaaggcau

SEQ ID NO: 2139189 - RNA, 14 nt, Homo sapiens
uugcgaaugugcag

SEQ ID NO: 2139190 - RNA, 17 nt, Homo sapiens
uuacuuaugaugaugaa

SEQ ID NO: 2139191 - RNA, 16 nt, Homo sapiens
auguugagcugaguuc

SEQ ID NO: 2139192 - RNA, 16 nt, Homo sapiens
cucuggugcugcagua

SEQ ID NO: 2139193 - RNA, 23 nt, Homo sapiens
uuuacguuugauacaacauuaag

SEQ ID NO: 2139194 - RNA, 19 nt, Homo sapiens
cuauccugcaauuucuccc

SEQ ID NO: 2139195 - RNA, 22 nt, Homo sapiens
uugcccauggaagucucaaaga

SEQ ID NO: 2139196 - RNA, 20 nt, Homo sapiens
uccauauugcucucauuuca

SEQ ID NO: 2139197 - RNA, 17 nt, Homo sapiens
cugcaaggggacauucc

SEQ ID NO: 2139198 - RNA, 16 nt, Homo sapiens
ucgacaugcugccagg

SEQ ID NO: 2139199 - RNA, 13 nt, Homo sapiens
agcucagugccac

SEQ ID NO: 2139200 - RNA, 13 nt, Homo sapiens
agaauagugcauu

SEQ ID NO: 2139201 - RNA, 23 nt, Homo sapiens
gguucuggggaggaagggccagg

SEQ ID NO: 2139202 - RNA, 11 nt, Homo sapiens
ucccucuacau

SEQ ID NO: 2139203 - RNA, 17 nt, Homo sapiens
cugaaucaccagcacau

SEQ ID NO: 2139204 - RNA, 17 nt, Homo sapiens
aacagaaauauucuaca

SEQ ID NO: 2139205 - RNA, 15 nt, Homo sapiens
aggccauacuuguga

SEQ ID NO: 2139206 - RNA, 15 nt, Homo sapiens
agcaaggauggagcu

SEQ ID NO: 2139207 - RNA, 16 nt, Homo sapiens
aagauauuuuuauuca

SEQ ID NO: 2139208 - RNA, 22 nt, Homo sapiens
caugguuuuuuguauuggucau

SEQ ID NO: 2139209 - RNA, 22 nt, Homo sapiens
ggcaguggacucagaaagccaa

SEQ ID NO: 2139210 - RNA, 13 nt, Homo sapiens
aguaguaucugcu

SEQ ID NO: 2139211 - RNA, 20 nt, Homo sapiens
ggcuuugugucuggccagcu

SEQ ID NO: 2139212 - RNA, 21 nt, Homo sapiens
uauguagcccgggguggucca

SEQ ID NO: 2139213 - RNA, 21 nt, Homo sapiens
uuacacuggaagaagagcccc

SEQ ID NO: 2139214 - RNA, 20 nt, Homo sapiens
cauauagaaaucuagaauuu

SEQ ID NO: 2139215 - RNA, 20 nt, Homo sapiens
cccauggguuaagagcucac

SEQ ID NO: 2139216 - RNA, 23 nt, Homo sapiens
augggaagguuguucuuggcuca

SEQ ID NO: 2139217 - RNA, 18 nt, Homo sapiens
acaacuucaggagcucuu

SEQ ID NO: 2139218 - RNA, 14 nt, Homo sapiens
augcuccuaaaaga

SEQ ID NO: 2139219 - RNA, 16 nt, Homo sapiens
accuccuggaaggcag

SEQ ID NO: 2139220 - RNA, 18 nt, Homo sapiens
ucugucccacugcugcuu

SEQ ID NO: 2139221 - RNA, 12 nt, Homo sapiens
uugucucagaug

SEQ ID NO: 2139222 - RNA, 19 nt, Homo sapiens
cugugucacgugacccugu

SEQ ID NO: 2139223 - RNA, 23 nt, Homo sapiens
ucccacugggacacaaccacuaa

SEQ ID NO: 2139224 - RNA, 18 nt, Homo sapiens
ugaagcguuuuucucaaa

SEQ ID NO: 2139225 - RNA, 19 nt, Homo sapiens
gcuuucaauugauggacua

SEQ ID NO: 2139226 - RNA, 18 nt, Homo sapiens
cuccuauucaguucccag

SEQ ID NO: 2139227 - RNA, 18 nt, Homo sapiens
ccaggcuggagggcagug

SEQ ID NO: 2139228 - RNA, 15 nt, Homo sapiens
cuggcuggccagucu

SEQ ID NO: 2139229 - RNA, 16 nt, Homo sapiens
caccaccuacacagga

SEQ ID NO: 2139230 - RNA, 14 nt, Homo sapiens
ccaaaagccaguca

SEQ ID NO: 2139231 - RNA, 20 nt, Homo sapiens
cucaguucuacacugauaca

SEQ ID NO: 2139232 - RNA, 11 nt, Homo sapiens
gggacugcugc

SEQ ID NO: 2139233 - RNA, 11 nt, Homo sapiens
uaauaccucaa

SEQ ID NO: 2139234 - RNA, 17 nt, Homo sapiens
cuuauuaugugcaacau

SEQ ID NO: 2139235 - RNA, 18 nt, Homo sapiens
acagcuaaaucauuugag

SEQ ID NO: 2139236 - RNA, 19 nt, Homo sapiens
ggccuccugugcaucugua

SEQ ID NO: 2139237 - RNA, 20 nt, Homo sapiens
gaaugaauuuaucuuuacca

SEQ ID NO: 2139238 - RNA, 19 nt, Homo sapiens
acaucugcccugacugaau

SEQ ID NO: 2139239 - RNA, 13 nt, Homo sapiens
gcauugcucuuau

SEQ ID NO: 2139240 - RNA, 18 nt, Homo sapiens
uuauuucugugcaaacaa

SEQ ID NO: 2139241 - RNA, 13 nt, Homo sapiens
aaccaggauccug

SEQ ID NO: 2139242 - RNA, 21 nt, Homo sapiens
ucagccuugccagagauccaa

SEQ ID NO: 2139243 - RNA, 15 nt, Homo sapiens
cucuuuuacaguuag

SEQ ID NO: 2139244 - RNA, 22 nt, Homo sapiens
uuuauaauucagaagacuacua

SEQ ID NO: 2139245 - RNA, 19 nt, Homo sapiens
cagguagucaaaggcaguu

SEQ ID NO: 2139246 - RNA, 15 nt, Homo sapiens
cuccaaaugcagcuu

SEQ ID NO: 2139247 - RNA, 14 nt, Homo sapiens
caggagaaguugag

SEQ ID NO: 2139248 - RNA, 18 nt, Homo sapiens
uauugucuugguugccag

SEQ ID NO: 2139249 - RNA, 13 nt, Homo sapiens
uguuucuuccaaa

SEQ ID NO: 2139250 - RNA, 21 nt, Homo sapiens
gaaaauaaucugguguucuug

SEQ ID NO: 2139251 - RNA, 15 nt, Homo sapiens
accugugagcccagc

SEQ ID NO: 2139252 - RNA, 18 nt, Homo sapiens
gcaaaugcacucaucaca

SEQ ID NO: 2139253 - RNA, 17 nt, Homo sapiens
ucucagaaccacuccug

SEQ ID NO: 2139254 - RNA, 22 nt, Homo sapiens
ucccucuaaaaguaaacuacug

SEQ ID NO: 2139255 - RNA, 23 nt, Homo sapiens
ugagccgagauagcaccauugca

SEQ ID NO: 2139256 - RNA, 19 nt, Homo sapiens
cuucacagggguacagaaa

SEQ ID NO: 2139257 - RNA, 21 nt, Homo sapiens
cucccuggccuguucuguuuu

SEQ ID NO: 2139258 - RNA, 17 nt, Homo sapiens
ccucauccaggcuacca

SEQ ID NO: 2139259 - RNA, 15 nt, Homo sapiens
acaauaaaacacuuu

SEQ ID NO: 2139260 - RNA, 23 nt, Homo sapiens
aguuuuaggacaaacagcucagu

SEQ ID NO: 2139261 - RNA, 14 nt, Homo sapiens
acuuuagaugcuga

SEQ ID NO: 2139262 - RNA, 22 nt, Homo sapiens
gucacacaaacugaugaugaca

SEQ ID NO: 2139263 - RNA, 18 nt, Homo sapiens
ugggucaaguacaccagc

SEQ ID NO: 2139264 - RNA, 15 nt, Homo sapiens
guggagcuugcagug

SEQ ID NO: 2139265 - RNA, 13 nt, Homo sapiens
caaguguucacaa

SEQ ID NO: 2139266 - RNA, 14 nt, Homo sapiens
cugauuccuguugc

SEQ ID NO: 2139267 - RNA, 15 nt, Homo sapiens
gccacuaacuucuaa

SEQ ID NO: 2139268 - RNA, 21 nt, Homo sapiens
auuuaaccccuugguacugaa

SEQ ID NO: 2139269 - RNA, 17 nt, Homo sapiens
aaagcuauauaagacaa

SEQ ID NO: 2139270 - RNA, 19 nt, Homo sapiens
aaaauaaauaggagcuuaa

SEQ ID NO: 2139271 - RNA, 15 nt, Homo sapiens
gccagaaaaaagugu

SEQ ID NO: 2139272 - RNA, 19 nt, Homo sapiens
gugccccaugccuguccag

SEQ ID NO: 2139273 - RNA, 20 nt, Homo sapiens
gugcuuuucacuacuuugua

SEQ ID NO: 2139274 - RNA, 14 nt, Homo sapiens
ccauucugccucuc

SEQ ID NO: 2139275 - RNA, 20 nt, Homo sapiens
ucagaacacgacagaaacag

SEQ ID NO: 2139276 - RNA, 19 nt, Homo sapiens
acucauuaucacagugaau

SEQ ID NO: 2139277 - RNA, 23 nt, Homo sapiens
cagauaucuuggacaaaucacau

SEQ ID NO: 2139278 - RNA, 16 nt, Homo sapiens
cuuacuuuacugccug

SEQ ID NO: 2139279 - RNA, 17 nt, Homo sapiens
agucgccagucacugcu

SEQ ID NO: 2139280 - RNA, 22 nt, Homo sapiens
aucaaaauuucagcauuauuga

SEQ ID NO: 2139281 - RNA, 17 nt, Homo sapiens
ucuguucccugggcuga

SEQ ID NO: 2139282 - RNA, 16 nt, Homo sapiens
uuuuaaaaguuauuaa

SEQ ID NO: 2139283 - RNA, 21 nt, Homo sapiens
acagaaccuuguuauuucuca

SEQ ID NO: 2139284 - RNA, 14 nt, Homo sapiens
auggugcucagccc

SEQ ID NO: 2139285 - RNA, 16 nt, Homo sapiens
ccuaauaugcuuuaca

SEQ ID NO: 2139286 - RNA, 12 nt, Homo sapiens
cgagauagccac

SEQ ID NO: 2139287 - RNA, 20 nt, Homo sapiens
uauuggagauuaaucuacca

SEQ ID NO: 2139288 - RNA, 13 nt, Homo sapiens
cccucggugggcc

SEQ ID NO: 2139289 - RNA, 21 nt, Homo sapiens
uuauuagguacguaacuauuu

SEQ ID NO: 2139290 - RNA, 22 nt, Homo sapiens
ugccacauuucugaucagaggu

SEQ ID NO: 2139291 - RNA, 14 nt, Homo sapiens
uuggugcauagaac

SEQ ID NO: 2139292 - RNA, 22 nt, Homo sapiens
gaguggccagccagugccauuc

SEQ ID NO: 2139293 - RNA, 15 nt, Homo sapiens
aaauuucuauucucu

SEQ ID NO: 2139294 - RNA, 15 nt, Homo sapiens
caugacacauuugaa

SEQ ID NO: 2139295 - RNA, 14 nt, Homo sapiens
acgacaaagcagaa

SEQ ID NO: 2139296 - RNA, 18 nt, Homo sapiens
gacaauuuauaauuugaa

SEQ ID NO: 2139297 - RNA, 11 nt, Homo sapiens
cuucacugaag

SEQ ID NO: 2139298 - RNA, 13 nt, Homo sapiens
uuugacgagcuca

SEQ ID NO: 2139299 - RNA, 18 nt, Homo sapiens
uaaguguugguagcacuu

SEQ ID NO: 2139300 - RNA, 16 nt, Homo sapiens
uugcccaaaacuguca

SEQ ID NO: 2139301 - RNA, 22 nt, Homo sapiens
agaccucagugccuuccuguuu

SEQ ID NO: 2139302 - RNA, 12 nt, Homo sapiens
ucuucuguaaau

SEQ ID NO: 2139303 - RNA, 14 nt, Homo sapiens
cuuuguauauuaca

SEQ ID NO: 2139304 - RNA, 14 nt, Homo sapiens
aucaucauggccag

SEQ ID NO: 2139305 - RNA, 15 nt, Homo sapiens
gcacaccccaaggga

SEQ ID NO: 2139306 - RNA, 19 nt, Homo sapiens
gaaucauccagacuccuca

SEQ ID NO: 2139307 - RNA, 18 nt, Homo sapiens
aguaccccccuaccacac

SEQ ID NO: 2139308 - RNA, 19 nt, Homo sapiens
uggaaucagcuuuuaauaa

SEQ ID NO: 2139309 - RNA, 17 nt, Homo sapiens
aaauaagggaauccuga

SEQ ID NO: 2139310 - RNA, 13 nt, Homo sapiens
cuucuguugucau

SEQ ID NO: 2139311 - RNA, 13 nt, Homo sapiens
uucaaguguacag

SEQ ID NO: 2139312 - RNA, 19 nt, Homo sapiens
gugcagcagggucaucugu

SEQ ID NO: 2139313 - RNA, 12 nt, Homo sapiens
cccugugcuguc

SEQ ID NO: 2139314 - RNA, 19 nt, Homo sapiens
ccacaaaucaucuguaaca

SEQ ID NO: 2139315 - RNA, 19 nt, Homo sapiens
cagcuggcgucaugcaaag

SEQ ID NO: 2139316 - RNA, 21 nt, Homo sapiens
uuggauaauauccacugcaau

SEQ ID NO: 2139317 - RNA, 18 nt, Homo sapiens
gguauaguucaugucugc

SEQ ID NO: 2139318 - RNA, 21 nt, Homo sapiens
aucaugaucacaacugagauc

SEQ ID NO: 2139319 - RNA, 15 nt, Homo sapiens
acuggucacauugcc

SEQ ID NO: 2139320 - RNA, 19 nt, Homo sapiens
augauuuguaacauucaca

SEQ ID NO: 2139321 - RNA, 17 nt, Homo sapiens
guagguggcacacuggg

SEQ ID NO: 2139322 - RNA, 20 nt, Homo sapiens
agaaaaacuacagcaucauu

SEQ ID NO: 2139323 - RNA, 11 nt, Homo sapiens
acaaccugcug

SEQ ID NO: 2139324 - RNA, 13 nt, Homo sapiens
ucuuaauuuggaa

SEQ ID NO: 2139325 - RNA, 15 nt, Homo sapiens
ccuuucaugauuugc

SEQ ID NO: 2139326 - RNA, 22 nt, Homo sapiens
ugucucuggauuauauuaugaa

SEQ ID NO: 2139327 - RNA, 19 nt, Homo sapiens
gugcccucccucacuugug

SEQ ID NO: 2139328 - RNA, 14 nt, Homo sapiens
gaagcaaggccagc

SEQ ID NO: 2139329 - RNA, 17 nt, Homo sapiens
uuugagaacauucccug

SEQ ID NO: 2139330 - RNA, 21 nt, Homo sapiens
gaacccccucccugucccagg

SEQ ID NO: 2139331 - RNA, 13 nt, Homo sapiens
uguauauugcuaa

SEQ ID NO: 2139332 - RNA, 13 nt, Homo sapiens
auuacuacuccuu

SEQ ID NO: 2139333 - RNA, 21 nt, Homo sapiens
cugcgaacccaagcaaugggg

SEQ ID NO: 2139334 - RNA, 23 nt, Homo sapiens
uugguguaaucucucauggugaa

SEQ ID NO: 2139335 - RNA, 14 nt, Homo sapiens
uggguuuggcaaaa

SEQ ID NO: 2139336 - RNA, 19 nt, Homo sapiens
uaaacaaaauguagacaaa

SEQ ID NO: 2139337 - RNA, 16 nt, Homo sapiens
aucguuagaggagcaa

SEQ ID NO: 2139338 - RNA, 15 nt, Homo sapiens
uaacuuccacuuugu

SEQ ID NO: 2139339 - RNA, 18 nt, Homo sapiens
uuccugcuccuccaguac

SEQ ID NO: 2139340 - RNA, 16 nt, Homo sapiens
uuucaugggacuaaau

SEQ ID NO: 2139341 - RNA, 22 nt, Homo sapiens
uuuaacuuuauaaauccaguga

SEQ ID NO: 2139342 - RNA, 20 nt, Homo sapiens
gaguauuagcuuacccaaug

SEQ ID NO: 2139343 - RNA, 21 nt, Homo sapiens
ucuggaagucaucucauucca

SEQ ID NO: 2139344 - RNA, 17 nt, Homo sapiens
caaaagguuaagccaua

SEQ ID NO: 2139345 - RNA, 22 nt, Homo sapiens
guuaaauccuuugcuucauucc

SEQ ID NO: 2139346 - RNA, 13 nt, Homo sapiens
ugacauuacaauc

SEQ ID NO: 2139347 - RNA, 14 nt, Homo sapiens
ucugugccccaugc

SEQ ID NO: 2139348 - RNA, 14 nt, Homo sapiens
ggagaccuggcacu

SEQ ID NO: 2139349 - RNA, 15 nt, Homo sapiens
agaaaauauagucac

SEQ ID NO: 2139350 - RNA, 22 nt, Homo sapiens
ccaaggucacuuccguuuaccu

SEQ ID NO: 2139351 - RNA, 17 nt, Homo sapiens
gggcaugccacccucac

SEQ ID NO: 2139352 - RNA, 19 nt, Homo sapiens
aggcuauuauuuauuguau

SEQ ID NO: 2139353 - RNA, 17 nt, Homo sapiens
caaguaagaagacauga

SEQ ID NO: 2139354 - RNA, 17 nt, Homo sapiens
augucgaugacuucauc

SEQ ID NO: 2139355 - RNA, 16 nt, Homo sapiens
aaaguucucauugaau

SEQ ID NO: 2139356 - RNA, 18 nt, Homo sapiens
acagguccucaguguccu

SEQ ID NO: 2139357 - RNA, 21 nt, Homo sapiens
auuccuacaauuucuaugugg

SEQ ID NO: 2139358 - RNA, 15 nt, Homo sapiens
ggaauaaagccuuuu

SEQ ID NO: 2139359 - RNA, 23 nt, Homo sapiens
uugcccaccacaacuaacaaugc

SEQ ID NO: 2139360 - RNA, 22 nt, Homo sapiens
guuucuucaaucugaagauaca

SEQ ID NO: 2139361 - RNA, 21 nt, Homo sapiens
ggcccuucuugccuacuaugc

SEQ ID NO: 2139362 - RNA, 16 nt, Homo sapiens
aaaauaguaaacauua

SEQ ID NO: 2139363 - RNA, 23 nt, Homo sapiens
agauuuuuuauugcuaguauuug

SEQ ID NO: 2139364 - RNA, 14 nt, Homo sapiens
uaaauagaauuaug

SEQ ID NO: 2139365 - RNA, 17 nt, Homo sapiens
uugaauuaaaacagcug

SEQ ID NO: 2139366 - RNA, 18 nt, Homo sapiens
cgcugcucuuaugccauu

SEQ ID NO: 2139367 - RNA, 18 nt, Homo sapiens
uaacaaauaaagugcagu

SEQ ID NO: 2139368 - RNA, 20 nt, Homo sapiens
ggcugaggcaggcagaucac

SEQ ID NO: 2139369 - RNA, 17 nt, Homo sapiens
cagggaaacaacaugaa

SEQ ID NO: 2139370 - RNA, 15 nt, Homo sapiens
cuuuugcacauauau

SEQ ID NO: 2139371 - RNA, 19 nt, Homo sapiens
ccagcuuucccugccaggc

SEQ ID NO: 2139372 - RNA, 20 nt, Homo sapiens
aauuuauaccuagcacuuua

SEQ ID NO: 2139373 - RNA, 17 nt, Homo sapiens
uaaauguuuguggaaua

SEQ ID NO: 2139374 - RNA, 16 nt, Homo sapiens
cagaacuauaacauuc

SEQ ID NO: 2139375 - RNA, 20 nt, Homo sapiens
caagcaggaaccccaggaga

SEQ ID NO: 2139376 - RNA, 17 nt, Homo sapiens
ucucagguccagcuuua

SEQ ID NO: 2139377 - RNA, 22 nt, Homo sapiens
cugaacuaauaaaucuguugcc

SEQ ID NO: 2139378 - RNA, 16 nt, Homo sapiens
aagguucuauccuguu

SEQ ID NO: 2139379 - RNA, 20 nt, Homo sapiens
cauagcaacuccccuacauc

SEQ ID NO: 2139380 - RNA, 16 nt, Homo sapiens
uuuccauaaucacuca

SEQ ID NO: 2139381 - RNA, 12 nt, Homo sapiens
cuggccacugca

SEQ ID NO: 2139382 - RNA, 16 nt, Homo sapiens
uuaagcccugcucuuu

SEQ ID NO: 2139383 - RNA, 15 nt, Homo sapiens
cagugauccaugucc

SEQ ID NO: 2139384 - RNA, 15 nt, Homo sapiens
uucagaaaagcaccu

SEQ ID NO: 2139385 - RNA, 19 nt, Homo sapiens
caaguuguuuaacugugca

SEQ ID NO: 2139386 - RNA, 16 nt, Homo sapiens
gccauggaauaaacca

SEQ ID NO: 2139387 - RNA, 14 nt, Homo sapiens
gauuugucugucaa

SEQ ID NO: 2139388 - RNA, 16 nt, Homo sapiens
cuauuaauacucugca

SEQ ID NO: 2139389 - RNA, 17 nt, Homo sapiens
uggauuucauacuguaa

SEQ ID NO: 2139390 - RNA, 11 nt, Homo sapiens
ccuuguuguug

SEQ ID NO: 2139391 - RNA, 21 nt, Homo sapiens
auuucucaaaugcacaucuca

SEQ ID NO: 2139392 - RNA, 13 nt, Homo sapiens
aaacugcacugcc

SEQ ID NO: 2139393 - RNA, 16 nt, Homo sapiens
ucucuacagacuccaa

SEQ ID NO: 2139394 - RNA, 18 nt, Homo sapiens
ccucaaauguugagggaa

SEQ ID NO: 2139395 - RNA, 18 nt, Homo sapiens
cuguccacaugaccucca

SEQ ID NO: 2139396 - RNA, 17 nt, Homo sapiens
uccugcagaggcccagc

SEQ ID NO: 2139397 - RNA, 16 nt, Homo sapiens
cuugagaaagaucuaa

SEQ ID NO: 2139398 - RNA, 20 nt, Homo sapiens
gugacuuggagagagauuca

SEQ ID NO: 2139399 - RNA, 13 nt, Homo sapiens
aacugacaaugaa

SEQ ID NO: 2139400 - RNA, 17 nt, Homo sapiens
uuccuuaagagcuauuu

SEQ ID NO: 2139401 - RNA, 20 nt, Homo sapiens
ucaguagugcuaaugcauuu

SEQ ID NO: 2139402 - RNA, 22 nt, Homo sapiens
aacaucagcugaauucacuuaa

SEQ ID NO: 2139403 - RNA, 18 nt, Homo sapiens
ugccauguuuuugccaaa

SEQ ID NO: 2139404 - RNA, 15 nt, Homo sapiens
augccacucaccaac

SEQ ID NO: 2139405 - RNA, 20 nt, Homo sapiens
guuguagcagguuucacuau

SEQ ID NO: 2139406 - RNA, 20 nt, Homo sapiens
agaagcuuugguucugccau

SEQ ID NO: 2139407 - RNA, 13 nt, Homo sapiens
ugcaaaugaaugc

SEQ ID NO: 2139408 - RNA, 14 nt, Homo sapiens
gucgcaucucagug

SEQ ID NO: 2139409 - RNA, 17 nt, Homo sapiens
aucaagagaauauacug

SEQ ID NO: 2139410 - RNA, 15 nt, Homo sapiens
aaauguccccuugau

SEQ ID NO: 2139411 - RNA, 17 nt, Homo sapiens
uaaauauuuauuuauuc

SEQ ID NO: 2139412 - RNA, 17 nt, Homo sapiens
aagacguggacuccucu

SEQ ID NO: 2139413 - RNA, 23 nt, Homo sapiens
uuuaaggcaaugguuucacaugg

SEQ ID NO: 2139414 - RNA, 14 nt, Homo sapiens
gccacaacccuguu

SEQ ID NO: 2139415 - RNA, 14 nt, Homo sapiens
aagguaacuguaca

SEQ ID NO: 2139416 - RNA, 18 nt, Homo sapiens
aguaagcauuuccagccu

SEQ ID NO: 2139417 - RNA, 16 nt, Homo sapiens
uuuauuuuucucauga

SEQ ID NO: 2139418 - RNA, 11 nt, Homo sapiens
ggucaugccac

SEQ ID NO: 2139419 - RNA, 15 nt, Homo sapiens
uaucccagugaucac

SEQ ID NO: 2139420 - RNA, 21 nt, Homo sapiens
uguaccuguuuccuacagaca

SEQ ID NO: 2139421 - RNA, 13 nt, Homo sapiens
ugagaggaugaau

SEQ ID NO: 2139422 - RNA, 15 nt, Homo sapiens
cuuuugguaugugac

SEQ ID NO: 2139423 - RNA, 19 nt, Homo sapiens
aucuuacaaaaacaagaca

SEQ ID NO: 2139424 - RNA, 13 nt, Homo sapiens
aaggccuuuggga

SEQ ID NO: 2139425 - RNA, 21 nt, Homo sapiens
aaucauguugaucauguacuu

SEQ ID NO: 2139426 - RNA, 21 nt, Homo sapiens
ugggcacaguuugguccguua

SEQ ID NO: 2139427 - RNA, 15 nt, Homo sapiens
ugauaaaauuauuga

SEQ ID NO: 2139428 - RNA, 20 nt, Homo sapiens
gggacagaggauuucugcuu

SEQ ID NO: 2139429 - RNA, 17 nt, Homo sapiens
uccagugaaacuuuuag

SEQ ID NO: 2139430 - RNA, 21 nt, Homo sapiens
acggaguuucacucuugucac

SEQ ID NO: 2139431 - RNA, 21 nt, Homo sapiens
uggagagccccucacacagcc

SEQ ID NO: 2139432 - RNA, 16 nt, Homo sapiens
ucucccguccauucca

SEQ ID NO: 2139433 - RNA, 19 nt, Homo sapiens
ucugcauuccugaugacca

SEQ ID NO: 2139434 - RNA, 14 nt, Homo sapiens
cccaucccauccca

SEQ ID NO: 2139435 - RNA, 18 nt, Homo sapiens
cugauuauuuaucacaua

SEQ ID NO: 2139436 - RNA, 18 nt, Homo sapiens
gaauucuuaacauagcca

SEQ ID NO: 2139437 - RNA, 21 nt, Homo sapiens
uguacaugguauuaacacuua

SEQ ID NO: 2139438 - RNA, 17 nt, Homo sapiens
cuuacagaacuacuucu

SEQ ID NO: 2139439 - RNA, 19 nt, Homo sapiens
cagaggguggagaugucag

SEQ ID NO: 2139440 - RNA, 22 nt, Homo sapiens
caugguggcucacgccuguaau

SEQ ID NO: 2139441 - RNA, 19 nt, Homo sapiens
ugaguugggaaaaacugac

SEQ ID NO: 2139442 - RNA, 16 nt, Homo sapiens
uuucucuaaagucacu

SEQ ID NO: 2139443 - RNA, 20 nt, Homo sapiens
acccuuguguccacugugac

SEQ ID NO: 2139444 - RNA, 22 nt, Homo sapiens
uguauuuuuaacaccagaaaga

SEQ ID NO: 2139445 - RNA, 20 nt, Homo sapiens
cuacugagucacaauaaaga

SEQ ID NO: 2139446 - RNA, 15 nt, Homo sapiens
aaagauucugucuua

SEQ ID NO: 2139447 - RNA, 14 nt, Homo sapiens
auucuagugcugcu

SEQ ID NO: 2139448 - RNA, 15 nt, Homo sapiens
gcagcuguugcagug

SEQ ID NO: 2139449 - RNA, 15 nt, Homo sapiens
uuguagcguuuccuu

SEQ ID NO: 2139450 - RNA, 20 nt, Homo sapiens
auugacacacagcacucucu

SEQ ID NO: 2139451 - RNA, 18 nt, Homo sapiens
aaaacuguguaaaccaca

SEQ ID NO: 2139452 - RNA, 20 nt, Homo sapiens
auuugugcuagaaauuuuca

SEQ ID NO: 2139453 - RNA, 20 nt, Homo sapiens
aauacauuucaauuauacua

SEQ ID NO: 2139454 - RNA, 18 nt, Homo sapiens
uaagaaaaagaagaacua

SEQ ID NO: 2139455 - RNA, 21 nt, Homo sapiens
ucccuuuguugcacacucacu

SEQ ID NO: 2139456 - RNA, 17 nt, Homo sapiens
ucauaagcgaucacuuc

SEQ ID NO: 2139457 - RNA, 17 nt, Homo sapiens
cauuacuugcacaagcu

SEQ ID NO: 2139458 - RNA, 22 nt, Homo sapiens
ugguguuuagaaugucaguuga

SEQ ID NO: 2139459 - RNA, 14 nt, Homo sapiens
gguuucuucaagag

SEQ ID NO: 2139460 - RNA, 18 nt, Homo sapiens
ggcccuguuccccaagga

SEQ ID NO: 2139461 - RNA, 20 nt, Homo sapiens
auuucaagguaagagccuua

SEQ ID NO: 2139462 - RNA, 21 nt, Homo sapiens
uucuaagacuuacucuaagau

SEQ ID NO: 2139463 - RNA, 20 nt, Homo sapiens
gagggcuagaaccuagaagg

SEQ ID NO: 2139464 - RNA, 17 nt, Homo sapiens
gaauaaaaguuccucuc

SEQ ID NO: 2139465 - RNA, 13 nt, Homo sapiens
aacuacugugauc

SEQ ID NO: 2139466 - RNA, 21 nt, Homo sapiens
aguuugagaccagccugggca

SEQ ID NO: 2139467 - RNA, 18 nt, Homo sapiens
acaaaggcaguucagucc

SEQ ID NO: 2139468 - RNA, 16 nt, Homo sapiens
aguggaaugacugaaa

SEQ ID NO: 2139469 - RNA, 23 nt, Homo sapiens
gacagaaggccuugaagaauuug

SEQ ID NO: 2139470 - RNA, 16 nt, Homo sapiens
uccauggccagcagca

SEQ ID NO: 2139471 - RNA, 11 nt, Homo sapiens
uggcaccugca

SEQ ID NO: 2139472 - RNA, 21 nt, Homo sapiens
uugagcagaauacaaugggaa

SEQ ID NO: 2139473 - RNA, 19 nt, Homo sapiens
aggaguucgcuggccauug

SEQ ID NO: 2139474 - RNA, 17 nt, Homo sapiens
uuaauaugauucuagua

SEQ ID NO: 2139475 - RNA, 15 nt, Homo sapiens
ccauucagagcuaug

SEQ ID NO: 2139476 - RNA, 21 nt, Homo sapiens
augaucuguuuuucaccacuu

SEQ ID NO: 2139477 - RNA, 22 nt, Homo sapiens
aauacgguaccuggcaauguuu

SEQ ID NO: 2139478 - RNA, 12 nt, Homo sapiens
uccaaacauucu

SEQ ID NO: 2139479 - RNA, 12 nt, Homo sapiens
uuaaaacaucau

SEQ ID NO: 2139480 - RNA, 20 nt, Homo sapiens
auauaaagaaaaucaaugaa

SEQ ID NO: 2139481 - RNA, 20 nt, Homo sapiens
cauagagauagcuacagugu

SEQ ID NO: 2139482 - RNA, 18 nt, Homo sapiens
gaagaaaccccaagcagc

SEQ ID NO: 2139483 - RNA, 17 nt, Homo sapiens
uguugacauagccuuug

SEQ ID NO: 2139484 - RNA, 21 nt, Homo sapiens
acaucuccuugaucaugucuu

SEQ ID NO: 2139485 - RNA, 23 nt, Homo sapiens
cuauucuauaaaacucugcaugu

SEQ ID NO: 2139486 - RNA, 17 nt, Homo sapiens
aucugucuucagcacau

SEQ ID NO: 2139487 - RNA, 24 nt, Homo sapiens
aacuaaugauaaaguaaugaucuc

SEQ ID NO: 2139488 - RNA, 18 nt, Homo sapiens
caaacccagccucuagaa

SEQ ID NO: 2139489 - RNA, 17 nt, Homo sapiens
aauccuuccacuaucau

SEQ ID NO: 2139490 - RNA, 23 nt, Homo sapiens
aagaaaguuuccccaccagugaa

SEQ ID NO: 2139491 - RNA, 13 nt, Homo sapiens
auuugaacacugg

SEQ ID NO: 2139492 - RNA, 15 nt, Homo sapiens
gcacaaauuguacau

SEQ ID NO: 2139493 - RNA, 19 nt, Homo sapiens
uccgcccccaugcucucug

SEQ ID NO: 2139494 - RNA, 13 nt, Homo sapiens
uccaugcaugugc

SEQ ID NO: 2139495 - RNA, 19 nt, Homo sapiens
aggaacuuuuaaaagauua

SEQ ID NO: 2139496 - RNA, 22 nt, Homo sapiens
gcgggcucagagcuuugucacu

SEQ ID NO: 2139497 - RNA, 13 nt, Homo sapiens
aauuuugcuacau

SEQ ID NO: 2139498 - RNA, 12 nt, Homo sapiens
gaucuaucuaca

SEQ ID NO: 2139499 - RNA, 19 nt, Homo sapiens
caggguccagacccugaag

SEQ ID NO: 2139500 - RNA, 15 nt, Homo sapiens
ucaagcuccaagagg

SEQ ID NO: 2139501 - RNA, 20 nt, Homo sapiens
uuauaaacagaaaaucuuuc

SEQ ID NO: 2139502 - RNA, 22 nt, Homo sapiens
ugaggcaggagaauggcgugaa

SEQ ID NO: 2139503 - RNA, 16 nt, Homo sapiens
cacacggaugcacaga

SEQ ID NO: 2139504 - RNA, 22 nt, Homo sapiens
uccuagggcacuucuaguuuca

SEQ ID NO: 2139505 - RNA, 19 nt, Homo sapiens
cauggauuucucugcucac

SEQ ID NO: 2139506 - RNA, 15 nt, Homo sapiens
aacaagccaaagagc

SEQ ID NO: 2139507 - RNA, 13 nt, Homo sapiens
uauguaugcaucu

SEQ ID NO: 2139508 - RNA, 13 nt, Homo sapiens
caugaauguauca

SEQ ID NO: 2139509 - RNA, 14 nt, Homo sapiens
gagcacaaguucca

SEQ ID NO: 2139510 - RNA, 23 nt, Homo sapiens
guggcaaaagacauccucaaaag

SEQ ID NO: 2139511 - RNA, 22 nt, Homo sapiens
auugaucagagcauugugcaau

SEQ ID NO: 2139512 - RNA, 23 nt, Homo sapiens
guaaauccagauuuucacuguuc

SEQ ID NO: 2139513 - RNA, 23 nt, Homo sapiens
cgccagauucuuuccugaggcug

SEQ ID NO: 2139514 - RNA, 22 nt, Homo sapiens
uuuuaaacgauuagugaugucc

SEQ ID NO: 2139515 - RNA, 15 nt, Homo sapiens
ggcagcaacaauaaa

SEQ ID NO: 2139516 - RNA, 14 nt, Homo sapiens
cugccauccucacc

SEQ ID NO: 2139517 - RNA, 14 nt, Homo sapiens
agagcuccauuucc

SEQ ID NO: 2139518 - RNA, 23 nt, Homo sapiens
ucccaaauugaaucacugcucac

SEQ ID NO: 2139519 - RNA, 18 nt, Homo sapiens
gucaaaacauucagguau

SEQ ID NO: 2139520 - RNA, 22 nt, Homo sapiens
ccuaguacugccccccaugagg

SEQ ID NO: 2139521 - RNA, 16 nt, Homo sapiens
gagugagucagugaug

SEQ ID NO: 2139522 - RNA, 22 nt, Homo sapiens
caaggacgaauuugcacaguga

SEQ ID NO: 2139523 - RNA, 20 nt, Homo sapiens
ccaguaaaaucaaaugugca

SEQ ID NO: 2139524 - RNA, 23 nt, Homo sapiens
uggcagggccagggcaaugccau

SEQ ID NO: 2139525 - RNA, 19 nt, Homo sapiens
aaaaauauaauuaccugua

SEQ ID NO: 2139526 - RNA, 23 nt, Homo sapiens
ugccuagcacucacaugcuggac

SEQ ID NO: 2139527 - RNA, 20 nt, Homo sapiens
agucuucacuugcacugggg

SEQ ID NO: 2139528 - RNA, 22 nt, Homo sapiens
caaucagauuagacacuaugug

SEQ ID NO: 2139529 - RNA, 23 nt, Homo sapiens
uucccacccuccaccucucacgg

SEQ ID NO: 2139530 - RNA, 20 nt, Homo sapiens
gucccggggcuccacugaac

SEQ ID NO: 2139531 - RNA, 12 nt, Homo sapiens
aguccacuuuac

SEQ ID NO: 2139532 - RNA, 18 nt, Homo sapiens
cuacuguuacucuaaaua

SEQ ID NO: 2139533 - RNA, 22 nt, Homo sapiens
cuucccccaagauugagcucuc

SEQ ID NO: 2139534 - RNA, 14 nt, Homo sapiens
uccaauacuguugc

SEQ ID NO: 2139535 - RNA, 14 nt, Homo sapiens
ugcagcacucuuau

SEQ ID NO: 2139536 - RNA, 12 nt, Homo sapiens
gcaggugccucc

SEQ ID NO: 2139537 - RNA, 19 nt, Homo sapiens
auauuucucaucugcacua

SEQ ID NO: 2139538 - RNA, 18 nt, Homo sapiens
uaccuguuuccuacagac

SEQ ID NO: 2139539 - RNA, 22 nt, Homo sapiens
uacuaguuuuaguuuucucuua

SEQ ID NO: 2139540 - RNA, 15 nt, Homo sapiens
aaagucuuaccucag

SEQ ID NO: 2139541 - RNA, 12 nt, Homo sapiens
cagcucaggaua

SEQ ID NO: 2139542 - RNA, 23 nt, Homo sapiens
gagcaaugggaauggcauuauug

SEQ ID NO: 2139543 - RNA, 23 nt, Homo sapiens
uacuuguguaguccuaugcaaua

SEQ ID NO: 2139544 - RNA, 21 nt, Homo sapiens
auuugaauguaaaacaggaaa

SEQ ID NO: 2139545 - RNA, 14 nt, Homo sapiens
agagagaagugccc

SEQ ID NO: 2139546 - RNA, 16 nt, Homo sapiens
cucacccauugucuca

SEQ ID NO: 2139547 - RNA, 22 nt, Homo sapiens
acuuuuuuuuuuucugccugag

SEQ ID NO: 2139548 - RNA, 16 nt, Homo sapiens
cuggcacuugggacaa

SEQ ID NO: 2139549 - RNA, 13 nt, Homo sapiens
ccauaacaauucc

SEQ ID NO: 2139550 - RNA, 13 nt, Homo sapiens
ccccuacucccuc

SEQ ID NO: 2139551 - RNA, 14 nt, Homo sapiens
uccagcucuaauaa

SEQ ID NO: 2139552 - RNA, 13 nt, Homo sapiens
acacacauccagc

SEQ ID NO: 2139553 - RNA, 23 nt, Homo sapiens
uucucaaaugcacaucucauggc

SEQ ID NO: 2139554 - RNA, 15 nt, Homo sapiens
uugaggagcucaaga

SEQ ID NO: 2139555 - RNA, 19 nt, Homo sapiens
uguuaacacuguaauaucu

SEQ ID NO: 2139556 - RNA, 14 nt, Homo sapiens
cugucugggaugua

SEQ ID NO: 2139557 - RNA, 13 nt, Homo sapiens
ucaaauuaagcau

SEQ ID NO: 2139558 - RNA, 19 nt, Homo sapiens
ugauaucaacagcuucccu

SEQ ID NO: 2139559 - RNA, 14 nt, Homo sapiens
aacacacugaguga

SEQ ID NO: 2139560 - RNA, 17 nt, Homo sapiens
uaaagaaauaaccacug

SEQ ID NO: 2139561 - RNA, 15 nt, Homo sapiens
uaucguuuaauuuua

SEQ ID NO: 2139562 - RNA, 17 nt, Homo sapiens
agaaugcaccauacuca

SEQ ID NO: 2139563 - RNA, 20 nt, Homo sapiens
gaaaauuaauagaauuauuu

SEQ ID NO: 2139564 - RNA, 13 nt, Homo sapiens
agagcacagagca

SEQ ID NO: 2139565 - RNA, 12 nt, Homo sapiens
auacaaccagcc

SEQ ID NO: 2139566 - RNA, 23 nt, Homo sapiens
gagucacacgggggcagcugaua

SEQ ID NO: 2139567 - RNA, 23 nt, Homo sapiens
ucaucaaagcagaagucuggcuu

SEQ ID NO: 2139568 - RNA, 14 nt, Homo sapiens
ccacacguuugcca

SEQ ID NO: 2139569 - RNA, 21 nt, Homo sapiens
guuugucacgucuucugagaa

SEQ ID NO: 2139570 - RNA, 15 nt, Homo sapiens
auaaauguacuacau

SEQ ID NO: 2139571 - RNA, 19 nt, Homo sapiens
uccuaacuucaucauugau

SEQ ID NO: 2139572 - RNA, 21 nt, Homo sapiens
auuccuguuucugaaccauua

SEQ ID NO: 2139573 - RNA, 22 nt, Homo sapiens
cacccugggcagugagugccau

SEQ ID NO: 2139574 - RNA, 13 nt, Homo sapiens
aauucuagucaua

SEQ ID NO: 2139575 - RNA, 20 nt, Homo sapiens
uucuucuaagaagacauuuu

SEQ ID NO: 2139576 - RNA, 22 nt, Homo sapiens
aucaugucuauuuuugaugacu

SEQ ID NO: 2139577 - RNA, 11 nt, Homo sapiens
cccaagggaaa

SEQ ID NO: 2139578 - RNA, 22 nt, Homo sapiens
uaagaccuccucccaagcacuu

SEQ ID NO: 2139579 - RNA, 14 nt, Homo sapiens
uucuguaucauuga

SEQ ID NO: 2139580 - RNA, 22 nt, Homo sapiens
gaaucacuguuuagaacacaca

SEQ ID NO: 2139581 - RNA, 14 nt, Homo sapiens
ucaugcauuacuua

SEQ ID NO: 2139582 - RNA, 18 nt, Homo sapiens
gccucgggaccucaggug

SEQ ID NO: 2139583 - RNA, 16 nt, Homo sapiens
auauagcuacaaauga

SEQ ID NO: 2139584 - RNA, 22 nt, Homo sapiens
gaagcauuuguauuuuguguga

SEQ ID NO: 2139585 - RNA, 22 nt, Homo sapiens
uggagaaauagacuuugccuuu

SEQ ID NO: 2139586 - RNA, 15 nt, Homo sapiens
cagaaauuaaaugaa

SEQ ID NO: 2139587 - RNA, 19 nt, Homo sapiens
gaauauucuguaaaccuaa

SEQ ID NO: 2139588 - RNA, 22 nt, Homo sapiens
gcuucucacugccaugccagcu

SEQ ID NO: 2139589 - RNA, 20 nt, Homo sapiens
cucaugcugugugacucaaa

SEQ ID NO: 2139590 - RNA, 19 nt, Homo sapiens
gauuugagcacaaaggcaa

SEQ ID NO: 2139591 - RNA, 22 nt, Homo sapiens
cugcccgucucucucccaugga

SEQ ID NO: 2139592 - RNA, 13 nt, Homo sapiens
uaugugaugccaa

SEQ ID NO: 2139593 - RNA, 15 nt, Homo sapiens
gaagagccaggacau

SEQ ID NO: 2139594 - RNA, 16 nt, Homo sapiens
uggacacacacagcuu

SEQ ID NO: 2139595 - RNA, 17 nt, Homo sapiens
aagcagaacagugauua

SEQ ID NO: 2139596 - RNA, 16 nt, Homo sapiens
cuuuauuucugaucua

SEQ ID NO: 2139597 - RNA, 12 nt, Homo sapiens
cgggugcucaau

SEQ ID NO: 2139598 - RNA, 16 nt, Homo sapiens
uuguucugugguuauc

SEQ ID NO: 2139599 - RNA, 17 nt, Homo sapiens
ugugcgccgggggaccu

SEQ ID NO: 2139600 - RNA, 13 nt, Homo sapiens
agcuccacagugu

SEQ ID NO: 2139601 - RNA, 16 nt, Homo sapiens
caaugccacccucauc

SEQ ID NO: 2139602 - RNA, 21 nt, Homo sapiens
augggacgcaggagaucaucu

SEQ ID NO: 2139603 - RNA, 14 nt, Homo sapiens
accucacgugcaaa

SEQ ID NO: 2139604 - RNA, 13 nt, Homo sapiens
cacccgggagcag

SEQ ID NO: 2139605 - RNA, 19 nt, Homo sapiens
gugauauuuuuaugugcag

SEQ ID NO: 2139606 - RNA, 16 nt, Homo sapiens
agaauguuuuagcaca

SEQ ID NO: 2139607 - RNA, 22 nt, Homo sapiens
agaccuagcuaaggucuauaaa

SEQ ID NO: 2139608 - RNA, 20 nt, Homo sapiens
cagguuuuguguuuugucau

SEQ ID NO: 2139609 - RNA, 21 nt, Homo sapiens
auuuucauauuuaaagccaaa

SEQ ID NO: 2139610 - RNA, 23 nt, Homo sapiens
gugaauuaagcccaauuaauucc

SEQ ID NO: 2139611 - RNA, 23 nt, Homo sapiens
aaccaguuucuaucccuuaccug

SEQ ID NO: 2139612 - RNA, 21 nt, Homo sapiens
cucaagucuggcagacuuucu

SEQ ID NO: 2139613 - RNA, 16 nt, Homo sapiens
gccccuacccuggacu

SEQ ID NO: 2139614 - RNA, 15 nt, Homo sapiens
cuggcuucacucucc

SEQ ID NO: 2139615 - RNA, 19 nt, Homo sapiens
ucuagaagcgguuuccagg

SEQ ID NO: 2139616 - RNA, 15 nt, Homo sapiens
gucagucccuacuua

SEQ ID NO: 2139617 - RNA, 12 nt, Homo sapiens
ccuccaccaaac

SEQ ID NO: 2139618 - RNA, 16 nt, Homo sapiens
aaggguuuacuugaca

SEQ ID NO: 2139619 - RNA, 18 nt, Homo sapiens
uaccccaggacgcaugca

SEQ ID NO: 2139620 - RNA, 16 nt, Homo sapiens
acacuagugacaguau

SEQ ID NO: 2139621 - RNA, 13 nt, Homo sapiens
uucccuugccauc

SEQ ID NO: 2139622 - RNA, 13 nt, Homo sapiens
uuccauugccaua

SEQ ID NO: 2139623 - RNA, 19 nt, Homo sapiens
aaggucuccuaaaacuggg

SEQ ID NO: 2139624 - RNA, 20 nt, Homo sapiens
gccuugucacgccagacuuc

SEQ ID NO: 2139625 - RNA, 21 nt, Homo sapiens
caagcuguccagagaaaagag

SEQ ID NO: 2139626 - RNA, 17 nt, Homo sapiens
gggcuauauuucaguga

SEQ ID NO: 2139627 - RNA, 18 nt, Homo sapiens
caucaguagcugagugca

SEQ ID NO: 2139628 - RNA, 21 nt, Homo sapiens
cgaggcaaagagaaaagccac

SEQ ID NO: 2139629 - RNA, 21 nt, Homo sapiens
auaaaaggaaguagaugugaa

SEQ ID NO: 2139630 - RNA, 21 nt, Homo sapiens
aguuguucucaggggugcugg

SEQ ID NO: 2139631 - RNA, 12 nt, Homo sapiens
uguguguaaaaa

SEQ ID NO: 2139632 - RNA, 13 nt, Homo sapiens
ugcaucacugggu

SEQ ID NO: 2139633 - RNA, 17 nt, Homo sapiens
agccucaccccauccca

SEQ ID NO: 2139634 - RNA, 12 nt, Homo sapiens
aagcuuauguca

SEQ ID NO: 2139635 - RNA, 16 nt, Homo sapiens
uguuuucagacugccu

SEQ ID NO: 2139636 - RNA, 14 nt, Homo sapiens
ucaagaacauucua

SEQ ID NO: 2139637 - RNA, 19 nt, Homo sapiens
uugaaggguguucacccau

SEQ ID NO: 2139638 - RNA, 15 nt, Homo sapiens
uuuauucacuugugu

SEQ ID NO: 2139639 - RNA, 20 nt, Homo sapiens
uacaguuaggcaccagaaga

SEQ ID NO: 2139640 - RNA, 16 nt, Homo sapiens
augagccaaaccagca

SEQ ID NO: 2139641 - RNA, 18 nt, Homo sapiens
cagacuuaagcguacaaa

SEQ ID NO: 2139642 - RNA, 13 nt, Homo sapiens
guguguacugcac

SEQ ID NO: 2139643 - RNA, 18 nt, Homo sapiens
gcacaccgggccaaguga

SEQ ID NO: 2139644 - RNA, 18 nt, Homo sapiens
acuuuaguagacauuuau

SEQ ID NO: 2139645 - RNA, 13 nt, Homo sapiens
acuggucugggaa

SEQ ID NO: 2139646 - RNA, 18 nt, Homo sapiens
cuaccaaaaacuagacau

SEQ ID NO: 2139647 - RNA, 11 nt, Homo sapiens
agccagaggag

SEQ ID NO: 2139648 - RNA, 23 nt, Homo sapiens
cuggucuagucacgcaugcagug

SEQ ID NO: 2139649 - RNA, 15 nt, Homo sapiens
auucaaaauugacau

SEQ ID NO: 2139650 - RNA, 13 nt, Homo sapiens
uguuuuuuuucag

SEQ ID NO: 2139651 - RNA, 18 nt, Homo sapiens
cugaguggugaggggcca

SEQ ID NO: 2139652 - RNA, 22 nt, Homo sapiens
auagcgauauuuaucucuuccu

SEQ ID NO: 2139653 - RNA, 16 nt, Homo sapiens
aaacaucuuaguugau

SEQ ID NO: 2139654 - RNA, 21 nt, Homo sapiens
aucuaggcacacaaacauuua

SEQ ID NO: 2139655 - RNA, 16 nt, Homo sapiens
accucuuuuaaaucua

SEQ ID NO: 2139656 - RNA, 17 nt, Homo sapiens
uacucaauacuaccucu

SEQ ID NO: 2139657 - RNA, 23 nt, Homo sapiens
ugucaccucgcugggcucuaagg

SEQ ID NO: 2139658 - RNA, 12 nt, Homo sapiens
agggagcuuccu

SEQ ID NO: 2139659 - RNA, 19 nt, Homo sapiens
ugaaccccuggccagcucu

SEQ ID NO: 2139660 - RNA, 23 nt, Homo sapiens
cacagcgucccuagcagugaacu

SEQ ID NO: 2139661 - RNA, 19 nt, Homo sapiens
cuacaugcuuguugacaga

SEQ ID NO: 2139662 - RNA, 18 nt, Homo sapiens
ugaugaggccucuuggac

SEQ ID NO: 2139663 - RNA, 18 nt, Homo sapiens
augucagcacacacuuac

SEQ ID NO: 2139664 - RNA, 22 nt, Homo sapiens
cguuauacacauauaguguaca

SEQ ID NO: 2139665 - RNA, 21 nt, Homo sapiens
cuaaacucauuuauaaagcua

SEQ ID NO: 2139666 - RNA, 16 nt, Homo sapiens
auugaucaccaugaaa

SEQ ID NO: 2139667 - RNA, 14 nt, Homo sapiens
agggcugcaaaagu

SEQ ID NO: 2139668 - RNA, 12 nt, Homo sapiens
uuuuagcagaga

SEQ ID NO: 2139669 - RNA, 15 nt, Homo sapiens
uccugugacuguuuu

SEQ ID NO: 2139670 - RNA, 18 nt, Homo sapiens
caguauguuuguuucauu

SEQ ID NO: 2139671 - RNA, 17 nt, Homo sapiens
auugccuagaggugcuc

SEQ ID NO: 2139672 - RNA, 15 nt, Homo sapiens
cuaaauuuauauuca

SEQ ID NO: 2139673 - RNA, 21 nt, Homo sapiens
gguucugcgccacuuccuuug

SEQ ID NO: 2139674 - RNA, 15 nt, Homo sapiens
auaaaugaguucaac

SEQ ID NO: 2139675 - RNA, 11 nt, Homo sapiens
auugugaugcu

SEQ ID NO: 2139676 - RNA, 23 nt, Homo sapiens
cuguggauagcccauagcuauuu

SEQ ID NO: 2139677 - RNA, 22 nt, Homo sapiens
aggaguuccagaccagccugac

SEQ ID NO: 2139678 - RNA, 22 nt, Homo sapiens
gcauuaucuaugauaugcuaau

SEQ ID NO: 2139679 - RNA, 16 nt, Homo sapiens
ccgcagggccaugcag

SEQ ID NO: 2139680 - RNA, 18 nt, Homo sapiens
uacaaacacaauauucaa

SEQ ID NO: 2139681 - RNA, 16 nt, Homo sapiens
caguacacuucaguua

SEQ ID NO: 2139682 - RNA, 12 nt, Homo sapiens
acaguaauguca

SEQ ID NO: 2139683 - RNA, 14 nt, Homo sapiens
aagaaauuuuugcc

SEQ ID NO: 2139684 - RNA, 18 nt, Homo sapiens
caaacaugaauccuguga

SEQ ID NO: 2139685 - RNA, 14 nt, Homo sapiens
aaacaagucaaaga

SEQ ID NO: 2139686 - RNA, 14 nt, Homo sapiens
agguuggagugcau

SEQ ID NO: 2139687 - RNA, 20 nt, Homo sapiens
augaagacauuucugcucuc

SEQ ID NO: 2139688 - RNA, 21 nt, Homo sapiens
agaagcaguuguaccaaguga

SEQ ID NO: 2139689 - RNA, 23 nt, Homo sapiens
uucagcugugcuuuuugcaaaag

SEQ ID NO: 2139690 - RNA, 14 nt, Homo sapiens
aaacaccaagugag

SEQ ID NO: 2139691 - RNA, 21 nt, Homo sapiens
aaggggacaccuguacauucu

SEQ ID NO: 2139692 - RNA, 15 nt, Homo sapiens
cuaggccgcccugag

SEQ ID NO: 2139693 - RNA, 23 nt, Homo sapiens
uaaaugcuuuuauuaaagcaauc

SEQ ID NO: 2139694 - RNA, 11 nt, Homo sapiens
cuucagaugac

SEQ ID NO: 2139695 - RNA, 19 nt, Homo sapiens
auuuuccaaauuacagcau

SEQ ID NO: 2139696 - RNA, 15 nt, Homo sapiens
uggccggcacuccau

SEQ ID NO: 2139697 - RNA, 19 nt, Homo sapiens
gucucaaacucccgaccuc

SEQ ID NO: 2139698 - RNA, 18 nt, Homo sapiens
aggcgcucagccuuggcu

SEQ ID NO: 2139699 - RNA, 15 nt, Homo sapiens
gaaguccuucaguga

SEQ ID NO: 2139700 - RNA, 22 nt, Homo sapiens
cucuucagaacacacagacuuu

SEQ ID NO: 2139701 - RNA, 18 nt, Homo sapiens
auuguaggcaaccuuccc

SEQ ID NO: 2139702 - RNA, 14 nt, Homo sapiens
accauaacagccaa

SEQ ID NO: 2139703 - RNA, 14 nt, Homo sapiens
uggcccaggccaga

SEQ ID NO: 2139704 - RNA, 17 nt, Homo sapiens
uaacauggaaguacuau

SEQ ID NO: 2139705 - RNA, 18 nt, Homo sapiens
uauacucuguagucucag

SEQ ID NO: 2139706 - RNA, 13 nt, Homo sapiens
uauacaccuuagu

SEQ ID NO: 2139707 - RNA, 17 nt, Homo sapiens
cuaguuuuuauacaugu

SEQ ID NO: 2139708 - RNA, 13 nt, Homo sapiens
uuagaauaucuaa

SEQ ID NO: 2139709 - RNA, 13 nt, Homo sapiens
cccaaaacacagg

SEQ ID NO: 2139710 - RNA, 18 nt, Homo sapiens
cagaaaugcccccauucu

SEQ ID NO: 2139711 - RNA, 17 nt, Homo sapiens
ggccaaaacagauuuua

SEQ ID NO: 2139712 - RNA, 20 nt, Homo sapiens
uaaaauaagcucagugauac

SEQ ID NO: 2139713 - RNA, 20 nt, Homo sapiens
gggcccaagcaaggggccua

SEQ ID NO: 2139714 - RNA, 16 nt, Homo sapiens
uggggacucuggaaaa

SEQ ID NO: 2139715 - RNA, 12 nt, Homo sapiens
ggcuacucugcu

SEQ ID NO: 2139716 - RNA, 13 nt, Homo sapiens
ucugcuccaugca

SEQ ID NO: 2139717 - RNA, 21 nt, Homo sapiens
ccucugaaacagcugccuuag

SEQ ID NO: 2139718 - RNA, 22 nt, Homo sapiens
ccguuuugugaagaaacauuua

SEQ ID NO: 2139719 - RNA, 14 nt, Homo sapiens
acggcucuuagcac

SEQ ID NO: 2139720 - RNA, 16 nt, Homo sapiens
aagccagcugcagcug

SEQ ID NO: 2139721 - RNA, 20 nt, Homo sapiens
gcaugccauugaaacuaaga

SEQ ID NO: 2139722 - RNA, 17 nt, Homo sapiens
ucccuucuucccuagcc

SEQ ID NO: 2139723 - RNA, 22 nt, Homo sapiens
acuggccugggucucccuggug

SEQ ID NO: 2139724 - RNA, 20 nt, Homo sapiens
caagaucacgccacugcacu

SEQ ID NO: 2139725 - RNA, 15 nt, Homo sapiens
caugaaauuauccau

SEQ ID NO: 2139726 - RNA, 22 nt, Homo sapiens
cucauuuccaaaccaucagcug

SEQ ID NO: 2139727 - RNA, 17 nt, Homo sapiens
ccuugcaggggccggag

SEQ ID NO: 2139728 - RNA, 21 nt, Homo sapiens
uagacagaguugcuuaaugaa

SEQ ID NO: 2139729 - RNA, 14 nt, Homo sapiens
ugcaucuccacuug

SEQ ID NO: 2139730 - RNA, 16 nt, Homo sapiens
uaaacuaguguuauac

SEQ ID NO: 2139731 - RNA, 22 nt, Homo sapiens
auuaccuugugcuaauccucuu

SEQ ID NO: 2139732 - RNA, 23 nt, Homo sapiens
agccaagaauucuuaaauaugug

SEQ ID NO: 2139733 - RNA, 17 nt, Homo sapiens
cuagcuccauaauugca

SEQ ID NO: 2139734 - RNA, 23 nt, Homo sapiens
uucaggggacuguucucaccuua

SEQ ID NO: 2139735 - RNA, 15 nt, Homo sapiens
caggucugaagcuca

SEQ ID NO: 2139736 - RNA, 13 nt, Homo sapiens
uugcuaccaguau

SEQ ID NO: 2139737 - RNA, 18 nt, Homo sapiens
ucagccauucucuaccca

SEQ ID NO: 2139738 - RNA, 16 nt, Homo sapiens
uccguucaauaagcau

SEQ ID NO: 2139739 - RNA, 14 nt, Homo sapiens
cuuggagauuuauc

SEQ ID NO: 2139740 - RNA, 18 nt, Homo sapiens
cacagcauguguauuucc

SEQ ID NO: 2139741 - RNA, 11 nt, Homo sapiens
ccaggagcucu

SEQ ID NO: 2139742 - RNA, 17 nt, Homo sapiens
gaaugugagguguugcu

SEQ ID NO: 2139743 - RNA, 14 nt, Homo sapiens
gaauaaauucaaua

SEQ ID NO: 2139744 - RNA, 20 nt, Homo sapiens
gaugcacuuccuggucuucc

SEQ ID NO: 2139745 - RNA, 22 nt, Homo sapiens
agguaguagaaucucagcacuu

SEQ ID NO: 2139746 - RNA, 20 nt, Homo sapiens
caaaugaaaaaauuaaaaag

SEQ ID NO: 2139747 - RNA, 15 nt, Homo sapiens
acuguccaugaagca

SEQ ID NO: 2139748 - RNA, 13 nt, Homo sapiens
caucccacuccac

SEQ ID NO: 2139749 - RNA, 15 nt, Homo sapiens
agaguugcuuccagu

SEQ ID NO: 2139750 - RNA, 19 nt, Homo sapiens
caugcuuagaaaguuccaa

SEQ ID NO: 2139751 - RNA, 20 nt, Homo sapiens
augaugagcauuuagcacaa

SEQ ID NO: 2139752 - RNA, 14 nt, Homo sapiens
gccauccugauaca

SEQ ID NO: 2139753 - RNA, 16 nt, Homo sapiens
agaccuggaacaaauc

SEQ ID NO: 2139754 - RNA, 19 nt, Homo sapiens
cuucacaaaaucuguuuag

SEQ ID NO: 2139755 - RNA, 15 nt, Homo sapiens
aguagucaaggugcu

SEQ ID NO: 2139756 - RNA, 17 nt, Homo sapiens
gcagucuaguccugggg

SEQ ID NO: 2139757 - RNA, 19 nt, Homo sapiens
ucagcuggcggaaccuggc

SEQ ID NO: 2139758 - RNA, 23 nt, Homo sapiens
auugucauuagugagacauauuu

SEQ ID NO: 2139759 - RNA, 21 nt, Homo sapiens
agaaaaucaaccagcaggaaa

SEQ ID NO: 2139760 - RNA, 17 nt, Homo sapiens
gcacaugaaacauuauu

SEQ ID NO: 2139761 - RNA, 18 nt, Homo sapiens
gucuuccugacacuuuaa

SEQ ID NO: 2139762 - RNA, 16 nt, Homo sapiens
uaagcuuucucucaga

SEQ ID NO: 2139763 - RNA, 21 nt, Homo sapiens
cuucccacggcuccucgagau

SEQ ID NO: 2139764 - RNA, 15 nt, Homo sapiens
agcuuaauggaugua

SEQ ID NO: 2139765 - RNA, 20 nt, Homo sapiens
gcuugcuggaaaacugccac

SEQ ID NO: 2139766 - RNA, 15 nt, Homo sapiens
ggaugguucugugac

SEQ ID NO: 2139767 - RNA, 22 nt, Homo sapiens
uuuaaaaagaaaaucaguugau

SEQ ID NO: 2139768 - RNA, 19 nt, Homo sapiens
agguagcaucauugaucuu

SEQ ID NO: 2139769 - RNA, 16 nt, Homo sapiens
cugugccuaucaccuc

SEQ ID NO: 2139770 - RNA, 13 nt, Homo sapiens
ccuuuucaugauu

SEQ ID NO: 2139771 - RNA, 12 nt, Homo sapiens
cuggcagcuuug

SEQ ID NO: 2139772 - RNA, 20 nt, Homo sapiens
uugaauguacaccacaugcu

SEQ ID NO: 2139773 - RNA, 11 nt, Homo sapiens
cuucucagugu

SEQ ID NO: 2139774 - RNA, 12 nt, Homo sapiens
cacuuucuucaa

SEQ ID NO: 2139775 - RNA, 22 nt, Homo sapiens
cucuccuuggugaagaacaucc

SEQ ID NO: 2139776 - RNA, 23 nt, Homo sapiens
accagagaagggcuuggacucaa

SEQ ID NO: 2139777 - RNA, 15 nt, Homo sapiens
auccaagauucugcu

SEQ ID NO: 2139778 - RNA, 14 nt, Homo sapiens
cucugggagacuuu

SEQ ID NO: 2139779 - RNA, 21 nt, Homo sapiens
caaugaaaaauguaauuuaga

SEQ ID NO: 2139780 - RNA, 16 nt, Homo sapiens
aaacuuuuaacugaga

SEQ ID NO: 2139781 - RNA, 21 nt, Homo sapiens
ucagguuuucgaaccuugacc

SEQ ID NO: 2139782 - RNA, 15 nt, Homo sapiens
cuccucaucuccaag

SEQ ID NO: 2139783 - RNA, 18 nt, Homo sapiens
gaauccacagugucccau

SEQ ID NO: 2139784 - RNA, 16 nt, Homo sapiens
uuuauuaacuacugaa

SEQ ID NO: 2139785 - RNA, 14 nt, Homo sapiens
gaaacauguugauu

SEQ ID NO: 2139786 - RNA, 17 nt, Homo sapiens
cuaguauaucagugaca

SEQ ID NO: 2139787 - RNA, 22 nt, Homo sapiens
caggauugaagcuuuagugaaa

SEQ ID NO: 2139788 - RNA, 12 nt, Homo sapiens
cuccucccucag

SEQ ID NO: 2139789 - RNA, 12 nt, Homo sapiens
uucagaaacuca

SEQ ID NO: 2139790 - RNA, 20 nt, Homo sapiens
gacucccuccauagcgacac

SEQ ID NO: 2139791 - RNA, 22 nt, Homo sapiens
ucuccacacggagcuccuggca

SEQ ID NO: 2139792 - RNA, 19 nt, Homo sapiens
accugccaggcacacugag

SEQ ID NO: 2139793 - RNA, 14 nt, Homo sapiens
auggggcacccugg

SEQ ID NO: 2139794 - RNA, 16 nt, Homo sapiens
gaaaaacuuuguuaua

SEQ ID NO: 2139795 - RNA, 18 nt, Homo sapiens
caucucuccccauauaua

SEQ ID NO: 2139796 - RNA, 18 nt, Homo sapiens
gagcggggcccacccggu

SEQ ID NO: 2139797 - RNA, 12 nt, Homo sapiens
cagaaccauuca

SEQ ID NO: 2139798 - RNA, 17 nt, Homo sapiens
cuuugaggaacauucaa

SEQ ID NO: 2139799 - RNA, 16 nt, Homo sapiens
uccuucaugauuucca

SEQ ID NO: 2139800 - RNA, 13 nt, Homo sapiens
agaucgcaucauu

SEQ ID NO: 2139801 - RNA, 18 nt, Homo sapiens
gaaauaguuacuauuuca

SEQ ID NO: 2139802 - RNA, 22 nt, Homo sapiens
ugauguucauggguauaguuca

SEQ ID NO: 2139803 - RNA, 17 nt, Homo sapiens
auaugucuuacuacuuu

SEQ ID NO: 2139804 - RNA, 20 nt, Homo sapiens
uucuggaauggaauuggaca

SEQ ID NO: 2139805 - RNA, 15 nt, Homo sapiens
ugauguuucugugaa

SEQ ID NO: 2139806 - RNA, 18 nt, Homo sapiens
aggcaccucuuccuugau

SEQ ID NO: 2139807 - RNA, 20 nt, Homo sapiens
cuaucuggccuuugcaugga

SEQ ID NO: 2139808 - RNA, 20 nt, Homo sapiens
ugcacauuggucauugugaa

SEQ ID NO: 2139809 - RNA, 14 nt, Homo sapiens
uccucuccagacac

SEQ ID NO: 2139810 - RNA, 14 nt, Homo sapiens
ugccacccacaucu

SEQ ID NO: 2139811 - RNA, 22 nt, Homo sapiens
caucuuauaaacugacuucuuu

SEQ ID NO: 2139812 - RNA, 22 nt, Homo sapiens
agacugauaacaaccuuuuaca

SEQ ID NO: 2139813 - RNA, 17 nt, Homo sapiens
gccugguagaauuggga

SEQ ID NO: 2139814 - RNA, 22 nt, Homo sapiens
ucaaaagguuaauaaaguaauu

SEQ ID NO: 2139815 - RNA, 12 nt, Homo sapiens
gaucucaaggau

SEQ ID NO: 2139816 - RNA, 16 nt, Homo sapiens
gcacacaaacauuuaa

SEQ ID NO: 2139817 - RNA, 15 nt, Homo sapiens
uggguucacuugcca

SEQ ID NO: 2139818 - RNA, 22 nt, Homo sapiens
acuaacaaaguuuucaugugcu

SEQ ID NO: 2139819 - RNA, 15 nt, Homo sapiens
acauucaugcucagu

SEQ ID NO: 2139820 - RNA, 13 nt, Homo sapiens
uauuggggaacag

SEQ ID NO: 2139821 - RNA, 20 nt, Homo sapiens
uugcaccuaaguguguacua

SEQ ID NO: 2139822 - RNA, 18 nt, Homo sapiens
gcaucuccagcauucuca

SEQ ID NO: 2139823 - RNA, 20 nt, Homo sapiens
gcccugaaggcaccugucaa

SEQ ID NO: 2139824 - RNA, 17 nt, Homo sapiens
aaccucaccaacugcac

SEQ ID NO: 2139825 - RNA, 19 nt, Homo sapiens
ggagaauguggagaacuaa

SEQ ID NO: 2139826 - RNA, 17 nt, Homo sapiens
agcccaauuaauuccug

SEQ ID NO: 2139827 - RNA, 12 nt, Homo sapiens
aaaucaauacaa

SEQ ID NO: 2139828 - RNA, 14 nt, Homo sapiens
cuuuugcaaacaau

SEQ ID NO: 2139829 - RNA, 19 nt, Homo sapiens
cugcugggggugaggacac

SEQ ID NO: 2139830 - RNA, 13 nt, Homo sapiens
cgcaccacugcac

SEQ ID NO: 2139831 - RNA, 14 nt, Homo sapiens
uggaagaguaguaa

SEQ ID NO: 2139832 - RNA, 13 nt, Homo sapiens
guuuaaugcaaua

SEQ ID NO: 2139833 - RNA, 20 nt, Homo sapiens
uagaccaggauuucuaauca

SEQ ID NO: 2139834 - RNA, 12 nt, Homo sapiens
ccucagccugau

SEQ ID NO: 2139835 - RNA, 19 nt, Homo sapiens
uuugagugucuuugacuug

SEQ ID NO: 2139836 - RNA, 18 nt, Homo sapiens
ggaaucuuuguaccaaaa

SEQ ID NO: 2139837 - RNA, 13 nt, Homo sapiens
ccuuccuugccua

SEQ ID NO: 2139838 - RNA, 13 nt, Homo sapiens
ccccaaagaucuc

SEQ ID NO: 2139839 - RNA, 12 nt, Homo sapiens
ucugaaguacuu

SEQ ID NO: 2139840 - RNA, 17 nt, Homo sapiens
uggccuugugucacugg

SEQ ID NO: 2139841 - RNA, 21 nt, Homo sapiens
caagagaaucaacagaugaua

SEQ ID NO: 2139842 - RNA, 22 nt, Homo sapiens
aguaacaaucugcuuucuuugu

SEQ ID NO: 2139843 - RNA, 21 nt, Homo sapiens
gugugugcacaucuacaugcc

SEQ ID NO: 2139844 - RNA, 22 nt, Homo sapiens
agaaucuguugaguugcugcca

SEQ ID NO: 2139845 - RNA, 14 nt, Homo sapiens
aaauauaacaggug

SEQ ID NO: 2139846 - RNA, 14 nt, Homo sapiens
uccacagaguauaa

SEQ ID NO: 2139847 - RNA, 14 nt, Homo sapiens
uuuuaaacuacuga

SEQ ID NO: 2139848 - RNA, 14 nt, Homo sapiens
guccucaucugcaa

SEQ ID NO: 2139849 - RNA, 21 nt, Homo sapiens
gcuacaaucuguucaauguuu

SEQ ID NO: 2139850 - RNA, 18 nt, Homo sapiens
gaaagacagagcugggau

SEQ ID NO: 2139851 - RNA, 13 nt, Homo sapiens
ugcugcugugacc

SEQ ID NO: 2139852 - RNA, 22 nt, Homo sapiens
uaagauuuugaaaacuacauuu

SEQ ID NO: 2139853 - RNA, 18 nt, Homo sapiens
agaacaccuccagcuuuu

SEQ ID NO: 2139854 - RNA, 23 nt, Homo sapiens
acccacucugcuuugacugagca

SEQ ID NO: 2139855 - RNA, 17 nt, Homo sapiens
uuagaagcucacgccuu

SEQ ID NO: 2139856 - RNA, 14 nt, Homo sapiens
ccgcgugcaaagga

SEQ ID NO: 2139857 - RNA, 17 nt, Homo sapiens
gccaccucugccucuag

SEQ ID NO: 2139858 - RNA, 23 nt, Homo sapiens
ucagaaagugcauuaaacugaau

SEQ ID NO: 2139859 - RNA, 15 nt, Homo sapiens
agaccuugauugcac

SEQ ID NO: 2139860 - RNA, 17 nt, Homo sapiens
ucacuuauuuagauuca

SEQ ID NO: 2139861 - RNA, 20 nt, Homo sapiens
gauauauguguauacauaca

SEQ ID NO: 2139862 - RNA, 16 nt, Homo sapiens
gcaaguuuauagacau

SEQ ID NO: 2139863 - RNA, 17 nt, Homo sapiens
cuccauuauuccucuca

SEQ ID NO: 2139864 - RNA, 21 nt, Homo sapiens
cccuuaucguccccugugauu

SEQ ID NO: 2139865 - RNA, 13 nt, Homo sapiens
cacacuuugccau

SEQ ID NO: 2139866 - RNA, 22 nt, Homo sapiens
uaaauaguuacuccagugccaa

SEQ ID NO: 2139867 - RNA, 16 nt, Homo sapiens
uuaaaaugaucauuag

SEQ ID NO: 2139868 - RNA, 16 nt, Homo sapiens
ucaaaaauaccauuuu

SEQ ID NO: 2139869 - RNA, 22 nt, Homo sapiens
agauguacuuuuuaaaucaugu

SEQ ID NO: 2139870 - RNA, 18 nt, Homo sapiens
agaaggcaguaguuuuca

SEQ ID NO: 2139871 - RNA, 17 nt, Homo sapiens
ccagccuccaacuccag

SEQ ID NO: 2139872 - RNA, 15 nt, Homo sapiens
gccagggcagcauuu

SEQ ID NO: 2139873 - RNA, 22 nt, Homo sapiens
gaauaguguuggaaaaugugca

SEQ ID NO: 2139874 - RNA, 22 nt, Homo sapiens
ggggcuggccucuggcucucau

SEQ ID NO: 2139875 - RNA, 14 nt, Homo sapiens
ucuuaguuguucag

SEQ ID NO: 2139876 - RNA, 23 nt, Homo sapiens
cuuucugaggagcuguuacugaa

SEQ ID NO: 2139877 - RNA, 22 nt, Homo sapiens
ggguccuagaugccaaaggggu

SEQ ID NO: 2139878 - RNA, 16 nt, Homo sapiens
ugagaguacaccccaa

SEQ ID NO: 2139879 - RNA, 17 nt, Homo sapiens
cuucaguccuucuacug

SEQ ID NO: 2139880 - RNA, 22 nt, Homo sapiens
uguguagcucuguccacucuga

SEQ ID NO: 2139881 - RNA, 19 nt, Homo sapiens
gggcuggcugcuggaagaa

SEQ ID NO: 2139882 - RNA, 19 nt, Homo sapiens
aaccagcaacauugaccca

SEQ ID NO: 2139883 - RNA, 19 nt, Homo sapiens
cagcacacgaguuccagac

SEQ ID NO: 2139884 - RNA, 17 nt, Homo sapiens
ccacacggcugaccuca

SEQ ID NO: 2139885 - RNA, 23 nt, Homo sapiens
ggcuggacauuuguggcagugcu

SEQ ID NO: 2139886 - RNA, 11 nt, Homo sapiens
gaggucucccu

SEQ ID NO: 2139887 - RNA, 13 nt, Homo sapiens
cucuccaccaggu

SEQ ID NO: 2139888 - RNA, 15 nt, Homo sapiens
cagcuuucuaacuca

SEQ ID NO: 2139889 - RNA, 20 nt, Homo sapiens
aggugggucccggcucugug

SEQ ID NO: 2139890 - RNA, 15 nt, Homo sapiens
ggaugcuuacaguga

SEQ ID NO: 2139891 - RNA, 17 nt, Homo sapiens
ugcuggugacccagcau

SEQ ID NO: 2139892 - RNA, 15 nt, Homo sapiens
gccaaugccaugacu

SEQ ID NO: 2139893 - RNA, 20 nt, Homo sapiens
uaacccaaaucuuguuuaca

SEQ ID NO: 2139894 - RNA, 15 nt, Homo sapiens
uaccaguucugggca

SEQ ID NO: 2139895 - RNA, 22 nt, Homo sapiens
ggguguccugaugcaaaggugg

SEQ ID NO: 2139896 - RNA, 19 nt, Homo sapiens
cuuuaccuaaauaugagcc

SEQ ID NO: 2139897 - RNA, 21 nt, Homo sapiens
ugaugaaaacuaaggauuuuu

SEQ ID NO: 2139898 - RNA, 12 nt, Homo sapiens
aaauauauacac

SEQ ID NO: 2139899 - RNA, 22 nt, Homo sapiens
cauuguagccucaaucgaguga

SEQ ID NO: 2139900 - RNA, 18 nt, Homo sapiens
uaucacccaggaaucuca

SEQ ID NO: 2139901 - RNA, 12 nt, Homo sapiens
uggaggaccaga

SEQ ID NO: 2139902 - RNA, 17 nt, Homo sapiens
cuguauauuuaugacca

SEQ ID NO: 2139903 - RNA, 23 nt, Homo sapiens
uaagacuuccccucaacaugcug

SEQ ID NO: 2139904 - RNA, 20 nt, Homo sapiens
uacuccccagaccucaggga

SEQ ID NO: 2139905 - RNA, 21 nt, Homo sapiens
cacuggaauauaaaacaguca

SEQ ID NO: 2139906 - RNA, 19 nt, Homo sapiens
gacauccccccgccaaaag

SEQ ID NO: 2139907 - RNA, 15 nt, Homo sapiens
aggacacugaugggu

SEQ ID NO: 2139908 - RNA, 18 nt, Homo sapiens
accauggcacugacaaug

SEQ ID NO: 2139909 - RNA, 18 nt, Homo sapiens
cuucuucaguguccuuca

SEQ ID NO: 2139910 - RNA, 20 nt, Homo sapiens
uuuagauauuuuccauauau

SEQ ID NO: 2139911 - RNA, 17 nt, Homo sapiens
uuguaccagugugaaua

SEQ ID NO: 2139912 - RNA, 17 nt, Homo sapiens
ugugccaggccaaagau

SEQ ID NO: 2139913 - RNA, 20 nt, Homo sapiens
agaugcugacuguacuccuc

SEQ ID NO: 2139914 - RNA, 23 nt, Homo sapiens
agucaggguggagaugaggugcu

SEQ ID NO: 2139915 - RNA, 15 nt, Homo sapiens
aguuuucuguaguca

SEQ ID NO: 2139916 - RNA, 21 nt, Homo sapiens
acagcacuguauguguugcac

SEQ ID NO: 2139917 - RNA, 12 nt, Homo sapiens
uauauaauacua

SEQ ID NO: 2139918 - RNA, 22 nt, Homo sapiens
gccucagagcagccucauccca

SEQ ID NO: 2139919 - RNA, 18 nt, Homo sapiens
caggaggaucacuugagc

SEQ ID NO: 2139920 - RNA, 18 nt, Homo sapiens
cccuuaaggaauugacuu

SEQ ID NO: 2139921 - RNA, 22 nt, Homo sapiens
cauacuaaugaugagcauuuag

SEQ ID NO: 2139922 - RNA, 20 nt, Homo sapiens
gccaugaucaugccacugca

SEQ ID NO: 2139923 - RNA, 15 nt, Homo sapiens
cacacagcccauaaa

SEQ ID NO: 2139924 - RNA, 14 nt, Homo sapiens
ugaucacaauuugc

SEQ ID NO: 2139925 - RNA, 12 nt, Homo sapiens
augcaagcagcu

SEQ ID NO: 2139926 - RNA, 14 nt, Homo sapiens
aaaaaugacuaaaa

SEQ ID NO: 2139927 - RNA, 14 nt, Homo sapiens
aauuaagacuuuau

SEQ ID NO: 2139928 - RNA, 14 nt, Homo sapiens
uaugguuguauaca

SEQ ID NO: 2139929 - RNA, 16 nt, Homo sapiens
uucccaguucuugacc

SEQ ID NO: 2139930 - RNA, 15 nt, Homo sapiens
uccuuggcuugccug

SEQ ID NO: 2139931 - RNA, 17 nt, Homo sapiens
cuuuuggcuucugcaga

SEQ ID NO: 2139932 - RNA, 19 nt, Homo sapiens
augagcacaucucucugcc

SEQ ID NO: 2139933 - RNA, 15 nt, Homo sapiens
uguuugugugggaug

SEQ ID NO: 2139934 - RNA, 15 nt, Homo sapiens
ggaacacaauaaugu

SEQ ID NO: 2139935 - RNA, 19 nt, Homo sapiens
uguucaugcccauaccccu

SEQ ID NO: 2139936 - RNA, 22 nt, Homo sapiens
aaaacaagcaaugggcaaugga

SEQ ID NO: 2139937 - RNA, 18 nt, Homo sapiens
cuuuuccugcucccuaac

SEQ ID NO: 2139938 - RNA, 19 nt, Homo sapiens
uccucccccacgccuccau

SEQ ID NO: 2139939 - RNA, 21 nt, Homo sapiens
gcacuggguuugcucccugau

SEQ ID NO: 2139940 - RNA, 22 nt, Homo sapiens
auaaacagacuguuaauuauag

SEQ ID NO: 2139941 - RNA, 13 nt, Homo sapiens
uuuguguaugugu

SEQ ID NO: 2139942 - RNA, 13 nt, Homo sapiens
ugucaguauuuca

SEQ ID NO: 2139943 - RNA, 20 nt, Homo sapiens
uccuagaaacugacacaugc

SEQ ID NO: 2139944 - RNA, 15 nt, Homo sapiens
agcgaaacacacaaa

SEQ ID NO: 2139945 - RNA, 15 nt, Homo sapiens
uaagagaaaugagcu

SEQ ID NO: 2139946 - RNA, 16 nt, Homo sapiens
aggcagcuagacacca

SEQ ID NO: 2139947 - RNA, 20 nt, Homo sapiens
ccccagguggaggugccagg

SEQ ID NO: 2139948 - RNA, 19 nt, Homo sapiens
ucauugcucuguuaauaau

SEQ ID NO: 2139949 - RNA, 23 nt, Homo sapiens
acuuuccaucucugccugucaau

SEQ ID NO: 2139950 - RNA, 19 nt, Homo sapiens
caacauggcaauugcacuc

SEQ ID NO: 2139951 - RNA, 13 nt, Homo sapiens
ccaguccagaaga

SEQ ID NO: 2139952 - RNA, 13 nt, Homo sapiens
gcuguccacauga

SEQ ID NO: 2139953 - RNA, 16 nt, Homo sapiens
uuauauauaaagaagg

SEQ ID NO: 2139954 - RNA, 15 nt, Homo sapiens
auggaaggccagcuu

SEQ ID NO: 2139955 - RNA, 19 nt, Homo sapiens
uuaaaaauaaagcuacuga

SEQ ID NO: 2139956 - RNA, 11 nt, Homo sapiens
uucugccaaac

SEQ ID NO: 2139957 - RNA, 13 nt, Homo sapiens
ugagcucugggaa

SEQ ID NO: 2139958 - RNA, 16 nt, Homo sapiens
ccagagcuacugacua

SEQ ID NO: 2139959 - RNA, 19 nt, Homo sapiens
ucagccacuugccugugcu

SEQ ID NO: 2139960 - RNA, 17 nt, Homo sapiens
ccaaaccuccacugcug

SEQ ID NO: 2139961 - RNA, 19 nt, Homo sapiens
cgggggugaugugaaaaag

SEQ ID NO: 2139962 - RNA, 15 nt, Homo sapiens
ugccagugacagaca

SEQ ID NO: 2139963 - RNA, 12 nt, Homo sapiens
cucucucaggag

SEQ ID NO: 2139964 - RNA, 21 nt, Homo sapiens
aucucacuuuucuccaugagu

SEQ ID NO: 2139965 - RNA, 15 nt, Homo sapiens
ccagcccugaggggu

SEQ ID NO: 2139966 - RNA, 18 nt, Homo sapiens
ucuugagcagaugauucc

SEQ ID NO: 2139967 - RNA, 18 nt, Homo sapiens
gcaccgggccacagagaa

SEQ ID NO: 2139968 - RNA, 14 nt, Homo sapiens
caggggugcucacc

SEQ ID NO: 2139969 - RNA, 14 nt, Homo sapiens
uauaagaauuacua

SEQ ID NO: 2139970 - RNA, 17 nt, Homo sapiens
cuggugccccucgccag

SEQ ID NO: 2139971 - RNA, 14 nt, Homo sapiens
guaugucuaccucu

SEQ ID NO: 2139972 - RNA, 17 nt, Homo sapiens
gccagacccagagcccu

SEQ ID NO: 2139973 - RNA, 16 nt, Homo sapiens
uggccaauagucauau

SEQ ID NO: 2139974 - RNA, 17 nt, Homo sapiens
auacuauuuucauucuc

SEQ ID NO: 2139975 - RNA, 14 nt, Homo sapiens
uccguccaugccau

SEQ ID NO: 2139976 - RNA, 22 nt, Homo sapiens
acagcccucaugaucauucuca

SEQ ID NO: 2139977 - RNA, 14 nt, Homo sapiens
aacugcuuugugca

SEQ ID NO: 2139978 - RNA, 22 nt, Homo sapiens
cucugacaacagacuucugaaa

SEQ ID NO: 2139979 - RNA, 13 nt, Homo sapiens
ggacagguggugc

SEQ ID NO: 2139980 - RNA, 21 nt, Homo sapiens
uccuucauuaaugaugaucuu

SEQ ID NO: 2139981 - RNA, 16 nt, Homo sapiens
ggaagugggacuggca

SEQ ID NO: 2139982 - RNA, 17 nt, Homo sapiens
caugccuaguuauucau

SEQ ID NO: 2139983 - RNA, 13 nt, Homo sapiens
gugauugugccag

SEQ ID NO: 2139984 - RNA, 16 nt, Homo sapiens
caauguauucaguaua

SEQ ID NO: 2139985 - RNA, 21 nt, Homo sapiens
caucuagcaaccgccucaaaa

SEQ ID NO: 2139986 - RNA, 14 nt, Homo sapiens
gccccaaucuugcc

SEQ ID NO: 2139987 - RNA, 15 nt, Homo sapiens
cagucccaguauucu

SEQ ID NO: 2139988 - RNA, 22 nt, Homo sapiens
gcaucauaguuugcuuuguuua

SEQ ID NO: 2139989 - RNA, 22 nt, Homo sapiens
gaaaauuuccuccacauucaug

SEQ ID NO: 2139990 - RNA, 11 nt, Homo sapiens
auuaacuuuau

SEQ ID NO: 2139991 - RNA, 11 nt, Homo sapiens
uuaaacuuaaa

SEQ ID NO: 2139992 - RNA, 13 nt, Homo sapiens
aucaguccaaagg

SEQ ID NO: 2139993 - RNA, 12 nt, Homo sapiens
cagcucagaaaa

SEQ ID NO: 2139994 - RNA, 21 nt, Homo sapiens
ucuuuaauguuguccaggaaa

SEQ ID NO: 2139995 - RNA, 19 nt, Homo sapiens
gcuacaaucuucauuuaau

SEQ ID NO: 2139996 - RNA, 20 nt, Homo sapiens
auuagguauaucucccagug

SEQ ID NO: 2139997 - RNA, 16 nt, Homo sapiens
cagaaugacucuggaa

SEQ ID NO: 2139998 - RNA, 20 nt, Homo sapiens
cacaguacaauguuucagaa

SEQ ID NO: 2139999 - RNA, 18 nt, Homo sapiens
cagaucccacuugcagcc

SEQ ID NO: 2140000 - RNA, 21 nt, Homo sapiens
cugaaucuucagcauguucuc

SEQ ID NO: 2140001 - RNA, 12 nt, Homo sapiens
ucauucugcuaa

SEQ ID NO: 2140002 - RNA, 17 nt, Homo sapiens
gguaguauuacaccacc

SEQ ID NO: 2140003 - RNA, 15 nt, Homo sapiens
gccaaacacacugua

SEQ ID NO: 2140004 - RNA, 21 nt, Homo sapiens
uugguacaaucgacauccuag

SEQ ID NO: 2140005 - RNA, 13 nt, Homo sapiens
ggaaggagccagc

SEQ ID NO: 2140006 - RNA, 17 nt, Homo sapiens
uuugugaacgcugugau

SEQ ID NO: 2140007 - RNA, 23 nt, Homo sapiens
uuccuacacccuuggacuugagg

SEQ ID NO: 2140008 - RNA, 15 nt, Homo sapiens
ugacugcgcacugag

SEQ ID NO: 2140009 - RNA, 20 nt, Homo sapiens
cagaaagacagugacuguac

SEQ ID NO: 2140010 - RNA, 14 nt, Homo sapiens
auaagcagccagac

SEQ ID NO: 2140011 - RNA, 20 nt, Homo sapiens
uggaugcuggguccauauca

SEQ ID NO: 2140012 - RNA, 22 nt, Homo sapiens
gccgggcuggucuugaacuccu

SEQ ID NO: 2140013 - RNA, 15 nt, Homo sapiens
ccaacgacaaagcca

SEQ ID NO: 2140014 - RNA, 15 nt, Homo sapiens
cauaggucacuggcu

SEQ ID NO: 2140015 - RNA, 21 nt, Homo sapiens
uucugucagggguuucuucaa

SEQ ID NO: 2140016 - RNA, 17 nt, Homo sapiens
uggggguuaccaaaaau

SEQ ID NO: 2140017 - RNA, 16 nt, Homo sapiens
gagugcaguggcacga

SEQ ID NO: 2140018 - RNA, 19 nt, Homo sapiens
uaacaggaacaaaguaaca

SEQ ID NO: 2140019 - RNA, 14 nt, Homo sapiens
ccuaauaaacaauu

SEQ ID NO: 2140020 - RNA, 16 nt, Homo sapiens
gccccauuugccagau

SEQ ID NO: 2140021 - RNA, 11 nt, Homo sapiens
aaaaauaccau

SEQ ID NO: 2140022 - RNA, 11 nt, Homo sapiens
aauaauaccaa

SEQ ID NO: 2140023 - RNA, 17 nt, Homo sapiens
guauaguuuugucacaa

SEQ ID NO: 2140024 - RNA, 21 nt, Homo sapiens
cccaggaaacacaaauggggu

SEQ ID NO: 2140025 - RNA, 17 nt, Homo sapiens
gugcucuggcaccauca

SEQ ID NO: 2140026 - RNA, 14 nt, Homo sapiens
uagggauauuuaac

SEQ ID NO: 2140027 - RNA, 16 nt, Homo sapiens
uuugaguaauucuagc

SEQ ID NO: 2140028 - RNA, 19 nt, Homo sapiens
aauccuugagaugugggua

SEQ ID NO: 2140029 - RNA, 18 nt, Homo sapiens
uuuagaaucaagucugug

SEQ ID NO: 2140030 - RNA, 19 nt, Homo sapiens
cagacccccaucacuugau

SEQ ID NO: 2140031 - RNA, 22 nt, Homo sapiens
cucaucauagcaauaacauucc

SEQ ID NO: 2140032 - RNA, 20 nt, Homo sapiens
ccucaaaucacugcauucau

SEQ ID NO: 2140033 - RNA, 11 nt, Homo sapiens
gcagggccagg

SEQ ID NO: 2140034 - RNA, 17 nt, Homo sapiens
auggcuuugauugauuu

SEQ ID NO: 2140035 - RNA, 23 nt, Homo sapiens
gaggguuguucuccuagacugac

SEQ ID NO: 2140036 - RNA, 17 nt, Homo sapiens
uucuuauggcugcugaa

SEQ ID NO: 2140037 - RNA, 22 nt, Homo sapiens
auauugaauaaaaaauagacau

SEQ ID NO: 2140038 - RNA, 22 nt, Homo sapiens
acagacauacauagacauuuca

SEQ ID NO: 2140039 - RNA, 16 nt, Homo sapiens
agcucagugcucucuc

SEQ ID NO: 2140040 - RNA, 17 nt, Homo sapiens
cuccagguuacuaaagg

SEQ ID NO: 2140041 - RNA, 20 nt, Homo sapiens
ugagcaaguagguugcuguc

SEQ ID NO: 2140042 - RNA, 13 nt, Homo sapiens
guaccacacauau

SEQ ID NO: 2140043 - RNA, 20 nt, Homo sapiens
aaguauuuccaacuugucac

SEQ ID NO: 2140044 - RNA, 16 nt, Homo sapiens
uccugaacugcuuucc

SEQ ID NO: 2140045 - RNA, 12 nt, Homo sapiens
aagcacuggaau

SEQ ID NO: 2140046 - RNA, 18 nt, Homo sapiens
acuaccauacagacagca

SEQ ID NO: 2140047 - RNA, 14 nt, Homo sapiens
aaaugccauccaga

SEQ ID NO: 2140048 - RNA, 13 nt, Homo sapiens
gagagacuguuau

SEQ ID NO: 2140049 - RNA, 16 nt, Homo sapiens
accuguaauagccuca

SEQ ID NO: 2140050 - RNA, 15 nt, Homo sapiens
uuaaaugucugaaau

SEQ ID NO: 2140051 - RNA, 17 nt, Homo sapiens
cauuccggaggcuaaau

SEQ ID NO: 2140052 - RNA, 19 nt, Homo sapiens
ggauaguagaucuguggcg

SEQ ID NO: 2140053 - RNA, 22 nt, Homo sapiens
caugaguagauaauuucagggu

SEQ ID NO: 2140054 - RNA, 16 nt, Homo sapiens
ccauuuuaaaaaccaa

SEQ ID NO: 2140055 - RNA, 16 nt, Homo sapiens
aauuuuuuccuaccau

SEQ ID NO: 2140056 - RNA, 21 nt, Homo sapiens
auccacacauuuguugccaga

SEQ ID NO: 2140057 - RNA, 16 nt, Homo sapiens
gcguggacucugcaca

SEQ ID NO: 2140058 - RNA, 12 nt, Homo sapiens
cagcgacacaga

SEQ ID NO: 2140059 - RNA, 14 nt, Homo sapiens
cgugacaacacaaa

SEQ ID NO: 2140060 - RNA, 18 nt, Homo sapiens
uccccucguuaacacaug

SEQ ID NO: 2140061 - RNA, 18 nt, Homo sapiens
gcaggagagucacuugaa

SEQ ID NO: 2140062 - RNA, 21 nt, Homo sapiens
auuuccuuugcgcaaacuuua

SEQ ID NO: 2140063 - RNA, 19 nt, Homo sapiens
auugagauaaugauacuua

SEQ ID NO: 2140064 - RNA, 14 nt, Homo sapiens
cugaaggggaaccc

SEQ ID NO: 2140065 - RNA, 13 nt, Homo sapiens
cacagugcccaag

SEQ ID NO: 2140066 - RNA, 20 nt, Homo sapiens
gcuccauguagaagccacua

SEQ ID NO: 2140067 - RNA, 12 nt, Homo sapiens
caaccccagugg

SEQ ID NO: 2140068 - RNA, 19 nt, Homo sapiens
ccuuuguggaugaauccca

SEQ ID NO: 2140069 - RNA, 12 nt, Homo sapiens
ucaucauguauc

SEQ ID NO: 2140070 - RNA, 15 nt, Homo sapiens
uucaaugaauacugg

SEQ ID NO: 2140071 - RNA, 21 nt, Homo sapiens
uguaucccuacaucuaacuca

SEQ ID NO: 2140072 - RNA, 16 nt, Homo sapiens
ugcacuggauguggcc

SEQ ID NO: 2140073 - RNA, 16 nt, Homo sapiens
uuccacacugcacugu

SEQ ID NO: 2140074 - RNA, 14 nt, Homo sapiens
gaaggggccaugac

SEQ ID NO: 2140075 - RNA, 20 nt, Homo sapiens
cagaggcacagagagaguca

SEQ ID NO: 2140076 - RNA, 17 nt, Homo sapiens
ccaagacuugguguccu

SEQ ID NO: 2140077 - RNA, 14 nt, Homo sapiens
aaauaaauggauaa

SEQ ID NO: 2140078 - RNA, 14 nt, Homo sapiens
aaacccagucuccu

SEQ ID NO: 2140079 - RNA, 15 nt, Homo sapiens
ugaugucuaccucag

SEQ ID NO: 2140080 - RNA, 18 nt, Homo sapiens
cuuuuuaaagaaugcucu

SEQ ID NO: 2140081 - RNA, 17 nt, Homo sapiens
acacguucgacaaaagc

SEQ ID NO: 2140082 - RNA, 17 nt, Homo sapiens
cccaaagccaagaaaga

SEQ ID NO: 2140083 - RNA, 16 nt, Homo sapiens
gacuggggauggcgca

SEQ ID NO: 2140084 - RNA, 16 nt, Homo sapiens
gacaguugcagaauug

SEQ ID NO: 2140085 - RNA, 18 nt, Homo sapiens
aggcagggugguguaccu

SEQ ID NO: 2140086 - RNA, 14 nt, Homo sapiens
ugguuuucuugggg

SEQ ID NO: 2140087 - RNA, 19 nt, Homo sapiens
acauguguuuauucaucca

SEQ ID NO: 2140088 - RNA, 12 nt, Homo sapiens
uguucauugcac

SEQ ID NO: 2140089 - RNA, 16 nt, Homo sapiens
gucucuaaccauucaa

SEQ ID NO: 2140090 - RNA, 23 nt, Homo sapiens
uuuaaugacuuuugaauuacaga

SEQ ID NO: 2140091 - RNA, 20 nt, Homo sapiens
ugcuacaugguuuagauaaa

SEQ ID NO: 2140092 - RNA, 17 nt, Homo sapiens
ucauuacuguguucaau

SEQ ID NO: 2140093 - RNA, 15 nt, Homo sapiens
ccugaggauaacuca

SEQ ID NO: 2140094 - RNA, 17 nt, Homo sapiens
ggaagcaauaaagcucu

SEQ ID NO: 2140095 - RNA, 20 nt, Homo sapiens
gugggcagaucacgagguca

SEQ ID NO: 2140096 - RNA, 15 nt, Homo sapiens
caagugacaggguug

SEQ ID NO: 2140097 - RNA, 12 nt, Homo sapiens
uggcuguggcau

SEQ ID NO: 2140098 - RNA, 20 nt, Homo sapiens
gauucaaauaucaaaaggaa

SEQ ID NO: 2140099 - RNA, 18 nt, Homo sapiens
guggaaccaacacuaaca

SEQ ID NO: 2140100 - RNA, 13 nt, Homo sapiens
agcagcagcacca

SEQ ID NO: 2140101 - RNA, 17 nt, Homo sapiens
auguaaauagaugacaa

SEQ ID NO: 2140102 - RNA, 17 nt, Homo sapiens
uggaaaauuuaagacaa

SEQ ID NO: 2140103 - RNA, 20 nt, Homo sapiens
cucucagagcaagccuuuga

SEQ ID NO: 2140104 - RNA, 16 nt, Homo sapiens
acagauaaaacuugag

SEQ ID NO: 2140105 - RNA, 19 nt, Homo sapiens
agugagcuguguucuugcc

SEQ ID NO: 2140106 - RNA, 18 nt, Homo sapiens
uauuccaggaugcugcug

SEQ ID NO: 2140107 - RNA, 22 nt, Homo sapiens
ccaaugucaaguggcagcucag

SEQ ID NO: 2140108 - RNA, 15 nt, Homo sapiens
ggccaaugcauccaa

SEQ ID NO: 2140109 - RNA, 12 nt, Homo sapiens
guaccagccagg

SEQ ID NO: 2140110 - RNA, 14 nt, Homo sapiens
ucuggaauugcuca

SEQ ID NO: 2140111 - RNA, 17 nt, Homo sapiens
acaguuggaacuuacau

SEQ ID NO: 2140112 - RNA, 21 nt, Homo sapiens
agccuuacuucaaagugccug

SEQ ID NO: 2140113 - RNA, 13 nt, Homo sapiens
ggucaagggccag

SEQ ID NO: 2140114 - RNA, 15 nt, Homo sapiens
uucccuugaauuuca

SEQ ID NO: 2140115 - RNA, 14 nt, Homo sapiens
acucuugagaucuu

SEQ ID NO: 2140116 - RNA, 20 nt, Homo sapiens
auggcucacacagcuuaaga

SEQ ID NO: 2140117 - RNA, 22 nt, Homo sapiens
uggcucugggggacccaggugg

SEQ ID NO: 2140118 - RNA, 17 nt, Homo sapiens
acuuuaguaauagcuug

SEQ ID NO: 2140119 - RNA, 11 nt, Homo sapiens
cccugcuccac

SEQ ID NO: 2140120 - RNA, 15 nt, Homo sapiens
uaugcagugugcucc

SEQ ID NO: 2140121 - RNA, 15 nt, Homo sapiens
uaccuaugcuucuag

SEQ ID NO: 2140122 - RNA, 16 nt, Homo sapiens
ccuccauuaaccaaga

SEQ ID NO: 2140123 - RNA, 20 nt, Homo sapiens
uguugcuccuagcuaaugcu

SEQ ID NO: 2140124 - RNA, 22 nt, Homo sapiens
cagcugccuccccagcucuauc

SEQ ID NO: 2140125 - RNA, 18 nt, Homo sapiens
acauucucugaccuacuc

SEQ ID NO: 2140126 - RNA, 18 nt, Homo sapiens
auucuuuuguuuccaugg

SEQ ID NO: 2140127 - RNA, 11 nt, Homo sapiens
cugggccagug

SEQ ID NO: 2140128 - RNA, 16 nt, Homo sapiens
uugacuuuuuggcuca

SEQ ID NO: 2140129 - RNA, 22 nt, Homo sapiens
ugcacaaaaugggacugcugaa

SEQ ID NO: 2140130 - RNA, 21 nt, Homo sapiens
cagguaggaugaacacaggca

SEQ ID NO: 2140131 - RNA, 22 nt, Homo sapiens
aauaugaugccacuuugcagcu

SEQ ID NO: 2140132 - RNA, 17 nt, Homo sapiens
gagguggggugaagcug

SEQ ID NO: 2140133 - RNA, 16 nt, Homo sapiens
uagaguuguguuuacu

SEQ ID NO: 2140134 - RNA, 19 nt, Homo sapiens
ccagagaccaaacaaggac

SEQ ID NO: 2140135 - RNA, 13 nt, Homo sapiens
uacuuaaugcaca

SEQ ID NO: 2140136 - RNA, 19 nt, Homo sapiens
cucccacacuugugccagc

SEQ ID NO: 2140137 - RNA, 23 nt, Homo sapiens
auucccucagccuaagaaacacu

SEQ ID NO: 2140138 - RNA, 16 nt, Homo sapiens
uuaaagcaucaucugu

SEQ ID NO: 2140139 - RNA, 20 nt, Homo sapiens
uauuggaagagagaauuugc

SEQ ID NO: 2140140 - RNA, 20 nt, Homo sapiens
agucuguacuucaguucuca

SEQ ID NO: 2140141 - RNA, 16 nt, Homo sapiens
gcuuuucccacucuca

SEQ ID NO: 2140142 - RNA, 15 nt, Homo sapiens
uuuagauauacauau

SEQ ID NO: 2140143 - RNA, 20 nt, Homo sapiens
uagcucaggaccugggaccu

SEQ ID NO: 2140144 - RNA, 20 nt, Homo sapiens
aaauuauguuuuaauuccaa

SEQ ID NO: 2140145 - RNA, 15 nt, Homo sapiens
aauuaacugcuccaa

SEQ ID NO: 2140146 - RNA, 20 nt, Homo sapiens
auaagaguuggcuggucaac

SEQ ID NO: 2140147 - RNA, 17 nt, Homo sapiens
ggccccucaucugcuca

SEQ ID NO: 2140148 - RNA, 14 nt, Homo sapiens
cauccgcacuguaa

SEQ ID NO: 2140149 - RNA, 17 nt, Homo sapiens
aaccggagagccagcua

SEQ ID NO: 2140150 - RNA, 18 nt, Homo sapiens
uuauaaagucaaggacga

SEQ ID NO: 2140151 - RNA, 19 nt, Homo sapiens
ugcauugaaagaauuagau

SEQ ID NO: 2140152 - RNA, 17 nt, Homo sapiens
caagaugcaacuaggaa

SEQ ID NO: 2140153 - RNA, 11 nt, Homo sapiens
gaaaccaaagu

SEQ ID NO: 2140154 - RNA, 17 nt, Homo sapiens
agagucucccagugggu

SEQ ID NO: 2140155 - RNA, 12 nt, Homo sapiens
accuaagcaaug

SEQ ID NO: 2140156 - RNA, 14 nt, Homo sapiens
aagaugcacugaaa

SEQ ID NO: 2140157 - RNA, 19 nt, Homo sapiens
ccugcuucugcugccuguu

SEQ ID NO: 2140158 - RNA, 19 nt, Homo sapiens
aaaaauuauacuaacuuau

SEQ ID NO: 2140159 - RNA, 19 nt, Homo sapiens
gugugcugacgagcagggu

SEQ ID NO: 2140160 - RNA, 15 nt, Homo sapiens
aggccgggcccgggc

SEQ ID NO: 2140161 - RNA, 18 nt, Homo sapiens
auuguacauaaguaccuc

SEQ ID NO: 2140162 - RNA, 13 nt, Homo sapiens
cucauagcacaug

SEQ ID NO: 2140163 - RNA, 17 nt, Homo sapiens
agcugggcucugcaauu

SEQ ID NO: 2140164 - RNA, 21 nt, Homo sapiens
accuuuccucucccucagggg

SEQ ID NO: 2140165 - RNA, 14 nt, Homo sapiens
acucaaacugccuu

SEQ ID NO: 2140166 - RNA, 12 nt, Homo sapiens
ccucuguauacu

SEQ ID NO: 2140167 - RNA, 12 nt, Homo sapiens
ggagggggaccc

SEQ ID NO: 2140168 - RNA, 14 nt, Homo sapiens
acaucagugcacac

SEQ ID NO: 2140169 - RNA, 15 nt, Homo sapiens
aagaugaaacugaaa

SEQ ID NO: 2140170 - RNA, 22 nt, Homo sapiens
gcgaaaucccugcucacugcag

SEQ ID NO: 2140171 - RNA, 20 nt, Homo sapiens
cuucaaggauauacugcagc

SEQ ID NO: 2140172 - RNA, 20 nt, Homo sapiens
uagaacuuuauuaaguaaaa

SEQ ID NO: 2140173 - RNA, 18 nt, Homo sapiens
uuacuuuugaaccaugua

SEQ ID NO: 2140174 - RNA, 16 nt, Homo sapiens
caccaaggcagugcau

SEQ ID NO: 2140175 - RNA, 15 nt, Homo sapiens
ucugagaacuccuca

SEQ ID NO: 2140176 - RNA, 20 nt, Homo sapiens
aguauugccaccucuggcca

SEQ ID NO: 2140177 - RNA, 20 nt, Homo sapiens
aagcaauccucucaccucag

SEQ ID NO: 2140178 - RNA, 17 nt, Homo sapiens
gauaucugaacacauac

SEQ ID NO: 2140179 - RNA, 13 nt, Homo sapiens
uuuaaguacuuga

SEQ ID NO: 2140180 - RNA, 19 nt, Homo sapiens
ccgaauugacaacccaaac

SEQ ID NO: 2140181 - RNA, 16 nt, Homo sapiens
aucagagauguacaug

SEQ ID NO: 2140182 - RNA, 17 nt, Homo sapiens
ucucaauucaaauccau

SEQ ID NO: 2140183 - RNA, 23 nt, Homo sapiens
cugagacaggagaaacacuugaa

SEQ ID NO: 2140184 - RNA, 17 nt, Homo sapiens
ugacaauacaccuuccc

SEQ ID NO: 2140185 - RNA, 18 nt, Homo sapiens
cucucugagucaaaucca

SEQ ID NO: 2140186 - RNA, 21 nt, Homo sapiens
uuggaaaaccaaacuaguauc

SEQ ID NO: 2140187 - RNA, 15 nt, Homo sapiens
ccugggccucauggc

SEQ ID NO: 2140188 - RNA, 22 nt, Homo sapiens
ugaggggaaaccuucacccagc

SEQ ID NO: 2140189 - RNA, 21 nt, Homo sapiens
auaaaacaaaagcauuuugcu

SEQ ID NO: 2140190 - RNA, 19 nt, Homo sapiens
uagaacugucccacaaaau

SEQ ID NO: 2140191 - RNA, 18 nt, Homo sapiens
cauuuaaaagacagacau

SEQ ID NO: 2140192 - RNA, 14 nt, Homo sapiens
cauguuuuugccaa

SEQ ID NO: 2140193 - RNA, 17 nt, Homo sapiens
ccauacugucucuggag

SEQ ID NO: 2140194 - RNA, 17 nt, Homo sapiens
gcuucccuuugauuuuu

SEQ ID NO: 2140195 - RNA, 13 nt, Homo sapiens
uaaacuguuuaua

SEQ ID NO: 2140196 - RNA, 21 nt, Homo sapiens
cauccagaaguguauucauau

SEQ ID NO: 2140197 - RNA, 16 nt, Homo sapiens
acacucuuucuccugc

SEQ ID NO: 2140198 - RNA, 22 nt, Homo sapiens
augaucaguguuguugcucuag

SEQ ID NO: 2140199 - RNA, 16 nt, Homo sapiens
agugagacaggugaua

SEQ ID NO: 2140200 - RNA, 13 nt, Homo sapiens
gguagcugagggg

SEQ ID NO: 2140201 - RNA, 15 nt, Homo sapiens
aaguaagcauuucca

SEQ ID NO: 2140202 - RNA, 11 nt, Homo sapiens
uuuuguacuuu

SEQ ID NO: 2140203 - RNA, 11 nt, Homo sapiens
aauuguacaau

SEQ ID NO: 2140204 - RNA, 18 nt, Homo sapiens
ucuaccaaaaaauaaaaa

SEQ ID NO: 2140205 - RNA, 13 nt, Homo sapiens
uaaaauacuuauu

SEQ ID NO: 2140206 - RNA, 13 nt, Homo sapiens
aaaauuacauaua

SEQ ID NO: 2140207 - RNA, 13 nt, Homo sapiens
uauuuuacuuuaa

SEQ ID NO: 2140208 - RNA, 13 nt, Homo sapiens
cugggaacucaaa

SEQ ID NO: 2140209 - RNA, 17 nt, Homo sapiens
gggauugucuuacuguu

SEQ ID NO: 2140210 - RNA, 21 nt, Homo sapiens
acugggagaagagaaccucaa

SEQ ID NO: 2140211 - RNA, 16 nt, Homo sapiens
auggguuagugcuaug

SEQ ID NO: 2140212 - RNA, 18 nt, Homo sapiens
cagucaaggaguggcuua

SEQ ID NO: 2140213 - RNA, 19 nt, Homo sapiens
gccauuuccacuacaguga

SEQ ID NO: 2140214 - RNA, 14 nt, Homo sapiens
ccuggaaggcagcu

SEQ ID NO: 2140215 - RNA, 22 nt, Homo sapiens
uucuugguucuuuuuucaguua

SEQ ID NO: 2140216 - RNA, 22 nt, Homo sapiens
aauaucaaggaggucagaagaa

SEQ ID NO: 2140217 - RNA, 22 nt, Homo sapiens
aggaacccccucaccaccugcc

SEQ ID NO: 2140218 - RNA, 13 nt, Homo sapiens
ugagcugugcaca

SEQ ID NO: 2140219 - RNA, 19 nt, Homo sapiens
ccauguucuugagcagcug

SEQ ID NO: 2140220 - RNA, 10 nt, Homo sapiens
aagcugugau

SEQ ID NO: 2140221 - RNA, 15 nt, Homo sapiens
augucucccaggaca

SEQ ID NO: 2140222 - RNA, 21 nt, Homo sapiens
caggagaaaccccugacaccu

SEQ ID NO: 2140223 - RNA, 23 nt, Homo sapiens
cugugucauggugaugcaaguca

SEQ ID NO: 2140224 - RNA, 12 nt, Homo sapiens
cuaaagggacua

SEQ ID NO: 2140225 - RNA, 19 nt, Homo sapiens
uccuuaguccuacccugaa

SEQ ID NO: 2140226 - RNA, 20 nt, Homo sapiens
caaccacacaccucaccaga

SEQ ID NO: 2140227 - RNA, 17 nt, Homo sapiens
uaauguauuaugagcca

SEQ ID NO: 2140228 - RNA, 23 nt, Homo sapiens
uguuucccggggaggaaacacuu

SEQ ID NO: 2140229 - RNA, 20 nt, Homo sapiens
agccaaagagaaugccauuc

SEQ ID NO: 2140230 - RNA, 16 nt, Homo sapiens
agcuccuccccugcua

SEQ ID NO: 2140231 - RNA, 16 nt, Homo sapiens
gauuaugaagugacuc

SEQ ID NO: 2140232 - RNA, 18 nt, Homo sapiens
aaggacagaacauugccu

SEQ ID NO: 2140233 - RNA, 22 nt, Homo sapiens
auaagaccccacuggagucucu

SEQ ID NO: 2140234 - RNA, 21 nt, Homo sapiens
cucuuguccucuucugcucuu

SEQ ID NO: 2140235 - RNA, 21 nt, Homo sapiens
uucuggcccaguuaauuugca

SEQ ID NO: 2140236 - RNA, 17 nt, Homo sapiens
agaacuauaacauucaa

SEQ ID NO: 2140237 - RNA, 22 nt, Homo sapiens
ugcaggggguggacaaacugga

SEQ ID NO: 2140238 - RNA, 19 nt, Homo sapiens
ccuggccugguugugugca

SEQ ID NO: 2140239 - RNA, 16 nt, Homo sapiens
uacucauccuuguaua

SEQ ID NO: 2140240 - RNA, 19 nt, Homo sapiens
uguggauuccagcauuugc

SEQ ID NO: 2140241 - RNA, 16 nt, Homo sapiens
caguggucccaauagg

SEQ ID NO: 2140242 - RNA, 14 nt, Homo sapiens
ugaaaaugaaccau

SEQ ID NO: 2140243 - RNA, 12 nt, Homo sapiens
caugugugugca

SEQ ID NO: 2140244 - RNA, 18 nt, Homo sapiens
gcuaaccuguuacacugg

SEQ ID NO: 2140245 - RNA, 17 nt, Homo sapiens
gaaacacugcugcccuc

SEQ ID NO: 2140246 - RNA, 18 nt, Homo sapiens
ccgucucauauuuuuaca

SEQ ID NO: 2140247 - RNA, 15 nt, Homo sapiens
caucaucuucugggu

SEQ ID NO: 2140248 - RNA, 20 nt, Homo sapiens
aacaaauucauauucugucu

SEQ ID NO: 2140249 - RNA, 21 nt, Homo sapiens
aaauguuuuguaaacuuugaa

SEQ ID NO: 2140250 - RNA, 17 nt, Homo sapiens
aguuggcaaaauggggu

SEQ ID NO: 2140251 - RNA, 14 nt, Homo sapiens
uucuuugaauuuag

SEQ ID NO: 2140252 - RNA, 22 nt, Homo sapiens
cuguaugucaauaaacaacagc

SEQ ID NO: 2140253 - RNA, 19 nt, Homo sapiens
uuaacaacagcuucuugcu

SEQ ID NO: 2140254 - RNA, 12 nt, Homo sapiens
ggguccaccaug

SEQ ID NO: 2140255 - RNA, 19 nt, Homo sapiens
uguuagccgggauggucuu

SEQ ID NO: 2140256 - RNA, 22 nt, Homo sapiens
ucaauacugcacacugcacauu

SEQ ID NO: 2140257 - RNA, 21 nt, Homo sapiens
ugaauccagaucauuccucag

SEQ ID NO: 2140258 - RNA, 17 nt, Homo sapiens
gucagaauaguccuugg

SEQ ID NO: 2140259 - RNA, 23 nt, Homo sapiens
auagggcaugauuaacaaagcaa

SEQ ID NO: 2140260 - RNA, 19 nt, Homo sapiens
ugccuccucugguccccag

SEQ ID NO: 2140261 - RNA, 21 nt, Homo sapiens
gcagcucccagccucuuccca

SEQ ID NO: 2140262 - RNA, 22 nt, Homo sapiens
cuguaauauuguaaauacugga

SEQ ID NO: 2140263 - RNA, 13 nt, Homo sapiens
acuuuauguugca

SEQ ID NO: 2140264 - RNA, 11 nt, Homo sapiens
aaauagcuuua

SEQ ID NO: 2140265 - RNA, 18 nt, Homo sapiens
cugguauggccuuaccuu

SEQ ID NO: 2140266 - RNA, 20 nt, Homo sapiens
uucccaggacuagagcacaa

SEQ ID NO: 2140267 - RNA, 17 nt, Homo sapiens
agaagggauaacccuac

SEQ ID NO: 2140268 - RNA, 16 nt, Homo sapiens
acacucuagugccaua

SEQ ID NO: 2140269 - RNA, 16 nt, Homo sapiens
uuaaaauaagcacugu

SEQ ID NO: 2140270 - RNA, 17 nt, Homo sapiens
cugcuugcaucugcaca

SEQ ID NO: 2140271 - RNA, 15 nt, Homo sapiens
uugcugccaucaguc

SEQ ID NO: 2140272 - RNA, 13 nt, Homo sapiens
gucgagacuucac

SEQ ID NO: 2140273 - RNA, 20 nt, Homo sapiens
uaggagggcuggcaacuuag

SEQ ID NO: 2140274 - RNA, 22 nt, Homo sapiens
gcuagcucgugacuacauugaa

SEQ ID NO: 2140275 - RNA, 13 nt, Homo sapiens
aaggccagcugaa

SEQ ID NO: 2140276 - RNA, 22 nt, Homo sapiens
uaucauuuuuuuaacacauaac

SEQ ID NO: 2140277 - RNA, 14 nt, Homo sapiens
ccuaaaucacuuug

SEQ ID NO: 2140278 - RNA, 14 nt, Homo sapiens
ccguggccuggcau

SEQ ID NO: 2140279 - RNA, 17 nt, Homo sapiens
gaacuguguacgccauu

SEQ ID NO: 2140280 - RNA, 15 nt, Homo sapiens
ccucaucaacacagu

SEQ ID NO: 2140281 - RNA, 11 nt, Homo sapiens
cuaaagccagg

SEQ ID NO: 2140282 - RNA, 11 nt, Homo sapiens
cugaagccaga

SEQ ID NO: 2140283 - RNA, 23 nt, Homo sapiens
aauucugggaagcaaaacccaug

SEQ ID NO: 2140284 - RNA, 19 nt, Homo sapiens
ugaaaagguuaacagauac

SEQ ID NO: 2140285 - RNA, 21 nt, Homo sapiens
cuccguagcucugcugcugau

SEQ ID NO: 2140286 - RNA, 13 nt, Homo sapiens
cugcagaccaucc

SEQ ID NO: 2140287 - RNA, 21 nt, Homo sapiens
cuaaggccaaggccucaggag

SEQ ID NO: 2140288 - RNA, 16 nt, Homo sapiens
guauucucucuaugca

SEQ ID NO: 2140289 - RNA, 20 nt, Homo sapiens
auaccaaguugauacuugaa

SEQ ID NO: 2140290 - RNA, 10 nt, Homo sapiens
aggggccagc

SEQ ID NO: 2140291 - RNA, 21 nt, Homo sapiens
gucuuuuacccugugucagag

SEQ ID NO: 2140292 - RNA, 23 nt, Homo sapiens
guaagaaaauaucacuugucaau

SEQ ID NO: 2140293 - RNA, 14 nt, Homo sapiens
ccaaaacaauuucu

SEQ ID NO: 2140294 - RNA, 12 nt, Homo sapiens
cuacauguucuc

SEQ ID NO: 2140295 - RNA, 20 nt, Homo sapiens
uuggaagaggacuccuuaaa

SEQ ID NO: 2140296 - RNA, 17 nt, Homo sapiens
uucuuuuuggacauuua

SEQ ID NO: 2140297 - RNA, 22 nt, Homo sapiens
caccucucugagcucugcauuu

SEQ ID NO: 2140298 - RNA, 16 nt, Homo sapiens
cuuggacaaaccuaga

SEQ ID NO: 2140299 - RNA, 23 nt, Homo sapiens
acuugaaauaccagugaaccaaa

SEQ ID NO: 2140300 - RNA, 12 nt, Homo sapiens
acagucccucac

SEQ ID NO: 2140301 - RNA, 11 nt, Homo sapiens
gaucugugguc

SEQ ID NO: 2140302 - RNA, 15 nt, Homo sapiens
aaaggaaaugcuccu

SEQ ID NO: 2140303 - RNA, 21 nt, Homo sapiens
aacucucagucagugucauga

SEQ ID NO: 2140304 - RNA, 10 nt, Homo sapiens
ucacacagcc

SEQ ID NO: 2140305 - RNA, 18 nt, Homo sapiens
gccuuuaguccacggacc

SEQ ID NO: 2140306 - RNA, 15 nt, Homo sapiens
accgugggucaugca

SEQ ID NO: 2140307 - RNA, 20 nt, Homo sapiens
cagugcaucacaucugcaca

SEQ ID NO: 2140308 - RNA, 21 nt, Homo sapiens
acaacagccucuacaccaacg

SEQ ID NO: 2140309 - RNA, 17 nt, Homo sapiens
uaugguuucuacuuuau

SEQ ID NO: 2140310 - RNA, 16 nt, Homo sapiens
guaaguuaucuuugaa

SEQ ID NO: 2140311 - RNA, 16 nt, Homo sapiens
uguucuaaucuuguca

SEQ ID NO: 2140312 - RNA, 17 nt, Homo sapiens
acuggucgagagccaaa

SEQ ID NO: 2140313 - RNA, 16 nt, Homo sapiens
aaaggagccuaggcca

SEQ ID NO: 2140314 - RNA, 12 nt, Homo sapiens
cacuaugcugcu

SEQ ID NO: 2140315 - RNA, 12 nt, Homo sapiens
ugaaaugccaaa

SEQ ID NO: 2140316 - RNA, 19 nt, Homo sapiens
cacuggagcugcacugcau

SEQ ID NO: 2140317 - RNA, 12 nt, Homo sapiens
ccauuucugggg

SEQ ID NO: 2140318 - RNA, 13 nt, Homo sapiens
aaugaauccauca

SEQ ID NO: 2140319 - RNA, 19 nt, Homo sapiens
cucuugugguaccuaguca

SEQ ID NO: 2140320 - RNA, 20 nt, Homo sapiens
augcacgcugggcaaugaga

SEQ ID NO: 2140321 - RNA, 14 nt, Homo sapiens
uagccucaccuucc

SEQ ID NO: 2140322 - RNA, 17 nt, Homo sapiens
uaacguccacuagcuua

SEQ ID NO: 2140323 - RNA, 13 nt, Homo sapiens
cucuguagagggu

SEQ ID NO: 2140324 - RNA, 21 nt, Homo sapiens
ccuccugaccccaccuagaau

SEQ ID NO: 2140325 - RNA, 14 nt, Homo sapiens
uauuuaauauguca

SEQ ID NO: 2140326 - RNA, 20 nt, Homo sapiens
acaaagguuccauucagugc

SEQ ID NO: 2140327 - RNA, 13 nt, Homo sapiens
uucuuaacuauuc

SEQ ID NO: 2140328 - RNA, 22 nt, Homo sapiens
aauauuaaggaaaaaagcaagu

SEQ ID NO: 2140329 - RNA, 13 nt, Homo sapiens
uuuuucaagccug

SEQ ID NO: 2140330 - RNA, 13 nt, Homo sapiens
uucugcaagcuuu

SEQ ID NO: 2140331 - RNA, 14 nt, Homo sapiens
cauuuauuuuauga

SEQ ID NO: 2140332 - RNA, 13 nt, Homo sapiens
cguguagugucug

SEQ ID NO: 2140333 - RNA, 11 nt, Homo sapiens
gaaacuggaag

SEQ ID NO: 2140334 - RNA, 22 nt, Homo sapiens
uuaccuguaauagccucaccuu

SEQ ID NO: 2140335 - RNA, 22 nt, Homo sapiens
ugagagacaguaacacaauuaa

SEQ ID NO: 2140336 - RNA, 19 nt, Homo sapiens
auggugcacuaauuucacu

SEQ ID NO: 2140337 - RNA, 21 nt, Homo sapiens
ccuuggcuuuaugcaaauaca

SEQ ID NO: 2140338 - RNA, 18 nt, Homo sapiens
cuaaagagagaugaacca

SEQ ID NO: 2140339 - RNA, 13 nt, Homo sapiens
accuaaacuguau

SEQ ID NO: 2140340 - RNA, 21 nt, Homo sapiens
gaggaggggagcaaggcugcu

SEQ ID NO: 2140341 - RNA, 13 nt, Homo sapiens
ucaagagugcuga

SEQ ID NO: 2140342 - RNA, 19 nt, Homo sapiens
aaaucugcauccuuuucaa

SEQ ID NO: 2140343 - RNA, 18 nt, Homo sapiens
cuggugcagucauuauga

SEQ ID NO: 2140344 - RNA, 13 nt, Homo sapiens
cauaaaacaaauc

SEQ ID NO: 2140345 - RNA, 21 nt, Homo sapiens
ugagcaagcaagggacugagu

SEQ ID NO: 2140346 - RNA, 18 nt, Homo sapiens
ugucccauuagcaaaaau

SEQ ID NO: 2140347 - RNA, 23 nt, Homo sapiens
cacucugcucucaggagaucugg

SEQ ID NO: 2140348 - RNA, 14 nt, Homo sapiens
aaauguuugugaug

SEQ ID NO: 2140349 - RNA, 14 nt, Homo sapiens
aaauguauacuaua

SEQ ID NO: 2140350 - RNA, 21 nt, Homo sapiens
ucagaacagaugcugagccau

SEQ ID NO: 2140351 - RNA, 16 nt, Homo sapiens
agaaugguauuugaau

SEQ ID NO: 2140352 - RNA, 15 nt, Homo sapiens
agugauuaucucuuu

SEQ ID NO: 2140353 - RNA, 15 nt, Homo sapiens
acugauuaugucuuu

SEQ ID NO: 2140354 - RNA, 23 nt, Homo sapiens
cuuguaaaaugcuuuucacuuuc

SEQ ID NO: 2140355 - RNA, 16 nt, Homo sapiens
gguccugacucacacu

SEQ ID NO: 2140356 - RNA, 19 nt, Homo sapiens
uaguuguuggucuguagca

SEQ ID NO: 2140357 - RNA, 18 nt, Homo sapiens
aaucuuugugaacauucu

SEQ ID NO: 2140358 - RNA, 16 nt, Homo sapiens
ucugcauucucuaguc

SEQ ID NO: 2140359 - RNA, 19 nt, Homo sapiens
aaugcucuuuugcacaagg

SEQ ID NO: 2140360 - RNA, 13 nt, Homo sapiens
acagaguguccuu

SEQ ID NO: 2140361 - RNA, 21 nt, Homo sapiens
aucauuccccccgugaagucu

SEQ ID NO: 2140362 - RNA, 17 nt, Homo sapiens
cuuuacagauaaccuaa

SEQ ID NO: 2140363 - RNA, 18 nt, Homo sapiens
uccugaugccauggaaug

SEQ ID NO: 2140364 - RNA, 18 nt, Homo sapiens
auaugugcgucucucuuu

SEQ ID NO: 2140365 - RNA, 16 nt, Homo sapiens
cccugguggcagcuca

SEQ ID NO: 2140366 - RNA, 22 nt, Homo sapiens
cacaucacuacaguacagugag

SEQ ID NO: 2140367 - RNA, 20 nt, Homo sapiens
aucuuaccagguucacuuaa

SEQ ID NO: 2140368 - RNA, 17 nt, Homo sapiens
auaagaacugugcagua

SEQ ID NO: 2140369 - RNA, 23 nt, Homo sapiens
uaacccucagaaacacuggggcu

SEQ ID NO: 2140370 - RNA, 20 nt, Homo sapiens
ggcuucccuaaacugcagcc

SEQ ID NO: 2140371 - RNA, 19 nt, Homo sapiens
ugaaauaauauugauuucu

SEQ ID NO: 2140372 - RNA, 14 nt, Homo sapiens
uguagcagucuuca

SEQ ID NO: 2140373 - RNA, 23 nt, Homo sapiens
caucugcuauuaaccuugccuua

SEQ ID NO: 2140374 - RNA, 16 nt, Homo sapiens
agugcuagcuagccag

SEQ ID NO: 2140375 - RNA, 20 nt, Homo sapiens
gcacacgccuguauucccac

SEQ ID NO: 2140376 - RNA, 19 nt, Homo sapiens
aucaucaacaagauuuccu

SEQ ID NO: 2140377 - RNA, 14 nt, Homo sapiens
aucuuuggaggaau

SEQ ID NO: 2140378 - RNA, 23 nt, Homo sapiens
gggccuugucucuuccucugcag

SEQ ID NO: 2140379 - RNA, 18 nt, Homo sapiens
aucccacaucccaguuuc

SEQ ID NO: 2140380 - RNA, 11 nt, Homo sapiens
ggaggcuuccu

SEQ ID NO: 2140381 - RNA, 15 nt, Homo sapiens
agcacugcugccuca

SEQ ID NO: 2140382 - RNA, 18 nt, Homo sapiens
gcaagagaaaauaaacca

SEQ ID NO: 2140383 - RNA, 13 nt, Homo sapiens
ucuguuaauguca

SEQ ID NO: 2140384 - RNA, 15 nt, Homo sapiens
uacacuguauuacau

SEQ ID NO: 2140385 - RNA, 17 nt, Homo sapiens
auauucugcaacacugu

SEQ ID NO: 2140386 - RNA, 14 nt, Homo sapiens
acucuaaaaucuca

SEQ ID NO: 2140387 - RNA, 14 nt, Homo sapiens
cccuuaaacuucca

SEQ ID NO: 2140388 - RNA, 23 nt, Homo sapiens
ccuugcuggacggggacugggga

SEQ ID NO: 2140389 - RNA, 22 nt, Homo sapiens
ggggaccuuaagugauuugccu

SEQ ID NO: 2140390 - RNA, 13 nt, Homo sapiens
uuucccaucacug

SEQ ID NO: 2140391 - RNA, 12 nt, Homo sapiens
gagccacagugc

SEQ ID NO: 2140392 - RNA, 12 nt, Homo sapiens
cacacacacuca

SEQ ID NO: 2140393 - RNA, 19 nt, Homo sapiens
uuauuaugcccucuucuca

SEQ ID NO: 2140394 - RNA, 21 nt, Homo sapiens
aagcauuugcaacagcuacag

SEQ ID NO: 2140395 - RNA, 17 nt, Homo sapiens
cuuuccggcacacugcc

SEQ ID NO: 2140396 - RNA, 22 nt, Homo sapiens
guugagaccuuugauuuuugcc

SEQ ID NO: 2140397 - RNA, 20 nt, Homo sapiens
agccccuuggauuacuuugu

SEQ ID NO: 2140398 - RNA, 14 nt, Homo sapiens
ucucccccacucca

SEQ ID NO: 2140399 - RNA, 16 nt, Homo sapiens
aucugacucacaagaa

SEQ ID NO: 2140400 - RNA, 20 nt, Homo sapiens
cgugguggaggaacagggcu

SEQ ID NO: 2140401 - RNA, 18 nt, Homo sapiens
ugacauuucacugaugcu

SEQ ID NO: 2140402 - RNA, 13 nt, Homo sapiens
aaggguggaaauc

SEQ ID NO: 2140403 - RNA, 14 nt, Homo sapiens
augugacuacagcc

SEQ ID NO: 2140404 - RNA, 23 nt, Homo sapiens
ucucucugggaugcagaacuucc

SEQ ID NO: 2140405 - RNA, 13 nt, Homo sapiens
gcccaucaggggc

SEQ ID NO: 2140406 - RNA, 21 nt, Homo sapiens
agcagacucuggaggccugug

SEQ ID NO: 2140407 - RNA, 14 nt, Homo sapiens
uaucucagccauag

SEQ ID NO: 2140408 - RNA, 16 nt, Homo sapiens
ucgcuccccacucugc

SEQ ID NO: 2140409 - RNA, 13 nt, Homo sapiens
ucuauucauuuga

SEQ ID NO: 2140410 - RNA, 13 nt, Homo sapiens
ugagagggugcua

SEQ ID NO: 2140411 - RNA, 21 nt, Homo sapiens
gauggacccaaugcacacaaa

SEQ ID NO: 2140412 - RNA, 23 nt, Homo sapiens
cugacucacaguagggcugcuau

SEQ ID NO: 2140413 - RNA, 19 nt, Homo sapiens
acgccaacauggcacaugu

SEQ ID NO: 2140414 - RNA, 14 nt, Homo sapiens
ucuuuuuaucauga

SEQ ID NO: 2140415 - RNA, 21 nt, Homo sapiens
uaucugaacacauacuagaaa

SEQ ID NO: 2140416 - RNA, 17 nt, Homo sapiens
aaaauaguacaguuaca

SEQ ID NO: 2140417 - RNA, 23 nt, Homo sapiens
ggucauuaaauagauuuuugaag

SEQ ID NO: 2140418 - RNA, 21 nt, Homo sapiens
ucaaagcuuuuuccagaggcu

SEQ ID NO: 2140419 - RNA, 12 nt, Homo sapiens
auguacugagag

SEQ ID NO: 2140420 - RNA, 19 nt, Homo sapiens
aucugcucuguacaucaga

SEQ ID NO: 2140421 - RNA, 14 nt, Homo sapiens
ugagcgacagugag

SEQ ID NO: 2140422 - RNA, 19 nt, Homo sapiens
uggucagcucacacccuaa

SEQ ID NO: 2140423 - RNA, 11 nt, Homo sapiens
uucccagagau

SEQ ID NO: 2140424 - RNA, 21 nt, Homo sapiens
ugacuucuuuugaguuagguu

SEQ ID NO: 2140425 - RNA, 18 nt, Homo sapiens
ucaaccugcuguccucca

SEQ ID NO: 2140426 - RNA, 13 nt, Homo sapiens
gacaggugccagg

SEQ ID NO: 2140427 - RNA, 13 nt, Homo sapiens
ucuguagccugaa

SEQ ID NO: 2140428 - RNA, 20 nt, Homo sapiens
uucccgcacaaauuccacau

SEQ ID NO: 2140429 - RNA, 18 nt, Homo sapiens
agcuggugcuucgugugc

SEQ ID NO: 2140430 - RNA, 17 nt, Homo sapiens
cucucaauuucuggaaa

SEQ ID NO: 2140431 - RNA, 16 nt, Homo sapiens
gacucuuccaccagag

SEQ ID NO: 2140432 - RNA, 21 nt, Homo sapiens
gauucauccauauuguugaau

SEQ ID NO: 2140433 - RNA, 17 nt, Homo sapiens
agccacgucagccaaau

SEQ ID NO: 2140434 - RNA, 20 nt, Homo sapiens
caaaggagaagaguguaaga

SEQ ID NO: 2140435 - RNA, 15 nt, Homo sapiens
uuccucuauugagca

SEQ ID NO: 2140436 - RNA, 16 nt, Homo sapiens
cauuggaugugcauuu

SEQ ID NO: 2140437 - RNA, 14 nt, Homo sapiens
ugacagagguacaa

SEQ ID NO: 2140438 - RNA, 15 nt, Homo sapiens
agacacuuaacucaa

SEQ ID NO: 2140439 - RNA, 14 nt, Homo sapiens
uaucuugcaucuac

SEQ ID NO: 2140440 - RNA, 18 nt, Homo sapiens
cugccuucucaugaucca

SEQ ID NO: 2140441 - RNA, 17 nt, Homo sapiens
aauuuaggaaugcucaa

SEQ ID NO: 2140442 - RNA, 22 nt, Homo sapiens
gggccuguuaugucaaacuguc

SEQ ID NO: 2140443 - RNA, 13 nt, Homo sapiens
cauugcacaggga

SEQ ID NO: 2140444 - RNA, 13 nt, Homo sapiens
acauaagcacuga

SEQ ID NO: 2140445 - RNA, 17 nt, Homo sapiens
agccacacuucucagga

SEQ ID NO: 2140446 - RNA, 22 nt, Homo sapiens
gggccccgccagggcuggggac

SEQ ID NO: 2140447 - RNA, 15 nt, Homo sapiens
accaaggacugagca

SEQ ID NO: 2140448 - RNA, 20 nt, Homo sapiens
gcuuuaaaacaaagggaaaa

SEQ ID NO: 2140449 - RNA, 21 nt, Homo sapiens
caagggagggguuaaugcaga

SEQ ID NO: 2140450 - RNA, 15 nt, Homo sapiens
auuuacauguuuaua

SEQ ID NO: 2140451 - RNA, 18 nt, Homo sapiens
uggucagagccacagggu

SEQ ID NO: 2140452 - RNA, 16 nt, Homo sapiens
cauuaaaucuaugaag

SEQ ID NO: 2140453 - RNA, 20 nt, Homo sapiens
gcucucuccacaaccucuug

SEQ ID NO: 2140454 - RNA, 17 nt, Homo sapiens
aauuaggaaguguuucc

SEQ ID NO: 2140455 - RNA, 13 nt, Homo sapiens
aggacacuaagag

SEQ ID NO: 2140456 - RNA, 17 nt, Homo sapiens
aaaugugucuugucucc

SEQ ID NO: 2140457 - RNA, 22 nt, Homo sapiens
auaauuuugauagugggaccac

SEQ ID NO: 2140458 - RNA, 15 nt, Homo sapiens
auaugaaacauuuaa

SEQ ID NO: 2140459 - RNA, 18 nt, Homo sapiens
uggcuggcucuaccuucc

SEQ ID NO: 2140460 - RNA, 19 nt, Homo sapiens
augaagaagacaaagucua

SEQ ID NO: 2140461 - RNA, 17 nt, Homo sapiens
ccuguaauccuugcauu

SEQ ID NO: 2140462 - RNA, 20 nt, Homo sapiens
uagauauuucaugugcuaua

SEQ ID NO: 2140463 - RNA, 22 nt, Homo sapiens
cugucucaaaaccgaguugcca

SEQ ID NO: 2140464 - RNA, 20 nt, Homo sapiens
cagugagccaagaucgugcc

SEQ ID NO: 2140465 - RNA, 18 nt, Homo sapiens
cugggcagcauacugaga

SEQ ID NO: 2140466 - RNA, 15 nt, Homo sapiens
cugaccaauauugua

SEQ ID NO: 2140467 - RNA, 16 nt, Homo sapiens
gagaaugucauuugcu

SEQ ID NO: 2140468 - RNA, 21 nt, Homo sapiens
gucaccuucuaccaccagggc

SEQ ID NO: 2140469 - RNA, 16 nt, Homo sapiens
uucuuguaaaccugga

SEQ ID NO: 2140470 - RNA, 15 nt, Homo sapiens
ucuuuauacagauuu

SEQ ID NO: 2140471 - RNA, 17 nt, Homo sapiens
cucccuccccuugccug

SEQ ID NO: 2140472 - RNA, 21 nt, Homo sapiens
caucacugagacaaucaugua

SEQ ID NO: 2140473 - RNA, 18 nt, Homo sapiens
agccaguugucaguguuc

SEQ ID NO: 2140474 - RNA, 13 nt, Homo sapiens
gccucagccucca

SEQ ID NO: 2140475 - RNA, 14 nt, Homo sapiens
ucuugguuccagcc

SEQ ID NO: 2140476 - RNA, 22 nt, Homo sapiens
acagaaauggggaauucucuaa

SEQ ID NO: 2140477 - RNA, 23 nt, Homo sapiens
caaacacugcagaacagcaucau

SEQ ID NO: 2140478 - RNA, 13 nt, Homo sapiens
auauauuuccuca

SEQ ID NO: 2140479 - RNA, 12 nt, Homo sapiens
ccuucuuaacau

SEQ ID NO: 2140480 - RNA, 22 nt, Homo sapiens
aauugaguaucacuuuaacuca

SEQ ID NO: 2140481 - RNA, 17 nt, Homo sapiens
uccugauggcacucugu

SEQ ID NO: 2140482 - RNA, 16 nt, Homo sapiens
uugugacucuuuccua

SEQ ID NO: 2140483 - RNA, 22 nt, Homo sapiens
uaucaggucccaucaauucuua

SEQ ID NO: 2140484 - RNA, 20 nt, Homo sapiens
ccaggcaucacugauucccu

SEQ ID NO: 2140485 - RNA, 15 nt, Homo sapiens
ccaaccccucucuca

SEQ ID NO: 2140486 - RNA, 19 nt, Homo sapiens
cugcgacgcuugcucuguu

SEQ ID NO: 2140487 - RNA, 18 nt, Homo sapiens
uaaaacacaccaaucagc

SEQ ID NO: 2140488 - RNA, 16 nt, Homo sapiens
cagacauccugugaug

SEQ ID NO: 2140489 - RNA, 14 nt, Homo sapiens
ggcauaaauuacag

SEQ ID NO: 2140490 - RNA, 22 nt, Homo sapiens
cugcagauuagcuaggggacag

SEQ ID NO: 2140491 - RNA, 18 nt, Homo sapiens
uguacucaauggauuuga

SEQ ID NO: 2140492 - RNA, 15 nt, Homo sapiens
cuugcucacucccua

SEQ ID NO: 2140493 - RNA, 18 nt, Homo sapiens
ccagauauggaaacagaa

SEQ ID NO: 2140494 - RNA, 14 nt, Homo sapiens
ucugauaaugcuca

SEQ ID NO: 2140495 - RNA, 16 nt, Homo sapiens
auuuccuaaugucaga

SEQ ID NO: 2140496 - RNA, 16 nt, Homo sapiens
cuuuaaugacauugau

SEQ ID NO: 2140497 - RNA, 14 nt, Homo sapiens
caauucacaguaug

SEQ ID NO: 2140498 - RNA, 13 nt, Homo sapiens
acagaaccacuga

SEQ ID NO: 2140499 - RNA, 21 nt, Homo sapiens
ugaguccgacccagacaucca

SEQ ID NO: 2140500 - RNA, 16 nt, Homo sapiens
aauauuguuguuuacc

SEQ ID NO: 2140501 - RNA, 14 nt, Homo sapiens
ugggauuacaggca

SEQ ID NO: 2140502 - RNA, 17 nt, Homo sapiens
ggcauccaaggcaaaca

SEQ ID NO: 2140503 - RNA, 18 nt, Homo sapiens
gcugggcuucaguggcag

SEQ ID NO: 2140504 - RNA, 14 nt, Homo sapiens
cccacuucuggcca

SEQ ID NO: 2140505 - RNA, 13 nt, Homo sapiens
cggcuccacuaca

SEQ ID NO: 2140506 - RNA, 20 nt, Homo sapiens
guacuaagauugugcucaau

SEQ ID NO: 2140507 - RNA, 15 nt, Homo sapiens
accacuuaauugcuu

SEQ ID NO: 2140508 - RNA, 18 nt, Homo sapiens
gcugagggccugcuggag

SEQ ID NO: 2140509 - RNA, 20 nt, Homo sapiens
accauuaauauaauuggcac

SEQ ID NO: 2140510 - RNA, 15 nt, Homo sapiens
ggcuuaauaccuggg

SEQ ID NO: 2140511 - RNA, 19 nt, Homo sapiens
ucguggcucugccuucaaa

SEQ ID NO: 2140512 - RNA, 21 nt, Homo sapiens
guuuaagccgcagaccuggag

SEQ ID NO: 2140513 - RNA, 15 nt, Homo sapiens
uccagucauuucaau

SEQ ID NO: 2140514 - RNA, 17 nt, Homo sapiens
uauugcaccauacuccu

SEQ ID NO: 2140515 - RNA, 22 nt, Homo sapiens
ugucaagaagcguuaugugcag

SEQ ID NO: 2140516 - RNA, 14 nt, Homo sapiens
ugaaaauguacuga

SEQ ID NO: 2140517 - RNA, 19 nt, Homo sapiens
uauauuugaaguggagcca

SEQ ID NO: 2140518 - RNA, 20 nt, Homo sapiens
cucuuuuuuaaaaacaaaca

SEQ ID NO: 2140519 - RNA, 17 nt, Homo sapiens
agauuuugcugagauga

SEQ ID NO: 2140520 - RNA, 17 nt, Homo sapiens
uguaaguuucaggugac

SEQ ID NO: 2140521 - RNA, 20 nt, Homo sapiens
auaauuagcuuguuacaauu

SEQ ID NO: 2140522 - RNA, 14 nt, Homo sapiens
uacaaaauauccaa

SEQ ID NO: 2140523 - RNA, 15 nt, Homo sapiens
ccuguuaaggcaucc

SEQ ID NO: 2140524 - RNA, 19 nt, Homo sapiens
cuuugguucucugauuugu

SEQ ID NO: 2140525 - RNA, 21 nt, Homo sapiens
ucuaauuauguagcucuuugu

SEQ ID NO: 2140526 - RNA, 20 nt, Homo sapiens
uucuuuauggucgauauaca

SEQ ID NO: 2140527 - RNA, 15 nt, Homo sapiens
cggguccccuugaaa

SEQ ID NO: 2140528 - RNA, 15 nt, Homo sapiens
uuuccuccucaggca

SEQ ID NO: 2140529 - RNA, 14 nt, Homo sapiens
agacguguacauag

SEQ ID NO: 2140530 - RNA, 19 nt, Homo sapiens
ucaucccuuuccaguuaag

SEQ ID NO: 2140531 - RNA, 16 nt, Homo sapiens
acaccauugcaugaau

SEQ ID NO: 2140532 - RNA, 14 nt, Homo sapiens
auauuucuuagcaa

SEQ ID NO: 2140533 - RNA, 13 nt, Homo sapiens
ucauugcuaauau

SEQ ID NO: 2140534 - RNA, 16 nt, Homo sapiens
caggccacaccacagc

SEQ ID NO: 2140535 - RNA, 22 nt, Homo sapiens
guaaaaaaguaugcuuguuaau

SEQ ID NO: 2140536 - RNA, 19 nt, Homo sapiens
guuuggaaaccacagucag

SEQ ID NO: 2140537 - RNA, 14 nt, Homo sapiens
aagcuaccaaaaaa

SEQ ID NO: 2140538 - RNA, 16 nt, Homo sapiens
cauggugccccaggac

SEQ ID NO: 2140539 - RNA, 14 nt, Homo sapiens
gauuaugcuuucuu

SEQ ID NO: 2140540 - RNA, 20 nt, Homo sapiens
gugaauuaagaagcuaagaa

SEQ ID NO: 2140541 - RNA, 20 nt, Homo sapiens
uuccaugaacaccauaccuu

SEQ ID NO: 2140542 - RNA, 14 nt, Homo sapiens
gugaaaacagcagc

SEQ ID NO: 2140543 - RNA, 21 nt, Homo sapiens
aaggucagggagcaagaggug

SEQ ID NO: 2140544 - RNA, 16 nt, Homo sapiens
gggucccagggcugca

SEQ ID NO: 2140545 - RNA, 22 nt, Homo sapiens
gcauuccugcagucagugcuaa

SEQ ID NO: 2140546 - RNA, 23 nt, Homo sapiens
acauccuguuuugcaaauuggac

SEQ ID NO: 2140547 - RNA, 18 nt, Homo sapiens
ccaaguuggagugcagug

SEQ ID NO: 2140548 - RNA, 19 nt, Homo sapiens
uuccagaaugguauggaau

SEQ ID NO: 2140549 - RNA, 14 nt, Homo sapiens
aaguuuuacuugag

SEQ ID NO: 2140550 - RNA, 14 nt, Homo sapiens
auuuguguauuaua

SEQ ID NO: 2140551 - RNA, 15 nt, Homo sapiens
gaauuccagugccag

SEQ ID NO: 2140552 - RNA, 15 nt, Homo sapiens
acuucccaccucucu

SEQ ID NO: 2140553 - RNA, 22 nt, Homo sapiens
gccaaccgugggguuagcucua

SEQ ID NO: 2140554 - RNA, 13 nt, Homo sapiens
caaaggaacacug

SEQ ID NO: 2140555 - RNA, 15 nt, Homo sapiens
cuugcggaagccaua

SEQ ID NO: 2140556 - RNA, 13 nt, Homo sapiens
gaucaacugaguu

SEQ ID NO: 2140557 - RNA, 13 nt, Homo sapiens
aauuguagugcaa

SEQ ID NO: 2140558 - RNA, 22 nt, Homo sapiens
gugaacaaucagcggcauuuag

SEQ ID NO: 2140559 - RNA, 10 nt, Homo sapiens
agucugcucc

SEQ ID NO: 2140560 - RNA, 16 nt, Homo sapiens
cuguuuauuggaucua

SEQ ID NO: 2140561 - RNA, 16 nt, Homo sapiens
uauaagagagaguuaa

SEQ ID NO: 2140562 - RNA, 19 nt, Homo sapiens
ucuuaaauauuuaguugau

SEQ ID NO: 2140563 - RNA, 15 nt, Homo sapiens
accucaaaggagcaa

SEQ ID NO: 2140564 - RNA, 22 nt, Homo sapiens
gccugcuuggggggugaugagg

SEQ ID NO: 2140565 - RNA, 14 nt, Homo sapiens
uuccugccaccagu

SEQ ID NO: 2140566 - RNA, 13 nt, Homo sapiens
ccuucgcagcuuu

SEQ ID NO: 2140567 - RNA, 18 nt, Homo sapiens
gcugggcucuacuaccug

SEQ ID NO: 2140568 - RNA, 15 nt, Homo sapiens
aaaaucaucuuauaa

SEQ ID NO: 2140569 - RNA, 16 nt, Homo sapiens
caaaugcuuuuccuca

SEQ ID NO: 2140570 - RNA, 15 nt, Homo sapiens
ggcccucuuaucuca

SEQ ID NO: 2140571 - RNA, 15 nt, Homo sapiens
cagauggaacacugg

SEQ ID NO: 2140572 - RNA, 16 nt, Homo sapiens
uuaaauuuuuuuuaca

SEQ ID NO: 2140573 - RNA, 20 nt, Homo sapiens
uaucuguuuguuacugcauc

SEQ ID NO: 2140574 - RNA, 12 nt, Homo sapiens
ucuccagguuug

SEQ ID NO: 2140575 - RNA, 12 nt, Homo sapiens
ccaccaggcuag

SEQ ID NO: 2140576 - RNA, 13 nt, Homo sapiens
ugacagacaauga

SEQ ID NO: 2140577 - RNA, 15 nt, Homo sapiens
uuagaaacaccagcc

SEQ ID NO: 2140578 - RNA, 23 nt, Homo sapiens
cugaguguuauuugcacacugca

SEQ ID NO: 2140579 - RNA, 20 nt, Homo sapiens
uggaacauauagaaugcaga

SEQ ID NO: 2140580 - RNA, 12 nt, Homo sapiens
uguaaaaaccuu

SEQ ID NO: 2140581 - RNA, 16 nt, Homo sapiens
gacuuccuggggcccc

SEQ ID NO: 2140582 - RNA, 21 nt, Homo sapiens
gggauccaccgccacacuggc

SEQ ID NO: 2140583 - RNA, 15 nt, Homo sapiens
gucggugugcuguca

SEQ ID NO: 2140584 - RNA, 13 nt, Homo sapiens
ugcccacuauggc

SEQ ID NO: 2140585 - RNA, 18 nt, Homo sapiens
acguggcaaaaucccucu

SEQ ID NO: 2140586 - RNA, 10 nt, Homo sapiens
uuugccaugc

SEQ ID NO: 2140587 - RNA, 19 nt, Homo sapiens
ugaagccugucguguucuc

SEQ ID NO: 2140588 - RNA, 16 nt, Homo sapiens
cugaaugaccucucua

SEQ ID NO: 2140589 - RNA, 17 nt, Homo sapiens
ugaaacccuugagcuca

SEQ ID NO: 2140590 - RNA, 14 nt, Homo sapiens
gugcagcugucaca

SEQ ID NO: 2140591 - RNA, 18 nt, Homo sapiens
uuugcccacacacacucc

SEQ ID NO: 2140592 - RNA, 22 nt, Homo sapiens
uggcguagaaguuuuuguacug

SEQ ID NO: 2140593 - RNA, 21 nt, Homo sapiens
uuugcauuccuuacuugcacu

SEQ ID NO: 2140594 - RNA, 16 nt, Homo sapiens
uguuugugaaagacau

SEQ ID NO: 2140595 - RNA, 18 nt, Homo sapiens
cugcauggcucacacaga

SEQ ID NO: 2140596 - RNA, 17 nt, Homo sapiens
uuuccauuaaaggugga

SEQ ID NO: 2140597 - RNA, 12 nt, Homo sapiens
uaacuagaauuu

SEQ ID NO: 2140598 - RNA, 15 nt, Homo sapiens
cauguaaugugguca

SEQ ID NO: 2140599 - RNA, 15 nt, Homo sapiens
ucuucaccuuauuca

SEQ ID NO: 2140600 - RNA, 18 nt, Homo sapiens
ccaaggcuggagugcagu

SEQ ID NO: 2140601 - RNA, 21 nt, Homo sapiens
uguagucccagcuacucagga

SEQ ID NO: 2140602 - RNA, 19 nt, Homo sapiens
cguguauucaggaccccau

SEQ ID NO: 2140603 - RNA, 20 nt, Homo sapiens
ggagaccccuuguugcacug

SEQ ID NO: 2140604 - RNA, 22 nt, Homo sapiens
gaccccgggagacucaaaggga

SEQ ID NO: 2140605 - RNA, 21 nt, Homo sapiens
accuagccuuagaagucacac

SEQ ID NO: 2140606 - RNA, 15 nt, Homo sapiens
guagaaaucucagaa

SEQ ID NO: 2140607 - RNA, 18 nt, Homo sapiens
cuucuagaagauaacauu

SEQ ID NO: 2140608 - RNA, 18 nt, Homo sapiens
gugcacuccggucccaaa

SEQ ID NO: 2140609 - RNA, 19 nt, Homo sapiens
agucuuucuugagcagaug

SEQ ID NO: 2140610 - RNA, 17 nt, Homo sapiens
ugccuccauuucagaga

SEQ ID NO: 2140611 - RNA, 19 nt, Homo sapiens
aucuggcagacucauugca

SEQ ID NO: 2140612 - RNA, 18 nt, Homo sapiens
acuuauagcgcugaccaa

SEQ ID NO: 2140613 - RNA, 17 nt, Homo sapiens
gugguggcaaaagacau

SEQ ID NO: 2140614 - RNA, 15 nt, Homo sapiens
auuuucugcuugaag

SEQ ID NO: 2140615 - RNA, 21 nt, Homo sapiens
acaucuuucacacuuccacca

SEQ ID NO: 2140616 - RNA, 16 nt, Homo sapiens
gaagguaauaaauaca

SEQ ID NO: 2140617 - RNA, 19 nt, Homo sapiens
uugugcuccugccagcuca

SEQ ID NO: 2140618 - RNA, 16 nt, Homo sapiens
uuaggaguuaccuuaa

SEQ ID NO: 2140619 - RNA, 16 nt, Homo sapiens
gaggcgcacaguguga

SEQ ID NO: 2140620 - RNA, 15 nt, Homo sapiens
ccucccaaacccagc

SEQ ID NO: 2140621 - RNA, 15 nt, Homo sapiens
cugugaucccagcua

SEQ ID NO: 2140622 - RNA, 18 nt, Homo sapiens
aaagccagucaagggcau

SEQ ID NO: 2140623 - RNA, 20 nt, Homo sapiens
aaauuuguaaacaaucuaau

SEQ ID NO: 2140624 - RNA, 17 nt, Homo sapiens
ucuugcacccucauucc

SEQ ID NO: 2140625 - RNA, 11 nt, Homo sapiens
uugaccagcag

SEQ ID NO: 2140626 - RNA, 19 nt, Homo sapiens
accucagcugcacauuccu

SEQ ID NO: 2140627 - RNA, 11 nt, Homo sapiens
ugcaaaggggu

SEQ ID NO: 2140628 - RNA, 21 nt, Homo sapiens
cucauuuagaacuugcagcug

SEQ ID NO: 2140629 - RNA, 21 nt, Homo sapiens
agcuccugggaagcccugggu

SEQ ID NO: 2140630 - RNA, 11 nt, Homo sapiens
gccacuccugg

SEQ ID NO: 2140631 - RNA, 17 nt, Homo sapiens
caccgccgccaccagcc

SEQ ID NO: 2140632 - RNA, 22 nt, Homo sapiens
ucuggaugggaggagagccacu

SEQ ID NO: 2140633 - RNA, 13 nt, Homo sapiens
agaagcagcagcu

SEQ ID NO: 2140634 - RNA, 12 nt, Homo sapiens
caguaacuguca

SEQ ID NO: 2140635 - RNA, 19 nt, Homo sapiens
gcauaaauaugcagugaua

SEQ ID NO: 2140636 - RNA, 19 nt, Homo sapiens
auggugaaaccccgucucu

SEQ ID NO: 2140637 - RNA, 17 nt, Homo sapiens
aaggacaagacacugag

SEQ ID NO: 2140638 - RNA, 15 nt, Homo sapiens
agggaaacacagcag

SEQ ID NO: 2140639 - RNA, 21 nt, Homo sapiens
cauaaucuauaaacaaugaaa

SEQ ID NO: 2140640 - RNA, 21 nt, Homo sapiens
agcaacuuguccuagcacaga

SEQ ID NO: 2140641 - RNA, 19 nt, Homo sapiens
uauuacacauuaaaguaaa

SEQ ID NO: 2140642 - RNA, 14 nt, Homo sapiens
agcacaauuugcac

SEQ ID NO: 2140643 - RNA, 21 nt, Homo sapiens
ggcuuuuacugaagccuuucu

SEQ ID NO: 2140644 - RNA, 12 nt, Homo sapiens
auaauuuugccu

SEQ ID NO: 2140645 - RNA, 21 nt, Homo sapiens
aggugugcccuguacacaggc

SEQ ID NO: 2140646 - RNA, 15 nt, Homo sapiens
aaccaucccugaugu

SEQ ID NO: 2140647 - RNA, 18 nt, Homo sapiens
uuagacauaacaaaacac

SEQ ID NO: 2140648 - RNA, 16 nt, Homo sapiens
cauacaacagaaacca

SEQ ID NO: 2140649 - RNA, 16 nt, Homo sapiens
uaauccaauaccucuu

SEQ ID NO: 2140650 - RNA, 19 nt, Homo sapiens
ccgguggcggcagggccag

SEQ ID NO: 2140651 - RNA, 16 nt, Homo sapiens
guguuuuguacacuua

SEQ ID NO: 2140652 - RNA, 19 nt, Homo sapiens
agcucuaagucucaacugc

SEQ ID NO: 2140653 - RNA, 18 nt, Homo sapiens
caguucuaggugcuaaaa

SEQ ID NO: 2140654 - RNA, 12 nt, Homo sapiens
gcuuuaguacau

SEQ ID NO: 2140655 - RNA, 15 nt, Homo sapiens
ugaacaaacaaugaa

SEQ ID NO: 2140656 - RNA, 14 nt, Homo sapiens
aggcuccagcacau

SEQ ID NO: 2140657 - RNA, 20 nt, Homo sapiens
ccauaaagacaaucacugcc

SEQ ID NO: 2140658 - RNA, 18 nt, Homo sapiens
uacugccuuagucccaau

SEQ ID NO: 2140659 - RNA, 20 nt, Homo sapiens
acagccguccucccuccuag

SEQ ID NO: 2140660 - RNA, 17 nt, Homo sapiens
uagauggauaagggaau

SEQ ID NO: 2140661 - RNA, 14 nt, Homo sapiens
accauaagcagcca

SEQ ID NO: 2140662 - RNA, 15 nt, Homo sapiens
uccuuucuccaggac

SEQ ID NO: 2140663 - RNA, 16 nt, Homo sapiens
cuggccauauuuacua

SEQ ID NO: 2140664 - RNA, 18 nt, Homo sapiens
ggaauaaagcccuugaac

SEQ ID NO: 2140665 - RNA, 19 nt, Homo sapiens
agagaaggcuuccuccagc

SEQ ID NO: 2140666 - RNA, 11 nt, Homo sapiens
ccacucaggga

SEQ ID NO: 2140667 - RNA, 17 nt, Homo sapiens
acucaccuaucaacaga

SEQ ID NO: 2140668 - RNA, 16 nt, Homo sapiens
gggcuuugugucauca

SEQ ID NO: 2140669 - RNA, 20 nt, Homo sapiens
uacuaucucuguauuguucu

SEQ ID NO: 2140670 - RNA, 20 nt, Homo sapiens
uuccauauagcucgagcaaa

SEQ ID NO: 2140671 - RNA, 14 nt, Homo sapiens
ccugcagggugacc

SEQ ID NO: 2140672 - RNA, 13 nt, Homo sapiens
ugugauguucuaa

SEQ ID NO: 2140673 - RNA, 21 nt, Homo sapiens
ugaaaccucccauuggccaaa

SEQ ID NO: 2140674 - RNA, 14 nt, Homo sapiens
aucgucaaccacuu

SEQ ID NO: 2140675 - RNA, 22 nt, Homo sapiens
uguaauccagcaauacaguuua

SEQ ID NO: 2140676 - RNA, 22 nt, Homo sapiens
uccuuucuugcacuauuccaca

SEQ ID NO: 2140677 - RNA, 20 nt, Homo sapiens
agcugcuggcugugacaaug

SEQ ID NO: 2140678 - RNA, 19 nt, Homo sapiens
ugcccuuuuaaauggcaug

SEQ ID NO: 2140679 - RNA, 15 nt, Homo sapiens
cacugucugcauauc

SEQ ID NO: 2140680 - RNA, 14 nt, Homo sapiens
acaccugaggacag

SEQ ID NO: 2140681 - RNA, 23 nt, Homo sapiens
aacaacauguuuccagcauuccc

SEQ ID NO: 2140682 - RNA, 20 nt, Homo sapiens
ucaugcuuuugcuugcaaug

SEQ ID NO: 2140683 - RNA, 14 nt, Homo sapiens
uguuuacaaagcau

SEQ ID NO: 2140684 - RNA, 22 nt, Homo sapiens
gagauccaucaagacaauggga

SEQ ID NO: 2140685 - RNA, 17 nt, Homo sapiens
auuugaggugaaauuca

SEQ ID NO: 2140686 - RNA, 21 nt, Homo sapiens
gcacauguuauccacaagcaa

SEQ ID NO: 2140687 - RNA, 20 nt, Homo sapiens
uaagaacugugaaauuuaca

SEQ ID NO: 2140688 - RNA, 20 nt, Homo sapiens
ucgaguuuacuucaugagga

SEQ ID NO: 2140689 - RNA, 21 nt, Homo sapiens
ucagauuuuaaaaagucuuca

SEQ ID NO: 2140690 - RNA, 14 nt, Homo sapiens
guggcgacucugca

SEQ ID NO: 2140691 - RNA, 20 nt, Homo sapiens
ucuuagaagcacuacaccuu

SEQ ID NO: 2140692 - RNA, 20 nt, Homo sapiens
cuacacaguaaaaacuugua

SEQ ID NO: 2140693 - RNA, 14 nt, Homo sapiens
uguaaagacuauga

SEQ ID NO: 2140694 - RNA, 15 nt, Homo sapiens
cucaccuugagccca

SEQ ID NO: 2140695 - RNA, 20 nt, Homo sapiens
gaaacagggcagugacaagu

SEQ ID NO: 2140696 - RNA, 17 nt, Homo sapiens
auauuuauaauuaaaga

SEQ ID NO: 2140697 - RNA, 21 nt, Homo sapiens
ucucaaccaccuuucagauaa

SEQ ID NO: 2140698 - RNA, 21 nt, Homo sapiens
guaaaugaaagcuauugagau

SEQ ID NO: 2140699 - RNA, 16 nt, Homo sapiens
ucucuaaccauucaaa

SEQ ID NO: 2140700 - RNA, 17 nt, Homo sapiens
cuucucugggucuggca

SEQ ID NO: 2140701 - RNA, 22 nt, Homo sapiens
ugcagagcuggcagcaauggau

SEQ ID NO: 2140702 - RNA, 13 nt, Homo sapiens
ucaggugugcuca

SEQ ID NO: 2140703 - RNA, 22 nt, Homo sapiens
gccauuuuggguuuugggucuu

SEQ ID NO: 2140704 - RNA, 22 nt, Homo sapiens
augggaaggcuaauauauucca

SEQ ID NO: 2140705 - RNA, 14 nt, Homo sapiens
agucggaaugucau

SEQ ID NO: 2140706 - RNA, 12 nt, Homo sapiens
aucuccacagga

SEQ ID NO: 2140707 - RNA, 12 nt, Homo sapiens
gaagaugcugcc

SEQ ID NO: 2140708 - RNA, 15 nt, Homo sapiens
aauucuaugagauag

SEQ ID NO: 2140709 - RNA, 19 nt, Homo sapiens
caggguaggggagcauucu

SEQ ID NO: 2140710 - RNA, 21 nt, Homo sapiens
gagcugaguggccagccagug

SEQ ID NO: 2140711 - RNA, 16 nt, Homo sapiens
ucugauuuacauucaa

SEQ ID NO: 2140712 - RNA, 18 nt, Homo sapiens
gcuguccagguucugucu

SEQ ID NO: 2140713 - RNA, 11 nt, Homo sapiens
auaucuuccac

SEQ ID NO: 2140714 - RNA, 18 nt, Homo sapiens
aacguagaucgaagccaa

SEQ ID NO: 2140715 - RNA, 12 nt, Homo sapiens
acacacugaguu

SEQ ID NO: 2140716 - RNA, 19 nt, Homo sapiens
auuaaaugaaagaauaucu

SEQ ID NO: 2140717 - RNA, 18 nt, Homo sapiens
auugagcagcaugauuau

SEQ ID NO: 2140718 - RNA, 17 nt, Homo sapiens
aaguguuuuacaaugau

SEQ ID NO: 2140719 - RNA, 14 nt, Homo sapiens
aaaugcuauauugc

SEQ ID NO: 2140720 - RNA, 14 nt, Homo sapiens
aagcucugaaguca

SEQ ID NO: 2140721 - RNA, 19 nt, Homo sapiens
ucacacaugccacuaugag

SEQ ID NO: 2140722 - RNA, 21 nt, Homo sapiens
uuucuacaccuguugcaccuc

SEQ ID NO: 2140723 - RNA, 22 nt, Homo sapiens
aaucuguagcauaggcuagugg

SEQ ID NO: 2140724 - RNA, 22 nt, Homo sapiens
ugggucaaagugguacaggaag

SEQ ID NO: 2140725 - RNA, 21 nt, Homo sapiens
gaucagccccgccugucacaa

SEQ ID NO: 2140726 - RNA, 20 nt, Homo sapiens
gaagcugggugagccaagga

SEQ ID NO: 2140727 - RNA, 23 nt, Homo sapiens
ugugauauauuagggacacuuuc

SEQ ID NO: 2140728 - RNA, 20 nt, Homo sapiens
aggagagucuugcagugauu

SEQ ID NO: 2140729 - RNA, 14 nt, Homo sapiens
uauacaaucucuuu

SEQ ID NO: 2140730 - RNA, 19 nt, Homo sapiens
gcgauucccuguguagcuc

SEQ ID NO: 2140731 - RNA, 20 nt, Homo sapiens
cuuccauggugcccuguugg

SEQ ID NO: 2140732 - RNA, 19 nt, Homo sapiens
uguugcaggaaacccuuuu

SEQ ID NO: 2140733 - RNA, 17 nt, Homo sapiens
ugaccuuccaagagccu

SEQ ID NO: 2140734 - RNA, 21 nt, Homo sapiens
gugagcuuuuuguucccucau

SEQ ID NO: 2140735 - RNA, 14 nt, Homo sapiens
ugaauaagcacuuu

SEQ ID NO: 2140736 - RNA, 15 nt, Homo sapiens
aagacaaacuuugca

SEQ ID NO: 2140737 - RNA, 18 nt, Homo sapiens
auguaccguaggcuuugu

SEQ ID NO: 2140738 - RNA, 23 nt, Homo sapiens
ccaagaagauuccuucuaacuga

SEQ ID NO: 2140739 - RNA, 23 nt, Homo sapiens
aaaacagggauuuugaauaugcc

SEQ ID NO: 2140740 - RNA, 22 nt, Homo sapiens
cuaaggucauuaccacaggcca

SEQ ID NO: 2140741 - RNA, 22 nt, Homo sapiens
uucaguuccucuuugcauggaa

SEQ ID NO: 2140742 - RNA, 21 nt, Homo sapiens
auuuauaaaaauaaaaaacac

SEQ ID NO: 2140743 - RNA, 19 nt, Homo sapiens
guuuuccaugauuuagcaa

SEQ ID NO: 2140744 - RNA, 18 nt, Homo sapiens
caaauauaucugcuauuc

SEQ ID NO: 2140745 - RNA, 21 nt, Homo sapiens
acacauucuuaacacaugucc

SEQ ID NO: 2140746 - RNA, 14 nt, Homo sapiens
guccucucaguaau

SEQ ID NO: 2140747 - RNA, 16 nt, Homo sapiens
ccacuaggacucugag

SEQ ID NO: 2140748 - RNA, 21 nt, Homo sapiens
gcuugagccuggcuguccaac

SEQ ID NO: 2140749 - RNA, 20 nt, Homo sapiens
uaucaggguuuaacaauagg

SEQ ID NO: 2140750 - RNA, 23 nt, Homo sapiens
gugcaauauauuuuguaugcaag

SEQ ID NO: 2140751 - RNA, 15 nt, Homo sapiens
auggagggagaagaa

SEQ ID NO: 2140752 - RNA, 19 nt, Homo sapiens
uuccaagugugugugcaau

SEQ ID NO: 2140753 - RNA, 21 nt, Homo sapiens
cuggcucccuggaagagauca

SEQ ID NO: 2140754 - RNA, 16 nt, Homo sapiens
gaaaagggcugacauu

SEQ ID NO: 2140755 - RNA, 19 nt, Homo sapiens
ugaacuagggcaagucuua

SEQ ID NO: 2140756 - RNA, 19 nt, Homo sapiens
cuuggcuuauccacuuuga

SEQ ID NO: 2140757 - RNA, 13 nt, Homo sapiens
gucgacuagggga

SEQ ID NO: 2140758 - RNA, 16 nt, Homo sapiens
uacuaguuuucaauca

SEQ ID NO: 2140759 - RNA, 21 nt, Homo sapiens
agcuguuggaaggacuagguc

SEQ ID NO: 2140760 - RNA, 15 nt, Homo sapiens
ucuguagugugaaac

SEQ ID NO: 2140761 - RNA, 18 nt, Homo sapiens
gcucccugcgccugacau

SEQ ID NO: 2140762 - RNA, 23 nt, Homo sapiens
ccuuaggaaaaugcuucuguugu

SEQ ID NO: 2140763 - RNA, 18 nt, Homo sapiens
auuaaaggaaacuuugaa

SEQ ID NO: 2140764 - RNA, 16 nt, Homo sapiens
caagaaguaacaaaag

SEQ ID NO: 2140765 - RNA, 16 nt, Homo sapiens
cuugucacuugccagu

SEQ ID NO: 2140766 - RNA, 12 nt, Homo sapiens
uuucaacuauuu

SEQ ID NO: 2140767 - RNA, 14 nt, Homo sapiens
caggccaguuugaa

SEQ ID NO: 2140768 - RNA, 12 nt, Homo sapiens
auggaaacacca

SEQ ID NO: 2140769 - RNA, 18 nt, Homo sapiens
uggcuuaaaaauacuuaa

SEQ ID NO: 2140770 - RNA, 16 nt, Homo sapiens
auuaacuuacuuccaa

SEQ ID NO: 2140771 - RNA, 14 nt, Homo sapiens
uuacgacacuuugg

SEQ ID NO: 2140772 - RNA, 20 nt, Homo sapiens
ccuuuuacaauuguugaaau

SEQ ID NO: 2140773 - RNA, 13 nt, Homo sapiens
augugaggauuuu

SEQ ID NO: 2140774 - RNA, 17 nt, Homo sapiens
cagaguuccccaugcag

SEQ ID NO: 2140775 - RNA, 20 nt, Homo sapiens
cucaacauugcauggugcua

SEQ ID NO: 2140776 - RNA, 13 nt, Homo sapiens
gagucuaccucuu

SEQ ID NO: 2140777 - RNA, 23 nt, Homo sapiens
uauauugugaacccuagcugugu

SEQ ID NO: 2140778 - RNA, 15 nt, Homo sapiens
aaaaaucucucccca

SEQ ID NO: 2140779 - RNA, 14 nt, Homo sapiens
guguagacauguca

SEQ ID NO: 2140780 - RNA, 12 nt, Homo sapiens
agggccgugccc

SEQ ID NO: 2140781 - RNA, 16 nt, Homo sapiens
uucacugcgaagaccc

SEQ ID NO: 2140782 - RNA, 21 nt, Homo sapiens
cauccauaguaacugacauga

SEQ ID NO: 2140783 - RNA, 14 nt, Homo sapiens
guauugucuauuau

SEQ ID NO: 2140784 - RNA, 23 nt, Homo sapiens
cgcagggacauggggcaagccag

SEQ ID NO: 2140785 - RNA, 23 nt, Homo sapiens
ccagugcuccaggcacccagcuu

SEQ ID NO: 2140786 - RNA, 10 nt, Homo sapiens
aagugcagag

SEQ ID NO: 2140787 - RNA, 19 nt, Homo sapiens
ugcacaugauaaacaucaa

SEQ ID NO: 2140788 - RNA, 15 nt, Homo sapiens
cuaaaauagcaauaa

SEQ ID NO: 2140789 - RNA, 14 nt, Homo sapiens
guauggccaaagau

SEQ ID NO: 2140790 - RNA, 16 nt, Homo sapiens
guauguuuguacuugg

SEQ ID NO: 2140791 - RNA, 22 nt, Homo sapiens
uaaaaugugauguucuaaggcu

SEQ ID NO: 2140792 - RNA, 13 nt, Homo sapiens
gagggaaggugac

SEQ ID NO: 2140793 - RNA, 16 nt, Homo sapiens
ucaugagcacaggguc

SEQ ID NO: 2140794 - RNA, 16 nt, Homo sapiens
cugaguggugccaaac

SEQ ID NO: 2140795 - RNA, 15 nt, Homo sapiens
ccuggggcugugcau

SEQ ID NO: 2140796 - RNA, 12 nt, Homo sapiens
uucaagucuucc

SEQ ID NO: 2140797 - RNA, 21 nt, Homo sapiens
gaaaggucauccaaagaacau

SEQ ID NO: 2140798 - RNA, 22 nt, Homo sapiens
gcuuauucuuuccuucuuucau

SEQ ID NO: 2140799 - RNA, 14 nt, Homo sapiens
gaugaugugugaaa

SEQ ID NO: 2140800 - RNA, 21 nt, Homo sapiens
aauuaaagggcagauauucuc

SEQ ID NO: 2140801 - RNA, 19 nt, Homo sapiens
gaaacgucuggacugcuau

SEQ ID NO: 2140802 - RNA, 18 nt, Homo sapiens
aaauaaaguaccacacau

SEQ ID NO: 2140803 - RNA, 16 nt, Homo sapiens
gauaugccacuaacuu

SEQ ID NO: 2140804 - RNA, 18 nt, Homo sapiens
aggucuucaaucuuaaaa

SEQ ID NO: 2140805 - RNA, 20 nt, Homo sapiens
gcgugauggcuaugccuugc

SEQ ID NO: 2140806 - RNA, 16 nt, Homo sapiens
aagagcaucaggcuca

SEQ ID NO: 2140807 - RNA, 14 nt, Homo sapiens
ccugggggagaccu

SEQ ID NO: 2140808 - RNA, 13 nt, Homo sapiens
ugacauacauauu

SEQ ID NO: 2140809 - RNA, 17 nt, Homo sapiens
agcagcaacuauucaca

SEQ ID NO: 2140810 - RNA, 18 nt, Homo sapiens
ucugcccugccugaggag

SEQ ID NO: 2140811 - RNA, 21 nt, Homo sapiens
aauguaucugcauauguuuuc

SEQ ID NO: 2140812 - RNA, 20 nt, Homo sapiens
cccugucucggggcuugccc

SEQ ID NO: 2140813 - RNA, 18 nt, Homo sapiens
uuuauuuacuucuguaug

SEQ ID NO: 2140814 - RNA, 16 nt, Homo sapiens
cuuaacucagccagaa

SEQ ID NO: 2140815 - RNA, 15 nt, Homo sapiens
acagggaaaggucag

SEQ ID NO: 2140816 - RNA, 14 nt, Homo sapiens
uacugaagucuuac

SEQ ID NO: 2140817 - RNA, 15 nt, Homo sapiens
augcugugcuaugaa

SEQ ID NO: 2140818 - RNA, 19 nt, Homo sapiens
uguucaacuuuucacucua

SEQ ID NO: 2140819 - RNA, 14 nt, Homo sapiens
gcccaacacuggcc

SEQ ID NO: 2140820 - RNA, 15 nt, Homo sapiens
aacuaauaaucacca

SEQ ID NO: 2140821 - RNA, 23 nt, Homo sapiens
ccgacacugcugcaccagaguga

SEQ ID NO: 2140822 - RNA, 13 nt, Homo sapiens
aauuaauguagcu

SEQ ID NO: 2140823 - RNA, 14 nt, Homo sapiens
ccaagaagcaaagu

SEQ ID NO: 2140824 - RNA, 23 nt, Homo sapiens
aaauccaggcugguguucugucu

SEQ ID NO: 2140825 - RNA, 20 nt, Homo sapiens
cuaaaccaaggacugagcac

SEQ ID NO: 2140826 - RNA, 16 nt, Homo sapiens
cuccuguuuugcacag

SEQ ID NO: 2140827 - RNA, 22 nt, Homo sapiens
ucuuacacaaggggcaaaugaa

SEQ ID NO: 2140828 - RNA, 17 nt, Homo sapiens
ugaaaaccucuuuccaa

SEQ ID NO: 2140829 - RNA, 15 nt, Homo sapiens
auguacaugucaaua

SEQ ID NO: 2140830 - RNA, 18 nt, Homo sapiens
ccugugcaacuuucccaa

SEQ ID NO: 2140831 - RNA, 17 nt, Homo sapiens
guuuccacugucuugcc

SEQ ID NO: 2140832 - RNA, 14 nt, Homo sapiens
uaaccuuucuaacc

SEQ ID NO: 2140833 - RNA, 16 nt, Homo sapiens
auccagcgguucucaa

SEQ ID NO: 2140834 - RNA, 16 nt, Homo sapiens
aacuaccagauuugag

SEQ ID NO: 2140835 - RNA, 20 nt, Homo sapiens
ugcuguaugaauagcugugu

SEQ ID NO: 2140836 - RNA, 16 nt, Homo sapiens
cagcgcgguccugacu

SEQ ID NO: 2140837 - RNA, 15 nt, Homo sapiens
aacaaugaagauaaa

SEQ ID NO: 2140838 - RNA, 20 nt, Homo sapiens
uagcuccaaaccuucacaca

SEQ ID NO: 2140839 - RNA, 16 nt, Homo sapiens
auauaacaaccuuuaa

SEQ ID NO: 2140840 - RNA, 13 nt, Homo sapiens
uaacuguguuuua

SEQ ID NO: 2140841 - RNA, 15 nt, Homo sapiens
auuuacaaggaguua

SEQ ID NO: 2140842 - RNA, 22 nt, Homo sapiens
ccacguauuccagggagccuuu

SEQ ID NO: 2140843 - RNA, 17 nt, Homo sapiens
acagaauauucuguaaa

SEQ ID NO: 2140844 - RNA, 16 nt, Homo sapiens
uucauacccuguuacc

SEQ ID NO: 2140845 - RNA, 19 nt, Homo sapiens
auuaggacuuuuauuguga

SEQ ID NO: 2140846 - RNA, 23 nt, Homo sapiens
cuagaaacacacauuucuuugaa

SEQ ID NO: 2140847 - RNA, 14 nt, Homo sapiens
uuaaauuuuguaug

SEQ ID NO: 2140848 - RNA, 15 nt, Homo sapiens
cacuugaagcacuua

SEQ ID NO: 2140849 - RNA, 15 nt, Homo sapiens
aguguugacacuuaa

SEQ ID NO: 2140850 - RNA, 18 nt, Homo sapiens
augaaaguauuggcauuc

SEQ ID NO: 2140851 - RNA, 14 nt, Homo sapiens
gcauggcacugacc

SEQ ID NO: 2140852 - RNA, 19 nt, Homo sapiens
gagccuccugggaacacau

SEQ ID NO: 2140853 - RNA, 20 nt, Homo sapiens
uugggaggcuggaguggaaa

SEQ ID NO: 2140854 - RNA, 15 nt, Homo sapiens
ucugacacuuguggu

SEQ ID NO: 2140855 - RNA, 14 nt, Homo sapiens
cuuaaaaugugcua

SEQ ID NO: 2140856 - RNA, 17 nt, Homo sapiens
uugugacuucacuguau

SEQ ID NO: 2140857 - RNA, 16 nt, Homo sapiens
caagaaguacaugaag

SEQ ID NO: 2140858 - RNA, 12 nt, Homo sapiens
gagaauuguuga

SEQ ID NO: 2140859 - RNA, 15 nt, Homo sapiens
aucuuguuuuuccac

SEQ ID NO: 2140860 - RNA, 18 nt, Homo sapiens
ggcugcacccacccagga

SEQ ID NO: 2140861 - RNA, 14 nt, Homo sapiens
acacagcuguuucc

SEQ ID NO: 2140862 - RNA, 18 nt, Homo sapiens
gcuacccuuuuccuuugu

SEQ ID NO: 2140863 - RNA, 13 nt, Homo sapiens
caaaugucuaagg

SEQ ID NO: 2140864 - RNA, 13 nt, Homo sapiens
cccgugucuccag

SEQ ID NO: 2140865 - RNA, 12 nt, Homo sapiens
aguaaacuuucu

SEQ ID NO: 2140866 - RNA, 20 nt, Homo sapiens
gcgcauagcacgggauucau

SEQ ID NO: 2140867 - RNA, 20 nt, Homo sapiens
agaaguuuggcugcugucau

SEQ ID NO: 2140868 - RNA, 22 nt, Homo sapiens
uuugaaguagacucauucuuca

SEQ ID NO: 2140869 - RNA, 19 nt, Homo sapiens
uccuagaugccaaaggggu

SEQ ID NO: 2140870 - RNA, 21 nt, Homo sapiens
aacuguauuuauugugaugcc

SEQ ID NO: 2140871 - RNA, 14 nt, Homo sapiens
gaaaacaaacaaau

SEQ ID NO: 2140872 - RNA, 13 nt, Homo sapiens
uaaucccaacacu

SEQ ID NO: 2140873 - RNA, 20 nt, Homo sapiens
gacuagugcuuuaccuuuau

SEQ ID NO: 2140874 - RNA, 15 nt, Homo sapiens
ccuacaaaauggagg

SEQ ID NO: 2140875 - RNA, 23 nt, Homo sapiens
cccauuacuuuaauacucaccuc

SEQ ID NO: 2140876 - RNA, 14 nt, Homo sapiens
aggaaaaauugaug

SEQ ID NO: 2140877 - RNA, 23 nt, Homo sapiens
cuaugacaauaaauuuuaucuca

SEQ ID NO: 2140878 - RNA, 20 nt, Homo sapiens
accugugggggaagaucagc

SEQ ID NO: 2140879 - RNA, 18 nt, Homo sapiens
aguagaacccaggucuga

SEQ ID NO: 2140880 - RNA, 19 nt, Homo sapiens
acaggguuucaccauguua

SEQ ID NO: 2140881 - RNA, 19 nt, Homo sapiens
cuuguggaaugcugccuuu

SEQ ID NO: 2140882 - RNA, 21 nt, Homo sapiens
gaaaaugcgagacucugaugg

SEQ ID NO: 2140883 - RNA, 21 nt, Homo sapiens
auuuuagucugucauccagaa

SEQ ID NO: 2140884 - RNA, 19 nt, Homo sapiens
cugaaaaaaugcugagcca

SEQ ID NO: 2140885 - RNA, 14 nt, Homo sapiens
cuugugaggcuucc

SEQ ID NO: 2140886 - RNA, 23 nt, Homo sapiens
agauuuguuuuucucuuuucaca

SEQ ID NO: 2140887 - RNA, 22 nt, Homo sapiens
guacacagugagaguacucacu

SEQ ID NO: 2140888 - RNA, 12 nt, Homo sapiens
ccaggugcaauu

SEQ ID NO: 2140889 - RNA, 20 nt, Homo sapiens
cuugucugucucagcucaac

SEQ ID NO: 2140890 - RNA, 18 nt, Homo sapiens
ugacauugcaccuggaug

SEQ ID NO: 2140891 - RNA, 13 nt, Homo sapiens
ggcagucacacug

SEQ ID NO: 2140892 - RNA, 14 nt, Homo sapiens
aacuuccacuaccu

SEQ ID NO: 2140893 - RNA, 13 nt, Homo sapiens
gacuguugcacuc

SEQ ID NO: 2140894 - RNA, 16 nt, Homo sapiens
ugguauacacacucgu

SEQ ID NO: 2140895 - RNA, 23 nt, Homo sapiens
uagaagugguuuguagacuuccu

SEQ ID NO: 2140896 - RNA, 17 nt, Homo sapiens
gaauaagggacuuugga

SEQ ID NO: 2140897 - RNA, 13 nt, Homo sapiens
caauaaaguuuac

SEQ ID NO: 2140898 - RNA, 15 nt, Homo sapiens
uaauguuauuuuccu

SEQ ID NO: 2140899 - RNA, 20 nt, Homo sapiens
cgccucccgggucucaggcc

SEQ ID NO: 2140900 - RNA, 15 nt, Homo sapiens
guagcuuuuacuuuu

SEQ ID NO: 2140901 - RNA, 17 nt, Homo sapiens
agucacaggaugagaca

SEQ ID NO: 2140902 - RNA, 18 nt, Homo sapiens
ccgauaaacuuucucaaa

SEQ ID NO: 2140903 - RNA, 19 nt, Homo sapiens
uauaucuuagguaagacau

SEQ ID NO: 2140904 - RNA, 17 nt, Homo sapiens
augccacucccuaccca

SEQ ID NO: 2140905 - RNA, 18 nt, Homo sapiens
auauuaauauauuuccau

SEQ ID NO: 2140906 - RNA, 20 nt, Homo sapiens
guggggugugcacaucucug

SEQ ID NO: 2140907 - RNA, 18 nt, Homo sapiens
augaagacaccagagugu

SEQ ID NO: 2140908 - RNA, 15 nt, Homo sapiens
aaacuguuacugaaa

SEQ ID NO: 2140909 - RNA, 22 nt, Homo sapiens
agcagggucuuuucaucuggga

SEQ ID NO: 2140910 - RNA, 14 nt, Homo sapiens
uaugggaacacugg

SEQ ID NO: 2140911 - RNA, 18 nt, Homo sapiens
auggcagacucaccaccu

SEQ ID NO: 2140912 - RNA, 20 nt, Homo sapiens
aacagaugugucagccagga

SEQ ID NO: 2140913 - RNA, 17 nt, Homo sapiens
uggaauaaaacugucuc

SEQ ID NO: 2140914 - RNA, 12 nt, Homo sapiens
gagaagugcccu

SEQ ID NO: 2140915 - RNA, 16 nt, Homo sapiens
uauuccagacagucac

SEQ ID NO: 2140916 - RNA, 16 nt, Homo sapiens
ucuuauuuaaaacugu

SEQ ID NO: 2140917 - RNA, 16 nt, Homo sapiens
cuuccuugaccaaagc

SEQ ID NO: 2140918 - RNA, 18 nt, Homo sapiens
uauuguaacagacauugu

SEQ ID NO: 2140919 - RNA, 22 nt, Homo sapiens
cuaaagcuuagaauagugugau

SEQ ID NO: 2140920 - RNA, 21 nt, Homo sapiens
gucuucacaaccuccgugcug

SEQ ID NO: 2140921 - RNA, 12 nt, Homo sapiens
cccuauucugcc

SEQ ID NO: 2140922 - RNA, 18 nt, Homo sapiens
gagucauggcuaauuuaa

SEQ ID NO: 2140923 - RNA, 18 nt, Homo sapiens
aguagucaaaaacaaagc

SEQ ID NO: 2140924 - RNA, 19 nt, Homo sapiens
guaauacguagcucucuua

SEQ ID NO: 2140925 - RNA, 23 nt, Homo sapiens
ccucuucagauccuggucugcac

SEQ ID NO: 2140926 - RNA, 14 nt, Homo sapiens
uuuacagaaaucaa

SEQ ID NO: 2140927 - RNA, 18 nt, Homo sapiens
gcagaccccucuaccucc

SEQ ID NO: 2140928 - RNA, 21 nt, Homo sapiens
uggagcugcguuuccugugca

SEQ ID NO: 2140929 - RNA, 16 nt, Homo sapiens
cauccacuagugcaaa

SEQ ID NO: 2140930 - RNA, 20 nt, Homo sapiens
cuggguggcuuaugagagag

SEQ ID NO: 2140931 - RNA, 20 nt, Homo sapiens
gcgcagggacauggggcaag

SEQ ID NO: 2140932 - RNA, 16 nt, Homo sapiens
gugguuugaagacccc

SEQ ID NO: 2140933 - RNA, 23 nt, Homo sapiens
agcauuagauuccuuuccugugu

SEQ ID NO: 2140934 - RNA, 17 nt, Homo sapiens
aggcuucaucaccaaga

SEQ ID NO: 2140935 - RNA, 18 nt, Homo sapiens
ccauuguuuugccaguga

SEQ ID NO: 2140936 - RNA, 18 nt, Homo sapiens
uaccucggccucccaaag

SEQ ID NO: 2140937 - RNA, 22 nt, Homo sapiens
gauagacuuauugccaaaaaca

SEQ ID NO: 2140938 - RNA, 16 nt, Homo sapiens
uauacuguuauuucac

SEQ ID NO: 2140939 - RNA, 20 nt, Homo sapiens
uuaaugaggguuugugcuac

SEQ ID NO: 2140940 - RNA, 15 nt, Homo sapiens
aauguuuaccagugu

SEQ ID NO: 2140941 - RNA, 19 nt, Homo sapiens
uuccaagauuucaaagugg

SEQ ID NO: 2140942 - RNA, 15 nt, Homo sapiens
uucuuggcccaggau

SEQ ID NO: 2140943 - RNA, 19 nt, Homo sapiens
ugucuguuuguuucaagaa

SEQ ID NO: 2140944 - RNA, 21 nt, Homo sapiens
cucagccuugcacacccacug

SEQ ID NO: 2140945 - RNA, 17 nt, Homo sapiens
caggugaagcaccaagc

SEQ ID NO: 2140946 - RNA, 22 nt, Homo sapiens
aacuuucacagugaagugccuu

SEQ ID NO: 2140947 - RNA, 23 nt, Homo sapiens
aaacuaaccuugaauaaggccca

SEQ ID NO: 2140948 - RNA, 22 nt, Homo sapiens
uguuuuucguuuuuuuggucac

SEQ ID NO: 2140949 - RNA, 11 nt, Homo sapiens
gcucaccucag

SEQ ID NO: 2140950 - RNA, 11 nt, Homo sapiens
caucaccugcg

SEQ ID NO: 2140951 - RNA, 15 nt, Homo sapiens
agauauaaggggaaa

SEQ ID NO: 2140952 - RNA, 16 nt, Homo sapiens
caucucuguuauuuau

SEQ ID NO: 2140953 - RNA, 16 nt, Homo sapiens
caaccaacugccccag

SEQ ID NO: 2140954 - RNA, 14 nt, Homo sapiens
ugcaggguaggggg

SEQ ID NO: 2140955 - RNA, 15 nt, Homo sapiens
aagccacucuuccaa

SEQ ID NO: 2140956 - RNA, 14 nt, Homo sapiens
gaaagaaacaugug

SEQ ID NO: 2140957 - RNA, 18 nt, Homo sapiens
cccuugcacuguaucauu

SEQ ID NO: 2140958 - RNA, 18 nt, Homo sapiens
caggaugauuguacagaa

SEQ ID NO: 2140959 - RNA, 18 nt, Homo sapiens
ggacuagaaaaacuuggg

SEQ ID NO: 2140960 - RNA, 14 nt, Homo sapiens
ucugaggacaagga

SEQ ID NO: 2140961 - RNA, 13 nt, Homo sapiens
uugcuaagcauuc

SEQ ID NO: 2140962 - RNA, 18 nt, Homo sapiens
ucaguauaaaagacaaaa

SEQ ID NO: 2140963 - RNA, 17 nt, Homo sapiens
ugcuugacaacaucuga

SEQ ID NO: 2140964 - RNA, 13 nt, Homo sapiens
caccuccauuaaa

SEQ ID NO: 2140965 - RNA, 18 nt, Homo sapiens
acucuggcaaagcuuuua

SEQ ID NO: 2140966 - RNA, 20 nt, Homo sapiens
ugcaaaauucuuucagauga

SEQ ID NO: 2140967 - RNA, 18 nt, Homo sapiens
uuuuuccuaagacauuuu

SEQ ID NO: 2140968 - RNA, 19 nt, Homo sapiens
uaucuuagguagucaugcu

SEQ ID NO: 2140969 - RNA, 17 nt, Homo sapiens
caucuucauuaauacug

SEQ ID NO: 2140970 - RNA, 13 nt, Homo sapiens
cagugguggugcc

SEQ ID NO: 2140971 - RNA, 14 nt, Homo sapiens
acguuucuguggag

SEQ ID NO: 2140972 - RNA, 20 nt, Homo sapiens
ugagaaagccuggcuuguau

SEQ ID NO: 2140973 - RNA, 20 nt, Homo sapiens
cccugcacucccuccuggag

SEQ ID NO: 2140974 - RNA, 20 nt, Homo sapiens
agccugauuuaggcacugcu

SEQ ID NO: 2140975 - RNA, 20 nt, Homo sapiens
uuuggguuugucaggaugga

SEQ ID NO: 2140976 - RNA, 13 nt, Homo sapiens
uauuccacaucua

SEQ ID NO: 2140977 - RNA, 20 nt, Homo sapiens
aucucauuggacccuuccau

SEQ ID NO: 2140978 - RNA, 22 nt, Homo sapiens
acagggugcuccuugucaauac

SEQ ID NO: 2140979 - RNA, 16 nt, Homo sapiens
gggucagccauuuuua

SEQ ID NO: 2140980 - RNA, 18 nt, Homo sapiens
accugaucacuagccugu

SEQ ID NO: 2140981 - RNA, 10 nt, Homo sapiens
gccuccucaa

SEQ ID NO: 2140982 - RNA, 22 nt, Homo sapiens
acaauccuccccaccagucuca

SEQ ID NO: 2140983 - RNA, 22 nt, Homo sapiens
auucaugcugcuuagaugacau

SEQ ID NO: 2140984 - RNA, 19 nt, Homo sapiens
agucagauuaucuacuuag

SEQ ID NO: 2140985 - RNA, 22 nt, Homo sapiens
cggagggccccugcgugggggc

SEQ ID NO: 2140986 - RNA, 20 nt, Homo sapiens
aagcuugagucucaagggug

SEQ ID NO: 2140987 - RNA, 13 nt, Homo sapiens
aaauguaugugcu

SEQ ID NO: 2140988 - RNA, 19 nt, Homo sapiens
ucaguaauaaaaccgguca

SEQ ID NO: 2140989 - RNA, 19 nt, Homo sapiens
cugccugccucggggacac

SEQ ID NO: 2140990 - RNA, 22 nt, Homo sapiens
guuuucaguagaagaacuuaaa

SEQ ID NO: 2140991 - RNA, 23 nt, Homo sapiens
ucccuucucuggucuccuugaga

SEQ ID NO: 2140992 - RNA, 14 nt, Homo sapiens
uguccuaugcaaua

SEQ ID NO: 2140993 - RNA, 19 nt, Homo sapiens
uaagaucuguuaaaaaaga

SEQ ID NO: 2140994 - RNA, 19 nt, Homo sapiens
ucacuugaguggagguuua

SEQ ID NO: 2140995 - RNA, 12 nt, Homo sapiens
gauuagcuguaa

SEQ ID NO: 2140996 - RNA, 19 nt, Homo sapiens
ugcagauuuugcccuugac

SEQ ID NO: 2140997 - RNA, 19 nt, Homo sapiens
caaaaggagagauuauuaa

SEQ ID NO: 2140998 - RNA, 18 nt, Homo sapiens
uccuuucauuuacugugg

SEQ ID NO: 2140999 - RNA, 15 nt, Homo sapiens
ccacuccagaagcau

SEQ ID NO: 2141000 - RNA, 12 nt, Homo sapiens
ggggccacucca

SEQ ID NO: 2141001 - RNA, 20 nt, Homo sapiens
gcaaucuggaagaaagcccu

SEQ ID NO: 2141002 - RNA, 15 nt, Homo sapiens
ccauguucuccauga

SEQ ID NO: 2141003 - RNA, 20 nt, Homo sapiens
acagcaagggugaugggaaa

SEQ ID NO: 2141004 - RNA, 15 nt, Homo sapiens
caggugucaucauca

SEQ ID NO: 2141005 - RNA, 18 nt, Homo sapiens
uccucacaguugccaugu

SEQ ID NO: 2141006 - RNA, 13 nt, Homo sapiens
aucuuucuuacua

SEQ ID NO: 2141007 - RNA, 15 nt, Homo sapiens
uagccucaccaaggu

SEQ ID NO: 2141008 - RNA, 13 nt, Homo sapiens
aacaauugcuuua

SEQ ID NO: 2141009 - RNA, 16 nt, Homo sapiens
gaauaucaaugcccaa

SEQ ID NO: 2141010 - RNA, 19 nt, Homo sapiens
uucauugacugauggugaa

SEQ ID NO: 2141011 - RNA, 16 nt, Homo sapiens
ucuaucagcaucugac

SEQ ID NO: 2141012 - RNA, 22 nt, Homo sapiens
accacccuuucacaagcaacag

SEQ ID NO: 2141013 - RNA, 16 nt, Homo sapiens
gauccugcccuggcca

SEQ ID NO: 2141014 - RNA, 18 nt, Homo sapiens
caauuacagggugacuca

SEQ ID NO: 2141015 - RNA, 14 nt, Homo sapiens
acuggucugggaag

SEQ ID NO: 2141016 - RNA, 23 nt, Homo sapiens
auuaauuuucuugguucuuucag

SEQ ID NO: 2141017 - RNA, 21 nt, Homo sapiens
uuacugcuucuuuucacuuca

SEQ ID NO: 2141018 - RNA, 19 nt, Homo sapiens
agcccuggggacaccugcc

SEQ ID NO: 2141019 - RNA, 16 nt, Homo sapiens
aacuucauuugacaca

SEQ ID NO: 2141020 - RNA, 19 nt, Homo sapiens
uucccauuggucugcaugu

SEQ ID NO: 2141021 - RNA, 17 nt, Homo sapiens
aaccuguugcuguguuu

SEQ ID NO: 2141022 - RNA, 18 nt, Homo sapiens
cggcugcggggggcacca

SEQ ID NO: 2141023 - RNA, 21 nt, Homo sapiens
aauguuauuauuacucuacac

SEQ ID NO: 2141024 - RNA, 14 nt, Homo sapiens
aguuucuuccugua

SEQ ID NO: 2141025 - RNA, 22 nt, Homo sapiens
ugagggguuaccucccucgccc

SEQ ID NO: 2141026 - RNA, 22 nt, Homo sapiens
gauucuuccacuggcuccacau

SEQ ID NO: 2141027 - RNA, 12 nt, Homo sapiens
ggugagcagggu

SEQ ID NO: 2141028 - RNA, 17 nt, Homo sapiens
ucuucgcacagugucua

SEQ ID NO: 2141029 - RNA, 14 nt, Homo sapiens
aaauguauucaccu

SEQ ID NO: 2141030 - RNA, 17 nt, Homo sapiens
aaucccagcuacucaag

SEQ ID NO: 2141031 - RNA, 21 nt, Homo sapiens
acuccacucagguucuucagg

SEQ ID NO: 2141032 - RNA, 23 nt, Homo sapiens
cuuggaaaucauugugugucuuc

SEQ ID NO: 2141033 - RNA, 22 nt, Homo sapiens
ucucuaggguacauggugcugg

SEQ ID NO: 2141034 - RNA, 20 nt, Homo sapiens
acuucuaaguaaaaccacag

SEQ ID NO: 2141035 - RNA, 20 nt, Homo sapiens
aaugguggucuucuccacca

SEQ ID NO: 2141036 - RNA, 20 nt, Homo sapiens
aagugggugggcacacugaa

SEQ ID NO: 2141037 - RNA, 12 nt, Homo sapiens
cauucaguguua

SEQ ID NO: 2141038 - RNA, 16 nt, Homo sapiens
aaaaguugcagucuca

SEQ ID NO: 2141039 - RNA, 11 nt, Homo sapiens
caucucuccag

SEQ ID NO: 2141040 - RNA, 23 nt, Homo sapiens
ugaagcuuuauacguguagcuau

SEQ ID NO: 2141041 - RNA, 13 nt, Homo sapiens
gcugaggugggca

SEQ ID NO: 2141042 - RNA, 18 nt, Homo sapiens
uguuggcguaggcuacag

SEQ ID NO: 2141043 - RNA, 16 nt, Homo sapiens
ucaguagugccuguga

SEQ ID NO: 2141044 - RNA, 17 nt, Homo sapiens
caggcuggcuguuggcc

SEQ ID NO: 2141045 - RNA, 15 nt, Homo sapiens
ccaaagccagaccag

SEQ ID NO: 2141046 - RNA, 13 nt, Homo sapiens
accaaucaugaau

SEQ ID NO: 2141047 - RNA, 21 nt, Homo sapiens
auugugugaaagguacuucaa

SEQ ID NO: 2141048 - RNA, 17 nt, Homo sapiens
gauaucucaaucugcag

SEQ ID NO: 2141049 - RNA, 18 nt, Homo sapiens
uaaacauuaauauuuacc

SEQ ID NO: 2141050 - RNA, 13 nt, Homo sapiens
auguaugaggaaa

SEQ ID NO: 2141051 - RNA, 11 nt, Homo sapiens
cagcaccucau

SEQ ID NO: 2141052 - RNA, 13 nt, Homo sapiens
uucaagugccaaa

SEQ ID NO: 2141053 - RNA, 14 nt, Homo sapiens
aauaagcuauauua

SEQ ID NO: 2141054 - RNA, 16 nt, Homo sapiens
uugagccaaugacugu

SEQ ID NO: 2141055 - RNA, 18 nt, Homo sapiens
gcccugaucuagugcagu

SEQ ID NO: 2141056 - RNA, 23 nt, Homo sapiens
cugugaugucaguagugccugug

SEQ ID NO: 2141057 - RNA, 14 nt, Homo sapiens
aagauugaacuuaa

SEQ ID NO: 2141058 - RNA, 15 nt, Homo sapiens
uaaucugauguuaac

SEQ ID NO: 2141059 - RNA, 14 nt, Homo sapiens
uguucccacucagc

SEQ ID NO: 2141060 - RNA, 13 nt, Homo sapiens
uguaauuccagcu

SEQ ID NO: 2141061 - RNA, 14 nt, Homo sapiens
cucugcacagacaa

SEQ ID NO: 2141062 - RNA, 21 nt, Homo sapiens
uacauugaaacccuccaaauc

SEQ ID NO: 2141063 - RNA, 21 nt, Homo sapiens
auggguagcuucugaccucag

SEQ ID NO: 2141064 - RNA, 23 nt, Homo sapiens
aauuuucuguguuuugcuguacc

SEQ ID NO: 2141065 - RNA, 17 nt, Homo sapiens
aauccauuauccuuuau

SEQ ID NO: 2141066 - RNA, 18 nt, Homo sapiens
gucuaguagcggaucuca

SEQ ID NO: 2141067 - RNA, 11 nt, Homo sapiens
ccuagggugau

SEQ ID NO: 2141068 - RNA, 17 nt, Homo sapiens
aggaugacaugugccau

SEQ ID NO: 2141069 - RNA, 14 nt, Homo sapiens
acacccacuggcca

SEQ ID NO: 2141070 - RNA, 17 nt, Homo sapiens
ccauuuguuuaaauuca

SEQ ID NO: 2141071 - RNA, 12 nt, Homo sapiens
accucaccaaaa

SEQ ID NO: 2141072 - RNA, 14 nt, Homo sapiens
auaucuauuugaga

SEQ ID NO: 2141073 - RNA, 22 nt, Homo sapiens
gcgcucucagcuuucccugcca

SEQ ID NO: 2141074 - RNA, 20 nt, Homo sapiens
aucgauccuggauucacuca

SEQ ID NO: 2141075 - RNA, 12 nt, Homo sapiens
cuggaguggugu

SEQ ID NO: 2141076 - RNA, 11 nt, Homo sapiens
cagaggaccag

SEQ ID NO: 2141077 - RNA, 18 nt, Homo sapiens
ugagcacccagaacucca

SEQ ID NO: 2141078 - RNA, 23 nt, Homo sapiens
cuguauucuguuugcguacuugu

SEQ ID NO: 2141079 - RNA, 13 nt, Homo sapiens
cuuccagauccug

SEQ ID NO: 2141080 - RNA, 13 nt, Homo sapiens
caaaauuauaugu

SEQ ID NO: 2141081 - RNA, 16 nt, Homo sapiens
cgccucuccccggggc

SEQ ID NO: 2141082 - RNA, 14 nt, Homo sapiens
cuauauuaggcaug

SEQ ID NO: 2141083 - RNA, 16 nt, Homo sapiens
caaaggauaaacugca

SEQ ID NO: 2141084 - RNA, 15 nt, Homo sapiens
ucaaaugucagagcu

SEQ ID NO: 2141085 - RNA, 14 nt, Homo sapiens
cuuagugauugaga

SEQ ID NO: 2141086 - RNA, 12 nt, Homo sapiens
cauugagcauuu

SEQ ID NO: 2141087 - RNA, 14 nt, Homo sapiens
guaggggcaaaaau

SEQ ID NO: 2141088 - RNA, 20 nt, Homo sapiens
aacuuuagcaacaguuauca

SEQ ID NO: 2141089 - RNA, 12 nt, Homo sapiens
augggagccagg

SEQ ID NO: 2141090 - RNA, 18 nt, Homo sapiens
ugcacagcccaaccagga

SEQ ID NO: 2141091 - RNA, 21 nt, Homo sapiens
ccugucucuacuaaaaauaca

SEQ ID NO: 2141092 - RNA, 14 nt, Homo sapiens
ccucucucaggggu

SEQ ID NO: 2141093 - RNA, 15 nt, Homo sapiens
aaugauuacuaauau

SEQ ID NO: 2141094 - RNA, 19 nt, Homo sapiens
agaaggccuugaagaauuu

SEQ ID NO: 2141095 - RNA, 18 nt, Homo sapiens
ccucaaugucacuuggug

SEQ ID NO: 2141096 - RNA, 16 nt, Homo sapiens
aagcgccgcugugagg

SEQ ID NO: 2141097 - RNA, 22 nt, Homo sapiens
ccagccagggugugacucggga

SEQ ID NO: 2141098 - RNA, 20 nt, Homo sapiens
auuuauacaccagcaauuua

SEQ ID NO: 2141099 - RNA, 12 nt, Homo sapiens
aaagaacucuca

SEQ ID NO: 2141100 - RNA, 15 nt, Homo sapiens
ccuucuccaugcuga

SEQ ID NO: 2141101 - RNA, 19 nt, Homo sapiens
uuaaaaaauacacauagca

SEQ ID NO: 2141102 - RNA, 17 nt, Homo sapiens
ccaaggcagaaagauag

SEQ ID NO: 2141103 - RNA, 22 nt, Homo sapiens
aaaauaaagucugucaugccaa

SEQ ID NO: 2141104 - RNA, 15 nt, Homo sapiens
auuaggaaaauauaa

SEQ ID NO: 2141105 - RNA, 19 nt, Homo sapiens
ugguuccuuggggggccaa

SEQ ID NO: 2141106 - RNA, 18 nt, Homo sapiens
augggucccccucagcaa

SEQ ID NO: 2141107 - RNA, 15 nt, Homo sapiens
cuuucccuaagccag

SEQ ID NO: 2141108 - RNA, 12 nt, Homo sapiens
auauauuuugca

SEQ ID NO: 2141109 - RNA, 21 nt, Homo sapiens
uacaucugagguccugugauc

SEQ ID NO: 2141110 - RNA, 14 nt, Homo sapiens
ggcccgcacguguc

SEQ ID NO: 2141111 - RNA, 13 nt, Homo sapiens
ccuaaguguaaug

SEQ ID NO: 2141112 - RNA, 16 nt, Homo sapiens
augugcaaaggcaucu

SEQ ID NO: 2141113 - RNA, 14 nt, Homo sapiens
auucugcuaccaau

SEQ ID NO: 2141114 - RNA, 19 nt, Homo sapiens
accaucugugacuauaaag

SEQ ID NO: 2141115 - RNA, 13 nt, Homo sapiens
guaccaugcugcc

SEQ ID NO: 2141116 - RNA, 14 nt, Homo sapiens
uucucacacacugg

SEQ ID NO: 2141117 - RNA, 14 nt, Homo sapiens
aauaauuugcacug

SEQ ID NO: 2141118 - RNA, 19 nt, Homo sapiens
caacuuguguucuauuaau

SEQ ID NO: 2141119 - RNA, 16 nt, Homo sapiens
aacagugugaugcaau

SEQ ID NO: 2141120 - RNA, 16 nt, Homo sapiens
cagcagucacaggucu

SEQ ID NO: 2141121 - RNA, 19 nt, Homo sapiens
uucaacaguuuuugcuaau

SEQ ID NO: 2141122 - RNA, 14 nt, Homo sapiens
ugcaccccaugugg

SEQ ID NO: 2141123 - RNA, 17 nt, Homo sapiens
ggggccggaggaaccga

SEQ ID NO: 2141124 - RNA, 10 nt, Homo sapiens
agaugcauua

SEQ ID NO: 2141125 - RNA, 15 nt, Homo sapiens
gaccuaacauucgau

SEQ ID NO: 2141126 - RNA, 13 nt, Homo sapiens
guagcagcuauau

SEQ ID NO: 2141127 - RNA, 15 nt, Homo sapiens
ugaugccauucuucc

SEQ ID NO: 2141128 - RNA, 13 nt, Homo sapiens
ucgcugugccaca

SEQ ID NO: 2141129 - RNA, 20 nt, Homo sapiens
gaagauguugguuauggugu

SEQ ID NO: 2141130 - RNA, 16 nt, Homo sapiens
gcaaggggccaggaag

SEQ ID NO: 2141131 - RNA, 22 nt, Homo sapiens
acucagauggaaccgcaggaag

SEQ ID NO: 2141132 - RNA, 14 nt, Homo sapiens
acagugacaaaagg

SEQ ID NO: 2141133 - RNA, 17 nt, Homo sapiens
aagcuuuacuacugugg

SEQ ID NO: 2141134 - RNA, 21 nt, Homo sapiens
aauggcugcuuuugucucccu

SEQ ID NO: 2141135 - RNA, 20 nt, Homo sapiens
aauauauguauauauauucu

SEQ ID NO: 2141136 - RNA, 17 nt, Homo sapiens
uugagaaugguuacaaa

SEQ ID NO: 2141137 - RNA, 15 nt, Homo sapiens
accugaccagacugu

SEQ ID NO: 2141138 - RNA, 23 nt, Homo sapiens
accuggagggcuggaaucuggag

SEQ ID NO: 2141139 - RNA, 14 nt, Homo sapiens
ccaaaucucaaaag

SEQ ID NO: 2141140 - RNA, 13 nt, Homo sapiens
aggcccucaguga

SEQ ID NO: 2141141 - RNA, 22 nt, Homo sapiens
uauguggaagugugggucugug

SEQ ID NO: 2141142 - RNA, 22 nt, Homo sapiens
auuuucagugcuuugcccuuga

SEQ ID NO: 2141143 - RNA, 23 nt, Homo sapiens
gccugcccuccccagagcacugg

SEQ ID NO: 2141144 - RNA, 19 nt, Homo sapiens
aacaaggggucaaugucau

SEQ ID NO: 2141145 - RNA, 22 nt, Homo sapiens
gucugcaaugucccuugcacag

SEQ ID NO: 2141146 - RNA, 21 nt, Homo sapiens
gagcucaggucccaggccagc

SEQ ID NO: 2141147 - RNA, 17 nt, Homo sapiens
aagggggguugcagugg

SEQ ID NO: 2141148 - RNA, 11 nt, Homo sapiens
acacaccugca

SEQ ID NO: 2141149 - RNA, 14 nt, Homo sapiens
ccauauuacguugu

SEQ ID NO: 2141150 - RNA, 13 nt, Homo sapiens
cugugacacacua

SEQ ID NO: 2141151 - RNA, 14 nt, Homo sapiens
ucccuccaaagggc

SEQ ID NO: 2141152 - RNA, 12 nt, Homo sapiens
gacgaauuccac

SEQ ID NO: 2141153 - RNA, 18 nt, Homo sapiens
aaugucauagucuugaaa

SEQ ID NO: 2141154 - RNA, 19 nt, Homo sapiens
acaauuaaugaaauaauua

SEQ ID NO: 2141155 - RNA, 19 nt, Homo sapiens
ugucacuuucucucuuaua

SEQ ID NO: 2141156 - RNA, 16 nt, Homo sapiens
aaaaucccuuguucuc

SEQ ID NO: 2141157 - RNA, 17 nt, Homo sapiens
gucucuguuccaugucu

SEQ ID NO: 2141158 - RNA, 15 nt, Homo sapiens
ccuaggcuaccucaa

SEQ ID NO: 2141159 - RNA, 18 nt, Homo sapiens
cuauaagauuccaaaaag

SEQ ID NO: 2141160 - RNA, 19 nt, Homo sapiens
auaggucauuuucuauuca

SEQ ID NO: 2141161 - RNA, 18 nt, Homo sapiens
guuugucagaggaacaaa

SEQ ID NO: 2141162 - RNA, 18 nt, Homo sapiens
gauaacuggcacccagag

SEQ ID NO: 2141163 - RNA, 19 nt, Homo sapiens
ccacugucuauguacaaua

SEQ ID NO: 2141164 - RNA, 19 nt, Homo sapiens
cuccagccugggaggcaca

SEQ ID NO: 2141165 - RNA, 19 nt, Homo sapiens
auacauuuuuuucucuuuc

SEQ ID NO: 2141166 - RNA, 12 nt, Homo sapiens
cacucauuccca

SEQ ID NO: 2141167 - RNA, 14 nt, Homo sapiens
gccugggucauggg

SEQ ID NO: 2141168 - RNA, 13 nt, Homo sapiens
gaaguggauucug

SEQ ID NO: 2141169 - RNA, 16 nt, Homo sapiens
uuuuaaaguguuucag

SEQ ID NO: 2141170 - RNA, 23 nt, Homo sapiens
ucuuaaaggcuucucauccacug

SEQ ID NO: 2141171 - RNA, 22 nt, Homo sapiens
gagaccaaaggauccagagacu

SEQ ID NO: 2141172 - RNA, 14 nt, Homo sapiens
uugggaaaacuggg

SEQ ID NO: 2141173 - RNA, 14 nt, Homo sapiens
ccucagcgucucuu

SEQ ID NO: 2141174 - RNA, 13 nt, Homo sapiens
ggccuuuucugug

SEQ ID NO: 2141175 - RNA, 11 nt, Homo sapiens
acacagugcug

SEQ ID NO: 2141176 - RNA, 13 nt, Homo sapiens
uuuuguuaucuga

SEQ ID NO: 2141177 - RNA, 15 nt, Homo sapiens
caaguuauauugaau

SEQ ID NO: 2141178 - RNA, 21 nt, Homo sapiens
gcucccucuguuagguccauu

SEQ ID NO: 2141179 - RNA, 14 nt, Homo sapiens
uacagaccagguga

SEQ ID NO: 2141180 - RNA, 17 nt, Homo sapiens
acuugguccaacugcaa

SEQ ID NO: 2141181 - RNA, 17 nt, Homo sapiens
cuguuuauucauaugca

SEQ ID NO: 2141182 - RNA, 15 nt, Homo sapiens
aucuuacaaaauccu

SEQ ID NO: 2141183 - RNA, 18 nt, Homo sapiens
cuuuuguaagguacugaa

SEQ ID NO: 2141184 - RNA, 20 nt, Homo sapiens
uggcuucagcccccaccagg

SEQ ID NO: 2141185 - RNA, 13 nt, Homo sapiens
cccagcaccucau

SEQ ID NO: 2141186 - RNA, 16 nt, Homo sapiens
augcacuaaaaguagu

SEQ ID NO: 2141187 - RNA, 23 nt, Homo sapiens
ucuucgcugugaugcaugagcuc

SEQ ID NO: 2141188 - RNA, 17 nt, Homo sapiens
ucugccagaccugcaug

SEQ ID NO: 2141189 - RNA, 21 nt, Homo sapiens
uugcuucuuauccuuacacuc

SEQ ID NO: 2141190 - RNA, 21 nt, Homo sapiens
ggcucuuccucuacagccucc

SEQ ID NO: 2141191 - RNA, 22 nt, Homo sapiens
cagggcucagccuggugggccu

SEQ ID NO: 2141192 - RNA, 19 nt, Homo sapiens
ggccaucaggacuuucccu

SEQ ID NO: 2141193 - RNA, 21 nt, Homo sapiens
auaaaaacccuguauggcacu

SEQ ID NO: 2141194 - RNA, 18 nt, Homo sapiens
ccugacuccugacuugua

SEQ ID NO: 2141195 - RNA, 12 nt, Homo sapiens
ggccacacagaa

SEQ ID NO: 2141196 - RNA, 22 nt, Homo sapiens
ucgggaggcugaggcggaagaa

SEQ ID NO: 2141197 - RNA, 19 nt, Homo sapiens
aaaaaugaauugggaacau

SEQ ID NO: 2141198 - RNA, 19 nt, Homo sapiens
ccacagccacuaagauaaa

SEQ ID NO: 2141199 - RNA, 18 nt, Homo sapiens
aacccaucgguaggcaaa

SEQ ID NO: 2141200 - RNA, 18 nt, Homo sapiens
cucaggugugggugggag

SEQ ID NO: 2141201 - RNA, 21 nt, Homo sapiens
accagcccgggcuggcccaag

SEQ ID NO: 2141202 - RNA, 16 nt, Homo sapiens
cagugcuccugugcag

SEQ ID NO: 2141203 - RNA, 16 nt, Homo sapiens
guuauacaucaauaug

SEQ ID NO: 2141204 - RNA, 20 nt, Homo sapiens
caagcuuauuuaagaucaca

SEQ ID NO: 2141205 - RNA, 14 nt, Homo sapiens
uguuugccucaugc

SEQ ID NO: 2141206 - RNA, 19 nt, Homo sapiens
auaggaaugcuaacaguuc

SEQ ID NO: 2141207 - RNA, 14 nt, Homo sapiens
ugacaggugaugcu

SEQ ID NO: 2141208 - RNA, 23 nt, Homo sapiens
ucacuagccaugauaacugcaau

SEQ ID NO: 2141209 - RNA, 15 nt, Homo sapiens
aauuuucaguucuau

SEQ ID NO: 2141210 - RNA, 13 nt, Homo sapiens
aauaugccaagau

SEQ ID NO: 2141211 - RNA, 17 nt, Homo sapiens
aacucuucuuugcugca

SEQ ID NO: 2141212 - RNA, 14 nt, Homo sapiens
gauuccauccugug

SEQ ID NO: 2141213 - RNA, 18 nt, Homo sapiens
ucggacuauacugcugag

SEQ ID NO: 2141214 - RNA, 20 nt, Homo sapiens
ugucagugacuuugagcuga

SEQ ID NO: 2141215 - RNA, 20 nt, Homo sapiens
aaugucaguguucagccaaa

SEQ ID NO: 2141216 - RNA, 20 nt, Homo sapiens
ccaucaaaccucacauuugu

SEQ ID NO: 2141217 - RNA, 21 nt, Homo sapiens
aauguuaacacucaugaagca

SEQ ID NO: 2141218 - RNA, 17 nt, Homo sapiens
accaaaacaccccaacu

SEQ ID NO: 2141219 - RNA, 15 nt, Homo sapiens
gguuccagacagggu

SEQ ID NO: 2141220 - RNA, 15 nt, Homo sapiens
acccauuuugaauau

SEQ ID NO: 2141221 - RNA, 19 nt, Homo sapiens
uuuucacuuuuggucuccu

SEQ ID NO: 2141222 - RNA, 14 nt, Homo sapiens
guccaugugauaau

SEQ ID NO: 2141223 - RNA, 20 nt, Homo sapiens
cagcucaaaggcacagugaa

SEQ ID NO: 2141224 - RNA, 14 nt, Homo sapiens
cuuucacuacucaa

SEQ ID NO: 2141225 - RNA, 16 nt, Homo sapiens
uaggaacgguaaauuu

SEQ ID NO: 2141226 - RNA, 15 nt, Homo sapiens
gagaaugaauucuga

SEQ ID NO: 2141227 - RNA, 14 nt, Homo sapiens
ggaaggcaccugcu

SEQ ID NO: 2141228 - RNA, 15 nt, Homo sapiens
gucagacagauguca

SEQ ID NO: 2141229 - RNA, 17 nt, Homo sapiens
uggaacccaagccucau

SEQ ID NO: 2141230 - RNA, 22 nt, Homo sapiens
aacugugacauuccacagaguu

SEQ ID NO: 2141231 - RNA, 14 nt, Homo sapiens
aguuuuaacuguaa

SEQ ID NO: 2141232 - RNA, 23 nt, Homo sapiens
agaccagcccaccccugugccca

SEQ ID NO: 2141233 - RNA, 13 nt, Homo sapiens
uguuuacuaugca

SEQ ID NO: 2141234 - RNA, 13 nt, Homo sapiens
caaagcuaccuuu

SEQ ID NO: 2141235 - RNA, 15 nt, Homo sapiens
uuguggugucuagca

SEQ ID NO: 2141236 - RNA, 23 nt, Homo sapiens
ggcacucagaaguugugcuaaac

SEQ ID NO: 2141237 - RNA, 17 nt, Homo sapiens
agugagguagugccaau

SEQ ID NO: 2141238 - RNA, 18 nt, Homo sapiens
aauguuauccucuugcua

SEQ ID NO: 2141239 - RNA, 18 nt, Homo sapiens
aguuaucaucucaccaca

SEQ ID NO: 2141240 - RNA, 18 nt, Homo sapiens
aaacacugccauauugug

SEQ ID NO: 2141241 - RNA, 13 nt, Homo sapiens
accuguagugaga

SEQ ID NO: 2141242 - RNA, 19 nt, Homo sapiens
ucuguguuguguccugaca

SEQ ID NO: 2141243 - RNA, 22 nt, Homo sapiens
uccuucucugccucuuaacucc

SEQ ID NO: 2141244 - RNA, 14 nt, Homo sapiens
caaguugcucugua

SEQ ID NO: 2141245 - RNA, 20 nt, Homo sapiens
gcauuuccuaccuugugcuu

SEQ ID NO: 2141246 - RNA, 12 nt, Homo sapiens
cacacacagcca

SEQ ID NO: 2141247 - RNA, 18 nt, Homo sapiens
ggaauucuuucuguugaa

SEQ ID NO: 2141248 - RNA, 19 nt, Homo sapiens
aauguuugcugaguuagaa

SEQ ID NO: 2141249 - RNA, 16 nt, Homo sapiens
ucacagcuggacccug

SEQ ID NO: 2141250 - RNA, 22 nt, Homo sapiens
gcagacagguguauggagucac

SEQ ID NO: 2141251 - RNA, 22 nt, Homo sapiens
uuauauucccaaaucucaaaag

SEQ ID NO: 2141252 - RNA, 15 nt, Homo sapiens
cucuggguuucauau

SEQ ID NO: 2141253 - RNA, 20 nt, Homo sapiens
cucaaagcaccugaacaguu

SEQ ID NO: 2141254 - RNA, 18 nt, Homo sapiens
cucugcacuccauggcca

SEQ ID NO: 2141255 - RNA, 17 nt, Homo sapiens
ccaagaggucuccauca

SEQ ID NO: 2141256 - RNA, 23 nt, Homo sapiens
aucccaauaaaguccucuucccu

SEQ ID NO: 2141257 - RNA, 21 nt, Homo sapiens
ucugcauccuuuucaaaaccu

SEQ ID NO: 2141258 - RNA, 15 nt, Homo sapiens
cccucacuguugaau

SEQ ID NO: 2141259 - RNA, 21 nt, Homo sapiens
cuuuuuauuucucugugggcu

SEQ ID NO: 2141260 - RNA, 19 nt, Homo sapiens
gaagacccuugugcauugu

SEQ ID NO: 2141261 - RNA, 19 nt, Homo sapiens
auaacuggaaaacagaaca

SEQ ID NO: 2141262 - RNA, 19 nt, Homo sapiens
acuucugguauaauugugu

SEQ ID NO: 2141263 - RNA, 16 nt, Homo sapiens
ucagcgguugccagga

SEQ ID NO: 2141264 - RNA, 17 nt, Homo sapiens
cauuucugucacucaca

SEQ ID NO: 2141265 - RNA, 17 nt, Homo sapiens
uuccuucagcacuuuag

SEQ ID NO: 2141266 - RNA, 17 nt, Homo sapiens
aucuucuaucauuccaa

SEQ ID NO: 2141267 - RNA, 20 nt, Homo sapiens
ggcugcuuggagcagccuaa

SEQ ID NO: 2141268 - RNA, 16 nt, Homo sapiens
uguaauacacauaucu

SEQ ID NO: 2141269 - RNA, 20 nt, Homo sapiens
agccacgguguucugugaua

SEQ ID NO: 2141270 - RNA, 12 nt, Homo sapiens
cacacacacaaa

SEQ ID NO: 2141271 - RNA, 12 nt, Homo sapiens
aacacacaaaaa

SEQ ID NO: 2141272 - RNA, 12 nt, Homo sapiens
ccaccacacccc

SEQ ID NO: 2141273 - RNA, 19 nt, Homo sapiens
uauggaauugauuugcauu

SEQ ID NO: 2141274 - RNA, 16 nt, Homo sapiens
uuugaggcaaaggcca

SEQ ID NO: 2141275 - RNA, 20 nt, Homo sapiens
cuaaagaaaaacuaauguca

SEQ ID NO: 2141276 - RNA, 13 nt, Homo sapiens
gcagcucuuggga

SEQ ID NO: 2141277 - RNA, 18 nt, Homo sapiens
agcuuuuccucaccagga

SEQ ID NO: 2141278 - RNA, 15 nt, Homo sapiens
aacccaaaucuuguu

SEQ ID NO: 2141279 - RNA, 18 nt, Homo sapiens
uagaccaauuacugcacu

SEQ ID NO: 2141280 - RNA, 23 nt, Homo sapiens
uaaacauauuuuuauacuuuauu

SEQ ID NO: 2141281 - RNA, 16 nt, Homo sapiens
caacugagauguuaaa

SEQ ID NO: 2141282 - RNA, 22 nt, Homo sapiens
acccuguccggcccagugccac

SEQ ID NO: 2141283 - RNA, 19 nt, Homo sapiens
cauguaaaugcucaaagau

SEQ ID NO: 2141284 - RNA, 16 nt, Homo sapiens
gaauaguaugaugcuu

SEQ ID NO: 2141285 - RNA, 17 nt, Homo sapiens
gaguuauauguucacug

SEQ ID NO: 2141286 - RNA, 19 nt, Homo sapiens
agagaauguuccagacauu

SEQ ID NO: 2141287 - RNA, 22 nt, Homo sapiens
aauccaguccagauauuucaca

SEQ ID NO: 2141288 - RNA, 17 nt, Homo sapiens
aaagugucucugagaau

SEQ ID NO: 2141289 - RNA, 14 nt, Homo sapiens
aaagugcaugaugg

SEQ ID NO: 2141290 - RNA, 14 nt, Homo sapiens
cuuucaaacauaua

SEQ ID NO: 2141291 - RNA, 14 nt, Homo sapiens
ggaucccaacaguu

SEQ ID NO: 2141292 - RNA, 18 nt, Homo sapiens
cuauaggccaaugcauga

SEQ ID NO: 2141293 - RNA, 17 nt, Homo sapiens
gucuuccggucauucuu

SEQ ID NO: 2141294 - RNA, 20 nt, Homo sapiens
aacuugauggcuaacuuaca

SEQ ID NO: 2141295 - RNA, 14 nt, Homo sapiens
uccugaacucccag

SEQ ID NO: 2141296 - RNA, 17 nt, Homo sapiens
uuuccuagcuguguuau

SEQ ID NO: 2141297 - RNA, 15 nt, Homo sapiens
uaccuuaauuugacu

SEQ ID NO: 2141298 - RNA, 14 nt, Homo sapiens
ggauccgcugccac

SEQ ID NO: 2141299 - RNA, 18 nt, Homo sapiens
acacuucucaggacacag

SEQ ID NO: 2141300 - RNA, 15 nt, Homo sapiens
uggaauugacugccu

SEQ ID NO: 2141301 - RNA, 17 nt, Homo sapiens
augaggcuacagaacua

SEQ ID NO: 2141302 - RNA, 16 nt, Homo sapiens
augcuccagcacucaa

SEQ ID NO: 2141303 - RNA, 17 nt, Homo sapiens
uuuugaaauuaaccucu

SEQ ID NO: 2141304 - RNA, 12 nt, Homo sapiens
uuuccugauaca

SEQ ID NO: 2141305 - RNA, 11 nt, Homo sapiens
caaauuugaug

SEQ ID NO: 2141306 - RNA, 20 nt, Homo sapiens
agcuuucccuggcucaggga

SEQ ID NO: 2141307 - RNA, 23 nt, Homo sapiens
cuuguuccccacugacagccucc

SEQ ID NO: 2141308 - RNA, 14 nt, Homo sapiens
aggccaacugccuc

SEQ ID NO: 2141309 - RNA, 20 nt, Homo sapiens
agaaauugaaaaugaccaaa

SEQ ID NO: 2141310 - RNA, 15 nt, Homo sapiens
acuuucuucuuccca

SEQ ID NO: 2141311 - RNA, 13 nt, Homo sapiens
agaaaauaugaua

SEQ ID NO: 2141312 - RNA, 21 nt, Homo sapiens
ccauggaggccagugccagca

SEQ ID NO: 2141313 - RNA, 19 nt, Homo sapiens
ccaaucuacuuuguugcua

SEQ ID NO: 2141314 - RNA, 18 nt, Homo sapiens
auagaguuuaacagauau

SEQ ID NO: 2141315 - RNA, 15 nt, Homo sapiens
gagaaggcacacaga

SEQ ID NO: 2141316 - RNA, 22 nt, Homo sapiens
cagaugcauauagacacacaua

SEQ ID NO: 2141317 - RNA, 20 nt, Homo sapiens
agccaggagugcggacacca

SEQ ID NO: 2141318 - RNA, 20 nt, Homo sapiens
aggaauuggccgcugucacu

SEQ ID NO: 2141319 - RNA, 16 nt, Homo sapiens
uggaccaccauuggaa

SEQ ID NO: 2141320 - RNA, 21 nt, Homo sapiens
acuguuggaaguucacuggag

SEQ ID NO: 2141321 - RNA, 21 nt, Homo sapiens
uagucaaucaaacagggacac

SEQ ID NO: 2141322 - RNA, 15 nt, Homo sapiens
guucaaaacauucca

SEQ ID NO: 2141323 - RNA, 17 nt, Homo sapiens
aucagguagacuuuuaa

SEQ ID NO: 2141324 - RNA, 14 nt, Homo sapiens
aaauugaagcaacu

SEQ ID NO: 2141325 - RNA, 12 nt, Homo sapiens
accucuugccuc

SEQ ID NO: 2141326 - RNA, 20 nt, Homo sapiens
cucugagcaaauguggcucc

SEQ ID NO: 2141327 - RNA, 13 nt, Homo sapiens
guauuucucagga

SEQ ID NO: 2141328 - RNA, 21 nt, Homo sapiens
caauguuucuguuucuuaaau

SEQ ID NO: 2141329 - RNA, 23 nt, Homo sapiens
gagcaguagcagcagcaucucug

SEQ ID NO: 2141330 - RNA, 22 nt, Homo sapiens
uccccuccacugucacauugua

SEQ ID NO: 2141331 - RNA, 17 nt, Homo sapiens
gcauuaaauuuuagcaa

SEQ ID NO: 2141332 - RNA, 18 nt, Homo sapiens
aauaaaguucuguacuca

SEQ ID NO: 2141333 - RNA, 21 nt, Homo sapiens
gccaucggucuagaaccacua

SEQ ID NO: 2141334 - RNA, 21 nt, Homo sapiens
uccaacagaccuggugcucua

SEQ ID NO: 2141335 - RNA, 17 nt, Homo sapiens
auauguuuucacuguau

SEQ ID NO: 2141336 - RNA, 16 nt, Homo sapiens
aacaugaaacuuguca

SEQ ID NO: 2141337 - RNA, 22 nt, Homo sapiens
gacaugagucuguaggagcaag

SEQ ID NO: 2141338 - RNA, 19 nt, Homo sapiens
gaggguaaauaaaccacug

SEQ ID NO: 2141339 - RNA, 16 nt, Homo sapiens
cugugaauauguguaa

SEQ ID NO: 2141340 - RNA, 18 nt, Homo sapiens
ggccugugcgugccaucc

SEQ ID NO: 2141341 - RNA, 15 nt, Homo sapiens
agaauguaacuccag

SEQ ID NO: 2141342 - RNA, 22 nt, Homo sapiens
uguuaggagaugucaucaagcu

SEQ ID NO: 2141343 - RNA, 18 nt, Homo sapiens
augguaaagagaugucaa

SEQ ID NO: 2141344 - RNA, 16 nt, Homo sapiens
cacauccugugucaga

SEQ ID NO: 2141345 - RNA, 22 nt, Homo sapiens
ugcaguaucucuugcugggaac

SEQ ID NO: 2141346 - RNA, 15 nt, Homo sapiens
ggauuuucacauucu

SEQ ID NO: 2141347 - RNA, 18 nt, Homo sapiens
gccuccuauccaccacug

SEQ ID NO: 2141348 - RNA, 16 nt, Homo sapiens
cuuguguccacuguga

SEQ ID NO: 2141349 - RNA, 17 nt, Homo sapiens
uacaucucuacuaaaaa

SEQ ID NO: 2141350 - RNA, 13 nt, Homo sapiens
cagcagaggcacu

SEQ ID NO: 2141351 - RNA, 15 nt, Homo sapiens
gcuggaguccagugc

SEQ ID NO: 2141352 - RNA, 20 nt, Homo sapiens
gaaucauugcuuaugacaug

SEQ ID NO: 2141353 - RNA, 14 nt, Homo sapiens
auccugaaagccag

SEQ ID NO: 2141354 - RNA, 22 nt, Homo sapiens
aaugagguugggggaaccagca

SEQ ID NO: 2141355 - RNA, 23 nt, Homo sapiens
ucacuggccaagaaaauugccuu

SEQ ID NO: 2141356 - RNA, 13 nt, Homo sapiens
guuucuguucucc

SEQ ID NO: 2141357 - RNA, 15 nt, Homo sapiens
ugacucaucaggcag

SEQ ID NO: 2141358 - RNA, 20 nt, Homo sapiens
cacauuaucgggagcagugu

SEQ ID NO: 2141359 - RNA, 16 nt, Homo sapiens
auacaacugagucucg

SEQ ID NO: 2141360 - RNA, 13 nt, Homo sapiens
cauuaacaaugac

SEQ ID NO: 2141361 - RNA, 22 nt, Homo sapiens
auaauaacuuuauugcauauag

SEQ ID NO: 2141362 - RNA, 21 nt, Homo sapiens
ucucuccuuuccuuuugucua

SEQ ID NO: 2141363 - RNA, 16 nt, Homo sapiens
cucugcacauacgcac

SEQ ID NO: 2141364 - RNA, 16 nt, Homo sapiens
ugccucuucuaccucu

SEQ ID NO: 2141365 - RNA, 22 nt, Homo sapiens
gcacacucaaguccugcaguca

SEQ ID NO: 2141366 - RNA, 21 nt, Homo sapiens
caguuaauuuauuauuuuguu

SEQ ID NO: 2141367 - RNA, 17 nt, Homo sapiens
gaggaugauguaauuaa

SEQ ID NO: 2141368 - RNA, 22 nt, Homo sapiens
aacccgagaaaacaaacccagg

SEQ ID NO: 2141369 - RNA, 19 nt, Homo sapiens
uaaagaacagcugaggcug

SEQ ID NO: 2141370 - RNA, 21 nt, Homo sapiens
agaaaauguuacuucucucau

SEQ ID NO: 2141371 - RNA, 21 nt, Homo sapiens
augugaaaauuacaguccaaa

SEQ ID NO: 2141372 - RNA, 17 nt, Homo sapiens
gacucaggccagugugu

SEQ ID NO: 2141373 - RNA, 21 nt, Homo sapiens
ucuacgugggagucugugcau

SEQ ID NO: 2141374 - RNA, 21 nt, Homo sapiens
uuaaauuauguuuuacuguuc

SEQ ID NO: 2141375 - RNA, 15 nt, Homo sapiens
gaaucacuugaacuc

SEQ ID NO: 2141376 - RNA, 14 nt, Homo sapiens
acacagcaucagcu

SEQ ID NO: 2141377 - RNA, 21 nt, Homo sapiens
agcccuggauggccucugggg

SEQ ID NO: 2141378 - RNA, 22 nt, Homo sapiens
aaaaagcaugaauauuucuuaa

SEQ ID NO: 2141379 - RNA, 17 nt, Homo sapiens
augguagggagcauuug

SEQ ID NO: 2141380 - RNA, 20 nt, Homo sapiens
ugaagcuguugcggacauca

SEQ ID NO: 2141381 - RNA, 13 nt, Homo sapiens
ccuuuuguuaaaa

SEQ ID NO: 2141382 - RNA, 18 nt, Homo sapiens
cauugaaagggaguauua

SEQ ID NO: 2141383 - RNA, 15 nt, Homo sapiens
uuuguuucacauuca

SEQ ID NO: 2141384 - RNA, 22 nt, Homo sapiens
gagcucagcuuccuaggcauua

SEQ ID NO: 2141385 - RNA, 18 nt, Homo sapiens
aauacuaggaaguaaagu

SEQ ID NO: 2141386 - RNA, 22 nt, Homo sapiens
uggcucuugaggcauuuccaga

SEQ ID NO: 2141387 - RNA, 16 nt, Homo sapiens
ucccaacaacaugaaa

SEQ ID NO: 2141388 - RNA, 19 nt, Homo sapiens
gccaugaggccucagugga

SEQ ID NO: 2141389 - RNA, 18 nt, Homo sapiens
aacugaguacaauuguua

SEQ ID NO: 2141390 - RNA, 18 nt, Homo sapiens
ucauguaacacauaaaca

SEQ ID NO: 2141391 - RNA, 18 nt, Homo sapiens
gcauugucuguaaugaca

SEQ ID NO: 2141392 - RNA, 14 nt, Homo sapiens
cccuggagugcagu

SEQ ID NO: 2141393 - RNA, 20 nt, Homo sapiens
aauuucucucagauuuccac

SEQ ID NO: 2141394 - RNA, 12 nt, Homo sapiens
gaacaacacuuc

SEQ ID NO: 2141395 - RNA, 22 nt, Homo sapiens
ucucccaccugguuaccacagu

SEQ ID NO: 2141396 - RNA, 19 nt, Homo sapiens
aaacauugguauauuucca

SEQ ID NO: 2141397 - RNA, 11 nt, Homo sapiens
gucacagauuc

SEQ ID NO: 2141398 - RNA, 20 nt, Homo sapiens
cccccugggcuggggccuca

SEQ ID NO: 2141399 - RNA, 13 nt, Homo sapiens
ccagcauucucag

SEQ ID NO: 2141400 - RNA, 16 nt, Homo sapiens
uuuuggauuauuccuc

SEQ ID NO: 2141401 - RNA, 22 nt, Homo sapiens
gagagagauggacauggcucau

SEQ ID NO: 2141402 - RNA, 22 nt, Homo sapiens
gacacagggcauccaacugaga

SEQ ID NO: 2141403 - RNA, 15 nt, Homo sapiens
gaccgugaggccaga

SEQ ID NO: 2141404 - RNA, 22 nt, Homo sapiens
gaauuuacuuuggaaaguagaa

SEQ ID NO: 2141405 - RNA, 17 nt, Homo sapiens
gcaaggccucugccccu

SEQ ID NO: 2141406 - RNA, 17 nt, Homo sapiens
uucucuuggacauugua

SEQ ID NO: 2141407 - RNA, 19 nt, Homo sapiens
aggccucugcuggcucagg

SEQ ID NO: 2141408 - RNA, 19 nt, Homo sapiens
ccaugcagagcgccgugag

SEQ ID NO: 2141409 - RNA, 12 nt, Homo sapiens
gcccucacagag

SEQ ID NO: 2141410 - RNA, 20 nt, Homo sapiens
uaagguaaaaccaucuagga

SEQ ID NO: 2141411 - RNA, 14 nt, Homo sapiens
aaggaacaucucug

SEQ ID NO: 2141412 - RNA, 20 nt, Homo sapiens
ccuucguguggcuccuggua

SEQ ID NO: 2141413 - RNA, 12 nt, Homo sapiens
cuuugugcugug

SEQ ID NO: 2141414 - RNA, 13 nt, Homo sapiens
cgcaccccagugc

SEQ ID NO: 2141415 - RNA, 22 nt, Homo sapiens
uagaagccuaauugucacauca

SEQ ID NO: 2141416 - RNA, 23 nt, Homo sapiens
acaugugugacugcgcacugagu

SEQ ID NO: 2141417 - RNA, 13 nt, Homo sapiens
caucucauuccaa

SEQ ID NO: 2141418 - RNA, 17 nt, Homo sapiens
augccugcaaucccagc

SEQ ID NO: 2141419 - RNA, 17 nt, Homo sapiens
auggaagccuccaccug

SEQ ID NO: 2141420 - RNA, 16 nt, Homo sapiens
ucggagcuggcugugc

SEQ ID NO: 2141421 - RNA, 19 nt, Homo sapiens
cauuuuuguaaugagccau

SEQ ID NO: 2141422 - RNA, 22 nt, Homo sapiens
aaacauauccuuucaagacaga

SEQ ID NO: 2141423 - RNA, 23 nt, Homo sapiens
uguggaauuuuccacuucuggca

SEQ ID NO: 2141424 - RNA, 20 nt, Homo sapiens
ugcugaagaggguugguaua

SEQ ID NO: 2141425 - RNA, 21 nt, Homo sapiens
ugccccucgcucgguccggcu

SEQ ID NO: 2141426 - RNA, 15 nt, Homo sapiens
cuaugauaugugcuu

SEQ ID NO: 2141427 - RNA, 16 nt, Homo sapiens
uuuuauuacacauuua

SEQ ID NO: 2141428 - RNA, 16 nt, Homo sapiens
ugaguauaaauuuacu

SEQ ID NO: 2141429 - RNA, 20 nt, Homo sapiens
aagggugagacuccaucuca

SEQ ID NO: 2141430 - RNA, 17 nt, Homo sapiens
gagaugcggaaagcccu

SEQ ID NO: 2141431 - RNA, 23 nt, Homo sapiens
cucauguuuaucugagcucuuau

SEQ ID NO: 2141432 - RNA, 17 nt, Homo sapiens
ccauuaggucacuuaag

SEQ ID NO: 2141433 - RNA, 23 nt, Homo sapiens
auacacuucuggcucacaggaaa

SEQ ID NO: 2141434 - RNA, 19 nt, Homo sapiens
cauaauuccuacagcacua

SEQ ID NO: 2141435 - RNA, 18 nt, Homo sapiens
aaagacuuaacugguuca

SEQ ID NO: 2141436 - RNA, 18 nt, Homo sapiens
gauuguugucaggccaua

SEQ ID NO: 2141437 - RNA, 20 nt, Homo sapiens
uggaaaguggugcaugguca

SEQ ID NO: 2141438 - RNA, 15 nt, Homo sapiens
accccauucaugaga

SEQ ID NO: 2141439 - RNA, 24 nt, Homo sapiens
cucuaugaccucgcccuccacaaa

SEQ ID NO: 2141440 - RNA, 21 nt, Homo sapiens
gcuggccuccuaugccucauc

SEQ ID NO: 2141441 - RNA, 20 nt, Homo sapiens
ucauuaagaggcaggucuua

SEQ ID NO: 2141442 - RNA, 19 nt, Homo sapiens
gacuccuaugaucucaggu

SEQ ID NO: 2141443 - RNA, 16 nt, Homo sapiens
ucuaaagagcaucuga

SEQ ID NO: 2141444 - RNA, 20 nt, Homo sapiens
acgcugauccauaaagacaa

SEQ ID NO: 2141445 - RNA, 12 nt, Homo sapiens
gcugaggccaga

SEQ ID NO: 2141446 - RNA, 22 nt, Homo sapiens
gcugccucuugaaugcagggac

SEQ ID NO: 2141447 - RNA, 18 nt, Homo sapiens
cagacuccugugcaacuu

SEQ ID NO: 2141448 - RNA, 18 nt, Homo sapiens
cagucauuuccuacccuu

SEQ ID NO: 2141449 - RNA, 14 nt, Homo sapiens
aggcacgugccugu

SEQ ID NO: 2141450 - RNA, 18 nt, Homo sapiens
gacuggaaaagguggacu

SEQ ID NO: 2141451 - RNA, 18 nt, Homo sapiens
auuuaaaucuuacagauc

SEQ ID NO: 2141452 - RNA, 13 nt, Homo sapiens
aggcuuccuucau

SEQ ID NO: 2141453 - RNA, 11 nt, Homo sapiens
accaugaagcg

SEQ ID NO: 2141454 - RNA, 17 nt, Homo sapiens
gcguggauucaugggga

SEQ ID NO: 2141455 - RNA, 13 nt, Homo sapiens
ggacaccacccag

SEQ ID NO: 2141456 - RNA, 17 nt, Homo sapiens
caaagugcuaggauuac

SEQ ID NO: 2141457 - RNA, 16 nt, Homo sapiens
agucccagcuacucag

SEQ ID NO: 2141458 - RNA, 21 nt, Homo sapiens
aguagagcuuguaauaaauac

SEQ ID NO: 2141459 - RNA, 14 nt, Homo sapiens
ucuaaggcaugcuc

SEQ ID NO: 2141460 - RNA, 19 nt, Homo sapiens
aaaucacaaggcaacugug

SEQ ID NO: 2141461 - RNA, 22 nt, Homo sapiens
ucugggacugugcgcuggacuu

SEQ ID NO: 2141462 - RNA, 17 nt, Homo sapiens
gguauuuaccacagcag

SEQ ID NO: 2141463 - RNA, 15 nt, Homo sapiens
accauccauguauuu

SEQ ID NO: 2141464 - RNA, 17 nt, Homo sapiens
uaguuucugauucacua

SEQ ID NO: 2141465 - RNA, 22 nt, Homo sapiens
accccagauucaugcacuguag

SEQ ID NO: 2141466 - RNA, 14 nt, Homo sapiens
caucaguaguucac

SEQ ID NO: 2141467 - RNA, 21 nt, Homo sapiens
agugcauuuaugagcucuuca

SEQ ID NO: 2141468 - RNA, 18 nt, Homo sapiens
ucuuaaacuaacaauuca

SEQ ID NO: 2141469 - RNA, 19 nt, Homo sapiens
aagagaugugacuacagcc

SEQ ID NO: 2141470 - RNA, 15 nt, Homo sapiens
caggcaaugcuguac

SEQ ID NO: 2141471 - RNA, 23 nt, Homo sapiens
ccgagccagcaagaggaaggggu

SEQ ID NO: 2141472 - RNA, 21 nt, Homo sapiens
uugacgacagugcauuugccu

SEQ ID NO: 2141473 - RNA, 18 nt, Homo sapiens
uugcaggcagaaggcagu

SEQ ID NO: 2141474 - RNA, 21 nt, Homo sapiens
cucuugccugcuccaucucau

SEQ ID NO: 2141475 - RNA, 16 nt, Homo sapiens
cuuggaaaaagaaaga

SEQ ID NO: 2141476 - RNA, 20 nt, Homo sapiens
gccuggaauaaauacguuuu

SEQ ID NO: 2141477 - RNA, 14 nt, Homo sapiens
gcacacugucugcc

SEQ ID NO: 2141478 - RNA, 14 nt, Homo sapiens
auuguaacagacau

SEQ ID NO: 2141479 - RNA, 23 nt, Homo sapiens
gggucugggcugggcaccugacu

SEQ ID NO: 2141480 - RNA, 21 nt, Homo sapiens
aaaggccugcccugaugcucu

SEQ ID NO: 2141481 - RNA, 17 nt, Homo sapiens
ugcuucagcgaaaggga

SEQ ID NO: 2141482 - RNA, 19 nt, Homo sapiens
uauugucuugguugccagu

SEQ ID NO: 2141483 - RNA, 20 nt, Homo sapiens
gcccugggacagggcaaaca

SEQ ID NO: 2141484 - RNA, 21 nt, Homo sapiens
agagcaaaucaauucuaguca

SEQ ID NO: 2141485 - RNA, 19 nt, Homo sapiens
ugacauuccuaaacuaucu

SEQ ID NO: 2141486 - RNA, 16 nt, Homo sapiens
ucaggagccaccagca

SEQ ID NO: 2141487 - RNA, 22 nt, Homo sapiens
ugucauaaacgauucugagcca

SEQ ID NO: 2141488 - RNA, 23 nt, Homo sapiens
ccacaaagcacaguuugaacaaa

SEQ ID NO: 2141489 - RNA, 14 nt, Homo sapiens
uuauuaaauacaaa

SEQ ID NO: 2141490 - RNA, 14 nt, Homo sapiens
caauuaaacucaaa

SEQ ID NO: 2141491 - RNA, 19 nt, Homo sapiens
aagugguccacaagcuucu

SEQ ID NO: 2141492 - RNA, 20 nt, Homo sapiens
cauggcucugaacugcacaa

SEQ ID NO: 2141493 - RNA, 19 nt, Homo sapiens
gugguuuguagacuuccuu

SEQ ID NO: 2141494 - RNA, 14 nt, Homo sapiens
acuggccucuguga

SEQ ID NO: 2141495 - RNA, 18 nt, Homo sapiens
cucuugccuaaguauucc

SEQ ID NO: 2141496 - RNA, 14 nt, Homo sapiens
aauuguugugugua

SEQ ID NO: 2141497 - RNA, 13 nt, Homo sapiens
ucucacauauaca

SEQ ID NO: 2141498 - RNA, 13 nt, Homo sapiens
acaaucauuuuau

SEQ ID NO: 2141499 - RNA, 18 nt, Homo sapiens
ucucaauaaucaaugaag

SEQ ID NO: 2141500 - RNA, 15 nt, Homo sapiens
augcacaccaaaaaa

SEQ ID NO: 2141501 - RNA, 22 nt, Homo sapiens
ucuguuucuuaagggcacacac

SEQ ID NO: 2141502 - RNA, 15 nt, Homo sapiens
gacagucaggguuca

SEQ ID NO: 2141503 - RNA, 20 nt, Homo sapiens
gaaagacaggaguuuaucua

SEQ ID NO: 2141504 - RNA, 21 nt, Homo sapiens
ccauguccugaaaaaugcuca

SEQ ID NO: 2141505 - RNA, 18 nt, Homo sapiens
agcugaucauaagugaau

SEQ ID NO: 2141506 - RNA, 19 nt, Homo sapiens
aaaugaaguuuugauuuau

SEQ ID NO: 2141507 - RNA, 19 nt, Homo sapiens
aaguacugaaauacauaug

SEQ ID NO: 2141508 - RNA, 19 nt, Homo sapiens
ucuuccagauuuccuuuca

SEQ ID NO: 2141509 - RNA, 18 nt, Homo sapiens
caaauuucaucuuuccaa

SEQ ID NO: 2141510 - RNA, 20 nt, Homo sapiens
aaauaaccccaaaaugaaga

SEQ ID NO: 2141511 - RNA, 17 nt, Homo sapiens
uucuuuguaccaucugu

SEQ ID NO: 2141512 - RNA, 14 nt, Homo sapiens
uccucccagugaga

SEQ ID NO: 2141513 - RNA, 19 nt, Homo sapiens
gcgugcucccgaugcugcu

SEQ ID NO: 2141514 - RNA, 14 nt, Homo sapiens
gaaaaacaacccag

SEQ ID NO: 2141515 - RNA, 10 nt, Homo sapiens
ucucucugca

SEQ ID NO: 2141516 - RNA, 16 nt, Homo sapiens
cccauccccaccagcu

SEQ ID NO: 2141517 - RNA, 16 nt, Homo sapiens
uaccacauuccaugac

SEQ ID NO: 2141518 - RNA, 16 nt, Homo sapiens
gacaugcugcccaccc

SEQ ID NO: 2141519 - RNA, 16 nt, Homo sapiens
cuccagcugacagcca

SEQ ID NO: 2141520 - RNA, 12 nt, Homo sapiens
cgugaaacacaa

SEQ ID NO: 2141521 - RNA, 16 nt, Homo sapiens
aaauacugaauuagua

SEQ ID NO: 2141522 - RNA, 19 nt, Homo sapiens
ugagccaccguguccuugu

SEQ ID NO: 2141523 - RNA, 13 nt, Homo sapiens
cgagagagggaaa

SEQ ID NO: 2141524 - RNA, 21 nt, Homo sapiens
auaccacuaguggaaagucag

SEQ ID NO: 2141525 - RNA, 22 nt, Homo sapiens
ucacaguacuucccaacaacuc

SEQ ID NO: 2141526 - RNA, 14 nt, Homo sapiens
uuaaauguguuccu

SEQ ID NO: 2141527 - RNA, 20 nt, Homo sapiens
ggaccacucagccccuagga

SEQ ID NO: 2141528 - RNA, 21 nt, Homo sapiens
cgguuggaggcucucaugucu

SEQ ID NO: 2141529 - RNA, 18 nt, Homo sapiens
ugaucaaaggacaaagac

SEQ ID NO: 2141530 - RNA, 17 nt, Homo sapiens
ccacaggagcguguccu

SEQ ID NO: 2141531 - RNA, 20 nt, Homo sapiens
uguauuuccagugcaauugu

SEQ ID NO: 2141532 - RNA, 17 nt, Homo sapiens
caucaagaauuuaauga

SEQ ID NO: 2141533 - RNA, 16 nt, Homo sapiens
augaaagggcaaagac

SEQ ID NO: 2141534 - RNA, 14 nt, Homo sapiens
cagggcaccagagg

SEQ ID NO: 2141535 - RNA, 14 nt, Homo sapiens
ugugucacuguaug

SEQ ID NO: 2141536 - RNA, 22 nt, Homo sapiens
auuuuccaguaggaaaagcaau

SEQ ID NO: 2141537 - RNA, 19 nt, Homo sapiens
uccuggccaacauggugaa

SEQ ID NO: 2141538 - RNA, 18 nt, Homo sapiens
cuugccuuccugccuagu

SEQ ID NO: 2141539 - RNA, 13 nt, Homo sapiens
uacaccugaguca

SEQ ID NO: 2141540 - RNA, 22 nt, Homo sapiens
aaauacuuaggaaggauccgca

SEQ ID NO: 2141541 - RNA, 19 nt, Homo sapiens
agccauuucggaagacacc

SEQ ID NO: 2141542 - RNA, 14 nt, Homo sapiens
ccagagcacaagaa

SEQ ID NO: 2141543 - RNA, 22 nt, Homo sapiens
uuucaaggcacucuagauucca

SEQ ID NO: 2141544 - RNA, 17 nt, Homo sapiens
cagugcugaauuucccu

SEQ ID NO: 2141545 - RNA, 19 nt, Homo sapiens
aaaacauucuuuaacauac

SEQ ID NO: 2141546 - RNA, 16 nt, Homo sapiens
aagcuacugaauuuau

SEQ ID NO: 2141547 - RNA, 15 nt, Homo sapiens
caggauuuuaucucc

SEQ ID NO: 2141548 - RNA, 22 nt, Homo sapiens
gaccugaauaccacuuaccuca

SEQ ID NO: 2141549 - RNA, 18 nt, Homo sapiens
aucuuauacuguacaaua

SEQ ID NO: 2141550 - RNA, 23 nt, Homo sapiens
cuagucuauggucaguugaggaa

SEQ ID NO: 2141551 - RNA, 19 nt, Homo sapiens
ucaccauguugcccaggcu

SEQ ID NO: 2141552 - RNA, 14 nt, Homo sapiens
ucugaaaauuccag

SEQ ID NO: 2141553 - RNA, 23 nt, Homo sapiens
ccugaggcagguccccagacucc

SEQ ID NO: 2141554 - RNA, 18 nt, Homo sapiens
uucccuguuuucccccca

SEQ ID NO: 2141555 - RNA, 19 nt, Homo sapiens
aaugauuuagguacgucaa

SEQ ID NO: 2141556 - RNA, 12 nt, Homo sapiens
aaaauaauucua

SEQ ID NO: 2141557 - RNA, 15 nt, Homo sapiens
uccgcuuugcuugcu

SEQ ID NO: 2141558 - RNA, 17 nt, Homo sapiens
aacuaugugauguuaac

SEQ ID NO: 2141559 - RNA, 17 nt, Homo sapiens
gcucaaugccauugugc

SEQ ID NO: 2141560 - RNA, 23 nt, Homo sapiens
uggcagacaucggccuccaugac

SEQ ID NO: 2141561 - RNA, 13 nt, Homo sapiens
ucagcaugcaucc

SEQ ID NO: 2141562 - RNA, 20 nt, Homo sapiens
gauaacuggcacccagagaa

SEQ ID NO: 2141563 - RNA, 19 nt, Homo sapiens
guauguauuuaaggagaac

SEQ ID NO: 2141564 - RNA, 11 nt, Homo sapiens
auuauggugaa

SEQ ID NO: 2141565 - RNA, 16 nt, Homo sapiens
augguauuugagaugg

SEQ ID NO: 2141566 - RNA, 16 nt, Homo sapiens
auucuuucagcuauca

SEQ ID NO: 2141567 - RNA, 16 nt, Homo sapiens
cuuaaguacuguagaa

SEQ ID NO: 2141568 - RNA, 14 nt, Homo sapiens
guuaauucuugcca

SEQ ID NO: 2141569 - RNA, 18 nt, Homo sapiens
aagguggacuuccagcuu

SEQ ID NO: 2141570 - RNA, 19 nt, Homo sapiens
caccuguacuggagagcaa

SEQ ID NO: 2141571 - RNA, 20 nt, Homo sapiens
ucccuaaugagaagucaaca

SEQ ID NO: 2141572 - RNA, 16 nt, Homo sapiens
aagguuaacagauaca

SEQ ID NO: 2141573 - RNA, 20 nt, Homo sapiens
ucacuuguuucuacucaaaa

SEQ ID NO: 2141574 - RNA, 15 nt, Homo sapiens
aguaggcuccagaca

SEQ ID NO: 2141575 - RNA, 17 nt, Homo sapiens
auggaggaacaguauua

SEQ ID NO: 2141576 - RNA, 14 nt, Homo sapiens
augguuauaucuaa

SEQ ID NO: 2141577 - RNA, 23 nt, Homo sapiens
uuauauuuccaagaaauauuccu

SEQ ID NO: 2141578 - RNA, 13 nt, Homo sapiens
uguauuuccaaau

SEQ ID NO: 2141579 - RNA, 16 nt, Homo sapiens
caugucgccucugcau

SEQ ID NO: 2141580 - RNA, 20 nt, Homo sapiens
aguaacacccccaucaccuu

SEQ ID NO: 2141581 - RNA, 15 nt, Homo sapiens
uggugguaucaggga

SEQ ID NO: 2141582 - RNA, 20 nt, Homo sapiens
uuaagcuuuuuuuuuuugaa

SEQ ID NO: 2141583 - RNA, 23 nt, Homo sapiens
gcauaaagaauuugucacaggaa

SEQ ID NO: 2141584 - RNA, 16 nt, Homo sapiens
ugcucccuagccagag

SEQ ID NO: 2141585 - RNA, 17 nt, Homo sapiens
aauugucacaucaagca

SEQ ID NO: 2141586 - RNA, 13 nt, Homo sapiens
ucccaucugugaa

SEQ ID NO: 2141587 - RNA, 14 nt, Homo sapiens
agcaaucacugggc

SEQ ID NO: 2141588 - RNA, 21 nt, Homo sapiens
cauuuugcagaaaauacauuu

SEQ ID NO: 2141589 - RNA, 22 nt, Homo sapiens
aacuuccuuggacucauuuuaa

SEQ ID NO: 2141590 - RNA, 19 nt, Homo sapiens
cuggggaaacaacauuuau

SEQ ID NO: 2141591 - RNA, 18 nt, Homo sapiens
gcuuaugcuuguguauau

SEQ ID NO: 2141592 - RNA, 13 nt, Homo sapiens
ucccuaugucaug

SEQ ID NO: 2141593 - RNA, 17 nt, Homo sapiens
cuugucuuauuugcuau

SEQ ID NO: 2141594 - RNA, 16 nt, Homo sapiens
aacuuauggacuguuu

SEQ ID NO: 2141595 - RNA, 22 nt, Homo sapiens
ggaaaccuguuaugccaaacag

SEQ ID NO: 2141596 - RNA, 15 nt, Homo sapiens
aacagggggcaaaga

SEQ ID NO: 2141597 - RNA, 16 nt, Homo sapiens
agguauuuuguaauau

SEQ ID NO: 2141598 - RNA, 14 nt, Homo sapiens
cagauaugcuuacu

SEQ ID NO: 2141599 - RNA, 23 nt, Homo sapiens
aauacucucugaguacauugugc

SEQ ID NO: 2141600 - RNA, 19 nt, Homo sapiens
augucauguggcuaccugu

SEQ ID NO: 2141601 - RNA, 15 nt, Homo sapiens
gccuuuccucagugu

SEQ ID NO: 2141602 - RNA, 14 nt, Homo sapiens
acauuuggcauuug

SEQ ID NO: 2141603 - RNA, 21 nt, Homo sapiens
accugagggugcuuuguguaa

SEQ ID NO: 2141604 - RNA, 20 nt, Homo sapiens
uucucucuccagucuuccac

SEQ ID NO: 2141605 - RNA, 14 nt, Homo sapiens
uaaccuuugcugua

SEQ ID NO: 2141606 - RNA, 23 nt, Homo sapiens
acaauaguaauucucaggccauc

SEQ ID NO: 2141607 - RNA, 18 nt, Homo sapiens
augugaauuauugacacu

SEQ ID NO: 2141608 - RNA, 21 nt, Homo sapiens
aaagcuucccucucagcugcu

SEQ ID NO: 2141609 - RNA, 22 nt, Homo sapiens
gcccucuccucccccuccuagg

SEQ ID NO: 2141610 - RNA, 19 nt, Homo sapiens
ugacuguccuacaauauca

SEQ ID NO: 2141611 - RNA, 21 nt, Homo sapiens
gccguuugcuuaaugccagaa

SEQ ID NO: 2141612 - RNA, 13 nt, Homo sapiens
cacuuccuugccc

SEQ ID NO: 2141613 - RNA, 18 nt, Homo sapiens
acucaguggagccaggcu

SEQ ID NO: 2141614 - RNA, 13 nt, Homo sapiens
ccaacuuuugcau

SEQ ID NO: 2141615 - RNA, 14 nt, Homo sapiens
guaacaucuguuau

SEQ ID NO: 2141616 - RNA, 17 nt, Homo sapiens
acgagcguucaaacugc

SEQ ID NO: 2141617 - RNA, 14 nt, Homo sapiens
uaaguucagcacuu

SEQ ID NO: 2141618 - RNA, 18 nt, Homo sapiens
acagcugggaccacaggu

SEQ ID NO: 2141619 - RNA, 12 nt, Homo sapiens
uuccauuugggu

SEQ ID NO: 2141620 - RNA, 13 nt, Homo sapiens
auaauuacuuucc

SEQ ID NO: 2141621 - RNA, 13 nt, Homo sapiens
uuuaauagucauu

SEQ ID NO: 2141622 - RNA, 23 nt, Homo sapiens
ucuccaacgaauagcuccucuac

SEQ ID NO: 2141623 - RNA, 15 nt, Homo sapiens
auacugaaugggaaa

SEQ ID NO: 2141624 - RNA, 13 nt, Homo sapiens
cacuucauaucca

SEQ ID NO: 2141625 - RNA, 14 nt, Homo sapiens
gaauugaaacugag

SEQ ID NO: 2141626 - RNA, 21 nt, Homo sapiens
ucauuagcuuugggugccuuu

SEQ ID NO: 2141627 - RNA, 13 nt, Homo sapiens
ugauuguagcuau

SEQ ID NO: 2141628 - RNA, 14 nt, Homo sapiens
uuggaacagugaau

SEQ ID NO: 2141629 - RNA, 14 nt, Homo sapiens
uuggaucagugaaa

SEQ ID NO: 2141630 - RNA, 20 nt, Homo sapiens
auccagaccucuacaagcaa

SEQ ID NO: 2141631 - RNA, 23 nt, Homo sapiens
gaugauuuuguaauucuuaugac

SEQ ID NO: 2141632 - RNA, 17 nt, Homo sapiens
cugugaaguuacaugca

SEQ ID NO: 2141633 - RNA, 16 nt, Homo sapiens
aaauguguaagaacaa

SEQ ID NO: 2141634 - RNA, 21 nt, Homo sapiens
aauuauauaacuguauuugaa

SEQ ID NO: 2141635 - RNA, 12 nt, Homo sapiens
guggcucuucag

SEQ ID NO: 2141636 - RNA, 17 nt, Homo sapiens
cacuuagguaccauaug

SEQ ID NO: 2141637 - RNA, 18 nt, Homo sapiens
auaaaauaaaugagcuau

SEQ ID NO: 2141638 - RNA, 17 nt, Homo sapiens
gggguuggaagugcaga

SEQ ID NO: 2141639 - RNA, 12 nt, Homo sapiens
uuagguugugaa

SEQ ID NO: 2141640 - RNA, 20 nt, Homo sapiens
aacuuaaugugcugcugcuu

SEQ ID NO: 2141641 - RNA, 24 nt, Homo sapiens
uaucuuuaccaaaaaccauguugc

SEQ ID NO: 2141642 - RNA, 14 nt, Homo sapiens
auuuaaacucugcc

SEQ ID NO: 2141643 - RNA, 14 nt, Homo sapiens
auuuaucacacaaa

SEQ ID NO: 2141644 - RNA, 14 nt, Homo sapiens
auuugacacacagu

SEQ ID NO: 2141645 - RNA, 20 nt, Homo sapiens
uucacaaaguagcaccaaau

SEQ ID NO: 2141646 - RNA, 17 nt, Homo sapiens
ugcucaaaacacuucca

SEQ ID NO: 2141647 - RNA, 16 nt, Homo sapiens
aauaagaucagacucu

SEQ ID NO: 2141648 - RNA, 12 nt, Homo sapiens
uaagcucuggcu

SEQ ID NO: 2141649 - RNA, 13 nt, Homo sapiens
aagagcaaugugu

SEQ ID NO: 2141650 - RNA, 22 nt, Homo sapiens
auuuauuguuauauuacuugcc

SEQ ID NO: 2141651 - RNA, 12 nt, Homo sapiens
gaauucagcuca

SEQ ID NO: 2141652 - RNA, 18 nt, Homo sapiens
ucccacgaugucaaggac

SEQ ID NO: 2141653 - RNA, 14 nt, Homo sapiens
ccugcccaaugaga

SEQ ID NO: 2141654 - RNA, 14 nt, Homo sapiens
caaccuugcaguau

SEQ ID NO: 2141655 - RNA, 15 nt, Homo sapiens
uuauuggcugagaua

SEQ ID NO: 2141656 - RNA, 22 nt, Homo sapiens
caauauauacuuauagaauuca

SEQ ID NO: 2141657 - RNA, 15 nt, Homo sapiens
cugagucugaauucu

SEQ ID NO: 2141658 - RNA, 14 nt, Homo sapiens
uguaaauacauaaa

SEQ ID NO: 2141659 - RNA, 15 nt, Homo sapiens
cagcugcugugcauu

SEQ ID NO: 2141660 - RNA, 23 nt, Homo sapiens
uauauuagauaaccauauucaca

SEQ ID NO: 2141661 - RNA, 16 nt, Homo sapiens
gaauuuucaucuagga

SEQ ID NO: 2141662 - RNA, 21 nt, Homo sapiens
ugaccuuguaccucucuuuga

SEQ ID NO: 2141663 - RNA, 19 nt, Homo sapiens
gugggaggcccggggcccu

SEQ ID NO: 2141664 - RNA, 16 nt, Homo sapiens
guguaacauccagcuc

SEQ ID NO: 2141665 - RNA, 20 nt, Homo sapiens
uagccacaucacuacaguac

SEQ ID NO: 2141666 - RNA, 13 nt, Homo sapiens
aaacugcuuugag

SEQ ID NO: 2141667 - RNA, 11 nt, Homo sapiens
gggacaggaug

SEQ ID NO: 2141668 - RNA, 16 nt, Homo sapiens
ugaagacaacagcaua

SEQ ID NO: 2141669 - RNA, 12 nt, Homo sapiens
ccuggauaggca

SEQ ID NO: 2141670 - RNA, 16 nt, Homo sapiens
gaucaccaagcaggaa

SEQ ID NO: 2141671 - RNA, 19 nt, Homo sapiens
gaacacuaacucaccagcc

SEQ ID NO: 2141672 - RNA, 19 nt, Homo sapiens
cagucucccauucucauau

SEQ ID NO: 2141673 - RNA, 22 nt, Homo sapiens
auuuggcucuucugacauuuau

SEQ ID NO: 2141674 - RNA, 23 nt, Homo sapiens
ucuuccuccagcaguuacuugau

SEQ ID NO: 2141675 - RNA, 15 nt, Homo sapiens
caaacagaaacacaa

SEQ ID NO: 2141676 - RNA, 18 nt, Homo sapiens
gguguccuguuccugcca

SEQ ID NO: 2141677 - RNA, 17 nt, Homo sapiens
cauccaaggcacuguca

SEQ ID NO: 2141678 - RNA, 16 nt, Homo sapiens
uacaaaaaaauacaaa

SEQ ID NO: 2141679 - RNA, 14 nt, Homo sapiens
aagagucacaauuu

SEQ ID NO: 2141680 - RNA, 16 nt, Homo sapiens
gacacggcggggcccg

SEQ ID NO: 2141681 - RNA, 13 nt, Homo sapiens
uucagccaccucu

SEQ ID NO: 2141682 - RNA, 18 nt, Homo sapiens
acauuaagagauuuucaa

SEQ ID NO: 2141683 - RNA, 18 nt, Homo sapiens
gcuucuggcuccuaccac

SEQ ID NO: 2141684 - RNA, 20 nt, Homo sapiens
aaugcaagcuuauaauguau

SEQ ID NO: 2141685 - RNA, 16 nt, Homo sapiens
cugugcugugucugca

SEQ ID NO: 2141686 - RNA, 15 nt, Homo sapiens
ggaaaagccaucuca

SEQ ID NO: 2141687 - RNA, 12 nt, Homo sapiens
caacccacuuaa

SEQ ID NO: 2141688 - RNA, 21 nt, Homo sapiens
cagggaaugccugagugccug

SEQ ID NO: 2141689 - RNA, 18 nt, Homo sapiens
cugacauuuaucaggcac

SEQ ID NO: 2141690 - RNA, 16 nt, Homo sapiens
acacauuugaaaucau

SEQ ID NO: 2141691 - RNA, 14 nt, Homo sapiens
cuucuguauaacua

SEQ ID NO: 2141692 - RNA, 18 nt, Homo sapiens
gagucucaugaccucuca

SEQ ID NO: 2141693 - RNA, 20 nt, Homo sapiens
gcaccugggccccacuggac

SEQ ID NO: 2141694 - RNA, 16 nt, Homo sapiens
auaacuuuauugcaua

SEQ ID NO: 2141695 - RNA, 19 nt, Homo sapiens
ugauccuaggcauuugcug

SEQ ID NO: 2141696 - RNA, 17 nt, Homo sapiens
caaugugaacuuuauua

SEQ ID NO: 2141697 - RNA, 19 nt, Homo sapiens
cuuuaccagaacgguucuu

SEQ ID NO: 2141698 - RNA, 15 nt, Homo sapiens
gaaagugaacaauca

SEQ ID NO: 2141699 - RNA, 18 nt, Homo sapiens
agcccuaaagaaugcaac

SEQ ID NO: 2141700 - RNA, 12 nt, Homo sapiens
uuuuacauuuca

SEQ ID NO: 2141701 - RNA, 14 nt, Homo sapiens
cccagccaugccag

SEQ ID NO: 2141702 - RNA, 18 nt, Homo sapiens
agcaggggcagaugccac

SEQ ID NO: 2141703 - RNA, 23 nt, Homo sapiens
agacccccuccccuccugugucc

SEQ ID NO: 2141704 - RNA, 12 nt, Homo sapiens
acacagugcagu

SEQ ID NO: 2141705 - RNA, 19 nt, Homo sapiens
cagcugccucugcucccuc

SEQ ID NO: 2141706 - RNA, 18 nt, Homo sapiens
ucuaccaugaacagaaaa

SEQ ID NO: 2141707 - RNA, 18 nt, Homo sapiens
aucuccccucucaccuca

SEQ ID NO: 2141708 - RNA, 12 nt, Homo sapiens
caucuuccauau

SEQ ID NO: 2141709 - RNA, 15 nt, Homo sapiens
cugcaccuuugcacg

SEQ ID NO: 2141710 - RNA, 19 nt, Homo sapiens
agggaacugagcacagggg

SEQ ID NO: 2141711 - RNA, 16 nt, Homo sapiens
cuuauuugaugguggu

SEQ ID NO: 2141712 - RNA, 22 nt, Homo sapiens
ucaaaauuuucuaacaacuuua

SEQ ID NO: 2141713 - RNA, 22 nt, Homo sapiens
cuucauucacuucgccauucau

SEQ ID NO: 2141714 - RNA, 19 nt, Homo sapiens
uccuucgaaaggccuucag

SEQ ID NO: 2141715 - RNA, 16 nt, Homo sapiens
aggaaaggauuuuacc

SEQ ID NO: 2141716 - RNA, 21 nt, Homo sapiens
agacccucaugcugccaauau

SEQ ID NO: 2141717 - RNA, 20 nt, Homo sapiens
caugugcggcggcuaccuga

SEQ ID NO: 2141718 - RNA, 17 nt, Homo sapiens
accaaaaugauacuuac

SEQ ID NO: 2141719 - RNA, 15 nt, Homo sapiens
cuaucucacagcaca

SEQ ID NO: 2141720 - RNA, 21 nt, Homo sapiens
aagucugcagcggugccucac

SEQ ID NO: 2141721 - RNA, 21 nt, Homo sapiens
agauauuuuucaugauuuuga

SEQ ID NO: 2141722 - RNA, 14 nt, Homo sapiens
agagugacaugugc

SEQ ID NO: 2141723 - RNA, 23 nt, Homo sapiens
aagaguauuuuuaacacuuaaau

SEQ ID NO: 2141724 - RNA, 13 nt, Homo sapiens
acgcucucugucu

SEQ ID NO: 2141725 - RNA, 23 nt, Homo sapiens
auccagggaaugaugacaacaau

SEQ ID NO: 2141726 - RNA, 14 nt, Homo sapiens
gauguuuguugcua

SEQ ID NO: 2141727 - RNA, 11 nt, Homo sapiens
aagaaagcaaa

SEQ ID NO: 2141728 - RNA, 20 nt, Homo sapiens
cuacaauuuguuuuugcauu

SEQ ID NO: 2141729 - RNA, 18 nt, Homo sapiens
caucccuuuccugaguca

SEQ ID NO: 2141730 - RNA, 15 nt, Homo sapiens
agacauaaucagcug

SEQ ID NO: 2141731 - RNA, 17 nt, Homo sapiens
ucaacugucuauuguca

SEQ ID NO: 2141732 - RNA, 15 nt, Homo sapiens
aucccuggaaggaca

SEQ ID NO: 2141733 - RNA, 14 nt, Homo sapiens
ggagagaagugagc

SEQ ID NO: 2141734 - RNA, 13 nt, Homo sapiens
gaaaaguagaaag

SEQ ID NO: 2141735 - RNA, 21 nt, Homo sapiens
ucugcuggcagaaagcaaaug

SEQ ID NO: 2141736 - RNA, 18 nt, Homo sapiens
uccucaaagauucugcau

SEQ ID NO: 2141737 - RNA, 15 nt, Homo sapiens
aacccucucuucccu

SEQ ID NO: 2141738 - RNA, 21 nt, Homo sapiens
uaaauacauauggauguuacu

SEQ ID NO: 2141739 - RNA, 15 nt, Homo sapiens
gagggaaagacaaga

SEQ ID NO: 2141740 - RNA, 19 nt, Homo sapiens
agaucgcaucauugcacuc

SEQ ID NO: 2141741 - RNA, 20 nt, Homo sapiens
aagaaaaggcaucacuuucc

SEQ ID NO: 2141742 - RNA, 14 nt, Homo sapiens
uauagcauuuugcu

SEQ ID NO: 2141743 - RNA, 21 nt, Homo sapiens
ucaucauaaaauaaaguauau

SEQ ID NO: 2141744 - RNA, 11 nt, Homo sapiens
aacucuuucau

SEQ ID NO: 2141745 - RNA, 11 nt, Homo sapiens
cuuucuuuauc

SEQ ID NO: 2141746 - RNA, 17 nt, Homo sapiens
gagggcaggguucuaga

SEQ ID NO: 2141747 - RNA, 17 nt, Homo sapiens
agcuaguguaccuccuc

SEQ ID NO: 2141748 - RNA, 14 nt, Homo sapiens
gaaacuugaugcca

SEQ ID NO: 2141749 - RNA, 12 nt, Homo sapiens
caugacugcaau

SEQ ID NO: 2141750 - RNA, 22 nt, Homo sapiens
cacagucucuuuaaucuucagu

SEQ ID NO: 2141751 - RNA, 22 nt, Homo sapiens
acucaauaaauacauguuaaau

SEQ ID NO: 2141752 - RNA, 12 nt, Homo sapiens
cauuaguuucag

SEQ ID NO: 2141753 - RNA, 21 nt, Homo sapiens
gugaacauccccucccaucau

SEQ ID NO: 2141754 - RNA, 19 nt, Homo sapiens
gcugggaagacuauggugc

SEQ ID NO: 2141755 - RNA, 14 nt, Homo sapiens
ggacugauacugca

SEQ ID NO: 2141756 - RNA, 22 nt, Homo sapiens
agaaguccacagacaucuuuca

SEQ ID NO: 2141757 - RNA, 16 nt, Homo sapiens
acacauuucacuguga

SEQ ID NO: 2141758 - RNA, 11 nt, Homo sapiens
aucagccagac

SEQ ID NO: 2141759 - RNA, 11 nt, Homo sapiens
auuagccagau

SEQ ID NO: 2141760 - RNA, 16 nt, Homo sapiens
uaaccagugagcacug

SEQ ID NO: 2141761 - RNA, 13 nt, Homo sapiens
gccagguggcacc

SEQ ID NO: 2141762 - RNA, 18 nt, Homo sapiens
cuagaagugccaucucaa

SEQ ID NO: 2141763 - RNA, 15 nt, Homo sapiens
cgaacauguagcaug

SEQ ID NO: 2141764 - RNA, 23 nt, Homo sapiens
gagccaauugauuucaacagaau

SEQ ID NO: 2141765 - RNA, 15 nt, Homo sapiens
acaugaaaagcaaau

SEQ ID NO: 2141766 - RNA, 16 nt, Homo sapiens
cauagaaacaugacac

SEQ ID NO: 2141767 - RNA, 16 nt, Homo sapiens
auaaguaaaagcccua

SEQ ID NO: 2141768 - RNA, 20 nt, Homo sapiens
acggugucuuguucugucac

SEQ ID NO: 2141769 - RNA, 23 nt, Homo sapiens
ucuggguggcucacucagcacuu

SEQ ID NO: 2141770 - RNA, 13 nt, Homo sapiens
uugaaaauaguua

SEQ ID NO: 2141771 - RNA, 11 nt, Homo sapiens
acaaacccagg

SEQ ID NO: 2141772 - RNA, 14 nt, Homo sapiens
cccaggacccaggu

SEQ ID NO: 2141773 - RNA, 20 nt, Homo sapiens
gcagguuccccaagggcccu

SEQ ID NO: 2141774 - RNA, 20 nt, Homo sapiens
gaacaagaugcacucgcugu

SEQ ID NO: 2141775 - RNA, 13 nt, Homo sapiens
uacaaaaagccaa

SEQ ID NO: 2141776 - RNA, 16 nt, Homo sapiens
ggcugcccacagggaa

SEQ ID NO: 2141777 - RNA, 15 nt, Homo sapiens
uucuguguaccacuu

SEQ ID NO: 2141778 - RNA, 15 nt, Homo sapiens
uuuacgguacuuggu

SEQ ID NO: 2141779 - RNA, 19 nt, Homo sapiens
ugcuauauuaacaucaucu

SEQ ID NO: 2141780 - RNA, 20 nt, Homo sapiens
ucucuuaagaaaaugaugcu

SEQ ID NO: 2141781 - RNA, 22 nt, Homo sapiens
uguaaaauaaaaccaccaaagu

SEQ ID NO: 2141782 - RNA, 13 nt, Homo sapiens
uuuccucagugau

SEQ ID NO: 2141783 - RNA, 14 nt, Homo sapiens
ccucccgggcucaa

SEQ ID NO: 2141784 - RNA, 19 nt, Homo sapiens
gaaauauuacuauaauuga

SEQ ID NO: 2141785 - RNA, 13 nt, Homo sapiens
gauagguaccuga

SEQ ID NO: 2141786 - RNA, 23 nt, Homo sapiens
cagggauuacaggcaugagccac

SEQ ID NO: 2141787 - RNA, 21 nt, Homo sapiens
ucaccguggcuaccauuguca

SEQ ID NO: 2141788 - RNA, 18 nt, Homo sapiens
aguuucacuguacugcau

SEQ ID NO: 2141789 - RNA, 20 nt, Homo sapiens
ggaugaggcacuucugucaa

SEQ ID NO: 2141790 - RNA, 21 nt, Homo sapiens
ugauccagagcagaguuuacg

SEQ ID NO: 2141791 - RNA, 13 nt, Homo sapiens
uuuacacacauga

SEQ ID NO: 2141792 - RNA, 21 nt, Homo sapiens
ccugcucugcuuccucagggc

SEQ ID NO: 2141793 - RNA, 14 nt, Homo sapiens
uuucauuugccggg

SEQ ID NO: 2141794 - RNA, 14 nt, Homo sapiens
uaacuguucccuua

SEQ ID NO: 2141795 - RNA, 15 nt, Homo sapiens
uuuaagugcuaugca

SEQ ID NO: 2141796 - RNA, 22 nt, Homo sapiens
gguugggugugggcagucauca

SEQ ID NO: 2141797 - RNA, 14 nt, Homo sapiens
cuacauguauugca

SEQ ID NO: 2141798 - RNA, 15 nt, Homo sapiens
aacagacacuguaaa

SEQ ID NO: 2141799 - RNA, 22 nt, Homo sapiens
ucauugaggauaaauugccaua

SEQ ID NO: 2141800 - RNA, 13 nt, Homo sapiens
aaguugcugucac

SEQ ID NO: 2141801 - RNA, 14 nt, Homo sapiens
uucuacaacauauu

SEQ ID NO: 2141802 - RNA, 18 nt, Homo sapiens
cuccaacccgacaugugu

SEQ ID NO: 2141803 - RNA, 19 nt, Homo sapiens
guaaaaacaaaaacacacc

SEQ ID NO: 2141804 - RNA, 18 nt, Homo sapiens
gaaaacguuuaaauuacu

SEQ ID NO: 2141805 - RNA, 18 nt, Homo sapiens
caaauauuaggcuuaaaa

SEQ ID NO: 2141806 - RNA, 22 nt, Homo sapiens
ugccuuauggaacacucugaga

SEQ ID NO: 2141807 - RNA, 19 nt, Homo sapiens
gacagcauauaaauguaau

SEQ ID NO: 2141808 - RNA, 14 nt, Homo sapiens
gggucaguaaggaa

SEQ ID NO: 2141809 - RNA, 16 nt, Homo sapiens
uuaccugcugggaccu

SEQ ID NO: 2141810 - RNA, 23 nt, Homo sapiens
ugaaaaggugaagcuggcugugc

SEQ ID NO: 2141811 - RNA, 21 nt, Homo sapiens
agcuugcagugagccgagaua

SEQ ID NO: 2141812 - RNA, 12 nt, Homo sapiens
ccauacauuugu

SEQ ID NO: 2141813 - RNA, 22 nt, Homo sapiens
aaugucuuuuuucaaacuuuau

SEQ ID NO: 2141814 - RNA, 20 nt, Homo sapiens
agaguguguccacugagaag

SEQ ID NO: 2141815 - RNA, 19 nt, Homo sapiens
acaauuaaaaugacaagca

SEQ ID NO: 2141816 - RNA, 23 nt, Homo sapiens
cugcugaaggcagucauaucaaa

SEQ ID NO: 2141817 - RNA, 18 nt, Homo sapiens
aagauuuccuuuggcaau

SEQ ID NO: 2141818 - RNA, 18 nt, Homo sapiens
uccuuaaauuuuuagcca

SEQ ID NO: 2141819 - RNA, 23 nt, Homo sapiens
gugaagcugggagaaccaaaaag

SEQ ID NO: 2141820 - RNA, 21 nt, Homo sapiens
gaaccacucuaucaaguauua

SEQ ID NO: 2141821 - RNA, 24 nt, Homo sapiens
cauuacauuugaacuauauccuuc

SEQ ID NO: 2141822 - RNA, 21 nt, Homo sapiens
cacaucaauuacaagcuguag

SEQ ID NO: 2141823 - RNA, 17 nt, Homo sapiens
uagaauuuugauuccuu

SEQ ID NO: 2141824 - RNA, 15 nt, Homo sapiens
cugcuggccaugaau

SEQ ID NO: 2141825 - RNA, 21 nt, Homo sapiens
ccaagagaugcagugccagga

SEQ ID NO: 2141826 - RNA, 18 nt, Homo sapiens
caggcaugaacauguacu

SEQ ID NO: 2141827 - RNA, 14 nt, Homo sapiens
agguucacaggggu

SEQ ID NO: 2141828 - RNA, 16 nt, Homo sapiens
cccagcccagcucagc

SEQ ID NO: 2141829 - RNA, 19 nt, Homo sapiens
ucaugguacauuuaucacu

SEQ ID NO: 2141830 - RNA, 16 nt, Homo sapiens
ucugccugaagucaca

SEQ ID NO: 2141831 - RNA, 21 nt, Homo sapiens
cucaaagcagcaggacugugg

SEQ ID NO: 2141832 - RNA, 13 nt, Homo sapiens
cagaaacugaugc

SEQ ID NO: 2141833 - RNA, 17 nt, Homo sapiens
uccugccuuucugcaaa

SEQ ID NO: 2141834 - RNA, 17 nt, Homo sapiens
ccuauaaucuuauacaa

SEQ ID NO: 2141835 - RNA, 14 nt, Homo sapiens
ucaaaugcaugaua

SEQ ID NO: 2141836 - RNA, 15 nt, Homo sapiens
cuguacauacugcag

SEQ ID NO: 2141837 - RNA, 15 nt, Homo sapiens
caccaagcucugucc

SEQ ID NO: 2141838 - RNA, 22 nt, Homo sapiens
agugcccaccgcccuccuccac

SEQ ID NO: 2141839 - RNA, 23 nt, Homo sapiens
caucuuuggcaaaggucccugag

SEQ ID NO: 2141840 - RNA, 20 nt, Homo sapiens
guuuuaauuugucacucgga

SEQ ID NO: 2141841 - RNA, 22 nt, Homo sapiens
ugcaguauuuuauuaaagcaac

SEQ ID NO: 2141842 - RNA, 15 nt, Homo sapiens
ugcauugucuaauga

SEQ ID NO: 2141843 - RNA, 17 nt, Homo sapiens
caauaucccuuacuuua

SEQ ID NO: 2141844 - RNA, 14 nt, Homo sapiens
gaaagaacaucagu

SEQ ID NO: 2141845 - RNA, 24 nt, Homo sapiens
cucgguggcauacagacuggggac

SEQ ID NO: 2141846 - RNA, 20 nt, Homo sapiens
uauaagguguuuucugugua

SEQ ID NO: 2141847 - RNA, 16 nt, Homo sapiens
aggguugcuucaauga

SEQ ID NO: 2141848 - RNA, 19 nt, Homo sapiens
auuugcugagcauguacug

SEQ ID NO: 2141849 - RNA, 22 nt, Homo sapiens
acaaaauaacucuccaguaaca

SEQ ID NO: 2141850 - RNA, 11 nt, Homo sapiens
aucaaacauuu

SEQ ID NO: 2141851 - RNA, 13 nt, Homo sapiens
aaaaaguaaucaa

SEQ ID NO: 2141852 - RNA, 16 nt, Homo sapiens
guuuuuaauuguucau

SEQ ID NO: 2141853 - RNA, 12 nt, Homo sapiens
augugcuauuaa

SEQ ID NO: 2141854 - RNA, 15 nt, Homo sapiens
uaauauggacucagc

SEQ ID NO: 2141855 - RNA, 15 nt, Homo sapiens
caagcagagcucaca

SEQ ID NO: 2141856 - RNA, 16 nt, Homo sapiens
aaaggggccucuccuu

SEQ ID NO: 2141857 - RNA, 22 nt, Homo sapiens
ggccugcggaggcgguggcaga

SEQ ID NO: 2141858 - RNA, 17 nt, Homo sapiens
agcucauggacuucugc

SEQ ID NO: 2141859 - RNA, 15 nt, Homo sapiens
gcagaggcuguggug

SEQ ID NO: 2141860 - RNA, 18 nt, Homo sapiens
aacccucacaagcaugaa

SEQ ID NO: 2141861 - RNA, 19 nt, Homo sapiens
cuauucaggaggcugaggc

SEQ ID NO: 2141862 - RNA, 22 nt, Homo sapiens
ucucaaugcuuuccacauuucu

SEQ ID NO: 2141863 - RNA, 21 nt, Homo sapiens
cgagaucacgucacugcacuc

SEQ ID NO: 2141864 - RNA, 18 nt, Homo sapiens
ccuggcuggcaggcaccg

SEQ ID NO: 2141865 - RNA, 22 nt, Homo sapiens
agcccucagcugguccugacca

SEQ ID NO: 2141866 - RNA, 23 nt, Homo sapiens
acgugcgcgcccaggccagugcu

SEQ ID NO: 2141867 - RNA, 19 nt, Homo sapiens
cucagugcuugggcuccac

SEQ ID NO: 2141868 - RNA, 22 nt, Homo sapiens
uguauugacuguaccacagaca

SEQ ID NO: 2141869 - RNA, 19 nt, Homo sapiens
agcagcugauucagcagug

SEQ ID NO: 2141870 - RNA, 18 nt, Homo sapiens
cuugaccaauacugaccc

SEQ ID NO: 2141871 - RNA, 17 nt, Homo sapiens
uaauugcuguucugcug

SEQ ID NO: 2141872 - RNA, 21 nt, Homo sapiens
augccaaccggucacccagga

SEQ ID NO: 2141873 - RNA, 15 nt, Homo sapiens
augauucaagccauu

SEQ ID NO: 2141874 - RNA, 22 nt, Homo sapiens
aauuucuaaaguaaaauugaag

SEQ ID NO: 2141875 - RNA, 22 nt, Homo sapiens
uucacgaguguuccugugcuua

SEQ ID NO: 2141876 - RNA, 23 nt, Homo sapiens
uggaaacacccacucacuuugca

SEQ ID NO: 2141877 - RNA, 17 nt, Homo sapiens
agacuuaaaaacuugaa

SEQ ID NO: 2141878 - RNA, 23 nt, Homo sapiens
cuuccugaagggggacacuccau

SEQ ID NO: 2141879 - RNA, 19 nt, Homo sapiens
aguccuuaggcuacuguaa

SEQ ID NO: 2141880 - RNA, 15 nt, Homo sapiens
aaauauauuguuaau

SEQ ID NO: 2141881 - RNA, 13 nt, Homo sapiens
aaggagaugaaua

SEQ ID NO: 2141882 - RNA, 17 nt, Homo sapiens
gaaauaaugaauauuua

SEQ ID NO: 2141883 - RNA, 22 nt, Homo sapiens
acucuguccuuacauacucaau

SEQ ID NO: 2141884 - RNA, 14 nt, Homo sapiens
caacgggucugugg

SEQ ID NO: 2141885 - RNA, 14 nt, Homo sapiens
gaguaaguguacaa

SEQ ID NO: 2141886 - RNA, 15 nt, Homo sapiens
guuccucccaggaag

SEQ ID NO: 2141887 - RNA, 22 nt, Homo sapiens
uucaaaucacauggaacuuuag

SEQ ID NO: 2141888 - RNA, 17 nt, Homo sapiens
acugacugagcaggcug

SEQ ID NO: 2141889 - RNA, 12 nt, Homo sapiens
aaaugcauuuau

SEQ ID NO: 2141890 - RNA, 19 nt, Homo sapiens
cacagaauauguauguaua

SEQ ID NO: 2141891 - RNA, 17 nt, Homo sapiens
ugugagaaaggaaaaau

SEQ ID NO: 2141892 - RNA, 17 nt, Homo sapiens
ucuugguaauccccuaa

SEQ ID NO: 2141893 - RNA, 12 nt, Homo sapiens
aacaaaaccaag

SEQ ID NO: 2141894 - RNA, 13 nt, Homo sapiens
cugauucaagaac

SEQ ID NO: 2141895 - RNA, 13 nt, Homo sapiens
uaauauugccuug

SEQ ID NO: 2141896 - RNA, 18 nt, Homo sapiens
uugggaaaaaaacuuggc

SEQ ID NO: 2141897 - RNA, 19 nt, Homo sapiens
ucucucuuucccuuuggca

SEQ ID NO: 2141898 - RNA, 12 nt, Homo sapiens
cuauauuugcua

SEQ ID NO: 2141899 - RNA, 23 nt, Homo sapiens
gggccugauuuaucuagcugucc

SEQ ID NO: 2141900 - RNA, 13 nt, Homo sapiens
cuagaaugcacac

SEQ ID NO: 2141901 - RNA, 15 nt, Homo sapiens
gcaagaccagucacu

SEQ ID NO: 2141902 - RNA, 21 nt, Homo sapiens
cuuagcauagauuugcagcuc

SEQ ID NO: 2141903 - RNA, 21 nt, Homo sapiens
ucaguugggagugguugcuau

SEQ ID NO: 2141904 - RNA, 23 nt, Homo sapiens
caguccugggagaaccucaggcu

SEQ ID NO: 2141905 - RNA, 14 nt, Homo sapiens
aguucaucuugaau

SEQ ID NO: 2141906 - RNA, 14 nt, Homo sapiens
aguuauucuugaca

SEQ ID NO: 2141907 - RNA, 22 nt, Homo sapiens
cucuauuucucucuuucuuggu

SEQ ID NO: 2141908 - RNA, 15 nt, Homo sapiens
agagucaugggagag

SEQ ID NO: 2141909 - RNA, 16 nt, Homo sapiens
ugcaaaauagacauau

SEQ ID NO: 2141910 - RNA, 16 nt, Homo sapiens
agaguuuucuaaccca

SEQ ID NO: 2141911 - RNA, 22 nt, Homo sapiens
cauugugaauugccugccaugg

SEQ ID NO: 2141912 - RNA, 20 nt, Homo sapiens
uccuucaaauaaaugcuuug

SEQ ID NO: 2141913 - RNA, 20 nt, Homo sapiens
uucauucaccuaacuuucau

SEQ ID NO: 2141914 - RNA, 22 nt, Homo sapiens
ccaucuuugcugccagcucuca

SEQ ID NO: 2141915 - RNA, 13 nt, Homo sapiens
gcgcagccaugug

SEQ ID NO: 2141916 - RNA, 21 nt, Homo sapiens
acucggaaacuauaaguaauu

SEQ ID NO: 2141917 - RNA, 15 nt, Homo sapiens
auuuaugguaccuau

SEQ ID NO: 2141918 - RNA, 15 nt, Homo sapiens
aggauuuugauccaa

SEQ ID NO: 2141919 - RNA, 16 nt, Homo sapiens
accaauguaacacugg

SEQ ID NO: 2141920 - RNA, 20 nt, Homo sapiens
uacaagaaauaaaucuauau

SEQ ID NO: 2141921 - RNA, 18 nt, Homo sapiens
ucuccuuggccacagacu

SEQ ID NO: 2141922 - RNA, 17 nt, Homo sapiens
auauugaacucaaugau

SEQ ID NO: 2141923 - RNA, 12 nt, Homo sapiens
uuaccuuucaua

SEQ ID NO: 2141924 - RNA, 18 nt, Homo sapiens
gaugaguuuaucauguca

SEQ ID NO: 2141925 - RNA, 20 nt, Homo sapiens
uguaaucccagcacuuuggc

SEQ ID NO: 2141926 - RNA, 21 nt, Homo sapiens
cuggaaagcaggcaagcaugu

SEQ ID NO: 2141927 - RNA, 16 nt, Homo sapiens
aguaucugaggcacau

SEQ ID NO: 2141928 - RNA, 16 nt, Homo sapiens
uuccacuggcuccaca

SEQ ID NO: 2141929 - RNA, 16 nt, Homo sapiens
ucucgaacugcuggau

SEQ ID NO: 2141930 - RNA, 21 nt, Homo sapiens
ucauguugauguguccgugaa

SEQ ID NO: 2141931 - RNA, 22 nt, Homo sapiens
uuauugcaucuguuauucacca

SEQ ID NO: 2141932 - RNA, 19 nt, Homo sapiens
aacauaucaaacauaugua

SEQ ID NO: 2141933 - RNA, 15 nt, Homo sapiens
uccaucuguugacaa

SEQ ID NO: 2141934 - RNA, 14 nt, Homo sapiens
cacccaaugcauau

SEQ ID NO: 2141935 - RNA, 22 nt, Homo sapiens
cguaauguauuuauauguuaau

SEQ ID NO: 2141936 - RNA, 20 nt, Homo sapiens
guagagacaggguuuugcca

SEQ ID NO: 2141937 - RNA, 18 nt, Homo sapiens
uuauuauuuaaacaucag

SEQ ID NO: 2141938 - RNA, 15 nt, Homo sapiens
auuuagaaacaguga

SEQ ID NO: 2141939 - RNA, 18 nt, Homo sapiens
gagaaaaggacuccucag

SEQ ID NO: 2141940 - RNA, 13 nt, Homo sapiens
guucaaggccagc

SEQ ID NO: 2141941 - RNA, 20 nt, Homo sapiens
cauuagccuaugugcaugca

SEQ ID NO: 2141942 - RNA, 15 nt, Homo sapiens
cucagguucuuucca

SEQ ID NO: 2141943 - RNA, 17 nt, Homo sapiens
cauucccucucaucuca

SEQ ID NO: 2141944 - RNA, 11 nt, Homo sapiens
aaaacucucug

SEQ ID NO: 2141945 - RNA, 20 nt, Homo sapiens
cuuuaugaagugcuacagaa

SEQ ID NO: 2141946 - RNA, 15 nt, Homo sapiens
aagcagcccuucccc

SEQ ID NO: 2141947 - RNA, 13 nt, Homo sapiens
gcagugucugcug

SEQ ID NO: 2141948 - RNA, 13 nt, Homo sapiens
gaagaaaacauau

SEQ ID NO: 2141949 - RNA, 17 nt, Homo sapiens
uccuucuugacauuuau

SEQ ID NO: 2141950 - RNA, 23 nt, Homo sapiens
ggcuaucuaauuuuacacucugu

SEQ ID NO: 2141951 - RNA, 21 nt, Homo sapiens
aagagugggggagagcaggcu

SEQ ID NO: 2141952 - RNA, 14 nt, Homo sapiens
ugccuucucaugau

SEQ ID NO: 2141953 - RNA, 15 nt, Homo sapiens
guauucuagugauaa

SEQ ID NO: 2141954 - RNA, 21 nt, Homo sapiens
auguauuuauuugggagaccg

SEQ ID NO: 2141955 - RNA, 17 nt, Homo sapiens
ugagaccacuguuauca

SEQ ID NO: 2141956 - RNA, 20 nt, Homo sapiens
auugaaacuacuacaaugau

SEQ ID NO: 2141957 - RNA, 21 nt, Homo sapiens
agcccugucagcaugaauuug

SEQ ID NO: 2141958 - RNA, 16 nt, Homo sapiens
acugaauuagccaaaa

SEQ ID NO: 2141959 - RNA, 16 nt, Homo sapiens
uugagugucaagcuga

SEQ ID NO: 2141960 - RNA, 13 nt, Homo sapiens
ucuaguaucacau

SEQ ID NO: 2141961 - RNA, 12 nt, Homo sapiens
uaagagaaauga

SEQ ID NO: 2141962 - RNA, 12 nt, Homo sapiens
ucuugacuuccc

SEQ ID NO: 2141963 - RNA, 18 nt, Homo sapiens
aguucaggaagguacaaa

SEQ ID NO: 2141964 - RNA, 21 nt, Homo sapiens
cuuaauggaagguuggaucca

SEQ ID NO: 2141965 - RNA, 16 nt, Homo sapiens
gcagcuccagugccag

SEQ ID NO: 2141966 - RNA, 18 nt, Homo sapiens
cucaaaacugcacuguca

SEQ ID NO: 2141967 - RNA, 14 nt, Homo sapiens
cugcauggcaaguu

SEQ ID NO: 2141968 - RNA, 22 nt, Homo sapiens
cugaccauauugugcuucacag

SEQ ID NO: 2141969 - RNA, 16 nt, Homo sapiens
aggccccaaucuugcc

SEQ ID NO: 2141970 - RNA, 18 nt, Homo sapiens
acucuuaucaaucccaac

SEQ ID NO: 2141971 - RNA, 20 nt, Homo sapiens
acaagggcugcaaugcccuc

SEQ ID NO: 2141972 - RNA, 13 nt, Homo sapiens
aggagcucuccac

SEQ ID NO: 2141973 - RNA, 18 nt, Homo sapiens
gagaaaauuugaaugugg

SEQ ID NO: 2141974 - RNA, 14 nt, Homo sapiens
cgcugggugguacc

SEQ ID NO: 2141975 - RNA, 18 nt, Homo sapiens
ugguacguggguacccag

SEQ ID NO: 2141976 - RNA, 22 nt, Homo sapiens
ugugauauguaccuaacgaagu

SEQ ID NO: 2141977 - RNA, 20 nt, Homo sapiens
uuauccucccuguaacuuga

SEQ ID NO: 2141978 - RNA, 14 nt, Homo sapiens
ggugaaagugcugc

SEQ ID NO: 2141979 - RNA, 19 nt, Homo sapiens
ccugugaguacuacagucc

SEQ ID NO: 2141980 - RNA, 18 nt, Homo sapiens
auccuuaaguaucagaaa

SEQ ID NO: 2141981 - RNA, 14 nt, Homo sapiens
aggaagcuugucac

SEQ ID NO: 2141982 - RNA, 16 nt, Homo sapiens
guuaauaguacuauua

SEQ ID NO: 2141983 - RNA, 18 nt, Homo sapiens
aagccugucucuuuccac

SEQ ID NO: 2141984 - RNA, 17 nt, Homo sapiens
cguaaacacgccugcaa

SEQ ID NO: 2141985 - RNA, 16 nt, Homo sapiens
cuucacuggcuuccau

SEQ ID NO: 2141986 - RNA, 15 nt, Homo sapiens
cuauguaugcaucua

SEQ ID NO: 2141987 - RNA, 17 nt, Homo sapiens
gaauugucuuccgcuag

SEQ ID NO: 2141988 - RNA, 14 nt, Homo sapiens
augagcacuuugua

SEQ ID NO: 2141989 - RNA, 22 nt, Homo sapiens
gagaaaagugggcugcagcagc

SEQ ID NO: 2141990 - RNA, 12 nt, Homo sapiens
gagagggcugcu

SEQ ID NO: 2141991 - RNA, 16 nt, Homo sapiens
gggugcgguggcucac

SEQ ID NO: 2141992 - RNA, 13 nt, Homo sapiens
augaaauccagug

SEQ ID NO: 2141993 - RNA, 17 nt, Homo sapiens
cuaguuaggagcccacc

SEQ ID NO: 2141994 - RNA, 19 nt, Homo sapiens
uaauaaguacaacuaccua

SEQ ID NO: 2141995 - RNA, 17 nt, Homo sapiens
ugacacuuuucaugugu

SEQ ID NO: 2141996 - RNA, 19 nt, Homo sapiens
cauagcccagaucagcucc

SEQ ID NO: 2141997 - RNA, 18 nt, Homo sapiens
auaaagcguccucucagu

SEQ ID NO: 2141998 - RNA, 20 nt, Homo sapiens
cuacuaaaacuauggagaaa

SEQ ID NO: 2141999 - RNA, 11 nt, Homo sapiens
cucucucaugu

SEQ ID NO: 2142000 - RNA, 15 nt, Homo sapiens
uaucuucaucuguga

SEQ ID NO: 2142001 - RNA, 19 nt, Homo sapiens
cuuccugaacaaccagcug

SEQ ID NO: 2142002 - RNA, 18 nt, Homo sapiens
guuagauaugugccaaag

SEQ ID NO: 2142003 - RNA, 16 nt, Homo sapiens
agauggcgacaaaagu

SEQ ID NO: 2142004 - RNA, 16 nt, Homo sapiens
cauauauuacuagcau

SEQ ID NO: 2142005 - RNA, 19 nt, Homo sapiens
auuuuuucuuuaucaagga

SEQ ID NO: 2142006 - RNA, 23 nt, Homo sapiens
caggacaccagccuggugcccau

SEQ ID NO: 2142007 - RNA, 17 nt, Homo sapiens
gaugugaucacugagac

SEQ ID NO: 2142008 - RNA, 15 nt, Homo sapiens
acagauaucaguguc

SEQ ID NO: 2142009 - RNA, 21 nt, Homo sapiens
cacaagucauaccuacauuca

SEQ ID NO: 2142010 - RNA, 20 nt, Homo sapiens
cacucagaaagaggucuccc

SEQ ID NO: 2142011 - RNA, 15 nt, Homo sapiens
ccugcgcauggugca

SEQ ID NO: 2142012 - RNA, 13 nt, Homo sapiens
acucuacaaaaug

SEQ ID NO: 2142013 - RNA, 17 nt, Homo sapiens
agagucgcugugccaca

SEQ ID NO: 2142014 - RNA, 22 nt, Homo sapiens
cugaauuuuuuuuaaaaaucca

SEQ ID NO: 2142015 - RNA, 12 nt, Homo sapiens
agcacagugugu

SEQ ID NO: 2142016 - RNA, 15 nt, Homo sapiens
gugucucacaucuac

SEQ ID NO: 2142017 - RNA, 15 nt, Homo sapiens
uuaaacaccuccuca

SEQ ID NO: 2142018 - RNA, 17 nt, Homo sapiens
auuucucucagauuucc

SEQ ID NO: 2142019 - RNA, 19 nt, Homo sapiens
agucucugaacuaggugau

SEQ ID NO: 2142020 - RNA, 12 nt, Homo sapiens
acugaccaaauu

SEQ ID NO: 2142021 - RNA, 20 nt, Homo sapiens
cuugauugagugcuccugug

SEQ ID NO: 2142022 - RNA, 20 nt, Homo sapiens
cacggccacuggccaucucc

SEQ ID NO: 2142023 - RNA, 19 nt, Homo sapiens
cucacuauucaaguauuag

SEQ ID NO: 2142024 - RNA, 20 nt, Homo sapiens
cagcagccgccuuaagcuga

SEQ ID NO: 2142025 - RNA, 19 nt, Homo sapiens
uacaacuaagugauuugua

SEQ ID NO: 2142026 - RNA, 14 nt, Homo sapiens
ucagagcauuucaa

SEQ ID NO: 2142027 - RNA, 19 nt, Homo sapiens
accuguugguuagauucaa

SEQ ID NO: 2142028 - RNA, 22 nt, Homo sapiens
gggaaggugaccacauccaccu

SEQ ID NO: 2142029 - RNA, 20 nt, Homo sapiens
ccugccaaauuuuagauuua

SEQ ID NO: 2142030 - RNA, 17 nt, Homo sapiens
caaaaacaaagugcaaa

SEQ ID NO: 2142031 - RNA, 19 nt, Homo sapiens
agggcacugcugcugccuu

SEQ ID NO: 2142032 - RNA, 21 nt, Homo sapiens
ugccuuguugaugaagcacau

SEQ ID NO: 2142033 - RNA, 16 nt, Homo sapiens
accugcgucauuucag

SEQ ID NO: 2142034 - RNA, 16 nt, Homo sapiens
ucagaccaacucucuc

SEQ ID NO: 2142035 - RNA, 21 nt, Homo sapiens
cccagccucugccccacccau

SEQ ID NO: 2142036 - RNA, 16 nt, Homo sapiens
auaaacucacaacucu

SEQ ID NO: 2142037 - RNA, 22 nt, Homo sapiens
caaaaacaguaaaaauaaccac

SEQ ID NO: 2142038 - RNA, 17 nt, Homo sapiens
aagaaaagcauuuucag

SEQ ID NO: 2142039 - RNA, 13 nt, Homo sapiens
gcaccugccucag

SEQ ID NO: 2142040 - RNA, 16 nt, Homo sapiens
gcauucacacacagcc

SEQ ID NO: 2142041 - RNA, 15 nt, Homo sapiens
uggagccugcaauaa

SEQ ID NO: 2142042 - RNA, 21 nt, Homo sapiens
caagaucgugccauugcacuc

SEQ ID NO: 2142043 - RNA, 13 nt, Homo sapiens
agcaaguguucac

SEQ ID NO: 2142044 - RNA, 23 nt, Homo sapiens
ccuagcagcaccguucugugcac

SEQ ID NO: 2142045 - RNA, 18 nt, Homo sapiens
aaaagccauaacuugaaa

SEQ ID NO: 2142046 - RNA, 21 nt, Homo sapiens
guaaacacccucuugcuuaau

SEQ ID NO: 2142047 - RNA, 20 nt, Homo sapiens
gugaaaauuuuuacauucau

SEQ ID NO: 2142048 - RNA, 22 nt, Homo sapiens
uauggugccgaauugucuuugg

SEQ ID NO: 2142049 - RNA, 17 nt, Homo sapiens
ugcaccccagcauucca

SEQ ID NO: 2142050 - RNA, 16 nt, Homo sapiens
aaugaaaacaguccca

SEQ ID NO: 2142051 - RNA, 16 nt, Homo sapiens
acuguggcacuuuuca

SEQ ID NO: 2142052 - RNA, 15 nt, Homo sapiens
uaacuggggauauaa

SEQ ID NO: 2142053 - RNA, 16 nt, Homo sapiens
ucacugucaucuucaa

SEQ ID NO: 2142054 - RNA, 14 nt, Homo sapiens
cuacgcacuggaca

SEQ ID NO: 2142055 - RNA, 23 nt, Homo sapiens
ucuuaccagaucuaauauugacu

SEQ ID NO: 2142056 - RNA, 11 nt, Homo sapiens
cuccaucccag

SEQ ID NO: 2142057 - RNA, 18 nt, Homo sapiens
ccucaugagcacaggguc

SEQ ID NO: 2142058 - RNA, 22 nt, Homo sapiens
accucugagccaucccagagcc

SEQ ID NO: 2142059 - RNA, 24 nt, Homo sapiens
ugugauucuauaaaacacaucauc

SEQ ID NO: 2142060 - RNA, 21 nt, Homo sapiens
uuucucuacuccaugguucuc

SEQ ID NO: 2142061 - RNA, 23 nt, Homo sapiens
uaacaguuugauauuuuguaaaa

SEQ ID NO: 2142062 - RNA, 13 nt, Homo sapiens
agaaauccauaac

SEQ ID NO: 2142063 - RNA, 12 nt, Homo sapiens
uggaauucugcu

SEQ ID NO: 2142064 - RNA, 20 nt, Homo sapiens
caagcacgaggccucagguc

SEQ ID NO: 2142065 - RNA, 21 nt, Homo sapiens
ggcucauauuccugcagccug

SEQ ID NO: 2142066 - RNA, 14 nt, Homo sapiens
aguuaagugucauu

SEQ ID NO: 2142067 - RNA, 19 nt, Homo sapiens
agcuauugccaaccaguuu

SEQ ID NO: 2142068 - RNA, 20 nt, Homo sapiens
uaagcugagcuccuuagccu

SEQ ID NO: 2142069 - RNA, 18 nt, Homo sapiens
accagcagcccaagggcu

SEQ ID NO: 2142070 - RNA, 15 nt, Homo sapiens
aucuuuaggcuuuca

SEQ ID NO: 2142071 - RNA, 20 nt, Homo sapiens
gauacagccuuacaauacaa

SEQ ID NO: 2142072 - RNA, 19 nt, Homo sapiens
gccauuguuuugccaguga

SEQ ID NO: 2142073 - RNA, 11 nt, Homo sapiens
ugcaccaaaga

SEQ ID NO: 2142074 - RNA, 13 nt, Homo sapiens
cgauacaaagugu

SEQ ID NO: 2142075 - RNA, 22 nt, Homo sapiens
caguaacacaauacaguacuca

SEQ ID NO: 2142076 - RNA, 14 nt, Homo sapiens
acuguuucugucag

SEQ ID NO: 2142077 - RNA, 18 nt, Homo sapiens
ggcaacagaugaagaccc

SEQ ID NO: 2142078 - RNA, 15 nt, Homo sapiens
aacauguaugugcau

SEQ ID NO: 2142079 - RNA, 21 nt, Homo sapiens
ccugcacagcuuacacuguca

SEQ ID NO: 2142080 - RNA, 22 nt, Homo sapiens
acaucauccagaagacacacau

SEQ ID NO: 2142081 - RNA, 14 nt, Homo sapiens
gggcaaagaucuca

SEQ ID NO: 2142082 - RNA, 19 nt, Homo sapiens
gaauauaaauuuguguucu

SEQ ID NO: 2142083 - RNA, 15 nt, Homo sapiens
cugaaauuacuuuaa

SEQ ID NO: 2142084 - RNA, 21 nt, Homo sapiens
cuucuuaauauaacugccuua

SEQ ID NO: 2142085 - RNA, 17 nt, Homo sapiens
cagaugauccuugcaca

SEQ ID NO: 2142086 - RNA, 15 nt, Homo sapiens
aguggugacauaguc

SEQ ID NO: 2142087 - RNA, 16 nt, Homo sapiens
ugcuggaacacaaaga

SEQ ID NO: 2142088 - RNA, 23 nt, Homo sapiens
cucaccugucuaggucuccucag

SEQ ID NO: 2142089 - RNA, 15 nt, Homo sapiens
ucaaaauccaaaaag

SEQ ID NO: 2142090 - RNA, 19 nt, Homo sapiens
uuuaaaaagcccaaccucu

SEQ ID NO: 2142091 - RNA, 16 nt, Homo sapiens
aauugugcaguacuuu

SEQ ID NO: 2142092 - RNA, 19 nt, Homo sapiens
uugaaaucagcauacucaa

SEQ ID NO: 2142093 - RNA, 16 nt, Homo sapiens
acuuuaaaagcauuuu

SEQ ID NO: 2142094 - RNA, 13 nt, Homo sapiens
ggaaaaauggggu

SEQ ID NO: 2142095 - RNA, 23 nt, Homo sapiens
ggagaccccaaaaagaguuacac

SEQ ID NO: 2142096 - RNA, 13 nt, Homo sapiens
ggacagguccuga

SEQ ID NO: 2142097 - RNA, 19 nt, Homo sapiens
uaauauaucagugcuccag

SEQ ID NO: 2142098 - RNA, 22 nt, Homo sapiens
auugauguuuuacgugcaaaca

SEQ ID NO: 2142099 - RNA, 17 nt, Homo sapiens
ucuacuccucccucuga

SEQ ID NO: 2142100 - RNA, 20 nt, Homo sapiens
aaccaauaauguagcaguuc

SEQ ID NO: 2142101 - RNA, 11 nt, Homo sapiens
uuuauucuugu

SEQ ID NO: 2142102 - RNA, 22 nt, Homo sapiens
ggcaggaucaaagacacacagg

SEQ ID NO: 2142103 - RNA, 22 nt, Homo sapiens
aguaaucuaaaggaaagaugau

SEQ ID NO: 2142104 - RNA, 20 nt, Homo sapiens
auuugaugaaggugaauauu

SEQ ID NO: 2142105 - RNA, 22 nt, Homo sapiens
gauucagccggagggaagggac

SEQ ID NO: 2142106 - RNA, 19 nt, Homo sapiens
agauuaacacucauuucca

SEQ ID NO: 2142107 - RNA, 19 nt, Homo sapiens
ugcaauaaauggcuugauu

SEQ ID NO: 2142108 - RNA, 23 nt, Homo sapiens
augaaggccaucuugauggucuc

SEQ ID NO: 2142109 - RNA, 20 nt, Homo sapiens
ggacuuuggaaaacuacuuu

SEQ ID NO: 2142110 - RNA, 19 nt, Homo sapiens
cauuucaggacauuuggaa

SEQ ID NO: 2142111 - RNA, 18 nt, Homo sapiens
cagggaaauggccuuccc

SEQ ID NO: 2142112 - RNA, 22 nt, Homo sapiens
cagcuuugacuggaggguccau

SEQ ID NO: 2142113 - RNA, 17 nt, Homo sapiens
guauggcaaacugccau

SEQ ID NO: 2142114 - RNA, 13 nt, Homo sapiens
auaugagcuuucg

SEQ ID NO: 2142115 - RNA, 21 nt, Homo sapiens
augcucucuuucuuuucucug

SEQ ID NO: 2142116 - RNA, 18 nt, Homo sapiens
aaacauucaucaagcugu

SEQ ID NO: 2142117 - RNA, 20 nt, Homo sapiens
auaaauaccaauuauggaaa

SEQ ID NO: 2142118 - RNA, 23 nt, Homo sapiens
ccaguuaccacugguguaugaaa

SEQ ID NO: 2142119 - RNA, 13 nt, Homo sapiens
accuagugcuguu

SEQ ID NO: 2142120 - RNA, 18 nt, Homo sapiens
aacaucgucuaaacuuua

SEQ ID NO: 2142121 - RNA, 15 nt, Homo sapiens
ccauuccagcucucc

SEQ ID NO: 2142122 - RNA, 12 nt, Homo sapiens
gcacaugccuuc

SEQ ID NO: 2142123 - RNA, 21 nt, Homo sapiens
ugaggaaaggccagcuggcag

SEQ ID NO: 2142124 - RNA, 16 nt, Homo sapiens
uacccuugugauuucu

SEQ ID NO: 2142125 - RNA, 17 nt, Homo sapiens
gaauuacuuguguuacu

SEQ ID NO: 2142126 - RNA, 21 nt, Homo sapiens
aaacugguuuaggauuacuua

SEQ ID NO: 2142127 - RNA, 12 nt, Homo sapiens
acccucugugag

SEQ ID NO: 2142128 - RNA, 16 nt, Homo sapiens
aaagaugccguuuaaa

SEQ ID NO: 2142129 - RNA, 21 nt, Homo sapiens
ugcuguccaggaacuuuccag

SEQ ID NO: 2142130 - RNA, 11 nt, Homo sapiens
uccuguucucu

SEQ ID NO: 2142131 - RNA, 16 nt, Homo sapiens
ucuaauguaugcauuc

SEQ ID NO: 2142132 - RNA, 19 nt, Homo sapiens
uuucaccaggggugcucac

SEQ ID NO: 2142133 - RNA, 22 nt, Homo sapiens
auauucuaauuaaaauugugca

SEQ ID NO: 2142134 - RNA, 22 nt, Homo sapiens
aaaaaccuuggcauaagacaga

SEQ ID NO: 2142135 - RNA, 11 nt, Homo sapiens
accucaauauu

SEQ ID NO: 2142136 - RNA, 18 nt, Homo sapiens
aaucuggcgucuguuuca

SEQ ID NO: 2142137 - RNA, 22 nt, Homo sapiens
agaaaauagagaucuuauguca

SEQ ID NO: 2142138 - RNA, 19 nt, Homo sapiens
caaauaauaaauguucucg

SEQ ID NO: 2142139 - RNA, 15 nt, Homo sapiens
ugggcaacagaugaa

SEQ ID NO: 2142140 - RNA, 15 nt, Homo sapiens
cagccuucuuuucaa

SEQ ID NO: 2142141 - RNA, 19 nt, Homo sapiens
guggcauccgaaggugucu

SEQ ID NO: 2142142 - RNA, 18 nt, Homo sapiens
ggcuguucccuuugccuu

SEQ ID NO: 2142143 - RNA, 13 nt, Homo sapiens
acuuugagccugc

SEQ ID NO: 2142144 - RNA, 16 nt, Homo sapiens
aaauccccuccccaaa

SEQ ID NO: 2142145 - RNA, 23 nt, Homo sapiens
ggaccacacugauccuggagaaa

SEQ ID NO: 2142146 - RNA, 20 nt, Homo sapiens
ccaggcccauuuccugcuuu

SEQ ID NO: 2142147 - RNA, 19 nt, Homo sapiens
ugucauguuaugcagugaa

SEQ ID NO: 2142148 - RNA, 22 nt, Homo sapiens
ucaauuaacagcagaaucucag

SEQ ID NO: 2142149 - RNA, 19 nt, Homo sapiens
gccuguacagucugucuuc

SEQ ID NO: 2142150 - RNA, 20 nt, Homo sapiens
caguaguagcgaacugcacu

SEQ ID NO: 2142151 - RNA, 21 nt, Homo sapiens
uacauaagacuggacauuuaa

SEQ ID NO: 2142152 - RNA, 14 nt, Homo sapiens
aaaaugucaucuca

SEQ ID NO: 2142153 - RNA, 22 nt, Homo sapiens
uguaauacuuaaauaaacauga

SEQ ID NO: 2142154 - RNA, 21 nt, Homo sapiens
aagcaaauagacacagucaua

SEQ ID NO: 2142155 - RNA, 19 nt, Homo sapiens
auguuuggaauaaagucaa

SEQ ID NO: 2142156 - RNA, 21 nt, Homo sapiens
gcccacauguguccaucccag

SEQ ID NO: 2142157 - RNA, 17 nt, Homo sapiens
uagggaaauucaaagca

SEQ ID NO: 2142158 - RNA, 17 nt, Homo sapiens
ugcccagggcagcuuug

SEQ ID NO: 2142159 - RNA, 16 nt, Homo sapiens
uguugugucuugcuau

SEQ ID NO: 2142160 - RNA, 16 nt, Homo sapiens
ugagcaagcuaugagg

SEQ ID NO: 2142161 - RNA, 21 nt, Homo sapiens
ucuugaauuguaggugacuau

SEQ ID NO: 2142162 - RNA, 13 nt, Homo sapiens
uuggaugagaaag

SEQ ID NO: 2142163 - RNA, 16 nt, Homo sapiens
gaaaugagcagggaug

SEQ ID NO: 2142164 - RNA, 17 nt, Homo sapiens
cuguccacuuggagcua

SEQ ID NO: 2142165 - RNA, 19 nt, Homo sapiens
uuucugcaugacuauugua

SEQ ID NO: 2142166 - RNA, 16 nt, Homo sapiens
gcaauggcgugaucuc

SEQ ID NO: 2142167 - RNA, 18 nt, Homo sapiens
ugcuucucuagcucucua

SEQ ID NO: 2142168 - RNA, 14 nt, Homo sapiens
gggcagaaccaaga

SEQ ID NO: 2142169 - RNA, 13 nt, Homo sapiens
agaacugugccac

SEQ ID NO: 2142170 - RNA, 21 nt, Homo sapiens
acaguugauuugggggcacuu

SEQ ID NO: 2142171 - RNA, 13 nt, Homo sapiens
ccucgugaaguca

SEQ ID NO: 2142172 - RNA, 18 nt, Homo sapiens
ucaaagauucugcauuuu

SEQ ID NO: 2142173 - RNA, 18 nt, Homo sapiens
uguauuccugucauugcg

SEQ ID NO: 2142174 - RNA, 17 nt, Homo sapiens
acaugcacucagcucuu

SEQ ID NO: 2142175 - RNA, 14 nt, Homo sapiens
uucacuuccagaga

SEQ ID NO: 2142176 - RNA, 19 nt, Homo sapiens
gagcaaagggaaggacuga

SEQ ID NO: 2142177 - RNA, 20 nt, Homo sapiens
cugggaaaggugcucaaaga

SEQ ID NO: 2142178 - RNA, 18 nt, Homo sapiens
uguccaagugccacguga

SEQ ID NO: 2142179 - RNA, 17 nt, Homo sapiens
aguaucuguaacccuug

SEQ ID NO: 2142180 - RNA, 14 nt, Homo sapiens
ccccacagcucuuu

SEQ ID NO: 2142181 - RNA, 20 nt, Homo sapiens
aaaugcauagagcaauuaaa

SEQ ID NO: 2142182 - RNA, 17 nt, Homo sapiens
aggccagugcugugagc

SEQ ID NO: 2142183 - RNA, 15 nt, Homo sapiens
acccaggaaugccac

SEQ ID NO: 2142184 - RNA, 23 nt, Homo sapiens
cuggccagacaagaagacuguca

SEQ ID NO: 2142185 - RNA, 13 nt, Homo sapiens
ugcccccuccagu

SEQ ID NO: 2142186 - RNA, 16 nt, Homo sapiens
uggcugugcuaccuga

SEQ ID NO: 2142187 - RNA, 17 nt, Homo sapiens
uccccauaaucacugac

SEQ ID NO: 2142188 - RNA, 16 nt, Homo sapiens
uacugauggugcauuu

SEQ ID NO: 2142189 - RNA, 19 nt, Homo sapiens
ugcauauuuguuacuuuac

SEQ ID NO: 2142190 - RNA, 23 nt, Homo sapiens
aucuggcccuugcuuaccucuca

SEQ ID NO: 2142191 - RNA, 14 nt, Homo sapiens
cucccaaacucagg

SEQ ID NO: 2142192 - RNA, 20 nt, Homo sapiens
cuuucacaaggcauccauac

SEQ ID NO: 2142193 - RNA, 23 nt, Homo sapiens
acacccaagaagaaaugcuuucc

SEQ ID NO: 2142194 - RNA, 13 nt, Homo sapiens
ccaaaaugucauu

SEQ ID NO: 2142195 - RNA, 20 nt, Homo sapiens
aacauggugaaacaugguga

SEQ ID NO: 2142196 - RNA, 17 nt, Homo sapiens
uguauaugaaugaauaa

SEQ ID NO: 2142197 - RNA, 17 nt, Homo sapiens
aaacagccuacagccag

SEQ ID NO: 2142198 - RNA, 16 nt, Homo sapiens
cuaucaggugccccuc

SEQ ID NO: 2142199 - RNA, 18 nt, Homo sapiens
acuggccuauuuaucuga

SEQ ID NO: 2142200 - RNA, 21 nt, Homo sapiens
ucccuuccuccauugcacaug

SEQ ID NO: 2142201 - RNA, 14 nt, Homo sapiens
acuaggaucagaau

SEQ ID NO: 2142202 - RNA, 20 nt, Homo sapiens
cugugguguuucgugcuguc

SEQ ID NO: 2142203 - RNA, 12 nt, Homo sapiens
uccccaccuguc

SEQ ID NO: 2142204 - RNA, 23 nt, Homo sapiens
aaguauacaauaaagucuuaccu

SEQ ID NO: 2142205 - RNA, 22 nt, Homo sapiens
uuccuguggggggaaguccaug

SEQ ID NO: 2142206 - RNA, 17 nt, Homo sapiens
acucuuguugugcucuu

SEQ ID NO: 2142207 - RNA, 15 nt, Homo sapiens
cuucaaucacuguaa

SEQ ID NO: 2142208 - RNA, 14 nt, Homo sapiens
agcuaagaaccugg

SEQ ID NO: 2142209 - RNA, 14 nt, Homo sapiens
ugucgagaucucag

SEQ ID NO: 2142210 - RNA, 19 nt, Homo sapiens
aaaaagaugguugccaagc

SEQ ID NO: 2142211 - RNA, 21 nt, Homo sapiens
guccaugauguccuuguuauu

SEQ ID NO: 2142212 - RNA, 21 nt, Homo sapiens
ugaagaaaagugaaugcucaa

SEQ ID NO: 2142213 - RNA, 11 nt, Homo sapiens
ccuccaugacc

SEQ ID NO: 2142214 - RNA, 19 nt, Homo sapiens
aagaacaucccaagccaga

SEQ ID NO: 2142215 - RNA, 22 nt, Homo sapiens
acaggaagccugcaguccugga

SEQ ID NO: 2142216 - RNA, 12 nt, Homo sapiens
gcaauggaagaa

SEQ ID NO: 2142217 - RNA, 16 nt, Homo sapiens
gucgggggcuguggau

SEQ ID NO: 2142218 - RNA, 15 nt, Homo sapiens
uuggauucccuuaaa

SEQ ID NO: 2142219 - RNA, 22 nt, Homo sapiens
agccuggcucccaggacacgac

SEQ ID NO: 2142220 - RNA, 14 nt, Homo sapiens
auucauaguggauu

SEQ ID NO: 2142221 - RNA, 21 nt, Homo sapiens
gugaauccuuuguacugauga

SEQ ID NO: 2142222 - RNA, 22 nt, Homo sapiens
augcugugaauuuuacaaaaau

SEQ ID NO: 2142223 - RNA, 22 nt, Homo sapiens
acuuugucuguacauacuggcc

SEQ ID NO: 2142224 - RNA, 19 nt, Homo sapiens
ucaacacuuguaucuggcc

SEQ ID NO: 2142225 - RNA, 21 nt, Homo sapiens
aaauauagaaaacuaaucuaa

SEQ ID NO: 2142226 - RNA, 16 nt, Homo sapiens
agguaccuucucaccu

SEQ ID NO: 2142227 - RNA, 20 nt, Homo sapiens
uauauccccucuacucuuac

SEQ ID NO: 2142228 - RNA, 20 nt, Homo sapiens
aauuuucuucuugguucuga

SEQ ID NO: 2142229 - RNA, 13 nt, Homo sapiens
aucuauccuuuaa

SEQ ID NO: 2142230 - RNA, 17 nt, Homo sapiens
cugauuuccuucugcua

SEQ ID NO: 2142231 - RNA, 23 nt, Homo sapiens
caugcuacuuuuuuuuaguucaa

SEQ ID NO: 2142232 - RNA, 18 nt, Homo sapiens
gggugguuuuugagccau

SEQ ID NO: 2142233 - RNA, 17 nt, Homo sapiens
ugcagcuucgaggacag

SEQ ID NO: 2142234 - RNA, 23 nt, Homo sapiens
gaggccugggugugaccugacac

SEQ ID NO: 2142235 - RNA, 15 nt, Homo sapiens
ugcuauucuggcaau

SEQ ID NO: 2142236 - RNA, 14 nt, Homo sapiens
agcaaauguuccuu

SEQ ID NO: 2142237 - RNA, 22 nt, Homo sapiens
ucucagacacugccgacaucag

SEQ ID NO: 2142238 - RNA, 18 nt, Homo sapiens
cuggagggaggggcggga

SEQ ID NO: 2142239 - RNA, 22 nt, Homo sapiens
agcauuaacuuauugucuaggc

SEQ ID NO: 2142240 - RNA, 12 nt, Homo sapiens
uaaaaguuugaa

SEQ ID NO: 2142241 - RNA, 23 nt, Homo sapiens
ucacucucugaagaugaucauuu

SEQ ID NO: 2142242 - RNA, 18 nt, Homo sapiens
uucugggugggugaaagg

SEQ ID NO: 2142243 - RNA, 16 nt, Homo sapiens
ggaaaagaaagagcug

SEQ ID NO: 2142244 - RNA, 14 nt, Homo sapiens
uucaaaacauucau

SEQ ID NO: 2142245 - RNA, 19 nt, Homo sapiens
caaauccaaggaaacaugc

SEQ ID NO: 2142246 - RNA, 15 nt, Homo sapiens
auuucuauacaacag

SEQ ID NO: 2142247 - RNA, 18 nt, Homo sapiens
aagccugcugauuucuac

SEQ ID NO: 2142248 - RNA, 15 nt, Homo sapiens
cauccaugcacuuua

SEQ ID NO: 2142249 - RNA, 18 nt, Homo sapiens
ugaaguagaguguuggaa

SEQ ID NO: 2142250 - RNA, 12 nt, Homo sapiens
auuguuuggacc

SEQ ID NO: 2142251 - RNA, 18 nt, Homo sapiens
caagagugauugcagcuu

SEQ ID NO: 2142252 - RNA, 15 nt, Homo sapiens
uuccuucaccaccuc

SEQ ID NO: 2142253 - RNA, 16 nt, Homo sapiens
guguaucaugguguuc

SEQ ID NO: 2142254 - RNA, 22 nt, Homo sapiens
cuaccacugucuucuucagggu

SEQ ID NO: 2142255 - RNA, 16 nt, Homo sapiens
aagccggcuuuccucu

SEQ ID NO: 2142256 - RNA, 22 nt, Homo sapiens
acuuauguacuugauacugaau

SEQ ID NO: 2142257 - RNA, 16 nt, Homo sapiens
uaaccauguaucuaau

SEQ ID NO: 2142258 - RNA, 19 nt, Homo sapiens
ccgucaauaggcaaagggg

SEQ ID NO: 2142259 - RNA, 14 nt, Homo sapiens
ucuugcaauccaca

SEQ ID NO: 2142260 - RNA, 16 nt, Homo sapiens
ggauguaccagcaucu

SEQ ID NO: 2142261 - RNA, 14 nt, Homo sapiens
uuaagagccauaua

SEQ ID NO: 2142262 - RNA, 21 nt, Homo sapiens
aucauuucaaaacucauuucc

SEQ ID NO: 2142263 - RNA, 15 nt, Homo sapiens
ucuauucaagcacuu

SEQ ID NO: 2142264 - RNA, 18 nt, Homo sapiens
cugcagucccaugcacaa

SEQ ID NO: 2142265 - RNA, 21 nt, Homo sapiens
gaguguguuugugugcaugaa

SEQ ID NO: 2142266 - RNA, 23 nt, Homo sapiens
agugacauugcaucaaagcaucu

SEQ ID NO: 2142267 - RNA, 15 nt, Homo sapiens
aacacuaaacuucau

SEQ ID NO: 2142268 - RNA, 12 nt, Homo sapiens
accugugcugug

SEQ ID NO: 2142269 - RNA, 17 nt, Homo sapiens
ucaccccacagacacuu

SEQ ID NO: 2142270 - RNA, 17 nt, Homo sapiens
auguaagagcuuuacaa

SEQ ID NO: 2142271 - RNA, 17 nt, Homo sapiens
aggccuggagggcacuu

SEQ ID NO: 2142272 - RNA, 22 nt, Homo sapiens
ccuggcaaggacacagaugaaa

SEQ ID NO: 2142273 - RNA, 14 nt, Homo sapiens
acgacccaaggaau

SEQ ID NO: 2142274 - RNA, 16 nt, Homo sapiens
uggagagggacuggca

SEQ ID NO: 2142275 - RNA, 21 nt, Homo sapiens
ccccuggccuuugaggcaaag

SEQ ID NO: 2142276 - RNA, 19 nt, Homo sapiens
aaaagcuuuuguuuugcuu

SEQ ID NO: 2142277 - RNA, 21 nt, Homo sapiens
uuagagaaaugguucuggaua

SEQ ID NO: 2142278 - RNA, 12 nt, Homo sapiens
ugauaguccuuu

SEQ ID NO: 2142279 - RNA, 13 nt, Homo sapiens
ggcuggcaguugg

SEQ ID NO: 2142280 - RNA, 17 nt, Homo sapiens
aauauuuaaacuucuug

SEQ ID NO: 2142281 - RNA, 21 nt, Homo sapiens
ucccuccaccucccugcaaua

SEQ ID NO: 2142282 - RNA, 19 nt, Homo sapiens
gaaaucuaugaaauaucau

SEQ ID NO: 2142283 - RNA, 18 nt, Homo sapiens
cauugaugaacugccaaa

SEQ ID NO: 2142284 - RNA, 16 nt, Homo sapiens
guaaaaaagauuugua

SEQ ID NO: 2142285 - RNA, 15 nt, Homo sapiens
aaaaauaccauuuau

SEQ ID NO: 2142286 - RNA, 20 nt, Homo sapiens
agccccuuauuugcacuuca

SEQ ID NO: 2142287 - RNA, 19 nt, Homo sapiens
aauaauauccucugagacc

SEQ ID NO: 2142288 - RNA, 23 nt, Homo sapiens
ggcccgccucacaccccagugga

SEQ ID NO: 2142289 - RNA, 15 nt, Homo sapiens
aauuuauuucaaaaa

SEQ ID NO: 2142290 - RNA, 15 nt, Homo sapiens
cuggagugcaauggu

SEQ ID NO: 2142291 - RNA, 16 nt, Homo sapiens
agaaaauuaugcagcu

SEQ ID NO: 2142292 - RNA, 16 nt, Homo sapiens
gugguacuacuguaag

SEQ ID NO: 2142293 - RNA, 21 nt, Homo sapiens
uccuuaacacugagcugucau

SEQ ID NO: 2142294 - RNA, 14 nt, Homo sapiens
ggaacacaaaacca

SEQ ID NO: 2142295 - RNA, 12 nt, Homo sapiens
uaagaaacauug

SEQ ID NO: 2142296 - RNA, 16 nt, Homo sapiens
uguagugcuacagggu

SEQ ID NO: 2142297 - RNA, 13 nt, Homo sapiens
aaauuuccagaga

SEQ ID NO: 2142298 - RNA, 16 nt, Homo sapiens
caguuuauuccagagc

SEQ ID NO: 2142299 - RNA, 13 nt, Homo sapiens
aagcaugagacau

SEQ ID NO: 2142300 - RNA, 13 nt, Homo sapiens
auccauccaaagg

SEQ ID NO: 2142301 - RNA, 21 nt, Homo sapiens
agacuaugugucaugauuuca

SEQ ID NO: 2142302 - RNA, 16 nt, Homo sapiens
auaccagaucacucaa

SEQ ID NO: 2142303 - RNA, 23 nt, Homo sapiens
ccagaugggggaaagcacaggug

SEQ ID NO: 2142304 - RNA, 13 nt, Homo sapiens
auauuaaucaaaa

SEQ ID NO: 2142305 - RNA, 18 nt, Homo sapiens
agcucucacaugcacagg

SEQ ID NO: 2142306 - RNA, 11 nt, Homo sapiens
aacacugcugc

SEQ ID NO: 2142307 - RNA, 11 nt, Homo sapiens
uggacugcaag

SEQ ID NO: 2142308 - RNA, 23 nt, Homo sapiens
aauuuuugaaaaauauugcuaaa

SEQ ID NO: 2142309 - RNA, 18 nt, Homo sapiens
uaaggaugucacagggcc

SEQ ID NO: 2142310 - RNA, 13 nt, Homo sapiens
gauguaugaucuc

SEQ ID NO: 2142311 - RNA, 17 nt, Homo sapiens
uccugcuucccuguuga

SEQ ID NO: 2142312 - RNA, 20 nt, Homo sapiens
cuaaauuacagugcaguuua

SEQ ID NO: 2142313 - RNA, 21 nt, Homo sapiens
uaaaaauggauagcucauuaa

SEQ ID NO: 2142314 - RNA, 21 nt, Homo sapiens
guugccaggcuggagugcagu

SEQ ID NO: 2142315 - RNA, 23 nt, Homo sapiens
uucccuuuaugcacccaagagau

SEQ ID NO: 2142316 - RNA, 23 nt, Homo sapiens
acuguccccacgccgggaaccaa

SEQ ID NO: 2142317 - RNA, 13 nt, Homo sapiens
uguugccugcauu

SEQ ID NO: 2142318 - RNA, 19 nt, Homo sapiens
ccaaauuacaaguauucag

SEQ ID NO: 2142319 - RNA, 12 nt, Homo sapiens
gugacugcaaua

SEQ ID NO: 2142320 - RNA, 13 nt, Homo sapiens
agagcuauacagu

SEQ ID NO: 2142321 - RNA, 18 nt, Homo sapiens
aaagccuccgcugggcuu

SEQ ID NO: 2142322 - RNA, 17 nt, Homo sapiens
cccagacaggacugcag

SEQ ID NO: 2142323 - RNA, 22 nt, Homo sapiens
acagaauucacuuuaugugaga

SEQ ID NO: 2142324 - RNA, 16 nt, Homo sapiens
uuaauuagggugaaaa

SEQ ID NO: 2142325 - RNA, 15 nt, Homo sapiens
acugaggcauccacu

SEQ ID NO: 2142326 - RNA, 19 nt, Homo sapiens
cccuguucauucugcauuc

SEQ ID NO: 2142327 - RNA, 14 nt, Homo sapiens
ugucaguauuuuaa

SEQ ID NO: 2142328 - RNA, 12 nt, Homo sapiens
ccgacaucacag

SEQ ID NO: 2142329 - RNA, 23 nt, Homo sapiens
uaauaauuguagauucaguguau

SEQ ID NO: 2142330 - RNA, 22 nt, Homo sapiens
gacuguuauuuuuauuugcacu

SEQ ID NO: 2142331 - RNA, 17 nt, Homo sapiens
uauucauccggggagga

SEQ ID NO: 2142332 - RNA, 15 nt, Homo sapiens
ugcuaaguauuuccc

SEQ ID NO: 2142333 - RNA, 16 nt, Homo sapiens
uaccacucuaccaaau

SEQ ID NO: 2142334 - RNA, 14 nt, Homo sapiens
ugccccagcuuuau

SEQ ID NO: 2142335 - RNA, 13 nt, Homo sapiens
ucauuuucaccuc

SEQ ID NO: 2142336 - RNA, 19 nt, Homo sapiens
cauugucugugaagugaga

SEQ ID NO: 2142337 - RNA, 20 nt, Homo sapiens
gccuccugcccagcacagga

SEQ ID NO: 2142338 - RNA, 19 nt, Homo sapiens
uguugaugguaggcuguau

SEQ ID NO: 2142339 - RNA, 14 nt, Homo sapiens
cucccaggguccug

SEQ ID NO: 2142340 - RNA, 19 nt, Homo sapiens
aaguugacaggcagugcca

SEQ ID NO: 2142341 - RNA, 19 nt, Homo sapiens
ugagaggaucaucuggggc

SEQ ID NO: 2142342 - RNA, 18 nt, Homo sapiens
ugccagguuuaaggucac

SEQ ID NO: 2142343 - RNA, 13 nt, Homo sapiens
ugaagccacagca

SEQ ID NO: 2142344 - RNA, 21 nt, Homo sapiens
cuuuuuuuaaauuuucuccag

SEQ ID NO: 2142345 - RNA, 21 nt, Homo sapiens
agcccuuuuguugagccaggc

SEQ ID NO: 2142346 - RNA, 22 nt, Homo sapiens
aaacuaguggcaauauccaaau

SEQ ID NO: 2142347 - RNA, 17 nt, Homo sapiens
uccucaugguacuguag

SEQ ID NO: 2142348 - RNA, 21 nt, Homo sapiens
agaaccggccuggagcuccuu

SEQ ID NO: 2142349 - RNA, 21 nt, Homo sapiens
acuuucugccagcaucugcag

SEQ ID NO: 2142350 - RNA, 17 nt, Homo sapiens
gaggccgaguggcugcc

SEQ ID NO: 2142351 - RNA, 11 nt, Homo sapiens
ccucacuuuag

SEQ ID NO: 2142352 - RNA, 13 nt, Homo sapiens
gaguauaccauga

SEQ ID NO: 2142353 - RNA, 21 nt, Homo sapiens
uaaaacuucaucuuccccaag

SEQ ID NO: 2142354 - RNA, 21 nt, Homo sapiens
uguagacucuaagauacacug

SEQ ID NO: 2142355 - RNA, 19 nt, Homo sapiens
ugucacuacgugacugugg

SEQ ID NO: 2142356 - RNA, 16 nt, Homo sapiens
ugucuauaauggaaac

SEQ ID NO: 2142357 - RNA, 20 nt, Homo sapiens
aggcaccucugugcugcauc

SEQ ID NO: 2142358 - RNA, 23 nt, Homo sapiens
gaaaaagaacuuccccauacaaa

SEQ ID NO: 2142359 - RNA, 14 nt, Homo sapiens
cagggggaaggugg

SEQ ID NO: 2142360 - RNA, 22 nt, Homo sapiens
caaaagaggagcacuuccaaaa

SEQ ID NO: 2142361 - RNA, 14 nt, Homo sapiens
aucagaaagacauu

SEQ ID NO: 2142362 - RNA, 14 nt, Homo sapiens
agaaaagacacuuc

SEQ ID NO: 2142363 - RNA, 16 nt, Homo sapiens
auaucauacuguucaa

SEQ ID NO: 2142364 - RNA, 14 nt, Homo sapiens
aucucaucccucaa

SEQ ID NO: 2142365 - RNA, 21 nt, Homo sapiens
cuguucccccacccuccaugc

SEQ ID NO: 2142366 - RNA, 17 nt, Homo sapiens
cuguguguacuaauaca

SEQ ID NO: 2142367 - RNA, 17 nt, Homo sapiens
ucacuguccagguagga

SEQ ID NO: 2142368 - RNA, 19 nt, Homo sapiens
aacccaggaguucaggguc

SEQ ID NO: 2142369 - RNA, 14 nt, Homo sapiens
ucccauuacuuuga

SEQ ID NO: 2142370 - RNA, 17 nt, Homo sapiens
ugguuaaacauuaauau

SEQ ID NO: 2142371 - RNA, 21 nt, Homo sapiens
ucugcauuucgguggcuaguc

SEQ ID NO: 2142372 - RNA, 21 nt, Homo sapiens
ucaguguugccucuugcaaug

SEQ ID NO: 2142373 - RNA, 18 nt, Homo sapiens
auaagauggaagcuucca

SEQ ID NO: 2142374 - RNA, 17 nt, Homo sapiens
cauaauaaaaaggcaau

SEQ ID NO: 2142375 - RNA, 15 nt, Homo sapiens
cuacuaaagugccua

SEQ ID NO: 2142376 - RNA, 19 nt, Homo sapiens
aaccuccccauugcacaga

SEQ ID NO: 2142377 - RNA, 19 nt, Homo sapiens
uaauauaagaaucauagug

SEQ ID NO: 2142378 - RNA, 17 nt, Homo sapiens
acacucucuugggccag

SEQ ID NO: 2142379 - RNA, 21 nt, Homo sapiens
acaaggggucaaugucauaaa

SEQ ID NO: 2142380 - RNA, 16 nt, Homo sapiens
aaugacaucauguuag

SEQ ID NO: 2142381 - RNA, 21 nt, Homo sapiens
aauuggguggggggaaugagc

SEQ ID NO: 2142382 - RNA, 16 nt, Homo sapiens
ucagguggggcagcuu

SEQ ID NO: 2142383 - RNA, 23 nt, Homo sapiens
aaucuugcugugaaacagugugg

SEQ ID NO: 2142384 - RNA, 12 nt, Homo sapiens
agcugcuucuau

SEQ ID NO: 2142385 - RNA, 17 nt, Homo sapiens
gcagcuccugaccaaag

SEQ ID NO: 2142386 - RNA, 19 nt, Homo sapiens
aauaauccaaauccaucaa

SEQ ID NO: 2142387 - RNA, 23 nt, Homo sapiens
ccauccccugaugcccaggucac

SEQ ID NO: 2142388 - RNA, 15 nt, Homo sapiens
gugaaugcacugugu

SEQ ID NO: 2142389 - RNA, 23 nt, Homo sapiens
auuccacuuaggaagaaaugccc

SEQ ID NO: 2142390 - RNA, 18 nt, Homo sapiens
auuuucuugguagcacaa

SEQ ID NO: 2142391 - RNA, 15 nt, Homo sapiens
ccaggauagugggca

SEQ ID NO: 2142392 - RNA, 15 nt, Homo sapiens
gcaagcaacugagau

SEQ ID NO: 2142393 - RNA, 16 nt, Homo sapiens
uuccaacaagccucaa

SEQ ID NO: 2142394 - RNA, 17 nt, Homo sapiens
gagucugggcacaagug

SEQ ID NO: 2142395 - RNA, 12 nt, Homo sapiens
gcuuuugaacug

SEQ ID NO: 2142396 - RNA, 11 nt, Homo sapiens
agaccuuccag

SEQ ID NO: 2142397 - RNA, 19 nt, Homo sapiens
aggcuggauggcaccucag

SEQ ID NO: 2142398 - RNA, 19 nt, Homo sapiens
caggagaggagcgggaccu

SEQ ID NO: 2142399 - RNA, 21 nt, Homo sapiens
gaauaaaaugaaauacuaaau

SEQ ID NO: 2142400 - RNA, 20 nt, Homo sapiens
gugaaaugcuggcauuugca

SEQ ID NO: 2142401 - RNA, 23 nt, Homo sapiens
caguguauuuggaaaauguuaug

SEQ ID NO: 2142402 - RNA, 21 nt, Homo sapiens
auaaaccuggagaugaugaug

SEQ ID NO: 2142403 - RNA, 16 nt, Homo sapiens
uucaaaauuggacuua

SEQ ID NO: 2142404 - RNA, 21 nt, Homo sapiens
uaaaaugucuagcuugguggu

SEQ ID NO: 2142405 - RNA, 18 nt, Homo sapiens
gagagcuugcugugacua

SEQ ID NO: 2142406 - RNA, 14 nt, Homo sapiens
cuuucacucuguca

SEQ ID NO: 2142407 - RNA, 14 nt, Homo sapiens
caugcacucaggca

SEQ ID NO: 2142408 - RNA, 21 nt, Homo sapiens
gaacaguugcauuuagcuucu

SEQ ID NO: 2142409 - RNA, 16 nt, Homo sapiens
cucucuccucuuugau

SEQ ID NO: 2142410 - RNA, 21 nt, Homo sapiens
acucacauagagguugagcca

SEQ ID NO: 2142411 - RNA, 22 nt, Homo sapiens
uucugccaccccuaaacuccag

SEQ ID NO: 2142412 - RNA, 18 nt, Homo sapiens
cagugcugccaccugcug

SEQ ID NO: 2142413 - RNA, 13 nt, Homo sapiens
guuugagaccagc

SEQ ID NO: 2142414 - RNA, 17 nt, Homo sapiens
agagauuuggagcacuc

SEQ ID NO: 2142415 - RNA, 19 nt, Homo sapiens
aacauggugccuauaucug

SEQ ID NO: 2142416 - RNA, 16 nt, Homo sapiens
uaccacucacaugaca

SEQ ID NO: 2142417 - RNA, 15 nt, Homo sapiens
gcaaaauaaagugau

SEQ ID NO: 2142418 - RNA, 13 nt, Homo sapiens
ucagagguccagg

SEQ ID NO: 2142419 - RNA, 16 nt, Homo sapiens
cuuggagugcuucuga

SEQ ID NO: 2142420 - RNA, 14 nt, Homo sapiens
ucaugccacugcac

SEQ ID NO: 2142421 - RNA, 18 nt, Homo sapiens
gagccacugcgcccggcc

SEQ ID NO: 2142422 - RNA, 22 nt, Homo sapiens
uaguuuuacuccucaguuccuc

SEQ ID NO: 2142423 - RNA, 14 nt, Homo sapiens
acacugcuaauaau

SEQ ID NO: 2142424 - RNA, 17 nt, Homo sapiens
acuguuuuucagggagg

SEQ ID NO: 2142425 - RNA, 14 nt, Homo sapiens
cagacaauaaaccc

SEQ ID NO: 2142426 - RNA, 16 nt, Homo sapiens
caggaagccaggugag

SEQ ID NO: 2142427 - RNA, 17 nt, Homo sapiens
ugcauaagcauugcuca

SEQ ID NO: 2142428 - RNA, 17 nt, Homo sapiens
ucccaguaaaaggcacu

SEQ ID NO: 2142429 - RNA, 17 nt, Homo sapiens
uguucuguauucugacc

SEQ ID NO: 2142430 - RNA, 17 nt, Homo sapiens
auuagcaacgccugccu

SEQ ID NO: 2142431 - RNA, 10 nt, Homo sapiens
ccacacauau

SEQ ID NO: 2142432 - RNA, 17 nt, Homo sapiens
uuuucuuauugcgcugc

SEQ ID NO: 2142433 - RNA, 15 nt, Homo sapiens
agacauacauuucuc

SEQ ID NO: 2142434 - RNA, 21 nt, Homo sapiens
uggauacuauuaaaguaacau

SEQ ID NO: 2142435 - RNA, 13 nt, Homo sapiens
agugaacuugaaa

SEQ ID NO: 2142436 - RNA, 13 nt, Homo sapiens
ugaagaacacugu

SEQ ID NO: 2142437 - RNA, 21 nt, Homo sapiens
auuacuagacugccacaagga

SEQ ID NO: 2142438 - RNA, 22 nt, Homo sapiens
uaacagaaagaacgugaucucc

SEQ ID NO: 2142439 - RNA, 13 nt, Homo sapiens
cucuuaagccauc

SEQ ID NO: 2142440 - RNA, 11 nt, Homo sapiens
aauaaauggau

SEQ ID NO: 2142441 - RNA, 21 nt, Homo sapiens
aauccuugugggaaaagaaau

SEQ ID NO: 2142442 - RNA, 21 nt, Homo sapiens
auuccuucacauaguuugaua

SEQ ID NO: 2142443 - RNA, 17 nt, Homo sapiens
ggcacagcuaaccacuu

SEQ ID NO: 2142444 - RNA, 18 nt, Homo sapiens
cuuucuccuguagcacaa

SEQ ID NO: 2142445 - RNA, 23 nt, Homo sapiens
agaaguucaguuuuuacugagga

SEQ ID NO: 2142446 - RNA, 17 nt, Homo sapiens
uuuaaaccaauugcagg

SEQ ID NO: 2142447 - RNA, 22 nt, Homo sapiens
gaaagauuaaauaugaucacuu

SEQ ID NO: 2142448 - RNA, 19 nt, Homo sapiens
cacauugcuauucccaucc

SEQ ID NO: 2142449 - RNA, 14 nt, Homo sapiens
cagcccccacuuuc

SEQ ID NO: 2142450 - RNA, 15 nt, Homo sapiens
ccaaacaucuuucag

SEQ ID NO: 2142451 - RNA, 20 nt, Homo sapiens
accugugauauuuuacuuga

SEQ ID NO: 2142452 - RNA, 12 nt, Homo sapiens
accuacauauuc

SEQ ID NO: 2142453 - RNA, 20 nt, Homo sapiens
gugagcagagauguacugca

SEQ ID NO: 2142454 - RNA, 21 nt, Homo sapiens
ugucacuugcuggcugugaaa

SEQ ID NO: 2142455 - RNA, 20 nt, Homo sapiens
gcucagggaaauggccuucc

SEQ ID NO: 2142456 - RNA, 15 nt, Homo sapiens
augcuuuagguugcu

SEQ ID NO: 2142457 - RNA, 14 nt, Homo sapiens
uaaauuccaaagau

SEQ ID NO: 2142458 - RNA, 14 nt, Homo sapiens
agccaagcaaaaug

SEQ ID NO: 2142459 - RNA, 18 nt, Homo sapiens
ugcacccagcagugucac

SEQ ID NO: 2142460 - RNA, 20 nt, Homo sapiens
aaacuuuucuaauacucuac

SEQ ID NO: 2142461 - RNA, 19 nt, Homo sapiens
cugcccagugcaaaccacu

SEQ ID NO: 2142462 - RNA, 21 nt, Homo sapiens
uguaacaauuguguagccuuu

SEQ ID NO: 2142463 - RNA, 13 nt, Homo sapiens
ggggacagugauu

SEQ ID NO: 2142464 - RNA, 17 nt, Homo sapiens
ugugguuaacaucucag

SEQ ID NO: 2142465 - RNA, 17 nt, Homo sapiens
gggcgcaagucaaagag

SEQ ID NO: 2142466 - RNA, 11 nt, Homo sapiens
acaucccucag

SEQ ID NO: 2142467 - RNA, 19 nt, Homo sapiens
cuuguccaucacucuagua

SEQ ID NO: 2142468 - RNA, 16 nt, Homo sapiens
ugucuucaaacuguga

SEQ ID NO: 2142469 - RNA, 21 nt, Homo sapiens
caugggccccuucaaaccuca

SEQ ID NO: 2142470 - RNA, 18 nt, Homo sapiens
uggaguccgacaaagcua

SEQ ID NO: 2142471 - RNA, 22 nt, Homo sapiens
uuucaauacacucaagugccau

SEQ ID NO: 2142472 - RNA, 16 nt, Homo sapiens
ugggcccaagggcaga

SEQ ID NO: 2142473 - RNA, 18 nt, Homo sapiens
accucuugaagaacugac

SEQ ID NO: 2142474 - RNA, 16 nt, Homo sapiens
aguaucacacuguaua

SEQ ID NO: 2142475 - RNA, 15 nt, Homo sapiens
acaaagacucacucu

SEQ ID NO: 2142476 - RNA, 18 nt, Homo sapiens
caaaauucuuaaguaugu

SEQ ID NO: 2142477 - RNA, 22 nt, Homo sapiens
cauaauugcuguucugcugaau

SEQ ID NO: 2142478 - RNA, 15 nt, Homo sapiens
gaaaaguaagcccuu

SEQ ID NO: 2142479 - RNA, 23 nt, Homo sapiens
cuaucagcauuuuacuacuuuaa

SEQ ID NO: 2142480 - RNA, 13 nt, Homo sapiens
guaauaauaccuc

SEQ ID NO: 2142481 - RNA, 23 nt, Homo sapiens
ccugcccuacagaggucucugcc

SEQ ID NO: 2142482 - RNA, 13 nt, Homo sapiens
gucuuaccaauga

SEQ ID NO: 2142483 - RNA, 19 nt, Homo sapiens
guuucgaaguugaugcaau

SEQ ID NO: 2142484 - RNA, 12 nt, Homo sapiens
uuauaaacuaga

SEQ ID NO: 2142485 - RNA, 21 nt, Homo sapiens
aauccuggaaggacacaguga

SEQ ID NO: 2142486 - RNA, 17 nt, Homo sapiens
agauccuuaaugcagag

SEQ ID NO: 2142487 - RNA, 17 nt, Homo sapiens
acauccucucaaguuag

SEQ ID NO: 2142488 - RNA, 15 nt, Homo sapiens
ugccaggcugcuaaa

SEQ ID NO: 2142489 - RNA, 16 nt, Homo sapiens
agguucaguauuaugu

SEQ ID NO: 2142490 - RNA, 13 nt, Homo sapiens
uuaugacuguugu

SEQ ID NO: 2142491 - RNA, 17 nt, Homo sapiens
ccauaaauccuugauga

SEQ ID NO: 2142492 - RNA, 13 nt, Homo sapiens
uuauuacuguugg

SEQ ID NO: 2142493 - RNA, 13 nt, Homo sapiens
cugccguccccua

SEQ ID NO: 2142494 - RNA, 14 nt, Homo sapiens
uauuuugaucuuca

SEQ ID NO: 2142495 - RNA, 22 nt, Homo sapiens
gugcuauaaaugccagagccaa

SEQ ID NO: 2142496 - RNA, 18 nt, Homo sapiens
accaaggaggggccagug

SEQ ID NO: 2142497 - RNA, 15 nt, Homo sapiens
ugcaaccuccaccuc

SEQ ID NO: 2142498 - RNA, 19 nt, Homo sapiens
gaaguuccuuagguuuucu

SEQ ID NO: 2142499 - RNA, 20 nt, Homo sapiens
auuucuuuguauguauuucu

SEQ ID NO: 2142500 - RNA, 20 nt, Homo sapiens
uaucccaguuuaauauucca

SEQ ID NO: 2142501 - RNA, 19 nt, Homo sapiens
guuccuuccugcagaccug

SEQ ID NO: 2142502 - RNA, 16 nt, Homo sapiens
auaagauuaaaggaag

SEQ ID NO: 2142503 - RNA, 22 nt, Homo sapiens
ucaagaggcgagaugagcccac

SEQ ID NO: 2142504 - RNA, 15 nt, Homo sapiens
gcaaauuaaugugua

SEQ ID NO: 2142505 - RNA, 16 nt, Homo sapiens
ucuucaugagcacuuu

SEQ ID NO: 2142506 - RNA, 19 nt, Homo sapiens
accccacaacacgccuaaa

SEQ ID NO: 2142507 - RNA, 12 nt, Homo sapiens
cauucugcaaug

SEQ ID NO: 2142508 - RNA, 21 nt, Homo sapiens
auucuucugagcacuguuuau

SEQ ID NO: 2142509 - RNA, 17 nt, Homo sapiens
cucgaaucucugugccu

SEQ ID NO: 2142510 - RNA, 14 nt, Homo sapiens
aagggucuugacuc

SEQ ID NO: 2142511 - RNA, 13 nt, Homo sapiens
aacgugcugucag

SEQ ID NO: 2142512 - RNA, 23 nt, Homo sapiens
uucuaagguccgguguucuaaga

SEQ ID NO: 2142513 - RNA, 14 nt, Homo sapiens
uacauaaggcugga

SEQ ID NO: 2142514 - RNA, 23 nt, Homo sapiens
gaaagaaguccuuucucuuuauu

SEQ ID NO: 2142515 - RNA, 18 nt, Homo sapiens
cuggaauauugugauucu

SEQ ID NO: 2142516 - RNA, 21 nt, Homo sapiens
auagacccucucaagugcccu

SEQ ID NO: 2142517 - RNA, 17 nt, Homo sapiens
accguggggaggccauu

SEQ ID NO: 2142518 - RNA, 12 nt, Homo sapiens
acuugccaagaa

SEQ ID NO: 2142519 - RNA, 15 nt, Homo sapiens
cuaauuaaucacaaa

SEQ ID NO: 2142520 - RNA, 14 nt, Homo sapiens
accagugugcuugg

SEQ ID NO: 2142521 - RNA, 21 nt, Homo sapiens
agccuaacacacuccaagaua

SEQ ID NO: 2142522 - RNA, 19 nt, Homo sapiens
aacuauaaauauguacaau

SEQ ID NO: 2142523 - RNA, 13 nt, Homo sapiens
agauuaacacuga

SEQ ID NO: 2142524 - RNA, 20 nt, Homo sapiens
gggcaacauggcccuaccag

SEQ ID NO: 2142525 - RNA, 21 nt, Homo sapiens
ugccuaugccaagucccugga

SEQ ID NO: 2142526 - RNA, 14 nt, Homo sapiens
caaaugaacuugca

SEQ ID NO: 2142527 - RNA, 17 nt, Homo sapiens
agaauacacugugacuu

SEQ ID NO: 2142528 - RNA, 17 nt, Homo sapiens
accgcucuuuucauuga

SEQ ID NO: 2142529 - RNA, 17 nt, Homo sapiens
acauaaaauuuacauuu

SEQ ID NO: 2142530 - RNA, 20 nt, Homo sapiens
ggagcaaaaucgaugcagug

SEQ ID NO: 2142531 - RNA, 23 nt, Homo sapiens
augcuuuugugucccugauuugg

SEQ ID NO: 2142532 - RNA, 18 nt, Homo sapiens
uggagacuaaagauugca

SEQ ID NO: 2142533 - RNA, 21 nt, Homo sapiens
ccauguugcugccaaccauac

SEQ ID NO: 2142534 - RNA, 21 nt, Homo sapiens
gcagagggagguagaagccau

SEQ ID NO: 2142535 - RNA, 19 nt, Homo sapiens
aaaguguaauagcauacau

SEQ ID NO: 2142536 - RNA, 18 nt, Homo sapiens
ucacugccccucucucag

SEQ ID NO: 2142537 - RNA, 16 nt, Homo sapiens
auuuuuaugugcaaua

SEQ ID NO: 2142538 - RNA, 23 nt, Homo sapiens
aaggaaaaugugcacacauauac

SEQ ID NO: 2142539 - RNA, 14 nt, Homo sapiens
aaugaaaaaauuaa

SEQ ID NO: 2142540 - RNA, 22 nt, Homo sapiens
aagugcagggauuacaggcaug

SEQ ID NO: 2142541 - RNA, 18 nt, Homo sapiens
uauugcuagccaucuuga

SEQ ID NO: 2142542 - RNA, 19 nt, Homo sapiens
aucuggaaaccucuacaua

SEQ ID NO: 2142543 - RNA, 13 nt, Homo sapiens
aucacaguauuau

SEQ ID NO: 2142544 - RNA, 17 nt, Homo sapiens
auucugauuuauuccua

SEQ ID NO: 2142545 - RNA, 13 nt, Homo sapiens
aguuugcaaaaaa

SEQ ID NO: 2142546 - RNA, 20 nt, Homo sapiens
cuuuccagccuauagcagaa

SEQ ID NO: 2142547 - RNA, 16 nt, Homo sapiens
ggagcuagaacauucc

SEQ ID NO: 2142548 - RNA, 19 nt, Homo sapiens
ccugcaguggugugaaaca

SEQ ID NO: 2142549 - RNA, 23 nt, Homo sapiens
ugccucaccuaauaggcugggag

SEQ ID NO: 2142550 - RNA, 22 nt, Homo sapiens
auauccaacaugugcucaggga

SEQ ID NO: 2142551 - RNA, 14 nt, Homo sapiens
cccuauuacuuguu

SEQ ID NO: 2142552 - RNA, 18 nt, Homo sapiens
cagagcugcacaggguuu

SEQ ID NO: 2142553 - RNA, 15 nt, Homo sapiens
cacucccaguucccu

SEQ ID NO: 2142554 - RNA, 22 nt, Homo sapiens
gucuuucgcacauucuccugau

SEQ ID NO: 2142555 - RNA, 16 nt, Homo sapiens
gaaggacggugccaag

SEQ ID NO: 2142556 - RNA, 17 nt, Homo sapiens
ggaaccucgaguacugu

SEQ ID NO: 2142557 - RNA, 16 nt, Homo sapiens
ggcaagggaccugcuu

SEQ ID NO: 2142558 - RNA, 18 nt, Homo sapiens
uuggaaucaugcaaaaaa

SEQ ID NO: 2142559 - RNA, 15 nt, Homo sapiens
ugccacccuaccugu

SEQ ID NO: 2142560 - RNA, 23 nt, Homo sapiens
acaguacucaguuaggcagugca

SEQ ID NO: 2142561 - RNA, 22 nt, Homo sapiens
caggggagcaagcuuacacaag

SEQ ID NO: 2142562 - RNA, 13 nt, Homo sapiens
uuuagugauuuga

SEQ ID NO: 2142563 - RNA, 23 nt, Homo sapiens
cugaaaccucugggucaucucuc

SEQ ID NO: 2142564 - RNA, 23 nt, Homo sapiens
gcagaacuaagcucaguauguga

SEQ ID NO: 2142565 - RNA, 18 nt, Homo sapiens
acagucaaaauguuugau

SEQ ID NO: 2142566 - RNA, 13 nt, Homo sapiens
gacauuaugugug

SEQ ID NO: 2142567 - RNA, 21 nt, Homo sapiens
agccacaugggaaacuuccaa

SEQ ID NO: 2142568 - RNA, 17 nt, Homo sapiens
ugacaucaaaaugaguc

SEQ ID NO: 2142569 - RNA, 21 nt, Homo sapiens
ggucaucucucacacauucca

SEQ ID NO: 2142570 - RNA, 13 nt, Homo sapiens
cuaucgugucaac

SEQ ID NO: 2142571 - RNA, 24 nt, Homo sapiens
ccuugaugauugacaacacccauu

SEQ ID NO: 2142572 - RNA, 19 nt, Homo sapiens
aauccaauggguuuuuccc

SEQ ID NO: 2142573 - RNA, 22 nt, Homo sapiens
ccuggccaagcgagagcagcug

SEQ ID NO: 2142574 - RNA, 23 nt, Homo sapiens
auggagcugcguuuccugugcau

SEQ ID NO: 2142575 - RNA, 13 nt, Homo sapiens
caaaucagucuca

SEQ ID NO: 2142576 - RNA, 22 nt, Homo sapiens
guucucggggaugcauagauuc

SEQ ID NO: 2142577 - RNA, 16 nt, Homo sapiens
cugugucaaugccugu

SEQ ID NO: 2142578 - RNA, 16 nt, Homo sapiens
cuaaauaugagcccag

SEQ ID NO: 2142579 - RNA, 22 nt, Homo sapiens
ccggcucccuucuacagccuca

SEQ ID NO: 2142580 - RNA, 17 nt, Homo sapiens
cccugguggguggcacu

SEQ ID NO: 2142581 - RNA, 22 nt, Homo sapiens
uuuggggaccaaaggucaggga

SEQ ID NO: 2142582 - RNA, 14 nt, Homo sapiens
cauuuucaccccac

SEQ ID NO: 2142583 - RNA, 15 nt, Homo sapiens
ucuauagaacaucca

SEQ ID NO: 2142584 - RNA, 19 nt, Homo sapiens
gcugacccaagagaacuca

SEQ ID NO: 2142585 - RNA, 19 nt, Homo sapiens
uggacaucuucacgaacag

SEQ ID NO: 2142586 - RNA, 18 nt, Homo sapiens
aacuuauuugcugcagaa

SEQ ID NO: 2142587 - RNA, 12 nt, Homo sapiens
acaucauuccuu

SEQ ID NO: 2142588 - RNA, 22 nt, Homo sapiens
caguguuuaagucagcaaaucu

SEQ ID NO: 2142589 - RNA, 13 nt, Homo sapiens
caacauagucaua

SEQ ID NO: 2142590 - RNA, 23 nt, Homo sapiens
gugacaagaauuguuaccuguca

SEQ ID NO: 2142591 - RNA, 16 nt, Homo sapiens
ccaaagaguguggugu

SEQ ID NO: 2142592 - RNA, 19 nt, Homo sapiens
ccagccuugagaugcuuca

SEQ ID NO: 2142593 - RNA, 21 nt, Homo sapiens
auuuagaauauguuaaugcaa

SEQ ID NO: 2142594 - RNA, 12 nt, Homo sapiens
ugacugcugcuc

SEQ ID NO: 2142595 - RNA, 13 nt, Homo sapiens
ucauuuccaauca

SEQ ID NO: 2142596 - RNA, 20 nt, Homo sapiens
gaaaccccaucucuacuaaa

SEQ ID NO: 2142597 - RNA, 19 nt, Homo sapiens
uggacauuuauguacaaaa

SEQ ID NO: 2142598 - RNA, 15 nt, Homo sapiens
gaggcagaauggugg

SEQ ID NO: 2142599 - RNA, 23 nt, Homo sapiens
acuuuacaggagguuguggaugc

SEQ ID NO: 2142600 - RNA, 23 nt, Homo sapiens
uuacacagguuuaguugacuaau

SEQ ID NO: 2142601 - RNA, 22 nt, Homo sapiens
uccacaggcaggcucauuucac

SEQ ID NO: 2142602 - RNA, 16 nt, Homo sapiens
uuguauuuauuuccag

SEQ ID NO: 2142603 - RNA, 24 nt, Homo sapiens
cuccuucccccagcccaauaaagg

SEQ ID NO: 2142604 - RNA, 14 nt, Homo sapiens
uuauaagacuggaa

SEQ ID NO: 2142605 - RNA, 15 nt, Homo sapiens
uuaacagcaugcugc

SEQ ID NO: 2142606 - RNA, 21 nt, Homo sapiens
cauccuagugaauguaaaaug

SEQ ID NO: 2142607 - RNA, 21 nt, Homo sapiens
acagcccuggggacaccugcc

SEQ ID NO: 2142608 - RNA, 22 nt, Homo sapiens
acgugcaggacagcucuugauu

SEQ ID NO: 2142609 - RNA, 14 nt, Homo sapiens
ugacaaaaggcaga

SEQ ID NO: 2142610 - RNA, 14 nt, Homo sapiens
ggacaaaaugcaga

SEQ ID NO: 2142611 - RNA, 15 nt, Homo sapiens
cucaaauaacuaaaa

SEQ ID NO: 2142612 - RNA, 18 nt, Homo sapiens
aacuccccuuguacucuu

SEQ ID NO: 2142613 - RNA, 19 nt, Homo sapiens
cagacaacacugggaaaca

SEQ ID NO: 2142614 - RNA, 13 nt, Homo sapiens
agaacugccaaag

SEQ ID NO: 2142615 - RNA, 16 nt, Homo sapiens
uauuuugguugcugau

SEQ ID NO: 2142616 - RNA, 17 nt, Homo sapiens
agcuucacucucugggg

SEQ ID NO: 2142617 - RNA, 21 nt, Homo sapiens
gcaaauuccaccccuccuucc

SEQ ID NO: 2142618 - RNA, 15 nt, Homo sapiens
cacauauggcacaac

SEQ ID NO: 2142619 - RNA, 16 nt, Homo sapiens
agugcuuuaccuuuaa

SEQ ID NO: 2142620 - RNA, 14 nt, Homo sapiens
uaugaugaaaaccu

SEQ ID NO: 2142621 - RNA, 22 nt, Homo sapiens
gaccaaggcgggcggaucacuu

SEQ ID NO: 2142622 - RNA, 17 nt, Homo sapiens
ucacauuuuuacaaaua

SEQ ID NO: 2142623 - RNA, 17 nt, Homo sapiens
gcucuauguuuguauau

SEQ ID NO: 2142624 - RNA, 20 nt, Homo sapiens
uuuuacugugaaacuggcac

SEQ ID NO: 2142625 - RNA, 15 nt, Homo sapiens
augccagugccuuau

SEQ ID NO: 2142626 - RNA, 18 nt, Homo sapiens
ugcacucuaaacugcaaa

SEQ ID NO: 2142627 - RNA, 18 nt, Homo sapiens
ugagcaacuccuguucuu

SEQ ID NO: 2142628 - RNA, 17 nt, Homo sapiens
ucuguucccuugccauc

SEQ ID NO: 2142629 - RNA, 11 nt, Homo sapiens
gugccugagac

SEQ ID NO: 2142630 - RNA, 14 nt, Homo sapiens
ccuuguuauuugua

SEQ ID NO: 2142631 - RNA, 16 nt, Homo sapiens
aaguaaaugagccuuu

SEQ ID NO: 2142632 - RNA, 16 nt, Homo sapiens
ugagcucugacagugu

SEQ ID NO: 2142633 - RNA, 16 nt, Homo sapiens
cacauaacaugcuuua

SEQ ID NO: 2142634 - RNA, 21 nt, Homo sapiens
caccaucaacuuaaagugaau

SEQ ID NO: 2142635 - RNA, 17 nt, Homo sapiens
auuauagauacuuaaag

SEQ ID NO: 2142636 - RNA, 15 nt, Homo sapiens
uuuacauuaugcaaa

SEQ ID NO: 2142637 - RNA, 17 nt, Homo sapiens
ccagucacuuugccaga

SEQ ID NO: 2142638 - RNA, 23 nt, Homo sapiens
cuuuuucuccccuccucuauucc

SEQ ID NO: 2142639 - RNA, 15 nt, Homo sapiens
ucuccccggggcccg

SEQ ID NO: 2142640 - RNA, 21 nt, Homo sapiens
gucacucuguaguuacugugg

SEQ ID NO: 2142641 - RNA, 13 nt, Homo sapiens
uuccuuguauucu

SEQ ID NO: 2142642 - RNA, 21 nt, Homo sapiens
ugaacuccuggccucaaguga

SEQ ID NO: 2142643 - RNA, 18 nt, Homo sapiens
auagccgggcuccaggga

SEQ ID NO: 2142644 - RNA, 21 nt, Homo sapiens
ucagucccagagcauugcuau

SEQ ID NO: 2142645 - RNA, 19 nt, Homo sapiens
acacucauccccucacuug

SEQ ID NO: 2142646 - RNA, 17 nt, Homo sapiens
caaaccacaauacuucc

SEQ ID NO: 2142647 - RNA, 16 nt, Homo sapiens
guaacgagaagacaaa

SEQ ID NO: 2142648 - RNA, 11 nt, Homo sapiens
aaccuggaccc

SEQ ID NO: 2142649 - RNA, 15 nt, Homo sapiens
aaacuauaugccaua

SEQ ID NO: 2142650 - RNA, 15 nt, Homo sapiens
aaaauguuggaagag

SEQ ID NO: 2142651 - RNA, 22 nt, Homo sapiens
uuagcacccuucugcuguauac

SEQ ID NO: 2142652 - RNA, 13 nt, Homo sapiens
gagggcugcaguu

SEQ ID NO: 2142653 - RNA, 18 nt, Homo sapiens
gacaguggucuaauucaa

SEQ ID NO: 2142654 - RNA, 15 nt, Homo sapiens
uuauaaaugcuauuu

SEQ ID NO: 2142655 - RNA, 17 nt, Homo sapiens
aacgugccugacuuuga

SEQ ID NO: 2142656 - RNA, 14 nt, Homo sapiens
aagaagucuucucu

SEQ ID NO: 2142657 - RNA, 13 nt, Homo sapiens
ugcuucagaccau

SEQ ID NO: 2142658 - RNA, 19 nt, Homo sapiens
cuccuggagaaagacuucc

SEQ ID NO: 2142659 - RNA, 17 nt, Homo sapiens
accuucucuggagccaa

SEQ ID NO: 2142660 - RNA, 16 nt, Homo sapiens
cauuugaacacauuau

SEQ ID NO: 2142661 - RNA, 20 nt, Homo sapiens
uuaauauaagaagcuuucag

SEQ ID NO: 2142662 - RNA, 19 nt, Homo sapiens
agacaagcaacccaaacug

SEQ ID NO: 2142663 - RNA, 17 nt, Homo sapiens
uaucuuaaaggacauaa

SEQ ID NO: 2142664 - RNA, 21 nt, Homo sapiens
uacacaacuuagaaaccaaau

SEQ ID NO: 2142665 - RNA, 19 nt, Homo sapiens
cuuugaaggguaugucaca

SEQ ID NO: 2142666 - RNA, 22 nt, Homo sapiens
gugccaauuuauuuacauuuaa

SEQ ID NO: 2142667 - RNA, 22 nt, Homo sapiens
uacauaaucaaagcuaccugug

SEQ ID NO: 2142668 - RNA, 13 nt, Homo sapiens
aaacacuguggaa

SEQ ID NO: 2142669 - RNA, 22 nt, Homo sapiens
cuuugucagucugggugucuca

SEQ ID NO: 2142670 - RNA, 15 nt, Homo sapiens
caauauuuugccuuu

SEQ ID NO: 2142671 - RNA, 12 nt, Homo sapiens
ugauacuuugac

SEQ ID NO: 2142672 - RNA, 14 nt, Homo sapiens
uucacagcacauuu

SEQ ID NO: 2142673 - RNA, 19 nt, Homo sapiens
aauauguguacacauauga

SEQ ID NO: 2142674 - RNA, 16 nt, Homo sapiens
acacccaguugccaaa

SEQ ID NO: 2142675 - RNA, 18 nt, Homo sapiens
aagccauuucugucucca

SEQ ID NO: 2142676 - RNA, 13 nt, Homo sapiens
gccaggccucuac

SEQ ID NO: 2142677 - RNA, 14 nt, Homo sapiens
auaagacacucaaa

SEQ ID NO: 2142678 - RNA, 16 nt, Homo sapiens
ccugauuuguuccuuc

SEQ ID NO: 2142679 - RNA, 16 nt, Homo sapiens
uccuugaagcuuguau

SEQ ID NO: 2142680 - RNA, 23 nt, Homo sapiens
uuggcaugccauugaaacuaaga

SEQ ID NO: 2142681 - RNA, 17 nt, Homo sapiens
gcucccaugcucauacc

SEQ ID NO: 2142682 - RNA, 16 nt, Homo sapiens
uuggggguuugagggu

SEQ ID NO: 2142683 - RNA, 18 nt, Homo sapiens
ccaggcaggucuugaacu

SEQ ID NO: 2142684 - RNA, 18 nt, Homo sapiens
guggccacuucuguccau

SEQ ID NO: 2142685 - RNA, 21 nt, Homo sapiens
gggaaugaagauacugaaaua

SEQ ID NO: 2142686 - RNA, 15 nt, Homo sapiens
aucuguucacuuuuc

SEQ ID NO: 2142687 - RNA, 19 nt, Homo sapiens
gaacuccuaaccucaagug

SEQ ID NO: 2142688 - RNA, 14 nt, Homo sapiens
ccugcuucauaucu

SEQ ID NO: 2142689 - RNA, 14 nt, Homo sapiens
ugcucuccaucucu

SEQ ID NO: 2142690 - RNA, 16 nt, Homo sapiens
cugcaaauaaauucau

SEQ ID NO: 2142691 - RNA, 14 nt, Homo sapiens
ccaaguguauuuaa

SEQ ID NO: 2142692 - RNA, 13 nt, Homo sapiens
cagccacuucugc

SEQ ID NO: 2142693 - RNA, 20 nt, Homo sapiens
uaauaagauauuuaguaaua

SEQ ID NO: 2142694 - RNA, 17 nt, Homo sapiens
agccaaaaguaagugga

SEQ ID NO: 2142695 - RNA, 13 nt, Homo sapiens
cucaugccuuaau

SEQ ID NO: 2142696 - RNA, 15 nt, Homo sapiens
augacuuaaccauau

SEQ ID NO: 2142697 - RNA, 15 nt, Homo sapiens
agaacuauaacauuc

SEQ ID NO: 2142698 - RNA, 13 nt, Homo sapiens
cacaauaugaaua

SEQ ID NO: 2142699 - RNA, 18 nt, Homo sapiens
auaacccuuucuguggua

SEQ ID NO: 2142700 - RNA, 15 nt, Homo sapiens
aauaugagaauguau

SEQ ID NO: 2142701 - RNA, 13 nt, Homo sapiens
aaacacacuucca

SEQ ID NO: 2142702 - RNA, 17 nt, Homo sapiens
uugcaugacuuggacac

SEQ ID NO: 2142703 - RNA, 16 nt, Homo sapiens
acuuggguugaacuau

SEQ ID NO: 2142704 - RNA, 17 nt, Homo sapiens
aauaaugcuuaacauaa

SEQ ID NO: 2142705 - RNA, 17 nt, Homo sapiens
cucauuucacagccuuu

SEQ ID NO: 2142706 - RNA, 21 nt, Homo sapiens
uucuuuuggcaauacauuuga

SEQ ID NO: 2142707 - RNA, 15 nt, Homo sapiens
auaaaugccuuccac

SEQ ID NO: 2142708 - RNA, 18 nt, Homo sapiens
gccaaggaugacacugcc

SEQ ID NO: 2142709 - RNA, 18 nt, Homo sapiens
cuuuuagagucagacucc

SEQ ID NO: 2142710 - RNA, 20 nt, Homo sapiens
acagcugaaaagagcuuugu

SEQ ID NO: 2142711 - RNA, 18 nt, Homo sapiens
cuaacucaucugcuggua

SEQ ID NO: 2142712 - RNA, 11 nt, Homo sapiens
ugcccuuugag

SEQ ID NO: 2142713 - RNA, 16 nt, Homo sapiens
ucugccuucaacuuca

SEQ ID NO: 2142714 - RNA, 21 nt, Homo sapiens
ugcaguggcucaaugcaaccu

SEQ ID NO: 2142715 - RNA, 11 nt, Homo sapiens
ucugggcuccc

SEQ ID NO: 2142716 - RNA, 18 nt, Homo sapiens
guacuuuuagucugucau

SEQ ID NO: 2142717 - RNA, 13 nt, Homo sapiens
uuucuucucugga

SEQ ID NO: 2142718 - RNA, 12 nt, Homo sapiens
cucuaacaacaa

SEQ ID NO: 2142719 - RNA, 22 nt, Homo sapiens
uguauaucacuaaaagcaugaa

SEQ ID NO: 2142720 - RNA, 14 nt, Homo sapiens
uuggccuccagggc

SEQ ID NO: 2142721 - RNA, 23 nt, Homo sapiens
caggggggcugugccaaccuguu

SEQ ID NO: 2142722 - RNA, 15 nt, Homo sapiens
gcuugagccuuugac

SEQ ID NO: 2142723 - RNA, 17 nt, Homo sapiens
uguggccacagcagcuu

SEQ ID NO: 2142724 - RNA, 16 nt, Homo sapiens
acugacauuguuggcc

SEQ ID NO: 2142725 - RNA, 12 nt, Homo sapiens
guugauccugag

SEQ ID NO: 2142726 - RNA, 12 nt, Homo sapiens
agugccuuccac

SEQ ID NO: 2142727 - RNA, 23 nt, Homo sapiens
ggaagacgcuuccuuccaggaca

SEQ ID NO: 2142728 - RNA, 18 nt, Homo sapiens
ucaguuauuauauuuaca

SEQ ID NO: 2142729 - RNA, 14 nt, Homo sapiens
acagucucugggag

SEQ ID NO: 2142730 - RNA, 19 nt, Homo sapiens
cugagccuggcccauagaa

SEQ ID NO: 2142731 - RNA, 13 nt, Homo sapiens
uugccagagccuu

SEQ ID NO: 2142732 - RNA, 19 nt, Homo sapiens
uaccuuguaauuugaaaua

SEQ ID NO: 2142733 - RNA, 12 nt, Homo sapiens
cuuuaccugggg

SEQ ID NO: 2142734 - RNA, 19 nt, Homo sapiens
agugcaaacuucagaguuc

SEQ ID NO: 2142735 - RNA, 21 nt, Homo sapiens
uggaguaucauucuuuacaua

SEQ ID NO: 2142736 - RNA, 12 nt, Homo sapiens
gcacacaccgau

SEQ ID NO: 2142737 - RNA, 21 nt, Homo sapiens
aaauuaugcaaaagcagcuaa

SEQ ID NO: 2142738 - RNA, 16 nt, Homo sapiens
ucaccauauugcccag

SEQ ID NO: 2142739 - RNA, 19 nt, Homo sapiens
uccagaacugaggucacug

SEQ ID NO: 2142740 - RNA, 21 nt, Homo sapiens
cuagaauauuauguuccucaa

SEQ ID NO: 2142741 - RNA, 16 nt, Homo sapiens
uauguacuguacuaau

SEQ ID NO: 2142742 - RNA, 21 nt, Homo sapiens
caagucuuaguacauccucac

SEQ ID NO: 2142743 - RNA, 18 nt, Homo sapiens
cuuuaugcccuugccucu

SEQ ID NO: 2142744 - RNA, 21 nt, Homo sapiens
auuucuuuucuggccaaaagc

SEQ ID NO: 2142745 - RNA, 19 nt, Homo sapiens
auugacccacaaaguuuca

SEQ ID NO: 2142746 - RNA, 13 nt, Homo sapiens
agucuugucagaa

SEQ ID NO: 2142747 - RNA, 15 nt, Homo sapiens
cugagcugcuaggaa

SEQ ID NO: 2142748 - RNA, 18 nt, Homo sapiens
uuugacucuugcaaucca

SEQ ID NO: 2142749 - RNA, 20 nt, Homo sapiens
cucccagcuaauugagacca

SEQ ID NO: 2142750 - RNA, 18 nt, Homo sapiens
uccuucaaaaagcaaucu

SEQ ID NO: 2142751 - RNA, 19 nt, Homo sapiens
auuauguuaacauguaauc

SEQ ID NO: 2142752 - RNA, 16 nt, Homo sapiens
gucccacacugugcag

SEQ ID NO: 2142753 - RNA, 16 nt, Homo sapiens
aagaccccagcacaga

SEQ ID NO: 2142754 - RNA, 16 nt, Homo sapiens
ucuacuccaugcacau

SEQ ID NO: 2142755 - RNA, 12 nt, Homo sapiens
cagaugcacaug

SEQ ID NO: 2142756 - RNA, 16 nt, Homo sapiens
gccccuggcacucuug

SEQ ID NO: 2142757 - RNA, 16 nt, Homo sapiens
augauccugccaaucu

SEQ ID NO: 2142758 - RNA, 15 nt, Homo sapiens
aauugccacugagag

SEQ ID NO: 2142759 - RNA, 16 nt, Homo sapiens
cuucaaucugaagaua

SEQ ID NO: 2142760 - RNA, 13 nt, Homo sapiens
uccuucucagccu

SEQ ID NO: 2142761 - RNA, 15 nt, Homo sapiens
cacaacguaaaaaua

SEQ ID NO: 2142762 - RNA, 14 nt, Homo sapiens
acucccauuuuccc

SEQ ID NO: 2142763 - RNA, 14 nt, Homo sapiens
uuccaaauacccaa

SEQ ID NO: 2142764 - RNA, 14 nt, Homo sapiens
aucuuaauuccuua

SEQ ID NO: 2142765 - RNA, 21 nt, Homo sapiens
aaccgggagaaggcaugagaa

SEQ ID NO: 2142766 - RNA, 16 nt, Homo sapiens
acugcuauuagucaug

SEQ ID NO: 2142767 - RNA, 14 nt, Homo sapiens
gcacagagucagga

SEQ ID NO: 2142768 - RNA, 19 nt, Homo sapiens
cagccuaggcccuggggag

SEQ ID NO: 2142769 - RNA, 22 nt, Homo sapiens
ccugggcagccguuuuccucau

SEQ ID NO: 2142770 - RNA, 12 nt, Homo sapiens
gaugaacaucuc

SEQ ID NO: 2142771 - RNA, 22 nt, Homo sapiens
gaauacccugcucaacauuuaa

SEQ ID NO: 2142772 - RNA, 24 nt, Homo sapiens
augaaugcuuuuagugugugcaua

SEQ ID NO: 2142773 - RNA, 17 nt, Homo sapiens
ggaugaagcucuggcca

SEQ ID NO: 2142774 - RNA, 16 nt, Homo sapiens
auuauuucucuaauua

SEQ ID NO: 2142775 - RNA, 13 nt, Homo sapiens
cacugacagccug

SEQ ID NO: 2142776 - RNA, 13 nt, Homo sapiens
caaaaacagcaaa

SEQ ID NO: 2142777 - RNA, 17 nt, Homo sapiens
aggacuacucagcacug

SEQ ID NO: 2142778 - RNA, 21 nt, Homo sapiens
gcugcacucaagcuuggguga

SEQ ID NO: 2142779 - RNA, 22 nt, Homo sapiens
uccggggugggugggugggcag

SEQ ID NO: 2142780 - RNA, 14 nt, Homo sapiens
uuugaugaaaucag

SEQ ID NO: 2142781 - RNA, 19 nt, Homo sapiens
uggcuucugugccugacuc

SEQ ID NO: 2142782 - RNA, 17 nt, Homo sapiens
agacaugugacauuuau

SEQ ID NO: 2142783 - RNA, 12 nt, Homo sapiens
aaaauaugauau

SEQ ID NO: 2142784 - RNA, 17 nt, Homo sapiens
agaguucaauggcugcu

SEQ ID NO: 2142785 - RNA, 21 nt, Homo sapiens
uaaaaugauuguaguaaucug

SEQ ID NO: 2142786 - RNA, 19 nt, Homo sapiens
uuauuucucauugccucuu

SEQ ID NO: 2142787 - RNA, 13 nt, Homo sapiens
ugaggggacugca

SEQ ID NO: 2142788 - RNA, 21 nt, Homo sapiens
ugaaugcugcugagugaauga

SEQ ID NO: 2142789 - RNA, 16 nt, Homo sapiens
ccagugugaggcugua

SEQ ID NO: 2142790 - RNA, 22 nt, Homo sapiens
uaaaggauaauggugaacauuu

SEQ ID NO: 2142791 - RNA, 17 nt, Homo sapiens
ccaaguuggagugcagu

SEQ ID NO: 2142792 - RNA, 15 nt, Homo sapiens
ccuuggcucaauccu

SEQ ID NO: 2142793 - RNA, 20 nt, Homo sapiens
agggagcugaguaacaccau

SEQ ID NO: 2142794 - RNA, 11 nt, Homo sapiens
ggcuucucacg

SEQ ID NO: 2142795 - RNA, 15 nt, Homo sapiens
cuucaaacgaaaugg

SEQ ID NO: 2142796 - RNA, 19 nt, Homo sapiens
aaugucaguguuugggaaa

SEQ ID NO: 2142797 - RNA, 23 nt, Homo sapiens
guaauuccuaacuaucacugguu

SEQ ID NO: 2142798 - RNA, 21 nt, Homo sapiens
acuggaacacuaaugaggaaa

SEQ ID NO: 2142799 - RNA, 20 nt, Homo sapiens
ucagcaucgugcuguuugcc

SEQ ID NO: 2142800 - RNA, 15 nt, Homo sapiens
guccaugcugaugau

SEQ ID NO: 2142801 - RNA, 19 nt, Homo sapiens
aggccauucuuucccaaca

SEQ ID NO: 2142802 - RNA, 18 nt, Homo sapiens
auugaacuuucacauagc

SEQ ID NO: 2142803 - RNA, 15 nt, Homo sapiens
acccucccuagcucu

SEQ ID NO: 2142804 - RNA, 24 nt, Homo sapiens
ccaccccagguuuuucaucugaaa

SEQ ID NO: 2142805 - RNA, 22 nt, Homo sapiens
ggcacccauccgcuccgugacc

SEQ ID NO: 2142806 - RNA, 19 nt, Homo sapiens
ggauuccucgaaacugcca

SEQ ID NO: 2142807 - RNA, 19 nt, Homo sapiens
ggcaaucaugagcaaguga

SEQ ID NO: 2142808 - RNA, 16 nt, Homo sapiens
aaaagaacaugcaguu

SEQ ID NO: 2142809 - RNA, 19 nt, Homo sapiens
ugcuggcgacacucagggc

SEQ ID NO: 2142810 - RNA, 22 nt, Homo sapiens
aauuauacuguagcugaugaaa

SEQ ID NO: 2142811 - RNA, 18 nt, Homo sapiens
agaauaggaaaacauugc

SEQ ID NO: 2142812 - RNA, 15 nt, Homo sapiens
aacccagcaguucuc

SEQ ID NO: 2142813 - RNA, 21 nt, Homo sapiens
gucagaggaaggacuuuggca

SEQ ID NO: 2142814 - RNA, 20 nt, Homo sapiens
uaauuuuaaagucaguguug

SEQ ID NO: 2142815 - RNA, 23 nt, Homo sapiens
uucucauguugaagccacugccu

SEQ ID NO: 2142816 - RNA, 19 nt, Homo sapiens
cuaagaccuuggcauccuu

SEQ ID NO: 2142817 - RNA, 21 nt, Homo sapiens
ugugauuaucaauuaccacac

SEQ ID NO: 2142818 - RNA, 14 nt, Homo sapiens
auuggcacugcuaa

SEQ ID NO: 2142819 - RNA, 23 nt, Homo sapiens
caaacaaaaauauuuugaucaug

SEQ ID NO: 2142820 - RNA, 15 nt, Homo sapiens
cauuuucuaugcuug

SEQ ID NO: 2142821 - RNA, 23 nt, Homo sapiens
cauuaaaaaugcauauacuuuaa

SEQ ID NO: 2142822 - RNA, 12 nt, Homo sapiens
uuuccaaaacau

SEQ ID NO: 2142823 - RNA, 15 nt, Homo sapiens
cuuucagaauacaau

SEQ ID NO: 2142824 - RNA, 21 nt, Homo sapiens
gagcaggccggaaccacaggg

SEQ ID NO: 2142825 - RNA, 23 nt, Homo sapiens
uaaugagugaguucucacucugg

SEQ ID NO: 2142826 - RNA, 20 nt, Homo sapiens
uacuauggaagccacaucac

SEQ ID NO: 2142827 - RNA, 14 nt, Homo sapiens
gagccaaguccaaa

SEQ ID NO: 2142828 - RNA, 14 nt, Homo sapiens
uagccaaggccaaa

SEQ ID NO: 2142829 - RNA, 16 nt, Homo sapiens
acugcuaugugucaca

SEQ ID NO: 2142830 - RNA, 22 nt, Homo sapiens
accauaaaauaaauaaucucau

SEQ ID NO: 2142831 - RNA, 14 nt, Homo sapiens
aucuggaaugugaa

SEQ ID NO: 2142832 - RNA, 17 nt, Homo sapiens
ugaucagugggccucca

SEQ ID NO: 2142833 - RNA, 13 nt, Homo sapiens
gggguucuccccc

SEQ ID NO: 2142834 - RNA, 13 nt, Homo sapiens
ccccuccaaaacc

SEQ ID NO: 2142835 - RNA, 17 nt, Homo sapiens
gaaaaaaaaacuggggc

SEQ ID NO: 2142836 - RNA, 17 nt, Homo sapiens
auaguaacuacuuuuua

SEQ ID NO: 2142837 - RNA, 22 nt, Homo sapiens
ucugaugaccuaaccuaagcaa

SEQ ID NO: 2142838 - RNA, 16 nt, Homo sapiens
uucagcaagauaaaca

SEQ ID NO: 2142839 - RNA, 20 nt, Homo sapiens
aggucccggcuccugugcug

SEQ ID NO: 2142840 - RNA, 13 nt, Homo sapiens
gcccaaggcgaua

SEQ ID NO: 2142841 - RNA, 18 nt, Homo sapiens
acagucuuccauuugcaa

SEQ ID NO: 2142842 - RNA, 15 nt, Homo sapiens
cugcacacaccugca

SEQ ID NO: 2142843 - RNA, 22 nt, Homo sapiens
uggaaacauuggugaugcuauc

SEQ ID NO: 2142844 - RNA, 11 nt, Homo sapiens
uguugauccca

SEQ ID NO: 2142845 - RNA, 14 nt, Homo sapiens
aacauuaggaguaa

SEQ ID NO: 2142846 - RNA, 19 nt, Homo sapiens
auuccuuuuucuucacuua

SEQ ID NO: 2142847 - RNA, 21 nt, Homo sapiens
cauaucuguguauuaucucaa

SEQ ID NO: 2142848 - RNA, 20 nt, Homo sapiens
guaauuuaucuuaaccucaa

SEQ ID NO: 2142849 - RNA, 19 nt, Homo sapiens
ugacauugauuugcucuua

SEQ ID NO: 2142850 - RNA, 13 nt, Homo sapiens
ucugucuaccugg

SEQ ID NO: 2142851 - RNA, 23 nt, Homo sapiens
cuugccgaaacuggaaguuauuu

SEQ ID NO: 2142852 - RNA, 19 nt, Homo sapiens
acagaaggaaucugugcag

SEQ ID NO: 2142853 - RNA, 16 nt, Homo sapiens
cucccugcaagaaauc

SEQ ID NO: 2142854 - RNA, 15 nt, Homo sapiens
caucauugcauucca

SEQ ID NO: 2142855 - RNA, 17 nt, Homo sapiens
gaggccaagucuaauga

SEQ ID NO: 2142856 - RNA, 22 nt, Homo sapiens
uauuuugccagugggaacuccu

SEQ ID NO: 2142857 - RNA, 19 nt, Homo sapiens
gugcuguagauucacauac

SEQ ID NO: 2142858 - RNA, 23 nt, Homo sapiens
gaacauuuggaaaccaugcacua

SEQ ID NO: 2142859 - RNA, 20 nt, Homo sapiens
gagguggauuuggagaccga

SEQ ID NO: 2142860 - RNA, 17 nt, Homo sapiens
gaaagggaagcacauga

SEQ ID NO: 2142861 - RNA, 12 nt, Homo sapiens
aguucugcucau

SEQ ID NO: 2142862 - RNA, 20 nt, Homo sapiens
aauuuacauuuaauacagau

SEQ ID NO: 2142863 - RNA, 22 nt, Homo sapiens
ugcccagacacagacuggcaau

SEQ ID NO: 2142864 - RNA, 16 nt, Homo sapiens
ucaggcucugccucac

SEQ ID NO: 2142865 - RNA, 19 nt, Homo sapiens
uuaaaaugagagucacuug

SEQ ID NO: 2142866 - RNA, 22 nt, Homo sapiens
cucccucagacccagcggucca

SEQ ID NO: 2142867 - RNA, 23 nt, Homo sapiens
gaggagcaguguggggggacaga

SEQ ID NO: 2142868 - RNA, 18 nt, Homo sapiens
uaaaauaauuuuaucucu

SEQ ID NO: 2142869 - RNA, 16 nt, Homo sapiens
cauucuuaacaaacuc

SEQ ID NO: 2142870 - RNA, 19 nt, Homo sapiens
ugaaagucuucauggugau

SEQ ID NO: 2142871 - RNA, 18 nt, Homo sapiens
uccucaaaccacuugccu

SEQ ID NO: 2142872 - RNA, 18 nt, Homo sapiens
augagauagcugguguua

SEQ ID NO: 2142873 - RNA, 17 nt, Homo sapiens
cugacacugacauuuca

SEQ ID NO: 2142874 - RNA, 12 nt, Homo sapiens
aagccauuccaa

SEQ ID NO: 2142875 - RNA, 16 nt, Homo sapiens
agaagugguaggucag

SEQ ID NO: 2142876 - RNA, 20 nt, Homo sapiens
aggugggggaacacugagaa

SEQ ID NO: 2142877 - RNA, 19 nt, Homo sapiens
cucauuagugguacugggg

SEQ ID NO: 2142878 - RNA, 19 nt, Homo sapiens
gcgugaaucuguaucuugc

SEQ ID NO: 2142879 - RNA, 13 nt, Homo sapiens
ucccagcucaggg

SEQ ID NO: 2142880 - RNA, 13 nt, Homo sapiens
auugguucaccug

SEQ ID NO: 2142881 - RNA, 20 nt, Homo sapiens
acccuuggcacaggugucca

SEQ ID NO: 2142882 - RNA, 23 nt, Homo sapiens
auaaagcauaggguaguuugcaa

SEQ ID NO: 2142883 - RNA, 17 nt, Homo sapiens
gcaaguguucacugcuc

SEQ ID NO: 2142884 - RNA, 13 nt, Homo sapiens
gaguucuccagac

SEQ ID NO: 2142885 - RNA, 16 nt, Homo sapiens
aaaguguuuaucuuca

SEQ ID NO: 2142886 - RNA, 21 nt, Homo sapiens
cagcuccuggccauauaucaa

SEQ ID NO: 2142887 - RNA, 15 nt, Homo sapiens
aauugcagauuuuga

SEQ ID NO: 2142888 - RNA, 17 nt, Homo sapiens
ccgucucugucgcucuu

SEQ ID NO: 2142889 - RNA, 17 nt, Homo sapiens
cuuucucugacacugug

SEQ ID NO: 2142890 - RNA, 21 nt, Homo sapiens
uuuuauaugcuuacugauaua

SEQ ID NO: 2142891 - RNA, 22 nt, Homo sapiens
ugugccccauguccaaguccaa

SEQ ID NO: 2142892 - RNA, 22 nt, Homo sapiens
uuguacaagguauuuacacaua

SEQ ID NO: 2142893 - RNA, 13 nt, Homo sapiens
cgcaacaguuuuu

SEQ ID NO: 2142894 - RNA, 22 nt, Homo sapiens
uccaucauacauuagugccaua

SEQ ID NO: 2142895 - RNA, 22 nt, Homo sapiens
agcccaugggacaaauugcaca

SEQ ID NO: 2142896 - RNA, 19 nt, Homo sapiens
aguuucuuacacacugucu

SEQ ID NO: 2142897 - RNA, 23 nt, Homo sapiens
uuuaugguccuaaaagcaaaaua

SEQ ID NO: 2142898 - RNA, 20 nt, Homo sapiens
cccagccuccaacuccagcu

SEQ ID NO: 2142899 - RNA, 20 nt, Homo sapiens
uccauauaacaauucaguaa

SEQ ID NO: 2142900 - RNA, 21 nt, Homo sapiens
gaagagacguuuaaaagccau

SEQ ID NO: 2142901 - RNA, 15 nt, Homo sapiens
cuuugugacuucaag

SEQ ID NO: 2142902 - RNA, 14 nt, Homo sapiens
ccaugcaccucagg

SEQ ID NO: 2142903 - RNA, 20 nt, Homo sapiens
cuuguaccacuucaucaaaa

SEQ ID NO: 2142904 - RNA, 18 nt, Homo sapiens
aacauauuuuacaucuga

SEQ ID NO: 2142905 - RNA, 14 nt, Homo sapiens
ugaaaaagaacugu

SEQ ID NO: 2142906 - RNA, 23 nt, Homo sapiens
ccaccaaauucugaauuuguaga

SEQ ID NO: 2142907 - RNA, 22 nt, Homo sapiens
gcccaugaugcagagcuuucaa

SEQ ID NO: 2142908 - RNA, 14 nt, Homo sapiens
ccuacccugaaccu

SEQ ID NO: 2142909 - RNA, 23 nt, Homo sapiens
uacccacccuuacuuccuggccu

SEQ ID NO: 2142910 - RNA, 16 nt, Homo sapiens
auugagggccagugau

SEQ ID NO: 2142911 - RNA, 21 nt, Homo sapiens
agguugcagugagcugagauc

SEQ ID NO: 2142912 - RNA, 13 nt, Homo sapiens
ggugcucagccca

SEQ ID NO: 2142913 - RNA, 20 nt, Homo sapiens
guaaauacuguaaaugcauu

SEQ ID NO: 2142914 - RNA, 16 nt, Homo sapiens
cccaggccuccagcuc

SEQ ID NO: 2142915 - RNA, 12 nt, Homo sapiens
uucaagagccag

SEQ ID NO: 2142916 - RNA, 20 nt, Homo sapiens
gcuucugcuggggccuggga

SEQ ID NO: 2142917 - RNA, 16 nt, Homo sapiens
cccuccagacaaugcc

SEQ ID NO: 2142918 - RNA, 13 nt, Homo sapiens
uagaaaaugugac

SEQ ID NO: 2142919 - RNA, 21 nt, Homo sapiens
ccucccugucucugcaucuga

SEQ ID NO: 2142920 - RNA, 14 nt, Homo sapiens
ucagcucuaaagca

SEQ ID NO: 2142921 - RNA, 18 nt, Homo sapiens
gauaaaugcacauuucag

SEQ ID NO: 2142922 - RNA, 17 nt, Homo sapiens
gaccaggauuugcacag

SEQ ID NO: 2142923 - RNA, 14 nt, Homo sapiens
aggcuccccagggc

SEQ ID NO: 2142924 - RNA, 20 nt, Homo sapiens
gucuuuccugaaccaugugg

SEQ ID NO: 2142925 - RNA, 22 nt, Homo sapiens
gaaauauauauguguguguaug

SEQ ID NO: 2142926 - RNA, 21 nt, Homo sapiens
uauauauuucuuuaaaccuug

SEQ ID NO: 2142927 - RNA, 22 nt, Homo sapiens
uaacccuuucugggaugcaaua

SEQ ID NO: 2142928 - RNA, 21 nt, Homo sapiens
cuuuauugcuuaauuucugcc

SEQ ID NO: 2142929 - RNA, 17 nt, Homo sapiens
uuauuccuugaucauuu

SEQ ID NO: 2142930 - RNA, 17 nt, Homo sapiens
uucacccacgcauauac

SEQ ID NO: 2142931 - RNA, 16 nt, Homo sapiens
uaguguaccauucuca

SEQ ID NO: 2142932 - RNA, 14 nt, Homo sapiens
uccagaaaccaaac

SEQ ID NO: 2142933 - RNA, 23 nt, Homo sapiens
agcuguuuccucacguccaucac

SEQ ID NO: 2142934 - RNA, 19 nt, Homo sapiens
cagcaggcuccuggcugug

SEQ ID NO: 2142935 - RNA, 19 nt, Homo sapiens
uuuacagugucugugugug

SEQ ID NO: 2142936 - RNA, 14 nt, Homo sapiens
cacccaccuggauu

SEQ ID NO: 2142937 - RNA, 16 nt, Homo sapiens
uucucuauacucaggu

SEQ ID NO: 2142938 - RNA, 22 nt, Homo sapiens
uccccauauccaaguaccaaug

SEQ ID NO: 2142939 - RNA, 18 nt, Homo sapiens
gaacugauucacaucuca

SEQ ID NO: 2142940 - RNA, 23 nt, Homo sapiens
aaugaaugaccuuguugcaugau

SEQ ID NO: 2142941 - RNA, 17 nt, Homo sapiens
auccugguuucgugugc

SEQ ID NO: 2142942 - RNA, 12 nt, Homo sapiens
uauuacagugaa

SEQ ID NO: 2142943 - RNA, 15 nt, Homo sapiens
uuaauaaagcuuuau

SEQ ID NO: 2142944 - RNA, 21 nt, Homo sapiens
ucuuccucaagucuugacaau

SEQ ID NO: 2142945 - RNA, 16 nt, Homo sapiens
ugcuauguauuugcaa

SEQ ID NO: 2142946 - RNA, 19 nt, Homo sapiens
auugcacagagcacacuua

SEQ ID NO: 2142947 - RNA, 14 nt, Homo sapiens
gccaaaaugcagac

SEQ ID NO: 2142948 - RNA, 16 nt, Homo sapiens
agugccagcaaugaca

SEQ ID NO: 2142949 - RNA, 22 nt, Homo sapiens
ucauuuacuuuuaaacuuugau

SEQ ID NO: 2142950 - RNA, 19 nt, Homo sapiens
uuuuuacggguaacaguga

SEQ ID NO: 2142951 - RNA, 17 nt, Homo sapiens
aaauuaggacuguauaa

SEQ ID NO: 2142952 - RNA, 23 nt, Homo sapiens
ugugacaacuuccugagggaucu

SEQ ID NO: 2142953 - RNA, 12 nt, Homo sapiens
ccacccaaaaca

SEQ ID NO: 2142954 - RNA, 14 nt, Homo sapiens
gggcucaagcugca

SEQ ID NO: 2142955 - RNA, 15 nt, Homo sapiens
cucaagauucaguag

SEQ ID NO: 2142956 - RNA, 22 nt, Homo sapiens
uaaauaauacauuuauaaucua

SEQ ID NO: 2142957 - RNA, 20 nt, Homo sapiens
guuaacuaguguuucugcag

SEQ ID NO: 2142958 - RNA, 22 nt, Homo sapiens
aaaaagugcuuauuaugugcaa

SEQ ID NO: 2142959 - RNA, 19 nt, Homo sapiens
ucuggccguugauguuggc

SEQ ID NO: 2142960 - RNA, 13 nt, Homo sapiens
aacacuaccucuu

SEQ ID NO: 2142961 - RNA, 22 nt, Homo sapiens
ugugagauguaacccaccuuga

SEQ ID NO: 2142962 - RNA, 19 nt, Homo sapiens
auguggcaaaauguuacag

SEQ ID NO: 2142963 - RNA, 19 nt, Homo sapiens
uauuuuuauuuuugcacaa

SEQ ID NO: 2142964 - RNA, 19 nt, Homo sapiens
gcgcccccaccccagaccc

SEQ ID NO: 2142965 - RNA, 20 nt, Homo sapiens
agccuuccguauccaucgaa

SEQ ID NO: 2142966 - RNA, 19 nt, Homo sapiens
gaugaauuuuaucagccau

SEQ ID NO: 2142967 - RNA, 17 nt, Homo sapiens
auuauuugcacagaaga

SEQ ID NO: 2142968 - RNA, 17 nt, Homo sapiens
accaaggcagugcaugc

SEQ ID NO: 2142969 - RNA, 21 nt, Homo sapiens
ugagcuggucaguugccaaag

SEQ ID NO: 2142970 - RNA, 16 nt, Homo sapiens
aggcuucuugcccaga

SEQ ID NO: 2142971 - RNA, 14 nt, Homo sapiens
ugguugcuguccuc

SEQ ID NO: 2142972 - RNA, 16 nt, Homo sapiens
caugggccuagcauag

SEQ ID NO: 2142973 - RNA, 14 nt, Homo sapiens
uggcaggccagugu

SEQ ID NO: 2142974 - RNA, 14 nt, Homo sapiens
gucuugagcucuaa

SEQ ID NO: 2142975 - RNA, 21 nt, Homo sapiens
cugcuguuuggcuuaacacau

SEQ ID NO: 2142976 - RNA, 19 nt, Homo sapiens
gccugucaauaaauguuga

SEQ ID NO: 2142977 - RNA, 13 nt, Homo sapiens
cggaucacuugag

SEQ ID NO: 2142978 - RNA, 14 nt, Homo sapiens
auucaggugaaaau

SEQ ID NO: 2142979 - RNA, 12 nt, Homo sapiens
uccugaguuucu

SEQ ID NO: 2142980 - RNA, 14 nt, Homo sapiens
cauugcaucauuua

SEQ ID NO: 2142981 - RNA, 20 nt, Homo sapiens
gccugugcauguaugucuug

SEQ ID NO: 2142982 - RNA, 22 nt, Homo sapiens
uagacuggacuggaccagacaa

SEQ ID NO: 2142983 - RNA, 14 nt, Homo sapiens
accagagcagcuca

SEQ ID NO: 2142984 - RNA, 14 nt, Homo sapiens
aauaaacuguuaug

SEQ ID NO: 2142985 - RNA, 21 nt, Homo sapiens
aaaucaaguuggcuucuaauc

SEQ ID NO: 2142986 - RNA, 23 nt, Homo sapiens
caagagugggcuuuguggaaaca

SEQ ID NO: 2142987 - RNA, 23 nt, Homo sapiens
caagugaagaaucuaaugaaugu

SEQ ID NO: 2142988 - RNA, 14 nt, Homo sapiens
ugugagccuugcug

SEQ ID NO: 2142989 - RNA, 20 nt, Homo sapiens
cucuggaaccuuauuccagc

SEQ ID NO: 2142990 - RNA, 15 nt, Homo sapiens
agaauaaagauuuau

SEQ ID NO: 2142991 - RNA, 21 nt, Homo sapiens
ccagccccacugccagcagca

SEQ ID NO: 2142992 - RNA, 16 nt, Homo sapiens
aaccccugcuccaguc

SEQ ID NO: 2142993 - RNA, 16 nt, Homo sapiens
cugcagucaagcccug

SEQ ID NO: 2142994 - RNA, 18 nt, Homo sapiens
cuaacagucuagugcaaa

SEQ ID NO: 2142995 - RNA, 16 nt, Homo sapiens
gaaagaaucuuuacaa

SEQ ID NO: 2142996 - RNA, 13 nt, Homo sapiens
aggacaagggaau

SEQ ID NO: 2142997 - RNA, 22 nt, Homo sapiens
acacaguggauuccagugcaug

SEQ ID NO: 2142998 - RNA, 22 nt, Homo sapiens
auucuucagauacaaacugcag

SEQ ID NO: 2142999 - RNA, 14 nt, Homo sapiens
gaaagaacuaugaa

SEQ ID NO: 2143000 - RNA, 14 nt, Homo sapiens
gcagaucuacaugu

SEQ ID NO: 2143001 - RNA, 23 nt, Homo sapiens
gagaaggugcuuuguaauauucu

SEQ ID NO: 2143002 - RNA, 15 nt, Homo sapiens
uucuccaucaugccc

SEQ ID NO: 2143003 - RNA, 13 nt, Homo sapiens
agugugagugugc

SEQ ID NO: 2143004 - RNA, 20 nt, Homo sapiens
uuacauagaaagagucugac

SEQ ID NO: 2143005 - RNA, 23 nt, Homo sapiens
caguguucaaauaaacugaagga

SEQ ID NO: 2143006 - RNA, 22 nt, Homo sapiens
uuugcgugaaaguguuacauau

SEQ ID NO: 2143007 - RNA, 18 nt, Homo sapiens
gugccuccuagagugcag

SEQ ID NO: 2143008 - RNA, 15 nt, Homo sapiens
gaaauguauccugau

SEQ ID NO: 2143009 - RNA, 18 nt, Homo sapiens
cauucaguaaguucugug

SEQ ID NO: 2143010 - RNA, 14 nt, Homo sapiens
agauaguagaacca

SEQ ID NO: 2143011 - RNA, 14 nt, Homo sapiens
uuagaacauucacu

SEQ ID NO: 2143012 - RNA, 14 nt, Homo sapiens
auaccaaaggugcu

SEQ ID NO: 2143013 - RNA, 21 nt, Homo sapiens
ucccagcaucauguagugcau

SEQ ID NO: 2143014 - RNA, 14 nt, Homo sapiens
aaagcauccaugug

SEQ ID NO: 2143015 - RNA, 16 nt, Homo sapiens
gcaguggcucaaucuc

SEQ ID NO: 2143016 - RNA, 12 nt, Homo sapiens
acugacauuucu

SEQ ID NO: 2143017 - RNA, 19 nt, Homo sapiens
acaauggaagauuugccca

SEQ ID NO: 2143018 - RNA, 21 nt, Homo sapiens
cagaauuggccucaguguagu

SEQ ID NO: 2143019 - RNA, 17 nt, Homo sapiens
aaacguuucuugaacaa

SEQ ID NO: 2143020 - RNA, 19 nt, Homo sapiens
guccucuugccagcucauu

SEQ ID NO: 2143021 - RNA, 15 nt, Homo sapiens
ucacucuucuguaaa

SEQ ID NO: 2143022 - RNA, 16 nt, Homo sapiens
agugagccaugaucau

SEQ ID NO: 2143023 - RNA, 21 nt, Homo sapiens
aaaguacauugcuuaaaauau

SEQ ID NO: 2143024 - RNA, 15 nt, Homo sapiens
aucagacagcuugaa

SEQ ID NO: 2143025 - RNA, 20 nt, Homo sapiens
aaaucccaagaaauggaauc

SEQ ID NO: 2143026 - RNA, 20 nt, Homo sapiens
cacuguuuauguuacaguga

SEQ ID NO: 2143027 - RNA, 22 nt, Homo sapiens
gcacuauucuuuguauuaccaa

SEQ ID NO: 2143028 - RNA, 21 nt, Homo sapiens
ucagcuaagggaagacauuuc

SEQ ID NO: 2143029 - RNA, 21 nt, Homo sapiens
auguguuugggauacugcuua

SEQ ID NO: 2143030 - RNA, 16 nt, Homo sapiens
ucuucugagugaaugu

SEQ ID NO: 2143031 - RNA, 17 nt, Homo sapiens
aggcuaccucaccuggg

SEQ ID NO: 2143032 - RNA, 17 nt, Homo sapiens
agcccagucuggaugug

SEQ ID NO: 2143033 - RNA, 13 nt, Homo sapiens
cuauaaacacugu

SEQ ID NO: 2143034 - RNA, 17 nt, Homo sapiens
ccuuguccgcaaggggu

SEQ ID NO: 2143035 - RNA, 19 nt, Homo sapiens
aaggacagaguaugaacac

SEQ ID NO: 2143036 - RNA, 14 nt, Homo sapiens
ggagaguacuuugg

SEQ ID NO: 2143037 - RNA, 13 nt, Homo sapiens
aucccuacaugua

SEQ ID NO: 2143038 - RNA, 20 nt, Homo sapiens
uaaaagaauugugacauaac

SEQ ID NO: 2143039 - RNA, 18 nt, Homo sapiens
uguggugcaguaaccauu

SEQ ID NO: 2143040 - RNA, 20 nt, Homo sapiens
acuuucugugacgcagacag

SEQ ID NO: 2143041 - RNA, 14 nt, Homo sapiens
aucaugguagucac

SEQ ID NO: 2143042 - RNA, 21 nt, Homo sapiens
aucuagcucuccauacuuuga

SEQ ID NO: 2143043 - RNA, 22 nt, Homo sapiens
aguaauauuauuacuuuaugaa

SEQ ID NO: 2143044 - RNA, 22 nt, Homo sapiens
cugccaagggcaggaccaaugg

SEQ ID NO: 2143045 - RNA, 17 nt, Homo sapiens
cuccaacccuagcaaaa

SEQ ID NO: 2143046 - RNA, 15 nt, Homo sapiens
ccuccaggugcacaa

SEQ ID NO: 2143047 - RNA, 15 nt, Homo sapiens
agaaucuauaguuca

SEQ ID NO: 2143048 - RNA, 16 nt, Homo sapiens
gucuugguugccagua

SEQ ID NO: 2143049 - RNA, 22 nt, Homo sapiens
gaggggcgagaaacaagacaag

SEQ ID NO: 2143050 - RNA, 17 nt, Homo sapiens
acugacuucagugggac

SEQ ID NO: 2143051 - RNA, 21 nt, Homo sapiens
uccccaaccucccccaggugc

SEQ ID NO: 2143052 - RNA, 16 nt, Homo sapiens
acaucugcuucaccaa

SEQ ID NO: 2143053 - RNA, 20 nt, Homo sapiens
uuuaccaaggauauuuacag

SEQ ID NO: 2143054 - RNA, 10 nt, Homo sapiens
agaauuugca

SEQ ID NO: 2143055 - RNA, 14 nt, Homo sapiens
gaucucugcaucuc

SEQ ID NO: 2143056 - RNA, 14 nt, Homo sapiens
cccaccuggccacc

SEQ ID NO: 2143057 - RNA, 14 nt, Homo sapiens
gcuuugugccuuug

SEQ ID NO: 2143058 - RNA, 22 nt, Homo sapiens
gaguacuuugaagaugucaucc

SEQ ID NO: 2143059 - RNA, 19 nt, Homo sapiens
cagucuucuucacuucccu

SEQ ID NO: 2143060 - RNA, 16 nt, Homo sapiens
gcugugaggucagggu

SEQ ID NO: 2143061 - RNA, 21 nt, Homo sapiens
uggcacuagcauuauaccaag

SEQ ID NO: 2143062 - RNA, 21 nt, Homo sapiens
uaugcaguaaauuaucuuggg

SEQ ID NO: 2143063 - RNA, 21 nt, Homo sapiens
caaccaccuaggcaaugaaga

SEQ ID NO: 2143064 - RNA, 23 nt, Homo sapiens
aggugaaacccagucacugugag

SEQ ID NO: 2143065 - RNA, 23 nt, Homo sapiens
guaacuguuuagaugaaugucag

SEQ ID NO: 2143066 - RNA, 16 nt, Homo sapiens
gacucauccuugccca

SEQ ID NO: 2143067 - RNA, 18 nt, Homo sapiens
gacggugcccaagccaga

SEQ ID NO: 2143068 - RNA, 19 nt, Homo sapiens
aaaauuaaucugggccaga

SEQ ID NO: 2143069 - RNA, 18 nt, Homo sapiens
ucuuccugccuacuggau

SEQ ID NO: 2143070 - RNA, 20 nt, Homo sapiens
gaguuguuucugacccacug

SEQ ID NO: 2143071 - RNA, 12 nt, Homo sapiens
auuaaaacucau

SEQ ID NO: 2143072 - RNA, 23 nt, Homo sapiens
uaaacuguuuucauguguugcaa

SEQ ID NO: 2143073 - RNA, 23 nt, Homo sapiens
caaguucauugaugacccucuga

SEQ ID NO: 2143074 - RNA, 22 nt, Homo sapiens
cuguaccauauucagcauuuga

SEQ ID NO: 2143075 - RNA, 20 nt, Homo sapiens
gaaaacuacugauacuuuca

SEQ ID NO: 2143076 - RNA, 22 nt, Homo sapiens
uuguuuuugcaugaaauuguau

SEQ ID NO: 2143077 - RNA, 23 nt, Homo sapiens
aaggcagggugguguaccugcug

SEQ ID NO: 2143078 - RNA, 13 nt, Homo sapiens
augaaauuacuua

SEQ ID NO: 2143079 - RNA, 18 nt, Homo sapiens
accugcacacuccaucuc

SEQ ID NO: 2143080 - RNA, 23 nt, Homo sapiens
gccugcuuccugucuuugggaga

SEQ ID NO: 2143081 - RNA, 14 nt, Homo sapiens
caaaaaaaacaaca

SEQ ID NO: 2143082 - RNA, 16 nt, Homo sapiens
cuccucuccccagcaa

SEQ ID NO: 2143083 - RNA, 13 nt, Homo sapiens
ugagccagugauu

SEQ ID NO: 2143084 - RNA, 23 nt, Homo sapiens
uuagccagagaugcaauauaucc

SEQ ID NO: 2143085 - RNA, 17 nt, Homo sapiens
acucuuccaccucccaa

SEQ ID NO: 2143086 - RNA, 16 nt, Homo sapiens
agauaaaaaaacagcu

SEQ ID NO: 2143087 - RNA, 13 nt, Homo sapiens
gauuuuagucaaa

SEQ ID NO: 2143088 - RNA, 19 nt, Homo sapiens
gaagagcguagacaggugu

SEQ ID NO: 2143089 - RNA, 22 nt, Homo sapiens
gaacuaggugaucucaguucuc

SEQ ID NO: 2143090 - RNA, 16 nt, Homo sapiens
uaagcuaccuugucau

SEQ ID NO: 2143091 - RNA, 14 nt, Homo sapiens
aaaaugcaaaagca

SEQ ID NO: 2143092 - RNA, 14 nt, Homo sapiens
guucaaagacugug

SEQ ID NO: 2143093 - RNA, 19 nt, Homo sapiens
guccucaguccacugcuga

SEQ ID NO: 2143094 - RNA, 13 nt, Homo sapiens
aacuucaucuuca

SEQ ID NO: 2143095 - RNA, 13 nt, Homo sapiens
gagguacacucuu

SEQ ID NO: 2143096 - RNA, 20 nt, Homo sapiens
uacaacaccagcaacauuau

SEQ ID NO: 2143097 - RNA, 15 nt, Homo sapiens
uacagauacugugag

SEQ ID NO: 2143098 - RNA, 12 nt, Homo sapiens
gacuuuguuaca

SEQ ID NO: 2143099 - RNA, 15 nt, Homo sapiens
agauuuuacaaaaga

SEQ ID NO: 2143100 - RNA, 22 nt, Homo sapiens
agcucuugcuucagagcagauu

SEQ ID NO: 2143101 - RNA, 18 nt, Homo sapiens
uguuggaguguaaaccaa

SEQ ID NO: 2143102 - RNA, 18 nt, Homo sapiens
aaaccaucaaaaauauuc

SEQ ID NO: 2143103 - RNA, 17 nt, Homo sapiens
uaucauggugaaaagcu

SEQ ID NO: 2143104 - RNA, 12 nt, Homo sapiens
aagcaaccacac

SEQ ID NO: 2143105 - RNA, 19 nt, Homo sapiens
cucauacugucugggauua

SEQ ID NO: 2143106 - RNA, 21 nt, Homo sapiens
uuugauauacuauuuucauuc

SEQ ID NO: 2143107 - RNA, 22 nt, Homo sapiens
uagaaauuauauuuuagccuuu

SEQ ID NO: 2143108 - RNA, 17 nt, Homo sapiens
agaugugaucacugaga

SEQ ID NO: 2143109 - RNA, 12 nt, Homo sapiens
ccagcccauugc

SEQ ID NO: 2143110 - RNA, 19 nt, Homo sapiens
ggcuccucugcuucucacg

SEQ ID NO: 2143111 - RNA, 18 nt, Homo sapiens
ucaaagagaaaacaucuc

SEQ ID NO: 2143112 - RNA, 22 nt, Homo sapiens
caagccugccauggguccucuc

SEQ ID NO: 2143113 - RNA, 19 nt, Homo sapiens
cacggcugauaucuuugag

SEQ ID NO: 2143114 - RNA, 15 nt, Homo sapiens
uacugcaaauuuugu

SEQ ID NO: 2143115 - RNA, 11 nt, Homo sapiens
acaagcauuuu

SEQ ID NO: 2143116 - RNA, 19 nt, Homo sapiens
ugucuuccaggcccagucc

SEQ ID NO: 2143117 - RNA, 22 nt, Homo sapiens
agccaauagaguugggacaauu

SEQ ID NO: 2143118 - RNA, 11 nt, Homo sapiens
ccuacaacuua

SEQ ID NO: 2143119 - RNA, 18 nt, Homo sapiens
gaggcaggagaauugcuu

SEQ ID NO: 2143120 - RNA, 13 nt, Homo sapiens
auaaaugccucau

SEQ ID NO: 2143121 - RNA, 22 nt, Homo sapiens
gcuuugacaugacugcaaucau

SEQ ID NO: 2143122 - RNA, 22 nt, Homo sapiens
cccuuguggcacagaugcccac

SEQ ID NO: 2143123 - RNA, 19 nt, Homo sapiens
ggaggacacuggugguucu

SEQ ID NO: 2143124 - RNA, 22 nt, Homo sapiens
ggggcgugccugccaagcucac

SEQ ID NO: 2143125 - RNA, 17 nt, Homo sapiens
augagaacacacugagu

SEQ ID NO: 2143126 - RNA, 18 nt, Homo sapiens
acuucaaggugacagaag

SEQ ID NO: 2143127 - RNA, 17 nt, Homo sapiens
ucagcccaaccuagacc

SEQ ID NO: 2143128 - RNA, 21 nt, Homo sapiens
cuccagccagccaaauccauc

SEQ ID NO: 2143129 - RNA, 19 nt, Homo sapiens
guagcauggcucuuucaua

SEQ ID NO: 2143130 - RNA, 18 nt, Homo sapiens
gaauggaaggcuuugcca

SEQ ID NO: 2143131 - RNA, 15 nt, Homo sapiens
aggagggcaaaaauu

SEQ ID NO: 2143132 - RNA, 13 nt, Homo sapiens
ccugcgagggcag

SEQ ID NO: 2143133 - RNA, 13 nt, Homo sapiens
uuuguuucucuga

SEQ ID NO: 2143134 - RNA, 16 nt, Homo sapiens
aaagaaacaccacuua

SEQ ID NO: 2143135 - RNA, 20 nt, Homo sapiens
agaacuuccaacaagccuca

SEQ ID NO: 2143136 - RNA, 19 nt, Homo sapiens
caccucugauuacauguau

SEQ ID NO: 2143137 - RNA, 17 nt, Homo sapiens
ucauagacaauuccucc

SEQ ID NO: 2143138 - RNA, 23 nt, Homo sapiens
cugacccagaggguggguguuca

SEQ ID NO: 2143139 - RNA, 21 nt, Homo sapiens
acagaaagccugggugacauu

SEQ ID NO: 2143140 - RNA, 22 nt, Homo sapiens
ugccccagauuuacuaaaucaa

SEQ ID NO: 2143141 - RNA, 13 nt, Homo sapiens
cagcccugcagug

SEQ ID NO: 2143142 - RNA, 14 nt, Homo sapiens
ggcgugguggcaca

SEQ ID NO: 2143143 - RNA, 18 nt, Homo sapiens
uucaccugcagauguucu

SEQ ID NO: 2143144 - RNA, 20 nt, Homo sapiens
accgcauccucacugggcuc

SEQ ID NO: 2143145 - RNA, 15 nt, Homo sapiens
ugaaaauuguagggu

SEQ ID NO: 2143146 - RNA, 18 nt, Homo sapiens
gugagacuguaaguuaca

SEQ ID NO: 2143147 - RNA, 20 nt, Homo sapiens
gaaugccgguuaaauuccau

SEQ ID NO: 2143148 - RNA, 16 nt, Homo sapiens
uuaugcuccugcugau

SEQ ID NO: 2143149 - RNA, 14 nt, Homo sapiens
uauccaccaccucc

SEQ ID NO: 2143150 - RNA, 12 nt, Homo sapiens
ucugcugugguc

SEQ ID NO: 2143151 - RNA, 21 nt, Homo sapiens
uaaaaauggcucagaugccac

SEQ ID NO: 2143152 - RNA, 17 nt, Homo sapiens
gaaugggagcugcaaac

SEQ ID NO: 2143153 - RNA, 15 nt, Homo sapiens
gagacuuggggacca

SEQ ID NO: 2143154 - RNA, 15 nt, Homo sapiens
aacuaggugaucuca

SEQ ID NO: 2143155 - RNA, 22 nt, Homo sapiens
ugaaauccacaauaaacgucau

SEQ ID NO: 2143156 - RNA, 22 nt, Homo sapiens
uguacuaacccagucuuucuuc

SEQ ID NO: 2143157 - RNA, 15 nt, Homo sapiens
acuuccccugggaug

SEQ ID NO: 2143158 - RNA, 23 nt, Homo sapiens
aucuuuauacuggguuucaagaa

SEQ ID NO: 2143159 - RNA, 16 nt, Homo sapiens
uacgcaaaaacuuccu

SEQ ID NO: 2143160 - RNA, 15 nt, Homo sapiens
auaauguaugaauuu

SEQ ID NO: 2143161 - RNA, 23 nt, Homo sapiens
guccagguaaaugguaugaucaa

SEQ ID NO: 2143162 - RNA, 14 nt, Homo sapiens
uacagaugugcuga

SEQ ID NO: 2143163 - RNA, 14 nt, Homo sapiens
uacuagugugcaag

SEQ ID NO: 2143164 - RNA, 16 nt, Homo sapiens
aaaaucucaacuauaa

SEQ ID NO: 2143165 - RNA, 17 nt, Homo sapiens
gcaggcuucucagucuc

SEQ ID NO: 2143166 - RNA, 19 nt, Homo sapiens
caguuacuggggucaccca

SEQ ID NO: 2143167 - RNA, 15 nt, Homo sapiens
cucuccuaacauaua

SEQ ID NO: 2143168 - RNA, 14 nt, Homo sapiens
gacugccacaagga

SEQ ID NO: 2143169 - RNA, 19 nt, Homo sapiens
aaucaugugaggaaaugau

SEQ ID NO: 2143170 - RNA, 13 nt, Homo sapiens
gggaaaaggagua

SEQ ID NO: 2143171 - RNA, 19 nt, Homo sapiens
uaguuaauuguggcuuuau

SEQ ID NO: 2143172 - RNA, 20 nt, Homo sapiens
caccaagcugcucuccuuca

SEQ ID NO: 2143173 - RNA, 15 nt, Homo sapiens
accagacucuugccu

SEQ ID NO: 2143174 - RNA, 18 nt, Homo sapiens
caagaauggggaucacag

SEQ ID NO: 2143175 - RNA, 23 nt, Homo sapiens
uaacuuguuuacauagcauuugu

SEQ ID NO: 2143176 - RNA, 14 nt, Homo sapiens
guauuuagugucuu

SEQ ID NO: 2143177 - RNA, 18 nt, Homo sapiens
acgaugccgagaccucaa

SEQ ID NO: 2143178 - RNA, 15 nt, Homo sapiens
ggagaaaugucauaa

SEQ ID NO: 2143179 - RNA, 21 nt, Homo sapiens
ugagguugaccagcucugggg

SEQ ID NO: 2143180 - RNA, 15 nt, Homo sapiens
cugcugggacugaga

SEQ ID NO: 2143181 - RNA, 16 nt, Homo sapiens
uaaaaaugcuauaauu

SEQ ID NO: 2143182 - RNA, 17 nt, Homo sapiens
augugguuacuuccuac

SEQ ID NO: 2143183 - RNA, 15 nt, Homo sapiens
auggcccagccacug

SEQ ID NO: 2143184 - RNA, 22 nt, Homo sapiens
acaacaacgagauaccaucuca

SEQ ID NO: 2143185 - RNA, 19 nt, Homo sapiens
aaacuuauuugagugauua

SEQ ID NO: 2143186 - RNA, 23 nt, Homo sapiens
acauuuuuauaaaaaugagugcu

SEQ ID NO: 2143187 - RNA, 22 nt, Homo sapiens
ccuguggaacccagcaguucug

SEQ ID NO: 2143188 - RNA, 15 nt, Homo sapiens
agaauaaaauacucu

SEQ ID NO: 2143189 - RNA, 14 nt, Homo sapiens
aagcacaucaauua

SEQ ID NO: 2143190 - RNA, 18 nt, Homo sapiens
gaauaauuuuaacagaca

SEQ ID NO: 2143191 - RNA, 20 nt, Homo sapiens
cuuaaucuccacuguuauuc

SEQ ID NO: 2143192 - RNA, 19 nt, Homo sapiens
cuuggaaaaaaauuacaaa

SEQ ID NO: 2143193 - RNA, 18 nt, Homo sapiens
gccuuuuauaaaccucua

SEQ ID NO: 2143194 - RNA, 14 nt, Homo sapiens
uacaaccuacaugu

SEQ ID NO: 2143195 - RNA, 19 nt, Homo sapiens
cauaaaagacaagcacuuu

SEQ ID NO: 2143196 - RNA, 14 nt, Homo sapiens
ccuuucaaagcacu

SEQ ID NO: 2143197 - RNA, 21 nt, Homo sapiens
cucuacagguccaggguuguu

SEQ ID NO: 2143198 - RNA, 18 nt, Homo sapiens
uguucauagcaacauuau

SEQ ID NO: 2143199 - RNA, 18 nt, Homo sapiens
cuauaguccagcuuuguu

SEQ ID NO: 2143200 - RNA, 18 nt, Homo sapiens
aaguuugcuguaccacaa

SEQ ID NO: 2143201 - RNA, 15 nt, Homo sapiens
auccaggcacucaga

SEQ ID NO: 2143202 - RNA, 19 nt, Homo sapiens
aacagauuuguucauuccg

SEQ ID NO: 2143203 - RNA, 23 nt, Homo sapiens
caaguuauaaaucaaugucacuu

SEQ ID NO: 2143204 - RNA, 15 nt, Homo sapiens
agugcccagcaugaa

SEQ ID NO: 2143205 - RNA, 16 nt, Homo sapiens
gcacagcucuucacac

SEQ ID NO: 2143206 - RNA, 16 nt, Homo sapiens
gucaaaaggacauuua

SEQ ID NO: 2143207 - RNA, 16 nt, Homo sapiens
gaccuguuuugcuuuu

SEQ ID NO: 2143208 - RNA, 18 nt, Homo sapiens
ccauuuuagucacuuuuu

SEQ ID NO: 2143209 - RNA, 15 nt, Homo sapiens
gaaagauuugaugua

SEQ ID NO: 2143210 - RNA, 23 nt, Homo sapiens
cauggcgagauacugcauguuug

SEQ ID NO: 2143211 - RNA, 20 nt, Homo sapiens
uacuucuggaagucaucuca

SEQ ID NO: 2143212 - RNA, 20 nt, Homo sapiens
ucuacuucaaaaacauuuca

SEQ ID NO: 2143213 - RNA, 18 nt, Homo sapiens
ugggaagaccagcuuugc

SEQ ID NO: 2143214 - RNA, 22 nt, Homo sapiens
gccccccguguggacacagauc

SEQ ID NO: 2143215 - RNA, 19 nt, Homo sapiens
agacggguugaaagacauc

SEQ ID NO: 2143216 - RNA, 21 nt, Homo sapiens
agcuccuuggagcaggcaaaa

SEQ ID NO: 2143217 - RNA, 20 nt, Homo sapiens
gugguugauaaugaucugaa

SEQ ID NO: 2143218 - RNA, 20 nt, Homo sapiens
uaauuaucgggaacaguguu

SEQ ID NO: 2143219 - RNA, 20 nt, Homo sapiens
ccuaauuuggacaagauuau

SEQ ID NO: 2143220 - RNA, 23 nt, Homo sapiens
uuauucuguaguuucacucucau

SEQ ID NO: 2143221 - RNA, 20 nt, Homo sapiens
gaaucaaggugauugugauu

SEQ ID NO: 2143222 - RNA, 13 nt, Homo sapiens
ugcagcauugcca

SEQ ID NO: 2143223 - RNA, 22 nt, Homo sapiens
acaacagcaaaacuccaucuca

SEQ ID NO: 2143224 - RNA, 22 nt, Homo sapiens
cugagaacagaucuccaaagcu

SEQ ID NO: 2143225 - RNA, 17 nt, Homo sapiens
aauuguuuaaaaaccga

SEQ ID NO: 2143226 - RNA, 19 nt, Homo sapiens
auuuaaaauuaaaugcaug

SEQ ID NO: 2143227 - RNA, 22 nt, Homo sapiens
uggacaaaauuaauacauucua

SEQ ID NO: 2143228 - RNA, 16 nt, Homo sapiens
cucuccaucucuagga

SEQ ID NO: 2143229 - RNA, 22 nt, Homo sapiens
gaagcuucuaaauggugcugca

SEQ ID NO: 2143230 - RNA, 14 nt, Homo sapiens
ggauucccaggaug

SEQ ID NO: 2143231 - RNA, 23 nt, Homo sapiens
auaugaacgcacaacaugcacau

SEQ ID NO: 2143232 - RNA, 16 nt, Homo sapiens
cauucuggaucugacc

SEQ ID NO: 2143233 - RNA, 18 nt, Homo sapiens
cagacacuuuucaaaaga

SEQ ID NO: 2143234 - RNA, 18 nt, Homo sapiens
ccuuuaagccugcauucu

SEQ ID NO: 2143235 - RNA, 15 nt, Homo sapiens
caaggcuccacaagc

SEQ ID NO: 2143236 - RNA, 15 nt, Homo sapiens
ggagcuuaaacagcu

SEQ ID NO: 2143237 - RNA, 16 nt, Homo sapiens
cuuccaugauacuuua

SEQ ID NO: 2143238 - RNA, 18 nt, Homo sapiens
cauuguacuaccugugua

SEQ ID NO: 2143239 - RNA, 15 nt, Homo sapiens
cuguucccaacucag

SEQ ID NO: 2143240 - RNA, 24 nt, Homo sapiens
ccugugacugacauguacgauuca

SEQ ID NO: 2143241 - RNA, 15 nt, Homo sapiens
guaugaauuauucaa

SEQ ID NO: 2143242 - RNA, 17 nt, Homo sapiens
aagaauuuuaauauugc

SEQ ID NO: 2143243 - RNA, 20 nt, Homo sapiens
gccucaccuuggggccuuga

SEQ ID NO: 2143244 - RNA, 13 nt, Homo sapiens
acacaucuuccac

SEQ ID NO: 2143245 - RNA, 19 nt, Homo sapiens
augucagccacugugauag

SEQ ID NO: 2143246 - RNA, 17 nt, Homo sapiens
auccaaguauauaugaa

SEQ ID NO: 2143247 - RNA, 12 nt, Homo sapiens
cgccauccucau

SEQ ID NO: 2143248 - RNA, 18 nt, Homo sapiens
augcaaccugugcaaaau

SEQ ID NO: 2143249 - RNA, 21 nt, Homo sapiens
agaagaggagggaccuacuga

SEQ ID NO: 2143250 - RNA, 16 nt, Homo sapiens
aacuccuauaauuccc

SEQ ID NO: 2143251 - RNA, 16 nt, Homo sapiens
ggcuccgugugggaga

SEQ ID NO: 2143252 - RNA, 22 nt, Homo sapiens
agggcccagugacaaggcccug

SEQ ID NO: 2143253 - RNA, 13 nt, Homo sapiens
ggcauucgcagug

SEQ ID NO: 2143254 - RNA, 19 nt, Homo sapiens
caggaaauggcuguggagu

SEQ ID NO: 2143255 - RNA, 19 nt, Homo sapiens
acugugcuaauaacagugc

SEQ ID NO: 2143256 - RNA, 15 nt, Homo sapiens
aaugacaucucaggg

SEQ ID NO: 2143257 - RNA, 20 nt, Homo sapiens
agaagggaaaugacuucucc

SEQ ID NO: 2143258 - RNA, 17 nt, Homo sapiens
cucauggcuuugauuga

SEQ ID NO: 2143259 - RNA, 17 nt, Homo sapiens
aacuaguaauacugucu

SEQ ID NO: 2143260 - RNA, 10 nt, Homo sapiens
gcuugcuauc

SEQ ID NO: 2143261 - RNA, 17 nt, Homo sapiens
agaugcaccaaguacag

SEQ ID NO: 2143262 - RNA, 21 nt, Homo sapiens
cuugccuugggaccauggcca

SEQ ID NO: 2143263 - RNA, 23 nt, Homo sapiens
ugauauauuagggacacuuucac

SEQ ID NO: 2143264 - RNA, 21 nt, Homo sapiens
guuggacuguaagggauugaa

SEQ ID NO: 2143265 - RNA, 17 nt, Homo sapiens
ggucagagggcccagug

SEQ ID NO: 2143266 - RNA, 21 nt, Homo sapiens
gcacgcccuacuccacugccc

SEQ ID NO: 2143267 - RNA, 18 nt, Homo sapiens
cccugucucuacuaaaaa

SEQ ID NO: 2143268 - RNA, 23 nt, Homo sapiens
auguaaugcauaggaaguauggc

SEQ ID NO: 2143269 - RNA, 22 nt, Homo sapiens
aguccucuggauugagauacuu

SEQ ID NO: 2143270 - RNA, 15 nt, Homo sapiens
ucaaacccauucccu

SEQ ID NO: 2143271 - RNA, 20 nt, Homo sapiens
cugccagggcccgaccuggg

SEQ ID NO: 2143272 - RNA, 19 nt, Homo sapiens
cacacagcuggggcuguag

SEQ ID NO: 2143273 - RNA, 15 nt, Homo sapiens
cucgcugcguccuca

SEQ ID NO: 2143274 - RNA, 22 nt, Homo sapiens
auuuuaacacacauaaaggaua

SEQ ID NO: 2143275 - RNA, 16 nt, Homo sapiens
aaguccuucaccucac

SEQ ID NO: 2143276 - RNA, 18 nt, Homo sapiens
aaggauaccaaauaccau

SEQ ID NO: 2143277 - RNA, 20 nt, Homo sapiens
ugauucgcccaaagccagac

SEQ ID NO: 2143278 - RNA, 20 nt, Homo sapiens
uauuaaaggaacacauaccu

SEQ ID NO: 2143279 - RNA, 14 nt, Homo sapiens
acugcuacugacca

SEQ ID NO: 2143280 - RNA, 15 nt, Homo sapiens
aagcaguccucccac

SEQ ID NO: 2143281 - RNA, 16 nt, Homo sapiens
auuuuaauuagcccaa

SEQ ID NO: 2143282 - RNA, 16 nt, Homo sapiens
gcucaggcgucgcugg

SEQ ID NO: 2143283 - RNA, 23 nt, Homo sapiens
acuggggaggaauccuggaccaa

SEQ ID NO: 2143284 - RNA, 17 nt, Homo sapiens
gucaugaggacaccaaa

SEQ ID NO: 2143285 - RNA, 16 nt, Homo sapiens
caugcuuuuacuuuau

SEQ ID NO: 2143286 - RNA, 19 nt, Homo sapiens
ugcgauucugcagccacaa

SEQ ID NO: 2143287 - RNA, 18 nt, Homo sapiens
aaggucacauugugccuu

SEQ ID NO: 2143288 - RNA, 13 nt, Homo sapiens
cauuguccugguu

SEQ ID NO: 2143289 - RNA, 12 nt, Homo sapiens
ugagacccaggc

SEQ ID NO: 2143290 - RNA, 11 nt, Homo sapiens
uuucaccucau

SEQ ID NO: 2143291 - RNA, 17 nt, Homo sapiens
agagaagucacagggca

SEQ ID NO: 2143292 - RNA, 19 nt, Homo sapiens
ucgaauaucuuaauuccuu

SEQ ID NO: 2143293 - RNA, 12 nt, Homo sapiens
auguguccugac

SEQ ID NO: 2143294 - RNA, 23 nt, Homo sapiens
agccaagaagaauuuauuacaaa

SEQ ID NO: 2143295 - RNA, 21 nt, Homo sapiens
cuaagguaguaacuuuccaua

SEQ ID NO: 2143296 - RNA, 17 nt, Homo sapiens
aggccacagugcaauuu

SEQ ID NO: 2143297 - RNA, 18 nt, Homo sapiens
uuuccauuguagcucuuu

SEQ ID NO: 2143298 - RNA, 13 nt, Homo sapiens
aggagcugggcuu

SEQ ID NO: 2143299 - RNA, 21 nt, Homo sapiens
caguguuuggugcacgcuggg

SEQ ID NO: 2143300 - RNA, 14 nt, Homo sapiens
augcaaagcacuga

SEQ ID NO: 2143301 - RNA, 17 nt, Homo sapiens
cugugcauaucacuuga

SEQ ID NO: 2143302 - RNA, 18 nt, Homo sapiens
auugugauaagguaacau

SEQ ID NO: 2143303 - RNA, 18 nt, Homo sapiens
aguguaucaaaaugcucu

SEQ ID NO: 2143304 - RNA, 22 nt, Homo sapiens
aauguggcaguccugugccuca

SEQ ID NO: 2143305 - RNA, 11 nt, Homo sapiens
uggacucagcc

SEQ ID NO: 2143306 - RNA, 21 nt, Homo sapiens
uaaauggaaugaaauaauuca

SEQ ID NO: 2143307 - RNA, 17 nt, Homo sapiens
accaugguuuuggcucu

SEQ ID NO: 2143308 - RNA, 14 nt, Homo sapiens
caggacgcccucac

SEQ ID NO: 2143309 - RNA, 16 nt, Homo sapiens
uucuaacuccagugaa

SEQ ID NO: 2143310 - RNA, 12 nt, Homo sapiens
gcucucucugag

SEQ ID NO: 2143311 - RNA, 22 nt, Homo sapiens
cagaaacccuuuuacagucaca

SEQ ID NO: 2143312 - RNA, 17 nt, Homo sapiens
gaccccaaguuauccac

SEQ ID NO: 2143313 - RNA, 13 nt, Homo sapiens
aggcuggggcuau

SEQ ID NO: 2143314 - RNA, 13 nt, Homo sapiens
agaaguacuuugu

SEQ ID NO: 2143315 - RNA, 17 nt, Homo sapiens
gaacuaggacugaacua

SEQ ID NO: 2143316 - RNA, 22 nt, Homo sapiens
gaggaaaaugcccugucccuag

SEQ ID NO: 2143317 - RNA, 22 nt, Homo sapiens
ccuaggacucaggccugccaau

SEQ ID NO: 2143318 - RNA, 21 nt, Homo sapiens
uuugacuagccaucucaagca

SEQ ID NO: 2143319 - RNA, 17 nt, Homo sapiens
gcccaggccaucuucca

SEQ ID NO: 2143320 - RNA, 20 nt, Homo sapiens
ggagguugcagugagccaag

SEQ ID NO: 2143321 - RNA, 13 nt, Homo sapiens
uuauuauuucuau

SEQ ID NO: 2143322 - RNA, 18 nt, Homo sapiens
aaggcagugcagugcuca

SEQ ID NO: 2143323 - RNA, 17 nt, Homo sapiens
aaauguacagacauauu

SEQ ID NO: 2143324 - RNA, 16 nt, Homo sapiens
agagccagggcugaug

SEQ ID NO: 2143325 - RNA, 22 nt, Homo sapiens
aaaaagccuccaguccaaggaa

SEQ ID NO: 2143326 - RNA, 20 nt, Homo sapiens
uacauuagcugaaaagagaa

SEQ ID NO: 2143327 - RNA, 23 nt, Homo sapiens
ucacugccagagauaaacuaaug

SEQ ID NO: 2143328 - RNA, 22 nt, Homo sapiens
uaccagagccuucaagugccaa

SEQ ID NO: 2143329 - RNA, 14 nt, Homo sapiens
auguugguuuccag

SEQ ID NO: 2143330 - RNA, 21 nt, Homo sapiens
aaaagaugcaucuaccgcucu

SEQ ID NO: 2143331 - RNA, 15 nt, Homo sapiens
ugaaacauguucuca

SEQ ID NO: 2143332 - RNA, 16 nt, Homo sapiens
uggauguggggucccc

SEQ ID NO: 2143333 - RNA, 19 nt, Homo sapiens
aaacuccuggccucaagca

SEQ ID NO: 2143334 - RNA, 18 nt, Homo sapiens
acuacaagugauccucag

SEQ ID NO: 2143335 - RNA, 18 nt, Homo sapiens
acuauaaguaauucucaa

SEQ ID NO: 2143336 - RNA, 14 nt, Homo sapiens
ugacgucugccacc

SEQ ID NO: 2143337 - RNA, 12 nt, Homo sapiens
cgccaacacuug

SEQ ID NO: 2143338 - RNA, 20 nt, Homo sapiens
aucugggccuuggccuggag

SEQ ID NO: 2143339 - RNA, 16 nt, Homo sapiens
auuugcacagaagagu

SEQ ID NO: 2143340 - RNA, 15 nt, Homo sapiens
uaaaguucuagugac

SEQ ID NO: 2143341 - RNA, 21 nt, Homo sapiens
gcucaguguuuuugugaauug

SEQ ID NO: 2143342 - RNA, 13 nt, Homo sapiens
aacauuccaagaa

SEQ ID NO: 2143343 - RNA, 16 nt, Homo sapiens
cccaaaguuguuguaa

SEQ ID NO: 2143344 - RNA, 20 nt, Homo sapiens
ucccuaauuuaucuucaugu

SEQ ID NO: 2143345 - RNA, 14 nt, Homo sapiens
cuuccaugcccugg

SEQ ID NO: 2143346 - RNA, 24 nt, Homo sapiens
caggaaagcauggcucauucugca

SEQ ID NO: 2143347 - RNA, 18 nt, Homo sapiens
cuugacuuuugaaaacaa

SEQ ID NO: 2143348 - RNA, 18 nt, Homo sapiens
ucccugccuucacugugc

SEQ ID NO: 2143349 - RNA, 18 nt, Homo sapiens
guccuggcugcacucuug

SEQ ID NO: 2143350 - RNA, 17 nt, Homo sapiens
auaucagcucugcauaa

SEQ ID NO: 2143351 - RNA, 23 nt, Homo sapiens
agcugaucugcggaucucagcuu

SEQ ID NO: 2143352 - RNA, 21 nt, Homo sapiens
uuacucucaggcauggaugaa

SEQ ID NO: 2143353 - RNA, 22 nt, Homo sapiens
ucuuggcuccccacauuggccg

SEQ ID NO: 2143354 - RNA, 15 nt, Homo sapiens
aucuuugagcccauu

SEQ ID NO: 2143355 - RNA, 22 nt, Homo sapiens
ucuucauauucagcuugcacau

SEQ ID NO: 2143356 - RNA, 17 nt, Homo sapiens
aggauugcuacugaugc

SEQ ID NO: 2143357 - RNA, 14 nt, Homo sapiens
cuuucaggacucua

SEQ ID NO: 2143358 - RNA, 16 nt, Homo sapiens
aaauugacgacuucac

SEQ ID NO: 2143359 - RNA, 15 nt, Homo sapiens
aguauaauaugcagu

SEQ ID NO: 2143360 - RNA, 22 nt, Homo sapiens
cugggugugaccugacaccugc

SEQ ID NO: 2143361 - RNA, 18 nt, Homo sapiens
gcuauuuaucccuuuccu

SEQ ID NO: 2143362 - RNA, 15 nt, Homo sapiens
ccugcgcaaagggcg

SEQ ID NO: 2143363 - RNA, 19 nt, Homo sapiens
ugcauguuggcccagaccu

SEQ ID NO: 2143364 - RNA, 16 nt, Homo sapiens
ucccacacccaccucu

SEQ ID NO: 2143365 - RNA, 19 nt, Homo sapiens
uguagcuggggcuuugaug

SEQ ID NO: 2143366 - RNA, 21 nt, Homo sapiens
cacucuuaucuacauaaggau

SEQ ID NO: 2143367 - RNA, 14 nt, Homo sapiens
ccugaaacuuugag

SEQ ID NO: 2143368 - RNA, 15 nt, Homo sapiens
acugaugagcacauc

SEQ ID NO: 2143369 - RNA, 18 nt, Homo sapiens
auucacaaaauuuccaca

SEQ ID NO: 2143370 - RNA, 20 nt, Homo sapiens
acugcagggacugccagucc

SEQ ID NO: 2143371 - RNA, 22 nt, Homo sapiens
aggguacacauucgcaccccua

SEQ ID NO: 2143372 - RNA, 16 nt, Homo sapiens
guggagaaagcacuga

SEQ ID NO: 2143373 - RNA, 12 nt, Homo sapiens
cuuuaugagcag

SEQ ID NO: 2143374 - RNA, 22 nt, Homo sapiens
acuguugguauuauauaauuca

SEQ ID NO: 2143375 - RNA, 21 nt, Homo sapiens
ggcagccacccccucccccau

SEQ ID NO: 2143376 - RNA, 14 nt, Homo sapiens
ccauccuaccacaa

SEQ ID NO: 2143377 - RNA, 20 nt, Homo sapiens
aaacaaaacuugcaucuaac

SEQ ID NO: 2143378 - RNA, 14 nt, Homo sapiens
agcaacugucuuau

SEQ ID NO: 2143379 - RNA, 22 nt, Homo sapiens
ggcuaccucaagacucaccuca

SEQ ID NO: 2143380 - RNA, 17 nt, Homo sapiens
uuauuugcuucuucgaa

SEQ ID NO: 2143381 - RNA, 18 nt, Homo sapiens
ugagaaugacccugucaa

SEQ ID NO: 2143382 - RNA, 13 nt, Homo sapiens
gucacuugggagc

SEQ ID NO: 2143383 - RNA, 16 nt, Homo sapiens
cggcuguuuacugcuu

SEQ ID NO: 2143384 - RNA, 21 nt, Homo sapiens
cugggccuccugacagcaaua

SEQ ID NO: 2143385 - RNA, 23 nt, Homo sapiens
uugcuuuguuggcaaggagccag

SEQ ID NO: 2143386 - RNA, 13 nt, Homo sapiens
accaauaccuccu

SEQ ID NO: 2143387 - RNA, 15 nt, Homo sapiens
cuggcucucagagga

SEQ ID NO: 2143388 - RNA, 20 nt, Homo sapiens
acagauaccccccuacuuaa

SEQ ID NO: 2143389 - RNA, 22 nt, Homo sapiens
gacucaucuuggcccuccucag

SEQ ID NO: 2143390 - RNA, 15 nt, Homo sapiens
aauuccuuuuugcag

SEQ ID NO: 2143391 - RNA, 15 nt, Homo sapiens
aguuacugugguaug

SEQ ID NO: 2143392 - RNA, 22 nt, Homo sapiens
ugagaaucugugcagucaucaa

SEQ ID NO: 2143393 - RNA, 16 nt, Homo sapiens
auccugcccaggccag

SEQ ID NO: 2143394 - RNA, 15 nt, Homo sapiens
ugaaaaaacugguau

SEQ ID NO: 2143395 - RNA, 23 nt, Homo sapiens
agaacugccauuauuuucuguca

SEQ ID NO: 2143396 - RNA, 15 nt, Homo sapiens
acauucacuauaaug

SEQ ID NO: 2143397 - RNA, 17 nt, Homo sapiens
ccauuugugauacuucc

SEQ ID NO: 2143398 - RNA, 16 nt, Homo sapiens
aguggcuucuuuugaa

SEQ ID NO: 2143399 - RNA, 18 nt, Homo sapiens
gcaagaaaucagccauaa

SEQ ID NO: 2143400 - RNA, 19 nt, Homo sapiens
uaucucggaccuuucagcu

SEQ ID NO: 2143401 - RNA, 14 nt, Homo sapiens
gcugcuuggcacau

SEQ ID NO: 2143402 - RNA, 23 nt, Homo sapiens
auuuuccacgcaguucuuuccau

SEQ ID NO: 2143403 - RNA, 17 nt, Homo sapiens
aauuuugaguugccaca

SEQ ID NO: 2143404 - RNA, 22 nt, Homo sapiens
ggaggggcgggagagaggcaag

SEQ ID NO: 2143405 - RNA, 18 nt, Homo sapiens
caauaaagauacaugauu

SEQ ID NO: 2143406 - RNA, 17 nt, Homo sapiens
aucauuaggcuuacgua

SEQ ID NO: 2143407 - RNA, 16 nt, Homo sapiens
gucucucugccaagau

SEQ ID NO: 2143408 - RNA, 17 nt, Homo sapiens
ggaucuuuucauucuca

SEQ ID NO: 2143409 - RNA, 22 nt, Homo sapiens
cugcgucaggcacgucuccugc

SEQ ID NO: 2143410 - RNA, 19 nt, Homo sapiens
ucaagcuauucucaugccu

SEQ ID NO: 2143411 - RNA, 19 nt, Homo sapiens
ugacgacauacaugcuacu

SEQ ID NO: 2143412 - RNA, 21 nt, Homo sapiens
uaccagucuauuuccacugaa

SEQ ID NO: 2143413 - RNA, 15 nt, Homo sapiens
uagcuuggaaacugg

SEQ ID NO: 2143414 - RNA, 23 nt, Homo sapiens
gcaucguggugugucaaugccac

SEQ ID NO: 2143415 - RNA, 15 nt, Homo sapiens
cacaugacacccgug

SEQ ID NO: 2143416 - RNA, 20 nt, Homo sapiens
uguuugugcugcagacaaaa

SEQ ID NO: 2143417 - RNA, 12 nt, Homo sapiens
agguccacuucc

SEQ ID NO: 2143418 - RNA, 13 nt, Homo sapiens
auccugugugcug

SEQ ID NO: 2143419 - RNA, 16 nt, Homo sapiens
cuccucucuacuaaaa

SEQ ID NO: 2143420 - RNA, 20 nt, Homo sapiens
ggagaucagcagcgugcaca

SEQ ID NO: 2143421 - RNA, 22 nt, Homo sapiens
cggugcuagcuugacacaguca

SEQ ID NO: 2143422 - RNA, 12 nt, Homo sapiens
uucucagacuuu

SEQ ID NO: 2143423 - RNA, 22 nt, Homo sapiens
uuaacucccuuuuuacacuuua

SEQ ID NO: 2143424 - RNA, 21 nt, Homo sapiens
gcgcccuuggcuucugugaug

SEQ ID NO: 2143425 - RNA, 23 nt, Homo sapiens
gauacacacagccacgcugauaa

SEQ ID NO: 2143426 - RNA, 19 nt, Homo sapiens
acagggaggacgcucucug

SEQ ID NO: 2143427 - RNA, 13 nt, Homo sapiens
cacaccuacugua

SEQ ID NO: 2143428 - RNA, 15 nt, Homo sapiens
aggcaggugggcucg

SEQ ID NO: 2143429 - RNA, 21 nt, Homo sapiens
uuuuaagaaaaaggaugcaca

SEQ ID NO: 2143430 - RNA, 16 nt, Homo sapiens
gauggacugaugcuuu

SEQ ID NO: 2143431 - RNA, 15 nt, Homo sapiens
ccuacugcugugagc

SEQ ID NO: 2143432 - RNA, 15 nt, Homo sapiens
ucuggauguggacuu

SEQ ID NO: 2143433 - RNA, 19 nt, Homo sapiens
aagugccaggugaucuccu

SEQ ID NO: 2143434 - RNA, 17 nt, Homo sapiens
auaacuagaguaugugu

SEQ ID NO: 2143435 - RNA, 20 nt, Homo sapiens
cacuuucccacacugugaac

SEQ ID NO: 2143436 - RNA, 19 nt, Homo sapiens
uacauuuuguaaaauauua

SEQ ID NO: 2143437 - RNA, 16 nt, Homo sapiens
ccuccuguauuccuga

SEQ ID NO: 2143438 - RNA, 12 nt, Homo sapiens
ucugaccccagc

SEQ ID NO: 2143439 - RNA, 15 nt, Homo sapiens
uguacuuaaaccucc

SEQ ID NO: 2143440 - RNA, 13 nt, Homo sapiens
gcagggcugagga

SEQ ID NO: 2143441 - RNA, 16 nt, Homo sapiens
caaaaaaaucauauaa

SEQ ID NO: 2143442 - RNA, 16 nt, Homo sapiens
gccgugccugcauucg

SEQ ID NO: 2143443 - RNA, 20 nt, Homo sapiens
cuguaauaaacagccaggag

SEQ ID NO: 2143444 - RNA, 22 nt, Homo sapiens
gugguaaaaccuguucuccaua

SEQ ID NO: 2143445 - RNA, 19 nt, Homo sapiens
acugguauuuuaucuuuga

SEQ ID NO: 2143446 - RNA, 19 nt, Homo sapiens
aaauaaagaucacacauca

SEQ ID NO: 2143447 - RNA, 18 nt, Homo sapiens
aaagcucauuucaugcuc

SEQ ID NO: 2143448 - RNA, 17 nt, Homo sapiens
cuccacccuuggacuuu

SEQ ID NO: 2143449 - RNA, 14 nt, Homo sapiens
accccgggcucucu

SEQ ID NO: 2143450 - RNA, 22 nt, Homo sapiens
uaaaacaggaccguacugcuug

SEQ ID NO: 2143451 - RNA, 14 nt, Homo sapiens
auggaggcccuccu

SEQ ID NO: 2143452 - RNA, 23 nt, Homo sapiens
gauauuguaccaggaugugcuau

SEQ ID NO: 2143453 - RNA, 20 nt, Homo sapiens
agaacauacaaggacauuca

SEQ ID NO: 2143454 - RNA, 21 nt, Homo sapiens
auauucuuccccgaaucacac

SEQ ID NO: 2143455 - RNA, 16 nt, Homo sapiens
cugaagggaaggcaaa

SEQ ID NO: 2143456 - RNA, 18 nt, Homo sapiens
cacgauugagaacugaca

SEQ ID NO: 2143457 - RNA, 15 nt, Homo sapiens
gauuuucuauuuaug

SEQ ID NO: 2143458 - RNA, 18 nt, Homo sapiens
gaaggacaggacccucag

SEQ ID NO: 2143459 - RNA, 17 nt, Homo sapiens
cuuaaaauaaaaugcag

SEQ ID NO: 2143460 - RNA, 23 nt, Homo sapiens
aaacaggagccuaccacaaggcu

SEQ ID NO: 2143461 - RNA, 23 nt, Homo sapiens
gugacauuugggagacaugugac

SEQ ID NO: 2143462 - RNA, 12 nt, Homo sapiens
ucaaaagcaauc

SEQ ID NO: 2143463 - RNA, 18 nt, Homo sapiens
uaauguccuugcuuuaca

SEQ ID NO: 2143464 - RNA, 15 nt, Homo sapiens
ucugaccagagcuau

SEQ ID NO: 2143465 - RNA, 14 nt, Homo sapiens
ugcagauacuuuga

SEQ ID NO: 2143466 - RNA, 20 nt, Homo sapiens
guccaaaauaucgagugaau

SEQ ID NO: 2143467 - RNA, 20 nt, Homo sapiens
ugagcgcuguggacuguccu

SEQ ID NO: 2143468 - RNA, 23 nt, Homo sapiens
ucucagccccugauccugugaag

SEQ ID NO: 2143469 - RNA, 15 nt, Homo sapiens
cuggaaacagcagug

SEQ ID NO: 2143470 - RNA, 20 nt, Homo sapiens
gaacaguaucuuugcacucc

SEQ ID NO: 2143471 - RNA, 15 nt, Homo sapiens
aauauauguauacau

SEQ ID NO: 2143472 - RNA, 14 nt, Homo sapiens
uuagauguuucaca

SEQ ID NO: 2143473 - RNA, 14 nt, Homo sapiens
gaaaagcgucuuua

SEQ ID NO: 2143474 - RNA, 12 nt, Homo sapiens
gacagcaaguga

SEQ ID NO: 2143475 - RNA, 23 nt, Homo sapiens
ccuuagaaauguaaacugccaua

SEQ ID NO: 2143476 - RNA, 23 nt, Homo sapiens
guaaauugauucaagugagccag

SEQ ID NO: 2143477 - RNA, 21 nt, Homo sapiens
caccuggcggcccuaagccac

SEQ ID NO: 2143478 - RNA, 17 nt, Homo sapiens
caccagggucccaggaa

SEQ ID NO: 2143479 - RNA, 21 nt, Homo sapiens
uugaaacuugguucccagaaa

SEQ ID NO: 2143480 - RNA, 14 nt, Homo sapiens
aaguugcagucuca

SEQ ID NO: 2143481 - RNA, 13 nt, Homo sapiens
acagguaugccac

SEQ ID NO: 2143482 - RNA, 12 nt, Homo sapiens
ccacuccacuca

SEQ ID NO: 2143483 - RNA, 21 nt, Homo sapiens
ggccuaaagccagcauuuccu

SEQ ID NO: 2143484 - RNA, 10 nt, Homo sapiens
ggaccaccuc

SEQ ID NO: 2143485 - RNA, 16 nt, Homo sapiens
auauggcaauagcauu

SEQ ID NO: 2143486 - RNA, 19 nt, Homo sapiens
ccggcacacugccaaauaa

SEQ ID NO: 2143487 - RNA, 24 nt, Homo sapiens
ugcucucgggugcccugcauucac

SEQ ID NO: 2143488 - RNA, 20 nt, Homo sapiens
guagcugggacuacaggugu

SEQ ID NO: 2143489 - RNA, 17 nt, Homo sapiens
ucaauggaagaaaccac

SEQ ID NO: 2143490 - RNA, 23 nt, Homo sapiens
uaaacacauuuugguucuucuca

SEQ ID NO: 2143491 - RNA, 14 nt, Homo sapiens
ucaaaugugugcuu

SEQ ID NO: 2143492 - RNA, 18 nt, Homo sapiens
ccugcuauguauuugcaa

SEQ ID NO: 2143493 - RNA, 11 nt, Homo sapiens
gccuguucaua

SEQ ID NO: 2143494 - RNA, 16 nt, Homo sapiens
ccugggacagggcaaa

SEQ ID NO: 2143495 - RNA, 23 nt, Homo sapiens
gguuaagacaaacugcauaugua

SEQ ID NO: 2143496 - RNA, 18 nt, Homo sapiens
acuuccucgcuagaguuc

SEQ ID NO: 2143497 - RNA, 22 nt, Homo sapiens
ucuuucucugccagugacagac

SEQ ID NO: 2143498 - RNA, 17 nt, Homo sapiens
cuucucuguuaaccuac

SEQ ID NO: 2143499 - RNA, 18 nt, Homo sapiens
uucuucaguguaauguga

SEQ ID NO: 2143500 - RNA, 17 nt, Homo sapiens
aaccugcaugaaagcau

SEQ ID NO: 2143501 - RNA, 22 nt, Homo sapiens
agccugugcauguaugucuugg

SEQ ID NO: 2143502 - RNA, 12 nt, Homo sapiens
ccucauuugcau

SEQ ID NO: 2143503 - RNA, 21 nt, Homo sapiens
acuuugaauuuuuuuuauguc

SEQ ID NO: 2143504 - RNA, 16 nt, Homo sapiens
gguucagacugagcuc

SEQ ID NO: 2143505 - RNA, 18 nt, Homo sapiens
uauuuugcauaguaccaa

SEQ ID NO: 2143506 - RNA, 17 nt, Homo sapiens
guuugaagacacagccu

SEQ ID NO: 2143507 - RNA, 15 nt, Homo sapiens
cuguguuuccaucuc

SEQ ID NO: 2143508 - RNA, 21 nt, Homo sapiens
ugccauugcagauucgaguca

SEQ ID NO: 2143509 - RNA, 22 nt, Homo sapiens
ccaugggagguggggccucaau

SEQ ID NO: 2143510 - RNA, 14 nt, Homo sapiens
uguucaauuucagu

SEQ ID NO: 2143511 - RNA, 11 nt, Homo sapiens
acuugccaguu

SEQ ID NO: 2143512 - RNA, 18 nt, Homo sapiens
ugcucacuaccuccucag

SEQ ID NO: 2143513 - RNA, 18 nt, Homo sapiens
ugaguuugcuguuugcaa

SEQ ID NO: 2143514 - RNA, 19 nt, Homo sapiens
aauggagugggagaucagc

SEQ ID NO: 2143515 - RNA, 24 nt, Homo sapiens
uuucuuuugagacagagucucacu

SEQ ID NO: 2143516 - RNA, 18 nt, Homo sapiens
gcagugcagcaaccagag

SEQ ID NO: 2143517 - RNA, 17 nt, Homo sapiens
acacugugcuacugaaa

SEQ ID NO: 2143518 - RNA, 17 nt, Homo sapiens
gacacuuugacauuucc

SEQ ID NO: 2143519 - RNA, 17 nt, Homo sapiens
aagucauucaguuauca

SEQ ID NO: 2143520 - RNA, 17 nt, Homo sapiens
cauguaucuaugcauuu

SEQ ID NO: 2143521 - RNA, 22 nt, Homo sapiens
auguuaagauaacuuacuguau

SEQ ID NO: 2143522 - RNA, 17 nt, Homo sapiens
cauguuguaaugcugca

SEQ ID NO: 2143523 - RNA, 22 nt, Homo sapiens
cuugauuuuuuucauuuugcca

SEQ ID NO: 2143524 - RNA, 16 nt, Homo sapiens
uggguucaagcgauuc

SEQ ID NO: 2143525 - RNA, 18 nt, Homo sapiens
guauauuaaagugcuauc

SEQ ID NO: 2143526 - RNA, 15 nt, Homo sapiens
agcaugacauacuuu

SEQ ID NO: 2143527 - RNA, 13 nt, Homo sapiens
uaugugaccucac

SEQ ID NO: 2143528 - RNA, 18 nt, Homo sapiens
cuaauuaauaguauuuca

SEQ ID NO: 2143529 - RNA, 18 nt, Homo sapiens
auacuuaugaaaucucac

SEQ ID NO: 2143530 - RNA, 21 nt, Homo sapiens
uggaauauaaggaaagcaaua

SEQ ID NO: 2143531 - RNA, 12 nt, Homo sapiens
uccuuccagugu

SEQ ID NO: 2143532 - RNA, 19 nt, Homo sapiens
aaucauuuuauaugucaaa

SEQ ID NO: 2143533 - RNA, 12 nt, Homo sapiens
ugguauucauua

SEQ ID NO: 2143534 - RNA, 21 nt, Homo sapiens
agcaaucgaaucccuuucuca

SEQ ID NO: 2143535 - RNA, 17 nt, Homo sapiens
ccuaaugcuaguuucau

SEQ ID NO: 2143536 - RNA, 14 nt, Homo sapiens
uagaauaaucucau

SEQ ID NO: 2143537 - RNA, 19 nt, Homo sapiens
ugcucuuuugcacaaggaa

SEQ ID NO: 2143538 - RNA, 23 nt, Homo sapiens
aguccuauaaauaagauaaauac

SEQ ID NO: 2143539 - RNA, 16 nt, Homo sapiens
aauuaguacaguagcu

SEQ ID NO: 2143540 - RNA, 14 nt, Homo sapiens
auuugccauucaag

SEQ ID NO: 2143541 - RNA, 19 nt, Homo sapiens
agagugacggcuggcaugg

SEQ ID NO: 2143542 - RNA, 13 nt, Homo sapiens
caagugugcucuc

SEQ ID NO: 2143543 - RNA, 14 nt, Homo sapiens
cucuuccuauccca

SEQ ID NO: 2143544 - RNA, 21 nt, Homo sapiens
cccagaaggaaccagccauga

SEQ ID NO: 2143545 - RNA, 19 nt, Homo sapiens
aagaaauccaaauuucuca

SEQ ID NO: 2143546 - RNA, 14 nt, Homo sapiens
aaauaaguuauaca

SEQ ID NO: 2143547 - RNA, 23 nt, Homo sapiens
agggccaggccucugcuggcuca

SEQ ID NO: 2143548 - RNA, 20 nt, Homo sapiens
auaaaagaauuacauaugaa

SEQ ID NO: 2143549 - RNA, 18 nt, Homo sapiens
uacaucaaugguguguua

SEQ ID NO: 2143550 - RNA, 20 nt, Homo sapiens
gaaggcaagagaaacauucu

SEQ ID NO: 2143551 - RNA, 19 nt, Homo sapiens
ugacaccauuuuccugccu

SEQ ID NO: 2143552 - RNA, 16 nt, Homo sapiens
ccauggugguuucaga

SEQ ID NO: 2143553 - RNA, 19 nt, Homo sapiens
auuuuccuuccuacacccu

SEQ ID NO: 2143554 - RNA, 15 nt, Homo sapiens
uucaaccacuguaaa

SEQ ID NO: 2143555 - RNA, 14 nt, Homo sapiens
cugcaagauucuga

SEQ ID NO: 2143556 - RNA, 12 nt, Homo sapiens
ccaggugcugcu

SEQ ID NO: 2143557 - RNA, 19 nt, Homo sapiens
gcaaucacguugaaacaag

SEQ ID NO: 2143558 - RNA, 17 nt, Homo sapiens
uuagaaacagugcaaca

SEQ ID NO: 2143559 - RNA, 18 nt, Homo sapiens
agaacacuagacaugcca

SEQ ID NO: 2143560 - RNA, 11 nt, Homo sapiens
agaggcugcug

SEQ ID NO: 2143561 - RNA, 20 nt, Homo sapiens
ggacuaauccaauaccucuu

SEQ ID NO: 2143562 - RNA, 17 nt, Homo sapiens
gauuugggggugcaaug

SEQ ID NO: 2143563 - RNA, 18 nt, Homo sapiens
caaagugcuggcauuaca

SEQ ID NO: 2143564 - RNA, 18 nt, Homo sapiens
ccaggagcaggcacgggu

SEQ ID NO: 2143565 - RNA, 16 nt, Homo sapiens
agccuagcacagcagc

SEQ ID NO: 2143566 - RNA, 23 nt, Homo sapiens
accaggagagagggcaaagggau

SEQ ID NO: 2143567 - RNA, 14 nt, Homo sapiens
cugcucagggcugg

SEQ ID NO: 2143568 - RNA, 21 nt, Homo sapiens
auaguguucacaaacugugaa

SEQ ID NO: 2143569 - RNA, 24 nt, Homo sapiens
ucaaguuucuucaaucugaagaua

SEQ ID NO: 2143570 - RNA, 18 nt, Homo sapiens
ugggguggggauagggag

SEQ ID NO: 2143571 - RNA, 18 nt, Homo sapiens
gaccacagggccuugaau

SEQ ID NO: 2143572 - RNA, 18 nt, Homo sapiens
uggcagugcuugugauuc

SEQ ID NO: 2143573 - RNA, 21 nt, Homo sapiens
cuguaccuguaggaaacagaa

SEQ ID NO: 2143574 - RNA, 14 nt, Homo sapiens
cugaaaagaagccu

SEQ ID NO: 2143575 - RNA, 20 nt, Homo sapiens
cuguauaaccccaccuugcc

SEQ ID NO: 2143576 - RNA, 21 nt, Homo sapiens
agucuuguagaaaucucagaa

SEQ ID NO: 2143577 - RNA, 18 nt, Homo sapiens
gcuaaauucacauuugcc

SEQ ID NO: 2143578 - RNA, 18 nt, Homo sapiens
ucuuaccuugaacugaag

SEQ ID NO: 2143579 - RNA, 23 nt, Homo sapiens
ucaccaugaugugaagaguuuca

SEQ ID NO: 2143580 - RNA, 13 nt, Homo sapiens
cccaggaagagcu

SEQ ID NO: 2143581 - RNA, 13 nt, Homo sapiens
cagcugaagccag

SEQ ID NO: 2143582 - RNA, 19 nt, Homo sapiens
ucucccacuuccuccuacc

SEQ ID NO: 2143583 - RNA, 22 nt, Homo sapiens
agccuggccucucagccugcau

SEQ ID NO: 2143584 - RNA, 19 nt, Homo sapiens
agguauucugcugaugcua

SEQ ID NO: 2143585 - RNA, 12 nt, Homo sapiens
gauacacuguau

SEQ ID NO: 2143586 - RNA, 22 nt, Homo sapiens
caccucucuccuuugcugaggc

SEQ ID NO: 2143587 - RNA, 13 nt, Homo sapiens
uaagcaguggcau

SEQ ID NO: 2143588 - RNA, 13 nt, Homo sapiens
gguguugccaguu

SEQ ID NO: 2143589 - RNA, 18 nt, Homo sapiens
ccaucugccaaugccaug

SEQ ID NO: 2143590 - RNA, 12 nt, Homo sapiens
aagaaggcauug

SEQ ID NO: 2143591 - RNA, 13 nt, Homo sapiens
auacauuauuaga

SEQ ID NO: 2143592 - RNA, 19 nt, Homo sapiens
acaguacucaggcagugca

SEQ ID NO: 2143593 - RNA, 17 nt, Homo sapiens
gucucauugccaguggu

SEQ ID NO: 2143594 - RNA, 17 nt, Homo sapiens
cucaacccuugagauga

SEQ ID NO: 2143595 - RNA, 16 nt, Homo sapiens
ccuauuacuuaugauu

SEQ ID NO: 2143596 - RNA, 14 nt, Homo sapiens
aggcagagaaucau

SEQ ID NO: 2143597 - RNA, 19 nt, Homo sapiens
uaaaggguggggcauugag

SEQ ID NO: 2143598 - RNA, 17 nt, Homo sapiens
guggccacagcagcuuu

SEQ ID NO: 2143599 - RNA, 15 nt, Homo sapiens
uagaauucugagauc

SEQ ID NO: 2143600 - RNA, 13 nt, Homo sapiens
accugaagacacc

SEQ ID NO: 2143601 - RNA, 21 nt, Homo sapiens
cuuagcacuauggacauuuug

SEQ ID NO: 2143602 - RNA, 23 nt, Homo sapiens
caaagcaggggaguaugcaaaag

SEQ ID NO: 2143603 - RNA, 23 nt, Homo sapiens
augucaaguaccaaaauguuaau

SEQ ID NO: 2143604 - RNA, 20 nt, Homo sapiens
ugaggcagauagcacugggu

SEQ ID NO: 2143605 - RNA, 16 nt, Homo sapiens
gggcuuggaaggaaaa

SEQ ID NO: 2143606 - RNA, 13 nt, Homo sapiens
uugauguccuucc

SEQ ID NO: 2143607 - RNA, 20 nt, Homo sapiens
agcccuucaugcauuugcac

SEQ ID NO: 2143608 - RNA, 23 nt, Homo sapiens
caguaaauguacaacugcaccug

SEQ ID NO: 2143609 - RNA, 13 nt, Homo sapiens
ucccagugacaac

SEQ ID NO: 2143610 - RNA, 22 nt, Homo sapiens
gaguugggggccagcacagcug

SEQ ID NO: 2143611 - RNA, 20 nt, Homo sapiens
agauucuaacauauugccau

SEQ ID NO: 2143612 - RNA, 20 nt, Homo sapiens
acaguggcuucaagaguccu

SEQ ID NO: 2143613 - RNA, 16 nt, Homo sapiens
agacugaugagcacau

SEQ ID NO: 2143614 - RNA, 21 nt, Homo sapiens
guuucccaucagacugucaag

SEQ ID NO: 2143615 - RNA, 16 nt, Homo sapiens
guauugaaaacuucaa

SEQ ID NO: 2143616 - RNA, 16 nt, Homo sapiens
gcgcaagcgacacagg

SEQ ID NO: 2143617 - RNA, 15 nt, Homo sapiens
gcacuguucaucuca

SEQ ID NO: 2143618 - RNA, 20 nt, Homo sapiens
uuauggaaauaccaggacca

SEQ ID NO: 2143619 - RNA, 19 nt, Homo sapiens
aaguuucuuaaagcaacac

SEQ ID NO: 2143620 - RNA, 22 nt, Homo sapiens
cuagaggacauauucacaguga

SEQ ID NO: 2143621 - RNA, 18 nt, Homo sapiens
ccaagaagucccaagacc

SEQ ID NO: 2143622 - RNA, 24 nt, Homo sapiens
auuaguuuaccucauccaugcacu

SEQ ID NO: 2143623 - RNA, 17 nt, Homo sapiens
ucaggcuacuaaaauau

SEQ ID NO: 2143624 - RNA, 19 nt, Homo sapiens
uacugacuuggaucccaaa

SEQ ID NO: 2143625 - RNA, 15 nt, Homo sapiens
gcaccaauaaagccu

SEQ ID NO: 2143626 - RNA, 15 nt, Homo sapiens
aaagacuugcacaaa

SEQ ID NO: 2143627 - RNA, 22 nt, Homo sapiens
cccugucaugguguccagacag

SEQ ID NO: 2143628 - RNA, 20 nt, Homo sapiens
auuuguucguauuuagaaug

SEQ ID NO: 2143629 - RNA, 18 nt, Homo sapiens
caagccugugauuguguu

SEQ ID NO: 2143630 - RNA, 20 nt, Homo sapiens
cuaggaaggugaaucugccc

SEQ ID NO: 2143631 - RNA, 15 nt, Homo sapiens
cuugggugucugaac

SEQ ID NO: 2143632 - RNA, 21 nt, Homo sapiens
caagagcaaaacuccgucuca

SEQ ID NO: 2143633 - RNA, 20 nt, Homo sapiens
gaggugggguacauuucucu

SEQ ID NO: 2143634 - RNA, 16 nt, Homo sapiens
aagcuccuagcagaga

SEQ ID NO: 2143635 - RNA, 11 nt, Homo sapiens
accaguguucc

SEQ ID NO: 2143636 - RNA, 14 nt, Homo sapiens
ugcccagacauuuu

SEQ ID NO: 2143637 - RNA, 16 nt, Homo sapiens
cagggccccccaacug

SEQ ID NO: 2143638 - RNA, 16 nt, Homo sapiens
agagugaaggauuuau

SEQ ID NO: 2143639 - RNA, 13 nt, Homo sapiens
aauuagaugaacu

SEQ ID NO: 2143640 - RNA, 20 nt, Homo sapiens
cgcuggacagcacucugcca

SEQ ID NO: 2143641 - RNA, 19 nt, Homo sapiens
auaccaggcagccaaagag

SEQ ID NO: 2143642 - RNA, 20 nt, Homo sapiens
aaacaauuuuuugugaugaa

SEQ ID NO: 2143643 - RNA, 16 nt, Homo sapiens
cugucucucucugucc

SEQ ID NO: 2143644 - RNA, 14 nt, Homo sapiens
auuggcucugcuca

SEQ ID NO: 2143645 - RNA, 17 nt, Homo sapiens
uuuucaugucauuugac

SEQ ID NO: 2143646 - RNA, 15 nt, Homo sapiens
uaaauggaccauccu

SEQ ID NO: 2143647 - RNA, 12 nt, Homo sapiens
agaaagucuuca

SEQ ID NO: 2143648 - RNA, 21 nt, Homo sapiens
cuggggaggugagagugcaga

SEQ ID NO: 2143649 - RNA, 21 nt, Homo sapiens
caccagaggucagguguucaa

SEQ ID NO: 2143650 - RNA, 21 nt, Homo sapiens
ugcccaaccugcucuccucuu

SEQ ID NO: 2143651 - RNA, 19 nt, Homo sapiens
agcucccaugugcugagaa

SEQ ID NO: 2143652 - RNA, 22 nt, Homo sapiens
uguaucuuuuuuaaacuguaaa

SEQ ID NO: 2143653 - RNA, 17 nt, Homo sapiens
auaugucaaaggucuaa

SEQ ID NO: 2143654 - RNA, 14 nt, Homo sapiens
agaagacacguguu

SEQ ID NO: 2143655 - RNA, 18 nt, Homo sapiens
gggauacggggucuugcu

SEQ ID NO: 2143656 - RNA, 15 nt, Homo sapiens
aacuccugccuauga

SEQ ID NO: 2143657 - RNA, 17 nt, Homo sapiens
ggaaagaaguugcuaag

SEQ ID NO: 2143658 - RNA, 18 nt, Homo sapiens
gauggcaccacugcacuc

SEQ ID NO: 2143659 - RNA, 21 nt, Homo sapiens
gauauuauucaguaguggaaa

SEQ ID NO: 2143660 - RNA, 21 nt, Homo sapiens
gagauaggccugugggccaga

SEQ ID NO: 2143661 - RNA, 13 nt, Homo sapiens
uuauuaagacugg

SEQ ID NO: 2143662 - RNA, 23 nt, Homo sapiens
ccuaauagacuuagccccaugag

SEQ ID NO: 2143663 - RNA, 21 nt, Homo sapiens
uuucuaaagcucugaacaaaa

SEQ ID NO: 2143664 - RNA, 18 nt, Homo sapiens
gacaagcagugucuguca

SEQ ID NO: 2143665 - RNA, 12 nt, Homo sapiens
gaugaaaaccua

SEQ ID NO: 2143666 - RNA, 18 nt, Homo sapiens
uuagaauuuacagcaaga

SEQ ID NO: 2143667 - RNA, 15 nt, Homo sapiens
acaaaagcccaaugu

SEQ ID NO: 2143668 - RNA, 16 nt, Homo sapiens
cagcuucaggugaccc

SEQ ID NO: 2143669 - RNA, 11 nt, Homo sapiens
ccccaggguuu

SEQ ID NO: 2143670 - RNA, 17 nt, Homo sapiens
accucuauaauugccac

SEQ ID NO: 2143671 - RNA, 20 nt, Homo sapiens
gguuugguagacuuggacau

SEQ ID NO: 2143672 - RNA, 14 nt, Homo sapiens
acccugaaucagag

SEQ ID NO: 2143673 - RNA, 19 nt, Homo sapiens
gauggaaacaaaguggaag

SEQ ID NO: 2143674 - RNA, 17 nt, Homo sapiens
uucucugccuccuccuc

SEQ ID NO: 2143675 - RNA, 19 nt, Homo sapiens
auaauuuugcuugcugaag

SEQ ID NO: 2143676 - RNA, 13 nt, Homo sapiens
acuuuaccugaaa

SEQ ID NO: 2143677 - RNA, 15 nt, Homo sapiens
gugcuugcuggugcc

SEQ ID NO: 2143678 - RNA, 21 nt, Homo sapiens
uacacuccagcgguugccuuu

SEQ ID NO: 2143679 - RNA, 15 nt, Homo sapiens
ggaagaacugugaua

SEQ ID NO: 2143680 - RNA, 19 nt, Homo sapiens
gagauggggucuugcuaua

SEQ ID NO: 2143681 - RNA, 13 nt, Homo sapiens
augaauuauucaa

SEQ ID NO: 2143682 - RNA, 18 nt, Homo sapiens
ggguccuccacaauaagg

SEQ ID NO: 2143683 - RNA, 15 nt, Homo sapiens
ucuauauccauaacu

SEQ ID NO: 2143684 - RNA, 17 nt, Homo sapiens
ugcaaagucaugcaaag

SEQ ID NO: 2143685 - RNA, 20 nt, Homo sapiens
ucuuaaccuuugcuauguaa

SEQ ID NO: 2143686 - RNA, 23 nt, Homo sapiens
uacacacacccaggcccaugcca

SEQ ID NO: 2143687 - RNA, 20 nt, Homo sapiens
aagauuauuuacugacauau

SEQ ID NO: 2143688 - RNA, 16 nt, Homo sapiens
cuaaaauacaaaccca

SEQ ID NO: 2143689 - RNA, 14 nt, Homo sapiens
uaccacuuaccuca

SEQ ID NO: 2143690 - RNA, 18 nt, Homo sapiens
gucauaaucucuuuccau

SEQ ID NO: 2143691 - RNA, 12 nt, Homo sapiens
caaacacccaug

SEQ ID NO: 2143692 - RNA, 12 nt, Homo sapiens
ugagcaccugua

SEQ ID NO: 2143693 - RNA, 18 nt, Homo sapiens
uagugaucacagcagcuu

SEQ ID NO: 2143694 - RNA, 19 nt, Homo sapiens
accaugcaaaugucuucca

SEQ ID NO: 2143695 - RNA, 20 nt, Homo sapiens
aauucucaagccgcauccca

SEQ ID NO: 2143696 - RNA, 14 nt, Homo sapiens
aaauuacccccucc

SEQ ID NO: 2143697 - RNA, 23 nt, Homo sapiens
auaacuaauacagcugagcuaug

SEQ ID NO: 2143698 - RNA, 22 nt, Homo sapiens
uagacacagggaugauucccac

SEQ ID NO: 2143699 - RNA, 18 nt, Homo sapiens
gcaccuuauauuucugug

SEQ ID NO: 2143700 - RNA, 14 nt, Homo sapiens
caacuaaugccuua

SEQ ID NO: 2143701 - RNA, 15 nt, Homo sapiens
cguuuacuagacuuu

SEQ ID NO: 2143702 - RNA, 15 nt, Homo sapiens
ucaggcacacagcua

SEQ ID NO: 2143703 - RNA, 12 nt, Homo sapiens
aggaaguggcug

SEQ ID NO: 2143704 - RNA, 14 nt, Homo sapiens
caccaaaaccaaac

SEQ ID NO: 2143705 - RNA, 18 nt, Homo sapiens
ucuggggauacuggcaaa

SEQ ID NO: 2143706 - RNA, 11 nt, Homo sapiens
aaucacuggaa

SEQ ID NO: 2143707 - RNA, 18 nt, Homo sapiens
aacacacuugggcacgga

SEQ ID NO: 2143708 - RNA, 17 nt, Homo sapiens
gucuucuugacugucuu

SEQ ID NO: 2143709 - RNA, 21 nt, Homo sapiens
cagcaccaucucuuuaccucc

SEQ ID NO: 2143710 - RNA, 15 nt, Homo sapiens
caacagaguccugua

SEQ ID NO: 2143711 - RNA, 22 nt, Homo sapiens
ugaaagugacucucacuaaaga

SEQ ID NO: 2143712 - RNA, 16 nt, Homo sapiens
uacucaggaaccucac

SEQ ID NO: 2143713 - RNA, 12 nt, Homo sapiens
uauuuccacuuc

SEQ ID NO: 2143714 - RNA, 22 nt, Homo sapiens
aggccaccuccuaaaaggccca

SEQ ID NO: 2143715 - RNA, 16 nt, Homo sapiens
ccuccuugguuucucc

SEQ ID NO: 2143716 - RNA, 22 nt, Homo sapiens
ugccuucaacuucagcaccugc

SEQ ID NO: 2143717 - RNA, 20 nt, Homo sapiens
ggcaguguggcagugaccau

SEQ ID NO: 2143718 - RNA, 15 nt, Homo sapiens
ccucauccugagaga

SEQ ID NO: 2143719 - RNA, 11 nt, Homo sapiens
agccauaugca

SEQ ID NO: 2143720 - RNA, 21 nt, Homo sapiens
ucauuugacuaagagucucca

SEQ ID NO: 2143721 - RNA, 18 nt, Homo sapiens
guagagacgggguuucac

SEQ ID NO: 2143722 - RNA, 14 nt, Homo sapiens
gggagaagggacaa

SEQ ID NO: 2143723 - RNA, 12 nt, Homo sapiens
augggaugaaug

SEQ ID NO: 2143724 - RNA, 13 nt, Homo sapiens
uugacgucacuga

SEQ ID NO: 2143725 - RNA, 12 nt, Homo sapiens
auuaaugaacau

SEQ ID NO: 2143726 - RNA, 14 nt, Homo sapiens
gccucaaugugacc

SEQ ID NO: 2143727 - RNA, 21 nt, Homo sapiens
uucaacuaauacaugguuuaa

SEQ ID NO: 2143728 - RNA, 21 nt, Homo sapiens
ccuacagcaaguuugacacaa

SEQ ID NO: 2143729 - RNA, 17 nt, Homo sapiens
ggcucagaagaauuuaa

SEQ ID NO: 2143730 - RNA, 22 nt, Homo sapiens
ucaguaucuucaagguuuggaa

SEQ ID NO: 2143731 - RNA, 16 nt, Homo sapiens
cagaguguaugcauac

SEQ ID NO: 2143732 - RNA, 20 nt, Homo sapiens
uuaccaucacugaguuuucc

SEQ ID NO: 2143733 - RNA, 21 nt, Homo sapiens
agagauggaauaaagcccuug

SEQ ID NO: 2143734 - RNA, 15 nt, Homo sapiens
cuugcucuucaaugc

SEQ ID NO: 2143735 - RNA, 19 nt, Homo sapiens
uuacagacaugaacugcca

SEQ ID NO: 2143736 - RNA, 17 nt, Homo sapiens
aaauaaggaacaugaaa

SEQ ID NO: 2143737 - RNA, 15 nt, Homo sapiens
caguaaaacagauuc

SEQ ID NO: 2143738 - RNA, 16 nt, Homo sapiens
uuguagugugugcuua

SEQ ID NO: 2143739 - RNA, 21 nt, Homo sapiens
uuguuucccagauuucaggaa

SEQ ID NO: 2143740 - RNA, 18 nt, Homo sapiens
ucagaguaauccaagcaa

SEQ ID NO: 2143741 - RNA, 20 nt, Homo sapiens
caggccauugucccugaaga

SEQ ID NO: 2143742 - RNA, 18 nt, Homo sapiens
aaugauuucacagugugu

SEQ ID NO: 2143743 - RNA, 13 nt, Homo sapiens
gccuaacacuggg

SEQ ID NO: 2143744 - RNA, 19 nt, Homo sapiens
aauguuacugaucaugcau

SEQ ID NO: 2143745 - RNA, 13 nt, Homo sapiens
cucaaagcacugu

SEQ ID NO: 2143746 - RNA, 19 nt, Homo sapiens
cuuaaaugagaaagcauuu

SEQ ID NO: 2143747 - RNA, 18 nt, Homo sapiens
aaagucuacuuuaccuaa

SEQ ID NO: 2143748 - RNA, 20 nt, Homo sapiens
agccauguuaaaugacuuga

SEQ ID NO: 2143749 - RNA, 12 nt, Homo sapiens
gcucaugccauc

SEQ ID NO: 2143750 - RNA, 16 nt, Homo sapiens
cagggcugguuuguuc

SEQ ID NO: 2143751 - RNA, 16 nt, Homo sapiens
uucuccaaccacucau

SEQ ID NO: 2143752 - RNA, 14 nt, Homo sapiens
guguaagaaacaca

SEQ ID NO: 2143753 - RNA, 21 nt, Homo sapiens
aauuuucuucacacuaucaac

SEQ ID NO: 2143754 - RNA, 21 nt, Homo sapiens
gcuucuucuucaagauuuaug

SEQ ID NO: 2143755 - RNA, 19 nt, Homo sapiens
aaaucuuauuccucaguga

SEQ ID NO: 2143756 - RNA, 21 nt, Homo sapiens
uaucaaaucuguauauguugu

SEQ ID NO: 2143757 - RNA, 16 nt, Homo sapiens
ggggcuggaaucucau

SEQ ID NO: 2143758 - RNA, 13 nt, Homo sapiens
uaaaaaccaauga

SEQ ID NO: 2143759 - RNA, 21 nt, Homo sapiens
uccauuuaccuggaaaccaga

SEQ ID NO: 2143760 - RNA, 20 nt, Homo sapiens
aaaugucgaugcuacccugg

SEQ ID NO: 2143761 - RNA, 14 nt, Homo sapiens
aauauccaagacuu

SEQ ID NO: 2143762 - RNA, 14 nt, Homo sapiens
ggcccacccacuaa

SEQ ID NO: 2143763 - RNA, 21 nt, Homo sapiens
auccucaacaacaaaccaaaa

SEQ ID NO: 2143764 - RNA, 20 nt, Homo sapiens
acagccugaauaaaccaaga

SEQ ID NO: 2143765 - RNA, 18 nt, Homo sapiens
caacuuuuucauucccug

SEQ ID NO: 2143766 - RNA, 15 nt, Homo sapiens
ccugaagugaccuca

SEQ ID NO: 2143767 - RNA, 17 nt, Homo sapiens
cuaguuaucaugcaugu

SEQ ID NO: 2143768 - RNA, 17 nt, Homo sapiens
ggauaaccuugugccuu

SEQ ID NO: 2143769 - RNA, 22 nt, Homo sapiens
agcucagggacuggcacacugg

SEQ ID NO: 2143770 - RNA, 19 nt, Homo sapiens
uggaacacggccacaucaa

SEQ ID NO: 2143771 - RNA, 20 nt, Homo sapiens
caggacugggugguccaaag

SEQ ID NO: 2143772 - RNA, 17 nt, Homo sapiens
uaggaaauugcucauaa

SEQ ID NO: 2143773 - RNA, 16 nt, Homo sapiens
ucccccgacgcucucu

SEQ ID NO: 2143774 - RNA, 13 nt, Homo sapiens
aggcuuucagcuu

SEQ ID NO: 2143775 - RNA, 14 nt, Homo sapiens
acaagugagacaaa

SEQ ID NO: 2143776 - RNA, 23 nt, Homo sapiens
uuguucaacucccuucucggggu

SEQ ID NO: 2143777 - RNA, 13 nt, Homo sapiens
caaggugccuguu

SEQ ID NO: 2143778 - RNA, 18 nt, Homo sapiens
auuggauguuguguauug

SEQ ID NO: 2143779 - RNA, 15 nt, Homo sapiens
caaagccuuuccaga

SEQ ID NO: 2143780 - RNA, 19 nt, Homo sapiens
agacuucucuuugccucaa

SEQ ID NO: 2143781 - RNA, 21 nt, Homo sapiens
ucucggaccuuucagcuguga

SEQ ID NO: 2143782 - RNA, 23 nt, Homo sapiens
guuccacuucaacaaguaccuga

SEQ ID NO: 2143783 - RNA, 23 nt, Homo sapiens
uggcccagcuuuuagaaaaugca

SEQ ID NO: 2143784 - RNA, 19 nt, Homo sapiens
ggccaggaagaauggugug

SEQ ID NO: 2143785 - RNA, 21 nt, Homo sapiens
auguucaaagugugacauuca

SEQ ID NO: 2143786 - RNA, 16 nt, Homo sapiens
ucuuaacucucuguua

SEQ ID NO: 2143787 - RNA, 18 nt, Homo sapiens
ucuagguccauuuuccua

SEQ ID NO: 2143788 - RNA, 23 nt, Homo sapiens
caaauacaaucagcccagugcaa

SEQ ID NO: 2143789 - RNA, 17 nt, Homo sapiens
uccaagcuuguauuuaa

SEQ ID NO: 2143790 - RNA, 13 nt, Homo sapiens
acuacauuuugcu

SEQ ID NO: 2143791 - RNA, 13 nt, Homo sapiens
ucaaaauaaugaa

SEQ ID NO: 2143792 - RNA, 19 nt, Homo sapiens
ccccugggcccuugugcuc

SEQ ID NO: 2143793 - RNA, 18 nt, Homo sapiens
uuauauucaaggaucuca

SEQ ID NO: 2143794 - RNA, 15 nt, Homo sapiens
uuagccagugaugcu

SEQ ID NO: 2143795 - RNA, 15 nt, Homo sapiens
auaauaaacuacaca

SEQ ID NO: 2143796 - RNA, 12 nt, Homo sapiens
aaccauaguuau

SEQ ID NO: 2143797 - RNA, 21 nt, Homo sapiens
gcuauauucaaaaugucuaua

SEQ ID NO: 2143798 - RNA, 16 nt, Homo sapiens
aaugcaugacuucccu

SEQ ID NO: 2143799 - RNA, 15 nt, Homo sapiens
uagccacaagccuga

SEQ ID NO: 2143800 - RNA, 15 nt, Homo sapiens
ccuagggcacuuuaa

SEQ ID NO: 2143801 - RNA, 16 nt, Homo sapiens
ucaaguaugugcuacu

SEQ ID NO: 2143802 - RNA, 18 nt, Homo sapiens
uacuauauuaacuuuuau

SEQ ID NO: 2143803 - RNA, 14 nt, Homo sapiens
aucuuaaaugccag

SEQ ID NO: 2143804 - RNA, 15 nt, Homo sapiens
cauagcuuccaugag

SEQ ID NO: 2143805 - RNA, 14 nt, Homo sapiens
gcccugagcauucu

SEQ ID NO: 2143806 - RNA, 18 nt, Homo sapiens
uguccugauuacaaugcu

SEQ ID NO: 2143807 - RNA, 15 nt, Homo sapiens
agucaauccugucau

SEQ ID NO: 2143808 - RNA, 16 nt, Homo sapiens
uaggacccaagcagag

SEQ ID NO: 2143809 - RNA, 15 nt, Homo sapiens
cccaacgcacaggaa

SEQ ID NO: 2143810 - RNA, 20 nt, Homo sapiens
cugccuuccacaauucacua

SEQ ID NO: 2143811 - RNA, 12 nt, Homo sapiens
auugaauacuuu

SEQ ID NO: 2143812 - RNA, 14 nt, Homo sapiens
cauuccugauccca

SEQ ID NO: 2143813 - RNA, 12 nt, Homo sapiens
cacgcaguauug

SEQ ID NO: 2143814 - RNA, 23 nt, Homo sapiens
gccgucaucgcgccacuaagcca

SEQ ID NO: 2143815 - RNA, 22 nt, Homo sapiens
agucuggagggcuggucauuca

SEQ ID NO: 2143816 - RNA, 22 nt, Homo sapiens
auuucucugugaauccaugggu

SEQ ID NO: 2143817 - RNA, 17 nt, Homo sapiens
ugucuguaaccaauaau

SEQ ID NO: 2143818 - RNA, 21 nt, Homo sapiens
gccacaguggggcugcaggca

SEQ ID NO: 2143819 - RNA, 17 nt, Homo sapiens
cauugauuuaauguaau

SEQ ID NO: 2143820 - RNA, 19 nt, Homo sapiens
ugagcaccagccugaaugc

SEQ ID NO: 2143821 - RNA, 20 nt, Homo sapiens
uaacacuuuugcucugcagg

SEQ ID NO: 2143822 - RNA, 16 nt, Homo sapiens
cuuucucagcauauau

SEQ ID NO: 2143823 - RNA, 21 nt, Homo sapiens
gacacccuaacucuugcucac

SEQ ID NO: 2143824 - RNA, 21 nt, Homo sapiens
gucugcacugaugaccgucug

SEQ ID NO: 2143825 - RNA, 11 nt, Homo sapiens
uuaauuacuuu

SEQ ID NO: 2143826 - RNA, 22 nt, Homo sapiens
gcaagaugaaugcagauuacac

SEQ ID NO: 2143827 - RNA, 13 nt, Homo sapiens
guuccaggccuga

SEQ ID NO: 2143828 - RNA, 15 nt, Homo sapiens
uuggguguagauuuc

SEQ ID NO: 2143829 - RNA, 15 nt, Homo sapiens
acaaaaagacaugga

SEQ ID NO: 2143830 - RNA, 23 nt, Homo sapiens
aagagccaauaucuaggcauuuu

SEQ ID NO: 2143831 - RNA, 21 nt, Homo sapiens
aggaaacuagcuuacaugaga

SEQ ID NO: 2143832 - RNA, 20 nt, Homo sapiens
aauagauuugaaacauuuau

SEQ ID NO: 2143833 - RNA, 18 nt, Homo sapiens
cccauggggagacaguug

SEQ ID NO: 2143834 - RNA, 11 nt, Homo sapiens
uaucaugcaaa

SEQ ID NO: 2143835 - RNA, 19 nt, Homo sapiens
uuucacuuaauaaugugua

SEQ ID NO: 2143836 - RNA, 15 nt, Homo sapiens
gcuucuccauggcca

SEQ ID NO: 2143837 - RNA, 18 nt, Homo sapiens
agaaccacucauaauucu

SEQ ID NO: 2143838 - RNA, 19 nt, Homo sapiens
cugggagggggcgggaaau

SEQ ID NO: 2143839 - RNA, 16 nt, Homo sapiens
auaaaagcacuuacuu

SEQ ID NO: 2143840 - RNA, 21 nt, Homo sapiens
uugguccgguuauucacuuga

SEQ ID NO: 2143841 - RNA, 15 nt, Homo sapiens
ccaaguacagaauua

SEQ ID NO: 2143842 - RNA, 22 nt, Homo sapiens
aagguuguguagcugugucaug

SEQ ID NO: 2143843 - RNA, 15 nt, Homo sapiens
gauuguuugaugaau

SEQ ID NO: 2143844 - RNA, 23 nt, Homo sapiens
cccugucuggugccccuuugccc

SEQ ID NO: 2143845 - RNA, 18 nt, Homo sapiens
ucgggcugagaaggcagu

SEQ ID NO: 2143846 - RNA, 22 nt, Homo sapiens
cuauagccuaagcggcuguuua

SEQ ID NO: 2143847 - RNA, 17 nt, Homo sapiens
cuaagagaugugacuac

SEQ ID NO: 2143848 - RNA, 16 nt, Homo sapiens
aaggaguaaucugugu

SEQ ID NO: 2143849 - RNA, 15 nt, Homo sapiens
uuggagcuguuccau

SEQ ID NO: 2143850 - RNA, 15 nt, Homo sapiens
aguuucaccacuccu

SEQ ID NO: 2143851 - RNA, 19 nt, Homo sapiens
uuauacuguagcugaugaa

SEQ ID NO: 2143852 - RNA, 11 nt, Homo sapiens
aaaugcugcuu

SEQ ID NO: 2143853 - RNA, 14 nt, Homo sapiens
caaccuaugcacca

SEQ ID NO: 2143854 - RNA, 19 nt, Homo sapiens
aucucccgugggcaucuca

SEQ ID NO: 2143855 - RNA, 23 nt, Homo sapiens
ugcaacaugccagccacugugau

SEQ ID NO: 2143856 - RNA, 15 nt, Homo sapiens
cagguugaucuugaa

SEQ ID NO: 2143857 - RNA, 16 nt, Homo sapiens
uucacauuguacuuaa

SEQ ID NO: 2143858 - RNA, 23 nt, Homo sapiens
cgcauuggcucaugucuguaauc

SEQ ID NO: 2143859 - RNA, 22 nt, Homo sapiens
gcguaagaugauggauuugauu

SEQ ID NO: 2143860 - RNA, 18 nt, Homo sapiens
ggaaggagaguauggucc

SEQ ID NO: 2143861 - RNA, 22 nt, Homo sapiens
cuaaugucucacuguucugcaa

SEQ ID NO: 2143862 - RNA, 21 nt, Homo sapiens
cuaauuauaaaauuaacauga

SEQ ID NO: 2143863 - RNA, 17 nt, Homo sapiens
ugacaaccuccauucua

SEQ ID NO: 2143864 - RNA, 15 nt, Homo sapiens
guaagugcugcuaua

SEQ ID NO: 2143865 - RNA, 17 nt, Homo sapiens
caauaacuucagagaag

SEQ ID NO: 2143866 - RNA, 12 nt, Homo sapiens
uuuuaaaacaca

SEQ ID NO: 2143867 - RNA, 14 nt, Homo sapiens
ugacagagcgagac

SEQ ID NO: 2143868 - RNA, 15 nt, Homo sapiens
uaugugcuucacaua

SEQ ID NO: 2143869 - RNA, 15 nt, Homo sapiens
ugcagaaaccuuuaa

SEQ ID NO: 2143870 - RNA, 15 nt, Homo sapiens
uguuugaacccagga

SEQ ID NO: 2143871 - RNA, 18 nt, Homo sapiens
cucucgcacacacaguga

SEQ ID NO: 2143872 - RNA, 15 nt, Homo sapiens
ugacaauaauuucag

SEQ ID NO: 2143873 - RNA, 15 nt, Homo sapiens
ugaggaauuaagggu

SEQ ID NO: 2143874 - RNA, 21 nt, Homo sapiens
acugucucucuucucagagug

SEQ ID NO: 2143875 - RNA, 23 nt, Homo sapiens
cgaaucuuccgauggaugaaucu

SEQ ID NO: 2143876 - RNA, 17 nt, Homo sapiens
cgguguacaguuuaaca

SEQ ID NO: 2143877 - RNA, 17 nt, Homo sapiens
uagaauuuaacaugacu

SEQ ID NO: 2143878 - RNA, 21 nt, Homo sapiens
uuagccccaugaguuugccau

SEQ ID NO: 2143879 - RNA, 21 nt, Homo sapiens
cuuuaaaaccauaaacuguac

SEQ ID NO: 2143880 - RNA, 14 nt, Homo sapiens
uacuaagcauuuca

SEQ ID NO: 2143881 - RNA, 15 nt, Homo sapiens
uuuagucuaccaaaa

SEQ ID NO: 2143882 - RNA, 12 nt, Homo sapiens
caaucuguucua

SEQ ID NO: 2143883 - RNA, 16 nt, Homo sapiens
acuagugugacuccuu

SEQ ID NO: 2143884 - RNA, 20 nt, Homo sapiens
ccaauacuagucaccccaag

SEQ ID NO: 2143885 - RNA, 15 nt, Homo sapiens
cagccucucugcuau

SEQ ID NO: 2143886 - RNA, 15 nt, Homo sapiens
uaaauacuuuaacuu

SEQ ID NO: 2143887 - RNA, 13 nt, Homo sapiens
cagucacagccac

SEQ ID NO: 2143888 - RNA, 22 nt, Homo sapiens
acaucuuccgagaaacaggcga

SEQ ID NO: 2143889 - RNA, 13 nt, Homo sapiens
agaggacuguguu

SEQ ID NO: 2143890 - RNA, 22 nt, Homo sapiens
uauuuacuugaaagaugggucu

SEQ ID NO: 2143891 - RNA, 22 nt, Homo sapiens
gugauugacagcuuugcugcug

SEQ ID NO: 2143892 - RNA, 20 nt, Homo sapiens
cucaaaccuccaaaagcccu

SEQ ID NO: 2143893 - RNA, 13 nt, Homo sapiens
ucugagcuggacg

SEQ ID NO: 2143894 - RNA, 17 nt, Homo sapiens
uuaguuaauaaaauaau

SEQ ID NO: 2143895 - RNA, 21 nt, Homo sapiens
gugcaccuguggccucucagu

SEQ ID NO: 2143896 - RNA, 17 nt, Homo sapiens
caauuaugaacauccaa

SEQ ID NO: 2143897 - RNA, 23 nt, Homo sapiens
acugcaaccuucgccaccugggu

SEQ ID NO: 2143898 - RNA, 23 nt, Homo sapiens
ggccccucuccuccguggcacau

SEQ ID NO: 2143899 - RNA, 22 nt, Homo sapiens
ucuagacucaaaaccuggagau

SEQ ID NO: 2143900 - RNA, 13 nt, Homo sapiens
aguuaauucucau

SEQ ID NO: 2143901 - RNA, 19 nt, Homo sapiens
cuccagggcgagcacuuuc

SEQ ID NO: 2143902 - RNA, 22 nt, Homo sapiens
ugaaacccuauggagaauuuau

SEQ ID NO: 2143903 - RNA, 23 nt, Homo sapiens
cauuggguccugggucuuucaug

SEQ ID NO: 2143904 - RNA, 22 nt, Homo sapiens
gaacaguuucaucaggaccaaa

SEQ ID NO: 2143905 - RNA, 16 nt, Homo sapiens
uaaaaauaugugagca

SEQ ID NO: 2143906 - RNA, 20 nt, Homo sapiens
aaugcccaguaaaauuucag

SEQ ID NO: 2143907 - RNA, 18 nt, Homo sapiens
ucaggaugagaacacacu

SEQ ID NO: 2143908 - RNA, 13 nt, Homo sapiens
aucacagcugcca

SEQ ID NO: 2143909 - RNA, 13 nt, Homo sapiens
cuauaccuaugug

SEQ ID NO: 2143910 - RNA, 22 nt, Homo sapiens
gccaccuggcucucaccucuag

SEQ ID NO: 2143911 - RNA, 22 nt, Homo sapiens
ugcaaauuccaccccuccuucc

SEQ ID NO: 2143912 - RNA, 14 nt, Homo sapiens
uucguguacugcaa

SEQ ID NO: 2143913 - RNA, 14 nt, Homo sapiens
uaauaacuuaucua

SEQ ID NO: 2143914 - RNA, 22 nt, Homo sapiens
uccuucagaauuaaaauacuua

SEQ ID NO: 2143915 - RNA, 16 nt, Homo sapiens
gcucaagugauccucc

SEQ ID NO: 2143916 - RNA, 18 nt, Homo sapiens
cagccuugcacacccacu

SEQ ID NO: 2143917 - RNA, 20 nt, Homo sapiens
augucaccuccccaucaucc

SEQ ID NO: 2143918 - RNA, 13 nt, Homo sapiens
augcagucucuuu

SEQ ID NO: 2143919 - RNA, 23 nt, Homo sapiens
ggaccuggcgugcucagacccaa

SEQ ID NO: 2143920 - RNA, 21 nt, Homo sapiens
auuccagcgucugcuguugau

SEQ ID NO: 2143921 - RNA, 18 nt, Homo sapiens
uaaauagaugaguccugu

SEQ ID NO: 2143922 - RNA, 18 nt, Homo sapiens
guggacuuagaaagcagg

SEQ ID NO: 2143923 - RNA, 21 nt, Homo sapiens
aaguaggugugacuugaacua

SEQ ID NO: 2143924 - RNA, 17 nt, Homo sapiens
ucucgcuagccauauau

SEQ ID NO: 2143925 - RNA, 23 nt, Homo sapiens
gaaaagauucccacccaauucaa

SEQ ID NO: 2143926 - RNA, 18 nt, Homo sapiens
acagagcaggggcuccag

SEQ ID NO: 2143927 - RNA, 16 nt, Homo sapiens
agaagaggaaagggag

SEQ ID NO: 2143928 - RNA, 22 nt, Homo sapiens
aguguaggccuuccagugcagg

SEQ ID NO: 2143929 - RNA, 20 nt, Homo sapiens
cucgguauuaauccaaagcu

SEQ ID NO: 2143930 - RNA, 15 nt, Homo sapiens
cggaaugccacccac

SEQ ID NO: 2143931 - RNA, 16 nt, Homo sapiens
gccccaccagugccuc

SEQ ID NO: 2143932 - RNA, 13 nt, Homo sapiens
cuuuuuugccaga

SEQ ID NO: 2143933 - RNA, 22 nt, Homo sapiens
ggacagcaaagcagcagugucc

SEQ ID NO: 2143934 - RNA, 17 nt, Homo sapiens
gauaaucguguccugaa

SEQ ID NO: 2143935 - RNA, 16 nt, Homo sapiens
accucccaaacccagc

SEQ ID NO: 2143936 - RNA, 12 nt, Homo sapiens
ugaagcuuuaua

SEQ ID NO: 2143937 - RNA, 13 nt, Homo sapiens
gacuccaucucaa

SEQ ID NO: 2143938 - RNA, 18 nt, Homo sapiens
ccagguguggugacucac

SEQ ID NO: 2143939 - RNA, 13 nt, Homo sapiens
uucugguuccaaa

SEQ ID NO: 2143940 - RNA, 23 nt, Homo sapiens
agcccacugcaccgccucagggu

SEQ ID NO: 2143941 - RNA, 13 nt, Homo sapiens
gugcaugaugcug

SEQ ID NO: 2143942 - RNA, 20 nt, Homo sapiens
uagcccuggcccggucccag

SEQ ID NO: 2143943 - RNA, 23 nt, Homo sapiens
uuucagaguguggauuguauaac

SEQ ID NO: 2143944 - RNA, 18 nt, Homo sapiens
acaggagaagaaacagcg

SEQ ID NO: 2143945 - RNA, 16 nt, Homo sapiens
cccugcggucaggcug

SEQ ID NO: 2143946 - RNA, 19 nt, Homo sapiens
gcucgcuacacuacuccug

SEQ ID NO: 2143947 - RNA, 17 nt, Homo sapiens
aguaugaagacacuguc

SEQ ID NO: 2143948 - RNA, 21 nt, Homo sapiens
ugccuccucguuccuuucucc

SEQ ID NO: 2143949 - RNA, 19 nt, Homo sapiens
uuuauacuccaguguacau

SEQ ID NO: 2143950 - RNA, 19 nt, Homo sapiens
ugccaaauagccccagacu

SEQ ID NO: 2143951 - RNA, 20 nt, Homo sapiens
gagguggaggcugcagugag

SEQ ID NO: 2143952 - RNA, 21 nt, Homo sapiens
cuuauuuugucuuauucuuaa

SEQ ID NO: 2143953 - RNA, 18 nt, Homo sapiens
aauugaaugucaauauga

SEQ ID NO: 2143954 - RNA, 19 nt, Homo sapiens
cccacgucccgggcacugu

SEQ ID NO: 2143955 - RNA, 23 nt, Homo sapiens
aaaucagcaugcccgccuaguua

SEQ ID NO: 2143956 - RNA, 15 nt, Homo sapiens
cccauggcucuauuu

SEQ ID NO: 2143957 - RNA, 18 nt, Homo sapiens
ugugccacuacacuccag

SEQ ID NO: 2143958 - RNA, 21 nt, Homo sapiens
ccacuguagacaggaaagcca

SEQ ID NO: 2143959 - RNA, 16 nt, Homo sapiens
uuuaguauuugugcau

SEQ ID NO: 2143960 - RNA, 21 nt, Homo sapiens
aacuuggucugcagaccaucc

SEQ ID NO: 2143961 - RNA, 17 nt, Homo sapiens
ucagauauuguaagcau

SEQ ID NO: 2143962 - RNA, 20 nt, Homo sapiens
gcaagacucugucucaaaaa

SEQ ID NO: 2143963 - RNA, 21 nt, Homo sapiens
caggguuguuagaucuucugg

SEQ ID NO: 2143964 - RNA, 13 nt, Homo sapiens
acaacaugaaaua

SEQ ID NO: 2143965 - RNA, 13 nt, Homo sapiens
ccaucaugcaaaa

SEQ ID NO: 2143966 - RNA, 16 nt, Homo sapiens
ccuggacgaagagcag

SEQ ID NO: 2143967 - RNA, 20 nt, Homo sapiens
cuauucugaaaaagacauaa

SEQ ID NO: 2143968 - RNA, 15 nt, Homo sapiens
cugugccucuuccca

SEQ ID NO: 2143969 - RNA, 12 nt, Homo sapiens
cagcauuugacc

SEQ ID NO: 2143970 - RNA, 21 nt, Homo sapiens
cuuugccuccagaagcacugg

SEQ ID NO: 2143971 - RNA, 14 nt, Homo sapiens
cagucuugccuagg

SEQ ID NO: 2143972 - RNA, 21 nt, Homo sapiens
aaguaaagugaagaauuuauc

SEQ ID NO: 2143973 - RNA, 14 nt, Homo sapiens
augucacuaaacaa

SEQ ID NO: 2143974 - RNA, 18 nt, Homo sapiens
augucuuaaccucaggga

SEQ ID NO: 2143975 - RNA, 14 nt, Homo sapiens
agaucauccuaaca

SEQ ID NO: 2143976 - RNA, 19 nt, Homo sapiens
gugcagaaauuugaaugac

SEQ ID NO: 2143977 - RNA, 18 nt, Homo sapiens
aguauauuuuuacuucuu

SEQ ID NO: 2143978 - RNA, 19 nt, Homo sapiens
aaagaugaaaaaugguccc

SEQ ID NO: 2143979 - RNA, 14 nt, Homo sapiens
gccucugaagccua

SEQ ID NO: 2143980 - RNA, 18 nt, Homo sapiens
ucacuuguucucacuguc

SEQ ID NO: 2143981 - RNA, 12 nt, Homo sapiens
ucuuaccagauc

SEQ ID NO: 2143982 - RNA, 18 nt, Homo sapiens
ggacucuuccgaagggau

SEQ ID NO: 2143983 - RNA, 21 nt, Homo sapiens
acagacuugggcccaggcuca

SEQ ID NO: 2143984 - RNA, 16 nt, Homo sapiens
aacaguuuacuuggaa

SEQ ID NO: 2143985 - RNA, 19 nt, Homo sapiens
aaggcugcccacuggagac

SEQ ID NO: 2143986 - RNA, 14 nt, Homo sapiens
aaauugaaccuggu

SEQ ID NO: 2143987 - RNA, 22 nt, Homo sapiens
gagaaauugacagaucaagcug

SEQ ID NO: 2143988 - RNA, 19 nt, Homo sapiens
aaccaggccacuugccuca

SEQ ID NO: 2143989 - RNA, 18 nt, Homo sapiens
aacaauacuguucuauac

SEQ ID NO: 2143990 - RNA, 20 nt, Homo sapiens
cagacaagucuugcugugcu

SEQ ID NO: 2143991 - RNA, 22 nt, Homo sapiens
cagccuagauaugaagaaucug

SEQ ID NO: 2143992 - RNA, 21 nt, Homo sapiens
uccuuggaaaucaaauguaaa

SEQ ID NO: 2143993 - RNA, 15 nt, Homo sapiens
uuaaaagauucacua

SEQ ID NO: 2143994 - RNA, 21 nt, Homo sapiens
gagaaguccagcucuucgccc

SEQ ID NO: 2143995 - RNA, 21 nt, Homo sapiens
auccacuucaggagcccuacu

SEQ ID NO: 2143996 - RNA, 18 nt, Homo sapiens
cagcugcucccacacuug

SEQ ID NO: 2143997 - RNA, 14 nt, Homo sapiens
acacccaguguccu

SEQ ID NO: 2143998 - RNA, 18 nt, Homo sapiens
ucagaaaagacacuucaa

SEQ ID NO: 2143999 - RNA, 22 nt, Homo sapiens
uuaccaguaaaauauuacugua

SEQ ID NO: 2144000 - RNA, 16 nt, Homo sapiens
gagaacccacugcuuu

SEQ ID NO: 2144001 - RNA, 16 nt, Homo sapiens
ucugucaggugugaua

SEQ ID NO: 2144002 - RNA, 20 nt, Homo sapiens
cuuccagcggcucacaaaga

SEQ ID NO: 2144003 - RNA, 15 nt, Homo sapiens
ggaguggcucuguaa

SEQ ID NO: 2144004 - RNA, 15 nt, Homo sapiens
acaguuuggaagugu

SEQ ID NO: 2144005 - RNA, 14 nt, Homo sapiens
aagagacacuccaa

SEQ ID NO: 2144006 - RNA, 20 nt, Homo sapiens
cuguuuacgguacuugguaa

SEQ ID NO: 2144007 - RNA, 20 nt, Homo sapiens
ccauccacacacagcagcuc

SEQ ID NO: 2144008 - RNA, 14 nt, Homo sapiens
ugacagggaaaaga

SEQ ID NO: 2144009 - RNA, 21 nt, Homo sapiens
cucagguccuacuggggaaac

SEQ ID NO: 2144010 - RNA, 19 nt, Homo sapiens
gucuaaacaaaauugcaau

SEQ ID NO: 2144011 - RNA, 15 nt, Homo sapiens
ucaguauucugacau

SEQ ID NO: 2144012 - RNA, 14 nt, Homo sapiens
aaugggugauaucc

SEQ ID NO: 2144013 - RNA, 16 nt, Homo sapiens
gaagccgucucaugca

SEQ ID NO: 2144014 - RNA, 14 nt, Homo sapiens
uguugguagcaauu

SEQ ID NO: 2144015 - RNA, 15 nt, Homo sapiens
uccagaaacuuucca

SEQ ID NO: 2144016 - RNA, 14 nt, Homo sapiens
gagagcaugccugu

SEQ ID NO: 2144017 - RNA, 13 nt, Homo sapiens
aggucauaugcac

SEQ ID NO: 2144018 - RNA, 20 nt, Homo sapiens
uuaaauaagauuuaauucac

SEQ ID NO: 2144019 - RNA, 19 nt, Homo sapiens
guaccauucucagguggug

SEQ ID NO: 2144020 - RNA, 22 nt, Homo sapiens
gccauagaauggcacaugucau

SEQ ID NO: 2144021 - RNA, 18 nt, Homo sapiens
aaaacagggaauacauug

SEQ ID NO: 2144022 - RNA, 23 nt, Homo sapiens
aacacuguccaucuugcaucauu

SEQ ID NO: 2144023 - RNA, 19 nt, Homo sapiens
gguauuuauugagcaccug

SEQ ID NO: 2144024 - RNA, 19 nt, Homo sapiens
caaguguguguguguuuua

SEQ ID NO: 2144025 - RNA, 15 nt, Homo sapiens
aagaaaucaugugca

SEQ ID NO: 2144026 - RNA, 12 nt, Homo sapiens
cacagcacauuu

SEQ ID NO: 2144027 - RNA, 17 nt, Homo sapiens
uggagagaagugagaau

SEQ ID NO: 2144028 - RNA, 13 nt, Homo sapiens
cugcuuugccaag

SEQ ID NO: 2144029 - RNA, 19 nt, Homo sapiens
auuuuuacaguucucccaa

SEQ ID NO: 2144030 - RNA, 17 nt, Homo sapiens
ucauucagaaugugcaa

SEQ ID NO: 2144031 - RNA, 22 nt, Homo sapiens
ccacauuucucugcaaaauguc

SEQ ID NO: 2144032 - RNA, 13 nt, Homo sapiens
guuugcaagaacc

SEQ ID NO: 2144033 - RNA, 20 nt, Homo sapiens
accaggguugaccccagagg

SEQ ID NO: 2144034 - RNA, 20 nt, Homo sapiens
ggagaagagcgcaguguuuu

SEQ ID NO: 2144035 - RNA, 14 nt, Homo sapiens
ggcagaaugaaaag

SEQ ID NO: 2144036 - RNA, 21 nt, Homo sapiens
gaaauagguuaaacugaagca

SEQ ID NO: 2144037 - RNA, 16 nt, Homo sapiens
caaauucaccuucccc

SEQ ID NO: 2144038 - RNA, 19 nt, Homo sapiens
gccaucccacuagcagcuu

SEQ ID NO: 2144039 - RNA, 14 nt, Homo sapiens
aauggccaucugua

SEQ ID NO: 2144040 - RNA, 14 nt, Homo sapiens
ucaauacaaaaagc

SEQ ID NO: 2144041 - RNA, 22 nt, Homo sapiens
ucagccucugaucaguuucaca

SEQ ID NO: 2144042 - RNA, 18 nt, Homo sapiens
uaacaagccuuggaccaa

SEQ ID NO: 2144043 - RNA, 21 nt, Homo sapiens
aagcauuucuuuucucuuuaa

SEQ ID NO: 2144044 - RNA, 22 nt, Homo sapiens
cuuaaaaaggcuuuuguuuauu

SEQ ID NO: 2144045 - RNA, 18 nt, Homo sapiens
cagcuauaccucauucac

SEQ ID NO: 2144046 - RNA, 14 nt, Homo sapiens
cauuauauuugcau

SEQ ID NO: 2144047 - RNA, 16 nt, Homo sapiens
acaucagcuaguggcu

SEQ ID NO: 2144048 - RNA, 14 nt, Homo sapiens
auuuucaagacuuu

SEQ ID NO: 2144049 - RNA, 14 nt, Homo sapiens
uaaugaaggucaua

SEQ ID NO: 2144050 - RNA, 20 nt, Homo sapiens
ucagcacuguuuucaucaca

SEQ ID NO: 2144051 - RNA, 14 nt, Homo sapiens
uuccccacucaaug

SEQ ID NO: 2144052 - RNA, 13 nt, Homo sapiens
cuaggaaggugaa

SEQ ID NO: 2144053 - RNA, 16 nt, Homo sapiens
aacuacauguaaucca

SEQ ID NO: 2144054 - RNA, 18 nt, Homo sapiens
agcuuuuggagggugaua

SEQ ID NO: 2144055 - RNA, 12 nt, Homo sapiens
cugaugcuguug

SEQ ID NO: 2144056 - RNA, 19 nt, Homo sapiens
ggaggcugcagccaggccu

SEQ ID NO: 2144057 - RNA, 20 nt, Homo sapiens
auaccagguuaccucacuuu

SEQ ID NO: 2144058 - RNA, 17 nt, Homo sapiens
cacaugcccuaaugucu

SEQ ID NO: 2144059 - RNA, 21 nt, Homo sapiens
uuuugguugcuuuaauaucau

SEQ ID NO: 2144060 - RNA, 11 nt, Homo sapiens
gggacauucca

SEQ ID NO: 2144061 - RNA, 18 nt, Homo sapiens
auccggcagcacaagcug

SEQ ID NO: 2144062 - RNA, 23 nt, Homo sapiens
uugcuagagguagaguuugauca

SEQ ID NO: 2144063 - RNA, 18 nt, Homo sapiens
aacagugagaaagggcau

SEQ ID NO: 2144064 - RNA, 13 nt, Homo sapiens
gcaucaccuuccu

SEQ ID NO: 2144065 - RNA, 14 nt, Homo sapiens
aaccaagcaaauua

SEQ ID NO: 2144066 - RNA, 23 nt, Homo sapiens
cugaugcuuugcuucaaauccau

SEQ ID NO: 2144067 - RNA, 21 nt, Homo sapiens
augcuuacuacagaaagcaaa

SEQ ID NO: 2144068 - RNA, 17 nt, Homo sapiens
aaaguuuacccaugaag

SEQ ID NO: 2144069 - RNA, 18 nt, Homo sapiens
gguuggcccccaaagaua

SEQ ID NO: 2144070 - RNA, 15 nt, Homo sapiens
aaaaagccaucugau

SEQ ID NO: 2144071 - RNA, 15 nt, Homo sapiens
gagaccauccuggcc

SEQ ID NO: 2144072 - RNA, 14 nt, Homo sapiens
aauacaaaucugua

SEQ ID NO: 2144073 - RNA, 17 nt, Homo sapiens
gagaaagcuuauggcug

SEQ ID NO: 2144074 - RNA, 13 nt, Homo sapiens
cuucuuagcucau

SEQ ID NO: 2144075 - RNA, 23 nt, Homo sapiens
caagugguuaaaacauagcuuuc

SEQ ID NO: 2144076 - RNA, 13 nt, Homo sapiens
gucuaaaaccuua

SEQ ID NO: 2144077 - RNA, 16 nt, Homo sapiens
uguaaagacaaauaaa

SEQ ID NO: 2144078 - RNA, 16 nt, Homo sapiens
gaacuaggugaucuca

SEQ ID NO: 2144079 - RNA, 23 nt, Homo sapiens
aacaugguucagguacacauauu

SEQ ID NO: 2144080 - RNA, 13 nt, Homo sapiens
aaguugcugugaa

SEQ ID NO: 2144081 - RNA, 19 nt, Homo sapiens
cccacauuugugccgacac

SEQ ID NO: 2144082 - RNA, 22 nt, Homo sapiens
cuaugcacaccaaauugcugag

SEQ ID NO: 2144083 - RNA, 12 nt, Homo sapiens
uuuuuuuguacg

SEQ ID NO: 2144084 - RNA, 21 nt, Homo sapiens
ucaccaaggaaacgcuaccuc

SEQ ID NO: 2144085 - RNA, 20 nt, Homo sapiens
ugaaugccuaaauauaauua

SEQ ID NO: 2144086 - RNA, 15 nt, Homo sapiens
cugagacagcuuguc

SEQ ID NO: 2144087 - RNA, 11 nt, Homo sapiens
aggacccauag

SEQ ID NO: 2144088 - RNA, 13 nt, Homo sapiens
cagcuuaucucag

SEQ ID NO: 2144089 - RNA, 20 nt, Homo sapiens
cacuauuaaguggguuugcc

SEQ ID NO: 2144090 - RNA, 19 nt, Homo sapiens
ggugguacagccgugcaca

SEQ ID NO: 2144091 - RNA, 22 nt, Homo sapiens
aaacuggaaugcuguuacuuug

SEQ ID NO: 2144092 - RNA, 17 nt, Homo sapiens
ugcucaauaaggcagug

SEQ ID NO: 2144093 - RNA, 22 nt, Homo sapiens
gcaucaaagaugagaagccaaa

SEQ ID NO: 2144094 - RNA, 21 nt, Homo sapiens
uuuuguuacaaaaagacaaaa

SEQ ID NO: 2144095 - RNA, 17 nt, Homo sapiens
acuaauggaaauauuau

SEQ ID NO: 2144096 - RNA, 17 nt, Homo sapiens
agugaguaccugcaaaa

SEQ ID NO: 2144097 - RNA, 16 nt, Homo sapiens
ucccucacagcacuag

SEQ ID NO: 2144098 - RNA, 19 nt, Homo sapiens
aaagccaccaacagccacu

SEQ ID NO: 2144099 - RNA, 13 nt, Homo sapiens
gugauacauuucu

SEQ ID NO: 2144100 - RNA, 23 nt, Homo sapiens
ggaaauaguaccuucaauacuua

SEQ ID NO: 2144101 - RNA, 17 nt, Homo sapiens
aagggauggacuuguga

SEQ ID NO: 2144102 - RNA, 15 nt, Homo sapiens
uacgaucaggcacag

SEQ ID NO: 2144103 - RNA, 20 nt, Homo sapiens
cuuuuuaguguuuugcaagg

SEQ ID NO: 2144104 - RNA, 15 nt, Homo sapiens
cauccccacccaguc

SEQ ID NO: 2144105 - RNA, 21 nt, Homo sapiens
gagccuuaaaacccacaaaag

SEQ ID NO: 2144106 - RNA, 17 nt, Homo sapiens
uggacccugacuguaua

SEQ ID NO: 2144107 - RNA, 20 nt, Homo sapiens
ucuugaaagaauaacagaaa

SEQ ID NO: 2144108 - RNA, 22 nt, Homo sapiens
accucacuggccugccaugcca

SEQ ID NO: 2144109 - RNA, 23 nt, Homo sapiens
ucuccagaugagaguacacccca

SEQ ID NO: 2144110 - RNA, 23 nt, Homo sapiens
aacugacaugauuagcagaagaa

SEQ ID NO: 2144111 - RNA, 16 nt, Homo sapiens
uuccuccccuguucau

SEQ ID NO: 2144112 - RNA, 21 nt, Homo sapiens
acauguaaaauaugucuuucu

SEQ ID NO: 2144113 - RNA, 19 nt, Homo sapiens
aguuuuguaucaaccuaaa

SEQ ID NO: 2144114 - RNA, 16 nt, Homo sapiens
cuggcaccagaacuga

SEQ ID NO: 2144115 - RNA, 16 nt, Homo sapiens
caggaauaugacacaa

SEQ ID NO: 2144116 - RNA, 21 nt, Homo sapiens
uccauccuccucuccaugcaa

SEQ ID NO: 2144117 - RNA, 17 nt, Homo sapiens
ucuuaucaauucugaug

SEQ ID NO: 2144118 - RNA, 19 nt, Homo sapiens
ucccuguggguggggagcu

SEQ ID NO: 2144119 - RNA, 15 nt, Homo sapiens
cacccaugccagaga

SEQ ID NO: 2144120 - RNA, 20 nt, Homo sapiens
acuaccccaggacgcaugca

SEQ ID NO: 2144121 - RNA, 21 nt, Homo sapiens
agagcuugugcuccucuugau

SEQ ID NO: 2144122 - RNA, 16 nt, Homo sapiens
cuuucuucaccaaauc

SEQ ID NO: 2144123 - RNA, 16 nt, Homo sapiens
cccaauucauuucauc

SEQ ID NO: 2144124 - RNA, 16 nt, Homo sapiens
cauggaucugaucugu

SEQ ID NO: 2144125 - RNA, 13 nt, Homo sapiens
gaucccucuccag

SEQ ID NO: 2144126 - RNA, 19 nt, Homo sapiens
gaagaacccucaggucaca

SEQ ID NO: 2144127 - RNA, 19 nt, Homo sapiens
ucuauagcugcuauagcaa

SEQ ID NO: 2144128 - RNA, 23 nt, Homo sapiens
ugaaucgcaaggccugugcugca

SEQ ID NO: 2144129 - RNA, 14 nt, Homo sapiens
cccugaugggccaa

SEQ ID NO: 2144130 - RNA, 18 nt, Homo sapiens
cucccugggccaccuccu

SEQ ID NO: 2144131 - RNA, 17 nt, Homo sapiens
ccaagugccacgugaac

SEQ ID NO: 2144132 - RNA, 22 nt, Homo sapiens
aggagcuaguguuaauccagag

SEQ ID NO: 2144133 - RNA, 15 nt, Homo sapiens
caguuagacuagucc

SEQ ID NO: 2144134 - RNA, 16 nt, Homo sapiens
uguagcaauggcacug

SEQ ID NO: 2144135 - RNA, 17 nt, Homo sapiens
gcacagguuagggcaug

SEQ ID NO: 2144136 - RNA, 16 nt, Homo sapiens
cugaucaggaccucca

SEQ ID NO: 2144137 - RNA, 23 nt, Homo sapiens
guugacgccuaacugaauuugaa

SEQ ID NO: 2144138 - RNA, 22 nt, Homo sapiens
aucacuauugcuuccuaaaggu

SEQ ID NO: 2144139 - RNA, 16 nt, Homo sapiens
ugacugugaccaccuu

SEQ ID NO: 2144140 - RNA, 12 nt, Homo sapiens
cacugcaucucu

SEQ ID NO: 2144141 - RNA, 17 nt, Homo sapiens
agcaagacuccauuuca

SEQ ID NO: 2144142 - RNA, 19 nt, Homo sapiens
aaguauaaagucacuucca

SEQ ID NO: 2144143 - RNA, 15 nt, Homo sapiens
uuggcuacacacaaa

SEQ ID NO: 2144144 - RNA, 16 nt, Homo sapiens
gccaggccuacuguaa

SEQ ID NO: 2144145 - RNA, 16 nt, Homo sapiens
cuaccucuaguaaauu

SEQ ID NO: 2144146 - RNA, 22 nt, Homo sapiens
cagcaauuccuggacucggggg

SEQ ID NO: 2144147 - RNA, 16 nt, Homo sapiens
cacuuuuugugaauua

SEQ ID NO: 2144148 - RNA, 22 nt, Homo sapiens
uaaguaccccugauaagcaaau

SEQ ID NO: 2144149 - RNA, 17 nt, Homo sapiens
cugcuuugagcaguuug

SEQ ID NO: 2144150 - RNA, 23 nt, Homo sapiens
auaaaucaacaccuuaauaugcu

SEQ ID NO: 2144151 - RNA, 19 nt, Homo sapiens
guaggugguucgugcugug

SEQ ID NO: 2144152 - RNA, 17 nt, Homo sapiens
agcaaauaaauaucauc

SEQ ID NO: 2144153 - RNA, 19 nt, Homo sapiens
accccagggccagcuuuuc

SEQ ID NO: 2144154 - RNA, 22 nt, Homo sapiens
aagcagacccauaccuuuccag

SEQ ID NO: 2144155 - RNA, 19 nt, Homo sapiens
ucugagcacauuugacucc

SEQ ID NO: 2144156 - RNA, 19 nt, Homo sapiens
aauaaaccacaagcaucuc

SEQ ID NO: 2144157 - RNA, 22 nt, Homo sapiens
aagcccaggggccggccagugg

SEQ ID NO: 2144158 - RNA, 21 nt, Homo sapiens
ugucacaaccucucugaucuu

SEQ ID NO: 2144159 - RNA, 19 nt, Homo sapiens
cccagaguuuucagggagu

SEQ ID NO: 2144160 - RNA, 16 nt, Homo sapiens
ucuauauaauguagua

SEQ ID NO: 2144161 - RNA, 22 nt, Homo sapiens
gcuaccaaucugugagaaguuu

SEQ ID NO: 2144162 - RNA, 23 nt, Homo sapiens
ccuaagggaguguuugugucuga

SEQ ID NO: 2144163 - RNA, 21 nt, Homo sapiens
agcgacguuuauuucaucucu

SEQ ID NO: 2144164 - RNA, 20 nt, Homo sapiens
acacuuggaacacaaugacu

SEQ ID NO: 2144165 - RNA, 22 nt, Homo sapiens
uauauucaacagaaaugcauga

SEQ ID NO: 2144166 - RNA, 15 nt, Homo sapiens
ucccuucuacagccu

SEQ ID NO: 2144167 - RNA, 23 nt, Homo sapiens
acaaauagucggauuagaaauaa

SEQ ID NO: 2144168 - RNA, 14 nt, Homo sapiens
uuuaaagugauuaa

SEQ ID NO: 2144169 - RNA, 22 nt, Homo sapiens
gaacugucagcccacagcagca

SEQ ID NO: 2144170 - RNA, 15 nt, Homo sapiens
cacagaaguccugua

SEQ ID NO: 2144171 - RNA, 21 nt, Homo sapiens
gagccgugggcaauugucuga

SEQ ID NO: 2144172 - RNA, 18 nt, Homo sapiens
gaggcuggaugacuugcu

SEQ ID NO: 2144173 - RNA, 15 nt, Homo sapiens
ccuucagucugcucc

SEQ ID NO: 2144174 - RNA, 21 nt, Homo sapiens
auauuaaagucugagaaauuu

SEQ ID NO: 2144175 - RNA, 17 nt, Homo sapiens
agucccacacugugcag

SEQ ID NO: 2144176 - RNA, 13 nt, Homo sapiens
cgaucaaaaccug

SEQ ID NO: 2144177 - RNA, 19 nt, Homo sapiens
caaucuucggggugugaug

SEQ ID NO: 2144178 - RNA, 16 nt, Homo sapiens
auauaaugcaaaccau

SEQ ID NO: 2144179 - RNA, 15 nt, Homo sapiens
cccugugcgucucag

SEQ ID NO: 2144180 - RNA, 16 nt, Homo sapiens
aguaagaauaccacau

SEQ ID NO: 2144181 - RNA, 18 nt, Homo sapiens
guaaucucucauggugaa

SEQ ID NO: 2144182 - RNA, 22 nt, Homo sapiens
gggaaucauuuuagcugguguc

SEQ ID NO: 2144183 - RNA, 22 nt, Homo sapiens
uccuccggcuggaccugggguc

SEQ ID NO: 2144184 - RNA, 19 nt, Homo sapiens
ggagccaacugucagggag

SEQ ID NO: 2144185 - RNA, 16 nt, Homo sapiens
aauucugugacauaca

SEQ ID NO: 2144186 - RNA, 19 nt, Homo sapiens
aauaaacuagauuacauuc

SEQ ID NO: 2144187 - RNA, 22 nt, Homo sapiens
cuuaaaaaucauucuaauuaca

SEQ ID NO: 2144188 - RNA, 18 nt, Homo sapiens
uuucaauaaaccuaauaa

SEQ ID NO: 2144189 - RNA, 14 nt, Homo sapiens
gaaugauucagugu

SEQ ID NO: 2144190 - RNA, 18 nt, Homo sapiens
aggaauucuucuguucuc

SEQ ID NO: 2144191 - RNA, 14 nt, Homo sapiens
agagagaagccagc

SEQ ID NO: 2144192 - RNA, 17 nt, Homo sapiens
ggagaagcaugaaaaag

SEQ ID NO: 2144193 - RNA, 15 nt, Homo sapiens
gggccaaaaggaaaa

SEQ ID NO: 2144194 - RNA, 19 nt, Homo sapiens
auuuaauuuuuuacuuuca

SEQ ID NO: 2144195 - RNA, 14 nt, Homo sapiens
acacacauugcuau

SEQ ID NO: 2144196 - RNA, 14 nt, Homo sapiens
agggcucagcuccu

SEQ ID NO: 2144197 - RNA, 13 nt, Homo sapiens
ggaaauuagccac

SEQ ID NO: 2144198 - RNA, 22 nt, Homo sapiens
ggcacagcaguuucaccaucuu

SEQ ID NO: 2144199 - RNA, 13 nt, Homo sapiens
caagggagacuga

SEQ ID NO: 2144200 - RNA, 17 nt, Homo sapiens
uacuagucaccagagac

SEQ ID NO: 2144201 - RNA, 23 nt, Homo sapiens
uuaacaaauuauguuacaucugu

SEQ ID NO: 2144202 - RNA, 23 nt, Homo sapiens
agacaaggaaacuucuauguaaa

SEQ ID NO: 2144203 - RNA, 15 nt, Homo sapiens
acuaagaguaugugc

SEQ ID NO: 2144204 - RNA, 20 nt, Homo sapiens
ugguuuaaaugauacaguau

SEQ ID NO: 2144205 - RNA, 17 nt, Homo sapiens
guuucaccguguuagcc

SEQ ID NO: 2144206 - RNA, 14 nt, Homo sapiens
ucuuuguaccaaaa

SEQ ID NO: 2144207 - RNA, 14 nt, Homo sapiens
uaaauguacauuaa

SEQ ID NO: 2144208 - RNA, 20 nt, Homo sapiens
aucugucugugcacaugccu

SEQ ID NO: 2144209 - RNA, 21 nt, Homo sapiens
auggccuggugagacugucca

SEQ ID NO: 2144210 - RNA, 23 nt, Homo sapiens
ucaaacacggacccauagacagc

SEQ ID NO: 2144211 - RNA, 18 nt, Homo sapiens
augucagaggaccccagg

SEQ ID NO: 2144212 - RNA, 14 nt, Homo sapiens
cccuucacgcuggc

SEQ ID NO: 2144213 - RNA, 14 nt, Homo sapiens
gccuggacccugug

SEQ ID NO: 2144214 - RNA, 22 nt, Homo sapiens
ccuacagugcuguguacccugg

SEQ ID NO: 2144215 - RNA, 17 nt, Homo sapiens
acaugaaaauagcaaua

SEQ ID NO: 2144216 - RNA, 24 nt, Homo sapiens
cccccaguaaaaucaaaugugcau

SEQ ID NO: 2144217 - RNA, 17 nt, Homo sapiens
cccauaguaaugaguga

SEQ ID NO: 2144218 - RNA, 18 nt, Homo sapiens
ucaccaugacaccugcca

SEQ ID NO: 2144219 - RNA, 18 nt, Homo sapiens
agacaaagugacauuccu

SEQ ID NO: 2144220 - RNA, 17 nt, Homo sapiens
acggagucuugcucugu

SEQ ID NO: 2144221 - RNA, 13 nt, Homo sapiens
ugacagaugucug

SEQ ID NO: 2144222 - RNA, 14 nt, Homo sapiens
agcagaauaaugga

SEQ ID NO: 2144223 - RNA, 20 nt, Homo sapiens
acucagccaaccuuacuuac

SEQ ID NO: 2144224 - RNA, 23 nt, Homo sapiens
uagggggagccccuucugcucag

SEQ ID NO: 2144225 - RNA, 15 nt, Homo sapiens
agacucuagagucca

SEQ ID NO: 2144226 - RNA, 12 nt, Homo sapiens
ccuugcugcacc

SEQ ID NO: 2144227 - RNA, 15 nt, Homo sapiens
auucauguucugaaa

SEQ ID NO: 2144228 - RNA, 19 nt, Homo sapiens
aauauuucugauacugcug

SEQ ID NO: 2144229 - RNA, 16 nt, Homo sapiens
cccagaacgcaugcag

SEQ ID NO: 2144230 - RNA, 15 nt, Homo sapiens
uggggaagacagugg

SEQ ID NO: 2144231 - RNA, 17 nt, Homo sapiens
aaucagcauucucacuc

SEQ ID NO: 2144232 - RNA, 13 nt, Homo sapiens
ucuccugcuugua

SEQ ID NO: 2144233 - RNA, 15 nt, Homo sapiens
cuaaagugcauuauu

SEQ ID NO: 2144234 - RNA, 21 nt, Homo sapiens
uggagugauuuauacugugaa

SEQ ID NO: 2144235 - RNA, 16 nt, Homo sapiens
ucaaucaacuuuacug

SEQ ID NO: 2144236 - RNA, 18 nt, Homo sapiens
gaauuauaagaggcugau

SEQ ID NO: 2144237 - RNA, 17 nt, Homo sapiens
auacaauucagucuucu

SEQ ID NO: 2144238 - RNA, 14 nt, Homo sapiens
caggggagugugaa

SEQ ID NO: 2144239 - RNA, 20 nt, Homo sapiens
ugauaaucugggcaucucgu

SEQ ID NO: 2144240 - RNA, 15 nt, Homo sapiens
uauucuuguucaggg

SEQ ID NO: 2144241 - RNA, 22 nt, Homo sapiens
uuugcaaaggacuguaagcaga

SEQ ID NO: 2144242 - RNA, 18 nt, Homo sapiens
gacacggcuucacugacc

SEQ ID NO: 2144243 - RNA, 18 nt, Homo sapiens
auuauggaauuacucuac

SEQ ID NO: 2144244 - RNA, 19 nt, Homo sapiens
caccucuauauuaguuuau

SEQ ID NO: 2144245 - RNA, 20 nt, Homo sapiens
aagauggcgaccaccaaagu

SEQ ID NO: 2144246 - RNA, 19 nt, Homo sapiens
ugacaaaaaggccaagaga

SEQ ID NO: 2144247 - RNA, 18 nt, Homo sapiens
uagcugggauuacaggug

SEQ ID NO: 2144248 - RNA, 21 nt, Homo sapiens
aagggauaauagacacaucaa

SEQ ID NO: 2144249 - RNA, 22 nt, Homo sapiens
auaacuguaaaugugacauuga

SEQ ID NO: 2144250 - RNA, 20 nt, Homo sapiens
aggucuaccugaaaauucaa

SEQ ID NO: 2144251 - RNA, 22 nt, Homo sapiens
caggauggaauccuacagccuc

SEQ ID NO: 2144252 - RNA, 14 nt, Homo sapiens
ugcuucaucauucc

SEQ ID NO: 2144253 - RNA, 21 nt, Homo sapiens
uucaagccuggcccagugaga

SEQ ID NO: 2144254 - RNA, 14 nt, Homo sapiens
aggagaccuccagc

SEQ ID NO: 2144255 - RNA, 12 nt, Homo sapiens
agccuuugcacu

SEQ ID NO: 2144256 - RNA, 12 nt, Homo sapiens
ccagcuccgugu

SEQ ID NO: 2144257 - RNA, 15 nt, Homo sapiens
gaucguuucuuccag

SEQ ID NO: 2144258 - RNA, 19 nt, Homo sapiens
ucacacggacuaaucuuuc

SEQ ID NO: 2144259 - RNA, 14 nt, Homo sapiens
cugauguccauuca

SEQ ID NO: 2144260 - RNA, 13 nt, Homo sapiens
acaaagacauuua

SEQ ID NO: 2144261 - RNA, 13 nt, Homo sapiens
uacacacugucug

SEQ ID NO: 2144262 - RNA, 15 nt, Homo sapiens
auggcaggauccaag

SEQ ID NO: 2144263 - RNA, 21 nt, Homo sapiens
ugccccucggccccagcacau

SEQ ID NO: 2144264 - RNA, 17 nt, Homo sapiens
gggggcuccagggggug

SEQ ID NO: 2144265 - RNA, 23 nt, Homo sapiens
aacauucccuggaauugccacau

SEQ ID NO: 2144266 - RNA, 20 nt, Homo sapiens
acuuaagcccagugcacuga

SEQ ID NO: 2144267 - RNA, 20 nt, Homo sapiens
auugugacuuugcuuugaga

SEQ ID NO: 2144268 - RNA, 15 nt, Homo sapiens
aagacccucaguuau

SEQ ID NO: 2144269 - RNA, 15 nt, Homo sapiens
cucccuccccaaaug

SEQ ID NO: 2144270 - RNA, 18 nt, Homo sapiens
ccagaaggcgugcuggca

SEQ ID NO: 2144271 - RNA, 24 nt, Homo sapiens
agcccccuggaugggcauugggcu

SEQ ID NO: 2144272 - RNA, 12 nt, Homo sapiens
uugacuuucuaa

SEQ ID NO: 2144273 - RNA, 15 nt, Homo sapiens
acaaguccuugaccu

SEQ ID NO: 2144274 - RNA, 12 nt, Homo sapiens
ugauugccauuu

SEQ ID NO: 2144275 - RNA, 12 nt, Homo sapiens
aguaugccuuaa

SEQ ID NO: 2144276 - RNA, 13 nt, Homo sapiens
uauuuugguucuu

SEQ ID NO: 2144277 - RNA, 13 nt, Homo sapiens
aaccaaacggaac

SEQ ID NO: 2144278 - RNA, 14 nt, Homo sapiens
cuggaaggugcugu

SEQ ID NO: 2144279 - RNA, 21 nt, Homo sapiens
auguccacuguucuguucuca

SEQ ID NO: 2144280 - RNA, 14 nt, Homo sapiens
uccugagaccucaa

SEQ ID NO: 2144281 - RNA, 16 nt, Homo sapiens
agaaauuaacacccaa

SEQ ID NO: 2144282 - RNA, 19 nt, Homo sapiens
cauacucuguugccuccuc

SEQ ID NO: 2144283 - RNA, 14 nt, Homo sapiens
gaaccgauuaucua

SEQ ID NO: 2144284 - RNA, 20 nt, Homo sapiens
uauggaguaccauguggcaa

SEQ ID NO: 2144285 - RNA, 17 nt, Homo sapiens
aaggauaccaaauacca

SEQ ID NO: 2144286 - RNA, 16 nt, Homo sapiens
auuccuuagaaauuag

SEQ ID NO: 2144287 - RNA, 22 nt, Homo sapiens
ccaaagugcaugucacaugcca

SEQ ID NO: 2144288 - RNA, 20 nt, Homo sapiens
caggccaaagccccaugugc

SEQ ID NO: 2144289 - RNA, 21 nt, Homo sapiens
gccgccuggagaugacuugag

SEQ ID NO: 2144290 - RNA, 13 nt, Homo sapiens
gucacagcuuugu

SEQ ID NO: 2144291 - RNA, 19 nt, Homo sapiens
gugaggugggccuuugaga

SEQ ID NO: 2144292 - RNA, 15 nt, Homo sapiens
uggaauaucaaugcc

SEQ ID NO: 2144293 - RNA, 23 nt, Homo sapiens
aggaaacuugaaaggucugagga

SEQ ID NO: 2144294 - RNA, 13 nt, Homo sapiens
uuuuugcuuccaa

SEQ ID NO: 2144295 - RNA, 14 nt, Homo sapiens
gauuucaaaugcug

SEQ ID NO: 2144296 - RNA, 17 nt, Homo sapiens
acaaauuaauuuuacuc

SEQ ID NO: 2144297 - RNA, 22 nt, Homo sapiens
ucaguaguauucuaaagcuuuc

SEQ ID NO: 2144298 - RNA, 13 nt, Homo sapiens
caucuacaagcau

SEQ ID NO: 2144299 - RNA, 21 nt, Homo sapiens
cagcaucugaagacucaggca

SEQ ID NO: 2144300 - RNA, 17 nt, Homo sapiens
auaccaacugaagucaa

SEQ ID NO: 2144301 - RNA, 23 nt, Homo sapiens
ugagcauccucucucacauggaa

SEQ ID NO: 2144302 - RNA, 23 nt, Homo sapiens
aauauguaaauagaaacguguau

SEQ ID NO: 2144303 - RNA, 23 nt, Homo sapiens
gugauccucaaacacacaaacua

SEQ ID NO: 2144304 - RNA, 20 nt, Homo sapiens
ucucacagaggcaguaggaa

SEQ ID NO: 2144305 - RNA, 22 nt, Homo sapiens
cagaaguggaguuuucugugag

SEQ ID NO: 2144306 - RNA, 20 nt, Homo sapiens
auaucuucauaauauuccca

SEQ ID NO: 2144307 - RNA, 16 nt, Homo sapiens
uuagauguagcacuga

SEQ ID NO: 2144308 - RNA, 12 nt, Homo sapiens
aguauucugcau

SEQ ID NO: 2144309 - RNA, 19 nt, Homo sapiens
auacagcuguccacacuga

SEQ ID NO: 2144310 - RNA, 20 nt, Homo sapiens
gccauuccacuccacucagg

SEQ ID NO: 2144311 - RNA, 20 nt, Homo sapiens
gaagccccuacccugugagc

SEQ ID NO: 2144312 - RNA, 13 nt, Homo sapiens
ugaagaauuuaga

SEQ ID NO: 2144313 - RNA, 16 nt, Homo sapiens
ugccuauccucuguau

SEQ ID NO: 2144314 - RNA, 14 nt, Homo sapiens
agggaagccuuuug

SEQ ID NO: 2144315 - RNA, 15 nt, Homo sapiens
gcaccacuguguauu

SEQ ID NO: 2144316 - RNA, 13 nt, Homo sapiens
augagaacauucc

SEQ ID NO: 2144317 - RNA, 14 nt, Homo sapiens
gcuuuuuaauugag

SEQ ID NO: 2144318 - RNA, 12 nt, Homo sapiens
augcacauuucu

SEQ ID NO: 2144319 - RNA, 22 nt, Homo sapiens
ugcucaagaggaaaauccaaaa

SEQ ID NO: 2144320 - RNA, 12 nt, Homo sapiens
accuaguacaag

SEQ ID NO: 2144321 - RNA, 17 nt, Homo sapiens
cuguuuugccagcccau

SEQ ID NO: 2144322 - RNA, 11 nt, Homo sapiens
ggugggguccu

SEQ ID NO: 2144323 - RNA, 23 nt, Homo sapiens
ugaaccacccagaguggcccaag

SEQ ID NO: 2144324 - RNA, 16 nt, Homo sapiens
guuauuuguuacuaaa

SEQ ID NO: 2144325 - RNA, 23 nt, Homo sapiens
cugggagagaaggagaucagggc

SEQ ID NO: 2144326 - RNA, 13 nt, Homo sapiens
ccccaucuucauc

SEQ ID NO: 2144327 - RNA, 16 nt, Homo sapiens
cuacuacucugccaau

SEQ ID NO: 2144328 - RNA, 23 nt, Homo sapiens
uaaagggaccagcccuucauggg

SEQ ID NO: 2144329 - RNA, 18 nt, Homo sapiens
uuaaugugacaguguuca

SEQ ID NO: 2144330 - RNA, 19 nt, Homo sapiens
cccaacacuuccagcauuu

SEQ ID NO: 2144331 - RNA, 21 nt, Homo sapiens
auggagugaccauagcuccuu

SEQ ID NO: 2144332 - RNA, 20 nt, Homo sapiens
agccuagagaccauguugac

SEQ ID NO: 2144333 - RNA, 14 nt, Homo sapiens
ugucuaccugggag

SEQ ID NO: 2144334 - RNA, 20 nt, Homo sapiens
gcaaguuugacacaaacuca

SEQ ID NO: 2144335 - RNA, 15 nt, Homo sapiens
gcucuguauguguuc

SEQ ID NO: 2144336 - RNA, 16 nt, Homo sapiens
ccuuggggaggacaaa

SEQ ID NO: 2144337 - RNA, 21 nt, Homo sapiens
cuaccugcuccccucaaaagc

SEQ ID NO: 2144338 - RNA, 15 nt, Homo sapiens
gacugcaagcugcuu

SEQ ID NO: 2144339 - RNA, 14 nt, Homo sapiens
acacgcgugcacac

SEQ ID NO: 2144340 - RNA, 14 nt, Homo sapiens
acaggugugcagau

SEQ ID NO: 2144341 - RNA, 15 nt, Homo sapiens
auaugccacugaccg

SEQ ID NO: 2144342 - RNA, 17 nt, Homo sapiens
cuuugagacugggucuc

SEQ ID NO: 2144343 - RNA, 15 nt, Homo sapiens
ggcuuuucacauggg

SEQ ID NO: 2144344 - RNA, 15 nt, Homo sapiens
uggcccaaauccagu

SEQ ID NO: 2144345 - RNA, 17 nt, Homo sapiens
cauagccauaccuggua

SEQ ID NO: 2144346 - RNA, 14 nt, Homo sapiens
ccggccacauucag

SEQ ID NO: 2144347 - RNA, 23 nt, Homo sapiens
uccccuugggggugguggaugaa

SEQ ID NO: 2144348 - RNA, 19 nt, Homo sapiens
ccuucaaauaguauagaaa

SEQ ID NO: 2144349 - RNA, 22 nt, Homo sapiens
cguguaaauaauuuauuacaag

SEQ ID NO: 2144350 - RNA, 18 nt, Homo sapiens
gcacaguaggaauuggaa

SEQ ID NO: 2144351 - RNA, 16 nt, Homo sapiens
cauaugcuuuaagaau

SEQ ID NO: 2144352 - RNA, 13 nt, Homo sapiens
caguucucacucc

SEQ ID NO: 2144353 - RNA, 13 nt, Homo sapiens
uuagugaguauaa

SEQ ID NO: 2144354 - RNA, 15 nt, Homo sapiens
guuaguaucaucaga

SEQ ID NO: 2144355 - RNA, 14 nt, Homo sapiens
gacauaauuuacau

SEQ ID NO: 2144356 - RNA, 17 nt, Homo sapiens
ugcuucccccaccccuc

SEQ ID NO: 2144357 - RNA, 19 nt, Homo sapiens
ccacauugagaucacuacu

SEQ ID NO: 2144358 - RNA, 23 nt, Homo sapiens
uugaaccuucaaagcuuuuguaa

SEQ ID NO: 2144359 - RNA, 14 nt, Homo sapiens
auucugcugacaaa

SEQ ID NO: 2144360 - RNA, 19 nt, Homo sapiens
uguagcaagaugagcaaug

SEQ ID NO: 2144361 - RNA, 19 nt, Homo sapiens
agccuagguguugucagca

SEQ ID NO: 2144362 - RNA, 15 nt, Homo sapiens
ccaaggaaaauggac

SEQ ID NO: 2144363 - RNA, 19 nt, Homo sapiens
uuuucuaaguguaaccuca

SEQ ID NO: 2144364 - RNA, 18 nt, Homo sapiens
uaaaugauguacuacauu

SEQ ID NO: 2144365 - RNA, 23 nt, Homo sapiens
aaagcuuaauauauucccaagcu

SEQ ID NO: 2144366 - RNA, 16 nt, Homo sapiens
gaagcagaaauguacu

SEQ ID NO: 2144367 - RNA, 19 nt, Homo sapiens
gauugugcgugcaugugug

SEQ ID NO: 2144368 - RNA, 17 nt, Homo sapiens
cauaccuacauucaagg

SEQ ID NO: 2144369 - RNA, 19 nt, Homo sapiens
cucuucaaauaaacauguc

SEQ ID NO: 2144370 - RNA, 14 nt, Homo sapiens
aacuuacuuccaag

SEQ ID NO: 2144371 - RNA, 19 nt, Homo sapiens
agaugaaucauugauugaa

SEQ ID NO: 2144372 - RNA, 20 nt, Homo sapiens
aaauugggacuaguuuauag

SEQ ID NO: 2144373 - RNA, 14 nt, Homo sapiens
gccacaacugcccc

SEQ ID NO: 2144374 - RNA, 19 nt, Homo sapiens
gaacugaaaaauuacuuau

SEQ ID NO: 2144375 - RNA, 18 nt, Homo sapiens
cauaggcgcaggugcaca

SEQ ID NO: 2144376 - RNA, 18 nt, Homo sapiens
gaaugaugcacauuucau

SEQ ID NO: 2144377 - RNA, 17 nt, Homo sapiens
acacaaaacaaaugcca

SEQ ID NO: 2144378 - RNA, 15 nt, Homo sapiens
agccugaccaaaagu

SEQ ID NO: 2144379 - RNA, 20 nt, Homo sapiens
gagguggagguugcagugag

SEQ ID NO: 2144380 - RNA, 22 nt, Homo sapiens
cugaaauuauauaaggcauucu

SEQ ID NO: 2144381 - RNA, 19 nt, Homo sapiens
auauuagccaaagaggcau

SEQ ID NO: 2144382 - RNA, 15 nt, Homo sapiens
ggccuggcccagcca

SEQ ID NO: 2144383 - RNA, 12 nt, Homo sapiens
cagauaccucca

SEQ ID NO: 2144384 - RNA, 15 nt, Homo sapiens
uagcgauccauguaa

SEQ ID NO: 2144385 - RNA, 12 nt, Homo sapiens
cuggugacuccu

SEQ ID NO: 2144386 - RNA, 23 nt, Homo sapiens
ugcccucugacuaguagauuucu

SEQ ID NO: 2144387 - RNA, 17 nt, Homo sapiens
uguuuuccugcugguaa

SEQ ID NO: 2144388 - RNA, 13 nt, Homo sapiens
aaaaaaacuucau

SEQ ID NO: 2144389 - RNA, 15 nt, Homo sapiens
uagacauucuuuauc

SEQ ID NO: 2144390 - RNA, 17 nt, Homo sapiens
ucuaagcugugugcagg

SEQ ID NO: 2144391 - RNA, 21 nt, Homo sapiens
gccacagaccuaggauuucau

SEQ ID NO: 2144392 - RNA, 10 nt, Homo sapiens
gaauggugug

SEQ ID NO: 2144393 - RNA, 17 nt, Homo sapiens
cagucauuggguuuuau

SEQ ID NO: 2144394 - RNA, 23 nt, Homo sapiens
gaacacucuuagcuauguugaca

SEQ ID NO: 2144395 - RNA, 23 nt, Homo sapiens
cauguacuuuauauuuucuauau

SEQ ID NO: 2144396 - RNA, 19 nt, Homo sapiens
agauucagggaaaguggga

SEQ ID NO: 2144397 - RNA, 13 nt, Homo sapiens
agaaggagggaga

SEQ ID NO: 2144398 - RNA, 15 nt, Homo sapiens
uugccauaaagucaa

SEQ ID NO: 2144399 - RNA, 18 nt, Homo sapiens
acagauguggacaugcac

SEQ ID NO: 2144400 - RNA, 19 nt, Homo sapiens
cuuucccuuggauaccuag

SEQ ID NO: 2144401 - RNA, 17 nt, Homo sapiens
acuggcaucuagucaag

SEQ ID NO: 2144402 - RNA, 18 nt, Homo sapiens
gacggccggggacugccu

SEQ ID NO: 2144403 - RNA, 18 nt, Homo sapiens
acucugcucuaugccagg

SEQ ID NO: 2144404 - RNA, 15 nt, Homo sapiens
gccagcuuauaguca

SEQ ID NO: 2144405 - RNA, 17 nt, Homo sapiens
cauucagcaucagagag

SEQ ID NO: 2144406 - RNA, 15 nt, Homo sapiens
caguucuacugaccu

SEQ ID NO: 2144407 - RNA, 14 nt, Homo sapiens
cuguauaacccugu

SEQ ID NO: 2144408 - RNA, 13 nt, Homo sapiens
guaaauacaggua

SEQ ID NO: 2144409 - RNA, 17 nt, Homo sapiens
uaaauuacaaaugcaau

SEQ ID NO: 2144410 - RNA, 21 nt, Homo sapiens
cagauaaaauguucagugcaa

SEQ ID NO: 2144411 - RNA, 22 nt, Homo sapiens
ugguaacugcuuucuguuccaa

SEQ ID NO: 2144412 - RNA, 14 nt, Homo sapiens
cuuuaaauuucaaa

SEQ ID NO: 2144413 - RNA, 21 nt, Homo sapiens
gagacuucucccauagcaaag

SEQ ID NO: 2144414 - RNA, 23 nt, Homo sapiens
ucaucugugauucccuccugcua

SEQ ID NO: 2144415 - RNA, 16 nt, Homo sapiens
acuccuaugaucucag

SEQ ID NO: 2144416 - RNA, 18 nt, Homo sapiens
uauuauagaauugcacau

SEQ ID NO: 2144417 - RNA, 20 nt, Homo sapiens
agguuaaaggaaaagcacaa

SEQ ID NO: 2144418 - RNA, 21 nt, Homo sapiens
uccaaaacuaauuuccucuga

SEQ ID NO: 2144419 - RNA, 11 nt, Homo sapiens
aauacuuuauc

SEQ ID NO: 2144420 - RNA, 15 nt, Homo sapiens
aaagaaaaucuuuag

SEQ ID NO: 2144421 - RNA, 13 nt, Homo sapiens
ccgugaacacaaa

SEQ ID NO: 2144422 - RNA, 19 nt, Homo sapiens
cagagguggucuggugcca

SEQ ID NO: 2144423 - RNA, 16 nt, Homo sapiens
auuuauuuacauguga

SEQ ID NO: 2144424 - RNA, 23 nt, Homo sapiens
aaggagaugucugaauacugcag

SEQ ID NO: 2144425 - RNA, 20 nt, Homo sapiens
ccagggcaaagaacacaaac

SEQ ID NO: 2144426 - RNA, 20 nt, Homo sapiens
cgaaagucugaaucucccaa

SEQ ID NO: 2144427 - RNA, 16 nt, Homo sapiens
uaagcuaggaaugaaa

SEQ ID NO: 2144428 - RNA, 15 nt, Homo sapiens
auuugcacagaagag

SEQ ID NO: 2144429 - RNA, 18 nt, Homo sapiens
agggugacugaugauaca

SEQ ID NO: 2144430 - RNA, 17 nt, Homo sapiens
cuauccugggcauccuu

SEQ ID NO: 2144431 - RNA, 22 nt, Homo sapiens
uaagacaggaggaucacaagag

SEQ ID NO: 2144432 - RNA, 16 nt, Homo sapiens
uauuuccaucauguca

SEQ ID NO: 2144433 - RNA, 18 nt, Homo sapiens
ucauaaaaggacucucag

SEQ ID NO: 2144434 - RNA, 17 nt, Homo sapiens
aaccacacaaagacauu

SEQ ID NO: 2144435 - RNA, 21 nt, Homo sapiens
gcugcuggggccucagacgag

SEQ ID NO: 2144436 - RNA, 16 nt, Homo sapiens
ggaaaauuaauaucac

SEQ ID NO: 2144437 - RNA, 16 nt, Homo sapiens
auucucagugccaacu

SEQ ID NO: 2144438 - RNA, 20 nt, Homo sapiens
guucucauaacucugugauc

SEQ ID NO: 2144439 - RNA, 18 nt, Homo sapiens
ugaacuuucacauagcac

SEQ ID NO: 2144440 - RNA, 12 nt, Homo sapiens
gugaaaccagcu

SEQ ID NO: 2144441 - RNA, 21 nt, Homo sapiens
uggaaugggcagcucaucucu

SEQ ID NO: 2144442 - RNA, 20 nt, Homo sapiens
ugcaccuuaccaacuuucug

SEQ ID NO: 2144443 - RNA, 21 nt, Homo sapiens
uaauaaaggcccccacuucuc

SEQ ID NO: 2144444 - RNA, 18 nt, Homo sapiens
ucagagaauaaacaucau

SEQ ID NO: 2144445 - RNA, 16 nt, Homo sapiens
uaauacuacuacuguu

SEQ ID NO: 2144446 - RNA, 14 nt, Homo sapiens
cagaagaugugaug

SEQ ID NO: 2144447 - RNA, 20 nt, Homo sapiens
agucaugaacacaucagcua

SEQ ID NO: 2144448 - RNA, 18 nt, Homo sapiens
uuccugcauucacccaga

SEQ ID NO: 2144449 - RNA, 24 nt, Homo sapiens
aaaguacugggauuacaggcguga

SEQ ID NO: 2144450 - RNA, 17 nt, Homo sapiens
accacauuuagaacuuu

SEQ ID NO: 2144451 - RNA, 12 nt, Homo sapiens
augcugguggcu

SEQ ID NO: 2144452 - RNA, 21 nt, Homo sapiens
cucugagcagugcuugaauga

SEQ ID NO: 2144453 - RNA, 13 nt, Homo sapiens
uuugaaagcaaaa

SEQ ID NO: 2144454 - RNA, 14 nt, Homo sapiens
cguccauccauuca

SEQ ID NO: 2144455 - RNA, 13 nt, Homo sapiens
auucauacucaga

SEQ ID NO: 2144456 - RNA, 19 nt, Homo sapiens
cucccugaaguaagcaaag

SEQ ID NO: 2144457 - RNA, 18 nt, Homo sapiens
guauaucuuugcacugaa

SEQ ID NO: 2144458 - RNA, 16 nt, Homo sapiens
uagccacugacuugcu

SEQ ID NO: 2144459 - RNA, 13 nt, Homo sapiens
augcaacucaucu

SEQ ID NO: 2144460 - RNA, 13 nt, Homo sapiens
auguccucagggc

SEQ ID NO: 2144461 - RNA, 21 nt, Homo sapiens
acugacaaccucauccaggcu

SEQ ID NO: 2144462 - RNA, 22 nt, Homo sapiens
uagucacagagauaauucuagc

SEQ ID NO: 2144463 - RNA, 11 nt, Homo sapiens
aaaacuacuuc

SEQ ID NO: 2144464 - RNA, 11 nt, Homo sapiens
aacacuacuua

SEQ ID NO: 2144465 - RNA, 16 nt, Homo sapiens
cauccccagcgauucc

SEQ ID NO: 2144466 - RNA, 19 nt, Homo sapiens
acgacgucagccucuuacc

SEQ ID NO: 2144467 - RNA, 17 nt, Homo sapiens
uuauccugcuagcugua

SEQ ID NO: 2144468 - RNA, 19 nt, Homo sapiens
aaacuuagacagcauguau

SEQ ID NO: 2144469 - RNA, 15 nt, Homo sapiens
ugacggcaaccucug

SEQ ID NO: 2144470 - RNA, 23 nt, Homo sapiens
uaaccaguccacaccacuguugc

SEQ ID NO: 2144471 - RNA, 21 nt, Homo sapiens
cugaacaggccgcacaucuca

SEQ ID NO: 2144472 - RNA, 18 nt, Homo sapiens
caucuggcggccaaguga

SEQ ID NO: 2144473 - RNA, 16 nt, Homo sapiens
aacauacuuacauuuc

SEQ ID NO: 2144474 - RNA, 16 nt, Homo sapiens
caugguuaaugcaggc

SEQ ID NO: 2144475 - RNA, 21 nt, Homo sapiens
gggugacagagcgagacucca

SEQ ID NO: 2144476 - RNA, 20 nt, Homo sapiens
aacucuccccuugucugcac

SEQ ID NO: 2144477 - RNA, 19 nt, Homo sapiens
gacuaugacggugacucuu

SEQ ID NO: 2144478 - RNA, 17 nt, Homo sapiens
gacaaagagaaugagaa

SEQ ID NO: 2144479 - RNA, 17 nt, Homo sapiens
cccugcagccaaacaga

SEQ ID NO: 2144480 - RNA, 17 nt, Homo sapiens
ugaaauauugcuguaua

SEQ ID NO: 2144481 - RNA, 17 nt, Homo sapiens
cuccuugcuuguuacau

SEQ ID NO: 2144482 - RNA, 16 nt, Homo sapiens
ucuaggagcaagguga

SEQ ID NO: 2144483 - RNA, 15 nt, Homo sapiens
cauccauccaaaggc

SEQ ID NO: 2144484 - RNA, 14 nt, Homo sapiens
augcuuuaaaaacu

SEQ ID NO: 2144485 - RNA, 17 nt, Homo sapiens
aucuauaggcagcuucu

SEQ ID NO: 2144486 - RNA, 19 nt, Homo sapiens
agaaaaaucauaacucacu

SEQ ID NO: 2144487 - RNA, 12 nt, Homo sapiens
agaaggcucuau

SEQ ID NO: 2144488 - RNA, 13 nt, Homo sapiens
guaugcacagggu

SEQ ID NO: 2144489 - RNA, 17 nt, Homo sapiens
gacugguuagacaguac

SEQ ID NO: 2144490 - RNA, 17 nt, Homo sapiens
accuggaaacagcuuua

SEQ ID NO: 2144491 - RNA, 22 nt, Homo sapiens
guaaaacagauuuguucauucc

SEQ ID NO: 2144492 - RNA, 12 nt, Homo sapiens
uauauucuuaca

SEQ ID NO: 2144493 - RNA, 14 nt, Homo sapiens
auaaugcaagcuua

SEQ ID NO: 2144494 - RNA, 14 nt, Homo sapiens
aucuugcaagaaua

SEQ ID NO: 2144495 - RNA, 13 nt, Homo sapiens
agggcucagcucc

SEQ ID NO: 2144496 - RNA, 22 nt, Homo sapiens
ucuauuuggggcuugaugacuu

SEQ ID NO: 2144497 - RNA, 16 nt, Homo sapiens
caggccacccagggac

SEQ ID NO: 2144498 - RNA, 17 nt, Homo sapiens
gcuacagcuuucuugcu

SEQ ID NO: 2144499 - RNA, 14 nt, Homo sapiens
uacuggugauuucu

SEQ ID NO: 2144500 - RNA, 15 nt, Homo sapiens
aggaagagugugcuu

SEQ ID NO: 2144501 - RNA, 21 nt, Homo sapiens
gcugcaaauaaggacagcagc

SEQ ID NO: 2144502 - RNA, 15 nt, Homo sapiens
acuuaaaauugcuaa

SEQ ID NO: 2144503 - RNA, 23 nt, Homo sapiens
agaguaacguacauuugugcugu

SEQ ID NO: 2144504 - RNA, 16 nt, Homo sapiens
ugucggcggcuugaua

SEQ ID NO: 2144505 - RNA, 21 nt, Homo sapiens
ugacuuccccaaacccagaaa

SEQ ID NO: 2144506 - RNA, 12 nt, Homo sapiens
accaagggcaga

SEQ ID NO: 2144507 - RNA, 20 nt, Homo sapiens
aaaugugaauugcaugacuu

SEQ ID NO: 2144508 - RNA, 21 nt, Homo sapiens
accuguugauagcaagugaau

SEQ ID NO: 2144509 - RNA, 23 nt, Homo sapiens
gcucaagaacgagaagcagcauu

SEQ ID NO: 2144510 - RNA, 22 nt, Homo sapiens
aaaauaguggaucucaguuuuu

SEQ ID NO: 2144511 - RNA, 14 nt, Homo sapiens
auuuauagcuguag

SEQ ID NO: 2144512 - RNA, 21 nt, Homo sapiens
cccugugaucuauaccaccuu

SEQ ID NO: 2144513 - RNA, 14 nt, Homo sapiens
aauauaauacauuu

SEQ ID NO: 2144514 - RNA, 22 nt, Homo sapiens
uaacucagucuuuaaucugaga

SEQ ID NO: 2144515 - RNA, 19 nt, Homo sapiens
aagccucuauugccaugag

SEQ ID NO: 2144516 - RNA, 15 nt, Homo sapiens
aggcucaugccauca

SEQ ID NO: 2144517 - RNA, 23 nt, Homo sapiens
gggccuguacaaaagggacauga

SEQ ID NO: 2144518 - RNA, 22 nt, Homo sapiens
guguggcccagggaagccaaaa

SEQ ID NO: 2144519 - RNA, 15 nt, Homo sapiens
augagauguaugccc

SEQ ID NO: 2144520 - RNA, 19 nt, Homo sapiens
ucuuccuccucgcugccag

SEQ ID NO: 2144521 - RNA, 19 nt, Homo sapiens
caggccuucccaccaggaa

SEQ ID NO: 2144522 - RNA, 15 nt, Homo sapiens
aauccacgcucaauc

SEQ ID NO: 2144523 - RNA, 14 nt, Homo sapiens
uguauuucagggac

SEQ ID NO: 2144524 - RNA, 20 nt, Homo sapiens
uuccugcagccagaaaggaa

SEQ ID NO: 2144525 - RNA, 17 nt, Homo sapiens
agcuucuuaguuacuuu

SEQ ID NO: 2144526 - RNA, 17 nt, Homo sapiens
uucaaucauuuauucau

SEQ ID NO: 2144527 - RNA, 12 nt, Homo sapiens
guuuugccucac

SEQ ID NO: 2144528 - RNA, 16 nt, Homo sapiens
aguuuuuucuccucau

SEQ ID NO: 2144529 - RNA, 18 nt, Homo sapiens
cuuggaaugaauucucuc

SEQ ID NO: 2144530 - RNA, 22 nt, Homo sapiens
auugugcuccuucggauaugau

SEQ ID NO: 2144531 - RNA, 20 nt, Homo sapiens
guggucuuugaauaaagucu

SEQ ID NO: 2144532 - RNA, 19 nt, Homo sapiens
aaacaaaacuugcaucuaa

SEQ ID NO: 2144533 - RNA, 20 nt, Homo sapiens
ccucacacacagacucauau

SEQ ID NO: 2144534 - RNA, 13 nt, Homo sapiens
uagaacugccugg

SEQ ID NO: 2144535 - RNA, 23 nt, Homo sapiens
acagaacuuauucuccaucucaa

SEQ ID NO: 2144536 - RNA, 16 nt, Homo sapiens
acuguucagcuguccu

SEQ ID NO: 2144537 - RNA, 17 nt, Homo sapiens
ugucccagaaaugucau

SEQ ID NO: 2144538 - RNA, 14 nt, Homo sapiens
aauacagauuugaa

SEQ ID NO: 2144539 - RNA, 22 nt, Homo sapiens
ugcacaaucccuaaaauaaaga

SEQ ID NO: 2144540 - RNA, 21 nt, Homo sapiens
cacuucaaggcucaaugcuau

SEQ ID NO: 2144541 - RNA, 17 nt, Homo sapiens
cuagugccagagcuugc

SEQ ID NO: 2144542 - RNA, 14 nt, Homo sapiens
aaagguccuggcaa

SEQ ID NO: 2144543 - RNA, 20 nt, Homo sapiens
gaacagggucauguuugcag

SEQ ID NO: 2144544 - RNA, 21 nt, Homo sapiens
uggagugccuguacaagcuga

SEQ ID NO: 2144545 - RNA, 16 nt, Homo sapiens
agacugguuugggcaa

SEQ ID NO: 2144546 - RNA, 22 nt, Homo sapiens
gcuuuuuucuugaguacuagaa

SEQ ID NO: 2144547 - RNA, 19 nt, Homo sapiens
cugcaccccauguggguga

SEQ ID NO: 2144548 - RNA, 15 nt, Homo sapiens
agaagagaccaagcu

SEQ ID NO: 2144549 - RNA, 16 nt, Homo sapiens
ugcuggaaauggacac

SEQ ID NO: 2144550 - RNA, 14 nt, Homo sapiens
agguaugguggcau

SEQ ID NO: 2144551 - RNA, 14 nt, Homo sapiens
gggaaauugcugcu

SEQ ID NO: 2144552 - RNA, 18 nt, Homo sapiens
aaccaggcaccucuuccu

SEQ ID NO: 2144553 - RNA, 17 nt, Homo sapiens
gagggacaggcacucca

SEQ ID NO: 2144554 - RNA, 16 nt, Homo sapiens
ucacacugaagccaca

SEQ ID NO: 2144555 - RNA, 14 nt, Homo sapiens
ugguuaucuuugag

SEQ ID NO: 2144556 - RNA, 14 nt, Homo sapiens
aagaaaaacaucuu

SEQ ID NO: 2144557 - RNA, 22 nt, Homo sapiens
gaugcaccaaguacagccuuca

SEQ ID NO: 2144558 - RNA, 18 nt, Homo sapiens
cuggucauuaaugugucc

SEQ ID NO: 2144559 - RNA, 17 nt, Homo sapiens
cgcaguggcauguccac

SEQ ID NO: 2144560 - RNA, 15 nt, Homo sapiens
gccagugucuguuca

SEQ ID NO: 2144561 - RNA, 15 nt, Homo sapiens
cccaguguguguuca

SEQ ID NO: 2144562 - RNA, 14 nt, Homo sapiens
ugcaguugcucagg

SEQ ID NO: 2144563 - RNA, 16 nt, Homo sapiens
gagcaggaacaaugac

SEQ ID NO: 2144564 - RNA, 20 nt, Homo sapiens
aaacccgccucccagguuua

SEQ ID NO: 2144565 - RNA, 21 nt, Homo sapiens
ugcacagccugcugucugcag

SEQ ID NO: 2144566 - RNA, 15 nt, Homo sapiens
gagaguugacuuggu

SEQ ID NO: 2144567 - RNA, 13 nt, Homo sapiens
cgagcacacauaa

SEQ ID NO: 2144568 - RNA, 19 nt, Homo sapiens
cagaaguagcuuugcacuu

SEQ ID NO: 2144569 - RNA, 18 nt, Homo sapiens
acacaguccagacucaaa

SEQ ID NO: 2144570 - RNA, 19 nt, Homo sapiens
uccauaaugcuacugucuc

SEQ ID NO: 2144571 - RNA, 21 nt, Homo sapiens
cagaugcagggguggggagcg

SEQ ID NO: 2144572 - RNA, 12 nt, Homo sapiens
uagaauucugaa

SEQ ID NO: 2144573 - RNA, 16 nt, Homo sapiens
aagcauguacuguacu

SEQ ID NO: 2144574 - RNA, 12 nt, Homo sapiens
ucccgaccucag

SEQ ID NO: 2144575 - RNA, 18 nt, Homo sapiens
ccaguguuguuuguaaau

SEQ ID NO: 2144576 - RNA, 21 nt, Homo sapiens
ugaaagaaccaaaagagauca

SEQ ID NO: 2144577 - RNA, 18 nt, Homo sapiens
ccuuaauuuccuuuuuga

SEQ ID NO: 2144578 - RNA, 15 nt, Homo sapiens
ucaugacagcaaagu

SEQ ID NO: 2144579 - RNA, 17 nt, Homo sapiens
ucacuauugaugcauuu

SEQ ID NO: 2144580 - RNA, 16 nt, Homo sapiens
uccuaagcuauucagu

SEQ ID NO: 2144581 - RNA, 17 nt, Homo sapiens
cccuggcggagggaugc

SEQ ID NO: 2144582 - RNA, 14 nt, Homo sapiens
caggcaagugaaga

SEQ ID NO: 2144583 - RNA, 15 nt, Homo sapiens
uuauucccuuucaca

SEQ ID NO: 2144584 - RNA, 14 nt, Homo sapiens
ucuguuuuaucuuc

SEQ ID NO: 2144585 - RNA, 16 nt, Homo sapiens
auuuauguccaggugu

SEQ ID NO: 2144586 - RNA, 20 nt, Homo sapiens
aguccagauuuacacuggga

SEQ ID NO: 2144587 - RNA, 22 nt, Homo sapiens
uugcaccccaaagcuuuccugc

SEQ ID NO: 2144588 - RNA, 13 nt, Homo sapiens
uaauuacuguaaa

SEQ ID NO: 2144589 - RNA, 15 nt, Homo sapiens
ugguuccaagaaaga

SEQ ID NO: 2144590 - RNA, 13 nt, Homo sapiens
acgugagccacag

SEQ ID NO: 2144591 - RNA, 14 nt, Homo sapiens
auugucuuacuguu

SEQ ID NO: 2144592 - RNA, 14 nt, Homo sapiens
aucucuuuaccucc

SEQ ID NO: 2144593 - RNA, 18 nt, Homo sapiens
uccagcugauccagaugu

SEQ ID NO: 2144594 - RNA, 11 nt, Homo sapiens
cagaaugucac

SEQ ID NO: 2144595 - RNA, 15 nt, Homo sapiens
ugcucuacagauaau

SEQ ID NO: 2144596 - RNA, 19 nt, Homo sapiens
cuggcacacaguaagcacu

SEQ ID NO: 2144597 - RNA, 22 nt, Homo sapiens
cucuuagaauuuguuucaucua

SEQ ID NO: 2144598 - RNA, 23 nt, Homo sapiens
agagaauaaguggcuugucugca

SEQ ID NO: 2144599 - RNA, 20 nt, Homo sapiens
cuguaaaucaagaccaaaga

SEQ ID NO: 2144600 - RNA, 17 nt, Homo sapiens
aaucacaaacugaauga

SEQ ID NO: 2144601 - RNA, 22 nt, Homo sapiens
cuacaguacaugacccggauga

SEQ ID NO: 2144602 - RNA, 16 nt, Homo sapiens
uauaccucacuagcca

SEQ ID NO: 2144603 - RNA, 16 nt, Homo sapiens
cauauguaucuauaca

SEQ ID NO: 2144604 - RNA, 16 nt, Homo sapiens
uaaaacaaucugucca

SEQ ID NO: 2144605 - RNA, 16 nt, Homo sapiens
acagaccuaauaucau

SEQ ID NO: 2144606 - RNA, 21 nt, Homo sapiens
agccagcccuucccaggccag

SEQ ID NO: 2144607 - RNA, 23 nt, Homo sapiens
uggacauuuuuguagaccacuuu

SEQ ID NO: 2144608 - RNA, 14 nt, Homo sapiens
cacaacagugaaaa

SEQ ID NO: 2144609 - RNA, 18 nt, Homo sapiens
ucuuacaaaggugaaaau

SEQ ID NO: 2144610 - RNA, 13 nt, Homo sapiens
caucuggagucuu

SEQ ID NO: 2144611 - RNA, 14 nt, Homo sapiens
cuauccacagagag

SEQ ID NO: 2144612 - RNA, 20 nt, Homo sapiens
aaguaaacugcccugucuag

SEQ ID NO: 2144613 - RNA, 16 nt, Homo sapiens
ggcuccuggcagugac

SEQ ID NO: 2144614 - RNA, 23 nt, Homo sapiens
ucugcagcccggcgccaccaucc

SEQ ID NO: 2144615 - RNA, 22 nt, Homo sapiens
augccauccuuccagcaaacgu

SEQ ID NO: 2144616 - RNA, 20 nt, Homo sapiens
agcucaguuucaccguccac

SEQ ID NO: 2144617 - RNA, 13 nt, Homo sapiens
auuuucacuggag

SEQ ID NO: 2144618 - RNA, 17 nt, Homo sapiens
ugaaagacaucaaugaa

SEQ ID NO: 2144619 - RNA, 16 nt, Homo sapiens
auuaaccgaugcuuua

SEQ ID NO: 2144620 - RNA, 19 nt, Homo sapiens
uguaaaaaugaaaagccaa

SEQ ID NO: 2144621 - RNA, 20 nt, Homo sapiens
ccauucagagcuauggugcu

SEQ ID NO: 2144622 - RNA, 13 nt, Homo sapiens
gggccccagagag

SEQ ID NO: 2144623 - RNA, 20 nt, Homo sapiens
uuccaggaauuuugugugau

SEQ ID NO: 2144624 - RNA, 15 nt, Homo sapiens
ccagcugcaccccuu

SEQ ID NO: 2144625 - RNA, 21 nt, Homo sapiens
uccucuacuacuuuuacuaca

SEQ ID NO: 2144626 - RNA, 19 nt, Homo sapiens
caaauggggccagauccag

SEQ ID NO: 2144627 - RNA, 21 nt, Homo sapiens
cuuuagugcuacagaaaagaa

SEQ ID NO: 2144628 - RNA, 18 nt, Homo sapiens
ugaacuaugaacacuguc

SEQ ID NO: 2144629 - RNA, 23 nt, Homo sapiens
cuacugggugucauuucauucca

SEQ ID NO: 2144630 - RNA, 21 nt, Homo sapiens
auuuacacauacaacuucaua

SEQ ID NO: 2144631 - RNA, 22 nt, Homo sapiens
auaauguucugcuaaauuucaa

SEQ ID NO: 2144632 - RNA, 23 nt, Homo sapiens
auacagggauuacuggugugagc

SEQ ID NO: 2144633 - RNA, 23 nt, Homo sapiens
uuccccagcgucccagucucugg

SEQ ID NO: 2144634 - RNA, 18 nt, Homo sapiens
uauuucaucucuuucuac

SEQ ID NO: 2144635 - RNA, 21 nt, Homo sapiens
guaaaucauguugaucaugua

SEQ ID NO: 2144636 - RNA, 14 nt, Homo sapiens
ggagucucugccac

SEQ ID NO: 2144637 - RNA, 12 nt, Homo sapiens
cccuauacauuu

SEQ ID NO: 2144638 - RNA, 15 nt, Homo sapiens
uggaagacacuugcu

SEQ ID NO: 2144639 - RNA, 19 nt, Homo sapiens
cagccuccaauguacaacu

SEQ ID NO: 2144640 - RNA, 21 nt, Homo sapiens
gggucucgcugucacuggcug

SEQ ID NO: 2144641 - RNA, 21 nt, Homo sapiens
uguccugcagucccacacugu

SEQ ID NO: 2144642 - RNA, 18 nt, Homo sapiens
ggguuucuugacaauggg

SEQ ID NO: 2144643 - RNA, 15 nt, Homo sapiens
agagcccacuuccau

SEQ ID NO: 2144644 - RNA, 21 nt, Homo sapiens
gacauaaugggguccuggcca

SEQ ID NO: 2144645 - RNA, 16 nt, Homo sapiens
gaaaacauacacugag

SEQ ID NO: 2144646 - RNA, 20 nt, Homo sapiens
ccacccguaggcagccucuc

SEQ ID NO: 2144647 - RNA, 22 nt, Homo sapiens
ccugucuggauccuauccuccu

SEQ ID NO: 2144648 - RNA, 14 nt, Homo sapiens
cccuacacugugaa

SEQ ID NO: 2144649 - RNA, 21 nt, Homo sapiens
cucacacugcaccaagcaccc

SEQ ID NO: 2144650 - RNA, 14 nt, Homo sapiens
ucauugucugugga

SEQ ID NO: 2144651 - RNA, 17 nt, Homo sapiens
ugacauggaggcacuga

SEQ ID NO: 2144652 - RNA, 14 nt, Homo sapiens
ggagcaccaaagga

SEQ ID NO: 2144653 - RNA, 18 nt, Homo sapiens
uuugcuucuucaauggca

SEQ ID NO: 2144654 - RNA, 22 nt, Homo sapiens
uuucuagauaaggaagagucuc

SEQ ID NO: 2144655 - RNA, 12 nt, Homo sapiens
guauuaccaugu

SEQ ID NO: 2144656 - RNA, 13 nt, Homo sapiens
cagacaaaccuug

SEQ ID NO: 2144657 - RNA, 17 nt, Homo sapiens
ccuucuggcugugcuac

SEQ ID NO: 2144658 - RNA, 14 nt, Homo sapiens
uucauuggagcauu

SEQ ID NO: 2144659 - RNA, 12 nt, Homo sapiens
augcacagugaa

SEQ ID NO: 2144660 - RNA, 12 nt, Homo sapiens
aaaggaacugca

SEQ ID NO: 2144661 - RNA, 22 nt, Homo sapiens
gaggaaaaacgaucgcugugaa

SEQ ID NO: 2144662 - RNA, 19 nt, Homo sapiens
aaguguugccaccauaccu

SEQ ID NO: 2144663 - RNA, 23 nt, Homo sapiens
gcaggaagcauucagagagcagc

SEQ ID NO: 2144664 - RNA, 17 nt, Homo sapiens
auuugaaggucugcaag

SEQ ID NO: 2144665 - RNA, 20 nt, Homo sapiens
cagagaguccugugcugaau

SEQ ID NO: 2144666 - RNA, 18 nt, Homo sapiens
uugaacaguuuaugcagu

SEQ ID NO: 2144667 - RNA, 20 nt, Homo sapiens
gcucuuaaaaagacacuuau

SEQ ID NO: 2144668 - RNA, 14 nt, Homo sapiens
guuaucaaccauau

SEQ ID NO: 2144669 - RNA, 12 nt, Homo sapiens
uuaauccagcuu

SEQ ID NO: 2144670 - RNA, 21 nt, Homo sapiens
acauacauguugggcaugauu

SEQ ID NO: 2144671 - RNA, 15 nt, Homo sapiens
ggccacucaggccag

SEQ ID NO: 2144672 - RNA, 19 nt, Homo sapiens
gagugcaauggugcaauca

SEQ ID NO: 2144673 - RNA, 16 nt, Homo sapiens
ucuccuuggaggacag

SEQ ID NO: 2144674 - RNA, 13 nt, Homo sapiens
gcagccaccagcg

SEQ ID NO: 2144675 - RNA, 22 nt, Homo sapiens
aaauauagcuaauaacauguga

SEQ ID NO: 2144676 - RNA, 17 nt, Homo sapiens
cgcccccaccagcucaa

SEQ ID NO: 2144677 - RNA, 16 nt, Homo sapiens
ggccauggcucauggg

SEQ ID NO: 2144678 - RNA, 23 nt, Homo sapiens
aaaaucugaauuggaaugcacuc

SEQ ID NO: 2144679 - RNA, 19 nt, Homo sapiens
uuccuucauuuccaccagg

SEQ ID NO: 2144680 - RNA, 19 nt, Homo sapiens
gcucaaucaugaguaccuc

SEQ ID NO: 2144681 - RNA, 16 nt, Homo sapiens
cuucagacacaggaaa

SEQ ID NO: 2144682 - RNA, 14 nt, Homo sapiens
uuuguaugugaaca

SEQ ID NO: 2144683 - RNA, 17 nt, Homo sapiens
gcgagucuuacuuugag

SEQ ID NO: 2144684 - RNA, 13 nt, Homo sapiens
uuguuggcucaga

SEQ ID NO: 2144685 - RNA, 16 nt, Homo sapiens
cauuccauuugaagca

SEQ ID NO: 2144686 - RNA, 17 nt, Homo sapiens
cuguaaacuauaaacua

SEQ ID NO: 2144687 - RNA, 17 nt, Homo sapiens
uccccugaauaccccaa

SEQ ID NO: 2144688 - RNA, 13 nt, Homo sapiens
aacagagggccac

SEQ ID NO: 2144689 - RNA, 18 nt, Homo sapiens
auuucccacugcacucca

SEQ ID NO: 2144690 - RNA, 18 nt, Homo sapiens
aauugacugagacuggaa

SEQ ID NO: 2144691 - RNA, 19 nt, Homo sapiens
acaucuuauaaacugacuu

SEQ ID NO: 2144692 - RNA, 12 nt, Homo sapiens
ugccaugugaag

SEQ ID NO: 2144693 - RNA, 18 nt, Homo sapiens
ucuauugaguguacauuu

SEQ ID NO: 2144694 - RNA, 22 nt, Homo sapiens
augcuuuguucagccugccuuc

SEQ ID NO: 2144695 - RNA, 11 nt, Homo sapiens
aaaaaaaagcu

SEQ ID NO: 2144696 - RNA, 20 nt, Homo sapiens
gcccuucuauacccacccag

SEQ ID NO: 2144697 - RNA, 21 nt, Homo sapiens
aaauggugggauuacaggugu

SEQ ID NO: 2144698 - RNA, 13 nt, Homo sapiens
uacacacacaaag

SEQ ID NO: 2144699 - RNA, 17 nt, Homo sapiens
uuccaauuuuguugcau

SEQ ID NO: 2144700 - RNA, 15 nt, Homo sapiens
caaagagaaaagcca

SEQ ID NO: 2144701 - RNA, 18 nt, Homo sapiens
uuguagcacaauccuauu

SEQ ID NO: 2144702 - RNA, 21 nt, Homo sapiens
caaacugcuuuuuccaacuca

SEQ ID NO: 2144703 - RNA, 13 nt, Homo sapiens
ccacucacuccag

SEQ ID NO: 2144704 - RNA, 18 nt, Homo sapiens
auuaaguguguguauacu

SEQ ID NO: 2144705 - RNA, 19 nt, Homo sapiens
gcugcugcacaccaaggcc

SEQ ID NO: 2144706 - RNA, 18 nt, Homo sapiens
uguaaaacuauauucuca

SEQ ID NO: 2144707 - RNA, 16 nt, Homo sapiens
cuggaggagcucugca

SEQ ID NO: 2144708 - RNA, 18 nt, Homo sapiens
guuuacagaaugcuacaa

SEQ ID NO: 2144709 - RNA, 20 nt, Homo sapiens
caagauacacgucacaaaga

SEQ ID NO: 2144710 - RNA, 12 nt, Homo sapiens
uuaaaagcauuu

SEQ ID NO: 2144711 - RNA, 12 nt, Homo sapiens
uauaaagcaaau

SEQ ID NO: 2144712 - RNA, 16 nt, Homo sapiens
augagaaguacuuugu

SEQ ID NO: 2144713 - RNA, 19 nt, Homo sapiens
gcuacugcaaaugcuauau

SEQ ID NO: 2144714 - RNA, 19 nt, Homo sapiens
aagauugauuaaugaacua

SEQ ID NO: 2144715 - RNA, 19 nt, Homo sapiens
ucuaacauaugauacugau

SEQ ID NO: 2144716 - RNA, 20 nt, Homo sapiens
agguuggaacuaugcagugu

SEQ ID NO: 2144717 - RNA, 20 nt, Homo sapiens
uuacugaggaaauauuucca

SEQ ID NO: 2144718 - RNA, 21 nt, Homo sapiens
ggauccuguguggagagggaa

SEQ ID NO: 2144719 - RNA, 17 nt, Homo sapiens
aucauccauucucucug

SEQ ID NO: 2144720 - RNA, 18 nt, Homo sapiens
guuagaagacgacugugg

SEQ ID NO: 2144721 - RNA, 23 nt, Homo sapiens
uaaucuaaguaaagcacaguccc

SEQ ID NO: 2144722 - RNA, 18 nt, Homo sapiens
cuuuuucuucuucccucc

SEQ ID NO: 2144723 - RNA, 16 nt, Homo sapiens
uucauucugcaaguau

SEQ ID NO: 2144724 - RNA, 22 nt, Homo sapiens
ccagccacggagggaggcacca

SEQ ID NO: 2144725 - RNA, 15 nt, Homo sapiens
uuuaccaacauguau

SEQ ID NO: 2144726 - RNA, 17 nt, Homo sapiens
ugagugaaaacaucugc

SEQ ID NO: 2144727 - RNA, 12 nt, Homo sapiens
ccaacagcacuu

SEQ ID NO: 2144728 - RNA, 17 nt, Homo sapiens
gucugggccacucaggg

SEQ ID NO: 2144729 - RNA, 18 nt, Homo sapiens
acccacgugcuguuccac

SEQ ID NO: 2144730 - RNA, 16 nt, Homo sapiens
ugagguugggcugaga

SEQ ID NO: 2144731 - RNA, 13 nt, Homo sapiens
gauuuguguuaua

SEQ ID NO: 2144732 - RNA, 13 nt, Homo sapiens
gaacuguguuuca

SEQ ID NO: 2144733 - RNA, 20 nt, Homo sapiens
acauuauuucuaguccaaaa

SEQ ID NO: 2144734 - RNA, 17 nt, Homo sapiens
agcaaaugggagaaaua

SEQ ID NO: 2144735 - RNA, 20 nt, Homo sapiens
uccaaaaaaauacugccaga

SEQ ID NO: 2144736 - RNA, 19 nt, Homo sapiens
uuauuaauaaacauucuau

SEQ ID NO: 2144737 - RNA, 15 nt, Homo sapiens
gccacacagugacuu

SEQ ID NO: 2144738 - RNA, 14 nt, Homo sapiens
aagguggacggggu

SEQ ID NO: 2144739 - RNA, 15 nt, Homo sapiens
uaacuaugacagaua

SEQ ID NO: 2144740 - RNA, 14 nt, Homo sapiens
uaaaagacaugcau

SEQ ID NO: 2144741 - RNA, 17 nt, Homo sapiens
ugacccagcaucuccca

SEQ ID NO: 2144742 - RNA, 15 nt, Homo sapiens
ugaaacaaauauacu

SEQ ID NO: 2144743 - RNA, 14 nt, Homo sapiens
aguguuauuugcac

SEQ ID NO: 2144744 - RNA, 14 nt, Homo sapiens
ggcagugggaccaa

SEQ ID NO: 2144745 - RNA, 14 nt, Homo sapiens
uugcuuaaaucagu

SEQ ID NO: 2144746 - RNA, 15 nt, Homo sapiens
uaggacuaaguucuc

SEQ ID NO: 2144747 - RNA, 15 nt, Homo sapiens
cuaguuuuacuuuga

SEQ ID NO: 2144748 - RNA, 18 nt, Homo sapiens
agacccucuucucugggc

SEQ ID NO: 2144749 - RNA, 18 nt, Homo sapiens
gguccacccagcaaagag

SEQ ID NO: 2144750 - RNA, 16 nt, Homo sapiens
gagggcccagcccaga

SEQ ID NO: 2144751 - RNA, 18 nt, Homo sapiens
ccuccccuggcaacugcu

SEQ ID NO: 2144752 - RNA, 14 nt, Homo sapiens
cacaaaacuugaaa

SEQ ID NO: 2144753 - RNA, 11 nt, Homo sapiens
uugcacaggau

SEQ ID NO: 2144754 - RNA, 20 nt, Homo sapiens
uccuucccugcucuugcagu

SEQ ID NO: 2144755 - RNA, 20 nt, Homo sapiens
ugugcugguaaaauguuuaa

SEQ ID NO: 2144756 - RNA, 15 nt, Homo sapiens
aguuagguagcuuua

SEQ ID NO: 2144757 - RNA, 23 nt, Homo sapiens
uuauaaaagaauaaaauugcacu

SEQ ID NO: 2144758 - RNA, 20 nt, Homo sapiens
auuuuuuaagguaacaaaua

SEQ ID NO: 2144759 - RNA, 16 nt, Homo sapiens
ucucccaccaccucac

SEQ ID NO: 2144760 - RNA, 17 nt, Homo sapiens
aaauucuugaaguucau

SEQ ID NO: 2144761 - RNA, 17 nt, Homo sapiens
cugucacucagcugaga

SEQ ID NO: 2144762 - RNA, 15 nt, Homo sapiens
uuuaauucacaucaa

SEQ ID NO: 2144763 - RNA, 12 nt, Homo sapiens
gcacgugucuca

SEQ ID NO: 2144764 - RNA, 19 nt, Homo sapiens
cuucauuuuauuaauauuu

SEQ ID NO: 2144765 - RNA, 15 nt, Homo sapiens
gugcagggcucaggg

SEQ ID NO: 2144766 - RNA, 16 nt, Homo sapiens
cauccucaugcugcuc

SEQ ID NO: 2144767 - RNA, 17 nt, Homo sapiens
ggaauuagaaauauauc

SEQ ID NO: 2144768 - RNA, 17 nt, Homo sapiens
ugugcauguaugucuug

SEQ ID NO: 2144769 - RNA, 14 nt, Homo sapiens
ucauguacuaugga

SEQ ID NO: 2144770 - RNA, 23 nt, Homo sapiens
cugcauuuucuggguucugggug

SEQ ID NO: 2144771 - RNA, 18 nt, Homo sapiens
agaaucccuguucauugu

SEQ ID NO: 2144772 - RNA, 19 nt, Homo sapiens
augcaaagcacucucugca

SEQ ID NO: 2144773 - RNA, 19 nt, Homo sapiens
cuuucugcuccuuucucca

SEQ ID NO: 2144774 - RNA, 23 nt, Homo sapiens
gcuucucuacagacuccaaaagg

SEQ ID NO: 2144775 - RNA, 13 nt, Homo sapiens
gguucuucagugc

SEQ ID NO: 2144776 - RNA, 15 nt, Homo sapiens
cuguccucuguagua

SEQ ID NO: 2144777 - RNA, 20 nt, Homo sapiens
cauaugucuuacuacuuuaa

SEQ ID NO: 2144778 - RNA, 16 nt, Homo sapiens
cuauugcuuaaacaaa

SEQ ID NO: 2144779 - RNA, 20 nt, Homo sapiens
ucauuggccagcucauaaaa

SEQ ID NO: 2144780 - RNA, 17 nt, Homo sapiens
cacagccccauggacaa

SEQ ID NO: 2144781 - RNA, 14 nt, Homo sapiens
cagaugauuccccu

SEQ ID NO: 2144782 - RNA, 20 nt, Homo sapiens
caugguuacaaucauugcug

SEQ ID NO: 2144783 - RNA, 17 nt, Homo sapiens
gaagggucucucuccag

SEQ ID NO: 2144784 - RNA, 18 nt, Homo sapiens
agauuuuuuuguguaugu

SEQ ID NO: 2144785 - RNA, 18 nt, Homo sapiens
ugcaguugucaccaaaua

SEQ ID NO: 2144786 - RNA, 11 nt, Homo sapiens
gcaugugccaa

SEQ ID NO: 2144787 - RNA, 20 nt, Homo sapiens
cauacccuuacucugccaga

SEQ ID NO: 2144788 - RNA, 19 nt, Homo sapiens
uuagaucaaauaguugcau

SEQ ID NO: 2144789 - RNA, 15 nt, Homo sapiens
ggaagggacacacac

SEQ ID NO: 2144790 - RNA, 18 nt, Homo sapiens
caggggaaaaugaagguu

SEQ ID NO: 2144791 - RNA, 15 nt, Homo sapiens
ugacaagugagacaa

SEQ ID NO: 2144792 - RNA, 14 nt, Homo sapiens
gaagaaacuggggc

SEQ ID NO: 2144793 - RNA, 20 nt, Homo sapiens
auuaguaaauaugugaagaa

SEQ ID NO: 2144794 - RNA, 22 nt, Homo sapiens
uacuugacaaauuugugugaca

SEQ ID NO: 2144795 - RNA, 18 nt, Homo sapiens
uacaggcucaugccauca

SEQ ID NO: 2144796 - RNA, 22 nt, Homo sapiens
caagaagccauuuagggcagca

SEQ ID NO: 2144797 - RNA, 19 nt, Homo sapiens
uccagauccuucaaagagu

SEQ ID NO: 2144798 - RNA, 21 nt, Homo sapiens
acacccagugggaagagugug

SEQ ID NO: 2144799 - RNA, 16 nt, Homo sapiens
ccucugccaggugcuu

SEQ ID NO: 2144800 - RNA, 23 nt, Homo sapiens
auguaaagaaaaaagcaccaaag

SEQ ID NO: 2144801 - RNA, 13 nt, Homo sapiens
uccccaauaccua

SEQ ID NO: 2144802 - RNA, 13 nt, Homo sapiens
agacaaauugauc

SEQ ID NO: 2144803 - RNA, 13 nt, Homo sapiens
auccaaauuucuc

SEQ ID NO: 2144804 - RNA, 19 nt, Homo sapiens
ccugcagggacuccaugcu

SEQ ID NO: 2144805 - RNA, 14 nt, Homo sapiens
uaauaccaucucuu

SEQ ID NO: 2144806 - RNA, 17 nt, Homo sapiens
uuuguagcguacaucaa

SEQ ID NO: 2144807 - RNA, 23 nt, Homo sapiens
gaacucaaauggggccagaucca

SEQ ID NO: 2144808 - RNA, 22 nt, Homo sapiens
gucuuugcccugaauggucuca

SEQ ID NO: 2144809 - RNA, 18 nt, Homo sapiens
agcauggaggaggaggga

SEQ ID NO: 2144810 - RNA, 21 nt, Homo sapiens
acaaaacccucagcacuguua

SEQ ID NO: 2144811 - RNA, 14 nt, Homo sapiens
ccagacaugcugcc

SEQ ID NO: 2144812 - RNA, 14 nt, Homo sapiens
cgggccgggcgggg

SEQ ID NO: 2144813 - RNA, 15 nt, Homo sapiens
aucuacuuacuugag

SEQ ID NO: 2144814 - RNA, 20 nt, Homo sapiens
cauagcucaccaggacuguu

SEQ ID NO: 2144815 - RNA, 18 nt, Homo sapiens
ugugcaguuuaaucuuuu

SEQ ID NO: 2144816 - RNA, 18 nt, Homo sapiens
uuaaucuguuauguacua

SEQ ID NO: 2144817 - RNA, 19 nt, Homo sapiens
guguauauaaauacaugca

SEQ ID NO: 2144818 - RNA, 14 nt, Homo sapiens
agcagggacuugaa

SEQ ID NO: 2144819 - RNA, 13 nt, Homo sapiens
guaaccauaucac

SEQ ID NO: 2144820 - RNA, 15 nt, Homo sapiens
aaaaagaaauuugau

SEQ ID NO: 2144821 - RNA, 20 nt, Homo sapiens
uacaguuucaaaaacuguau

SEQ ID NO: 2144822 - RNA, 20 nt, Homo sapiens
gcauaauucuaagucuucca

SEQ ID NO: 2144823 - RNA, 13 nt, Homo sapiens
uuauauauaaaga

SEQ ID NO: 2144824 - RNA, 11 nt, Homo sapiens
caugcucccuu

SEQ ID NO: 2144825 - RNA, 17 nt, Homo sapiens
uugguuuugcucacaaa

SEQ ID NO: 2144826 - RNA, 15 nt, Homo sapiens
uuuauaaccuggcaa

SEQ ID NO: 2144827 - RNA, 19 nt, Homo sapiens
cuggauuccucgaaacugc

SEQ ID NO: 2144828 - RNA, 13 nt, Homo sapiens
cauuaacauuuag

SEQ ID NO: 2144829 - RNA, 19 nt, Homo sapiens
uuugagcaauucauuucac

SEQ ID NO: 2144830 - RNA, 16 nt, Homo sapiens
cuccagcgauggugcu

SEQ ID NO: 2144831 - RNA, 21 nt, Homo sapiens
caugugcaccuuugcacagug

SEQ ID NO: 2144832 - RNA, 19 nt, Homo sapiens
gaugucccugaagugccag

SEQ ID NO: 2144833 - RNA, 23 nt, Homo sapiens
ugccuuccacgcugucuccagac

SEQ ID NO: 2144834 - RNA, 23 nt, Homo sapiens
aagucuuuccgucucccuaaaau

SEQ ID NO: 2144835 - RNA, 21 nt, Homo sapiens
cauuucaucguggcuguuucu

SEQ ID NO: 2144836 - RNA, 16 nt, Homo sapiens
aauuauguuacuguau

SEQ ID NO: 2144837 - RNA, 15 nt, Homo sapiens
uugugaccacaggcu

SEQ ID NO: 2144838 - RNA, 20 nt, Homo sapiens
ucaaguauuagggguaauau

SEQ ID NO: 2144839 - RNA, 15 nt, Homo sapiens
acagucuccauaagg

SEQ ID NO: 2144840 - RNA, 17 nt, Homo sapiens
cuuugcucccugcaaga

SEQ ID NO: 2144841 - RNA, 18 nt, Homo sapiens
aguacuaugucaaagcaa

SEQ ID NO: 2144842 - RNA, 12 nt, Homo sapiens
acagaugcugag

SEQ ID NO: 2144843 - RNA, 20 nt, Homo sapiens
guuggccauguucauucaca

SEQ ID NO: 2144844 - RNA, 14 nt, Homo sapiens
uggaacaagcacag

SEQ ID NO: 2144845 - RNA, 16 nt, Homo sapiens
uauuccaggaugcugc

SEQ ID NO: 2144846 - RNA, 21 nt, Homo sapiens
gcuucuuccuccuccaucacc

SEQ ID NO: 2144847 - RNA, 17 nt, Homo sapiens
uagaaaacuaaucuaaa

SEQ ID NO: 2144848 - RNA, 16 nt, Homo sapiens
uacaaacacaagcaaa

SEQ ID NO: 2144849 - RNA, 17 nt, Homo sapiens
aguagacauuuuaacaa

SEQ ID NO: 2144850 - RNA, 13 nt, Homo sapiens
aacuaacucuccu

SEQ ID NO: 2144851 - RNA, 18 nt, Homo sapiens
gccacuagcccacucccc

SEQ ID NO: 2144852 - RNA, 23 nt, Homo sapiens
uguuuccugaaauauaaacugua

SEQ ID NO: 2144853 - RNA, 23 nt, Homo sapiens
guaacuaugcuguuaacagcugu

SEQ ID NO: 2144854 - RNA, 12 nt, Homo sapiens
ccagcacccucu

SEQ ID NO: 2144855 - RNA, 21 nt, Homo sapiens
aguuaaaagacugcagcugcu

SEQ ID NO: 2144856 - RNA, 14 nt, Homo sapiens
cuggcccagccaaa

SEQ ID NO: 2144857 - RNA, 16 nt, Homo sapiens
ggauagacgaguugau

SEQ ID NO: 2144858 - RNA, 22 nt, Homo sapiens
gcuauuugccaagaccauuuca

SEQ ID NO: 2144859 - RNA, 21 nt, Homo sapiens
uuacagacaugaaccaccacg

SEQ ID NO: 2144860 - RNA, 17 nt, Homo sapiens
cuuugaucuucagggaa

SEQ ID NO: 2144861 - RNA, 17 nt, Homo sapiens
gcccaauucugccacuu

SEQ ID NO: 2144862 - RNA, 19 nt, Homo sapiens
cagacucuguaauugaaua

SEQ ID NO: 2144863 - RNA, 22 nt, Homo sapiens
auucaaagaaucaccuaauuaa

SEQ ID NO: 2144864 - RNA, 12 nt, Homo sapiens
cgugugcuccuc

SEQ ID NO: 2144865 - RNA, 18 nt, Homo sapiens
caaaguucuucauugaua

SEQ ID NO: 2144866 - RNA, 15 nt, Homo sapiens
gaugcaugagcuccc

SEQ ID NO: 2144867 - RNA, 18 nt, Homo sapiens
uacucugaaauuggucac

SEQ ID NO: 2144868 - RNA, 11 nt, Homo sapiens
uaucugugaaa

SEQ ID NO: 2144869 - RNA, 17 nt, Homo sapiens
cacaaaaacagaaacaa

SEQ ID NO: 2144870 - RNA, 22 nt, Homo sapiens
acauaaaucaguuaauggcuca

SEQ ID NO: 2144871 - RNA, 13 nt, Homo sapiens
gugcacuggggac

SEQ ID NO: 2144872 - RNA, 19 nt, Homo sapiens
cgccaaucccgccaugcuc

SEQ ID NO: 2144873 - RNA, 13 nt, Homo sapiens
gucuccauucugu

SEQ ID NO: 2144874 - RNA, 14 nt, Homo sapiens
aaggaaaacugcca

SEQ ID NO: 2144875 - RNA, 15 nt, Homo sapiens
aguguuaagugacau

SEQ ID NO: 2144876 - RNA, 23 nt, Homo sapiens
ggcucagccaggugcugugacac

SEQ ID NO: 2144877 - RNA, 11 nt, Homo sapiens
cagccaagacc

SEQ ID NO: 2144878 - RNA, 19 nt, Homo sapiens
gagucuagcacucauuuuc

SEQ ID NO: 2144879 - RNA, 16 nt, Homo sapiens
uauuaauauauuucca

SEQ ID NO: 2144880 - RNA, 15 nt, Homo sapiens
aauguaucugaauau

SEQ ID NO: 2144881 - RNA, 21 nt, Homo sapiens
cagaucuauggcgaacacagg

SEQ ID NO: 2144882 - RNA, 18 nt, Homo sapiens
ugagaauauuaauugugg

SEQ ID NO: 2144883 - RNA, 15 nt, Homo sapiens
uccuggaaugaagca

SEQ ID NO: 2144884 - RNA, 18 nt, Homo sapiens
ucucaggcuggcaucucc

SEQ ID NO: 2144885 - RNA, 16 nt, Homo sapiens
uuuauuaaccucagca

SEQ ID NO: 2144886 - RNA, 17 nt, Homo sapiens
augcucugaacccugag

SEQ ID NO: 2144887 - RNA, 15 nt, Homo sapiens
cuaugugaaacuuga

SEQ ID NO: 2144888 - RNA, 17 nt, Homo sapiens
uagggcuuuugauuuau

SEQ ID NO: 2144889 - RNA, 18 nt, Homo sapiens
ccagcgucacuccagugc

SEQ ID NO: 2144890 - RNA, 17 nt, Homo sapiens
ccacauccacacagcca

SEQ ID NO: 2144891 - RNA, 17 nt, Homo sapiens
cucuuuccuucuugccu

SEQ ID NO: 2144892 - RNA, 12 nt, Homo sapiens
uaaaacaaaaga

SEQ ID NO: 2144893 - RNA, 12 nt, Homo sapiens
gaugaugcaguu

SEQ ID NO: 2144894 - RNA, 14 nt, Homo sapiens
uguuaauauuugaa

SEQ ID NO: 2144895 - RNA, 18 nt, Homo sapiens
cgcgccguggcaccccaa

SEQ ID NO: 2144896 - RNA, 22 nt, Homo sapiens
cucagucucccagcuaauugag

SEQ ID NO: 2144897 - RNA, 18 nt, Homo sapiens
ugagcccaaggcacugag

SEQ ID NO: 2144898 - RNA, 17 nt, Homo sapiens
cagauagucacagucaa

SEQ ID NO: 2144899 - RNA, 16 nt, Homo sapiens
gccuuguuucugauga

SEQ ID NO: 2144900 - RNA, 16 nt, Homo sapiens
gcuucaccgcauucca

SEQ ID NO: 2144901 - RNA, 22 nt, Homo sapiens
cagcugguucugcaaugacugc

SEQ ID NO: 2144902 - RNA, 14 nt, Homo sapiens
guaacacaccaagu

SEQ ID NO: 2144903 - RNA, 13 nt, Homo sapiens
acuuccacagggu

SEQ ID NO: 2144904 - RNA, 13 nt, Homo sapiens
aauagucuucuca

SEQ ID NO: 2144905 - RNA, 23 nt, Homo sapiens
ugacucagaacuucugccucuaa

SEQ ID NO: 2144906 - RNA, 19 nt, Homo sapiens
cuucucccauccaagagaa

SEQ ID NO: 2144907 - RNA, 21 nt, Homo sapiens
caggagguugagguaggagaa

SEQ ID NO: 2144908 - RNA, 14 nt, Homo sapiens
aaguccacuuaugu

SEQ ID NO: 2144909 - RNA, 17 nt, Homo sapiens
ugagacucccgccuuug

SEQ ID NO: 2144910 - RNA, 23 nt, Homo sapiens
uauuccccccacuuaagacugug

SEQ ID NO: 2144911 - RNA, 22 nt, Homo sapiens
ugggaugggagguugauuugcu

SEQ ID NO: 2144912 - RNA, 18 nt, Homo sapiens
uccccaagugaccuauac

SEQ ID NO: 2144913 - RNA, 14 nt, Homo sapiens
cuuccuguccagag

SEQ ID NO: 2144914 - RNA, 13 nt, Homo sapiens
cgagugcauuugc

SEQ ID NO: 2144915 - RNA, 13 nt, Homo sapiens
acccaaagccugu

SEQ ID NO: 2144916 - RNA, 14 nt, Homo sapiens
gcaaggugugaaug

SEQ ID NO: 2144917 - RNA, 17 nt, Homo sapiens
gaugcugugagcauuaa

SEQ ID NO: 2144918 - RNA, 21 nt, Homo sapiens
ucaagauuuucauacuuuuac

SEQ ID NO: 2144919 - RNA, 20 nt, Homo sapiens
uacaaaagugaaccaucuca

SEQ ID NO: 2144920 - RNA, 14 nt, Homo sapiens
uaaggaaacugggu

SEQ ID NO: 2144921 - RNA, 21 nt, Homo sapiens
ucaacaauaaaaaaaaaccua

SEQ ID NO: 2144922 - RNA, 24 nt, Homo sapiens
ccuauugcugauacugucuuugca

SEQ ID NO: 2144923 - RNA, 22 nt, Homo sapiens
cuagggacaugaaauuuacaaa

SEQ ID NO: 2144924 - RNA, 18 nt, Homo sapiens
ugauacugcugcuuguca

SEQ ID NO: 2144925 - RNA, 21 nt, Homo sapiens
uguuggggaccucaccugcug

SEQ ID NO: 2144926 - RNA, 16 nt, Homo sapiens
ggccccaucauagccu

SEQ ID NO: 2144927 - RNA, 12 nt, Homo sapiens
aguuagucaauc

SEQ ID NO: 2144928 - RNA, 17 nt, Homo sapiens
aaauuuaauauagcuau

SEQ ID NO: 2144929 - RNA, 18 nt, Homo sapiens
caaaggacccaaucccca

SEQ ID NO: 2144930 - RNA, 17 nt, Homo sapiens
ucugagccuucuacuua

SEQ ID NO: 2144931 - RNA, 14 nt, Homo sapiens
uaauuacucuuuga

SEQ ID NO: 2144932 - RNA, 13 nt, Homo sapiens
cuuucugaugucu

SEQ ID NO: 2144933 - RNA, 21 nt, Homo sapiens
guuguuuuaacagaugccaau

SEQ ID NO: 2144934 - RNA, 21 nt, Homo sapiens
aggccaaaggaagcacaugcc

SEQ ID NO: 2144935 - RNA, 17 nt, Homo sapiens
ucaaccgcuugccauau

SEQ ID NO: 2144936 - RNA, 14 nt, Homo sapiens
aguaaucccaguga

SEQ ID NO: 2144937 - RNA, 15 nt, Homo sapiens
agagggaaaacagaa

SEQ ID NO: 2144938 - RNA, 16 nt, Homo sapiens
cugggccaguggaccc

SEQ ID NO: 2144939 - RNA, 15 nt, Homo sapiens
acguggagaaaauca

SEQ ID NO: 2144940 - RNA, 12 nt, Homo sapiens
agcauauggagu

SEQ ID NO: 2144941 - RNA, 20 nt, Homo sapiens
cacaggcuaucaacauguua

SEQ ID NO: 2144942 - RNA, 15 nt, Homo sapiens
aaauaccaaucacaa

SEQ ID NO: 2144943 - RNA, 19 nt, Homo sapiens
cuaguucccucagugugaa

SEQ ID NO: 2144944 - RNA, 14 nt, Homo sapiens
caggcaaugcugua

SEQ ID NO: 2144945 - RNA, 19 nt, Homo sapiens
cguggugggugcucaagac

SEQ ID NO: 2144946 - RNA, 23 nt, Homo sapiens
uggcacugcugugcugugcccaa

SEQ ID NO: 2144947 - RNA, 19 nt, Homo sapiens
guguaaauauaugucugau

SEQ ID NO: 2144948 - RNA, 21 nt, Homo sapiens
agugucuuugucaugcgucuc

SEQ ID NO: 2144949 - RNA, 23 nt, Homo sapiens
cauucuuauuaauucuucaccug

SEQ ID NO: 2144950 - RNA, 12 nt, Homo sapiens
acuguguucaau

SEQ ID NO: 2144951 - RNA, 23 nt, Homo sapiens
aagccauaguggagagaacugaa

SEQ ID NO: 2144952 - RNA, 20 nt, Homo sapiens
cugcucuugaacuccugacc

SEQ ID NO: 2144953 - RNA, 15 nt, Homo sapiens
auuaaccucuuguuu

SEQ ID NO: 2144954 - RNA, 15 nt, Homo sapiens
gggcaggcugagggu

SEQ ID NO: 2144955 - RNA, 21 nt, Homo sapiens
auuagagagcaucugcaacaa

SEQ ID NO: 2144956 - RNA, 23 nt, Homo sapiens
cugugagcuggagagaacccaga

SEQ ID NO: 2144957 - RNA, 20 nt, Homo sapiens
gagugucaccagcugccaaa

SEQ ID NO: 2144958 - RNA, 22 nt, Homo sapiens
ugaaagccaacaacucugccuu

SEQ ID NO: 2144959 - RNA, 17 nt, Homo sapiens
gaccaucugcugcaguu

SEQ ID NO: 2144960 - RNA, 14 nt, Homo sapiens
cuaugugcaugcag

SEQ ID NO: 2144961 - RNA, 20 nt, Homo sapiens
ggcuuuacauggguucaauu

SEQ ID NO: 2144962 - RNA, 20 nt, Homo sapiens
aauauuuccuuaaacugugu

SEQ ID NO: 2144963 - RNA, 14 nt, Homo sapiens
uccuucuccuccac

SEQ ID NO: 2144964 - RNA, 21 nt, Homo sapiens
ugauguaaaaaauacaaacau

SEQ ID NO: 2144965 - RNA, 19 nt, Homo sapiens
caugguguguguucagcuc

SEQ ID NO: 2144966 - RNA, 17 nt, Homo sapiens
aaccagauggugaccca

SEQ ID NO: 2144967 - RNA, 16 nt, Homo sapiens
aucccaacuacucaga

SEQ ID NO: 2144968 - RNA, 16 nt, Homo sapiens
uuaaaguggcuuucaa

SEQ ID NO: 2144969 - RNA, 14 nt, Homo sapiens
cuuugagugggaca

SEQ ID NO: 2144970 - RNA, 23 nt, Homo sapiens
gcuuucggaauuccugcaggaaa

SEQ ID NO: 2144971 - RNA, 13 nt, Homo sapiens
ucuuagauucucu

SEQ ID NO: 2144972 - RNA, 22 nt, Homo sapiens
gacugaugccagacaaaccuug

SEQ ID NO: 2144973 - RNA, 21 nt, Homo sapiens
gcacagccccuggagccucag

SEQ ID NO: 2144974 - RNA, 23 nt, Homo sapiens
gcccucuuccugacgaaacuggc

SEQ ID NO: 2144975 - RNA, 21 nt, Homo sapiens
ucacuaagaagcuugaaucua

SEQ ID NO: 2144976 - RNA, 15 nt, Homo sapiens
uccucgggcacagac

SEQ ID NO: 2144977 - RNA, 14 nt, Homo sapiens
gcagugacucccca

SEQ ID NO: 2144978 - RNA, 16 nt, Homo sapiens
ggaaaaaaacuauuaa

SEQ ID NO: 2144979 - RNA, 20 nt, Homo sapiens
caaccccccuccugcuccuc

SEQ ID NO: 2144980 - RNA, 18 nt, Homo sapiens
uuucucuugaagaacuga

SEQ ID NO: 2144981 - RNA, 14 nt, Homo sapiens
cuuuuaguacccac

SEQ ID NO: 2144982 - RNA, 17 nt, Homo sapiens
gaauacugaauuuugag

SEQ ID NO: 2144983 - RNA, 22 nt, Homo sapiens
auccccuaagcagaccacugau

SEQ ID NO: 2144984 - RNA, 18 nt, Homo sapiens
auagcuugcaguuucaug

SEQ ID NO: 2144985 - RNA, 20 nt, Homo sapiens
ggccaugguggagggcacuu

SEQ ID NO: 2144986 - RNA, 20 nt, Homo sapiens
caggcccgcacugggggcaa

SEQ ID NO: 2144987 - RNA, 14 nt, Homo sapiens
acucacuagacuca

SEQ ID NO: 2144988 - RNA, 19 nt, Homo sapiens
gagcacuguagcacuuaac

SEQ ID NO: 2144989 - RNA, 12 nt, Homo sapiens
uacauaaucucu

SEQ ID NO: 2144990 - RNA, 21 nt, Homo sapiens
guguacaacaaugcuuugaua

SEQ ID NO: 2144991 - RNA, 20 nt, Homo sapiens
ccagcaaugauguccagaag

SEQ ID NO: 2144992 - RNA, 16 nt, Homo sapiens
gccagggccaagugaa

SEQ ID NO: 2144993 - RNA, 23 nt, Homo sapiens
acauaauccacgcucaucuugca

SEQ ID NO: 2144994 - RNA, 17 nt, Homo sapiens
cucuccaauacucaggu

SEQ ID NO: 2144995 - RNA, 16 nt, Homo sapiens
gggacucagggccaug

SEQ ID NO: 2144996 - RNA, 20 nt, Homo sapiens
uauacccguuucacaugcuu

SEQ ID NO: 2144997 - RNA, 19 nt, Homo sapiens
ucauuuuguuauagaaacu

SEQ ID NO: 2144998 - RNA, 20 nt, Homo sapiens
ugggaugaaacuaaagcaau

SEQ ID NO: 2144999 - RNA, 22 nt, Homo sapiens
acugcugcugaggcuccuguua

SEQ ID NO: 2145000 - RNA, 16 nt, Homo sapiens
auggccuuugcuugaa

SEQ ID NO: 2145001 - RNA, 15 nt, Homo sapiens
gcuauauccauguac

SEQ ID NO: 2145002 - RNA, 21 nt, Homo sapiens
uaauuucacucucugcauuga

SEQ ID NO: 2145003 - RNA, 19 nt, Homo sapiens
ugcucuguccccaaaggac

SEQ ID NO: 2145004 - RNA, 13 nt, Homo sapiens
gaaggcaagagau

SEQ ID NO: 2145005 - RNA, 14 nt, Homo sapiens
uaaugucugagcua

SEQ ID NO: 2145006 - RNA, 20 nt, Homo sapiens
uaucagaauuguucaacuuu

SEQ ID NO: 2145007 - RNA, 16 nt, Homo sapiens
uaaggacaaauuagca

SEQ ID NO: 2145008 - RNA, 14 nt, Homo sapiens
acagccuggaccac

SEQ ID NO: 2145009 - RNA, 19 nt, Homo sapiens
guccaugugguucuucaaa

SEQ ID NO: 2145010 - RNA, 14 nt, Homo sapiens
uagaaagggccuug

SEQ ID NO: 2145011 - RNA, 21 nt, Homo sapiens
aaagaccaaauuccuuggcau

SEQ ID NO: 2145012 - RNA, 19 nt, Homo sapiens
gcaucaauacaaccagccc

SEQ ID NO: 2145013 - RNA, 22 nt, Homo sapiens
uccagccuuuggccuuggcuuu

SEQ ID NO: 2145014 - RNA, 22 nt, Homo sapiens
aagggacagcaagugagcagag

SEQ ID NO: 2145015 - RNA, 14 nt, Homo sapiens
cagaggcaccucaa

SEQ ID NO: 2145016 - RNA, 21 nt, Homo sapiens
ucaaaggacaaagacaguauu

SEQ ID NO: 2145017 - RNA, 20 nt, Homo sapiens
cucaguuuaagguacacugu

SEQ ID NO: 2145018 - RNA, 13 nt, Homo sapiens
ugcguguguuugu

SEQ ID NO: 2145019 - RNA, 20 nt, Homo sapiens
cguuccccgcuccacagaga

SEQ ID NO: 2145020 - RNA, 16 nt, Homo sapiens
acaaugagaugcauga

SEQ ID NO: 2145021 - RNA, 16 nt, Homo sapiens
cugcuugaccaaagag

SEQ ID NO: 2145022 - RNA, 14 nt, Homo sapiens
ucaccuagcucaau

SEQ ID NO: 2145023 - RNA, 19 nt, Homo sapiens
aaaaauaaaaaagaucucc

SEQ ID NO: 2145024 - RNA, 16 nt, Homo sapiens
aagcaucccugugagc

SEQ ID NO: 2145025 - RNA, 22 nt, Homo sapiens
ucugaaacucccuuguguuccu

SEQ ID NO: 2145026 - RNA, 22 nt, Homo sapiens
aguuggcucugagauacuaaua

SEQ ID NO: 2145027 - RNA, 21 nt, Homo sapiens
caaguuuaaaaauauuauuaa

SEQ ID NO: 2145028 - RNA, 20 nt, Homo sapiens
acacuguguuuuauuguggu

SEQ ID NO: 2145029 - RNA, 18 nt, Homo sapiens
uguuaaaaaaaaugauaa

SEQ ID NO: 2145030 - RNA, 18 nt, Homo sapiens
acuguuagugacagagcc

SEQ ID NO: 2145031 - RNA, 19 nt, Homo sapiens
guaccaagaucacaaauag

SEQ ID NO: 2145032 - RNA, 18 nt, Homo sapiens
agggugguuuaccugcac

SEQ ID NO: 2145033 - RNA, 23 nt, Homo sapiens
auaaaauuggcaccaugugccau

SEQ ID NO: 2145034 - RNA, 17 nt, Homo sapiens
ggaaaaacaaacaugaa

SEQ ID NO: 2145035 - RNA, 21 nt, Homo sapiens
acgaggcaaugacugugagcg

SEQ ID NO: 2145036 - RNA, 21 nt, Homo sapiens
gaggagggucggugccuucaa

SEQ ID NO: 2145037 - RNA, 15 nt, Homo sapiens
ccuaauccucuagga

SEQ ID NO: 2145038 - RNA, 12 nt, Homo sapiens
uucauacuuugg

SEQ ID NO: 2145039 - RNA, 19 nt, Homo sapiens
aagagggggcaagucacau

SEQ ID NO: 2145040 - RNA, 11 nt, Homo sapiens
ccucuauauau

SEQ ID NO: 2145041 - RNA, 13 nt, Homo sapiens
cucugggucuugg

SEQ ID NO: 2145042 - RNA, 13 nt, Homo sapiens
ggugggguggcug

SEQ ID NO: 2145043 - RNA, 17 nt, Homo sapiens
gcagugcaguacucagg

SEQ ID NO: 2145044 - RNA, 13 nt, Homo sapiens
auaauguguguau

SEQ ID NO: 2145045 - RNA, 13 nt, Homo sapiens
uguuugugauauu

SEQ ID NO: 2145046 - RNA, 15 nt, Homo sapiens
caaaauaaaaugagu

SEQ ID NO: 2145047 - RNA, 21 nt, Homo sapiens
uggccaagccugccccggcca

SEQ ID NO: 2145048 - RNA, 17 nt, Homo sapiens
agaaaggagcucugaau

SEQ ID NO: 2145049 - RNA, 20 nt, Homo sapiens
uccuuggcuuaccugaccuc

SEQ ID NO: 2145050 - RNA, 22 nt, Homo sapiens
uauccuggugccccccaccccu

SEQ ID NO: 2145051 - RNA, 23 nt, Homo sapiens
ugauagcacuuucuacaauguga

SEQ ID NO: 2145052 - RNA, 16 nt, Homo sapiens
ccuaggaacucagucc

SEQ ID NO: 2145053 - RNA, 13 nt, Homo sapiens
cuugauuguacuu

SEQ ID NO: 2145054 - RNA, 13 nt, Homo sapiens
agagauccaaaga

SEQ ID NO: 2145055 - RNA, 16 nt, Homo sapiens
uccacucccacuuccc

SEQ ID NO: 2145056 - RNA, 14 nt, Homo sapiens
ugagaucccgacaa

SEQ ID NO: 2145057 - RNA, 15 nt, Homo sapiens
agaacugaagcucuu

SEQ ID NO: 2145058 - RNA, 19 nt, Homo sapiens
ggagucucacucuugucac

SEQ ID NO: 2145059 - RNA, 16 nt, Homo sapiens
uaagcaucacauuaaa

SEQ ID NO: 2145060 - RNA, 20 nt, Homo sapiens
uagucaauuucuacuucugg

SEQ ID NO: 2145061 - RNA, 19 nt, Homo sapiens
gagaaauugugccaaagau

SEQ ID NO: 2145062 - RNA, 13 nt, Homo sapiens
aacucuugcuauc

SEQ ID NO: 2145063 - RNA, 12 nt, Homo sapiens
gcugccgugccc

SEQ ID NO: 2145064 - RNA, 17 nt, Homo sapiens
aaaaugaauacaauuaa

SEQ ID NO: 2145065 - RNA, 22 nt, Homo sapiens
caacagacuucucaauaaucaa

SEQ ID NO: 2145066 - RNA, 20 nt, Homo sapiens
acauacaauuccaaacacau

SEQ ID NO: 2145067 - RNA, 16 nt, Homo sapiens
gauuacuuuugggagg

SEQ ID NO: 2145068 - RNA, 14 nt, Homo sapiens
aacuaaaaagccau

SEQ ID NO: 2145069 - RNA, 14 nt, Homo sapiens
cuauauuugcuaga

SEQ ID NO: 2145070 - RNA, 20 nt, Homo sapiens
guacaaugacacuuuuugca

SEQ ID NO: 2145071 - RNA, 15 nt, Homo sapiens
gagccuggcacagga

SEQ ID NO: 2145072 - RNA, 13 nt, Homo sapiens
auaaagauguuau

SEQ ID NO: 2145073 - RNA, 20 nt, Homo sapiens
ugaguuggggcgacugugaa

SEQ ID NO: 2145074 - RNA, 22 nt, Homo sapiens
cuuaaaacuaaauguaauuuau

SEQ ID NO: 2145075 - RNA, 23 nt, Homo sapiens
uguucccuggggcuuuaacuccu

SEQ ID NO: 2145076 - RNA, 16 nt, Homo sapiens
gaacugcuugugcacu

SEQ ID NO: 2145077 - RNA, 19 nt, Homo sapiens
aggagcccacagugccugu

SEQ ID NO: 2145078 - RNA, 18 nt, Homo sapiens
aauaauuugguauccuua

SEQ ID NO: 2145079 - RNA, 14 nt, Homo sapiens
gaggaaaaacaaca

SEQ ID NO: 2145080 - RNA, 14 nt, Homo sapiens
ucccaaaacugcca

SEQ ID NO: 2145081 - RNA, 22 nt, Homo sapiens
auagugaugaaccagaguuucu

SEQ ID NO: 2145082 - RNA, 14 nt, Homo sapiens
gacuccugaggaca

SEQ ID NO: 2145083 - RNA, 11 nt, Homo sapiens
ccagugacacc

SEQ ID NO: 2145084 - RNA, 21 nt, Homo sapiens
accugacggcuggggacccac

SEQ ID NO: 2145085 - RNA, 16 nt, Homo sapiens
augaacaugguguuca

SEQ ID NO: 2145086 - RNA, 16 nt, Homo sapiens
cuggaggucaggaguu

SEQ ID NO: 2145087 - RNA, 17 nt, Homo sapiens
agaaacacacagucaca

SEQ ID NO: 2145088 - RNA, 14 nt, Homo sapiens
gaauuacacugugc

SEQ ID NO: 2145089 - RNA, 17 nt, Homo sapiens
acagucaaggugauaua

SEQ ID NO: 2145090 - RNA, 18 nt, Homo sapiens
aauaaagaucacagagca

SEQ ID NO: 2145091 - RNA, 18 nt, Homo sapiens
ugggaggaagcagaauaa

SEQ ID NO: 2145092 - RNA, 13 nt, Homo sapiens
augcccagcugua

SEQ ID NO: 2145093 - RNA, 20 nt, Homo sapiens
agaucuuucaggaaagacgg

SEQ ID NO: 2145094 - RNA, 15 nt, Homo sapiens
cauuacaggugugag

SEQ ID NO: 2145095 - RNA, 16 nt, Homo sapiens
accaccaacauucugu

SEQ ID NO: 2145096 - RNA, 19 nt, Homo sapiens
auuuauuuugcucuuguuu

SEQ ID NO: 2145097 - RNA, 13 nt, Homo sapiens
ucucaauggugcu

SEQ ID NO: 2145098 - RNA, 16 nt, Homo sapiens
auaaugccaaugaaca

SEQ ID NO: 2145099 - RNA, 17 nt, Homo sapiens
gagccgugcagcuggga

SEQ ID NO: 2145100 - RNA, 20 nt, Homo sapiens
agaccauuggggcucccagc

SEQ ID NO: 2145101 - RNA, 15 nt, Homo sapiens
cuuuucaguguuccc

SEQ ID NO: 2145102 - RNA, 16 nt, Homo sapiens
gaguggaguugaaacu

SEQ ID NO: 2145103 - RNA, 14 nt, Homo sapiens
ucuugaauucaugu

SEQ ID NO: 2145104 - RNA, 14 nt, Homo sapiens
gcaaaaaugcuaau

SEQ ID NO: 2145105 - RNA, 15 nt, Homo sapiens
gggaucgacuguaaa

SEQ ID NO: 2145106 - RNA, 22 nt, Homo sapiens
gugaccugccaggcacacugag

SEQ ID NO: 2145107 - RNA, 17 nt, Homo sapiens
uagccaggcuaucuggc

SEQ ID NO: 2145108 - RNA, 18 nt, Homo sapiens
ggguugaaagacaucaau

SEQ ID NO: 2145109 - RNA, 13 nt, Homo sapiens
caaguuacaguga

SEQ ID NO: 2145110 - RNA, 18 nt, Homo sapiens
cgccauguuucuggugag

SEQ ID NO: 2145111 - RNA, 13 nt, Homo sapiens
aaacacugaggca

SEQ ID NO: 2145112 - RNA, 21 nt, Homo sapiens
guggcagauaaucagccucuu

SEQ ID NO: 2145113 - RNA, 15 nt, Homo sapiens
gcugaaaagugcuuu

SEQ ID NO: 2145114 - RNA, 21 nt, Homo sapiens
acuccuuaggcuuuguugaau

SEQ ID NO: 2145115 - RNA, 14 nt, Homo sapiens
cucuaaguguaaaa

SEQ ID NO: 2145116 - RNA, 17 nt, Homo sapiens
uucugacccugugaaau

SEQ ID NO: 2145117 - RNA, 23 nt, Homo sapiens
ucugagcgaggagugacugccaa

SEQ ID NO: 2145118 - RNA, 19 nt, Homo sapiens
gcucugggagacuuugaag

SEQ ID NO: 2145119 - RNA, 24 nt, Homo sapiens
gaauagucuuuugcaugucgcaca

SEQ ID NO: 2145120 - RNA, 18 nt, Homo sapiens
aguagugcccacuugagg

SEQ ID NO: 2145121 - RNA, 13 nt, Homo sapiens
gugcugagugcac

SEQ ID NO: 2145122 - RNA, 21 nt, Homo sapiens
acaaacauuugcugaauagcu

SEQ ID NO: 2145123 - RNA, 18 nt, Homo sapiens
cuccccaccccaaccacu

SEQ ID NO: 2145124 - RNA, 14 nt, Homo sapiens
aauuuggagucuga

SEQ ID NO: 2145125 - RNA, 16 nt, Homo sapiens
cagcaucagcucaggg

SEQ ID NO: 2145126 - RNA, 18 nt, Homo sapiens
accuuuaaauauuucaca

SEQ ID NO: 2145127 - RNA, 15 nt, Homo sapiens
cccaucaccuucuca

SEQ ID NO: 2145128 - RNA, 13 nt, Homo sapiens
aaaggagauuuau

SEQ ID NO: 2145129 - RNA, 15 nt, Homo sapiens
acuugaccucuguga

SEQ ID NO: 2145130 - RNA, 22 nt, Homo sapiens
uaaaacaaauccauaauuauua

SEQ ID NO: 2145131 - RNA, 14 nt, Homo sapiens
aauuccgacuuucu

SEQ ID NO: 2145132 - RNA, 15 nt, Homo sapiens
aauugggcagucuua

SEQ ID NO: 2145133 - RNA, 16 nt, Homo sapiens
acccaccaucaugucu

SEQ ID NO: 2145134 - RNA, 20 nt, Homo sapiens
auauguuuagcuacguuuac

SEQ ID NO: 2145135 - RNA, 17 nt, Homo sapiens
aggcuacuggcauuaau

SEQ ID NO: 2145136 - RNA, 22 nt, Homo sapiens
accugcccaaggaugcugucaa

SEQ ID NO: 2145137 - RNA, 18 nt, Homo sapiens
accgaggcuacagcucca

SEQ ID NO: 2145138 - RNA, 15 nt, Homo sapiens
uagagauuuggugua

SEQ ID NO: 2145139 - RNA, 16 nt, Homo sapiens
auacaauuugcccaag

SEQ ID NO: 2145140 - RNA, 17 nt, Homo sapiens
uaacccuuaucaccagc

SEQ ID NO: 2145141 - RNA, 20 nt, Homo sapiens
ccagaaauugugugugcaag

SEQ ID NO: 2145142 - RNA, 12 nt, Homo sapiens
ggcaacugccug

SEQ ID NO: 2145143 - RNA, 18 nt, Homo sapiens
cuugaagggccagagcca

SEQ ID NO: 2145144 - RNA, 22 nt, Homo sapiens
aacuccuuguaggucugcagau

SEQ ID NO: 2145145 - RNA, 23 nt, Homo sapiens
ccucagcccgccaagguagccau

SEQ ID NO: 2145146 - RNA, 16 nt, Homo sapiens
uaguacccaaccaaag

SEQ ID NO: 2145147 - RNA, 22 nt, Homo sapiens
aaugauuuaaauuuauaauuaa

SEQ ID NO: 2145148 - RNA, 15 nt, Homo sapiens
uuuggggggcagaga

SEQ ID NO: 2145149 - RNA, 23 nt, Homo sapiens
ccauuagaaugugauuuuuguuc

SEQ ID NO: 2145150 - RNA, 15 nt, Homo sapiens
ugacaccucacugag

SEQ ID NO: 2145151 - RNA, 14 nt, Homo sapiens
aaaccuuguagaua

SEQ ID NO: 2145152 - RNA, 23 nt, Homo sapiens
caggcuagggaugguaauccuuu

SEQ ID NO: 2145153 - RNA, 23 nt, Homo sapiens
ggccucuggggcaggaccacuag

SEQ ID NO: 2145154 - RNA, 23 nt, Homo sapiens
cuuuauaccccauuugauuucga

SEQ ID NO: 2145155 - RNA, 14 nt, Homo sapiens
ggagauccuaauau

SEQ ID NO: 2145156 - RNA, 15 nt, Homo sapiens
ugccuggacacugua

SEQ ID NO: 2145157 - RNA, 20 nt, Homo sapiens
uuauugacugggcaacacug

SEQ ID NO: 2145158 - RNA, 18 nt, Homo sapiens
uguggaguggguaaucca

SEQ ID NO: 2145159 - RNA, 16 nt, Homo sapiens
ugaccauaaccacuga

SEQ ID NO: 2145160 - RNA, 13 nt, Homo sapiens
caggaagcucucu

SEQ ID NO: 2145161 - RNA, 19 nt, Homo sapiens
gaaggagcagucacuggga

SEQ ID NO: 2145162 - RNA, 15 nt, Homo sapiens
agaggagcgggaccu

SEQ ID NO: 2145163 - RNA, 23 nt, Homo sapiens
uugagcuccccaaaaaccucacc

SEQ ID NO: 2145164 - RNA, 13 nt, Homo sapiens
aaucaauauccca

SEQ ID NO: 2145165 - RNA, 17 nt, Homo sapiens
ggucucuuuguucaauu

SEQ ID NO: 2145166 - RNA, 22 nt, Homo sapiens
agucgggaugucagcagacaca

SEQ ID NO: 2145167 - RNA, 18 nt, Homo sapiens
ccuuuagaguguagguga

SEQ ID NO: 2145168 - RNA, 19 nt, Homo sapiens
auucccaauuaucaaaaaa

SEQ ID NO: 2145169 - RNA, 14 nt, Homo sapiens
uaagauuuugccug

SEQ ID NO: 2145170 - RNA, 16 nt, Homo sapiens
caguaaaauacuauuc

SEQ ID NO: 2145171 - RNA, 13 nt, Homo sapiens
aagugaaaaacau

SEQ ID NO: 2145172 - RNA, 14 nt, Homo sapiens
cuaaaaucagggaa

SEQ ID NO: 2145173 - RNA, 14 nt, Homo sapiens
uccaaacagacaaa

SEQ ID NO: 2145174 - RNA, 12 nt, Homo sapiens
gaaaaugauuua

SEQ ID NO: 2145175 - RNA, 17 nt, Homo sapiens
cuuucccacguugacac

SEQ ID NO: 2145176 - RNA, 16 nt, Homo sapiens
gcaguucuuuggcuga

SEQ ID NO: 2145177 - RNA, 18 nt, Homo sapiens
cuucuuucauucuaaucc

SEQ ID NO: 2145178 - RNA, 20 nt, Homo sapiens
guguugcccaggcuggucuu

SEQ ID NO: 2145179 - RNA, 16 nt, Homo sapiens
auaacccacuugucac

SEQ ID NO: 2145180 - RNA, 22 nt, Homo sapiens
gugcaugaggaucaguuugcag

SEQ ID NO: 2145181 - RNA, 18 nt, Homo sapiens
cuacuucacuaaugacga

SEQ ID NO: 2145182 - RNA, 15 nt, Homo sapiens
cuguagcacgcugcc

SEQ ID NO: 2145183 - RNA, 23 nt, Homo sapiens
acaccagccauacuuaucucucu

SEQ ID NO: 2145184 - RNA, 23 nt, Homo sapiens
ccuucgguuguaaguagccagau

SEQ ID NO: 2145185 - RNA, 11 nt, Homo sapiens
uccuugcugca

SEQ ID NO: 2145186 - RNA, 20 nt, Homo sapiens
ccugcgagacccaaggcuca

SEQ ID NO: 2145187 - RNA, 18 nt, Homo sapiens
ggcaauauagcaagaucc

SEQ ID NO: 2145188 - RNA, 22 nt, Homo sapiens
cacaguuuuaauaagaacagau

SEQ ID NO: 2145189 - RNA, 16 nt, Homo sapiens
ccuggcugugcacauu

SEQ ID NO: 2145190 - RNA, 14 nt, Homo sapiens
acacauugacaaug

SEQ ID NO: 2145191 - RNA, 20 nt, Homo sapiens
ucugguaguuguggcuuuua

SEQ ID NO: 2145192 - RNA, 19 nt, Homo sapiens
cgugcugagcacacaacag

SEQ ID NO: 2145193 - RNA, 20 nt, Homo sapiens
cuccccuucccuggggagcc

SEQ ID NO: 2145194 - RNA, 23 nt, Homo sapiens
uacaacuuuuuaccuaguacaag

SEQ ID NO: 2145195 - RNA, 13 nt, Homo sapiens
acaucuaacaaag

SEQ ID NO: 2145196 - RNA, 23 nt, Homo sapiens
ugucauaggauuaagcaguuuaa

SEQ ID NO: 2145197 - RNA, 14 nt, Homo sapiens
cuugaaaugaaauc

SEQ ID NO: 2145198 - RNA, 15 nt, Homo sapiens
ggccuuugcucuuac

SEQ ID NO: 2145199 - RNA, 15 nt, Homo sapiens
cugucuuggggccac

SEQ ID NO: 2145200 - RNA, 10 nt, Homo sapiens
ccugccaagu

SEQ ID NO: 2145201 - RNA, 19 nt, Homo sapiens
agcacaagugguagguuaa

SEQ ID NO: 2145202 - RNA, 15 nt, Homo sapiens
uugaaggauggauga

SEQ ID NO: 2145203 - RNA, 17 nt, Homo sapiens
acauucacuuuccugca

SEQ ID NO: 2145204 - RNA, 23 nt, Homo sapiens
ucccugucaggacacauggauuu

SEQ ID NO: 2145205 - RNA, 19 nt, Homo sapiens
agugacuguguguaggggg

SEQ ID NO: 2145206 - RNA, 22 nt, Homo sapiens
gccuuguucaauaauuacugua

SEQ ID NO: 2145207 - RNA, 15 nt, Homo sapiens
aauucugcaagcuuu

SEQ ID NO: 2145208 - RNA, 20 nt, Homo sapiens
auugggacgcacagugcagu

SEQ ID NO: 2145209 - RNA, 22 nt, Homo sapiens
aucaggacuuucccugacagcu

SEQ ID NO: 2145210 - RNA, 14 nt, Homo sapiens
acuaucaacacugc

SEQ ID NO: 2145211 - RNA, 15 nt, Homo sapiens
augacacaucucuga

SEQ ID NO: 2145212 - RNA, 21 nt, Homo sapiens
auguguccccucacucuguca

SEQ ID NO: 2145213 - RNA, 22 nt, Homo sapiens
ucugcacggugggagaccugcu

SEQ ID NO: 2145214 - RNA, 19 nt, Homo sapiens
cuucaacaugguuaccucu

SEQ ID NO: 2145215 - RNA, 14 nt, Homo sapiens
agcagaacacugca

SEQ ID NO: 2145216 - RNA, 14 nt, Homo sapiens
cuaccuugcagugu

SEQ ID NO: 2145217 - RNA, 17 nt, Homo sapiens
ucccucagcucucuggg

SEQ ID NO: 2145218 - RNA, 16 nt, Homo sapiens
ccuccccaugggcaca

SEQ ID NO: 2145219 - RNA, 15 nt, Homo sapiens
aaaggucagacugaa

SEQ ID NO: 2145220 - RNA, 21 nt, Homo sapiens
agugacauaauuuacaugcaa

SEQ ID NO: 2145221 - RNA, 18 nt, Homo sapiens
ccuucagucuuaauacuu

SEQ ID NO: 2145222 - RNA, 17 nt, Homo sapiens
gagacuauaacugucau

SEQ ID NO: 2145223 - RNA, 17 nt, Homo sapiens
caugcguuuaaucacau

SEQ ID NO: 2145224 - RNA, 18 nt, Homo sapiens
uuguggacaaguuuccca

SEQ ID NO: 2145225 - RNA, 14 nt, Homo sapiens
guccucuccagcuu

SEQ ID NO: 2145226 - RNA, 13 nt, Homo sapiens
ugccccaauguga

SEQ ID NO: 2145227 - RNA, 13 nt, Homo sapiens
uuuuuugccacuu

SEQ ID NO: 2145228 - RNA, 22 nt, Homo sapiens
acccucgauguucauggaauug

SEQ ID NO: 2145229 - RNA, 15 nt, Homo sapiens
cacaaguccugugaa

SEQ ID NO: 2145230 - RNA, 16 nt, Homo sapiens
augacaguagcauuau

SEQ ID NO: 2145231 - RNA, 22 nt, Homo sapiens
cgaugcuggaggcccucgagga

SEQ ID NO: 2145232 - RNA, 19 nt, Homo sapiens
cuauaguguggcuuuagaa

SEQ ID NO: 2145233 - RNA, 19 nt, Homo sapiens
ugagacuaaucuuauucau

SEQ ID NO: 2145234 - RNA, 16 nt, Homo sapiens
ugcagggaauuuucau

SEQ ID NO: 2145235 - RNA, 19 nt, Homo sapiens
gaaucagcucaaucuucaa

SEQ ID NO: 2145236 - RNA, 21 nt, Homo sapiens
uuaauaagaaacaugauguga

SEQ ID NO: 2145237 - RNA, 22 nt, Homo sapiens
augugauaacgagguuccagua

SEQ ID NO: 2145238 - RNA, 13 nt, Homo sapiens
cccaacgugguga

SEQ ID NO: 2145239 - RNA, 22 nt, Homo sapiens
cuaauuaaaaaguuaaucuuca

SEQ ID NO: 2145240 - RNA, 17 nt, Homo sapiens
ucuugccccuccagaga

SEQ ID NO: 2145241 - RNA, 17 nt, Homo sapiens
cuacagaacacuuugcu

SEQ ID NO: 2145242 - RNA, 13 nt, Homo sapiens
uagucugucaggg

SEQ ID NO: 2145243 - RNA, 21 nt, Homo sapiens
gguguccuuucccuccacucc

SEQ ID NO: 2145244 - RNA, 16 nt, Homo sapiens
aaugaaaaagcuucau

SEQ ID NO: 2145245 - RNA, 21 nt, Homo sapiens
uggagauucaguuuucauuug

SEQ ID NO: 2145246 - RNA, 18 nt, Homo sapiens
gacauaauuuaauuccuu

SEQ ID NO: 2145247 - RNA, 20 nt, Homo sapiens
cgcagacacacccacagaag

SEQ ID NO: 2145248 - RNA, 16 nt, Homo sapiens
ugcuuaguaaugcuac

SEQ ID NO: 2145249 - RNA, 18 nt, Homo sapiens
cuguaaaaaauggagcuc

SEQ ID NO: 2145250 - RNA, 19 nt, Homo sapiens
auuaggcaaaaauaauuua

SEQ ID NO: 2145251 - RNA, 20 nt, Homo sapiens
gucaagcaguagacaagcaa

SEQ ID NO: 2145252 - RNA, 21 nt, Homo sapiens
cuagcuuuaggggaccaugaa

SEQ ID NO: 2145253 - RNA, 22 nt, Homo sapiens
cucuucagaauauggacaaaga

SEQ ID NO: 2145254 - RNA, 19 nt, Homo sapiens
caggaucagaucaauacaa

SEQ ID NO: 2145255 - RNA, 20 nt, Homo sapiens
agaccccuacccuuucccaa

SEQ ID NO: 2145256 - RNA, 18 nt, Homo sapiens
gccagccucagaaggccc

SEQ ID NO: 2145257 - RNA, 22 nt, Homo sapiens
cuuucgccuccuccagcuccug

SEQ ID NO: 2145258 - RNA, 17 nt, Homo sapiens
cugcaauuuuaauugau

SEQ ID NO: 2145259 - RNA, 20 nt, Homo sapiens
agagcgagagaauaugucac

SEQ ID NO: 2145260 - RNA, 14 nt, Homo sapiens
acucuggcagccuc

SEQ ID NO: 2145261 - RNA, 19 nt, Homo sapiens
aguacugacagaaagcaag

SEQ ID NO: 2145262 - RNA, 22 nt, Homo sapiens
cuuaugggguauuuuaagcauu

SEQ ID NO: 2145263 - RNA, 20 nt, Homo sapiens
uugucaccucaauauuuacu

SEQ ID NO: 2145264 - RNA, 22 nt, Homo sapiens
guuccuuaugacuuuucaugca

SEQ ID NO: 2145265 - RNA, 20 nt, Homo sapiens
uaaauguccauccugugcca

SEQ ID NO: 2145266 - RNA, 20 nt, Homo sapiens
uauuuaaagaaaauaaacac

SEQ ID NO: 2145267 - RNA, 15 nt, Homo sapiens
auaagaccucuggca

SEQ ID NO: 2145268 - RNA, 16 nt, Homo sapiens
acucaggggaccccac

SEQ ID NO: 2145269 - RNA, 15 nt, Homo sapiens
agucuggccugccag

SEQ ID NO: 2145270 - RNA, 19 nt, Homo sapiens
agauguguuaggaauguca

SEQ ID NO: 2145271 - RNA, 17 nt, Homo sapiens
auaccugaagcugucac

SEQ ID NO: 2145272 - RNA, 21 nt, Homo sapiens
ccuuaauuuaagucauuuuca

SEQ ID NO: 2145273 - RNA, 20 nt, Homo sapiens
gcuucauguucccaaaauca

SEQ ID NO: 2145274 - RNA, 22 nt, Homo sapiens
ucaauggcuuguucaucaucca

SEQ ID NO: 2145275 - RNA, 17 nt, Homo sapiens
ugcaguccucaucucca

SEQ ID NO: 2145276 - RNA, 19 nt, Homo sapiens
gaggaagcuguugguguuc

SEQ ID NO: 2145277 - RNA, 17 nt, Homo sapiens
aauauuguaaauacugg

SEQ ID NO: 2145278 - RNA, 14 nt, Homo sapiens
gcuagagguggcau

SEQ ID NO: 2145279 - RNA, 16 nt, Homo sapiens
gaggugccacacugaa

SEQ ID NO: 2145280 - RNA, 20 nt, Homo sapiens
auguauuuuaauaacauauc

SEQ ID NO: 2145281 - RNA, 15 nt, Homo sapiens
uggccagcacucuga

SEQ ID NO: 2145282 - RNA, 19 nt, Homo sapiens
ccgggagccucuccuugcc

SEQ ID NO: 2145283 - RNA, 18 nt, Homo sapiens
gccuccuggcccagguga

SEQ ID NO: 2145284 - RNA, 21 nt, Homo sapiens
agccguacuuugcuaacugug

SEQ ID NO: 2145285 - RNA, 18 nt, Homo sapiens
auagauuaguacuggauu

SEQ ID NO: 2145286 - RNA, 11 nt, Homo sapiens
uccugggaccc

SEQ ID NO: 2145287 - RNA, 23 nt, Homo sapiens
acccuccgcuccugcgcucugcc

SEQ ID NO: 2145288 - RNA, 22 nt, Homo sapiens
cuguuacagcuuucugugcaga

SEQ ID NO: 2145289 - RNA, 17 nt, Homo sapiens
cguugguucugcacuaa

SEQ ID NO: 2145290 - RNA, 15 nt, Homo sapiens
gggcagccuccaguc

SEQ ID NO: 2145291 - RNA, 23 nt, Homo sapiens
aagaggcguugcuuucacucucc

SEQ ID NO: 2145292 - RNA, 20 nt, Homo sapiens
gccuggccaggagcucuuca

SEQ ID NO: 2145293 - RNA, 21 nt, Homo sapiens
ccuaaauguggacaucaugaa

SEQ ID NO: 2145294 - RNA, 18 nt, Homo sapiens
cagcacaucucugagguu

SEQ ID NO: 2145295 - RNA, 17 nt, Homo sapiens
aauucaccacagacuuu

SEQ ID NO: 2145296 - RNA, 21 nt, Homo sapiens
cuucuggacccuugaguccaa

SEQ ID NO: 2145297 - RNA, 23 nt, Homo sapiens
cccaccugucaaccugaauuaaa

SEQ ID NO: 2145298 - RNA, 17 nt, Homo sapiens
uccaauauuuugccuuu

SEQ ID NO: 2145299 - RNA, 12 nt, Homo sapiens
acguccaucucu

SEQ ID NO: 2145300 - RNA, 19 nt, Homo sapiens
cuucuccuagcuggcuuau

SEQ ID NO: 2145301 - RNA, 17 nt, Homo sapiens
agccaaguuuuaaauau

SEQ ID NO: 2145302 - RNA, 21 nt, Homo sapiens
ucuacugacuuuucccauuca

SEQ ID NO: 2145303 - RNA, 16 nt, Homo sapiens
ugacaguaaaucucac

SEQ ID NO: 2145304 - RNA, 16 nt, Homo sapiens
aauaagaaugaaucuc

SEQ ID NO: 2145305 - RNA, 19 nt, Homo sapiens
cugugccucaucacugcuc

SEQ ID NO: 2145306 - RNA, 21 nt, Homo sapiens
cugccuggguugggggcacuc

SEQ ID NO: 2145307 - RNA, 20 nt, Homo sapiens
aggugggcggaucacuugag

SEQ ID NO: 2145308 - RNA, 19 nt, Homo sapiens
gaggcuccucucaggcugg

SEQ ID NO: 2145309 - RNA, 23 nt, Homo sapiens
cuuaaugaaguuugaauguuaaa

SEQ ID NO: 2145310 - RNA, 20 nt, Homo sapiens
gugauguggugggagcacag

SEQ ID NO: 2145311 - RNA, 16 nt, Homo sapiens
cuugauucacaaugaa

SEQ ID NO: 2145312 - RNA, 17 nt, Homo sapiens
aagacagaaccacaggg

SEQ ID NO: 2145313 - RNA, 22 nt, Homo sapiens
gaccuggcggcaggaagccaaa

SEQ ID NO: 2145314 - RNA, 21 nt, Homo sapiens
caggacacggggcaguggcaa

SEQ ID NO: 2145315 - RNA, 14 nt, Homo sapiens
uugaggcaggagga

SEQ ID NO: 2145316 - RNA, 19 nt, Homo sapiens
aagccuucuaaaugaguca

SEQ ID NO: 2145317 - RNA, 15 nt, Homo sapiens
uaguccuccaaaaca

SEQ ID NO: 2145318 - RNA, 21 nt, Homo sapiens
gaagaccccagcacagacuca

SEQ ID NO: 2145319 - RNA, 20 nt, Homo sapiens
acucuguccuuccaugcaaa

SEQ ID NO: 2145320 - RNA, 19 nt, Homo sapiens
ugcucugccccaccuugcc

SEQ ID NO: 2145321 - RNA, 14 nt, Homo sapiens
uggugaauggaguc

SEQ ID NO: 2145322 - RNA, 18 nt, Homo sapiens
uccagaaaguaaagguga

SEQ ID NO: 2145323 - RNA, 22 nt, Homo sapiens
gugugguugcucacagcuguaa

SEQ ID NO: 2145324 - RNA, 15 nt, Homo sapiens
cccugcucagugcuu

SEQ ID NO: 2145325 - RNA, 14 nt, Homo sapiens
gcauggagggaugg

SEQ ID NO: 2145326 - RNA, 12 nt, Homo sapiens
cauuaugcugcu

SEQ ID NO: 2145327 - RNA, 12 nt, Homo sapiens
cagggcacuuca

SEQ ID NO: 2145328 - RNA, 17 nt, Homo sapiens
uagauuucuaaugaaga

SEQ ID NO: 2145329 - RNA, 20 nt, Homo sapiens
uucagggaagaagcauacaa

SEQ ID NO: 2145330 - RNA, 23 nt, Homo sapiens
uucacuuguguuuuaaaauaagg

SEQ ID NO: 2145331 - RNA, 22 nt, Homo sapiens
ugcuaggcugucugcgaagaag

SEQ ID NO: 2145332 - RNA, 20 nt, Homo sapiens
gcuggugaauaacuaugcca

SEQ ID NO: 2145333 - RNA, 15 nt, Homo sapiens
auguauuucaucuca

SEQ ID NO: 2145334 - RNA, 12 nt, Homo sapiens
augcauuauuaa

SEQ ID NO: 2145335 - RNA, 21 nt, Homo sapiens
gccccucuccuccguggcaca

SEQ ID NO: 2145336 - RNA, 12 nt, Homo sapiens
ccaaagaaccaa

SEQ ID NO: 2145337 - RNA, 13 nt, Homo sapiens
guaugcaugugaa

SEQ ID NO: 2145338 - RNA, 14 nt, Homo sapiens
acagcugcauggca

SEQ ID NO: 2145339 - RNA, 22 nt, Homo sapiens
cucagaaccauucacuggcaaa

SEQ ID NO: 2145340 - RNA, 20 nt, Homo sapiens
uuaacgacccagucaaugaa

SEQ ID NO: 2145341 - RNA, 12 nt, Homo sapiens
gagacaggguuu

SEQ ID NO: 2145342 - RNA, 18 nt, Homo sapiens
agugcugaggggcacucu

SEQ ID NO: 2145343 - RNA, 14 nt, Homo sapiens
ccuuagagguccuc

SEQ ID NO: 2145344 - RNA, 14 nt, Homo sapiens
aguggacuccugaa

SEQ ID NO: 2145345 - RNA, 13 nt, Homo sapiens
agccaaagagccu

SEQ ID NO: 2145346 - RNA, 13 nt, Homo sapiens
uagcuaaguagca

SEQ ID NO: 2145347 - RNA, 13 nt, Homo sapiens
auuaaaagauuau

SEQ ID NO: 2145348 - RNA, 16 nt, Homo sapiens
cuuaauccccaugcuu

SEQ ID NO: 2145349 - RNA, 17 nt, Homo sapiens
caugacaaguacuguau

SEQ ID NO: 2145350 - RNA, 15 nt, Homo sapiens
cuuucuacaccuguu

SEQ ID NO: 2145351 - RNA, 18 nt, Homo sapiens
agucacaaagaacaugua

SEQ ID NO: 2145352 - RNA, 21 nt, Homo sapiens
ucaucucuuguaaauacaugu

SEQ ID NO: 2145353 - RNA, 15 nt, Homo sapiens
ccagcacaugugcug

SEQ ID NO: 2145354 - RNA, 16 nt, Homo sapiens
cagagaaauacuuuca

SEQ ID NO: 2145355 - RNA, 12 nt, Homo sapiens
gaauuacagaca

SEQ ID NO: 2145356 - RNA, 19 nt, Homo sapiens
aucuuggagacaauuacaa

SEQ ID NO: 2145357 - RNA, 22 nt, Homo sapiens
uuucuacuaaaaauacaaaaau

SEQ ID NO: 2145358 - RNA, 23 nt, Homo sapiens
gcccuccuccccuccuugcaccg

SEQ ID NO: 2145359 - RNA, 11 nt, Homo sapiens
cuaaccaaaua

SEQ ID NO: 2145360 - RNA, 23 nt, Homo sapiens
ccagccuauacuucccuuuuuga

SEQ ID NO: 2145361 - RNA, 21 nt, Homo sapiens
agaauauuuuaaguauugcau

SEQ ID NO: 2145362 - RNA, 20 nt, Homo sapiens
gagggugguuuaugauuaag

SEQ ID NO: 2145363 - RNA, 20 nt, Homo sapiens
cugggugcggugacucaugc

SEQ ID NO: 2145364 - RNA, 20 nt, Homo sapiens
uugacaucaaugaugaggcu

SEQ ID NO: 2145365 - RNA, 19 nt, Homo sapiens
cacacugucuguauagugu

SEQ ID NO: 2145366 - RNA, 13 nt, Homo sapiens
uucuuuccagaaa

SEQ ID NO: 2145367 - RNA, 14 nt, Homo sapiens
gauuuuaguucacu

SEQ ID NO: 2145368 - RNA, 14 nt, Homo sapiens
ucaguuuuccuuag

SEQ ID NO: 2145369 - RNA, 16 nt, Homo sapiens
aguuaagcaacaucua

SEQ ID NO: 2145370 - RNA, 14 nt, Homo sapiens
uuguuccuggggcu

SEQ ID NO: 2145371 - RNA, 13 nt, Homo sapiens
cauguuuccucuu

SEQ ID NO: 2145372 - RNA, 17 nt, Homo sapiens
augcauagcuuugcacu

SEQ ID NO: 2145373 - RNA, 15 nt, Homo sapiens
agaaugugcuuugua

SEQ ID NO: 2145374 - RNA, 12 nt, Homo sapiens
aaauauagccuu

SEQ ID NO: 2145375 - RNA, 17 nt, Homo sapiens
uauuuguaaauuuagug

SEQ ID NO: 2145376 - RNA, 22 nt, Homo sapiens
caggagguggagguugcaguga

SEQ ID NO: 2145377 - RNA, 14 nt, Homo sapiens
gcauauaguuaaac

SEQ ID NO: 2145378 - RNA, 15 nt, Homo sapiens
ucuaauguauuucaa

SEQ ID NO: 2145379 - RNA, 14 nt, Homo sapiens
aucuagucuugacc

SEQ ID NO: 2145380 - RNA, 16 nt, Homo sapiens
aacuagguaugaagua

SEQ ID NO: 2145381 - RNA, 23 nt, Homo sapiens
gcccccuggugggacaacaaaga

SEQ ID NO: 2145382 - RNA, 15 nt, Homo sapiens
uugaauugcacugaa

SEQ ID NO: 2145383 - RNA, 17 nt, Homo sapiens
cucaauaaagugcuuug

SEQ ID NO: 2145384 - RNA, 17 nt, Homo sapiens
cuguacaaaguagaagu

SEQ ID NO: 2145385 - RNA, 21 nt, Homo sapiens
uagcuuucaauuccguagcca

SEQ ID NO: 2145386 - RNA, 15 nt, Homo sapiens
ucugucauccugcua

SEQ ID NO: 2145387 - RNA, 17 nt, Homo sapiens
aucuaaggaugucacag

SEQ ID NO: 2145388 - RNA, 22 nt, Homo sapiens
uugaugucuaaguaugccucag

SEQ ID NO: 2145389 - RNA, 21 nt, Homo sapiens
ugauccacagaaauacaugaa

SEQ ID NO: 2145390 - RNA, 23 nt, Homo sapiens
uaauuacaggagggaacauuucc

SEQ ID NO: 2145391 - RNA, 21 nt, Homo sapiens
uccccagaacaaucuggauuu

SEQ ID NO: 2145392 - RNA, 16 nt, Homo sapiens
ugcgcaguggcauguc

SEQ ID NO: 2145393 - RNA, 13 nt, Homo sapiens
cuuauuucuauga

SEQ ID NO: 2145394 - RNA, 18 nt, Homo sapiens
cccucccacaugauguca

SEQ ID NO: 2145395 - RNA, 17 nt, Homo sapiens
ugaacugaaguuucaca

SEQ ID NO: 2145396 - RNA, 13 nt, Homo sapiens
gaccucugacaca

SEQ ID NO: 2145397 - RNA, 16 nt, Homo sapiens
accuagaccuugccuc

SEQ ID NO: 2145398 - RNA, 20 nt, Homo sapiens
aucaauguucaucauguauc

SEQ ID NO: 2145399 - RNA, 14 nt, Homo sapiens
gccaauccaugcuc

SEQ ID NO: 2145400 - RNA, 13 nt, Homo sapiens
acccacugccaga

SEQ ID NO: 2145401 - RNA, 19 nt, Homo sapiens
acauuacuaaggcuaauaa

SEQ ID NO: 2145402 - RNA, 23 nt, Homo sapiens
ccuguguccacaucuaacaaagu

SEQ ID NO: 2145403 - RNA, 22 nt, Homo sapiens
agggccaggauuccucucucag

SEQ ID NO: 2145404 - RNA, 15 nt, Homo sapiens
cagcacauguugcua

SEQ ID NO: 2145405 - RNA, 18 nt, Homo sapiens
gccaucacccccuacccc

SEQ ID NO: 2145406 - RNA, 17 nt, Homo sapiens
gauucuaaauguucaug

SEQ ID NO: 2145407 - RNA, 21 nt, Homo sapiens
ggcacacaucaggaguucaau

SEQ ID NO: 2145408 - RNA, 10 nt, Homo sapiens
uagugccuuc

SEQ ID NO: 2145409 - RNA, 16 nt, Homo sapiens
guuuuggaugcagugc

SEQ ID NO: 2145410 - RNA, 22 nt, Homo sapiens
gacccuggacucgccacuggua

SEQ ID NO: 2145411 - RNA, 13 nt, Homo sapiens
auaaaacaauguu

SEQ ID NO: 2145412 - RNA, 15 nt, Homo sapiens
aagucacuggccagu

SEQ ID NO: 2145413 - RNA, 13 nt, Homo sapiens
guuugcacuuccu

SEQ ID NO: 2145414 - RNA, 20 nt, Homo sapiens
gcccuccccagagcacuggg

SEQ ID NO: 2145415 - RNA, 18 nt, Homo sapiens
gcucacauaucugucauu

SEQ ID NO: 2145416 - RNA, 14 nt, Homo sapiens
gaauggagauuuca

SEQ ID NO: 2145417 - RNA, 20 nt, Homo sapiens
ucuggccaaauaugcacuuu

SEQ ID NO: 2145418 - RNA, 17 nt, Homo sapiens
uaagaaauaugugagau

SEQ ID NO: 2145419 - RNA, 14 nt, Homo sapiens
uguccagagucucu

SEQ ID NO: 2145420 - RNA, 17 nt, Homo sapiens
uauacgcacgcacccac

SEQ ID NO: 2145421 - RNA, 19 nt, Homo sapiens
ugguuaaugaaaaaucuga

SEQ ID NO: 2145422 - RNA, 14 nt, Homo sapiens
accugcagccagca

SEQ ID NO: 2145423 - RNA, 23 nt, Homo sapiens
uuaaguaaagucaacauaugcaa

SEQ ID NO: 2145424 - RNA, 16 nt, Homo sapiens
gccccucaucagccuu

SEQ ID NO: 2145425 - RNA, 20 nt, Homo sapiens
ugauauggcggccugcagug

SEQ ID NO: 2145426 - RNA, 13 nt, Homo sapiens
cacuuugcagcua

SEQ ID NO: 2145427 - RNA, 21 nt, Homo sapiens
agaagaauauguauguuucua

SEQ ID NO: 2145428 - RNA, 17 nt, Homo sapiens
auuucuuaugugacauu

SEQ ID NO: 2145429 - RNA, 20 nt, Homo sapiens
aacuuaccgugagcgacaaa

SEQ ID NO: 2145430 - RNA, 23 nt, Homo sapiens
caacagcuuuucgucuucagugu

SEQ ID NO: 2145431 - RNA, 15 nt, Homo sapiens
auggucacacacuga

SEQ ID NO: 2145432 - RNA, 18 nt, Homo sapiens
agacccaggagagacaga

SEQ ID NO: 2145433 - RNA, 21 nt, Homo sapiens
agaucgaugauaugaccagaa

SEQ ID NO: 2145434 - RNA, 16 nt, Homo sapiens
ugaaauguucugucaa

SEQ ID NO: 2145435 - RNA, 14 nt, Homo sapiens
aucuuaaagcacuu

SEQ ID NO: 2145436 - RNA, 19 nt, Homo sapiens
uggcacauaaagaaaucuu

SEQ ID NO: 2145437 - RNA, 16 nt, Homo sapiens
cugcaacgcugccuuu

SEQ ID NO: 2145438 - RNA, 13 nt, Homo sapiens
aacuguagucuca

SEQ ID NO: 2145439 - RNA, 21 nt, Homo sapiens
aacggaauaauaaaaagcauu

SEQ ID NO: 2145440 - RNA, 14 nt, Homo sapiens
uucaguguuuucau

SEQ ID NO: 2145441 - RNA, 21 nt, Homo sapiens
cuccuucccagggaccagcac

SEQ ID NO: 2145442 - RNA, 14 nt, Homo sapiens
aagauguaaggaau

SEQ ID NO: 2145443 - RNA, 20 nt, Homo sapiens
agguuugagaccgaccagcc

SEQ ID NO: 2145444 - RNA, 18 nt, Homo sapiens
uggaagacuuagaucuga

SEQ ID NO: 2145445 - RNA, 16 nt, Homo sapiens
aggcacgaaugaucuu

SEQ ID NO: 2145446 - RNA, 16 nt, Homo sapiens
caagugcaagacugaa

SEQ ID NO: 2145447 - RNA, 13 nt, Homo sapiens
ccaaaccucaaua

SEQ ID NO: 2145448 - RNA, 14 nt, Homo sapiens
guucugugcacaaa

SEQ ID NO: 2145449 - RNA, 13 nt, Homo sapiens
gaauacacaugca

SEQ ID NO: 2145450 - RNA, 22 nt, Homo sapiens
agacacuguuacagagauacug

SEQ ID NO: 2145451 - RNA, 16 nt, Homo sapiens
uaaaagucuccaaaac

SEQ ID NO: 2145452 - RNA, 16 nt, Homo sapiens
uuugaaccaacaucuu

SEQ ID NO: 2145453 - RNA, 13 nt, Homo sapiens
auacggcacugaa

SEQ ID NO: 2145454 - RNA, 21 nt, Homo sapiens
uucuuaaggaagaagaguauu

SEQ ID NO: 2145455 - RNA, 13 nt, Homo sapiens
cccaaacagugac

SEQ ID NO: 2145456 - RNA, 22 nt, Homo sapiens
ugauugagaagaggacauugga

SEQ ID NO: 2145457 - RNA, 12 nt, Homo sapiens
guagcugagacu

SEQ ID NO: 2145458 - RNA, 21 nt, Homo sapiens
cuuuacuuuguacaaauguaa

SEQ ID NO: 2145459 - RNA, 16 nt, Homo sapiens
uuggcagaacugcugg

SEQ ID NO: 2145460 - RNA, 14 nt, Homo sapiens
cagcaauauugccu

SEQ ID NO: 2145461 - RNA, 19 nt, Homo sapiens
ugcgaaggcugggcacugc

SEQ ID NO: 2145462 - RNA, 14 nt, Homo sapiens
gcaaagagccagca

SEQ ID NO: 2145463 - RNA, 22 nt, Homo sapiens
auuuucaagacacagacaaagu

SEQ ID NO: 2145464 - RNA, 20 nt, Homo sapiens
uaggucauuacuaaccauag

SEQ ID NO: 2145465 - RNA, 16 nt, Homo sapiens
guagcagguuucacua

SEQ ID NO: 2145466 - RNA, 18 nt, Homo sapiens
auccaggaacacaugcac

SEQ ID NO: 2145467 - RNA, 18 nt, Homo sapiens
uuuuauuucugacucuua

SEQ ID NO: 2145468 - RNA, 14 nt, Homo sapiens
cucuggaguucauc

SEQ ID NO: 2145469 - RNA, 18 nt, Homo sapiens
auuucauuuguaacuuua

SEQ ID NO: 2145470 - RNA, 14 nt, Homo sapiens
uacgcucucugucu

SEQ ID NO: 2145471 - RNA, 23 nt, Homo sapiens
ggcgcguuugugcauaucugccu

SEQ ID NO: 2145472 - RNA, 14 nt, Homo sapiens
acugcaguggacag

SEQ ID NO: 2145473 - RNA, 14 nt, Homo sapiens
uugcauuaauauug

SEQ ID NO: 2145474 - RNA, 13 nt, Homo sapiens
uaauagcauucau

SEQ ID NO: 2145475 - RNA, 12 nt, Homo sapiens
aaugaauaccuu

SEQ ID NO: 2145476 - RNA, 19 nt, Homo sapiens
uuaaggaacuucugaagau

SEQ ID NO: 2145477 - RNA, 13 nt, Homo sapiens
gccaggacacugc

SEQ ID NO: 2145478 - RNA, 20 nt, Homo sapiens
ccuuguuguguuucuaucuc

SEQ ID NO: 2145479 - RNA, 14 nt, Homo sapiens
gaucaugcauuguu

SEQ ID NO: 2145480 - RNA, 17 nt, Homo sapiens
cugaguuugauuuguua

SEQ ID NO: 2145481 - RNA, 20 nt, Homo sapiens
gaucuguguuuuauugacau

SEQ ID NO: 2145482 - RNA, 22 nt, Homo sapiens
aauuuucaaaacaauccuuuaa

SEQ ID NO: 2145483 - RNA, 22 nt, Homo sapiens
aggaagaauuccugccaugccc

SEQ ID NO: 2145484 - RNA, 16 nt, Homo sapiens
agaggcaaccuguuga

SEQ ID NO: 2145485 - RNA, 20 nt, Homo sapiens
cuucuaaccugaacugaugg

SEQ ID NO: 2145486 - RNA, 17 nt, Homo sapiens
ugagaugggacauucca

SEQ ID NO: 2145487 - RNA, 15 nt, Homo sapiens
uuaaaguaugcaaaa

SEQ ID NO: 2145488 - RNA, 19 nt, Homo sapiens
ugucaagccggaugccuaa

SEQ ID NO: 2145489 - RNA, 14 nt, Homo sapiens
uggcauaagacaga

SEQ ID NO: 2145490 - RNA, 22 nt, Homo sapiens
auucauaaaaauaaccaaaaaa

SEQ ID NO: 2145491 - RNA, 19 nt, Homo sapiens
gugucuuggggugggcaca

SEQ ID NO: 2145492 - RNA, 19 nt, Homo sapiens
ugauaaucccauacucuca

SEQ ID NO: 2145493 - RNA, 15 nt, Homo sapiens
ggcccccacaggccc

SEQ ID NO: 2145494 - RNA, 19 nt, Homo sapiens
uccaggucuagaaggccag

SEQ ID NO: 2145495 - RNA, 14 nt, Homo sapiens
aucaauuucuaaug

SEQ ID NO: 2145496 - RNA, 21 nt, Homo sapiens
aggggagggagaaguuucugu

SEQ ID NO: 2145497 - RNA, 23 nt, Homo sapiens
ucucaccccugcuauaacuauga

SEQ ID NO: 2145498 - RNA, 17 nt, Homo sapiens
aacauguucucaauaaa

SEQ ID NO: 2145499 - RNA, 16 nt, Homo sapiens
caaaacuccaucucaa

SEQ ID NO: 2145500 - RNA, 18 nt, Homo sapiens
augguaaaaccccaucuc

SEQ ID NO: 2145501 - RNA, 21 nt, Homo sapiens
gucaccccucacugugacuga

SEQ ID NO: 2145502 - RNA, 18 nt, Homo sapiens
cugaaugucuuacuguga

SEQ ID NO: 2145503 - RNA, 21 nt, Homo sapiens
gcaccgggcuggccugacaca

SEQ ID NO: 2145504 - RNA, 15 nt, Homo sapiens
acuuugagaagcuga

SEQ ID NO: 2145505 - RNA, 23 nt, Homo sapiens
auagugcugcaauaaacauaugu

SEQ ID NO: 2145506 - RNA, 11 nt, Homo sapiens
gugaugcuccu

SEQ ID NO: 2145507 - RNA, 13 nt, Homo sapiens
aagccugagcuca

SEQ ID NO: 2145508 - RNA, 19 nt, Homo sapiens
cagauuugcucaaagcaau

SEQ ID NO: 2145509 - RNA, 19 nt, Homo sapiens
gcuguauuugcugccagac

SEQ ID NO: 2145510 - RNA, 14 nt, Homo sapiens
accaggucauucuu

SEQ ID NO: 2145511 - RNA, 19 nt, Homo sapiens
ccgaugugcgcacacacag

SEQ ID NO: 2145512 - RNA, 18 nt, Homo sapiens
cacuguauguguugcacg

SEQ ID NO: 2145513 - RNA, 21 nt, Homo sapiens
gaauuuuuacuuagauacuaa

SEQ ID NO: 2145514 - RNA, 21 nt, Homo sapiens
caauugaagucaauuacucua

SEQ ID NO: 2145515 - RNA, 15 nt, Homo sapiens
ucuuagguuuccacg

SEQ ID NO: 2145516 - RNA, 12 nt, Homo sapiens
uacccagcgcua

SEQ ID NO: 2145517 - RNA, 16 nt, Homo sapiens
ggccagugaacagggu

SEQ ID NO: 2145518 - RNA, 17 nt, Homo sapiens
caaggauaggcuuuauu

SEQ ID NO: 2145519 - RNA, 13 nt, Homo sapiens
acguaaacuuccu

SEQ ID NO: 2145520 - RNA, 20 nt, Homo sapiens
ggcuggagugcaguggcgcc

SEQ ID NO: 2145521 - RNA, 14 nt, Homo sapiens
caaagcagcugcag

SEQ ID NO: 2145522 - RNA, 22 nt, Homo sapiens
acugacccucaggcacaccuug

SEQ ID NO: 2145523 - RNA, 18 nt, Homo sapiens
agccaagagucaugucaa

SEQ ID NO: 2145524 - RNA, 15 nt, Homo sapiens
uguaaguacuuccac

SEQ ID NO: 2145525 - RNA, 16 nt, Homo sapiens
caaaaucuucacugaa

SEQ ID NO: 2145526 - RNA, 13 nt, Homo sapiens
ucauccuuuccag

SEQ ID NO: 2145527 - RNA, 19 nt, Homo sapiens
cuugccagccucaggcuug

SEQ ID NO: 2145528 - RNA, 20 nt, Homo sapiens
ccuuaaggauaucaguaaau

SEQ ID NO: 2145529 - RNA, 17 nt, Homo sapiens
guaguucugaguccuga

SEQ ID NO: 2145530 - RNA, 14 nt, Homo sapiens
caguggagccugaa

SEQ ID NO: 2145531 - RNA, 21 nt, Homo sapiens
uugaauaggaguucuccugga

SEQ ID NO: 2145532 - RNA, 22 nt, Homo sapiens
aaucuagguucaggaagaccac

SEQ ID NO: 2145533 - RNA, 16 nt, Homo sapiens
ccucaugcuguuucac

SEQ ID NO: 2145534 - RNA, 17 nt, Homo sapiens
cugucgauaaucagaga

SEQ ID NO: 2145535 - RNA, 22 nt, Homo sapiens
gaagugagcaaggugcucuuga

SEQ ID NO: 2145536 - RNA, 14 nt, Homo sapiens
accaugucacugug

SEQ ID NO: 2145537 - RNA, 14 nt, Homo sapiens
accaaaucacugaa

SEQ ID NO: 2145538 - RNA, 16 nt, Homo sapiens
cuuguaaaaccaacua

SEQ ID NO: 2145539 - RNA, 15 nt, Homo sapiens
augcagugcuuccaa

SEQ ID NO: 2145540 - RNA, 21 nt, Homo sapiens
cauggcagaaggcaaacccau

SEQ ID NO: 2145541 - RNA, 22 nt, Homo sapiens
ccuacccuccuuccacauguac

SEQ ID NO: 2145542 - RNA, 13 nt, Homo sapiens
cacagcuacagcu

SEQ ID NO: 2145543 - RNA, 19 nt, Homo sapiens
ugggcccccaaauggaaau

SEQ ID NO: 2145544 - RNA, 11 nt, Homo sapiens
ucccugggaag

SEQ ID NO: 2145545 - RNA, 12 nt, Homo sapiens
gccuaucugacu

SEQ ID NO: 2145546 - RNA, 12 nt, Homo sapiens
cagaugugguaa

SEQ ID NO: 2145547 - RNA, 24 nt, Homo sapiens
uggcuuacacuggcaaugguaguu

SEQ ID NO: 2145548 - RNA, 14 nt, Homo sapiens
uuauacugcacuuu

SEQ ID NO: 2145549 - RNA, 16 nt, Homo sapiens
cucuccccagagcauu

SEQ ID NO: 2145550 - RNA, 21 nt, Homo sapiens
uaaaucccaagaaauggaauc

SEQ ID NO: 2145551 - RNA, 13 nt, Homo sapiens
ugcucauguauau

SEQ ID NO: 2145552 - RNA, 23 nt, Homo sapiens
ccaaucuuaguuucuaaccaaag

SEQ ID NO: 2145553 - RNA, 14 nt, Homo sapiens
ccacacucagcaca

SEQ ID NO: 2145554 - RNA, 18 nt, Homo sapiens
cauauauaacaaugcugu

SEQ ID NO: 2145555 - RNA, 22 nt, Homo sapiens
acucuggguuucauauccagcu

SEQ ID NO: 2145556 - RNA, 16 nt, Homo sapiens
agagguggaguucuua

SEQ ID NO: 2145557 - RNA, 20 nt, Homo sapiens
ccaucuccaagaaugcugaa

SEQ ID NO: 2145558 - RNA, 15 nt, Homo sapiens
ucucccuaaccacua

SEQ ID NO: 2145559 - RNA, 21 nt, Homo sapiens
cggccuccucuccuacuuugg

SEQ ID NO: 2145560 - RNA, 20 nt, Homo sapiens
ucauacccaccaggaugugu

SEQ ID NO: 2145561 - RNA, 22 nt, Homo sapiens
augucccuauggaagcauauug

SEQ ID NO: 2145562 - RNA, 13 nt, Homo sapiens
ggcuuucuguuga

SEQ ID NO: 2145563 - RNA, 16 nt, Homo sapiens
gggugacagugccuuc

SEQ ID NO: 2145564 - RNA, 15 nt, Homo sapiens
aaauguuuucugggg

SEQ ID NO: 2145565 - RNA, 16 nt, Homo sapiens
ggugcaggacacuggu

SEQ ID NO: 2145566 - RNA, 21 nt, Homo sapiens
cugucauuuuggcaucugcaa

SEQ ID NO: 2145567 - RNA, 21 nt, Homo sapiens
cucguaauuuuuuaacuguaa

SEQ ID NO: 2145568 - RNA, 17 nt, Homo sapiens
acagcaaagauccacuu

SEQ ID NO: 2145569 - RNA, 20 nt, Homo sapiens
augugugguuuuugcaaaug

SEQ ID NO: 2145570 - RNA, 16 nt, Homo sapiens
ucccaucccagcugaa

SEQ ID NO: 2145571 - RNA, 14 nt, Homo sapiens
auggcccauucuac

SEQ ID NO: 2145572 - RNA, 24 nt, Homo sapiens
agcccuauggaagucucaagguca

SEQ ID NO: 2145573 - RNA, 18 nt, Homo sapiens
aggugcuacaaaaacaca

SEQ ID NO: 2145574 - RNA, 16 nt, Homo sapiens
agcgucccuagcagug

SEQ ID NO: 2145575 - RNA, 14 nt, Homo sapiens
cagaugaaugggag

SEQ ID NO: 2145576 - RNA, 16 nt, Homo sapiens
gaguaucacaucacac

SEQ ID NO: 2145577 - RNA, 22 nt, Homo sapiens
aacaaaaccuacgcacauaccu

SEQ ID NO: 2145578 - RNA, 18 nt, Homo sapiens
aaaacugacaucagauuu

SEQ ID NO: 2145579 - RNA, 22 nt, Homo sapiens
uguugcuucuugugaaggccau

SEQ ID NO: 2145580 - RNA, 22 nt, Homo sapiens
auuaccuguauuugugcaauaa

SEQ ID NO: 2145581 - RNA, 18 nt, Homo sapiens
agggauggggccaucucc

SEQ ID NO: 2145582 - RNA, 18 nt, Homo sapiens
uuuccaaccaaguggaaa

SEQ ID NO: 2145583 - RNA, 19 nt, Homo sapiens
uggggaagaguggucuuga

SEQ ID NO: 2145584 - RNA, 13 nt, Homo sapiens
acaugauuccuua

SEQ ID NO: 2145585 - RNA, 14 nt, Homo sapiens
uuaaaagucucaca

SEQ ID NO: 2145586 - RNA, 21 nt, Homo sapiens
cacacacccagcuugugccug

SEQ ID NO: 2145587 - RNA, 21 nt, Homo sapiens
caguaaucuuucggucuccuu

SEQ ID NO: 2145588 - RNA, 13 nt, Homo sapiens
guaugcuaugcua

SEQ ID NO: 2145589 - RNA, 18 nt, Homo sapiens
aaucauuuucauuccuaa

SEQ ID NO: 2145590 - RNA, 13 nt, Homo sapiens
auacacuagacaa

SEQ ID NO: 2145591 - RNA, 15 nt, Homo sapiens
uuaaacaauucuugu

SEQ ID NO: 2145592 - RNA, 19 nt, Homo sapiens
gugauagagcuaacccuua

SEQ ID NO: 2145593 - RNA, 19 nt, Homo sapiens
uagaacaucccugggcaag

SEQ ID NO: 2145594 - RNA, 20 nt, Homo sapiens
caccaagguggcuucuccuu

SEQ ID NO: 2145595 - RNA, 21 nt, Homo sapiens
uccaaaggguuuuaagccagg

SEQ ID NO: 2145596 - RNA, 16 nt, Homo sapiens
guuugcagaugucaua

SEQ ID NO: 2145597 - RNA, 20 nt, Homo sapiens
gaaaauauauuuaauaccuu

SEQ ID NO: 2145598 - RNA, 20 nt, Homo sapiens
uuaguacacagcaccagaau

SEQ ID NO: 2145599 - RNA, 16 nt, Homo sapiens
augaaauuauauaagu

SEQ ID NO: 2145600 - RNA, 22 nt, Homo sapiens
aacccagugaguucagccuuua

SEQ ID NO: 2145601 - RNA, 19 nt, Homo sapiens
aguuuugggaaugcacuug

SEQ ID NO: 2145602 - RNA, 15 nt, Homo sapiens
ggagggagaucuuuc

SEQ ID NO: 2145603 - RNA, 21 nt, Homo sapiens
auugugccuacgaauagccac

SEQ ID NO: 2145604 - RNA, 15 nt, Homo sapiens
aaaaccucuaugcaa

SEQ ID NO: 2145605 - RNA, 16 nt, Homo sapiens
cugaaaggaacacugg

SEQ ID NO: 2145606 - RNA, 16 nt, Homo sapiens
aagaccaucugguauc

SEQ ID NO: 2145607 - RNA, 15 nt, Homo sapiens
aagaauguagucaga

SEQ ID NO: 2145608 - RNA, 18 nt, Homo sapiens
acacguccugcaguuccu

SEQ ID NO: 2145609 - RNA, 22 nt, Homo sapiens
gcccuggcaggcagguguuuau

SEQ ID NO: 2145610 - RNA, 19 nt, Homo sapiens
ucugcauccuggcuugaaa

SEQ ID NO: 2145611 - RNA, 21 nt, Homo sapiens
ugguguucuugcuaacuuugc

SEQ ID NO: 2145612 - RNA, 16 nt, Homo sapiens
guuuuaggucuagccu

SEQ ID NO: 2145613 - RNA, 15 nt, Homo sapiens
gauuuuaucuguuaa

SEQ ID NO: 2145614 - RNA, 12 nt, Homo sapiens
auagaggcuagc

SEQ ID NO: 2145615 - RNA, 17 nt, Homo sapiens
acguaugcaugcuaaau

SEQ ID NO: 2145616 - RNA, 21 nt, Homo sapiens
aucacugaggcauuuuuacua

SEQ ID NO: 2145617 - RNA, 11 nt, Homo sapiens
ucccucaguga

SEQ ID NO: 2145618 - RNA, 18 nt, Homo sapiens
uaauauacugagcugcua

SEQ ID NO: 2145619 - RNA, 18 nt, Homo sapiens
auacaaaucaaagauuug

SEQ ID NO: 2145620 - RNA, 12 nt, Homo sapiens
gccagguggcca

SEQ ID NO: 2145621 - RNA, 12 nt, Homo sapiens
aauaggugaaua

SEQ ID NO: 2145622 - RNA, 20 nt, Homo sapiens
guaucuuccuuucuugucuu

SEQ ID NO: 2145623 - RNA, 16 nt, Homo sapiens
aggccgagaugugcaa

SEQ ID NO: 2145624 - RNA, 13 nt, Homo sapiens
ugaagagcauuug

SEQ ID NO: 2145625 - RNA, 15 nt, Homo sapiens
ccggcacacugccaa

SEQ ID NO: 2145626 - RNA, 14 nt, Homo sapiens
aaaguauauuuucc

SEQ ID NO: 2145627 - RNA, 20 nt, Homo sapiens
augagcacguuuuuguaaaa

SEQ ID NO: 2145628 - RNA, 22 nt, Homo sapiens
gaacaacuaggcuucagcauau

SEQ ID NO: 2145629 - RNA, 17 nt, Homo sapiens
guuaauaaaccuuugca

SEQ ID NO: 2145630 - RNA, 17 nt, Homo sapiens
ugucaccuugcucagcc

SEQ ID NO: 2145631 - RNA, 16 nt, Homo sapiens
uuaugcuaugaagagu

SEQ ID NO: 2145632 - RNA, 16 nt, Homo sapiens
gggacagaguguccuu

SEQ ID NO: 2145633 - RNA, 20 nt, Homo sapiens
cggauccagcaauuccugag

SEQ ID NO: 2145634 - RNA, 17 nt, Homo sapiens
aagauaguuacauuuau

SEQ ID NO: 2145635 - RNA, 12 nt, Homo sapiens
ugggaagaugua

SEQ ID NO: 2145636 - RNA, 20 nt, Homo sapiens
aguggcgccaucucggcuca

SEQ ID NO: 2145637 - RNA, 19 nt, Homo sapiens
aguauuagaugcacuuaag

SEQ ID NO: 2145638 - RNA, 19 nt, Homo sapiens
uuuugccaacccuguguca

SEQ ID NO: 2145639 - RNA, 20 nt, Homo sapiens
ugaagcaugcuuugcugcua

SEQ ID NO: 2145640 - RNA, 16 nt, Homo sapiens
aauguuuacuguauca

SEQ ID NO: 2145641 - RNA, 20 nt, Homo sapiens
guucccagccccuccucccu

SEQ ID NO: 2145642 - RNA, 15 nt, Homo sapiens
gacacaucucccacc

SEQ ID NO: 2145643 - RNA, 18 nt, Homo sapiens
aaugggagaucuucucag

SEQ ID NO: 2145644 - RNA, 22 nt, Homo sapiens
cucuucuuuuuucuuguugcaa

SEQ ID NO: 2145645 - RNA, 16 nt, Homo sapiens
gacagaagguugccag

SEQ ID NO: 2145646 - RNA, 14 nt, Homo sapiens
uggaauaaagucaa

SEQ ID NO: 2145647 - RNA, 22 nt, Homo sapiens
ggcuguauuuuugaaauacucu

SEQ ID NO: 2145648 - RNA, 22 nt, Homo sapiens
gacaucugcuaauauaaauggg

SEQ ID NO: 2145649 - RNA, 19 nt, Homo sapiens
uaugaauuacccuuucauu

SEQ ID NO: 2145650 - RNA, 15 nt, Homo sapiens
gucugggucuaccag

SEQ ID NO: 2145651 - RNA, 20 nt, Homo sapiens
uuucucuacacaaaugugua

SEQ ID NO: 2145652 - RNA, 20 nt, Homo sapiens
ucucuugaaaaguucaggga

SEQ ID NO: 2145653 - RNA, 12 nt, Homo sapiens
ggauagucuccu

SEQ ID NO: 2145654 - RNA, 22 nt, Homo sapiens
uggagaccagaaaccuuccaga

SEQ ID NO: 2145655 - RNA, 13 nt, Homo sapiens
aauuuauaguuaa

SEQ ID NO: 2145656 - RNA, 13 nt, Homo sapiens
cuugauuaagggc

SEQ ID NO: 2145657 - RNA, 21 nt, Homo sapiens
auaaaagcuaugacacgagaa

SEQ ID NO: 2145658 - RNA, 16 nt, Homo sapiens
caugccuuuccagugc

SEQ ID NO: 2145659 - RNA, 13 nt, Homo sapiens
ggcugguggaaca

SEQ ID NO: 2145660 - RNA, 21 nt, Homo sapiens
caauugucaugcuugacacaa

SEQ ID NO: 2145661 - RNA, 18 nt, Homo sapiens
uaggaccuaaugggaccc

SEQ ID NO: 2145662 - RNA, 16 nt, Homo sapiens
gcguguguccaugugu

SEQ ID NO: 2145663 - RNA, 17 nt, Homo sapiens
guucuagacuuccccau

SEQ ID NO: 2145664 - RNA, 15 nt, Homo sapiens
ccaguguacagugaa

SEQ ID NO: 2145665 - RNA, 12 nt, Homo sapiens
acagcaguauug

SEQ ID NO: 2145666 - RNA, 14 nt, Homo sapiens
agaugggauuucac

SEQ ID NO: 2145667 - RNA, 22 nt, Homo sapiens
ugguucuuuuaccccacgaaga

SEQ ID NO: 2145668 - RNA, 21 nt, Homo sapiens
agcuuucuucuacaaccagag

SEQ ID NO: 2145669 - RNA, 22 nt, Homo sapiens
agacagaaagcagaacagugau

SEQ ID NO: 2145670 - RNA, 15 nt, Homo sapiens
uauuccuuugccaau

SEQ ID NO: 2145671 - RNA, 14 nt, Homo sapiens
aaaauucaaccaca

SEQ ID NO: 2145672 - RNA, 19 nt, Homo sapiens
cauggaggccaagaacuug

SEQ ID NO: 2145673 - RNA, 16 nt, Homo sapiens
uggcacuugcuaacaa

SEQ ID NO: 2145674 - RNA, 20 nt, Homo sapiens
aacauaugcauuaugaaguu

SEQ ID NO: 2145675 - RNA, 15 nt, Homo sapiens
caccuccuacgucaa

SEQ ID NO: 2145676 - RNA, 18 nt, Homo sapiens
acuuauaaaucauauucu

SEQ ID NO: 2145677 - RNA, 14 nt, Homo sapiens
cagaaaaccuacca

SEQ ID NO: 2145678 - RNA, 13 nt, Homo sapiens
agcuugaugccag

SEQ ID NO: 2145679 - RNA, 14 nt, Homo sapiens
aauacauuuugcac

SEQ ID NO: 2145680 - RNA, 14 nt, Homo sapiens
cucugaguagcuuu

SEQ ID NO: 2145681 - RNA, 19 nt, Homo sapiens
acccccauuaaauucacuu

SEQ ID NO: 2145682 - RNA, 12 nt, Homo sapiens
aaugucacugua

SEQ ID NO: 2145683 - RNA, 14 nt, Homo sapiens
agcaggcacccacu

SEQ ID NO: 2145684 - RNA, 14 nt, Homo sapiens
uacacacaguggau

SEQ ID NO: 2145685 - RNA, 16 nt, Homo sapiens
cacacugugaaccacu

SEQ ID NO: 2145686 - RNA, 16 nt, Homo sapiens
aaauagaugacauuga

SEQ ID NO: 2145687 - RNA, 16 nt, Homo sapiens
gaaaauguaacuugaa

SEQ ID NO: 2145688 - RNA, 22 nt, Homo sapiens
uauuuccucugugcaaagggaa

SEQ ID NO: 2145689 - RNA, 13 nt, Homo sapiens
agugggcauguau

SEQ ID NO: 2145690 - RNA, 16 nt, Homo sapiens
aaagguucuaucugcu

SEQ ID NO: 2145691 - RNA, 21 nt, Homo sapiens
ugugcugacucuggccuuaca

SEQ ID NO: 2145692 - RNA, 19 nt, Homo sapiens
guuuaggaacuacugagga

SEQ ID NO: 2145693 - RNA, 19 nt, Homo sapiens
uuagagagggugguuuucc

SEQ ID NO: 2145694 - RNA, 16 nt, Homo sapiens
acugguucacauccua

SEQ ID NO: 2145695 - RNA, 22 nt, Homo sapiens
ugucaaagaaaacuuccaaaaa

SEQ ID NO: 2145696 - RNA, 10 nt, Homo sapiens
aacagugccc

SEQ ID NO: 2145697 - RNA, 18 nt, Homo sapiens
gcaugcauucuagcacaa

SEQ ID NO: 2145698 - RNA, 17 nt, Homo sapiens
ccagcggcccugucauc

SEQ ID NO: 2145699 - RNA, 21 nt, Homo sapiens
ugcaggauuuguuguucugac

SEQ ID NO: 2145700 - RNA, 17 nt, Homo sapiens
auugggcuucaaucacu

SEQ ID NO: 2145701 - RNA, 16 nt, Homo sapiens
uaauaguaaacacagg

SEQ ID NO: 2145702 - RNA, 16 nt, Homo sapiens
aaauaguguacacaga

SEQ ID NO: 2145703 - RNA, 18 nt, Homo sapiens
uggaggauggcacagccu

SEQ ID NO: 2145704 - RNA, 23 nt, Homo sapiens
gcugcuuuaacaguggagcugaa

SEQ ID NO: 2145705 - RNA, 22 nt, Homo sapiens
caauaaaaucagugugcuugcc

SEQ ID NO: 2145706 - RNA, 23 nt, Homo sapiens
aaauuaaagcccauaaggccaga

SEQ ID NO: 2145707 - RNA, 11 nt, Homo sapiens
cccaccagcuc

SEQ ID NO: 2145708 - RNA, 17 nt, Homo sapiens
ugguaaaucacacugaa

SEQ ID NO: 2145709 - RNA, 19 nt, Homo sapiens
ucccucagcccucauuaaa

SEQ ID NO: 2145710 - RNA, 15 nt, Homo sapiens
ugguuggacacugug

SEQ ID NO: 2145711 - RNA, 18 nt, Homo sapiens
agaccaccagggucccag

SEQ ID NO: 2145712 - RNA, 21 nt, Homo sapiens
ugauggcggcucacaagugaa

SEQ ID NO: 2145713 - RNA, 16 nt, Homo sapiens
ggagcucgugggacag

SEQ ID NO: 2145714 - RNA, 16 nt, Homo sapiens
gaaccuaauagcacca

SEQ ID NO: 2145715 - RNA, 18 nt, Homo sapiens
uagcagaaggcaagcacc

SEQ ID NO: 2145716 - RNA, 19 nt, Homo sapiens
ggccaaaaccaaugcugau

SEQ ID NO: 2145717 - RNA, 21 nt, Homo sapiens
cacucaaaaaggugugucaaa

SEQ ID NO: 2145718 - RNA, 19 nt, Homo sapiens
ccucucucccuagugccuu

SEQ ID NO: 2145719 - RNA, 21 nt, Homo sapiens
aauacuggacucaggaacuuu

SEQ ID NO: 2145720 - RNA, 19 nt, Homo sapiens
aacgaggcaaugacuguga

SEQ ID NO: 2145721 - RNA, 20 nt, Homo sapiens
agaaacguuuggaacaaucu

SEQ ID NO: 2145722 - RNA, 22 nt, Homo sapiens
uaauaaaaaauauucuugucaa

SEQ ID NO: 2145723 - RNA, 20 nt, Homo sapiens
gugaugugugagcuaugcaa

SEQ ID NO: 2145724 - RNA, 15 nt, Homo sapiens
auuguguugacauua

SEQ ID NO: 2145725 - RNA, 16 nt, Homo sapiens
gagcuaacauaaagga

SEQ ID NO: 2145726 - RNA, 23 nt, Homo sapiens
cauuuguuguuguuuuuccucaa

SEQ ID NO: 2145727 - RNA, 16 nt, Homo sapiens
cacccaccucaccaaa

SEQ ID NO: 2145728 - RNA, 20 nt, Homo sapiens
gccaccuuuauggacuggcc

SEQ ID NO: 2145729 - RNA, 11 nt, Homo sapiens
gucucauucug

SEQ ID NO: 2145730 - RNA, 13 nt, Homo sapiens
auucucuugccuc

SEQ ID NO: 2145731 - RNA, 14 nt, Homo sapiens
auguauuaugcaaa

SEQ ID NO: 2145732 - RNA, 14 nt, Homo sapiens
uuguaauaagcaau

SEQ ID NO: 2145733 - RNA, 13 nt, Homo sapiens
agagauacauucc

SEQ ID NO: 2145734 - RNA, 12 nt, Homo sapiens
gugacacuggac

SEQ ID NO: 2145735 - RNA, 16 nt, Homo sapiens
uacuguuuuaucucca

SEQ ID NO: 2145736 - RNA, 21 nt, Homo sapiens
uaagcauuccuucuuucacag

SEQ ID NO: 2145737 - RNA, 19 nt, Homo sapiens
ucccucguccgucugucuc

SEQ ID NO: 2145738 - RNA, 19 nt, Homo sapiens
cugcaggcagagacugaaa

SEQ ID NO: 2145739 - RNA, 24 nt, Homo sapiens
acccagggggcugaaacuugaacu

SEQ ID NO: 2145740 - RNA, 14 nt, Homo sapiens
ugaauuggcauuuc

SEQ ID NO: 2145741 - RNA, 17 nt, Homo sapiens
uucuacagcagcacugu

SEQ ID NO: 2145742 - RNA, 23 nt, Homo sapiens
acuuuguaauaccagaacucuaa

SEQ ID NO: 2145743 - RNA, 20 nt, Homo sapiens
cugauguccguaggccuuaa

SEQ ID NO: 2145744 - RNA, 23 nt, Homo sapiens
gggaaaaauaugugaauguguag

SEQ ID NO: 2145745 - RNA, 23 nt, Homo sapiens
uaaacaguugcacagcaucucag

SEQ ID NO: 2145746 - RNA, 21 nt, Homo sapiens
auuguacucaaugguaucauu

SEQ ID NO: 2145747 - RNA, 18 nt, Homo sapiens
cauuuauaacuucuguac

SEQ ID NO: 2145748 - RNA, 15 nt, Homo sapiens
aguguuguguuacaa

SEQ ID NO: 2145749 - RNA, 21 nt, Homo sapiens
ucuauuuacauaaaaugggug

SEQ ID NO: 2145750 - RNA, 19 nt, Homo sapiens
gcagagguugggaggccau

SEQ ID NO: 2145751 - RNA, 23 nt, Homo sapiens
caggcagagacugaaaauugcag

SEQ ID NO: 2145752 - RNA, 21 nt, Homo sapiens
uaugggggagauugaacuuuc

SEQ ID NO: 2145753 - RNA, 16 nt, Homo sapiens
ggugauuccgcaguga

SEQ ID NO: 2145754 - RNA, 13 nt, Homo sapiens
uguucuacacuca

SEQ ID NO: 2145755 - RNA, 21 nt, Homo sapiens
auaaauaaagaagaaaauaac

SEQ ID NO: 2145756 - RNA, 16 nt, Homo sapiens
aaguacagaacaguaa

SEQ ID NO: 2145757 - RNA, 15 nt, Homo sapiens
accguugauguugau

SEQ ID NO: 2145758 - RNA, 19 nt, Homo sapiens
aaccaaaaugauacuuacu

SEQ ID NO: 2145759 - RNA, 15 nt, Homo sapiens
ccacacuagcuugca

SEQ ID NO: 2145760 - RNA, 20 nt, Homo sapiens
cuguaguugcagcugaugcc

SEQ ID NO: 2145761 - RNA, 21 nt, Homo sapiens
gaauucuugaucucuaaugag

SEQ ID NO: 2145762 - RNA, 15 nt, Homo sapiens
acugaaucacuuaaa

SEQ ID NO: 2145763 - RNA, 15 nt, Homo sapiens
ucauugucucaguga

SEQ ID NO: 2145764 - RNA, 15 nt, Homo sapiens
gcugaccacacuccg

SEQ ID NO: 2145765 - RNA, 17 nt, Homo sapiens
agauacgcaaacacacc

SEQ ID NO: 2145766 - RNA, 17 nt, Homo sapiens
agauaaacaaacaagcc

SEQ ID NO: 2145767 - RNA, 21 nt, Homo sapiens
cucuauaagauuccaaaaagc

SEQ ID NO: 2145768 - RNA, 21 nt, Homo sapiens
gcauaccauugaaacaugcca

SEQ ID NO: 2145769 - RNA, 14 nt, Homo sapiens
gagaagacacugca

SEQ ID NO: 2145770 - RNA, 15 nt, Homo sapiens
caaaaagacagugug

SEQ ID NO: 2145771 - RNA, 14 nt, Homo sapiens
augcggucuaggga

SEQ ID NO: 2145772 - RNA, 14 nt, Homo sapiens
uugguuugacccag

SEQ ID NO: 2145773 - RNA, 22 nt, Homo sapiens
cugcucagcccugcaccaugcu

SEQ ID NO: 2145774 - RNA, 11 nt, Homo sapiens
aggcagugcag

SEQ ID NO: 2145775 - RNA, 12 nt, Homo sapiens
gugucaggugac

SEQ ID NO: 2145776 - RNA, 18 nt, Homo sapiens
auuaauuaucuaguuuaa

SEQ ID NO: 2145777 - RNA, 18 nt, Homo sapiens
ucugaccucuuggccaca

SEQ ID NO: 2145778 - RNA, 22 nt, Homo sapiens
gcacagggagacccguccauuu

SEQ ID NO: 2145779 - RNA, 23 nt, Homo sapiens
acaaacuccugaaaugccaagug

SEQ ID NO: 2145780 - RNA, 16 nt, Homo sapiens
gaaacaugaagcauaa

SEQ ID NO: 2145781 - RNA, 20 nt, Homo sapiens
uauuuagauauaacacuaug

SEQ ID NO: 2145782 - RNA, 16 nt, Homo sapiens
uagggacuugugucac

SEQ ID NO: 2145783 - RNA, 15 nt, Homo sapiens
ccaggccaacaguag

SEQ ID NO: 2145784 - RNA, 18 nt, Homo sapiens
ucauccaaugcucaagaa

SEQ ID NO: 2145785 - RNA, 15 nt, Homo sapiens
gcgaugggcaucaca

SEQ ID NO: 2145786 - RNA, 21 nt, Homo sapiens
ugcucuccggcgcagacaggc

SEQ ID NO: 2145787 - RNA, 14 nt, Homo sapiens
ucaagcacacugga

SEQ ID NO: 2145788 - RNA, 14 nt, Homo sapiens
uugcucacaaaagu

SEQ ID NO: 2145789 - RNA, 18 nt, Homo sapiens
auuacuggcaugagccac

SEQ ID NO: 2145790 - RNA, 12 nt, Homo sapiens
uuccaaauucau

SEQ ID NO: 2145791 - RNA, 16 nt, Homo sapiens
acauacuagcaucuua

SEQ ID NO: 2145792 - RNA, 15 nt, Homo sapiens
uucucaaugaaugaa

SEQ ID NO: 2145793 - RNA, 19 nt, Homo sapiens
cauuagcuuccugccccag

SEQ ID NO: 2145794 - RNA, 16 nt, Homo sapiens
uguauuuucugaucau

SEQ ID NO: 2145795 - RNA, 17 nt, Homo sapiens
ugcacuguauugcuccu

SEQ ID NO: 2145796 - RNA, 23 nt, Homo sapiens
accugagggaaucaauggcuuuu

SEQ ID NO: 2145797 - RNA, 13 nt, Homo sapiens
cuccucaacuggg

SEQ ID NO: 2145798 - RNA, 14 nt, Homo sapiens
gccaaaaugccauu

SEQ ID NO: 2145799 - RNA, 23 nt, Homo sapiens
gccacuuagacacuuuaccucuu

SEQ ID NO: 2145800 - RNA, 22 nt, Homo sapiens
uagcacggccaccucucagggc

SEQ ID NO: 2145801 - RNA, 17 nt, Homo sapiens
uugcacuaaaagugaug

SEQ ID NO: 2145802 - RNA, 17 nt, Homo sapiens
gcccuugagaagccaac

SEQ ID NO: 2145803 - RNA, 18 nt, Homo sapiens
gaaggacuugacugggga

SEQ ID NO: 2145804 - RNA, 14 nt, Homo sapiens
acugauccuguuuc

SEQ ID NO: 2145805 - RNA, 15 nt, Homo sapiens
cugccugcuguguua

SEQ ID NO: 2145806 - RNA, 15 nt, Homo sapiens
ugauaaugaucugaa

SEQ ID NO: 2145807 - RNA, 18 nt, Homo sapiens
aggucagaaguucaaggc

SEQ ID NO: 2145808 - RNA, 15 nt, Homo sapiens
uuguucagaugcuuc

SEQ ID NO: 2145809 - RNA, 18 nt, Homo sapiens
auguguuuuaucacuuca

SEQ ID NO: 2145810 - RNA, 17 nt, Homo sapiens
cacuggucgagagccaa

SEQ ID NO: 2145811 - RNA, 16 nt, Homo sapiens
cccucugcugaucuca

SEQ ID NO: 2145812 - RNA, 16 nt, Homo sapiens
guuuuucaaaacaauu

SEQ ID NO: 2145813 - RNA, 14 nt, Homo sapiens
uuuccaaacauucu

SEQ ID NO: 2145814 - RNA, 18 nt, Homo sapiens
cacugcccccuccacugg

SEQ ID NO: 2145815 - RNA, 22 nt, Homo sapiens
gcacugcgccaccugcuucaca

SEQ ID NO: 2145816 - RNA, 16 nt, Homo sapiens
aguuaugggguuuacc

SEQ ID NO: 2145817 - RNA, 16 nt, Homo sapiens
uuggucuguugcccag

SEQ ID NO: 2145818 - RNA, 21 nt, Homo sapiens
guucaguuugucucuuugcaa

SEQ ID NO: 2145819 - RNA, 16 nt, Homo sapiens
gagacuccgucucaag

SEQ ID NO: 2145820 - RNA, 19 nt, Homo sapiens
agcaaguucugagagccag

SEQ ID NO: 2145821 - RNA, 17 nt, Homo sapiens
acauucccuugaucuca

SEQ ID NO: 2145822 - RNA, 15 nt, Homo sapiens
gagugaauucccuca

SEQ ID NO: 2145823 - RNA, 15 nt, Homo sapiens
gcaggaaagaaauca

SEQ ID NO: 2145824 - RNA, 17 nt, Homo sapiens
auguaccugaugcuaug

SEQ ID NO: 2145825 - RNA, 16 nt, Homo sapiens
accucacuucuggcac

SEQ ID NO: 2145826 - RNA, 15 nt, Homo sapiens
aggguggaugacagg

SEQ ID NO: 2145827 - RNA, 14 nt, Homo sapiens
agaugugucuuacc

SEQ ID NO: 2145828 - RNA, 13 nt, Homo sapiens
ccuuaacuggaga

SEQ ID NO: 2145829 - RNA, 18 nt, Homo sapiens
cugcccaccccagcauca

SEQ ID NO: 2145830 - RNA, 22 nt, Homo sapiens
uaugaaggcuguacacugcacg

SEQ ID NO: 2145831 - RNA, 22 nt, Homo sapiens
ucuucacuucuaaaugcauauc

SEQ ID NO: 2145832 - RNA, 18 nt, Homo sapiens
aacguuccucuccaccug

SEQ ID NO: 2145833 - RNA, 15 nt, Homo sapiens
cugcucauccaaagu

SEQ ID NO: 2145834 - RNA, 17 nt, Homo sapiens
accacccccuguucccu

SEQ ID NO: 2145835 - RNA, 16 nt, Homo sapiens
auaaacauuugcacca

SEQ ID NO: 2145836 - RNA, 14 nt, Homo sapiens
aauuuacuggccac

SEQ ID NO: 2145837 - RNA, 13 nt, Homo sapiens
cuuugacugaugc

SEQ ID NO: 2145838 - RNA, 21 nt, Homo sapiens
gagccaaaaucccaccacugc

SEQ ID NO: 2145839 - RNA, 13 nt, Homo sapiens
gaccccaggaaca

SEQ ID NO: 2145840 - RNA, 20 nt, Homo sapiens
cgugugagugagggagacag

SEQ ID NO: 2145841 - RNA, 17 nt, Homo sapiens
cccaugaggacuaggag

SEQ ID NO: 2145842 - RNA, 19 nt, Homo sapiens
agaaagcuagauaugccuu

SEQ ID NO: 2145843 - RNA, 22 nt, Homo sapiens
ugaugucaagcaccacacccca

SEQ ID NO: 2145844 - RNA, 19 nt, Homo sapiens
auaugucacgaacuugaaa

SEQ ID NO: 2145845 - RNA, 14 nt, Homo sapiens
aauacauucaccca

SEQ ID NO: 2145846 - RNA, 12 nt, Homo sapiens
agccaucucaag

SEQ ID NO: 2145847 - RNA, 15 nt, Homo sapiens
gacuucuguuuucaa

SEQ ID NO: 2145848 - RNA, 18 nt, Homo sapiens
gagccuuagaggucuuua

SEQ ID NO: 2145849 - RNA, 19 nt, Homo sapiens
ggaguuugagaccagccuc

SEQ ID NO: 2145850 - RNA, 15 nt, Homo sapiens
gauccagacuguaag

SEQ ID NO: 2145851 - RNA, 15 nt, Homo sapiens
cauugcuuaugacau

SEQ ID NO: 2145852 - RNA, 18 nt, Homo sapiens
cccuucuauacccaccca

SEQ ID NO: 2145853 - RNA, 20 nt, Homo sapiens
aaagcaggugcaacacucaa

SEQ ID NO: 2145854 - RNA, 17 nt, Homo sapiens
cuuguuguuauugaugu

SEQ ID NO: 2145855 - RNA, 19 nt, Homo sapiens
uccccagccugcucccuag

SEQ ID NO: 2145856 - RNA, 15 nt, Homo sapiens
agcaaugccauuuca

SEQ ID NO: 2145857 - RNA, 22 nt, Homo sapiens
gaaauguucguuuucuccugcc

SEQ ID NO: 2145858 - RNA, 18 nt, Homo sapiens
gccacauggccgcugccc

SEQ ID NO: 2145859 - RNA, 14 nt, Homo sapiens
agcuguucuggacu

SEQ ID NO: 2145860 - RNA, 17 nt, Homo sapiens
gcuuaugccugccucuu

SEQ ID NO: 2145861 - RNA, 22 nt, Homo sapiens
aguggaaccguugccaaccgag

SEQ ID NO: 2145862 - RNA, 13 nt, Homo sapiens
uuugaucagacag

SEQ ID NO: 2145863 - RNA, 16 nt, Homo sapiens
ucaaguccugccucuu

SEQ ID NO: 2145864 - RNA, 16 nt, Homo sapiens
uguacugagcacugaa

SEQ ID NO: 2145865 - RNA, 21 nt, Homo sapiens
caguugaaugacaacagaagc

SEQ ID NO: 2145866 - RNA, 17 nt, Homo sapiens
guguugacacaccaguu

SEQ ID NO: 2145867 - RNA, 17 nt, Homo sapiens
uggcuuaacuuaguaua

SEQ ID NO: 2145868 - RNA, 19 nt, Homo sapiens
aagaugucaagggccaaga

SEQ ID NO: 2145869 - RNA, 14 nt, Homo sapiens
acccagaguagcca

SEQ ID NO: 2145870 - RNA, 19 nt, Homo sapiens
acuggcuucucuugaguca

SEQ ID NO: 2145871 - RNA, 22 nt, Homo sapiens
gaggagaacacuagacaugcca

SEQ ID NO: 2145872 - RNA, 20 nt, Homo sapiens
aggauaaccuugugccuugg

SEQ ID NO: 2145873 - RNA, 20 nt, Homo sapiens
ugcugauacugggucugcga

SEQ ID NO: 2145874 - RNA, 12 nt, Homo sapiens
gacagcaugaaa

SEQ ID NO: 2145875 - RNA, 14 nt, Homo sapiens
aaugcaaaacucau

SEQ ID NO: 2145876 - RNA, 12 nt, Homo sapiens
aagaauuacacu

SEQ ID NO: 2145877 - RNA, 17 nt, Homo sapiens
aaaaccuauuccacuua

SEQ ID NO: 2145878 - RNA, 15 nt, Homo sapiens
aauuaacugaagcaa

SEQ ID NO: 2145879 - RNA, 14 nt, Homo sapiens
uguagucucaggac

SEQ ID NO: 2145880 - RNA, 16 nt, Homo sapiens
acacaccuccgagaca

SEQ ID NO: 2145881 - RNA, 23 nt, Homo sapiens
gcugaacaggccgcacaucucac

SEQ ID NO: 2145882 - RNA, 13 nt, Homo sapiens
gcuaaguacacaa

SEQ ID NO: 2145883 - RNA, 23 nt, Homo sapiens
auguacguugagaaucacugcuc

SEQ ID NO: 2145884 - RNA, 17 nt, Homo sapiens
aacacaggcgcugagua

SEQ ID NO: 2145885 - RNA, 20 nt, Homo sapiens
cugagugaaauauuacucug

SEQ ID NO: 2145886 - RNA, 21 nt, Homo sapiens
aucuaaaugaaugagccaaaa

SEQ ID NO: 2145887 - RNA, 13 nt, Homo sapiens
auuuuucuguacu

SEQ ID NO: 2145888 - RNA, 11 nt, Homo sapiens
acuauugcaca

SEQ ID NO: 2145889 - RNA, 18 nt, Homo sapiens
cccaucccugugaaggag

SEQ ID NO: 2145890 - RNA, 12 nt, Homo sapiens
gaagcucaucuc

SEQ ID NO: 2145891 - RNA, 20 nt, Homo sapiens
aucguucauugccuuuccag

SEQ ID NO: 2145892 - RNA, 19 nt, Homo sapiens
aggaguacuccaagacaga

SEQ ID NO: 2145893 - RNA, 18 nt, Homo sapiens
agaagugggagugggaga

SEQ ID NO: 2145894 - RNA, 21 nt, Homo sapiens
ugggcucgccacaucccauga

SEQ ID NO: 2145895 - RNA, 18 nt, Homo sapiens
gcaauaucuacguguuuu

SEQ ID NO: 2145896 - RNA, 22 nt, Homo sapiens
caggaugcuggggcacuuuaaa

SEQ ID NO: 2145897 - RNA, 11 nt, Homo sapiens
caaaauacuuc

SEQ ID NO: 2145898 - RNA, 22 nt, Homo sapiens
agugguuuuucuuuucuuggac

SEQ ID NO: 2145899 - RNA, 15 nt, Homo sapiens
agcagucaauacaaa

SEQ ID NO: 2145900 - RNA, 14 nt, Homo sapiens
ggaagggggggaca

SEQ ID NO: 2145901 - RNA, 16 nt, Homo sapiens
aaauagucuuccacaa

SEQ ID NO: 2145902 - RNA, 21 nt, Homo sapiens
ccccacuccuccuccagccca

SEQ ID NO: 2145903 - RNA, 16 nt, Homo sapiens
uugcugauccaugaga

SEQ ID NO: 2145904 - RNA, 20 nt, Homo sapiens
ccacuaaagagugaaugcca

SEQ ID NO: 2145905 - RNA, 15 nt, Homo sapiens
ggcccugcugaguca

SEQ ID NO: 2145906 - RNA, 24 nt, Homo sapiens
uuagaucaaccuccaacaacgaca

SEQ ID NO: 2145907 - RNA, 23 nt, Homo sapiens
aagauuuauuaauuaaaccagac

SEQ ID NO: 2145908 - RNA, 19 nt, Homo sapiens
gcugcuguagcaacagagc

SEQ ID NO: 2145909 - RNA, 22 nt, Homo sapiens
auaagaguugagauuuugcaau

SEQ ID NO: 2145910 - RNA, 14 nt, Homo sapiens
uggaaaguguaaag

SEQ ID NO: 2145911 - RNA, 18 nt, Homo sapiens
ggcuggaugugcuuucau

SEQ ID NO: 2145912 - RNA, 16 nt, Homo sapiens
gguuugguccuugaac

SEQ ID NO: 2145913 - RNA, 15 nt, Homo sapiens
uucacucugcucuca

SEQ ID NO: 2145914 - RNA, 13 nt, Homo sapiens
aggugucauccac

SEQ ID NO: 2145915 - RNA, 15 nt, Homo sapiens
aaccucaagcugcau

SEQ ID NO: 2145916 - RNA, 21 nt, Homo sapiens
aggggugagagaccugcucag

SEQ ID NO: 2145917 - RNA, 22 nt, Homo sapiens
ucuaugagauagguacuauuau

SEQ ID NO: 2145918 - RNA, 11 nt, Homo sapiens
caagcauuaag

SEQ ID NO: 2145919 - RNA, 12 nt, Homo sapiens
ccccaccuccag

SEQ ID NO: 2145920 - RNA, 14 nt, Homo sapiens
uaugauagugcaag

SEQ ID NO: 2145921 - RNA, 13 nt, Homo sapiens
caccaugaaucuu

SEQ ID NO: 2145922 - RNA, 17 nt, Homo sapiens
caggugcgguuccucau

SEQ ID NO: 2145923 - RNA, 17 nt, Homo sapiens
cuucucuucacagucac

SEQ ID NO: 2145924 - RNA, 14 nt, Homo sapiens
ggaguaaguguaca

SEQ ID NO: 2145925 - RNA, 14 nt, Homo sapiens
auauuccuuugcca

SEQ ID NO: 2145926 - RNA, 12 nt, Homo sapiens
aacagcacuggc

SEQ ID NO: 2145927 - RNA, 16 nt, Homo sapiens
agagaaagaacuauga

SEQ ID NO: 2145928 - RNA, 16 nt, Homo sapiens
ucaagucccccaagac

SEQ ID NO: 2145929 - RNA, 17 nt, Homo sapiens
gcugguaaaaacauggg

SEQ ID NO: 2145930 - RNA, 17 nt, Homo sapiens
acucagcggucauucua

SEQ ID NO: 2145931 - RNA, 12 nt, Homo sapiens
cucucacaugca

SEQ ID NO: 2145932 - RNA, 22 nt, Homo sapiens
ucccccgacacagacucucaau

SEQ ID NO: 2145933 - RNA, 16 nt, Homo sapiens
auauaggaaaacaaua

SEQ ID NO: 2145934 - RNA, 14 nt, Homo sapiens
uaaggaagauaucu

SEQ ID NO: 2145935 - RNA, 17 nt, Homo sapiens
cugaaucgagaugucca

SEQ ID NO: 2145936 - RNA, 23 nt, Homo sapiens
guuucagaugauucuaugucuca

SEQ ID NO: 2145937 - RNA, 15 nt, Homo sapiens
gcgaccccaucugcc

SEQ ID NO: 2145938 - RNA, 15 nt, Homo sapiens
gcaggaguagcugag

SEQ ID NO: 2145939 - RNA, 17 nt, Homo sapiens
ucaaucuucaauccuug

SEQ ID NO: 2145940 - RNA, 17 nt, Homo sapiens
aguccuuuaaauuuugc

SEQ ID NO: 2145941 - RNA, 23 nt, Homo sapiens
uccuaucacugauaguguccaaa

SEQ ID NO: 2145942 - RNA, 16 nt, Homo sapiens
cuuguuuucuucacag

SEQ ID NO: 2145943 - RNA, 17 nt, Homo sapiens
gaugucuccccugccac

SEQ ID NO: 2145944 - RNA, 23 nt, Homo sapiens
aacaccugacagaaugagaccaa

SEQ ID NO: 2145945 - RNA, 14 nt, Homo sapiens
acaccaccuauucc

SEQ ID NO: 2145946 - RNA, 16 nt, Homo sapiens
ucuagaagagggguua

SEQ ID NO: 2145947 - RNA, 22 nt, Homo sapiens
aucugcuggauauuuaguucaa

SEQ ID NO: 2145948 - RNA, 14 nt, Homo sapiens
gaaaacacugugca

SEQ ID NO: 2145949 - RNA, 18 nt, Homo sapiens
ugauaaguucauacauug

SEQ ID NO: 2145950 - RNA, 13 nt, Homo sapiens
uagaauaagccuu

SEQ ID NO: 2145951 - RNA, 16 nt, Homo sapiens
uauaguucuacuccau

SEQ ID NO: 2145952 - RNA, 12 nt, Homo sapiens
uuaugugcuaua

SEQ ID NO: 2145953 - RNA, 12 nt, Homo sapiens
uaaugugcuuua

SEQ ID NO: 2145954 - RNA, 23 nt, Homo sapiens
auacugcugcgucauuacagggc

SEQ ID NO: 2145955 - RNA, 15 nt, Homo sapiens
agacucuucuugcaa

SEQ ID NO: 2145956 - RNA, 19 nt, Homo sapiens
uaaaucauggcuaagcuua

SEQ ID NO: 2145957 - RNA, 20 nt, Homo sapiens
cugugucuugcaauggcagc

SEQ ID NO: 2145958 - RNA, 16 nt, Homo sapiens
aagcaaaucuguauaa

SEQ ID NO: 2145959 - RNA, 16 nt, Homo sapiens
cugcaaguaaguauga

SEQ ID NO: 2145960 - RNA, 15 nt, Homo sapiens
guucugcacugaaaa

SEQ ID NO: 2145961 - RNA, 23 nt, Homo sapiens
uguuucuaauuugcugcugauaa

SEQ ID NO: 2145962 - RNA, 16 nt, Homo sapiens
uuugaauaacaaggaa

SEQ ID NO: 2145963 - RNA, 15 nt, Homo sapiens
cuggugagaggugca

SEQ ID NO: 2145964 - RNA, 14 nt, Homo sapiens
caaaccacuugccu

SEQ ID NO: 2145965 - RNA, 15 nt, Homo sapiens
auggggcaaacucaa

SEQ ID NO: 2145966 - RNA, 20 nt, Homo sapiens
ggcaccuuccgacaucccag

SEQ ID NO: 2145967 - RNA, 16 nt, Homo sapiens
gggcaugguagcucaa

SEQ ID NO: 2145968 - RNA, 14 nt, Homo sapiens
gauccuccaggugc

SEQ ID NO: 2145969 - RNA, 23 nt, Homo sapiens
ucuaauggcuguggcauuguuga

SEQ ID NO: 2145970 - RNA, 14 nt, Homo sapiens
uaagcacauguuua

SEQ ID NO: 2145971 - RNA, 14 nt, Homo sapiens
auuaauagccaaag

SEQ ID NO: 2145972 - RNA, 21 nt, Homo sapiens
ccuuaaagaguguggcaaaau

SEQ ID NO: 2145973 - RNA, 15 nt, Homo sapiens
ccauuuguauacuuu

SEQ ID NO: 2145974 - RNA, 16 nt, Homo sapiens
ccugcucaggugcuau

SEQ ID NO: 2145975 - RNA, 22 nt, Homo sapiens
aaacugagaaauuuacuacagu

SEQ ID NO: 2145976 - RNA, 18 nt, Homo sapiens
auuuaaccauggcacuga

SEQ ID NO: 2145977 - RNA, 19 nt, Homo sapiens
uccuacucccagacaccca

SEQ ID NO: 2145978 - RNA, 15 nt, Homo sapiens
ugacgagcagggugg

SEQ ID NO: 2145979 - RNA, 14 nt, Homo sapiens
aguguggcuucuau

SEQ ID NO: 2145980 - RNA, 22 nt, Homo sapiens
agaaagaugacaaaagaaaauu

SEQ ID NO: 2145981 - RNA, 13 nt, Homo sapiens
caaggucacaaua

SEQ ID NO: 2145982 - RNA, 17 nt, Homo sapiens
cuggaaagcuauuucag

SEQ ID NO: 2145983 - RNA, 14 nt, Homo sapiens
gccugaguccaguu

SEQ ID NO: 2145984 - RNA, 19 nt, Homo sapiens
aaaagucuacaacauagca

SEQ ID NO: 2145985 - RNA, 19 nt, Homo sapiens
uaaagcacuuugcacuuaa

SEQ ID NO: 2145986 - RNA, 18 nt, Homo sapiens
aacaauuuuuuugaaucu

SEQ ID NO: 2145987 - RNA, 19 nt, Homo sapiens
cuccugaagauagccagag

SEQ ID NO: 2145988 - RNA, 19 nt, Homo sapiens
gagaaggacaccuccuucc

SEQ ID NO: 2145989 - RNA, 21 nt, Homo sapiens
aaggggagcucuucaacauua

SEQ ID NO: 2145990 - RNA, 16 nt, Homo sapiens
aagagucaaaguaguu

SEQ ID NO: 2145991 - RNA, 16 nt, Homo sapiens
ccaaguuuccauagca

SEQ ID NO: 2145992 - RNA, 16 nt, Homo sapiens
acacuuccaccagccu

SEQ ID NO: 2145993 - RNA, 23 nt, Homo sapiens
accaaaucauccugaaucugauc

SEQ ID NO: 2145994 - RNA, 14 nt, Homo sapiens
uaauugcauauaaa

SEQ ID NO: 2145995 - RNA, 22 nt, Homo sapiens
caagcuagaaggccacauguca

SEQ ID NO: 2145996 - RNA, 22 nt, Homo sapiens
cacauuuuuuuaugcucuugaa

SEQ ID NO: 2145997 - RNA, 14 nt, Homo sapiens
uaaagcacaugccu

SEQ ID NO: 2145998 - RNA, 20 nt, Homo sapiens
auccuguaccaaaucugaca

SEQ ID NO: 2145999 - RNA, 23 nt, Homo sapiens
cucccauucacagauaccucucu

SEQ ID NO: 2146000 - RNA, 16 nt, Homo sapiens
uggcagugagauguca

SEQ ID NO: 2146001 - RNA, 21 nt, Homo sapiens
gccuauaucuucaucugugaa

SEQ ID NO: 2146002 - RNA, 14 nt, Homo sapiens
uaaauaaaacugaa

SEQ ID NO: 2146003 - RNA, 14 nt, Homo sapiens
ucaaaaacauuuca

SEQ ID NO: 2146004 - RNA, 21 nt, Homo sapiens
gaagauggauguuugucaaaa

SEQ ID NO: 2146005 - RNA, 12 nt, Homo sapiens
ccauguuugcug

SEQ ID NO: 2146006 - RNA, 18 nt, Homo sapiens
gucuggggucuccuauac

SEQ ID NO: 2146007 - RNA, 15 nt, Homo sapiens
agcugucgucugacu

SEQ ID NO: 2146008 - RNA, 14 nt, Homo sapiens
cguuucuguauaca

SEQ ID NO: 2146009 - RNA, 15 nt, Homo sapiens
cuggaauuauuuuag

SEQ ID NO: 2146010 - RNA, 16 nt, Homo sapiens
uaaaacauguuugcac

SEQ ID NO: 2146011 - RNA, 15 nt, Homo sapiens
uguaaauuucucaaa

SEQ ID NO: 2146012 - RNA, 20 nt, Homo sapiens
auuugaauuuuuuuuucaac

SEQ ID NO: 2146013 - RNA, 16 nt, Homo sapiens
agcaauguacaccaga

SEQ ID NO: 2146014 - RNA, 17 nt, Homo sapiens
aaauacccacuaacaaa

SEQ ID NO: 2146015 - RNA, 18 nt, Homo sapiens
ccucccuugggcacgugu

SEQ ID NO: 2146016 - RNA, 21 nt, Homo sapiens
cauauuuucuuuaaaagacaa

SEQ ID NO: 2146017 - RNA, 21 nt, Homo sapiens
gaugggggaaagcacaggugg

SEQ ID NO: 2146018 - RNA, 13 nt, Homo sapiens
uucaguucccaga

SEQ ID NO: 2146019 - RNA, 20 nt, Homo sapiens
aauauuuuucuguaguguga

SEQ ID NO: 2146020 - RNA, 18 nt, Homo sapiens
ugacaggcugaaagccca

SEQ ID NO: 2146021 - RNA, 17 nt, Homo sapiens
ugccuuucuucugcccu

SEQ ID NO: 2146022 - RNA, 17 nt, Homo sapiens
aaauuagcaugcugcuu

SEQ ID NO: 2146023 - RNA, 16 nt, Homo sapiens
aggccacauaccucuc

SEQ ID NO: 2146024 - RNA, 21 nt, Homo sapiens
gaacucugugcaggugcugcc

SEQ ID NO: 2146025 - RNA, 21 nt, Homo sapiens
ugccuucuaaauggcaugaca

SEQ ID NO: 2146026 - RNA, 14 nt, Homo sapiens
cccaacucuuacuc

SEQ ID NO: 2146027 - RNA, 15 nt, Homo sapiens
ugucacauaggcaaa

SEQ ID NO: 2146028 - RNA, 19 nt, Homo sapiens
ugaaaauguuuuucugcca

SEQ ID NO: 2146029 - RNA, 15 nt, Homo sapiens
cuucuucuucuaaaa

SEQ ID NO: 2146030 - RNA, 15 nt, Homo sapiens
uccaucaaaccucac

SEQ ID NO: 2146031 - RNA, 18 nt, Homo sapiens
aguaaaacaaacaauacc

SEQ ID NO: 2146032 - RNA, 18 nt, Homo sapiens
ucugaugccaauacuagu

SEQ ID NO: 2146033 - RNA, 23 nt, Homo sapiens
ggcaauaaucuuuuaacaguguu

SEQ ID NO: 2146034 - RNA, 16 nt, Homo sapiens
aaaccaagugcuuaua

SEQ ID NO: 2146035 - RNA, 21 nt, Homo sapiens
gaugugggccaaguccacugu

SEQ ID NO: 2146036 - RNA, 21 nt, Homo sapiens
ccacugacccuggucaccaga

SEQ ID NO: 2146037 - RNA, 16 nt, Homo sapiens
gauguaaaugccacaa

SEQ ID NO: 2146038 - RNA, 19 nt, Homo sapiens
gcugccucccuuucauaca

SEQ ID NO: 2146039 - RNA, 13 nt, Homo sapiens
caaaacuguacug

SEQ ID NO: 2146040 - RNA, 20 nt, Homo sapiens
uaccuacauuuuaaugcacc

SEQ ID NO: 2146041 - RNA, 13 nt, Homo sapiens
caccacaaacugu

SEQ ID NO: 2146042 - RNA, 18 nt, Homo sapiens
uauuacaguccuucaaga

SEQ ID NO: 2146043 - RNA, 18 nt, Homo sapiens
uuccauuuacuugaucau

SEQ ID NO: 2146044 - RNA, 17 nt, Homo sapiens
uaaauaauuuuacaugu

SEQ ID NO: 2146045 - RNA, 21 nt, Homo sapiens
uuuucgugcuuccuccugaca

SEQ ID NO: 2146046 - RNA, 21 nt, Homo sapiens
ccucucucucccaggucccag

SEQ ID NO: 2146047 - RNA, 21 nt, Homo sapiens
uccaaagggcauggguuuuau

SEQ ID NO: 2146048 - RNA, 12 nt, Homo sapiens
ucauguucucau

SEQ ID NO: 2146049 - RNA, 14 nt, Homo sapiens
acccggggcagcug

SEQ ID NO: 2146050 - RNA, 15 nt, Homo sapiens
ccauucuugcauuga

SEQ ID NO: 2146051 - RNA, 16 nt, Homo sapiens
aaacauucuuuuccac

SEQ ID NO: 2146052 - RNA, 18 nt, Homo sapiens
ugguguaugacaguuaga

SEQ ID NO: 2146053 - RNA, 22 nt, Homo sapiens
caugagguuucaucauguuggc

SEQ ID NO: 2146054 - RNA, 19 nt, Homo sapiens
cuauuauggaaaacugugu

SEQ ID NO: 2146055 - RNA, 17 nt, Homo sapiens
agcaguaccagugugcu

SEQ ID NO: 2146056 - RNA, 13 nt, Homo sapiens
cuuuaauguugcc

SEQ ID NO: 2146057 - RNA, 20 nt, Homo sapiens
uuccuaaccccuaaggcaac

SEQ ID NO: 2146058 - RNA, 23 nt, Homo sapiens
gugugaaguguaguggcauccau

SEQ ID NO: 2146059 - RNA, 12 nt, Homo sapiens
guauugucuacc

SEQ ID NO: 2146060 - RNA, 21 nt, Homo sapiens
uacucccccaccacucaggcc

SEQ ID NO: 2146061 - RNA, 18 nt, Homo sapiens
ggagccaucagcugggug

SEQ ID NO: 2146062 - RNA, 16 nt, Homo sapiens
ucgagggacuuuaugu

SEQ ID NO: 2146063 - RNA, 15 nt, Homo sapiens
gcaaggcacaaguca

SEQ ID NO: 2146064 - RNA, 18 nt, Homo sapiens
ugaaaucccaucucuaca

SEQ ID NO: 2146065 - RNA, 17 nt, Homo sapiens
uugucuuacuguugcau

SEQ ID NO: 2146066 - RNA, 14 nt, Homo sapiens
cagaaaaugaauga

SEQ ID NO: 2146067 - RNA, 13 nt, Homo sapiens
uguguaacagcuc

SEQ ID NO: 2146068 - RNA, 16 nt, Homo sapiens
ugaaaaauuacagcuu

SEQ ID NO: 2146069 - RNA, 18 nt, Homo sapiens
gaaggccgggcgcagugg

SEQ ID NO: 2146070 - RNA, 13 nt, Homo sapiens
agucaucaaagau

SEQ ID NO: 2146071 - RNA, 20 nt, Homo sapiens
cuuguaauaccugauugauc

SEQ ID NO: 2146072 - RNA, 16 nt, Homo sapiens
ccugccccugacugug

SEQ ID NO: 2146073 - RNA, 23 nt, Homo sapiens
aucucaauaucugggucaaucca

SEQ ID NO: 2146074 - RNA, 15 nt, Homo sapiens
caaaaggccugugau

SEQ ID NO: 2146075 - RNA, 22 nt, Homo sapiens
cuuccagaccugcuuccugaaa

SEQ ID NO: 2146076 - RNA, 13 nt, Homo sapiens
gaaacaacucuuu

SEQ ID NO: 2146077 - RNA, 16 nt, Homo sapiens
auggagugaccauagc

SEQ ID NO: 2146078 - RNA, 18 nt, Homo sapiens
uccaugugugugcaagug

SEQ ID NO: 2146079 - RNA, 20 nt, Homo sapiens
augcacauuggaagcuccca

SEQ ID NO: 2146080 - RNA, 18 nt, Homo sapiens
agaagaaggaaauugaau

SEQ ID NO: 2146081 - RNA, 18 nt, Homo sapiens
uacacagaaaugcugcug

SEQ ID NO: 2146082 - RNA, 16 nt, Homo sapiens
cuuccucuccacagga

SEQ ID NO: 2146083 - RNA, 11 nt, Homo sapiens
ugaaugcucaa

SEQ ID NO: 2146084 - RNA, 21 nt, Homo sapiens
caguguuuuuguaaagugugg

SEQ ID NO: 2146085 - RNA, 17 nt, Homo sapiens
caaauacucauguguau

SEQ ID NO: 2146086 - RNA, 21 nt, Homo sapiens
uccagauaccaagcaugugga

SEQ ID NO: 2146087 - RNA, 23 nt, Homo sapiens
aauacuaccucugaauguuacaa

SEQ ID NO: 2146088 - RNA, 18 nt, Homo sapiens
uauauaauccauuccucu

SEQ ID NO: 2146089 - RNA, 19 nt, Homo sapiens
ccacugucuagagcaacuu

SEQ ID NO: 2146090 - RNA, 15 nt, Homo sapiens
auagaggaaagggau

SEQ ID NO: 2146091 - RNA, 18 nt, Homo sapiens
gggccucaucugcuccua

SEQ ID NO: 2146092 - RNA, 17 nt, Homo sapiens
ccccagagaugucauca

SEQ ID NO: 2146093 - RNA, 15 nt, Homo sapiens
cuggcugacuggcca

SEQ ID NO: 2146094 - RNA, 15 nt, Homo sapiens
auuugugaauuugca

SEQ ID NO: 2146095 - RNA, 14 nt, Homo sapiens
gaaauaauucaaac

SEQ ID NO: 2146096 - RNA, 16 nt, Homo sapiens
acucuagucaaugaca

SEQ ID NO: 2146097 - RNA, 19 nt, Homo sapiens
auuaugugacauuuuacau

SEQ ID NO: 2146098 - RNA, 16 nt, Homo sapiens
aagaguuaauagcuau

SEQ ID NO: 2146099 - RNA, 20 nt, Homo sapiens
aacagaaguaucaagccaug

SEQ ID NO: 2146100 - RNA, 22 nt, Homo sapiens
gcaggggaagcucucacucugu

SEQ ID NO: 2146101 - RNA, 18 nt, Homo sapiens
cugaacugcaacacugga

SEQ ID NO: 2146102 - RNA, 18 nt, Homo sapiens
ucccagaaucaaagcaau

SEQ ID NO: 2146103 - RNA, 16 nt, Homo sapiens
aacuucgugcucaggu

SEQ ID NO: 2146104 - RNA, 14 nt, Homo sapiens
uauucauuggucua

SEQ ID NO: 2146105 - RNA, 21 nt, Homo sapiens
gcagcaugagacuuucugcug

SEQ ID NO: 2146106 - RNA, 22 nt, Homo sapiens
ccaucucuacuaaaaauacaaa

SEQ ID NO: 2146107 - RNA, 16 nt, Homo sapiens
gagggcaggugcccuc

SEQ ID NO: 2146108 - RNA, 21 nt, Homo sapiens
gaaucagccuacaggccucac

SEQ ID NO: 2146109 - RNA, 16 nt, Homo sapiens
cuuauaccaugagugu

SEQ ID NO: 2146110 - RNA, 20 nt, Homo sapiens
ugaagacugcacaggugaca

SEQ ID NO: 2146111 - RNA, 15 nt, Homo sapiens
auuaauucuucaccu

SEQ ID NO: 2146112 - RNA, 18 nt, Homo sapiens
ccugccuguucuccagau

SEQ ID NO: 2146113 - RNA, 15 nt, Homo sapiens
agcuuaaguguaaau

SEQ ID NO: 2146114 - RNA, 16 nt, Homo sapiens
aggauauuuucuucca

SEQ ID NO: 2146115 - RNA, 21 nt, Homo sapiens
acucuuaucugggugccuuaa

SEQ ID NO: 2146116 - RNA, 20 nt, Homo sapiens
uucucuccagagcuccugag

SEQ ID NO: 2146117 - RNA, 17 nt, Homo sapiens
ucucaaugaagccagcu

SEQ ID NO: 2146118 - RNA, 21 nt, Homo sapiens
gcaugugcggcggcuaccuga

SEQ ID NO: 2146119 - RNA, 21 nt, Homo sapiens
aacuacucagcucuccugcug

SEQ ID NO: 2146120 - RNA, 20 nt, Homo sapiens
gacaaaccacuguacauaua

SEQ ID NO: 2146121 - RNA, 20 nt, Homo sapiens
gauuaugaagugacucucac

SEQ ID NO: 2146122 - RNA, 14 nt, Homo sapiens
cuugguucuuucag

SEQ ID NO: 2146123 - RNA, 13 nt, Homo sapiens
uuuccacucugga

SEQ ID NO: 2146124 - RNA, 14 nt, Homo sapiens
gcagggagcacugu

SEQ ID NO: 2146125 - RNA, 19 nt, Homo sapiens
auguuucuggacauucucu

SEQ ID NO: 2146126 - RNA, 13 nt, Homo sapiens
cagcuuuuccuca

SEQ ID NO: 2146127 - RNA, 19 nt, Homo sapiens
auaaaaucugugaauuaaa

SEQ ID NO: 2146128 - RNA, 13 nt, Homo sapiens
cauuagcucucau

SEQ ID NO: 2146129 - RNA, 18 nt, Homo sapiens
cccgugcccuguuuccaa

SEQ ID NO: 2146130 - RNA, 14 nt, Homo sapiens
cucagcggugccac

SEQ ID NO: 2146131 - RNA, 13 nt, Homo sapiens
cuaguuaaucaua

SEQ ID NO: 2146132 - RNA, 14 nt, Homo sapiens
ucaccuuaucugga

SEQ ID NO: 2146133 - RNA, 19 nt, Homo sapiens
gacgccucucccugcaguc

SEQ ID NO: 2146134 - RNA, 23 nt, Homo sapiens
ccacauaggaaaaugccaugaaa

SEQ ID NO: 2146135 - RNA, 17 nt, Homo sapiens
cggcaugugaauucugu

SEQ ID NO: 2146136 - RNA, 23 nt, Homo sapiens
aagugaagaaaagugaaugcuca

SEQ ID NO: 2146137 - RNA, 18 nt, Homo sapiens
aucauuaaaauauauguu

SEQ ID NO: 2146138 - RNA, 17 nt, Homo sapiens
caaggaagccaaaguuu

SEQ ID NO: 2146139 - RNA, 14 nt, Homo sapiens
uuaaagcuguacac

SEQ ID NO: 2146140 - RNA, 14 nt, Homo sapiens
uggcaccugggaag

SEQ ID NO: 2146141 - RNA, 18 nt, Homo sapiens
aauucucacaucccucua

SEQ ID NO: 2146142 - RNA, 21 nt, Homo sapiens
ggauaaguuucuauucuguca

SEQ ID NO: 2146143 - RNA, 21 nt, Homo sapiens
acaugcugaaaaauauagccu

SEQ ID NO: 2146144 - RNA, 13 nt, Homo sapiens
cagguacuaugca

SEQ ID NO: 2146145 - RNA, 22 nt, Homo sapiens
uguguuugauggaucaguguga

SEQ ID NO: 2146146 - RNA, 17 nt, Homo sapiens
uucaaauuuuaucucca

SEQ ID NO: 2146147 - RNA, 17 nt, Homo sapiens
gcccaacuccaccagau

SEQ ID NO: 2146148 - RNA, 18 nt, Homo sapiens
augauguuaguaacuuuu

SEQ ID NO: 2146149 - RNA, 20 nt, Homo sapiens
ugacaacugugaagccaccc

SEQ ID NO: 2146150 - RNA, 15 nt, Homo sapiens
uacccugaucuggac

SEQ ID NO: 2146151 - RNA, 14 nt, Homo sapiens
gcucuacaucuucu

SEQ ID NO: 2146152 - RNA, 20 nt, Homo sapiens
cagaggcuaauucaguguca

SEQ ID NO: 2146153 - RNA, 12 nt, Homo sapiens
aguagauaagga

SEQ ID NO: 2146154 - RNA, 13 nt, Homo sapiens
aaguucccuccau

SEQ ID NO: 2146155 - RNA, 15 nt, Homo sapiens
ccggccaccugagug

SEQ ID NO: 2146156 - RNA, 22 nt, Homo sapiens
cuuaaguauuauauaaacugug

SEQ ID NO: 2146157 - RNA, 22 nt, Homo sapiens
cuugugauuucuuaugccuguc

SEQ ID NO: 2146158 - RNA, 20 nt, Homo sapiens
ucaucucaggccucccucaa

SEQ ID NO: 2146159 - RNA, 17 nt, Homo sapiens
uuauuauguacuauuca

SEQ ID NO: 2146160 - RNA, 15 nt, Homo sapiens
aauaucaauggugcu

SEQ ID NO: 2146161 - RNA, 20 nt, Homo sapiens
uaugaaaaccguaaagugcc

SEQ ID NO: 2146162 - RNA, 19 nt, Homo sapiens
uaugaaugagaaugugcca

SEQ ID NO: 2146163 - RNA, 20 nt, Homo sapiens
cugguccuucugaccccacu

SEQ ID NO: 2146164 - RNA, 19 nt, Homo sapiens
uggaccuaggguggccuga

SEQ ID NO: 2146165 - RNA, 14 nt, Homo sapiens
acuggcccucuagc

SEQ ID NO: 2146166 - RNA, 14 nt, Homo sapiens
uaagaaccaaaaaa

SEQ ID NO: 2146167 - RNA, 15 nt, Homo sapiens
uuaaagguucacagg

SEQ ID NO: 2146168 - RNA, 11 nt, Homo sapiens
ucacagaggaa

SEQ ID NO: 2146169 - RNA, 23 nt, Homo sapiens
uauggaagaguuaaaacauuucu

SEQ ID NO: 2146170 - RNA, 20 nt, Homo sapiens
gcaaccuaauuguagcaucu

SEQ ID NO: 2146171 - RNA, 21 nt, Homo sapiens
aaaucauacuuuuucuuugaa

SEQ ID NO: 2146172 - RNA, 21 nt, Homo sapiens
cccccaaguucaagugauucu

SEQ ID NO: 2146173 - RNA, 14 nt, Homo sapiens
uuaagcagaacaaa

SEQ ID NO: 2146174 - RNA, 18 nt, Homo sapiens
cuguugcaaacucagugc

SEQ ID NO: 2146175 - RNA, 20 nt, Homo sapiens
uaaaaucucacgcugccauu

SEQ ID NO: 2146176 - RNA, 19 nt, Homo sapiens
ugaguuaggcugagccaca

SEQ ID NO: 2146177 - RNA, 13 nt, Homo sapiens
caauuucauucaa

SEQ ID NO: 2146178 - RNA, 14 nt, Homo sapiens
gcauugacaucaca

SEQ ID NO: 2146179 - RNA, 23 nt, Homo sapiens
uucucuacagaggugaaauucca

SEQ ID NO: 2146180 - RNA, 17 nt, Homo sapiens
augguauuaguugacca

SEQ ID NO: 2146181 - RNA, 22 nt, Homo sapiens
aaaguguucuguguccuucuac

SEQ ID NO: 2146182 - RNA, 20 nt, Homo sapiens
aauggugauuuaaaaacuug

SEQ ID NO: 2146183 - RNA, 12 nt, Homo sapiens
uuuacugaggaa

SEQ ID NO: 2146184 - RNA, 22 nt, Homo sapiens
caaaggcaugcagucaugagaa

SEQ ID NO: 2146185 - RNA, 22 nt, Homo sapiens
caugcgaugacacuuguacaau

SEQ ID NO: 2146186 - RNA, 20 nt, Homo sapiens
acuuggugggaccaugaaca

SEQ ID NO: 2146187 - RNA, 20 nt, Homo sapiens
uuauuuaaaaagaacucuga

SEQ ID NO: 2146188 - RNA, 15 nt, Homo sapiens
augacuucugcugaa

SEQ ID NO: 2146189 - RNA, 20 nt, Homo sapiens
gcaucauaagcugauuugau

SEQ ID NO: 2146190 - RNA, 20 nt, Homo sapiens
ccaugaggcaaugucaggaa

SEQ ID NO: 2146191 - RNA, 22 nt, Homo sapiens
uaauacuagauugaucuaaggg

SEQ ID NO: 2146192 - RNA, 18 nt, Homo sapiens
uaaaauuugauacagguu

SEQ ID NO: 2146193 - RNA, 14 nt, Homo sapiens
aaaaaugaacagug

SEQ ID NO: 2146194 - RNA, 14 nt, Homo sapiens
gucauaaacagcau

SEQ ID NO: 2146195 - RNA, 20 nt, Homo sapiens
ggaaaaagaaagaaacacuc

SEQ ID NO: 2146196 - RNA, 15 nt, Homo sapiens
ugccagcucagguga

SEQ ID NO: 2146197 - RNA, 23 nt, Homo sapiens
cuucaguacacuugguguacugg

SEQ ID NO: 2146198 - RNA, 19 nt, Homo sapiens
agugauucuuccaccucag

SEQ ID NO: 2146199 - RNA, 13 nt, Homo sapiens
agacuagcaggcu

SEQ ID NO: 2146200 - RNA, 13 nt, Homo sapiens
aaagaagcaagga

SEQ ID NO: 2146201 - RNA, 14 nt, Homo sapiens
acgucacugcacuc

SEQ ID NO: 2146202 - RNA, 14 nt, Homo sapiens
ugcaguaguauuua

SEQ ID NO: 2146203 - RNA, 19 nt, Homo sapiens
ccaaaauauuuuuugcaag

SEQ ID NO: 2146204 - RNA, 21 nt, Homo sapiens
uuucauagcgaguuuucugac

SEQ ID NO: 2146205 - RNA, 21 nt, Homo sapiens
uggaccaugcugucuggcaca

SEQ ID NO: 2146206 - RNA, 19 nt, Homo sapiens
gugaaauggccacuacuuu

SEQ ID NO: 2146207 - RNA, 18 nt, Homo sapiens
acagcaucaggugggaaa

SEQ ID NO: 2146208 - RNA, 15 nt, Homo sapiens
uaugaugggggaaaa

SEQ ID NO: 2146209 - RNA, 20 nt, Homo sapiens
gggaagacuuuaaaccaccu

SEQ ID NO: 2146210 - RNA, 17 nt, Homo sapiens
guauugauugaaaaaag

SEQ ID NO: 2146211 - RNA, 14 nt, Homo sapiens
ugaaugcgaggaaa

SEQ ID NO: 2146212 - RNA, 16 nt, Homo sapiens
cuuaagauuugcucau

SEQ ID NO: 2146213 - RNA, 15 nt, Homo sapiens
caggaguccaagacc

SEQ ID NO: 2146214 - RNA, 19 nt, Homo sapiens
acaagccuucagccacagg

SEQ ID NO: 2146215 - RNA, 15 nt, Homo sapiens
uagacuccucaggag

SEQ ID NO: 2146216 - RNA, 13 nt, Homo sapiens
ccggcaucuggcc

SEQ ID NO: 2146217 - RNA, 21 nt, Homo sapiens
agagcacauuuaguccaauga

SEQ ID NO: 2146218 - RNA, 21 nt, Homo sapiens
cuucccugggggucccaggau

SEQ ID NO: 2146219 - RNA, 15 nt, Homo sapiens
gcccggacugaccaa

SEQ ID NO: 2146220 - RNA, 12 nt, Homo sapiens
uauauccuguga

SEQ ID NO: 2146221 - RNA, 15 nt, Homo sapiens
auaauguucugggaa

SEQ ID NO: 2146222 - RNA, 16 nt, Homo sapiens
cuauucagaacuugua

SEQ ID NO: 2146223 - RNA, 12 nt, Homo sapiens
uuucuacccagc

SEQ ID NO: 2146224 - RNA, 13 nt, Homo sapiens
gcugugcacagac

SEQ ID NO: 2146225 - RNA, 15 nt, Homo sapiens
agcuggggcuucuuu

SEQ ID NO: 2146226 - RNA, 13 nt, Homo sapiens
auggaguagccau

SEQ ID NO: 2146227 - RNA, 22 nt, Homo sapiens
cuaggcugggugcccacagccc

SEQ ID NO: 2146228 - RNA, 17 nt, Homo sapiens
caugaaaauggaguuau

SEQ ID NO: 2146229 - RNA, 21 nt, Homo sapiens
aaugaaaaaaaguacauguau

SEQ ID NO: 2146230 - RNA, 18 nt, Homo sapiens
ucuugaguuccucugcag

SEQ ID NO: 2146231 - RNA, 16 nt, Homo sapiens
cucaguuaaaucuccu

SEQ ID NO: 2146232 - RNA, 23 nt, Homo sapiens
gaauuaucccccaaaaugcauuu

SEQ ID NO: 2146233 - RNA, 23 nt, Homo sapiens
uucuacuucuggaagucaucuca

SEQ ID NO: 2146234 - RNA, 16 nt, Homo sapiens
ugugccuugggucuca

SEQ ID NO: 2146235 - RNA, 19 nt, Homo sapiens
cuggaggcuccucuaggcc

SEQ ID NO: 2146236 - RNA, 22 nt, Homo sapiens
ugggaucuuucugacacacuua

SEQ ID NO: 2146237 - RNA, 14 nt, Homo sapiens
uguauauguauuau

SEQ ID NO: 2146238 - RNA, 13 nt, Homo sapiens
ugagaugccuguu

SEQ ID NO: 2146239 - RNA, 13 nt, Homo sapiens
cuguuugcugaga

SEQ ID NO: 2146240 - RNA, 19 nt, Homo sapiens
agaauuucaauaucaagac

SEQ ID NO: 2146241 - RNA, 19 nt, Homo sapiens
uuaaacaagucaauucugu

SEQ ID NO: 2146242 - RNA, 23 nt, Homo sapiens
agcagcuccacaaccaccuccag

SEQ ID NO: 2146243 - RNA, 15 nt, Homo sapiens
cucucuucuggaauc

SEQ ID NO: 2146244 - RNA, 16 nt, Homo sapiens
gaaaggaacacuggcu

SEQ ID NO: 2146245 - RNA, 15 nt, Homo sapiens
acugcuguacccaga

SEQ ID NO: 2146246 - RNA, 19 nt, Homo sapiens
agugggugaauaauacagu

SEQ ID NO: 2146247 - RNA, 20 nt, Homo sapiens
uucagaggggaggcucagga

SEQ ID NO: 2146248 - RNA, 15 nt, Homo sapiens
ucacaucucagggaa

SEQ ID NO: 2146249 - RNA, 18 nt, Homo sapiens
uacagcuguccacacuga

SEQ ID NO: 2146250 - RNA, 15 nt, Homo sapiens
aucaguuaauggcuc

SEQ ID NO: 2146251 - RNA, 21 nt, Homo sapiens
ugcauaauucuaagucuucca

SEQ ID NO: 2146252 - RNA, 22 nt, Homo sapiens
aaaagugaucuguccccucucc

SEQ ID NO: 2146253 - RNA, 17 nt, Homo sapiens
cuuuuucaucaaaaccu

SEQ ID NO: 2146254 - RNA, 16 nt, Homo sapiens
uucacaucuaaccuca

SEQ ID NO: 2146255 - RNA, 21 nt, Homo sapiens
cuuacguccuuccacuuccaa

SEQ ID NO: 2146256 - RNA, 19 nt, Homo sapiens
guuguguuaacaaugcagu

SEQ ID NO: 2146257 - RNA, 17 nt, Homo sapiens
uuuguugacauuagucu

SEQ ID NO: 2146258 - RNA, 17 nt, Homo sapiens
gaacagccgcucacaau

SEQ ID NO: 2146259 - RNA, 23 nt, Homo sapiens
aaaaauagauaaacuauacacuu

SEQ ID NO: 2146260 - RNA, 18 nt, Homo sapiens
uacauauugucacugaca

SEQ ID NO: 2146261 - RNA, 14 nt, Homo sapiens
ccacccccauggaa

SEQ ID NO: 2146262 - RNA, 13 nt, Homo sapiens
uuggaagugcaga

SEQ ID NO: 2146263 - RNA, 18 nt, Homo sapiens
caucgauauguauaucau

SEQ ID NO: 2146264 - RNA, 23 nt, Homo sapiens
cuguguuacugcuuugcaaagac

SEQ ID NO: 2146265 - RNA, 19 nt, Homo sapiens
gagaaucaacauuucucaa

SEQ ID NO: 2146266 - RNA, 23 nt, Homo sapiens
uaaugucuuuaaaaguauccaga

SEQ ID NO: 2146267 - RNA, 24 nt, Homo sapiens
agacaagugacuguaucuguguag

SEQ ID NO: 2146268 - RNA, 16 nt, Homo sapiens
acaccuguguccaaga

SEQ ID NO: 2146269 - RNA, 17 nt, Homo sapiens
auuucucugcucacaga

SEQ ID NO: 2146270 - RNA, 23 nt, Homo sapiens
auuaaaacucauuuuuguuuuca

SEQ ID NO: 2146271 - RNA, 13 nt, Homo sapiens
gcagggcucugau

SEQ ID NO: 2146272 - RNA, 13 nt, Homo sapiens
ccagugcugugag

SEQ ID NO: 2146273 - RNA, 17 nt, Homo sapiens
uaaaaguguccauugaa

SEQ ID NO: 2146274 - RNA, 16 nt, Homo sapiens
ucucuuccuuacaggu

SEQ ID NO: 2146275 - RNA, 15 nt, Homo sapiens
augagcgaaauuguc

SEQ ID NO: 2146276 - RNA, 19 nt, Homo sapiens
ucuuuugggggcuggggcu

SEQ ID NO: 2146277 - RNA, 18 nt, Homo sapiens
uguuaaaauacaguauau

SEQ ID NO: 2146278 - RNA, 14 nt, Homo sapiens
aaaguuucagagaa

SEQ ID NO: 2146279 - RNA, 19 nt, Homo sapiens
aaaacucaguaagaauuau

SEQ ID NO: 2146280 - RNA, 17 nt, Homo sapiens
aaugaaucuuacuccuu

SEQ ID NO: 2146281 - RNA, 16 nt, Homo sapiens
cugcagaaacaguacu

SEQ ID NO: 2146282 - RNA, 21 nt, Homo sapiens
auucuuaacuuauuaccucag

SEQ ID NO: 2146283 - RNA, 21 nt, Homo sapiens
aauguaugugcucuuagcaaa

SEQ ID NO: 2146284 - RNA, 19 nt, Homo sapiens
cuuucagcugcagcuggga

SEQ ID NO: 2146285 - RNA, 17 nt, Homo sapiens
ugaacuggagcugcuaa

SEQ ID NO: 2146286 - RNA, 13 nt, Homo sapiens
aguaucagaauug

SEQ ID NO: 2146287 - RNA, 22 nt, Homo sapiens
uaaaugcuacugaaacuuaccu

SEQ ID NO: 2146288 - RNA, 22 nt, Homo sapiens
gccgagaacaccgagcacugaa

SEQ ID NO: 2146289 - RNA, 19 nt, Homo sapiens
gaagcuccgugagccucag

SEQ ID NO: 2146290 - RNA, 23 nt, Homo sapiens
gcccagggcugcgucugcaaagg

SEQ ID NO: 2146291 - RNA, 17 nt, Homo sapiens
caccgcugagcagugac

SEQ ID NO: 2146292 - RNA, 13 nt, Homo sapiens
gcacacacugacc

SEQ ID NO: 2146293 - RNA, 13 nt, Homo sapiens
gauuuuuugccca

SEQ ID NO: 2146294 - RNA, 22 nt, Homo sapiens
ugucaagcaauggggaauacaa

SEQ ID NO: 2146295 - RNA, 13 nt, Homo sapiens
caacaucauucca

SEQ ID NO: 2146296 - RNA, 13 nt, Homo sapiens
uaaaaucacucaa

SEQ ID NO: 2146297 - RNA, 20 nt, Homo sapiens
gaagagaccuuggcugcuca

SEQ ID NO: 2146298 - RNA, 21 nt, Homo sapiens
agauuaaucuaccuugcagug

SEQ ID NO: 2146299 - RNA, 18 nt, Homo sapiens
aucaaaugaaacagggaa

SEQ ID NO: 2146300 - RNA, 16 nt, Homo sapiens
ugugaaauaucaucac

SEQ ID NO: 2146301 - RNA, 20 nt, Homo sapiens
gcugcauugaaaagagcuga

SEQ ID NO: 2146302 - RNA, 18 nt, Homo sapiens
cagggauuaggagcagcu

SEQ ID NO: 2146303 - RNA, 16 nt, Homo sapiens
cuuugccaucggaacu

SEQ ID NO: 2146304 - RNA, 17 nt, Homo sapiens
ucgauaaacuaacuacu

SEQ ID NO: 2146305 - RNA, 14 nt, Homo sapiens
cuuggugguggaug

SEQ ID NO: 2146306 - RNA, 23 nt, Homo sapiens
gggugcugcuguaccacacagcc

SEQ ID NO: 2146307 - RNA, 13 nt, Homo sapiens
ucuugucucuggu

SEQ ID NO: 2146308 - RNA, 17 nt, Homo sapiens
ccagauuacacuccagc

SEQ ID NO: 2146309 - RNA, 21 nt, Homo sapiens
cagaaggggacugccaccucc

SEQ ID NO: 2146310 - RNA, 23 nt, Homo sapiens
ucugacuuuacacucggcuuugg

SEQ ID NO: 2146311 - RNA, 22 nt, Homo sapiens
uagugcaacuguuuugauacug

SEQ ID NO: 2146312 - RNA, 22 nt, Homo sapiens
caacucucuccuguauaaucuc

SEQ ID NO: 2146313 - RNA, 10 nt, Homo sapiens
aggagccauu

SEQ ID NO: 2146314 - RNA, 18 nt, Homo sapiens
gaugugaaaauauacuug

SEQ ID NO: 2146315 - RNA, 14 nt, Homo sapiens
cacauuaacauuuu

SEQ ID NO: 2146316 - RNA, 14 nt, Homo sapiens
gcuuggaagccagg

SEQ ID NO: 2146317 - RNA, 14 nt, Homo sapiens
gcucccacagaaca

SEQ ID NO: 2146318 - RNA, 19 nt, Homo sapiens
aacuacuguuaacacugcu

SEQ ID NO: 2146319 - RNA, 17 nt, Homo sapiens
cccagcaccugcuccca

SEQ ID NO: 2146320 - RNA, 17 nt, Homo sapiens
ggaaaauuggacauuaa

SEQ ID NO: 2146321 - RNA, 13 nt, Homo sapiens
agugugaguguga

SEQ ID NO: 2146322 - RNA, 13 nt, Homo sapiens
ugauuuguauuaa

SEQ ID NO: 2146323 - RNA, 14 nt, Homo sapiens
auuaaguauuacug

SEQ ID NO: 2146324 - RNA, 22 nt, Homo sapiens
ggaccugccccggaccuaccuc

SEQ ID NO: 2146325 - RNA, 23 nt, Homo sapiens
ggaggugccgguaccagccugac

SEQ ID NO: 2146326 - RNA, 23 nt, Homo sapiens
auucaggucccaguugcugucac

SEQ ID NO: 2146327 - RNA, 18 nt, Homo sapiens
auuaacgguggugaaaag

SEQ ID NO: 2146328 - RNA, 23 nt, Homo sapiens
gaaucccagauaugguugcacaa

SEQ ID NO: 2146329 - RNA, 19 nt, Homo sapiens
uugcuagagcuaacagaca

SEQ ID NO: 2146330 - RNA, 18 nt, Homo sapiens
gaccccugucucccaaaa

SEQ ID NO: 2146331 - RNA, 19 nt, Homo sapiens
gugcccacggagccuaccc

SEQ ID NO: 2146332 - RNA, 17 nt, Homo sapiens
aaccaaagacuacauau

SEQ ID NO: 2146333 - RNA, 21 nt, Homo sapiens
auaauagguauauagaacaca

SEQ ID NO: 2146334 - RNA, 16 nt, Homo sapiens
ugaccagccacucaaa

SEQ ID NO: 2146335 - RNA, 21 nt, Homo sapiens
caccagcguuggguuugcuca

SEQ ID NO: 2146336 - RNA, 20 nt, Homo sapiens
agcuaauaaaauaucauuca

SEQ ID NO: 2146337 - RNA, 23 nt, Homo sapiens
auuuaucagaaauuauacuauau

SEQ ID NO: 2146338 - RNA, 17 nt, Homo sapiens
uaaacaaaaaacuauca

SEQ ID NO: 2146339 - RNA, 19 nt, Homo sapiens
aaguauugcaucuguauaa

SEQ ID NO: 2146340 - RNA, 16 nt, Homo sapiens
cagcuccccuucugaa

SEQ ID NO: 2146341 - RNA, 15 nt, Homo sapiens
aaacuuugcuucucc

SEQ ID NO: 2146342 - RNA, 15 nt, Homo sapiens
acugcacccaugaga

SEQ ID NO: 2146343 - RNA, 16 nt, Homo sapiens
caaaaucaagccugau

SEQ ID NO: 2146344 - RNA, 22 nt, Homo sapiens
acuuagcuuuugaugucuccaa

SEQ ID NO: 2146345 - RNA, 13 nt, Homo sapiens
caaauggcacugc

SEQ ID NO: 2146346 - RNA, 16 nt, Homo sapiens
ucacagcaugugcaau

SEQ ID NO: 2146347 - RNA, 20 nt, Homo sapiens
ucccagacucccaccccagg

SEQ ID NO: 2146348 - RNA, 18 nt, Homo sapiens
uucagguccaggcugugu

SEQ ID NO: 2146349 - RNA, 23 nt, Homo sapiens
cagggugaggugcuugcccccau

SEQ ID NO: 2146350 - RNA, 15 nt, Homo sapiens
uagaaaugucuaugu

SEQ ID NO: 2146351 - RNA, 19 nt, Homo sapiens
ggcugaaggaaaccagugc

SEQ ID NO: 2146352 - RNA, 17 nt, Homo sapiens
cagaccauugucuucca

SEQ ID NO: 2146353 - RNA, 16 nt, Homo sapiens
uccaaacuagauucau

SEQ ID NO: 2146354 - RNA, 15 nt, Homo sapiens
agcuagauacuggaa

SEQ ID NO: 2146355 - RNA, 19 nt, Homo sapiens
uuugcuguggccuucccgg

SEQ ID NO: 2146356 - RNA, 11 nt, Homo sapiens
auauuugccac

SEQ ID NO: 2146357 - RNA, 23 nt, Homo sapiens
gagaauuuccaaaacuuuaauga

SEQ ID NO: 2146358 - RNA, 17 nt, Homo sapiens
cauuggaacaacugaua

SEQ ID NO: 2146359 - RNA, 14 nt, Homo sapiens
cagaucccagcuca

SEQ ID NO: 2146360 - RNA, 23 nt, Homo sapiens
uuagcaguggcuggugcccauga

SEQ ID NO: 2146361 - RNA, 15 nt, Homo sapiens
cauuuuucuacugcu

SEQ ID NO: 2146362 - RNA, 22 nt, Homo sapiens
cauuuucuauaagaaaaaggaa

SEQ ID NO: 2146363 - RNA, 18 nt, Homo sapiens
agaacugucauguaaaca

SEQ ID NO: 2146364 - RNA, 13 nt, Homo sapiens
aauugaacuacuu

SEQ ID NO: 2146365 - RNA, 13 nt, Homo sapiens
agcauaacuguag

SEQ ID NO: 2146366 - RNA, 18 nt, Homo sapiens
uaccagguccauuuugcc

SEQ ID NO: 2146367 - RNA, 13 nt, Homo sapiens
aguguuugucaua

SEQ ID NO: 2146368 - RNA, 17 nt, Homo sapiens
ucuccccuucucuguau

SEQ ID NO: 2146369 - RNA, 14 nt, Homo sapiens
cuuaaggucuccaa

SEQ ID NO: 2146370 - RNA, 12 nt, Homo sapiens
cuuuuagcacau

SEQ ID NO: 2146371 - RNA, 16 nt, Homo sapiens
uccccuagucacucau

SEQ ID NO: 2146372 - RNA, 16 nt, Homo sapiens
aacuuuauaaauccag

SEQ ID NO: 2146373 - RNA, 22 nt, Homo sapiens
acaaccuuuuacauugugacug

SEQ ID NO: 2146374 - RNA, 20 nt, Homo sapiens
gcacaguaucuuuucuuuca

SEQ ID NO: 2146375 - RNA, 17 nt, Homo sapiens
uccuuaauaacaacaga

SEQ ID NO: 2146376 - RNA, 17 nt, Homo sapiens
gcuuccaugauguuaca

SEQ ID NO: 2146377 - RNA, 20 nt, Homo sapiens
uuagguuauuuaagggugca

SEQ ID NO: 2146378 - RNA, 14 nt, Homo sapiens
cagugaccauggca

SEQ ID NO: 2146379 - RNA, 14 nt, Homo sapiens
aaggcucccugugu

SEQ ID NO: 2146380 - RNA, 16 nt, Homo sapiens
agcacauucgggccau

SEQ ID NO: 2146381 - RNA, 16 nt, Homo sapiens
uugaaauggcauuuaa

SEQ ID NO: 2146382 - RNA, 23 nt, Homo sapiens
gcacccuggggccuggaccugcc

SEQ ID NO: 2146383 - RNA, 14 nt, Homo sapiens
gggccguggcacag

SEQ ID NO: 2146384 - RNA, 20 nt, Homo sapiens
ucuugcuguuuaccgcccac

SEQ ID NO: 2146385 - RNA, 19 nt, Homo sapiens
ccaacugcaaaaaaagccu

SEQ ID NO: 2146386 - RNA, 23 nt, Homo sapiens
guggugacuuccugaacaucagc

SEQ ID NO: 2146387 - RNA, 21 nt, Homo sapiens
uucucagguguugccaaauau

SEQ ID NO: 2146388 - RNA, 19 nt, Homo sapiens
uacaugcaccuuauauuuc

SEQ ID NO: 2146389 - RNA, 21 nt, Homo sapiens
acccccagccuggacaccucu

SEQ ID NO: 2146390 - RNA, 17 nt, Homo sapiens
aaacccggccugauuaa

SEQ ID NO: 2146391 - RNA, 22 nt, Homo sapiens
uuuuaucaugugaaaucauuca

SEQ ID NO: 2146392 - RNA, 15 nt, Homo sapiens
gaaaucucuagcuca

SEQ ID NO: 2146393 - RNA, 13 nt, Homo sapiens
augcaaguauucu

SEQ ID NO: 2146394 - RNA, 21 nt, Homo sapiens
ggaaagugauuuguaauauga

SEQ ID NO: 2146395 - RNA, 15 nt, Homo sapiens
gaggcgcacagugug

SEQ ID NO: 2146396 - RNA, 14 nt, Homo sapiens
cuaaggaucucuca

SEQ ID NO: 2146397 - RNA, 18 nt, Homo sapiens
ccucagccuuuagggcuu

SEQ ID NO: 2146398 - RNA, 19 nt, Homo sapiens
aaaauuauguuugccacuu

SEQ ID NO: 2146399 - RNA, 17 nt, Homo sapiens
caaguauuggcaaagau

SEQ ID NO: 2146400 - RNA, 22 nt, Homo sapiens
auauuuucuuaaaaccaaucaa

SEQ ID NO: 2146401 - RNA, 20 nt, Homo sapiens
agaugguaacagauuugcuc

SEQ ID NO: 2146402 - RNA, 13 nt, Homo sapiens
agagguggcugcu

SEQ ID NO: 2146403 - RNA, 13 nt, Homo sapiens
auauuugucauaa

SEQ ID NO: 2146404 - RNA, 18 nt, Homo sapiens
gaugaaaguacauuggga

SEQ ID NO: 2146405 - RNA, 18 nt, Homo sapiens
ucaccucccgaagccacc

SEQ ID NO: 2146406 - RNA, 17 nt, Homo sapiens
cggcaucaggcuuucuu

SEQ ID NO: 2146407 - RNA, 20 nt, Homo sapiens
cugcugggugccuccuugcc

SEQ ID NO: 2146408 - RNA, 12 nt, Homo sapiens
ucaguaguguac

SEQ ID NO: 2146409 - RNA, 23 nt, Homo sapiens
gagauacucucccugacauuucu

SEQ ID NO: 2146410 - RNA, 12 nt, Homo sapiens
ccuuacccaaac

SEQ ID NO: 2146411 - RNA, 24 nt, Homo sapiens
caccaacccuucauuuaacaagua

SEQ ID NO: 2146412 - RNA, 16 nt, Homo sapiens
aagccuucccccagca

SEQ ID NO: 2146413 - RNA, 22 nt, Homo sapiens
agagucaaugccuucaugggaa

SEQ ID NO: 2146414 - RNA, 15 nt, Homo sapiens
gggaggccaaggugg

SEQ ID NO: 2146415 - RNA, 17 nt, Homo sapiens
aucuacagcucaccucu

SEQ ID NO: 2146416 - RNA, 23 nt, Homo sapiens
cucuauguaucaaauguaacuua

SEQ ID NO: 2146417 - RNA, 14 nt, Homo sapiens
aggaagcaagugac

SEQ ID NO: 2146418 - RNA, 15 nt, Homo sapiens
acugaaagaagacau

SEQ ID NO: 2146419 - RNA, 13 nt, Homo sapiens
ucugagagcauca

SEQ ID NO: 2146420 - RNA, 20 nt, Homo sapiens
guagaggcuuagagacaguu

SEQ ID NO: 2146421 - RNA, 15 nt, Homo sapiens
gaccacacuccagcu

SEQ ID NO: 2146422 - RNA, 15 nt, Homo sapiens
cccauuucuauuuau

SEQ ID NO: 2146423 - RNA, 15 nt, Homo sapiens
uuauuaauucuucac

SEQ ID NO: 2146424 - RNA, 15 nt, Homo sapiens
uuuuucauucauccc

SEQ ID NO: 2146425 - RNA, 12 nt, Homo sapiens
ccagccugauuu

SEQ ID NO: 2146426 - RNA, 20 nt, Homo sapiens
cuuccaggagccaccuugcc

SEQ ID NO: 2146427 - RNA, 18 nt, Homo sapiens
cuauugaccgagcacaua

SEQ ID NO: 2146428 - RNA, 22 nt, Homo sapiens
uaaaacaaauaaauuagucucu

SEQ ID NO: 2146429 - RNA, 19 nt, Homo sapiens
ugaagccauguagccaccc

SEQ ID NO: 2146430 - RNA, 13 nt, Homo sapiens
agaugaucucucc

SEQ ID NO: 2146431 - RNA, 21 nt, Homo sapiens
gccuuaaguggcagaauauaa

SEQ ID NO: 2146432 - RNA, 22 nt, Homo sapiens
agccugcugguuuuacauuaga

SEQ ID NO: 2146433 - RNA, 16 nt, Homo sapiens
guacaaagguugcagu

SEQ ID NO: 2146434 - RNA, 14 nt, Homo sapiens
acugaagugcuugc

SEQ ID NO: 2146435 - RNA, 13 nt, Homo sapiens
gaaguuugcuauu

SEQ ID NO: 2146436 - RNA, 11 nt, Homo sapiens
aaaggguccca

SEQ ID NO: 2146437 - RNA, 14 nt, Homo sapiens
augacugaagggaa

SEQ ID NO: 2146438 - RNA, 14 nt, Homo sapiens
ggggaagagugacu

SEQ ID NO: 2146439 - RNA, 17 nt, Homo sapiens
gacauuuauaauacaaa

SEQ ID NO: 2146440 - RNA, 18 nt, Homo sapiens
cacucacuguuuauaaau

SEQ ID NO: 2146441 - RNA, 13 nt, Homo sapiens
accugaaccuggg

SEQ ID NO: 2146442 - RNA, 19 nt, Homo sapiens
ccaguguucuaugaacaac

SEQ ID NO: 2146443 - RNA, 15 nt, Homo sapiens
cucaggcuugaaaug

SEQ ID NO: 2146444 - RNA, 23 nt, Homo sapiens
ccaagauaagaugaaucauuuaa

SEQ ID NO: 2146445 - RNA, 16 nt, Homo sapiens
ugacauaauaauagca

SEQ ID NO: 2146446 - RNA, 17 nt, Homo sapiens
uguuaguaauaccucua

SEQ ID NO: 2146447 - RNA, 21 nt, Homo sapiens
ucacccaccccauggagacaa

SEQ ID NO: 2146448 - RNA, 16 nt, Homo sapiens
uaagauucuugacuua

SEQ ID NO: 2146449 - RNA, 16 nt, Homo sapiens
uggugucccuuucaca

SEQ ID NO: 2146450 - RNA, 15 nt, Homo sapiens
cagucaucuugacca

SEQ ID NO: 2146451 - RNA, 13 nt, Homo sapiens
ucaacugccaauc

SEQ ID NO: 2146452 - RNA, 18 nt, Homo sapiens
ccuacaucaaaugcucaa

SEQ ID NO: 2146453 - RNA, 21 nt, Homo sapiens
uccauuuuuaaccacuugccu

SEQ ID NO: 2146454 - RNA, 15 nt, Homo sapiens
caugggaucaagucc

SEQ ID NO: 2146455 - RNA, 14 nt, Homo sapiens
auagccagcauuuu

SEQ ID NO: 2146456 - RNA, 18 nt, Homo sapiens
gcucccucacucucagga

SEQ ID NO: 2146457 - RNA, 14 nt, Homo sapiens
uauccaacaugugc

SEQ ID NO: 2146458 - RNA, 23 nt, Homo sapiens
agcauugguuauucaaguauuca

SEQ ID NO: 2146459 - RNA, 14 nt, Homo sapiens
uuuuuagcaacaca

SEQ ID NO: 2146460 - RNA, 12 nt, Homo sapiens
ggaugaauggaa

SEQ ID NO: 2146461 - RNA, 15 nt, Homo sapiens
uacuauccaaucugu

SEQ ID NO: 2146462 - RNA, 14 nt, Homo sapiens
ucccuuuccccaua

SEQ ID NO: 2146463 - RNA, 17 nt, Homo sapiens
auugucuuguaccuuga

SEQ ID NO: 2146464 - RNA, 21 nt, Homo sapiens
caggucucuccacugcucuca

SEQ ID NO: 2146465 - RNA, 20 nt, Homo sapiens
gaagucaucucauuccacug

SEQ ID NO: 2146466 - RNA, 18 nt, Homo sapiens
ucgggucccuucaccucc

SEQ ID NO: 2146467 - RNA, 20 nt, Homo sapiens
cauaguaccauuuauacaaa

SEQ ID NO: 2146468 - RNA, 20 nt, Homo sapiens
ccucuuugugucccuugguc

SEQ ID NO: 2146469 - RNA, 19 nt, Homo sapiens
agcaaauuucuaucagccu

SEQ ID NO: 2146470 - RNA, 17 nt, Homo sapiens
agguucccgacaccaga

SEQ ID NO: 2146471 - RNA, 20 nt, Homo sapiens
accuagcuuuauucuucaga

SEQ ID NO: 2146472 - RNA, 23 nt, Homo sapiens
cauauuguuccuuaucaccugcc

SEQ ID NO: 2146473 - RNA, 12 nt, Homo sapiens
accccugcugag

SEQ ID NO: 2146474 - RNA, 15 nt, Homo sapiens
acauggcguccugcc

SEQ ID NO: 2146475 - RNA, 21 nt, Homo sapiens
ugcucauucauuuaacagagc

SEQ ID NO: 2146476 - RNA, 22 nt, Homo sapiens
cauaucaagguuccugauucag

SEQ ID NO: 2146477 - RNA, 22 nt, Homo sapiens
uucaaugauuauuuguauuuac

SEQ ID NO: 2146478 - RNA, 19 nt, Homo sapiens
aguagcggaucucacucag

SEQ ID NO: 2146479 - RNA, 19 nt, Homo sapiens
acagcgcuggccgggaccc

SEQ ID NO: 2146480 - RNA, 12 nt, Homo sapiens
auguccacagau

SEQ ID NO: 2146481 - RNA, 23 nt, Homo sapiens
aacgccuguuacacacaaacugu

SEQ ID NO: 2146482 - RNA, 20 nt, Homo sapiens
cacucaggaacccuggagac

SEQ ID NO: 2146483 - RNA, 22 nt, Homo sapiens
uuucaucugcucuccuuccugg

SEQ ID NO: 2146484 - RNA, 23 nt, Homo sapiens
aagagaccuaccucagguugcug

SEQ ID NO: 2146485 - RNA, 17 nt, Homo sapiens
aacaguuuaacagaaaa

SEQ ID NO: 2146486 - RNA, 17 nt, Homo sapiens
gacuguagauuauuuau

SEQ ID NO: 2146487 - RNA, 16 nt, Homo sapiens
aaugcagucuguccag

SEQ ID NO: 2146488 - RNA, 13 nt, Homo sapiens
cugagaaggcagu

SEQ ID NO: 2146489 - RNA, 20 nt, Homo sapiens
acauuccaaugcauugcuaa

SEQ ID NO: 2146490 - RNA, 17 nt, Homo sapiens
aaauaaagauauuguuc

SEQ ID NO: 2146491 - RNA, 22 nt, Homo sapiens
uccugccccagauggcuuugug

SEQ ID NO: 2146492 - RNA, 14 nt, Homo sapiens
uaugugacuugcau

SEQ ID NO: 2146493 - RNA, 15 nt, Homo sapiens
caaauguguaaugga

SEQ ID NO: 2146494 - RNA, 13 nt, Homo sapiens
auacagcuaugaa

SEQ ID NO: 2146495 - RNA, 21 nt, Homo sapiens
auuugugaugacaacuggaau

SEQ ID NO: 2146496 - RNA, 23 nt, Homo sapiens
ccaacuccccuccgucugugaca

SEQ ID NO: 2146497 - RNA, 17 nt, Homo sapiens
gcugcaggacuugagaa

SEQ ID NO: 2146498 - RNA, 19 nt, Homo sapiens
ccaggaugaguuacuugaa

SEQ ID NO: 2146499 - RNA, 14 nt, Homo sapiens
ggcaacaugaugaa

SEQ ID NO: 2146500 - RNA, 14 nt, Homo sapiens
caugugggcugugg

SEQ ID NO: 2146501 - RNA, 20 nt, Homo sapiens
cagaaggguggggauaucag

SEQ ID NO: 2146502 - RNA, 22 nt, Homo sapiens
ucaucaaaaccugcgcagucau

SEQ ID NO: 2146503 - RNA, 13 nt, Homo sapiens
agccacuugucag

SEQ ID NO: 2146504 - RNA, 14 nt, Homo sapiens
gcgggaucccagca

SEQ ID NO: 2146505 - RNA, 14 nt, Homo sapiens
agcaacaagcuauu

SEQ ID NO: 2146506 - RNA, 20 nt, Homo sapiens
uuggaugaugaaacauucau

SEQ ID NO: 2146507 - RNA, 19 nt, Homo sapiens
uccucgagaugcucugcug

SEQ ID NO: 2146508 - RNA, 18 nt, Homo sapiens
guuucccugccccugucc

SEQ ID NO: 2146509 - RNA, 18 nt, Homo sapiens
aauccugccucuccccaa

SEQ ID NO: 2146510 - RNA, 20 nt, Homo sapiens
guggcacuugccugggucac

SEQ ID NO: 2146511 - RNA, 20 nt, Homo sapiens
uccaucuuuacaaaacuaca

SEQ ID NO: 2146512 - RNA, 21 nt, Homo sapiens
ccuacagccagaacuucugag

SEQ ID NO: 2146513 - RNA, 22 nt, Homo sapiens
aucugggcuaccccacccaagu

SEQ ID NO: 2146514 - RNA, 20 nt, Homo sapiens
gagccaugugucauguaaua

SEQ ID NO: 2146515 - RNA, 21 nt, Homo sapiens
cauuugauaagcaagaaagau

SEQ ID NO: 2146516 - RNA, 21 nt, Homo sapiens
uguaaugaucagaugaacuca

SEQ ID NO: 2146517 - RNA, 19 nt, Homo sapiens
aaccuucacaucugucacg

SEQ ID NO: 2146518 - RNA, 18 nt, Homo sapiens
cacacccaugacugcccc

SEQ ID NO: 2146519 - RNA, 11 nt, Homo sapiens
ugagggcuccu

SEQ ID NO: 2146520 - RNA, 18 nt, Homo sapiens
cacuuccuauaugcacuu

SEQ ID NO: 2146521 - RNA, 16 nt, Homo sapiens
aaugacccaaagacca

SEQ ID NO: 2146522 - RNA, 16 nt, Homo sapiens
acagcagcacugcaga

SEQ ID NO: 2146523 - RNA, 16 nt, Homo sapiens
caagacaccaugacaa

SEQ ID NO: 2146524 - RNA, 16 nt, Homo sapiens
ggggucgcgaugaugg

SEQ ID NO: 2146525 - RNA, 17 nt, Homo sapiens
gaaaucaggcaguuccc

SEQ ID NO: 2146526 - RNA, 22 nt, Homo sapiens
cagugucccaccuugaccaaaa

SEQ ID NO: 2146527 - RNA, 18 nt, Homo sapiens
cauaugagaauauaccuu

SEQ ID NO: 2146528 - RNA, 22 nt, Homo sapiens
caguuuuuauuaaucuacugua

SEQ ID NO: 2146529 - RNA, 20 nt, Homo sapiens
aauggaucacugauauuuua

SEQ ID NO: 2146530 - RNA, 19 nt, Homo sapiens
uaauuugaaauuugacuca

SEQ ID NO: 2146531 - RNA, 22 nt, Homo sapiens
aaccugaauuaaagucuacacu

SEQ ID NO: 2146532 - RNA, 20 nt, Homo sapiens
agugugggaggcuccuguua

SEQ ID NO: 2146533 - RNA, 23 nt, Homo sapiens
gcaaguaaaaaggcuaaauggaa

SEQ ID NO: 2146534 - RNA, 15 nt, Homo sapiens
uucauacgguuguau

SEQ ID NO: 2146535 - RNA, 20 nt, Homo sapiens
ggcuggguaccaaugcugca

SEQ ID NO: 2146536 - RNA, 15 nt, Homo sapiens
ccaaguagcugggau

SEQ ID NO: 2146537 - RNA, 20 nt, Homo sapiens
cccagcauucucaggcacca

SEQ ID NO: 2146538 - RNA, 19 nt, Homo sapiens
uuuccccagugacaccuca

SEQ ID NO: 2146539 - RNA, 19 nt, Homo sapiens
gagauaccccacuccacau

SEQ ID NO: 2146540 - RNA, 22 nt, Homo sapiens
ucucaucucuucagguucucau

SEQ ID NO: 2146541 - RNA, 23 nt, Homo sapiens
acuaauuaggcaaggcuauguga

SEQ ID NO: 2146542 - RNA, 21 nt, Homo sapiens
gccaaagauccccccagaccc

SEQ ID NO: 2146543 - RNA, 18 nt, Homo sapiens
cuggggccugugcacugu

SEQ ID NO: 2146544 - RNA, 13 nt, Homo sapiens
cagucucuggaaa

SEQ ID NO: 2146545 - RNA, 18 nt, Homo sapiens
ucuacauugagcauuuga

SEQ ID NO: 2146546 - RNA, 11 nt, Homo sapiens
aggagccauga

SEQ ID NO: 2146547 - RNA, 15 nt, Homo sapiens
gaugaccguguacaa

SEQ ID NO: 2146548 - RNA, 15 nt, Homo sapiens
cuugguagauuuagu

SEQ ID NO: 2146549 - RNA, 17 nt, Homo sapiens
uccuuuuaaccauuuua

SEQ ID NO: 2146550 - RNA, 17 nt, Homo sapiens
gccaagggcagaucaca

SEQ ID NO: 2146551 - RNA, 15 nt, Homo sapiens
gccgcucucucugag

SEQ ID NO: 2146552 - RNA, 16 nt, Homo sapiens
uguguuuucagucuuu

SEQ ID NO: 2146553 - RNA, 12 nt, Homo sapiens
aaggcuucucuc

SEQ ID NO: 2146554 - RNA, 12 nt, Homo sapiens
gaugccuacuuu

SEQ ID NO: 2146555 - RNA, 18 nt, Homo sapiens
uauacacagucuauacaa

SEQ ID NO: 2146556 - RNA, 20 nt, Homo sapiens
gauaaaaagaggaauauucu

SEQ ID NO: 2146557 - RNA, 13 nt, Homo sapiens
aguaaacaaugaa

SEQ ID NO: 2146558 - RNA, 15 nt, Homo sapiens
gaaauuagcauuccu

SEQ ID NO: 2146559 - RNA, 20 nt, Homo sapiens
gaguuuaaacaaaaaaccca

SEQ ID NO: 2146560 - RNA, 21 nt, Homo sapiens
gcacucucgcacacacaguga

SEQ ID NO: 2146561 - RNA, 17 nt, Homo sapiens
ugcagaucugugcucau

SEQ ID NO: 2146562 - RNA, 10 nt, Homo sapiens
ccugccccaa

SEQ ID NO: 2146563 - RNA, 17 nt, Homo sapiens
ucucugcuuaguucuau

SEQ ID NO: 2146564 - RNA, 16 nt, Homo sapiens
uucuggccggugcugg

SEQ ID NO: 2146565 - RNA, 19 nt, Homo sapiens
aggcaagcaggaccuggca

SEQ ID NO: 2146566 - RNA, 15 nt, Homo sapiens
aaauaucaugcacaa

SEQ ID NO: 2146567 - RNA, 23 nt, Homo sapiens
gaaguucucagaauaacuaccuc

SEQ ID NO: 2146568 - RNA, 21 nt, Homo sapiens
ucagggagaggucaccagcug

SEQ ID NO: 2146569 - RNA, 21 nt, Homo sapiens
acccuucuggaaacugugaag

SEQ ID NO: 2146570 - RNA, 20 nt, Homo sapiens
cuggggugggggccaaguca

SEQ ID NO: 2146571 - RNA, 19 nt, Homo sapiens
caugaauauaaaugggaaa

SEQ ID NO: 2146572 - RNA, 15 nt, Homo sapiens
gaaagaauggcacuc

SEQ ID NO: 2146573 - RNA, 19 nt, Homo sapiens
ccaaaucaaaagacuuuuu

SEQ ID NO: 2146574 - RNA, 11 nt, Homo sapiens
auaaaccaaga

SEQ ID NO: 2146575 - RNA, 15 nt, Homo sapiens
uuuucguuugcauug

SEQ ID NO: 2146576 - RNA, 14 nt, Homo sapiens
agacgucucaagac

SEQ ID NO: 2146577 - RNA, 16 nt, Homo sapiens
gcuuuugcaacauggu

SEQ ID NO: 2146578 - RNA, 18 nt, Homo sapiens
caguacauacgucugcca

SEQ ID NO: 2146579 - RNA, 20 nt, Homo sapiens
aucauacuaaacuucaccua

SEQ ID NO: 2146580 - RNA, 20 nt, Homo sapiens
uauguucuccccuacauuag

SEQ ID NO: 2146581 - RNA, 23 nt, Homo sapiens
auucauuucauugugaucagcua

SEQ ID NO: 2146582 - RNA, 12 nt, Homo sapiens
ggaaaacuacug

SEQ ID NO: 2146583 - RNA, 18 nt, Homo sapiens
uuaauggugaugggguaa

SEQ ID NO: 2146584 - RNA, 19 nt, Homo sapiens
guuccgcacuuuccacuuc

SEQ ID NO: 2146585 - RNA, 17 nt, Homo sapiens
agcuauucucaugccuc

SEQ ID NO: 2146586 - RNA, 17 nt, Homo sapiens
uuuuaauuuuuugucaa

SEQ ID NO: 2146587 - RNA, 22 nt, Homo sapiens
ccagaacauggauuccacugaa

SEQ ID NO: 2146588 - RNA, 21 nt, Homo sapiens
aucuuccacuggaacguuuca

SEQ ID NO: 2146589 - RNA, 21 nt, Homo sapiens
uguaaaguagaauaagccuuc

SEQ ID NO: 2146590 - RNA, 18 nt, Homo sapiens
gagucaaugugcagugua

SEQ ID NO: 2146591 - RNA, 22 nt, Homo sapiens
cuugaucaacaucuuuucuugc

SEQ ID NO: 2146592 - RNA, 13 nt, Homo sapiens
ggaccguccaggg

SEQ ID NO: 2146593 - RNA, 23 nt, Homo sapiens
uuaauuguauaagucaagcacau

SEQ ID NO: 2146594 - RNA, 21 nt, Homo sapiens
ugacuuugccacauccauuga

SEQ ID NO: 2146595 - RNA, 21 nt, Homo sapiens
caucccuuuuccugucagugu

SEQ ID NO: 2146596 - RNA, 23 nt, Homo sapiens
gaggggagcccccucuuccacuc

SEQ ID NO: 2146597 - RNA, 17 nt, Homo sapiens
auaaauauacuaauaaa

SEQ ID NO: 2146598 - RNA, 22 nt, Homo sapiens
cuucauagaauacucagggaaa

SEQ ID NO: 2146599 - RNA, 18 nt, Homo sapiens
ucccagacagcaguguga

SEQ ID NO: 2146600 - RNA, 12 nt, Homo sapiens
ggaaguucuccu

SEQ ID NO: 2146601 - RNA, 14 nt, Homo sapiens
ugaaaggguuugau

SEQ ID NO: 2146602 - RNA, 14 nt, Homo sapiens
cauuuccuguguuu

SEQ ID NO: 2146603 - RNA, 23 nt, Homo sapiens
acucuuaguuacucauucaggga

SEQ ID NO: 2146604 - RNA, 17 nt, Homo sapiens
uuugauacauauaauuc

SEQ ID NO: 2146605 - RNA, 17 nt, Homo sapiens
ugcuagaaaggaagaca

SEQ ID NO: 2146606 - RNA, 14 nt, Homo sapiens
cauucuacugaaaa

SEQ ID NO: 2146607 - RNA, 19 nt, Homo sapiens
uuaauuccaauaugaugac

SEQ ID NO: 2146608 - RNA, 11 nt, Homo sapiens
ggcacgguggu

SEQ ID NO: 2146609 - RNA, 16 nt, Homo sapiens
aagccaaacucugcca

SEQ ID NO: 2146610 - RNA, 19 nt, Homo sapiens
ccuaguuuguuagugcauu

SEQ ID NO: 2146611 - RNA, 16 nt, Homo sapiens
gacaguugaacagagc

SEQ ID NO: 2146612 - RNA, 13 nt, Homo sapiens
cugucugguuguu

SEQ ID NO: 2146613 - RNA, 17 nt, Homo sapiens
cuccagcucuggcuucc

SEQ ID NO: 2146614 - RNA, 16 nt, Homo sapiens
cgagcagucagcauuc

SEQ ID NO: 2146615 - RNA, 21 nt, Homo sapiens
auaaggucuguaguauacaga

SEQ ID NO: 2146616 - RNA, 14 nt, Homo sapiens
gacacuacauaucu

SEQ ID NO: 2146617 - RNA, 15 nt, Homo sapiens
aaauggccaaauaua

SEQ ID NO: 2146618 - RNA, 16 nt, Homo sapiens
guaagccaugaucaua

SEQ ID NO: 2146619 - RNA, 16 nt, Homo sapiens
agcccagucuggaugu

SEQ ID NO: 2146620 - RNA, 16 nt, Homo sapiens
acuauugcuugcacaa

SEQ ID NO: 2146621 - RNA, 15 nt, Homo sapiens
ugggcucuucuggac

SEQ ID NO: 2146622 - RNA, 21 nt, Homo sapiens
ggaagcacaugccucucucag

SEQ ID NO: 2146623 - RNA, 16 nt, Homo sapiens
caacaaaaaccaaaaa

SEQ ID NO: 2146624 - RNA, 11 nt, Homo sapiens
agacagcaguu

SEQ ID NO: 2146625 - RNA, 20 nt, Homo sapiens
aaaaguguuauuauuuggca

SEQ ID NO: 2146626 - RNA, 15 nt, Homo sapiens
ugaccucccacuuug

SEQ ID NO: 2146627 - RNA, 15 nt, Homo sapiens
ugggauccacacuga

SEQ ID NO: 2146628 - RNA, 18 nt, Homo sapiens
cacuucaacccccagcua

SEQ ID NO: 2146629 - RNA, 13 nt, Homo sapiens
uccucaugcugcu

SEQ ID NO: 2146630 - RNA, 15 nt, Homo sapiens
ucaucuaacgugcau

SEQ ID NO: 2146631 - RNA, 16 nt, Homo sapiens
uuguauuuaagacaua

SEQ ID NO: 2146632 - RNA, 19 nt, Homo sapiens
cagcugaagaaaaugagca

SEQ ID NO: 2146633 - RNA, 14 nt, Homo sapiens
guuguuauuauuca

SEQ ID NO: 2146634 - RNA, 23 nt, Homo sapiens
gaacuaaucgagcacuucucacc

SEQ ID NO: 2146635 - RNA, 14 nt, Homo sapiens
auuuuuuucccaag

SEQ ID NO: 2146636 - RNA, 16 nt, Homo sapiens
uucaauaaacuaaaga

SEQ ID NO: 2146637 - RNA, 14 nt, Homo sapiens
ccaguguaucucaa

SEQ ID NO: 2146638 - RNA, 22 nt, Homo sapiens
caggaugguguuacugcaguug

SEQ ID NO: 2146639 - RNA, 15 nt, Homo sapiens
cuuagauugaaucug

SEQ ID NO: 2146640 - RNA, 18 nt, Homo sapiens
cacauaugggaacuauga

SEQ ID NO: 2146641 - RNA, 14 nt, Homo sapiens
auccuccauugcuc

SEQ ID NO: 2146642 - RNA, 20 nt, Homo sapiens
auuuguaguggaaacauuua

SEQ ID NO: 2146643 - RNA, 15 nt, Homo sapiens
uuaaugcagacaaac

SEQ ID NO: 2146644 - RNA, 20 nt, Homo sapiens
ggccacgggaccuucuaucc

SEQ ID NO: 2146645 - RNA, 18 nt, Homo sapiens
uggcugguguuaacagaa

SEQ ID NO: 2146646 - RNA, 20 nt, Homo sapiens
ucaggacgguugucacuuau

SEQ ID NO: 2146647 - RNA, 12 nt, Homo sapiens
cugagcugugau

SEQ ID NO: 2146648 - RNA, 17 nt, Homo sapiens
guuacauugucauuuau

SEQ ID NO: 2146649 - RNA, 14 nt, Homo sapiens
aauucugcuucucu

SEQ ID NO: 2146650 - RNA, 14 nt, Homo sapiens
aaccaagcuuucaa

SEQ ID NO: 2146651 - RNA, 18 nt, Homo sapiens
auaaaacuguggcacuuu

SEQ ID NO: 2146652 - RNA, 16 nt, Homo sapiens
aagauuuuaugcugcu

SEQ ID NO: 2146653 - RNA, 16 nt, Homo sapiens
cacuauugaugcauuu

SEQ ID NO: 2146654 - RNA, 16 nt, Homo sapiens
uuggguugcaaucugg

SEQ ID NO: 2146655 - RNA, 19 nt, Homo sapiens
gcuuagaaaguuccaaaug

SEQ ID NO: 2146656 - RNA, 19 nt, Homo sapiens
auuguaauacacauaucua

SEQ ID NO: 2146657 - RNA, 13 nt, Homo sapiens
uaaaaacauguga

SEQ ID NO: 2146658 - RNA, 23 nt, Homo sapiens
aggguuuugccccaaguccucau

SEQ ID NO: 2146659 - RNA, 16 nt, Homo sapiens
cuggcccccucagugu

SEQ ID NO: 2146660 - RNA, 18 nt, Homo sapiens
ugagaagccuucagcucc

SEQ ID NO: 2146661 - RNA, 19 nt, Homo sapiens
augaaagacuuacaggccu

SEQ ID NO: 2146662 - RNA, 20 nt, Homo sapiens
gcaaaguauugugaaaguau

SEQ ID NO: 2146663 - RNA, 15 nt, Homo sapiens
aaaugaaucuucaca

SEQ ID NO: 2146664 - RNA, 19 nt, Homo sapiens
aaguuuccccaccagugaa

SEQ ID NO: 2146665 - RNA, 14 nt, Homo sapiens
aaaggaaugauaua

SEQ ID NO: 2146666 - RNA, 12 nt, Homo sapiens
uccaccuguggg

SEQ ID NO: 2146667 - RNA, 23 nt, Homo sapiens
guggauuuuguccauucaucuca

SEQ ID NO: 2146668 - RNA, 13 nt, Homo sapiens
uuaugcggcauuu

SEQ ID NO: 2146669 - RNA, 16 nt, Homo sapiens
gaaauaaaugauguac

SEQ ID NO: 2146670 - RNA, 13 nt, Homo sapiens
gaacggggguaca

SEQ ID NO: 2146671 - RNA, 15 nt, Homo sapiens
ugucauuuccucuag

SEQ ID NO: 2146672 - RNA, 14 nt, Homo sapiens
agccuccugaccug

SEQ ID NO: 2146673 - RNA, 13 nt, Homo sapiens
cucagacccagga

SEQ ID NO: 2146674 - RNA, 20 nt, Homo sapiens
ucgccuucuugccagccaca

SEQ ID NO: 2146675 - RNA, 13 nt, Homo sapiens
aaagcagugcucu

SEQ ID NO: 2146676 - RNA, 18 nt, Homo sapiens
ugcaucaucucuuccuca

SEQ ID NO: 2146677 - RNA, 20 nt, Homo sapiens
auugucgguuaccucugcau

SEQ ID NO: 2146678 - RNA, 12 nt, Homo sapiens
gaguggcccaag

SEQ ID NO: 2146679 - RNA, 13 nt, Homo sapiens
gccacuuucugcc

SEQ ID NO: 2146680 - RNA, 13 nt, Homo sapiens
aagggaccccaga

SEQ ID NO: 2146681 - RNA, 13 nt, Homo sapiens
uuucuuccuuuga

SEQ ID NO: 2146682 - RNA, 20 nt, Homo sapiens
cugacggaguccuguguuug

SEQ ID NO: 2146683 - RNA, 17 nt, Homo sapiens
ugcccuggauccaucag

SEQ ID NO: 2146684 - RNA, 15 nt, Homo sapiens
gcuccuucuguccua

SEQ ID NO: 2146685 - RNA, 20 nt, Homo sapiens
aacuucaaguucucuugauu

SEQ ID NO: 2146686 - RNA, 21 nt, Homo sapiens
cugggagacuuugaagaccag

SEQ ID NO: 2146687 - RNA, 16 nt, Homo sapiens
gccacacugugacaca

SEQ ID NO: 2146688 - RNA, 18 nt, Homo sapiens
agcucccgagcuacucuc

SEQ ID NO: 2146689 - RNA, 18 nt, Homo sapiens
cauuucugugaaacuauc

SEQ ID NO: 2146690 - RNA, 18 nt, Homo sapiens
guauggaagccaccggga

SEQ ID NO: 2146691 - RNA, 14 nt, Homo sapiens
gaaauaaaccugga

SEQ ID NO: 2146692 - RNA, 19 nt, Homo sapiens
ccccucccacagcgcuggc

SEQ ID NO: 2146693 - RNA, 13 nt, Homo sapiens
ccaucaucacugg

SEQ ID NO: 2146694 - RNA, 17 nt, Homo sapiens
aaaaagacuaagccaga

SEQ ID NO: 2146695 - RNA, 17 nt, Homo sapiens
ugacaggggcucaggau

SEQ ID NO: 2146696 - RNA, 21 nt, Homo sapiens
cucccuuagcucccuguucuu

SEQ ID NO: 2146697 - RNA, 17 nt, Homo sapiens
ccaguccggaucuccac

SEQ ID NO: 2146698 - RNA, 16 nt, Homo sapiens
agaacgaagccaccuu

SEQ ID NO: 2146699 - RNA, 20 nt, Homo sapiens
gaccucacgugcaaagccac

SEQ ID NO: 2146700 - RNA, 19 nt, Homo sapiens
cuggcauuugcaccuaccu

SEQ ID NO: 2146701 - RNA, 19 nt, Homo sapiens
aaccuggggugaauacuua

SEQ ID NO: 2146702 - RNA, 17 nt, Homo sapiens
augccaccaacuuacaa

SEQ ID NO: 2146703 - RNA, 20 nt, Homo sapiens
ugcagguuguugucaucuga

SEQ ID NO: 2146704 - RNA, 16 nt, Homo sapiens
auguuguuugggagag

SEQ ID NO: 2146705 - RNA, 16 nt, Homo sapiens
gcuucuugcuuacagg

SEQ ID NO: 2146706 - RNA, 22 nt, Homo sapiens
ggcgugauggcaggugccugua

SEQ ID NO: 2146707 - RNA, 15 nt, Homo sapiens
cucugcauaccguga

SEQ ID NO: 2146708 - RNA, 21 nt, Homo sapiens
ccuccaggggcuccuggguug

SEQ ID NO: 2146709 - RNA, 14 nt, Homo sapiens
cuucucuugacagu

SEQ ID NO: 2146710 - RNA, 11 nt, Homo sapiens
aagauuacuuu

SEQ ID NO: 2146711 - RNA, 23 nt, Homo sapiens
cucagaauauacccauccaugca

SEQ ID NO: 2146712 - RNA, 14 nt, Homo sapiens
gacaugcacugacc

SEQ ID NO: 2146713 - RNA, 17 nt, Homo sapiens
uaaaaacuuccaucccu

SEQ ID NO: 2146714 - RNA, 16 nt, Homo sapiens
ggaugaauaaguuuua

SEQ ID NO: 2146715 - RNA, 20 nt, Homo sapiens
gcuggugggcaugugagaug

SEQ ID NO: 2146716 - RNA, 17 nt, Homo sapiens
uauuuuuuaauaaacug

SEQ ID NO: 2146717 - RNA, 18 nt, Homo sapiens
uugaagagugaaauacca

SEQ ID NO: 2146718 - RNA, 23 nt, Homo sapiens
auaguggcauaccaaauggcacu

SEQ ID NO: 2146719 - RNA, 21 nt, Homo sapiens
aguaauuguguuuacauuuua

SEQ ID NO: 2146720 - RNA, 23 nt, Homo sapiens
aacucugcuugauuuuugccucu

SEQ ID NO: 2146721 - RNA, 20 nt, Homo sapiens
uuuuggggaaaaaagcacau

SEQ ID NO: 2146722 - RNA, 16 nt, Homo sapiens
cagaucacuacugcag

SEQ ID NO: 2146723 - RNA, 22 nt, Homo sapiens
ucccuguacaguagauuuucca

SEQ ID NO: 2146724 - RNA, 23 nt, Homo sapiens
cacucuguaucuaugcaaagcac

SEQ ID NO: 2146725 - RNA, 20 nt, Homo sapiens
caaagaaaacugucugggag

SEQ ID NO: 2146726 - RNA, 13 nt, Homo sapiens
aucugaacauuua

SEQ ID NO: 2146727 - RNA, 16 nt, Homo sapiens
cacuaaguaaccucua

SEQ ID NO: 2146728 - RNA, 11 nt, Homo sapiens
auaccuguggu

SEQ ID NO: 2146729 - RNA, 18 nt, Homo sapiens
ccacgcaaggcugugcuc

SEQ ID NO: 2146730 - RNA, 18 nt, Homo sapiens
aucuuagggaacuuugau

SEQ ID NO: 2146731 - RNA, 15 nt, Homo sapiens
ucaguggaucuucag

SEQ ID NO: 2146732 - RNA, 23 nt, Homo sapiens
uagaauauuuauuaccucugaua

SEQ ID NO: 2146733 - RNA, 14 nt, Homo sapiens
uaucuagcauuuau

SEQ ID NO: 2146734 - RNA, 16 nt, Homo sapiens
uucauugaaaucuuug

SEQ ID NO: 2146735 - RNA, 23 nt, Homo sapiens
acaaguuggaugcggccauucaa

SEQ ID NO: 2146736 - RNA, 18 nt, Homo sapiens
accuuaucaagaggaucu

SEQ ID NO: 2146737 - RNA, 16 nt, Homo sapiens
uguacaccacaugcua

SEQ ID NO: 2146738 - RNA, 13 nt, Homo sapiens
ugugugugucacc

SEQ ID NO: 2146739 - RNA, 13 nt, Homo sapiens
cucuccacaccca

SEQ ID NO: 2146740 - RNA, 22 nt, Homo sapiens
uccuugugguugaaaaccacag

SEQ ID NO: 2146741 - RNA, 21 nt, Homo sapiens
uucugccuccauucugaccau

SEQ ID NO: 2146742 - RNA, 16 nt, Homo sapiens
cucuuagacccacaga

SEQ ID NO: 2146743 - RNA, 13 nt, Homo sapiens
gagagugcacuga

SEQ ID NO: 2146744 - RNA, 17 nt, Homo sapiens
uaaagaaguaugggaaa

SEQ ID NO: 2146745 - RNA, 21 nt, Homo sapiens
auuuaaaacagacacuggcau

SEQ ID NO: 2146746 - RNA, 13 nt, Homo sapiens
caugcccuguuca

SEQ ID NO: 2146747 - RNA, 16 nt, Homo sapiens
agccucaagaugaagg

SEQ ID NO: 2146748 - RNA, 16 nt, Homo sapiens
gagggaaaagcuaaga

SEQ ID NO: 2146749 - RNA, 15 nt, Homo sapiens
cauggauaacacauu

SEQ ID NO: 2146750 - RNA, 12 nt, Homo sapiens
cuuucugcuaaa

SEQ ID NO: 2146751 - RNA, 13 nt, Homo sapiens
agaauaagaauuu

SEQ ID NO: 2146752 - RNA, 16 nt, Homo sapiens
ugaccuccugcaggga

SEQ ID NO: 2146753 - RNA, 22 nt, Homo sapiens
gguuuuguagguagaggaauaa

SEQ ID NO: 2146754 - RNA, 18 nt, Homo sapiens
ucaccaaaucagcugcua

SEQ ID NO: 2146755 - RNA, 17 nt, Homo sapiens
cuguggggcuuacagaa

SEQ ID NO: 2146756 - RNA, 16 nt, Homo sapiens
uauuuugagauucaua

SEQ ID NO: 2146757 - RNA, 14 nt, Homo sapiens
uaccaaagcaucaa

SEQ ID NO: 2146758 - RNA, 20 nt, Homo sapiens
guagcugggauuacaggugu

SEQ ID NO: 2146759 - RNA, 14 nt, Homo sapiens
cucaaagaaagugu

SEQ ID NO: 2146760 - RNA, 18 nt, Homo sapiens
ucagaaugcucacacuga

SEQ ID NO: 2146761 - RNA, 23 nt, Homo sapiens
uuggggacagauucagucuugcc

SEQ ID NO: 2146762 - RNA, 16 nt, Homo sapiens
augauggcacugagaa

SEQ ID NO: 2146763 - RNA, 18 nt, Homo sapiens
agauggcgaccaccaaag

SEQ ID NO: 2146764 - RNA, 23 nt, Homo sapiens
cauucucuccaguguguguaaca

SEQ ID NO: 2146765 - RNA, 17 nt, Homo sapiens
cuguaugucucguggua

SEQ ID NO: 2146766 - RNA, 20 nt, Homo sapiens
cuuauucuuggcaagaaugc

SEQ ID NO: 2146767 - RNA, 19 nt, Homo sapiens
aagaacauguccuacaaca

SEQ ID NO: 2146768 - RNA, 23 nt, Homo sapiens
uggugcagaugccugcagugcca

SEQ ID NO: 2146769 - RNA, 19 nt, Homo sapiens
ugaaaaagauguacagaac

SEQ ID NO: 2146770 - RNA, 16 nt, Homo sapiens
uuagagcugagcacuu

SEQ ID NO: 2146771 - RNA, 19 nt, Homo sapiens
auuugcccaaaucuucuuc

SEQ ID NO: 2146772 - RNA, 13 nt, Homo sapiens
aaauaaauuccaa

SEQ ID NO: 2146773 - RNA, 16 nt, Homo sapiens
augaagacccagugua

SEQ ID NO: 2146774 - RNA, 21 nt, Homo sapiens
ccaagcugaggaggugcugca

SEQ ID NO: 2146775 - RNA, 20 nt, Homo sapiens
uguaggcaauacauguaucu

SEQ ID NO: 2146776 - RNA, 22 nt, Homo sapiens
guuauaaaucaaugucacuuaa

SEQ ID NO: 2146777 - RNA, 24 nt, Homo sapiens
gaccccagggcacaggagcuaccu

SEQ ID NO: 2146778 - RNA, 18 nt, Homo sapiens
ugaacauuaguugcacua

SEQ ID NO: 2146779 - RNA, 21 nt, Homo sapiens
accaaugccaagauaauucac

SEQ ID NO: 2146780 - RNA, 16 nt, Homo sapiens
gggcugguugcuguag

SEQ ID NO: 2146781 - RNA, 20 nt, Homo sapiens
cugguccugggagccacugg

SEQ ID NO: 2146782 - RNA, 20 nt, Homo sapiens
uuccccaucgccuucugggg

SEQ ID NO: 2146783 - RNA, 23 nt, Homo sapiens
auuugguauauacuuugccacug

SEQ ID NO: 2146784 - RNA, 12 nt, Homo sapiens
uaaguauuucca

SEQ ID NO: 2146785 - RNA, 16 nt, Homo sapiens
acugcaugucagagca

SEQ ID NO: 2146786 - RNA, 17 nt, Homo sapiens
guaaugcgccaauaaac

SEQ ID NO: 2146787 - RNA, 18 nt, Homo sapiens
uagcacaauuugcacuaa

SEQ ID NO: 2146788 - RNA, 13 nt, Homo sapiens
gugggaggcagaa

SEQ ID NO: 2146789 - RNA, 19 nt, Homo sapiens
ugcugugucuuuagaacag

SEQ ID NO: 2146790 - RNA, 21 nt, Homo sapiens
caaugccacauacuugcagcu

SEQ ID NO: 2146791 - RNA, 12 nt, Homo sapiens
uggcuggcugcc

SEQ ID NO: 2146792 - RNA, 17 nt, Homo sapiens
ggaggggagaagccaag

SEQ ID NO: 2146793 - RNA, 12 nt, Homo sapiens
agaagcauuucu

SEQ ID NO: 2146794 - RNA, 16 nt, Homo sapiens
cucccggcauccugaa

SEQ ID NO: 2146795 - RNA, 18 nt, Homo sapiens
uuucauguucugugucac

SEQ ID NO: 2146796 - RNA, 13 nt, Homo sapiens
accccuacaugaa

SEQ ID NO: 2146797 - RNA, 16 nt, Homo sapiens
gucucuggggucagga

SEQ ID NO: 2146798 - RNA, 22 nt, Homo sapiens
aagggcccagauucuaccacac

SEQ ID NO: 2146799 - RNA, 18 nt, Homo sapiens
cggggugucugucuuccu

SEQ ID NO: 2146800 - RNA, 17 nt, Homo sapiens
cacccuccaugcuccuc

SEQ ID NO: 2146801 - RNA, 10 nt, Homo sapiens
gccacucccc

SEQ ID NO: 2146802 - RNA, 19 nt, Homo sapiens
ccuucuuccauucccagac

SEQ ID NO: 2146803 - RNA, 13 nt, Homo sapiens
gcaagugugugca

SEQ ID NO: 2146804 - RNA, 16 nt, Homo sapiens
cagcaugugcucagcc

SEQ ID NO: 2146805 - RNA, 23 nt, Homo sapiens
acacuaacgauuuguuaaugaua

SEQ ID NO: 2146806 - RNA, 18 nt, Homo sapiens
uuuuaauuaugggaauaa

SEQ ID NO: 2146807 - RNA, 23 nt, Homo sapiens
ugacaccgugggucauuacaaaa

SEQ ID NO: 2146808 - RNA, 22 nt, Homo sapiens
cacaaauuucucuguuccauag

SEQ ID NO: 2146809 - RNA, 15 nt, Homo sapiens
agcuggguaucucaa

SEQ ID NO: 2146810 - RNA, 15 nt, Homo sapiens
aauguuugauacucu

SEQ ID NO: 2146811 - RNA, 16 nt, Homo sapiens
cuuaugcuucuuucaa

SEQ ID NO: 2146812 - RNA, 16 nt, Homo sapiens
uccaauggaacaguag

SEQ ID NO: 2146813 - RNA, 18 nt, Homo sapiens
cuccucccagguuucuuc

SEQ ID NO: 2146814 - RNA, 21 nt, Homo sapiens
uuaauuaguuuauauuacucu

SEQ ID NO: 2146815 - RNA, 21 nt, Homo sapiens
cugccaggcccccaccacaca

SEQ ID NO: 2146816 - RNA, 20 nt, Homo sapiens
uuuugcaauaguuaccucaa

SEQ ID NO: 2146817 - RNA, 20 nt, Homo sapiens
gaauuaugucguaagucacu

SEQ ID NO: 2146818 - RNA, 12 nt, Homo sapiens
ucuggauuucau

SEQ ID NO: 2146819 - RNA, 21 nt, Homo sapiens
agcagcccuaaggaucucuca

SEQ ID NO: 2146820 - RNA, 13 nt, Homo sapiens
uuuaaucauuucc

SEQ ID NO: 2146821 - RNA, 13 nt, Homo sapiens
agaccucaagaaa

SEQ ID NO: 2146822 - RNA, 21 nt, Homo sapiens
ucagagcccagucgagaccuc

SEQ ID NO: 2146823 - RNA, 13 nt, Homo sapiens
cuuauuaaagcaa

SEQ ID NO: 2146824 - RNA, 13 nt, Homo sapiens
aacugaaccacaa

SEQ ID NO: 2146825 - RNA, 12 nt, Homo sapiens
ccucucucucag

SEQ ID NO: 2146826 - RNA, 13 nt, Homo sapiens
ccagcaaggcagg

SEQ ID NO: 2146827 - RNA, 16 nt, Homo sapiens
aggauggaacaucagu

SEQ ID NO: 2146828 - RNA, 16 nt, Homo sapiens
caaaguguugauggua

SEQ ID NO: 2146829 - RNA, 18 nt, Homo sapiens
cacuucgccauucauuca

SEQ ID NO: 2146830 - RNA, 22 nt, Homo sapiens
auauaaaccgugugucauguca

SEQ ID NO: 2146831 - RNA, 21 nt, Homo sapiens
cgaaggaaaagggcuuucuca

SEQ ID NO: 2146832 - RNA, 19 nt, Homo sapiens
cuuuucuaaucacaguguu

SEQ ID NO: 2146833 - RNA, 21 nt, Homo sapiens
cugcuugcuaccaaucuguga

SEQ ID NO: 2146834 - RNA, 20 nt, Homo sapiens
gggugcuugagagacacugg

SEQ ID NO: 2146835 - RNA, 19 nt, Homo sapiens
cccagucccagacaauucc

SEQ ID NO: 2146836 - RNA, 14 nt, Homo sapiens
ccugagacauauua

SEQ ID NO: 2146837 - RNA, 17 nt, Homo sapiens
uggcacuaccccaaacc

SEQ ID NO: 2146838 - RNA, 11 nt, Homo sapiens
agacccagugg

SEQ ID NO: 2146839 - RNA, 21 nt, Homo sapiens
agaauuuuguuucaaagggau

SEQ ID NO: 2146840 - RNA, 22 nt, Homo sapiens
uggaugugcccacagggaccaa

SEQ ID NO: 2146841 - RNA, 16 nt, Homo sapiens
aguaauuucuucucaa

SEQ ID NO: 2146842 - RNA, 20 nt, Homo sapiens
cugagcccccugaccuucca

SEQ ID NO: 2146843 - RNA, 15 nt, Homo sapiens
gcacauuaacuucug

SEQ ID NO: 2146844 - RNA, 20 nt, Homo sapiens
auuuacuauuacgugcuauu

SEQ ID NO: 2146845 - RNA, 19 nt, Homo sapiens
ucucauuuaaaaugagauc

SEQ ID NO: 2146846 - RNA, 16 nt, Homo sapiens
gccaguuuuacuguga

SEQ ID NO: 2146847 - RNA, 20 nt, Homo sapiens
cuucuaugguugacauugua

SEQ ID NO: 2146848 - RNA, 15 nt, Homo sapiens
uccuuggaaauugga

SEQ ID NO: 2146849 - RNA, 13 nt, Homo sapiens
ggaaaauggugcc

SEQ ID NO: 2146850 - RNA, 15 nt, Homo sapiens
gagaugcagcuggaa

SEQ ID NO: 2146851 - RNA, 11 nt, Homo sapiens
guaaaauaugu

SEQ ID NO: 2146852 - RNA, 16 nt, Homo sapiens
uaagccuuugacuuaa

SEQ ID NO: 2146853 - RNA, 20 nt, Homo sapiens
acacuguguaaauacccaua

SEQ ID NO: 2146854 - RNA, 18 nt, Homo sapiens
gucuguuuggaagaccag

SEQ ID NO: 2146855 - RNA, 12 nt, Homo sapiens
caggauggagug

SEQ ID NO: 2146856 - RNA, 15 nt, Homo sapiens
uuacaagcauaacau

SEQ ID NO: 2146857 - RNA, 15 nt, Homo sapiens
gaagaucaagccagu

SEQ ID NO: 2146858 - RNA, 16 nt, Homo sapiens
auuauguauaaacaua

SEQ ID NO: 2146859 - RNA, 15 nt, Homo sapiens
guccccucacgugac

SEQ ID NO: 2146860 - RNA, 14 nt, Homo sapiens
ggguugguaucuca

SEQ ID NO: 2146861 - RNA, 19 nt, Homo sapiens
ggccaagagcaucgugacc

SEQ ID NO: 2146862 - RNA, 23 nt, Homo sapiens
ggcuucccuucuccccagccaga

SEQ ID NO: 2146863 - RNA, 18 nt, Homo sapiens
aacugccuccuugccagc

SEQ ID NO: 2146864 - RNA, 16 nt, Homo sapiens
aguucaacucauggag

SEQ ID NO: 2146865 - RNA, 12 nt, Homo sapiens
cuagacuaaaga

SEQ ID NO: 2146866 - RNA, 21 nt, Homo sapiens
cuuuucaguguuuuuucacuu

SEQ ID NO: 2146867 - RNA, 20 nt, Homo sapiens
guccaccgaccagacccugg

SEQ ID NO: 2146868 - RNA, 15 nt, Homo sapiens
aggcacgaagcaauu

SEQ ID NO: 2146869 - RNA, 13 nt, Homo sapiens
agacucagugcac

SEQ ID NO: 2146870 - RNA, 18 nt, Homo sapiens
ucuacacauauaaacaca

SEQ ID NO: 2146871 - RNA, 12 nt, Homo sapiens
gagacacaggga

SEQ ID NO: 2146872 - RNA, 16 nt, Homo sapiens
guccuauuauauucau

SEQ ID NO: 2146873 - RNA, 21 nt, Homo sapiens
agacugcccagcuaaagcaau

SEQ ID NO: 2146874 - RNA, 17 nt, Homo sapiens
cuucugcuccauagaca

SEQ ID NO: 2146875 - RNA, 14 nt, Homo sapiens
uaaucucacauuca

SEQ ID NO: 2146876 - RNA, 13 nt, Homo sapiens
aauggcagguguc

SEQ ID NO: 2146877 - RNA, 19 nt, Homo sapiens
uggugagaugcagcuggaa

SEQ ID NO: 2146878 - RNA, 19 nt, Homo sapiens
cccggguggggcugcagaa

SEQ ID NO: 2146879 - RNA, 18 nt, Homo sapiens
caggagacagaccacuug

SEQ ID NO: 2146880 - RNA, 23 nt, Homo sapiens
gaaaaguguguauauauuuugug

SEQ ID NO: 2146881 - RNA, 16 nt, Homo sapiens
agagcuuuccuacuug

SEQ ID NO: 2146882 - RNA, 23 nt, Homo sapiens
aggaaaaugugcacacauauaca

SEQ ID NO: 2146883 - RNA, 17 nt, Homo sapiens
cccaaaggccaacagca

SEQ ID NO: 2146884 - RNA, 23 nt, Homo sapiens
uauaguauuuaacgaagccuaga

SEQ ID NO: 2146885 - RNA, 18 nt, Homo sapiens
uauagugacaugcaguua

SEQ ID NO: 2146886 - RNA, 16 nt, Homo sapiens
guugaugaaauaucaa

SEQ ID NO: 2146887 - RNA, 13 nt, Homo sapiens
cuguuaacugaau

SEQ ID NO: 2146888 - RNA, 13 nt, Homo sapiens
ugagcuacuucag

SEQ ID NO: 2146889 - RNA, 22 nt, Homo sapiens
cuggaucuuauacccaacacac

SEQ ID NO: 2146890 - RNA, 20 nt, Homo sapiens
cucacgucuguaaucccagc

SEQ ID NO: 2146891 - RNA, 22 nt, Homo sapiens
agguguucaagaccagccugac

SEQ ID NO: 2146892 - RNA, 15 nt, Homo sapiens
cauaauaugcauaua

SEQ ID NO: 2146893 - RNA, 15 nt, Homo sapiens
cauuaaaugcaaaaa

SEQ ID NO: 2146894 - RNA, 15 nt, Homo sapiens
gauauuuuccauuuu

SEQ ID NO: 2146895 - RNA, 13 nt, Homo sapiens
cugucuccauggc

SEQ ID NO: 2146896 - RNA, 18 nt, Homo sapiens
aauccugcauuugcagau

SEQ ID NO: 2146897 - RNA, 17 nt, Homo sapiens
ucuccccugcacuguaa

SEQ ID NO: 2146898 - RNA, 17 nt, Homo sapiens
guucuguuauaccccau

SEQ ID NO: 2146899 - RNA, 19 nt, Homo sapiens
ugcacagucacugcucuuc

SEQ ID NO: 2146900 - RNA, 17 nt, Homo sapiens
ucagugguggucuucaa

SEQ ID NO: 2146901 - RNA, 13 nt, Homo sapiens
augucuggcucaa

SEQ ID NO: 2146902 - RNA, 15 nt, Homo sapiens
guauagacaucugcc

SEQ ID NO: 2146903 - RNA, 20 nt, Homo sapiens
acaauguuucagaagcccca

SEQ ID NO: 2146904 - RNA, 20 nt, Homo sapiens
agugcaauaccuggcagcua

SEQ ID NO: 2146905 - RNA, 14 nt, Homo sapiens
cugcgucugcucuu

SEQ ID NO: 2146906 - RNA, 22 nt, Homo sapiens
cucaugaaugaaaauacaucuu

SEQ ID NO: 2146907 - RNA, 16 nt, Homo sapiens
auuuucagucaucuca

SEQ ID NO: 2146908 - RNA, 21 nt, Homo sapiens
caggucaacuucagagacuau

SEQ ID NO: 2146909 - RNA, 22 nt, Homo sapiens
uguauaguuuuuagucugugua

SEQ ID NO: 2146910 - RNA, 16 nt, Homo sapiens
cuccugaccucaggug

SEQ ID NO: 2146911 - RNA, 15 nt, Homo sapiens
cccacuggauccauc

SEQ ID NO: 2146912 - RNA, 15 nt, Homo sapiens
uccaagucucagugg

SEQ ID NO: 2146913 - RNA, 22 nt, Homo sapiens
gauauaucuuuaauaaguaauc

SEQ ID NO: 2146914 - RNA, 21 nt, Homo sapiens
ucaauuucagaaacuaagaau

SEQ ID NO: 2146915 - RNA, 22 nt, Homo sapiens
ggcagacacuguuugcccagug

SEQ ID NO: 2146916 - RNA, 17 nt, Homo sapiens
caccuuccccagaacca

SEQ ID NO: 2146917 - RNA, 20 nt, Homo sapiens
uuauccuccaccgucuuucu

SEQ ID NO: 2146918 - RNA, 18 nt, Homo sapiens
ccuugcuguuuucaucuc

SEQ ID NO: 2146919 - RNA, 17 nt, Homo sapiens
cacagcccgcaugcagc

SEQ ID NO: 2146920 - RNA, 17 nt, Homo sapiens
augaaguucuaucuagu

SEQ ID NO: 2146921 - RNA, 14 nt, Homo sapiens
cagagcuugaacac

SEQ ID NO: 2146922 - RNA, 24 nt, Homo sapiens
agagguccuccacgcuuguuugcc

SEQ ID NO: 2146923 - RNA, 16 nt, Homo sapiens
ugaacaaauggccuuu

SEQ ID NO: 2146924 - RNA, 18 nt, Homo sapiens
cuggagugcaguggcaca

SEQ ID NO: 2146925 - RNA, 22 nt, Homo sapiens
gugaucuauuacucugacauaa

SEQ ID NO: 2146926 - RNA, 17 nt, Homo sapiens
agcuaguucccaugacu

SEQ ID NO: 2146927 - RNA, 14 nt, Homo sapiens
agcaggcuuuguga

SEQ ID NO: 2146928 - RNA, 19 nt, Homo sapiens
gagccaggcacacacugug

SEQ ID NO: 2146929 - RNA, 14 nt, Homo sapiens
cagacacacccaca

SEQ ID NO: 2146930 - RNA, 15 nt, Homo sapiens
auucauauaggccag

SEQ ID NO: 2146931 - RNA, 18 nt, Homo sapiens
auacuccauacauaacuu

SEQ ID NO: 2146932 - RNA, 17 nt, Homo sapiens
cugcaagugugugcucu

SEQ ID NO: 2146933 - RNA, 17 nt, Homo sapiens
ggcauagcucuggggug

SEQ ID NO: 2146934 - RNA, 20 nt, Homo sapiens
ccagagcaaaaauguaaaaa

SEQ ID NO: 2146935 - RNA, 14 nt, Homo sapiens
gauagagugggaca

SEQ ID NO: 2146936 - RNA, 14 nt, Homo sapiens
gaggguguggugcu

SEQ ID NO: 2146937 - RNA, 12 nt, Homo sapiens
cgucucaagacu

SEQ ID NO: 2146938 - RNA, 22 nt, Homo sapiens
aagggaucugcuugauauccca

SEQ ID NO: 2146939 - RNA, 16 nt, Homo sapiens
gccacagauagcugcc

SEQ ID NO: 2146940 - RNA, 20 nt, Homo sapiens
aggggcaggcacagcacagg

SEQ ID NO: 2146941 - RNA, 21 nt, Homo sapiens
gucccaccccuaccucuagua

SEQ ID NO: 2146942 - RNA, 18 nt, Homo sapiens
aggucaagaacacaguga

SEQ ID NO: 2146943 - RNA, 18 nt, Homo sapiens
ucaugagaagucacucac

SEQ ID NO: 2146944 - RNA, 13 nt, Homo sapiens
cuccugugcuauu

SEQ ID NO: 2146945 - RNA, 13 nt, Homo sapiens
gccuuguggcacu

SEQ ID NO: 2146946 - RNA, 17 nt, Homo sapiens
accuuggcaguguggac

SEQ ID NO: 2146947 - RNA, 17 nt, Homo sapiens
gcugugcuccuguggau

SEQ ID NO: 2146948 - RNA, 19 nt, Homo sapiens
uuccugcugccauccucac

SEQ ID NO: 2146949 - RNA, 18 nt, Homo sapiens
ggcuuccccucugucaaa

SEQ ID NO: 2146950 - RNA, 15 nt, Homo sapiens
caauagcauaucaca

SEQ ID NO: 2146951 - RNA, 19 nt, Homo sapiens
ucauaaagguuuacaguga

SEQ ID NO: 2146952 - RNA, 16 nt, Homo sapiens
uucuaggccacuggga

SEQ ID NO: 2146953 - RNA, 23 nt, Homo sapiens
uuaacauccuuauucagccuuau

SEQ ID NO: 2146954 - RNA, 17 nt, Homo sapiens
accauauguccacuguu

SEQ ID NO: 2146955 - RNA, 19 nt, Homo sapiens
augguggacucgccuguaa

SEQ ID NO: 2146956 - RNA, 13 nt, Homo sapiens
gucuauguguaua

SEQ ID NO: 2146957 - RNA, 13 nt, Homo sapiens
aucuguguauaug

SEQ ID NO: 2146958 - RNA, 20 nt, Homo sapiens
aagaagauucuuaccaagag

SEQ ID NO: 2146959 - RNA, 19 nt, Homo sapiens
agcuuaucuuucuuuccau

SEQ ID NO: 2146960 - RNA, 14 nt, Homo sapiens
aggguuaugauuaa

SEQ ID NO: 2146961 - RNA, 15 nt, Homo sapiens
ccuccaggcugaggg

SEQ ID NO: 2146962 - RNA, 12 nt, Homo sapiens
agauggccauau

SEQ ID NO: 2146963 - RNA, 17 nt, Homo sapiens
uagcuggugguuucacg

SEQ ID NO: 2146964 - RNA, 21 nt, Homo sapiens
cucacagccgcauuggugacu

SEQ ID NO: 2146965 - RNA, 17 nt, Homo sapiens
guggaucacgaggucag

SEQ ID NO: 2146966 - RNA, 16 nt, Homo sapiens
acacacccugagguca

SEQ ID NO: 2146967 - RNA, 16 nt, Homo sapiens
ccugugugcgugcgca

SEQ ID NO: 2146968 - RNA, 18 nt, Homo sapiens
ucuuccaaaccaccuucc

SEQ ID NO: 2146969 - RNA, 18 nt, Homo sapiens
ccuugguuaucaaauaca

SEQ ID NO: 2146970 - RNA, 16 nt, Homo sapiens
ugagucagugccauga

SEQ ID NO: 2146971 - RNA, 17 nt, Homo sapiens
uguggacuucaucucaa

SEQ ID NO: 2146972 - RNA, 19 nt, Homo sapiens
ccaauaaaaaguucagagu

SEQ ID NO: 2146973 - RNA, 21 nt, Homo sapiens
gugcuuuauaccccauuugau

SEQ ID NO: 2146974 - RNA, 22 nt, Homo sapiens
uuuuccacauaggaaaaugcca

SEQ ID NO: 2146975 - RNA, 14 nt, Homo sapiens
cguucagccccuga

SEQ ID NO: 2146976 - RNA, 15 nt, Homo sapiens
gggcuccacgggcag

SEQ ID NO: 2146977 - RNA, 14 nt, Homo sapiens
ugcuaaaugcacug

SEQ ID NO: 2146978 - RNA, 20 nt, Homo sapiens
gcucuucucuccaguguuuc

SEQ ID NO: 2146979 - RNA, 15 nt, Homo sapiens
ccaaggggcagucug

SEQ ID NO: 2146980 - RNA, 19 nt, Homo sapiens
cuuuaagacagaauucacu

SEQ ID NO: 2146981 - RNA, 16 nt, Homo sapiens
caggaugccaaguggc

SEQ ID NO: 2146982 - RNA, 12 nt, Homo sapiens
aaaccaaacucu

SEQ ID NO: 2146983 - RNA, 18 nt, Homo sapiens
ugacuuuuuaaaauauaa

SEQ ID NO: 2146984 - RNA, 17 nt, Homo sapiens
ccaauccacacauauug

SEQ ID NO: 2146985 - RNA, 12 nt, Homo sapiens
guuaugccauga

SEQ ID NO: 2146986 - RNA, 12 nt, Homo sapiens
guuuugccaugu

SEQ ID NO: 2146987 - RNA, 23 nt, Homo sapiens
uggagcucauuuuccacauggca

SEQ ID NO: 2146988 - RNA, 19 nt, Homo sapiens
augaauucugucauuucaa

SEQ ID NO: 2146989 - RNA, 17 nt, Homo sapiens
cucugccgcuaccuccc

SEQ ID NO: 2146990 - RNA, 13 nt, Homo sapiens
aauuuuaauugaa

SEQ ID NO: 2146991 - RNA, 17 nt, Homo sapiens
ucuguuuggaagaccag

SEQ ID NO: 2146992 - RNA, 22 nt, Homo sapiens
gaaaaagaagguugagggcaau

SEQ ID NO: 2146993 - RNA, 13 nt, Homo sapiens
ucugcaguucuca

SEQ ID NO: 2146994 - RNA, 19 nt, Homo sapiens
uguuaauaaaaauaagaaa

SEQ ID NO: 2146995 - RNA, 15 nt, Homo sapiens
uguaccuuguguacu

SEQ ID NO: 2146996 - RNA, 17 nt, Homo sapiens
acuaaacugcugcaaaa

SEQ ID NO: 2146997 - RNA, 15 nt, Homo sapiens
ucacauauucaucag

SEQ ID NO: 2146998 - RNA, 15 nt, Homo sapiens
ugcuauguugcccaa

SEQ ID NO: 2146999 - RNA, 16 nt, Homo sapiens
aguagaauaagccuuc

SEQ ID NO: 2147000 - RNA, 22 nt, Homo sapiens
accuccuccugcugcucacucc

SEQ ID NO: 2147001 - RNA, 15 nt, Homo sapiens
acuugcccugagcac

SEQ ID NO: 2147002 - RNA, 15 nt, Homo sapiens
gagacagauaccucc

SEQ ID NO: 2147003 - RNA, 17 nt, Homo sapiens
acagugugggaccugcc

SEQ ID NO: 2147004 - RNA, 18 nt, Homo sapiens
agcaaagcuuaaaugccu

SEQ ID NO: 2147005 - RNA, 16 nt, Homo sapiens
caggaguaaaacuccc

SEQ ID NO: 2147006 - RNA, 21 nt, Homo sapiens
ccucccuguuugauauuaaaa

SEQ ID NO: 2147007 - RNA, 18 nt, Homo sapiens
ucccuacagggugucugu

SEQ ID NO: 2147008 - RNA, 15 nt, Homo sapiens
uucaucuauucuuuc

SEQ ID NO: 2147009 - RNA, 19 nt, Homo sapiens
aauuuuuaugaaauacugc

SEQ ID NO: 2147010 - RNA, 20 nt, Homo sapiens
agacaugguggcaugcaccu

SEQ ID NO: 2147011 - RNA, 22 nt, Homo sapiens
uggaguauuuggaagcaacgug

SEQ ID NO: 2147012 - RNA, 20 nt, Homo sapiens
cuggaauuauucuaugucaa

SEQ ID NO: 2147013 - RNA, 19 nt, Homo sapiens
ucaugucuaagaacucuuu

SEQ ID NO: 2147014 - RNA, 15 nt, Homo sapiens
uuucaauuauuucaa

SEQ ID NO: 2147015 - RNA, 12 nt, Homo sapiens
auuuuugcaaug

SEQ ID NO: 2147016 - RNA, 17 nt, Homo sapiens
ccaccauugucagcuca

SEQ ID NO: 2147017 - RNA, 18 nt, Homo sapiens
agugauagaaaagugugg

SEQ ID NO: 2147018 - RNA, 13 nt, Homo sapiens
uucagcaagguga

SEQ ID NO: 2147019 - RNA, 18 nt, Homo sapiens
acuguauuuccuucucau

SEQ ID NO: 2147020 - RNA, 21 nt, Homo sapiens
agcuacccacagagcaaguga

SEQ ID NO: 2147021 - RNA, 18 nt, Homo sapiens
ugaauaaagcacgugcaa

SEQ ID NO: 2147022 - RNA, 17 nt, Homo sapiens
gaauauggacuuggaaa

SEQ ID NO: 2147023 - RNA, 17 nt, Homo sapiens
acgagggauaauucaaa

SEQ ID NO: 2147024 - RNA, 22 nt, Homo sapiens
gcacauuuucagacugcaauau

SEQ ID NO: 2147025 - RNA, 13 nt, Homo sapiens
ugggaggcuguga

SEQ ID NO: 2147026 - RNA, 18 nt, Homo sapiens
agguaugccaccaacacu

SEQ ID NO: 2147027 - RNA, 20 nt, Homo sapiens
augaaucucguucccaaaga

SEQ ID NO: 2147028 - RNA, 12 nt, Homo sapiens
agcaacaacuua

SEQ ID NO: 2147029 - RNA, 11 nt, Homo sapiens
aaaaaugcacc

SEQ ID NO: 2147030 - RNA, 16 nt, Homo sapiens
ccuuaaaaaugcacac

SEQ ID NO: 2147031 - RNA, 17 nt, Homo sapiens
acugccaucauuuacuu

SEQ ID NO: 2147032 - RNA, 11 nt, Homo sapiens
ccuccaucuca

SEQ ID NO: 2147033 - RNA, 13 nt, Homo sapiens
gaguggaugccuc

SEQ ID NO: 2147034 - RNA, 18 nt, Homo sapiens
aggugggagaggccucau

SEQ ID NO: 2147035 - RNA, 16 nt, Homo sapiens
cuucacucaggucuca

SEQ ID NO: 2147036 - RNA, 21 nt, Homo sapiens
auuuccuaggcugacuaagaa

SEQ ID NO: 2147037 - RNA, 23 nt, Homo sapiens
auggguuagggaaaacauuccau

SEQ ID NO: 2147038 - RNA, 16 nt, Homo sapiens
ccagugcaguccauuu

SEQ ID NO: 2147039 - RNA, 23 nt, Homo sapiens
aaugaaccaucuucguacaugaa

SEQ ID NO: 2147040 - RNA, 22 nt, Homo sapiens
gucuuaaaugagaaguacuugg

SEQ ID NO: 2147041 - RNA, 17 nt, Homo sapiens
cuagccuuugggcacaa

SEQ ID NO: 2147042 - RNA, 19 nt, Homo sapiens
ccaugaagcgaaacacaga

SEQ ID NO: 2147043 - RNA, 13 nt, Homo sapiens
cccaggaguacac

SEQ ID NO: 2147044 - RNA, 16 nt, Homo sapiens
gcugcaccuggucaua

SEQ ID NO: 2147045 - RNA, 15 nt, Homo sapiens
auuuuuaaggacuuu

SEQ ID NO: 2147046 - RNA, 19 nt, Homo sapiens
agccucaugccaacccugg

SEQ ID NO: 2147047 - RNA, 14 nt, Homo sapiens
ugugccgccaccuc

SEQ ID NO: 2147048 - RNA, 16 nt, Homo sapiens
cuuuuggcaguucuga

SEQ ID NO: 2147049 - RNA, 21 nt, Homo sapiens
cugucacuagucucaccagcc

SEQ ID NO: 2147050 - RNA, 15 nt, Homo sapiens
aggcccagcagccuu

SEQ ID NO: 2147051 - RNA, 15 nt, Homo sapiens
ggagguugagugagc

SEQ ID NO: 2147052 - RNA, 15 nt, Homo sapiens
aauuaugagucucua

SEQ ID NO: 2147053 - RNA, 16 nt, Homo sapiens
ucuauggcacccaugc

SEQ ID NO: 2147054 - RNA, 22 nt, Homo sapiens
cagacuacagccagaagcccau

SEQ ID NO: 2147055 - RNA, 19 nt, Homo sapiens
aguacucaguaacacagug

SEQ ID NO: 2147056 - RNA, 18 nt, Homo sapiens
aaugaccaaggacugcua

SEQ ID NO: 2147057 - RNA, 22 nt, Homo sapiens
ucuguaaaucaagaccaaagag

SEQ ID NO: 2147058 - RNA, 13 nt, Homo sapiens
uuccuaugaugua

SEQ ID NO: 2147059 - RNA, 17 nt, Homo sapiens
ucgccauucuugcugaa

SEQ ID NO: 2147060 - RNA, 14 nt, Homo sapiens
ugaagccugcaugu

SEQ ID NO: 2147061 - RNA, 12 nt, Homo sapiens
uucggcauuuga

SEQ ID NO: 2147062 - RNA, 14 nt, Homo sapiens
cagguuuguuacau

SEQ ID NO: 2147063 - RNA, 18 nt, Homo sapiens
acagugggcagcaccuuu

SEQ ID NO: 2147064 - RNA, 19 nt, Homo sapiens
acucugucuggauuugccu

SEQ ID NO: 2147065 - RNA, 23 nt, Homo sapiens
auucagacuugauuuacaauuua

SEQ ID NO: 2147066 - RNA, 15 nt, Homo sapiens
uggauccuagccuua

SEQ ID NO: 2147067 - RNA, 17 nt, Homo sapiens
acgagccuccucagggg

SEQ ID NO: 2147068 - RNA, 16 nt, Homo sapiens
accuagaacacuaacu

SEQ ID NO: 2147069 - RNA, 18 nt, Homo sapiens
ucggaguccaaaggguuu

SEQ ID NO: 2147070 - RNA, 15 nt, Homo sapiens
cuguugcauauacca

SEQ ID NO: 2147071 - RNA, 15 nt, Homo sapiens
aauacuuaaugccaa

SEQ ID NO: 2147072 - RNA, 11 nt, Homo sapiens
uacaguggaau

SEQ ID NO: 2147073 - RNA, 15 nt, Homo sapiens
uaugcaaguuagggu

SEQ ID NO: 2147074 - RNA, 22 nt, Homo sapiens
acaaaaauacuguaagucucaa

SEQ ID NO: 2147075 - RNA, 11 nt, Homo sapiens
guaugugaaca

SEQ ID NO: 2147076 - RNA, 17 nt, Homo sapiens
cuagucgacacuaagaa

SEQ ID NO: 2147077 - RNA, 12 nt, Homo sapiens
gaaaagauuuua

SEQ ID NO: 2147078 - RNA, 23 nt, Homo sapiens
acauuuccgugagagucaucuca

SEQ ID NO: 2147079 - RNA, 20 nt, Homo sapiens
cuucugcuuuuuuucaggga

SEQ ID NO: 2147080 - RNA, 18 nt, Homo sapiens
ugccuuuugcaaacuuua

SEQ ID NO: 2147081 - RNA, 13 nt, Homo sapiens
auuguaacgacuu

SEQ ID NO: 2147082 - RNA, 19 nt, Homo sapiens
agaucauuuggagcucuug

SEQ ID NO: 2147083 - RNA, 19 nt, Homo sapiens
aucugcuuaccacaucaca

SEQ ID NO: 2147084 - RNA, 21 nt, Homo sapiens
gcaccaaugcccagcagggga

SEQ ID NO: 2147085 - RNA, 14 nt, Homo sapiens
uagcuguagguuuu

SEQ ID NO: 2147086 - RNA, 22 nt, Homo sapiens
caaaguuaaaagcaaacacuua

SEQ ID NO: 2147087 - RNA, 19 nt, Homo sapiens
agcucccauuucuacucuc

SEQ ID NO: 2147088 - RNA, 21 nt, Homo sapiens
ugugcaguggugcaugcacug

SEQ ID NO: 2147089 - RNA, 19 nt, Homo sapiens
guaaguuauagaagagaaa

SEQ ID NO: 2147090 - RNA, 20 nt, Homo sapiens
caacagccaacagcuacaac

SEQ ID NO: 2147091 - RNA, 17 nt, Homo sapiens
agucuuugaagcugaaa

SEQ ID NO: 2147092 - RNA, 21 nt, Homo sapiens
cccagcgcuuugggaggccga

SEQ ID NO: 2147093 - RNA, 22 nt, Homo sapiens
cagguccuccccucucuuguca

SEQ ID NO: 2147094 - RNA, 14 nt, Homo sapiens
gaaguaugagggaa

SEQ ID NO: 2147095 - RNA, 21 nt, Homo sapiens
aaaugcagacaacaccuuccu

SEQ ID NO: 2147096 - RNA, 16 nt, Homo sapiens
agcaaauugacaugcu

SEQ ID NO: 2147097 - RNA, 16 nt, Homo sapiens
agugucaggcacuggg

SEQ ID NO: 2147098 - RNA, 16 nt, Homo sapiens
gacaggggcucaggau

SEQ ID NO: 2147099 - RNA, 15 nt, Homo sapiens
gcuaacccccaaaua

SEQ ID NO: 2147100 - RNA, 18 nt, Homo sapiens
cuaaaggccacagcugag

SEQ ID NO: 2147101 - RNA, 17 nt, Homo sapiens
agaauugccaucgguca

SEQ ID NO: 2147102 - RNA, 15 nt, Homo sapiens
cgccuuuuguauaca

SEQ ID NO: 2147103 - RNA, 12 nt, Homo sapiens
uccaaugagcuc

SEQ ID NO: 2147104 - RNA, 13 nt, Homo sapiens
gaauuucuaagaa

SEQ ID NO: 2147105 - RNA, 16 nt, Homo sapiens
uugagcccucccagca

SEQ ID NO: 2147106 - RNA, 17 nt, Homo sapiens
aagacugguauucucuu

SEQ ID NO: 2147107 - RNA, 13 nt, Homo sapiens
uugcuuguuuauu

SEQ ID NO: 2147108 - RNA, 16 nt, Homo sapiens
augaggaaacugcacu

SEQ ID NO: 2147109 - RNA, 14 nt, Homo sapiens
uguaaauuccaaag

SEQ ID NO: 2147110 - RNA, 18 nt, Homo sapiens
aacucagaucacuacugc

SEQ ID NO: 2147111 - RNA, 18 nt, Homo sapiens
aucuuucuuuaccugaga

SEQ ID NO: 2147112 - RNA, 18 nt, Homo sapiens
cuugcacucuuuaacaca

SEQ ID NO: 2147113 - RNA, 17 nt, Homo sapiens
ucauaauaucaugugca

SEQ ID NO: 2147114 - RNA, 19 nt, Homo sapiens
uacauaugagaauauaccu

SEQ ID NO: 2147115 - RNA, 13 nt, Homo sapiens
cuccauuaaccaa

SEQ ID NO: 2147116 - RNA, 15 nt, Homo sapiens
ugucuuacugugauc

SEQ ID NO: 2147117 - RNA, 17 nt, Homo sapiens
guggaacaaccugcugg

SEQ ID NO: 2147118 - RNA, 13 nt, Homo sapiens
ccuagaaacacac

SEQ ID NO: 2147119 - RNA, 13 nt, Homo sapiens
uauuacacauuaa

SEQ ID NO: 2147120 - RNA, 17 nt, Homo sapiens
cagcauuuucauaucca

SEQ ID NO: 2147121 - RNA, 18 nt, Homo sapiens
ucugacaugauuccuucc

SEQ ID NO: 2147122 - RNA, 22 nt, Homo sapiens
cugccuucuccccuccaaguga

SEQ ID NO: 2147123 - RNA, 17 nt, Homo sapiens
ggaugcuccggggccau

SEQ ID NO: 2147124 - RNA, 13 nt, Homo sapiens
acaggcccagcgc

SEQ ID NO: 2147125 - RNA, 22 nt, Homo sapiens
uaaauagcuuuugugucuuaca

SEQ ID NO: 2147126 - RNA, 14 nt, Homo sapiens
aggaacauguggug

SEQ ID NO: 2147127 - RNA, 11 nt, Homo sapiens
cuccucuguca

SEQ ID NO: 2147128 - RNA, 13 nt, Homo sapiens
uaucuaagacuca

SEQ ID NO: 2147129 - RNA, 19 nt, Homo sapiens
uaauauuuuuccacuuaaa

SEQ ID NO: 2147130 - RNA, 21 nt, Homo sapiens
aguuuggauaaaaaauggcag

SEQ ID NO: 2147131 - RNA, 19 nt, Homo sapiens
agagaucgacagacagcca

SEQ ID NO: 2147132 - RNA, 23 nt, Homo sapiens
cucagccacugucacaggcauau

SEQ ID NO: 2147133 - RNA, 18 nt, Homo sapiens
ugcuugggcuauaccugg

SEQ ID NO: 2147134 - RNA, 22 nt, Homo sapiens
acccagccuaucaggugccccu

SEQ ID NO: 2147135 - RNA, 12 nt, Homo sapiens
uaucacaaucuc

SEQ ID NO: 2147136 - RNA, 12 nt, Homo sapiens
acacacaaaaac

SEQ ID NO: 2147137 - RNA, 14 nt, Homo sapiens
acacgugaugugau

SEQ ID NO: 2147138 - RNA, 20 nt, Homo sapiens
cuuacuccugguucagugcc

SEQ ID NO: 2147139 - RNA, 14 nt, Homo sapiens
gaaaucccaucagg

SEQ ID NO: 2147140 - RNA, 11 nt, Homo sapiens
aaaaugaauuu

SEQ ID NO: 2147141 - RNA, 21 nt, Homo sapiens
augagcuuuuuauucuacuac

SEQ ID NO: 2147142 - RNA, 20 nt, Homo sapiens
gaacaguccauaacuuaccu

SEQ ID NO: 2147143 - RNA, 17 nt, Homo sapiens
acaguacuuuauuguac

SEQ ID NO: 2147144 - RNA, 20 nt, Homo sapiens
guccugggggcugcugcacu

SEQ ID NO: 2147145 - RNA, 20 nt, Homo sapiens
ucacccccaccucaagguca

SEQ ID NO: 2147146 - RNA, 21 nt, Homo sapiens
cuccuguauuugagacuagga

SEQ ID NO: 2147147 - RNA, 17 nt, Homo sapiens
uaauguacguuacagcu

SEQ ID NO: 2147148 - RNA, 14 nt, Homo sapiens
cuacagacuaaaga

SEQ ID NO: 2147149 - RNA, 12 nt, Homo sapiens
acacccaccucu

SEQ ID NO: 2147150 - RNA, 15 nt, Homo sapiens
agaaugaugcuauga

SEQ ID NO: 2147151 - RNA, 16 nt, Homo sapiens
aacagcauaacuaaau

SEQ ID NO: 2147152 - RNA, 16 nt, Homo sapiens
uuauaaaauuaagcaa

SEQ ID NO: 2147153 - RNA, 22 nt, Homo sapiens
uagaagguucucuccuccccaa

SEQ ID NO: 2147154 - RNA, 22 nt, Homo sapiens
ucuuaauuauuguacauuuaua

SEQ ID NO: 2147155 - RNA, 21 nt, Homo sapiens
ugaggcggguggaucacuuga

SEQ ID NO: 2147156 - RNA, 14 nt, Homo sapiens
uccagaaguaagua

SEQ ID NO: 2147157 - RNA, 21 nt, Homo sapiens
auauuuuuagauacagugaaa

SEQ ID NO: 2147158 - RNA, 17 nt, Homo sapiens
cuucccacuuugccacu

SEQ ID NO: 2147159 - RNA, 17 nt, Homo sapiens
cuaguugaauacuugaa

SEQ ID NO: 2147160 - RNA, 17 nt, Homo sapiens
cagcccagaaggccaga

SEQ ID NO: 2147161 - RNA, 17 nt, Homo sapiens
ucuccagcccugcagcu

SEQ ID NO: 2147162 - RNA, 20 nt, Homo sapiens
gcccugaaagucccagauca

SEQ ID NO: 2147163 - RNA, 20 nt, Homo sapiens
aucaaaauauuucagugaau

SEQ ID NO: 2147164 - RNA, 13 nt, Homo sapiens
cccagcacuguga

SEQ ID NO: 2147165 - RNA, 23 nt, Homo sapiens
uagccaguugaauuuauggaauc

SEQ ID NO: 2147166 - RNA, 17 nt, Homo sapiens
gcuuuccagacuuugaa

SEQ ID NO: 2147167 - RNA, 14 nt, Homo sapiens
aacugagccaaaaa

SEQ ID NO: 2147168 - RNA, 17 nt, Homo sapiens
auuucuccguugaguca

SEQ ID NO: 2147169 - RNA, 17 nt, Homo sapiens
auacauaggaugacaaa

SEQ ID NO: 2147170 - RNA, 13 nt, Homo sapiens
cuucucugugaac

SEQ ID NO: 2147171 - RNA, 13 nt, Homo sapiens
cuacccuguguau

SEQ ID NO: 2147172 - RNA, 14 nt, Homo sapiens
aagugugagaagac

SEQ ID NO: 2147173 - RNA, 20 nt, Homo sapiens
aguucaggaagguacaaaca

SEQ ID NO: 2147174 - RNA, 18 nt, Homo sapiens
uguccucaaaaggaauaa

SEQ ID NO: 2147175 - RNA, 23 nt, Homo sapiens
caaaacuuccuguuuguggaaca

SEQ ID NO: 2147176 - RNA, 21 nt, Homo sapiens
ggugguuuuauuucaaaggga

SEQ ID NO: 2147177 - RNA, 15 nt, Homo sapiens
cauguuugcaccugu

SEQ ID NO: 2147178 - RNA, 21 nt, Homo sapiens
auagcacugguuuguuucuca

SEQ ID NO: 2147179 - RNA, 14 nt, Homo sapiens
uaguuauaaucuga

SEQ ID NO: 2147180 - RNA, 16 nt, Homo sapiens
uggcaagcugcaaaag

SEQ ID NO: 2147181 - RNA, 17 nt, Homo sapiens
accugggguuuugacuu

SEQ ID NO: 2147182 - RNA, 22 nt, Homo sapiens
cacacaccgaugugcgcacaca

SEQ ID NO: 2147183 - RNA, 19 nt, Homo sapiens
ccacugugcugaauucugc

SEQ ID NO: 2147184 - RNA, 21 nt, Homo sapiens
ucacacacacacaauggcaag

SEQ ID NO: 2147185 - RNA, 20 nt, Homo sapiens
ucacccaggcuggagugcag

SEQ ID NO: 2147186 - RNA, 20 nt, Homo sapiens
ucacccaggcuagagugcaa

SEQ ID NO: 2147187 - RNA, 20 nt, Homo sapiens
uccauaguggaccacuugga

SEQ ID NO: 2147188 - RNA, 23 nt, Homo sapiens
uccuggggaacauagaacucaug

SEQ ID NO: 2147189 - RNA, 21 nt, Homo sapiens
cauucucccuugauuccacuu

SEQ ID NO: 2147190 - RNA, 15 nt, Homo sapiens
aauaaaugccuucca

SEQ ID NO: 2147191 - RNA, 16 nt, Homo sapiens
cauaauaaaaggaguu

SEQ ID NO: 2147192 - RNA, 15 nt, Homo sapiens
uuccaguuaaccuau

SEQ ID NO: 2147193 - RNA, 22 nt, Homo sapiens
ugacaguaauauuggcauagaa

SEQ ID NO: 2147194 - RNA, 14 nt, Homo sapiens
caaaucgugccuug

SEQ ID NO: 2147195 - RNA, 15 nt, Homo sapiens
augauuaaaaauauc

SEQ ID NO: 2147196 - RNA, 15 nt, Homo sapiens
agauaugugccaaag

SEQ ID NO: 2147197 - RNA, 15 nt, Homo sapiens
uguucuugaauuaua

SEQ ID NO: 2147198 - RNA, 14 nt, Homo sapiens
ugaaauaauuuuca

SEQ ID NO: 2147199 - RNA, 23 nt, Homo sapiens
gaaauuaaagucuuccauugcau

SEQ ID NO: 2147200 - RNA, 20 nt, Homo sapiens
aaucacagcccucaugauca

SEQ ID NO: 2147201 - RNA, 17 nt, Homo sapiens
gauccagucacagccau

SEQ ID NO: 2147202 - RNA, 16 nt, Homo sapiens
uaggcaguagacucau

SEQ ID NO: 2147203 - RNA, 14 nt, Homo sapiens
ucucaguuaggaga

SEQ ID NO: 2147204 - RNA, 15 nt, Homo sapiens
cuuaaacacaaauuu

SEQ ID NO: 2147205 - RNA, 16 nt, Homo sapiens
agacggagaugcaugg

SEQ ID NO: 2147206 - RNA, 20 nt, Homo sapiens
cucugagcacccaagccagg

SEQ ID NO: 2147207 - RNA, 15 nt, Homo sapiens
cauugucuacuccua

SEQ ID NO: 2147208 - RNA, 15 nt, Homo sapiens
uaugcauaccuggau

SEQ ID NO: 2147209 - RNA, 22 nt, Homo sapiens
aggaacugcaauaauaucaaaa

SEQ ID NO: 2147210 - RNA, 16 nt, Homo sapiens
aauuuucugaaaguua

SEQ ID NO: 2147211 - RNA, 15 nt, Homo sapiens
agccuggugcugcug

SEQ ID NO: 2147212 - RNA, 17 nt, Homo sapiens
aaucuuaaugucucuuc

SEQ ID NO: 2147213 - RNA, 15 nt, Homo sapiens
acacucaacaauaaa

SEQ ID NO: 2147214 - RNA, 13 nt, Homo sapiens
acauacuuuugca

SEQ ID NO: 2147215 - RNA, 19 nt, Homo sapiens
ucccggaggcggugggccu

SEQ ID NO: 2147216 - RNA, 16 nt, Homo sapiens
cuggcccagggcugca

SEQ ID NO: 2147217 - RNA, 22 nt, Homo sapiens
uuccugggaauaacauggugag

SEQ ID NO: 2147218 - RNA, 15 nt, Homo sapiens
acaguuuucuauucu

SEQ ID NO: 2147219 - RNA, 21 nt, Homo sapiens
ugauguuuugguguauuguca

SEQ ID NO: 2147220 - RNA, 15 nt, Homo sapiens
caaauuaaggcauaa

SEQ ID NO: 2147221 - RNA, 14 nt, Homo sapiens
acccagaaucccuc

SEQ ID NO: 2147222 - RNA, 13 nt, Homo sapiens
guucuccacuaau

SEQ ID NO: 2147223 - RNA, 18 nt, Homo sapiens
agccagcugugcacuuuc

SEQ ID NO: 2147224 - RNA, 23 nt, Homo sapiens
ucagcaaaaauauuuuaugaucc

SEQ ID NO: 2147225 - RNA, 18 nt, Homo sapiens
aaugucuuuuuaagcuua

SEQ ID NO: 2147226 - RNA, 13 nt, Homo sapiens
ggucacacucuca

SEQ ID NO: 2147227 - RNA, 15 nt, Homo sapiens
ggcuguacacugcac

SEQ ID NO: 2147228 - RNA, 14 nt, Homo sapiens
auuuaacuauucau

SEQ ID NO: 2147229 - RNA, 20 nt, Homo sapiens
acauaaguauuuaauucaug

SEQ ID NO: 2147230 - RNA, 22 nt, Homo sapiens
cuuuaaaaauacauagcauuaa

SEQ ID NO: 2147231 - RNA, 17 nt, Homo sapiens
uuaaaguuugcaguauu

SEQ ID NO: 2147232 - RNA, 19 nt, Homo sapiens
aauaauugaagagacaaua

SEQ ID NO: 2147233 - RNA, 20 nt, Homo sapiens
aaggccucuucucaacuuuu

SEQ ID NO: 2147234 - RNA, 21 nt, Homo sapiens
ucccacacgauuagcuuuauu

SEQ ID NO: 2147235 - RNA, 20 nt, Homo sapiens
cuacuuaacuugguagccuc

SEQ ID NO: 2147236 - RNA, 24 nt, Homo sapiens
ccagggcucuggcagguggccagg

SEQ ID NO: 2147237 - RNA, 22 nt, Homo sapiens
ggucucauagguugagcaauuu

SEQ ID NO: 2147238 - RNA, 20 nt, Homo sapiens
ucugggggguugccucgagu

SEQ ID NO: 2147239 - RNA, 20 nt, Homo sapiens
ggcuagaaaacaagcguuua

SEQ ID NO: 2147240 - RNA, 23 nt, Homo sapiens
ucaacucuucagccucauucacu

SEQ ID NO: 2147241 - RNA, 13 nt, Homo sapiens
gggagcaccagcg

SEQ ID NO: 2147242 - RNA, 13 nt, Homo sapiens
cacagugcaucuc

SEQ ID NO: 2147243 - RNA, 19 nt, Homo sapiens
auaaagcagggacugugaa

SEQ ID NO: 2147244 - RNA, 19 nt, Homo sapiens
aaauguuuugaaaugauau

SEQ ID NO: 2147245 - RNA, 23 nt, Homo sapiens
auacagaaguccccucuacuuua

SEQ ID NO: 2147246 - RNA, 15 nt, Homo sapiens
gaggugaacauucau

SEQ ID NO: 2147247 - RNA, 14 nt, Homo sapiens
gucacaucuuggca

SEQ ID NO: 2147248 - RNA, 16 nt, Homo sapiens
aauacuuuugcugaug

SEQ ID NO: 2147249 - RNA, 17 nt, Homo sapiens
ugugccagcaccacagc

SEQ ID NO: 2147250 - RNA, 12 nt, Homo sapiens
caagcuucauau

SEQ ID NO: 2147251 - RNA, 18 nt, Homo sapiens
ucgaaaccugggauucag

SEQ ID NO: 2147252 - RNA, 20 nt, Homo sapiens
ccucacuggggcagacaaua

SEQ ID NO: 2147253 - RNA, 22 nt, Homo sapiens
cagguggccccaguucaaucuc

SEQ ID NO: 2147254 - RNA, 19 nt, Homo sapiens
uaauuaaagcccacaaucc

SEQ ID NO: 2147255 - RNA, 12 nt, Homo sapiens
ucccuguacaau

SEQ ID NO: 2147256 - RNA, 19 nt, Homo sapiens
ucacacgguuugaagccug

SEQ ID NO: 2147257 - RNA, 15 nt, Homo sapiens
caaggcuucagucuc

SEQ ID NO: 2147258 - RNA, 20 nt, Homo sapiens
caaaagcacuggaaaugagu

SEQ ID NO: 2147259 - RNA, 23 nt, Homo sapiens
agaaaaugacuuauuucugcucu

SEQ ID NO: 2147260 - RNA, 15 nt, Homo sapiens
cccguuuccauacag

SEQ ID NO: 2147261 - RNA, 19 nt, Homo sapiens
uguuaaggagcuucaggga

SEQ ID NO: 2147262 - RNA, 12 nt, Homo sapiens
caugaacugucu

SEQ ID NO: 2147263 - RNA, 17 nt, Homo sapiens
ccugaaccuugagcaaa

SEQ ID NO: 2147264 - RNA, 23 nt, Homo sapiens
uuucuuaaguaucucaacaacau

SEQ ID NO: 2147265 - RNA, 15 nt, Homo sapiens
uuaaaucaguauucc

SEQ ID NO: 2147266 - RNA, 22 nt, Homo sapiens
agaaauuaaguaucugacaucu

SEQ ID NO: 2147267 - RNA, 17 nt, Homo sapiens
uaacauuaucuaguuca

SEQ ID NO: 2147268 - RNA, 20 nt, Homo sapiens
acuauggagucuugugaaag

SEQ ID NO: 2147269 - RNA, 13 nt, Homo sapiens
cacuuucccaaaa

SEQ ID NO: 2147270 - RNA, 23 nt, Homo sapiens
aagaauguuuaauagaaaauuaa

SEQ ID NO: 2147271 - RNA, 17 nt, Homo sapiens
aaaaauguugcagcuca

SEQ ID NO: 2147272 - RNA, 18 nt, Homo sapiens
ccaugaaacugacucauc

SEQ ID NO: 2147273 - RNA, 23 nt, Homo sapiens
cgacacggucggggcaucuggcc

SEQ ID NO: 2147274 - RNA, 22 nt, Homo sapiens
ggagagagccuugggagccacu

SEQ ID NO: 2147275 - RNA, 16 nt, Homo sapiens
cccaugaggacuagga

SEQ ID NO: 2147276 - RNA, 23 nt, Homo sapiens
uuuucccaagagcauaacuguuc

SEQ ID NO: 2147277 - RNA, 19 nt, Homo sapiens
ccccaagguccccccacag

SEQ ID NO: 2147278 - RNA, 14 nt, Homo sapiens
ccuuuggaaagcca

SEQ ID NO: 2147279 - RNA, 22 nt, Homo sapiens
uccugaggaagagggacuguuc

SEQ ID NO: 2147280 - RNA, 18 nt, Homo sapiens
auuucuaacucugaugua

SEQ ID NO: 2147281 - RNA, 21 nt, Homo sapiens
auuuguauugguucagggaac

SEQ ID NO: 2147282 - RNA, 23 nt, Homo sapiens
ccauauucuuccccgaaucacac

SEQ ID NO: 2147283 - RNA, 11 nt, Homo sapiens
ucagugcuccu

SEQ ID NO: 2147284 - RNA, 11 nt, Homo sapiens
uuugugcucua

SEQ ID NO: 2147285 - RNA, 19 nt, Homo sapiens
uccccuguacuuaccuguu

SEQ ID NO: 2147286 - RNA, 20 nt, Homo sapiens
uaucuuuuugaaagcaauau

SEQ ID NO: 2147287 - RNA, 18 nt, Homo sapiens
cuagaauccccacaggga

SEQ ID NO: 2147288 - RNA, 11 nt, Homo sapiens
guuagaaccac

SEQ ID NO: 2147289 - RNA, 13 nt, Homo sapiens
ccuccuccaggaa

SEQ ID NO: 2147290 - RNA, 21 nt, Homo sapiens
auuuccacuucuucauucucu

SEQ ID NO: 2147291 - RNA, 20 nt, Homo sapiens
ucugucuucagcacauucca

SEQ ID NO: 2147292 - RNA, 19 nt, Homo sapiens
cuaggaguugaguacagug

SEQ ID NO: 2147293 - RNA, 19 nt, Homo sapiens
uggccaagccuggcccuua

SEQ ID NO: 2147294 - RNA, 13 nt, Homo sapiens
acaaaaaacccaa

SEQ ID NO: 2147295 - RNA, 15 nt, Homo sapiens
ugccccuuggcugcu

SEQ ID NO: 2147296 - RNA, 19 nt, Homo sapiens
uaauucagaaggaucuuca

SEQ ID NO: 2147297 - RNA, 15 nt, Homo sapiens
acacucaaucuagaa

SEQ ID NO: 2147298 - RNA, 14 nt, Homo sapiens
agaaugcuauuuca

SEQ ID NO: 2147299 - RNA, 19 nt, Homo sapiens
ugacugagcagacugguga

SEQ ID NO: 2147300 - RNA, 22 nt, Homo sapiens
uaaccaaaugcaaugugaaaua

SEQ ID NO: 2147301 - RNA, 18 nt, Homo sapiens
aaugcaaacugggaugaa

SEQ ID NO: 2147302 - RNA, 12 nt, Homo sapiens
cacacagugggc

SEQ ID NO: 2147303 - RNA, 16 nt, Homo sapiens
ucuuugcucauggcaa

SEQ ID NO: 2147304 - RNA, 19 nt, Homo sapiens
cgccccuggacaggcuucg

SEQ ID NO: 2147305 - RNA, 21 nt, Homo sapiens
auauugagcaguucccaagga

SEQ ID NO: 2147306 - RNA, 19 nt, Homo sapiens
aagguuucuacaacauauu

SEQ ID NO: 2147307 - RNA, 24 nt, Homo sapiens
ucacaaugucccuucagcaccuga

SEQ ID NO: 2147308 - RNA, 18 nt, Homo sapiens
cacucauccccucacuug

SEQ ID NO: 2147309 - RNA, 21 nt, Homo sapiens
uggguggcucugauugcuuua

SEQ ID NO: 2147310 - RNA, 20 nt, Homo sapiens
ccccacccaguuucuggaaa

SEQ ID NO: 2147311 - RNA, 17 nt, Homo sapiens
aucuaguuuacagaaaa

SEQ ID NO: 2147312 - RNA, 12 nt, Homo sapiens
caagugaagguu

SEQ ID NO: 2147313 - RNA, 21 nt, Homo sapiens
ccuauagcaucuucucauucc

SEQ ID NO: 2147314 - RNA, 17 nt, Homo sapiens
agcacugugagcaccug

SEQ ID NO: 2147315 - RNA, 20 nt, Homo sapiens
cuucccuuguauccagugau

SEQ ID NO: 2147316 - RNA, 20 nt, Homo sapiens
ccucuucugggcuacugcca

SEQ ID NO: 2147317 - RNA, 13 nt, Homo sapiens
ccucauuccauaa

SEQ ID NO: 2147318 - RNA, 16 nt, Homo sapiens
ggucauccugccccug

SEQ ID NO: 2147319 - RNA, 15 nt, Homo sapiens
aggggccaaguguag

SEQ ID NO: 2147320 - RNA, 16 nt, Homo sapiens
uuuccccaccagaugc

SEQ ID NO: 2147321 - RNA, 17 nt, Homo sapiens
gcaccugcaugugcugu

SEQ ID NO: 2147322 - RNA, 22 nt, Homo sapiens
agcauauguuaguaggcuuagu

SEQ ID NO: 2147323 - RNA, 19 nt, Homo sapiens
acgugggagucugugcauu

SEQ ID NO: 2147324 - RNA, 15 nt, Homo sapiens
guauuucucugugaa

SEQ ID NO: 2147325 - RNA, 15 nt, Homo sapiens
cuaugacuguguuua

SEQ ID NO: 2147326 - RNA, 13 nt, Homo sapiens
gugugaugugcau

SEQ ID NO: 2147327 - RNA, 16 nt, Homo sapiens
uucuugugguguaaag

SEQ ID NO: 2147328 - RNA, 12 nt, Homo sapiens
gucaacauaugu

SEQ ID NO: 2147329 - RNA, 15 nt, Homo sapiens
ugcaugaaagacaga

SEQ ID NO: 2147330 - RNA, 21 nt, Homo sapiens
ucaccuacauuugagaauuau

SEQ ID NO: 2147331 - RNA, 14 nt, Homo sapiens
uggcuuguucauca

SEQ ID NO: 2147332 - RNA, 20 nt, Homo sapiens
gcuaacccccuucuacugag

SEQ ID NO: 2147333 - RNA, 22 nt, Homo sapiens
auacagccugaauaaaccaaga

SEQ ID NO: 2147334 - RNA, 23 nt, Homo sapiens
aacuuuuauuuuuaucaguuaca

SEQ ID NO: 2147335 - RNA, 13 nt, Homo sapiens
cagaaaccaaaac

SEQ ID NO: 2147336 - RNA, 19 nt, Homo sapiens
uccuugcaaccaggcagcu

SEQ ID NO: 2147337 - RNA, 11 nt, Homo sapiens
auacagcauug

SEQ ID NO: 2147338 - RNA, 17 nt, Homo sapiens
ccucgggugugcuaugg

SEQ ID NO: 2147339 - RNA, 18 nt, Homo sapiens
gaacagcaaaccaaugcu

SEQ ID NO: 2147340 - RNA, 18 nt, Homo sapiens
cuucaaaaagcauuuuaa

SEQ ID NO: 2147341 - RNA, 18 nt, Homo sapiens
cagggagacugcaucuca

SEQ ID NO: 2147342 - RNA, 20 nt, Homo sapiens
ggcuggagugcaguggcacg

SEQ ID NO: 2147343 - RNA, 20 nt, Homo sapiens
ggcuggaguguaguggcaug

SEQ ID NO: 2147344 - RNA, 21 nt, Homo sapiens
cuagagaaggcugugagccaa

SEQ ID NO: 2147345 - RNA, 14 nt, Homo sapiens
uaaaguaccacaca

SEQ ID NO: 2147346 - RNA, 13 nt, Homo sapiens
uugccagccauuc

SEQ ID NO: 2147347 - RNA, 18 nt, Homo sapiens
cccaggggacaagggauu

SEQ ID NO: 2147348 - RNA, 18 nt, Homo sapiens
uuauucacugagucucau

SEQ ID NO: 2147349 - RNA, 20 nt, Homo sapiens
ucccgaguaguugggauuac

SEQ ID NO: 2147350 - RNA, 18 nt, Homo sapiens
augcugggcccccagccu

SEQ ID NO: 2147351 - RNA, 23 nt, Homo sapiens
caggcugggagcuggauaccugc

SEQ ID NO: 2147352 - RNA, 20 nt, Homo sapiens
cugagcccuacugugucuca

SEQ ID NO: 2147353 - RNA, 20 nt, Homo sapiens
guuccuuuauuuuauguaaa

SEQ ID NO: 2147354 - RNA, 17 nt, Homo sapiens
cucagcucuguccuguu

SEQ ID NO: 2147355 - RNA, 14 nt, Homo sapiens
caaaccauuuccaa

SEQ ID NO: 2147356 - RNA, 18 nt, Homo sapiens
uaauuccagucacaguuu

SEQ ID NO: 2147357 - RNA, 17 nt, Homo sapiens
aucaaggcugccuggag

SEQ ID NO: 2147358 - RNA, 18 nt, Homo sapiens
cugcagcccccucgggga

SEQ ID NO: 2147359 - RNA, 14 nt, Homo sapiens
cucugagaacagac

SEQ ID NO: 2147360 - RNA, 14 nt, Homo sapiens
aaacauuucuuuca

SEQ ID NO: 2147361 - RNA, 14 nt, Homo sapiens
aaauaauucuuccu

SEQ ID NO: 2147362 - RNA, 12 nt, Homo sapiens
aggcugguggga

SEQ ID NO: 2147363 - RNA, 12 nt, Homo sapiens
aggauggugggc

SEQ ID NO: 2147364 - RNA, 12 nt, Homo sapiens
acuaaccuggua

SEQ ID NO: 2147365 - RNA, 14 nt, Homo sapiens
auagcauaggcaaa

SEQ ID NO: 2147366 - RNA, 14 nt, Homo sapiens
ugaucuuucuagag

SEQ ID NO: 2147367 - RNA, 16 nt, Homo sapiens
gcaggggccuggagau

SEQ ID NO: 2147368 - RNA, 21 nt, Homo sapiens
guaugccuuaagcagaacaaa

SEQ ID NO: 2147369 - RNA, 22 nt, Homo sapiens
ugcccaggacguccuaucuccc

SEQ ID NO: 2147370 - RNA, 15 nt, Homo sapiens
cuuuaagcaacacag

SEQ ID NO: 2147371 - RNA, 15 nt, Homo sapiens
agauagaccugacaa

SEQ ID NO: 2147372 - RNA, 22 nt, Homo sapiens
acagccuucuaaauucccaaau

SEQ ID NO: 2147373 - RNA, 14 nt, Homo sapiens
agaauaacuaccuc

SEQ ID NO: 2147374 - RNA, 16 nt, Homo sapiens
gagagggggauguuuc

SEQ ID NO: 2147375 - RNA, 18 nt, Homo sapiens
cugcaucuccccucagau

SEQ ID NO: 2147376 - RNA, 22 nt, Homo sapiens
gcauugccauguggaaggcaag

SEQ ID NO: 2147377 - RNA, 17 nt, Homo sapiens
guggcugcagccucagg

SEQ ID NO: 2147378 - RNA, 21 nt, Homo sapiens
ccacaauagcagacaguguuu

SEQ ID NO: 2147379 - RNA, 19 nt, Homo sapiens
cucacauuuauucugcuca

SEQ ID NO: 2147380 - RNA, 16 nt, Homo sapiens
aguaggcacuaaauac

SEQ ID NO: 2147381 - RNA, 20 nt, Homo sapiens
cacaccugaacacaucguga

SEQ ID NO: 2147382 - RNA, 17 nt, Homo sapiens
cccaccaaucugcccuu

SEQ ID NO: 2147383 - RNA, 17 nt, Homo sapiens
guuaauaucugauacug

SEQ ID NO: 2147384 - RNA, 13 nt, Homo sapiens
ucccuacuccuac

SEQ ID NO: 2147385 - RNA, 15 nt, Homo sapiens
cacaccugcucucuc

SEQ ID NO: 2147386 - RNA, 15 nt, Homo sapiens
ggaagcaccaugaau

SEQ ID NO: 2147387 - RNA, 15 nt, Homo sapiens
aauguacauuuauuc

SEQ ID NO: 2147388 - RNA, 15 nt, Homo sapiens
uagaauuaauggaau

SEQ ID NO: 2147389 - RNA, 16 nt, Homo sapiens
auucuagagcuuuuau

SEQ ID NO: 2147390 - RNA, 15 nt, Homo sapiens
cagugcccuuugcau

SEQ ID NO: 2147391 - RNA, 12 nt, Homo sapiens
caaagugaggag

SEQ ID NO: 2147392 - RNA, 21 nt, Homo sapiens
cguggacuuggggucagagac

SEQ ID NO: 2147393 - RNA, 21 nt, Homo sapiens
gauaaaugagugauucugucc

SEQ ID NO: 2147394 - RNA, 18 nt, Homo sapiens
agugugugcuuacaguaa

SEQ ID NO: 2147395 - RNA, 20 nt, Homo sapiens
aguuuauaaaugugaacuua

SEQ ID NO: 2147396 - RNA, 22 nt, Homo sapiens
guguaaauacaguggaucucaa

SEQ ID NO: 2147397 - RNA, 13 nt, Homo sapiens
acacacucugcau

SEQ ID NO: 2147398 - RNA, 23 nt, Homo sapiens
uggguugcaggaccucaggugag

SEQ ID NO: 2147399 - RNA, 20 nt, Homo sapiens
ggauucaggcagcagugucu

SEQ ID NO: 2147400 - RNA, 14 nt, Homo sapiens
guacccucucagcu

SEQ ID NO: 2147401 - RNA, 21 nt, Homo sapiens
augucacucuggucccuuuaa

SEQ ID NO: 2147402 - RNA, 18 nt, Homo sapiens
aaauaucuuggccuaaac

SEQ ID NO: 2147403 - RNA, 18 nt, Homo sapiens
ucccagaugccccagcaa

SEQ ID NO: 2147404 - RNA, 14 nt, Homo sapiens
gaguuggcaaaaug

SEQ ID NO: 2147405 - RNA, 14 nt, Homo sapiens
gaaagagcaaguga

SEQ ID NO: 2147406 - RNA, 15 nt, Homo sapiens
auuugugccacuuua

SEQ ID NO: 2147407 - RNA, 22 nt, Homo sapiens
ccuacaggugcuguucagugcc

SEQ ID NO: 2147408 - RNA, 13 nt, Homo sapiens
aggaaagaaucuc

SEQ ID NO: 2147409 - RNA, 21 nt, Homo sapiens
caggucuugacucauggcagc

SEQ ID NO: 2147410 - RNA, 18 nt, Homo sapiens
auauuacucuaugaugau

SEQ ID NO: 2147411 - RNA, 13 nt, Homo sapiens
ugggccuccucua

SEQ ID NO: 2147412 - RNA, 18 nt, Homo sapiens
caaaagaaacaccagugu

SEQ ID NO: 2147413 - RNA, 14 nt, Homo sapiens
uaaguaugggauga

SEQ ID NO: 2147414 - RNA, 20 nt, Homo sapiens
ugcaguguaagaaaauugga

SEQ ID NO: 2147415 - RNA, 12 nt, Homo sapiens
aauuacuucuuc

SEQ ID NO: 2147416 - RNA, 19 nt, Homo sapiens
uggugacaugugccuguaa

SEQ ID NO: 2147417 - RNA, 15 nt, Homo sapiens
cuacacugacacugg

SEQ ID NO: 2147418 - RNA, 19 nt, Homo sapiens
ggaaaugauaacaacccaa

SEQ ID NO: 2147419 - RNA, 18 nt, Homo sapiens
uugagugacagcuuucug

SEQ ID NO: 2147420 - RNA, 17 nt, Homo sapiens
cccagcagcuuggaugg

SEQ ID NO: 2147421 - RNA, 16 nt, Homo sapiens
acauauuaacaugcuu

SEQ ID NO: 2147422 - RNA, 21 nt, Homo sapiens
uuuucuaagaaagaaauugua

SEQ ID NO: 2147423 - RNA, 17 nt, Homo sapiens
uugaaaaauaaaaacca

SEQ ID NO: 2147424 - RNA, 13 nt, Homo sapiens
guagguaagggcc

SEQ ID NO: 2147425 - RNA, 16 nt, Homo sapiens
acgcgugcaugcacac

SEQ ID NO: 2147426 - RNA, 22 nt, Homo sapiens
ugagcuucccccccaccacagg

SEQ ID NO: 2147427 - RNA, 16 nt, Homo sapiens
gauuguuuacagucau

SEQ ID NO: 2147428 - RNA, 23 nt, Homo sapiens
gcucucccucucuuagggugaga

SEQ ID NO: 2147429 - RNA, 20 nt, Homo sapiens
gugccacgcagggcagagga

SEQ ID NO: 2147430 - RNA, 14 nt, Homo sapiens
ccaaggcaagcaug

SEQ ID NO: 2147431 - RNA, 20 nt, Homo sapiens
aaaaugccugucucuagcug

SEQ ID NO: 2147432 - RNA, 15 nt, Homo sapiens
uaaauuucaucucag

SEQ ID NO: 2147433 - RNA, 15 nt, Homo sapiens
gagaaguacagguca

SEQ ID NO: 2147434 - RNA, 16 nt, Homo sapiens
uuggacuucucugaaa

SEQ ID NO: 2147435 - RNA, 18 nt, Homo sapiens
gguugcuguccucucauu

SEQ ID NO: 2147436 - RNA, 14 nt, Homo sapiens
aaagaccuugcuua

SEQ ID NO: 2147437 - RNA, 18 nt, Homo sapiens
aggaugauccuggggaag

SEQ ID NO: 2147438 - RNA, 13 nt, Homo sapiens
acugguaaccaag

SEQ ID NO: 2147439 - RNA, 14 nt, Homo sapiens
uggaaguaguaauu

SEQ ID NO: 2147440 - RNA, 12 nt, Homo sapiens
cuaaaugaugcc

SEQ ID NO: 2147441 - RNA, 17 nt, Homo sapiens
cuugcccccagugccuc

SEQ ID NO: 2147442 - RNA, 17 nt, Homo sapiens
caagauauugaugauaa

SEQ ID NO: 2147443 - RNA, 13 nt, Homo sapiens
cuugggaucucag

SEQ ID NO: 2147444 - RNA, 15 nt, Homo sapiens
uucaucuucucagcu

SEQ ID NO: 2147445 - RNA, 14 nt, Homo sapiens
uccuuugcauucau

SEQ ID NO: 2147446 - RNA, 23 nt, Homo sapiens
cuguaaaccacuugucacuacaa

SEQ ID NO: 2147447 - RNA, 15 nt, Homo sapiens
uuguaauggugaaaa

SEQ ID NO: 2147448 - RNA, 21 nt, Homo sapiens
ucaucaaaacaaaacagcagc

SEQ ID NO: 2147449 - RNA, 22 nt, Homo sapiens
gucaaguucccaacugagucau

SEQ ID NO: 2147450 - RNA, 16 nt, Homo sapiens
aaggcugucuaccuga

SEQ ID NO: 2147451 - RNA, 19 nt, Homo sapiens
acagccucuuugcccaaau

SEQ ID NO: 2147452 - RNA, 10 nt, Homo sapiens
aucuauccaa

SEQ ID NO: 2147453 - RNA, 18 nt, Homo sapiens
aaugagacuuuaaaagca

SEQ ID NO: 2147454 - RNA, 23 nt, Homo sapiens
uuuuggggaggaguugucugucc

SEQ ID NO: 2147455 - RNA, 18 nt, Homo sapiens
agcuaugaaggcuguaca

SEQ ID NO: 2147456 - RNA, 13 nt, Homo sapiens
ugguuugacucag

SEQ ID NO: 2147457 - RNA, 22 nt, Homo sapiens
agaaaagagucggauuaccaaa

SEQ ID NO: 2147458 - RNA, 12 nt, Homo sapiens
agcuuucugucc

SEQ ID NO: 2147459 - RNA, 17 nt, Homo sapiens
guuucaucccauguaca

SEQ ID NO: 2147460 - RNA, 19 nt, Homo sapiens
acaaaaauucucaguucuc

SEQ ID NO: 2147461 - RNA, 22 nt, Homo sapiens
uacacagcucagcagacaucca

SEQ ID NO: 2147462 - RNA, 13 nt, Homo sapiens
agugugugugcgu

SEQ ID NO: 2147463 - RNA, 15 nt, Homo sapiens
agaagucagcuacuc

SEQ ID NO: 2147464 - RNA, 18 nt, Homo sapiens
uccuaagaagagugcugu

SEQ ID NO: 2147465 - RNA, 14 nt, Homo sapiens
aagcacagccucag

SEQ ID NO: 2147466 - RNA, 13 nt, Homo sapiens
cauauauguagcu

SEQ ID NO: 2147467 - RNA, 16 nt, Homo sapiens
uacuguguucccucau

SEQ ID NO: 2147468 - RNA, 16 nt, Homo sapiens
ucucuuguuauugcau

SEQ ID NO: 2147469 - RNA, 14 nt, Homo sapiens
aaguuuucagugga

SEQ ID NO: 2147470 - RNA, 18 nt, Homo sapiens
acacaagacuuuccccau

SEQ ID NO: 2147471 - RNA, 13 nt, Homo sapiens
aaggugaccucac

SEQ ID NO: 2147472 - RNA, 14 nt, Homo sapiens
agaauaaacaacua

SEQ ID NO: 2147473 - RNA, 20 nt, Homo sapiens
aaagaaugaaaguagcugua

SEQ ID NO: 2147474 - RNA, 15 nt, Homo sapiens
guuuaaagaagagua

SEQ ID NO: 2147475 - RNA, 23 nt, Homo sapiens
cauguauaauuuucuacaaccua

SEQ ID NO: 2147476 - RNA, 19 nt, Homo sapiens
uguaacaucuucaacaugu

SEQ ID NO: 2147477 - RNA, 14 nt, Homo sapiens
ggcuucgcagcucu

SEQ ID NO: 2147478 - RNA, 16 nt, Homo sapiens
gacacugccuggggug

SEQ ID NO: 2147479 - RNA, 17 nt, Homo sapiens
ccacaggccacugcaaa

SEQ ID NO: 2147480 - RNA, 14 nt, Homo sapiens
cucauuuuaaugua

SEQ ID NO: 2147481 - RNA, 17 nt, Homo sapiens
cagauaccaugaugcug

SEQ ID NO: 2147482 - RNA, 15 nt, Homo sapiens
caggucuuuaaauca

SEQ ID NO: 2147483 - RNA, 18 nt, Homo sapiens
cagccaaacugucuuugu

SEQ ID NO: 2147484 - RNA, 19 nt, Homo sapiens
aaauugcaauuucuuaggu

SEQ ID NO: 2147485 - RNA, 23 nt, Homo sapiens
uaaaauuugggaccugcuucauu

SEQ ID NO: 2147486 - RNA, 19 nt, Homo sapiens
gugcagccccuuccuggug

SEQ ID NO: 2147487 - RNA, 13 nt, Homo sapiens
gcucuagucacug

SEQ ID NO: 2147488 - RNA, 21 nt, Homo sapiens
aauauauuguacacuacagca

SEQ ID NO: 2147489 - RNA, 14 nt, Homo sapiens
uguauaagaauuac

SEQ ID NO: 2147490 - RNA, 20 nt, Homo sapiens
ccaaaaggaagccucuucau

SEQ ID NO: 2147491 - RNA, 19 nt, Homo sapiens
uaaaucuauucugcuaaga

SEQ ID NO: 2147492 - RNA, 20 nt, Homo sapiens
cucagaaugcacuugauuca

SEQ ID NO: 2147493 - RNA, 21 nt, Homo sapiens
gaucaggccaaccccaaagaa

SEQ ID NO: 2147494 - RNA, 21 nt, Homo sapiens
uuucuagggcugggaaacacu

SEQ ID NO: 2147495 - RNA, 22 nt, Homo sapiens
auuccauuacuaagaaacacau

SEQ ID NO: 2147496 - RNA, 15 nt, Homo sapiens
aagacucugucucaa

SEQ ID NO: 2147497 - RNA, 15 nt, Homo sapiens
uaacaguuauaaaga

SEQ ID NO: 2147498 - RNA, 15 nt, Homo sapiens
ccugugcuaauccca

SEQ ID NO: 2147499 - RNA, 16 nt, Homo sapiens
ucagccauaggugcag

SEQ ID NO: 2147500 - RNA, 14 nt, Homo sapiens
uccugauuccaaau

SEQ ID NO: 2147501 - RNA, 15 nt, Homo sapiens
uaauucauugugauu

SEQ ID NO: 2147502 - RNA, 22 nt, Homo sapiens
ugcgcccagccugaaucauuuc

SEQ ID NO: 2147503 - RNA, 13 nt, Homo sapiens
caccugagaagau

SEQ ID NO: 2147504 - RNA, 19 nt, Homo sapiens
ccugucaagaggcaaagga

SEQ ID NO: 2147505 - RNA, 23 nt, Homo sapiens
ucuccucucucuguaauaaacuc

SEQ ID NO: 2147506 - RNA, 20 nt, Homo sapiens
acuucaaguuaaagugaaua

SEQ ID NO: 2147507 - RNA, 18 nt, Homo sapiens
aucuuacacaucugccac

SEQ ID NO: 2147508 - RNA, 19 nt, Homo sapiens
aucauuguggugguugaga

SEQ ID NO: 2147509 - RNA, 18 nt, Homo sapiens
aauugguuuuaugcauug

SEQ ID NO: 2147510 - RNA, 17 nt, Homo sapiens
aaaaucccaccuuccca

SEQ ID NO: 2147511 - RNA, 13 nt, Homo sapiens
auuccauccacua

SEQ ID NO: 2147512 - RNA, 20 nt, Homo sapiens
uccgcccccggauuugcuca

SEQ ID NO: 2147513 - RNA, 18 nt, Homo sapiens
ugacuguguucagugccu

SEQ ID NO: 2147514 - RNA, 23 nt, Homo sapiens
ggcauuccccccaggucuuuuca

SEQ ID NO: 2147515 - RNA, 12 nt, Homo sapiens
cgauacacugca

SEQ ID NO: 2147516 - RNA, 20 nt, Homo sapiens
auugaaaauaaugcuguucu

SEQ ID NO: 2147517 - RNA, 20 nt, Homo sapiens
gcuccucagagcgccaggaa

SEQ ID NO: 2147518 - RNA, 21 nt, Homo sapiens
cugcauuugugucauugacaa

SEQ ID NO: 2147519 - RNA, 17 nt, Homo sapiens
caggccagagugcagug

SEQ ID NO: 2147520 - RNA, 20 nt, Homo sapiens
uuacaucaaaucccacuuac

SEQ ID NO: 2147521 - RNA, 20 nt, Homo sapiens
agacaagagggcaagccucu

SEQ ID NO: 2147522 - RNA, 17 nt, Homo sapiens
acagucccccacccacc

SEQ ID NO: 2147523 - RNA, 23 nt, Homo sapiens
uaaaauuucguuguccaauuugu

SEQ ID NO: 2147524 - RNA, 18 nt, Homo sapiens
acagaaugguggagugua

SEQ ID NO: 2147525 - RNA, 13 nt, Homo sapiens
accaagaaugucu

SEQ ID NO: 2147526 - RNA, 16 nt, Homo sapiens
gcugagauccuggacu

SEQ ID NO: 2147527 - RNA, 12 nt, Homo sapiens
aaucaaucugca

SEQ ID NO: 2147528 - RNA, 13 nt, Homo sapiens
uguucacugcaau

SEQ ID NO: 2147529 - RNA, 17 nt, Homo sapiens
cuucuggaacccagaag

SEQ ID NO: 2147530 - RNA, 22 nt, Homo sapiens
caggagagcuugucauugagcc

SEQ ID NO: 2147531 - RNA, 22 nt, Homo sapiens
uccccaauuggcucuagucacu

SEQ ID NO: 2147532 - RNA, 19 nt, Homo sapiens
guaagcauuugaguuugca

SEQ ID NO: 2147533 - RNA, 20 nt, Homo sapiens
aucaggacugugaccaaagc

SEQ ID NO: 2147534 - RNA, 14 nt, Homo sapiens
ugaauuuugccaua

SEQ ID NO: 2147535 - RNA, 20 nt, Homo sapiens
aauuucucccagucauuuaa

SEQ ID NO: 2147536 - RNA, 19 nt, Homo sapiens
aaugacuuuuauugagcuc

SEQ ID NO: 2147537 - RNA, 21 nt, Homo sapiens
acagggucuaccucugucacc

SEQ ID NO: 2147538 - RNA, 14 nt, Homo sapiens
auucugucauuuca

SEQ ID NO: 2147539 - RNA, 22 nt, Homo sapiens
caugugcguggaaguguuccug

SEQ ID NO: 2147540 - RNA, 14 nt, Homo sapiens
cuguucaacaugua

SEQ ID NO: 2147541 - RNA, 13 nt, Homo sapiens
uucugucugggcu

SEQ ID NO: 2147542 - RNA, 13 nt, Homo sapiens
uggugucuguccu

SEQ ID NO: 2147543 - RNA, 15 nt, Homo sapiens
cuguacagucugucu

SEQ ID NO: 2147544 - RNA, 21 nt, Homo sapiens
gcccuguaauuuuucugggaa

SEQ ID NO: 2147545 - RNA, 15 nt, Homo sapiens
uguacccgagcacau

SEQ ID NO: 2147546 - RNA, 21 nt, Homo sapiens
ugugugaucugugggcacauu

SEQ ID NO: 2147547 - RNA, 21 nt, Homo sapiens
ggaugcaacaaaaugauccuu

SEQ ID NO: 2147548 - RNA, 19 nt, Homo sapiens
gcuaaucuucuuaugcaau

SEQ ID NO: 2147549 - RNA, 20 nt, Homo sapiens
gauagguauaaguggugugu

SEQ ID NO: 2147550 - RNA, 13 nt, Homo sapiens
ugacauccagaaa

SEQ ID NO: 2147551 - RNA, 16 nt, Homo sapiens
uacuugccuaucugac

SEQ ID NO: 2147552 - RNA, 16 nt, Homo sapiens
ucucgaacuccugacc

SEQ ID NO: 2147553 - RNA, 13 nt, Homo sapiens
cuccagggcauug

SEQ ID NO: 2147554 - RNA, 16 nt, Homo sapiens
cacuuagccauugaaa

SEQ ID NO: 2147555 - RNA, 16 nt, Homo sapiens
caaacauuugccaagu

SEQ ID NO: 2147556 - RNA, 15 nt, Homo sapiens
cucaucuuacuguac

SEQ ID NO: 2147557 - RNA, 18 nt, Homo sapiens
auuuaguaacaguuguga

SEQ ID NO: 2147558 - RNA, 18 nt, Homo sapiens
agagagugugacucauca

SEQ ID NO: 2147559 - RNA, 12 nt, Homo sapiens
cuccuccuguca

SEQ ID NO: 2147560 - RNA, 14 nt, Homo sapiens
gccuuaaaagccau

SEQ ID NO: 2147561 - RNA, 14 nt, Homo sapiens
agauuuaagcacaa

SEQ ID NO: 2147562 - RNA, 19 nt, Homo sapiens
cagguuaggcaguauaaag

SEQ ID NO: 2147563 - RNA, 20 nt, Homo sapiens
uuaaauuaaacucuacuuca

SEQ ID NO: 2147564 - RNA, 13 nt, Homo sapiens
ccuaacugaauuu

SEQ ID NO: 2147565 - RNA, 22 nt, Homo sapiens
aggccucgccugcccuccucuc

SEQ ID NO: 2147566 - RNA, 16 nt, Homo sapiens
cugggcucagacaucc

SEQ ID NO: 2147567 - RNA, 15 nt, Homo sapiens
ugcgugugucaggga

SEQ ID NO: 2147568 - RNA, 23 nt, Homo sapiens
guauagaaguuuguccauuugua

SEQ ID NO: 2147569 - RNA, 20 nt, Homo sapiens
ucaaaaaaucugaccaaaac

SEQ ID NO: 2147570 - RNA, 18 nt, Homo sapiens
uuaguuuucuaguaacua

SEQ ID NO: 2147571 - RNA, 19 nt, Homo sapiens
uucaugccuguaaucccag

SEQ ID NO: 2147572 - RNA, 23 nt, Homo sapiens
uaagcuguaagauaauguugcuu

SEQ ID NO: 2147573 - RNA, 23 nt, Homo sapiens
uuuaagcuaucagcaauacucau

SEQ ID NO: 2147574 - RNA, 22 nt, Homo sapiens
augcaacaaaugaauuuuccac

SEQ ID NO: 2147575 - RNA, 20 nt, Homo sapiens
aauuaguucagccauugugg

SEQ ID NO: 2147576 - RNA, 18 nt, Homo sapiens
caguauucugacauguaa

SEQ ID NO: 2147577 - RNA, 21 nt, Homo sapiens
gaaaccuguuaugccaaacag

SEQ ID NO: 2147578 - RNA, 12 nt, Homo sapiens
guucuuguucuu

SEQ ID NO: 2147579 - RNA, 16 nt, Homo sapiens
aaguucauucaugcca

SEQ ID NO: 2147580 - RNA, 18 nt, Homo sapiens
auuugacuguucaaugau

SEQ ID NO: 2147581 - RNA, 16 nt, Homo sapiens
caccucuuucuucaau

SEQ ID NO: 2147582 - RNA, 16 nt, Homo sapiens
gacuacacaauacagu

SEQ ID NO: 2147583 - RNA, 17 nt, Homo sapiens
caauguuuuccacccau

SEQ ID NO: 2147584 - RNA, 19 nt, Homo sapiens
uauacagaaagauugguaa

SEQ ID NO: 2147585 - RNA, 17 nt, Homo sapiens
ccaacauggauguguug

SEQ ID NO: 2147586 - RNA, 15 nt, Homo sapiens
aagacaagcuguaua

SEQ ID NO: 2147587 - RNA, 18 nt, Homo sapiens
ccagugaugugugagcua

SEQ ID NO: 2147588 - RNA, 13 nt, Homo sapiens
gccuucugccaac

SEQ ID NO: 2147589 - RNA, 15 nt, Homo sapiens
cggcacacugccaaa

SEQ ID NO: 2147590 - RNA, 21 nt, Homo sapiens
ugcccaccccgccucugggcu

SEQ ID NO: 2147591 - RNA, 23 nt, Homo sapiens
cuuuacgaggagucucacugggc

SEQ ID NO: 2147592 - RNA, 21 nt, Homo sapiens
cccccaccuccacucugccau

SEQ ID NO: 2147593 - RNA, 12 nt, Homo sapiens
guuacacuggag

SEQ ID NO: 2147594 - RNA, 21 nt, Homo sapiens
ggccaucacuuucauucaauu

SEQ ID NO: 2147595 - RNA, 18 nt, Homo sapiens
cuuucccucccuuccucu

SEQ ID NO: 2147596 - RNA, 15 nt, Homo sapiens
uguguccaacuccag

SEQ ID NO: 2147597 - RNA, 12 nt, Homo sapiens
uuauaauuacaa

SEQ ID NO: 2147598 - RNA, 15 nt, Homo sapiens
ugacuccaagcugca

SEQ ID NO: 2147599 - RNA, 21 nt, Homo sapiens
cuaucugguuggaugguggcu

SEQ ID NO: 2147600 - RNA, 15 nt, Homo sapiens
cacaaacacauuaua

SEQ ID NO: 2147601 - RNA, 19 nt, Homo sapiens
cugagguuuagaugugcaa

SEQ ID NO: 2147602 - RNA, 19 nt, Homo sapiens
uccagcuugggcaacagag

SEQ ID NO: 2147603 - RNA, 20 nt, Homo sapiens
ucagauuguuaucuaucaac

SEQ ID NO: 2147604 - RNA, 19 nt, Homo sapiens
cauaaaauauauaggauua

SEQ ID NO: 2147605 - RNA, 15 nt, Homo sapiens
uggaccaacccuguu

SEQ ID NO: 2147606 - RNA, 14 nt, Homo sapiens
cccacccuaccaca

SEQ ID NO: 2147607 - RNA, 16 nt, Homo sapiens
ccuugagcugccugcu

SEQ ID NO: 2147608 - RNA, 15 nt, Homo sapiens
uuauuucaaagggaa

SEQ ID NO: 2147609 - RNA, 14 nt, Homo sapiens
ccaguuaucaguac

SEQ ID NO: 2147610 - RNA, 14 nt, Homo sapiens
aaggacauacauuu

SEQ ID NO: 2147611 - RNA, 15 nt, Homo sapiens
ugagaucacuacuca

SEQ ID NO: 2147612 - RNA, 17 nt, Homo sapiens
aggauucauguggaaua

SEQ ID NO: 2147613 - RNA, 21 nt, Homo sapiens
cuggaaugaagaccaugccua

SEQ ID NO: 2147614 - RNA, 22 nt, Homo sapiens
aucauuugguuuuaaaauauga

SEQ ID NO: 2147615 - RNA, 14 nt, Homo sapiens
uucuugcaucuaau

SEQ ID NO: 2147616 - RNA, 15 nt, Homo sapiens
uugacauucggggug

SEQ ID NO: 2147617 - RNA, 16 nt, Homo sapiens
auauccaaagacugua

SEQ ID NO: 2147618 - RNA, 14 nt, Homo sapiens
cacuggcucuccaa

SEQ ID NO: 2147619 - RNA, 20 nt, Homo sapiens
caaauaggagggagacugug

SEQ ID NO: 2147620 - RNA, 15 nt, Homo sapiens
uuauucuuuguccau

SEQ ID NO: 2147621 - RNA, 21 nt, Homo sapiens
auggcacugcuuuucugagga

SEQ ID NO: 2147622 - RNA, 23 nt, Homo sapiens
aaaagggcggaagaguuacaaua

SEQ ID NO: 2147623 - RNA, 20 nt, Homo sapiens
uuacuguugcuuuagucacu

SEQ ID NO: 2147624 - RNA, 23 nt, Homo sapiens
auugcuuugccaaaauaccagag

SEQ ID NO: 2147625 - RNA, 11 nt, Homo sapiens
gaccauaucac

SEQ ID NO: 2147626 - RNA, 22 nt, Homo sapiens
aacucaucugcugguaccuauu

SEQ ID NO: 2147627 - RNA, 19 nt, Homo sapiens
ugaacgcagaagaaagggu

SEQ ID NO: 2147628 - RNA, 14 nt, Homo sapiens
uguccaaacuaauu

SEQ ID NO: 2147629 - RNA, 22 nt, Homo sapiens
aaaaauguuugaguauucugca

SEQ ID NO: 2147630 - RNA, 16 nt, Homo sapiens
cugugacccacuucuc

SEQ ID NO: 2147631 - RNA, 22 nt, Homo sapiens
auaaaggaaucuagccagugaa

SEQ ID NO: 2147632 - RNA, 20 nt, Homo sapiens
ggcccugguuccugcugucc

SEQ ID NO: 2147633 - RNA, 13 nt, Homo sapiens
acaaugcuguauu

SEQ ID NO: 2147634 - RNA, 21 nt, Homo sapiens
cuuagugagcagugagcacug

SEQ ID NO: 2147635 - RNA, 16 nt, Homo sapiens
cucaaaaaaagggcaa

SEQ ID NO: 2147636 - RNA, 20 nt, Homo sapiens
ccucuuuuucuagucuucau

SEQ ID NO: 2147637 - RNA, 13 nt, Homo sapiens
cagaggaccugag

SEQ ID NO: 2147638 - RNA, 18 nt, Homo sapiens
caagaaaaguaagcccuu

SEQ ID NO: 2147639 - RNA, 15 nt, Homo sapiens
auucauguaacaguu

SEQ ID NO: 2147640 - RNA, 15 nt, Homo sapiens
agucgugaccugcua

SEQ ID NO: 2147641 - RNA, 19 nt, Homo sapiens
acccucccagucucaucuc

SEQ ID NO: 2147642 - RNA, 20 nt, Homo sapiens
cucuguuaccacgacuucua

SEQ ID NO: 2147643 - RNA, 22 nt, Homo sapiens
ucccuauuuuucucuccugucc

SEQ ID NO: 2147644 - RNA, 15 nt, Homo sapiens
cccagggggcaacug

SEQ ID NO: 2147645 - RNA, 18 nt, Homo sapiens
ugacacaacucauccaga

SEQ ID NO: 2147646 - RNA, 14 nt, Homo sapiens
ggagaggguggcau

SEQ ID NO: 2147647 - RNA, 16 nt, Homo sapiens
cuuugagcaacuaacu

SEQ ID NO: 2147648 - RNA, 15 nt, Homo sapiens
ugccaugccagcuua

SEQ ID NO: 2147649 - RNA, 20 nt, Homo sapiens
aauauuuagcuguaaacuga

SEQ ID NO: 2147650 - RNA, 12 nt, Homo sapiens
cuccacauaccu

SEQ ID NO: 2147651 - RNA, 15 nt, Homo sapiens
uguugcugcaucucc

SEQ ID NO: 2147652 - RNA, 19 nt, Homo sapiens
ccgacucccccaaccaagg

SEQ ID NO: 2147653 - RNA, 20 nt, Homo sapiens
auauauauguauguaugugu

SEQ ID NO: 2147654 - RNA, 18 nt, Homo sapiens
ugaccaagacugagccag

SEQ ID NO: 2147655 - RNA, 17 nt, Homo sapiens
gacaguauuaaggguag

SEQ ID NO: 2147656 - RNA, 15 nt, Homo sapiens
cugggauuacaggcg

SEQ ID NO: 2147657 - RNA, 14 nt, Homo sapiens
ucaaauaaacucaa

SEQ ID NO: 2147658 - RNA, 16 nt, Homo sapiens
uacaauguauguaauu

SEQ ID NO: 2147659 - RNA, 20 nt, Homo sapiens
aauacaaacauucuaauuaa

SEQ ID NO: 2147660 - RNA, 17 nt, Homo sapiens
uaauaagauggcugugg

SEQ ID NO: 2147661 - RNA, 19 nt, Homo sapiens
ugcaguaucucccauaaac

SEQ ID NO: 2147662 - RNA, 21 nt, Homo sapiens
ucauuccugaaagaaacaguu

SEQ ID NO: 2147663 - RNA, 21 nt, Homo sapiens
gccuggcacacgccuguauuc

SEQ ID NO: 2147664 - RNA, 17 nt, Homo sapiens
agacuccaauggggcca

SEQ ID NO: 2147665 - RNA, 12 nt, Homo sapiens
cccucugcaguc

SEQ ID NO: 2147666 - RNA, 22 nt, Homo sapiens
cuugucccaacucgaugggcac

SEQ ID NO: 2147667 - RNA, 23 nt, Homo sapiens
aaaagugucccuugagugaggca

SEQ ID NO: 2147668 - RNA, 10 nt, Homo sapiens
ccaccucuca

SEQ ID NO: 2147669 - RNA, 21 nt, Homo sapiens
gguaacauaacaacaacaguu

SEQ ID NO: 2147670 - RNA, 21 nt, Homo sapiens
aaaacuuuuugauuugaacca

SEQ ID NO: 2147671 - RNA, 21 nt, Homo sapiens
uaucuggccuaaaaucuugga

SEQ ID NO: 2147672 - RNA, 14 nt, Homo sapiens
acauuagauguuac

SEQ ID NO: 2147673 - RNA, 14 nt, Homo sapiens
acaaaagauguauc

SEQ ID NO: 2147674 - RNA, 13 nt, Homo sapiens
ucccagcaguggg

SEQ ID NO: 2147675 - RNA, 21 nt, Homo sapiens
ccagaagugcagaacugcagu

SEQ ID NO: 2147676 - RNA, 16 nt, Homo sapiens
cccuccugcugccuaa

SEQ ID NO: 2147677 - RNA, 16 nt, Homo sapiens
ccagguugaucuugaa

SEQ ID NO: 2147678 - RNA, 21 nt, Homo sapiens
gcuaccgucuuggaugcauga

SEQ ID NO: 2147679 - RNA, 16 nt, Homo sapiens
aaugauuugcucauaa

SEQ ID NO: 2147680 - RNA, 13 nt, Homo sapiens
auagacaauuuau

SEQ ID NO: 2147681 - RNA, 19 nt, Homo sapiens
ccugcaggugagcaggcag

SEQ ID NO: 2147682 - RNA, 18 nt, Homo sapiens
aaaaguaaugaagaaaau

SEQ ID NO: 2147683 - RNA, 16 nt, Homo sapiens
aguaaaagcuacuaug

SEQ ID NO: 2147684 - RNA, 13 nt, Homo sapiens
caacaaaucuuca

SEQ ID NO: 2147685 - RNA, 18 nt, Homo sapiens
cuuagggcagauuuucau

SEQ ID NO: 2147686 - RNA, 17 nt, Homo sapiens
ccucuuugcccaaaaua

SEQ ID NO: 2147687 - RNA, 17 nt, Homo sapiens
aaccaggacccugucca

SEQ ID NO: 2147688 - RNA, 19 nt, Homo sapiens
caugaugcuagccagcaaa

SEQ ID NO: 2147689 - RNA, 18 nt, Homo sapiens
ugccucauuucuuccucu

SEQ ID NO: 2147690 - RNA, 22 nt, Homo sapiens
gaaacuguagucucaggaccua

SEQ ID NO: 2147691 - RNA, 18 nt, Homo sapiens
caugggcaccaaccugca

SEQ ID NO: 2147692 - RNA, 23 nt, Homo sapiens
aucuggcugguaaaugacaucua

SEQ ID NO: 2147693 - RNA, 17 nt, Homo sapiens
agcugggauuacaggca

SEQ ID NO: 2147694 - RNA, 14 nt, Homo sapiens
ccaguacucuguaa

SEQ ID NO: 2147695 - RNA, 15 nt, Homo sapiens
cauuugugucaaugg

SEQ ID NO: 2147696 - RNA, 12 nt, Homo sapiens
acugaaugcacc

SEQ ID NO: 2147697 - RNA, 20 nt, Homo sapiens
cacgucucagagauucuuga

SEQ ID NO: 2147698 - RNA, 23 nt, Homo sapiens
caaauuggaauggaacuacugua

SEQ ID NO: 2147699 - RNA, 14 nt, Homo sapiens
auagugcacaaaau

SEQ ID NO: 2147700 - RNA, 13 nt, Homo sapiens
uauaaucagagau

SEQ ID NO: 2147701 - RNA, 12 nt, Homo sapiens
ccuugcacacag

SEQ ID NO: 2147702 - RNA, 19 nt, Homo sapiens
agaguucuucauuccuugc

SEQ ID NO: 2147703 - RNA, 22 nt, Homo sapiens
uccccggggucuucuaccucag

SEQ ID NO: 2147704 - RNA, 14 nt, Homo sapiens
uuugaugauacaga

SEQ ID NO: 2147705 - RNA, 13 nt, Homo sapiens
aauaaaugugaga

SEQ ID NO: 2147706 - RNA, 12 nt, Homo sapiens
uuacugaaucuu

SEQ ID NO: 2147707 - RNA, 19 nt, Homo sapiens
acaaagggacacacaguga

SEQ ID NO: 2147708 - RNA, 20 nt, Homo sapiens
cccagcgacuucugaagggc

SEQ ID NO: 2147709 - RNA, 15 nt, Homo sapiens
aaguucucauugaau

SEQ ID NO: 2147710 - RNA, 20 nt, Homo sapiens
cguguucacacacacacaau

SEQ ID NO: 2147711 - RNA, 21 nt, Homo sapiens
caucucaaaaauaaugcauaa

SEQ ID NO: 2147712 - RNA, 17 nt, Homo sapiens
cuugggguaagccagag

SEQ ID NO: 2147713 - RNA, 21 nt, Homo sapiens
ugcagggagcucaagcccuug

SEQ ID NO: 2147714 - RNA, 18 nt, Homo sapiens
uugaggccuuuuuugcca

SEQ ID NO: 2147715 - RNA, 13 nt, Homo sapiens
uuaacuuuuggaa

SEQ ID NO: 2147716 - RNA, 18 nt, Homo sapiens
augucacaaccucucuga

SEQ ID NO: 2147717 - RNA, 13 nt, Homo sapiens
gacugugaccacc

SEQ ID NO: 2147718 - RNA, 15 nt, Homo sapiens
ccaauuguacauucc

SEQ ID NO: 2147719 - RNA, 11 nt, Homo sapiens
ugucaucucag

SEQ ID NO: 2147720 - RNA, 17 nt, Homo sapiens
uaauuaggaucuaugca

SEQ ID NO: 2147721 - RNA, 16 nt, Homo sapiens
agccccagaguggcuc

SEQ ID NO: 2147722 - RNA, 21 nt, Homo sapiens
aaccauuuguaaaacauucca

SEQ ID NO: 2147723 - RNA, 23 nt, Homo sapiens
cagccuuucacaggacucugcag

SEQ ID NO: 2147724 - RNA, 20 nt, Homo sapiens
acuguggcugcuagcacuug

SEQ ID NO: 2147725 - RNA, 22 nt, Homo sapiens
cacaaugugaaaauguaucuga

SEQ ID NO: 2147726 - RNA, 14 nt, Homo sapiens
gaaaugccaauaac

SEQ ID NO: 2147727 - RNA, 12 nt, Homo sapiens
cuuucucucaga

SEQ ID NO: 2147728 - RNA, 16 nt, Homo sapiens
ccuggacaugccuguc

SEQ ID NO: 2147729 - RNA, 23 nt, Homo sapiens
cauuugcuaaguguaugauguca

SEQ ID NO: 2147730 - RNA, 18 nt, Homo sapiens
gcaagggaaugaauccau

SEQ ID NO: 2147731 - RNA, 15 nt, Homo sapiens
ucugcuucaccaagg

SEQ ID NO: 2147732 - RNA, 20 nt, Homo sapiens
acuugaacucacucccucac

SEQ ID NO: 2147733 - RNA, 17 nt, Homo sapiens
ucuguaaugauacugau

SEQ ID NO: 2147734 - RNA, 19 nt, Homo sapiens
auuauagauuuucauguuc

SEQ ID NO: 2147735 - RNA, 23 nt, Homo sapiens
auauauuuuuugagucuguucuu

SEQ ID NO: 2147736 - RNA, 16 nt, Homo sapiens
gaucaaacuacauauu

SEQ ID NO: 2147737 - RNA, 23 nt, Homo sapiens
aguguaaaaaaugucucauguca

SEQ ID NO: 2147738 - RNA, 16 nt, Homo sapiens
uggaacccccagaaua

SEQ ID NO: 2147739 - RNA, 18 nt, Homo sapiens
accauguuguccaggcug

SEQ ID NO: 2147740 - RNA, 21 nt, Homo sapiens
guucgauugaaauuuugcacc

SEQ ID NO: 2147741 - RNA, 13 nt, Homo sapiens
aagaaaauggauu

SEQ ID NO: 2147742 - RNA, 15 nt, Homo sapiens
gcacuuuaaaugaag

SEQ ID NO: 2147743 - RNA, 18 nt, Homo sapiens
gaccuuaagacacuguga

SEQ ID NO: 2147744 - RNA, 15 nt, Homo sapiens
caugaguuuguuuac

SEQ ID NO: 2147745 - RNA, 21 nt, Homo sapiens
ucauugaaccucuuggguuca

SEQ ID NO: 2147746 - RNA, 21 nt, Homo sapiens
aacugagugugcucuuagcuc

SEQ ID NO: 2147747 - RNA, 20 nt, Homo sapiens
uuugauucagcaaaaaucuc

SEQ ID NO: 2147748 - RNA, 21 nt, Homo sapiens
aaaaauauccuugauguacag

SEQ ID NO: 2147749 - RNA, 16 nt, Homo sapiens
agggugcagggaccaa

SEQ ID NO: 2147750 - RNA, 12 nt, Homo sapiens
acacugccaaau

SEQ ID NO: 2147751 - RNA, 21 nt, Homo sapiens
uggccacacacugaguugcac

SEQ ID NO: 2147752 - RNA, 18 nt, Homo sapiens
gacaagaaugugcacucu

SEQ ID NO: 2147753 - RNA, 19 nt, Homo sapiens
ucguggugugucaaugcca

SEQ ID NO: 2147754 - RNA, 24 nt, Homo sapiens
auguuauuggaagcugauucccag

SEQ ID NO: 2147755 - RNA, 19 nt, Homo sapiens
acuuggaguaaaacuguau

SEQ ID NO: 2147756 - RNA, 12 nt, Homo sapiens
gucuccaagacc

SEQ ID NO: 2147757 - RNA, 17 nt, Homo sapiens
aaagaaggacacuugua

SEQ ID NO: 2147758 - RNA, 17 nt, Homo sapiens
ccuggcucccaagggag

SEQ ID NO: 2147759 - RNA, 14 nt, Homo sapiens
acuuuuccuuugaa

SEQ ID NO: 2147760 - RNA, 15 nt, Homo sapiens
agauccugucuugcu

SEQ ID NO: 2147761 - RNA, 14 nt, Homo sapiens
cauaucagaacugu

SEQ ID NO: 2147762 - RNA, 16 nt, Homo sapiens
ucugggaaaagcccaa

SEQ ID NO: 2147763 - RNA, 14 nt, Homo sapiens
aauaaauacuuaag

SEQ ID NO: 2147764 - RNA, 16 nt, Homo sapiens
aguagaaauuuuacaa

SEQ ID NO: 2147765 - RNA, 19 nt, Homo sapiens
cauauuuuuuuuacuguca

SEQ ID NO: 2147766 - RNA, 19 nt, Homo sapiens
aaaucguucaucauaagaa

SEQ ID NO: 2147767 - RNA, 17 nt, Homo sapiens
aagggacauauucauuu

SEQ ID NO: 2147768 - RNA, 11 nt, Homo sapiens
ccugcacacaa

SEQ ID NO: 2147769 - RNA, 13 nt, Homo sapiens
agggccucaggca

SEQ ID NO: 2147770 - RNA, 15 nt, Homo sapiens
gugauuggugcugag

SEQ ID NO: 2147771 - RNA, 17 nt, Homo sapiens
cuccugccggcuccuug

SEQ ID NO: 2147772 - RNA, 18 nt, Homo sapiens
ucauagggcccugucuua

SEQ ID NO: 2147773 - RNA, 21 nt, Homo sapiens
cuguccuggaucugcucuaga

SEQ ID NO: 2147774 - RNA, 17 nt, Homo sapiens
gaaaucuguccuguggc

SEQ ID NO: 2147775 - RNA, 16 nt, Homo sapiens
uucuccuacaaaggga

SEQ ID NO: 2147776 - RNA, 13 nt, Homo sapiens
ucuccaugcacau

SEQ ID NO: 2147777 - RNA, 18 nt, Homo sapiens
cacuuuguuucauauucu

SEQ ID NO: 2147778 - RNA, 11 nt, Homo sapiens
ccagacagggu

SEQ ID NO: 2147779 - RNA, 13 nt, Homo sapiens
aaccugugccagg

SEQ ID NO: 2147780 - RNA, 15 nt, Homo sapiens
agccacagacaauau

SEQ ID NO: 2147781 - RNA, 19 nt, Homo sapiens
acccuucuggaaacuguga

SEQ ID NO: 2147782 - RNA, 17 nt, Homo sapiens
caguguccugagcucag

SEQ ID NO: 2147783 - RNA, 12 nt, Homo sapiens
caucgggagcac

SEQ ID NO: 2147784 - RNA, 15 nt, Homo sapiens
accauucugcauuua

SEQ ID NO: 2147785 - RNA, 16 nt, Homo sapiens
acagauggacacugcc

SEQ ID NO: 2147786 - RNA, 17 nt, Homo sapiens
aaucaguuacucuucag

SEQ ID NO: 2147787 - RNA, 15 nt, Homo sapiens
uugggccauggcuuu

SEQ ID NO: 2147788 - RNA, 20 nt, Homo sapiens
auuugggggacuuacaugau

SEQ ID NO: 2147789 - RNA, 10 nt, Homo sapiens
agugcaguuu

SEQ ID NO: 2147790 - RNA, 22 nt, Homo sapiens
gagcaggaagccgaugugacug

SEQ ID NO: 2147791 - RNA, 16 nt, Homo sapiens
cugcaguuagcacaga

SEQ ID NO: 2147792 - RNA, 23 nt, Homo sapiens
cacuuuuuuuauaagcaaaaacg

SEQ ID NO: 2147793 - RNA, 18 nt, Homo sapiens
cuggacaaagacuaccug

SEQ ID NO: 2147794 - RNA, 20 nt, Homo sapiens
gcuggaguguaguggcgcga

SEQ ID NO: 2147795 - RNA, 16 nt, Homo sapiens
aagggaaauuguuuau

SEQ ID NO: 2147796 - RNA, 17 nt, Homo sapiens
cacaccugccgucuuca

SEQ ID NO: 2147797 - RNA, 14 nt, Homo sapiens
augugagucuggga

SEQ ID NO: 2147798 - RNA, 15 nt, Homo sapiens
acuauuagacaugaa

SEQ ID NO: 2147799 - RNA, 18 nt, Homo sapiens
aucugugccagagguaau

SEQ ID NO: 2147800 - RNA, 23 nt, Homo sapiens
agaauuggggcacuuaaugguca

SEQ ID NO: 2147801 - RNA, 18 nt, Homo sapiens
uccagugcaguagugcca

SEQ ID NO: 2147802 - RNA, 16 nt, Homo sapiens
caaaucuugaaauuaa

SEQ ID NO: 2147803 - RNA, 22 nt, Homo sapiens
ugauucucaagaucaaagggga

SEQ ID NO: 2147804 - RNA, 21 nt, Homo sapiens
ucacuuuccacccucucucca

SEQ ID NO: 2147805 - RNA, 16 nt, Homo sapiens
ucucguauaauauuca

SEQ ID NO: 2147806 - RNA, 13 nt, Homo sapiens
uuuucucugaaaa

SEQ ID NO: 2147807 - RNA, 16 nt, Homo sapiens
ucaguggcuuugcaua

SEQ ID NO: 2147808 - RNA, 13 nt, Homo sapiens
aacuauaccugcu

SEQ ID NO: 2147809 - RNA, 13 nt, Homo sapiens
cacuuucugccag

SEQ ID NO: 2147810 - RNA, 21 nt, Homo sapiens
ucuuggggcaagacugcaaac

SEQ ID NO: 2147811 - RNA, 19 nt, Homo sapiens
ccaguaaggcagcucuguc

SEQ ID NO: 2147812 - RNA, 13 nt, Homo sapiens
agccugcacuggg

SEQ ID NO: 2147813 - RNA, 15 nt, Homo sapiens
ucauucugaugucca

SEQ ID NO: 2147814 - RNA, 22 nt, Homo sapiens
cacagauguuugaggcuuucag

SEQ ID NO: 2147815 - RNA, 13 nt, Homo sapiens
uccuuugaucucg

SEQ ID NO: 2147816 - RNA, 22 nt, Homo sapiens
ccacugaauugacaugacccuc

SEQ ID NO: 2147817 - RNA, 22 nt, Homo sapiens
uggcagacuagagucugagaug

SEQ ID NO: 2147818 - RNA, 23 nt, Homo sapiens
gagcacuuuugaaaagcuugucc

SEQ ID NO: 2147819 - RNA, 20 nt, Homo sapiens
gucuaccuucuuuucuuccu

SEQ ID NO: 2147820 - RNA, 19 nt, Homo sapiens
agggcaccguauuccucuc

SEQ ID NO: 2147821 - RNA, 19 nt, Homo sapiens
cugauaagcuaacaccaga

SEQ ID NO: 2147822 - RNA, 21 nt, Homo sapiens
aaguuuuuuccucccugcuua

SEQ ID NO: 2147823 - RNA, 21 nt, Homo sapiens
aguauuccaugagcugcucau

SEQ ID NO: 2147824 - RNA, 20 nt, Homo sapiens
uugauguucagaguggcuca

SEQ ID NO: 2147825 - RNA, 11 nt, Homo sapiens
gcgaugugcaa

SEQ ID NO: 2147826 - RNA, 15 nt, Homo sapiens
uucgcugaaauacuu

SEQ ID NO: 2147827 - RNA, 15 nt, Homo sapiens
acauacgucuuucac

SEQ ID NO: 2147828 - RNA, 21 nt, Homo sapiens
uuuacagcuaucgaacuucac

SEQ ID NO: 2147829 - RNA, 16 nt, Homo sapiens
cagguccauuuugccu

SEQ ID NO: 2147830 - RNA, 19 nt, Homo sapiens
cuggggccaugggugcaug

SEQ ID NO: 2147831 - RNA, 17 nt, Homo sapiens
ugaccaucugcuuuuau

SEQ ID NO: 2147832 - RNA, 15 nt, Homo sapiens
uuugaagcgagcagu

SEQ ID NO: 2147833 - RNA, 13 nt, Homo sapiens
uuucacugccaua

SEQ ID NO: 2147834 - RNA, 16 nt, Homo sapiens
caugaacucauuucca

SEQ ID NO: 2147835 - RNA, 21 nt, Homo sapiens
gccacguauguuuuuguguau

SEQ ID NO: 2147836 - RNA, 23 nt, Homo sapiens
acauuucucuaacuccugccauu

SEQ ID NO: 2147837 - RNA, 22 nt, Homo sapiens
gccccauucccaaagggcacau

SEQ ID NO: 2147838 - RNA, 18 nt, Homo sapiens
cucccacccuucucaggg

SEQ ID NO: 2147839 - RNA, 21 nt, Homo sapiens
aagacuacuggacuucuauca

SEQ ID NO: 2147840 - RNA, 21 nt, Homo sapiens
aggugcuggugggucugagcu

SEQ ID NO: 2147841 - RNA, 20 nt, Homo sapiens
cagguuaacuuagcuacuuu

SEQ ID NO: 2147842 - RNA, 15 nt, Homo sapiens
acccagaaaucauuu

SEQ ID NO: 2147843 - RNA, 21 nt, Homo sapiens
uugggcguuugaacucaggga

SEQ ID NO: 2147844 - RNA, 16 nt, Homo sapiens
gaauugaccccuuccu

SEQ ID NO: 2147845 - RNA, 21 nt, Homo sapiens
gauguugaaauaugcauacua

SEQ ID NO: 2147846 - RNA, 22 nt, Homo sapiens
accacaccuggcauggugcagg

SEQ ID NO: 2147847 - RNA, 13 nt, Homo sapiens
caacucaucuuag

SEQ ID NO: 2147848 - RNA, 23 nt, Homo sapiens
agaagacugcuccacccaugaug

SEQ ID NO: 2147849 - RNA, 19 nt, Homo sapiens
ccaccuucccuccucaugc

SEQ ID NO: 2147850 - RNA, 17 nt, Homo sapiens
auuggcaguuccuggca

SEQ ID NO: 2147851 - RNA, 15 nt, Homo sapiens
aagaguagcauuuca

SEQ ID NO: 2147852 - RNA, 12 nt, Homo sapiens
ucuuuaaucaca

SEQ ID NO: 2147853 - RNA, 14 nt, Homo sapiens
caugagaauuacag

SEQ ID NO: 2147854 - RNA, 14 nt, Homo sapiens
caugaaaauuacaa

SEQ ID NO: 2147855 - RNA, 17 nt, Homo sapiens
ugccauagaauggcaca

SEQ ID NO: 2147856 - RNA, 17 nt, Homo sapiens
ugacugauuucaaauca

SEQ ID NO: 2147857 - RNA, 16 nt, Homo sapiens
augucaaacaguaaua

SEQ ID NO: 2147858 - RNA, 18 nt, Homo sapiens
uaagaguaaaauuccucu

SEQ ID NO: 2147859 - RNA, 17 nt, Homo sapiens
ggccuugcggcuccuca

SEQ ID NO: 2147860 - RNA, 14 nt, Homo sapiens
aaauaacagacugu

SEQ ID NO: 2147861 - RNA, 15 nt, Homo sapiens
aggaaccacaauguu

SEQ ID NO: 2147862 - RNA, 19 nt, Homo sapiens
ccccucuggugucuuugau

SEQ ID NO: 2147863 - RNA, 14 nt, Homo sapiens
auuuccuccacauu

SEQ ID NO: 2147864 - RNA, 20 nt, Homo sapiens
uuauguaugaaaauuauucu

SEQ ID NO: 2147865 - RNA, 20 nt, Homo sapiens
cauuuagugaaguugugcaa

SEQ ID NO: 2147866 - RNA, 18 nt, Homo sapiens
gcaccagggacuaugaau

SEQ ID NO: 2147867 - RNA, 19 nt, Homo sapiens
ugguggucucugcuugcau

SEQ ID NO: 2147868 - RNA, 14 nt, Homo sapiens
gcugcuuugcacac

SEQ ID NO: 2147869 - RNA, 15 nt, Homo sapiens
ugcaauaacagcugc

SEQ ID NO: 2147870 - RNA, 20 nt, Homo sapiens
auccaaaaauagcccugcaa

SEQ ID NO: 2147871 - RNA, 14 nt, Homo sapiens
augacaucuucaaa

SEQ ID NO: 2147872 - RNA, 14 nt, Homo sapiens
gcccucagccagag

SEQ ID NO: 2147873 - RNA, 22 nt, Homo sapiens
ucccauuuuugcuuagcucaau

SEQ ID NO: 2147874 - RNA, 22 nt, Homo sapiens
cgcuagagauugcuacaaaucu

SEQ ID NO: 2147875 - RNA, 17 nt, Homo sapiens
gucuugauucagucaca

SEQ ID NO: 2147876 - RNA, 13 nt, Homo sapiens
ccuaaugucugac

SEQ ID NO: 2147877 - RNA, 22 nt, Homo sapiens
uaugacaauaaauuuuaucuca

SEQ ID NO: 2147878 - RNA, 12 nt, Homo sapiens
uuguagcacauu

SEQ ID NO: 2147879 - RNA, 15 nt, Homo sapiens
guguaaacuugggga

SEQ ID NO: 2147880 - RNA, 21 nt, Homo sapiens
aagcuuucuguugauguuaac

SEQ ID NO: 2147881 - RNA, 21 nt, Homo sapiens
accaggucuuguuucucucuc

SEQ ID NO: 2147882 - RNA, 18 nt, Homo sapiens
ugcacauuugucacugaa

SEQ ID NO: 2147883 - RNA, 22 nt, Homo sapiens
gcaucugucccacugggacaca

SEQ ID NO: 2147884 - RNA, 16 nt, Homo sapiens
ugcaaagauuugcuuu

SEQ ID NO: 2147885 - RNA, 17 nt, Homo sapiens
aaauguuuuucuaugua

SEQ ID NO: 2147886 - RNA, 17 nt, Homo sapiens
cauuuuuacguacuuga

SEQ ID NO: 2147887 - RNA, 18 nt, Homo sapiens
aaagauaaaugaugauuc

SEQ ID NO: 2147888 - RNA, 17 nt, Homo sapiens
ccagcuugggcccagcu

SEQ ID NO: 2147889 - RNA, 20 nt, Homo sapiens
augacugaauagugugguuc

SEQ ID NO: 2147890 - RNA, 19 nt, Homo sapiens
acuugcaacuaaggacaaa

SEQ ID NO: 2147891 - RNA, 21 nt, Homo sapiens
accuaaauaugagcccagaaa

SEQ ID NO: 2147892 - RNA, 23 nt, Homo sapiens
auggugcuaagcgggcccggguc

SEQ ID NO: 2147893 - RNA, 18 nt, Homo sapiens
ugacuucucccaucuagu

SEQ ID NO: 2147894 - RNA, 22 nt, Homo sapiens
cucuuaugagcuccauguugcu

SEQ ID NO: 2147895 - RNA, 21 nt, Homo sapiens
aggcgcaggagcagccagcug

SEQ ID NO: 2147896 - RNA, 18 nt, Homo sapiens
ugucauugguuacaaauu

SEQ ID NO: 2147897 - RNA, 17 nt, Homo sapiens
uuuaacccucacuggga

SEQ ID NO: 2147898 - RNA, 20 nt, Homo sapiens
acccuauucuauccaucucc

SEQ ID NO: 2147899 - RNA, 22 nt, Homo sapiens
aacucuaagguacacacuuuca

SEQ ID NO: 2147900 - RNA, 17 nt, Homo sapiens
cuaaguccaguguuucu

SEQ ID NO: 2147901 - RNA, 14 nt, Homo sapiens
aucuucucauuccc

SEQ ID NO: 2147902 - RNA, 14 nt, Homo sapiens
ugcuuuucuguccu

SEQ ID NO: 2147903 - RNA, 14 nt, Homo sapiens
ucaaacagugccaa

SEQ ID NO: 2147904 - RNA, 23 nt, Homo sapiens
ccucuacauugaaaacaacaaaa

SEQ ID NO: 2147905 - RNA, 16 nt, Homo sapiens
caugguaggcuacuuu

SEQ ID NO: 2147906 - RNA, 14 nt, Homo sapiens
ugcaguagccguuu

SEQ ID NO: 2147907 - RNA, 21 nt, Homo sapiens
aaaaugcuaaacaacugggua

SEQ ID NO: 2147908 - RNA, 14 nt, Homo sapiens
cuguugcagguguc

SEQ ID NO: 2147909 - RNA, 17 nt, Homo sapiens
cuugugaaguggaaaug

SEQ ID NO: 2147910 - RNA, 22 nt, Homo sapiens
ucagauccuuucuccacacagc

SEQ ID NO: 2147911 - RNA, 18 nt, Homo sapiens
cuguccugaaagccacag

SEQ ID NO: 2147912 - RNA, 12 nt, Homo sapiens
gcuggggccaaa

SEQ ID NO: 2147913 - RNA, 13 nt, Homo sapiens
uaguaaauccaug

SEQ ID NO: 2147914 - RNA, 17 nt, Homo sapiens
caaaccucuaacccagg

SEQ ID NO: 2147915 - RNA, 17 nt, Homo sapiens
uaacuaaaugcucauac

SEQ ID NO: 2147916 - RNA, 19 nt, Homo sapiens
ggcaguuggggcggcccac

SEQ ID NO: 2147917 - RNA, 22 nt, Homo sapiens
agugaaaauuguuuagugauau

SEQ ID NO: 2147918 - RNA, 15 nt, Homo sapiens
ggaaauuagccacau

SEQ ID NO: 2147919 - RNA, 14 nt, Homo sapiens
guccuuuucuccca

SEQ ID NO: 2147920 - RNA, 21 nt, Homo sapiens
aacuaagaaaauucuauguua

SEQ ID NO: 2147921 - RNA, 14 nt, Homo sapiens
caacccggcacugc

SEQ ID NO: 2147922 - RNA, 14 nt, Homo sapiens
gcgcaguggcucac

SEQ ID NO: 2147923 - RNA, 18 nt, Homo sapiens
aucugauauuuuaaaaag

SEQ ID NO: 2147924 - RNA, 21 nt, Homo sapiens
cauacaagcaacagcaaaagc

SEQ ID NO: 2147925 - RNA, 12 nt, Homo sapiens
ucaucugggaaa

SEQ ID NO: 2147926 - RNA, 15 nt, Homo sapiens
cccaaccugacuuug

SEQ ID NO: 2147927 - RNA, 20 nt, Homo sapiens
uaccaggcacgucugcagaa

SEQ ID NO: 2147928 - RNA, 19 nt, Homo sapiens
gaugacaggucagcaguau

SEQ ID NO: 2147929 - RNA, 12 nt, Homo sapiens
aaugugcacucu

SEQ ID NO: 2147930 - RNA, 16 nt, Homo sapiens
gagucauugacuucau

SEQ ID NO: 2147931 - RNA, 19 nt, Homo sapiens
cauuccuucacucauccag

SEQ ID NO: 2147932 - RNA, 18 nt, Homo sapiens
ucaaccaaugccaaaaaa

SEQ ID NO: 2147933 - RNA, 17 nt, Homo sapiens
cauuauuaaaguuuuca

SEQ ID NO: 2147934 - RNA, 19 nt, Homo sapiens
cuuccaaacagaacuaugg

SEQ ID NO: 2147935 - RNA, 19 nt, Homo sapiens
cuccccagugcaaaugcau

SEQ ID NO: 2147936 - RNA, 14 nt, Homo sapiens
aguauuacugcugc

SEQ ID NO: 2147937 - RNA, 13 nt, Homo sapiens
gcaucagugacug

SEQ ID NO: 2147938 - RNA, 21 nt, Homo sapiens
ucaucugcuccuagcccagca

SEQ ID NO: 2147939 - RNA, 14 nt, Homo sapiens
augaucaugaugau

SEQ ID NO: 2147940 - RNA, 17 nt, Homo sapiens
agagaaagcacaauuua

SEQ ID NO: 2147941 - RNA, 14 nt, Homo sapiens
aaaugacauuucac

SEQ ID NO: 2147942 - RNA, 16 nt, Homo sapiens
uacaccgacuagccag

SEQ ID NO: 2147943 - RNA, 15 nt, Homo sapiens
ccugcagaaguccca

SEQ ID NO: 2147944 - RNA, 18 nt, Homo sapiens
ucagacuuucacaccauu

SEQ ID NO: 2147945 - RNA, 12 nt, Homo sapiens
agucacaugacc

SEQ ID NO: 2147946 - RNA, 14 nt, Homo sapiens
cucgagagugagaa

SEQ ID NO: 2147947 - RNA, 16 nt, Homo sapiens
auucucgggcugagaa

SEQ ID NO: 2147948 - RNA, 15 nt, Homo sapiens
ccugggacaucuucu

SEQ ID NO: 2147949 - RNA, 13 nt, Homo sapiens
aaguguacuggau

SEQ ID NO: 2147950 - RNA, 20 nt, Homo sapiens
auacuuuuaugcaaccauaa

SEQ ID NO: 2147951 - RNA, 17 nt, Homo sapiens
gcccgcccgcauagcac

SEQ ID NO: 2147952 - RNA, 18 nt, Homo sapiens
gaaauucagguacagaaa

SEQ ID NO: 2147953 - RNA, 21 nt, Homo sapiens
aacuccuuguuaauccaguga

SEQ ID NO: 2147954 - RNA, 15 nt, Homo sapiens
ucucuauugcugcuc

SEQ ID NO: 2147955 - RNA, 19 nt, Homo sapiens
ccaccuagagcuagaugug

SEQ ID NO: 2147956 - RNA, 20 nt, Homo sapiens
accgcuccagguaccuugac

SEQ ID NO: 2147957 - RNA, 23 nt, Homo sapiens
uacuuuuaaagccuauucacuug

SEQ ID NO: 2147958 - RNA, 22 nt, Homo sapiens
aagcaggugcuacaacauguga

SEQ ID NO: 2147959 - RNA, 16 nt, Homo sapiens
agcccaggacacugcc

SEQ ID NO: 2147960 - RNA, 15 nt, Homo sapiens
ugagaccaagucucu

SEQ ID NO: 2147961 - RNA, 16 nt, Homo sapiens
ccugguccuucccuga

SEQ ID NO: 2147962 - RNA, 22 nt, Homo sapiens
gagaggcccugggguucucccc

SEQ ID NO: 2147963 - RNA, 17 nt, Homo sapiens
cugcacagugcaucuca

SEQ ID NO: 2147964 - RNA, 21 nt, Homo sapiens
acagcuguaaucccagcacuu

SEQ ID NO: 2147965 - RNA, 19 nt, Homo sapiens
uucuaaauccgacuugaau

SEQ ID NO: 2147966 - RNA, 19 nt, Homo sapiens
gacaucuccagugugccag

SEQ ID NO: 2147967 - RNA, 15 nt, Homo sapiens
cauauuuaccucagc

SEQ ID NO: 2147968 - RNA, 18 nt, Homo sapiens
aacuauaugguaguuuaa

SEQ ID NO: 2147969 - RNA, 17 nt, Homo sapiens
aaucuucagaccuagaa

SEQ ID NO: 2147970 - RNA, 16 nt, Homo sapiens
auaaucguguccugaa

SEQ ID NO: 2147971 - RNA, 14 nt, Homo sapiens
cagaagaagcuggu

SEQ ID NO: 2147972 - RNA, 19 nt, Homo sapiens
ccaaagagaaugccauucu

SEQ ID NO: 2147973 - RNA, 18 nt, Homo sapiens
guaugcuggccagcaccc

SEQ ID NO: 2147974 - RNA, 14 nt, Homo sapiens
gauuaaagugccca

SEQ ID NO: 2147975 - RNA, 16 nt, Homo sapiens
aggcgcaggugcacag

SEQ ID NO: 2147976 - RNA, 17 nt, Homo sapiens
gggugcagagagaucau

SEQ ID NO: 2147977 - RNA, 19 nt, Homo sapiens
gcuuauccccucagaaucc

SEQ ID NO: 2147978 - RNA, 20 nt, Homo sapiens
gggaaggcaaaggcagagga

SEQ ID NO: 2147979 - RNA, 21 nt, Homo sapiens
gccuggggacccaaacccccu

SEQ ID NO: 2147980 - RNA, 20 nt, Homo sapiens
cagucacgcaagcuaguucc

SEQ ID NO: 2147981 - RNA, 22 nt, Homo sapiens
ucacuuucuuuaggaaagagaa

SEQ ID NO: 2147982 - RNA, 18 nt, Homo sapiens
uggcauguugauuucuau

SEQ ID NO: 2147983 - RNA, 22 nt, Homo sapiens
acuggcauggacaucagcauca

SEQ ID NO: 2147984 - RNA, 15 nt, Homo sapiens
cggguaaugagccau

SEQ ID NO: 2147985 - RNA, 16 nt, Homo sapiens
uggcugaggauuucaa

SEQ ID NO: 2147986 - RNA, 15 nt, Homo sapiens
uaaguaaugaugucg

SEQ ID NO: 2147987 - RNA, 22 nt, Homo sapiens
ggaaggguuagggguucauucu

SEQ ID NO: 2147988 - RNA, 19 nt, Homo sapiens
ccaagguggagggaaggau

SEQ ID NO: 2147989 - RNA, 14 nt, Homo sapiens
ucugugggugcuac

SEQ ID NO: 2147990 - RNA, 18 nt, Homo sapiens
auauuauuguaaccaaua

SEQ ID NO: 2147991 - RNA, 16 nt, Homo sapiens
acaguggagagagaaa

SEQ ID NO: 2147992 - RNA, 20 nt, Homo sapiens
ccacuaucccauuugcccuc

SEQ ID NO: 2147993 - RNA, 20 nt, Homo sapiens
cguagccacgcacagccaga

SEQ ID NO: 2147994 - RNA, 18 nt, Homo sapiens
ugagaaucacuugaacuc

SEQ ID NO: 2147995 - RNA, 12 nt, Homo sapiens
uuggaauucacc

SEQ ID NO: 2147996 - RNA, 15 nt, Homo sapiens
uccccugcuaccugc

SEQ ID NO: 2147997 - RNA, 12 nt, Homo sapiens
uuuuccaaauaa

SEQ ID NO: 2147998 - RNA, 18 nt, Homo sapiens
gaaaacuucagaagcaaa

SEQ ID NO: 2147999 - RNA, 22 nt, Homo sapiens
cacugcuccaguuucaccucuu

SEQ ID NO: 2148000 - RNA, 19 nt, Homo sapiens
uauacuguuauuucacuuu

SEQ ID NO: 2148001 - RNA, 23 nt, Homo sapiens
agaaauuugguuucaaguguaca

SEQ ID NO: 2148002 - RNA, 18 nt, Homo sapiens
auggaagggccuucucca

SEQ ID NO: 2148003 - RNA, 18 nt, Homo sapiens
ggaguggcguggggccaa

SEQ ID NO: 2148004 - RNA, 20 nt, Homo sapiens
gaaugcaaaaaaucuuccaa

SEQ ID NO: 2148005 - RNA, 21 nt, Homo sapiens
aggugaacacuuagugaucau

SEQ ID NO: 2148006 - RNA, 22 nt, Homo sapiens
gaaagacaagcucaaguguuca

SEQ ID NO: 2148007 - RNA, 14 nt, Homo sapiens
agcaagaccuggag

SEQ ID NO: 2148008 - RNA, 17 nt, Homo sapiens
uuuuaaccccauuugca

SEQ ID NO: 2148009 - RNA, 15 nt, Homo sapiens
aacauaugcaaaaua

SEQ ID NO: 2148010 - RNA, 17 nt, Homo sapiens
agacaagucuggcacuu

SEQ ID NO: 2148011 - RNA, 14 nt, Homo sapiens
aggguagugcuaag

SEQ ID NO: 2148012 - RNA, 14 nt, Homo sapiens
ccacacacagagga

SEQ ID NO: 2148013 - RNA, 23 nt, Homo sapiens
ccacaugcaugucugccuaugca

SEQ ID NO: 2148014 - RNA, 22 nt, Homo sapiens
ccuuuuaaaaggcccugugguc

SEQ ID NO: 2148015 - RNA, 19 nt, Homo sapiens
ucacuacaguuucaacguc

SEQ ID NO: 2148016 - RNA, 14 nt, Homo sapiens
uugugucacuguac

SEQ ID NO: 2148017 - RNA, 23 nt, Homo sapiens
ggagagcccggcgccccugccac

SEQ ID NO: 2148018 - RNA, 21 nt, Homo sapiens
agaucuuuuagcccagucaua

SEQ ID NO: 2148019 - RNA, 16 nt, Homo sapiens
cuuccucccauuuccc

SEQ ID NO: 2148020 - RNA, 15 nt, Homo sapiens
uccuagucuucacaa

SEQ ID NO: 2148021 - RNA, 23 nt, Homo sapiens
gauuauacgacuuuuaagcaaag

SEQ ID NO: 2148022 - RNA, 20 nt, Homo sapiens
gaggcugccccucucaccaa

SEQ ID NO: 2148023 - RNA, 15 nt, Homo sapiens
ucuguacugauucaa

SEQ ID NO: 2148024 - RNA, 13 nt, Homo sapiens
cauaugaacauau

SEQ ID NO: 2148025 - RNA, 13 nt, Homo sapiens
aaagagaaaaaga

SEQ ID NO: 2148026 - RNA, 13 nt, Homo sapiens
gccaggaagccag

SEQ ID NO: 2148027 - RNA, 19 nt, Homo sapiens
ucaucugucugucccaguu

SEQ ID NO: 2148028 - RNA, 22 nt, Homo sapiens
cgaaagcaaugcuucuaucaaa

SEQ ID NO: 2148029 - RNA, 22 nt, Homo sapiens
acgagcuagcuucugcaauguu

SEQ ID NO: 2148030 - RNA, 15 nt, Homo sapiens
uguaauaaguaucac

SEQ ID NO: 2148031 - RNA, 22 nt, Homo sapiens
acaauuuucacuuuuucugucu

SEQ ID NO: 2148032 - RNA, 20 nt, Homo sapiens
auauguaaaauuacacuuug

SEQ ID NO: 2148033 - RNA, 23 nt, Homo sapiens
gcguuacacccuuucuugacaaa

SEQ ID NO: 2148034 - RNA, 14 nt, Homo sapiens
agauuccaaaaagc

SEQ ID NO: 2148035 - RNA, 13 nt, Homo sapiens
gccuaaaguacag

SEQ ID NO: 2148036 - RNA, 19 nt, Homo sapiens
aauacguguguaccuaaaa

SEQ ID NO: 2148037 - RNA, 18 nt, Homo sapiens
gaccuuucugagugacau

SEQ ID NO: 2148038 - RNA, 21 nt, Homo sapiens
uuucuccccacgaugauaucu

SEQ ID NO: 2148039 - RNA, 17 nt, Homo sapiens
auguugacaugggacau

SEQ ID NO: 2148040 - RNA, 12 nt, Homo sapiens
gccugucuuucc

SEQ ID NO: 2148041 - RNA, 22 nt, Homo sapiens
aguuuuccuuuguaaucacucc

SEQ ID NO: 2148042 - RNA, 16 nt, Homo sapiens
ggaaacuucaguugau

SEQ ID NO: 2148043 - RNA, 16 nt, Homo sapiens
gugucugcugacuguu

SEQ ID NO: 2148044 - RNA, 18 nt, Homo sapiens
aaaaucuuguacauuaua

SEQ ID NO: 2148045 - RNA, 22 nt, Homo sapiens
aggggccuccaaccuucugccc

SEQ ID NO: 2148046 - RNA, 21 nt, Homo sapiens
ucugagacucgcgacaaugca

SEQ ID NO: 2148047 - RNA, 18 nt, Homo sapiens
caagcacugcaugggcaa

SEQ ID NO: 2148048 - RNA, 12 nt, Homo sapiens
gugcaguacuca

SEQ ID NO: 2148049 - RNA, 12 nt, Homo sapiens
gcuucgacuacu

SEQ ID NO: 2148050 - RNA, 12 nt, Homo sapiens
gcccaaauggaa

SEQ ID NO: 2148051 - RNA, 14 nt, Homo sapiens
cagcaacauccaga

SEQ ID NO: 2148052 - RNA, 22 nt, Homo sapiens
uaugacuuuccucagaacauga

SEQ ID NO: 2148053 - RNA, 14 nt, Homo sapiens
auaugcacuugaaa

SEQ ID NO: 2148054 - RNA, 19 nt, Homo sapiens
uuugaaagcuuauuugaua

SEQ ID NO: 2148055 - RNA, 16 nt, Homo sapiens
agcauggucuuaugca

SEQ ID NO: 2148056 - RNA, 13 nt, Homo sapiens
ugggcucgcacug

SEQ ID NO: 2148057 - RNA, 15 nt, Homo sapiens
agccucagugaccca

SEQ ID NO: 2148058 - RNA, 15 nt, Homo sapiens
ucuuggagcugagau

SEQ ID NO: 2148059 - RNA, 20 nt, Homo sapiens
ugauuucaggagaaccuaac

SEQ ID NO: 2148060 - RNA, 18 nt, Homo sapiens
gagaaggcgaggucaagu

SEQ ID NO: 2148061 - RNA, 14 nt, Homo sapiens
uaaaaugacauuca

SEQ ID NO: 2148062 - RNA, 23 nt, Homo sapiens
acagccuucagcagcagcucaca

SEQ ID NO: 2148063 - RNA, 16 nt, Homo sapiens
uucaucuuccccaagu

SEQ ID NO: 2148064 - RNA, 14 nt, Homo sapiens
gcgauuugagggag

SEQ ID NO: 2148065 - RNA, 21 nt, Homo sapiens
ggguuccuccucuccuacucg

SEQ ID NO: 2148066 - RNA, 15 nt, Homo sapiens
aaccacaugucccag

SEQ ID NO: 2148067 - RNA, 13 nt, Homo sapiens
ugggacugagaug

SEQ ID NO: 2148068 - RNA, 16 nt, Homo sapiens
ccuaacucuugcucac

SEQ ID NO: 2148069 - RNA, 19 nt, Homo sapiens
gggaauugaggacacugau

SEQ ID NO: 2148070 - RNA, 13 nt, Homo sapiens
aaugccauccuca

SEQ ID NO: 2148071 - RNA, 19 nt, Homo sapiens
agaggaagagcugcaacgg

SEQ ID NO: 2148072 - RNA, 23 nt, Homo sapiens
gaugcuccuaguuugaccucaca

SEQ ID NO: 2148073 - RNA, 14 nt, Homo sapiens
cauugugauuuauu

SEQ ID NO: 2148074 - RNA, 14 nt, Homo sapiens
gagcugagaucacg

SEQ ID NO: 2148075 - RNA, 15 nt, Homo sapiens
cuccgcuacuuccag

SEQ ID NO: 2148076 - RNA, 14 nt, Homo sapiens
aagccaauauuuua

SEQ ID NO: 2148077 - RNA, 23 nt, Homo sapiens
aagauacugaggaaugucuuuca

SEQ ID NO: 2148078 - RNA, 22 nt, Homo sapiens
aagcaucauuacaauacaguau

SEQ ID NO: 2148079 - RNA, 20 nt, Homo sapiens
gaucuuaaagcauuccccaa

SEQ ID NO: 2148080 - RNA, 14 nt, Homo sapiens
cguggagcugccug

SEQ ID NO: 2148081 - RNA, 19 nt, Homo sapiens
gcucuuacagccacaggca

SEQ ID NO: 2148082 - RNA, 15 nt, Homo sapiens
uuaagaagacauacu

SEQ ID NO: 2148083 - RNA, 15 nt, Homo sapiens
uaaugcuuauaagac

SEQ ID NO: 2148084 - RNA, 17 nt, Homo sapiens
aauacauuuucauuuau

SEQ ID NO: 2148085 - RNA, 21 nt, Homo sapiens
aaaaaauuuuagcucuuccca

SEQ ID NO: 2148086 - RNA, 23 nt, Homo sapiens
aacaucuuuuggaaguuuugcua

SEQ ID NO: 2148087 - RNA, 16 nt, Homo sapiens
aggccugagauuucau

SEQ ID NO: 2148088 - RNA, 19 nt, Homo sapiens
augucacacaagcuccuua

SEQ ID NO: 2148089 - RNA, 22 nt, Homo sapiens
agauggcugugccucugccugu

SEQ ID NO: 2148090 - RNA, 22 nt, Homo sapiens
agggagcucacucccacuggaa

SEQ ID NO: 2148091 - RNA, 22 nt, Homo sapiens
uaacagacugaaaugugcucag

SEQ ID NO: 2148092 - RNA, 13 nt, Homo sapiens
agggcaccuggag

SEQ ID NO: 2148093 - RNA, 23 nt, Homo sapiens
aaauaaaccacuggucccagagc

SEQ ID NO: 2148094 - RNA, 18 nt, Homo sapiens
uuugaaugcaugugugaa

SEQ ID NO: 2148095 - RNA, 17 nt, Homo sapiens
acagccugagccaaggc

SEQ ID NO: 2148096 - RNA, 13 nt, Homo sapiens
gugcacguugcuu

SEQ ID NO: 2148097 - RNA, 14 nt, Homo sapiens
cacagaagcucauc

SEQ ID NO: 2148098 - RNA, 14 nt, Homo sapiens
gagaacaagaaagg

SEQ ID NO: 2148099 - RNA, 19 nt, Homo sapiens
aaggcaucauuuucaccuc

SEQ ID NO: 2148100 - RNA, 19 nt, Homo sapiens
auguguuauuugucacaaa

SEQ ID NO: 2148101 - RNA, 19 nt, Homo sapiens
gguucguucuguacuguua

SEQ ID NO: 2148102 - RNA, 14 nt, Homo sapiens
auuuucccaugcca

SEQ ID NO: 2148103 - RNA, 23 nt, Homo sapiens
augacagugaagcagcacuguga

SEQ ID NO: 2148104 - RNA, 22 nt, Homo sapiens
guucaugcgaauucuugcuuga

SEQ ID NO: 2148105 - RNA, 18 nt, Homo sapiens
aauaacugacggauguaa

SEQ ID NO: 2148106 - RNA, 17 nt, Homo sapiens
caaggaguaaguacaaa

SEQ ID NO: 2148107 - RNA, 22 nt, Homo sapiens
ggugaaagcuacugaaauaagc

SEQ ID NO: 2148108 - RNA, 15 nt, Homo sapiens
gggucuccccaaaca

SEQ ID NO: 2148109 - RNA, 18 nt, Homo sapiens
auuucagauauuccaggu

SEQ ID NO: 2148110 - RNA, 19 nt, Homo sapiens
ugccacuguguacugugga

SEQ ID NO: 2148111 - RNA, 15 nt, Homo sapiens
guccaugaagcacug

SEQ ID NO: 2148112 - RNA, 15 nt, Homo sapiens
augccagagggccag

SEQ ID NO: 2148113 - RNA, 16 nt, Homo sapiens
accccagcuacucuga

SEQ ID NO: 2148114 - RNA, 14 nt, Homo sapiens
auuuuguaugaaaa

SEQ ID NO: 2148115 - RNA, 15 nt, Homo sapiens
gguuuugaaauccca

SEQ ID NO: 2148116 - RNA, 14 nt, Homo sapiens
augaggaauccaaa

SEQ ID NO: 2148117 - RNA, 16 nt, Homo sapiens
gggucaucgcugccca

SEQ ID NO: 2148118 - RNA, 15 nt, Homo sapiens
uccccaccagcuuua

SEQ ID NO: 2148119 - RNA, 17 nt, Homo sapiens
ucgaagggauuguguau

SEQ ID NO: 2148120 - RNA, 19 nt, Homo sapiens
aguggcauucacaucucau

SEQ ID NO: 2148121 - RNA, 22 nt, Homo sapiens
uggggccaaauaaagucucuuc

SEQ ID NO: 2148122 - RNA, 15 nt, Homo sapiens
gucucccaucagaaa

SEQ ID NO: 2148123 - RNA, 14 nt, Homo sapiens
cuuuccuacucuca

SEQ ID NO: 2148124 - RNA, 14 nt, Homo sapiens
agagcaaucagaau

SEQ ID NO: 2148125 - RNA, 18 nt, Homo sapiens
ugcagaauggcauuugca

SEQ ID NO: 2148126 - RNA, 19 nt, Homo sapiens
aguauuuuauucuuauuca

SEQ ID NO: 2148127 - RNA, 17 nt, Homo sapiens
ucagucuucacuugcac

SEQ ID NO: 2148128 - RNA, 23 nt, Homo sapiens
ucccagaaauuagaaaccuuaau

SEQ ID NO: 2148129 - RNA, 20 nt, Homo sapiens
gccaggaucccccucuuugc

SEQ ID NO: 2148130 - RNA, 21 nt, Homo sapiens
auaaauuacuuuuucauucuu

SEQ ID NO: 2148131 - RNA, 16 nt, Homo sapiens
gcagcuggaccaucuc

SEQ ID NO: 2148132 - RNA, 15 nt, Homo sapiens
agaaguaaucaguau

SEQ ID NO: 2148133 - RNA, 15 nt, Homo sapiens
uccuggccucauaca

SEQ ID NO: 2148134 - RNA, 20 nt, Homo sapiens
guagaucaacucauguuaau

SEQ ID NO: 2148135 - RNA, 15 nt, Homo sapiens
accucugacagcagc

SEQ ID NO: 2148136 - RNA, 20 nt, Homo sapiens
caagcauuucuagcagugau

SEQ ID NO: 2148137 - RNA, 22 nt, Homo sapiens
ggccaacauggugaaacccugu

SEQ ID NO: 2148138 - RNA, 16 nt, Homo sapiens
auaucuaugcugagua

SEQ ID NO: 2148139 - RNA, 20 nt, Homo sapiens
cagguaauaaaagcuuugac

SEQ ID NO: 2148140 - RNA, 15 nt, Homo sapiens
aggaggggcugucca

SEQ ID NO: 2148141 - RNA, 16 nt, Homo sapiens
cugugucccucaauua

SEQ ID NO: 2148142 - RNA, 15 nt, Homo sapiens
gcagaaugagccaga

SEQ ID NO: 2148143 - RNA, 17 nt, Homo sapiens
ugcaauccaaugcacug

SEQ ID NO: 2148144 - RNA, 20 nt, Homo sapiens
ucaaugcugacuggacugug

SEQ ID NO: 2148145 - RNA, 22 nt, Homo sapiens
aaaacuaaggcauuugauuaaa

SEQ ID NO: 2148146 - RNA, 14 nt, Homo sapiens
aauguaggcuccuc

SEQ ID NO: 2148147 - RNA, 22 nt, Homo sapiens
ucccagacccccuugcccaggc

SEQ ID NO: 2148148 - RNA, 16 nt, Homo sapiens
gugcucaggacucaga

SEQ ID NO: 2148149 - RNA, 15 nt, Homo sapiens
ugaaagaaccagaga

SEQ ID NO: 2148150 - RNA, 17 nt, Homo sapiens
gaaauuuucuacaguac

SEQ ID NO: 2148151 - RNA, 21 nt, Homo sapiens
uccaucucugagcccguguca

SEQ ID NO: 2148152 - RNA, 15 nt, Homo sapiens
uccagauaaguguau

SEQ ID NO: 2148153 - RNA, 18 nt, Homo sapiens
auacaaggggguaacuca

SEQ ID NO: 2148154 - RNA, 15 nt, Homo sapiens
cacgccuaaaacuca

SEQ ID NO: 2148155 - RNA, 22 nt, Homo sapiens
ggcagcaaccccugcaugccau

SEQ ID NO: 2148156 - RNA, 18 nt, Homo sapiens
augggaaggggaggaccc

SEQ ID NO: 2148157 - RNA, 21 nt, Homo sapiens
agaagaaaacgaacugggaaa

SEQ ID NO: 2148158 - RNA, 17 nt, Homo sapiens
caggcaguucccagaaa

SEQ ID NO: 2148159 - RNA, 18 nt, Homo sapiens
uuauuuaaguauggaaua

SEQ ID NO: 2148160 - RNA, 17 nt, Homo sapiens
gauuagaaauguaacau

SEQ ID NO: 2148161 - RNA, 12 nt, Homo sapiens
ccaaacuccugc

SEQ ID NO: 2148162 - RNA, 21 nt, Homo sapiens
guccucuggaucacagacacu

SEQ ID NO: 2148163 - RNA, 12 nt, Homo sapiens
ccaauaccuccu

SEQ ID NO: 2148164 - RNA, 23 nt, Homo sapiens
aaacacuuaggaagaaaucacuu

SEQ ID NO: 2148165 - RNA, 12 nt, Homo sapiens
cccugauuuggg

SEQ ID NO: 2148166 - RNA, 22 nt, Homo sapiens
caauaaagcagccucauucuga

SEQ ID NO: 2148167 - RNA, 23 nt, Homo sapiens
ggugggggugccgcugucucuga

SEQ ID NO: 2148168 - RNA, 16 nt, Homo sapiens
ugcauagucauguaag

SEQ ID NO: 2148169 - RNA, 14 nt, Homo sapiens
cagggcaguacaau

SEQ ID NO: 2148170 - RNA, 19 nt, Homo sapiens
cuugcucaugagcuccuga

SEQ ID NO: 2148171 - RNA, 19 nt, Homo sapiens
cugugcuauggugcucugu

SEQ ID NO: 2148172 - RNA, 13 nt, Homo sapiens
uucccacccaagc

SEQ ID NO: 2148173 - RNA, 15 nt, Homo sapiens
gcaaaagucagucuu

SEQ ID NO: 2148174 - RNA, 14 nt, Homo sapiens
uuaagaaacacagg

SEQ ID NO: 2148175 - RNA, 22 nt, Homo sapiens
auuaccgucauuggccugugaa

SEQ ID NO: 2148176 - RNA, 18 nt, Homo sapiens
uuugcuaagaugcauuua

SEQ ID NO: 2148177 - RNA, 20 nt, Homo sapiens
cagggucucacuauguugcc

SEQ ID NO: 2148178 - RNA, 15 nt, Homo sapiens
cgucacccaacauca

SEQ ID NO: 2148179 - RNA, 17 nt, Homo sapiens
aacaccguccaacauuc

SEQ ID NO: 2148180 - RNA, 21 nt, Homo sapiens
ccauugucaccuaacucugaa

SEQ ID NO: 2148181 - RNA, 17 nt, Homo sapiens
auauacaaaacuuuauc

SEQ ID NO: 2148182 - RNA, 17 nt, Homo sapiens
guguccaccuuucagga

SEQ ID NO: 2148183 - RNA, 22 nt, Homo sapiens
cgugucucgcgcgacugagaac

SEQ ID NO: 2148184 - RNA, 17 nt, Homo sapiens
cuaauucggauuugcca

SEQ ID NO: 2148185 - RNA, 19 nt, Homo sapiens
auaacacuugcccaugcua

SEQ ID NO: 2148186 - RNA, 21 nt, Homo sapiens
caauguauuugucaaugcauc

SEQ ID NO: 2148187 - RNA, 15 nt, Homo sapiens
cucucccauggugcc

SEQ ID NO: 2148188 - RNA, 18 nt, Homo sapiens
ucaaaaagggaaugcauu

SEQ ID NO: 2148189 - RNA, 20 nt, Homo sapiens
gauagaacaaugcuauaaua

SEQ ID NO: 2148190 - RNA, 22 nt, Homo sapiens
aaaugugucauuggaagccauc

SEQ ID NO: 2148191 - RNA, 16 nt, Homo sapiens
cugcaacuucuguccc

SEQ ID NO: 2148192 - RNA, 21 nt, Homo sapiens
uuuugccaguauuaugcauau

SEQ ID NO: 2148193 - RNA, 18 nt, Homo sapiens
acuuuguuuuacugucuu

SEQ ID NO: 2148194 - RNA, 16 nt, Homo sapiens
ccccacuguaacgccu

SEQ ID NO: 2148195 - RNA, 14 nt, Homo sapiens
aaaauagcagagau

SEQ ID NO: 2148196 - RNA, 21 nt, Homo sapiens
gaagaacaucccaagccagaa

SEQ ID NO: 2148197 - RNA, 15 nt, Homo sapiens
acggcgcugccucag

SEQ ID NO: 2148198 - RNA, 14 nt, Homo sapiens
gccauucacugccc

SEQ ID NO: 2148199 - RNA, 14 nt, Homo sapiens
aucuagauuuuccu

SEQ ID NO: 2148200 - RNA, 17 nt, Homo sapiens
uucaauucugauuccaa

SEQ ID NO: 2148201 - RNA, 19 nt, Homo sapiens
uauggguacggcaaccaca

SEQ ID NO: 2148202 - RNA, 20 nt, Homo sapiens
guccaauacacgcgugugcu

SEQ ID NO: 2148203 - RNA, 23 nt, Homo sapiens
uacaagcauuuguuccaugccug

SEQ ID NO: 2148204 - RNA, 17 nt, Homo sapiens
uguagucucacacuguu

SEQ ID NO: 2148205 - RNA, 18 nt, Homo sapiens
ggggaucagcagggcagu

SEQ ID NO: 2148206 - RNA, 21 nt, Homo sapiens
cuucaagugccuuuugcugcg

SEQ ID NO: 2148207 - RNA, 15 nt, Homo sapiens
ggccuucucagcucu

SEQ ID NO: 2148208 - RNA, 19 nt, Homo sapiens
gaaaguuuucuccacugga

SEQ ID NO: 2148209 - RNA, 14 nt, Homo sapiens
augaagagcugucu

SEQ ID NO: 2148210 - RNA, 21 nt, Homo sapiens
aagauucacauaguuuauuuc

SEQ ID NO: 2148211 - RNA, 20 nt, Homo sapiens
cauuuuagucaugcaaagau

SEQ ID NO: 2148212 - RNA, 18 nt, Homo sapiens
auucucugaaaguuucuu

SEQ ID NO: 2148213 - RNA, 13 nt, Homo sapiens
ucccaaagugcug

SEQ ID NO: 2148214 - RNA, 19 nt, Homo sapiens
gagaaauguuuaagccaaa

SEQ ID NO: 2148215 - RNA, 16 nt, Homo sapiens
ggccaagucuaaugaa

SEQ ID NO: 2148216 - RNA, 16 nt, Homo sapiens
aaugcaugaacaaguu

SEQ ID NO: 2148217 - RNA, 15 nt, Homo sapiens
cagaauuagcugcuu

SEQ ID NO: 2148218 - RNA, 18 nt, Homo sapiens
acccccaucucugcaaaa

SEQ ID NO: 2148219 - RNA, 14 nt, Homo sapiens
uaaucuccacuguu

SEQ ID NO: 2148220 - RNA, 19 nt, Homo sapiens
acaagcuugucaaugauuu

SEQ ID NO: 2148221 - RNA, 16 nt, Homo sapiens
acugguuguucuguua

SEQ ID NO: 2148222 - RNA, 16 nt, Homo sapiens
acuguauguguugcac

SEQ ID NO: 2148223 - RNA, 11 nt, Homo sapiens
ccuguucucuc

SEQ ID NO: 2148224 - RNA, 16 nt, Homo sapiens
uagagaaaauggaaca

SEQ ID NO: 2148225 - RNA, 19 nt, Homo sapiens
ccacagggucugcacucua

SEQ ID NO: 2148226 - RNA, 20 nt, Homo sapiens
uaaauccuucuuauguuucu

SEQ ID NO: 2148227 - RNA, 22 nt, Homo sapiens
gccuccccuggggcuggcagcu

SEQ ID NO: 2148228 - RNA, 12 nt, Homo sapiens
aaaugugcaaua

SEQ ID NO: 2148229 - RNA, 12 nt, Homo sapiens
acaagugcacuu

SEQ ID NO: 2148230 - RNA, 22 nt, Homo sapiens
uaaguaauuuccccacucugag

SEQ ID NO: 2148231 - RNA, 15 nt, Homo sapiens
aauauggacuuccaa

SEQ ID NO: 2148232 - RNA, 19 nt, Homo sapiens
guuccuuuugcaaacaauu

SEQ ID NO: 2148233 - RNA, 12 nt, Homo sapiens
cucuucaaagac

SEQ ID NO: 2148234 - RNA, 13 nt, Homo sapiens
caacccaccaucu

SEQ ID NO: 2148235 - RNA, 13 nt, Homo sapiens
caagucaccaugc

SEQ ID NO: 2148236 - RNA, 13 nt, Homo sapiens
ccuuccacccauu

SEQ ID NO: 2148237 - RNA, 23 nt, Homo sapiens
uugucacuaugcuauuucuggcc

SEQ ID NO: 2148238 - RNA, 11 nt, Homo sapiens
auaaaccaaaa

SEQ ID NO: 2148239 - RNA, 14 nt, Homo sapiens
gagcccccuguccu

SEQ ID NO: 2148240 - RNA, 15 nt, Homo sapiens
uaauuuuuacaugga

SEQ ID NO: 2148241 - RNA, 15 nt, Homo sapiens
aacaguuuuccauga

SEQ ID NO: 2148242 - RNA, 14 nt, Homo sapiens
cagggaagguaauu

SEQ ID NO: 2148243 - RNA, 22 nt, Homo sapiens
uccaaccuuuggaagucaugag

SEQ ID NO: 2148244 - RNA, 15 nt, Homo sapiens
agacuaugucaccca

SEQ ID NO: 2148245 - RNA, 20 nt, Homo sapiens
cagcuaacauuccauguuuc

SEQ ID NO: 2148246 - RNA, 18 nt, Homo sapiens
gggacgcacagugcaguu

SEQ ID NO: 2148247 - RNA, 18 nt, Homo sapiens
uguaaaaacccugcuaaa

SEQ ID NO: 2148248 - RNA, 14 nt, Homo sapiens
uacauggcucuaaa

SEQ ID NO: 2148249 - RNA, 17 nt, Homo sapiens
auuuauuaaauaaucuc

SEQ ID NO: 2148250 - RNA, 23 nt, Homo sapiens
auguuaagcaaaggaaaccaaag

SEQ ID NO: 2148251 - RNA, 23 nt, Homo sapiens
caaagaaaaaauuccacaaugaa

SEQ ID NO: 2148252 - RNA, 16 nt, Homo sapiens
gucugaauucuggaau

SEQ ID NO: 2148253 - RNA, 18 nt, Homo sapiens
ucuuuaauaaauugcuua

SEQ ID NO: 2148254 - RNA, 15 nt, Homo sapiens
ucauaaaucuauuca

SEQ ID NO: 2148255 - RNA, 18 nt, Homo sapiens
augugcggggaucaucug

SEQ ID NO: 2148256 - RNA, 20 nt, Homo sapiens
acuggaaguaagaaauauua

SEQ ID NO: 2148257 - RNA, 18 nt, Homo sapiens
ugaguagcuuuacacugc

SEQ ID NO: 2148258 - RNA, 14 nt, Homo sapiens
acagauugagcuuu

SEQ ID NO: 2148259 - RNA, 22 nt, Homo sapiens
ucuugaaaacugggacguguau

SEQ ID NO: 2148260 - RNA, 19 nt, Homo sapiens
auuguagaccuguuucaua

SEQ ID NO: 2148261 - RNA, 11 nt, Homo sapiens
uguuuuuaccu

SEQ ID NO: 2148262 - RNA, 23 nt, Homo sapiens
gaaacaacacucaguccuuccac

SEQ ID NO: 2148263 - RNA, 13 nt, Homo sapiens
uaaaagugcuuuc

SEQ ID NO: 2148264 - RNA, 15 nt, Homo sapiens
aaacuuuuggcaaau

SEQ ID NO: 2148265 - RNA, 15 nt, Homo sapiens
auauuaaggggauca

SEQ ID NO: 2148266 - RNA, 19 nt, Homo sapiens
aggaugccagccccugccu

SEQ ID NO: 2148267 - RNA, 15 nt, Homo sapiens
cucuccgaggggugg

SEQ ID NO: 2148268 - RNA, 24 nt, Homo sapiens
auguauguacagcuggugcuuagu

SEQ ID NO: 2148269 - RNA, 19 nt, Homo sapiens
caggaaggaaaacuaugua

SEQ ID NO: 2148270 - RNA, 17 nt, Homo sapiens
augggacugaugucauc

SEQ ID NO: 2148271 - RNA, 19 nt, Homo sapiens
aggguguuuuggguggcau

SEQ ID NO: 2148272 - RNA, 15 nt, Homo sapiens
caaaucagucuuccu

SEQ ID NO: 2148273 - RNA, 23 nt, Homo sapiens
ugacauuugucagugauguugcc

SEQ ID NO: 2148274 - RNA, 18 nt, Homo sapiens
cugucaggauucuucaag

SEQ ID NO: 2148275 - RNA, 14 nt, Homo sapiens
ggccaagcaggcac

SEQ ID NO: 2148276 - RNA, 13 nt, Homo sapiens
cuguucaguauug

SEQ ID NO: 2148277 - RNA, 18 nt, Homo sapiens
ucugcuucccuugccuau

SEQ ID NO: 2148278 - RNA, 21 nt, Homo sapiens
cugguuccacugcuacugacc

SEQ ID NO: 2148279 - RNA, 20 nt, Homo sapiens
gguaauaaaugugacucagc

SEQ ID NO: 2148280 - RNA, 19 nt, Homo sapiens
cuguauucagaucguauua

SEQ ID NO: 2148281 - RNA, 16 nt, Homo sapiens
uuauuuugguugcagu

SEQ ID NO: 2148282 - RNA, 18 nt, Homo sapiens
gucuaccaaccuguucaa

SEQ ID NO: 2148283 - RNA, 13 nt, Homo sapiens
uuuaagugaagga

SEQ ID NO: 2148284 - RNA, 20 nt, Homo sapiens
uugacuuugccacauccauu

SEQ ID NO: 2148285 - RNA, 17 nt, Homo sapiens
caucuaaauauuuccau

SEQ ID NO: 2148286 - RNA, 18 nt, Homo sapiens
gaagaguauuuuugacag

SEQ ID NO: 2148287 - RNA, 13 nt, Homo sapiens
ggggcucccugug

SEQ ID NO: 2148288 - RNA, 18 nt, Homo sapiens
cacugcaauccugucuuu

SEQ ID NO: 2148289 - RNA, 20 nt, Homo sapiens
ggcagauuuucaugcaaaag

SEQ ID NO: 2148290 - RNA, 23 nt, Homo sapiens
uuaggaguacugauagggguuca

SEQ ID NO: 2148291 - RNA, 21 nt, Homo sapiens
guuggggcugcgaccgccaga

SEQ ID NO: 2148292 - RNA, 18 nt, Homo sapiens
aaacuuugcaucucagua

SEQ ID NO: 2148293 - RNA, 14 nt, Homo sapiens
ccuugucagauauu

SEQ ID NO: 2148294 - RNA, 17 nt, Homo sapiens
gauaacuggcacccaga

SEQ ID NO: 2148295 - RNA, 17 nt, Homo sapiens
auacaaaaaaaauuuag

SEQ ID NO: 2148296 - RNA, 22 nt, Homo sapiens
ggcugggggccucagugccacu

SEQ ID NO: 2148297 - RNA, 18 nt, Homo sapiens
cccucccgaacacugaga

SEQ ID NO: 2148298 - RNA, 22 nt, Homo sapiens
aagguuaagcagccugccauau

SEQ ID NO: 2148299 - RNA, 12 nt, Homo sapiens
uagaugcaggag

SEQ ID NO: 2148300 - RNA, 22 nt, Homo sapiens
gaucccugaucaagcuucagac

SEQ ID NO: 2148301 - RNA, 12 nt, Homo sapiens
uccaucaucucu

SEQ ID NO: 2148302 - RNA, 16 nt, Homo sapiens
acucugguggugcuuu

SEQ ID NO: 2148303 - RNA, 17 nt, Homo sapiens
aucuuuaucaaauggaa

SEQ ID NO: 2148304 - RNA, 18 nt, Homo sapiens
ccaagugggaauguuuaa

SEQ ID NO: 2148305 - RNA, 18 nt, Homo sapiens
ucaguuaggcagugcagu

SEQ ID NO: 2148306 - RNA, 15 nt, Homo sapiens
aacaaucucucaaca

SEQ ID NO: 2148307 - RNA, 22 nt, Homo sapiens
gcucugaggggaggcaccucca

SEQ ID NO: 2148308 - RNA, 22 nt, Homo sapiens
ucugccauuccggcccaccucc

SEQ ID NO: 2148309 - RNA, 19 nt, Homo sapiens
aggcaguuuagugcaucuu

SEQ ID NO: 2148310 - RNA, 19 nt, Homo sapiens
auacaauuccaaacacaua

SEQ ID NO: 2148311 - RNA, 21 nt, Homo sapiens
ucaagcaauccuccugaguga

SEQ ID NO: 2148312 - RNA, 23 nt, Homo sapiens
ucagcucccccaggcuguucucc

SEQ ID NO: 2148313 - RNA, 22 nt, Homo sapiens
augcucuggcuugccccaggac

SEQ ID NO: 2148314 - RNA, 21 nt, Homo sapiens
agacccucccccaccauucca

SEQ ID NO: 2148315 - RNA, 20 nt, Homo sapiens
ccgagugcucugaugcaaua

SEQ ID NO: 2148316 - RNA, 18 nt, Homo sapiens
aguaucacaaaaccaccu

SEQ ID NO: 2148317 - RNA, 23 nt, Homo sapiens
uuaaauguuauauacaucucaag

SEQ ID NO: 2148318 - RNA, 12 nt, Homo sapiens
agcaaaccauua

SEQ ID NO: 2148319 - RNA, 18 nt, Homo sapiens
agaaacaugacacugacc

SEQ ID NO: 2148320 - RNA, 19 nt, Homo sapiens
ucaaguauuuauucaggaa

SEQ ID NO: 2148321 - RNA, 14 nt, Homo sapiens
cauugaaacaugcc

SEQ ID NO: 2148322 - RNA, 19 nt, Homo sapiens
guucuuaugccauguuaau

SEQ ID NO: 2148323 - RNA, 20 nt, Homo sapiens
uguauggaaucccacuguau

SEQ ID NO: 2148324 - RNA, 19 nt, Homo sapiens
gaaccucaguuuccucauc

SEQ ID NO: 2148325 - RNA, 15 nt, Homo sapiens
ugcgccugagugagu

SEQ ID NO: 2148326 - RNA, 12 nt, Homo sapiens
cuggccacugcu

SEQ ID NO: 2148327 - RNA, 19 nt, Homo sapiens
cggccucccuaguagcugg

SEQ ID NO: 2148328 - RNA, 18 nt, Homo sapiens
caguacagauuguucuca

SEQ ID NO: 2148329 - RNA, 13 nt, Homo sapiens
ugggcaugccacc

SEQ ID NO: 2148330 - RNA, 18 nt, Homo sapiens
gugcuacaaaaacacagc

SEQ ID NO: 2148331 - RNA, 17 nt, Homo sapiens
uuaauggggaggacaaa

SEQ ID NO: 2148332 - RNA, 20 nt, Homo sapiens
caucgaggcucuugcucaag

SEQ ID NO: 2148333 - RNA, 17 nt, Homo sapiens
ugugacuaaaaaugcau

SEQ ID NO: 2148334 - RNA, 22 nt, Homo sapiens
uuauuuggaguuagguccucac

SEQ ID NO: 2148335 - RNA, 21 nt, Homo sapiens
uuccucaccaggagcccggcu

SEQ ID NO: 2148336 - RNA, 13 nt, Homo sapiens
acacaugcucuaa

SEQ ID NO: 2148337 - RNA, 21 nt, Homo sapiens
agcucacuaagaagcuugaau

SEQ ID NO: 2148338 - RNA, 18 nt, Homo sapiens
uucacgauuaacugugaa

SEQ ID NO: 2148339 - RNA, 23 nt, Homo sapiens
gucaugauggcaccacugcacuc

SEQ ID NO: 2148340 - RNA, 20 nt, Homo sapiens
ccgcacccuggccugguccc

SEQ ID NO: 2148341 - RNA, 13 nt, Homo sapiens
ccacuccagugcc

SEQ ID NO: 2148342 - RNA, 14 nt, Homo sapiens
gggaaaagggucca

SEQ ID NO: 2148343 - RNA, 22 nt, Homo sapiens
caaagcccacuucacacauuua

SEQ ID NO: 2148344 - RNA, 19 nt, Homo sapiens
uauggaaucagcugcuaca

SEQ ID NO: 2148345 - RNA, 20 nt, Homo sapiens
aauggcauaugguccuagac

SEQ ID NO: 2148346 - RNA, 23 nt, Homo sapiens
ucaauuaguuccccuacuacacu

SEQ ID NO: 2148347 - RNA, 20 nt, Homo sapiens
gccuguucccugaggaccug

SEQ ID NO: 2148348 - RNA, 16 nt, Homo sapiens
aacuaacuccagaagc

SEQ ID NO: 2148349 - RNA, 19 nt, Homo sapiens
cauucacccagacagcucc

SEQ ID NO: 2148350 - RNA, 23 nt, Homo sapiens
gcaauccaugagauagcuauuau

SEQ ID NO: 2148351 - RNA, 14 nt, Homo sapiens
auuccaguuuagga

SEQ ID NO: 2148352 - RNA, 16 nt, Homo sapiens
uaggaaggugaaucug

SEQ ID NO: 2148353 - RNA, 18 nt, Homo sapiens
uagagucauguuugcacu

SEQ ID NO: 2148354 - RNA, 16 nt, Homo sapiens
cagaaggcaaaaagac

SEQ ID NO: 2148355 - RNA, 17 nt, Homo sapiens
ggcuggggcuugcccuu

SEQ ID NO: 2148356 - RNA, 17 nt, Homo sapiens
guuuauauaauuuugca

SEQ ID NO: 2148357 - RNA, 13 nt, Homo sapiens
cguauagguugau

SEQ ID NO: 2148358 - RNA, 19 nt, Homo sapiens
gugcugggauuaacaggua

SEQ ID NO: 2148359 - RNA, 17 nt, Homo sapiens
acagaucuguaauucac

SEQ ID NO: 2148360 - RNA, 22 nt, Homo sapiens
ggaccccucgccccagccucau

SEQ ID NO: 2148361 - RNA, 20 nt, Homo sapiens
agucccuguccccaccucca

SEQ ID NO: 2148362 - RNA, 19 nt, Homo sapiens
ccucauccacuaggugccc

SEQ ID NO: 2148363 - RNA, 17 nt, Homo sapiens
gacuucugccuggagac

SEQ ID NO: 2148364 - RNA, 18 nt, Homo sapiens
ggaagcugugagagcagu

SEQ ID NO: 2148365 - RNA, 20 nt, Homo sapiens
uauucccaaguaugccuuaa

SEQ ID NO: 2148366 - RNA, 15 nt, Homo sapiens
ucccauguaaugugu

SEQ ID NO: 2148367 - RNA, 21 nt, Homo sapiens
uggugcaugccuguagucuca

SEQ ID NO: 2148368 - RNA, 15 nt, Homo sapiens
ccguuuccaagcugc

SEQ ID NO: 2148369 - RNA, 23 nt, Homo sapiens
uagaaaggcuuccagaugucuaa

SEQ ID NO: 2148370 - RNA, 14 nt, Homo sapiens
caggugugccuguu

SEQ ID NO: 2148371 - RNA, 14 nt, Homo sapiens
acaaaucauuccau

SEQ ID NO: 2148372 - RNA, 11 nt, Homo sapiens
uagaaccacaa

SEQ ID NO: 2148373 - RNA, 22 nt, Homo sapiens
aguagaaguaauaugcucucau

SEQ ID NO: 2148374 - RNA, 15 nt, Homo sapiens
ugauaauagcacuaa

SEQ ID NO: 2148375 - RNA, 15 nt, Homo sapiens
ugacaguagcauuga

SEQ ID NO: 2148376 - RNA, 13 nt, Homo sapiens
cucauccaucaca

SEQ ID NO: 2148377 - RNA, 15 nt, Homo sapiens
auagaugacauugac

SEQ ID NO: 2148378 - RNA, 13 nt, Homo sapiens
cuauccuguguau

SEQ ID NO: 2148379 - RNA, 22 nt, Homo sapiens
ggguuuaauagacugagucaga

SEQ ID NO: 2148380 - RNA, 17 nt, Homo sapiens
ggauuguccaccuucug

SEQ ID NO: 2148381 - RNA, 22 nt, Homo sapiens
gcugcucuaagcccaggaucuc

SEQ ID NO: 2148382 - RNA, 15 nt, Homo sapiens
gcaaacgagacuuuc

SEQ ID NO: 2148383 - RNA, 19 nt, Homo sapiens
cuuccaccucagucuccca

SEQ ID NO: 2148384 - RNA, 22 nt, Homo sapiens
auuaaccuuacuaauuauacua

SEQ ID NO: 2148385 - RNA, 11 nt, Homo sapiens
ccuccucacaa

SEQ ID NO: 2148386 - RNA, 18 nt, Homo sapiens
aguaaaagcaaaaugaua

SEQ ID NO: 2148387 - RNA, 24 nt, Homo sapiens
gaauaguauucugaucaguugcca

SEQ ID NO: 2148388 - RNA, 16 nt, Homo sapiens
gcaccugacuuggcug

SEQ ID NO: 2148389 - RNA, 14 nt, Homo sapiens
ucagguccaauuug

SEQ ID NO: 2148390 - RNA, 23 nt, Homo sapiens
gugcacaugugucugugugguau

SEQ ID NO: 2148391 - RNA, 12 nt, Homo sapiens
ccugaacuucac

SEQ ID NO: 2148392 - RNA, 14 nt, Homo sapiens
agaugaaugggagu

SEQ ID NO: 2148393 - RNA, 12 nt, Homo sapiens
uaucaacucaag

SEQ ID NO: 2148394 - RNA, 15 nt, Homo sapiens
agaucagacuuuaau

SEQ ID NO: 2148395 - RNA, 21 nt, Homo sapiens
agauaacuugagcaccgucau

SEQ ID NO: 2148396 - RNA, 19 nt, Homo sapiens
aauucaaaaguuccaagag

SEQ ID NO: 2148397 - RNA, 23 nt, Homo sapiens
ugguaccaccagucugacuguuu

SEQ ID NO: 2148398 - RNA, 17 nt, Homo sapiens
augugacaccccggggg

SEQ ID NO: 2148399 - RNA, 12 nt, Homo sapiens
cccaggcagcug

SEQ ID NO: 2148400 - RNA, 16 nt, Homo sapiens
gccaauguuaugccag

SEQ ID NO: 2148401 - RNA, 13 nt, Homo sapiens
uaaaaaguaacug

SEQ ID NO: 2148402 - RNA, 20 nt, Homo sapiens
aagcagaacagugauuacca

SEQ ID NO: 2148403 - RNA, 16 nt, Homo sapiens
uaaaaguuauuaccuu

SEQ ID NO: 2148404 - RNA, 16 nt, Homo sapiens
auauccccacuacuca

SEQ ID NO: 2148405 - RNA, 23 nt, Homo sapiens
gcaucccgcagauggcuggaaua

SEQ ID NO: 2148406 - RNA, 22 nt, Homo sapiens
uccccgggucucucacuguugc

SEQ ID NO: 2148407 - RNA, 20 nt, Homo sapiens
cuacauuauaccgcagagua

SEQ ID NO: 2148408 - RNA, 18 nt, Homo sapiens
auccacccauguuuauua

SEQ ID NO: 2148409 - RNA, 12 nt, Homo sapiens
ccuuugcuuguc

SEQ ID NO: 2148410 - RNA, 10 nt, Homo sapiens
cagacauauu

SEQ ID NO: 2148411 - RNA, 17 nt, Homo sapiens
uggccggcaucuggccc

SEQ ID NO: 2148412 - RNA, 16 nt, Homo sapiens
ccuuaaugacaacacu

SEQ ID NO: 2148413 - RNA, 15 nt, Homo sapiens
uauaucauauugcuu

SEQ ID NO: 2148414 - RNA, 20 nt, Homo sapiens
aauauucaaugaacuuccau

SEQ ID NO: 2148415 - RNA, 23 nt, Homo sapiens
aaaucucuacugcuuuggauccu

SEQ ID NO: 2148416 - RNA, 21 nt, Homo sapiens
aauaccauggguuauuuaugc

SEQ ID NO: 2148417 - RNA, 22 nt, Homo sapiens
ccacaguucaguggcagggcuc

SEQ ID NO: 2148418 - RNA, 17 nt, Homo sapiens
acuugagccuauaucag

SEQ ID NO: 2148419 - RNA, 15 nt, Homo sapiens
uaaccauucaaauga

SEQ ID NO: 2148420 - RNA, 21 nt, Homo sapiens
ucaccuucuagucuuggccag

SEQ ID NO: 2148421 - RNA, 13 nt, Homo sapiens
cucuccacccgcu

SEQ ID NO: 2148422 - RNA, 14 nt, Homo sapiens
ugaguaugccacug

SEQ ID NO: 2148423 - RNA, 15 nt, Homo sapiens
agcagauaacuuuuu

SEQ ID NO: 2148424 - RNA, 23 nt, Homo sapiens
aggacuuagggugucguuuucac

SEQ ID NO: 2148425 - RNA, 15 nt, Homo sapiens
cauguaacauucuuc

SEQ ID NO: 2148426 - RNA, 23 nt, Homo sapiens
auggaccugccccggaccuaccu

SEQ ID NO: 2148427 - RNA, 12 nt, Homo sapiens
ccacagcucuuc

SEQ ID NO: 2148428 - RNA, 18 nt, Homo sapiens
cagcagagaagcuguagg

SEQ ID NO: 2148429 - RNA, 18 nt, Homo sapiens
cuuuccugcagccucuug

SEQ ID NO: 2148430 - RNA, 11 nt, Homo sapiens
ggcugccauag

SEQ ID NO: 2148431 - RNA, 22 nt, Homo sapiens
aagcauaauguugaacauucau

SEQ ID NO: 2148432 - RNA, 19 nt, Homo sapiens
gaaucagacugacaguuua

SEQ ID NO: 2148433 - RNA, 22 nt, Homo sapiens
cuaacuugaaaagaaaaccaca

SEQ ID NO: 2148434 - RNA, 18 nt, Homo sapiens
ccagauauaacugucuug

SEQ ID NO: 2148435 - RNA, 20 nt, Homo sapiens
acuucaaauguguaacuuua

SEQ ID NO: 2148436 - RNA, 16 nt, Homo sapiens
auuauucucugaugca

SEQ ID NO: 2148437 - RNA, 23 nt, Homo sapiens
agcagagcuuagcuucaaggaca

SEQ ID NO: 2148438 - RNA, 16 nt, Homo sapiens
ucuaaaguagcuuucu

SEQ ID NO: 2148439 - RNA, 14 nt, Homo sapiens
aucuguaucuugcc

SEQ ID NO: 2148440 - RNA, 15 nt, Homo sapiens
cuugaguuggggcca

SEQ ID NO: 2148441 - RNA, 14 nt, Homo sapiens
aagaaaugggagaa

SEQ ID NO: 2148442 - RNA, 17 nt, Homo sapiens
uuagaaaaaaacaugaa

SEQ ID NO: 2148443 - RNA, 19 nt, Homo sapiens
ugacaaaaaauuaaagcau

SEQ ID NO: 2148444 - RNA, 11 nt, Homo sapiens
cauucccugag

SEQ ID NO: 2148445 - RNA, 18 nt, Homo sapiens
aggugcuguccccacugc

SEQ ID NO: 2148446 - RNA, 22 nt, Homo sapiens
gccagccccgccacgcuugugu

SEQ ID NO: 2148447 - RNA, 19 nt, Homo sapiens
accuaccccugcacaagcc

SEQ ID NO: 2148448 - RNA, 15 nt, Homo sapiens
auaaugaacacucau

SEQ ID NO: 2148449 - RNA, 14 nt, Homo sapiens
gaauuuguguuugu

SEQ ID NO: 2148450 - RNA, 22 nt, Homo sapiens
acucuuuaagaccucaaaccau

SEQ ID NO: 2148451 - RNA, 15 nt, Homo sapiens
aguuuaaucuucaca

SEQ ID NO: 2148452 - RNA, 17 nt, Homo sapiens
aucauacaaacucucac

SEQ ID NO: 2148453 - RNA, 18 nt, Homo sapiens
aaauuuuagaucuuucaa

SEQ ID NO: 2148454 - RNA, 11 nt, Homo sapiens
cuucucagaaa

SEQ ID NO: 2148455 - RNA, 13 nt, Homo sapiens
ugacaaguacugu

SEQ ID NO: 2148456 - RNA, 19 nt, Homo sapiens
aagaaguguccgagaacua

SEQ ID NO: 2148457 - RNA, 16 nt, Homo sapiens
aaaucaaugcagguuu

SEQ ID NO: 2148458 - RNA, 14 nt, Homo sapiens
aaugccacugggac

SEQ ID NO: 2148459 - RNA, 11 nt, Homo sapiens
uagugugcaag

SEQ ID NO: 2148460 - RNA, 11 nt, Homo sapiens
uugugugcaug

SEQ ID NO: 2148461 - RNA, 11 nt, Homo sapiens
agcugugcugc

SEQ ID NO: 2148462 - RNA, 13 nt, Homo sapiens
caggcuugugcaa

SEQ ID NO: 2148463 - RNA, 15 nt, Homo sapiens
uaaaaugacagaucc

SEQ ID NO: 2148464 - RNA, 15 nt, Homo sapiens
ggccagcccggcugg

SEQ ID NO: 2148465 - RNA, 19 nt, Homo sapiens
gucucaaacuccugaccuc

SEQ ID NO: 2148466 - RNA, 23 nt, Homo sapiens
auaaauguaccagagagaguugu

SEQ ID NO: 2148467 - RNA, 21 nt, Homo sapiens
uggaagcuuguugaaaaccca

SEQ ID NO: 2148468 - RNA, 17 nt, Homo sapiens
gaacacugaaacuguau

SEQ ID NO: 2148469 - RNA, 12 nt, Homo sapiens
ccugcacucuca

SEQ ID NO: 2148470 - RNA, 15 nt, Homo sapiens
gcauuagcacauauu

SEQ ID NO: 2148471 - RNA, 14 nt, Homo sapiens
cagcacauugcccu

SEQ ID NO: 2148472 - RNA, 14 nt, Homo sapiens
gaaguucacuuccc

SEQ ID NO: 2148473 - RNA, 16 nt, Homo sapiens
aggcuggagacaggug

SEQ ID NO: 2148474 - RNA, 16 nt, Homo sapiens
aggcuagagacagaug

SEQ ID NO: 2148475 - RNA, 17 nt, Homo sapiens
aaugaacaucuauaaaa

SEQ ID NO: 2148476 - RNA, 14 nt, Homo sapiens
uccccccaguggga

SEQ ID NO: 2148477 - RNA, 19 nt, Homo sapiens
agguaacuagcugagcacu

SEQ ID NO: 2148478 - RNA, 16 nt, Homo sapiens
ccagaccuguucugac

SEQ ID NO: 2148479 - RNA, 13 nt, Homo sapiens
uaagaguugccaa

SEQ ID NO: 2148480 - RNA, 13 nt, Homo sapiens
ucaguguugacau

SEQ ID NO: 2148481 - RNA, 19 nt, Homo sapiens
ugcauauguaaggaaguca

SEQ ID NO: 2148482 - RNA, 17 nt, Homo sapiens
aggguuaaccacugugg

SEQ ID NO: 2148483 - RNA, 16 nt, Homo sapiens
uaaaaguguccauuga

SEQ ID NO: 2148484 - RNA, 17 nt, Homo sapiens
ucaggcggggugggcag

SEQ ID NO: 2148485 - RNA, 20 nt, Homo sapiens
acacagcugaugaacugugg

SEQ ID NO: 2148486 - RNA, 21 nt, Homo sapiens
uaagguauauaaauuuuccca

SEQ ID NO: 2148487 - RNA, 17 nt, Homo sapiens
accagaagugccaugcu

SEQ ID NO: 2148488 - RNA, 23 nt, Homo sapiens
auuuguaugguuccaaagacacu

SEQ ID NO: 2148489 - RNA, 16 nt, Homo sapiens
uacaaugauguaaaua

SEQ ID NO: 2148490 - RNA, 18 nt, Homo sapiens
uacuuuaauauaaaccca

SEQ ID NO: 2148491 - RNA, 21 nt, Homo sapiens
cagcaucgugaucacugagcc

SEQ ID NO: 2148492 - RNA, 19 nt, Homo sapiens
guuucaccauguuagccag

SEQ ID NO: 2148493 - RNA, 22 nt, Homo sapiens
aucaaggucuuuggucuucucc

SEQ ID NO: 2148494 - RNA, 20 nt, Homo sapiens
gagacaguuuacuuugccaa

SEQ ID NO: 2148495 - RNA, 13 nt, Homo sapiens
uaccuacaucaga

SEQ ID NO: 2148496 - RNA, 21 nt, Homo sapiens
uucucugugucuaagauucua

SEQ ID NO: 2148497 - RNA, 15 nt, Homo sapiens
auucuuuguuuccug

SEQ ID NO: 2148498 - RNA, 16 nt, Homo sapiens
agauuauaaacugacu

SEQ ID NO: 2148499 - RNA, 11 nt, Homo sapiens
acucuguguaa

SEQ ID NO: 2148500 - RNA, 20 nt, Homo sapiens
auggugaaaccucaucucua

SEQ ID NO: 2148501 - RNA, 17 nt, Homo sapiens
acugcaaacaguguucu

SEQ ID NO: 2148502 - RNA, 16 nt, Homo sapiens
cuagaauuggugguga

SEQ ID NO: 2148503 - RNA, 19 nt, Homo sapiens
ggaauuucuguuagcaaua

SEQ ID NO: 2148504 - RNA, 15 nt, Homo sapiens
acccaguccugcaca

SEQ ID NO: 2148505 - RNA, 15 nt, Homo sapiens
gcaaagaaucaacag

SEQ ID NO: 2148506 - RNA, 23 nt, Homo sapiens
gcuugucacagucucuacuguua

SEQ ID NO: 2148507 - RNA, 23 nt, Homo sapiens
aucacaguuuugguugcuuuaau

SEQ ID NO: 2148508 - RNA, 14 nt, Homo sapiens
guuucuugcucuga

SEQ ID NO: 2148509 - RNA, 14 nt, Homo sapiens
gauucaugcacugu

SEQ ID NO: 2148510 - RNA, 17 nt, Homo sapiens
aagcucuucuccucagc

SEQ ID NO: 2148511 - RNA, 16 nt, Homo sapiens
guugucacauucucau

SEQ ID NO: 2148512 - RNA, 14 nt, Homo sapiens
uauuuaaagccaaa

SEQ ID NO: 2148513 - RNA, 16 nt, Homo sapiens
auauugacuuguuaca

SEQ ID NO: 2148514 - RNA, 11 nt, Homo sapiens
agaugcaaaua

SEQ ID NO: 2148515 - RNA, 12 nt, Homo sapiens
cagaucuuuaaa

SEQ ID NO: 2148516 - RNA, 20 nt, Homo sapiens
caccucacaggccccaggaa

SEQ ID NO: 2148517 - RNA, 17 nt, Homo sapiens
aguuuggagucacugua

SEQ ID NO: 2148518 - RNA, 12 nt, Homo sapiens
ggaaagugaaac

SEQ ID NO: 2148519 - RNA, 13 nt, Homo sapiens
auugaacuuuccc

SEQ ID NO: 2148520 - RNA, 16 nt, Homo sapiens
uauuuuaucugcuaug

SEQ ID NO: 2148521 - RNA, 21 nt, Homo sapiens
ucaggagucugccacuuguca

SEQ ID NO: 2148522 - RNA, 18 nt, Homo sapiens
gccuuguaagacccuuau

SEQ ID NO: 2148523 - RNA, 19 nt, Homo sapiens
ugaccuuuuucacuguggc

SEQ ID NO: 2148524 - RNA, 22 nt, Homo sapiens
acagauuaucuuguacagccuu

SEQ ID NO: 2148525 - RNA, 18 nt, Homo sapiens
gauaugaguacauacuca

SEQ ID NO: 2148526 - RNA, 22 nt, Homo sapiens
gugugacucgggagcugcacac

SEQ ID NO: 2148527 - RNA, 20 nt, Homo sapiens
aacacacgagcaaacccaga

SEQ ID NO: 2148528 - RNA, 16 nt, Homo sapiens
acacaccucuugaaac

SEQ ID NO: 2148529 - RNA, 15 nt, Homo sapiens
aaacaguucuuggac

SEQ ID NO: 2148530 - RNA, 16 nt, Homo sapiens
auccaagaaucaguga

SEQ ID NO: 2148531 - RNA, 16 nt, Homo sapiens
gugagugugugcaagu

SEQ ID NO: 2148532 - RNA, 21 nt, Homo sapiens
gcccuuccucaucuccaugcu

SEQ ID NO: 2148533 - RNA, 14 nt, Homo sapiens
cugcuccuagccca

SEQ ID NO: 2148534 - RNA, 20 nt, Homo sapiens
aucgugccauuacacuccag

SEQ ID NO: 2148535 - RNA, 18 nt, Homo sapiens
cuuuuuaaggacacuggg

SEQ ID NO: 2148536 - RNA, 19 nt, Homo sapiens
agaauccccuucuccaaac

SEQ ID NO: 2148537 - RNA, 13 nt, Homo sapiens
aauaaaaaacacu

SEQ ID NO: 2148538 - RNA, 14 nt, Homo sapiens
uggauuugauucau

SEQ ID NO: 2148539 - RNA, 18 nt, Homo sapiens
uuucccuuuuugcuucca

SEQ ID NO: 2148540 - RNA, 16 nt, Homo sapiens
aaacaaaacaaaaacc

SEQ ID NO: 2148541 - RNA, 14 nt, Homo sapiens
gauagauaaugccu

SEQ ID NO: 2148542 - RNA, 13 nt, Homo sapiens
cuuuacuucccag

SEQ ID NO: 2148543 - RNA, 13 nt, Homo sapiens
uuuugcuuuccaa

SEQ ID NO: 2148544 - RNA, 13 nt, Homo sapiens
agccacugugccc

SEQ ID NO: 2148545 - RNA, 16 nt, Homo sapiens
caauauuagcaagaca

SEQ ID NO: 2148546 - RNA, 17 nt, Homo sapiens
aaaugaaguauuucuca

SEQ ID NO: 2148547 - RNA, 19 nt, Homo sapiens
guuaacuauuuauucccug

SEQ ID NO: 2148548 - RNA, 21 nt, Homo sapiens
uauucuuauuuggacagccaa

SEQ ID NO: 2148549 - RNA, 17 nt, Homo sapiens
uucgggauucuuugaca

SEQ ID NO: 2148550 - RNA, 18 nt, Homo sapiens
ucccaaaccuucaggaaa

SEQ ID NO: 2148551 - RNA, 13 nt, Homo sapiens
ggaaucugaugaa

SEQ ID NO: 2148552 - RNA, 13 nt, Homo sapiens
gucagugcucaga

SEQ ID NO: 2148553 - RNA, 14 nt, Homo sapiens
agcagcgccaguga

SEQ ID NO: 2148554 - RNA, 11 nt, Homo sapiens
gugcugggaug

SEQ ID NO: 2148555 - RNA, 23 nt, Homo sapiens
cgccuuccucucuggauacugca

SEQ ID NO: 2148556 - RNA, 20 nt, Homo sapiens
agcuuacacugaggacugug

SEQ ID NO: 2148557 - RNA, 20 nt, Homo sapiens
ucucgucaggaggugccuga

SEQ ID NO: 2148558 - RNA, 13 nt, Homo sapiens
cugauugucuuag

SEQ ID NO: 2148559 - RNA, 24 nt, Homo sapiens
cuuggccccagacgcauagacuga

SEQ ID NO: 2148560 - RNA, 12 nt, Homo sapiens
cucgagucugag

SEQ ID NO: 2148561 - RNA, 23 nt, Homo sapiens
ccuagaccagcagacagagccag

SEQ ID NO: 2148562 - RNA, 20 nt, Homo sapiens
gagcaaaucaauucuaguca

SEQ ID NO: 2148563 - RNA, 20 nt, Homo sapiens
gguagaaaaggcuagguaca

SEQ ID NO: 2148564 - RNA, 14 nt, Homo sapiens
ucagggagugcaga

SEQ ID NO: 2148565 - RNA, 20 nt, Homo sapiens
uuggccacagccccaaacaa

SEQ ID NO: 2148566 - RNA, 16 nt, Homo sapiens
acauaauaagacuuuu

SEQ ID NO: 2148567 - RNA, 16 nt, Homo sapiens
gcuagucucugaggga

SEQ ID NO: 2148568 - RNA, 13 nt, Homo sapiens
cugacucccaugc

SEQ ID NO: 2148569 - RNA, 17 nt, Homo sapiens
aucagcggccccuugac

SEQ ID NO: 2148570 - RNA, 15 nt, Homo sapiens
ggugaaaucugcucu

SEQ ID NO: 2148571 - RNA, 22 nt, Homo sapiens
cucaucaauuuugucuauuaaa

SEQ ID NO: 2148572 - RNA, 21 nt, Homo sapiens
uucaaaggccacauaccucuc

SEQ ID NO: 2148573 - RNA, 22 nt, Homo sapiens
ucuguaagaaaccuacugccca

SEQ ID NO: 2148574 - RNA, 15 nt, Homo sapiens
aagcacauguauuga

SEQ ID NO: 2148575 - RNA, 15 nt, Homo sapiens
aagacuagucccuug

SEQ ID NO: 2148576 - RNA, 12 nt, Homo sapiens
uguguuacugau

SEQ ID NO: 2148577 - RNA, 17 nt, Homo sapiens
uaacuucucccuucucc

SEQ ID NO: 2148578 - RNA, 15 nt, Homo sapiens
agcagccacuugacu

SEQ ID NO: 2148579 - RNA, 13 nt, Homo sapiens
cauggcacugaca

SEQ ID NO: 2148580 - RNA, 16 nt, Homo sapiens
ugagcagcggacuuca

SEQ ID NO: 2148581 - RNA, 14 nt, Homo sapiens
gcaaacugcugccu

SEQ ID NO: 2148582 - RNA, 14 nt, Homo sapiens
ugaauccaucagga

SEQ ID NO: 2148583 - RNA, 11 nt, Homo sapiens
accaccccagc

SEQ ID NO: 2148584 - RNA, 15 nt, Homo sapiens
cuccuggagcacugu

SEQ ID NO: 2148585 - RNA, 23 nt, Homo sapiens
uggggaacugcguggugcucuuu

SEQ ID NO: 2148586 - RNA, 17 nt, Homo sapiens
gaaugcagcacaguacu

SEQ ID NO: 2148587 - RNA, 14 nt, Homo sapiens
ccaccuacacagga

SEQ ID NO: 2148588 - RNA, 13 nt, Homo sapiens
gaacucuguaaaa

SEQ ID NO: 2148589 - RNA, 15 nt, Homo sapiens
aaggagucacugaga

SEQ ID NO: 2148590 - RNA, 14 nt, Homo sapiens
acagagccacucuu

SEQ ID NO: 2148591 - RNA, 19 nt, Homo sapiens
gugaucuccacaccaaagu

SEQ ID NO: 2148592 - RNA, 22 nt, Homo sapiens
agagacucgcucacucccaugu

SEQ ID NO: 2148593 - RNA, 16 nt, Homo sapiens
cauucucaucuacuca

SEQ ID NO: 2148594 - RNA, 19 nt, Homo sapiens
cagcaccuucccucucacc

SEQ ID NO: 2148595 - RNA, 22 nt, Homo sapiens
caucugaucccagccaaggagg

SEQ ID NO: 2148596 - RNA, 14 nt, Homo sapiens
agaaaucagccaug

SEQ ID NO: 2148597 - RNA, 18 nt, Homo sapiens
ggcccaucugccgccugg

SEQ ID NO: 2148598 - RNA, 12 nt, Homo sapiens
gagaacauuuac

SEQ ID NO: 2148599 - RNA, 18 nt, Homo sapiens
ggcugcuuccugugacag

SEQ ID NO: 2148600 - RNA, 21 nt, Homo sapiens
uggugcacaaguaacacauuu

SEQ ID NO: 2148601 - RNA, 13 nt, Homo sapiens
ucuacgugcuccu

SEQ ID NO: 2148602 - RNA, 17 nt, Homo sapiens
acuacuuaaacaguauu

SEQ ID NO: 2148603 - RNA, 16 nt, Homo sapiens
aauguuagccaugacu

SEQ ID NO: 2148604 - RNA, 17 nt, Homo sapiens
gacacccugaucuucac

SEQ ID NO: 2148605 - RNA, 15 nt, Homo sapiens
acccacugccagaca

SEQ ID NO: 2148606 - RNA, 23 nt, Homo sapiens
gaaugugaagccagaucucggga

SEQ ID NO: 2148607 - RNA, 16 nt, Homo sapiens
auguacaagacuuuac

SEQ ID NO: 2148608 - RNA, 20 nt, Homo sapiens
aucuaucagaguauccacug

SEQ ID NO: 2148609 - RNA, 20 nt, Homo sapiens
cuguccacccugccaagacu

SEQ ID NO: 2148610 - RNA, 14 nt, Homo sapiens
cccacccacaugug

SEQ ID NO: 2148611 - RNA, 13 nt, Homo sapiens
cagcauuugauaa

SEQ ID NO: 2148612 - RNA, 17 nt, Homo sapiens
cuuuucucuacuuuaaa

SEQ ID NO: 2148613 - RNA, 14 nt, Homo sapiens
uaugugacuuaaag

SEQ ID NO: 2148614 - RNA, 22 nt, Homo sapiens
ccagccuucugucagcagugaa

SEQ ID NO: 2148615 - RNA, 15 nt, Homo sapiens
ucuggaucuugugac

SEQ ID NO: 2148616 - RNA, 18 nt, Homo sapiens
caauguaucccugaggaa

SEQ ID NO: 2148617 - RNA, 15 nt, Homo sapiens
agcugggcacagugg

SEQ ID NO: 2148618 - RNA, 17 nt, Homo sapiens
gugcugagaacacccca

SEQ ID NO: 2148619 - RNA, 21 nt, Homo sapiens
accuuugucucacgauuccag

SEQ ID NO: 2148620 - RNA, 13 nt, Homo sapiens
auaccuacauuca

SEQ ID NO: 2148621 - RNA, 21 nt, Homo sapiens
gggcugugauuacugcaauca

SEQ ID NO: 2148622 - RNA, 20 nt, Homo sapiens
cagcucaaguuagcauuuca

SEQ ID NO: 2148623 - RNA, 15 nt, Homo sapiens
uucauaaaaaccaaa

SEQ ID NO: 2148624 - RNA, 18 nt, Homo sapiens
gugacuauaaagcuguua

SEQ ID NO: 2148625 - RNA, 16 nt, Homo sapiens
aauggaauacagucau

SEQ ID NO: 2148626 - RNA, 14 nt, Homo sapiens
uccugucuccuuug

SEQ ID NO: 2148627 - RNA, 19 nt, Homo sapiens
uaauauggggaugcagcau

SEQ ID NO: 2148628 - RNA, 18 nt, Homo sapiens
cgucaaggaaagggcagu

SEQ ID NO: 2148629 - RNA, 21 nt, Homo sapiens
agaacuuuguuaacgcacuug

SEQ ID NO: 2148630 - RNA, 13 nt, Homo sapiens
gaucccagcucac

SEQ ID NO: 2148631 - RNA, 20 nt, Homo sapiens
auacuuaggaggcuuacuuc

SEQ ID NO: 2148632 - RNA, 21 nt, Homo sapiens
auauuuaacuggagcagagaa

SEQ ID NO: 2148633 - RNA, 18 nt, Homo sapiens
caccaagccaauaccagc

SEQ ID NO: 2148634 - RNA, 22 nt, Homo sapiens
accaugagcaccuccagcugua

SEQ ID NO: 2148635 - RNA, 23 nt, Homo sapiens
ccaccuuuuccuuauacuguaua

SEQ ID NO: 2148636 - RNA, 15 nt, Homo sapiens
ccaaacuuguucauu

SEQ ID NO: 2148637 - RNA, 18 nt, Homo sapiens
aaggaaccuguguuauca

SEQ ID NO: 2148638 - RNA, 14 nt, Homo sapiens
uccaggacuggggc

SEQ ID NO: 2148639 - RNA, 12 nt, Homo sapiens
uuuccucaaaac

SEQ ID NO: 2148640 - RNA, 16 nt, Homo sapiens
caguggcgcgaucuca

SEQ ID NO: 2148641 - RNA, 16 nt, Homo sapiens
auacugcugcuuguca

SEQ ID NO: 2148642 - RNA, 17 nt, Homo sapiens
agcuucuggggaugcag

SEQ ID NO: 2148643 - RNA, 22 nt, Homo sapiens
ucagaacagcugaaacauuccg

SEQ ID NO: 2148644 - RNA, 19 nt, Homo sapiens
ccaaggccagcccacacag

SEQ ID NO: 2148645 - RNA, 23 nt, Homo sapiens
caaaccagcccuugagucuguca

SEQ ID NO: 2148646 - RNA, 13 nt, Homo sapiens
agagcaaaugcua

SEQ ID NO: 2148647 - RNA, 23 nt, Homo sapiens
cauucccauggaguugccaacua

SEQ ID NO: 2148648 - RNA, 15 nt, Homo sapiens
cuggccgcugcaguc

SEQ ID NO: 2148649 - RNA, 15 nt, Homo sapiens
uacugacuguagcca

SEQ ID NO: 2148650 - RNA, 14 nt, Homo sapiens
accuccaacuuucc

SEQ ID NO: 2148651 - RNA, 15 nt, Homo sapiens
auagguacugccaua

SEQ ID NO: 2148652 - RNA, 12 nt, Homo sapiens
gcucaaucucag

SEQ ID NO: 2148653 - RNA, 18 nt, Homo sapiens
ccuuggaccguaucacug

SEQ ID NO: 2148654 - RNA, 16 nt, Homo sapiens
ucuggauacugcaaag

SEQ ID NO: 2148655 - RNA, 14 nt, Homo sapiens
uggggcaaagccuc

SEQ ID NO: 2148656 - RNA, 17 nt, Homo sapiens
caucgcgaugggaaccg

SEQ ID NO: 2148657 - RNA, 20 nt, Homo sapiens
ucaaugaaguagcugagaaa

SEQ ID NO: 2148658 - RNA, 21 nt, Homo sapiens
cucauuugagauaaagucaaa

SEQ ID NO: 2148659 - RNA, 21 nt, Homo sapiens
auauuaggagacacagggaag

SEQ ID NO: 2148660 - RNA, 12 nt, Homo sapiens
agugauuuccac

SEQ ID NO: 2148661 - RNA, 16 nt, Homo sapiens
aaauuagccauuucac

SEQ ID NO: 2148662 - RNA, 19 nt, Homo sapiens
auguuugauacucuaguau

SEQ ID NO: 2148663 - RNA, 22 nt, Homo sapiens
cagaccacuauucuuaacuauu

SEQ ID NO: 2148664 - RNA, 15 nt, Homo sapiens
uaaaauacuuuuugu

SEQ ID NO: 2148665 - RNA, 19 nt, Homo sapiens
cacaugugacacauaugca

SEQ ID NO: 2148666 - RNA, 20 nt, Homo sapiens
cugugggguuuuuaaucucu

SEQ ID NO: 2148667 - RNA, 16 nt, Homo sapiens
guguauauauguguau

SEQ ID NO: 2148668 - RNA, 23 nt, Homo sapiens
augugucaccggggcaacugccu

SEQ ID NO: 2148669 - RNA, 21 nt, Homo sapiens
aagccccgcauaugugaguga

SEQ ID NO: 2148670 - RNA, 23 nt, Homo sapiens
gccaagacaguggcagcaaagga

SEQ ID NO: 2148671 - RNA, 16 nt, Homo sapiens
cuguaccauccaugga

SEQ ID NO: 2148672 - RNA, 17 nt, Homo sapiens
augaccuugacauacca

SEQ ID NO: 2148673 - RNA, 13 nt, Homo sapiens
gccuuuuacuuug

SEQ ID NO: 2148674 - RNA, 22 nt, Homo sapiens
gccccuugggagacuccaggga

SEQ ID NO: 2148675 - RNA, 14 nt, Homo sapiens
caaagaaacaccac

SEQ ID NO: 2148676 - RNA, 13 nt, Homo sapiens
augaauuugucca

SEQ ID NO: 2148677 - RNA, 20 nt, Homo sapiens
uccucauagcaauacuugga

SEQ ID NO: 2148678 - RNA, 15 nt, Homo sapiens
ccuggggugggcaca

SEQ ID NO: 2148679 - RNA, 23 nt, Homo sapiens
aauagucucauucaaauacugua

SEQ ID NO: 2148680 - RNA, 18 nt, Homo sapiens
gaugagagaauguggaaa

SEQ ID NO: 2148681 - RNA, 18 nt, Homo sapiens
auaccuggcuuuuacuuu

SEQ ID NO: 2148682 - RNA, 17 nt, Homo sapiens
ggcagccaggacaucuc

SEQ ID NO: 2148683 - RNA, 19 nt, Homo sapiens
cuuuauuuauaauacauuu

SEQ ID NO: 2148684 - RNA, 19 nt, Homo sapiens
gcauaaaugaauaaauuca

SEQ ID NO: 2148685 - RNA, 19 nt, Homo sapiens
caugaguccaugagucuaa

SEQ ID NO: 2148686 - RNA, 19 nt, Homo sapiens
ugagaccaggggaccagag

SEQ ID NO: 2148687 - RNA, 19 nt, Homo sapiens
cuguagauuaccaaaacaa

SEQ ID NO: 2148688 - RNA, 20 nt, Homo sapiens
uguucaacuccuaguacuua

SEQ ID NO: 2148689 - RNA, 15 nt, Homo sapiens
acauucuauagccau

SEQ ID NO: 2148690 - RNA, 12 nt, Homo sapiens
gggucuucaggg

SEQ ID NO: 2148691 - RNA, 12 nt, Homo sapiens
ucccauggaaua

SEQ ID NO: 2148692 - RNA, 20 nt, Homo sapiens
gcugccagugcuggucacua

SEQ ID NO: 2148693 - RNA, 15 nt, Homo sapiens
acgggcagucugcuc

SEQ ID NO: 2148694 - RNA, 20 nt, Homo sapiens
gaauccuuggugugguuucu

SEQ ID NO: 2148695 - RNA, 19 nt, Homo sapiens
uaaagggcgcaaagggcau

SEQ ID NO: 2148696 - RNA, 12 nt, Homo sapiens
agguacauauuu

SEQ ID NO: 2148697 - RNA, 16 nt, Homo sapiens
augccauuucuucucu

SEQ ID NO: 2148698 - RNA, 16 nt, Homo sapiens
ucucaguggagccuua

SEQ ID NO: 2148699 - RNA, 16 nt, Homo sapiens
gcucuuccaggagcca

SEQ ID NO: 2148700 - RNA, 18 nt, Homo sapiens
gggguccuccugugcuau

SEQ ID NO: 2148701 - RNA, 23 nt, Homo sapiens
uuauuacacuaaaugauauucau

SEQ ID NO: 2148702 - RNA, 19 nt, Homo sapiens
ggaaauguuuguccuugca

SEQ ID NO: 2148703 - RNA, 18 nt, Homo sapiens
uuauaaaauccugugcaa

SEQ ID NO: 2148704 - RNA, 22 nt, Homo sapiens
ugacauuucauuagccaugcaa

SEQ ID NO: 2148705 - RNA, 22 nt, Homo sapiens
cacaugacauagcacuugccga

SEQ ID NO: 2148706 - RNA, 17 nt, Homo sapiens
aucuuguuacugugaua

SEQ ID NO: 2148707 - RNA, 22 nt, Homo sapiens
gcuaggacuccaaccucaggga

SEQ ID NO: 2148708 - RNA, 13 nt, Homo sapiens
uggccauguucuc

SEQ ID NO: 2148709 - RNA, 19 nt, Homo sapiens
ggccccucacccaccaugg

SEQ ID NO: 2148710 - RNA, 19 nt, Homo sapiens
ucacugucccucaaaugac

SEQ ID NO: 2148711 - RNA, 12 nt, Homo sapiens
cacuagaucucc

SEQ ID NO: 2148712 - RNA, 16 nt, Homo sapiens
ugcaguaucucuuaca

SEQ ID NO: 2148713 - RNA, 12 nt, Homo sapiens
ccguaacaacug

SEQ ID NO: 2148714 - RNA, 23 nt, Homo sapiens
gccaaguccagauuuacacuggg

SEQ ID NO: 2148715 - RNA, 16 nt, Homo sapiens
auucccuucagggauu

SEQ ID NO: 2148716 - RNA, 14 nt, Homo sapiens
ucagaaacaucuga

SEQ ID NO: 2148717 - RNA, 15 nt, Homo sapiens
ccuaaaagcacuccu

SEQ ID NO: 2148718 - RNA, 16 nt, Homo sapiens
aagaagagaucaggaa

SEQ ID NO: 2148719 - RNA, 13 nt, Homo sapiens
uacaucacuguau

SEQ ID NO: 2148720 - RNA, 14 nt, Homo sapiens
ugauuugcuaucaa

SEQ ID NO: 2148721 - RNA, 14 nt, Homo sapiens
uguaauauuuugcu

SEQ ID NO: 2148722 - RNA, 18 nt, Homo sapiens
gaaaugccagugguggag

SEQ ID NO: 2148723 - RNA, 18 nt, Homo sapiens
cagcccauucccaaggga

SEQ ID NO: 2148724 - RNA, 15 nt, Homo sapiens
gagacaaggugcuaa

SEQ ID NO: 2148725 - RNA, 21 nt, Homo sapiens
acaagcccacagcacagcucc

SEQ ID NO: 2148726 - RNA, 20 nt, Homo sapiens
uaucuucauacaaugacaag

SEQ ID NO: 2148727 - RNA, 17 nt, Homo sapiens
agauuaguaaauaugug

SEQ ID NO: 2148728 - RNA, 19 nt, Homo sapiens
uuuaaaaaaaauauucugu

SEQ ID NO: 2148729 - RNA, 19 nt, Homo sapiens
cuaggggaacagaccagug

SEQ ID NO: 2148730 - RNA, 17 nt, Homo sapiens
aauuucuggaaaacugc

SEQ ID NO: 2148731 - RNA, 17 nt, Homo sapiens
cuagauucuaacauauu

SEQ ID NO: 2148732 - RNA, 17 nt, Homo sapiens
aauauccgaacuuuaau

SEQ ID NO: 2148733 - RNA, 17 nt, Homo sapiens
cgccacuccacaaauga

SEQ ID NO: 2148734 - RNA, 19 nt, Homo sapiens
ucaaauuccuacaguuucu

SEQ ID NO: 2148735 - RNA, 16 nt, Homo sapiens
uuauugucaacuugaa

SEQ ID NO: 2148736 - RNA, 18 nt, Homo sapiens
cucccaggucacaugcac

SEQ ID NO: 2148737 - RNA, 18 nt, Homo sapiens
ugaacaugccugccaaag

SEQ ID NO: 2148738 - RNA, 18 nt, Homo sapiens
cugcuccagaguugguga

SEQ ID NO: 2148739 - RNA, 14 nt, Homo sapiens
aaacugcugugaau

SEQ ID NO: 2148740 - RNA, 21 nt, Homo sapiens
uuccacagaauacaagccacu

SEQ ID NO: 2148741 - RNA, 14 nt, Homo sapiens
acaaguccucagug

SEQ ID NO: 2148742 - RNA, 15 nt, Homo sapiens
uauuaggccauauau

SEQ ID NO: 2148743 - RNA, 13 nt, Homo sapiens
aacaaaaauguua

SEQ ID NO: 2148744 - RNA, 14 nt, Homo sapiens
aauaauuaugugcc

SEQ ID NO: 2148745 - RNA, 11 nt, Homo sapiens
uucacacugca

SEQ ID NO: 2148746 - RNA, 15 nt, Homo sapiens
ugauuucauuuagau

SEQ ID NO: 2148747 - RNA, 21 nt, Homo sapiens
aacaauuguguuuucgucaca

SEQ ID NO: 2148748 - RNA, 18 nt, Homo sapiens
agguuuuuaagccuuaaa

SEQ ID NO: 2148749 - RNA, 19 nt, Homo sapiens
cuccaacugaaauguuaag

SEQ ID NO: 2148750 - RNA, 14 nt, Homo sapiens
ucacuugcauucca

SEQ ID NO: 2148751 - RNA, 16 nt, Homo sapiens
auuaaagucuacacug

SEQ ID NO: 2148752 - RNA, 16 nt, Homo sapiens
gucuaaguaugccuca

SEQ ID NO: 2148753 - RNA, 23 nt, Homo sapiens
gucugggaguauacggaaacaaa

SEQ ID NO: 2148754 - RNA, 22 nt, Homo sapiens
cucaauaaaggucauauuggaa

SEQ ID NO: 2148755 - RNA, 12 nt, Homo sapiens
aggaaucugcca

SEQ ID NO: 2148756 - RNA, 19 nt, Homo sapiens
ugacaguccacaggggcca

SEQ ID NO: 2148757 - RNA, 18 nt, Homo sapiens
caguucuuugggcugggu

SEQ ID NO: 2148758 - RNA, 15 nt, Homo sapiens
cagacaaugauccag

SEQ ID NO: 2148759 - RNA, 13 nt, Homo sapiens
ccuggcacauuca

SEQ ID NO: 2148760 - RNA, 13 nt, Homo sapiens
cugggcacacgca

SEQ ID NO: 2148761 - RNA, 15 nt, Homo sapiens
cuauuuacauauaau

SEQ ID NO: 2148762 - RNA, 16 nt, Homo sapiens
agggacggcuguggga

SEQ ID NO: 2148763 - RNA, 21 nt, Homo sapiens
cuuuaaagcaggauuucucaa

SEQ ID NO: 2148764 - RNA, 14 nt, Homo sapiens
gagggagugacaga

SEQ ID NO: 2148765 - RNA, 16 nt, Homo sapiens
uugcacacagauguga

SEQ ID NO: 2148766 - RNA, 16 nt, Homo sapiens
ggcugaccgugucucu

SEQ ID NO: 2148767 - RNA, 19 nt, Homo sapiens
auauuuuaaaaucugucac

SEQ ID NO: 2148768 - RNA, 18 nt, Homo sapiens
ugugacucgggagcugca

SEQ ID NO: 2148769 - RNA, 16 nt, Homo sapiens
auucuagagccagcug

SEQ ID NO: 2148770 - RNA, 21 nt, Homo sapiens
aagccacaaauaggaugcuug

SEQ ID NO: 2148771 - RNA, 19 nt, Homo sapiens
cuccaggcuuucuggaguu

SEQ ID NO: 2148772 - RNA, 14 nt, Homo sapiens
caaauuauguggau

SEQ ID NO: 2148773 - RNA, 12 nt, Homo sapiens
uaaaagacauua

SEQ ID NO: 2148774 - RNA, 14 nt, Homo sapiens
aaugucuuucaugu

SEQ ID NO: 2148775 - RNA, 20 nt, Homo sapiens
gcuuuuauuugguguguucg

SEQ ID NO: 2148776 - RNA, 13 nt, Homo sapiens
ccccaggcccacu

SEQ ID NO: 2148777 - RNA, 22 nt, Homo sapiens
ucagcccaccuggggaguuuac

SEQ ID NO: 2148778 - RNA, 21 nt, Homo sapiens
ucacuuucauuuuugauagcu

SEQ ID NO: 2148779 - RNA, 20 nt, Homo sapiens
cuaagaaacauuuauauuga

SEQ ID NO: 2148780 - RNA, 18 nt, Homo sapiens
uuuuaagucacaauuuca

SEQ ID NO: 2148781 - RNA, 14 nt, Homo sapiens
agcugggauuacag

SEQ ID NO: 2148782 - RNA, 14 nt, Homo sapiens
uuugacuagccauc

SEQ ID NO: 2148783 - RNA, 22 nt, Homo sapiens
cuaggcguuuguuauauaaaaa

SEQ ID NO: 2148784 - RNA, 18 nt, Homo sapiens
uuuuguuagccaacauaa

SEQ ID NO: 2148785 - RNA, 23 nt, Homo sapiens
ccuugcccagcuuucaaaggaca

SEQ ID NO: 2148786 - RNA, 18 nt, Homo sapiens
caaucauauuuaaaggga

SEQ ID NO: 2148787 - RNA, 20 nt, Homo sapiens
cauguucauauguacuuguu

SEQ ID NO: 2148788 - RNA, 18 nt, Homo sapiens
ugguuucccaagagcuac

SEQ ID NO: 2148789 - RNA, 22 nt, Homo sapiens
auuuuuuaaaucauauuaaaau

SEQ ID NO: 2148790 - RNA, 14 nt, Homo sapiens
aauuuaaaagcaca

SEQ ID NO: 2148791 - RNA, 16 nt, Homo sapiens
auaccagguuaccuca

SEQ ID NO: 2148792 - RNA, 20 nt, Homo sapiens
gaauaauuauguuuaccuca

SEQ ID NO: 2148793 - RNA, 15 nt, Homo sapiens
acagcagaugccaaa

SEQ ID NO: 2148794 - RNA, 19 nt, Homo sapiens
gacaccucccccuacccau

SEQ ID NO: 2148795 - RNA, 17 nt, Homo sapiens
gacuuacaaaaugccaa

SEQ ID NO: 2148796 - RNA, 12 nt, Homo sapiens
cacgucugcuaa

SEQ ID NO: 2148797 - RNA, 15 nt, Homo sapiens
augggccuccagaga

SEQ ID NO: 2148798 - RNA, 17 nt, Homo sapiens
accugucucuaccuaag

SEQ ID NO: 2148799 - RNA, 18 nt, Homo sapiens
gucuuuuuccaaacaauu

SEQ ID NO: 2148800 - RNA, 16 nt, Homo sapiens
gagucggaguggacac

SEQ ID NO: 2148801 - RNA, 20 nt, Homo sapiens
gcugagaucgcgccacugca

SEQ ID NO: 2148802 - RNA, 20 nt, Homo sapiens
ugcugcaugaaaaacauucc

SEQ ID NO: 2148803 - RNA, 14 nt, Homo sapiens
uggcucuuuuacca

SEQ ID NO: 2148804 - RNA, 13 nt, Homo sapiens
agagcuguucccc

SEQ ID NO: 2148805 - RNA, 16 nt, Homo sapiens
gcacagggggccucca

SEQ ID NO: 2148806 - RNA, 15 nt, Homo sapiens
aaagauggaugugcu

SEQ ID NO: 2148807 - RNA, 21 nt, Homo sapiens
aauuugaaccaaaacauuccg

SEQ ID NO: 2148808 - RNA, 16 nt, Homo sapiens
aagaauagcaucugua

SEQ ID NO: 2148809 - RNA, 14 nt, Homo sapiens
caaaaaaagacagg

SEQ ID NO: 2148810 - RNA, 17 nt, Homo sapiens
uaaaaucuaaaauuuca

SEQ ID NO: 2148811 - RNA, 13 nt, Homo sapiens
cugggugaucugc

SEQ ID NO: 2148812 - RNA, 16 nt, Homo sapiens
ucauuaucacagugaa

SEQ ID NO: 2148813 - RNA, 16 nt, Homo sapiens
aggacagucagcauuu

SEQ ID NO: 2148814 - RNA, 10 nt, Homo sapiens
ccaccugcua

SEQ ID NO: 2148815 - RNA, 22 nt, Homo sapiens
uaauuccgaaacaaaacuguga

SEQ ID NO: 2148816 - RNA, 19 nt, Homo sapiens
gaucccuacugccaaccug

SEQ ID NO: 2148817 - RNA, 16 nt, Homo sapiens
aauaugccaaacacau

SEQ ID NO: 2148818 - RNA, 22 nt, Homo sapiens
aguauugcgaaugugcagaaag

SEQ ID NO: 2148819 - RNA, 12 nt, Homo sapiens
ugauuuacuuaa

SEQ ID NO: 2148820 - RNA, 22 nt, Homo sapiens
aagguuguguugccugcugagc

SEQ ID NO: 2148821 - RNA, 22 nt, Homo sapiens
ugaggcagggauacucuguuuu

SEQ ID NO: 2148822 - RNA, 20 nt, Homo sapiens
caaccaggcagcugagacca

SEQ ID NO: 2148823 - RNA, 12 nt, Homo sapiens
cucgcccugugc

SEQ ID NO: 2148824 - RNA, 21 nt, Homo sapiens
aauaaugaguuagaacuauua

SEQ ID NO: 2148825 - RNA, 19 nt, Homo sapiens
gugggacccccguggggca

SEQ ID NO: 2148826 - RNA, 15 nt, Homo sapiens
ggaagcaacguguua

SEQ ID NO: 2148827 - RNA, 16 nt, Homo sapiens
agaaaaaaacuucuuu

SEQ ID NO: 2148828 - RNA, 22 nt, Homo sapiens
ccacuuuucuauauugcagugu

SEQ ID NO: 2148829 - RNA, 18 nt, Homo sapiens
aggauacuuuacaugguu

SEQ ID NO: 2148830 - RNA, 19 nt, Homo sapiens
gcaaaagaggauguucacc

SEQ ID NO: 2148831 - RNA, 16 nt, Homo sapiens
caugaucacagcucac

SEQ ID NO: 2148832 - RNA, 14 nt, Homo sapiens
uuuucccauuucaa

SEQ ID NO: 2148833 - RNA, 17 nt, Homo sapiens
ugccaaucuguacaaaa

SEQ ID NO: 2148834 - RNA, 17 nt, Homo sapiens
gcaguggcgcgaucuca

SEQ ID NO: 2148835 - RNA, 13 nt, Homo sapiens
cuaaauaugagcc

SEQ ID NO: 2148836 - RNA, 14 nt, Homo sapiens
gugugacucauuaa

SEQ ID NO: 2148837 - RNA, 12 nt, Homo sapiens
gcaccacuuuuu

SEQ ID NO: 2148838 - RNA, 21 nt, Homo sapiens
caaguacugguugacuuucua

SEQ ID NO: 2148839 - RNA, 18 nt, Homo sapiens
cucugccucccuagcuuu

SEQ ID NO: 2148840 - RNA, 15 nt, Homo sapiens
gagggcuguggugcc

SEQ ID NO: 2148841 - RNA, 18 nt, Homo sapiens
cuuagaaauucagcauuu

SEQ ID NO: 2148842 - RNA, 21 nt, Homo sapiens
agagaccgagccucugucacu

SEQ ID NO: 2148843 - RNA, 20 nt, Homo sapiens
uagcuuuagagaagccauaa

SEQ ID NO: 2148844 - RNA, 18 nt, Homo sapiens
guggaguucucuguucua

SEQ ID NO: 2148845 - RNA, 18 nt, Homo sapiens
cuucuguuugcacaccca

SEQ ID NO: 2148846 - RNA, 16 nt, Homo sapiens
gauuaauaagugaagg

SEQ ID NO: 2148847 - RNA, 18 nt, Homo sapiens
gagcaguugaccuuugcc

SEQ ID NO: 2148848 - RNA, 21 nt, Homo sapiens
gcacugcaaaugccgcucuca

SEQ ID NO: 2148849 - RNA, 19 nt, Homo sapiens
acuuaguagcuaugugauu

SEQ ID NO: 2148850 - RNA, 21 nt, Homo sapiens
ucaucugaauuugcccuggga

SEQ ID NO: 2148851 - RNA, 19 nt, Homo sapiens
gcccaggccuccagcucag

SEQ ID NO: 2148852 - RNA, 15 nt, Homo sapiens
aaguuuuaacuuuua

SEQ ID NO: 2148853 - RNA, 18 nt, Homo sapiens
uugggggggccaaaagga

SEQ ID NO: 2148854 - RNA, 23 nt, Homo sapiens
ucauucuucaguucucuacuccc

SEQ ID NO: 2148855 - RNA, 18 nt, Homo sapiens
gagacaucacuugccaau

SEQ ID NO: 2148856 - RNA, 17 nt, Homo sapiens
uguuggcaaaucagaug

SEQ ID NO: 2148857 - RNA, 17 nt, Homo sapiens
ugaaaauauuuguauca

SEQ ID NO: 2148858 - RNA, 17 nt, Homo sapiens
caucuagaauucacuga

SEQ ID NO: 2148859 - RNA, 16 nt, Homo sapiens
ucgggcgcgaccugcu

SEQ ID NO: 2148860 - RNA, 22 nt, Homo sapiens
ugggcgacagagcgagacucca

SEQ ID NO: 2148861 - RNA, 22 nt, Homo sapiens
uuuccagcuccguguuucucua

SEQ ID NO: 2148862 - RNA, 14 nt, Homo sapiens
aacaccacuuaauc

SEQ ID NO: 2148863 - RNA, 17 nt, Homo sapiens
cuucuccaaaugagauc

SEQ ID NO: 2148864 - RNA, 23 nt, Homo sapiens
acugaaaaaugguaauuguugcu

SEQ ID NO: 2148865 - RNA, 23 nt, Homo sapiens
ccgguuaaauuccauaugcucca

SEQ ID NO: 2148866 - RNA, 20 nt, Homo sapiens
aggccuuacuuaaacccagc

SEQ ID NO: 2148867 - RNA, 23 nt, Homo sapiens
ucaguuguaacauucuauuucaa

SEQ ID NO: 2148868 - RNA, 11 nt, Homo sapiens
ccuaaagugaa

SEQ ID NO: 2148869 - RNA, 14 nt, Homo sapiens
ugcccucuccacac

SEQ ID NO: 2148870 - RNA, 14 nt, Homo sapiens
uccagaacacucuu

SEQ ID NO: 2148871 - RNA, 21 nt, Homo sapiens
uaaagauugcuuuauccagca

SEQ ID NO: 2148872 - RNA, 22 nt, Homo sapiens
uuagcaaaaaaugaacagugau

SEQ ID NO: 2148873 - RNA, 18 nt, Homo sapiens
ugagacuuucuaaaucaa

SEQ ID NO: 2148874 - RNA, 16 nt, Homo sapiens
uguuaucaccuagcug

SEQ ID NO: 2148875 - RNA, 13 nt, Homo sapiens
aaaacacacuccu

SEQ ID NO: 2148876 - RNA, 22 nt, Homo sapiens
cuucccgaguaacugagauuac

SEQ ID NO: 2148877 - RNA, 15 nt, Homo sapiens
uuuuacucaaccaaa

SEQ ID NO: 2148878 - RNA, 15 nt, Homo sapiens
uacuacacauucaau

SEQ ID NO: 2148879 - RNA, 20 nt, Homo sapiens
ccuuagauuuggugaacaac

SEQ ID NO: 2148880 - RNA, 19 nt, Homo sapiens
ucaguaccauuugaucugc

SEQ ID NO: 2148881 - RNA, 23 nt, Homo sapiens
acuguaaauguggcccccagugg

SEQ ID NO: 2148882 - RNA, 16 nt, Homo sapiens
ugaagaaucuacuuaa

SEQ ID NO: 2148883 - RNA, 14 nt, Homo sapiens
ggcugcacaggcug

SEQ ID NO: 2148884 - RNA, 15 nt, Homo sapiens
gccuuuauugacuac

SEQ ID NO: 2148885 - RNA, 15 nt, Homo sapiens
uuucaaccuugccag

SEQ ID NO: 2148886 - RNA, 19 nt, Homo sapiens
uaauguaaagguuuucuca

SEQ ID NO: 2148887 - RNA, 16 nt, Homo sapiens
ugcauccuuugcacug

SEQ ID NO: 2148888 - RNA, 18 nt, Homo sapiens
cuaugcauuaagaguaaa

SEQ ID NO: 2148889 - RNA, 17 nt, Homo sapiens
gaagaccuguuauguag

SEQ ID NO: 2148890 - RNA, 19 nt, Homo sapiens
aaauaagcuauuugaugua

SEQ ID NO: 2148891 - RNA, 13 nt, Homo sapiens
guugcuguucaca

SEQ ID NO: 2148892 - RNA, 13 nt, Homo sapiens
agcugccgugccu

SEQ ID NO: 2148893 - RNA, 21 nt, Homo sapiens
uaaauauauauucaccuagca

SEQ ID NO: 2148894 - RNA, 22 nt, Homo sapiens
agcaaggugggggucaggcuac

SEQ ID NO: 2148895 - RNA, 11 nt, Homo sapiens
uccuuccucuu

SEQ ID NO: 2148896 - RNA, 18 nt, Homo sapiens
agagaugacucugucuca

SEQ ID NO: 2148897 - RNA, 24 nt, Homo sapiens
gccacccugagaaccccucuggga

SEQ ID NO: 2148898 - RNA, 20 nt, Homo sapiens
ugauucuuuucccaucacca

SEQ ID NO: 2148899 - RNA, 15 nt, Homo sapiens
uaguaacaucaaaga

SEQ ID NO: 2148900 - RNA, 21 nt, Homo sapiens
aguuuaauccuuuguauuaca

SEQ ID NO: 2148901 - RNA, 15 nt, Homo sapiens
agaaccccucuggga

SEQ ID NO: 2148902 - RNA, 11 nt, Homo sapiens
aagcuuuguga

SEQ ID NO: 2148903 - RNA, 11 nt, Homo sapiens
uggcuuugaaa

SEQ ID NO: 2148904 - RNA, 24 nt, Homo sapiens
agaaacccuuccacguguaugcaa

SEQ ID NO: 2148905 - RNA, 22 nt, Homo sapiens
acccaagugaagguucccaagg

SEQ ID NO: 2148906 - RNA, 23 nt, Homo sapiens
gcccauggcuuuagcuaccucac

SEQ ID NO: 2148907 - RNA, 19 nt, Homo sapiens
accgucuuccuucagggau

SEQ ID NO: 2148908 - RNA, 22 nt, Homo sapiens
ugaauacaugcguguaccucac

SEQ ID NO: 2148909 - RNA, 16 nt, Homo sapiens
agaucgcaccacugca

SEQ ID NO: 2148910 - RNA, 17 nt, Homo sapiens
agagggguauaggacaa

SEQ ID NO: 2148911 - RNA, 18 nt, Homo sapiens
agaccccccaucagugga

SEQ ID NO: 2148912 - RNA, 16 nt, Homo sapiens
gccuuucuuccaucag

SEQ ID NO: 2148913 - RNA, 21 nt, Homo sapiens
gggagaaaaagaaacacaaga

SEQ ID NO: 2148914 - RNA, 18 nt, Homo sapiens
ccaaugcacauccauucc

SEQ ID NO: 2148915 - RNA, 21 nt, Homo sapiens
uaaacuguuagcacuguugau

SEQ ID NO: 2148916 - RNA, 16 nt, Homo sapiens
aauguacuacauuugc

SEQ ID NO: 2148917 - RNA, 21 nt, Homo sapiens
cugcacguggcuucugaugaa

SEQ ID NO: 2148918 - RNA, 14 nt, Homo sapiens
caauaaaaccuuug

SEQ ID NO: 2148919 - RNA, 14 nt, Homo sapiens
uuggagcagugcuu

SEQ ID NO: 2148920 - RNA, 17 nt, Homo sapiens
auauaccaugacaugaa

SEQ ID NO: 2148921 - RNA, 20 nt, Homo sapiens
ugagcagcuacuguaacuuu

SEQ ID NO: 2148922 - RNA, 14 nt, Homo sapiens
uaguuucugauuca

SEQ ID NO: 2148923 - RNA, 13 nt, Homo sapiens
gcccugcccucac

SEQ ID NO: 2148924 - RNA, 21 nt, Homo sapiens
aggcagagguugcagugagcu

SEQ ID NO: 2148925 - RNA, 14 nt, Homo sapiens
gacagcuuuucuca

SEQ ID NO: 2148926 - RNA, 12 nt, Homo sapiens
cuaaauguauuc

SEQ ID NO: 2148927 - RNA, 22 nt, Homo sapiens
cuugccccuguuaccuaauuag

SEQ ID NO: 2148928 - RNA, 21 nt, Homo sapiens
aguuuuuaaaauuuauuugca

SEQ ID NO: 2148929 - RNA, 20 nt, Homo sapiens
ggaccuuuguauuaagccaa

SEQ ID NO: 2148930 - RNA, 16 nt, Homo sapiens
ucccugcacagugacu

SEQ ID NO: 2148931 - RNA, 16 nt, Homo sapiens
ggauauuaaauguugc

SEQ ID NO: 2148932 - RNA, 16 nt, Homo sapiens
acccagcauguacaaa

SEQ ID NO: 2148933 - RNA, 23 nt, Homo sapiens
auuuaaaaacaaaaaaacacaaa

SEQ ID NO: 2148934 - RNA, 22 nt, Homo sapiens
auaguuuaggagaaaccagcuu

SEQ ID NO: 2148935 - RNA, 15 nt, Homo sapiens
cacauauaaauguac

SEQ ID NO: 2148936 - RNA, 23 nt, Homo sapiens
gccaccucccuauacugcuugga

SEQ ID NO: 2148937 - RNA, 16 nt, Homo sapiens
cuguguguguucuuca

SEQ ID NO: 2148938 - RNA, 21 nt, Homo sapiens
caucuugaccaagcaggaagc

SEQ ID NO: 2148939 - RNA, 14 nt, Homo sapiens
auauaagccauagc

SEQ ID NO: 2148940 - RNA, 16 nt, Homo sapiens
ccaaauaagcaucugu

SEQ ID NO: 2148941 - RNA, 21 nt, Homo sapiens
uggaauuuuucuguacuucag

SEQ ID NO: 2148942 - RNA, 16 nt, Homo sapiens
aguccacaguacauaa

SEQ ID NO: 2148943 - RNA, 19 nt, Homo sapiens
gaacgcugcuccaugcaca

SEQ ID NO: 2148944 - RNA, 19 nt, Homo sapiens
uacgugcgcucugccauuc

SEQ ID NO: 2148945 - RNA, 17 nt, Homo sapiens
cagggugugaggccaca

SEQ ID NO: 2148946 - RNA, 20 nt, Homo sapiens
cuucccuucuuugcacuuuu

SEQ ID NO: 2148947 - RNA, 19 nt, Homo sapiens
augcacagaguccuuaaaa

SEQ ID NO: 2148948 - RNA, 17 nt, Homo sapiens
uucuucccauacuugca

SEQ ID NO: 2148949 - RNA, 19 nt, Homo sapiens
uauccgugaaaaguugaua

SEQ ID NO: 2148950 - RNA, 14 nt, Homo sapiens
accguauacuuaaa

SEQ ID NO: 2148951 - RNA, 21 nt, Homo sapiens
auuauggggcugcuuuuguca

SEQ ID NO: 2148952 - RNA, 17 nt, Homo sapiens
cagaaggccccagagag

SEQ ID NO: 2148953 - RNA, 20 nt, Homo sapiens
cugggaaaccccugaaaugc

SEQ ID NO: 2148954 - RNA, 22 nt, Homo sapiens
uaaaugugcaaaccuguucauc

SEQ ID NO: 2148955 - RNA, 21 nt, Homo sapiens
cacacuucggcucucuggaca

SEQ ID NO: 2148956 - RNA, 21 nt, Homo sapiens
gacagaugaccgcaauaauga

SEQ ID NO: 2148957 - RNA, 13 nt, Homo sapiens
aggcagagcucag

SEQ ID NO: 2148958 - RNA, 14 nt, Homo sapiens
gucacgcaccuggg

SEQ ID NO: 2148959 - RNA, 21 nt, Homo sapiens
caaguuaagagaaacuuuaua

SEQ ID NO: 2148960 - RNA, 21 nt, Homo sapiens
auuccuucgaaaggccuucag

SEQ ID NO: 2148961 - RNA, 14 nt, Homo sapiens
cacacccuaccuuc

SEQ ID NO: 2148962 - RNA, 20 nt, Homo sapiens
uaauuugagagaaauaugaa

SEQ ID NO: 2148963 - RNA, 18 nt, Homo sapiens
gaccccaaaggagucaga

SEQ ID NO: 2148964 - RNA, 13 nt, Homo sapiens
aucauucauucau

SEQ ID NO: 2148965 - RNA, 16 nt, Homo sapiens
gccagucagcagucau

SEQ ID NO: 2148966 - RNA, 13 nt, Homo sapiens
agagcugcuucca

SEQ ID NO: 2148967 - RNA, 22 nt, Homo sapiens
ucauaaacaggcugacuggcag

SEQ ID NO: 2148968 - RNA, 14 nt, Homo sapiens
cuaaaugucaauca

SEQ ID NO: 2148969 - RNA, 14 nt, Homo sapiens
aaaacuguauauaa

SEQ ID NO: 2148970 - RNA, 18 nt, Homo sapiens
gcaguuggccaggcucuu

SEQ ID NO: 2148971 - RNA, 18 nt, Homo sapiens
auacuucauuaauuucaa

SEQ ID NO: 2148972 - RNA, 17 nt, Homo sapiens
uucaucuuuuguauagu

SEQ ID NO: 2148973 - RNA, 21 nt, Homo sapiens
uuacagcuacuuuaaccuaug

SEQ ID NO: 2148974 - RNA, 18 nt, Homo sapiens
aguccacugcugaggaca

SEQ ID NO: 2148975 - RNA, 14 nt, Homo sapiens
aaaaucagggccac

SEQ ID NO: 2148976 - RNA, 20 nt, Homo sapiens
ugagcacugcguacaaacau

SEQ ID NO: 2148977 - RNA, 18 nt, Homo sapiens
cuguguguccuugcaugg

SEQ ID NO: 2148978 - RNA, 21 nt, Homo sapiens
cccuuuacauuuugugcagug

SEQ ID NO: 2148979 - RNA, 22 nt, Homo sapiens
auuagaagccugcagaauccag

SEQ ID NO: 2148980 - RNA, 14 nt, Homo sapiens
aaaacucaaccaga

SEQ ID NO: 2148981 - RNA, 20 nt, Homo sapiens
uaaugaaggggaagagauua

SEQ ID NO: 2148982 - RNA, 21 nt, Homo sapiens
uuauagcacuuugaaauaccu

SEQ ID NO: 2148983 - RNA, 22 nt, Homo sapiens
aauuugcaccaguuuuauccau

SEQ ID NO: 2148984 - RNA, 19 nt, Homo sapiens
uccuggcagucucagucca

SEQ ID NO: 2148985 - RNA, 14 nt, Homo sapiens
ucuguuauauagug

SEQ ID NO: 2148986 - RNA, 20 nt, Homo sapiens
cacuugggacuagaucacaa

SEQ ID NO: 2148987 - RNA, 15 nt, Homo sapiens
uaaacuugaugccag

SEQ ID NO: 2148988 - RNA, 19 nt, Homo sapiens
uagcuuccugccccagaca

SEQ ID NO: 2148989 - RNA, 19 nt, Homo sapiens
uagugccauuggaauaaua

SEQ ID NO: 2148990 - RNA, 16 nt, Homo sapiens
ucucaaaaaaagggca

SEQ ID NO: 2148991 - RNA, 12 nt, Homo sapiens
gauugacagguu

SEQ ID NO: 2148992 - RNA, 15 nt, Homo sapiens
cguaggcuacagaga

SEQ ID NO: 2148993 - RNA, 23 nt, Homo sapiens
ucaugaagcucaguuuggcugua

SEQ ID NO: 2148994 - RNA, 16 nt, Homo sapiens
cuugggacauggcaca

SEQ ID NO: 2148995 - RNA, 16 nt, Homo sapiens
uauaaagauuguacuu

SEQ ID NO: 2148996 - RNA, 15 nt, Homo sapiens
uguaggccaggcgug

SEQ ID NO: 2148997 - RNA, 17 nt, Homo sapiens
ugguauauucagucucu

SEQ ID NO: 2148998 - RNA, 23 nt, Homo sapiens
cuggagggaauccauaucagcuc

SEQ ID NO: 2148999 - RNA, 20 nt, Homo sapiens
aacugugaugaaauaugaaa

SEQ ID NO: 2149000 - RNA, 21 nt, Homo sapiens
acuugaaaauuaacaugaaua

SEQ ID NO: 2149001 - RNA, 22 nt, Homo sapiens
aucuguaaauuuaacugcauau

SEQ ID NO: 2149002 - RNA, 15 nt, Homo sapiens
cacacugcaagggau

SEQ ID NO: 2149003 - RNA, 17 nt, Homo sapiens
cuggagugugugggggu

SEQ ID NO: 2149004 - RNA, 15 nt, Homo sapiens
ugauacgugugugaa

SEQ ID NO: 2149005 - RNA, 19 nt, Homo sapiens
uauaacaauuaaaaucuca

SEQ ID NO: 2149006 - RNA, 15 nt, Homo sapiens
cuccugagagcuguu

SEQ ID NO: 2149007 - RNA, 19 nt, Homo sapiens
ucugggacuuuuaaauuca

SEQ ID NO: 2149008 - RNA, 13 nt, Homo sapiens
ccauuaccugacu

SEQ ID NO: 2149009 - RNA, 22 nt, Homo sapiens
gccuagcugggaaggugaccac

SEQ ID NO: 2149010 - RNA, 14 nt, Homo sapiens
cacugugcuuucag

SEQ ID NO: 2149011 - RNA, 22 nt, Homo sapiens
aacagcaucuucccaaaaccau

SEQ ID NO: 2149012 - RNA, 15 nt, Homo sapiens
caauccuugaccuca

SEQ ID NO: 2149013 - RNA, 23 nt, Homo sapiens
caugccuggagacauaucacuca

SEQ ID NO: 2149014 - RNA, 13 nt, Homo sapiens
gaaagugcugacu

SEQ ID NO: 2149015 - RNA, 22 nt, Homo sapiens
ugcguguaucuaauucagcuga

SEQ ID NO: 2149016 - RNA, 18 nt, Homo sapiens
ggaacuucuuugcaguuc

SEQ ID NO: 2149017 - RNA, 16 nt, Homo sapiens
caucacugguugcacu

SEQ ID NO: 2149018 - RNA, 12 nt, Homo sapiens
aauaaaacugau

SEQ ID NO: 2149019 - RNA, 12 nt, Homo sapiens
aaauaaacugua

SEQ ID NO: 2149020 - RNA, 18 nt, Homo sapiens
uggcaaggagccagggaa

SEQ ID NO: 2149021 - RNA, 16 nt, Homo sapiens
auugcuacacuuacaa

SEQ ID NO: 2149022 - RNA, 16 nt, Homo sapiens
aucuuucuccuugaau

SEQ ID NO: 2149023 - RNA, 18 nt, Homo sapiens
aacugcugcugugcacau

SEQ ID NO: 2149024 - RNA, 16 nt, Homo sapiens
guuguguuagccucuu

SEQ ID NO: 2149025 - RNA, 15 nt, Homo sapiens
agaugaucugggcuu

SEQ ID NO: 2149026 - RNA, 22 nt, Homo sapiens
gcuacucugugccagagccugg

SEQ ID NO: 2149027 - RNA, 19 nt, Homo sapiens
ggaauggaaagaauguggg

SEQ ID NO: 2149028 - RNA, 23 nt, Homo sapiens
uuuugaaacauacagaauguucu

SEQ ID NO: 2149029 - RNA, 14 nt, Homo sapiens
caggguagggagaa

SEQ ID NO: 2149030 - RNA, 17 nt, Homo sapiens
uaccauuggaaauuuca

SEQ ID NO: 2149031 - RNA, 13 nt, Homo sapiens
aaauacugauggu

SEQ ID NO: 2149032 - RNA, 22 nt, Homo sapiens
acucagacccaaucaccucuaa

SEQ ID NO: 2149033 - RNA, 11 nt, Homo sapiens
cccuaccuaaa

SEQ ID NO: 2149034 - RNA, 12 nt, Homo sapiens
uuuucaccucau

SEQ ID NO: 2149035 - RNA, 17 nt, Homo sapiens
uauaaaucaugaugcua

SEQ ID NO: 2149036 - RNA, 22 nt, Homo sapiens
agcaaugccccaaacuuucuca

SEQ ID NO: 2149037 - RNA, 22 nt, Homo sapiens
cucugcaguaaaacacauuugg

SEQ ID NO: 2149038 - RNA, 19 nt, Homo sapiens
agcauuuacauuuauuagg

SEQ ID NO: 2149039 - RNA, 14 nt, Homo sapiens
aaguggccaugcca

SEQ ID NO: 2149040 - RNA, 19 nt, Homo sapiens
guuacuaaagucacauaua

SEQ ID NO: 2149041 - RNA, 19 nt, Homo sapiens
cuuuguaaucacucccauu

SEQ ID NO: 2149042 - RNA, 21 nt, Homo sapiens
caggguuuugccauguuggcc

SEQ ID NO: 2149043 - RNA, 13 nt, Homo sapiens
acggucaguccau

SEQ ID NO: 2149044 - RNA, 14 nt, Homo sapiens
cuuccucugccaug

SEQ ID NO: 2149045 - RNA, 14 nt, Homo sapiens
agaggcgcccuccc

SEQ ID NO: 2149046 - RNA, 13 nt, Homo sapiens
agccucagugaaa

SEQ ID NO: 2149047 - RNA, 15 nt, Homo sapiens
uaacuaaugaauuga

SEQ ID NO: 2149048 - RNA, 19 nt, Homo sapiens
uggauuuacgacugaagaa

SEQ ID NO: 2149049 - RNA, 21 nt, Homo sapiens
caucucuauuaaaauacaaaa

SEQ ID NO: 2149050 - RNA, 19 nt, Homo sapiens
gagucuagcucuccugcca

SEQ ID NO: 2149051 - RNA, 12 nt, Homo sapiens
cuaauaaagcca

SEQ ID NO: 2149052 - RNA, 21 nt, Homo sapiens
augcaaaaguucugacuugac

SEQ ID NO: 2149053 - RNA, 15 nt, Homo sapiens
uugggaauucuugcu

SEQ ID NO: 2149054 - RNA, 19 nt, Homo sapiens
ccucuugaagcauagcuuu

SEQ ID NO: 2149055 - RNA, 16 nt, Homo sapiens
caaaaaaucaucucac

SEQ ID NO: 2149056 - RNA, 14 nt, Homo sapiens
acaaaaauguuucc

SEQ ID NO: 2149057 - RNA, 14 nt, Homo sapiens
gucuacuucacuaa

SEQ ID NO: 2149058 - RNA, 13 nt, Homo sapiens
accaucugauuaa

SEQ ID NO: 2149059 - RNA, 16 nt, Homo sapiens
uauauuggaaucugua

SEQ ID NO: 2149060 - RNA, 16 nt, Homo sapiens
uucccgggaucacuua

SEQ ID NO: 2149061 - RNA, 16 nt, Homo sapiens
ugaucacccaaugcau

SEQ ID NO: 2149062 - RNA, 23 nt, Homo sapiens
cuccacacagugcucaaggccag

SEQ ID NO: 2149063 - RNA, 16 nt, Homo sapiens
gcacuuuaaagcauua

SEQ ID NO: 2149064 - RNA, 19 nt, Homo sapiens
uguaacuguaaaacauuga

SEQ ID NO: 2149065 - RNA, 23 nt, Homo sapiens
auuagagguuugucaacacaaag

SEQ ID NO: 2149066 - RNA, 16 nt, Homo sapiens
ucagaaacuccaugau

SEQ ID NO: 2149067 - RNA, 20 nt, Homo sapiens
uaucuuaucccuugacaaaa

SEQ ID NO: 2149068 - RNA, 16 nt, Homo sapiens
cucauuaggaucugau

SEQ ID NO: 2149069 - RNA, 23 nt, Homo sapiens
aagaugaccuuugucucaccuca

SEQ ID NO: 2149070 - RNA, 21 nt, Homo sapiens
agagcugagggcccuguggag

SEQ ID NO: 2149071 - RNA, 22 nt, Homo sapiens
uggaauagcuuguacacauaua

SEQ ID NO: 2149072 - RNA, 20 nt, Homo sapiens
aauaauacguguguaccuaa

SEQ ID NO: 2149073 - RNA, 21 nt, Homo sapiens
cugggccaugcgaggggccag

SEQ ID NO: 2149074 - RNA, 15 nt, Homo sapiens
aaccucccucuuguu

SEQ ID NO: 2149075 - RNA, 15 nt, Homo sapiens
cuuccugaaacuuca

SEQ ID NO: 2149076 - RNA, 16 nt, Homo sapiens
gcaaauguaauugauu

SEQ ID NO: 2149077 - RNA, 16 nt, Homo sapiens
gugcgugugugcaagu

SEQ ID NO: 2149078 - RNA, 21 nt, Homo sapiens
uccgccugcagaggacagagc

SEQ ID NO: 2149079 - RNA, 14 nt, Homo sapiens
ccuuagacugaaaa

SEQ ID NO: 2149080 - RNA, 19 nt, Homo sapiens
accccugccuuugggagca

SEQ ID NO: 2149081 - RNA, 22 nt, Homo sapiens
uagaucuaguucucaaucacug

SEQ ID NO: 2149082 - RNA, 12 nt, Homo sapiens
ccuccauuucag

SEQ ID NO: 2149083 - RNA, 13 nt, Homo sapiens
aaccugcucuccu

SEQ ID NO: 2149084 - RNA, 13 nt, Homo sapiens
auguagcucagua

SEQ ID NO: 2149085 - RNA, 13 nt, Homo sapiens
aacccgcucuccc

SEQ ID NO: 2149086 - RNA, 16 nt, Homo sapiens
cagcaggcccagcaug

SEQ ID NO: 2149087 - RNA, 14 nt, Homo sapiens
cuuugaucaguaua

SEQ ID NO: 2149088 - RNA, 11 nt, Homo sapiens
uccacccacag

SEQ ID NO: 2149089 - RNA, 23 nt, Homo sapiens
gccucacuuaugagaugccugaa

SEQ ID NO: 2149090 - RNA, 19 nt, Homo sapiens
guaacuccagcucugcucc

SEQ ID NO: 2149091 - RNA, 18 nt, Homo sapiens
cagcuggagaaauggcau

SEQ ID NO: 2149092 - RNA, 13 nt, Homo sapiens
cucaucacuagga

SEQ ID NO: 2149093 - RNA, 21 nt, Homo sapiens
aacagucccagaaugacccca

SEQ ID NO: 2149094 - RNA, 15 nt, Homo sapiens
ucuggaccccaaaga

SEQ ID NO: 2149095 - RNA, 13 nt, Homo sapiens
ucuccuccagugu

SEQ ID NO: 2149096 - RNA, 22 nt, Homo sapiens
cgggaaaagcagcccuuggcca

SEQ ID NO: 2149097 - RNA, 16 nt, Homo sapiens
uugcguagcucucaaa

SEQ ID NO: 2149098 - RNA, 13 nt, Homo sapiens
ugaagugccacau

SEQ ID NO: 2149099 - RNA, 13 nt, Homo sapiens
gaccaauauucaa

SEQ ID NO: 2149100 - RNA, 17 nt, Homo sapiens
acacaauccauugucau

SEQ ID NO: 2149101 - RNA, 14 nt, Homo sapiens
auccaccugcacaa

SEQ ID NO: 2149102 - RNA, 17 nt, Homo sapiens
aaguagcacccuggauu

SEQ ID NO: 2149103 - RNA, 18 nt, Homo sapiens
acguggugcauuuugcuu

SEQ ID NO: 2149104 - RNA, 18 nt, Homo sapiens
ucugccuuccuugcuaau

SEQ ID NO: 2149105 - RNA, 12 nt, Homo sapiens
ggcccccagugg

SEQ ID NO: 2149106 - RNA, 13 nt, Homo sapiens
aagaguaguaaua

SEQ ID NO: 2149107 - RNA, 14 nt, Homo sapiens
ccaaaagaauuaaa

SEQ ID NO: 2149108 - RNA, 14 nt, Homo sapiens
ccuuuagaauauua

SEQ ID NO: 2149109 - RNA, 14 nt, Homo sapiens
cuaaaugaacuaau

SEQ ID NO: 2149110 - RNA, 18 nt, Homo sapiens
ggauuccucaccaagcuc

SEQ ID NO: 2149111 - RNA, 18 nt, Homo sapiens
ccuacagaauacuagcca

SEQ ID NO: 2149112 - RNA, 18 nt, Homo sapiens
ccuuguuuuuaaucuccu

SEQ ID NO: 2149113 - RNA, 22 nt, Homo sapiens
guucugcaagcaucaguucuac

SEQ ID NO: 2149114 - RNA, 17 nt, Homo sapiens
gagacgggguuucacca

SEQ ID NO: 2149115 - RNA, 17 nt, Homo sapiens
uauguauuuuugucaua

SEQ ID NO: 2149116 - RNA, 21 nt, Homo sapiens
cuguaauaaauaugagugcca

SEQ ID NO: 2149117 - RNA, 20 nt, Homo sapiens
ccuuguucaauaauuacugu

SEQ ID NO: 2149118 - RNA, 19 nt, Homo sapiens
aaggaaaccgcugccuuua

SEQ ID NO: 2149119 - RNA, 18 nt, Homo sapiens
uccuccccacacuccacu

SEQ ID NO: 2149120 - RNA, 18 nt, Homo sapiens
caaugaccacauccugaa

SEQ ID NO: 2149121 - RNA, 20 nt, Homo sapiens
aacucuguauuacagcuuuc

SEQ ID NO: 2149122 - RNA, 14 nt, Homo sapiens
uaauguacaugggc

SEQ ID NO: 2149123 - RNA, 13 nt, Homo sapiens
caauuaaucauuu

SEQ ID NO: 2149124 - RNA, 15 nt, Homo sapiens
augaaaucuugcaau

SEQ ID NO: 2149125 - RNA, 18 nt, Homo sapiens
uaaaaguaaaggaugcuu

SEQ ID NO: 2149126 - RNA, 18 nt, Homo sapiens
cagauugaaaaguguccu

SEQ ID NO: 2149127 - RNA, 15 nt, Homo sapiens
auauccugugacugu

SEQ ID NO: 2149128 - RNA, 14 nt, Homo sapiens
cugcacacauaaca

SEQ ID NO: 2149129 - RNA, 23 nt, Homo sapiens
cuuacggucaugaugucugcaaa

SEQ ID NO: 2149130 - RNA, 15 nt, Homo sapiens
auuaucagaugcuuu

SEQ ID NO: 2149131 - RNA, 17 nt, Homo sapiens
acaaaaacaaaaaacca

SEQ ID NO: 2149132 - RNA, 22 nt, Homo sapiens
cucccucagacccaggggucca

SEQ ID NO: 2149133 - RNA, 13 nt, Homo sapiens
auugcuaccucuu

SEQ ID NO: 2149134 - RNA, 14 nt, Homo sapiens
ugcuucuccuccca

SEQ ID NO: 2149135 - RNA, 22 nt, Homo sapiens
ucuugaucuuuggaaugcaugc

SEQ ID NO: 2149136 - RNA, 23 nt, Homo sapiens
gacaggguuucaccguguuagcc

SEQ ID NO: 2149137 - RNA, 20 nt, Homo sapiens
ucacaggacucugcagauag

SEQ ID NO: 2149138 - RNA, 20 nt, Homo sapiens
cacuaaaaacuguuaaucag

SEQ ID NO: 2149139 - RNA, 20 nt, Homo sapiens
aacuaucauuuuuacacuau

SEQ ID NO: 2149140 - RNA, 13 nt, Homo sapiens
agcaauaaaagac

SEQ ID NO: 2149141 - RNA, 14 nt, Homo sapiens
cuuuugccuuucaa

SEQ ID NO: 2149142 - RNA, 16 nt, Homo sapiens
uguccuaaaaagacac

SEQ ID NO: 2149143 - RNA, 13 nt, Homo sapiens
ccaggcuggagac

SEQ ID NO: 2149144 - RNA, 15 nt, Homo sapiens
gucccaggcuuccca

SEQ ID NO: 2149145 - RNA, 16 nt, Homo sapiens
agaguugaugguugua

SEQ ID NO: 2149146 - RNA, 18 nt, Homo sapiens
ucacaugcuggacagguc

SEQ ID NO: 2149147 - RNA, 21 nt, Homo sapiens
accuucgacuucauuuugcca

SEQ ID NO: 2149148 - RNA, 21 nt, Homo sapiens
cuugcuaccaaucugugagaa

SEQ ID NO: 2149149 - RNA, 16 nt, Homo sapiens
cguucaaaaguggagu

SEQ ID NO: 2149150 - RNA, 13 nt, Homo sapiens
gaggccucaccau

SEQ ID NO: 2149151 - RNA, 14 nt, Homo sapiens
gacugccaagccau

SEQ ID NO: 2149152 - RNA, 21 nt, Homo sapiens
aaugauguuuuagaaugauuc

SEQ ID NO: 2149153 - RNA, 15 nt, Homo sapiens
ucaaaaacauucuua

SEQ ID NO: 2149154 - RNA, 14 nt, Homo sapiens
auucuguaauuaca

SEQ ID NO: 2149155 - RNA, 23 nt, Homo sapiens
cagacuugccaugugacucuggc

SEQ ID NO: 2149156 - RNA, 21 nt, Homo sapiens
agacuucucccauagcaaaga

SEQ ID NO: 2149157 - RNA, 15 nt, Homo sapiens
cgggcaaacuggccg

SEQ ID NO: 2149158 - RNA, 15 nt, Homo sapiens
uuuaaaauugcagca

SEQ ID NO: 2149159 - RNA, 14 nt, Homo sapiens
acacaggaaggaaa

SEQ ID NO: 2149160 - RNA, 19 nt, Homo sapiens
caacugcauugguuuucca

SEQ ID NO: 2149161 - RNA, 13 nt, Homo sapiens
aggaccaccaaug

SEQ ID NO: 2149162 - RNA, 14 nt, Homo sapiens
accucuacauuuga

SEQ ID NO: 2149163 - RNA, 21 nt, Homo sapiens
agagcaucugcaacaaaaagu

SEQ ID NO: 2149164 - RNA, 19 nt, Homo sapiens
uucuaaaauuacagacaaa

SEQ ID NO: 2149165 - RNA, 17 nt, Homo sapiens
gccaggggcgaggcccu

SEQ ID NO: 2149166 - RNA, 17 nt, Homo sapiens
gagaaacaaauaaacua

SEQ ID NO: 2149167 - RNA, 15 nt, Homo sapiens
uuccccaaaugaagg

SEQ ID NO: 2149168 - RNA, 11 nt, Homo sapiens
auaacauaaca

SEQ ID NO: 2149169 - RNA, 17 nt, Homo sapiens
acugccguccucaggug

SEQ ID NO: 2149170 - RNA, 23 nt, Homo sapiens
uuuuauaucuuggcagguaggaa

SEQ ID NO: 2149171 - RNA, 17 nt, Homo sapiens
ggaaacuggaugagguc

SEQ ID NO: 2149172 - RNA, 23 nt, Homo sapiens
uucacucccgaggauguguccua

SEQ ID NO: 2149173 - RNA, 17 nt, Homo sapiens
gauggagacaccaaccg

SEQ ID NO: 2149174 - RNA, 17 nt, Homo sapiens
agacaaagcauucuaaa

SEQ ID NO: 2149175 - RNA, 15 nt, Homo sapiens
gucacucauugcuga

SEQ ID NO: 2149176 - RNA, 20 nt, Homo sapiens
aaaggaacguugcagaagca

SEQ ID NO: 2149177 - RNA, 18 nt, Homo sapiens
ucugagacuaaaugagag

SEQ ID NO: 2149178 - RNA, 17 nt, Homo sapiens
acauaguuauucuauca

SEQ ID NO: 2149179 - RNA, 19 nt, Homo sapiens
cauucccccuuccuaguga

SEQ ID NO: 2149180 - RNA, 17 nt, Homo sapiens
ucggccaaacagacagg

SEQ ID NO: 2149181 - RNA, 15 nt, Homo sapiens
aaaagaacaaugaca

SEQ ID NO: 2149182 - RNA, 20 nt, Homo sapiens
ucuuuuuuuuuucgucuucc

SEQ ID NO: 2149183 - RNA, 22 nt, Homo sapiens
auagaaaacuugacauguagcu

SEQ ID NO: 2149184 - RNA, 13 nt, Homo sapiens
aguggucgaguga

SEQ ID NO: 2149185 - RNA, 19 nt, Homo sapiens
ccgugaagcaaucauuucc

SEQ ID NO: 2149186 - RNA, 20 nt, Homo sapiens
acagagccacgaguuuggau

SEQ ID NO: 2149187 - RNA, 23 nt, Homo sapiens
cuccaacgccccuguggccaacu

SEQ ID NO: 2149188 - RNA, 16 nt, Homo sapiens
accaaacccagccacu

SEQ ID NO: 2149189 - RNA, 22 nt, Homo sapiens
agagggaccaaauugcuucuag

SEQ ID NO: 2149190 - RNA, 23 nt, Homo sapiens
agaggggcagccaggacaucucu

SEQ ID NO: 2149191 - RNA, 17 nt, Homo sapiens
uaaaaccaaacaugcuu

SEQ ID NO: 2149192 - RNA, 19 nt, Homo sapiens
gacuccugggcuucagccu

SEQ ID NO: 2149193 - RNA, 12 nt, Homo sapiens
caggcccauuca

SEQ ID NO: 2149194 - RNA, 15 nt, Homo sapiens
ccuguggauguauau

SEQ ID NO: 2149195 - RNA, 18 nt, Homo sapiens
gugcgaauggacuuugga

SEQ ID NO: 2149196 - RNA, 22 nt, Homo sapiens
aauguuagaaaaauagcuguga

SEQ ID NO: 2149197 - RNA, 19 nt, Homo sapiens
ucuaccugccucagccucc

SEQ ID NO: 2149198 - RNA, 12 nt, Homo sapiens
cugcaagcucca

SEQ ID NO: 2149199 - RNA, 18 nt, Homo sapiens
ugcuuaggaaauugcuca

SEQ ID NO: 2149200 - RNA, 18 nt, Homo sapiens
cggggcuaggguaggggc

SEQ ID NO: 2149201 - RNA, 16 nt, Homo sapiens
uugcaacagaagcaaa

SEQ ID NO: 2149202 - RNA, 13 nt, Homo sapiens
gacaacacuggga

SEQ ID NO: 2149203 - RNA, 18 nt, Homo sapiens
gaaugcacucagacugua

SEQ ID NO: 2149204 - RNA, 19 nt, Homo sapiens
cccucugcucagccaagcu

SEQ ID NO: 2149205 - RNA, 12 nt, Homo sapiens
ugcagcaggaac

SEQ ID NO: 2149206 - RNA, 12 nt, Homo sapiens
cucucaacuuac

SEQ ID NO: 2149207 - RNA, 21 nt, Homo sapiens
accuauuucucuuucuuuaca

SEQ ID NO: 2149208 - RNA, 21 nt, Homo sapiens
uguuuuaaacucuccuaguca

SEQ ID NO: 2149209 - RNA, 21 nt, Homo sapiens
auaaucaaucauuucuauuaa

SEQ ID NO: 2149210 - RNA, 20 nt, Homo sapiens
ucaaaacgcacaagccagac

SEQ ID NO: 2149211 - RNA, 21 nt, Homo sapiens
guuucagcucacuuccuccag

SEQ ID NO: 2149212 - RNA, 13 nt, Homo sapiens
cugcagauuugau

SEQ ID NO: 2149213 - RNA, 21 nt, Homo sapiens
cuuuuaaacccuauugguaaa

SEQ ID NO: 2149214 - RNA, 23 nt, Homo sapiens
agugcccuggggcugaucucagg

SEQ ID NO: 2149215 - RNA, 15 nt, Homo sapiens
agcacagauggccag

SEQ ID NO: 2149216 - RNA, 22 nt, Homo sapiens
ggcacucagaaguugugcuaaa

SEQ ID NO: 2149217 - RNA, 16 nt, Homo sapiens
cugggacugugccugg

SEQ ID NO: 2149218 - RNA, 14 nt, Homo sapiens
uuaggguaauauca

SEQ ID NO: 2149219 - RNA, 20 nt, Homo sapiens
augcuuccuugccugaugac

SEQ ID NO: 2149220 - RNA, 20 nt, Homo sapiens
ggaauaucaaugcccaacag

SEQ ID NO: 2149221 - RNA, 15 nt, Homo sapiens
aguuucuucaugcau

SEQ ID NO: 2149222 - RNA, 16 nt, Homo sapiens
aaaagagaaugucucc

SEQ ID NO: 2149223 - RNA, 18 nt, Homo sapiens
uucuggaggaagaagaca

SEQ ID NO: 2149224 - RNA, 17 nt, Homo sapiens
caucugaaagugguacu

SEQ ID NO: 2149225 - RNA, 22 nt, Homo sapiens
gaagauuugauguugugaaaua

SEQ ID NO: 2149226 - RNA, 18 nt, Homo sapiens
acggaccgcauccuccag

SEQ ID NO: 2149227 - RNA, 20 nt, Homo sapiens
gaggccuuuccccagugugg

SEQ ID NO: 2149228 - RNA, 20 nt, Homo sapiens
guuugcacuccacacaucuu

SEQ ID NO: 2149229 - RNA, 19 nt, Homo sapiens
caguuggcaugcaucccac

SEQ ID NO: 2149230 - RNA, 18 nt, Homo sapiens
gcugaagaguaaaggaaa

SEQ ID NO: 2149231 - RNA, 20 nt, Homo sapiens
ggucugccucugagccacug

SEQ ID NO: 2149232 - RNA, 20 nt, Homo sapiens
uagcuaagaaauaaaacugu

SEQ ID NO: 2149233 - RNA, 18 nt, Homo sapiens
uguaucauuaugaaguca

SEQ ID NO: 2149234 - RNA, 15 nt, Homo sapiens
gauugcaauuugcac

SEQ ID NO: 2149235 - RNA, 17 nt, Homo sapiens
uaaugauguuaucuuaa

SEQ ID NO: 2149236 - RNA, 18 nt, Homo sapiens
acggccagggagaagcuc

SEQ ID NO: 2149237 - RNA, 12 nt, Homo sapiens
gagaugauuucc

SEQ ID NO: 2149238 - RNA, 13 nt, Homo sapiens
augaaacuugaaa

SEQ ID NO: 2149239 - RNA, 17 nt, Homo sapiens
cuucgacagcauuuucc

SEQ ID NO: 2149240 - RNA, 18 nt, Homo sapiens
uuucccagcccuuuccag

SEQ ID NO: 2149241 - RNA, 23 nt, Homo sapiens
gagaaacagagacaggcccaaga

SEQ ID NO: 2149242 - RNA, 13 nt, Homo sapiens
ucaaagaguccua

SEQ ID NO: 2149243 - RNA, 19 nt, Homo sapiens
gaaugaacaaaccugugau

SEQ ID NO: 2149244 - RNA, 18 nt, Homo sapiens
cugcucggccgucuucac

SEQ ID NO: 2149245 - RNA, 16 nt, Homo sapiens
aaaucaaauauauguc

SEQ ID NO: 2149246 - RNA, 17 nt, Homo sapiens
cagaaaagugacagugg

SEQ ID NO: 2149247 - RNA, 16 nt, Homo sapiens
acuuuuguaaacagcu

SEQ ID NO: 2149248 - RNA, 18 nt, Homo sapiens
accuugcuaagcacucua

SEQ ID NO: 2149249 - RNA, 20 nt, Homo sapiens
aauaaaacuuuuccaaugac

SEQ ID NO: 2149250 - RNA, 15 nt, Homo sapiens
uaauauugcagucaa

SEQ ID NO: 2149251 - RNA, 12 nt, Homo sapiens
ccuccacccucc

SEQ ID NO: 2149252 - RNA, 18 nt, Homo sapiens
aacguauuaguugccaau

SEQ ID NO: 2149253 - RNA, 15 nt, Homo sapiens
cucacaaacuugauu

SEQ ID NO: 2149254 - RNA, 12 nt, Homo sapiens
aaugucuaucaa

SEQ ID NO: 2149255 - RNA, 22 nt, Homo sapiens
ugaaaaauguaaauacucauga

SEQ ID NO: 2149256 - RNA, 22 nt, Homo sapiens
cauagcgcugcucuuaugccau

SEQ ID NO: 2149257 - RNA, 19 nt, Homo sapiens
acagaaggaggaaguggaa

SEQ ID NO: 2149258 - RNA, 14 nt, Homo sapiens
cagaauuaagugga

SEQ ID NO: 2149259 - RNA, 12 nt, Homo sapiens
ucuacugggacu

SEQ ID NO: 2149260 - RNA, 13 nt, Homo sapiens
ucugucaccaacu

SEQ ID NO: 2149261 - RNA, 22 nt, Homo sapiens
ugacaaaccauaacugacaaga

SEQ ID NO: 2149262 - RNA, 15 nt, Homo sapiens
cuauuacagaaauuc

SEQ ID NO: 2149263 - RNA, 16 nt, Homo sapiens
gaugagaaaggccuga

SEQ ID NO: 2149264 - RNA, 16 nt, Homo sapiens
cgccauugcacuccag

SEQ ID NO: 2149265 - RNA, 20 nt, Homo sapiens
cugcccuucauucagccuug

SEQ ID NO: 2149266 - RNA, 18 nt, Homo sapiens
gucaguuugguugggcua

SEQ ID NO: 2149267 - RNA, 19 nt, Homo sapiens
aaugcuuugguucuggguu

SEQ ID NO: 2149268 - RNA, 18 nt, Homo sapiens
caaggaugcauacauuuc

SEQ ID NO: 2149269 - RNA, 10 nt, Homo sapiens
ucuugccuug

SEQ ID NO: 2149270 - RNA, 17 nt, Homo sapiens
aguguccauugacaugu

SEQ ID NO: 2149271 - RNA, 12 nt, Homo sapiens
aaaaaauaccau

SEQ ID NO: 2149272 - RNA, 17 nt, Homo sapiens
uggaacaagacagccuu

SEQ ID NO: 2149273 - RNA, 14 nt, Homo sapiens
guggaaaauggaau

SEQ ID NO: 2149274 - RNA, 15 nt, Homo sapiens
agggcagcuuugcaa

SEQ ID NO: 2149275 - RNA, 15 nt, Homo sapiens
gaaaaaaaugcuucu

SEQ ID NO: 2149276 - RNA, 12 nt, Homo sapiens
ugacucuggaag

SEQ ID NO: 2149277 - RNA, 16 nt, Homo sapiens
cagacuuuuaccuacc

SEQ ID NO: 2149278 - RNA, 19 nt, Homo sapiens
cuuggaccucagugacuca

SEQ ID NO: 2149279 - RNA, 15 nt, Homo sapiens
agucugggugucuca

SEQ ID NO: 2149280 - RNA, 23 nt, Homo sapiens
ucuaauaaacagacuguuuucua

SEQ ID NO: 2149281 - RNA, 21 nt, Homo sapiens
auuuuguugccuucaucuuca

SEQ ID NO: 2149282 - RNA, 20 nt, Homo sapiens
ucagcucccugccuguuucc

SEQ ID NO: 2149283 - RNA, 12 nt, Homo sapiens
ucugugcuccaa

SEQ ID NO: 2149284 - RNA, 21 nt, Homo sapiens
uauaaauuggagaugcaaaua

SEQ ID NO: 2149285 - RNA, 15 nt, Homo sapiens
cucuuugcagugggg

SEQ ID NO: 2149286 - RNA, 15 nt, Homo sapiens
uccacgcacacaugg

SEQ ID NO: 2149287 - RNA, 15 nt, Homo sapiens
uaauuugaccaucuc

SEQ ID NO: 2149288 - RNA, 12 nt, Homo sapiens
aauacucugcag

SEQ ID NO: 2149289 - RNA, 23 nt, Homo sapiens
uaauuugaaugugguuacuuccu

SEQ ID NO: 2149290 - RNA, 23 nt, Homo sapiens
acaggcccuugggguucccccag

SEQ ID NO: 2149291 - RNA, 14 nt, Homo sapiens
uuacagacugugag

SEQ ID NO: 2149292 - RNA, 22 nt, Homo sapiens
ccacucacgaauauuaugccca

SEQ ID NO: 2149293 - RNA, 20 nt, Homo sapiens
uucuggauggugugccuucc

SEQ ID NO: 2149294 - RNA, 18 nt, Homo sapiens
cccggugguuugccaugu

SEQ ID NO: 2149295 - RNA, 21 nt, Homo sapiens
gagaagggguguucauagaag

SEQ ID NO: 2149296 - RNA, 22 nt, Homo sapiens
auacuagaaagcucugcaugug

SEQ ID NO: 2149297 - RNA, 19 nt, Homo sapiens
cauuauuuguaauagccaa

SEQ ID NO: 2149298 - RNA, 12 nt, Homo sapiens
uaaaugcauuag

SEQ ID NO: 2149299 - RNA, 18 nt, Homo sapiens
ccaaugcuuuguccauga

SEQ ID NO: 2149300 - RNA, 14 nt, Homo sapiens
auaauaauuacuua

SEQ ID NO: 2149301 - RNA, 23 nt, Homo sapiens
aggagggaugcguguuccagcca

SEQ ID NO: 2149302 - RNA, 13 nt, Homo sapiens
cuucuugugaaau

SEQ ID NO: 2149303 - RNA, 14 nt, Homo sapiens
uaggucugcagaug

SEQ ID NO: 2149304 - RNA, 14 nt, Homo sapiens
caaaccacuguuau

SEQ ID NO: 2149305 - RNA, 21 nt, Homo sapiens
aggcuggcagauuuccaaaag

SEQ ID NO: 2149306 - RNA, 14 nt, Homo sapiens
guacuuauguugca

SEQ ID NO: 2149307 - RNA, 16 nt, Homo sapiens
ucacgcaggcugaguc

SEQ ID NO: 2149308 - RNA, 12 nt, Homo sapiens
aaagcugccauu

SEQ ID NO: 2149309 - RNA, 14 nt, Homo sapiens
aaugcacacaaaac

SEQ ID NO: 2149310 - RNA, 21 nt, Homo sapiens
auaccuuacugagagcauguu

SEQ ID NO: 2149311 - RNA, 15 nt, Homo sapiens
caucccuuugguuaa

SEQ ID NO: 2149312 - RNA, 15 nt, Homo sapiens
acaaauccuaggcuc

SEQ ID NO: 2149313 - RNA, 17 nt, Homo sapiens
ucuucccuuaacuccaa

SEQ ID NO: 2149314 - RNA, 14 nt, Homo sapiens
cuccuuuugaccaa

SEQ ID NO: 2149315 - RNA, 11 nt, Homo sapiens
guuuccugaca

SEQ ID NO: 2149316 - RNA, 13 nt, Homo sapiens
cccacacugucca

SEQ ID NO: 2149317 - RNA, 22 nt, Homo sapiens
ugagcagaauacuggucucagg

SEQ ID NO: 2149318 - RNA, 17 nt, Homo sapiens
aaaugguagcauacuuu

SEQ ID NO: 2149319 - RNA, 14 nt, Homo sapiens
guaaacuccuccac

SEQ ID NO: 2149320 - RNA, 17 nt, Homo sapiens
gggccagggcaaugcca

SEQ ID NO: 2149321 - RNA, 16 nt, Homo sapiens
uggccagauuuccuca

SEQ ID NO: 2149322 - RNA, 21 nt, Homo sapiens
agagaagcaucauuuccccaa

SEQ ID NO: 2149323 - RNA, 16 nt, Homo sapiens
cuguggcaucuuugcc

SEQ ID NO: 2149324 - RNA, 22 nt, Homo sapiens
auagguaauuaaggcagcugaa

SEQ ID NO: 2149325 - RNA, 18 nt, Homo sapiens
uccgcaggcccacugucc

SEQ ID NO: 2149326 - RNA, 19 nt, Homo sapiens
cugagcacccagaacucca

SEQ ID NO: 2149327 - RNA, 15 nt, Homo sapiens
cacgcccagcuaauu

SEQ ID NO: 2149328 - RNA, 13 nt, Homo sapiens
auuccccuacauc

SEQ ID NO: 2149329 - RNA, 18 nt, Homo sapiens
cucaguuucccuaucucg

SEQ ID NO: 2149330 - RNA, 19 nt, Homo sapiens
aggaagccucuucaucucc

SEQ ID NO: 2149331 - RNA, 14 nt, Homo sapiens
cuaagacuuccuag

SEQ ID NO: 2149332 - RNA, 15 nt, Homo sapiens
cuaucuuuuugcuua

SEQ ID NO: 2149333 - RNA, 21 nt, Homo sapiens
uauggcuuucaaagcuaaaau

SEQ ID NO: 2149334 - RNA, 17 nt, Homo sapiens
agacagagaagaccaaa

SEQ ID NO: 2149335 - RNA, 18 nt, Homo sapiens
ugguggccuaauuuacaa

SEQ ID NO: 2149336 - RNA, 16 nt, Homo sapiens
gcguaaguacagagaa

SEQ ID NO: 2149337 - RNA, 14 nt, Homo sapiens
cuggguucacauga

SEQ ID NO: 2149338 - RNA, 13 nt, Homo sapiens
gauaaacuuugaa

SEQ ID NO: 2149339 - RNA, 19 nt, Homo sapiens
gcucccuggaagagaucaa

SEQ ID NO: 2149340 - RNA, 21 nt, Homo sapiens
acugcuuuuccaaacauucuc

SEQ ID NO: 2149341 - RNA, 12 nt, Homo sapiens
auaauacauuac

SEQ ID NO: 2149342 - RNA, 18 nt, Homo sapiens
ggaagucguuucaggaca

SEQ ID NO: 2149343 - RNA, 22 nt, Homo sapiens
uuuaaagugacauaauuuacau

SEQ ID NO: 2149344 - RNA, 18 nt, Homo sapiens
auuauucaagugccucuu

SEQ ID NO: 2149345 - RNA, 20 nt, Homo sapiens
uaaaaguuuacaacuugauu

SEQ ID NO: 2149346 - RNA, 13 nt, Homo sapiens
caagcuuccugug

SEQ ID NO: 2149347 - RNA, 17 nt, Homo sapiens
gaaaauaugucccagaa

SEQ ID NO: 2149348 - RNA, 19 nt, Homo sapiens
uuuguugugucuugcuaua

SEQ ID NO: 2149349 - RNA, 17 nt, Homo sapiens
uuaaugcaaaugacugu

SEQ ID NO: 2149350 - RNA, 19 nt, Homo sapiens
ccagaaaauaggguggaca

SEQ ID NO: 2149351 - RNA, 18 nt, Homo sapiens
aauuucugucaaaugcag

SEQ ID NO: 2149352 - RNA, 19 nt, Homo sapiens
ccagaaagcuucauccaca

SEQ ID NO: 2149353 - RNA, 15 nt, Homo sapiens
cagaagguugcucua

SEQ ID NO: 2149354 - RNA, 17 nt, Homo sapiens
ccugucaaacaaagcca

SEQ ID NO: 2149355 - RNA, 19 nt, Homo sapiens
cuuuaauggcccccaaaau

SEQ ID NO: 2149356 - RNA, 18 nt, Homo sapiens
ccuguucugcuuuccucu

SEQ ID NO: 2149357 - RNA, 15 nt, Homo sapiens
caaccuggacccaga

SEQ ID NO: 2149358 - RNA, 20 nt, Homo sapiens
caguguauuuuaaauucuca

SEQ ID NO: 2149359 - RNA, 11 nt, Homo sapiens
aaauccuugau

SEQ ID NO: 2149360 - RNA, 12 nt, Homo sapiens
gugagcaaaaau

SEQ ID NO: 2149361 - RNA, 15 nt, Homo sapiens
ugaccaagcaggaag

SEQ ID NO: 2149362 - RNA, 15 nt, Homo sapiens
cuacccuguucugua

SEQ ID NO: 2149363 - RNA, 15 nt, Homo sapiens
aaggccuccugugac

SEQ ID NO: 2149364 - RNA, 17 nt, Homo sapiens
gagacagauaccuccaa

SEQ ID NO: 2149365 - RNA, 17 nt, Homo sapiens
caggaaugaaggcuggg

SEQ ID NO: 2149366 - RNA, 17 nt, Homo sapiens
ggucgccaauccaugcu

SEQ ID NO: 2149367 - RNA, 14 nt, Homo sapiens
aauaaaauaauucu

SEQ ID NO: 2149368 - RNA, 18 nt, Homo sapiens
ugcuuuagcacaggacaa

SEQ ID NO: 2149369 - RNA, 19 nt, Homo sapiens
aaaaacugaaaauacuuag

SEQ ID NO: 2149370 - RNA, 21 nt, Homo sapiens
acuaaauguacagauaugcaa

SEQ ID NO: 2149371 - RNA, 13 nt, Homo sapiens
agaauuacauaaa

SEQ ID NO: 2149372 - RNA, 15 nt, Homo sapiens
cagagauggcuccuu

SEQ ID NO: 2149373 - RNA, 17 nt, Homo sapiens
uggaauggaauuggaca

SEQ ID NO: 2149374 - RNA, 18 nt, Homo sapiens
uuaaggcucugugccuug

SEQ ID NO: 2149375 - RNA, 21 nt, Homo sapiens
auucuucuccacuuucuagcc

SEQ ID NO: 2149376 - RNA, 15 nt, Homo sapiens
gacaguggcaccugg

SEQ ID NO: 2149377 - RNA, 14 nt, Homo sapiens
ugggagggggaccc

SEQ ID NO: 2149378 - RNA, 22 nt, Homo sapiens
cccucccagcccauugcugcca

SEQ ID NO: 2149379 - RNA, 21 nt, Homo sapiens
cagagccagccggcuaugaaa

SEQ ID NO: 2149380 - RNA, 18 nt, Homo sapiens
ucucucuacagagaggaa

SEQ ID NO: 2149381 - RNA, 18 nt, Homo sapiens
gggaauagaggaaugugu

SEQ ID NO: 2149382 - RNA, 18 nt, Homo sapiens
aaagagugaaggauuuau

SEQ ID NO: 2149383 - RNA, 23 nt, Homo sapiens
aagaaugugaugggccacaagga

SEQ ID NO: 2149384 - RNA, 14 nt, Homo sapiens
agcaaacuuugcau

SEQ ID NO: 2149385 - RNA, 23 nt, Homo sapiens
agaguaucaguugcaggugccaa

SEQ ID NO: 2149386 - RNA, 20 nt, Homo sapiens
agcucaggcgcagcccuagu

SEQ ID NO: 2149387 - RNA, 19 nt, Homo sapiens
gggccgccuccuccagacu

SEQ ID NO: 2149388 - RNA, 14 nt, Homo sapiens
agaaugacuuuuau

SEQ ID NO: 2149389 - RNA, 14 nt, Homo sapiens
ugugcaugcucaaa

SEQ ID NO: 2149390 - RNA, 14 nt, Homo sapiens
guagcuacaggaca

SEQ ID NO: 2149391 - RNA, 13 nt, Homo sapiens
uucauuaucacau

SEQ ID NO: 2149392 - RNA, 20 nt, Homo sapiens
ggcuggagugcagugaugca

SEQ ID NO: 2149393 - RNA, 19 nt, Homo sapiens
gcaccagcgguccaacgcc

SEQ ID NO: 2149394 - RNA, 14 nt, Homo sapiens
cuucuagaaaacau

SEQ ID NO: 2149395 - RNA, 19 nt, Homo sapiens
acaaaguccacuuuacuca

SEQ ID NO: 2149396 - RNA, 22 nt, Homo sapiens
ucacagcugauugggcaccuga

SEQ ID NO: 2149397 - RNA, 19 nt, Homo sapiens
gaauaugccuuguuucaua

SEQ ID NO: 2149398 - RNA, 23 nt, Homo sapiens
aacacugguuguagucaguuuug

SEQ ID NO: 2149399 - RNA, 15 nt, Homo sapiens
agggauuuucagccc

SEQ ID NO: 2149400 - RNA, 17 nt, Homo sapiens
accgcugcccagguggg

SEQ ID NO: 2149401 - RNA, 18 nt, Homo sapiens
acgugucuuccacuuugc

SEQ ID NO: 2149402 - RNA, 21 nt, Homo sapiens
aguagauuuuaaagacaaaau

SEQ ID NO: 2149403 - RNA, 18 nt, Homo sapiens
caucaucaaaaacuuugg

SEQ ID NO: 2149404 - RNA, 18 nt, Homo sapiens
cugcucccggcucugagg

SEQ ID NO: 2149405 - RNA, 17 nt, Homo sapiens
ucccccagccucaaguc

SEQ ID NO: 2149406 - RNA, 17 nt, Homo sapiens
ucuucagcacauuccac

SEQ ID NO: 2149407 - RNA, 23 nt, Homo sapiens
uggcuggucuucacuuuccucag

SEQ ID NO: 2149408 - RNA, 14 nt, Homo sapiens
aucuugaucugugu

SEQ ID NO: 2149409 - RNA, 19 nt, Homo sapiens
cagaaugcgcaagggcaaa

SEQ ID NO: 2149410 - RNA, 19 nt, Homo sapiens
cugguuucucagaauccaa

SEQ ID NO: 2149411 - RNA, 19 nt, Homo sapiens
auuauaaagccuucagagg

SEQ ID NO: 2149412 - RNA, 14 nt, Homo sapiens
acuuuguaugucau

SEQ ID NO: 2149413 - RNA, 14 nt, Homo sapiens
caaccaggccuuca

SEQ ID NO: 2149414 - RNA, 14 nt, Homo sapiens
acucuuccaccucc

SEQ ID NO: 2149415 - RNA, 21 nt, Homo sapiens
acaacuuccagagaagccaug

SEQ ID NO: 2149416 - RNA, 23 nt, Homo sapiens
aagauggagcucccccaucccac

SEQ ID NO: 2149417 - RNA, 13 nt, Homo sapiens
agauacauuucau

SEQ ID NO: 2149418 - RNA, 17 nt, Homo sapiens
uaacacuuuuugugaau

SEQ ID NO: 2149419 - RNA, 20 nt, Homo sapiens
cguguugcaugaaggagcag

SEQ ID NO: 2149420 - RNA, 18 nt, Homo sapiens
agacugaaagcagcagcu

SEQ ID NO: 2149421 - RNA, 18 nt, Homo sapiens
agaccugccugucuccca

SEQ ID NO: 2149422 - RNA, 18 nt, Homo sapiens
gugccaccacaccaggcu

SEQ ID NO: 2149423 - RNA, 17 nt, Homo sapiens
agguugcaaugagccaa

SEQ ID NO: 2149424 - RNA, 18 nt, Homo sapiens
agggauuucuuaauuuau

SEQ ID NO: 2149425 - RNA, 18 nt, Homo sapiens
caaccaccgagcaggcac

SEQ ID NO: 2149426 - RNA, 22 nt, Homo sapiens
ucuccucggacugugugcaggu

SEQ ID NO: 2149427 - RNA, 20 nt, Homo sapiens
ccaggcugaauuacagugaa

SEQ ID NO: 2149428 - RNA, 16 nt, Homo sapiens
cucugaggcuguagga

SEQ ID NO: 2149429 - RNA, 21 nt, Homo sapiens
cacugucauaaucucuuucca

SEQ ID NO: 2149430 - RNA, 16 nt, Homo sapiens
acucuuaagccaucuu

SEQ ID NO: 2149431 - RNA, 17 nt, Homo sapiens
gacccccucgccagcuu

SEQ ID NO: 2149432 - RNA, 10 nt, Homo sapiens
aaacuuguau

SEQ ID NO: 2149433 - RNA, 21 nt, Homo sapiens
ccaagguauugagacauauua

SEQ ID NO: 2149434 - RNA, 17 nt, Homo sapiens
guauguacuaagcagua

SEQ ID NO: 2149435 - RNA, 14 nt, Homo sapiens
agcuggcagugugc

SEQ ID NO: 2149436 - RNA, 21 nt, Homo sapiens
ccauguggaccauauuuugua

SEQ ID NO: 2149437 - RNA, 19 nt, Homo sapiens
uuuaacucuuugaaacugu

SEQ ID NO: 2149438 - RNA, 16 nt, Homo sapiens
uagaauuuaacaugac

SEQ ID NO: 2149439 - RNA, 17 nt, Homo sapiens
auauuuuagaaccacaa

SEQ ID NO: 2149440 - RNA, 22 nt, Homo sapiens
auguggguugagcuaugcagaa

SEQ ID NO: 2149441 - RNA, 20 nt, Homo sapiens
ccaugggaugucaacagcca

SEQ ID NO: 2149442 - RNA, 17 nt, Homo sapiens
gccauucuggacaccag

SEQ ID NO: 2149443 - RNA, 22 nt, Homo sapiens
agagacagaggaucaagggcuu

SEQ ID NO: 2149444 - RNA, 18 nt, Homo sapiens
augagaaaauggcuuuaa

SEQ ID NO: 2149445 - RNA, 17 nt, Homo sapiens
ccucaugaggccaugca

SEQ ID NO: 2149446 - RNA, 13 nt, Homo sapiens
ggcaguggcagag

SEQ ID NO: 2149447 - RNA, 19 nt, Homo sapiens
cucuuacagagccuugaga

SEQ ID NO: 2149448 - RNA, 13 nt, Homo sapiens
cuaucuagugucu

SEQ ID NO: 2149449 - RNA, 13 nt, Homo sapiens
gaccauccuugac

SEQ ID NO: 2149450 - RNA, 17 nt, Homo sapiens
cacccucccacugccaa

SEQ ID NO: 2149451 - RNA, 21 nt, Homo sapiens
gaugcaguucaaaaacaagac

SEQ ID NO: 2149452 - RNA, 15 nt, Homo sapiens
agaaaccuguaucuu

SEQ ID NO: 2149453 - RNA, 20 nt, Homo sapiens
aguacuuccucccagcauug

SEQ ID NO: 2149454 - RNA, 19 nt, Homo sapiens
ccucaugaaaacacacaua

SEQ ID NO: 2149455 - RNA, 14 nt, Homo sapiens
cuuuucacuacuuu

SEQ ID NO: 2149456 - RNA, 16 nt, Homo sapiens
agccuagcggagccca

SEQ ID NO: 2149457 - RNA, 14 nt, Homo sapiens
uucauuuccauugg

SEQ ID NO: 2149458 - RNA, 13 nt, Homo sapiens
aauaacugugaag

SEQ ID NO: 2149459 - RNA, 22 nt, Homo sapiens
agagaaaacagaccuaaugcuc

SEQ ID NO: 2149460 - RNA, 17 nt, Homo sapiens
ggaagacaagucugugg

SEQ ID NO: 2149461 - RNA, 22 nt, Homo sapiens
uucauugugagauugcaguucu

SEQ ID NO: 2149462 - RNA, 13 nt, Homo sapiens
caucuacuuagau

SEQ ID NO: 2149463 - RNA, 23 nt, Homo sapiens
aaaaacuagacuucguacuguga

SEQ ID NO: 2149464 - RNA, 17 nt, Homo sapiens
cuaauauguaacaagcc

SEQ ID NO: 2149465 - RNA, 13 nt, Homo sapiens
aaacucaucucau

SEQ ID NO: 2149466 - RNA, 13 nt, Homo sapiens
agaagguauuaag

SEQ ID NO: 2149467 - RNA, 18 nt, Homo sapiens
cccaugcucaaccacugu

SEQ ID NO: 2149468 - RNA, 15 nt, Homo sapiens
acuguucugucucau

SEQ ID NO: 2149469 - RNA, 20 nt, Homo sapiens
aaauaaaaagccucagugac

SEQ ID NO: 2149470 - RNA, 13 nt, Homo sapiens
aggagagagcagc

SEQ ID NO: 2149471 - RNA, 17 nt, Homo sapiens
agcaaaacuccaucuca

SEQ ID NO: 2149472 - RNA, 20 nt, Homo sapiens
uagcaaauggcagaaccaaa

SEQ ID NO: 2149473 - RNA, 16 nt, Homo sapiens
gaaccgaggcagggaa

SEQ ID NO: 2149474 - RNA, 20 nt, Homo sapiens
gcguaucaccauacccagcu

SEQ ID NO: 2149475 - RNA, 15 nt, Homo sapiens
agccauuggcacugu

SEQ ID NO: 2149476 - RNA, 15 nt, Homo sapiens
gcacugggagccaug

SEQ ID NO: 2149477 - RNA, 16 nt, Homo sapiens
cagggcacugcugcug

SEQ ID NO: 2149478 - RNA, 12 nt, Homo sapiens
caaaucucaguu

SEQ ID NO: 2149479 - RNA, 16 nt, Homo sapiens
acaccggguuccagca

SEQ ID NO: 2149480 - RNA, 22 nt, Homo sapiens
uaugugaaacuuuaucaucuuu

SEQ ID NO: 2149481 - RNA, 21 nt, Homo sapiens
ggugcaucuggcacguggcca

SEQ ID NO: 2149482 - RNA, 21 nt, Homo sapiens
uuugaaaucaguaaacacugu

SEQ ID NO: 2149483 - RNA, 15 nt, Homo sapiens
uaauuuaauuuagug

SEQ ID NO: 2149484 - RNA, 16 nt, Homo sapiens
cagcacagugccugac

SEQ ID NO: 2149485 - RNA, 15 nt, Homo sapiens
acccuggaccgagug

SEQ ID NO: 2149486 - RNA, 11 nt, Homo sapiens
ugggaaaaccu

SEQ ID NO: 2149487 - RNA, 17 nt, Homo sapiens
ccauuuauccacaggaa

SEQ ID NO: 2149488 - RNA, 14 nt, Homo sapiens
uaacuggggggcca

SEQ ID NO: 2149489 - RNA, 15 nt, Homo sapiens
guacaaaagcacugg

SEQ ID NO: 2149490 - RNA, 22 nt, Homo sapiens
gcuguauuuugaaaaugcuuua

SEQ ID NO: 2149491 - RNA, 16 nt, Homo sapiens
cuaccaagauauaccu

SEQ ID NO: 2149492 - RNA, 20 nt, Homo sapiens
ugaaaugagcaccuccauua

SEQ ID NO: 2149493 - RNA, 14 nt, Homo sapiens
uucaaguacuguaa

SEQ ID NO: 2149494 - RNA, 15 nt, Homo sapiens
aauuuaacugccuaa

SEQ ID NO: 2149495 - RNA, 23 nt, Homo sapiens
gguuacacuguuagaacacuauu

SEQ ID NO: 2149496 - RNA, 14 nt, Homo sapiens
ucuguuauuguuga

SEQ ID NO: 2149497 - RNA, 19 nt, Homo sapiens
uguucccuuaggagcaaaa

SEQ ID NO: 2149498 - RNA, 18 nt, Homo sapiens
agaugguggugagcacau

SEQ ID NO: 2149499 - RNA, 17 nt, Homo sapiens
cuagaguccucacuccc

SEQ ID NO: 2149500 - RNA, 16 nt, Homo sapiens
cugagaacacugugaa

SEQ ID NO: 2149501 - RNA, 13 nt, Homo sapiens
caaaaaucaucaa

SEQ ID NO: 2149502 - RNA, 14 nt, Homo sapiens
ccaaggagggugag

SEQ ID NO: 2149503 - RNA, 17 nt, Homo sapiens
auauauuuaauauguca

SEQ ID NO: 2149504 - RNA, 14 nt, Homo sapiens
ucugaacuguuaca

SEQ ID NO: 2149505 - RNA, 16 nt, Homo sapiens
ucaggccagggcucac

SEQ ID NO: 2149506 - RNA, 16 nt, Homo sapiens
acuccagcucugagac

SEQ ID NO: 2149507 - RNA, 15 nt, Homo sapiens
gccgagagcauugga

SEQ ID NO: 2149508 - RNA, 18 nt, Homo sapiens
uuauuucaaccagcacau

SEQ ID NO: 2149509 - RNA, 16 nt, Homo sapiens
ggcagcauuuagcaca

SEQ ID NO: 2149510 - RNA, 14 nt, Homo sapiens
acccacucaugacu

SEQ ID NO: 2149511 - RNA, 23 nt, Homo sapiens
aauguuuaaaccuuuuacguuaa

SEQ ID NO: 2149512 - RNA, 18 nt, Homo sapiens
ccacugacuauaccaacu

SEQ ID NO: 2149513 - RNA, 19 nt, Homo sapiens
aacuggguacuuguggaca

SEQ ID NO: 2149514 - RNA, 15 nt, Homo sapiens
ccuugagucucugaa

SEQ ID NO: 2149515 - RNA, 22 nt, Homo sapiens
ccaggugaucccccaaacagca

SEQ ID NO: 2149516 - RNA, 14 nt, Homo sapiens
ggccaacaugucag

SEQ ID NO: 2149517 - RNA, 14 nt, Homo sapiens
uaaauauagugaag

SEQ ID NO: 2149518 - RNA, 20 nt, Homo sapiens
cuagauuuuuaagagaauua

SEQ ID NO: 2149519 - RNA, 17 nt, Homo sapiens
uuagcugcucacuuaaa

SEQ ID NO: 2149520 - RNA, 19 nt, Homo sapiens
ugcagccgugaucaaggga

SEQ ID NO: 2149521 - RNA, 18 nt, Homo sapiens
ugacacauuuucaaguga

SEQ ID NO: 2149522 - RNA, 23 nt, Homo sapiens
uuucaaagaaggaauucuaggca

SEQ ID NO: 2149523 - RNA, 21 nt, Homo sapiens
aauuugacugucugauauuau

SEQ ID NO: 2149524 - RNA, 18 nt, Homo sapiens
agacucuaaauauuucau

SEQ ID NO: 2149525 - RNA, 23 nt, Homo sapiens
ccuuuguccuccugcugccagua

SEQ ID NO: 2149526 - RNA, 17 nt, Homo sapiens
gaccuuuuaagugaaaa

SEQ ID NO: 2149527 - RNA, 20 nt, Homo sapiens
uacucuuaagccaucuuggu

SEQ ID NO: 2149528 - RNA, 18 nt, Homo sapiens
ucacucuugaaguccagg

SEQ ID NO: 2149529 - RNA, 17 nt, Homo sapiens
caauugaacuuccagga

SEQ ID NO: 2149530 - RNA, 23 nt, Homo sapiens
agacuugaaauacuacuuaccau

SEQ ID NO: 2149531 - RNA, 12 nt, Homo sapiens
acuggaguggag

SEQ ID NO: 2149532 - RNA, 21 nt, Homo sapiens
gucacccaaacacuucugcuu

SEQ ID NO: 2149533 - RNA, 17 nt, Homo sapiens
cucagagaccagcacuc

SEQ ID NO: 2149534 - RNA, 14 nt, Homo sapiens
aauguuuaccauga

SEQ ID NO: 2149535 - RNA, 20 nt, Homo sapiens
uuugaccaaauaaaguacca

SEQ ID NO: 2149536 - RNA, 11 nt, Homo sapiens
acccuagccuc

SEQ ID NO: 2149537 - RNA, 20 nt, Homo sapiens
caaaaguggggcuaaaugaa

SEQ ID NO: 2149538 - RNA, 12 nt, Homo sapiens
ucaaagugcugg

SEQ ID NO: 2149539 - RNA, 17 nt, Homo sapiens
aguaaugugucauauca

SEQ ID NO: 2149540 - RNA, 21 nt, Homo sapiens
ugagcuucuaacucauuguau

SEQ ID NO: 2149541 - RNA, 22 nt, Homo sapiens
gucuuucccuggugaugguccc

SEQ ID NO: 2149542 - RNA, 14 nt, Homo sapiens
uagugcaucagaug

SEQ ID NO: 2149543 - RNA, 13 nt, Homo sapiens
acaacuaccuaug

SEQ ID NO: 2149544 - RNA, 22 nt, Homo sapiens
ucuggaaaggaaacauugccau

SEQ ID NO: 2149545 - RNA, 19 nt, Homo sapiens
aagugaagaaucuaaugaa

SEQ ID NO: 2149546 - RNA, 19 nt, Homo sapiens
aauugugugaacuuggaag

SEQ ID NO: 2149547 - RNA, 21 nt, Homo sapiens
caaagaauuucuucaguccag

SEQ ID NO: 2149548 - RNA, 14 nt, Homo sapiens
cagcccugagcugg

SEQ ID NO: 2149549 - RNA, 15 nt, Homo sapiens
uaggcagggcucucu

SEQ ID NO: 2149550 - RNA, 16 nt, Homo sapiens
agcgauucucaugccu

SEQ ID NO: 2149551 - RNA, 14 nt, Homo sapiens
acuuugauucacau

SEQ ID NO: 2149552 - RNA, 20 nt, Homo sapiens
uuuugggacauuugcauuca

SEQ ID NO: 2149553 - RNA, 20 nt, Homo sapiens
aaucucaaaacuguacuguc

SEQ ID NO: 2149554 - RNA, 14 nt, Homo sapiens
guguguugauccca

SEQ ID NO: 2149555 - RNA, 20 nt, Homo sapiens
acaucaaagagcacauuuac

SEQ ID NO: 2149556 - RNA, 20 nt, Homo sapiens
accuuuccauuuauucuuug

SEQ ID NO: 2149557 - RNA, 15 nt, Homo sapiens
gaaucucugugccuu

SEQ ID NO: 2149558 - RNA, 15 nt, Homo sapiens
acucaccugcacuaa

SEQ ID NO: 2149559 - RNA, 20 nt, Homo sapiens
cauggugaaaccucaucucu

SEQ ID NO: 2149560 - RNA, 13 nt, Homo sapiens
aaacacacaucca

SEQ ID NO: 2149561 - RNA, 21 nt, Homo sapiens
augaaccacauagacuuuaug

SEQ ID NO: 2149562 - RNA, 14 nt, Homo sapiens
cccuccgaccacuu

SEQ ID NO: 2149563 - RNA, 14 nt, Homo sapiens
aggacaacaucagc

SEQ ID NO: 2149564 - RNA, 17 nt, Homo sapiens
ugcacaaugucuuggua

SEQ ID NO: 2149565 - RNA, 12 nt, Homo sapiens
cugcagcuccuc

SEQ ID NO: 2149566 - RNA, 15 nt, Homo sapiens
cuuggcucaccugaa

SEQ ID NO: 2149567 - RNA, 17 nt, Homo sapiens
cucccugggucugggga

SEQ ID NO: 2149568 - RNA, 21 nt, Homo sapiens
cagggcuauauuucagugaca

SEQ ID NO: 2149569 - RNA, 17 nt, Homo sapiens
auuucccaucuggaccu

SEQ ID NO: 2149570 - RNA, 23 nt, Homo sapiens
auauacuaaauguauuuuagacu

SEQ ID NO: 2149571 - RNA, 23 nt, Homo sapiens
aaaguuagucaauccugucauau

SEQ ID NO: 2149572 - RNA, 15 nt, Homo sapiens
aagaucaagccaguu

SEQ ID NO: 2149573 - RNA, 12 nt, Homo sapiens
aguuaauuugca

SEQ ID NO: 2149574 - RNA, 14 nt, Homo sapiens
acaaccagauuuga

SEQ ID NO: 2149575 - RNA, 21 nt, Homo sapiens
cugcgcuuccaaaagcaaaug

SEQ ID NO: 2149576 - RNA, 14 nt, Homo sapiens
caguguguccaguu

SEQ ID NO: 2149577 - RNA, 20 nt, Homo sapiens
aaagggucuuaugaaacaau

SEQ ID NO: 2149578 - RNA, 20 nt, Homo sapiens
caaggaaaaacaggucuuca

SEQ ID NO: 2149579 - RNA, 13 nt, Homo sapiens
guuguuucaguga

SEQ ID NO: 2149580 - RNA, 21 nt, Homo sapiens
ugggacucauucacauuucaa

SEQ ID NO: 2149581 - RNA, 15 nt, Homo sapiens
gccucagccuuccaa

SEQ ID NO: 2149582 - RNA, 13 nt, Homo sapiens
aguacagacuuuu

SEQ ID NO: 2149583 - RNA, 22 nt, Homo sapiens
caacaaauuucauugcacuuuc

SEQ ID NO: 2149584 - RNA, 16 nt, Homo sapiens
uugguccaagauuccg

SEQ ID NO: 2149585 - RNA, 19 nt, Homo sapiens
ucuuguguuuuugucuuau

SEQ ID NO: 2149586 - RNA, 13 nt, Homo sapiens
uagaaacuacaaa

SEQ ID NO: 2149587 - RNA, 14 nt, Homo sapiens
ugaauuuuugcaau

SEQ ID NO: 2149588 - RNA, 21 nt, Homo sapiens
aguauuuaacuacaucugccu

SEQ ID NO: 2149589 - RNA, 18 nt, Homo sapiens
auuucagggaagcccuga

SEQ ID NO: 2149590 - RNA, 16 nt, Homo sapiens
uuugagcaaaccacau

SEQ ID NO: 2149591 - RNA, 14 nt, Homo sapiens
augcacuaagacaa

SEQ ID NO: 2149592 - RNA, 21 nt, Homo sapiens
gauacuuggaugcagcucuug

SEQ ID NO: 2149593 - RNA, 18 nt, Homo sapiens
cacuauucagaagacaca

SEQ ID NO: 2149594 - RNA, 21 nt, Homo sapiens
uugccaaaauaucauguucaa

SEQ ID NO: 2149595 - RNA, 20 nt, Homo sapiens
gacacucagaguaaugucua

SEQ ID NO: 2149596 - RNA, 16 nt, Homo sapiens
uguuggcaugcaagau

SEQ ID NO: 2149597 - RNA, 15 nt, Homo sapiens
uggaacuguguuuca

SEQ ID NO: 2149598 - RNA, 20 nt, Homo sapiens
augguggugagcaccuguaa

SEQ ID NO: 2149599 - RNA, 20 nt, Homo sapiens
cuauaaagaagaacuugcau

SEQ ID NO: 2149600 - RNA, 19 nt, Homo sapiens
acauuuucguccuguagca

SEQ ID NO: 2149601 - RNA, 14 nt, Homo sapiens
agagcacaaacuuc

SEQ ID NO: 2149602 - RNA, 18 nt, Homo sapiens
acaccuuaagaagucuau

SEQ ID NO: 2149603 - RNA, 19 nt, Homo sapiens
cagugcccaugaaugggac

SEQ ID NO: 2149604 - RNA, 18 nt, Homo sapiens
uaaagcuucucucugagc

SEQ ID NO: 2149605 - RNA, 18 nt, Homo sapiens
agccuuggaccaaaugga

SEQ ID NO: 2149606 - RNA, 18 nt, Homo sapiens
caccuuugggcaaaggcc

SEQ ID NO: 2149607 - RNA, 13 nt, Homo sapiens
agugcugggauga

SEQ ID NO: 2149608 - RNA, 21 nt, Homo sapiens
cuuuggucaauauuugaucua

SEQ ID NO: 2149609 - RNA, 22 nt, Homo sapiens
uauugaggccaagaauauugca

SEQ ID NO: 2149610 - RNA, 14 nt, Homo sapiens
gcggggugcagaag

SEQ ID NO: 2149611 - RNA, 13 nt, Homo sapiens
uucagccaugaua

SEQ ID NO: 2149612 - RNA, 22 nt, Homo sapiens
cuuuaaagccagucaucaucuc

SEQ ID NO: 2149613 - RNA, 17 nt, Homo sapiens
cccugucucuacaaaaa

SEQ ID NO: 2149614 - RNA, 12 nt, Homo sapiens
gaugguccugca

SEQ ID NO: 2149615 - RNA, 17 nt, Homo sapiens
gaaggaagcuguguuga

SEQ ID NO: 2149616 - RNA, 15 nt, Homo sapiens
aguaacuccccucag

SEQ ID NO: 2149617 - RNA, 22 nt, Homo sapiens
gcgaggugggagaggccucauc

SEQ ID NO: 2149618 - RNA, 15 nt, Homo sapiens
uuaacaguuuuccau

SEQ ID NO: 2149619 - RNA, 15 nt, Homo sapiens
ccagauuuccuuuca

SEQ ID NO: 2149620 - RNA, 22 nt, Homo sapiens
auuuacaggaacuucaucauaa

SEQ ID NO: 2149621 - RNA, 22 nt, Homo sapiens
uucuaggauaagcacuagaucu

SEQ ID NO: 2149622 - RNA, 18 nt, Homo sapiens
aaaauugccaucauucua

SEQ ID NO: 2149623 - RNA, 17 nt, Homo sapiens
acuuaaaaaaaugacag

SEQ ID NO: 2149624 - RNA, 18 nt, Homo sapiens
agcaaucucgcaguacau

SEQ ID NO: 2149625 - RNA, 17 nt, Homo sapiens
cugaaauagaggcuaaa

SEQ ID NO: 2149626 - RNA, 19 nt, Homo sapiens
agcugauccagagcacaga

SEQ ID NO: 2149627 - RNA, 17 nt, Homo sapiens
uggaggagaaggacauu

SEQ ID NO: 2149628 - RNA, 16 nt, Homo sapiens
aacuaucucagcauca

SEQ ID NO: 2149629 - RNA, 18 nt, Homo sapiens
ugggagaaucacuugaac

SEQ ID NO: 2149630 - RNA, 17 nt, Homo sapiens
ugcccaucaagugcagu

SEQ ID NO: 2149631 - RNA, 17 nt, Homo sapiens
cccaaauagcagcacag

SEQ ID NO: 2149632 - RNA, 17 nt, Homo sapiens
gagggaggcucaggucc

SEQ ID NO: 2149633 - RNA, 13 nt, Homo sapiens
caucaccaugaac

SEQ ID NO: 2149634 - RNA, 20 nt, Homo sapiens
uccuguggccugcucaucac

SEQ ID NO: 2149635 - RNA, 14 nt, Homo sapiens
aggagaaucacuug

SEQ ID NO: 2149636 - RNA, 18 nt, Homo sapiens
aauguggcuccaagcuca

SEQ ID NO: 2149637 - RNA, 21 nt, Homo sapiens
aaguauaucucuagaugcaaa

SEQ ID NO: 2149638 - RNA, 15 nt, Homo sapiens
ucuuauuuugcauuc

SEQ ID NO: 2149639 - RNA, 20 nt, Homo sapiens
aaucuaaaguugcuccauac

SEQ ID NO: 2149640 - RNA, 22 nt, Homo sapiens
augcaaccgggcccucucucug

SEQ ID NO: 2149641 - RNA, 22 nt, Homo sapiens
uacaauugcaguuuugccuaau

SEQ ID NO: 2149642 - RNA, 21 nt, Homo sapiens
uucugaaagaaucauuugcau

SEQ ID NO: 2149643 - RNA, 17 nt, Homo sapiens
guccuaauaauauccca

SEQ ID NO: 2149644 - RNA, 13 nt, Homo sapiens
aacuguauuugau

SEQ ID NO: 2149645 - RNA, 20 nt, Homo sapiens
accuguuccauuguugucaa

SEQ ID NO: 2149646 - RNA, 20 nt, Homo sapiens
uaugaauaaagaaugccauu

SEQ ID NO: 2149647 - RNA, 22 nt, Homo sapiens
ggggccggggacuggccacuga

SEQ ID NO: 2149648 - RNA, 14 nt, Homo sapiens
aauacacauuugcu

SEQ ID NO: 2149649 - RNA, 18 nt, Homo sapiens
uaauuuccccacucugag

SEQ ID NO: 2149650 - RNA, 23 nt, Homo sapiens
guguuauuauuuggcaugcuuaa

SEQ ID NO: 2149651 - RNA, 17 nt, Homo sapiens
cagugagccaugaucau

SEQ ID NO: 2149652 - RNA, 17 nt, Homo sapiens
uauacacauacauauau

SEQ ID NO: 2149653 - RNA, 19 nt, Homo sapiens
uuaaaaaaaaaaaguacaa

SEQ ID NO: 2149654 - RNA, 13 nt, Homo sapiens
ucuauuuaugcaa

SEQ ID NO: 2149655 - RNA, 21 nt, Homo sapiens
uuaauaaaaauuauuaccagu

SEQ ID NO: 2149656 - RNA, 21 nt, Homo sapiens
cugcaaccuccuucggcuuug

SEQ ID NO: 2149657 - RNA, 21 nt, Homo sapiens
uguugaguuuuuagagcucuu

SEQ ID NO: 2149658 - RNA, 22 nt, Homo sapiens
augauuaucuugauuucccaaa

SEQ ID NO: 2149659 - RNA, 15 nt, Homo sapiens
uggugaaaagcucca

SEQ ID NO: 2149660 - RNA, 16 nt, Homo sapiens
gcaccuucacucucca

SEQ ID NO: 2149661 - RNA, 16 nt, Homo sapiens
ccaggauugugcaaua

SEQ ID NO: 2149662 - RNA, 19 nt, Homo sapiens
gaaaaucugcacugugggc

SEQ ID NO: 2149663 - RNA, 17 nt, Homo sapiens
cuuacaguuauccugca

SEQ ID NO: 2149664 - RNA, 15 nt, Homo sapiens
uguguucaugcacac

SEQ ID NO: 2149665 - RNA, 18 nt, Homo sapiens
gauuacagacaugaacca

SEQ ID NO: 2149666 - RNA, 20 nt, Homo sapiens
aaagcaguggcuccauuggu

SEQ ID NO: 2149667 - RNA, 13 nt, Homo sapiens
ccaaagcuauaug

SEQ ID NO: 2149668 - RNA, 11 nt, Homo sapiens
ucuuagcuguc

SEQ ID NO: 2149669 - RNA, 22 nt, Homo sapiens
aguuccgucagaaaguguaaau

SEQ ID NO: 2149670 - RNA, 13 nt, Homo sapiens
uguucuucacuuc

SEQ ID NO: 2149671 - RNA, 13 nt, Homo sapiens
ugaaauucacaaa

SEQ ID NO: 2149672 - RNA, 13 nt, Homo sapiens
agacauucucaca

SEQ ID NO: 2149673 - RNA, 14 nt, Homo sapiens
uccucuugcucaaa

SEQ ID NO: 2149674 - RNA, 18 nt, Homo sapiens
cgugucccgcggugcuga

SEQ ID NO: 2149675 - RNA, 19 nt, Homo sapiens
uuacugagggccaccaaau

SEQ ID NO: 2149676 - RNA, 15 nt, Homo sapiens
gccacuggaccucag

SEQ ID NO: 2149677 - RNA, 20 nt, Homo sapiens
uauuaaggaagacaauguga

SEQ ID NO: 2149678 - RNA, 23 nt, Homo sapiens
ggaaugaguugaggccacugugu

SEQ ID NO: 2149679 - RNA, 14 nt, Homo sapiens
aaauuuguuugaca

SEQ ID NO: 2149680 - RNA, 21 nt, Homo sapiens
aauaaaaaguacaaagggcac

SEQ ID NO: 2149681 - RNA, 15 nt, Homo sapiens
aaccucagcuagcuc

SEQ ID NO: 2149682 - RNA, 16 nt, Homo sapiens
caucuccacccugagc

SEQ ID NO: 2149683 - RNA, 13 nt, Homo sapiens
caugaaacagagu

SEQ ID NO: 2149684 - RNA, 17 nt, Homo sapiens
auuguaauguucauuuc

SEQ ID NO: 2149685 - RNA, 15 nt, Homo sapiens
augugguugcauccu

SEQ ID NO: 2149686 - RNA, 17 nt, Homo sapiens
cucaguaacagugcagu

SEQ ID NO: 2149687 - RNA, 17 nt, Homo sapiens
uuucuggcagccaguac

SEQ ID NO: 2149688 - RNA, 15 nt, Homo sapiens
cuuucuuacacugaa

SEQ ID NO: 2149689 - RNA, 22 nt, Homo sapiens
augcaagaacucaucacugugg

SEQ ID NO: 2149690 - RNA, 12 nt, Homo sapiens
uugcuuuugccu

SEQ ID NO: 2149691 - RNA, 14 nt, Homo sapiens
agcgucuugcucug

SEQ ID NO: 2149692 - RNA, 16 nt, Homo sapiens
cuuuuugguuugauca

SEQ ID NO: 2149693 - RNA, 23 nt, Homo sapiens
caucacggauggugcaugggcuc

SEQ ID NO: 2149694 - RNA, 12 nt, Homo sapiens
ugaucaugguca

SEQ ID NO: 2149695 - RNA, 14 nt, Homo sapiens
ccucaugucaucaa

SEQ ID NO: 2149696 - RNA, 16 nt, Homo sapiens
cucagcuuuuaaaugg

SEQ ID NO: 2149697 - RNA, 12 nt, Homo sapiens
agaauacauauu

SEQ ID NO: 2149698 - RNA, 15 nt, Homo sapiens
gaaugcgggggagca

SEQ ID NO: 2149699 - RNA, 13 nt, Homo sapiens
agccugcagggaa

SEQ ID NO: 2149700 - RNA, 14 nt, Homo sapiens
ucuugguucuuauu

SEQ ID NO: 2149701 - RNA, 23 nt, Homo sapiens
ucauuagaggaagaaaaccagcg

SEQ ID NO: 2149702 - RNA, 16 nt, Homo sapiens
ccuagaagauacaaua

SEQ ID NO: 2149703 - RNA, 17 nt, Homo sapiens
uauuuucauucugccaa

SEQ ID NO: 2149704 - RNA, 20 nt, Homo sapiens
aacauauagcagaccaaucu

SEQ ID NO: 2149705 - RNA, 14 nt, Homo sapiens
auuccaacuugaag

SEQ ID NO: 2149706 - RNA, 19 nt, Homo sapiens
gcccggugccaucuuccau

SEQ ID NO: 2149707 - RNA, 13 nt, Homo sapiens
agaaacugccauu

SEQ ID NO: 2149708 - RNA, 12 nt, Homo sapiens
aauucuguuaca

SEQ ID NO: 2149709 - RNA, 16 nt, Homo sapiens
cccaggguagacuuug

SEQ ID NO: 2149710 - RNA, 15 nt, Homo sapiens
cacagcacuaauuca

SEQ ID NO: 2149711 - RNA, 19 nt, Homo sapiens
acacauugaguuggaauca

SEQ ID NO: 2149712 - RNA, 19 nt, Homo sapiens
gcccuuggcaccaccaggg

SEQ ID NO: 2149713 - RNA, 17 nt, Homo sapiens
uauguaauggaacuuag

SEQ ID NO: 2149714 - RNA, 17 nt, Homo sapiens
ccuuccaagcuguguua

SEQ ID NO: 2149715 - RNA, 19 nt, Homo sapiens
cauaaccacccuagcuuua

SEQ ID NO: 2149716 - RNA, 19 nt, Homo sapiens
cccuuccuggucuuugaau

SEQ ID NO: 2149717 - RNA, 13 nt, Homo sapiens
aagcaguccuccu

SEQ ID NO: 2149718 - RNA, 21 nt, Homo sapiens
gcaggugcuucaggauaccau

SEQ ID NO: 2149719 - RNA, 16 nt, Homo sapiens
aagucuuagacuugaa

SEQ ID NO: 2149720 - RNA, 16 nt, Homo sapiens
aggaaaacugggacau

SEQ ID NO: 2149721 - RNA, 17 nt, Homo sapiens
ccugaaccugggaacca

SEQ ID NO: 2149722 - RNA, 22 nt, Homo sapiens
auguacauccauggugugcugg

SEQ ID NO: 2149723 - RNA, 17 nt, Homo sapiens
auuuucuacaaccuaag

SEQ ID NO: 2149724 - RNA, 17 nt, Homo sapiens
uacaauagacauugcaa

SEQ ID NO: 2149725 - RNA, 13 nt, Homo sapiens
cugggacuuucac

SEQ ID NO: 2149726 - RNA, 16 nt, Homo sapiens
caucugguaucaucuu

SEQ ID NO: 2149727 - RNA, 15 nt, Homo sapiens
aacauguuucacuua

SEQ ID NO: 2149728 - RNA, 16 nt, Homo sapiens
cauaaagacaaucacu

SEQ ID NO: 2149729 - RNA, 22 nt, Homo sapiens
ucucagaucacugcaaccucug

SEQ ID NO: 2149730 - RNA, 18 nt, Homo sapiens
agaaaauugcaugaaacu

SEQ ID NO: 2149731 - RNA, 13 nt, Homo sapiens
aucaggacgagaa

SEQ ID NO: 2149732 - RNA, 13 nt, Homo sapiens
cugaaugaucuau

SEQ ID NO: 2149733 - RNA, 16 nt, Homo sapiens
acacacagagauaugc

SEQ ID NO: 2149734 - RNA, 23 nt, Homo sapiens
guuccuaacuggaaucagcucag

SEQ ID NO: 2149735 - RNA, 23 nt, Homo sapiens
uagaguuuggaaucccacuaaug

SEQ ID NO: 2149736 - RNA, 20 nt, Homo sapiens
aaaugccacuucaccaagga

SEQ ID NO: 2149737 - RNA, 23 nt, Homo sapiens
auucaccuugguguuucucucug

SEQ ID NO: 2149738 - RNA, 19 nt, Homo sapiens
gcccuugcuccagccugac

SEQ ID NO: 2149739 - RNA, 22 nt, Homo sapiens
aaguuguugacugugauuagau

SEQ ID NO: 2149740 - RNA, 16 nt, Homo sapiens
uuaaauaaaucaagaa

SEQ ID NO: 2149741 - RNA, 17 nt, Homo sapiens
ugaagauguaaggaauu

SEQ ID NO: 2149742 - RNA, 17 nt, Homo sapiens
ugccuucaacaacguga

SEQ ID NO: 2149743 - RNA, 13 nt, Homo sapiens
ugagauauggacu

SEQ ID NO: 2149744 - RNA, 15 nt, Homo sapiens
ccauugggcaggcag

SEQ ID NO: 2149745 - RNA, 20 nt, Homo sapiens
agccucaggggucugagcuc

SEQ ID NO: 2149746 - RNA, 13 nt, Homo sapiens
acugcaacuguau

SEQ ID NO: 2149747 - RNA, 15 nt, Homo sapiens
aaugcauuuucaaga

SEQ ID NO: 2149748 - RNA, 23 nt, Homo sapiens
ccagaguccuuuccaaggcuucu

SEQ ID NO: 2149749 - RNA, 13 nt, Homo sapiens
ucauuagauuaca

SEQ ID NO: 2149750 - RNA, 13 nt, Homo sapiens
gauccaagcaaga

SEQ ID NO: 2149751 - RNA, 12 nt, Homo sapiens
auccccccaugc

SEQ ID NO: 2149752 - RNA, 20 nt, Homo sapiens
acagcugccuguuuccuccc

SEQ ID NO: 2149753 - RNA, 14 nt, Homo sapiens
guaugucuguuacc

SEQ ID NO: 2149754 - RNA, 20 nt, Homo sapiens
cccuuagcagcccagcauuu

SEQ ID NO: 2149755 - RNA, 12 nt, Homo sapiens
ugauucugggau

SEQ ID NO: 2149756 - RNA, 22 nt, Homo sapiens
uaauacaguuuucuauucuugg

SEQ ID NO: 2149757 - RNA, 20 nt, Homo sapiens
cucccagaaugcuggguuua

SEQ ID NO: 2149758 - RNA, 18 nt, Homo sapiens
gcuuuggaggauuucacu

SEQ ID NO: 2149759 - RNA, 20 nt, Homo sapiens
cuuacauuuacaaacugaag

SEQ ID NO: 2149760 - RNA, 12 nt, Homo sapiens
cacuucuucagc

SEQ ID NO: 2149761 - RNA, 16 nt, Homo sapiens
uccucuuguugcugag

SEQ ID NO: 2149762 - RNA, 17 nt, Homo sapiens
uucccuuucacuggcau

SEQ ID NO: 2149763 - RNA, 14 nt, Homo sapiens
ugccgcucuucacu

SEQ ID NO: 2149764 - RNA, 20 nt, Homo sapiens
ugcaaguuagggucuaugua

SEQ ID NO: 2149765 - RNA, 19 nt, Homo sapiens
uugcaacucacugauucuc

SEQ ID NO: 2149766 - RNA, 14 nt, Homo sapiens
uaacucccagugau

SEQ ID NO: 2149767 - RNA, 14 nt, Homo sapiens
ucauccuuagcaac

SEQ ID NO: 2149768 - RNA, 17 nt, Homo sapiens
ugauugcuuugcugcac

SEQ ID NO: 2149769 - RNA, 18 nt, Homo sapiens
uccucaguuaaguguuuc

SEQ ID NO: 2149770 - RNA, 20 nt, Homo sapiens
aauuggucccaagacaugaa

SEQ ID NO: 2149771 - RNA, 16 nt, Homo sapiens
gcaguggaagcaguuu

SEQ ID NO: 2149772 - RNA, 20 nt, Homo sapiens
agcccuccccaccugcucac

SEQ ID NO: 2149773 - RNA, 14 nt, Homo sapiens
agccuuucacagga

SEQ ID NO: 2149774 - RNA, 15 nt, Homo sapiens
uccaagucccucuca

SEQ ID NO: 2149775 - RNA, 21 nt, Homo sapiens
uaaaauauauuuaugauaacu

SEQ ID NO: 2149776 - RNA, 18 nt, Homo sapiens
uuucaugcacacuguugg

SEQ ID NO: 2149777 - RNA, 15 nt, Homo sapiens
augcagucucuuuau

SEQ ID NO: 2149778 - RNA, 22 nt, Homo sapiens
augauaaguacuacauaccuca

SEQ ID NO: 2149779 - RNA, 18 nt, Homo sapiens
cagugagacacaguaauu

SEQ ID NO: 2149780 - RNA, 17 nt, Homo sapiens
uagaacuggcuauccuu

SEQ ID NO: 2149781 - RNA, 18 nt, Homo sapiens
ucgugaauucuuguucau

SEQ ID NO: 2149782 - RNA, 14 nt, Homo sapiens
gauaccauaugaau

SEQ ID NO: 2149783 - RNA, 11 nt, Homo sapiens
gccaccucucc

SEQ ID NO: 2149784 - RNA, 17 nt, Homo sapiens
gcagucaauuuucacau

SEQ ID NO: 2149785 - RNA, 15 nt, Homo sapiens
caugcaggauuugaa

SEQ ID NO: 2149786 - RNA, 15 nt, Homo sapiens
agugagcaaccagcu

SEQ ID NO: 2149787 - RNA, 13 nt, Homo sapiens
aaggaguguauga

SEQ ID NO: 2149788 - RNA, 18 nt, Homo sapiens
auagggacauaaguucau

SEQ ID NO: 2149789 - RNA, 15 nt, Homo sapiens
cucugggcuccagag

SEQ ID NO: 2149790 - RNA, 15 nt, Homo sapiens
cggggauagagggua

SEQ ID NO: 2149791 - RNA, 18 nt, Homo sapiens
guuuugaauugucaauau

SEQ ID NO: 2149792 - RNA, 21 nt, Homo sapiens
uuuucuaggccuacaugcuuu

SEQ ID NO: 2149793 - RNA, 20 nt, Homo sapiens
auuaaucuaccuugcagugu

SEQ ID NO: 2149794 - RNA, 13 nt, Homo sapiens
aaguaaugauuaa

SEQ ID NO: 2149795 - RNA, 13 nt, Homo sapiens
cuuuuaugcagau

SEQ ID NO: 2149796 - RNA, 13 nt, Homo sapiens
uuuuaauguagaa

SEQ ID NO: 2149797 - RNA, 14 nt, Homo sapiens
uuaucuccaugaua

SEQ ID NO: 2149798 - RNA, 19 nt, Homo sapiens
cagcauuuguucuuugcca

SEQ ID NO: 2149799 - RNA, 14 nt, Homo sapiens
ucgcaccugugcug

SEQ ID NO: 2149800 - RNA, 18 nt, Homo sapiens
aggagccccccaaagaca

SEQ ID NO: 2149801 - RNA, 18 nt, Homo sapiens
gcucccucuguguuagaa

SEQ ID NO: 2149802 - RNA, 18 nt, Homo sapiens
caagaaaucaaaauccaa

SEQ ID NO: 2149803 - RNA, 22 nt, Homo sapiens
aaccccucccccacgucucucu

SEQ ID NO: 2149804 - RNA, 14 nt, Homo sapiens
cuacuaaaaacaca

SEQ ID NO: 2149805 - RNA, 17 nt, Homo sapiens
caaaaugagacuuucua

SEQ ID NO: 2149806 - RNA, 18 nt, Homo sapiens
uuggacccaaaaaaucau

SEQ ID NO: 2149807 - RNA, 18 nt, Homo sapiens
aauuccaaacacauacag

SEQ ID NO: 2149808 - RNA, 21 nt, Homo sapiens
gcuauaauguauaaugggaaa

SEQ ID NO: 2149809 - RNA, 13 nt, Homo sapiens
ucucccucggggg

SEQ ID NO: 2149810 - RNA, 19 nt, Homo sapiens
uaaaaaugccuacacagua

SEQ ID NO: 2149811 - RNA, 14 nt, Homo sapiens
uuauugaucccaca

SEQ ID NO: 2149812 - RNA, 16 nt, Homo sapiens
guuauguuguaauauu

SEQ ID NO: 2149813 - RNA, 16 nt, Homo sapiens
uaauuacauauuugca

SEQ ID NO: 2149814 - RNA, 22 nt, Homo sapiens
acauugagcgugaccuugcaau

SEQ ID NO: 2149815 - RNA, 13 nt, Homo sapiens
gggccuaugcaga

SEQ ID NO: 2149816 - RNA, 12 nt, Homo sapiens
uagcucuuuucu

SEQ ID NO: 2149817 - RNA, 18 nt, Homo sapiens
uuuuugcugcugccucuu

SEQ ID NO: 2149818 - RNA, 15 nt, Homo sapiens
gacccucccaggaga

SEQ ID NO: 2149819 - RNA, 13 nt, Homo sapiens
cuuucagcuguga

SEQ ID NO: 2149820 - RNA, 15 nt, Homo sapiens
aacacugaagcucuu

SEQ ID NO: 2149821 - RNA, 21 nt, Homo sapiens
ccagcagacacccuguguccu

SEQ ID NO: 2149822 - RNA, 22 nt, Homo sapiens
auaaauuuaaaaaucaucuuau

SEQ ID NO: 2149823 - RNA, 18 nt, Homo sapiens
agcccugcgccaccucac

SEQ ID NO: 2149824 - RNA, 16 nt, Homo sapiens
aauacucuuauaucua

SEQ ID NO: 2149825 - RNA, 13 nt, Homo sapiens
cacacacaccaau

SEQ ID NO: 2149826 - RNA, 16 nt, Homo sapiens
auucauaaugacuuaa

SEQ ID NO: 2149827 - RNA, 21 nt, Homo sapiens
gcucaguaacacagugcagug

SEQ ID NO: 2149828 - RNA, 16 nt, Homo sapiens
guggacuucaucucaa

SEQ ID NO: 2149829 - RNA, 20 nt, Homo sapiens
uuucccuccccagaguucuu

SEQ ID NO: 2149830 - RNA, 21 nt, Homo sapiens
agacccaguguaaagaauaaa

SEQ ID NO: 2149831 - RNA, 24 nt, Homo sapiens
agguugcugguacacaccaaauga

SEQ ID NO: 2149832 - RNA, 23 nt, Homo sapiens
aaauauuucauuuugauggaggu

SEQ ID NO: 2149833 - RNA, 16 nt, Homo sapiens
uacaaguugugcaugc

SEQ ID NO: 2149834 - RNA, 11 nt, Homo sapiens
guguaaucucu

SEQ ID NO: 2149835 - RNA, 19 nt, Homo sapiens
cccuggucccucugcaguc

SEQ ID NO: 2149836 - RNA, 15 nt, Homo sapiens
ggcccucucauucuc

SEQ ID NO: 2149837 - RNA, 15 nt, Homo sapiens
cuuuuaaggcuaaaa

SEQ ID NO: 2149838 - RNA, 17 nt, Homo sapiens
caccucuuuaaccacuc

SEQ ID NO: 2149839 - RNA, 16 nt, Homo sapiens
aucacuagccugucau

SEQ ID NO: 2149840 - RNA, 20 nt, Homo sapiens
cuucaguauuguggggcuca

SEQ ID NO: 2149841 - RNA, 16 nt, Homo sapiens
auuucuuugaauuuag

SEQ ID NO: 2149842 - RNA, 21 nt, Homo sapiens
aucaguuuuccuagucuuugg

SEQ ID NO: 2149843 - RNA, 20 nt, Homo sapiens
caaagacaguauuuugacaa

SEQ ID NO: 2149844 - RNA, 21 nt, Homo sapiens
cacagacauccucuaugccag

SEQ ID NO: 2149845 - RNA, 21 nt, Homo sapiens
uuuuaauguuuauuauuuaca

SEQ ID NO: 2149846 - RNA, 19 nt, Homo sapiens
ccguuuccucuuuaacuga

SEQ ID NO: 2149847 - RNA, 20 nt, Homo sapiens
gcuugagggaaucaugggca

SEQ ID NO: 2149848 - RNA, 19 nt, Homo sapiens
acuggcacacuggccucca

SEQ ID NO: 2149849 - RNA, 19 nt, Homo sapiens
agaagccuccaagcacaga

SEQ ID NO: 2149850 - RNA, 21 nt, Homo sapiens
ugcacauuucuuugcauucca

SEQ ID NO: 2149851 - RNA, 18 nt, Homo sapiens
ggcagacuacacaggaug

SEQ ID NO: 2149852 - RNA, 20 nt, Homo sapiens
aguuuucaaagaucccguga

SEQ ID NO: 2149853 - RNA, 16 nt, Homo sapiens
uaaaacucacugugau

SEQ ID NO: 2149854 - RNA, 19 nt, Homo sapiens
guacaaaaggaacuaugaa

SEQ ID NO: 2149855 - RNA, 17 nt, Homo sapiens
ucuucaaacaguuccau

SEQ ID NO: 2149856 - RNA, 23 nt, Homo sapiens
uuguaccauauagagguguaaca

SEQ ID NO: 2149857 - RNA, 17 nt, Homo sapiens
auaauaaugccuagugg

SEQ ID NO: 2149858 - RNA, 18 nt, Homo sapiens
ggucugaauaacacugga

SEQ ID NO: 2149859 - RNA, 15 nt, Homo sapiens
acccuugacuguuau

SEQ ID NO: 2149860 - RNA, 14 nt, Homo sapiens
ccagauauccacau

SEQ ID NO: 2149861 - RNA, 14 nt, Homo sapiens
augcacauauggac

SEQ ID NO: 2149862 - RNA, 16 nt, Homo sapiens
uaguuauuuacuugaa

SEQ ID NO: 2149863 - RNA, 20 nt, Homo sapiens
acugcuuuuaaaagugcaca

SEQ ID NO: 2149864 - RNA, 18 nt, Homo sapiens
cagagaagcauccuccac

SEQ ID NO: 2149865 - RNA, 13 nt, Homo sapiens
auaucagaacugu

SEQ ID NO: 2149866 - RNA, 16 nt, Homo sapiens
acuugcggauuuccac

SEQ ID NO: 2149867 - RNA, 21 nt, Homo sapiens
gaguuaggaccaccaauggau

SEQ ID NO: 2149868 - RNA, 16 nt, Homo sapiens
ucuguuuaggugccuc

SEQ ID NO: 2149869 - RNA, 15 nt, Homo sapiens
cuuugucuugccccu

SEQ ID NO: 2149870 - RNA, 19 nt, Homo sapiens
cuugcaggcagaaggcagu

SEQ ID NO: 2149871 - RNA, 15 nt, Homo sapiens
gucagggacagcagc

SEQ ID NO: 2149872 - RNA, 15 nt, Homo sapiens
acagagaugugauaa

SEQ ID NO: 2149873 - RNA, 22 nt, Homo sapiens
cucccugggcagugcuccuccg

SEQ ID NO: 2149874 - RNA, 18 nt, Homo sapiens
gagcuauuuuaaaccaau

SEQ ID NO: 2149875 - RNA, 12 nt, Homo sapiens
cagaucauguuc

SEQ ID NO: 2149876 - RNA, 17 nt, Homo sapiens
gugacaugugcuggaca

SEQ ID NO: 2149877 - RNA, 19 nt, Homo sapiens
gcucgggcgcuguggcucc

SEQ ID NO: 2149878 - RNA, 23 nt, Homo sapiens
gaaaaauagcaacuuguguuaca

SEQ ID NO: 2149879 - RNA, 19 nt, Homo sapiens
ggugacccccccccauccc

SEQ ID NO: 2149880 - RNA, 17 nt, Homo sapiens
caaucaugaguaccuca

SEQ ID NO: 2149881 - RNA, 20 nt, Homo sapiens
cucuaguaaauuuaagucca

SEQ ID NO: 2149882 - RNA, 13 nt, Homo sapiens
gccccacacuccc

SEQ ID NO: 2149883 - RNA, 20 nt, Homo sapiens
gacaccugagacaugcugaa

SEQ ID NO: 2149884 - RNA, 15 nt, Homo sapiens
uccagcauggaugaa

SEQ ID NO: 2149885 - RNA, 23 nt, Homo sapiens
auacuauuaccaccaccugcuca

SEQ ID NO: 2149886 - RNA, 16 nt, Homo sapiens
uauaaagggcaaagga

SEQ ID NO: 2149887 - RNA, 19 nt, Homo sapiens
gcugcugagaaucuagccu

SEQ ID NO: 2149888 - RNA, 14 nt, Homo sapiens
ugucuccuacugag

SEQ ID NO: 2149889 - RNA, 18 nt, Homo sapiens
ugaaacaaauuuacauca

SEQ ID NO: 2149890 - RNA, 16 nt, Homo sapiens
cugcagaacagcauca

SEQ ID NO: 2149891 - RNA, 21 nt, Homo sapiens
acacucaucagguaaacugau

SEQ ID NO: 2149892 - RNA, 17 nt, Homo sapiens
gcauuuugucaguuuua

SEQ ID NO: 2149893 - RNA, 12 nt, Homo sapiens
ccuggcuucugg

SEQ ID NO: 2149894 - RNA, 24 nt, Homo sapiens
caauauuguauacuaccauaguga

SEQ ID NO: 2149895 - RNA, 22 nt, Homo sapiens
aaaaucacaaggcaacugugag

SEQ ID NO: 2149896 - RNA, 19 nt, Homo sapiens
gauaacucuguacgaggcu

SEQ ID NO: 2149897 - RNA, 14 nt, Homo sapiens
aguuugagaccagc

SEQ ID NO: 2149898 - RNA, 15 nt, Homo sapiens
cagaggcuggcacug

SEQ ID NO: 2149899 - RNA, 12 nt, Homo sapiens
caaaaacugggu

SEQ ID NO: 2149900 - RNA, 22 nt, Homo sapiens
uguuccaugaaggcagagccau

SEQ ID NO: 2149901 - RNA, 14 nt, Homo sapiens
uacuauacagccau

SEQ ID NO: 2149902 - RNA, 23 nt, Homo sapiens
acagaagagugacauguuuacaa

SEQ ID NO: 2149903 - RNA, 21 nt, Homo sapiens
uuaauggcucaucaacaauca

SEQ ID NO: 2149904 - RNA, 18 nt, Homo sapiens
uaaaauuguuaauaugca

SEQ ID NO: 2149905 - RNA, 17 nt, Homo sapiens
uaagucagguucuuuac

SEQ ID NO: 2149906 - RNA, 13 nt, Homo sapiens
gagaaaucuggcu

SEQ ID NO: 2149907 - RNA, 20 nt, Homo sapiens
ccacuguaugauucucuuaa

SEQ ID NO: 2149908 - RNA, 18 nt, Homo sapiens
guagacuuuugcuuuaug

SEQ ID NO: 2149909 - RNA, 19 nt, Homo sapiens
uuuaagaaaaguauuuuga

SEQ ID NO: 2149910 - RNA, 21 nt, Homo sapiens
ggguagguucugaacagcaga

SEQ ID NO: 2149911 - RNA, 17 nt, Homo sapiens
augucagaaaccaguua

SEQ ID NO: 2149912 - RNA, 14 nt, Homo sapiens
cgugguuacuguau

SEQ ID NO: 2149913 - RNA, 20 nt, Homo sapiens
aauaccuuaguuuuuuccac

SEQ ID NO: 2149914 - RNA, 15 nt, Homo sapiens
agcugcucugagcca

SEQ ID NO: 2149915 - RNA, 20 nt, Homo sapiens
gagaaaccuuauuguaccuc

SEQ ID NO: 2149916 - RNA, 13 nt, Homo sapiens
acucgcacugcaa

SEQ ID NO: 2149917 - RNA, 23 nt, Homo sapiens
accuacauuuuaaugcaccugaa

SEQ ID NO: 2149918 - RNA, 13 nt, Homo sapiens
uacccacauguac

SEQ ID NO: 2149919 - RNA, 13 nt, Homo sapiens
uaucuacaugcau

SEQ ID NO: 2149920 - RNA, 22 nt, Homo sapiens
uauuuuaauagaaagauacaac

SEQ ID NO: 2149921 - RNA, 18 nt, Homo sapiens
gggagcgccggauuugcu

SEQ ID NO: 2149922 - RNA, 18 nt, Homo sapiens
uuuuaaaagugccauuaa

SEQ ID NO: 2149923 - RNA, 21 nt, Homo sapiens
uuaauucauucuggucuuuga

SEQ ID NO: 2149924 - RNA, 19 nt, Homo sapiens
cucaauaaauugcaacaua

SEQ ID NO: 2149925 - RNA, 19 nt, Homo sapiens
cucagccaaccuuacuuac

SEQ ID NO: 2149926 - RNA, 20 nt, Homo sapiens
uguagaaaauaaaacugagc

SEQ ID NO: 2149927 - RNA, 13 nt, Homo sapiens
aaauguucacuga

SEQ ID NO: 2149928 - RNA, 23 nt, Homo sapiens
ccccgcagucgucccaggcugcc

SEQ ID NO: 2149929 - RNA, 18 nt, Homo sapiens
ucaguccuuugucuuucu

SEQ ID NO: 2149930 - RNA, 14 nt, Homo sapiens
acuauccaauaugg

SEQ ID NO: 2149931 - RNA, 17 nt, Homo sapiens
acuggcuuaacuuagua

SEQ ID NO: 2149932 - RNA, 14 nt, Homo sapiens
gccaggcuccuucc

SEQ ID NO: 2149933 - RNA, 13 nt, Homo sapiens
uaacacacagcua

SEQ ID NO: 2149934 - RNA, 19 nt, Homo sapiens
cugaaaggcacacuuugau

SEQ ID NO: 2149935 - RNA, 17 nt, Homo sapiens
uuucuauucagcaaaag

SEQ ID NO: 2149936 - RNA, 19 nt, Homo sapiens
ccagcuacaaaacaauuca

SEQ ID NO: 2149937 - RNA, 22 nt, Homo sapiens
uaaacguggagaaucacaggcu

SEQ ID NO: 2149938 - RNA, 22 nt, Homo sapiens
gccugagugaccuccuucugca

SEQ ID NO: 2149939 - RNA, 22 nt, Homo sapiens
caccuccuuccucaguccugga

SEQ ID NO: 2149940 - RNA, 16 nt, Homo sapiens
auaguuccuugccuua

SEQ ID NO: 2149941 - RNA, 17 nt, Homo sapiens
ucuuaccuggcagcaaa

SEQ ID NO: 2149942 - RNA, 22 nt, Homo sapiens
uucuaagugguauauacauaug

SEQ ID NO: 2149943 - RNA, 16 nt, Homo sapiens
cugguguucugaagug

SEQ ID NO: 2149944 - RNA, 14 nt, Homo sapiens
gaaacggauccagc

SEQ ID NO: 2149945 - RNA, 16 nt, Homo sapiens
agucaaugaaaacuga

SEQ ID NO: 2149946 - RNA, 17 nt, Homo sapiens
gaaaggcgagguggcug

SEQ ID NO: 2149947 - RNA, 21 nt, Homo sapiens
aauauggggauagucuggguc

SEQ ID NO: 2149948 - RNA, 17 nt, Homo sapiens
aaucuaggaagcucaga

SEQ ID NO: 2149949 - RNA, 17 nt, Homo sapiens
ggcgagccgcgggcgcu

SEQ ID NO: 2149950 - RNA, 22 nt, Homo sapiens
aagaaaaagucauccaaucuaa

SEQ ID NO: 2149951 - RNA, 23 nt, Homo sapiens
ccugggaauuuacagagccugcc

SEQ ID NO: 2149952 - RNA, 18 nt, Homo sapiens
guuagcuaaaggaucuua

SEQ ID NO: 2149953 - RNA, 13 nt, Homo sapiens
aacauuugccaaa

SEQ ID NO: 2149954 - RNA, 15 nt, Homo sapiens
ugagcaugcuuucug

SEQ ID NO: 2149955 - RNA, 17 nt, Homo sapiens
cuuugacaugacugcaa

SEQ ID NO: 2149956 - RNA, 18 nt, Homo sapiens
agcauagggucacuuugc

SEQ ID NO: 2149957 - RNA, 14 nt, Homo sapiens
uauuguuucugcau

SEQ ID NO: 2149958 - RNA, 19 nt, Homo sapiens
agcuccaaaugcagcuuua

SEQ ID NO: 2149959 - RNA, 16 nt, Homo sapiens
aauagccacauuugga

SEQ ID NO: 2149960 - RNA, 22 nt, Homo sapiens
uaucaggauuguguugugugga

SEQ ID NO: 2149961 - RNA, 20 nt, Homo sapiens
gauacuuuaguacaauuuca

SEQ ID NO: 2149962 - RNA, 14 nt, Homo sapiens
acaaucacugccaa

SEQ ID NO: 2149963 - RNA, 23 nt, Homo sapiens
agcuuucaauaguggcauaccaa

SEQ ID NO: 2149964 - RNA, 15 nt, Homo sapiens
gcuugcaugugcugc

SEQ ID NO: 2149965 - RNA, 17 nt, Homo sapiens
ccugaugcuaauuuuca

SEQ ID NO: 2149966 - RNA, 18 nt, Homo sapiens
acagagccaaaaugccau

SEQ ID NO: 2149967 - RNA, 22 nt, Homo sapiens
ucuggagggacaaacucacuca

SEQ ID NO: 2149968 - RNA, 15 nt, Homo sapiens
uaaaccagacucacu

SEQ ID NO: 2149969 - RNA, 18 nt, Homo sapiens
agcauggcucucuauucc

SEQ ID NO: 2149970 - RNA, 16 nt, Homo sapiens
ugugucaucugucagc

SEQ ID NO: 2149971 - RNA, 13 nt, Homo sapiens
agccgagcucucc

SEQ ID NO: 2149972 - RNA, 14 nt, Homo sapiens
aagaaagacuaucu

SEQ ID NO: 2149973 - RNA, 15 nt, Homo sapiens
gcaauaguguguucu

SEQ ID NO: 2149974 - RNA, 19 nt, Homo sapiens
gagaacucagcuguccagc

SEQ ID NO: 2149975 - RNA, 13 nt, Homo sapiens
ccagugacaaaga

SEQ ID NO: 2149976 - RNA, 21 nt, Homo sapiens
ucugugccugacucugugcug

SEQ ID NO: 2149977 - RNA, 17 nt, Homo sapiens
agcacugaagucaccau

SEQ ID NO: 2149978 - RNA, 21 nt, Homo sapiens
uauauuuugugugaaauugca

SEQ ID NO: 2149979 - RNA, 18 nt, Homo sapiens
cagagguuuccucuuagg

SEQ ID NO: 2149980 - RNA, 14 nt, Homo sapiens
aucaauacaauccu

SEQ ID NO: 2149981 - RNA, 12 nt, Homo sapiens
ccuuuaccccau

SEQ ID NO: 2149982 - RNA, 20 nt, Homo sapiens
gcugcuguagaugacuacuu

SEQ ID NO: 2149983 - RNA, 15 nt, Homo sapiens
agacauauaccaaaa

SEQ ID NO: 2149984 - RNA, 22 nt, Homo sapiens
auuguguggucauaucuaguca

SEQ ID NO: 2149985 - RNA, 16 nt, Homo sapiens
cccuuauauaauuacu

SEQ ID NO: 2149986 - RNA, 15 nt, Homo sapiens
agaucacaccacugc

SEQ ID NO: 2149987 - RNA, 22 nt, Homo sapiens
agcaacucagguuuuggcauua

SEQ ID NO: 2149988 - RNA, 23 nt, Homo sapiens
cucaaacucccuuuggcccugaa

SEQ ID NO: 2149989 - RNA, 14 nt, Homo sapiens
aauuguucucuuaa

SEQ ID NO: 2149990 - RNA, 14 nt, Homo sapiens
cugaggcauggugu

SEQ ID NO: 2149991 - RNA, 22 nt, Homo sapiens
guccagcccugccuugcugcag

SEQ ID NO: 2149992 - RNA, 20 nt, Homo sapiens
gcuuggcacacugccagugu

SEQ ID NO: 2149993 - RNA, 18 nt, Homo sapiens
ggguaaggaaauggaaua

SEQ ID NO: 2149994 - RNA, 14 nt, Homo sapiens
aaucauaacauuga

SEQ ID NO: 2149995 - RNA, 13 nt, Homo sapiens
uuccucacucaga

SEQ ID NO: 2149996 - RNA, 13 nt, Homo sapiens
auccucacacaga

SEQ ID NO: 2149997 - RNA, 15 nt, Homo sapiens
ucaggaauacauuug

SEQ ID NO: 2149998 - RNA, 13 nt, Homo sapiens
augguuacauauc

SEQ ID NO: 2149999 - RNA, 17 nt, Homo sapiens
uuccugcacuccagaau

SEQ ID NO: 2150000 - RNA, 20 nt, Homo sapiens
agagccuauggaaagggugu

SEQ ID NO: 2150001 - RNA, 17 nt, Homo sapiens
uccaccugcuaaucaca

SEQ ID NO: 2150002 - RNA, 10 nt, Homo sapiens
cacuguucaa

SEQ ID NO: 2150003 - RNA, 10 nt, Homo sapiens
uggcaaaaaa

SEQ ID NO: 2150004 - RNA, 14 nt, Homo sapiens
caauaaaguacuuu

SEQ ID NO: 2150005 - RNA, 15 nt, Homo sapiens
aaaauguucuuacac

SEQ ID NO: 2150006 - RNA, 17 nt, Homo sapiens
acugaaacgucuaggaa

SEQ ID NO: 2150007 - RNA, 22 nt, Homo sapiens
gaaucggcuuugcagugcacuu

SEQ ID NO: 2150008 - RNA, 22 nt, Homo sapiens
aauguaagaugauaacguuaga

SEQ ID NO: 2150009 - RNA, 16 nt, Homo sapiens
ucccaaagcagugcau

SEQ ID NO: 2150010 - RNA, 20 nt, Homo sapiens
caaaaugaacacaucuugag

SEQ ID NO: 2150011 - RNA, 18 nt, Homo sapiens
gcaucuggguagcuguaa

SEQ ID NO: 2150012 - RNA, 17 nt, Homo sapiens
uguucacauaacgccac

SEQ ID NO: 2150013 - RNA, 16 nt, Homo sapiens
acaccuuuauuuuauu

SEQ ID NO: 2150014 - RNA, 14 nt, Homo sapiens
uccccagaguguga

SEQ ID NO: 2150015 - RNA, 18 nt, Homo sapiens
ccauuccucagcuucuuc

SEQ ID NO: 2150016 - RNA, 13 nt, Homo sapiens
ugaaaugaccucu

SEQ ID NO: 2150017 - RNA, 13 nt, Homo sapiens
uaccucucucuuc

SEQ ID NO: 2150018 - RNA, 13 nt, Homo sapiens
ccaguguuuacaa

SEQ ID NO: 2150019 - RNA, 23 nt, Homo sapiens
uccugaggcuuuggauuugacau

SEQ ID NO: 2150020 - RNA, 15 nt, Homo sapiens
cuggugaaaugcugu

SEQ ID NO: 2150021 - RNA, 15 nt, Homo sapiens
aauccaaacaugcau

SEQ ID NO: 2150022 - RNA, 20 nt, Homo sapiens
auucuguuuauuaugacaaa

SEQ ID NO: 2150023 - RNA, 17 nt, Homo sapiens
gagugagaacagcauuu

SEQ ID NO: 2150024 - RNA, 18 nt, Homo sapiens
cgccauuuuugugcuuuu

SEQ ID NO: 2150025 - RNA, 13 nt, Homo sapiens
cuguucuuugcag

SEQ ID NO: 2150026 - RNA, 15 nt, Homo sapiens
cacaguggcuucaca

SEQ ID NO: 2150027 - RNA, 17 nt, Homo sapiens
agaaacaaauaaacuag

SEQ ID NO: 2150028 - RNA, 17 nt, Homo sapiens
caaagaugggugaaggc

SEQ ID NO: 2150029 - RNA, 16 nt, Homo sapiens
guuccagguggacaaa

SEQ ID NO: 2150030 - RNA, 16 nt, Homo sapiens
auagaacuacuuugaa

SEQ ID NO: 2150031 - RNA, 13 nt, Homo sapiens
gugaccucuugcc

SEQ ID NO: 2150032 - RNA, 16 nt, Homo sapiens
aaacgcuuauugugua

SEQ ID NO: 2150033 - RNA, 18 nt, Homo sapiens
cugccuggaacaccagca

SEQ ID NO: 2150034 - RNA, 16 nt, Homo sapiens
ucccuugcccauguga

SEQ ID NO: 2150035 - RNA, 21 nt, Homo sapiens
aggagccuacuucuagcugua

SEQ ID NO: 2150036 - RNA, 12 nt, Homo sapiens
aaugacuuucaa

SEQ ID NO: 2150037 - RNA, 19 nt, Homo sapiens
caaacacugcuuaaggaaa

SEQ ID NO: 2150038 - RNA, 14 nt, Homo sapiens
gcuaaaaaagcaua

SEQ ID NO: 2150039 - RNA, 17 nt, Homo sapiens
aggagcuuccagugcau

SEQ ID NO: 2150040 - RNA, 17 nt, Homo sapiens
uaggaauuguuuauaca

SEQ ID NO: 2150041 - RNA, 16 nt, Homo sapiens
gcgucucugcuuuaaa

SEQ ID NO: 2150042 - RNA, 17 nt, Homo sapiens
cuugacaacagacugaa

SEQ ID NO: 2150043 - RNA, 18 nt, Homo sapiens
cuuuucugaccaaagaga

SEQ ID NO: 2150044 - RNA, 14 nt, Homo sapiens
gcaccaggggccaa

SEQ ID NO: 2150045 - RNA, 17 nt, Homo sapiens
gguccuguucccuaccc

SEQ ID NO: 2150046 - RNA, 15 nt, Homo sapiens
ugguaaccuguggug

SEQ ID NO: 2150047 - RNA, 17 nt, Homo sapiens
uucaaacuucuguguac

SEQ ID NO: 2150048 - RNA, 18 nt, Homo sapiens
ucuugguaaaacauuacu

SEQ ID NO: 2150049 - RNA, 18 nt, Homo sapiens
aucugaaugaaaauaacu

SEQ ID NO: 2150050 - RNA, 18 nt, Homo sapiens
uccuugugguuuauguca

SEQ ID NO: 2150051 - RNA, 23 nt, Homo sapiens
cgauguuuauguucuuauagaau

SEQ ID NO: 2150052 - RNA, 15 nt, Homo sapiens
uucucuuugccucaa

SEQ ID NO: 2150053 - RNA, 21 nt, Homo sapiens
cuguagagaaugaaaggagca

SEQ ID NO: 2150054 - RNA, 17 nt, Homo sapiens
cuguggaccacccuagc

SEQ ID NO: 2150055 - RNA, 16 nt, Homo sapiens
uagaaaaacaucccaa

SEQ ID NO: 2150056 - RNA, 19 nt, Homo sapiens
uugagugcacugacuguga

SEQ ID NO: 2150057 - RNA, 16 nt, Homo sapiens
aucuagucacaaagac

SEQ ID NO: 2150058 - RNA, 21 nt, Homo sapiens
ucugaaaucagucuaccaagg

SEQ ID NO: 2150059 - RNA, 15 nt, Homo sapiens
caugugugugcaagu

SEQ ID NO: 2150060 - RNA, 15 nt, Homo sapiens
caauaaagugugagg

SEQ ID NO: 2150061 - RNA, 23 nt, Homo sapiens
cccacagcugagaauguggaaua

SEQ ID NO: 2150062 - RNA, 19 nt, Homo sapiens
cuuucaucuuaaacuaaua

SEQ ID NO: 2150063 - RNA, 18 nt, Homo sapiens
ccacacuguacucugcac

SEQ ID NO: 2150064 - RNA, 20 nt, Homo sapiens
augcuccuugaagaaucucu

SEQ ID NO: 2150065 - RNA, 16 nt, Homo sapiens
ugcuucauuccaaucu

SEQ ID NO: 2150066 - RNA, 14 nt, Homo sapiens
aggggggagccaga

SEQ ID NO: 2150067 - RNA, 16 nt, Homo sapiens
uagaaauaauugaaag

SEQ ID NO: 2150068 - RNA, 18 nt, Homo sapiens
cacauguuguucucauug

SEQ ID NO: 2150069 - RNA, 15 nt, Homo sapiens
uggauucccacagca

SEQ ID NO: 2150070 - RNA, 21 nt, Homo sapiens
auauacuaguccugacacuga

SEQ ID NO: 2150071 - RNA, 17 nt, Homo sapiens
cucaaucucugcaggau

SEQ ID NO: 2150072 - RNA, 19 nt, Homo sapiens
cuauaacauucaauuugcu

SEQ ID NO: 2150073 - RNA, 15 nt, Homo sapiens
gugaacugaaauuaa

SEQ ID NO: 2150074 - RNA, 23 nt, Homo sapiens
uguuugugacaacuaaacaaggc

SEQ ID NO: 2150075 - RNA, 21 nt, Homo sapiens
augugaauuauuuccugcuua

SEQ ID NO: 2150076 - RNA, 19 nt, Homo sapiens
ccaccuugggucuguguca

SEQ ID NO: 2150077 - RNA, 13 nt, Homo sapiens
ggaauaguggcau

SEQ ID NO: 2150078 - RNA, 13 nt, Homo sapiens
gaaauagugacau

SEQ ID NO: 2150079 - RNA, 16 nt, Homo sapiens
ccaauggaaugugaug

SEQ ID NO: 2150080 - RNA, 13 nt, Homo sapiens
agaucagugccua

SEQ ID NO: 2150081 - RNA, 15 nt, Homo sapiens
aggaacaggacugca

SEQ ID NO: 2150082 - RNA, 17 nt, Homo sapiens
cugagauccagcacaac

SEQ ID NO: 2150083 - RNA, 19 nt, Homo sapiens
uucaggaagauaaaaauca

SEQ ID NO: 2150084 - RNA, 14 nt, Homo sapiens
ggcaggccucccaa

SEQ ID NO: 2150085 - RNA, 20 nt, Homo sapiens
uaauaaguaucacacuguau

SEQ ID NO: 2150086 - RNA, 23 nt, Homo sapiens
gaggugcugcuuugcuucuucaa

SEQ ID NO: 2150087 - RNA, 19 nt, Homo sapiens
gguuugcagcgacuggcau

SEQ ID NO: 2150088 - RNA, 19 nt, Homo sapiens
cucaaucccugaggacuga

SEQ ID NO: 2150089 - RNA, 20 nt, Homo sapiens
caaccuuaucaaggauuuuc

SEQ ID NO: 2150090 - RNA, 20 nt, Homo sapiens
ggcacacgccucccacuggg

SEQ ID NO: 2150091 - RNA, 15 nt, Homo sapiens
ggagacucguggacu

SEQ ID NO: 2150092 - RNA, 14 nt, Homo sapiens
aucucaaauccacu

SEQ ID NO: 2150093 - RNA, 18 nt, Homo sapiens
uggaggcaacagggccau

SEQ ID NO: 2150094 - RNA, 19 nt, Homo sapiens
uguuaacugagugccuuuu

SEQ ID NO: 2150095 - RNA, 12 nt, Homo sapiens
ccaggcugcacg

SEQ ID NO: 2150096 - RNA, 21 nt, Homo sapiens
ucacaugaaggagacagcagc

SEQ ID NO: 2150097 - RNA, 22 nt, Homo sapiens
uuuucaagauacauuucaucug

SEQ ID NO: 2150098 - RNA, 18 nt, Homo sapiens
ggccaugggagguccugg

SEQ ID NO: 2150099 - RNA, 22 nt, Homo sapiens
guggggacauuuuauaaucuau

SEQ ID NO: 2150100 - RNA, 21 nt, Homo sapiens
caaagugcccgcagagcccac

SEQ ID NO: 2150101 - RNA, 15 nt, Homo sapiens
uuugacuacuagagc

SEQ ID NO: 2150102 - RNA, 21 nt, Homo sapiens
cgcuggagcuccuacauggug

SEQ ID NO: 2150103 - RNA, 18 nt, Homo sapiens
ucccuuacagaggaccau

SEQ ID NO: 2150104 - RNA, 17 nt, Homo sapiens
acagaagaggagucaag

SEQ ID NO: 2150105 - RNA, 24 nt, Homo sapiens
cagcuacucaggaggcugaggcag

SEQ ID NO: 2150106 - RNA, 20 nt, Homo sapiens
cuagaagugugaagugcaga

SEQ ID NO: 2150107 - RNA, 13 nt, Homo sapiens
uaagacagugcag

SEQ ID NO: 2150108 - RNA, 17 nt, Homo sapiens
cgccagccuccaaugua

SEQ ID NO: 2150109 - RNA, 14 nt, Homo sapiens
gucgugagugucuc

SEQ ID NO: 2150110 - RNA, 19 nt, Homo sapiens
uguucucuccuccaaaagu

SEQ ID NO: 2150111 - RNA, 18 nt, Homo sapiens
ggggagaagacaaaugaa

SEQ ID NO: 2150112 - RNA, 14 nt, Homo sapiens
aagaguggaaccaa

SEQ ID NO: 2150113 - RNA, 16 nt, Homo sapiens
caguguugaaauugga

SEQ ID NO: 2150114 - RNA, 13 nt, Homo sapiens
uagccuggaccaa

SEQ ID NO: 2150115 - RNA, 15 nt, Homo sapiens
uauccaggacuguuu

SEQ ID NO: 2150116 - RNA, 22 nt, Homo sapiens
gcuccaguggaagaagaaaaca

SEQ ID NO: 2150117 - RNA, 16 nt, Homo sapiens
aacaaugaaauauugc

SEQ ID NO: 2150118 - RNA, 18 nt, Homo sapiens
auuuggaaauguggucau

SEQ ID NO: 2150119 - RNA, 19 nt, Homo sapiens
uuaggcacccauccuagag

SEQ ID NO: 2150120 - RNA, 19 nt, Homo sapiens
aauccaaggaaacaugcag

SEQ ID NO: 2150121 - RNA, 17 nt, Homo sapiens
gggagcugcuggccaug

SEQ ID NO: 2150122 - RNA, 12 nt, Homo sapiens
ccuguagacugu

SEQ ID NO: 2150123 - RNA, 12 nt, Homo sapiens
aacaaaccacaa

SEQ ID NO: 2150124 - RNA, 12 nt, Homo sapiens
aacuaaccacau

SEQ ID NO: 2150125 - RNA, 15 nt, Homo sapiens
aucuuaggauuuacc

SEQ ID NO: 2150126 - RNA, 22 nt, Homo sapiens
aauaaauggaaugaaauaauuc

SEQ ID NO: 2150127 - RNA, 12 nt, Homo sapiens
cgaguuggucac

SEQ ID NO: 2150128 - RNA, 17 nt, Homo sapiens
auaucccuuacuuuaac

SEQ ID NO: 2150129 - RNA, 19 nt, Homo sapiens
gcauauauacuacaugaga

SEQ ID NO: 2150130 - RNA, 13 nt, Homo sapiens
uuaacauuugccu

SEQ ID NO: 2150131 - RNA, 13 nt, Homo sapiens
caugaauucacaa

SEQ ID NO: 2150132 - RNA, 12 nt, Homo sapiens
ucaggcuuucag

SEQ ID NO: 2150133 - RNA, 20 nt, Homo sapiens
caauguggaauuacauaaca

SEQ ID NO: 2150134 - RNA, 21 nt, Homo sapiens
ccacacuuguuccagcucuuu

SEQ ID NO: 2150135 - RNA, 14 nt, Homo sapiens
ugccagacaucacc

SEQ ID NO: 2150136 - RNA, 22 nt, Homo sapiens
cuguagaagaagugaacacuua

SEQ ID NO: 2150137 - RNA, 17 nt, Homo sapiens
uaagaauucuguacuuc

SEQ ID NO: 2150138 - RNA, 15 nt, Homo sapiens
aucugcaguuuaaca

SEQ ID NO: 2150139 - RNA, 15 nt, Homo sapiens
gcugcuugcugcuca

SEQ ID NO: 2150140 - RNA, 17 nt, Homo sapiens
ccagccuggaugccauc

SEQ ID NO: 2150141 - RNA, 14 nt, Homo sapiens
ccacagaggccagg

SEQ ID NO: 2150142 - RNA, 20 nt, Homo sapiens
ucaaaacagagggcugcauu

SEQ ID NO: 2150143 - RNA, 22 nt, Homo sapiens
gugcucaauaaggcagugcagu

SEQ ID NO: 2150144 - RNA, 17 nt, Homo sapiens
uaaaaauguccugccuu

SEQ ID NO: 2150145 - RNA, 16 nt, Homo sapiens
uccucaugucaucaaa

SEQ ID NO: 2150146 - RNA, 19 nt, Homo sapiens
uaugagcuugcucauuaau

SEQ ID NO: 2150147 - RNA, 18 nt, Homo sapiens
gucaugaauucuucucaa

SEQ ID NO: 2150148 - RNA, 18 nt, Homo sapiens
uagaggcugggggcucca

SEQ ID NO: 2150149 - RNA, 13 nt, Homo sapiens
ccuuuucauuuaa

SEQ ID NO: 2150150 - RNA, 22 nt, Homo sapiens
ugucuuacagagaaaagacaua

SEQ ID NO: 2150151 - RNA, 19 nt, Homo sapiens
uuauaaaaauacaacuaga

SEQ ID NO: 2150152 - RNA, 19 nt, Homo sapiens
uugcuccuggguucaagua

SEQ ID NO: 2150153 - RNA, 18 nt, Homo sapiens
acacuaaugggaagacca

SEQ ID NO: 2150154 - RNA, 17 nt, Homo sapiens
cucacuguccaauauga

SEQ ID NO: 2150155 - RNA, 15 nt, Homo sapiens
uuuccuucagugcau

SEQ ID NO: 2150156 - RNA, 17 nt, Homo sapiens
gauggaacaucagugga

SEQ ID NO: 2150157 - RNA, 15 nt, Homo sapiens
guuuguuuuugcaca

SEQ ID NO: 2150158 - RNA, 16 nt, Homo sapiens
agcuacccacuauccu

SEQ ID NO: 2150159 - RNA, 19 nt, Homo sapiens
acugacaaccucauccagg

SEQ ID NO: 2150160 - RNA, 15 nt, Homo sapiens
ugacuggcaguauua

SEQ ID NO: 2150161 - RNA, 21 nt, Homo sapiens
gucauguuugcaggggugacg

SEQ ID NO: 2150162 - RNA, 20 nt, Homo sapiens
ucuaguucaaauuauuugga

SEQ ID NO: 2150163 - RNA, 12 nt, Homo sapiens
aaaguccacaag

SEQ ID NO: 2150164 - RNA, 20 nt, Homo sapiens
auugccuuuagugaucacag

SEQ ID NO: 2150165 - RNA, 19 nt, Homo sapiens
gaaucggcauguauacuua

SEQ ID NO: 2150166 - RNA, 14 nt, Homo sapiens
cacuccggcuccua

SEQ ID NO: 2150167 - RNA, 14 nt, Homo sapiens
agaucauuucccaa

SEQ ID NO: 2150168 - RNA, 23 nt, Homo sapiens
cggcaggcguguggcagccacac

SEQ ID NO: 2150169 - RNA, 22 nt, Homo sapiens
guuaaacuguuagcacuguuga

SEQ ID NO: 2150170 - RNA, 14 nt, Homo sapiens
uaauagaaaacugu

SEQ ID NO: 2150171 - RNA, 13 nt, Homo sapiens
cucuguacacugc

SEQ ID NO: 2150172 - RNA, 22 nt, Homo sapiens
guucuuggguaaggaaauggaa

SEQ ID NO: 2150173 - RNA, 16 nt, Homo sapiens
agcaauacuaagggaa

SEQ ID NO: 2150174 - RNA, 17 nt, Homo sapiens
gcugccuaggcugaccu

SEQ ID NO: 2150175 - RNA, 21 nt, Homo sapiens
accccaaauuguguauauauc

SEQ ID NO: 2150176 - RNA, 16 nt, Homo sapiens
auguaaaaacuuucac

SEQ ID NO: 2150177 - RNA, 18 nt, Homo sapiens
acagccuggcacagggca

SEQ ID NO: 2150178 - RNA, 15 nt, Homo sapiens
aguggcgugaucuca

SEQ ID NO: 2150179 - RNA, 15 nt, Homo sapiens
aguggcaugaucucg

SEQ ID NO: 2150180 - RNA, 16 nt, Homo sapiens
cagcccugccauguca

SEQ ID NO: 2150181 - RNA, 17 nt, Homo sapiens
gucuucacaacuuugac

SEQ ID NO: 2150182 - RNA, 15 nt, Homo sapiens
uguacuguuacugug

SEQ ID NO: 2150183 - RNA, 18 nt, Homo sapiens
agcuuggggccaccaaag

SEQ ID NO: 2150184 - RNA, 20 nt, Homo sapiens
aaagacagcuagauuuugcu

SEQ ID NO: 2150185 - RNA, 20 nt, Homo sapiens
cugcuucaccaaggagcuac

SEQ ID NO: 2150186 - RNA, 23 nt, Homo sapiens
accuguaauaaauaugagugcca

SEQ ID NO: 2150187 - RNA, 15 nt, Homo sapiens
ggaagggacugccaa

SEQ ID NO: 2150188 - RNA, 13 nt, Homo sapiens
ugggccaccagcc

SEQ ID NO: 2150189 - RNA, 13 nt, Homo sapiens
cagcccacugggc

SEQ ID NO: 2150190 - RNA, 19 nt, Homo sapiens
uagagguucaaaggcagca

SEQ ID NO: 2150191 - RNA, 17 nt, Homo sapiens
gccaguugaucugcucu

SEQ ID NO: 2150192 - RNA, 12 nt, Homo sapiens
acgaaugaauga

SEQ ID NO: 2150193 - RNA, 12 nt, Homo sapiens
auuaaugaacua

SEQ ID NO: 2150194 - RNA, 13 nt, Homo sapiens
cuucaccaaagag

SEQ ID NO: 2150195 - RNA, 13 nt, Homo sapiens
aauagccacugca

SEQ ID NO: 2150196 - RNA, 19 nt, Homo sapiens
uuuguucacuucgaugacu

SEQ ID NO: 2150197 - RNA, 23 nt, Homo sapiens
uuuuaaauuugaagaugggaugu

SEQ ID NO: 2150198 - RNA, 17 nt, Homo sapiens
gcaggagaaucgcuuga

SEQ ID NO: 2150199 - RNA, 13 nt, Homo sapiens
aguggacaggaag

SEQ ID NO: 2150200 - RNA, 16 nt, Homo sapiens
uagacggugcucacuc

SEQ ID NO: 2150201 - RNA, 13 nt, Homo sapiens
uucccaacuccag

SEQ ID NO: 2150202 - RNA, 21 nt, Homo sapiens
gcaucucauugaggacaaaga

SEQ ID NO: 2150203 - RNA, 18 nt, Homo sapiens
uauaugaucaaacuucca

SEQ ID NO: 2150204 - RNA, 23 nt, Homo sapiens
gguucaagcaauccuccuaccuc

SEQ ID NO: 2150205 - RNA, 17 nt, Homo sapiens
cuguuucaacagaugac

SEQ ID NO: 2150206 - RNA, 22 nt, Homo sapiens
cuacugggcugcauucccauga

SEQ ID NO: 2150207 - RNA, 16 nt, Homo sapiens
aguguucaacugugag

SEQ ID NO: 2150208 - RNA, 20 nt, Homo sapiens
aagacuauucaaacagucuc

SEQ ID NO: 2150209 - RNA, 17 nt, Homo sapiens
ccucaguagucccugca

SEQ ID NO: 2150210 - RNA, 17 nt, Homo sapiens
gcuaaguggaagacaga

SEQ ID NO: 2150211 - RNA, 14 nt, Homo sapiens
ugguuccaugcagc

SEQ ID NO: 2150212 - RNA, 15 nt, Homo sapiens
ccguaucacaguguu

SEQ ID NO: 2150213 - RNA, 11 nt, Homo sapiens
cccugagcucu

SEQ ID NO: 2150214 - RNA, 19 nt, Homo sapiens
aaaguuguauuucaaauau

SEQ ID NO: 2150215 - RNA, 16 nt, Homo sapiens
cccaggacugcauugu

SEQ ID NO: 2150216 - RNA, 16 nt, Homo sapiens
acagacauacauuucu

SEQ ID NO: 2150217 - RNA, 21 nt, Homo sapiens
ggaaauaagcaaaaaacugca

SEQ ID NO: 2150218 - RNA, 13 nt, Homo sapiens
acuuggacaucuc

SEQ ID NO: 2150219 - RNA, 20 nt, Homo sapiens
aauuuucagauuugcacaaa

SEQ ID NO: 2150220 - RNA, 15 nt, Homo sapiens
gcccuuccuugccag

SEQ ID NO: 2150221 - RNA, 21 nt, Homo sapiens
cugaccaauauuguacaguuu

SEQ ID NO: 2150222 - RNA, 15 nt, Homo sapiens
cccggacaguggcac

SEQ ID NO: 2150223 - RNA, 15 nt, Homo sapiens
uccgugacagcacuu

SEQ ID NO: 2150224 - RNA, 21 nt, Homo sapiens
cuagacuucccaacagccuua

SEQ ID NO: 2150225 - RNA, 20 nt, Homo sapiens
uaaauauauuuuagugacag

SEQ ID NO: 2150226 - RNA, 22 nt, Homo sapiens
acugccaggcucucuuugccca

SEQ ID NO: 2150227 - RNA, 15 nt, Homo sapiens
uggccccaggguuga

SEQ ID NO: 2150228 - RNA, 21 nt, Homo sapiens
uuuuucccaaguacccugaga

SEQ ID NO: 2150229 - RNA, 20 nt, Homo sapiens
gaccuucuccuucaccuuug

SEQ ID NO: 2150230 - RNA, 16 nt, Homo sapiens
cuucuuacaaugcauu

SEQ ID NO: 2150231 - RNA, 22 nt, Homo sapiens
ucacaccacuagccucaggggu

SEQ ID NO: 2150232 - RNA, 20 nt, Homo sapiens
ugcccaguaucauacguuga

SEQ ID NO: 2150233 - RNA, 11 nt, Homo sapiens
ggggccuguuu

SEQ ID NO: 2150234 - RNA, 22 nt, Homo sapiens
uaacccaaaaggccuuacaaau

SEQ ID NO: 2150235 - RNA, 16 nt, Homo sapiens
augugcucagccaaau

SEQ ID NO: 2150236 - RNA, 14 nt, Homo sapiens
uaguccaccuucau

SEQ ID NO: 2150237 - RNA, 21 nt, Homo sapiens
gauacauuuggauaaacaaca

SEQ ID NO: 2150238 - RNA, 18 nt, Homo sapiens
uuuuauaagagggaacaa

SEQ ID NO: 2150239 - RNA, 22 nt, Homo sapiens
gagcacaggagcugccauguca

SEQ ID NO: 2150240 - RNA, 20 nt, Homo sapiens
uaaaagaguuaacaucccau

SEQ ID NO: 2150241 - RNA, 20 nt, Homo sapiens
gaggaaaagugcaaguccau

SEQ ID NO: 2150242 - RNA, 20 nt, Homo sapiens
guauucuacagcagauacuu

SEQ ID NO: 2150243 - RNA, 22 nt, Homo sapiens
auguaugucugcaggugucuga

SEQ ID NO: 2150244 - RNA, 12 nt, Homo sapiens
cugggccuagca

SEQ ID NO: 2150245 - RNA, 20 nt, Homo sapiens
uuugauggagggacuggggu

SEQ ID NO: 2150246 - RNA, 18 nt, Homo sapiens
gcucauugcuaaccacug

SEQ ID NO: 2150247 - RNA, 13 nt, Homo sapiens
augaaguagcuga

SEQ ID NO: 2150248 - RNA, 20 nt, Homo sapiens
caucaguagcugagugcacu

SEQ ID NO: 2150249 - RNA, 19 nt, Homo sapiens
uacagauuuuagacaagga

SEQ ID NO: 2150250 - RNA, 21 nt, Homo sapiens
agagucuucuuugugccugag

SEQ ID NO: 2150251 - RNA, 17 nt, Homo sapiens
gugccaguggcuuauua

SEQ ID NO: 2150252 - RNA, 15 nt, Homo sapiens
cagaucuugccucca

SEQ ID NO: 2150253 - RNA, 18 nt, Homo sapiens
gcagagguggaaaaugau

SEQ ID NO: 2150254 - RNA, 13 nt, Homo sapiens
cuaaauaaauggg

SEQ ID NO: 2150255 - RNA, 23 nt, Homo sapiens
cacaggauauuuuggggggcaga

SEQ ID NO: 2150256 - RNA, 19 nt, Homo sapiens
agcccugcaccaugcugcu

SEQ ID NO: 2150257 - RNA, 16 nt, Homo sapiens
cagucaacaguucaaa

SEQ ID NO: 2150258 - RNA, 20 nt, Homo sapiens
uaaaccaagaaggagaccuu

SEQ ID NO: 2150259 - RNA, 14 nt, Homo sapiens
aggcaaauggcaca

SEQ ID NO: 2150260 - RNA, 15 nt, Homo sapiens
caaaauaacauuuga

SEQ ID NO: 2150261 - RNA, 12 nt, Homo sapiens
acgaaacauuua

SEQ ID NO: 2150262 - RNA, 12 nt, Homo sapiens
cuuauggccaau

SEQ ID NO: 2150263 - RNA, 12 nt, Homo sapiens
uauuuggcuuaa

SEQ ID NO: 2150264 - RNA, 19 nt, Homo sapiens
aacucacaggugacucuaa

SEQ ID NO: 2150265 - RNA, 12 nt, Homo sapiens
caggaaaccaga

SEQ ID NO: 2150266 - RNA, 21 nt, Homo sapiens
uugaaaggacuagccacauac

SEQ ID NO: 2150267 - RNA, 23 nt, Homo sapiens
gaugauuuuggccucauuacuuu

SEQ ID NO: 2150268 - RNA, 19 nt, Homo sapiens
uccucaacaacaaaccaaa

SEQ ID NO: 2150269 - RNA, 16 nt, Homo sapiens
gaaaauugcaauacau

SEQ ID NO: 2150270 - RNA, 19 nt, Homo sapiens
ucauguaaggcuuaacaca

SEQ ID NO: 2150271 - RNA, 22 nt, Homo sapiens
acuacacauucaauaagcauca

SEQ ID NO: 2150272 - RNA, 23 nt, Homo sapiens
gccauauuaauugccuguuaaau

SEQ ID NO: 2150273 - RNA, 21 nt, Homo sapiens
ucuaauaaugcacucaguuua

SEQ ID NO: 2150274 - RNA, 19 nt, Homo sapiens
caguaaucaguuugcuaac

SEQ ID NO: 2150275 - RNA, 16 nt, Homo sapiens
ugagucccagagccaa

SEQ ID NO: 2150276 - RNA, 19 nt, Homo sapiens
ccagaaagcuaggucgugg

SEQ ID NO: 2150277 - RNA, 13 nt, Homo sapiens
caaugggagcaca

SEQ ID NO: 2150278 - RNA, 11 nt, Homo sapiens
ggagugccacg

SEQ ID NO: 2150279 - RNA, 18 nt, Homo sapiens
gccaaucaguagccagca

SEQ ID NO: 2150280 - RNA, 14 nt, Homo sapiens
cucaacguuacauu

SEQ ID NO: 2150281 - RNA, 23 nt, Homo sapiens
uggaaguccuugcccacuuccca

SEQ ID NO: 2150282 - RNA, 17 nt, Homo sapiens
accucagccccacugac

SEQ ID NO: 2150283 - RNA, 12 nt, Homo sapiens
gaagauaucaug

SEQ ID NO: 2150284 - RNA, 14 nt, Homo sapiens
auguuccucaaaag

SEQ ID NO: 2150285 - RNA, 18 nt, Homo sapiens
gcuuuaaaaaucauugua

SEQ ID NO: 2150286 - RNA, 14 nt, Homo sapiens
agccagcaguucag

SEQ ID NO: 2150287 - RNA, 22 nt, Homo sapiens
gcuuccuucauuuccuccguca

SEQ ID NO: 2150288 - RNA, 17 nt, Homo sapiens
caaaaacuagacauuau

SEQ ID NO: 2150289 - RNA, 13 nt, Homo sapiens
uccuaaagagaca

SEQ ID NO: 2150290 - RNA, 19 nt, Homo sapiens
gcuguucacucucucgucu

SEQ ID NO: 2150291 - RNA, 17 nt, Homo sapiens
cagaucuagucaaucaa

SEQ ID NO: 2150292 - RNA, 19 nt, Homo sapiens
uuuaacucagacucuggau

SEQ ID NO: 2150293 - RNA, 18 nt, Homo sapiens
aauucaaguuaaugcaaa

SEQ ID NO: 2150294 - RNA, 16 nt, Homo sapiens
uccagaacacaaccuu

SEQ ID NO: 2150295 - RNA, 14 nt, Homo sapiens
gaggaccagguguc

SEQ ID NO: 2150296 - RNA, 19 nt, Homo sapiens
aggcucuuccuugaaucuu

SEQ ID NO: 2150297 - RNA, 16 nt, Homo sapiens
accaguacucaguaua

SEQ ID NO: 2150298 - RNA, 15 nt, Homo sapiens
uuauaccgcagagua

SEQ ID NO: 2150299 - RNA, 16 nt, Homo sapiens
ugugauauuugacaga

SEQ ID NO: 2150300 - RNA, 15 nt, Homo sapiens
accugucaaccugaa

SEQ ID NO: 2150301 - RNA, 18 nt, Homo sapiens
aggguggacuucagugug

SEQ ID NO: 2150302 - RNA, 18 nt, Homo sapiens
caggaugguuucuuuaaa

SEQ ID NO: 2150303 - RNA, 22 nt, Homo sapiens
uaagacaaauauuccuuugcau

SEQ ID NO: 2150304 - RNA, 23 nt, Homo sapiens
cugagaaggcuaaagaagacaca

SEQ ID NO: 2150305 - RNA, 21 nt, Homo sapiens
ucagauaagguaaaaugccau

SEQ ID NO: 2150306 - RNA, 20 nt, Homo sapiens
auuuugaaguaccaccaaaa

SEQ ID NO: 2150307 - RNA, 16 nt, Homo sapiens
gugguagguguuugaa

SEQ ID NO: 2150308 - RNA, 23 nt, Homo sapiens
uggagggguggcccagagccaua

SEQ ID NO: 2150309 - RNA, 23 nt, Homo sapiens
ucuaugcucucgcaccuuuccaa

SEQ ID NO: 2150310 - RNA, 17 nt, Homo sapiens
gcucugagccagauuac

SEQ ID NO: 2150311 - RNA, 13 nt, Homo sapiens
uaaccacagcucc

SEQ ID NO: 2150312 - RNA, 18 nt, Homo sapiens
cagaucaccugaggucag

SEQ ID NO: 2150313 - RNA, 19 nt, Homo sapiens
cuacuguuuaaauucccau

SEQ ID NO: 2150314 - RNA, 16 nt, Homo sapiens
auuaauaagaacuuga

SEQ ID NO: 2150315 - RNA, 20 nt, Homo sapiens
agcugcuugggcuucauccu

SEQ ID NO: 2150316 - RNA, 21 nt, Homo sapiens
uauucccaaaaauuacuuugg

SEQ ID NO: 2150317 - RNA, 11 nt, Homo sapiens
aguuguugaug

SEQ ID NO: 2150318 - RNA, 17 nt, Homo sapiens
cccaguaccgcaucucc

SEQ ID NO: 2150319 - RNA, 12 nt, Homo sapiens
cucuccagugaa

SEQ ID NO: 2150320 - RNA, 21 nt, Homo sapiens
cugauagggauacaugcucuu

SEQ ID NO: 2150321 - RNA, 13 nt, Homo sapiens
ccacagggugagc

SEQ ID NO: 2150322 - RNA, 17 nt, Homo sapiens
cagcuaacaauugugaa

SEQ ID NO: 2150323 - RNA, 13 nt, Homo sapiens
aucccugccaaga

SEQ ID NO: 2150324 - RNA, 18 nt, Homo sapiens
gagaccuucacagagaca

SEQ ID NO: 2150325 - RNA, 16 nt, Homo sapiens
uaguguccuaugcaau

SEQ ID NO: 2150326 - RNA, 19 nt, Homo sapiens
ucaccuaaacccucuguga

SEQ ID NO: 2150327 - RNA, 13 nt, Homo sapiens
gguucaagugauu

SEQ ID NO: 2150328 - RNA, 17 nt, Homo sapiens
uaagacauaaauuacuu

SEQ ID NO: 2150329 - RNA, 16 nt, Homo sapiens
guuuauaauuguuaua

SEQ ID NO: 2150330 - RNA, 20 nt, Homo sapiens
ucuaaugauauaaauuucag

SEQ ID NO: 2150331 - RNA, 14 nt, Homo sapiens
auucggugugcugc

SEQ ID NO: 2150332 - RNA, 18 nt, Homo sapiens
auacaaagcaaacaaacu

SEQ ID NO: 2150333 - RNA, 14 nt, Homo sapiens
ggccacacugguca

SEQ ID NO: 2150334 - RNA, 21 nt, Homo sapiens
cucugggcagcugucauggaa

SEQ ID NO: 2150335 - RNA, 20 nt, Homo sapiens
cauuuacaagugcugcaagu

SEQ ID NO: 2150336 - RNA, 15 nt, Homo sapiens
aaaaacuguacugug

SEQ ID NO: 2150337 - RNA, 15 nt, Homo sapiens
cuaaaccauugugca

SEQ ID NO: 2150338 - RNA, 15 nt, Homo sapiens
ucuacccaaaggaua

SEQ ID NO: 2150339 - RNA, 19 nt, Homo sapiens
uacuaaaucuaaucaggaa

SEQ ID NO: 2150340 - RNA, 19 nt, Homo sapiens
ugauuuauucuggugucua

SEQ ID NO: 2150341 - RNA, 22 nt, Homo sapiens
uuccuuuaugaugacugcuuaa

SEQ ID NO: 2150342 - RNA, 13 nt, Homo sapiens
ugcccguggugag

SEQ ID NO: 2150343 - RNA, 19 nt, Homo sapiens
uucaugaauugcgccucag

SEQ ID NO: 2150344 - RNA, 14 nt, Homo sapiens
cugguuccaugccu

SEQ ID NO: 2150345 - RNA, 17 nt, Homo sapiens
cccucccccuaaggcag

SEQ ID NO: 2150346 - RNA, 23 nt, Homo sapiens
ccccacaauuccauuacuaagaa

SEQ ID NO: 2150347 - RNA, 17 nt, Homo sapiens
aggcaggagaugcugca

SEQ ID NO: 2150348 - RNA, 14 nt, Homo sapiens
gagacgacaggcga

SEQ ID NO: 2150349 - RNA, 20 nt, Homo sapiens
cacgcacacacacaaacaca

SEQ ID NO: 2150350 - RNA, 19 nt, Homo sapiens
ccuggaccccugcauugga

SEQ ID NO: 2150351 - RNA, 23 nt, Homo sapiens
agccaagguagggucacuaacca

SEQ ID NO: 2150352 - RNA, 22 nt, Homo sapiens
cagaacaccuaugcaaagauga

SEQ ID NO: 2150353 - RNA, 23 nt, Homo sapiens
gcgaauuuuaaaagaugcaaugu

SEQ ID NO: 2150354 - RNA, 15 nt, Homo sapiens
gucugaagugcuaau

SEQ ID NO: 2150355 - RNA, 18 nt, Homo sapiens
gaguugcaagaugcccua

SEQ ID NO: 2150356 - RNA, 13 nt, Homo sapiens
gauuucauuugaa

SEQ ID NO: 2150357 - RNA, 17 nt, Homo sapiens
cugaugaugguauaaag

SEQ ID NO: 2150358 - RNA, 21 nt, Homo sapiens
aaggagucccugguucauuga

SEQ ID NO: 2150359 - RNA, 22 nt, Homo sapiens
uauuacuuauuuuugacagugu

SEQ ID NO: 2150360 - RNA, 17 nt, Homo sapiens
ucuaaccugauuuaccu

SEQ ID NO: 2150361 - RNA, 12 nt, Homo sapiens
agacaccugguu

SEQ ID NO: 2150362 - RNA, 20 nt, Homo sapiens
ccuggcugcugccauaguuu

SEQ ID NO: 2150363 - RNA, 19 nt, Homo sapiens
uuauaaaucuuucucucac

SEQ ID NO: 2150364 - RNA, 17 nt, Homo sapiens
uaccuuuccagggucaa

SEQ ID NO: 2150365 - RNA, 18 nt, Homo sapiens
ccaagcauuuagugcaca

SEQ ID NO: 2150366 - RNA, 20 nt, Homo sapiens
auacacauccccagccagaa

SEQ ID NO: 2150367 - RNA, 20 nt, Homo sapiens
uccucccuuccucaccucca

SEQ ID NO: 2150368 - RNA, 19 nt, Homo sapiens
cauuagaaaggcuaacaaa

SEQ ID NO: 2150369 - RNA, 19 nt, Homo sapiens
auccaucaggacuugggaa

SEQ ID NO: 2150370 - RNA, 19 nt, Homo sapiens
auaaacuuuuagaaacuua

SEQ ID NO: 2150371 - RNA, 19 nt, Homo sapiens
aggauauuugagucacuug

SEQ ID NO: 2150372 - RNA, 23 nt, Homo sapiens
cuuguccuagcacagauggccag

SEQ ID NO: 2150373 - RNA, 19 nt, Homo sapiens
uuacaaagacaaagccuua

SEQ ID NO: 2150374 - RNA, 20 nt, Homo sapiens
aucaauaaauguugcaaugc

SEQ ID NO: 2150375 - RNA, 20 nt, Homo sapiens
gggaagggugguggagccag

SEQ ID NO: 2150376 - RNA, 17 nt, Homo sapiens
gacccagggacucucca

SEQ ID NO: 2150377 - RNA, 12 nt, Homo sapiens
cuguuaccaaau

SEQ ID NO: 2150378 - RNA, 14 nt, Homo sapiens
auuuacaagcacga

SEQ ID NO: 2150379 - RNA, 13 nt, Homo sapiens
uuggcaacagaaa

SEQ ID NO: 2150380 - RNA, 19 nt, Homo sapiens
gcuucccugucuauugccu

SEQ ID NO: 2150381 - RNA, 12 nt, Homo sapiens
ugcaguacuuga

SEQ ID NO: 2150382 - RNA, 20 nt, Homo sapiens
acaauaaaggcugagcucuu

SEQ ID NO: 2150383 - RNA, 16 nt, Homo sapiens
aguuugggccagugaa

SEQ ID NO: 2150384 - RNA, 20 nt, Homo sapiens
uaauacauuggaggcuuuau

SEQ ID NO: 2150385 - RNA, 20 nt, Homo sapiens
aggaagggguuuucccauga

SEQ ID NO: 2150386 - RNA, 19 nt, Homo sapiens
gagaguucaauggcugcug

SEQ ID NO: 2150387 - RNA, 22 nt, Homo sapiens
gggcaggggugcuuccuccuca

SEQ ID NO: 2150388 - RNA, 12 nt, Homo sapiens
uugcaugaaauu

SEQ ID NO: 2150389 - RNA, 14 nt, Homo sapiens
uggcaacaccuccu

SEQ ID NO: 2150390 - RNA, 20 nt, Homo sapiens
gguuagggaaaacauuccau

SEQ ID NO: 2150391 - RNA, 18 nt, Homo sapiens
guccacacggucuucaca

SEQ ID NO: 2150392 - RNA, 17 nt, Homo sapiens
acuuaaggggcugggau

SEQ ID NO: 2150393 - RNA, 17 nt, Homo sapiens
acuuaggaggcugaggu

SEQ ID NO: 2150394 - RNA, 21 nt, Homo sapiens
ucaaguccaucaaguaccuca

SEQ ID NO: 2150395 - RNA, 15 nt, Homo sapiens
caggcucaggccaaa

SEQ ID NO: 2150396 - RNA, 22 nt, Homo sapiens
ccuacuccguuccuggcauuug

SEQ ID NO: 2150397 - RNA, 20 nt, Homo sapiens
agaugaaggagaggcaacau

SEQ ID NO: 2150398 - RNA, 21 nt, Homo sapiens
uacauccuuguggcacauuuu

SEQ ID NO: 2150399 - RNA, 13 nt, Homo sapiens
cucauuauuacca

SEQ ID NO: 2150400 - RNA, 19 nt, Homo sapiens
aaucuugcaaauauuuuag

SEQ ID NO: 2150401 - RNA, 14 nt, Homo sapiens
aaaccucuccugac

SEQ ID NO: 2150402 - RNA, 17 nt, Homo sapiens
cauccagcuucucaugu

SEQ ID NO: 2150403 - RNA, 10 nt, Homo sapiens
uuuacuuuag

SEQ ID NO: 2150404 - RNA, 14 nt, Homo sapiens
uuguaauuauggag

SEQ ID NO: 2150405 - RNA, 12 nt, Homo sapiens
cucaucucacug

SEQ ID NO: 2150406 - RNA, 22 nt, Homo sapiens
agcuuccccaggagcucucugc

SEQ ID NO: 2150407 - RNA, 13 nt, Homo sapiens
uggagacacugag

SEQ ID NO: 2150408 - RNA, 18 nt, Homo sapiens
cauuccaaauagcccaca

SEQ ID NO: 2150409 - RNA, 20 nt, Homo sapiens
accaucugaagaaacuuccc

SEQ ID NO: 2150410 - RNA, 12 nt, Homo sapiens
aguuaagcuuuu

SEQ ID NO: 2150411 - RNA, 17 nt, Homo sapiens
ucuaacugugacaaaga

SEQ ID NO: 2150412 - RNA, 23 nt, Homo sapiens
acaaaugcuuuuccaacccauga

SEQ ID NO: 2150413 - RNA, 19 nt, Homo sapiens
aagaauaaacuccauuuaa

SEQ ID NO: 2150414 - RNA, 16 nt, Homo sapiens
uagaccuguucuuucc

SEQ ID NO: 2150415 - RNA, 22 nt, Homo sapiens
uaauuuuuccuauauugcauua

SEQ ID NO: 2150416 - RNA, 18 nt, Homo sapiens
cuuaguaaguaauaucaa

SEQ ID NO: 2150417 - RNA, 13 nt, Homo sapiens
cagugcccuaggc

SEQ ID NO: 2150418 - RNA, 18 nt, Homo sapiens
acuauggauguguucucu

SEQ ID NO: 2150419 - RNA, 14 nt, Homo sapiens
cugccgcauuuccu

SEQ ID NO: 2150420 - RNA, 19 nt, Homo sapiens
ccgucuuuugaaaacucau

SEQ ID NO: 2150421 - RNA, 24 nt, Homo sapiens
aguucuacgugggagucugugcau

SEQ ID NO: 2150422 - RNA, 18 nt, Homo sapiens
guccuucacaucacccau

SEQ ID NO: 2150423 - RNA, 14 nt, Homo sapiens
agcuaaaacuggcc

SEQ ID NO: 2150424 - RNA, 23 nt, Homo sapiens
gaggugaacaagcaaacccagac

SEQ ID NO: 2150425 - RNA, 23 nt, Homo sapiens
cuaaguaaucucacagcauuugc

SEQ ID NO: 2150426 - RNA, 20 nt, Homo sapiens
agaugaagcaaacacauuaa

SEQ ID NO: 2150427 - RNA, 12 nt, Homo sapiens
cuauguuugugu

SEQ ID NO: 2150428 - RNA, 22 nt, Homo sapiens
cacccuugccauggagguuaag

SEQ ID NO: 2150429 - RNA, 15 nt, Homo sapiens
guugccucucuugcc

SEQ ID NO: 2150430 - RNA, 11 nt, Homo sapiens
agcacagccaa

SEQ ID NO: 2150431 - RNA, 19 nt, Homo sapiens
ucucaauguuccauucagu

SEQ ID NO: 2150432 - RNA, 16 nt, Homo sapiens
ccuccagaauggagcu

SEQ ID NO: 2150433 - RNA, 17 nt, Homo sapiens
uacugcagaucaagaaa

SEQ ID NO: 2150434 - RNA, 14 nt, Homo sapiens
acaagcaucaugga

SEQ ID NO: 2150435 - RNA, 16 nt, Homo sapiens
auuuuaaacacuuaca

SEQ ID NO: 2150436 - RNA, 14 nt, Homo sapiens
cagcuaucagcucu

SEQ ID NO: 2150437 - RNA, 23 nt, Homo sapiens
accuuguguguuccaaguuucca

SEQ ID NO: 2150438 - RNA, 21 nt, Homo sapiens
gaggccacauugcuggcugcc

SEQ ID NO: 2150439 - RNA, 13 nt, Homo sapiens
cccagacucagcu

SEQ ID NO: 2150440 - RNA, 14 nt, Homo sapiens
aagaacaacagaaa

SEQ ID NO: 2150441 - RNA, 17 nt, Homo sapiens
accucuguuguccuccc

SEQ ID NO: 2150442 - RNA, 16 nt, Homo sapiens
cuuccaguuugcuuug

SEQ ID NO: 2150443 - RNA, 16 nt, Homo sapiens
ucccauggguuaagag

SEQ ID NO: 2150444 - RNA, 18 nt, Homo sapiens
agagucccggagcucaag

SEQ ID NO: 2150445 - RNA, 14 nt, Homo sapiens
cagaccuccguuca

SEQ ID NO: 2150446 - RNA, 17 nt, Homo sapiens
gacccuggucaccagag

SEQ ID NO: 2150447 - RNA, 15 nt, Homo sapiens
caaagcaagcauuca

SEQ ID NO: 2150448 - RNA, 17 nt, Homo sapiens
ucuucaauaaauuaagu

SEQ ID NO: 2150449 - RNA, 15 nt, Homo sapiens
ccccuggcagcacag

SEQ ID NO: 2150450 - RNA, 15 nt, Homo sapiens
cacuuuauugcaaug

SEQ ID NO: 2150451 - RNA, 17 nt, Homo sapiens
cuagugggaaggggugc

SEQ ID NO: 2150452 - RNA, 19 nt, Homo sapiens
cuacagcuaacccucacaa

SEQ ID NO: 2150453 - RNA, 15 nt, Homo sapiens
gaugcguauucugug

SEQ ID NO: 2150454 - RNA, 14 nt, Homo sapiens
augguagagcaaua

SEQ ID NO: 2150455 - RNA, 21 nt, Homo sapiens
uacucaauguuacuaucugcu

SEQ ID NO: 2150456 - RNA, 15 nt, Homo sapiens
aauucagucugcucu

SEQ ID NO: 2150457 - RNA, 13 nt, Homo sapiens
aggaugggaccaa

SEQ ID NO: 2150458 - RNA, 17 nt, Homo sapiens
uacauauguauacaugu

SEQ ID NO: 2150459 - RNA, 14 nt, Homo sapiens
uuacauuuuaguua

SEQ ID NO: 2150460 - RNA, 17 nt, Homo sapiens
agugaacacucaguggc

SEQ ID NO: 2150461 - RNA, 17 nt, Homo sapiens
ucuugcagucaucagaa

SEQ ID NO: 2150462 - RNA, 20 nt, Homo sapiens
caggaaggucugauuugcag

SEQ ID NO: 2150463 - RNA, 20 nt, Homo sapiens
agcuaccuugucauaugugu

SEQ ID NO: 2150464 - RNA, 22 nt, Homo sapiens
gccucugcggagcacacuggcu

SEQ ID NO: 2150465 - RNA, 12 nt, Homo sapiens
gauacacauuac

SEQ ID NO: 2150466 - RNA, 12 nt, Homo sapiens
uagaaaguaaaa

SEQ ID NO: 2150467 - RNA, 19 nt, Homo sapiens
uuaucaugcaaaugcugua

SEQ ID NO: 2150468 - RNA, 17 nt, Homo sapiens
aauguuuguuucagugc

SEQ ID NO: 2150469 - RNA, 14 nt, Homo sapiens
cccacuguccagca

SEQ ID NO: 2150470 - RNA, 23 nt, Homo sapiens
ucaauuuacuuuuuaaacagugu

SEQ ID NO: 2150471 - RNA, 15 nt, Homo sapiens
cuguagccacuggca

SEQ ID NO: 2150472 - RNA, 18 nt, Homo sapiens
uuaauacuucacacagaa

SEQ ID NO: 2150473 - RNA, 22 nt, Homo sapiens
ucaguugaaaaugcaacucuaa

SEQ ID NO: 2150474 - RNA, 22 nt, Homo sapiens
guucaaagacugugaacagcuu

SEQ ID NO: 2150475 - RNA, 20 nt, Homo sapiens
caucuaagucaguuucacau

SEQ ID NO: 2150476 - RNA, 17 nt, Homo sapiens
aaagggguugaggaaug

SEQ ID NO: 2150477 - RNA, 13 nt, Homo sapiens
cuggagcacugua

SEQ ID NO: 2150478 - RNA, 12 nt, Homo sapiens
cuugaagccaaa

SEQ ID NO: 2150479 - RNA, 14 nt, Homo sapiens
uaaucaaaugauuu

SEQ ID NO: 2150480 - RNA, 12 nt, Homo sapiens
aauaaagcauag

SEQ ID NO: 2150481 - RNA, 14 nt, Homo sapiens
gacuauggguacau

SEQ ID NO: 2150482 - RNA, 18 nt, Homo sapiens
uaaaugcugagauccuca

SEQ ID NO: 2150483 - RNA, 12 nt, Homo sapiens
caucuuaccucu

SEQ ID NO: 2150484 - RNA, 21 nt, Homo sapiens
ucucuuaaucacaagauuauu

SEQ ID NO: 2150485 - RNA, 16 nt, Homo sapiens
gaucaaaguugaugaa

SEQ ID NO: 2150486 - RNA, 12 nt, Homo sapiens
ggaauguaggga

SEQ ID NO: 2150487 - RNA, 12 nt, Homo sapiens
auguuguaauau

SEQ ID NO: 2150488 - RNA, 22 nt, Homo sapiens
uuaaaaguuuuugucacuaucu

SEQ ID NO: 2150489 - RNA, 21 nt, Homo sapiens
ugcuucaacaacuuugugcuu

SEQ ID NO: 2150490 - RNA, 15 nt, Homo sapiens
uuuguucuuacacau

SEQ ID NO: 2150491 - RNA, 15 nt, Homo sapiens
gaaguucuaggaaau

SEQ ID NO: 2150492 - RNA, 24 nt, Homo sapiens
aacaugaaucaaaagugccucaag

SEQ ID NO: 2150493 - RNA, 22 nt, Homo sapiens
aaguuucccuucucccagucca

SEQ ID NO: 2150494 - RNA, 15 nt, Homo sapiens
uuccccuugccuaaa

SEQ ID NO: 2150495 - RNA, 18 nt, Homo sapiens
caugaagaaauacugcac

SEQ ID NO: 2150496 - RNA, 21 nt, Homo sapiens
aagaagacaucuguggccaac

SEQ ID NO: 2150497 - RNA, 23 nt, Homo sapiens
gagccauauuaauugccuguuaa

SEQ ID NO: 2150498 - RNA, 20 nt, Homo sapiens
cucugauccgagcucagggg

SEQ ID NO: 2150499 - RNA, 18 nt, Homo sapiens
auaaaccaccucccaaag

SEQ ID NO: 2150500 - RNA, 23 nt, Homo sapiens
gcaaagugcugcuggaaguagaa

SEQ ID NO: 2150501 - RNA, 18 nt, Homo sapiens
agauaauuaccuacucug

SEQ ID NO: 2150502 - RNA, 14 nt, Homo sapiens
ccagagcuucaggg

SEQ ID NO: 2150503 - RNA, 19 nt, Homo sapiens
cuguaauuaauaucuugcu

SEQ ID NO: 2150504 - RNA, 19 nt, Homo sapiens
agcacuguauguguugcac

SEQ ID NO: 2150505 - RNA, 14 nt, Homo sapiens
aaauggaagacagc

SEQ ID NO: 2150506 - RNA, 17 nt, Homo sapiens
uaaauuaagauccuaaa

SEQ ID NO: 2150507 - RNA, 15 nt, Homo sapiens
aauuauguagcucuu

SEQ ID NO: 2150508 - RNA, 22 nt, Homo sapiens
auuuauuugugauguacuguaa

SEQ ID NO: 2150509 - RNA, 13 nt, Homo sapiens
cauucucugaguc

SEQ ID NO: 2150510 - RNA, 20 nt, Homo sapiens
ccuuauuuuuguaugccuuu

SEQ ID NO: 2150511 - RNA, 14 nt, Homo sapiens
aauuuuauaaucau

SEQ ID NO: 2150512 - RNA, 23 nt, Homo sapiens
gcucuggauaacaagacuuugac

SEQ ID NO: 2150513 - RNA, 12 nt, Homo sapiens
caauaugacuca

SEQ ID NO: 2150514 - RNA, 19 nt, Homo sapiens
agcauaauuuuaguuuugu

SEQ ID NO: 2150515 - RNA, 13 nt, Homo sapiens
acuuccacuuugu

SEQ ID NO: 2150516 - RNA, 20 nt, Homo sapiens
cucaacauuggagacaucac

SEQ ID NO: 2150517 - RNA, 17 nt, Homo sapiens
cccugagaaagcccugu

SEQ ID NO: 2150518 - RNA, 22 nt, Homo sapiens
agaagaaacuuugccucaagac

SEQ ID NO: 2150519 - RNA, 16 nt, Homo sapiens
uaauagcuuuugauua

SEQ ID NO: 2150520 - RNA, 11 nt, Homo sapiens
cucaagggaaa

SEQ ID NO: 2150521 - RNA, 16 nt, Homo sapiens
uugugucugcaggauu

SEQ ID NO: 2150522 - RNA, 17 nt, Homo sapiens
gcugucagcgccucaag

SEQ ID NO: 2150523 - RNA, 13 nt, Homo sapiens
aggugcaagagac

SEQ ID NO: 2150524 - RNA, 20 nt, Homo sapiens
ccaagcuuguuaucagcuuu

SEQ ID NO: 2150525 - RNA, 17 nt, Homo sapiens
aagauaaaugcuuuaaa

SEQ ID NO: 2150526 - RNA, 13 nt, Homo sapiens
ugcugaagcugcu

SEQ ID NO: 2150527 - RNA, 14 nt, Homo sapiens
aauaaugcacugag

SEQ ID NO: 2150528 - RNA, 23 nt, Homo sapiens
uuagggcugaaucuucuggagaa

SEQ ID NO: 2150529 - RNA, 19 nt, Homo sapiens
ccagaggugucacccaaac

SEQ ID NO: 2150530 - RNA, 21 nt, Homo sapiens
uggacagugaggucacagucc

SEQ ID NO: 2150531 - RNA, 22 nt, Homo sapiens
aauauuguauugcugcugugcg

SEQ ID NO: 2150532 - RNA, 22 nt, Homo sapiens
ucauaugaauuagccaaaagaa

SEQ ID NO: 2150533 - RNA, 16 nt, Homo sapiens
ucccccucucacgcca

SEQ ID NO: 2150534 - RNA, 20 nt, Homo sapiens
aauaugcugcucauccccac

SEQ ID NO: 2150535 - RNA, 15 nt, Homo sapiens
ccaguggcaguguau

SEQ ID NO: 2150536 - RNA, 20 nt, Homo sapiens
uccuauuucuggaauggaaa

SEQ ID NO: 2150537 - RNA, 12 nt, Homo sapiens
guuaagccuuug

SEQ ID NO: 2150538 - RNA, 15 nt, Homo sapiens
cagaucaccaccuga

SEQ ID NO: 2150539 - RNA, 18 nt, Homo sapiens
aagccugucugagacuca

SEQ ID NO: 2150540 - RNA, 18 nt, Homo sapiens
ccuggaaggacacaguga

SEQ ID NO: 2150541 - RNA, 20 nt, Homo sapiens
caucugcgaacccaagcaau

SEQ ID NO: 2150542 - RNA, 19 nt, Homo sapiens
uucuaguucagcugcccca

SEQ ID NO: 2150543 - RNA, 15 nt, Homo sapiens
gaggggaagggccag

SEQ ID NO: 2150544 - RNA, 15 nt, Homo sapiens
ucuaccagcauaaau

SEQ ID NO: 2150545 - RNA, 13 nt, Homo sapiens
cagcaagcaauaa

SEQ ID NO: 2150546 - RNA, 22 nt, Homo sapiens
auuuuuguuuucauuaucucaa

SEQ ID NO: 2150547 - RNA, 12 nt, Homo sapiens
uauuucuugaua

SEQ ID NO: 2150548 - RNA, 19 nt, Homo sapiens
cucugagaagacacaaggu

SEQ ID NO: 2150549 - RNA, 23 nt, Homo sapiens
aguaaucucacagcauuugccaa

SEQ ID NO: 2150550 - RNA, 22 nt, Homo sapiens
acucugcccucuagagccuuca

SEQ ID NO: 2150551 - RNA, 22 nt, Homo sapiens
uaguauuggagcacauguuacu

SEQ ID NO: 2150552 - RNA, 16 nt, Homo sapiens
gcuugagcccuggacu

SEQ ID NO: 2150553 - RNA, 18 nt, Homo sapiens
auacuaaacugauuaaau

SEQ ID NO: 2150554 - RNA, 20 nt, Homo sapiens
gacaaaucuaaaaugcaaag

SEQ ID NO: 2150555 - RNA, 18 nt, Homo sapiens
ccaauaguuucuuguuaa

SEQ ID NO: 2150556 - RNA, 19 nt, Homo sapiens
ucuggggcucagcccugag

SEQ ID NO: 2150557 - RNA, 12 nt, Homo sapiens
auagcucagaau

SEQ ID NO: 2150558 - RNA, 17 nt, Homo sapiens
aaccggggccuacuaga

SEQ ID NO: 2150559 - RNA, 22 nt, Homo sapiens
gagaagaugugauuuauuuuga

SEQ ID NO: 2150560 - RNA, 21 nt, Homo sapiens
aauguaaagauacugagaaua

SEQ ID NO: 2150561 - RNA, 22 nt, Homo sapiens
uaucauaucucucuuuacuucc

SEQ ID NO: 2150562 - RNA, 20 nt, Homo sapiens
gaaagagccuaacaucucca

SEQ ID NO: 2150563 - RNA, 17 nt, Homo sapiens
gacauagucuggcugua

SEQ ID NO: 2150564 - RNA, 22 nt, Homo sapiens
cuccagggccugaucuuuacca

SEQ ID NO: 2150565 - RNA, 11 nt, Homo sapiens
ugcccaugugg

SEQ ID NO: 2150566 - RNA, 16 nt, Homo sapiens
acaaugacuaaagaca

SEQ ID NO: 2150567 - RNA, 16 nt, Homo sapiens
uaaaauuuauuucacu

SEQ ID NO: 2150568 - RNA, 16 nt, Homo sapiens
gggcaugguggugagc

SEQ ID NO: 2150569 - RNA, 16 nt, Homo sapiens
auugccuagcucuuuu

SEQ ID NO: 2150570 - RNA, 15 nt, Homo sapiens
ucuccugugcauugu

SEQ ID NO: 2150571 - RNA, 21 nt, Homo sapiens
gcaguaaaauagcugagggaa

SEQ ID NO: 2150572 - RNA, 18 nt, Homo sapiens
aaacagugagcauaucug

SEQ ID NO: 2150573 - RNA, 12 nt, Homo sapiens
auuccucauguc

SEQ ID NO: 2150574 - RNA, 21 nt, Homo sapiens
cuuaauguacauagugcuaac

SEQ ID NO: 2150575 - RNA, 14 nt, Homo sapiens
auccacauuuuaac

SEQ ID NO: 2150576 - RNA, 22 nt, Homo sapiens
auguagaagcaugaagucuuaa

SEQ ID NO: 2150577 - RNA, 18 nt, Homo sapiens
agagugugacucaucagg

SEQ ID NO: 2150578 - RNA, 12 nt, Homo sapiens
caggucugugga

SEQ ID NO: 2150579 - RNA, 20 nt, Homo sapiens
aucauauggagcucauguca

SEQ ID NO: 2150580 - RNA, 18 nt, Homo sapiens
uucaaagacagagaagac

SEQ ID NO: 2150581 - RNA, 21 nt, Homo sapiens
aauucuuaguggaagacaaua

SEQ ID NO: 2150582 - RNA, 15 nt, Homo sapiens
ugcaaagaccaccuc

SEQ ID NO: 2150583 - RNA, 12 nt, Homo sapiens
uauaaagcagua

SEQ ID NO: 2150584 - RNA, 12 nt, Homo sapiens
uguuaagcaauu

SEQ ID NO: 2150585 - RNA, 18 nt, Homo sapiens
ggacaguggauuguuuau

SEQ ID NO: 2150586 - RNA, 19 nt, Homo sapiens
ucuguagcuacacuguaua

SEQ ID NO: 2150587 - RNA, 20 nt, Homo sapiens
aacacccauuuuugcucuau

SEQ ID NO: 2150588 - RNA, 20 nt, Homo sapiens
aagacuucaguauguuguca

SEQ ID NO: 2150589 - RNA, 16 nt, Homo sapiens
aaaaauaguggccaga

SEQ ID NO: 2150590 - RNA, 15 nt, Homo sapiens
acugguaaagccuca

SEQ ID NO: 2150591 - RNA, 19 nt, Homo sapiens
uucuuuucccaucaccaga

SEQ ID NO: 2150592 - RNA, 18 nt, Homo sapiens
agcauuagcuacuuuuca

SEQ ID NO: 2150593 - RNA, 21 nt, Homo sapiens
ugaccaguuuaaccugaugca

SEQ ID NO: 2150594 - RNA, 11 nt, Homo sapiens
gaugcacagua

SEQ ID NO: 2150595 - RNA, 12 nt, Homo sapiens
uuauacacauaa

SEQ ID NO: 2150596 - RNA, 15 nt, Homo sapiens
gagaugcaaauagca

SEQ ID NO: 2150597 - RNA, 23 nt, Homo sapiens
agucuuauuuacgucgucaaaaa

SEQ ID NO: 2150598 - RNA, 20 nt, Homo sapiens
ggaaugguuauaaaagugau

SEQ ID NO: 2150599 - RNA, 21 nt, Homo sapiens
cgguggcgccagcccuaggcu

SEQ ID NO: 2150600 - RNA, 17 nt, Homo sapiens
auuguugacaacuguga

SEQ ID NO: 2150601 - RNA, 14 nt, Homo sapiens
ucaugagaauuaca

SEQ ID NO: 2150602 - RNA, 16 nt, Homo sapiens
uuggccacagccaggg

SEQ ID NO: 2150603 - RNA, 19 nt, Homo sapiens
uacucaguggacagugcug

SEQ ID NO: 2150604 - RNA, 14 nt, Homo sapiens
aauagugauuucca

SEQ ID NO: 2150605 - RNA, 20 nt, Homo sapiens
auugaagauguccuguccac

SEQ ID NO: 2150606 - RNA, 18 nt, Homo sapiens
ccaggagugcggacacca

SEQ ID NO: 2150607 - RNA, 16 nt, Homo sapiens
gagcugggggccauga

SEQ ID NO: 2150608 - RNA, 12 nt, Homo sapiens
uagagugcaaug

SEQ ID NO: 2150609 - RNA, 12 nt, Homo sapiens
uggagugcagug

SEQ ID NO: 2150610 - RNA, 23 nt, Homo sapiens
ccaugaacagcauuagaauuuac

SEQ ID NO: 2150611 - RNA, 22 nt, Homo sapiens
uguuuguaauaauaaaaccaaa

SEQ ID NO: 2150612 - RNA, 13 nt, Homo sapiens
uuuucuugguguu

SEQ ID NO: 2150613 - RNA, 20 nt, Homo sapiens
uuuuucaugcgaugacacuu

SEQ ID NO: 2150614 - RNA, 12 nt, Homo sapiens
aacaucacuugu

SEQ ID NO: 2150615 - RNA, 17 nt, Homo sapiens
gggcauccaccucccag

SEQ ID NO: 2150616 - RNA, 20 nt, Homo sapiens
cuaaugauauuuuaugcaaa

SEQ ID NO: 2150617 - RNA, 21 nt, Homo sapiens
ccuucacgauuaacugugaaa

SEQ ID NO: 2150618 - RNA, 23 nt, Homo sapiens
caaaaugguaaccucuacuauga

SEQ ID NO: 2150619 - RNA, 21 nt, Homo sapiens
aaaagcuuuucuuuccuuuug

SEQ ID NO: 2150620 - RNA, 13 nt, Homo sapiens
ucuauaaagauca

SEQ ID NO: 2150621 - RNA, 22 nt, Homo sapiens
ucacauccuaccccuuugcacu

SEQ ID NO: 2150622 - RNA, 19 nt, Homo sapiens
ggcuguguuuccaucucaa

SEQ ID NO: 2150623 - RNA, 11 nt, Homo sapiens
uccucuucuau

SEQ ID NO: 2150624 - RNA, 14 nt, Homo sapiens
caauaguaaaagau

SEQ ID NO: 2150625 - RNA, 12 nt, Homo sapiens
aucucuuccuuu

SEQ ID NO: 2150626 - RNA, 12 nt, Homo sapiens
ccaaaguacugg

SEQ ID NO: 2150627 - RNA, 12 nt, Homo sapiens
cucuuccaaagg

SEQ ID NO: 2150628 - RNA, 20 nt, Homo sapiens
cugggcagucagaaagccca

SEQ ID NO: 2150629 - RNA, 19 nt, Homo sapiens
ucccugaaaacccagagag

SEQ ID NO: 2150630 - RNA, 15 nt, Homo sapiens
cuaaacuaccaccuc

SEQ ID NO: 2150631 - RNA, 17 nt, Homo sapiens
aguggucugaauucugg

SEQ ID NO: 2150632 - RNA, 15 nt, Homo sapiens
caagugcagcuguga

SEQ ID NO: 2150633 - RNA, 23 nt, Homo sapiens
ugcugccuuguuucaccuuccau

SEQ ID NO: 2150634 - RNA, 16 nt, Homo sapiens
agaaacaugaauuauu

SEQ ID NO: 2150635 - RNA, 16 nt, Homo sapiens
gcagauccucugggaa

SEQ ID NO: 2150636 - RNA, 23 nt, Homo sapiens
aagguaugcauuuuauacaugua

SEQ ID NO: 2150637 - RNA, 16 nt, Homo sapiens
uguccauucacuuuca

SEQ ID NO: 2150638 - RNA, 12 nt, Homo sapiens
cucccagaguuu

SEQ ID NO: 2150639 - RNA, 23 nt, Homo sapiens
cacucucauuuguuaaugcuuuc

SEQ ID NO: 2150640 - RNA, 20 nt, Homo sapiens
cuuggagcaccgaggccagc

SEQ ID NO: 2150641 - RNA, 19 nt, Homo sapiens
uucugagguccuuaugucc

SEQ ID NO: 2150642 - RNA, 16 nt, Homo sapiens
cagcccuauucauccc

SEQ ID NO: 2150643 - RNA, 17 nt, Homo sapiens
gcuaacugguuaaacau

SEQ ID NO: 2150644 - RNA, 16 nt, Homo sapiens
uucucuaacucagaaa

SEQ ID NO: 2150645 - RNA, 14 nt, Homo sapiens
auccagaacugcac

SEQ ID NO: 2150646 - RNA, 13 nt, Homo sapiens
gaugccacuuccc

SEQ ID NO: 2150647 - RNA, 13 nt, Homo sapiens
acaaugauacagu

SEQ ID NO: 2150648 - RNA, 12 nt, Homo sapiens
ggaaaguugcau

SEQ ID NO: 2150649 - RNA, 23 nt, Homo sapiens
cuucuaccucuuggcugccuugu

SEQ ID NO: 2150650 - RNA, 14 nt, Homo sapiens
cuuaccaagaucac

SEQ ID NO: 2150651 - RNA, 14 nt, Homo sapiens
gucccucuuccauc

SEQ ID NO: 2150652 - RNA, 18 nt, Homo sapiens
aguugcguggacucugca

SEQ ID NO: 2150653 - RNA, 21 nt, Homo sapiens
uuaacagauaaagaaacugag

SEQ ID NO: 2150654 - RNA, 20 nt, Homo sapiens
caagggaggggugguauuaa

SEQ ID NO: 2150655 - RNA, 12 nt, Homo sapiens
caaguaauacaa

SEQ ID NO: 2150656 - RNA, 20 nt, Homo sapiens
agccccagugccaagcacag

SEQ ID NO: 2150657 - RNA, 16 nt, Homo sapiens
uauacauuacaaucau

SEQ ID NO: 2150658 - RNA, 17 nt, Homo sapiens
ucaggaggccaaggugg

SEQ ID NO: 2150659 - RNA, 11 nt, Homo sapiens
uccgugccagg

SEQ ID NO: 2150660 - RNA, 15 nt, Homo sapiens
aaugagaaggccagg

SEQ ID NO: 2150661 - RNA, 21 nt, Homo sapiens
aggaugaaagugaccauguuu

SEQ ID NO: 2150662 - RNA, 23 nt, Homo sapiens
gacugcagaggagccaccugggc

SEQ ID NO: 2150663 - RNA, 17 nt, Homo sapiens
auauuauaauaauguuc

SEQ ID NO: 2150664 - RNA, 17 nt, Homo sapiens
cuauaauuuuaaaguau

SEQ ID NO: 2150665 - RNA, 19 nt, Homo sapiens
acaaugaguaaaaucacag

SEQ ID NO: 2150666 - RNA, 14 nt, Homo sapiens
ucaggaugcacauu

SEQ ID NO: 2150667 - RNA, 13 nt, Homo sapiens
cuuaaacuuucaa

SEQ ID NO: 2150668 - RNA, 19 nt, Homo sapiens
uuaaacauaggaaagaaga

SEQ ID NO: 2150669 - RNA, 19 nt, Homo sapiens
aacacauuuuuuaacuaau

SEQ ID NO: 2150670 - RNA, 22 nt, Homo sapiens
cuuuucaucucauuaauucaau

SEQ ID NO: 2150671 - RNA, 19 nt, Homo sapiens
cuggccagggcuuccucaa

SEQ ID NO: 2150672 - RNA, 14 nt, Homo sapiens
aucagccagucuca

SEQ ID NO: 2150673 - RNA, 18 nt, Homo sapiens
ucaaaacauccuagggug

SEQ ID NO: 2150674 - RNA, 17 nt, Homo sapiens
augcugguacuauugug

SEQ ID NO: 2150675 - RNA, 21 nt, Homo sapiens
gcuuuguugaauaauacgugu

SEQ ID NO: 2150676 - RNA, 22 nt, Homo sapiens
cugaagcaggagauuugcuuga

SEQ ID NO: 2150677 - RNA, 18 nt, Homo sapiens
uugucauuuuuaauauua

SEQ ID NO: 2150678 - RNA, 12 nt, Homo sapiens
cgcuaggucaac

SEQ ID NO: 2150679 - RNA, 16 nt, Homo sapiens
uuguguucacuacauu

SEQ ID NO: 2150680 - RNA, 14 nt, Homo sapiens
aaugaaauuccucc

SEQ ID NO: 2150681 - RNA, 20 nt, Homo sapiens
agaagcuuuuuguuugcauc

SEQ ID NO: 2150682 - RNA, 20 nt, Homo sapiens
ugcccuaucauuuauuuaca

SEQ ID NO: 2150683 - RNA, 20 nt, Homo sapiens
uuuaaugaguuucacagugu

SEQ ID NO: 2150684 - RNA, 19 nt, Homo sapiens
aaaaccucauuuaccauaa

SEQ ID NO: 2150685 - RNA, 20 nt, Homo sapiens
cuccagaaauuuaccacaaa

SEQ ID NO: 2150686 - RNA, 21 nt, Homo sapiens
ugcagggcacaugaucuggcc

SEQ ID NO: 2150687 - RNA, 16 nt, Homo sapiens
aauugugguucccuaa

SEQ ID NO: 2150688 - RNA, 21 nt, Homo sapiens
gcaaagaguguagaucagagc

SEQ ID NO: 2150689 - RNA, 23 nt, Homo sapiens
ccuggaacccaacaguucaugga

SEQ ID NO: 2150690 - RNA, 19 nt, Homo sapiens
aagaauaauugaacaauaa

SEQ ID NO: 2150691 - RNA, 16 nt, Homo sapiens
gcauuuagcacaguau

SEQ ID NO: 2150692 - RNA, 18 nt, Homo sapiens
aauguauuuuucacaaag

SEQ ID NO: 2150693 - RNA, 19 nt, Homo sapiens
uuucuuuaccugagaccag

SEQ ID NO: 2150694 - RNA, 22 nt, Homo sapiens
uucagcaugccccccucuucac

SEQ ID NO: 2150695 - RNA, 18 nt, Homo sapiens
uagaacuauuaaaacagc

SEQ ID NO: 2150696 - RNA, 17 nt, Homo sapiens
uccuagcuagagaagga

SEQ ID NO: 2150697 - RNA, 18 nt, Homo sapiens
aaguaagccucaccuuug

SEQ ID NO: 2150698 - RNA, 14 nt, Homo sapiens
auaagcauucaaua

SEQ ID NO: 2150699 - RNA, 13 nt, Homo sapiens
uuggucaguuaca

SEQ ID NO: 2150700 - RNA, 16 nt, Homo sapiens
acuucaaaauauugag

SEQ ID NO: 2150701 - RNA, 17 nt, Homo sapiens
ucucuccaccagguucu

SEQ ID NO: 2150702 - RNA, 15 nt, Homo sapiens
agaagacuauuuacc

SEQ ID NO: 2150703 - RNA, 13 nt, Homo sapiens
ugcacaucugcug

SEQ ID NO: 2150704 - RNA, 15 nt, Homo sapiens
guugcagcugucacc

SEQ ID NO: 2150705 - RNA, 17 nt, Homo sapiens
cuuuucaucuaauguga

SEQ ID NO: 2150706 - RNA, 18 nt, Homo sapiens
gaaaaaucaugggccaga

SEQ ID NO: 2150707 - RNA, 18 nt, Homo sapiens
uuuccugccgagugcucu

SEQ ID NO: 2150708 - RNA, 20 nt, Homo sapiens
gugccaauauguauuguaaa

SEQ ID NO: 2150709 - RNA, 23 nt, Homo sapiens
ccaagcgcgguuacuauggccag

SEQ ID NO: 2150710 - RNA, 15 nt, Homo sapiens
caauguagcugucuc

SEQ ID NO: 2150711 - RNA, 16 nt, Homo sapiens
ccuuuaggccaucuca

SEQ ID NO: 2150712 - RNA, 23 nt, Homo sapiens
caagagauuguuguuugccauac

SEQ ID NO: 2150713 - RNA, 15 nt, Homo sapiens
cauaaacacauuucc

SEQ ID NO: 2150714 - RNA, 19 nt, Homo sapiens
auaauuccauaugcuguuu

SEQ ID NO: 2150715 - RNA, 13 nt, Homo sapiens
gccgcucuucacu

SEQ ID NO: 2150716 - RNA, 22 nt, Homo sapiens
uuuucuccccucauaucugcgu

SEQ ID NO: 2150717 - RNA, 19 nt, Homo sapiens
ggcgacuccuagauccagg

SEQ ID NO: 2150718 - RNA, 20 nt, Homo sapiens
acaaaaugucucaguuuuca

SEQ ID NO: 2150719 - RNA, 16 nt, Homo sapiens
uuuggggggcagagaa

SEQ ID NO: 2150720 - RNA, 17 nt, Homo sapiens
ccugggcugucugucac

SEQ ID NO: 2150721 - RNA, 17 nt, Homo sapiens
uugaaugacguguccua

SEQ ID NO: 2150722 - RNA, 17 nt, Homo sapiens
aagaauugucucugggc

SEQ ID NO: 2150723 - RNA, 16 nt, Homo sapiens
aaagagggacaggcug

SEQ ID NO: 2150724 - RNA, 20 nt, Homo sapiens
gcuuguuuaagguucuugcu

SEQ ID NO: 2150725 - RNA, 14 nt, Homo sapiens
ccaagcgaauuugu

SEQ ID NO: 2150726 - RNA, 19 nt, Homo sapiens
cuaaggagcgcuagugccu

SEQ ID NO: 2150727 - RNA, 19 nt, Homo sapiens
gugacuauaaagcuguuau

SEQ ID NO: 2150728 - RNA, 21 nt, Homo sapiens
gcucucagcuugugccuugua

SEQ ID NO: 2150729 - RNA, 12 nt, Homo sapiens
uucuacuuuaag

SEQ ID NO: 2150730 - RNA, 20 nt, Homo sapiens
uauguagauaauggauuuuu

SEQ ID NO: 2150731 - RNA, 22 nt, Homo sapiens
aaguauaaucagcacuuugcca

SEQ ID NO: 2150732 - RNA, 15 nt, Homo sapiens
caugauuugcaacuu

SEQ ID NO: 2150733 - RNA, 23 nt, Homo sapiens
uuacccccaguccucccuagcuc

SEQ ID NO: 2150734 - RNA, 17 nt, Homo sapiens
gcuucuaugguugacau

SEQ ID NO: 2150735 - RNA, 12 nt, Homo sapiens
cgcagaccccac

SEQ ID NO: 2150736 - RNA, 20 nt, Homo sapiens
uagugucauccucacaguga

SEQ ID NO: 2150737 - RNA, 20 nt, Homo sapiens
ugcucagccccagaccugcc

SEQ ID NO: 2150738 - RNA, 21 nt, Homo sapiens
uagcucaguuucccuccuucc

SEQ ID NO: 2150739 - RNA, 13 nt, Homo sapiens
aaaacaaccaaca

SEQ ID NO: 2150740 - RNA, 23 nt, Homo sapiens
uuugacuuaggugugaagaccca

SEQ ID NO: 2150741 - RNA, 20 nt, Homo sapiens
ugagccuuuguugcuaucaa

SEQ ID NO: 2150742 - RNA, 18 nt, Homo sapiens
cgcugcuaagaagcuaaa

SEQ ID NO: 2150743 - RNA, 13 nt, Homo sapiens
cugcagauuccuu

SEQ ID NO: 2150744 - RNA, 18 nt, Homo sapiens
agcccuugagaagccaac

SEQ ID NO: 2150745 - RNA, 22 nt, Homo sapiens
cuguacuguuacugggcccuga

SEQ ID NO: 2150746 - RNA, 13 nt, Homo sapiens
gaaaaagcgcugu

SEQ ID NO: 2150747 - RNA, 21 nt, Homo sapiens
caggaauuauuaggaguaauu

SEQ ID NO: 2150748 - RNA, 13 nt, Homo sapiens
gguguugacaugu

SEQ ID NO: 2150749 - RNA, 19 nt, Homo sapiens
gacaugguggcaugcaccu

SEQ ID NO: 2150750 - RNA, 13 nt, Homo sapiens
acaguuaaugcca

SEQ ID NO: 2150751 - RNA, 19 nt, Homo sapiens
auggcacuuuugagcuccu

SEQ ID NO: 2150752 - RNA, 18 nt, Homo sapiens
uuaaguucucuaacaaga

SEQ ID NO: 2150753 - RNA, 22 nt, Homo sapiens
agaaauuccaggaaaaucugca

SEQ ID NO: 2150754 - RNA, 20 nt, Homo sapiens
cucagcaguccacaaagcau

SEQ ID NO: 2150755 - RNA, 22 nt, Homo sapiens
aacaugcuuuuccaaacccagg

SEQ ID NO: 2150756 - RNA, 18 nt, Homo sapiens
cuucucagagcagcacug

SEQ ID NO: 2150757 - RNA, 21 nt, Homo sapiens
ggcugaggcgggaggaucaca

SEQ ID NO: 2150758 - RNA, 20 nt, Homo sapiens
ucacuaaaaaggaaacuuca

SEQ ID NO: 2150759 - RNA, 20 nt, Homo sapiens
agaacagucccucacaccug

SEQ ID NO: 2150760 - RNA, 23 nt, Homo sapiens
aauuucucucuuuuguacucugu

SEQ ID NO: 2150761 - RNA, 22 nt, Homo sapiens
aauaaagugacccugcucucac

SEQ ID NO: 2150762 - RNA, 22 nt, Homo sapiens
aguucacaaacaguaaaggcca

SEQ ID NO: 2150763 - RNA, 16 nt, Homo sapiens
caguuugcuuugcccu

SEQ ID NO: 2150764 - RNA, 19 nt, Homo sapiens
gugacauuuccaugcauaa

SEQ ID NO: 2150765 - RNA, 19 nt, Homo sapiens
ugggugggaggggcccaca

SEQ ID NO: 2150766 - RNA, 17 nt, Homo sapiens
aauaucuugcuuucaaa

SEQ ID NO: 2150767 - RNA, 16 nt, Homo sapiens
cucaaacuugagaaaa

SEQ ID NO: 2150768 - RNA, 17 nt, Homo sapiens
uggauuguuacagcuuc

SEQ ID NO: 2150769 - RNA, 14 nt, Homo sapiens
cucucuccugucca

SEQ ID NO: 2150770 - RNA, 13 nt, Homo sapiens
ccaugcucaagau

SEQ ID NO: 2150771 - RNA, 20 nt, Homo sapiens
auauacuauuuucauucucu

SEQ ID NO: 2150772 - RNA, 16 nt, Homo sapiens
cuagggacacacaggc

SEQ ID NO: 2150773 - RNA, 15 nt, Homo sapiens
acagugcaguacuca

SEQ ID NO: 2150774 - RNA, 15 nt, Homo sapiens
acucagcaguugaca

SEQ ID NO: 2150775 - RNA, 21 nt, Homo sapiens
aggcuagaacagagaagcccu

SEQ ID NO: 2150776 - RNA, 23 nt, Homo sapiens
aguggaaugacugaaagauggga

SEQ ID NO: 2150777 - RNA, 17 nt, Homo sapiens
uggccaccccagagugg

SEQ ID NO: 2150778 - RNA, 14 nt, Homo sapiens
agucaggagccagc

SEQ ID NO: 2150779 - RNA, 15 nt, Homo sapiens
ggagggaaagccagc

SEQ ID NO: 2150780 - RNA, 22 nt, Homo sapiens
uguacaccagagccucagugag

SEQ ID NO: 2150781 - RNA, 18 nt, Homo sapiens
ccuacucuuccaucuuuc

SEQ ID NO: 2150782 - RNA, 22 nt, Homo sapiens
ucugccacauuaacuacacggu

SEQ ID NO: 2150783 - RNA, 16 nt, Homo sapiens
agccagcaaugauguc

SEQ ID NO: 2150784 - RNA, 19 nt, Homo sapiens
ugucuaaaaaacaaaacaa

SEQ ID NO: 2150785 - RNA, 14 nt, Homo sapiens
uuguugugcaaguu

SEQ ID NO: 2150786 - RNA, 17 nt, Homo sapiens
ucaagcuauucucaugc

SEQ ID NO: 2150787 - RNA, 18 nt, Homo sapiens
ugacaaaauucauuugcu

SEQ ID NO: 2150788 - RNA, 17 nt, Homo sapiens
uacagauguaaaugcca

SEQ ID NO: 2150789 - RNA, 19 nt, Homo sapiens
gagucagcaccuuggccca

SEQ ID NO: 2150790 - RNA, 19 nt, Homo sapiens
gucucacuauauugcucag

SEQ ID NO: 2150791 - RNA, 18 nt, Homo sapiens
aauaaaaacccuguaugg

SEQ ID NO: 2150792 - RNA, 18 nt, Homo sapiens
gugauccgccuaccucag

SEQ ID NO: 2150793 - RNA, 19 nt, Homo sapiens
guguccagcugaguuucuc

SEQ ID NO: 2150794 - RNA, 19 nt, Homo sapiens
aaauuauucagaacuauuu

SEQ ID NO: 2150795 - RNA, 18 nt, Homo sapiens
ugagacacaugggugcua

SEQ ID NO: 2150796 - RNA, 14 nt, Homo sapiens
aauagauccagugc

SEQ ID NO: 2150797 - RNA, 22 nt, Homo sapiens
ucuucagaagaaaggacagcuc

SEQ ID NO: 2150798 - RNA, 18 nt, Homo sapiens
uagaacuagccaaaccag

SEQ ID NO: 2150799 - RNA, 17 nt, Homo sapiens
auauuauugauucacuu

SEQ ID NO: 2150800 - RNA, 22 nt, Homo sapiens
cugccauuggagccaaugugug

SEQ ID NO: 2150801 - RNA, 16 nt, Homo sapiens
cuuuugaacuugucac

SEQ ID NO: 2150802 - RNA, 16 nt, Homo sapiens
acuguguaacuuucuc

SEQ ID NO: 2150803 - RNA, 17 nt, Homo sapiens
aagccuuuggcucuucu

SEQ ID NO: 2150804 - RNA, 18 nt, Homo sapiens
aagcuacuuaacuuggua

SEQ ID NO: 2150805 - RNA, 21 nt, Homo sapiens
uucaauaaaaaauacaauuca

SEQ ID NO: 2150806 - RNA, 12 nt, Homo sapiens
cagcucuuccau

SEQ ID NO: 2150807 - RNA, 17 nt, Homo sapiens
auugaaagcuuuuguua

SEQ ID NO: 2150808 - RNA, 15 nt, Homo sapiens
augucugccuaugca

SEQ ID NO: 2150809 - RNA, 20 nt, Homo sapiens
agcuuauggcaucucauuga

SEQ ID NO: 2150810 - RNA, 13 nt, Homo sapiens
auccgacaccucc

SEQ ID NO: 2150811 - RNA, 14 nt, Homo sapiens
aagugaaggagcug

SEQ ID NO: 2150812 - RNA, 18 nt, Homo sapiens
cuggagugugucagagcc

SEQ ID NO: 2150813 - RNA, 19 nt, Homo sapiens
uaaggaugacuuuagaaua

SEQ ID NO: 2150814 - RNA, 18 nt, Homo sapiens
aaaaaugucucaugucaa

SEQ ID NO: 2150815 - RNA, 16 nt, Homo sapiens
ucucaaucuugaacuc

SEQ ID NO: 2150816 - RNA, 17 nt, Homo sapiens
gaauauaaacauauaca

SEQ ID NO: 2150817 - RNA, 19 nt, Homo sapiens
aggggugagagaccugcuc

SEQ ID NO: 2150818 - RNA, 19 nt, Homo sapiens
uacugaggaaucagcucaa

SEQ ID NO: 2150819 - RNA, 21 nt, Homo sapiens
acauguauuuggugauuacau

SEQ ID NO: 2150820 - RNA, 20 nt, Homo sapiens
acccaggcuggagugcaaug

SEQ ID NO: 2150821 - RNA, 19 nt, Homo sapiens
uaacuuuggaaacaaaaau

SEQ ID NO: 2150822 - RNA, 18 nt, Homo sapiens
caagguuggcgacuguca

SEQ ID NO: 2150823 - RNA, 13 nt, Homo sapiens
uugcccuaauuca

SEQ ID NO: 2150824 - RNA, 16 nt, Homo sapiens
uggacucuccuaguga

SEQ ID NO: 2150825 - RNA, 20 nt, Homo sapiens
gccagucuaguuccugauga

SEQ ID NO: 2150826 - RNA, 16 nt, Homo sapiens
auuacuuguguuacuu

SEQ ID NO: 2150827 - RNA, 15 nt, Homo sapiens
uggcuucucccaaca

SEQ ID NO: 2150828 - RNA, 15 nt, Homo sapiens
uaauauuuggagcua

SEQ ID NO: 2150829 - RNA, 15 nt, Homo sapiens
augcugugcucuuug

SEQ ID NO: 2150830 - RNA, 18 nt, Homo sapiens
aaugcaagccaucucuaa

SEQ ID NO: 2150831 - RNA, 21 nt, Homo sapiens
aaauauuguaguuugaauauu

SEQ ID NO: 2150832 - RNA, 14 nt, Homo sapiens
gucuuggcuuucau

SEQ ID NO: 2150833 - RNA, 16 nt, Homo sapiens
gucaccacgacuggcc

SEQ ID NO: 2150834 - RNA, 16 nt, Homo sapiens
uguaaaugcuauuaua

SEQ ID NO: 2150835 - RNA, 16 nt, Homo sapiens
auucagcaucagagag

SEQ ID NO: 2150836 - RNA, 20 nt, Homo sapiens
cccuuuccccagcaucacuc

SEQ ID NO: 2150837 - RNA, 18 nt, Homo sapiens
aucauuuuuauacaggac

SEQ ID NO: 2150838 - RNA, 18 nt, Homo sapiens
aaggauccagacucucau

SEQ ID NO: 2150839 - RNA, 19 nt, Homo sapiens
acagcuccaagaauuucua

SEQ ID NO: 2150840 - RNA, 20 nt, Homo sapiens
cuagagucauuuacucuccu

SEQ ID NO: 2150841 - RNA, 21 nt, Homo sapiens
aaugauucaauuaacauauau

SEQ ID NO: 2150842 - RNA, 12 nt, Homo sapiens
ucccaauuuccc

SEQ ID NO: 2150843 - RNA, 12 nt, Homo sapiens
gcaaaauugcaa

SEQ ID NO: 2150844 - RNA, 19 nt, Homo sapiens
cacucagcguuugcgggaa

SEQ ID NO: 2150845 - RNA, 19 nt, Homo sapiens
ucucauuucgggugaaucu

SEQ ID NO: 2150846 - RNA, 16 nt, Homo sapiens
ugggcagcucaucucu

SEQ ID NO: 2150847 - RNA, 22 nt, Homo sapiens
acccaggaggggaacacugccc

SEQ ID NO: 2150848 - RNA, 22 nt, Homo sapiens
agggaagagccccccacugcag

SEQ ID NO: 2150849 - RNA, 16 nt, Homo sapiens
ugugacuuauucccug

SEQ ID NO: 2150850 - RNA, 22 nt, Homo sapiens
cucuucagucucuauaccaaua

SEQ ID NO: 2150851 - RNA, 15 nt, Homo sapiens
cuugaaauguagaau

SEQ ID NO: 2150852 - RNA, 16 nt, Homo sapiens
caauuugccauagcag

SEQ ID NO: 2150853 - RNA, 14 nt, Homo sapiens
caaauugcuucuag

SEQ ID NO: 2150854 - RNA, 19 nt, Homo sapiens
auuuuguauucuuuuccaa

SEQ ID NO: 2150855 - RNA, 23 nt, Homo sapiens
acuauuguaaugccaauaugaca

SEQ ID NO: 2150856 - RNA, 21 nt, Homo sapiens
aauuccaccaggauuaaucuc

SEQ ID NO: 2150857 - RNA, 15 nt, Homo sapiens
cggggcucuucucau

SEQ ID NO: 2150858 - RNA, 13 nt, Homo sapiens
caacuacccaccu

SEQ ID NO: 2150859 - RNA, 22 nt, Homo sapiens
ucugaucccugaucaagcuuca

SEQ ID NO: 2150860 - RNA, 19 nt, Homo sapiens
ccucuggcuccugggccug

SEQ ID NO: 2150861 - RNA, 21 nt, Homo sapiens
gacauggcaaucuagaccggu

SEQ ID NO: 2150862 - RNA, 17 nt, Homo sapiens
uguaaugguugggacca

SEQ ID NO: 2150863 - RNA, 22 nt, Homo sapiens
aaaugccgcucuucacucuggc

SEQ ID NO: 2150864 - RNA, 23 nt, Homo sapiens
ccucugcuccaacagacacccuc

SEQ ID NO: 2150865 - RNA, 20 nt, Homo sapiens
uaagaccuuggcauccuucc

SEQ ID NO: 2150866 - RNA, 16 nt, Homo sapiens
uagguuuguagugaaa

SEQ ID NO: 2150867 - RNA, 20 nt, Homo sapiens
agaggggccugccaccugga

SEQ ID NO: 2150868 - RNA, 17 nt, Homo sapiens
ccaagguauacaucuuc

SEQ ID NO: 2150869 - RNA, 24 nt, Homo sapiens
uucagaagcuagugaccaucuuca

SEQ ID NO: 2150870 - RNA, 18 nt, Homo sapiens
gcaggcgguauccagagg

SEQ ID NO: 2150871 - RNA, 19 nt, Homo sapiens
gaucuuucauuuugcaccu

SEQ ID NO: 2150872 - RNA, 13 nt, Homo sapiens
cauuccugucaac

SEQ ID NO: 2150873 - RNA, 21 nt, Homo sapiens
uguuugagguccacacugaca

SEQ ID NO: 2150874 - RNA, 20 nt, Homo sapiens
ucaaaggugauugugccagg

SEQ ID NO: 2150875 - RNA, 23 nt, Homo sapiens
gcacaugccgcgggcggccaggc

SEQ ID NO: 2150876 - RNA, 22 nt, Homo sapiens
caauacaucucacuuguuucua

SEQ ID NO: 2150877 - RNA, 18 nt, Homo sapiens
acgucccgggcacuguca

SEQ ID NO: 2150878 - RNA, 13 nt, Homo sapiens
cuaaucacucuga

SEQ ID NO: 2150879 - RNA, 19 nt, Homo sapiens
uguuuggaacggcaaaaaa

SEQ ID NO: 2150880 - RNA, 16 nt, Homo sapiens
cuccacuaauacuggu

SEQ ID NO: 2150881 - RNA, 15 nt, Homo sapiens
aaggaugguauugaa

SEQ ID NO: 2150882 - RNA, 21 nt, Homo sapiens
gccccuuggcgggcagcccag

SEQ ID NO: 2150883 - RNA, 16 nt, Homo sapiens
acuggaagacacuuca

SEQ ID NO: 2150884 - RNA, 14 nt, Homo sapiens
cagagcucugggaa

SEQ ID NO: 2150885 - RNA, 22 nt, Homo sapiens
cagccuuugcccaaaacuguca

SEQ ID NO: 2150886 - RNA, 16 nt, Homo sapiens
uauuuuggaucuauca

SEQ ID NO: 2150887 - RNA, 16 nt, Homo sapiens
acuuucucugcaaaga

SEQ ID NO: 2150888 - RNA, 15 nt, Homo sapiens
aguuccucccaggaa

SEQ ID NO: 2150889 - RNA, 14 nt, Homo sapiens
ugcgcagcuccuuc

SEQ ID NO: 2150890 - RNA, 14 nt, Homo sapiens
caagagccccaaag

SEQ ID NO: 2150891 - RNA, 19 nt, Homo sapiens
aauacuguaacacuguaua

SEQ ID NO: 2150892 - RNA, 12 nt, Homo sapiens
uauauacuaaua

SEQ ID NO: 2150893 - RNA, 17 nt, Homo sapiens
uguacagacuucuuggu

SEQ ID NO: 2150894 - RNA, 12 nt, Homo sapiens
auauuacuuuau

SEQ ID NO: 2150895 - RNA, 15 nt, Homo sapiens
uauuuaucacauagc

SEQ ID NO: 2150896 - RNA, 17 nt, Homo sapiens
cucuaguaagaugcacu

SEQ ID NO: 2150897 - RNA, 15 nt, Homo sapiens
ugugcccucugccag

SEQ ID NO: 2150898 - RNA, 16 nt, Homo sapiens
uuacacucuuugccac

SEQ ID NO: 2150899 - RNA, 16 nt, Homo sapiens
ucuggagucugaagga

SEQ ID NO: 2150900 - RNA, 21 nt, Homo sapiens
cugagaacaaauacaauucag

SEQ ID NO: 2150901 - RNA, 15 nt, Homo sapiens
ucuuuuaaaugggug

SEQ ID NO: 2150902 - RNA, 19 nt, Homo sapiens
cuuguucuuagggcuugga

SEQ ID NO: 2150903 - RNA, 17 nt, Homo sapiens
cauauuuaaaacaaaga

SEQ ID NO: 2150904 - RNA, 18 nt, Homo sapiens
aacauuccuuagucucaa

SEQ ID NO: 2150905 - RNA, 14 nt, Homo sapiens
uggcacccagagaa

SEQ ID NO: 2150906 - RNA, 17 nt, Homo sapiens
ugcacagagauaugcac

SEQ ID NO: 2150907 - RNA, 19 nt, Homo sapiens
aacauuuaaauuccacaga

SEQ ID NO: 2150908 - RNA, 14 nt, Homo sapiens
ugggagcacuuugu

SEQ ID NO: 2150909 - RNA, 18 nt, Homo sapiens
acaugcuauguucugucu

SEQ ID NO: 2150910 - RNA, 14 nt, Homo sapiens
acuucgagcacugu

SEQ ID NO: 2150911 - RNA, 23 nt, Homo sapiens
cauuauaaaaucuuuccaucuca

SEQ ID NO: 2150912 - RNA, 16 nt, Homo sapiens
uucuucagggccaguc

SEQ ID NO: 2150913 - RNA, 14 nt, Homo sapiens
gaguaaaauuccuu

SEQ ID NO: 2150914 - RNA, 22 nt, Homo sapiens
aaagaaucccuguucauuguaa

SEQ ID NO: 2150915 - RNA, 11 nt, Homo sapiens
guggugcauuc

SEQ ID NO: 2150916 - RNA, 15 nt, Homo sapiens
auccaccugcacaaa

SEQ ID NO: 2150917 - RNA, 13 nt, Homo sapiens
aggcacgugccac

SEQ ID NO: 2150918 - RNA, 15 nt, Homo sapiens
auuugcaacauuuac

SEQ ID NO: 2150919 - RNA, 21 nt, Homo sapiens
gaaucauagccaaaaacuuuu

SEQ ID NO: 2150920 - RNA, 12 nt, Homo sapiens
uuuccuuccaga

SEQ ID NO: 2150921 - RNA, 14 nt, Homo sapiens
cucaagaccagaga

SEQ ID NO: 2150922 - RNA, 21 nt, Homo sapiens
uuacugaaagaaaaagaccua

SEQ ID NO: 2150923 - RNA, 13 nt, Homo sapiens
cauuacaguuugg

SEQ ID NO: 2150924 - RNA, 11 nt, Homo sapiens
ugaagugcuug

SEQ ID NO: 2150925 - RNA, 15 nt, Homo sapiens
auuugagacauucca

SEQ ID NO: 2150926 - RNA, 14 nt, Homo sapiens
uggugacuuuugaa

SEQ ID NO: 2150927 - RNA, 19 nt, Homo sapiens
uccucuggggcauuaucca

SEQ ID NO: 2150928 - RNA, 16 nt, Homo sapiens
ccuggagacucgugga

SEQ ID NO: 2150929 - RNA, 14 nt, Homo sapiens
gaaaaaaagcaaaa

SEQ ID NO: 2150930 - RNA, 15 nt, Homo sapiens
uauaaaugaaugugc

SEQ ID NO: 2150931 - RNA, 22 nt, Homo sapiens
uaauacacagugagacacagua

SEQ ID NO: 2150932 - RNA, 14 nt, Homo sapiens
gucugcgugacuau

SEQ ID NO: 2150933 - RNA, 11 nt, Homo sapiens
ugagacagggu

SEQ ID NO: 2150934 - RNA, 15 nt, Homo sapiens
ccuggcaggccagug

SEQ ID NO: 2150935 - RNA, 21 nt, Homo sapiens
ccaaccccagugccucaguca

SEQ ID NO: 2150936 - RNA, 21 nt, Homo sapiens
auagagucaaccaccacagau

SEQ ID NO: 2150937 - RNA, 14 nt, Homo sapiens
uaugcugaaacaga

SEQ ID NO: 2150938 - RNA, 20 nt, Homo sapiens
acuguggagacuuucuguua

SEQ ID NO: 2150939 - RNA, 17 nt, Homo sapiens
gagaaucacuugcacuc

SEQ ID NO: 2150940 - RNA, 15 nt, Homo sapiens
gugaccuccugugac

SEQ ID NO: 2150941 - RNA, 21 nt, Homo sapiens
ugcugggcugacggugcaguc

SEQ ID NO: 2150942 - RNA, 13 nt, Homo sapiens
gccgacggagccg

SEQ ID NO: 2150943 - RNA, 15 nt, Homo sapiens
agcuagcucugccaa

SEQ ID NO: 2150944 - RNA, 14 nt, Homo sapiens
ccugccucugccac

SEQ ID NO: 2150945 - RNA, 17 nt, Homo sapiens
cacucucaaauccugau

SEQ ID NO: 2150946 - RNA, 22 nt, Homo sapiens
cuccaucccuuccccagagaug

SEQ ID NO: 2150947 - RNA, 17 nt, Homo sapiens
acucucaucaccccaga

SEQ ID NO: 2150948 - RNA, 16 nt, Homo sapiens
aaccaacuuuaccucu

SEQ ID NO: 2150949 - RNA, 18 nt, Homo sapiens
aaauauuuugucacugcu

SEQ ID NO: 2150950 - RNA, 21 nt, Homo sapiens
aaugauugucuuccgaguuuu

SEQ ID NO: 2150951 - RNA, 23 nt, Homo sapiens
uucgauacaccgggccuggagaa

SEQ ID NO: 2150952 - RNA, 12 nt, Homo sapiens
guuuuaagacug

SEQ ID NO: 2150953 - RNA, 23 nt, Homo sapiens
agcaugcuucccagagggagcag

SEQ ID NO: 2150954 - RNA, 19 nt, Homo sapiens
gccuuaaugagaacauuua

SEQ ID NO: 2150955 - RNA, 22 nt, Homo sapiens
ugaaacgucccacacuuugaag

SEQ ID NO: 2150956 - RNA, 20 nt, Homo sapiens
uauuuaauguggaaugucaa

SEQ ID NO: 2150957 - RNA, 20 nt, Homo sapiens
ugcuacaaauacucuuagga

SEQ ID NO: 2150958 - RNA, 21 nt, Homo sapiens
uaccucuaguaaauuuaaguc

SEQ ID NO: 2150959 - RNA, 16 nt, Homo sapiens
cucaaaacacuuccag

SEQ ID NO: 2150960 - RNA, 21 nt, Homo sapiens
augggccagcccuugcucuac

SEQ ID NO: 2150961 - RNA, 17 nt, Homo sapiens
gccuacagaagggcagu

SEQ ID NO: 2150962 - RNA, 17 nt, Homo sapiens
aaaguuacuauucugua

SEQ ID NO: 2150963 - RNA, 17 nt, Homo sapiens
agcuucaccagagcauu

SEQ ID NO: 2150964 - RNA, 17 nt, Homo sapiens
cuagccuugcacuuuca

SEQ ID NO: 2150965 - RNA, 22 nt, Homo sapiens
aaagaaauuuaaguucuaugag

SEQ ID NO: 2150966 - RNA, 21 nt, Homo sapiens
gcaguuccccuggagccccuu

SEQ ID NO: 2150967 - RNA, 19 nt, Homo sapiens
aaaugucuuuguaagucag

SEQ ID NO: 2150968 - RNA, 22 nt, Homo sapiens
uacacuguauguuauagaacuu

SEQ ID NO: 2150969 - RNA, 13 nt, Homo sapiens
aauuuugcuccuu

SEQ ID NO: 2150970 - RNA, 21 nt, Homo sapiens
uccccagcauugcaguauggu

SEQ ID NO: 2150971 - RNA, 17 nt, Homo sapiens
ucccaucaauucuuaga

SEQ ID NO: 2150972 - RNA, 16 nt, Homo sapiens
uggauccugcacucua

SEQ ID NO: 2150973 - RNA, 14 nt, Homo sapiens
uacauggucaagua

SEQ ID NO: 2150974 - RNA, 22 nt, Homo sapiens
cacgucucccuggccccaguga

SEQ ID NO: 2150975 - RNA, 21 nt, Homo sapiens
aaccucagccuggccagacac

SEQ ID NO: 2150976 - RNA, 14 nt, Homo sapiens
aacuaucuuuuugc

SEQ ID NO: 2150977 - RNA, 23 nt, Homo sapiens
gauuugggcuacccuaaagggag

SEQ ID NO: 2150978 - RNA, 14 nt, Homo sapiens
aaauaaagcacaaa

SEQ ID NO: 2150979 - RNA, 21 nt, Homo sapiens
ucuccacugucauaaucucuu

SEQ ID NO: 2150980 - RNA, 19 nt, Homo sapiens
aaauggggcaaacagucua

SEQ ID NO: 2150981 - RNA, 22 nt, Homo sapiens
cuguucugagccaaauucuaaa

SEQ ID NO: 2150982 - RNA, 18 nt, Homo sapiens
cuguagauacaggggcaa

SEQ ID NO: 2150983 - RNA, 21 nt, Homo sapiens
ucgccagcugaaguugcugag

SEQ ID NO: 2150984 - RNA, 18 nt, Homo sapiens
ucgcugccaggacaccug

SEQ ID NO: 2150985 - RNA, 22 nt, Homo sapiens
gcugcucuucaucccauuccag

SEQ ID NO: 2150986 - RNA, 17 nt, Homo sapiens
cauccuuugcuuugcaa

SEQ ID NO: 2150987 - RNA, 19 nt, Homo sapiens
ucccacuuuucggagacag

SEQ ID NO: 2150988 - RNA, 22 nt, Homo sapiens
aguguucaaauaaacugaagga

SEQ ID NO: 2150989 - RNA, 24 nt, Homo sapiens
agugaagugguacaaucuggcuca

SEQ ID NO: 2150990 - RNA, 17 nt, Homo sapiens
uacccaacccugcccug

SEQ ID NO: 2150991 - RNA, 15 nt, Homo sapiens
gacuauguagcaaua

SEQ ID NO: 2150992 - RNA, 19 nt, Homo sapiens
cucuguguauuuauauaaa

SEQ ID NO: 2150993 - RNA, 23 nt, Homo sapiens
uuucaguguaugauauacuuuau

SEQ ID NO: 2150994 - RNA, 22 nt, Homo sapiens
uuugugcuaucgcaaaucacaa

SEQ ID NO: 2150995 - RNA, 16 nt, Homo sapiens
cuucaaagacaaugga

SEQ ID NO: 2150996 - RNA, 14 nt, Homo sapiens
gugugugugcaagu

SEQ ID NO: 2150997 - RNA, 20 nt, Homo sapiens
aaugggggcagcaccuccua

SEQ ID NO: 2150998 - RNA, 21 nt, Homo sapiens
cuaaacacgugacacaaacac

SEQ ID NO: 2150999 - RNA, 11 nt, Homo sapiens
augggggauca

SEQ ID NO: 2151000 - RNA, 20 nt, Homo sapiens
cagaaaaccuaccacauuca

SEQ ID NO: 2151001 - RNA, 16 nt, Homo sapiens
uggaaucagcucagga

SEQ ID NO: 2151002 - RNA, 19 nt, Homo sapiens
ugacugaagugaacuauga

SEQ ID NO: 2151003 - RNA, 15 nt, Homo sapiens
uggaaaguucagcca

SEQ ID NO: 2151004 - RNA, 15 nt, Homo sapiens
auuuuaucugugaau

SEQ ID NO: 2151005 - RNA, 20 nt, Homo sapiens
aaggucaauuucaguguaug

SEQ ID NO: 2151006 - RNA, 15 nt, Homo sapiens
guuaccuacuuugac

SEQ ID NO: 2151007 - RNA, 23 nt, Homo sapiens
auuaaguuguuauuucaguuuua

SEQ ID NO: 2151008 - RNA, 15 nt, Homo sapiens
ucacaaaaauuugaa

SEQ ID NO: 2151009 - RNA, 23 nt, Homo sapiens
ccaggaugcuggcugguggaaca

SEQ ID NO: 2151010 - RNA, 18 nt, Homo sapiens
uaugucuugaaacauguu

SEQ ID NO: 2151011 - RNA, 18 nt, Homo sapiens
uccaaacauuaaugcaau

SEQ ID NO: 2151012 - RNA, 21 nt, Homo sapiens
guuugggagacugugcucucu

SEQ ID NO: 2151013 - RNA, 20 nt, Homo sapiens
aaagcuuaauuaaguacaac

SEQ ID NO: 2151014 - RNA, 11 nt, Homo sapiens
cacugccccag

SEQ ID NO: 2151015 - RNA, 11 nt, Homo sapiens
cucugccccug

SEQ ID NO: 2151016 - RNA, 19 nt, Homo sapiens
cuuuauuuguauuugccau

SEQ ID NO: 2151017 - RNA, 18 nt, Homo sapiens
acaccuaugucauuucau

SEQ ID NO: 2151018 - RNA, 21 nt, Homo sapiens
ucuaccagagcgugcacuugu

SEQ ID NO: 2151019 - RNA, 23 nt, Homo sapiens
acaucagcuaguggcucuucuca

SEQ ID NO: 2151020 - RNA, 22 nt, Homo sapiens
auaagucugggcacuggaugca

SEQ ID NO: 2151021 - RNA, 21 nt, Homo sapiens
uccugcagucccacacugugc

SEQ ID NO: 2151022 - RNA, 21 nt, Homo sapiens
aaucauuuguuuacauuugau

SEQ ID NO: 2151023 - RNA, 22 nt, Homo sapiens
accuggaugaucacuaauacua

SEQ ID NO: 2151024 - RNA, 19 nt, Homo sapiens
ggacuccaggccugaccag

SEQ ID NO: 2151025 - RNA, 16 nt, Homo sapiens
gaaucuccacuacuua

SEQ ID NO: 2151026 - RNA, 20 nt, Homo sapiens
ugcagccuccuccaccucac

SEQ ID NO: 2151027 - RNA, 23 nt, Homo sapiens
agccacaguuccccuauguggaa

SEQ ID NO: 2151028 - RNA, 16 nt, Homo sapiens
uaacuuuaaguuucag

SEQ ID NO: 2151029 - RNA, 12 nt, Homo sapiens
aauauauacuca

SEQ ID NO: 2151030 - RNA, 14 nt, Homo sapiens
gccugaauugagaa

SEQ ID NO: 2151031 - RNA, 20 nt, Homo sapiens
aguaucacauagaagcuguc

SEQ ID NO: 2151032 - RNA, 22 nt, Homo sapiens
uccuaaauauccaaagacugua

SEQ ID NO: 2151033 - RNA, 18 nt, Homo sapiens
aaacuuuuaugcgcaaau

SEQ ID NO: 2151034 - RNA, 22 nt, Homo sapiens
cuuccaaagagaguuaaaagca

SEQ ID NO: 2151035 - RNA, 21 nt, Homo sapiens
caagcuguccucccaccucag

SEQ ID NO: 2151036 - RNA, 23 nt, Homo sapiens
gagcugaauguuuguuucagugc

SEQ ID NO: 2151037 - RNA, 16 nt, Homo sapiens
uauugucgcuauguga

SEQ ID NO: 2151038 - RNA, 16 nt, Homo sapiens
ugauauauauguauaa

SEQ ID NO: 2151039 - RNA, 13 nt, Homo sapiens
aacuugcucucau

SEQ ID NO: 2151040 - RNA, 16 nt, Homo sapiens
gacuggcgugcugaga

SEQ ID NO: 2151041 - RNA, 21 nt, Homo sapiens
aaggcucagucgcuagcauuu

SEQ ID NO: 2151042 - RNA, 19 nt, Homo sapiens
cuagcgugcccugccccuc

SEQ ID NO: 2151043 - RNA, 14 nt, Homo sapiens
cucuggcacuuuga

SEQ ID NO: 2151044 - RNA, 20 nt, Homo sapiens
ugaucauuauaucauuggaa

SEQ ID NO: 2151045 - RNA, 22 nt, Homo sapiens
ggaaagccuuaaaaauauccuu

SEQ ID NO: 2151046 - RNA, 17 nt, Homo sapiens
gugaaguaggugaucuu

SEQ ID NO: 2151047 - RNA, 24 nt, Homo sapiens
gggacaagcccuggagaaauggga

SEQ ID NO: 2151048 - RNA, 14 nt, Homo sapiens
aguuugacuucuuu

SEQ ID NO: 2151049 - RNA, 14 nt, Homo sapiens
gcuauagcuacagg

SEQ ID NO: 2151050 - RNA, 19 nt, Homo sapiens
cacaauaagccacugguau

SEQ ID NO: 2151051 - RNA, 20 nt, Homo sapiens
uaaaaccauaaacuguacaa

SEQ ID NO: 2151052 - RNA, 21 nt, Homo sapiens
cuccaugcuggauacuggaca

SEQ ID NO: 2151053 - RNA, 23 nt, Homo sapiens
auggacuggagcucaucugcaaa

SEQ ID NO: 2151054 - RNA, 20 nt, Homo sapiens
ugggggaccaaugaggugag

SEQ ID NO: 2151055 - RNA, 16 nt, Homo sapiens
cucccaagacugcucc

SEQ ID NO: 2151056 - RNA, 14 nt, Homo sapiens
ccuuuccuggcagu

SEQ ID NO: 2151057 - RNA, 20 nt, Homo sapiens
accgagugaggccauagcaa

SEQ ID NO: 2151058 - RNA, 15 nt, Homo sapiens
caucucaacaggccu

SEQ ID NO: 2151059 - RNA, 22 nt, Homo sapiens
uagagcaauacuuuuuguggaa

SEQ ID NO: 2151060 - RNA, 22 nt, Homo sapiens
ucuuaauacuaaggaaccaaca

SEQ ID NO: 2151061 - RNA, 16 nt, Homo sapiens
agaacuauaugugaau

SEQ ID NO: 2151062 - RNA, 22 nt, Homo sapiens
uuuuauuguaacagacauuguu

SEQ ID NO: 2151063 - RNA, 21 nt, Homo sapiens
aauggacaucaaaaucaacuu

SEQ ID NO: 2151064 - RNA, 21 nt, Homo sapiens
uucagagcuaauaagugcuuu

SEQ ID NO: 2151065 - RNA, 20 nt, Homo sapiens
acaggcccuuuccucaggca

SEQ ID NO: 2151066 - RNA, 19 nt, Homo sapiens
ccuuaagagucauccagcu

SEQ ID NO: 2151067 - RNA, 13 nt, Homo sapiens
ggccucagggacc

SEQ ID NO: 2151068 - RNA, 20 nt, Homo sapiens
agccugcacccagguacuga

SEQ ID NO: 2151069 - RNA, 13 nt, Homo sapiens
aaaugcagugaaa

SEQ ID NO: 2151070 - RNA, 23 nt, Homo sapiens
uaacauacugcauuucacucugg

SEQ ID NO: 2151071 - RNA, 19 nt, Homo sapiens
auuacaaggcuuuaucuca

SEQ ID NO: 2151072 - RNA, 22 nt, Homo sapiens
aaguaaucuguugacagugcca

SEQ ID NO: 2151073 - RNA, 16 nt, Homo sapiens
uuugaguugugauuga

SEQ ID NO: 2151074 - RNA, 23 nt, Homo sapiens
agaaaggagcucugaaucugaua

SEQ ID NO: 2151075 - RNA, 21 nt, Homo sapiens
agagugggguagguugggaga

SEQ ID NO: 2151076 - RNA, 14 nt, Homo sapiens
ugacauagccucau

SEQ ID NO: 2151077 - RNA, 16 nt, Homo sapiens
gucuggaaugcagugg

SEQ ID NO: 2151078 - RNA, 14 nt, Homo sapiens
gacccacugugcug

SEQ ID NO: 2151079 - RNA, 23 nt, Homo sapiens
ccuuaauuuagaaacugaaaaau

SEQ ID NO: 2151080 - RNA, 16 nt, Homo sapiens
cuuuucacuucuuaag

SEQ ID NO: 2151081 - RNA, 13 nt, Homo sapiens
cccuccaauccca

SEQ ID NO: 2151082 - RNA, 17 nt, Homo sapiens
aaaguaagcauuuccag

SEQ ID NO: 2151083 - RNA, 21 nt, Homo sapiens
gcccagcccuggcccaggugc

SEQ ID NO: 2151084 - RNA, 17 nt, Homo sapiens
caagaaugcauugauau

SEQ ID NO: 2151085 - RNA, 16 nt, Homo sapiens
uggaagagcacaagag

SEQ ID NO: 2151086 - RNA, 19 nt, Homo sapiens
gacaugccacccucuccau

SEQ ID NO: 2151087 - RNA, 14 nt, Homo sapiens
acuucacauugcaa

SEQ ID NO: 2151088 - RNA, 22 nt, Homo sapiens
uggucuaagguucagccugaaa

SEQ ID NO: 2151089 - RNA, 17 nt, Homo sapiens
ucucucuugcuuacaaa

SEQ ID NO: 2151090 - RNA, 20 nt, Homo sapiens
aacauauaaagcacuauaca

SEQ ID NO: 2151091 - RNA, 22 nt, Homo sapiens
ucucuucuuuuggcuuccauga

SEQ ID NO: 2151092 - RNA, 14 nt, Homo sapiens
ccucagagggccau

SEQ ID NO: 2151093 - RNA, 21 nt, Homo sapiens
gccccgacguuugcggcagug

SEQ ID NO: 2151094 - RNA, 21 nt, Homo sapiens
acucuguauaaguugaaggaa

SEQ ID NO: 2151095 - RNA, 22 nt, Homo sapiens
guguuguaaacuuaguugcacu

SEQ ID NO: 2151096 - RNA, 17 nt, Homo sapiens
aucugcuuuugguuaua

SEQ ID NO: 2151097 - RNA, 19 nt, Homo sapiens
guaaacagaaauugcaaua

SEQ ID NO: 2151098 - RNA, 14 nt, Homo sapiens
auuaauucaaugaa

SEQ ID NO: 2151099 - RNA, 18 nt, Homo sapiens
cucagaguaaaauaggca

SEQ ID NO: 2151100 - RNA, 21 nt, Homo sapiens
gguuaguggucucuacugugg

SEQ ID NO: 2151101 - RNA, 19 nt, Homo sapiens
ccuaaaaaguaucauuaca

SEQ ID NO: 2151102 - RNA, 20 nt, Homo sapiens
auccuugaugaaucuggggu

SEQ ID NO: 2151103 - RNA, 21 nt, Homo sapiens
ugagagagagaaccuuuccac

SEQ ID NO: 2151104 - RNA, 16 nt, Homo sapiens
caagauuaaacugagu

SEQ ID NO: 2151105 - RNA, 18 nt, Homo sapiens
gucucugcuaaaccacca

SEQ ID NO: 2151106 - RNA, 18 nt, Homo sapiens
aaaauaguguguccaugc

SEQ ID NO: 2151107 - RNA, 23 nt, Homo sapiens
cagccacccuaacugagcugcca

SEQ ID NO: 2151108 - RNA, 17 nt, Homo sapiens
cuguucccuguccuacc

SEQ ID NO: 2151109 - RNA, 22 nt, Homo sapiens
aaauuguauacauuuuguuaua

SEQ ID NO: 2151110 - RNA, 16 nt, Homo sapiens
cacagauaaaguuuuc

SEQ ID NO: 2151111 - RNA, 23 nt, Homo sapiens
uuaaaaaguauugccaaacauua

SEQ ID NO: 2151112 - RNA, 16 nt, Homo sapiens
gcaacaaaauuuacac

SEQ ID NO: 2151113 - RNA, 13 nt, Homo sapiens
auggaguuucccu

SEQ ID NO: 2151114 - RNA, 14 nt, Homo sapiens
ugccuggagucagu

SEQ ID NO: 2151115 - RNA, 21 nt, Homo sapiens
agaaauugauugaacguucuc

SEQ ID NO: 2151116 - RNA, 22 nt, Homo sapiens
cuagaaagcugcacuggugcua

SEQ ID NO: 2151117 - RNA, 23 nt, Homo sapiens
agucuccccuugcagccugguca

SEQ ID NO: 2151118 - RNA, 13 nt, Homo sapiens
cugcugacuguuu

SEQ ID NO: 2151119 - RNA, 21 nt, Homo sapiens
gaaagguaauacagcuuguga

SEQ ID NO: 2151120 - RNA, 19 nt, Homo sapiens
cagccucccgaguagcuga

SEQ ID NO: 2151121 - RNA, 22 nt, Homo sapiens
ucccccacagccacuacugacu

SEQ ID NO: 2151122 - RNA, 21 nt, Homo sapiens
uauguuuggaauaaagucaac

SEQ ID NO: 2151123 - RNA, 17 nt, Homo sapiens
cacaccuccugccuuua

SEQ ID NO: 2151124 - RNA, 23 nt, Homo sapiens
agcugugauggcgggcacugggu

SEQ ID NO: 2151125 - RNA, 19 nt, Homo sapiens
aaguuauuguguugccuua

SEQ ID NO: 2151126 - RNA, 24 nt, Homo sapiens
aauuuucuucaugcaaugacaucu

SEQ ID NO: 2151127 - RNA, 18 nt, Homo sapiens
uucaaguuaccaauguaa

SEQ ID NO: 2151128 - RNA, 14 nt, Homo sapiens
acugucucucauga

SEQ ID NO: 2151129 - RNA, 17 nt, Homo sapiens
gggcgcaugccucccag

SEQ ID NO: 2151130 - RNA, 22 nt, Homo sapiens
ugcuguccagggcagaggccau

SEQ ID NO: 2151131 - RNA, 18 nt, Homo sapiens
auugagcuuugcauuuau

SEQ ID NO: 2151132 - RNA, 12 nt, Homo sapiens
caucaugacuga

SEQ ID NO: 2151133 - RNA, 18 nt, Homo sapiens
ucaccugcccugugcaug

SEQ ID NO: 2151134 - RNA, 19 nt, Homo sapiens
cuaaagccucaaaacaaag

SEQ ID NO: 2151135 - RNA, 12 nt, Homo sapiens
uaacugugcuga

SEQ ID NO: 2151136 - RNA, 19 nt, Homo sapiens
uaucucgcuagccauauau

SEQ ID NO: 2151137 - RNA, 17 nt, Homo sapiens
gaagaugagacugccca

SEQ ID NO: 2151138 - RNA, 21 nt, Homo sapiens
cauucccagaauuugcugcau

SEQ ID NO: 2151139 - RNA, 22 nt, Homo sapiens
agagaauuguaucauuugaaca

SEQ ID NO: 2151140 - RNA, 14 nt, Homo sapiens
uugcgugaaagugu

SEQ ID NO: 2151141 - RNA, 14 nt, Homo sapiens
uuuccugaaauucu

SEQ ID NO: 2151142 - RNA, 15 nt, Homo sapiens
cagaccagaccccaa

SEQ ID NO: 2151143 - RNA, 13 nt, Homo sapiens
cuuacguccuucc

SEQ ID NO: 2151144 - RNA, 19 nt, Homo sapiens
ccacugcagcaccugccac

SEQ ID NO: 2151145 - RNA, 13 nt, Homo sapiens
uaacagucuaaaa

SEQ ID NO: 2151146 - RNA, 15 nt, Homo sapiens
guaagacacugugca

SEQ ID NO: 2151147 - RNA, 15 nt, Homo sapiens
cugucauuuugcacu

SEQ ID NO: 2151148 - RNA, 22 nt, Homo sapiens
agagcaguuugguuucuagcau

SEQ ID NO: 2151149 - RNA, 16 nt, Homo sapiens
cuucagagagcagugc

SEQ ID NO: 2151150 - RNA, 23 nt, Homo sapiens
gaugaccacauaagaaggcaauu

SEQ ID NO: 2151151 - RNA, 22 nt, Homo sapiens
auggauuuugggagugacucaa

SEQ ID NO: 2151152 - RNA, 23 nt, Homo sapiens
ugcuuaaacuacaaacacaagca

SEQ ID NO: 2151153 - RNA, 15 nt, Homo sapiens
ucugaggggcuacca

SEQ ID NO: 2151154 - RNA, 17 nt, Homo sapiens
gauugcgagaauuuuca

SEQ ID NO: 2151155 - RNA, 15 nt, Homo sapiens
uauauaaacauauca

SEQ ID NO: 2151156 - RNA, 17 nt, Homo sapiens
cugagcccccugaccuu

SEQ ID NO: 2151157 - RNA, 14 nt, Homo sapiens
uaguuugcauucca

SEQ ID NO: 2151158 - RNA, 18 nt, Homo sapiens
gaauuuguggccuaccuu

SEQ ID NO: 2151159 - RNA, 14 nt, Homo sapiens
agacacuauguagu

SEQ ID NO: 2151160 - RNA, 23 nt, Homo sapiens
agauaguggggagacuucuuggc

SEQ ID NO: 2151161 - RNA, 18 nt, Homo sapiens
ugaaauaacaaaauggac

SEQ ID NO: 2151162 - RNA, 18 nt, Homo sapiens
aacuuuugguuuucagau

SEQ ID NO: 2151163 - RNA, 21 nt, Homo sapiens
uuguagacagggucucccuau

SEQ ID NO: 2151164 - RNA, 18 nt, Homo sapiens
cagaaacuuuacaaccug

SEQ ID NO: 2151165 - RNA, 19 nt, Homo sapiens
cccugaaauaaagcacauu

SEQ ID NO: 2151166 - RNA, 15 nt, Homo sapiens
cacuguuugucucac

SEQ ID NO: 2151167 - RNA, 14 nt, Homo sapiens
ucugauacagccuu

SEQ ID NO: 2151168 - RNA, 23 nt, Homo sapiens
uaugccauguggucauacucuca

SEQ ID NO: 2151169 - RNA, 19 nt, Homo sapiens
ugagcaggaaagacuggcc

SEQ ID NO: 2151170 - RNA, 18 nt, Homo sapiens
ccaggagagagggcaaag

SEQ ID NO: 2151171 - RNA, 24 nt, Homo sapiens
caaguccugggaauaugcuaguga

SEQ ID NO: 2151172 - RNA, 21 nt, Homo sapiens
aagaauuuaagacuugugcuu

SEQ ID NO: 2151173 - RNA, 20 nt, Homo sapiens
caggugugaaccacugugcc

SEQ ID NO: 2151174 - RNA, 21 nt, Homo sapiens
cuugccucaaguuccaugcuu

SEQ ID NO: 2151175 - RNA, 22 nt, Homo sapiens
aggaguccacugccuccaugau

SEQ ID NO: 2151176 - RNA, 15 nt, Homo sapiens
uuaugcaagcacaaa

SEQ ID NO: 2151177 - RNA, 22 nt, Homo sapiens
ugggaccaacuuccuguugaug

SEQ ID NO: 2151178 - RNA, 18 nt, Homo sapiens
caacugcugcugugcaca

SEQ ID NO: 2151179 - RNA, 22 nt, Homo sapiens
acaaacuguuguggguuccugc

SEQ ID NO: 2151180 - RNA, 13 nt, Homo sapiens
uauauucauuuca

SEQ ID NO: 2151181 - RNA, 13 nt, Homo sapiens
ggacuuccaucug

SEQ ID NO: 2151182 - RNA, 15 nt, Homo sapiens
uugggggaaccagca

SEQ ID NO: 2151183 - RNA, 23 nt, Homo sapiens
aagaucagcgacugccacaucau

SEQ ID NO: 2151184 - RNA, 13 nt, Homo sapiens
aucagccuugcua

SEQ ID NO: 2151185 - RNA, 21 nt, Homo sapiens
gucuuucccauuucuaccuaa

SEQ ID NO: 2151186 - RNA, 13 nt, Homo sapiens
cuaaguacuguaa

SEQ ID NO: 2151187 - RNA, 23 nt, Homo sapiens
uucucuuccgucuaaucucucac

SEQ ID NO: 2151188 - RNA, 19 nt, Homo sapiens
acccagaaaucauuuuacc

SEQ ID NO: 2151189 - RNA, 21 nt, Homo sapiens
gaagaacagcuguuccugugu

SEQ ID NO: 2151190 - RNA, 14 nt, Homo sapiens
ccuuaacuggcaua

SEQ ID NO: 2151191 - RNA, 17 nt, Homo sapiens
acgaauuccaucuugua

SEQ ID NO: 2151192 - RNA, 23 nt, Homo sapiens
uucagcuucagacuuuuaucaaa

SEQ ID NO: 2151193 - RNA, 11 nt, Homo sapiens
aaguguggaau

SEQ ID NO: 2151194 - RNA, 22 nt, Homo sapiens
agcccacggggcaaagcugcug

SEQ ID NO: 2151195 - RNA, 21 nt, Homo sapiens
cuaaacuaucuguauuuauua

SEQ ID NO: 2151196 - RNA, 17 nt, Homo sapiens
cauuugccaacucgaac

SEQ ID NO: 2151197 - RNA, 16 nt, Homo sapiens
cugcaucugucugucc

SEQ ID NO: 2151198 - RNA, 14 nt, Homo sapiens
uccacucucuacca

SEQ ID NO: 2151199 - RNA, 17 nt, Homo sapiens
acugaugcccuuuggaa

SEQ ID NO: 2151200 - RNA, 13 nt, Homo sapiens
gcccagugcaaac

SEQ ID NO: 2151201 - RNA, 16 nt, Homo sapiens
uacaucuuucauuucg

SEQ ID NO: 2151202 - RNA, 15 nt, Homo sapiens
ggccccacucaggga

SEQ ID NO: 2151203 - RNA, 16 nt, Homo sapiens
gaaauaauucaaacac

SEQ ID NO: 2151204 - RNA, 18 nt, Homo sapiens
acgggguuacacuguuaa

SEQ ID NO: 2151205 - RNA, 16 nt, Homo sapiens
uccauuacgugcauuu

SEQ ID NO: 2151206 - RNA, 18 nt, Homo sapiens
gcacuugcagaccugccu

SEQ ID NO: 2151207 - RNA, 17 nt, Homo sapiens
cugggagcccucgggaa

SEQ ID NO: 2151208 - RNA, 23 nt, Homo sapiens
gcaauuaauuccuucagcacuuu

SEQ ID NO: 2151209 - RNA, 22 nt, Homo sapiens
uggucuguggagauggacucag

SEQ ID NO: 2151210 - RNA, 21 nt, Homo sapiens
acuauugaaguugcagauuca

SEQ ID NO: 2151211 - RNA, 18 nt, Homo sapiens
ucugucuugucauuccag

SEQ ID NO: 2151212 - RNA, 14 nt, Homo sapiens
ugccccacugaauu

SEQ ID NO: 2151213 - RNA, 22 nt, Homo sapiens
agaggacgcacgcucgcugcca

SEQ ID NO: 2151214 - RNA, 14 nt, Homo sapiens
gaaagggucucccu

SEQ ID NO: 2151215 - RNA, 15 nt, Homo sapiens
uucccacuuugccac

SEQ ID NO: 2151216 - RNA, 15 nt, Homo sapiens
uggccaguugcccag

SEQ ID NO: 2151217 - RNA, 18 nt, Homo sapiens
caauuacucagguuugag

SEQ ID NO: 2151218 - RNA, 19 nt, Homo sapiens
uggcugggcuacaauuugu

SEQ ID NO: 2151219 - RNA, 19 nt, Homo sapiens
cugcacacagugacuuccu

SEQ ID NO: 2151220 - RNA, 21 nt, Homo sapiens
agucugccacuugucaaagaa

SEQ ID NO: 2151221 - RNA, 22 nt, Homo sapiens
caggguucccuugaaagcuuua

SEQ ID NO: 2151222 - RNA, 18 nt, Homo sapiens
aggcauagccacuugcuc

SEQ ID NO: 2151223 - RNA, 15 nt, Homo sapiens
aauuuagagucaauu

SEQ ID NO: 2151224 - RNA, 23 nt, Homo sapiens
cuaugaucacagugacuuuacag

SEQ ID NO: 2151225 - RNA, 19 nt, Homo sapiens
ucugguccuaagucccugc

SEQ ID NO: 2151226 - RNA, 17 nt, Homo sapiens
gaaaaugaaaugcauau

SEQ ID NO: 2151227 - RNA, 20 nt, Homo sapiens
aacugaauagcaaguggcau

SEQ ID NO: 2151228 - RNA, 22 nt, Homo sapiens
ccauccuccuuuucuccuugcc

SEQ ID NO: 2151229 - RNA, 15 nt, Homo sapiens
acuccugaccucgug

SEQ ID NO: 2151230 - RNA, 18 nt, Homo sapiens
cucauugacaagaacuga

SEQ ID NO: 2151231 - RNA, 19 nt, Homo sapiens
ugaacauucccuugaucuc

SEQ ID NO: 2151232 - RNA, 22 nt, Homo sapiens
auugggaguuuauaccaagaga

SEQ ID NO: 2151233 - RNA, 22 nt, Homo sapiens
gagcuuugugcuugucauucca

SEQ ID NO: 2151234 - RNA, 16 nt, Homo sapiens
uauuuuguugccuuca

SEQ ID NO: 2151235 - RNA, 19 nt, Homo sapiens
uggagugaccauagcuccu

SEQ ID NO: 2151236 - RNA, 19 nt, Homo sapiens
agggcugcagucacauuga

SEQ ID NO: 2151237 - RNA, 10 nt, Homo sapiens
uguacuugau

SEQ ID NO: 2151238 - RNA, 16 nt, Homo sapiens
cuaugaagaguauuaa

SEQ ID NO: 2151239 - RNA, 23 nt, Homo sapiens
ugcacuugcacgcccauguguga

SEQ ID NO: 2151240 - RNA, 13 nt, Homo sapiens
uccucaccugugu

SEQ ID NO: 2151241 - RNA, 14 nt, Homo sapiens
cccaggacccugaa

SEQ ID NO: 2151242 - RNA, 16 nt, Homo sapiens
gccaaaggaaugucca

SEQ ID NO: 2151243 - RNA, 17 nt, Homo sapiens
uagcagcccagcauuuc

SEQ ID NO: 2151244 - RNA, 22 nt, Homo sapiens
caugcuacccagccauuaccca

SEQ ID NO: 2151245 - RNA, 18 nt, Homo sapiens
cuuauguggaacuguaca

SEQ ID NO: 2151246 - RNA, 21 nt, Homo sapiens
cagguccgugggccguaucug

SEQ ID NO: 2151247 - RNA, 22 nt, Homo sapiens
cugaaacuauagaauaaagccu

SEQ ID NO: 2151248 - RNA, 20 nt, Homo sapiens
gugacagagcgagacuccau

SEQ ID NO: 2151249 - RNA, 13 nt, Homo sapiens
uguugcccccaaa

SEQ ID NO: 2151250 - RNA, 14 nt, Homo sapiens
uggcaauaaacucc

SEQ ID NO: 2151251 - RNA, 13 nt, Homo sapiens
ugcuaaaugugaa

SEQ ID NO: 2151252 - RNA, 15 nt, Homo sapiens
ggcuuucagagccag

SEQ ID NO: 2151253 - RNA, 20 nt, Homo sapiens
cauugugauuuguuccugcc

SEQ ID NO: 2151254 - RNA, 14 nt, Homo sapiens
uaaucgcuaaucag

SEQ ID NO: 2151255 - RNA, 14 nt, Homo sapiens
cugugccgugucca

SEQ ID NO: 2151256 - RNA, 10 nt, Homo sapiens
gaggcauuuc

SEQ ID NO: 2151257 - RNA, 16 nt, Homo sapiens
aggaaacgcuaccucu

SEQ ID NO: 2151258 - RNA, 16 nt, Homo sapiens
cacucaggauguccuu

SEQ ID NO: 2151259 - RNA, 20 nt, Homo sapiens
cuaauaaaaaacaccuucua

SEQ ID NO: 2151260 - RNA, 12 nt, Homo sapiens
uauacuguaaag

SEQ ID NO: 2151261 - RNA, 11 nt, Homo sapiens
gagauguaucc

SEQ ID NO: 2151262 - RNA, 23 nt, Homo sapiens
uugccaagcucaggaccaggcaa

SEQ ID NO: 2151263 - RNA, 15 nt, Homo sapiens
uauucucaugccuca

SEQ ID NO: 2151264 - RNA, 18 nt, Homo sapiens
caggcugauggagacagu

SEQ ID NO: 2151265 - RNA, 19 nt, Homo sapiens
aauaguggcauaccaaaug

SEQ ID NO: 2151266 - RNA, 22 nt, Homo sapiens
gaaucacagcccucaugaucau

SEQ ID NO: 2151267 - RNA, 18 nt, Homo sapiens
acugcaaacccugcugcc

SEQ ID NO: 2151268 - RNA, 14 nt, Homo sapiens
gcagugagugagcc

SEQ ID NO: 2151269 - RNA, 13 nt, Homo sapiens
aucuauaguauag

SEQ ID NO: 2151270 - RNA, 14 nt, Homo sapiens
caugcuugacauac

SEQ ID NO: 2151271 - RNA, 13 nt, Homo sapiens
uccaggcccucca

SEQ ID NO: 2151272 - RNA, 20 nt, Homo sapiens
cggggaucaucucugugacc

SEQ ID NO: 2151273 - RNA, 20 nt, Homo sapiens
cacacccuggaggauuucau

SEQ ID NO: 2151274 - RNA, 18 nt, Homo sapiens
cuccguuuggcagugcaa

SEQ ID NO: 2151275 - RNA, 22 nt, Homo sapiens
cauuuugaagugggauguuaau

SEQ ID NO: 2151276 - RNA, 17 nt, Homo sapiens
caccccuauggugcuca

SEQ ID NO: 2151277 - RNA, 23 nt, Homo sapiens
agcuggaagggucaacaucuuuu

SEQ ID NO: 2151278 - RNA, 21 nt, Homo sapiens
guucguucuguacuguuacug

SEQ ID NO: 2151279 - RNA, 15 nt, Homo sapiens
gaagauguaaggaau

SEQ ID NO: 2151280 - RNA, 17 nt, Homo sapiens
ccuccauucugaccauu

SEQ ID NO: 2151281 - RNA, 22 nt, Homo sapiens
gguucacaaggcuuggaccugc

SEQ ID NO: 2151282 - RNA, 17 nt, Homo sapiens
cuaaaacuuaacauuca

SEQ ID NO: 2151283 - RNA, 21 nt, Homo sapiens
uguugccuuuuuacagccaac

SEQ ID NO: 2151284 - RNA, 16 nt, Homo sapiens
uauacuuaucacauuu

SEQ ID NO: 2151285 - RNA, 21 nt, Homo sapiens
caaaugggguuucacaaauag

SEQ ID NO: 2151286 - RNA, 16 nt, Homo sapiens
gcccagucuggaugug

SEQ ID NO: 2151287 - RNA, 14 nt, Homo sapiens
ccauugacuucuuc

SEQ ID NO: 2151288 - RNA, 14 nt, Homo sapiens
ccacugacuuccuc

SEQ ID NO: 2151289 - RNA, 18 nt, Homo sapiens
cucuuuagagaaguccaa

SEQ ID NO: 2151290 - RNA, 11 nt, Homo sapiens
agcugcucagg

SEQ ID NO: 2151291 - RNA, 21 nt, Homo sapiens
caagagugguaucuugcagua

SEQ ID NO: 2151292 - RNA, 17 nt, Homo sapiens
uaauccaaauccaucaa

SEQ ID NO: 2151293 - RNA, 15 nt, Homo sapiens
auguaagcucuacug

SEQ ID NO: 2151294 - RNA, 20 nt, Homo sapiens
agcagggccaacaaccugug

SEQ ID NO: 2151295 - RNA, 18 nt, Homo sapiens
agcauguaaggccuuuca

SEQ ID NO: 2151296 - RNA, 13 nt, Homo sapiens
gcucagugccuuc

SEQ ID NO: 2151297 - RNA, 21 nt, Homo sapiens
ucuugggccccagaccccagg

SEQ ID NO: 2151298 - RNA, 14 nt, Homo sapiens
auaugcaagcagcu

SEQ ID NO: 2151299 - RNA, 22 nt, Homo sapiens
ugguugcauuugucaaagcauu

SEQ ID NO: 2151300 - RNA, 18 nt, Homo sapiens
ugcaacucuaacucugag

SEQ ID NO: 2151301 - RNA, 16 nt, Homo sapiens
uucagguauauaccuc

SEQ ID NO: 2151302 - RNA, 15 nt, Homo sapiens
caucccuauccugug

SEQ ID NO: 2151303 - RNA, 20 nt, Homo sapiens
auucgugcauuuuuggauca

SEQ ID NO: 2151304 - RNA, 23 nt, Homo sapiens
uauauaguuaugcauacauacac

SEQ ID NO: 2151305 - RNA, 15 nt, Homo sapiens
ccuugcucugccauc

SEQ ID NO: 2151306 - RNA, 18 nt, Homo sapiens
ccucacgcucuccaucau

SEQ ID NO: 2151307 - RNA, 23 nt, Homo sapiens
ccaugugugugcaagugugugca

SEQ ID NO: 2151308 - RNA, 15 nt, Homo sapiens
caguauggaagggag

SEQ ID NO: 2151309 - RNA, 15 nt, Homo sapiens
auaagucacugacau

SEQ ID NO: 2151310 - RNA, 14 nt, Homo sapiens
auccuuggugcugu

SEQ ID NO: 2151311 - RNA, 14 nt, Homo sapiens
uggcccugccucau

SEQ ID NO: 2151312 - RNA, 20 nt, Homo sapiens
uuuaaaaaauuuuaagcugu

SEQ ID NO: 2151313 - RNA, 16 nt, Homo sapiens
uucgcagccuagauau

SEQ ID NO: 2151314 - RNA, 19 nt, Homo sapiens
gaaccgagguguugccagu

SEQ ID NO: 2151315 - RNA, 19 nt, Homo sapiens
cucaucugcacuauguuuc

SEQ ID NO: 2151316 - RNA, 22 nt, Homo sapiens
uugauuccugguuugacucagu

SEQ ID NO: 2151317 - RNA, 19 nt, Homo sapiens
ggacugaugccccagggau

SEQ ID NO: 2151318 - RNA, 22 nt, Homo sapiens
caaaagagagaagaguccagga

SEQ ID NO: 2151319 - RNA, 13 nt, Homo sapiens
ugagcauccucuc

SEQ ID NO: 2151320 - RNA, 22 nt, Homo sapiens
gacuugcguggacagucagggu

SEQ ID NO: 2151321 - RNA, 14 nt, Homo sapiens
aauuauagucaaua

SEQ ID NO: 2151322 - RNA, 15 nt, Homo sapiens
uccuuucuccuguga

SEQ ID NO: 2151323 - RNA, 17 nt, Homo sapiens
acuuuccucgccugaca

SEQ ID NO: 2151324 - RNA, 22 nt, Homo sapiens
gccucucuuuguuuuucuuuug

SEQ ID NO: 2151325 - RNA, 12 nt, Homo sapiens
auauuagcauug

SEQ ID NO: 2151326 - RNA, 12 nt, Homo sapiens
aaaguagcaauu

SEQ ID NO: 2151327 - RNA, 21 nt, Homo sapiens
ccuuagugccaggagggcaca

SEQ ID NO: 2151328 - RNA, 15 nt, Homo sapiens
uuguggcccaugaaa

SEQ ID NO: 2151329 - RNA, 19 nt, Homo sapiens
ugaaauuuguuauacuuca

SEQ ID NO: 2151330 - RNA, 18 nt, Homo sapiens
acaggccucccaaguuuu

SEQ ID NO: 2151331 - RNA, 21 nt, Homo sapiens
uccugccaacugauuuaaaag

SEQ ID NO: 2151332 - RNA, 17 nt, Homo sapiens
ggccaggcugccugugu

SEQ ID NO: 2151333 - RNA, 16 nt, Homo sapiens
ugcuuugacacugaau

SEQ ID NO: 2151334 - RNA, 14 nt, Homo sapiens
uucauuuccagcau

SEQ ID NO: 2151335 - RNA, 22 nt, Homo sapiens
aaagaauuuucagauggacaug

SEQ ID NO: 2151336 - RNA, 19 nt, Homo sapiens
gcuuuuucaaaguguugau

SEQ ID NO: 2151337 - RNA, 21 nt, Homo sapiens
uuccuucugcccuuccuccag

SEQ ID NO: 2151338 - RNA, 20 nt, Homo sapiens
ugggccagaaguaccagacu

SEQ ID NO: 2151339 - RNA, 17 nt, Homo sapiens
uguccuguuccugccac

SEQ ID NO: 2151340 - RNA, 23 nt, Homo sapiens
uuaaguaucucaacaacauguca

SEQ ID NO: 2151341 - RNA, 19 nt, Homo sapiens
ugagaucuccacggucaga

SEQ ID NO: 2151342 - RNA, 20 nt, Homo sapiens
guugaaugguuaaaauguag

SEQ ID NO: 2151343 - RNA, 15 nt, Homo sapiens
ugccaggccuggcaa

SEQ ID NO: 2151344 - RNA, 15 nt, Homo sapiens
caucaagacuaucua

SEQ ID NO: 2151345 - RNA, 17 nt, Homo sapiens
auguaguuacuuccuuu

SEQ ID NO: 2151346 - RNA, 22 nt, Homo sapiens
agaccugaaaaaguuuugugga

SEQ ID NO: 2151347 - RNA, 12 nt, Homo sapiens
cugagcacagau

SEQ ID NO: 2151348 - RNA, 14 nt, Homo sapiens
ucuuagagcaaaga

SEQ ID NO: 2151349 - RNA, 12 nt, Homo sapiens
auagcuaauaau

SEQ ID NO: 2151350 - RNA, 21 nt, Homo sapiens
uaaucccagcacuuuggcagg

SEQ ID NO: 2151351 - RNA, 16 nt, Homo sapiens
uguguggcauuuucac

SEQ ID NO: 2151352 - RNA, 13 nt, Homo sapiens
cuggcagaguuag

SEQ ID NO: 2151353 - RNA, 23 nt, Homo sapiens
aggccagagaauucaaauuguua

SEQ ID NO: 2151354 - RNA, 18 nt, Homo sapiens
ugagaaagagcacuuaag

SEQ ID NO: 2151355 - RNA, 22 nt, Homo sapiens
acagugucugugccauggauuu

SEQ ID NO: 2151356 - RNA, 11 nt, Homo sapiens
uucuguuuacu

SEQ ID NO: 2151357 - RNA, 11 nt, Homo sapiens
uugagccaugc

SEQ ID NO: 2151358 - RNA, 19 nt, Homo sapiens
aauuacuuugauuccauuu

SEQ ID NO: 2151359 - RNA, 16 nt, Homo sapiens
guaucuaaaaguguca

SEQ ID NO: 2151360 - RNA, 14 nt, Homo sapiens
ccgggacacagaau

SEQ ID NO: 2151361 - RNA, 23 nt, Homo sapiens
auuaaaauccagcaucccaagau

SEQ ID NO: 2151362 - RNA, 14 nt, Homo sapiens
auaugggaggaaca

SEQ ID NO: 2151363 - RNA, 16 nt, Homo sapiens
cuguggaacauaaaaa

SEQ ID NO: 2151364 - RNA, 18 nt, Homo sapiens
uuguauuugcauauguau

SEQ ID NO: 2151365 - RNA, 19 nt, Homo sapiens
gugccuccuagagugcagg

SEQ ID NO: 2151366 - RNA, 22 nt, Homo sapiens
aaggucuuauaguccaaacuuu

SEQ ID NO: 2151367 - RNA, 17 nt, Homo sapiens
caagcccccccuuccac

SEQ ID NO: 2151368 - RNA, 19 nt, Homo sapiens
ccugggccccagaaagccu

SEQ ID NO: 2151369 - RNA, 13 nt, Homo sapiens
gaggacuccuuaa

SEQ ID NO: 2151370 - RNA, 18 nt, Homo sapiens
auaagggaauccugagaa

SEQ ID NO: 2151371 - RNA, 22 nt, Homo sapiens
ggaccucuuuacucucuccgau

SEQ ID NO: 2151372 - RNA, 21 nt, Homo sapiens
accccaagcaaaucccaacau

SEQ ID NO: 2151373 - RNA, 21 nt, Homo sapiens
ccacucccuucccaaguuccu

SEQ ID NO: 2151374 - RNA, 13 nt, Homo sapiens
auccgaaacggca

SEQ ID NO: 2151375 - RNA, 15 nt, Homo sapiens
gcuuucaagcucauc

SEQ ID NO: 2151376 - RNA, 18 nt, Homo sapiens
ugaguagcucugccuuug

SEQ ID NO: 2151377 - RNA, 13 nt, Homo sapiens
ccugugguucuga

SEQ ID NO: 2151378 - RNA, 16 nt, Homo sapiens
ucaaaugaaacaggga

SEQ ID NO: 2151379 - RNA, 21 nt, Homo sapiens
uggaaguguauuuauuuuaca

SEQ ID NO: 2151380 - RNA, 12 nt, Homo sapiens
gaaaacaaugca

SEQ ID NO: 2151381 - RNA, 17 nt, Homo sapiens
uuuaacuggagcagaga

SEQ ID NO: 2151382 - RNA, 19 nt, Homo sapiens
gaugccuguguacugccuu

SEQ ID NO: 2151383 - RNA, 15 nt, Homo sapiens
acauuagccuaugug

SEQ ID NO: 2151384 - RNA, 15 nt, Homo sapiens
cuaaguacacaauaa

SEQ ID NO: 2151385 - RNA, 17 nt, Homo sapiens
caauaaacucagucaaa

SEQ ID NO: 2151386 - RNA, 18 nt, Homo sapiens
agucaccuauguggucca

SEQ ID NO: 2151387 - RNA, 14 nt, Homo sapiens
caggagggugcagu

SEQ ID NO: 2151388 - RNA, 15 nt, Homo sapiens
aggcugauaucuuca

SEQ ID NO: 2151389 - RNA, 16 nt, Homo sapiens
agcuuuggacccaagg

SEQ ID NO: 2151390 - RNA, 22 nt, Homo sapiens
cugggcagcauagcaagacaca

SEQ ID NO: 2151391 - RNA, 20 nt, Homo sapiens
cuugucucaaaaaccauuac

SEQ ID NO: 2151392 - RNA, 14 nt, Homo sapiens
aauugccagcaaau

SEQ ID NO: 2151393 - RNA, 21 nt, Homo sapiens
aauauguuucuaaaaauuggu

SEQ ID NO: 2151394 - RNA, 13 nt, Homo sapiens
uuccuggacacac

SEQ ID NO: 2151395 - RNA, 20 nt, Homo sapiens
accugcagggagcagcacgc

SEQ ID NO: 2151396 - RNA, 17 nt, Homo sapiens
uaaaaguauaacuuauu

SEQ ID NO: 2151397 - RNA, 19 nt, Homo sapiens
aucuuuggauguggcuuuu

SEQ ID NO: 2151398 - RNA, 17 nt, Homo sapiens
agguuuuacacuugcau

SEQ ID NO: 2151399 - RNA, 22 nt, Homo sapiens
guuuuaauccuuaacacauuca

SEQ ID NO: 2151400 - RNA, 13 nt, Homo sapiens
agauccugcauuu

SEQ ID NO: 2151401 - RNA, 13 nt, Homo sapiens
cauuccugagauu

SEQ ID NO: 2151402 - RNA, 14 nt, Homo sapiens
ugcaccuggaugua

SEQ ID NO: 2151403 - RNA, 20 nt, Homo sapiens
agcagcuuaaguccagcuca

SEQ ID NO: 2151404 - RNA, 14 nt, Homo sapiens
agcucccccugucc

SEQ ID NO: 2151405 - RNA, 14 nt, Homo sapiens
gcccagauggcacu

SEQ ID NO: 2151406 - RNA, 16 nt, Homo sapiens
cccuggggcugagucu

SEQ ID NO: 2151407 - RNA, 20 nt, Homo sapiens
auaaucaucaaguaauacaa

SEQ ID NO: 2151408 - RNA, 14 nt, Homo sapiens
gccucccaccagag

SEQ ID NO: 2151409 - RNA, 15 nt, Homo sapiens
caaacuauacuacaa

SEQ ID NO: 2151410 - RNA, 20 nt, Homo sapiens
ugacggucccacacugguga

SEQ ID NO: 2151411 - RNA, 16 nt, Homo sapiens
aaucguuuauuucaca

SEQ ID NO: 2151412 - RNA, 14 nt, Homo sapiens
uacugcaugcacuu

SEQ ID NO: 2151413 - RNA, 15 nt, Homo sapiens
aucagugcagugaua

SEQ ID NO: 2151414 - RNA, 15 nt, Homo sapiens
cagaaauacaguaug

SEQ ID NO: 2151415 - RNA, 16 nt, Homo sapiens
aggaaggaugccuuau

SEQ ID NO: 2151416 - RNA, 15 nt, Homo sapiens
cugacuuacugucag

SEQ ID NO: 2151417 - RNA, 21 nt, Homo sapiens
gauaauucgagcaaacaacuu

SEQ ID NO: 2151418 - RNA, 19 nt, Homo sapiens
gugcugggauuacaggcau

SEQ ID NO: 2151419 - RNA, 13 nt, Homo sapiens
gcagaaugaaaau

SEQ ID NO: 2151420 - RNA, 23 nt, Homo sapiens
aaguaggcaggaccaugggacca

SEQ ID NO: 2151421 - RNA, 14 nt, Homo sapiens
gaagccacaaagac

SEQ ID NO: 2151422 - RNA, 18 nt, Homo sapiens
uuccuauaacacugugaa

SEQ ID NO: 2151423 - RNA, 12 nt, Homo sapiens
aguuuuuggacu

SEQ ID NO: 2151424 - RNA, 14 nt, Homo sapiens
cuucaaguggcagg

SEQ ID NO: 2151425 - RNA, 13 nt, Homo sapiens
ucacuuugcuaca

SEQ ID NO: 2151426 - RNA, 13 nt, Homo sapiens
uuugacauccagc

SEQ ID NO: 2151427 - RNA, 23 nt, Homo sapiens
uggguauuguuaggaaaugucau

SEQ ID NO: 2151428 - RNA, 15 nt, Homo sapiens
cauucuucacugucu

SEQ ID NO: 2151429 - RNA, 12 nt, Homo sapiens
cuugacuauuac

SEQ ID NO: 2151430 - RNA, 13 nt, Homo sapiens
acauuaaugccug

SEQ ID NO: 2151431 - RNA, 22 nt, Homo sapiens
guaauaauguuauuauuacucu

SEQ ID NO: 2151432 - RNA, 17 nt, Homo sapiens
uggugacaugugccugu

SEQ ID NO: 2151433 - RNA, 15 nt, Homo sapiens
ucucuaaugcuugau

SEQ ID NO: 2151434 - RNA, 14 nt, Homo sapiens
aacccuaaaccucu

SEQ ID NO: 2151435 - RNA, 16 nt, Homo sapiens
ggucuugggagcucuu

SEQ ID NO: 2151436 - RNA, 15 nt, Homo sapiens
caggucagcaucucg

SEQ ID NO: 2151437 - RNA, 22 nt, Homo sapiens
gauuuaaagguugaguauguga

SEQ ID NO: 2151438 - RNA, 23 nt, Homo sapiens
caguucacuucuuugcagagccu

SEQ ID NO: 2151439 - RNA, 20 nt, Homo sapiens
uguagacugaauucagcacc

SEQ ID NO: 2151440 - RNA, 18 nt, Homo sapiens
agugcuaguucugaccca

SEQ ID NO: 2151441 - RNA, 22 nt, Homo sapiens
cuaguagcugggauuacaggcg

SEQ ID NO: 2151442 - RNA, 21 nt, Homo sapiens
ccucuggggaccccaaccuca

SEQ ID NO: 2151443 - RNA, 15 nt, Homo sapiens
gaaauguacuuucug

SEQ ID NO: 2151444 - RNA, 18 nt, Homo sapiens
ccuccuuacauaugcaaa

SEQ ID NO: 2151445 - RNA, 18 nt, Homo sapiens
ccuuuccugcgccccaga

SEQ ID NO: 2151446 - RNA, 16 nt, Homo sapiens
ugaugaaaauuuacaa

SEQ ID NO: 2151447 - RNA, 19 nt, Homo sapiens
ggaugauucaagccauucc

SEQ ID NO: 2151448 - RNA, 20 nt, Homo sapiens
acacuuccacccccagcucc

SEQ ID NO: 2151449 - RNA, 16 nt, Homo sapiens
gugcauuggcuaauaa

SEQ ID NO: 2151450 - RNA, 14 nt, Homo sapiens
gcacuuuaccagag

SEQ ID NO: 2151451 - RNA, 17 nt, Homo sapiens
gacuacuccaagggaau

SEQ ID NO: 2151452 - RNA, 23 nt, Homo sapiens
augucucacgucucccuaaaaau

SEQ ID NO: 2151453 - RNA, 13 nt, Homo sapiens
ugaaaugccaaag

SEQ ID NO: 2151454 - RNA, 18 nt, Homo sapiens
caacaucuaaaaaucaaa

SEQ ID NO: 2151455 - RNA, 23 nt, Homo sapiens
cuuggaggacccagcacugaccc

SEQ ID NO: 2151456 - RNA, 19 nt, Homo sapiens
uacauguuuuagacagaga

SEQ ID NO: 2151457 - RNA, 21 nt, Homo sapiens
acccaauucaggacuggcuca

SEQ ID NO: 2151458 - RNA, 23 nt, Homo sapiens
gcugugaccauuuauaauguuag

SEQ ID NO: 2151459 - RNA, 22 nt, Homo sapiens
gauuguugaaagccaugaggga

SEQ ID NO: 2151460 - RNA, 22 nt, Homo sapiens
uguguuuuaaaauaaggauuuu

SEQ ID NO: 2151461 - RNA, 13 nt, Homo sapiens
gcuuuacauauuc

SEQ ID NO: 2151462 - RNA, 21 nt, Homo sapiens
gucugauguucuuuccaugaa

SEQ ID NO: 2151463 - RNA, 20 nt, Homo sapiens
cccauaaaaugauccugcca

SEQ ID NO: 2151464 - RNA, 17 nt, Homo sapiens
ccuuuguucacugugag

SEQ ID NO: 2151465 - RNA, 16 nt, Homo sapiens
cuccauuucugcucag

SEQ ID NO: 2151466 - RNA, 20 nt, Homo sapiens
cagacucuacagaggccaug

SEQ ID NO: 2151467 - RNA, 14 nt, Homo sapiens
uaacaacuaugauu

SEQ ID NO: 2151468 - RNA, 20 nt, Homo sapiens
ccaacaaacccaacucuaau

SEQ ID NO: 2151469 - RNA, 16 nt, Homo sapiens
aguucuaaacuaucaa

SEQ ID NO: 2151470 - RNA, 22 nt, Homo sapiens
ucuacuugcuuauuacauuuaa

SEQ ID NO: 2151471 - RNA, 13 nt, Homo sapiens
agauaaugcaguc

SEQ ID NO: 2151472 - RNA, 13 nt, Homo sapiens
caugaagaccaca

SEQ ID NO: 2151473 - RNA, 20 nt, Homo sapiens
agagcaagacucugucucaa

SEQ ID NO: 2151474 - RNA, 20 nt, Homo sapiens
agagugagacuccaucucaa

SEQ ID NO: 2151475 - RNA, 14 nt, Homo sapiens
gaauucucuugcug

SEQ ID NO: 2151476 - RNA, 19 nt, Homo sapiens
cuccaaaauauuaacauuc

SEQ ID NO: 2151477 - RNA, 19 nt, Homo sapiens
uaacauaucuuuaucuuua

SEQ ID NO: 2151478 - RNA, 13 nt, Homo sapiens
uauaucaucagca

SEQ ID NO: 2151479 - RNA, 16 nt, Homo sapiens
uuccaccuucuacgca

SEQ ID NO: 2151480 - RNA, 17 nt, Homo sapiens
cuacaaaaaaccaggau

SEQ ID NO: 2151481 - RNA, 23 nt, Homo sapiens
uacauuccugagauucugggaaa

SEQ ID NO: 2151482 - RNA, 17 nt, Homo sapiens
aguauguugucauaaca

SEQ ID NO: 2151483 - RNA, 18 nt, Homo sapiens
uuaauaagcccacauaua

SEQ ID NO: 2151484 - RNA, 14 nt, Homo sapiens
caaaauauucugua

SEQ ID NO: 2151485 - RNA, 23 nt, Homo sapiens
aguaucaggucugaccccagugg

SEQ ID NO: 2151486 - RNA, 18 nt, Homo sapiens
agccugucaagaggcaaa

SEQ ID NO: 2151487 - RNA, 19 nt, Homo sapiens
aucucuugcacucaaagcu

SEQ ID NO: 2151488 - RNA, 13 nt, Homo sapiens
uaauauaauaaua

SEQ ID NO: 2151489 - RNA, 15 nt, Homo sapiens
uucuacauucucuau

SEQ ID NO: 2151490 - RNA, 21 nt, Homo sapiens
acaccuguggauaaaacauua

SEQ ID NO: 2151491 - RNA, 16 nt, Homo sapiens
augacaucaaaaugag

SEQ ID NO: 2151492 - RNA, 16 nt, Homo sapiens
auuaauggcauguaau

SEQ ID NO: 2151493 - RNA, 17 nt, Homo sapiens
agucuuguuuuuuauuc

SEQ ID NO: 2151494 - RNA, 14 nt, Homo sapiens
gacucacuugccca

SEQ ID NO: 2151495 - RNA, 18 nt, Homo sapiens
cuugaacucuuggccuca

SEQ ID NO: 2151496 - RNA, 22 nt, Homo sapiens
ccuaaagaccgggaaaagggaa

SEQ ID NO: 2151497 - RNA, 17 nt, Homo sapiens
ccaagacaguggcagca

SEQ ID NO: 2151498 - RNA, 21 nt, Homo sapiens
aggcagggguuccagcacaaa

SEQ ID NO: 2151499 - RNA, 17 nt, Homo sapiens
ucucauuugggcaccuu

SEQ ID NO: 2151500 - RNA, 21 nt, Homo sapiens
agcagcuuuaaacaaauucau

SEQ ID NO: 2151501 - RNA, 22 nt, Homo sapiens
uguaggucauugcaccuaucuc

SEQ ID NO: 2151502 - RNA, 15 nt, Homo sapiens
uuuuguaaacuguau

SEQ ID NO: 2151503 - RNA, 15 nt, Homo sapiens
ucacucacauugaga

SEQ ID NO: 2151504 - RNA, 18 nt, Homo sapiens
cacagucccauuccucca

SEQ ID NO: 2151505 - RNA, 13 nt, Homo sapiens
ugcuaugcuauug

SEQ ID NO: 2151506 - RNA, 14 nt, Homo sapiens
gcacaaagugauuu

SEQ ID NO: 2151507 - RNA, 18 nt, Homo sapiens
gauaucgugaaauccuca

SEQ ID NO: 2151508 - RNA, 22 nt, Homo sapiens
ugaauuaaaacagcugcgacaa

SEQ ID NO: 2151509 - RNA, 19 nt, Homo sapiens
gaacaaugggaggcuguga

SEQ ID NO: 2151510 - RNA, 17 nt, Homo sapiens
uuccauuuacagucucu

SEQ ID NO: 2151511 - RNA, 18 nt, Homo sapiens
ccugcugaagcugcugca

SEQ ID NO: 2151512 - RNA, 20 nt, Homo sapiens
cagaucccacuugcagccuc

SEQ ID NO: 2151513 - RNA, 22 nt, Homo sapiens
uuaagggcaugccuugugcugu

SEQ ID NO: 2151514 - RNA, 17 nt, Homo sapiens
aguaacaguuugauauu

SEQ ID NO: 2151515 - RNA, 19 nt, Homo sapiens
cccaacagcaccaauugua

SEQ ID NO: 2151516 - RNA, 17 nt, Homo sapiens
uacccccucauccccca

SEQ ID NO: 2151517 - RNA, 13 nt, Homo sapiens
gcacagaauuugu

SEQ ID NO: 2151518 - RNA, 15 nt, Homo sapiens
ucgggacuaacccag

SEQ ID NO: 2151519 - RNA, 13 nt, Homo sapiens
cugcuguguguga

SEQ ID NO: 2151520 - RNA, 21 nt, Homo sapiens
ucacagcaagccccuuagucc

SEQ ID NO: 2151521 - RNA, 16 nt, Homo sapiens
uuauaggucacuuugu

SEQ ID NO: 2151522 - RNA, 12 nt, Homo sapiens
ucccuggcuuga

SEQ ID NO: 2151523 - RNA, 15 nt, Homo sapiens
auuaaaaacugagug

SEQ ID NO: 2151524 - RNA, 20 nt, Homo sapiens
uguaaauuuuucagcuauuu

SEQ ID NO: 2151525 - RNA, 21 nt, Homo sapiens
ugcugguccccuccucaguga

SEQ ID NO: 2151526 - RNA, 21 nt, Homo sapiens
gaaauuaguaggcucauuuac

SEQ ID NO: 2151527 - RNA, 15 nt, Homo sapiens
uggcaccacugcacu

SEQ ID NO: 2151528 - RNA, 21 nt, Homo sapiens
agcuccccugggggcuagcag

SEQ ID NO: 2151529 - RNA, 22 nt, Homo sapiens
acuuucccagguugacuaagaa

SEQ ID NO: 2151530 - RNA, 23 nt, Homo sapiens
cugauggagacaguaacacuggc

SEQ ID NO: 2151531 - RNA, 17 nt, Homo sapiens
caccgcucuccugccua

SEQ ID NO: 2151532 - RNA, 18 nt, Homo sapiens
uugaccggcagaauguuc

SEQ ID NO: 2151533 - RNA, 18 nt, Homo sapiens
auuuuuaccagucucaca

SEQ ID NO: 2151534 - RNA, 20 nt, Homo sapiens
ccuguucccacucagcagug

SEQ ID NO: 2151535 - RNA, 15 nt, Homo sapiens
cucacucuuaugaaa

SEQ ID NO: 2151536 - RNA, 21 nt, Homo sapiens
guggcucaugccuuaauccca

SEQ ID NO: 2151537 - RNA, 17 nt, Homo sapiens
cagcgggacucuucuca

SEQ ID NO: 2151538 - RNA, 13 nt, Homo sapiens
uccaugugccuuu

SEQ ID NO: 2151539 - RNA, 21 nt, Homo sapiens
aaaugugaagauggacuucau

SEQ ID NO: 2151540 - RNA, 18 nt, Homo sapiens
uguuuaauuguacucaau

SEQ ID NO: 2151541 - RNA, 14 nt, Homo sapiens
cagagacacguggc

SEQ ID NO: 2151542 - RNA, 18 nt, Homo sapiens
uuuggaugucuguagcau

SEQ ID NO: 2151543 - RNA, 17 nt, Homo sapiens
uagaugauaaaagagaa

SEQ ID NO: 2151544 - RNA, 13 nt, Homo sapiens
ucccuuguguucc

SEQ ID NO: 2151545 - RNA, 16 nt, Homo sapiens
agaggaggggaaaguc

SEQ ID NO: 2151546 - RNA, 13 nt, Homo sapiens
agcguguucucag

SEQ ID NO: 2151547 - RNA, 18 nt, Homo sapiens
auuccaagaauagcaucu

SEQ ID NO: 2151548 - RNA, 20 nt, Homo sapiens
cagguagaacacaaggucau

SEQ ID NO: 2151549 - RNA, 15 nt, Homo sapiens
accuggccucugcca

SEQ ID NO: 2151550 - RNA, 22 nt, Homo sapiens
gaacgcucugcaccuucugacg

SEQ ID NO: 2151551 - RNA, 23 nt, Homo sapiens
acacacccauagugcacacuugu

SEQ ID NO: 2151552 - RNA, 20 nt, Homo sapiens
uucuuuagcuuaccugggca

SEQ ID NO: 2151553 - RNA, 23 nt, Homo sapiens
ucucauugucuguguagaguguu

SEQ ID NO: 2151554 - RNA, 15 nt, Homo sapiens
ugagcgaaaacagga

SEQ ID NO: 2151555 - RNA, 18 nt, Homo sapiens
agacugcaggguccccaa

SEQ ID NO: 2151556 - RNA, 23 nt, Homo sapiens
cugggaaauaagcaaaaaacugc

SEQ ID NO: 2151557 - RNA, 17 nt, Homo sapiens
caaauauuuugucacug

SEQ ID NO: 2151558 - RNA, 20 nt, Homo sapiens
ucuguuuccccucagaacac

SEQ ID NO: 2151559 - RNA, 16 nt, Homo sapiens
cagaagagacaugcag

SEQ ID NO: 2151560 - RNA, 19 nt, Homo sapiens
uucauuaguugaaagggau

SEQ ID NO: 2151561 - RNA, 19 nt, Homo sapiens
uugucagaguucugcucua

SEQ ID NO: 2151562 - RNA, 18 nt, Homo sapiens
ccuguguacagaccuccg

SEQ ID NO: 2151563 - RNA, 22 nt, Homo sapiens
ccaaugugacuaccgugccagc

SEQ ID NO: 2151564 - RNA, 15 nt, Homo sapiens
uagaaacuuuggaag

SEQ ID NO: 2151565 - RNA, 17 nt, Homo sapiens
caauuccugacacuuga

SEQ ID NO: 2151566 - RNA, 23 nt, Homo sapiens
aggguuaacccuucaucuuccug

SEQ ID NO: 2151567 - RNA, 18 nt, Homo sapiens
cugcucugaacacgaagc

SEQ ID NO: 2151568 - RNA, 20 nt, Homo sapiens
uacaggugugagccaccaca

SEQ ID NO: 2151569 - RNA, 16 nt, Homo sapiens
uggaguuaaacuuuag

SEQ ID NO: 2151570 - RNA, 13 nt, Homo sapiens
ccgccccagacac

SEQ ID NO: 2151571 - RNA, 20 nt, Homo sapiens
cuuaagaaauuuguggaaaa

SEQ ID NO: 2151572 - RNA, 13 nt, Homo sapiens
aacaaguacuucu

SEQ ID NO: 2151573 - RNA, 13 nt, Homo sapiens
acacggucagggu

SEQ ID NO: 2151574 - RNA, 17 nt, Homo sapiens
auuuagaacagucauua

SEQ ID NO: 2151575 - RNA, 13 nt, Homo sapiens
cugacuugaacuc

SEQ ID NO: 2151576 - RNA, 20 nt, Homo sapiens
cugagugccuggccaaaggg

SEQ ID NO: 2151577 - RNA, 16 nt, Homo sapiens
guaagggaagaggucc

SEQ ID NO: 2151578 - RNA, 13 nt, Homo sapiens
ucauuaacccauc

SEQ ID NO: 2151579 - RNA, 14 nt, Homo sapiens
ccaguauuaugcau

SEQ ID NO: 2151580 - RNA, 12 nt, Homo sapiens
uuaaaucuguga

SEQ ID NO: 2151581 - RNA, 15 nt, Homo sapiens
gugugaagacccaaa

SEQ ID NO: 2151582 - RNA, 23 nt, Homo sapiens
acuaucagggcaagcucauagca

SEQ ID NO: 2151583 - RNA, 15 nt, Homo sapiens
agcugccuguacaca

SEQ ID NO: 2151584 - RNA, 18 nt, Homo sapiens
cuucaaaugccugacuag

SEQ ID NO: 2151585 - RNA, 15 nt, Homo sapiens
gcucagcuucuccaa

SEQ ID NO: 2151586 - RNA, 18 nt, Homo sapiens
uuguggcuuuuaugcuuu

SEQ ID NO: 2151587 - RNA, 20 nt, Homo sapiens
ccacuuaaggaccuuuuuaa

SEQ ID NO: 2151588 - RNA, 17 nt, Homo sapiens
cuaaaaguuaauagggu

SEQ ID NO: 2151589 - RNA, 19 nt, Homo sapiens
ggggccuagggagccgcac

SEQ ID NO: 2151590 - RNA, 17 nt, Homo sapiens
accaggcccacagccca

SEQ ID NO: 2151591 - RNA, 19 nt, Homo sapiens
ccugaucaagguacaauuc

SEQ ID NO: 2151592 - RNA, 14 nt, Homo sapiens
gcagugcacaucug

SEQ ID NO: 2151593 - RNA, 20 nt, Homo sapiens
aauaucuuuuuuggaacuaa

SEQ ID NO: 2151594 - RNA, 21 nt, Homo sapiens
gguuaauggcagcauucagaa

SEQ ID NO: 2151595 - RNA, 20 nt, Homo sapiens
cucugaaccccucccuccau

SEQ ID NO: 2151596 - RNA, 21 nt, Homo sapiens
accagccaccccaaagcccuc

SEQ ID NO: 2151597 - RNA, 12 nt, Homo sapiens
aucaaaacagag

SEQ ID NO: 2151598 - RNA, 18 nt, Homo sapiens
acauuucucauaccuucc

SEQ ID NO: 2151599 - RNA, 18 nt, Homo sapiens
aaucagucuauccacaga

SEQ ID NO: 2151600 - RNA, 16 nt, Homo sapiens
gacaaacuucuuucac

SEQ ID NO: 2151601 - RNA, 24 nt, Homo sapiens
ccuggagcgccacacacugcacau

SEQ ID NO: 2151602 - RNA, 21 nt, Homo sapiens
caaauuauaaucucauuucaa

SEQ ID NO: 2151603 - RNA, 13 nt, Homo sapiens
gggauagaggaua

SEQ ID NO: 2151604 - RNA, 16 nt, Homo sapiens
ggccacgggucugugu

SEQ ID NO: 2151605 - RNA, 22 nt, Homo sapiens
ugguaaaccagaucugucucca

SEQ ID NO: 2151606 - RNA, 18 nt, Homo sapiens
uugaggaaacaacagcuu

SEQ ID NO: 2151607 - RNA, 20 nt, Homo sapiens
ccuccuacccuuccagugcc

SEQ ID NO: 2151608 - RNA, 22 nt, Homo sapiens
auucaccuagagucuagaacac

SEQ ID NO: 2151609 - RNA, 15 nt, Homo sapiens
ucucuguauugucua

SEQ ID NO: 2151610 - RNA, 13 nt, Homo sapiens
ccaccucucaggg

SEQ ID NO: 2151611 - RNA, 20 nt, Homo sapiens
gagcaggcuacugucagcuc

SEQ ID NO: 2151612 - RNA, 18 nt, Homo sapiens
auaaaauguucagugcaa

SEQ ID NO: 2151613 - RNA, 14 nt, Homo sapiens
ggccgccugagacc

SEQ ID NO: 2151614 - RNA, 14 nt, Homo sapiens
augcauggaaaaug

SEQ ID NO: 2151615 - RNA, 14 nt, Homo sapiens
cuuuuugcuuucuu

SEQ ID NO: 2151616 - RNA, 14 nt, Homo sapiens
cuuuaggcuuucag

SEQ ID NO: 2151617 - RNA, 15 nt, Homo sapiens
gguucagcugaagcu

SEQ ID NO: 2151618 - RNA, 15 nt, Homo sapiens
cggcuggagcugccu

SEQ ID NO: 2151619 - RNA, 18 nt, Homo sapiens
augaugcgggacugcugg

SEQ ID NO: 2151620 - RNA, 14 nt, Homo sapiens
ccugcacucccgac

SEQ ID NO: 2151621 - RNA, 19 nt, Homo sapiens
cuguugccuuugcucuuau

SEQ ID NO: 2151622 - RNA, 23 nt, Homo sapiens
uuacucuauacauucaacagaga

SEQ ID NO: 2151623 - RNA, 22 nt, Homo sapiens
auuuggggaccacagaggcugu

SEQ ID NO: 2151624 - RNA, 19 nt, Homo sapiens
uggagugccaaguuugcaa

SEQ ID NO: 2151625 - RNA, 21 nt, Homo sapiens
ugauguggagaaaggacuaac

SEQ ID NO: 2151626 - RNA, 22 nt, Homo sapiens
gucacccagguuggagugcagu

SEQ ID NO: 2151627 - RNA, 15 nt, Homo sapiens
gggcagagaggcugu

SEQ ID NO: 2151628 - RNA, 15 nt, Homo sapiens
gaauuuagaaauauu

SEQ ID NO: 2151629 - RNA, 13 nt, Homo sapiens
auggaaugcuucu

SEQ ID NO: 2151630 - RNA, 13 nt, Homo sapiens
uccucaaccuuga

SEQ ID NO: 2151631 - RNA, 20 nt, Homo sapiens
gcccuucuaccuuccugcaa

SEQ ID NO: 2151632 - RNA, 18 nt, Homo sapiens
ucaaaaacacucucacua

SEQ ID NO: 2151633 - RNA, 13 nt, Homo sapiens
cagagacagagag

SEQ ID NO: 2151634 - RNA, 17 nt, Homo sapiens
ccuagagcuagaugugu

SEQ ID NO: 2151635 - RNA, 20 nt, Homo sapiens
gaugaaauuuucuagacuuu

SEQ ID NO: 2151636 - RNA, 14 nt, Homo sapiens
aacauaugauuuca

SEQ ID NO: 2151637 - RNA, 14 nt, Homo sapiens
uguuacuugcacuu

SEQ ID NO: 2151638 - RNA, 21 nt, Homo sapiens
gccaucaaggaguauauggac

SEQ ID NO: 2151639 - RNA, 20 nt, Homo sapiens
ucccauaauugcuuugccaa

SEQ ID NO: 2151640 - RNA, 14 nt, Homo sapiens
agcuuucagauuau

SEQ ID NO: 2151641 - RNA, 15 nt, Homo sapiens
aaguacuacaaggaa

SEQ ID NO: 2151642 - RNA, 19 nt, Homo sapiens
gaaugguuaaaauguaggc

SEQ ID NO: 2151643 - RNA, 15 nt, Homo sapiens
aguuuuacagcaagg

SEQ ID NO: 2151644 - RNA, 15 nt, Homo sapiens
ucucugaauacacag

SEQ ID NO: 2151645 - RNA, 15 nt, Homo sapiens
ugacuccuaugaucu

SEQ ID NO: 2151646 - RNA, 19 nt, Homo sapiens
cacagcacccaggcuccau

SEQ ID NO: 2151647 - RNA, 20 nt, Homo sapiens
gaggcccaaccuccuauaua

SEQ ID NO: 2151648 - RNA, 22 nt, Homo sapiens
gcuugcuggugccucuuuucag

SEQ ID NO: 2151649 - RNA, 17 nt, Homo sapiens
uuuaagguuucaacaaa

SEQ ID NO: 2151650 - RNA, 13 nt, Homo sapiens
acccacuaggaua

SEQ ID NO: 2151651 - RNA, 15 nt, Homo sapiens
aaagccaaguguccu

SEQ ID NO: 2151652 - RNA, 15 nt, Homo sapiens
aaagaaaaguguaau

SEQ ID NO: 2151653 - RNA, 17 nt, Homo sapiens
cugcucaaggaccaaga

SEQ ID NO: 2151654 - RNA, 17 nt, Homo sapiens
uaaaacgauuacugacu

SEQ ID NO: 2151655 - RNA, 22 nt, Homo sapiens
aagcaugaucuuguuacuguga

SEQ ID NO: 2151656 - RNA, 16 nt, Homo sapiens
auguuugcacuuguga

SEQ ID NO: 2151657 - RNA, 16 nt, Homo sapiens
ucuuaucccagugauc

SEQ ID NO: 2151658 - RNA, 15 nt, Homo sapiens
uuuuuccuccuuguc

SEQ ID NO: 2151659 - RNA, 18 nt, Homo sapiens
uugaaaaacaacugcaua

SEQ ID NO: 2151660 - RNA, 23 nt, Homo sapiens
caagaaauucaugauugcccaau

SEQ ID NO: 2151661 - RNA, 15 nt, Homo sapiens
agacuuacuaauaaa

SEQ ID NO: 2151662 - RNA, 16 nt, Homo sapiens
ccucugccuugcacaa

SEQ ID NO: 2151663 - RNA, 23 nt, Homo sapiens
cacacaaccaugacgcacugcuc

SEQ ID NO: 2151664 - RNA, 21 nt, Homo sapiens
agugaacauauccaucauccc

SEQ ID NO: 2151665 - RNA, 22 nt, Homo sapiens
gcugcuguggggaccacacuga

SEQ ID NO: 2151666 - RNA, 20 nt, Homo sapiens
uccucggcccuguagcccug

SEQ ID NO: 2151667 - RNA, 17 nt, Homo sapiens
aacucauuugaaugcuu

SEQ ID NO: 2151668 - RNA, 13 nt, Homo sapiens
gaaaacuauacaa

SEQ ID NO: 2151669 - RNA, 15 nt, Homo sapiens
uggccaaggugucca

SEQ ID NO: 2151670 - RNA, 13 nt, Homo sapiens
aacuggagcagag

SEQ ID NO: 2151671 - RNA, 20 nt, Homo sapiens
acuugauaugugcaccaaua

SEQ ID NO: 2151672 - RNA, 15 nt, Homo sapiens
uuucuggcucuccca

SEQ ID NO: 2151673 - RNA, 23 nt, Homo sapiens
gaaugagugaaucaccuguggua

SEQ ID NO: 2151674 - RNA, 17 nt, Homo sapiens
agcaucucccagcaaga

SEQ ID NO: 2151675 - RNA, 13 nt, Homo sapiens
ccuuauugaucuu

SEQ ID NO: 2151676 - RNA, 18 nt, Homo sapiens
aaaaccacagucagugga

SEQ ID NO: 2151677 - RNA, 15 nt, Homo sapiens
uaaccacaucaauau

SEQ ID NO: 2151678 - RNA, 22 nt, Homo sapiens
caauuaagagagugaacauauc

SEQ ID NO: 2151679 - RNA, 16 nt, Homo sapiens
caucuuuccuguucca

SEQ ID NO: 2151680 - RNA, 13 nt, Homo sapiens
ccuugaaccaaua

SEQ ID NO: 2151681 - RNA, 20 nt, Homo sapiens
aucuaaaacauguagaaaaa

SEQ ID NO: 2151682 - RNA, 18 nt, Homo sapiens
acccacucuccugugaga

SEQ ID NO: 2151683 - RNA, 19 nt, Homo sapiens
accggagaaccccaggacg

SEQ ID NO: 2151684 - RNA, 15 nt, Homo sapiens
ucucacugccaugga

SEQ ID NO: 2151685 - RNA, 20 nt, Homo sapiens
gaauuguacaagagucccuu

SEQ ID NO: 2151686 - RNA, 16 nt, Homo sapiens
caaggacauugcccca

SEQ ID NO: 2151687 - RNA, 22 nt, Homo sapiens
cuuacaaagaaagcacuucuua

SEQ ID NO: 2151688 - RNA, 12 nt, Homo sapiens
gcugcacugcau

SEQ ID NO: 2151689 - RNA, 12 nt, Homo sapiens
ucugcacuucau

SEQ ID NO: 2151690 - RNA, 17 nt, Homo sapiens
gaggugguagaaccacu

SEQ ID NO: 2151691 - RNA, 20 nt, Homo sapiens
aagguuugagaagcacuguu

SEQ ID NO: 2151692 - RNA, 14 nt, Homo sapiens
acgguuaugaaggc

SEQ ID NO: 2151693 - RNA, 19 nt, Homo sapiens
gcucaguaaccaugcaaaa

SEQ ID NO: 2151694 - RNA, 12 nt, Homo sapiens
uaaucauaacau

SEQ ID NO: 2151695 - RNA, 23 nt, Homo sapiens
ccacugauggaaacaaaguggaa

SEQ ID NO: 2151696 - RNA, 11 nt, Homo sapiens
acagcaucucc

SEQ ID NO: 2151697 - RNA, 23 nt, Homo sapiens
gccaggugcaaucuacuggaaau

SEQ ID NO: 2151698 - RNA, 22 nt, Homo sapiens
ucauaugguugacaguaugcau

SEQ ID NO: 2151699 - RNA, 16 nt, Homo sapiens
ucuagacagauuggaa

SEQ ID NO: 2151700 - RNA, 17 nt, Homo sapiens
caaaauuaaguugucuu

SEQ ID NO: 2151701 - RNA, 21 nt, Homo sapiens
cugagauccugcacaaggugg

SEQ ID NO: 2151702 - RNA, 15 nt, Homo sapiens
auuagaaaccaugaa

SEQ ID NO: 2151703 - RNA, 23 nt, Homo sapiens
uaagaaauguuuuccuugccaaa

SEQ ID NO: 2151704 - RNA, 13 nt, Homo sapiens
ugaggaaaaagcg

SEQ ID NO: 2151705 - RNA, 19 nt, Homo sapiens
cuacugccucggaucucuc

SEQ ID NO: 2151706 - RNA, 19 nt, Homo sapiens
acaaagaugccacauucaa

SEQ ID NO: 2151707 - RNA, 19 nt, Homo sapiens
aauucuguggcugccauca

SEQ ID NO: 2151708 - RNA, 15 nt, Homo sapiens
ugagugccacaaaag

SEQ ID NO: 2151709 - RNA, 19 nt, Homo sapiens
aauuuaaaauuaaaugcau

SEQ ID NO: 2151710 - RNA, 22 nt, Homo sapiens
cuccagguuccugaaauaucca

SEQ ID NO: 2151711 - RNA, 20 nt, Homo sapiens
uucacaaccucaccaaacua

SEQ ID NO: 2151712 - RNA, 19 nt, Homo sapiens
aaugaggaaacugcacugu

SEQ ID NO: 2151713 - RNA, 21 nt, Homo sapiens
caaugauuauuuucauuacaa

SEQ ID NO: 2151714 - RNA, 20 nt, Homo sapiens
auaguuauauuugcugauac

SEQ ID NO: 2151715 - RNA, 22 nt, Homo sapiens
acauauaaaauguaauuacuua

SEQ ID NO: 2151716 - RNA, 16 nt, Homo sapiens
ucuuauuuugcauucc

SEQ ID NO: 2151717 - RNA, 15 nt, Homo sapiens
aguuauuuaugcuau

SEQ ID NO: 2151718 - RNA, 16 nt, Homo sapiens
aggacaggaggagcuu

SEQ ID NO: 2151719 - RNA, 15 nt, Homo sapiens
uccuucuccauaaag

SEQ ID NO: 2151720 - RNA, 17 nt, Homo sapiens
ggagggagguaacgggu

SEQ ID NO: 2151721 - RNA, 21 nt, Homo sapiens
uucaagcaauccuccuaccuc

SEQ ID NO: 2151722 - RNA, 19 nt, Homo sapiens
agcuggccuucugcuucug

SEQ ID NO: 2151723 - RNA, 16 nt, Homo sapiens
ucccagauccaggaac

SEQ ID NO: 2151724 - RNA, 20 nt, Homo sapiens
uggaaaaauucauugucucu

SEQ ID NO: 2151725 - RNA, 19 nt, Homo sapiens
cccagauuugaagacaaaa

SEQ ID NO: 2151726 - RNA, 21 nt, Homo sapiens
cuggaugucugggugaccuca

SEQ ID NO: 2151727 - RNA, 18 nt, Homo sapiens
cuucaugugacacagggg

SEQ ID NO: 2151728 - RNA, 18 nt, Homo sapiens
acuagcaccugccaggga

SEQ ID NO: 2151729 - RNA, 18 nt, Homo sapiens
aaugauuuuacuuagcaa

SEQ ID NO: 2151730 - RNA, 19 nt, Homo sapiens
cucuauucuuuccaugaca

SEQ ID NO: 2151731 - RNA, 21 nt, Homo sapiens
ugauggaguuccuucuggugu

SEQ ID NO: 2151732 - RNA, 22 nt, Homo sapiens
acaaaacaaaauguuaugauaa

SEQ ID NO: 2151733 - RNA, 20 nt, Homo sapiens
accuugcacuauuggacuuu

SEQ ID NO: 2151734 - RNA, 21 nt, Homo sapiens
ugucauuuucuguuauacaca

SEQ ID NO: 2151735 - RNA, 20 nt, Homo sapiens
uuucagugggaaauaugcca

SEQ ID NO: 2151736 - RNA, 12 nt, Homo sapiens
aaaugugucaaa

SEQ ID NO: 2151737 - RNA, 16 nt, Homo sapiens
uuguugcugcugcugc

SEQ ID NO: 2151738 - RNA, 15 nt, Homo sapiens
gcggagaguacagug

SEQ ID NO: 2151739 - RNA, 14 nt, Homo sapiens
uuuggcaaugcuaa

SEQ ID NO: 2151740 - RNA, 16 nt, Homo sapiens
uacgaagacaaagucc

SEQ ID NO: 2151741 - RNA, 21 nt, Homo sapiens
cugcaggacagucaaggugau

SEQ ID NO: 2151742 - RNA, 13 nt, Homo sapiens
cucuagcuguucu

SEQ ID NO: 2151743 - RNA, 20 nt, Homo sapiens
acccagacuggagugcagug

SEQ ID NO: 2151744 - RNA, 20 nt, Homo sapiens
ucauaucaucacauugagcu

SEQ ID NO: 2151745 - RNA, 21 nt, Homo sapiens
ugagacuuucuucuagugcuu

SEQ ID NO: 2151746 - RNA, 16 nt, Homo sapiens
auuauuugcuuaugaa

SEQ ID NO: 2151747 - RNA, 14 nt, Homo sapiens
aaagaucuucugua

SEQ ID NO: 2151748 - RNA, 20 nt, Homo sapiens
ucaugcccgccagugcacag

SEQ ID NO: 2151749 - RNA, 20 nt, Homo sapiens
gauguuuugucccauuuccu

SEQ ID NO: 2151750 - RNA, 21 nt, Homo sapiens
uaaaccacuugucacuacaaa

SEQ ID NO: 2151751 - RNA, 20 nt, Homo sapiens
aguuucucagcucccauuuc

SEQ ID NO: 2151752 - RNA, 15 nt, Homo sapiens
caaguagcacacuga

SEQ ID NO: 2151753 - RNA, 14 nt, Homo sapiens
uugcuccuauccca

SEQ ID NO: 2151754 - RNA, 18 nt, Homo sapiens
aaagacuuguuaaaugua

SEQ ID NO: 2151755 - RNA, 18 nt, Homo sapiens
gcugacccagugugugcu

SEQ ID NO: 2151756 - RNA, 16 nt, Homo sapiens
cuccaggagcugcaag

SEQ ID NO: 2151757 - RNA, 16 nt, Homo sapiens
cauacaguuugcacuu

SEQ ID NO: 2151758 - RNA, 20 nt, Homo sapiens
uggagugcaguggugccauc

SEQ ID NO: 2151759 - RNA, 14 nt, Homo sapiens
gaaaaucacuugaa

SEQ ID NO: 2151760 - RNA, 23 nt, Homo sapiens
augucuccuuugcucuugccaaa

SEQ ID NO: 2151761 - RNA, 16 nt, Homo sapiens
aauacaaaaaugagcu

SEQ ID NO: 2151762 - RNA, 20 nt, Homo sapiens
aauauccaagcccagccuau

SEQ ID NO: 2151763 - RNA, 19 nt, Homo sapiens
augauggcaccacugcacu

SEQ ID NO: 2151764 - RNA, 16 nt, Homo sapiens
uccagcgguucucaaa

SEQ ID NO: 2151765 - RNA, 16 nt, Homo sapiens
cucugcagcccacaga

SEQ ID NO: 2151766 - RNA, 17 nt, Homo sapiens
gaucacuaaaguauauc

SEQ ID NO: 2151767 - RNA, 14 nt, Homo sapiens
aagcugcugucacu

SEQ ID NO: 2151768 - RNA, 21 nt, Homo sapiens
cucaguaaacgggaacaugcc

SEQ ID NO: 2151769 - RNA, 20 nt, Homo sapiens
uuuugggggucagcauccag

SEQ ID NO: 2151770 - RNA, 17 nt, Homo sapiens
uuucuuuuccuucauuc

SEQ ID NO: 2151771 - RNA, 17 nt, Homo sapiens
aggaugaaagacaaaga

SEQ ID NO: 2151772 - RNA, 21 nt, Homo sapiens
caaaggaaagagaaaccugag

SEQ ID NO: 2151773 - RNA, 20 nt, Homo sapiens
ccaugguguauaugugccac

SEQ ID NO: 2151774 - RNA, 21 nt, Homo sapiens
acaaguuucccaaauucccug

SEQ ID NO: 2151775 - RNA, 16 nt, Homo sapiens
cuaauagcauugucau

SEQ ID NO: 2151776 - RNA, 17 nt, Homo sapiens
agccccuccucccucag

SEQ ID NO: 2151777 - RNA, 16 nt, Homo sapiens
cauucauaguaagaau

SEQ ID NO: 2151778 - RNA, 16 nt, Homo sapiens
guaaguuucauucuaa

SEQ ID NO: 2151779 - RNA, 22 nt, Homo sapiens
aacgucugguccuaaccaguga

SEQ ID NO: 2151780 - RNA, 22 nt, Homo sapiens
uuaaacuacucuugaauuccug

SEQ ID NO: 2151781 - RNA, 16 nt, Homo sapiens
acugaauuuugggacu

SEQ ID NO: 2151782 - RNA, 16 nt, Homo sapiens
uuggauagacuucugc

SEQ ID NO: 2151783 - RNA, 14 nt, Homo sapiens
ccaccccuaccucu

SEQ ID NO: 2151784 - RNA, 13 nt, Homo sapiens
cuccaccagugug

SEQ ID NO: 2151785 - RNA, 21 nt, Homo sapiens
gaaaauucagcggcagugugu

SEQ ID NO: 2151786 - RNA, 16 nt, Homo sapiens
caucuacgaagccaca

SEQ ID NO: 2151787 - RNA, 21 nt, Homo sapiens
gacgggcacagugguggugcc

SEQ ID NO: 2151788 - RNA, 19 nt, Homo sapiens
ugugucucugcauguguaa

SEQ ID NO: 2151789 - RNA, 19 nt, Homo sapiens
guacuacagcuauauuuga

SEQ ID NO: 2151790 - RNA, 14 nt, Homo sapiens
ccugcuccaucuca

SEQ ID NO: 2151791 - RNA, 21 nt, Homo sapiens
auguacuuuuucuuccagaaa

SEQ ID NO: 2151792 - RNA, 17 nt, Homo sapiens
guuauuauaaacagaaa

SEQ ID NO: 2151793 - RNA, 22 nt, Homo sapiens
accuccgcgggcugacugggcc

SEQ ID NO: 2151794 - RNA, 22 nt, Homo sapiens
aguauucauucugcauugcuag

SEQ ID NO: 2151795 - RNA, 15 nt, Homo sapiens
uauauugcugcuggu

SEQ ID NO: 2151796 - RNA, 22 nt, Homo sapiens
aagccucuggcuaccucugucc

SEQ ID NO: 2151797 - RNA, 20 nt, Homo sapiens
uucgagaccagucuggccaa

SEQ ID NO: 2151798 - RNA, 13 nt, Homo sapiens
cuuucuaugcugu

SEQ ID NO: 2151799 - RNA, 21 nt, Homo sapiens
gucccaaaacccuuacaguga

SEQ ID NO: 2151800 - RNA, 15 nt, Homo sapiens
caugagggacuccuc

SEQ ID NO: 2151801 - RNA, 21 nt, Homo sapiens
uucgaauccagagagcagugu

SEQ ID NO: 2151802 - RNA, 16 nt, Homo sapiens
ucugggagcucaaggc

SEQ ID NO: 2151803 - RNA, 18 nt, Homo sapiens
aaacuuucuguaguaaaa

SEQ ID NO: 2151804 - RNA, 18 nt, Homo sapiens
ugaaauguauaauuaacu

SEQ ID NO: 2151805 - RNA, 12 nt, Homo sapiens
uugccgcuguau

SEQ ID NO: 2151806 - RNA, 13 nt, Homo sapiens
agccagaacuuga

SEQ ID NO: 2151807 - RNA, 22 nt, Homo sapiens
uugcauggagugaccauagcuc

SEQ ID NO: 2151808 - RNA, 23 nt, Homo sapiens
uauaaaccgaucuucgugauacu

SEQ ID NO: 2151809 - RNA, 17 nt, Homo sapiens
aauauuuuuauauuucc

SEQ ID NO: 2151810 - RNA, 16 nt, Homo sapiens
auuaacucuccaguua

SEQ ID NO: 2151811 - RNA, 16 nt, Homo sapiens
guguaauggaaaccaa

SEQ ID NO: 2151812 - RNA, 12 nt, Homo sapiens
ucacaugaugaa

SEQ ID NO: 2151813 - RNA, 12 nt, Homo sapiens
cucugucagcca

SEQ ID NO: 2151814 - RNA, 12 nt, Homo sapiens
cuggggacccag

SEQ ID NO: 2151815 - RNA, 16 nt, Homo sapiens
agaugaauaaacugaa

SEQ ID NO: 2151816 - RNA, 19 nt, Homo sapiens
caaugcuguggguuuccaa

SEQ ID NO: 2151817 - RNA, 22 nt, Homo sapiens
cuuaaacucagcuacugcaaau

SEQ ID NO: 2151818 - RNA, 19 nt, Homo sapiens
gaucagcaaaccggggccu

SEQ ID NO: 2151819 - RNA, 22 nt, Homo sapiens
ucuuauuuaauuuuugcaauua

SEQ ID NO: 2151820 - RNA, 20 nt, Homo sapiens
uaacaugucuuucagcauua

SEQ ID NO: 2151821 - RNA, 16 nt, Homo sapiens
cccugaauggucucag

SEQ ID NO: 2151822 - RNA, 19 nt, Homo sapiens
acagucuggagaagguauu

SEQ ID NO: 2151823 - RNA, 21 nt, Homo sapiens
auguuacggcaucacacuuau

SEQ ID NO: 2151824 - RNA, 12 nt, Homo sapiens
aaagaacuguau

SEQ ID NO: 2151825 - RNA, 22 nt, Homo sapiens
ccugugccaaccugaugccccu

SEQ ID NO: 2151826 - RNA, 15 nt, Homo sapiens
uccuuacuguuuaca

SEQ ID NO: 2151827 - RNA, 22 nt, Homo sapiens
cccagccaagaaagcuaucucu

SEQ ID NO: 2151828 - RNA, 22 nt, Homo sapiens
uagaagcuucagcaggaggcaa

SEQ ID NO: 2151829 - RNA, 19 nt, Homo sapiens
agacuaugcaaaaguacaa

SEQ ID NO: 2151830 - RNA, 16 nt, Homo sapiens
acuccuaccugaaggc

SEQ ID NO: 2151831 - RNA, 17 nt, Homo sapiens
ccacccuaauuugcccu

SEQ ID NO: 2151832 - RNA, 19 nt, Homo sapiens
uguccuuaauugaugcaaa

SEQ ID NO: 2151833 - RNA, 16 nt, Homo sapiens
uaaaaaacacagucac

SEQ ID NO: 2151834 - RNA, 16 nt, Homo sapiens
cagagucuguuucagg

SEQ ID NO: 2151835 - RNA, 22 nt, Homo sapiens
ugcuuuaaugucuaaccaagaa

SEQ ID NO: 2151836 - RNA, 16 nt, Homo sapiens
cagcgaacaugccuga

SEQ ID NO: 2151837 - RNA, 19 nt, Homo sapiens
cacugccgucccaaauaca

SEQ ID NO: 2151838 - RNA, 12 nt, Homo sapiens
auacaccauaug

SEQ ID NO: 2151839 - RNA, 16 nt, Homo sapiens
cuugaagaagaaggag

SEQ ID NO: 2151840 - RNA, 13 nt, Homo sapiens
caguuaaacugug

SEQ ID NO: 2151841 - RNA, 14 nt, Homo sapiens
cgccaaacauuccu

SEQ ID NO: 2151842 - RNA, 13 nt, Homo sapiens
gacagaacuggug

SEQ ID NO: 2151843 - RNA, 14 nt, Homo sapiens
cucagaugccacuu

SEQ ID NO: 2151844 - RNA, 14 nt, Homo sapiens
gaaauucacaaagu

SEQ ID NO: 2151845 - RNA, 16 nt, Homo sapiens
aacacuuaacagggaa

SEQ ID NO: 2151846 - RNA, 14 nt, Homo sapiens
cuucugaagaucuc

SEQ ID NO: 2151847 - RNA, 17 nt, Homo sapiens
gaaaaucuauuccugcc

SEQ ID NO: 2151848 - RNA, 13 nt, Homo sapiens
gcgaauaacaguc

SEQ ID NO: 2151849 - RNA, 15 nt, Homo sapiens
uuaauucucugcaac

SEQ ID NO: 2151850 - RNA, 15 nt, Homo sapiens
cauuugagcucauga

SEQ ID NO: 2151851 - RNA, 18 nt, Homo sapiens
ccacguccugucagugcc

SEQ ID NO: 2151852 - RNA, 20 nt, Homo sapiens
ugacuuuauuucugagcaaa

SEQ ID NO: 2151853 - RNA, 19 nt, Homo sapiens
auccacuggacacugugaa

SEQ ID NO: 2151854 - RNA, 15 nt, Homo sapiens
ugagggaaaaugagu

SEQ ID NO: 2151855 - RNA, 18 nt, Homo sapiens
caaggaaauguccugcau

SEQ ID NO: 2151856 - RNA, 22 nt, Homo sapiens
aauuaaauucuuauuggccaaa

SEQ ID NO: 2151857 - RNA, 14 nt, Homo sapiens
uccuaguacuuaga

SEQ ID NO: 2151858 - RNA, 18 nt, Homo sapiens
uguguacauguaguugaa

SEQ ID NO: 2151859 - RNA, 23 nt, Homo sapiens
aggcugucacccuccaccgagcc

SEQ ID NO: 2151860 - RNA, 21 nt, Homo sapiens
gaaggggccugggcugugagg

SEQ ID NO: 2151861 - RNA, 15 nt, Homo sapiens
ucuucccguguguau

SEQ ID NO: 2151862 - RNA, 18 nt, Homo sapiens
gcaauuccucugaacaaa

SEQ ID NO: 2151863 - RNA, 15 nt, Homo sapiens
auacagagcucucug

SEQ ID NO: 2151864 - RNA, 23 nt, Homo sapiens
uccugcugcucgggaaggccuga

SEQ ID NO: 2151865 - RNA, 17 nt, Homo sapiens
gacaauaguauuucucc

SEQ ID NO: 2151866 - RNA, 13 nt, Homo sapiens
agacagggcucca

SEQ ID NO: 2151867 - RNA, 12 nt, Homo sapiens
uggaaaccuguc

SEQ ID NO: 2151868 - RNA, 15 nt, Homo sapiens
ccugauuauuuucua

SEQ ID NO: 2151869 - RNA, 19 nt, Homo sapiens
uucaugcaggugaaaccca

SEQ ID NO: 2151870 - RNA, 20 nt, Homo sapiens
uugugguaaacaaagacaug

SEQ ID NO: 2151871 - RNA, 14 nt, Homo sapiens
acuuacaacccagg

SEQ ID NO: 2151872 - RNA, 12 nt, Homo sapiens
auggaccacuga

SEQ ID NO: 2151873 - RNA, 21 nt, Homo sapiens
ugcugacauggaccuacugca

SEQ ID NO: 2151874 - RNA, 19 nt, Homo sapiens
auuugagaauaaguucaua

SEQ ID NO: 2151875 - RNA, 23 nt, Homo sapiens
ucuagaaggaugaacaguucucc

SEQ ID NO: 2151876 - RNA, 17 nt, Homo sapiens
uugagucuaacacacca

SEQ ID NO: 2151877 - RNA, 23 nt, Homo sapiens
cuggccaggauaauauauuugca

SEQ ID NO: 2151878 - RNA, 15 nt, Homo sapiens
caauucuguauagau

SEQ ID NO: 2151879 - RNA, 19 nt, Homo sapiens
gaacucggccccuccucaa

SEQ ID NO: 2151880 - RNA, 23 nt, Homo sapiens
augauaacguuagagaaacugaa

SEQ ID NO: 2151881 - RNA, 15 nt, Homo sapiens
cuggaccagguccug

SEQ ID NO: 2151882 - RNA, 19 nt, Homo sapiens
cacuuguucauucugugac

SEQ ID NO: 2151883 - RNA, 21 nt, Homo sapiens
aaacgaggcaaugacugugag

SEQ ID NO: 2151884 - RNA, 21 nt, Homo sapiens
uuugaggcaaaggccagcagc

SEQ ID NO: 2151885 - RNA, 18 nt, Homo sapiens
acacaucuuccacagguc

SEQ ID NO: 2151886 - RNA, 14 nt, Homo sapiens
cuuaaaaauaugcu

SEQ ID NO: 2151887 - RNA, 22 nt, Homo sapiens
uguuguaacauuucacaguauu

SEQ ID NO: 2151888 - RNA, 21 nt, Homo sapiens
ugggggugccgcugucucuga

SEQ ID NO: 2151889 - RNA, 11 nt, Homo sapiens
caucaaugaug

SEQ ID NO: 2151890 - RNA, 16 nt, Homo sapiens
guugguguauuugcca

SEQ ID NO: 2151891 - RNA, 12 nt, Homo sapiens
ccaaaagcacag

SEQ ID NO: 2151892 - RNA, 19 nt, Homo sapiens
cucagccauaggugcaguu

SEQ ID NO: 2151893 - RNA, 18 nt, Homo sapiens
cucaagauuugaccaaau

SEQ ID NO: 2151894 - RNA, 20 nt, Homo sapiens
uucacagcccagaaccacag

SEQ ID NO: 2151895 - RNA, 14 nt, Homo sapiens
cacaaguauuacac

SEQ ID NO: 2151896 - RNA, 12 nt, Homo sapiens
cuguuucaugag

SEQ ID NO: 2151897 - RNA, 13 nt, Homo sapiens
cuuagaccucagc

SEQ ID NO: 2151898 - RNA, 17 nt, Homo sapiens
gagaaauccuuccuaaa

SEQ ID NO: 2151899 - RNA, 13 nt, Homo sapiens
uaaauguguauuc

SEQ ID NO: 2151900 - RNA, 19 nt, Homo sapiens
uggcggggcgcagugcugu

SEQ ID NO: 2151901 - RNA, 19 nt, Homo sapiens
uuaaaggggguaugugaua

SEQ ID NO: 2151902 - RNA, 17 nt, Homo sapiens
auucaucagucauuauu

SEQ ID NO: 2151903 - RNA, 12 nt, Homo sapiens
gccuggcacuua

SEQ ID NO: 2151904 - RNA, 14 nt, Homo sapiens
uacacaauaagcaa

SEQ ID NO: 2151905 - RNA, 17 nt, Homo sapiens
auuuaguucaacuguau

SEQ ID NO: 2151906 - RNA, 21 nt, Homo sapiens
gauuaugaaauuucauggaug

SEQ ID NO: 2151907 - RNA, 23 nt, Homo sapiens
cuguaaguaacuucacauuaaaa

SEQ ID NO: 2151908 - RNA, 19 nt, Homo sapiens
uaaaagugcuuugcauuga

SEQ ID NO: 2151909 - RNA, 15 nt, Homo sapiens
gcuccccuguucaaa

SEQ ID NO: 2151910 - RNA, 23 nt, Homo sapiens
accugaaaaaguuuuguggauua

SEQ ID NO: 2151911 - RNA, 19 nt, Homo sapiens
caugaaaccaaaaagagac

SEQ ID NO: 2151912 - RNA, 21 nt, Homo sapiens
ugcuggggagacaaaucucag

SEQ ID NO: 2151913 - RNA, 18 nt, Homo sapiens
cacgugugcagacugugg

SEQ ID NO: 2151914 - RNA, 14 nt, Homo sapiens
ccaaagaaccaaag

SEQ ID NO: 2151915 - RNA, 14 nt, Homo sapiens
cuucccaacuuccc

SEQ ID NO: 2151916 - RNA, 20 nt, Homo sapiens
uauuugagacuguccugugc

SEQ ID NO: 2151917 - RNA, 20 nt, Homo sapiens
auuuucacuuuuggcuugua

SEQ ID NO: 2151918 - RNA, 16 nt, Homo sapiens
gcacauggacagacuu

SEQ ID NO: 2151919 - RNA, 16 nt, Homo sapiens
cuuuugcauuaaucua

SEQ ID NO: 2151920 - RNA, 18 nt, Homo sapiens
gagaauccucccuuccca

SEQ ID NO: 2151921 - RNA, 15 nt, Homo sapiens
uauuuggacuuuuga

SEQ ID NO: 2151922 - RNA, 17 nt, Homo sapiens
aucugaacuguggaauc

SEQ ID NO: 2151923 - RNA, 22 nt, Homo sapiens
uaaagaaccaucagcaucaccc

SEQ ID NO: 2151924 - RNA, 23 nt, Homo sapiens
uggaugugguuuaauuguuuguc

SEQ ID NO: 2151925 - RNA, 21 nt, Homo sapiens
aauucucuuauccaacaucaa

SEQ ID NO: 2151926 - RNA, 13 nt, Homo sapiens
aauuccugugauu

SEQ ID NO: 2151927 - RNA, 17 nt, Homo sapiens
accccauuuguggucac

SEQ ID NO: 2151928 - RNA, 16 nt, Homo sapiens
ucugcuuugacugagc

SEQ ID NO: 2151929 - RNA, 15 nt, Homo sapiens
aguuguauccauuaa

SEQ ID NO: 2151930 - RNA, 16 nt, Homo sapiens
aaauccuucagcaauc

SEQ ID NO: 2151931 - RNA, 20 nt, Homo sapiens
aaucaggauuccuucuuccc

SEQ ID NO: 2151932 - RNA, 17 nt, Homo sapiens
gcuuccuucauuuccuc

SEQ ID NO: 2151933 - RNA, 18 nt, Homo sapiens
agcuggaaauaaaccugg

SEQ ID NO: 2151934 - RNA, 17 nt, Homo sapiens
gacccagugugugcuca

SEQ ID NO: 2151935 - RNA, 13 nt, Homo sapiens
cugugcacuguag

SEQ ID NO: 2151936 - RNA, 17 nt, Homo sapiens
uuggacccaaaaaauca

SEQ ID NO: 2151937 - RNA, 16 nt, Homo sapiens
gcuucuauguuucaua

SEQ ID NO: 2151938 - RNA, 16 nt, Homo sapiens
uccaaauuuucaauaa

SEQ ID NO: 2151939 - RNA, 16 nt, Homo sapiens
ccgaguaacugagauu

SEQ ID NO: 2151940 - RNA, 20 nt, Homo sapiens
gguccaagccugcaacucau

SEQ ID NO: 2151941 - RNA, 19 nt, Homo sapiens
uucuugugaagaagccaac

SEQ ID NO: 2151942 - RNA, 22 nt, Homo sapiens
agaagagggaaugagcuuccau

SEQ ID NO: 2151943 - RNA, 19 nt, Homo sapiens
acaaauuguucauguuacc

SEQ ID NO: 2151944 - RNA, 22 nt, Homo sapiens
cuuuucugccugcuccugcuua

SEQ ID NO: 2151945 - RNA, 19 nt, Homo sapiens
gaagaggcggaagaaagcu

SEQ ID NO: 2151946 - RNA, 19 nt, Homo sapiens
augugacaaagggccagca

SEQ ID NO: 2151947 - RNA, 14 nt, Homo sapiens
agaaagccugagaa

SEQ ID NO: 2151948 - RNA, 16 nt, Homo sapiens
aaccuucaaagcuuuu

SEQ ID NO: 2151949 - RNA, 18 nt, Homo sapiens
gcagcagagggucuccaa

SEQ ID NO: 2151950 - RNA, 15 nt, Homo sapiens
ugugcggacagcccu

SEQ ID NO: 2151951 - RNA, 16 nt, Homo sapiens
acuuuaccaugcucaa

SEQ ID NO: 2151952 - RNA, 13 nt, Homo sapiens
gcuuugacucacc

SEQ ID NO: 2151953 - RNA, 22 nt, Homo sapiens
uagaacuaaaguaucugagauu

SEQ ID NO: 2151954 - RNA, 17 nt, Homo sapiens
ugguagccucacuuuua

SEQ ID NO: 2151955 - RNA, 18 nt, Homo sapiens
gaguuccggaaagccuuc

SEQ ID NO: 2151956 - RNA, 20 nt, Homo sapiens
cguugauguuggcugggaac

SEQ ID NO: 2151957 - RNA, 20 nt, Homo sapiens
gcuggaagaacugcaugggg

SEQ ID NO: 2151958 - RNA, 18 nt, Homo sapiens
gaccccugaauucaauga

SEQ ID NO: 2151959 - RNA, 17 nt, Homo sapiens
ucuucagagcaagcacu

SEQ ID NO: 2151960 - RNA, 13 nt, Homo sapiens
gcccucugugguc

SEQ ID NO: 2151961 - RNA, 19 nt, Homo sapiens
auuaauugagcagcaugau

SEQ ID NO: 2151962 - RNA, 12 nt, Homo sapiens
gugccaucccac

SEQ ID NO: 2151963 - RNA, 20 nt, Homo sapiens
uuggcugagagaguggcauu

SEQ ID NO: 2151964 - RNA, 20 nt, Homo sapiens
cuugaagcugcucacugcuc

SEQ ID NO: 2151965 - RNA, 13 nt, Homo sapiens
aggcagugcagua

SEQ ID NO: 2151966 - RNA, 13 nt, Homo sapiens
agcagacacacac

SEQ ID NO: 2151967 - RNA, 14 nt, Homo sapiens
ccaggcccaucuca

SEQ ID NO: 2151968 - RNA, 16 nt, Homo sapiens
aagcugggagaaccaa

SEQ ID NO: 2151969 - RNA, 16 nt, Homo sapiens
augucagcgcucuggu

SEQ ID NO: 2151970 - RNA, 23 nt, Homo sapiens
gaagggcuuggacucaagcaaga

SEQ ID NO: 2151971 - RNA, 17 nt, Homo sapiens
agcugugguaugaugau

SEQ ID NO: 2151972 - RNA, 14 nt, Homo sapiens
cccaucuauucucu

SEQ ID NO: 2151973 - RNA, 15 nt, Homo sapiens
auugcuuugccaaaa

SEQ ID NO: 2151974 - RNA, 17 nt, Homo sapiens
cuguaacugguaguguu

SEQ ID NO: 2151975 - RNA, 12 nt, Homo sapiens
gaaaucugacaa

SEQ ID NO: 2151976 - RNA, 16 nt, Homo sapiens
uggggcaggggguucu

SEQ ID NO: 2151977 - RNA, 19 nt, Homo sapiens
caguuuaugcagugcugcu

SEQ ID NO: 2151978 - RNA, 15 nt, Homo sapiens
uccgguggaaggccu

SEQ ID NO: 2151979 - RNA, 15 nt, Homo sapiens
ugggggcacugacca

SEQ ID NO: 2151980 - RNA, 19 nt, Homo sapiens
ugguucuaacugcuguuaa

SEQ ID NO: 2151981 - RNA, 20 nt, Homo sapiens
cagccugggcaacacagcga

SEQ ID NO: 2151982 - RNA, 16 nt, Homo sapiens
aggagaaaaaaacuuc

SEQ ID NO: 2151983 - RNA, 16 nt, Homo sapiens
guguuuacagacagaa

SEQ ID NO: 2151984 - RNA, 13 nt, Homo sapiens
gacuccucaaaag

SEQ ID NO: 2151985 - RNA, 16 nt, Homo sapiens
ggagagggacuggcag

SEQ ID NO: 2151986 - RNA, 17 nt, Homo sapiens
gaggaauaagcucccag

SEQ ID NO: 2151987 - RNA, 19 nt, Homo sapiens
ggacccaggcaccugcauu

SEQ ID NO: 2151988 - RNA, 22 nt, Homo sapiens
ucacaccauuuuguuuagacaa

SEQ ID NO: 2151989 - RNA, 20 nt, Homo sapiens
caguaugagucaaugugcag

SEQ ID NO: 2151990 - RNA, 22 nt, Homo sapiens
uguuucuaaacuaggauugaca

SEQ ID NO: 2151991 - RNA, 22 nt, Homo sapiens
cagaagauugaagccuuugcca

SEQ ID NO: 2151992 - RNA, 15 nt, Homo sapiens
cacuacgugacugug

SEQ ID NO: 2151993 - RNA, 20 nt, Homo sapiens
augguccuggggcucugugc

SEQ ID NO: 2151994 - RNA, 14 nt, Homo sapiens
cugucacaaaggag

SEQ ID NO: 2151995 - RNA, 13 nt, Homo sapiens
aacuguugccagg

SEQ ID NO: 2151996 - RNA, 13 nt, Homo sapiens
cccauccuagugg

SEQ ID NO: 2151997 - RNA, 15 nt, Homo sapiens
cccuucccacacugu

SEQ ID NO: 2151998 - RNA, 17 nt, Homo sapiens
uuucccacacugugaac

SEQ ID NO: 2151999 - RNA, 13 nt, Homo sapiens
auaguccaaaaag

SEQ ID NO: 2152000 - RNA, 18 nt, Homo sapiens
aguaauauuauuacuuua

SEQ ID NO: 2152001 - RNA, 15 nt, Homo sapiens
cgccgaggagagcaa

SEQ ID NO: 2152002 - RNA, 18 nt, Homo sapiens
gccugcaccaggggugca

SEQ ID NO: 2152003 - RNA, 15 nt, Homo sapiens
acacagcaguaugaa

SEQ ID NO: 2152004 - RNA, 14 nt, Homo sapiens
ccaaacaccaguca

SEQ ID NO: 2152005 - RNA, 20 nt, Homo sapiens
uaggcgcuggggcucagcuu

SEQ ID NO: 2152006 - RNA, 17 nt, Homo sapiens
caggguggagugcagug

SEQ ID NO: 2152007 - RNA, 11 nt, Homo sapiens
gguuaccucug

SEQ ID NO: 2152008 - RNA, 13 nt, Homo sapiens
ccaaucauugcaa

SEQ ID NO: 2152009 - RNA, 14 nt, Homo sapiens
aaugaaaccaaagc

SEQ ID NO: 2152010 - RNA, 21 nt, Homo sapiens
agauaaaaccagagcaggaaa

SEQ ID NO: 2152011 - RNA, 15 nt, Homo sapiens
ucuguguuuacuuaa

SEQ ID NO: 2152012 - RNA, 13 nt, Homo sapiens
gacaagauuuaug

SEQ ID NO: 2152013 - RNA, 17 nt, Homo sapiens
ugaauuguuaauucaca

SEQ ID NO: 2152014 - RNA, 21 nt, Homo sapiens
cuggggugggagggaggcauc

SEQ ID NO: 2152015 - RNA, 12 nt, Homo sapiens
uugacacauaca

SEQ ID NO: 2152016 - RNA, 23 nt, Homo sapiens
aaagcacgugucucagacugcau

SEQ ID NO: 2152017 - RNA, 20 nt, Homo sapiens
uccacugagaagaucaauga

SEQ ID NO: 2152018 - RNA, 23 nt, Homo sapiens
acuacaugugacuggcaguauua

SEQ ID NO: 2152019 - RNA, 21 nt, Homo sapiens
aguuuguuuacacuugucuca

SEQ ID NO: 2152020 - RNA, 16 nt, Homo sapiens
cccaccugcauugcuc

SEQ ID NO: 2152021 - RNA, 18 nt, Homo sapiens
aaucacaauuuuccugug

SEQ ID NO: 2152022 - RNA, 14 nt, Homo sapiens
agaggcugugucag

SEQ ID NO: 2152023 - RNA, 13 nt, Homo sapiens
agacugccagugg

SEQ ID NO: 2152024 - RNA, 12 nt, Homo sapiens
guuucacagugg

SEQ ID NO: 2152025 - RNA, 15 nt, Homo sapiens
cuguccuaaucauau

SEQ ID NO: 2152026 - RNA, 13 nt, Homo sapiens
acucuacacugaa

SEQ ID NO: 2152027 - RNA, 18 nt, Homo sapiens
uaccucccccugccuucc

SEQ ID NO: 2152028 - RNA, 12 nt, Homo sapiens
cagauggaccaa

SEQ ID NO: 2152029 - RNA, 15 nt, Homo sapiens
cauauccauaagaau

SEQ ID NO: 2152030 - RNA, 19 nt, Homo sapiens
cuggguuaaauauuuugcu

SEQ ID NO: 2152031 - RNA, 14 nt, Homo sapiens
aguuuuuccuaguc

SEQ ID NO: 2152032 - RNA, 23 nt, Homo sapiens
uggagagaugucuguucuaaguc

SEQ ID NO: 2152033 - RNA, 21 nt, Homo sapiens
gugagaagcugaggccuaugc

SEQ ID NO: 2152034 - RNA, 20 nt, Homo sapiens
cucaaacuccugaccucagg

SEQ ID NO: 2152035 - RNA, 11 nt, Homo sapiens
ucccugaacac

SEQ ID NO: 2152036 - RNA, 11 nt, Homo sapiens
ucacugaacaa

SEQ ID NO: 2152037 - RNA, 16 nt, Homo sapiens
gcuggcuccccaaagg

SEQ ID NO: 2152038 - RNA, 18 nt, Homo sapiens
uaauaauacaaguuuuca

SEQ ID NO: 2152039 - RNA, 12 nt, Homo sapiens
auacaaugcaug

SEQ ID NO: 2152040 - RNA, 13 nt, Homo sapiens
uauuaaaagacuc

SEQ ID NO: 2152041 - RNA, 13 nt, Homo sapiens
accucugcucuga

SEQ ID NO: 2152042 - RNA, 20 nt, Homo sapiens
gauacaaggaucagaaugga

SEQ ID NO: 2152043 - RNA, 14 nt, Homo sapiens
agguaaugugaaua

SEQ ID NO: 2152044 - RNA, 19 nt, Homo sapiens
cauuuuggcgcuauuacaa

SEQ ID NO: 2152045 - RNA, 20 nt, Homo sapiens
acucugcacaugucuuguac

SEQ ID NO: 2152046 - RNA, 12 nt, Homo sapiens
ccauuaaguaaa

SEQ ID NO: 2152047 - RNA, 12 nt, Homo sapiens
uccaacauguga

SEQ ID NO: 2152048 - RNA, 19 nt, Homo sapiens
gauucuuaauucucugcaa

SEQ ID NO: 2152049 - RNA, 14 nt, Homo sapiens
acaucccacagugg

SEQ ID NO: 2152050 - RNA, 17 nt, Homo sapiens
acucaaauggggccaga

SEQ ID NO: 2152051 - RNA, 19 nt, Homo sapiens
uccacaguuaggccaagaa

SEQ ID NO: 2152052 - RNA, 16 nt, Homo sapiens
aguucauaggucucca

SEQ ID NO: 2152053 - RNA, 18 nt, Homo sapiens
aauuaaaggcuuugcaac

SEQ ID NO: 2152054 - RNA, 20 nt, Homo sapiens
caguguguguuuaacauuca

SEQ ID NO: 2152055 - RNA, 23 nt, Homo sapiens
ugacccggccccuaccagccacg

SEQ ID NO: 2152056 - RNA, 14 nt, Homo sapiens
acaggaccaccucc

SEQ ID NO: 2152057 - RNA, 13 nt, Homo sapiens
uugccuaccauuu

SEQ ID NO: 2152058 - RNA, 19 nt, Homo sapiens
cuuccagguaucuccagga

SEQ ID NO: 2152059 - RNA, 18 nt, Homo sapiens
agauggcuaggccaucac

SEQ ID NO: 2152060 - RNA, 15 nt, Homo sapiens
cacaaggugauuuca

SEQ ID NO: 2152061 - RNA, 21 nt, Homo sapiens
gcugucaagggcagaaugaau

SEQ ID NO: 2152062 - RNA, 21 nt, Homo sapiens
acugugcccaaguggguccaa

SEQ ID NO: 2152063 - RNA, 16 nt, Homo sapiens
cucauuccaccuuccc

SEQ ID NO: 2152064 - RNA, 13 nt, Homo sapiens
aagggccacggga

SEQ ID NO: 2152065 - RNA, 13 nt, Homo sapiens
ugguuuucuugcc

SEQ ID NO: 2152066 - RNA, 21 nt, Homo sapiens
gccucuugcuggugcacauga

SEQ ID NO: 2152067 - RNA, 23 nt, Homo sapiens
auugggcccuuccggcaugcccc

SEQ ID NO: 2152068 - RNA, 13 nt, Homo sapiens
cuugagaccagcc

SEQ ID NO: 2152069 - RNA, 14 nt, Homo sapiens
ucccaccacaggca

SEQ ID NO: 2152070 - RNA, 13 nt, Homo sapiens
cuccaaggcagug

SEQ ID NO: 2152071 - RNA, 19 nt, Homo sapiens
aauguuggaaaacauauga

SEQ ID NO: 2152072 - RNA, 22 nt, Homo sapiens
cugcuacuuauauaauugccaa

SEQ ID NO: 2152073 - RNA, 19 nt, Homo sapiens
gggccccugcacacucagu

SEQ ID NO: 2152074 - RNA, 15 nt, Homo sapiens
uauuauacaaauacu

SEQ ID NO: 2152075 - RNA, 17 nt, Homo sapiens
uaggccaguaguucuca

SEQ ID NO: 2152076 - RNA, 23 nt, Homo sapiens
uugaaucuugucucaaugcucau

SEQ ID NO: 2152077 - RNA, 12 nt, Homo sapiens
ucagguauuugu

SEQ ID NO: 2152078 - RNA, 22 nt, Homo sapiens
gagaaaauaaagaccuugcuua

SEQ ID NO: 2152079 - RNA, 17 nt, Homo sapiens
auaucuuguagcuuuau

SEQ ID NO: 2152080 - RNA, 22 nt, Homo sapiens
acuguaaauaugaaucugcuca

SEQ ID NO: 2152081 - RNA, 13 nt, Homo sapiens
aaaggaaugaacu

SEQ ID NO: 2152082 - RNA, 23 nt, Homo sapiens
uaaauaaacacacuauggcauga

SEQ ID NO: 2152083 - RNA, 14 nt, Homo sapiens
ugugcugaacacac

SEQ ID NO: 2152084 - RNA, 21 nt, Homo sapiens
gccacauucaugggaaacccu

SEQ ID NO: 2152085 - RNA, 19 nt, Homo sapiens
accccagggccuacugcca

SEQ ID NO: 2152086 - RNA, 19 nt, Homo sapiens
gccuccucccacaagcacc

SEQ ID NO: 2152087 - RNA, 21 nt, Homo sapiens
gaugaucccagucacuccucu

SEQ ID NO: 2152088 - RNA, 16 nt, Homo sapiens
uccaugccaugaauga

SEQ ID NO: 2152089 - RNA, 16 nt, Homo sapiens
gucaguggaagcccca

SEQ ID NO: 2152090 - RNA, 20 nt, Homo sapiens
cuucucuccuccacucugag

SEQ ID NO: 2152091 - RNA, 18 nt, Homo sapiens
ucuagaaaauaaugcaaa

SEQ ID NO: 2152092 - RNA, 15 nt, Homo sapiens
auuuaccuguauuua

SEQ ID NO: 2152093 - RNA, 15 nt, Homo sapiens
accuauuucugauga

SEQ ID NO: 2152094 - RNA, 20 nt, Homo sapiens
auuucuuuguaaagcauccu

SEQ ID NO: 2152095 - RNA, 18 nt, Homo sapiens
auuucuagaacccgugac

SEQ ID NO: 2152096 - RNA, 17 nt, Homo sapiens
auuaacccccaaauuca

SEQ ID NO: 2152097 - RNA, 13 nt, Homo sapiens
uucagagauauaa

SEQ ID NO: 2152098 - RNA, 14 nt, Homo sapiens
uuugccuucuccac

SEQ ID NO: 2152099 - RNA, 15 nt, Homo sapiens
cauuuagaacuugca

SEQ ID NO: 2152100 - RNA, 18 nt, Homo sapiens
ggaacaggguuacuguau

SEQ ID NO: 2152101 - RNA, 21 nt, Homo sapiens
agaauucuggauaucucagga

SEQ ID NO: 2152102 - RNA, 20 nt, Homo sapiens
guugguucguucuguacugu

SEQ ID NO: 2152103 - RNA, 18 nt, Homo sapiens
guccuaaggacacacuaa

SEQ ID NO: 2152104 - RNA, 22 nt, Homo sapiens
uggacccaaaaaaucaucucac

SEQ ID NO: 2152105 - RNA, 16 nt, Homo sapiens
uaaugcucugaccaag

SEQ ID NO: 2152106 - RNA, 21 nt, Homo sapiens
aucuggggauacuggcaaagc

SEQ ID NO: 2152107 - RNA, 15 nt, Homo sapiens
guauuuccuuccacu

SEQ ID NO: 2152108 - RNA, 13 nt, Homo sapiens
aaacucagugcaa

SEQ ID NO: 2152109 - RNA, 14 nt, Homo sapiens
gccaggggcaguuu

SEQ ID NO: 2152110 - RNA, 15 nt, Homo sapiens
ccuacagggccacaa

SEQ ID NO: 2152111 - RNA, 15 nt, Homo sapiens
uucagggaacugcau

SEQ ID NO: 2152112 - RNA, 15 nt, Homo sapiens
accucccugcaauaa

SEQ ID NO: 2152113 - RNA, 17 nt, Homo sapiens
ccgaggccgugcagugg

SEQ ID NO: 2152114 - RNA, 16 nt, Homo sapiens
ugagcuccccaaaaac

SEQ ID NO: 2152115 - RNA, 22 nt, Homo sapiens
cuuaguuauauagcaucuggaa

SEQ ID NO: 2152116 - RNA, 21 nt, Homo sapiens
gauggucaucgugacagcagc

SEQ ID NO: 2152117 - RNA, 20 nt, Homo sapiens
ucuuaaaguuugcaguauuc

SEQ ID NO: 2152118 - RNA, 19 nt, Homo sapiens
aaacacccaucguucucug

SEQ ID NO: 2152119 - RNA, 18 nt, Homo sapiens
gaaacacguaucccaccu

SEQ ID NO: 2152120 - RNA, 13 nt, Homo sapiens
uuguucuuugcca

SEQ ID NO: 2152121 - RNA, 18 nt, Homo sapiens
caaaagauaaaacuaauu

SEQ ID NO: 2152122 - RNA, 12 nt, Homo sapiens
acgucugugagu

SEQ ID NO: 2152123 - RNA, 23 nt, Homo sapiens
uaaaaucuuuccaucucauuaca

SEQ ID NO: 2152124 - RNA, 14 nt, Homo sapiens
cuaaaucaaaccag

SEQ ID NO: 2152125 - RNA, 13 nt, Homo sapiens
auuagccaaggau

SEQ ID NO: 2152126 - RNA, 20 nt, Homo sapiens
uaagcugugguguguucccc

SEQ ID NO: 2152127 - RNA, 13 nt, Homo sapiens
uucugaugagcau

SEQ ID NO: 2152128 - RNA, 17 nt, Homo sapiens
cuagaauggaaaacugc

SEQ ID NO: 2152129 - RNA, 12 nt, Homo sapiens
auuucugugauu

SEQ ID NO: 2152130 - RNA, 16 nt, Homo sapiens
gcccagcgcagugccu

SEQ ID NO: 2152131 - RNA, 22 nt, Homo sapiens
gcacccaacuacugagcugaga

SEQ ID NO: 2152132 - RNA, 18 nt, Homo sapiens
guuuuccaaauaacauca

SEQ ID NO: 2152133 - RNA, 21 nt, Homo sapiens
aucauugguacccacuugcuu

SEQ ID NO: 2152134 - RNA, 17 nt, Homo sapiens
aaaguagggaccucaga

SEQ ID NO: 2152135 - RNA, 19 nt, Homo sapiens
uaauaaaagaaucauuugc

SEQ ID NO: 2152136 - RNA, 12 nt, Homo sapiens
gggggaaggugg

SEQ ID NO: 2152137 - RNA, 12 nt, Homo sapiens
accaccaaaguc

SEQ ID NO: 2152138 - RNA, 13 nt, Homo sapiens
auuaagcacauua

SEQ ID NO: 2152139 - RNA, 14 nt, Homo sapiens
uaguuggugcucaa

SEQ ID NO: 2152140 - RNA, 20 nt, Homo sapiens
cccugcccuccccucucugc

SEQ ID NO: 2152141 - RNA, 14 nt, Homo sapiens
ucaauggauuugau

SEQ ID NO: 2152142 - RNA, 15 nt, Homo sapiens
gaauaaaaacauuuc

SEQ ID NO: 2152143 - RNA, 18 nt, Homo sapiens
ugccuccaccccccagaa

SEQ ID NO: 2152144 - RNA, 16 nt, Homo sapiens
aaucaugcucauguau

SEQ ID NO: 2152145 - RNA, 20 nt, Homo sapiens
ggcuucaggccgagccaggu

SEQ ID NO: 2152146 - RNA, 21 nt, Homo sapiens
agauagcaucuuauacgagua

SEQ ID NO: 2152147 - RNA, 21 nt, Homo sapiens
auagucuuacuaaaugcagaa

SEQ ID NO: 2152148 - RNA, 20 nt, Homo sapiens
ggcucaagcaguucucccac

SEQ ID NO: 2152149 - RNA, 21 nt, Homo sapiens
cuguuccaggcccuccagugg

SEQ ID NO: 2152150 - RNA, 15 nt, Homo sapiens
aauuaguaacaugug

SEQ ID NO: 2152151 - RNA, 16 nt, Homo sapiens
gcaauaguuaccucaa

SEQ ID NO: 2152152 - RNA, 18 nt, Homo sapiens
augaaaccgccauugggc

SEQ ID NO: 2152153 - RNA, 19 nt, Homo sapiens
gauucacuccuuugagucu

SEQ ID NO: 2152154 - RNA, 18 nt, Homo sapiens
augcaaccuuuggaugca

SEQ ID NO: 2152155 - RNA, 22 nt, Homo sapiens
ccaaaagcccauucauuccauu

SEQ ID NO: 2152156 - RNA, 19 nt, Homo sapiens
uccucauccccacaaucug

SEQ ID NO: 2152157 - RNA, 21 nt, Homo sapiens
ucugauucgaaugacacuguu

SEQ ID NO: 2152158 - RNA, 17 nt, Homo sapiens
aagaacgcgacuuccac

SEQ ID NO: 2152159 - RNA, 14 nt, Homo sapiens
ugcuggcucaggag

SEQ ID NO: 2152160 - RNA, 23 nt, Homo sapiens
aaaaugaagacaccagaguguau

SEQ ID NO: 2152161 - RNA, 20 nt, Homo sapiens
ccucccacagugcugggauu

SEQ ID NO: 2152162 - RNA, 19 nt, Homo sapiens
gacagacgaagaguuuaaa

SEQ ID NO: 2152163 - RNA, 21 nt, Homo sapiens
auguuuguuauuuacacuggu

SEQ ID NO: 2152164 - RNA, 22 nt, Homo sapiens
ggcaggaaggaacucaaggugg

SEQ ID NO: 2152165 - RNA, 20 nt, Homo sapiens
ugccaaccuggaauggagac

SEQ ID NO: 2152166 - RNA, 13 nt, Homo sapiens
uuauuaguauucu

SEQ ID NO: 2152167 - RNA, 17 nt, Homo sapiens
ccaggagggugcaucca

SEQ ID NO: 2152168 - RNA, 23 nt, Homo sapiens
aaugauauccaauauuaaaagau

SEQ ID NO: 2152169 - RNA, 15 nt, Homo sapiens
uugauucauauugca

SEQ ID NO: 2152170 - RNA, 17 nt, Homo sapiens
guagccugugcauguau

SEQ ID NO: 2152171 - RNA, 20 nt, Homo sapiens
uccaaggaaauacauaugca

SEQ ID NO: 2152172 - RNA, 15 nt, Homo sapiens
uguguuucaggugga

SEQ ID NO: 2152173 - RNA, 17 nt, Homo sapiens
auucuucuaauuaacag

SEQ ID NO: 2152174 - RNA, 16 nt, Homo sapiens
gacccuuuguugaaaa

SEQ ID NO: 2152175 - RNA, 18 nt, Homo sapiens
uuaggagacacagggaag

SEQ ID NO: 2152176 - RNA, 20 nt, Homo sapiens
cacuuggagcuaaaacuggc

SEQ ID NO: 2152177 - RNA, 15 nt, Homo sapiens
aucaagaagcuguga

SEQ ID NO: 2152178 - RNA, 22 nt, Homo sapiens
ucccagccugggggccaguggg

SEQ ID NO: 2152179 - RNA, 16 nt, Homo sapiens
cagcucaccuuuuuau

SEQ ID NO: 2152180 - RNA, 21 nt, Homo sapiens
augacgcaccaguuacagggg

SEQ ID NO: 2152181 - RNA, 20 nt, Homo sapiens
uaaauauauauaaaccuaaa

SEQ ID NO: 2152182 - RNA, 21 nt, Homo sapiens
acaugcugaagccaaagccaa

SEQ ID NO: 2152183 - RNA, 12 nt, Homo sapiens
aguuucccugaa

SEQ ID NO: 2152184 - RNA, 17 nt, Homo sapiens
cacccacccccucugga

SEQ ID NO: 2152185 - RNA, 16 nt, Homo sapiens
gucgagauugcacugc

SEQ ID NO: 2152186 - RNA, 16 nt, Homo sapiens
ugccgggcugcacaga

SEQ ID NO: 2152187 - RNA, 23 nt, Homo sapiens
ugcaccaugucaaggguucaaga

SEQ ID NO: 2152188 - RNA, 17 nt, Homo sapiens
uacaaaggcuugcuaag

SEQ ID NO: 2152189 - RNA, 21 nt, Homo sapiens
acucaugacugagucuggcaa

SEQ ID NO: 2152190 - RNA, 16 nt, Homo sapiens
caggguggagugcagu

SEQ ID NO: 2152191 - RNA, 14 nt, Homo sapiens
aggaauacauuugg

SEQ ID NO: 2152192 - RNA, 15 nt, Homo sapiens
cggagcgcaccugcu

SEQ ID NO: 2152193 - RNA, 17 nt, Homo sapiens
agcuugacuucaugcca

SEQ ID NO: 2152194 - RNA, 23 nt, Homo sapiens
caacauggagaagccccgucucu

SEQ ID NO: 2152195 - RNA, 16 nt, Homo sapiens
aaugcaugaugaacuc

SEQ ID NO: 2152196 - RNA, 14 nt, Homo sapiens
gcugcucuauugua

SEQ ID NO: 2152197 - RNA, 14 nt, Homo sapiens
cccagguaccagcu

SEQ ID NO: 2152198 - RNA, 13 nt, Homo sapiens
guauaugcugcau

SEQ ID NO: 2152199 - RNA, 23 nt, Homo sapiens
gguuacagcauaacuaggauuau

SEQ ID NO: 2152200 - RNA, 16 nt, Homo sapiens
acucaggggucacuga

SEQ ID NO: 2152201 - RNA, 16 nt, Homo sapiens
gcccagaggguggcaa

SEQ ID NO: 2152202 - RNA, 14 nt, Homo sapiens
aauaucccguguua

SEQ ID NO: 2152203 - RNA, 21 nt, Homo sapiens
ucucaggaaaacagcuaguag

SEQ ID NO: 2152204 - RNA, 21 nt, Homo sapiens
agcagaugcaaucucuugucu

SEQ ID NO: 2152205 - RNA, 19 nt, Homo sapiens
uaaugugaggaacucacau

SEQ ID NO: 2152206 - RNA, 21 nt, Homo sapiens
cagaaauggugcucaccaugc

SEQ ID NO: 2152207 - RNA, 21 nt, Homo sapiens
gauguuagccugcaaacaaca

SEQ ID NO: 2152208 - RNA, 15 nt, Homo sapiens
ugaauauuacuccua

SEQ ID NO: 2152209 - RNA, 20 nt, Homo sapiens
acagcaagacuccgucucaa

SEQ ID NO: 2152210 - RNA, 19 nt, Homo sapiens
cuguauagaccaugcacag

SEQ ID NO: 2152211 - RNA, 20 nt, Homo sapiens
uccaaaaauagcccugcaaa

SEQ ID NO: 2152212 - RNA, 18 nt, Homo sapiens
uaaaaugcagauucauag

SEQ ID NO: 2152213 - RNA, 16 nt, Homo sapiens
uaugacauuacuguau

SEQ ID NO: 2152214 - RNA, 20 nt, Homo sapiens
ucugagcacggacucuccca

SEQ ID NO: 2152215 - RNA, 12 nt, Homo sapiens
ucuuucacuuca

SEQ ID NO: 2152216 - RNA, 18 nt, Homo sapiens
ucuauauuggucauugcc

SEQ ID NO: 2152217 - RNA, 17 nt, Homo sapiens
cggccgcucuccgcccc

SEQ ID NO: 2152218 - RNA, 13 nt, Homo sapiens
gcccugcaccuug

SEQ ID NO: 2152219 - RNA, 15 nt, Homo sapiens
aggaaauugcaaaga

SEQ ID NO: 2152220 - RNA, 14 nt, Homo sapiens
gaaaucaugagggu

SEQ ID NO: 2152221 - RNA, 19 nt, Homo sapiens
guaaauguaaauacaguag

SEQ ID NO: 2152222 - RNA, 11 nt, Homo sapiens
uggaagccugc

SEQ ID NO: 2152223 - RNA, 15 nt, Homo sapiens
aacuugcugcugagu

SEQ ID NO: 2152224 - RNA, 12 nt, Homo sapiens
gcuguucuugcu

SEQ ID NO: 2152225 - RNA, 17 nt, Homo sapiens
aagcagggacugugaac

SEQ ID NO: 2152226 - RNA, 15 nt, Homo sapiens
gaggucucccaaacg

SEQ ID NO: 2152227 - RNA, 12 nt, Homo sapiens
cauccaagagaa

SEQ ID NO: 2152228 - RNA, 11 nt, Homo sapiens
uagaugcauua

SEQ ID NO: 2152229 - RNA, 22 nt, Homo sapiens
uaaauuauagaaucuacuuuaa

SEQ ID NO: 2152230 - RNA, 16 nt, Homo sapiens
cccaccguuaggauuc

SEQ ID NO: 2152231 - RNA, 20 nt, Homo sapiens
cccaggcuggagugcaaugg

SEQ ID NO: 2152232 - RNA, 16 nt, Homo sapiens
uuuaauuuuccucuaa

SEQ ID NO: 2152233 - RNA, 14 nt, Homo sapiens
cccucuucauggau

SEQ ID NO: 2152234 - RNA, 16 nt, Homo sapiens
agaaaauggccaguga

SEQ ID NO: 2152235 - RNA, 19 nt, Homo sapiens
aaccacuugccucuuucuc

SEQ ID NO: 2152236 - RNA, 21 nt, Homo sapiens
aaugugauauuugaagcauca

SEQ ID NO: 2152237 - RNA, 13 nt, Homo sapiens
uccuugacccaga

SEQ ID NO: 2152238 - RNA, 20 nt, Homo sapiens
accaaauugaacucacugcu

SEQ ID NO: 2152239 - RNA, 12 nt, Homo sapiens
acccaaucugcc

SEQ ID NO: 2152240 - RNA, 16 nt, Homo sapiens
aagaauacacugugac

SEQ ID NO: 2152241 - RNA, 16 nt, Homo sapiens
guugagcuauugcugu

SEQ ID NO: 2152242 - RNA, 22 nt, Homo sapiens
ccuucuuuugaaggacuccuua

SEQ ID NO: 2152243 - RNA, 18 nt, Homo sapiens
agaguccucuggauggca

SEQ ID NO: 2152244 - RNA, 21 nt, Homo sapiens
uuuuaaggucuaaucagugau

SEQ ID NO: 2152245 - RNA, 16 nt, Homo sapiens
aaccaggugcaauuau

SEQ ID NO: 2152246 - RNA, 17 nt, Homo sapiens
cuaacuagcauuguaaa

SEQ ID NO: 2152247 - RNA, 20 nt, Homo sapiens
ugucucaaaggagcuuucuc

SEQ ID NO: 2152248 - RNA, 12 nt, Homo sapiens
aaaguucuugcu

SEQ ID NO: 2152249 - RNA, 20 nt, Homo sapiens
acuugagaggaugaauguau

SEQ ID NO: 2152250 - RNA, 17 nt, Homo sapiens
ucccuaaaagcauuuga

SEQ ID NO: 2152251 - RNA, 19 nt, Homo sapiens
agugauguuggcuagccca

SEQ ID NO: 2152252 - RNA, 12 nt, Homo sapiens
cauuaaagccau

SEQ ID NO: 2152253 - RNA, 18 nt, Homo sapiens
uaucagagucaugaugaa

SEQ ID NO: 2152254 - RNA, 22 nt, Homo sapiens
uaaguacuauguaucaaugagu

SEQ ID NO: 2152255 - RNA, 21 nt, Homo sapiens
aggauccacuuggucugugag

SEQ ID NO: 2152256 - RNA, 14 nt, Homo sapiens
cuucaaagccacau

SEQ ID NO: 2152257 - RNA, 13 nt, Homo sapiens
acggcccaugcaa

SEQ ID NO: 2152258 - RNA, 19 nt, Homo sapiens
ucaguaacacagugcagua

SEQ ID NO: 2152259 - RNA, 14 nt, Homo sapiens
aucauuauaucauu

SEQ ID NO: 2152260 - RNA, 14 nt, Homo sapiens
ucucaaauucucaa

SEQ ID NO: 2152261 - RNA, 14 nt, Homo sapiens
gcacacaugcacac

SEQ ID NO: 2152262 - RNA, 14 nt, Homo sapiens
gaccugaugaccug

SEQ ID NO: 2152263 - RNA, 18 nt, Homo sapiens
cggagcagccuuuaucaa

SEQ ID NO: 2152264 - RNA, 20 nt, Homo sapiens
gggcgagccaggaccacaga

SEQ ID NO: 2152265 - RNA, 17 nt, Homo sapiens
uauaagguaugugcuau

SEQ ID NO: 2152266 - RNA, 21 nt, Homo sapiens
caacgcuuaaaggugucuucc

SEQ ID NO: 2152267 - RNA, 21 nt, Homo sapiens
uugggccagugaacaggguaa

SEQ ID NO: 2152268 - RNA, 21 nt, Homo sapiens
agcuagcagaagacaaggcau

SEQ ID NO: 2152269 - RNA, 21 nt, Homo sapiens
aauuggguggggggcuucaua

SEQ ID NO: 2152270 - RNA, 17 nt, Homo sapiens
ucauauguucuaaaaga

SEQ ID NO: 2152271 - RNA, 17 nt, Homo sapiens
cagaauuugcucgcuac

SEQ ID NO: 2152272 - RNA, 21 nt, Homo sapiens
aucuaaaaauuuugcauuuca

SEQ ID NO: 2152273 - RNA, 12 nt, Homo sapiens
acaaggaaaauu

SEQ ID NO: 2152274 - RNA, 16 nt, Homo sapiens
cugcccauacugagcc

SEQ ID NO: 2152275 - RNA, 22 nt, Homo sapiens
uggaaaaguauguuagugcaaa

SEQ ID NO: 2152276 - RNA, 23 nt, Homo sapiens
uaaccccugcgcucucuuugcaa

SEQ ID NO: 2152277 - RNA, 15 nt, Homo sapiens
uuguccugcucucuu

SEQ ID NO: 2152278 - RNA, 16 nt, Homo sapiens
guuucuuuuauguggu

SEQ ID NO: 2152279 - RNA, 13 nt, Homo sapiens
uggaugacauuaa

SEQ ID NO: 2152280 - RNA, 18 nt, Homo sapiens
auuuauggaaucuaccaa

SEQ ID NO: 2152281 - RNA, 15 nt, Homo sapiens
ccauaaggccagaaa

SEQ ID NO: 2152282 - RNA, 18 nt, Homo sapiens
cagaccauugucuuccaa

SEQ ID NO: 2152283 - RNA, 19 nt, Homo sapiens
ggccacaacagggcauuuu

SEQ ID NO: 2152284 - RNA, 18 nt, Homo sapiens
uguguuuuuuaggacgau

SEQ ID NO: 2152285 - RNA, 19 nt, Homo sapiens
ucgcuagguagaacacugc

SEQ ID NO: 2152286 - RNA, 14 nt, Homo sapiens
acucuauccaaagu

SEQ ID NO: 2152287 - RNA, 15 nt, Homo sapiens
ccccaucuuccaacc

SEQ ID NO: 2152288 - RNA, 11 nt, Homo sapiens
gccuucuuaua

SEQ ID NO: 2152289 - RNA, 9 nt, Homo sapiens
gagugaaug

SEQ ID NO: 2152290 - RNA, 14 nt, Homo sapiens
cuccaaagucguuu

SEQ ID NO: 2152291 - RNA, 21 nt, Homo sapiens
gacucauugcuucacaaccca

SEQ ID NO: 2152292 - RNA, 20 nt, Homo sapiens
gcugagugcauaggugacag

SEQ ID NO: 2152293 - RNA, 14 nt, Homo sapiens
gaccguugcacaaa

SEQ ID NO: 2152294 - RNA, 23 nt, Homo sapiens
cuaagaaaucauggcauucacac

SEQ ID NO: 2152295 - RNA, 14 nt, Homo sapiens
uauauaggcauuuc

SEQ ID NO: 2152296 - RNA, 23 nt, Homo sapiens
gugcccaguacuuccuggacaag

SEQ ID NO: 2152297 - RNA, 20 nt, Homo sapiens
auggaagauuagagguuugu

SEQ ID NO: 2152298 - RNA, 18 nt, Homo sapiens
acuuugauuuacagugcc

SEQ ID NO: 2152299 - RNA, 12 nt, Homo sapiens
caacagacugaa

SEQ ID NO: 2152300 - RNA, 16 nt, Homo sapiens
caaguugcaucagaaa

SEQ ID NO: 2152301 - RNA, 21 nt, Homo sapiens
cauccccugaugcccagguca

SEQ ID NO: 2152302 - RNA, 22 nt, Homo sapiens
aacuuuggcuuucauauucucu

SEQ ID NO: 2152303 - RNA, 13 nt, Homo sapiens
gcaaggugacauu

SEQ ID NO: 2152304 - RNA, 15 nt, Homo sapiens
auuaagucagagcca

SEQ ID NO: 2152305 - RNA, 19 nt, Homo sapiens
aauacacggacacaaccaa

SEQ ID NO: 2152306 - RNA, 22 nt, Homo sapiens
gccguauacaaggaauaugaca

SEQ ID NO: 2152307 - RNA, 23 nt, Homo sapiens
uaucaucugucauuauauucuaa

SEQ ID NO: 2152308 - RNA, 17 nt, Homo sapiens
aagguuuuuacugugag

SEQ ID NO: 2152309 - RNA, 15 nt, Homo sapiens
uuccucaucaccauc

SEQ ID NO: 2152310 - RNA, 13 nt, Homo sapiens
gaagagucauuuu

SEQ ID NO: 2152311 - RNA, 16 nt, Homo sapiens
gacucagaaagccaac

SEQ ID NO: 2152312 - RNA, 20 nt, Homo sapiens
cccuggugcaagugcuguca

SEQ ID NO: 2152313 - RNA, 14 nt, Homo sapiens
cuggaacauuccag

SEQ ID NO: 2152314 - RNA, 20 nt, Homo sapiens
cacacagucucaguccagau

SEQ ID NO: 2152315 - RNA, 16 nt, Homo sapiens
aguacuaagcauuuca

SEQ ID NO: 2152316 - RNA, 21 nt, Homo sapiens
ccugagaggaaccagagcaga

SEQ ID NO: 2152317 - RNA, 20 nt, Homo sapiens
aguccaguccucacaugccc

SEQ ID NO: 2152318 - RNA, 15 nt, Homo sapiens
ucuguaaaacuaaga

SEQ ID NO: 2152319 - RNA, 23 nt, Homo sapiens
cuaacuuuccuucauucaaccca

SEQ ID NO: 2152320 - RNA, 15 nt, Homo sapiens
ucccacuaaugcaaa

SEQ ID NO: 2152321 - RNA, 20 nt, Homo sapiens
ucauagugccuuuuuccuua

SEQ ID NO: 2152322 - RNA, 14 nt, Homo sapiens
uuccccaccaguga

SEQ ID NO: 2152323 - RNA, 14 nt, Homo sapiens
ucgcaucaugccaa

SEQ ID NO: 2152324 - RNA, 14 nt, Homo sapiens
agaugcugauucau

SEQ ID NO: 2152325 - RNA, 15 nt, Homo sapiens
aaaacaaauaauauc

SEQ ID NO: 2152326 - RNA, 21 nt, Homo sapiens
agacucuggaggucaucuggc

SEQ ID NO: 2152327 - RNA, 21 nt, Homo sapiens
gcucugugcccggugccaucu

SEQ ID NO: 2152328 - RNA, 20 nt, Homo sapiens
uaaguggcaggacccuguca

SEQ ID NO: 2152329 - RNA, 18 nt, Homo sapiens
auaccccuaguaucuggc

SEQ ID NO: 2152330 - RNA, 20 nt, Homo sapiens
ucucuuuggaggaagcccau

SEQ ID NO: 2152331 - RNA, 16 nt, Homo sapiens
ucaaauggguuuucca

SEQ ID NO: 2152332 - RNA, 15 nt, Homo sapiens
ucuuaaguucuauga

SEQ ID NO: 2152333 - RNA, 17 nt, Homo sapiens
aguauucauucugcauu

SEQ ID NO: 2152334 - RNA, 20 nt, Homo sapiens
acuugaaauucucaucaguc

SEQ ID NO: 2152335 - RNA, 12 nt, Homo sapiens
agccucugucac

SEQ ID NO: 2152336 - RNA, 22 nt, Homo sapiens
gacaaauauuguuaccaugaag

SEQ ID NO: 2152337 - RNA, 14 nt, Homo sapiens
gcucaacaucucag

SEQ ID NO: 2152338 - RNA, 23 nt, Homo sapiens
gcuuucauuuucucucaggugaa

SEQ ID NO: 2152339 - RNA, 16 nt, Homo sapiens
cacuacaacagaauuu

SEQ ID NO: 2152340 - RNA, 23 nt, Homo sapiens
ugcuucucugccgguggggccag

SEQ ID NO: 2152341 - RNA, 14 nt, Homo sapiens
aaugcauguugccc

SEQ ID NO: 2152342 - RNA, 14 nt, Homo sapiens
gugaagagaagcaa

SEQ ID NO: 2152343 - RNA, 20 nt, Homo sapiens
agagugcauaaagguucugg

SEQ ID NO: 2152344 - RNA, 20 nt, Homo sapiens
cuuuucuuauauaagacaag

SEQ ID NO: 2152345 - RNA, 23 nt, Homo sapiens
caaacauauccuuucaagacaga

SEQ ID NO: 2152346 - RNA, 18 nt, Homo sapiens
cauauggagcucauguca

SEQ ID NO: 2152347 - RNA, 19 nt, Homo sapiens
cccaccagccuuguccuaa

SEQ ID NO: 2152348 - RNA, 13 nt, Homo sapiens
gguggccacagcg

SEQ ID NO: 2152349 - RNA, 19 nt, Homo sapiens
caucauugaugaucacugu

SEQ ID NO: 2152350 - RNA, 18 nt, Homo sapiens
uugaaugccauagucaaa

SEQ ID NO: 2152351 - RNA, 23 nt, Homo sapiens
agcucggaacuuacuguguaaau

SEQ ID NO: 2152352 - RNA, 19 nt, Homo sapiens
gcaccugccucagcuaccu

SEQ ID NO: 2152353 - RNA, 16 nt, Homo sapiens
aaugaaaauucuaacc

SEQ ID NO: 2152354 - RNA, 17 nt, Homo sapiens
auuuugguguccuauua

SEQ ID NO: 2152355 - RNA, 19 nt, Homo sapiens
gaacaaaaauuacaaagaa

SEQ ID NO: 2152356 - RNA, 22 nt, Homo sapiens
cuaacugggaggacauucugcu

SEQ ID NO: 2152357 - RNA, 14 nt, Homo sapiens
aaacaaucucccaa

SEQ ID NO: 2152358 - RNA, 18 nt, Homo sapiens
uguauaguuagcuuuauu

SEQ ID NO: 2152359 - RNA, 12 nt, Homo sapiens
caggaugggaag

SEQ ID NO: 2152360 - RNA, 16 nt, Homo sapiens
caccgagaggaaaaag

SEQ ID NO: 2152361 - RNA, 15 nt, Homo sapiens
caagcuaaucugccu

SEQ ID NO: 2152362 - RNA, 15 nt, Homo sapiens
acaggcagcauuuag

SEQ ID NO: 2152363 - RNA, 15 nt, Homo sapiens
uugcaaaguacugua

SEQ ID NO: 2152364 - RNA, 24 nt, Homo sapiens
ugaaaugccagaaugacuucugac

SEQ ID NO: 2152365 - RNA, 16 nt, Homo sapiens
auuuauaauucaguau

SEQ ID NO: 2152366 - RNA, 14 nt, Homo sapiens
uuaaaaaguuucac

SEQ ID NO: 2152367 - RNA, 14 nt, Homo sapiens
aaaaaaagaaucac

SEQ ID NO: 2152368 - RNA, 19 nt, Homo sapiens
caaacuguggcaacugaga

SEQ ID NO: 2152369 - RNA, 22 nt, Homo sapiens
caagucccuuugugacuucaag

SEQ ID NO: 2152370 - RNA, 13 nt, Homo sapiens
aagauucuugacu

SEQ ID NO: 2152371 - RNA, 20 nt, Homo sapiens
cucaaaaugugccgucuuug

SEQ ID NO: 2152372 - RNA, 16 nt, Homo sapiens
aguauguguaugugua

SEQ ID NO: 2152373 - RNA, 20 nt, Homo sapiens
ucacaccggcacugugcacu

SEQ ID NO: 2152374 - RNA, 19 nt, Homo sapiens
caaacuaugaucacaguga

SEQ ID NO: 2152375 - RNA, 16 nt, Homo sapiens
aagccucugugcugca

SEQ ID NO: 2152376 - RNA, 18 nt, Homo sapiens
aguccuccacucgaccca

SEQ ID NO: 2152377 - RNA, 16 nt, Homo sapiens
auuucucugauuugca

SEQ ID NO: 2152378 - RNA, 21 nt, Homo sapiens
ugggaaggggagcacaauuuc

SEQ ID NO: 2152379 - RNA, 22 nt, Homo sapiens
augugaaaacccaucucuacaa

SEQ ID NO: 2152380 - RNA, 22 nt, Homo sapiens
uuaccucugaguuguguuccac

SEQ ID NO: 2152381 - RNA, 16 nt, Homo sapiens
cugcauguaaacacgc

SEQ ID NO: 2152382 - RNA, 17 nt, Homo sapiens
ggauggguccucacgca

SEQ ID NO: 2152383 - RNA, 22 nt, Homo sapiens
gccuggacacuguaccgacuuu

SEQ ID NO: 2152384 - RNA, 20 nt, Homo sapiens
cccuggcugaccccaaagag

SEQ ID NO: 2152385 - RNA, 12 nt, Homo sapiens
aaaaaccacagc

SEQ ID NO: 2152386 - RNA, 19 nt, Homo sapiens
auaaaaugucuucucccac

SEQ ID NO: 2152387 - RNA, 17 nt, Homo sapiens
uguggucuuacaaugga

SEQ ID NO: 2152388 - RNA, 18 nt, Homo sapiens
gccagcugcaucuacuca

SEQ ID NO: 2152389 - RNA, 13 nt, Homo sapiens
uucagcugggaag

SEQ ID NO: 2152390 - RNA, 13 nt, Homo sapiens
gucggcugugagg

SEQ ID NO: 2152391 - RNA, 23 nt, Homo sapiens
agaaaccuggggugaauacuuau

SEQ ID NO: 2152392 - RNA, 24 nt, Homo sapiens
uguucuuggaccuuuuguacugaa

SEQ ID NO: 2152393 - RNA, 15 nt, Homo sapiens
caggcccugcagugu

SEQ ID NO: 2152394 - RNA, 18 nt, Homo sapiens
gccagcucauuucacuuu

SEQ ID NO: 2152395 - RNA, 19 nt, Homo sapiens
gagcccuucucuuugacuu

SEQ ID NO: 2152396 - RNA, 22 nt, Homo sapiens
cacccaaagccugucccaggac

SEQ ID NO: 2152397 - RNA, 23 nt, Homo sapiens
cuggacaggcaaagacugcagua

SEQ ID NO: 2152398 - RNA, 14 nt, Homo sapiens
cuccuaacauauau

SEQ ID NO: 2152399 - RNA, 18 nt, Homo sapiens
uaguauuucucaggaaga

SEQ ID NO: 2152400 - RNA, 19 nt, Homo sapiens
gaucuauauuucuggugaa

SEQ ID NO: 2152401 - RNA, 17 nt, Homo sapiens
gccugaucaccagguga

SEQ ID NO: 2152402 - RNA, 14 nt, Homo sapiens
agcauuacaguggg

SEQ ID NO: 2152403 - RNA, 16 nt, Homo sapiens
aucuuuaggcuuucaa

SEQ ID NO: 2152404 - RNA, 18 nt, Homo sapiens
aggccacuguuugucuca

SEQ ID NO: 2152405 - RNA, 17 nt, Homo sapiens
cuugcuuuuugcugugu

SEQ ID NO: 2152406 - RNA, 17 nt, Homo sapiens
agcuaguuaugugagaa

SEQ ID NO: 2152407 - RNA, 16 nt, Homo sapiens
aggcuaugccaugugc

SEQ ID NO: 2152408 - RNA, 18 nt, Homo sapiens
cuguggugucugccuguu

SEQ ID NO: 2152409 - RNA, 15 nt, Homo sapiens
gagauuccugagcca

SEQ ID NO: 2152410 - RNA, 15 nt, Homo sapiens
ugggaagcuauuucc

SEQ ID NO: 2152411 - RNA, 15 nt, Homo sapiens
agugggacuguggug

SEQ ID NO: 2152412 - RNA, 18 nt, Homo sapiens
augacaaugaugaugaua

SEQ ID NO: 2152413 - RNA, 14 nt, Homo sapiens
uaagcaaauuuugu

SEQ ID NO: 2152414 - RNA, 16 nt, Homo sapiens
cuccuccacucugagc

SEQ ID NO: 2152415 - RNA, 19 nt, Homo sapiens
gcccaggcucaagcccuag

SEQ ID NO: 2152416 - RNA, 20 nt, Homo sapiens
gggagguggagguugcagug

SEQ ID NO: 2152417 - RNA, 13 nt, Homo sapiens
uuucucauuaaau

SEQ ID NO: 2152418 - RNA, 13 nt, Homo sapiens
aguacugaugaaa

SEQ ID NO: 2152419 - RNA, 16 nt, Homo sapiens
gauggaacaugcccac

SEQ ID NO: 2152420 - RNA, 17 nt, Homo sapiens
uuaaaaacaguuuucca

SEQ ID NO: 2152421 - RNA, 14 nt, Homo sapiens
gacaguaacacugg

SEQ ID NO: 2152422 - RNA, 15 nt, Homo sapiens
cgcacacacaccgau

SEQ ID NO: 2152423 - RNA, 19 nt, Homo sapiens
uuauucacuugugugugua

SEQ ID NO: 2152424 - RNA, 16 nt, Homo sapiens
ugucuaguagaacaau

SEQ ID NO: 2152425 - RNA, 21 nt, Homo sapiens
ggguuuggcaaaacucaggca

SEQ ID NO: 2152426 - RNA, 20 nt, Homo sapiens
uaacuaccuaaacauguuau

SEQ ID NO: 2152427 - RNA, 16 nt, Homo sapiens
gugaaagcuagacuga

SEQ ID NO: 2152428 - RNA, 16 nt, Homo sapiens
acaaucagcccagugc

SEQ ID NO: 2152429 - RNA, 22 nt, Homo sapiens
aaugauaaacucagaucugauc

SEQ ID NO: 2152430 - RNA, 14 nt, Homo sapiens
uucggucuuuccca

SEQ ID NO: 2152431 - RNA, 20 nt, Homo sapiens
agccugaauaaaccaagaca

SEQ ID NO: 2152432 - RNA, 19 nt, Homo sapiens
ugaguaauaaagauacaaa

SEQ ID NO: 2152433 - RNA, 15 nt, Homo sapiens
uggcaaaugaaaguu

SEQ ID NO: 2152434 - RNA, 19 nt, Homo sapiens
cauguggaugacacaaucc

SEQ ID NO: 2152435 - RNA, 22 nt, Homo sapiens
ucacaauaaaaauggcucagau

SEQ ID NO: 2152436 - RNA, 15 nt, Homo sapiens
ugagacguccuuucc

SEQ ID NO: 2152437 - RNA, 19 nt, Homo sapiens
auucuguaugccaagugaa

SEQ ID NO: 2152438 - RNA, 18 nt, Homo sapiens
ggcugacccagugugugc

SEQ ID NO: 2152439 - RNA, 22 nt, Homo sapiens
ggauuguauuuaagacauaaac

SEQ ID NO: 2152440 - RNA, 14 nt, Homo sapiens
caucugauuuacuu

SEQ ID NO: 2152441 - RNA, 16 nt, Homo sapiens
ggggcuggcaccagca

SEQ ID NO: 2152442 - RNA, 15 nt, Homo sapiens
aaauaaacacugugu

SEQ ID NO: 2152443 - RNA, 19 nt, Homo sapiens
gggcugcugggagccucuc

SEQ ID NO: 2152444 - RNA, 20 nt, Homo sapiens
gaucugcuuucuguucaucu

SEQ ID NO: 2152445 - RNA, 20 nt, Homo sapiens
cuccacggacccauucauac

SEQ ID NO: 2152446 - RNA, 18 nt, Homo sapiens
gugcacaggcgcauccca

SEQ ID NO: 2152447 - RNA, 13 nt, Homo sapiens
uuugaacugcagc

SEQ ID NO: 2152448 - RNA, 17 nt, Homo sapiens
uuaaaagacaaauaugu

SEQ ID NO: 2152449 - RNA, 20 nt, Homo sapiens
guauauuucucuuugucaga

SEQ ID NO: 2152450 - RNA, 18 nt, Homo sapiens
uccaggccaaagccccau

SEQ ID NO: 2152451 - RNA, 19 nt, Homo sapiens
aaauuuuuaucuuacuuuu

SEQ ID NO: 2152452 - RNA, 23 nt, Homo sapiens
auuuugacaaagugccucaugca

SEQ ID NO: 2152453 - RNA, 15 nt, Homo sapiens
uacagguuacaacag

SEQ ID NO: 2152454 - RNA, 19 nt, Homo sapiens
agguaccaguuguauuuaa

SEQ ID NO: 2152455 - RNA, 14 nt, Homo sapiens
ggcaugaaccacug

SEQ ID NO: 2152456 - RNA, 16 nt, Homo sapiens
ccuucuaauccaugug

SEQ ID NO: 2152457 - RNA, 16 nt, Homo sapiens
cacuucacuuucuuca

SEQ ID NO: 2152458 - RNA, 17 nt, Homo sapiens
gauaauuguacuuugaa

SEQ ID NO: 2152459 - RNA, 19 nt, Homo sapiens
aacacacugagacuugaau

SEQ ID NO: 2152460 - RNA, 15 nt, Homo sapiens
accaaugucauaaca

SEQ ID NO: 2152461 - RNA, 14 nt, Homo sapiens
guaaaacauuacuu

SEQ ID NO: 2152462 - RNA, 13 nt, Homo sapiens
auguuaugcauaa

SEQ ID NO: 2152463 - RNA, 13 nt, Homo sapiens
augaaaugcauuu

SEQ ID NO: 2152464 - RNA, 15 nt, Homo sapiens
ucaguguggaaaauu

SEQ ID NO: 2152465 - RNA, 18 nt, Homo sapiens
ccaaguugaagacuuugu

SEQ ID NO: 2152466 - RNA, 14 nt, Homo sapiens
cuuaucaccugcca

SEQ ID NO: 2152467 - RNA, 20 nt, Homo sapiens
gagauauuuauuaaacacca

SEQ ID NO: 2152468 - RNA, 23 nt, Homo sapiens
agacagguaaaugggcagugccu

SEQ ID NO: 2152469 - RNA, 22 nt, Homo sapiens
ucuguacauuuuguuguaaaaa

SEQ ID NO: 2152470 - RNA, 19 nt, Homo sapiens
ucaaaaaucauuaacacuu

SEQ ID NO: 2152471 - RNA, 23 nt, Homo sapiens
caggccaauguaucccugaggaa

SEQ ID NO: 2152472 - RNA, 18 nt, Homo sapiens
cagugcaccuacugcuua

SEQ ID NO: 2152473 - RNA, 22 nt, Homo sapiens
aacuaaggugcuaaaucugcga

SEQ ID NO: 2152474 - RNA, 17 nt, Homo sapiens
caccagccuaagaagcu

SEQ ID NO: 2152475 - RNA, 17 nt, Homo sapiens
ccucgccuguuccccaa

SEQ ID NO: 2152476 - RNA, 22 nt, Homo sapiens
agauguucauccuaacaugaca

SEQ ID NO: 2152477 - RNA, 18 nt, Homo sapiens
caacuuuuaauuacuguu

SEQ ID NO: 2152478 - RNA, 22 nt, Homo sapiens
aagaccauaacagccaacaggu

SEQ ID NO: 2152479 - RNA, 13 nt, Homo sapiens
uugaacuuugacc

SEQ ID NO: 2152480 - RNA, 15 nt, Homo sapiens
ccagcaggacaguga

SEQ ID NO: 2152481 - RNA, 16 nt, Homo sapiens
caucacccucuuccug

SEQ ID NO: 2152482 - RNA, 18 nt, Homo sapiens
gcgcuguguacaauguga

SEQ ID NO: 2152483 - RNA, 16 nt, Homo sapiens
gcugcuccagugcagg

SEQ ID NO: 2152484 - RNA, 23 nt, Homo sapiens
aacaauaagacaugcuuacuuuu

SEQ ID NO: 2152485 - RNA, 11 nt, Homo sapiens
ucugagccuug

SEQ ID NO: 2152486 - RNA, 17 nt, Homo sapiens
acuauuuuuuuaguuaa

SEQ ID NO: 2152487 - RNA, 15 nt, Homo sapiens
ccugcaggaguuucu

SEQ ID NO: 2152488 - RNA, 18 nt, Homo sapiens
acagugaaggcuguccuu

SEQ ID NO: 2152489 - RNA, 14 nt, Homo sapiens
guggcagcaagcaa

SEQ ID NO: 2152490 - RNA, 22 nt, Homo sapiens
ccagguuuaaccguugcgucac

SEQ ID NO: 2152491 - RNA, 13 nt, Homo sapiens
agccugggaccag

SEQ ID NO: 2152492 - RNA, 15 nt, Homo sapiens
uacacagacuauuga

SEQ ID NO: 2152493 - RNA, 23 nt, Homo sapiens
cccacagcgcucgauggaccuca

SEQ ID NO: 2152494 - RNA, 22 nt, Homo sapiens
uuaaaauucuccuguaacucaa

SEQ ID NO: 2152495 - RNA, 22 nt, Homo sapiens
accaaaaacauuugauuaauaa

SEQ ID NO: 2152496 - RNA, 20 nt, Homo sapiens
ccuguucucuuccacucucc

SEQ ID NO: 2152497 - RNA, 15 nt, Homo sapiens
cuguuucauagcaaa

SEQ ID NO: 2152498 - RNA, 15 nt, Homo sapiens
ucugaacuguggaau

SEQ ID NO: 2152499 - RNA, 22 nt, Homo sapiens
aacucaacugucuauugucaca

SEQ ID NO: 2152500 - RNA, 20 nt, Homo sapiens
ccagugaagacgucaggggc

SEQ ID NO: 2152501 - RNA, 14 nt, Homo sapiens
caagugugucuuac

SEQ ID NO: 2152502 - RNA, 20 nt, Homo sapiens
acuuguaacuaaaguauuua

SEQ ID NO: 2152503 - RNA, 14 nt, Homo sapiens
cuacccugcacauu

SEQ ID NO: 2152504 - RNA, 17 nt, Homo sapiens
gaccuuccacacagggu

SEQ ID NO: 2152505 - RNA, 20 nt, Homo sapiens
gccaugugaaacucaucuca

SEQ ID NO: 2152506 - RNA, 18 nt, Homo sapiens
uaauggaugguugaauua

SEQ ID NO: 2152507 - RNA, 15 nt, Homo sapiens
cacgucuugcuauuu

SEQ ID NO: 2152508 - RNA, 15 nt, Homo sapiens
ucaugugauaacuga

SEQ ID NO: 2152509 - RNA, 16 nt, Homo sapiens
augucuuuaaugcaau

SEQ ID NO: 2152510 - RNA, 23 nt, Homo sapiens
cagcaucaaagagauggugcuaa

SEQ ID NO: 2152511 - RNA, 18 nt, Homo sapiens
uucuagcauggcugccaa

SEQ ID NO: 2152512 - RNA, 15 nt, Homo sapiens
aaacucaucacauaa

SEQ ID NO: 2152513 - RNA, 22 nt, Homo sapiens
aaccaagcagaauguacuugau

SEQ ID NO: 2152514 - RNA, 21 nt, Homo sapiens
cauccuacccccugugccuug

SEQ ID NO: 2152515 - RNA, 16 nt, Homo sapiens
cugagggguggccauc

SEQ ID NO: 2152516 - RNA, 19 nt, Homo sapiens
uagaaauacccaacgcaca

SEQ ID NO: 2152517 - RNA, 22 nt, Homo sapiens
cuagaaucauacuuaacauuuc

SEQ ID NO: 2152518 - RNA, 14 nt, Homo sapiens
cugaaacuggagua

SEQ ID NO: 2152519 - RNA, 23 nt, Homo sapiens
ucuggaggacguggacuggggua

SEQ ID NO: 2152520 - RNA, 15 nt, Homo sapiens
cuguaauccuagcua

SEQ ID NO: 2152521 - RNA, 15 nt, Homo sapiens
cuauucuuaagcacu

SEQ ID NO: 2152522 - RNA, 22 nt, Homo sapiens
cuugaccaguauaaaauuacag

SEQ ID NO: 2152523 - RNA, 19 nt, Homo sapiens
cuucagacacaggaaaaau

SEQ ID NO: 2152524 - RNA, 21 nt, Homo sapiens
ucuccccgaaagggacacaau

SEQ ID NO: 2152525 - RNA, 22 nt, Homo sapiens
ugaaaucagaagccuacuuuga

SEQ ID NO: 2152526 - RNA, 14 nt, Homo sapiens
ccaaaaagaguuac

SEQ ID NO: 2152527 - RNA, 11 nt, Homo sapiens
ugugugccuuu

SEQ ID NO: 2152528 - RNA, 22 nt, Homo sapiens
gcucauuugagauaaagucaaa

SEQ ID NO: 2152529 - RNA, 19 nt, Homo sapiens
guggcaagagggaauguca

SEQ ID NO: 2152530 - RNA, 16 nt, Homo sapiens
agcagccaccccaugc

SEQ ID NO: 2152531 - RNA, 13 nt, Homo sapiens
cuuugucccagaa

SEQ ID NO: 2152532 - RNA, 19 nt, Homo sapiens
gagacauugaggcaggcac

SEQ ID NO: 2152533 - RNA, 13 nt, Homo sapiens
cuugagccuguga

SEQ ID NO: 2152534 - RNA, 12 nt, Homo sapiens
auauugaugaaa

SEQ ID NO: 2152535 - RNA, 18 nt, Homo sapiens
aaggggaggggaugucag

SEQ ID NO: 2152536 - RNA, 19 nt, Homo sapiens
cagaauuuuuaacuguacu

SEQ ID NO: 2152537 - RNA, 11 nt, Homo sapiens
uucuaccucag

SEQ ID NO: 2152538 - RNA, 12 nt, Homo sapiens
gauaacuuugac

SEQ ID NO: 2152539 - RNA, 18 nt, Homo sapiens
aauugcaguuuacaguau

SEQ ID NO: 2152540 - RNA, 22 nt, Homo sapiens
gcucgggucccuucaccuccuc

SEQ ID NO: 2152541 - RNA, 21 nt, Homo sapiens
cagccucauccuccccaggac

SEQ ID NO: 2152542 - RNA, 15 nt, Homo sapiens
uuuuguuacuugcac

SEQ ID NO: 2152543 - RNA, 17 nt, Homo sapiens
gcugagccuggucccac

SEQ ID NO: 2152544 - RNA, 18 nt, Homo sapiens
uaaauacaaucacauuaa

SEQ ID NO: 2152545 - RNA, 23 nt, Homo sapiens
cguaaugcauugccuguaacaau

SEQ ID NO: 2152546 - RNA, 22 nt, Homo sapiens
uggaaauaacugagcacuuuga

SEQ ID NO: 2152547 - RNA, 14 nt, Homo sapiens
ucgcuucuugccuc

SEQ ID NO: 2152548 - RNA, 19 nt, Homo sapiens
acaaucauguucugguggu

SEQ ID NO: 2152549 - RNA, 12 nt, Homo sapiens
ccaucacuggag

SEQ ID NO: 2152550 - RNA, 20 nt, Homo sapiens
ugguggcucacaccugcaau

SEQ ID NO: 2152551 - RNA, 22 nt, Homo sapiens
uuuauggcagacauugugcuag

SEQ ID NO: 2152552 - RNA, 20 nt, Homo sapiens
ugagggagggagccauggaa

SEQ ID NO: 2152553 - RNA, 19 nt, Homo sapiens
uuucaaagauguguugcua

SEQ ID NO: 2152554 - RNA, 19 nt, Homo sapiens
ccauguuuuugcaaauacu

SEQ ID NO: 2152555 - RNA, 15 nt, Homo sapiens
uccucugauucuguu

SEQ ID NO: 2152556 - RNA, 19 nt, Homo sapiens
agccacacaaacguuuacu

SEQ ID NO: 2152557 - RNA, 21 nt, Homo sapiens
ucugaauaaaguguaacaauu

SEQ ID NO: 2152558 - RNA, 20 nt, Homo sapiens
agcaaagcgcuaaguaaaaa

SEQ ID NO: 2152559 - RNA, 13 nt, Homo sapiens
cauuuauguacaa

SEQ ID NO: 2152560 - RNA, 15 nt, Homo sapiens
acccccuuuucccuu

SEQ ID NO: 2152561 - RNA, 15 nt, Homo sapiens
acauauuuuuauacu

SEQ ID NO: 2152562 - RNA, 13 nt, Homo sapiens
ucucuauaccaau

SEQ ID NO: 2152563 - RNA, 16 nt, Homo sapiens
cgccagugugcugucg

SEQ ID NO: 2152564 - RNA, 14 nt, Homo sapiens
uugcagaacugcca

SEQ ID NO: 2152565 - RNA, 15 nt, Homo sapiens
ugaaucuugucccag

SEQ ID NO: 2152566 - RNA, 23 nt, Homo sapiens
ucacgaacuguucacacugcaga

SEQ ID NO: 2152567 - RNA, 12 nt, Homo sapiens
aguguggcccag

SEQ ID NO: 2152568 - RNA, 15 nt, Homo sapiens
gaaugauaagcagga

SEQ ID NO: 2152569 - RNA, 23 nt, Homo sapiens
ggcucucaggugccagucuucca

SEQ ID NO: 2152570 - RNA, 22 nt, Homo sapiens
aacuguacauacugcaguguga

SEQ ID NO: 2152571 - RNA, 16 nt, Homo sapiens
accacacauauugcac

SEQ ID NO: 2152572 - RNA, 18 nt, Homo sapiens
aguauaaugcaguacauu

SEQ ID NO: 2152573 - RNA, 23 nt, Homo sapiens
auucucuguuugucuguugugga

SEQ ID NO: 2152574 - RNA, 12 nt, Homo sapiens
uaaaacauuccc

SEQ ID NO: 2152575 - RNA, 18 nt, Homo sapiens
gaauuugaguuggaucau

SEQ ID NO: 2152576 - RNA, 16 nt, Homo sapiens
gugucgagaagcaaca

SEQ ID NO: 2152577 - RNA, 20 nt, Homo sapiens
ucccgaguagcugggauuac

SEQ ID NO: 2152578 - RNA, 22 nt, Homo sapiens
guguguucaugcaacagccaua

SEQ ID NO: 2152579 - RNA, 20 nt, Homo sapiens
ugggccagugaacaggguaa

SEQ ID NO: 2152580 - RNA, 19 nt, Homo sapiens
uguuuaaauucucuuucac

SEQ ID NO: 2152581 - RNA, 15 nt, Homo sapiens
ugcuccguuggucag

SEQ ID NO: 2152582 - RNA, 14 nt, Homo sapiens
gugggaacggcuga

SEQ ID NO: 2152583 - RNA, 18 nt, Homo sapiens
gaggccaggcagauccca

SEQ ID NO: 2152584 - RNA, 12 nt, Homo sapiens
uauuuuuugcca

SEQ ID NO: 2152585 - RNA, 15 nt, Homo sapiens
ucugguaaugaagca

SEQ ID NO: 2152586 - RNA, 21 nt, Homo sapiens
cugugacaaugacuaagccaa

SEQ ID NO: 2152587 - RNA, 12 nt, Homo sapiens
uaaauaucucaa

SEQ ID NO: 2152588 - RNA, 15 nt, Homo sapiens
caaggaaauuugcaa

SEQ ID NO: 2152589 - RNA, 15 nt, Homo sapiens
caccuuggauuaaaa

SEQ ID NO: 2152590 - RNA, 13 nt, Homo sapiens
aacagugcccaag

SEQ ID NO: 2152591 - RNA, 18 nt, Homo sapiens
ucacauucgaauucgggu

SEQ ID NO: 2152592 - RNA, 14 nt, Homo sapiens
caauacauaccacg

SEQ ID NO: 2152593 - RNA, 22 nt, Homo sapiens
auaucuccuccaauguccugaa

SEQ ID NO: 2152594 - RNA, 18 nt, Homo sapiens
agaaauacaagauacuuu

SEQ ID NO: 2152595 - RNA, 22 nt, Homo sapiens
cacauacguaaaaaucucucau

SEQ ID NO: 2152596 - RNA, 18 nt, Homo sapiens
gaaaaggcagcauuugaa

SEQ ID NO: 2152597 - RNA, 17 nt, Homo sapiens
cgugucucauuugccag

SEQ ID NO: 2152598 - RNA, 23 nt, Homo sapiens
cgcuuaugguuuuaaugcaauga

SEQ ID NO: 2152599 - RNA, 14 nt, Homo sapiens
uacaggcacaaaau

SEQ ID NO: 2152600 - RNA, 17 nt, Homo sapiens
gcuaaccucacugccuc

SEQ ID NO: 2152601 - RNA, 12 nt, Homo sapiens
cuccaacuccaa

SEQ ID NO: 2152602 - RNA, 23 nt, Homo sapiens
cagcuucccucugccugacccca

SEQ ID NO: 2152603 - RNA, 22 nt, Homo sapiens
uuaccuucaaaggccaagagaa

SEQ ID NO: 2152604 - RNA, 18 nt, Homo sapiens
uccugcauagucuguucc

SEQ ID NO: 2152605 - RNA, 21 nt, Homo sapiens
aaucagauuagacacuaugug

SEQ ID NO: 2152606 - RNA, 19 nt, Homo sapiens
agccuaugauauuccccau

SEQ ID NO: 2152607 - RNA, 17 nt, Homo sapiens
ccuugagaagcugccau

SEQ ID NO: 2152608 - RNA, 22 nt, Homo sapiens
agcaaaaccaaauauuccagag

SEQ ID NO: 2152609 - RNA, 19 nt, Homo sapiens
aacuguagcucaaguuuaa

SEQ ID NO: 2152610 - RNA, 17 nt, Homo sapiens
uucggauuuggggugga

SEQ ID NO: 2152611 - RNA, 14 nt, Homo sapiens
ugaacucccgccac

SEQ ID NO: 2152612 - RNA, 17 nt, Homo sapiens
agucaaaacuacaaauc

SEQ ID NO: 2152613 - RNA, 19 nt, Homo sapiens
ccauaauugcuuugccaaa

SEQ ID NO: 2152614 - RNA, 21 nt, Homo sapiens
aggagaacugcuguguucuca

SEQ ID NO: 2152615 - RNA, 23 nt, Homo sapiens
caaugugcuguugauucuuucaa

SEQ ID NO: 2152616 - RNA, 18 nt, Homo sapiens
aaagaauuaaugcucuaa

SEQ ID NO: 2152617 - RNA, 16 nt, Homo sapiens
guggccaggcugccug

SEQ ID NO: 2152618 - RNA, 16 nt, Homo sapiens
cucugaacuugccuua

SEQ ID NO: 2152619 - RNA, 17 nt, Homo sapiens
gaauuuauucaauuccu

SEQ ID NO: 2152620 - RNA, 15 nt, Homo sapiens
gcugauuauucacua

SEQ ID NO: 2152621 - RNA, 14 nt, Homo sapiens
ggacagucaccuau

SEQ ID NO: 2152622 - RNA, 17 nt, Homo sapiens
gagccaauggcccggcc

SEQ ID NO: 2152623 - RNA, 23 nt, Homo sapiens
ugaggacagaaggacuggugcga

SEQ ID NO: 2152624 - RNA, 21 nt, Homo sapiens
gaucaauaaaugucagcauug

SEQ ID NO: 2152625 - RNA, 21 nt, Homo sapiens
cuccuugguaaauacaacaca

SEQ ID NO: 2152626 - RNA, 17 nt, Homo sapiens
gacugcauggagucuuc

SEQ ID NO: 2152627 - RNA, 22 nt, Homo sapiens
gcuaugaaaaugagcccuggcu

SEQ ID NO: 2152628 - RNA, 17 nt, Homo sapiens
gccucuuccugcagccu

SEQ ID NO: 2152629 - RNA, 22 nt, Homo sapiens
gcacaaacugcagcugugagug

SEQ ID NO: 2152630 - RNA, 19 nt, Homo sapiens
cagagagccuggugcugcu

SEQ ID NO: 2152631 - RNA, 20 nt, Homo sapiens
aggcuggcuccagaugcagg

SEQ ID NO: 2152632 - RNA, 12 nt, Homo sapiens
aagccuccucau

SEQ ID NO: 2152633 - RNA, 15 nt, Homo sapiens
gggauggguuugcuu

SEQ ID NO: 2152634 - RNA, 17 nt, Homo sapiens
cuuuguggauacuauua

SEQ ID NO: 2152635 - RNA, 19 nt, Homo sapiens
uguuauacuucuguacaca

SEQ ID NO: 2152636 - RNA, 18 nt, Homo sapiens
acuccaaccagaagugaa

SEQ ID NO: 2152637 - RNA, 19 nt, Homo sapiens
cuguucuaaguccacuuaa

SEQ ID NO: 2152638 - RNA, 13 nt, Homo sapiens
ugcagcugaugcc

SEQ ID NO: 2152639 - RNA, 12 nt, Homo sapiens
ugcagguggugu

SEQ ID NO: 2152640 - RNA, 16 nt, Homo sapiens
gccuggggauucugag

SEQ ID NO: 2152641 - RNA, 20 nt, Homo sapiens
ccucagaaggccccagagag

SEQ ID NO: 2152642 - RNA, 12 nt, Homo sapiens
aagauuacuuuu

SEQ ID NO: 2152643 - RNA, 23 nt, Homo sapiens
gaaaguggccaugccacccuguu

SEQ ID NO: 2152644 - RNA, 19 nt, Homo sapiens
uucccauuuuggaaccuaa

SEQ ID NO: 2152645 - RNA, 14 nt, Homo sapiens
uaaaugccuuccac

SEQ ID NO: 2152646 - RNA, 15 nt, Homo sapiens
uauuuuacugaucuc

SEQ ID NO: 2152647 - RNA, 12 nt, Homo sapiens
ugcucugccauc

SEQ ID NO: 2152648 - RNA, 17 nt, Homo sapiens
gucaccccaacucugug

SEQ ID NO: 2152649 - RNA, 20 nt, Homo sapiens
agcaggaggcuuucugggcu

SEQ ID NO: 2152650 - RNA, 12 nt, Homo sapiens
aaaaaaucugac

SEQ ID NO: 2152651 - RNA, 15 nt, Homo sapiens
auggucucgaucucc

SEQ ID NO: 2152652 - RNA, 14 nt, Homo sapiens
uaucugaggucaca

SEQ ID NO: 2152653 - RNA, 13 nt, Homo sapiens
aucugaggcacau

SEQ ID NO: 2152654 - RNA, 10 nt, Homo sapiens
guuucuugcc

SEQ ID NO: 2152655 - RNA, 16 nt, Homo sapiens
ccuauucuauugcagu

SEQ ID NO: 2152656 - RNA, 20 nt, Homo sapiens
cacauccaccccacuggauc

SEQ ID NO: 2152657 - RNA, 17 nt, Homo sapiens
cucucggcuucaccagg

SEQ ID NO: 2152658 - RNA, 16 nt, Homo sapiens
caugccuauuucugaa

SEQ ID NO: 2152659 - RNA, 20 nt, Homo sapiens
gccauccaugugcuagucac

SEQ ID NO: 2152660 - RNA, 17 nt, Homo sapiens
auuuguugagaguguga

SEQ ID NO: 2152661 - RNA, 19 nt, Homo sapiens
auguauauuuucagugggu

SEQ ID NO: 2152662 - RNA, 22 nt, Homo sapiens
uauucuuuuguauaacuacuaa

SEQ ID NO: 2152663 - RNA, 12 nt, Homo sapiens
uccacugucuca

SEQ ID NO: 2152664 - RNA, 13 nt, Homo sapiens
gcugagugccuga

SEQ ID NO: 2152665 - RNA, 22 nt, Homo sapiens
ccucacuucuuuccucaaagaa

SEQ ID NO: 2152666 - RNA, 13 nt, Homo sapiens
auuugcacauuaa

SEQ ID NO: 2152667 - RNA, 13 nt, Homo sapiens
gugaacacgugug

SEQ ID NO: 2152668 - RNA, 13 nt, Homo sapiens
ucucacucucuuc

SEQ ID NO: 2152669 - RNA, 20 nt, Homo sapiens
ccucaggugugccuguugcu

SEQ ID NO: 2152670 - RNA, 17 nt, Homo sapiens
uucugaggacauuccaa

SEQ ID NO: 2152671 - RNA, 20 nt, Homo sapiens
caggaauauuuccuccauuc

SEQ ID NO: 2152672 - RNA, 17 nt, Homo sapiens
uuuacucauaaguaaaa

SEQ ID NO: 2152673 - RNA, 22 nt, Homo sapiens
aucccuuaaccugccaccagug

SEQ ID NO: 2152674 - RNA, 14 nt, Homo sapiens
uauagauguuuauu

SEQ ID NO: 2152675 - RNA, 20 nt, Homo sapiens
ucugagaaaaggcaaaagaa

SEQ ID NO: 2152676 - RNA, 16 nt, Homo sapiens
uuuaaugcugcuacaa

SEQ ID NO: 2152677 - RNA, 18 nt, Homo sapiens
ugauuguugucaggccau

SEQ ID NO: 2152678 - RNA, 20 nt, Homo sapiens
uggauuaaacuuaaucuaaa

SEQ ID NO: 2152679 - RNA, 17 nt, Homo sapiens
aagcuauucucaugccu

SEQ ID NO: 2152680 - RNA, 15 nt, Homo sapiens
cuguggggaccccag

SEQ ID NO: 2152681 - RNA, 15 nt, Homo sapiens
uccugcugaaacugc

SEQ ID NO: 2152682 - RNA, 15 nt, Homo sapiens
gccauuuuguguuuu

SEQ ID NO: 2152683 - RNA, 15 nt, Homo sapiens
gccuucuugugaucu

SEQ ID NO: 2152684 - RNA, 18 nt, Homo sapiens
gaaggaauagccagagag

SEQ ID NO: 2152685 - RNA, 13 nt, Homo sapiens
ugaaugcucugua

SEQ ID NO: 2152686 - RNA, 15 nt, Homo sapiens
ggugaagaguccaag

SEQ ID NO: 2152687 - RNA, 14 nt, Homo sapiens
uacugugagacugu

SEQ ID NO: 2152688 - RNA, 22 nt, Homo sapiens
uaaauucuggaaaugucuuucu

SEQ ID NO: 2152689 - RNA, 19 nt, Homo sapiens
uuguaugucauuuccuuca

SEQ ID NO: 2152690 - RNA, 17 nt, Homo sapiens
agguaauuucuugugcc

SEQ ID NO: 2152691 - RNA, 18 nt, Homo sapiens
auugauagcagauaucac

SEQ ID NO: 2152692 - RNA, 18 nt, Homo sapiens
cucacaggccccaggaaa

SEQ ID NO: 2152693 - RNA, 20 nt, Homo sapiens
caagcagugaaauaugauaa

SEQ ID NO: 2152694 - RNA, 19 nt, Homo sapiens
cggcuaagaggcugcugaa

SEQ ID NO: 2152695 - RNA, 23 nt, Homo sapiens
gaaaaugaaccauucacagugca

SEQ ID NO: 2152696 - RNA, 16 nt, Homo sapiens
cucaagguuacuggga

SEQ ID NO: 2152697 - RNA, 15 nt, Homo sapiens
agcauuuucauaucc

SEQ ID NO: 2152698 - RNA, 20 nt, Homo sapiens
gucuucccuucugauugaug

SEQ ID NO: 2152699 - RNA, 16 nt, Homo sapiens
ucgccaccccuccuuc

SEQ ID NO: 2152700 - RNA, 14 nt, Homo sapiens
cugaucauuacaug

SEQ ID NO: 2152701 - RNA, 20 nt, Homo sapiens
caacauugcuuccuaaacuu

SEQ ID NO: 2152702 - RNA, 14 nt, Homo sapiens
uacaugcaauuuau

SEQ ID NO: 2152703 - RNA, 23 nt, Homo sapiens
cugauuuugucacugucuucaca

SEQ ID NO: 2152704 - RNA, 13 nt, Homo sapiens
ccaagaacuugca

SEQ ID NO: 2152705 - RNA, 19 nt, Homo sapiens
cuagacaccuucugugcuc

SEQ ID NO: 2152706 - RNA, 18 nt, Homo sapiens
uguuccaccuucccucau

SEQ ID NO: 2152707 - RNA, 12 nt, Homo sapiens
agcugccuaccu

SEQ ID NO: 2152708 - RNA, 22 nt, Homo sapiens
aaguugacuuauaguacaugau

SEQ ID NO: 2152709 - RNA, 23 nt, Homo sapiens
gcuggugccccacagcuaccuga

SEQ ID NO: 2152710 - RNA, 14 nt, Homo sapiens
uaggaauaugacca

SEQ ID NO: 2152711 - RNA, 17 nt, Homo sapiens
aacacuggcgagcaggu

SEQ ID NO: 2152712 - RNA, 21 nt, Homo sapiens
aaauucauuaguuguuaguga

SEQ ID NO: 2152713 - RNA, 17 nt, Homo sapiens
gccucuccagcacuucu

SEQ ID NO: 2152714 - RNA, 18 nt, Homo sapiens
caagugcgccaaggagaa

SEQ ID NO: 2152715 - RNA, 22 nt, Homo sapiens
aguucaaauucuucugaacuca

SEQ ID NO: 2152716 - RNA, 20 nt, Homo sapiens
agucuuuauuguguaucaua

SEQ ID NO: 2152717 - RNA, 12 nt, Homo sapiens
gggauggccaca

SEQ ID NO: 2152718 - RNA, 14 nt, Homo sapiens
ugcacauguacaua

SEQ ID NO: 2152719 - RNA, 13 nt, Homo sapiens
acggcuuacaugu

SEQ ID NO: 2152720 - RNA, 21 nt, Homo sapiens
aaugaagacucgcaauuucac

SEQ ID NO: 2152721 - RNA, 19 nt, Homo sapiens
caggcugcagugcaauggc

SEQ ID NO: 2152722 - RNA, 17 nt, Homo sapiens
agaggaccuccaugccc

SEQ ID NO: 2152723 - RNA, 22 nt, Homo sapiens
ugucaagacaaggucuugcuau

SEQ ID NO: 2152724 - RNA, 19 nt, Homo sapiens
aaaccccaucuuuacuaaa

SEQ ID NO: 2152725 - RNA, 11 nt, Homo sapiens
caagugccaua

SEQ ID NO: 2152726 - RNA, 12 nt, Homo sapiens
gguuaaaggcca

SEQ ID NO: 2152727 - RNA, 16 nt, Homo sapiens
auggugacuuuugaaa

SEQ ID NO: 2152728 - RNA, 17 nt, Homo sapiens
gucacaauuaaugaaau

SEQ ID NO: 2152729 - RNA, 23 nt, Homo sapiens
gaaauaauuguugauuaauuuga

SEQ ID NO: 2152730 - RNA, 17 nt, Homo sapiens
ccuggauggcugccuca

SEQ ID NO: 2152731 - RNA, 22 nt, Homo sapiens
uuagcaaacuuuguaugucauu

SEQ ID NO: 2152732 - RNA, 23 nt, Homo sapiens
gagguggaaaauggugccuggag

SEQ ID NO: 2152733 - RNA, 18 nt, Homo sapiens
agaauuauacagaccuaa

SEQ ID NO: 2152734 - RNA, 23 nt, Homo sapiens
ggcaagauaaaccaaugucauaa

SEQ ID NO: 2152735 - RNA, 12 nt, Homo sapiens
uuaauaugucaa

SEQ ID NO: 2152736 - RNA, 13 nt, Homo sapiens
ucgcucuuuucaa

SEQ ID NO: 2152737 - RNA, 18 nt, Homo sapiens
caguagcugccaaaaaga

SEQ ID NO: 2152738 - RNA, 15 nt, Homo sapiens
uggaauggagauuca

SEQ ID NO: 2152739 - RNA, 16 nt, Homo sapiens
uucuacagagugagac

SEQ ID NO: 2152740 - RNA, 16 nt, Homo sapiens
uaacaaaagcaauugu

SEQ ID NO: 2152741 - RNA, 16 nt, Homo sapiens
aaucucugaauuugag

SEQ ID NO: 2152742 - RNA, 17 nt, Homo sapiens
agggcccuccgaccacu

SEQ ID NO: 2152743 - RNA, 19 nt, Homo sapiens
guuuaugauauuucuugcu

SEQ ID NO: 2152744 - RNA, 16 nt, Homo sapiens
cuagcucuaguucaaa

SEQ ID NO: 2152745 - RNA, 17 nt, Homo sapiens
caggguggaugaucuca

SEQ ID NO: 2152746 - RNA, 17 nt, Homo sapiens
gcccagacacagacugg

SEQ ID NO: 2152747 - RNA, 21 nt, Homo sapiens
cauaaagagguaaaaaacugu

SEQ ID NO: 2152748 - RNA, 17 nt, Homo sapiens
aguucaauugugaaaau

SEQ ID NO: 2152749 - RNA, 15 nt, Homo sapiens
aagacaaaaccaaaa

SEQ ID NO: 2152750 - RNA, 17 nt, Homo sapiens
acaaagcuggguuugau

SEQ ID NO: 2152751 - RNA, 22 nt, Homo sapiens
uuguaauggcucccaaauucca

SEQ ID NO: 2152752 - RNA, 15 nt, Homo sapiens
uaaggggaugggggu

SEQ ID NO: 2152753 - RNA, 22 nt, Homo sapiens
caccaagugaggccauagcaau

SEQ ID NO: 2152754 - RNA, 15 nt, Homo sapiens
auuuaaauuaucaca

SEQ ID NO: 2152755 - RNA, 22 nt, Homo sapiens
gggcacugaccaggcccaagga

SEQ ID NO: 2152756 - RNA, 18 nt, Homo sapiens
guacauucuagcugagaa

SEQ ID NO: 2152757 - RNA, 19 nt, Homo sapiens
aguagcaggucaaaaaccu

SEQ ID NO: 2152758 - RNA, 19 nt, Homo sapiens
acugcacccuguuuaacau

SEQ ID NO: 2152759 - RNA, 18 nt, Homo sapiens
acuuuuuacagugcuauu

SEQ ID NO: 2152760 - RNA, 12 nt, Homo sapiens
ucugaccuguac

SEQ ID NO: 2152761 - RNA, 14 nt, Homo sapiens
gaccuggcaucuug

SEQ ID NO: 2152762 - RNA, 21 nt, Homo sapiens
gcaagauuucacaucagcuuu

SEQ ID NO: 2152763 - RNA, 21 nt, Homo sapiens
cuuucaagugagacccaaagg

SEQ ID NO: 2152764 - RNA, 15 nt, Homo sapiens
accacacuucuugaa

SEQ ID NO: 2152765 - RNA, 22 nt, Homo sapiens
cacuguuuuuuucccagguguu

SEQ ID NO: 2152766 - RNA, 22 nt, Homo sapiens
cacuugcucaugcccugccaag

SEQ ID NO: 2152767 - RNA, 23 nt, Homo sapiens
auacaaaaauuccuuuucccgaa

SEQ ID NO: 2152768 - RNA, 15 nt, Homo sapiens
cuucuuuuuaaucuu

SEQ ID NO: 2152769 - RNA, 11 nt, Homo sapiens
caaaguuucaa

SEQ ID NO: 2152770 - RNA, 18 nt, Homo sapiens
cuggaaaaggagcuucag

SEQ ID NO: 2152771 - RNA, 10 nt, Homo sapiens
gacuccucaa

SEQ ID NO: 2152772 - RNA, 17 nt, Homo sapiens
aaaacaaaaaaugugcu

SEQ ID NO: 2152773 - RNA, 14 nt, Homo sapiens
auuuuuugcacagc

SEQ ID NO: 2152774 - RNA, 19 nt, Homo sapiens
gcucacccacugcugcacc

SEQ ID NO: 2152775 - RNA, 18 nt, Homo sapiens
cugcauacgagagacuug

SEQ ID NO: 2152776 - RNA, 16 nt, Homo sapiens
caauauuaaugaagua

SEQ ID NO: 2152777 - RNA, 17 nt, Homo sapiens
cuauggcucuacuuuca

SEQ ID NO: 2152778 - RNA, 21 nt, Homo sapiens
uccuccccuccuggcacccac

SEQ ID NO: 2152779 - RNA, 13 nt, Homo sapiens
cugcugcugcuau

SEQ ID NO: 2152780 - RNA, 17 nt, Homo sapiens
uauuugcaagacauaga

SEQ ID NO: 2152781 - RNA, 21 nt, Homo sapiens
gcugguccuucucguuugcuc

SEQ ID NO: 2152782 - RNA, 23 nt, Homo sapiens
ccuuuuuaaggaaggcacuaaaa

SEQ ID NO: 2152783 - RNA, 21 nt, Homo sapiens
uagacacgcacggcagccaca

SEQ ID NO: 2152784 - RNA, 13 nt, Homo sapiens
aagcaacacuuua

SEQ ID NO: 2152785 - RNA, 12 nt, Homo sapiens
agcaaaccacau

SEQ ID NO: 2152786 - RNA, 15 nt, Homo sapiens
ugacucaagauuccc

SEQ ID NO: 2152787 - RNA, 19 nt, Homo sapiens
guucugcacccagccaaac

SEQ ID NO: 2152788 - RNA, 16 nt, Homo sapiens
gcacaaggcugaccaa

SEQ ID NO: 2152789 - RNA, 16 nt, Homo sapiens
auuucccagugaaaua

SEQ ID NO: 2152790 - RNA, 17 nt, Homo sapiens
uuauaaagauauaccaa

SEQ ID NO: 2152791 - RNA, 15 nt, Homo sapiens
auuacugguccaaaa

SEQ ID NO: 2152792 - RNA, 14 nt, Homo sapiens
guguauaugugcca

SEQ ID NO: 2152793 - RNA, 14 nt, Homo sapiens
aucuguuacacaaa

SEQ ID NO: 2152794 - RNA, 14 nt, Homo sapiens
caaaauuaauauga

SEQ ID NO: 2152795 - RNA, 17 nt, Homo sapiens
caagacauuugcugaac

SEQ ID NO: 2152796 - RNA, 22 nt, Homo sapiens
aguaaccuggguaaaugcagcg

SEQ ID NO: 2152797 - RNA, 13 nt, Homo sapiens
gccagaagacuca

SEQ ID NO: 2152798 - RNA, 18 nt, Homo sapiens
uuugggguaauacuucca

SEQ ID NO: 2152799 - RNA, 21 nt, Homo sapiens
uccuucaaaacacucaucucc

SEQ ID NO: 2152800 - RNA, 14 nt, Homo sapiens
aguaacacaccaag

SEQ ID NO: 2152801 - RNA, 14 nt, Homo sapiens
ucccuggugauggu

SEQ ID NO: 2152802 - RNA, 20 nt, Homo sapiens
uguguuuuaucuagucacau

SEQ ID NO: 2152803 - RNA, 22 nt, Homo sapiens
cuccugaguagcugggacuaca

SEQ ID NO: 2152804 - RNA, 19 nt, Homo sapiens
gucacuaccuucaugcaua

SEQ ID NO: 2152805 - RNA, 19 nt, Homo sapiens
uucaccacuguaguucucu

SEQ ID NO: 2152806 - RNA, 15 nt, Homo sapiens
uaaacgcaagcugag

SEQ ID NO: 2152807 - RNA, 18 nt, Homo sapiens
ggugcccucuccaaaggc

SEQ ID NO: 2152808 - RNA, 23 nt, Homo sapiens
aauccaucauacauuagugccau

SEQ ID NO: 2152809 - RNA, 18 nt, Homo sapiens
uguaaagugauauuuccc

SEQ ID NO: 2152810 - RNA, 20 nt, Homo sapiens
agcucagaggguuguucucc

SEQ ID NO: 2152811 - RNA, 23 nt, Homo sapiens
aaucaccacaaacuguaauacaa

SEQ ID NO: 2152812 - RNA, 22 nt, Homo sapiens
agauguagucuuacucugucac

SEQ ID NO: 2152813 - RNA, 12 nt, Homo sapiens
aaccuacugucu

SEQ ID NO: 2152814 - RNA, 20 nt, Homo sapiens
cuuccucccugucucugcau

SEQ ID NO: 2152815 - RNA, 20 nt, Homo sapiens
aagcaugcaauaaugugcaa

SEQ ID NO: 2152816 - RNA, 17 nt, Homo sapiens
ccgugcuccucagcagu

SEQ ID NO: 2152817 - RNA, 19 nt, Homo sapiens
gacgucagacuuggcucag

SEQ ID NO: 2152818 - RNA, 14 nt, Homo sapiens
ucaucuuuuuccac

SEQ ID NO: 2152819 - RNA, 14 nt, Homo sapiens
guaugccuauucag

SEQ ID NO: 2152820 - RNA, 18 nt, Homo sapiens
gaaaacacacuccuuugc

SEQ ID NO: 2152821 - RNA, 17 nt, Homo sapiens
gaacagcaggaugcccu

SEQ ID NO: 2152822 - RNA, 22 nt, Homo sapiens
acacuguucccagcuaccagcu

SEQ ID NO: 2152823 - RNA, 15 nt, Homo sapiens
aauagugucugauga

SEQ ID NO: 2152824 - RNA, 13 nt, Homo sapiens
uguuuuaggucua

SEQ ID NO: 2152825 - RNA, 16 nt, Homo sapiens
acagaucuaucuccuc

SEQ ID NO: 2152826 - RNA, 13 nt, Homo sapiens
cuuucuguugaaa

SEQ ID NO: 2152827 - RNA, 15 nt, Homo sapiens
aaaagguuuacagaa

SEQ ID NO: 2152828 - RNA, 14 nt, Homo sapiens
auaaucaugaucac

SEQ ID NO: 2152829 - RNA, 13 nt, Homo sapiens
agcaaaacuuucc

SEQ ID NO: 2152830 - RNA, 20 nt, Homo sapiens
cugggcuucgggcuaugcaa

SEQ ID NO: 2152831 - RNA, 21 nt, Homo sapiens
cacuaaauaaaggaagugccu

SEQ ID NO: 2152832 - RNA, 15 nt, Homo sapiens
gcuggggugagagua

SEQ ID NO: 2152833 - RNA, 13 nt, Homo sapiens
guuugcacuuaaa

SEQ ID NO: 2152834 - RNA, 14 nt, Homo sapiens
cuggaacaauguuu

SEQ ID NO: 2152835 - RNA, 22 nt, Homo sapiens
gugaucacugagacagccacuu

SEQ ID NO: 2152836 - RNA, 15 nt, Homo sapiens
gcaguguucuugggg

SEQ ID NO: 2152837 - RNA, 19 nt, Homo sapiens
gucuaacuuuagaagugca

SEQ ID NO: 2152838 - RNA, 16 nt, Homo sapiens
ucaauuuuucccagua

SEQ ID NO: 2152839 - RNA, 23 nt, Homo sapiens
uagacugacuuguuugucuucca

SEQ ID NO: 2152840 - RNA, 21 nt, Homo sapiens
acuagacguuguaaugcacac

SEQ ID NO: 2152841 - RNA, 20 nt, Homo sapiens
auaaucuuuggguaacuuca

SEQ ID NO: 2152842 - RNA, 16 nt, Homo sapiens
agauugcuacuagaaa

SEQ ID NO: 2152843 - RNA, 20 nt, Homo sapiens
auuuauuugguucccuuccu

SEQ ID NO: 2152844 - RNA, 20 nt, Homo sapiens
uuugauaguugguguucaaa

SEQ ID NO: 2152845 - RNA, 15 nt, Homo sapiens
ccaaucaacagcaug

SEQ ID NO: 2152846 - RNA, 16 nt, Homo sapiens
ggcuucuccaaaggga

SEQ ID NO: 2152847 - RNA, 14 nt, Homo sapiens
aauaacuacugcaa

SEQ ID NO: 2152848 - RNA, 19 nt, Homo sapiens
guuauuuugcuauuugccu

SEQ ID NO: 2152849 - RNA, 20 nt, Homo sapiens
acccacugugcaccaggcac

SEQ ID NO: 2152850 - RNA, 20 nt, Homo sapiens
accuguagugagaaacugau

SEQ ID NO: 2152851 - RNA, 13 nt, Homo sapiens
accuacccaugac

SEQ ID NO: 2152852 - RNA, 22 nt, Homo sapiens
ugacaaaggagcauugcaguca

SEQ ID NO: 2152853 - RNA, 20 nt, Homo sapiens
agaauuuacaguuccuucaa

SEQ ID NO: 2152854 - RNA, 23 nt, Homo sapiens
ccuuucugaggaguaaaaagacu

SEQ ID NO: 2152855 - RNA, 21 nt, Homo sapiens
agaauauuccuacuugcagua

SEQ ID NO: 2152856 - RNA, 15 nt, Homo sapiens
acauggcuagccuuu

SEQ ID NO: 2152857 - RNA, 21 nt, Homo sapiens
acccaucucucaggaaucauc

SEQ ID NO: 2152858 - RNA, 16 nt, Homo sapiens
uaacguucugcugcuu

SEQ ID NO: 2152859 - RNA, 22 nt, Homo sapiens
uggcccuauuuaaggcagauuu

SEQ ID NO: 2152860 - RNA, 22 nt, Homo sapiens
ugcauacugguguuaacaguca

SEQ ID NO: 2152861 - RNA, 18 nt, Homo sapiens
ugguggugacucauuucc

SEQ ID NO: 2152862 - RNA, 17 nt, Homo sapiens
gaagcccggacugacca

SEQ ID NO: 2152863 - RNA, 18 nt, Homo sapiens
cccuggggggcacagcca

SEQ ID NO: 2152864 - RNA, 13 nt, Homo sapiens
uuagaacuagucg

SEQ ID NO: 2152865 - RNA, 19 nt, Homo sapiens
ucuguuguuuuaagccaca

SEQ ID NO: 2152866 - RNA, 18 nt, Homo sapiens
uucaguuuuaccagauga

SEQ ID NO: 2152867 - RNA, 23 nt, Homo sapiens
acuauuucacuaauaaacauuug

SEQ ID NO: 2152868 - RNA, 13 nt, Homo sapiens
gaacagagugcaa

SEQ ID NO: 2152869 - RNA, 13 nt, Homo sapiens
agaaauaaggcua

SEQ ID NO: 2152870 - RNA, 21 nt, Homo sapiens
cacaaggugauuucagacugc

SEQ ID NO: 2152871 - RNA, 19 nt, Homo sapiens
acauccaggcaauggccua

SEQ ID NO: 2152872 - RNA, 14 nt, Homo sapiens
agccgugaugcuca

SEQ ID NO: 2152873 - RNA, 17 nt, Homo sapiens
uagaaaggacaacaguu

SEQ ID NO: 2152874 - RNA, 18 nt, Homo sapiens
augucucugagcauuaga

SEQ ID NO: 2152875 - RNA, 15 nt, Homo sapiens
ugagaauguggaaua

SEQ ID NO: 2152876 - RNA, 20 nt, Homo sapiens
agaguggcagccaagagcca

SEQ ID NO: 2152877 - RNA, 19 nt, Homo sapiens
gcacaacugauaauauuga

SEQ ID NO: 2152878 - RNA, 17 nt, Homo sapiens
accaauucaugaaguga

SEQ ID NO: 2152879 - RNA, 20 nt, Homo sapiens
cuacaagugauccucaggca

SEQ ID NO: 2152880 - RNA, 22 nt, Homo sapiens
caggaggcagagguugcaauga

SEQ ID NO: 2152881 - RNA, 21 nt, Homo sapiens
augccaaucucuucuaaaaaa

SEQ ID NO: 2152882 - RNA, 14 nt, Homo sapiens
uacucagcauuuga

SEQ ID NO: 2152883 - RNA, 19 nt, Homo sapiens
ucaaguuucuucaaucuga

SEQ ID NO: 2152884 - RNA, 22 nt, Homo sapiens
uaccauacagacagcacaaggu

SEQ ID NO: 2152885 - RNA, 13 nt, Homo sapiens
cugacaccugcuu

SEQ ID NO: 2152886 - RNA, 22 nt, Homo sapiens
accuaaaagagauuucaagaga

SEQ ID NO: 2152887 - RNA, 20 nt, Homo sapiens
aguuguucucaggggugcug

SEQ ID NO: 2152888 - RNA, 16 nt, Homo sapiens
aucacugccacacucu

SEQ ID NO: 2152889 - RNA, 20 nt, Homo sapiens
ugagcagagauguacugcaa

SEQ ID NO: 2152890 - RNA, 18 nt, Homo sapiens
cagauucucccuugcucu

SEQ ID NO: 2152891 - RNA, 16 nt, Homo sapiens
gcuggagcccagucac

SEQ ID NO: 2152892 - RNA, 18 nt, Homo sapiens
cuuuucuuacuauagucu

SEQ ID NO: 2152893 - RNA, 14 nt, Homo sapiens
guuucuggaauuga

SEQ ID NO: 2152894 - RNA, 21 nt, Homo sapiens
cagaccagccccaccaugcaa

SEQ ID NO: 2152895 - RNA, 23 nt, Homo sapiens
gauucacuaaagcagcacauagc

SEQ ID NO: 2152896 - RNA, 17 nt, Homo sapiens
aauuugcuagcaguaaa

SEQ ID NO: 2152897 - RNA, 14 nt, Homo sapiens
gagcagugucuucc

SEQ ID NO: 2152898 - RNA, 15 nt, Homo sapiens
agccaguauggcaaa

SEQ ID NO: 2152899 - RNA, 16 nt, Homo sapiens
cuagccaucucaagca

SEQ ID NO: 2152900 - RNA, 17 nt, Homo sapiens
uauguauacaugugcca

SEQ ID NO: 2152901 - RNA, 14 nt, Homo sapiens
uuguuaguaaacau

SEQ ID NO: 2152902 - RNA, 19 nt, Homo sapiens
uguuugggaagguggguga

SEQ ID NO: 2152903 - RNA, 18 nt, Homo sapiens
aaauguaacugugccagu

SEQ ID NO: 2152904 - RNA, 13 nt, Homo sapiens
aguucugauucau

SEQ ID NO: 2152905 - RNA, 17 nt, Homo sapiens
cgagaugggaaggcaca

SEQ ID NO: 2152906 - RNA, 19 nt, Homo sapiens
aggcuaagguggguggauc

SEQ ID NO: 2152907 - RNA, 17 nt, Homo sapiens
uuuaaaucaaacuguaa

SEQ ID NO: 2152908 - RNA, 11 nt, Homo sapiens
caagugcuauu

SEQ ID NO: 2152909 - RNA, 11 nt, Homo sapiens
auugugcucaa

SEQ ID NO: 2152910 - RNA, 21 nt, Homo sapiens
auguuccuuucgaaagcaaug

SEQ ID NO: 2152911 - RNA, 22 nt, Homo sapiens
caaauaauagaauugcucccua

SEQ ID NO: 2152912 - RNA, 17 nt, Homo sapiens
uggaagacaauacuccc

SEQ ID NO: 2152913 - RNA, 14 nt, Homo sapiens
ugcaccuugcuccc

SEQ ID NO: 2152914 - RNA, 19 nt, Homo sapiens
caaagaugaucaguaugaa

SEQ ID NO: 2152915 - RNA, 18 nt, Homo sapiens
cuggaguccacacuugaa

SEQ ID NO: 2152916 - RNA, 11 nt, Homo sapiens
uggaaaaagcg

SEQ ID NO: 2152917 - RNA, 21 nt, Homo sapiens
ccaccacaggcccuuuccuca

SEQ ID NO: 2152918 - RNA, 22 nt, Homo sapiens
cagccauaauaauaauuugcac

SEQ ID NO: 2152919 - RNA, 14 nt, Homo sapiens
auuacaaauuuuca

SEQ ID NO: 2152920 - RNA, 15 nt, Homo sapiens
aaagcauuguccaaa

SEQ ID NO: 2152921 - RNA, 13 nt, Homo sapiens
ccaucaagccuuu

SEQ ID NO: 2152922 - RNA, 22 nt, Homo sapiens
agaagcauugccuggacugacc

SEQ ID NO: 2152923 - RNA, 19 nt, Homo sapiens
uccagacuaugcagcucau

SEQ ID NO: 2152924 - RNA, 17 nt, Homo sapiens
aaaucauacugcauaca

SEQ ID NO: 2152925 - RNA, 17 nt, Homo sapiens
uugagaucauugcaaac

SEQ ID NO: 2152926 - RNA, 22 nt, Homo sapiens
uaacuuggauguagccaugacc

SEQ ID NO: 2152927 - RNA, 19 nt, Homo sapiens
gcaauaguaggacugcuga

SEQ ID NO: 2152928 - RNA, 16 nt, Homo sapiens
ccucaggccugaacuc

SEQ ID NO: 2152929 - RNA, 15 nt, Homo sapiens
agaccacuguuauca

SEQ ID NO: 2152930 - RNA, 17 nt, Homo sapiens
aaaagacaagaaaauca

SEQ ID NO: 2152931 - RNA, 17 nt, Homo sapiens
cuuugucgugguucuua

SEQ ID NO: 2152932 - RNA, 20 nt, Homo sapiens
gaaacagggccaggugcuuu

SEQ ID NO: 2152933 - RNA, 13 nt, Homo sapiens
aagucaggccauu

SEQ ID NO: 2152934 - RNA, 13 nt, Homo sapiens
acagugugcucca

SEQ ID NO: 2152935 - RNA, 13 nt, Homo sapiens
auggugacagcug

SEQ ID NO: 2152936 - RNA, 23 nt, Homo sapiens
aguaguuuuuacagcuguguuau

SEQ ID NO: 2152937 - RNA, 21 nt, Homo sapiens
ucuucauaauuucuucacuca

SEQ ID NO: 2152938 - RNA, 16 nt, Homo sapiens
ugaggccuuacuuaaa

SEQ ID NO: 2152939 - RNA, 21 nt, Homo sapiens
guuuccuuauccagacagugg

SEQ ID NO: 2152940 - RNA, 14 nt, Homo sapiens
augucuucacucua

SEQ ID NO: 2152941 - RNA, 19 nt, Homo sapiens
caggaucucagaucacugc

SEQ ID NO: 2152942 - RNA, 19 nt, Homo sapiens
ccuuggcuuuucuagccua

SEQ ID NO: 2152943 - RNA, 23 nt, Homo sapiens
agagauauuucaagcucauguca

SEQ ID NO: 2152944 - RNA, 18 nt, Homo sapiens
ucccaaauucacuuuauu

SEQ ID NO: 2152945 - RNA, 21 nt, Homo sapiens
gguuuucuuuuaagaaucaau

SEQ ID NO: 2152946 - RNA, 19 nt, Homo sapiens
uucccuuagccucucccac

SEQ ID NO: 2152947 - RNA, 15 nt, Homo sapiens
acugaaggugcaguu

SEQ ID NO: 2152948 - RNA, 14 nt, Homo sapiens
aauuuuuaggcaaa

SEQ ID NO: 2152949 - RNA, 20 nt, Homo sapiens
cagcgcagcuggacucugca

SEQ ID NO: 2152950 - RNA, 16 nt, Homo sapiens
cugugucaucugucag

SEQ ID NO: 2152951 - RNA, 16 nt, Homo sapiens
agugcugagggaccga

SEQ ID NO: 2152952 - RNA, 16 nt, Homo sapiens
ugccuuacccugguaa

SEQ ID NO: 2152953 - RNA, 18 nt, Homo sapiens
gugaacccaggacaagca

SEQ ID NO: 2152954 - RNA, 20 nt, Homo sapiens
agaacaucauuacuuaugau

SEQ ID NO: 2152955 - RNA, 16 nt, Homo sapiens
ucagugguuacucaag

SEQ ID NO: 2152956 - RNA, 20 nt, Homo sapiens
cuacaggagaugcugucacu

SEQ ID NO: 2152957 - RNA, 11 nt, Homo sapiens
aggucagucuu

SEQ ID NO: 2152958 - RNA, 13 nt, Homo sapiens
aagcaucagagau

SEQ ID NO: 2152959 - RNA, 22 nt, Homo sapiens
ccugagcaggaaagacuggccc

SEQ ID NO: 2152960 - RNA, 13 nt, Homo sapiens
cgccauccagggu

SEQ ID NO: 2152961 - RNA, 17 nt, Homo sapiens
ggguguguguagccaag

SEQ ID NO: 2152962 - RNA, 22 nt, Homo sapiens
cuccagugacauuggaacaugc

SEQ ID NO: 2152963 - RNA, 13 nt, Homo sapiens
ucuaagaugucag

SEQ ID NO: 2152964 - RNA, 22 nt, Homo sapiens
aacucugugucagcaucuuugc

SEQ ID NO: 2152965 - RNA, 16 nt, Homo sapiens
guuuaaaaaucuuaau

SEQ ID NO: 2152966 - RNA, 15 nt, Homo sapiens
uggcucaugccuuaa

SEQ ID NO: 2152967 - RNA, 18 nt, Homo sapiens
auugucuucugaccucua

SEQ ID NO: 2152968 - RNA, 18 nt, Homo sapiens
caucugccagaucaccaa

SEQ ID NO: 2152969 - RNA, 23 nt, Homo sapiens
auguuucuaaguaauaugcuuau

SEQ ID NO: 2152970 - RNA, 13 nt, Homo sapiens
uauuacaucuuua

SEQ ID NO: 2152971 - RNA, 13 nt, Homo sapiens
uugcccaucagcc

SEQ ID NO: 2152972 - RNA, 21 nt, Homo sapiens
cugcuuagugucccuuaccug

SEQ ID NO: 2152973 - RNA, 16 nt, Homo sapiens
gcaccucuccugugag

SEQ ID NO: 2152974 - RNA, 18 nt, Homo sapiens
ugaagugaugauggauga

SEQ ID NO: 2152975 - RNA, 12 nt, Homo sapiens
uauuauggauga

SEQ ID NO: 2152976 - RNA, 19 nt, Homo sapiens
auucuacuaugcauuaaau

SEQ ID NO: 2152977 - RNA, 23 nt, Homo sapiens
ugggagggaggagggagugcugu

SEQ ID NO: 2152978 - RNA, 16 nt, Homo sapiens
agccugggccacuggc

SEQ ID NO: 2152979 - RNA, 19 nt, Homo sapiens
auggagccuggaacugcau

SEQ ID NO: 2152980 - RNA, 18 nt, Homo sapiens
gaauucuuuccccaaaga

SEQ ID NO: 2152981 - RNA, 17 nt, Homo sapiens
uucuuaagggcacacac

SEQ ID NO: 2152982 - RNA, 20 nt, Homo sapiens
uaugggggcacugaggacca

SEQ ID NO: 2152983 - RNA, 12 nt, Homo sapiens
uaucucagagau

SEQ ID NO: 2152984 - RNA, 20 nt, Homo sapiens
ggcagacucuuuaugcuugc

SEQ ID NO: 2152985 - RNA, 23 nt, Homo sapiens
ucuggcaacagagcaagacucca

SEQ ID NO: 2152986 - RNA, 18 nt, Homo sapiens
caguggcuuagcugccau

SEQ ID NO: 2152987 - RNA, 19 nt, Homo sapiens
ugaaugucuuacugugauc

SEQ ID NO: 2152988 - RNA, 17 nt, Homo sapiens
caaaaaaaagcaugaau

SEQ ID NO: 2152989 - RNA, 21 nt, Homo sapiens
ugaaacuauuaagcuucuuaa

SEQ ID NO: 2152990 - RNA, 15 nt, Homo sapiens
caaggggcccagugc

SEQ ID NO: 2152991 - RNA, 18 nt, Homo sapiens
ccuucuauuuggggcuug

SEQ ID NO: 2152992 - RNA, 22 nt, Homo sapiens
auuccuguuucugaaccauuac

SEQ ID NO: 2152993 - RNA, 15 nt, Homo sapiens
agcagagacuuuagu

SEQ ID NO: 2152994 - RNA, 17 nt, Homo sapiens
gcuacugucucacugaa

SEQ ID NO: 2152995 - RNA, 16 nt, Homo sapiens
acaugguuacauauca

SEQ ID NO: 2152996 - RNA, 16 nt, Homo sapiens
cuuuuggagguauuca

SEQ ID NO: 2152997 - RNA, 23 nt, Homo sapiens
uuugauuuucgacguuugacuag

SEQ ID NO: 2152998 - RNA, 14 nt, Homo sapiens
ucuauaaacacugu

SEQ ID NO: 2152999 - RNA, 15 nt, Homo sapiens
aagguguucauuuug

SEQ ID NO: 2153000 - RNA, 12 nt, Homo sapiens
aagggugcuacu

SEQ ID NO: 2153001 - RNA, 17 nt, Homo sapiens
gcgcccaguccuuccac

SEQ ID NO: 2153002 - RNA, 19 nt, Homo sapiens
aaggacuccugucuguccu

SEQ ID NO: 2153003 - RNA, 17 nt, Homo sapiens
uuaaaagcaaaacugca

SEQ ID NO: 2153004 - RNA, 18 nt, Homo sapiens
acaguccacaggggccac

SEQ ID NO: 2153005 - RNA, 18 nt, Homo sapiens
cuaauguggcagcugucu

SEQ ID NO: 2153006 - RNA, 17 nt, Homo sapiens
ccucccugcuugcacac

SEQ ID NO: 2153007 - RNA, 16 nt, Homo sapiens
gauuacacauuucacu

SEQ ID NO: 2153008 - RNA, 18 nt, Homo sapiens
ucuguguugaagcacugu

SEQ ID NO: 2153009 - RNA, 22 nt, Homo sapiens
uugcuuauucuaggucuguaau

SEQ ID NO: 2153010 - RNA, 15 nt, Homo sapiens
ugaaaagguugccug

SEQ ID NO: 2153011 - RNA, 18 nt, Homo sapiens
auuucaggaagacugaca

SEQ ID NO: 2153012 - RNA, 15 nt, Homo sapiens
uuuacagcugagcac

SEQ ID NO: 2153013 - RNA, 14 nt, Homo sapiens
cauuuugguuuaaa

SEQ ID NO: 2153014 - RNA, 19 nt, Homo sapiens
cuaauucuucuguccugag

SEQ ID NO: 2153015 - RNA, 16 nt, Homo sapiens
uaagugccugagacac

SEQ ID NO: 2153016 - RNA, 11 nt, Homo sapiens
cugauugcauc

SEQ ID NO: 2153017 - RNA, 16 nt, Homo sapiens
aagauuagaagcugaa

SEQ ID NO: 2153018 - RNA, 17 nt, Homo sapiens
uacuuagacaguaugca

SEQ ID NO: 2153019 - RNA, 13 nt, Homo sapiens
ggcacacaccagu

SEQ ID NO: 2153020 - RNA, 12 nt, Homo sapiens
ucccuucuugga

SEQ ID NO: 2153021 - RNA, 14 nt, Homo sapiens
auggagugacuuag

SEQ ID NO: 2153022 - RNA, 17 nt, Homo sapiens
cuugaaggaacacaaag

SEQ ID NO: 2153023 - RNA, 14 nt, Homo sapiens
agacuucuggccua

SEQ ID NO: 2153024 - RNA, 13 nt, Homo sapiens
uugugagaaacau

SEQ ID NO: 2153025 - RNA, 16 nt, Homo sapiens
ggugggacuccagcuc

SEQ ID NO: 2153026 - RNA, 14 nt, Homo sapiens
cagcucagugccac

SEQ ID NO: 2153027 - RNA, 21 nt, Homo sapiens
guuuuacuguccaaagacaug

SEQ ID NO: 2153028 - RNA, 16 nt, Homo sapiens
acucauuuggguauau

SEQ ID NO: 2153029 - RNA, 12 nt, Homo sapiens
ugcaaacagugu

SEQ ID NO: 2153030 - RNA, 21 nt, Homo sapiens
ccuguagcacaaagagggagu

SEQ ID NO: 2153031 - RNA, 17 nt, Homo sapiens
ccuagcugugugcaguc

SEQ ID NO: 2153032 - RNA, 14 nt, Homo sapiens
uacauuacauguaa

SEQ ID NO: 2153033 - RNA, 17 nt, Homo sapiens
gcaugugugaaacauac

SEQ ID NO: 2153034 - RNA, 21 nt, Homo sapiens
agagauuuuucauuuuuccau

SEQ ID NO: 2153035 - RNA, 14 nt, Homo sapiens
auguguaacacuca

SEQ ID NO: 2153036 - RNA, 18 nt, Homo sapiens
ucaggggaggacuaggaa

SEQ ID NO: 2153037 - RNA, 15 nt, Homo sapiens
aggcugauuacugaa

SEQ ID NO: 2153038 - RNA, 13 nt, Homo sapiens
ccuggguucagcc

SEQ ID NO: 2153039 - RNA, 13 nt, Homo sapiens
uuggaggugcugc

SEQ ID NO: 2153040 - RNA, 21 nt, Homo sapiens
cuugcugcugcugcacccaac

SEQ ID NO: 2153041 - RNA, 17 nt, Homo sapiens
caagccuaauugugcaa

SEQ ID NO: 2153042 - RNA, 11 nt, Homo sapiens
gggcuggugac

SEQ ID NO: 2153043 - RNA, 18 nt, Homo sapiens
ucguguggcuccugguaa

SEQ ID NO: 2153044 - RNA, 14 nt, Homo sapiens
uuucucauacuuag

SEQ ID NO: 2153045 - RNA, 20 nt, Homo sapiens
gugcuguauaaaaucagcca

SEQ ID NO: 2153046 - RNA, 19 nt, Homo sapiens
auaagauauuuaguaauau

SEQ ID NO: 2153047 - RNA, 19 nt, Homo sapiens
uuuucaauuuuucuuuaaa

SEQ ID NO: 2153048 - RNA, 17 nt, Homo sapiens
guuuaacauuuccucag

SEQ ID NO: 2153049 - RNA, 17 nt, Homo sapiens
ugcgggggagcuggaaa

SEQ ID NO: 2153050 - RNA, 17 nt, Homo sapiens
ccucuugcaaugccuca

SEQ ID NO: 2153051 - RNA, 17 nt, Homo sapiens
uuguuguuuaucaggaa

SEQ ID NO: 2153052 - RNA, 14 nt, Homo sapiens
ggcugugaaggcag

SEQ ID NO: 2153053 - RNA, 18 nt, Homo sapiens
uucuggguguugaccacu

SEQ ID NO: 2153054 - RNA, 21 nt, Homo sapiens
uauacacacauauacauauau

SEQ ID NO: 2153055 - RNA, 16 nt, Homo sapiens
agauucuccugugcua

SEQ ID NO: 2153056 - RNA, 17 nt, Homo sapiens
aagcaacuuuacugaga

SEQ ID NO: 2153057 - RNA, 14 nt, Homo sapiens
acagcauaccucaa

SEQ ID NO: 2153058 - RNA, 20 nt, Homo sapiens
agaaggcaggaacacuggag

SEQ ID NO: 2153059 - RNA, 15 nt, Homo sapiens
ccacuuagcaugugu

SEQ ID NO: 2153060 - RNA, 15 nt, Homo sapiens
ggccaaaccucuguu

SEQ ID NO: 2153061 - RNA, 16 nt, Homo sapiens
ggauaauugaggcuaa

SEQ ID NO: 2153062 - RNA, 16 nt, Homo sapiens
ccaacucuuucucucu

SEQ ID NO: 2153063 - RNA, 19 nt, Homo sapiens
agcccuugagucugucaca

SEQ ID NO: 2153064 - RNA, 15 nt, Homo sapiens
cuguaguagcccuuu

SEQ ID NO: 2153065 - RNA, 14 nt, Homo sapiens
cuuguuuacucauu

SEQ ID NO: 2153066 - RNA, 14 nt, Homo sapiens
uaugcuuauacacu

SEQ ID NO: 2153067 - RNA, 22 nt, Homo sapiens
caucugucuggaggggagcucu

SEQ ID NO: 2153068 - RNA, 22 nt, Homo sapiens
uggcuaacuauauuugcuuuuu

SEQ ID NO: 2153069 - RNA, 19 nt, Homo sapiens
cuugguguuugacuguaau

SEQ ID NO: 2153070 - RNA, 22 nt, Homo sapiens
uugguucucauaacucugugau

SEQ ID NO: 2153071 - RNA, 19 nt, Homo sapiens
ccuuuagaguuccaugaac

SEQ ID NO: 2153072 - RNA, 17 nt, Homo sapiens
uuuaucuugucucuggg

SEQ ID NO: 2153073 - RNA, 10 nt, Homo sapiens
gcaguuauug

SEQ ID NO: 2153074 - RNA, 21 nt, Homo sapiens
gcagcaggcagcuucuacucc

SEQ ID NO: 2153075 - RNA, 16 nt, Homo sapiens
aaagagauauugauau

SEQ ID NO: 2153076 - RNA, 13 nt, Homo sapiens
ugucucaaaaaau

SEQ ID NO: 2153077 - RNA, 22 nt, Homo sapiens
cuucaauguauugagcauguga

SEQ ID NO: 2153078 - RNA, 13 nt, Homo sapiens
ccuuucuucucuc

SEQ ID NO: 2153079 - RNA, 15 nt, Homo sapiens
aaaaucacuggggau

SEQ ID NO: 2153080 - RNA, 15 nt, Homo sapiens
gcccagaugaucacu

SEQ ID NO: 2153081 - RNA, 21 nt, Homo sapiens
cucgaauaaaaucugcugcac

SEQ ID NO: 2153082 - RNA, 17 nt, Homo sapiens
cugaagcaucaauaaaa

SEQ ID NO: 2153083 - RNA, 19 nt, Homo sapiens
cugccagauaaccaaguga

SEQ ID NO: 2153084 - RNA, 15 nt, Homo sapiens
uugacugaagacauu

SEQ ID NO: 2153085 - RNA, 13 nt, Homo sapiens
ucuacaugugcca

SEQ ID NO: 2153086 - RNA, 13 nt, Homo sapiens
uuguuuauacaca

SEQ ID NO: 2153087 - RNA, 17 nt, Homo sapiens
auuaaaacuaagcacaa

SEQ ID NO: 2153088 - RNA, 16 nt, Homo sapiens
gaauguggucucagga

SEQ ID NO: 2153089 - RNA, 21 nt, Homo sapiens
gacuguguggagcuaaggaca

SEQ ID NO: 2153090 - RNA, 13 nt, Homo sapiens
agcaaaccugccc

SEQ ID NO: 2153091 - RNA, 13 nt, Homo sapiens
uccucccucagac

SEQ ID NO: 2153092 - RNA, 21 nt, Homo sapiens
gauguuuaacaaaucuaaucu

SEQ ID NO: 2153093 - RNA, 22 nt, Homo sapiens
ccugacuuuuauuuugccaaaa

SEQ ID NO: 2153094 - RNA, 22 nt, Homo sapiens
uugcuacgaagaaagacuccuu

SEQ ID NO: 2153095 - RNA, 21 nt, Homo sapiens
caucccggagcgcaccugcuu

SEQ ID NO: 2153096 - RNA, 18 nt, Homo sapiens
aucuaaauguauucugca

SEQ ID NO: 2153097 - RNA, 14 nt, Homo sapiens
aaauuccuguagca

SEQ ID NO: 2153098 - RNA, 19 nt, Homo sapiens
cgugaagaagccuguaaca

SEQ ID NO: 2153099 - RNA, 14 nt, Homo sapiens
aaacagcaguccca

SEQ ID NO: 2153100 - RNA, 15 nt, Homo sapiens
cucccacgugcacag

SEQ ID NO: 2153101 - RNA, 22 nt, Homo sapiens
uggccaguugcccagagcacuu

SEQ ID NO: 2153102 - RNA, 22 nt, Homo sapiens
ccuuucacuuuuaguuggcauu

SEQ ID NO: 2153103 - RNA, 19 nt, Homo sapiens
ucuuucuccagcagcugau

SEQ ID NO: 2153104 - RNA, 12 nt, Homo sapiens
aacgcacaaaac

SEQ ID NO: 2153105 - RNA, 23 nt, Homo sapiens
uuaaaaugcaaaauaaugucuua

SEQ ID NO: 2153106 - RNA, 23 nt, Homo sapiens
cucuuuaccuguucaaaauucca

SEQ ID NO: 2153107 - RNA, 21 nt, Homo sapiens
aauugggcuucaaucacugua

SEQ ID NO: 2153108 - RNA, 16 nt, Homo sapiens
auucagcugaugcuca

SEQ ID NO: 2153109 - RNA, 21 nt, Homo sapiens
ugauugacacacagcacucuc

SEQ ID NO: 2153110 - RNA, 18 nt, Homo sapiens
uauuuuauacugcacuuu

SEQ ID NO: 2153111 - RNA, 18 nt, Homo sapiens
ucaauauagcaagaccac

SEQ ID NO: 2153112 - RNA, 20 nt, Homo sapiens
cccucugggucucagugucc

SEQ ID NO: 2153113 - RNA, 14 nt, Homo sapiens
aggaacuuugucac

SEQ ID NO: 2153114 - RNA, 23 nt, Homo sapiens
ugaauacacgagguaugaggucu

SEQ ID NO: 2153115 - RNA, 14 nt, Homo sapiens
cauaguuugugaau

SEQ ID NO: 2153116 - RNA, 17 nt, Homo sapiens
uuaccagaagcuuccau

SEQ ID NO: 2153117 - RNA, 21 nt, Homo sapiens
ucauuuauucuucuuuuccaa

SEQ ID NO: 2153118 - RNA, 12 nt, Homo sapiens
aagcgauucucu

SEQ ID NO: 2153119 - RNA, 20 nt, Homo sapiens
accccuccugaacuggccac

SEQ ID NO: 2153120 - RNA, 16 nt, Homo sapiens
gccccggcugugccag

SEQ ID NO: 2153121 - RNA, 21 nt, Homo sapiens
gccaagaagauaggcucucag

SEQ ID NO: 2153122 - RNA, 15 nt, Homo sapiens
caccagcaacauuau

SEQ ID NO: 2153123 - RNA, 15 nt, Homo sapiens
auugcacuccagucu

SEQ ID NO: 2153124 - RNA, 14 nt, Homo sapiens
ccuauugucuccaa

SEQ ID NO: 2153125 - RNA, 22 nt, Homo sapiens
cuuggcuucugugaugagcuga

SEQ ID NO: 2153126 - RNA, 18 nt, Homo sapiens
ucccagccucuugcucag

SEQ ID NO: 2153127 - RNA, 21 nt, Homo sapiens
aauaucccagagaacaaucac

SEQ ID NO: 2153128 - RNA, 15 nt, Homo sapiens
ucccccugcaacuuc

SEQ ID NO: 2153129 - RNA, 13 nt, Homo sapiens
caggaaaagccau

SEQ ID NO: 2153130 - RNA, 21 nt, Homo sapiens
uguaauuaaguaaaccaaaaa

SEQ ID NO: 2153131 - RNA, 19 nt, Homo sapiens
guuucugugaaauucucag

SEQ ID NO: 2153132 - RNA, 21 nt, Homo sapiens
auauuguaauccuagcacuuu

SEQ ID NO: 2153133 - RNA, 13 nt, Homo sapiens
cugacagagaaau

SEQ ID NO: 2153134 - RNA, 15 nt, Homo sapiens
auaaauuagaaucuc

SEQ ID NO: 2153135 - RNA, 15 nt, Homo sapiens
aaaugaaucuuacuc

SEQ ID NO: 2153136 - RNA, 20 nt, Homo sapiens
ugucucuaaaggaagaaaua

SEQ ID NO: 2153137 - RNA, 20 nt, Homo sapiens
agucuaagaugaaaggagaa

SEQ ID NO: 2153138 - RNA, 14 nt, Homo sapiens
cgaaaaccaucaca

SEQ ID NO: 2153139 - RNA, 15 nt, Homo sapiens
auuacauauuuacac

SEQ ID NO: 2153140 - RNA, 21 nt, Homo sapiens
auacaguauucuguaccauag

SEQ ID NO: 2153141 - RNA, 21 nt, Homo sapiens
ccuggauuuucuuucuaugua

SEQ ID NO: 2153142 - RNA, 16 nt, Homo sapiens
aaaaacaucccaagaa

SEQ ID NO: 2153143 - RNA, 18 nt, Homo sapiens
caaaaccuuuaaucugca

SEQ ID NO: 2153144 - RNA, 21 nt, Homo sapiens
aaucugaauaaauaauucuuc

SEQ ID NO: 2153145 - RNA, 17 nt, Homo sapiens
auggagggaacacugaa

SEQ ID NO: 2153146 - RNA, 13 nt, Homo sapiens
ucucauaccucug

SEQ ID NO: 2153147 - RNA, 23 nt, Homo sapiens
aaaaggcaccuauaaaacagguc

SEQ ID NO: 2153148 - RNA, 21 nt, Homo sapiens
cauggagucuucagguagaaa

SEQ ID NO: 2153149 - RNA, 20 nt, Homo sapiens
uagugggguuuuauauccau

SEQ ID NO: 2153150 - RNA, 13 nt, Homo sapiens
acauuuaccucuu

SEQ ID NO: 2153151 - RNA, 14 nt, Homo sapiens
uuucauucugccaa

SEQ ID NO: 2153152 - RNA, 14 nt, Homo sapiens
acaguaugaugaaa

SEQ ID NO: 2153153 - RNA, 21 nt, Homo sapiens
aucauggagaacagcaugaca

SEQ ID NO: 2153154 - RNA, 14 nt, Homo sapiens
cuacccgagcccag

SEQ ID NO: 2153155 - RNA, 14 nt, Homo sapiens
cuaaagaauccaua

SEQ ID NO: 2153156 - RNA, 21 nt, Homo sapiens
aauggugccaccacucaagca

SEQ ID NO: 2153157 - RNA, 17 nt, Homo sapiens
cagacagcaguccuuca

SEQ ID NO: 2153158 - RNA, 15 nt, Homo sapiens
aaggauccugugcug

SEQ ID NO: 2153159 - RNA, 23 nt, Homo sapiens
aaucugccgcuuugucuguccag

SEQ ID NO: 2153160 - RNA, 16 nt, Homo sapiens
uagcuacguuuacuca

SEQ ID NO: 2153161 - RNA, 15 nt, Homo sapiens
ggccgggcuggucuu

SEQ ID NO: 2153162 - RNA, 17 nt, Homo sapiens
uauggcucacuaugaau

SEQ ID NO: 2153163 - RNA, 13 nt, Homo sapiens
ucccgccuuugac

SEQ ID NO: 2153164 - RNA, 18 nt, Homo sapiens
ucauucugaacccuccaa

SEQ ID NO: 2153165 - RNA, 17 nt, Homo sapiens
ugaccugugaccagcac

SEQ ID NO: 2153166 - RNA, 20 nt, Homo sapiens
ugcugauuuugaccuuguau

SEQ ID NO: 2153167 - RNA, 21 nt, Homo sapiens
acuguuuccccagagcaggag

SEQ ID NO: 2153168 - RNA, 13 nt, Homo sapiens
cuacuuuuaguug

SEQ ID NO: 2153169 - RNA, 21 nt, Homo sapiens
cuaauuuuucagcuccuucaa

SEQ ID NO: 2153170 - RNA, 15 nt, Homo sapiens
uguaaaggauauuaa

SEQ ID NO: 2153171 - RNA, 17 nt, Homo sapiens
gacuguaggauuugaag

SEQ ID NO: 2153172 - RNA, 23 nt, Homo sapiens
gaaaaaauauuguuuaaugcaaa

SEQ ID NO: 2153173 - RNA, 19 nt, Homo sapiens
aaacagccucacuccucag

SEQ ID NO: 2153174 - RNA, 16 nt, Homo sapiens
guguucaguaaacaaa

SEQ ID NO: 2153175 - RNA, 20 nt, Homo sapiens
ucucaccucuccuacucacu

SEQ ID NO: 2153176 - RNA, 10 nt, Homo sapiens
ucuccaggga

SEQ ID NO: 2153177 - RNA, 16 nt, Homo sapiens
uuagcagcccagcaca

SEQ ID NO: 2153178 - RNA, 17 nt, Homo sapiens
gcuccuggaauggaaga

SEQ ID NO: 2153179 - RNA, 23 nt, Homo sapiens
agcuugaucuuuuucugccauga

SEQ ID NO: 2153180 - RNA, 14 nt, Homo sapiens
auuuuauaccaaag

SEQ ID NO: 2153181 - RNA, 12 nt, Homo sapiens
gccgcugggaga

SEQ ID NO: 2153182 - RNA, 19 nt, Homo sapiens
auuuccuggugauucugau

SEQ ID NO: 2153183 - RNA, 11 nt, Homo sapiens
ugccagcagcu

SEQ ID NO: 2153184 - RNA, 15 nt, Homo sapiens
agaugguaugccucu

SEQ ID NO: 2153185 - RNA, 22 nt, Homo sapiens
caagugugcauauuguacacuu

SEQ ID NO: 2153186 - RNA, 21 nt, Homo sapiens
cagagacaacuucccaaagca

SEQ ID NO: 2153187 - RNA, 13 nt, Homo sapiens
agcagggacaaga

SEQ ID NO: 2153188 - RNA, 15 nt, Homo sapiens
accucuagagucacu

SEQ ID NO: 2153189 - RNA, 16 nt, Homo sapiens
uuuagaacaacauaaa

SEQ ID NO: 2153190 - RNA, 13 nt, Homo sapiens
acccagcucucag

SEQ ID NO: 2153191 - RNA, 19 nt, Homo sapiens
acuuccucuggcuccccaa

SEQ ID NO: 2153192 - RNA, 19 nt, Homo sapiens
uccaaaaagcacauauuag

SEQ ID NO: 2153193 - RNA, 18 nt, Homo sapiens
uuuauguuuuaauauccu

SEQ ID NO: 2153194 - RNA, 23 nt, Homo sapiens
uuuaacccuggauaagucacuua

SEQ ID NO: 2153195 - RNA, 22 nt, Homo sapiens
uuauuuaguuggaggccuuuag

SEQ ID NO: 2153196 - RNA, 14 nt, Homo sapiens
auaauuuacuuauu

SEQ ID NO: 2153197 - RNA, 18 nt, Homo sapiens
uguauucagaggcaguga

SEQ ID NO: 2153198 - RNA, 14 nt, Homo sapiens
aacagacaauaauu

SEQ ID NO: 2153199 - RNA, 22 nt, Homo sapiens
uuuaaaucaacgaguacuucaa

SEQ ID NO: 2153200 - RNA, 20 nt, Homo sapiens
ucugagaggcucuccgugca

SEQ ID NO: 2153201 - RNA, 22 nt, Homo sapiens
ccacacccaauuccacucugau

SEQ ID NO: 2153202 - RNA, 18 nt, Homo sapiens
ccagagugacagcuguau

SEQ ID NO: 2153203 - RNA, 19 nt, Homo sapiens
ccggccuccugucccucau

SEQ ID NO: 2153204 - RNA, 18 nt, Homo sapiens
ucuccugagcuccagucc

SEQ ID NO: 2153205 - RNA, 10 nt, Homo sapiens
aggacugugg

SEQ ID NO: 2153206 - RNA, 17 nt, Homo sapiens
accuauccgcccugcag

SEQ ID NO: 2153207 - RNA, 23 nt, Homo sapiens
cuuaguaaaaagcccuaugugaa

SEQ ID NO: 2153208 - RNA, 14 nt, Homo sapiens
ugugccccucaugc

SEQ ID NO: 2153209 - RNA, 15 nt, Homo sapiens
aauguuucuacagau

SEQ ID NO: 2153210 - RNA, 19 nt, Homo sapiens
ucuguuagcugcucacuua

SEQ ID NO: 2153211 - RNA, 18 nt, Homo sapiens
uauuaaaacugcacugcc

SEQ ID NO: 2153212 - RNA, 17 nt, Homo sapiens
caacaauuugagaugua

SEQ ID NO: 2153213 - RNA, 14 nt, Homo sapiens
caauaauccaugaa

SEQ ID NO: 2153214 - RNA, 22 nt, Homo sapiens
uaaagaagguuggugaauuuca

SEQ ID NO: 2153215 - RNA, 18 nt, Homo sapiens
ccugggugcugucaugcc

SEQ ID NO: 2153216 - RNA, 20 nt, Homo sapiens
agccuagaaacuaacacagc

SEQ ID NO: 2153217 - RNA, 17 nt, Homo sapiens
uccauauuuaacaugua

SEQ ID NO: 2153218 - RNA, 18 nt, Homo sapiens
gccuugcuggaugcugcu

SEQ ID NO: 2153219 - RNA, 17 nt, Homo sapiens
cauguaacuauguauca

SEQ ID NO: 2153220 - RNA, 17 nt, Homo sapiens
cucuagacaucuagucu

SEQ ID NO: 2153221 - RNA, 17 nt, Homo sapiens
uuugcuuacuugcuaaa

SEQ ID NO: 2153222 - RNA, 16 nt, Homo sapiens
gaguccaacaauguug

SEQ ID NO: 2153223 - RNA, 11 nt, Homo sapiens
cgccucagggc

SEQ ID NO: 2153224 - RNA, 12 nt, Homo sapiens
cagaaaacagag

SEQ ID NO: 2153225 - RNA, 15 nt, Homo sapiens
aggcagcucauccaa

SEQ ID NO: 2153226 - RNA, 19 nt, Homo sapiens
cucagaagucaguugcaaa

SEQ ID NO: 2153227 - RNA, 14 nt, Homo sapiens
caucugaagugucu

SEQ ID NO: 2153228 - RNA, 19 nt, Homo sapiens
cuccuggguucaagcaauc

SEQ ID NO: 2153229 - RNA, 19 nt, Homo sapiens
gcaaccaaagugcaggaca

SEQ ID NO: 2153230 - RNA, 13 nt, Homo sapiens
uuaugaugcuaug

SEQ ID NO: 2153231 - RNA, 13 nt, Homo sapiens
caucuauguaucu

SEQ ID NO: 2153232 - RNA, 15 nt, Homo sapiens
gcagccagucucaga

SEQ ID NO: 2153233 - RNA, 13 nt, Homo sapiens
acccacacaagcg

SEQ ID NO: 2153234 - RNA, 17 nt, Homo sapiens
cuuggagcccgugcagu

SEQ ID NO: 2153235 - RNA, 17 nt, Homo sapiens
gauggagucagguuugg

SEQ ID NO: 2153236 - RNA, 12 nt, Homo sapiens
gugcugggacag

SEQ ID NO: 2153237 - RNA, 20 nt, Homo sapiens
auuccacaaccugguuugcc

SEQ ID NO: 2153238 - RNA, 13 nt, Homo sapiens
guaaaacugugac

SEQ ID NO: 2153239 - RNA, 15 nt, Homo sapiens
cucacuccaccaccc

SEQ ID NO: 2153240 - RNA, 24 nt, Homo sapiens
aaacaauacuuuucaggcacuuua

SEQ ID NO: 2153241 - RNA, 17 nt, Homo sapiens
cucugaccugcacuggg

SEQ ID NO: 2153242 - RNA, 18 nt, Homo sapiens
ucuggcaaauaacaguaa

SEQ ID NO: 2153243 - RNA, 23 nt, Homo sapiens
auucaucuggaggcugcguccug

SEQ ID NO: 2153244 - RNA, 15 nt, Homo sapiens
uaguagaacucacag

SEQ ID NO: 2153245 - RNA, 17 nt, Homo sapiens
gacaacgccaacugccc

SEQ ID NO: 2153246 - RNA, 21 nt, Homo sapiens
uucagaggguaacuuaacaga

SEQ ID NO: 2153247 - RNA, 20 nt, Homo sapiens
acauucaauagcauaucaca

SEQ ID NO: 2153248 - RNA, 13 nt, Homo sapiens
ugcaagguuuuga

SEQ ID NO: 2153249 - RNA, 19 nt, Homo sapiens
ccuaggaccauuucucugc

SEQ ID NO: 2153250 - RNA, 14 nt, Homo sapiens
ucuacuuguaaaag

SEQ ID NO: 2153251 - RNA, 20 nt, Homo sapiens
aguucauaggucuccaagac

SEQ ID NO: 2153252 - RNA, 12 nt, Homo sapiens
aggcccucgcug

SEQ ID NO: 2153253 - RNA, 18 nt, Homo sapiens
uuugaaauuaaccucuca

SEQ ID NO: 2153254 - RNA, 19 nt, Homo sapiens
cuguauauuugucaugaca

SEQ ID NO: 2153255 - RNA, 14 nt, Homo sapiens
uaaaagaaaccuuc

SEQ ID NO: 2153256 - RNA, 17 nt, Homo sapiens
gggcccagcccuugaca

SEQ ID NO: 2153257 - RNA, 22 nt, Homo sapiens
ugaugguauaaacaggagacag

SEQ ID NO: 2153258 - RNA, 16 nt, Homo sapiens
cuguaacuugauccau

SEQ ID NO: 2153259 - RNA, 16 nt, Homo sapiens
guuaugugauuuuccu

SEQ ID NO: 2153260 - RNA, 15 nt, Homo sapiens
cauucuucccugaaa

SEQ ID NO: 2153261 - RNA, 14 nt, Homo sapiens
uaucuucauacaau

SEQ ID NO: 2153262 - RNA, 12 nt, Homo sapiens
uccuccaggugc

SEQ ID NO: 2153263 - RNA, 22 nt, Homo sapiens
ggaaaaaacaaauaauaaaugu

SEQ ID NO: 2153264 - RNA, 13 nt, Homo sapiens
uccacucaguugc

SEQ ID NO: 2153265 - RNA, 15 nt, Homo sapiens
gugcugucagcucag

SEQ ID NO: 2153266 - RNA, 22 nt, Homo sapiens
caaguguggaggagaggggugg

SEQ ID NO: 2153267 - RNA, 22 nt, Homo sapiens
aacaagagaaguacuaucuuug

SEQ ID NO: 2153268 - RNA, 16 nt, Homo sapiens
uuguuccagcccuauu

SEQ ID NO: 2153269 - RNA, 11 nt, Homo sapiens
aucuuuuacau

SEQ ID NO: 2153270 - RNA, 13 nt, Homo sapiens
gccaagacuccuc

SEQ ID NO: 2153271 - RNA, 23 nt, Homo sapiens
guuuagcauaguaccucugcuau

SEQ ID NO: 2153272 - RNA, 18 nt, Homo sapiens
aguuuguacucaguggac

SEQ ID NO: 2153273 - RNA, 16 nt, Homo sapiens
cucgcucuguuaccca

SEQ ID NO: 2153274 - RNA, 16 nt, Homo sapiens
cucacucuguugccca

SEQ ID NO: 2153275 - RNA, 20 nt, Homo sapiens
ggacaguuuaucaugaagcc

SEQ ID NO: 2153276 - RNA, 23 nt, Homo sapiens
cagggaaguggggaaguguucca

SEQ ID NO: 2153277 - RNA, 22 nt, Homo sapiens
gaaaacacuacacagggcugcu

SEQ ID NO: 2153278 - RNA, 22 nt, Homo sapiens
cuucagcugccuggaggccaga

SEQ ID NO: 2153279 - RNA, 19 nt, Homo sapiens
caauaaaggcagcugccuc

SEQ ID NO: 2153280 - RNA, 19 nt, Homo sapiens
caauguggacgugcacuga

SEQ ID NO: 2153281 - RNA, 23 nt, Homo sapiens
gaugccuuccgacaccacuggga

SEQ ID NO: 2153282 - RNA, 15 nt, Homo sapiens
aaaggguuaaugugu

SEQ ID NO: 2153283 - RNA, 13 nt, Homo sapiens
uagaagauucuau

SEQ ID NO: 2153284 - RNA, 18 nt, Homo sapiens
uaugaucaaaaacugccu

SEQ ID NO: 2153285 - RNA, 20 nt, Homo sapiens
aucguuccaguucccacuug

SEQ ID NO: 2153286 - RNA, 16 nt, Homo sapiens
ccucccuuucugggag

SEQ ID NO: 2153287 - RNA, 20 nt, Homo sapiens
uaaaaccaguuuugcugcua

SEQ ID NO: 2153288 - RNA, 16 nt, Homo sapiens
gaagacgccaaaaaca

SEQ ID NO: 2153289 - RNA, 16 nt, Homo sapiens
uuuuucauggcaacau

SEQ ID NO: 2153290 - RNA, 14 nt, Homo sapiens
aguagugcauuuaa

SEQ ID NO: 2153291 - RNA, 14 nt, Homo sapiens
cuuccauaauucag

SEQ ID NO: 2153292 - RNA, 22 nt, Homo sapiens
uuggguuuauuuggaaaggaau

SEQ ID NO: 2153293 - RNA, 10 nt, Homo sapiens
ccuccaggga

SEQ ID NO: 2153294 - RNA, 21 nt, Homo sapiens
caggaaaguucagaguuuucu

SEQ ID NO: 2153295 - RNA, 15 nt, Homo sapiens
cagcccaugugcacc

SEQ ID NO: 2153296 - RNA, 22 nt, Homo sapiens
uuggaguuuugaaaaacuccuu

SEQ ID NO: 2153297 - RNA, 13 nt, Homo sapiens
caaaucucaaagu

SEQ ID NO: 2153298 - RNA, 15 nt, Homo sapiens
cuggaagucaucuca

SEQ ID NO: 2153299 - RNA, 22 nt, Homo sapiens
gaugaauagcgaaucaucucaa

SEQ ID NO: 2153300 - RNA, 13 nt, Homo sapiens
cccgggacagggu

SEQ ID NO: 2153301 - RNA, 18 nt, Homo sapiens
acagguguauauaagcaa

SEQ ID NO: 2153302 - RNA, 13 nt, Homo sapiens
cuguauccaaguu

SEQ ID NO: 2153303 - RNA, 21 nt, Homo sapiens
cugcucccaguccugccugaa

SEQ ID NO: 2153304 - RNA, 23 nt, Homo sapiens
acaggaggcccccaucuaugagc

SEQ ID NO: 2153305 - RNA, 20 nt, Homo sapiens
caaccuguugaauuuacucu

SEQ ID NO: 2153306 - RNA, 20 nt, Homo sapiens
auguaaggccuuucaauauu

SEQ ID NO: 2153307 - RNA, 18 nt, Homo sapiens
uuaaaggacaaacaguga

SEQ ID NO: 2153308 - RNA, 13 nt, Homo sapiens
uuucagaucaugg

SEQ ID NO: 2153309 - RNA, 11 nt, Homo sapiens
cagcaucucac

SEQ ID NO: 2153310 - RNA, 15 nt, Homo sapiens
acuuugggaggccaa

SEQ ID NO: 2153311 - RNA, 12 nt, Homo sapiens
ggccaugcccuc

SEQ ID NO: 2153312 - RNA, 20 nt, Homo sapiens
uccaauucugaccuuacaaa

SEQ ID NO: 2153313 - RNA, 23 nt, Homo sapiens
acagggccggucgggggggaccc

SEQ ID NO: 2153314 - RNA, 22 nt, Homo sapiens
ccaaugugaaguucaucuugca

SEQ ID NO: 2153315 - RNA, 20 nt, Homo sapiens
cuccaaaggucugaugucuc

SEQ ID NO: 2153316 - RNA, 12 nt, Homo sapiens
uuaacugagcua

SEQ ID NO: 2153317 - RNA, 23 nt, Homo sapiens
aggaauaguugagccccaagucc

SEQ ID NO: 2153318 - RNA, 18 nt, Homo sapiens
cuuccucaagucuugaca

SEQ ID NO: 2153319 - RNA, 16 nt, Homo sapiens
ucaagaucaacauucc

SEQ ID NO: 2153320 - RNA, 21 nt, Homo sapiens
uauucuuggagaacuuuccau

SEQ ID NO: 2153321 - RNA, 22 nt, Homo sapiens
cugucaugugcgaacacaguga

SEQ ID NO: 2153322 - RNA, 18 nt, Homo sapiens
ugugaagggagaaaggga

SEQ ID NO: 2153323 - RNA, 18 nt, Homo sapiens
agcuucaacuacuucucu

SEQ ID NO: 2153324 - RNA, 14 nt, Homo sapiens
cagagcagugcagc

SEQ ID NO: 2153325 - RNA, 20 nt, Homo sapiens
auggaagacaaauacacaua

SEQ ID NO: 2153326 - RNA, 22 nt, Homo sapiens
gcuuuccuuguuagaaugcaag

SEQ ID NO: 2153327 - RNA, 17 nt, Homo sapiens
ugaaaagagaaacuuaa

SEQ ID NO: 2153328 - RNA, 18 nt, Homo sapiens
aucaugguagucacuaac

SEQ ID NO: 2153329 - RNA, 24 nt, Homo sapiens
aagaccagucacucccucugccuu

SEQ ID NO: 2153330 - RNA, 20 nt, Homo sapiens
cuguacacagaauuguucca

SEQ ID NO: 2153331 - RNA, 20 nt, Homo sapiens
cuuaaguucuuugauuugua

SEQ ID NO: 2153332 - RNA, 21 nt, Homo sapiens
cagcccuaaaguuuuaaacuc

SEQ ID NO: 2153333 - RNA, 17 nt, Homo sapiens
auaacaagauuuucuua

SEQ ID NO: 2153334 - RNA, 21 nt, Homo sapiens
gcccaggccugggaugcagug

SEQ ID NO: 2153335 - RNA, 19 nt, Homo sapiens
acucuauacuuaaucucac

SEQ ID NO: 2153336 - RNA, 22 nt, Homo sapiens
cccuugugcauugugugucaca

SEQ ID NO: 2153337 - RNA, 13 nt, Homo sapiens
uaaagcauuuugc

SEQ ID NO: 2153338 - RNA, 24 nt, Homo sapiens
cacuuuuuuuuuuucugccugaga

SEQ ID NO: 2153339 - RNA, 18 nt, Homo sapiens
cuuaaaaugggaucucau

SEQ ID NO: 2153340 - RNA, 14 nt, Homo sapiens
ucccagagcugcac

SEQ ID NO: 2153341 - RNA, 12 nt, Homo sapiens
gugcaugccagg

SEQ ID NO: 2153342 - RNA, 21 nt, Homo sapiens
uuuauaaacaguuuuacuugu

SEQ ID NO: 2153343 - RNA, 16 nt, Homo sapiens
aaccuacucugcaaac

SEQ ID NO: 2153344 - RNA, 14 nt, Homo sapiens
aaucagaauggaau

SEQ ID NO: 2153345 - RNA, 18 nt, Homo sapiens
cuuucagcuccugaccag

SEQ ID NO: 2153346 - RNA, 18 nt, Homo sapiens
aauuguuaguuucugagu

SEQ ID NO: 2153347 - RNA, 16 nt, Homo sapiens
aagucugaacguggaa

SEQ ID NO: 2153348 - RNA, 16 nt, Homo sapiens
ccuggcaggacuccag

SEQ ID NO: 2153349 - RNA, 16 nt, Homo sapiens
gcugcccucacugccu

SEQ ID NO: 2153350 - RNA, 20 nt, Homo sapiens
cuggccccagucgaacuggg

SEQ ID NO: 2153351 - RNA, 11 nt, Homo sapiens
uuuuucaauuu

SEQ ID NO: 2153352 - RNA, 23 nt, Homo sapiens
aaauuagccaggugugguggugc

SEQ ID NO: 2153353 - RNA, 16 nt, Homo sapiens
acugguccagcucuga

SEQ ID NO: 2153354 - RNA, 14 nt, Homo sapiens
ucucaagaccaaca

SEQ ID NO: 2153355 - RNA, 22 nt, Homo sapiens
aacaugggaaggugccacuggu

SEQ ID NO: 2153356 - RNA, 22 nt, Homo sapiens
caggauuucaucugagugugga

SEQ ID NO: 2153357 - RNA, 21 nt, Homo sapiens
agcccuucccagggcacccag

SEQ ID NO: 2153358 - RNA, 21 nt, Homo sapiens
gcuagaaggccacaugucacc

SEQ ID NO: 2153359 - RNA, 15 nt, Homo sapiens
ucaaauccaaaaugg

SEQ ID NO: 2153360 - RNA, 19 nt, Homo sapiens
ugaacuagagacucuguga

SEQ ID NO: 2153361 - RNA, 19 nt, Homo sapiens
caguguuaggccuggcaca

SEQ ID NO: 2153362 - RNA, 24 nt, Homo sapiens
ucaaugaagccagcucacagugcu

SEQ ID NO: 2153363 - RNA, 16 nt, Homo sapiens
aggacaguugggcuau

SEQ ID NO: 2153364 - RNA, 14 nt, Homo sapiens
cacagauaugcaca

SEQ ID NO: 2153365 - RNA, 21 nt, Homo sapiens
guuuauuuuccucagagccuu

SEQ ID NO: 2153366 - RNA, 16 nt, Homo sapiens
accugaagacugagga

SEQ ID NO: 2153367 - RNA, 18 nt, Homo sapiens
uuuagaaaaaaaacugaa

SEQ ID NO: 2153368 - RNA, 18 nt, Homo sapiens
agaaaccuuuguuugcau

SEQ ID NO: 2153369 - RNA, 22 nt, Homo sapiens
uggauugcagacucaugaaaga

SEQ ID NO: 2153370 - RNA, 20 nt, Homo sapiens
ggacagucagcucucuccuu

SEQ ID NO: 2153371 - RNA, 18 nt, Homo sapiens
agggcgugugguuucccu

SEQ ID NO: 2153372 - RNA, 21 nt, Homo sapiens
uaauaaauuauuuauuauuaa

SEQ ID NO: 2153373 - RNA, 10 nt, Homo sapiens
ggcugugagg

SEQ ID NO: 2153374 - RNA, 19 nt, Homo sapiens
guaacaucacuauccaugc

SEQ ID NO: 2153375 - RNA, 18 nt, Homo sapiens
caacagugagagacucca

SEQ ID NO: 2153376 - RNA, 23 nt, Homo sapiens
accacagcggaggagcuccgcua

SEQ ID NO: 2153377 - RNA, 17 nt, Homo sapiens
uuaauuacuacuaggua

SEQ ID NO: 2153378 - RNA, 18 nt, Homo sapiens
cuggggagcccaguccac

SEQ ID NO: 2153379 - RNA, 15 nt, Homo sapiens
gggcccuuucaucuu

SEQ ID NO: 2153380 - RNA, 18 nt, Homo sapiens
ugagaaguaauuccucug

SEQ ID NO: 2153381 - RNA, 23 nt, Homo sapiens
uuguuggucuguguaacauccaa

SEQ ID NO: 2153382 - RNA, 20 nt, Homo sapiens
guccgcgcgccagcacagaa

SEQ ID NO: 2153383 - RNA, 18 nt, Homo sapiens
uaggggaacagaccagug

SEQ ID NO: 2153384 - RNA, 19 nt, Homo sapiens
gcagugucuuuggaccuga

SEQ ID NO: 2153385 - RNA, 13 nt, Homo sapiens
agacuuggagcug

SEQ ID NO: 2153386 - RNA, 22 nt, Homo sapiens
ugcaugagcucccucgcuguau

SEQ ID NO: 2153387 - RNA, 15 nt, Homo sapiens
gauaaucuucaggug

SEQ ID NO: 2153388 - RNA, 17 nt, Homo sapiens
gaagaguguggagucau

SEQ ID NO: 2153389 - RNA, 20 nt, Homo sapiens
uaaucaaaaugaaggcuuag

SEQ ID NO: 2153390 - RNA, 17 nt, Homo sapiens
uggggagacaaaucuca

SEQ ID NO: 2153391 - RNA, 20 nt, Homo sapiens
caaacuuuuuuauaucuuuu

SEQ ID NO: 2153392 - RNA, 18 nt, Homo sapiens
acauuuucucuaccuucc

SEQ ID NO: 2153393 - RNA, 13 nt, Homo sapiens
gacaaagggaaau

SEQ ID NO: 2153394 - RNA, 12 nt, Homo sapiens
gagacuguccau

SEQ ID NO: 2153395 - RNA, 12 nt, Homo sapiens
guaaaaugaagg

SEQ ID NO: 2153396 - RNA, 21 nt, Homo sapiens
cagcuccacccugagcuuccu

SEQ ID NO: 2153397 - RNA, 14 nt, Homo sapiens
uuccagaaugguau

SEQ ID NO: 2153398 - RNA, 16 nt, Homo sapiens
ugcacugucacuuugc

SEQ ID NO: 2153399 - RNA, 17 nt, Homo sapiens
caggagaguacauggca

SEQ ID NO: 2153400 - RNA, 22 nt, Homo sapiens
acuuucuguugccacaacccug

SEQ ID NO: 2153401 - RNA, 12 nt, Homo sapiens
cuucagugcugg

SEQ ID NO: 2153402 - RNA, 16 nt, Homo sapiens
uucaugucacuaaaca

SEQ ID NO: 2153403 - RNA, 15 nt, Homo sapiens
gacacuguggcagca

SEQ ID NO: 2153404 - RNA, 21 nt, Homo sapiens
gacauagccaacugcuguuca

SEQ ID NO: 2153405 - RNA, 17 nt, Homo sapiens
gagaaaauauuugcaaa

SEQ ID NO: 2153406 - RNA, 17 nt, Homo sapiens
aauuaaaugugagcaaa

SEQ ID NO: 2153407 - RNA, 23 nt, Homo sapiens
caucucagcaaucacaagccaag

SEQ ID NO: 2153408 - RNA, 16 nt, Homo sapiens
aggcuagcaaagcuua

SEQ ID NO: 2153409 - RNA, 20 nt, Homo sapiens
ugagaaggcagccaccagcg

SEQ ID NO: 2153410 - RNA, 14 nt, Homo sapiens
aagaucccgugaaa

SEQ ID NO: 2153411 - RNA, 14 nt, Homo sapiens
cacaaugaaagaau

SEQ ID NO: 2153412 - RNA, 23 nt, Homo sapiens
aagaauucaaacuggggccucca

SEQ ID NO: 2153413 - RNA, 18 nt, Homo sapiens
cuuugcaggcaugcaugu

SEQ ID NO: 2153414 - RNA, 12 nt, Homo sapiens
ucuccacaaagu

SEQ ID NO: 2153415 - RNA, 12 nt, Homo sapiens
aagccacaucuu

SEQ ID NO: 2153416 - RNA, 19 nt, Homo sapiens
uucacaauggaaacuuuag

SEQ ID NO: 2153417 - RNA, 13 nt, Homo sapiens
cugaucugugaua

SEQ ID NO: 2153418 - RNA, 22 nt, Homo sapiens
ucacauauucauauuguucaau

SEQ ID NO: 2153419 - RNA, 15 nt, Homo sapiens
ccuaacaaaugcucc

SEQ ID NO: 2153420 - RNA, 15 nt, Homo sapiens
uuuccagucauggcc

SEQ ID NO: 2153421 - RNA, 13 nt, Homo sapiens
acgugucuccuca

SEQ ID NO: 2153422 - RNA, 20 nt, Homo sapiens
ugcuugaacugcugccaacu

SEQ ID NO: 2153423 - RNA, 22 nt, Homo sapiens
ugccgcuccucucuagaaccuu

SEQ ID NO: 2153424 - RNA, 18 nt, Homo sapiens
ugcugcauccccuuccag

SEQ ID NO: 2153425 - RNA, 21 nt, Homo sapiens
caugcuuuugcagacaguccu

SEQ ID NO: 2153426 - RNA, 14 nt, Homo sapiens
uugccagcagagua

SEQ ID NO: 2153427 - RNA, 22 nt, Homo sapiens
agaugaugccaugggcccucuc

SEQ ID NO: 2153428 - RNA, 13 nt, Homo sapiens
ugguaaguaacug

SEQ ID NO: 2153429 - RNA, 17 nt, Homo sapiens
ccauggucaccaaacag

SEQ ID NO: 2153430 - RNA, 20 nt, Homo sapiens
agugacuggugccaguguca

SEQ ID NO: 2153431 - RNA, 18 nt, Homo sapiens
ggcgacggcuuccaucug

SEQ ID NO: 2153432 - RNA, 17 nt, Homo sapiens
acacaaaaauuagccag

SEQ ID NO: 2153433 - RNA, 17 nt, Homo sapiens
uaacauuuccuuacaga

SEQ ID NO: 2153434 - RNA, 21 nt, Homo sapiens
uagagaggugaagguaugaga

SEQ ID NO: 2153435 - RNA, 22 nt, Homo sapiens
aagaaagcuucaaguuuucuca

SEQ ID NO: 2153436 - RNA, 16 nt, Homo sapiens
ccauuguggaagacag

SEQ ID NO: 2153437 - RNA, 19 nt, Homo sapiens
gaucugaugaaaaggucag

SEQ ID NO: 2153438 - RNA, 15 nt, Homo sapiens
auugcuggaacccag

SEQ ID NO: 2153439 - RNA, 23 nt, Homo sapiens
cugcccgaggagcccugccugcc

SEQ ID NO: 2153440 - RNA, 20 nt, Homo sapiens
cacccugcccuuguugucuc

SEQ ID NO: 2153441 - RNA, 13 nt, Homo sapiens
cuagaagcucagg

SEQ ID NO: 2153442 - RNA, 17 nt, Homo sapiens
aagcaaacacacucuca

SEQ ID NO: 2153443 - RNA, 16 nt, Homo sapiens
aagccaugugccagau

SEQ ID NO: 2153444 - RNA, 21 nt, Homo sapiens
acccagagaaaaggacuccuc

SEQ ID NO: 2153445 - RNA, 21 nt, Homo sapiens
cuauaaccaguuuagcuuuuu

SEQ ID NO: 2153446 - RNA, 10 nt, Homo sapiens
caucaucucu

SEQ ID NO: 2153447 - RNA, 20 nt, Homo sapiens
agaccuguguuaaugcuuug

SEQ ID NO: 2153448 - RNA, 14 nt, Homo sapiens
ggaccuuggcgcuu

SEQ ID NO: 2153449 - RNA, 13 nt, Homo sapiens
cuaaaauguauuu

SEQ ID NO: 2153450 - RNA, 20 nt, Homo sapiens
ucucaauuauuggccugcua

SEQ ID NO: 2153451 - RNA, 13 nt, Homo sapiens
aaugugaagccuu

SEQ ID NO: 2153452 - RNA, 19 nt, Homo sapiens
uucaaaccugaccacagaa

SEQ ID NO: 2153453 - RNA, 20 nt, Homo sapiens
ucaaggcaguagaacuccag

SEQ ID NO: 2153454 - RNA, 18 nt, Homo sapiens
cucuucggucguauccac

SEQ ID NO: 2153455 - RNA, 22 nt, Homo sapiens
ccacguucucucugccugugag

SEQ ID NO: 2153456 - RNA, 19 nt, Homo sapiens
ugaagggaaguggggagua

SEQ ID NO: 2153457 - RNA, 12 nt, Homo sapiens
ucucaagugaua

SEQ ID NO: 2153458 - RNA, 18 nt, Homo sapiens
ugcugcaggcguacaggu

SEQ ID NO: 2153459 - RNA, 20 nt, Homo sapiens
gcaccuucacucuccagggu

SEQ ID NO: 2153460 - RNA, 23 nt, Homo sapiens
cuucaaguuuagugcaugcaucu

SEQ ID NO: 2153461 - RNA, 10 nt, Homo sapiens
aaacccggga

SEQ ID NO: 2153462 - RNA, 12 nt, Homo sapiens
cuuucacuuuga

SEQ ID NO: 2153463 - RNA, 17 nt, Homo sapiens
uuuggggacaugugauu

SEQ ID NO: 2153464 - RNA, 19 nt, Homo sapiens
aagcugcugaaugcauuca

SEQ ID NO: 2153465 - RNA, 12 nt, Homo sapiens
uucaaaauaugu

SEQ ID NO: 2153466 - RNA, 14 nt, Homo sapiens
ucuaagugggagaa

SEQ ID NO: 2153467 - RNA, 13 nt, Homo sapiens
agccgacucuggc

SEQ ID NO: 2153468 - RNA, 20 nt, Homo sapiens
acaugaucuguuuuucacca

SEQ ID NO: 2153469 - RNA, 23 nt, Homo sapiens
cugugacaaagaagaccacaaau

SEQ ID NO: 2153470 - RNA, 16 nt, Homo sapiens
cauccaggcucccaaa

SEQ ID NO: 2153471 - RNA, 14 nt, Homo sapiens
uggcuuaaaaagca

SEQ ID NO: 2153472 - RNA, 19 nt, Homo sapiens
aucagaggaaauucuuucc

SEQ ID NO: 2153473 - RNA, 15 nt, Homo sapiens
gcuaaaaagaacuca

SEQ ID NO: 2153474 - RNA, 15 nt, Homo sapiens
acagauagcugccac

SEQ ID NO: 2153475 - RNA, 21 nt, Homo sapiens
caaaaugccauuuagcaauaa

SEQ ID NO: 2153476 - RNA, 16 nt, Homo sapiens
aauccuugagaaucuu

SEQ ID NO: 2153477 - RNA, 16 nt, Homo sapiens
cuuuagaaacugaguc

SEQ ID NO: 2153478 - RNA, 23 nt, Homo sapiens
uuucaguaguuugaucaguugaa

SEQ ID NO: 2153479 - RNA, 19 nt, Homo sapiens
uugaauggaaaacacaugg

SEQ ID NO: 2153480 - RNA, 15 nt, Homo sapiens
auuugagacagaguc

SEQ ID NO: 2153481 - RNA, 17 nt, Homo sapiens
uguugaaaguugcaguu

SEQ ID NO: 2153482 - RNA, 19 nt, Homo sapiens
uuggacauuuauguacaaa

SEQ ID NO: 2153483 - RNA, 15 nt, Homo sapiens
cuccuagcaagaccu

SEQ ID NO: 2153484 - RNA, 22 nt, Homo sapiens
aacgccuggugccccagcacca

SEQ ID NO: 2153485 - RNA, 14 nt, Homo sapiens
aagaccuugaaccg

SEQ ID NO: 2153486 - RNA, 18 nt, Homo sapiens
accaguaugaaugacaau

SEQ ID NO: 2153487 - RNA, 16 nt, Homo sapiens
agccuauuuaccugca

SEQ ID NO: 2153488 - RNA, 15 nt, Homo sapiens
guccccagagcuuua

SEQ ID NO: 2153489 - RNA, 22 nt, Homo sapiens
aacauccuacaagacacaguga

SEQ ID NO: 2153490 - RNA, 14 nt, Homo sapiens
ccaaaagucuucau

SEQ ID NO: 2153491 - RNA, 14 nt, Homo sapiens
cuuuuaacagaaca

SEQ ID NO: 2153492 - RNA, 23 nt, Homo sapiens
gaagagaauauuagcuuuacugu

SEQ ID NO: 2153493 - RNA, 19 nt, Homo sapiens
cugacauuuuuuccuaagg

SEQ ID NO: 2153494 - RNA, 12 nt, Homo sapiens
aagaagcucucc

SEQ ID NO: 2153495 - RNA, 21 nt, Homo sapiens
uguagcauauucuuuucugca

SEQ ID NO: 2153496 - RNA, 20 nt, Homo sapiens
uuagauauucauacuuucca

SEQ ID NO: 2153497 - RNA, 20 nt, Homo sapiens
gcccucugaacuugccuuaa

SEQ ID NO: 2153498 - RNA, 18 nt, Homo sapiens
agccugcucccuagccag

SEQ ID NO: 2153499 - RNA, 22 nt, Homo sapiens
gcuccaggaucuuugacugaaa

SEQ ID NO: 2153500 - RNA, 12 nt, Homo sapiens
acugaggugccu

SEQ ID NO: 2153501 - RNA, 19 nt, Homo sapiens
aucucuauuauaucuugua

SEQ ID NO: 2153502 - RNA, 22 nt, Homo sapiens
acggaagaggcugcugagaaag

SEQ ID NO: 2153503 - RNA, 13 nt, Homo sapiens
ucauguaaccaag

SEQ ID NO: 2153504 - RNA, 18 nt, Homo sapiens
gaccaucccccacuccuu

SEQ ID NO: 2153505 - RNA, 18 nt, Homo sapiens
uuuccccauugacccuca

SEQ ID NO: 2153506 - RNA, 13 nt, Homo sapiens
ucucuucuguccc

SEQ ID NO: 2153507 - RNA, 21 nt, Homo sapiens
cuuuugcaggaaaaggcuaag

SEQ ID NO: 2153508 - RNA, 18 nt, Homo sapiens
uuucuuuuaaaauuuuga

SEQ ID NO: 2153509 - RNA, 18 nt, Homo sapiens
ggaccuuuuguacuuuau

SEQ ID NO: 2153510 - RNA, 14 nt, Homo sapiens
uccaucagccagac

SEQ ID NO: 2153511 - RNA, 17 nt, Homo sapiens
uaaguauuuugaucacu

SEQ ID NO: 2153512 - RNA, 16 nt, Homo sapiens
caauucuacccagagc

SEQ ID NO: 2153513 - RNA, 14 nt, Homo sapiens
guaaacaacaaacu

SEQ ID NO: 2153514 - RNA, 17 nt, Homo sapiens
gauccuaguuccaccau

SEQ ID NO: 2153515 - RNA, 20 nt, Homo sapiens
cugcuugccgaaacuggaag

SEQ ID NO: 2153516 - RNA, 19 nt, Homo sapiens
ccaugcgcagaugaggggc

SEQ ID NO: 2153517 - RNA, 13 nt, Homo sapiens
gcuggcacugagc

SEQ ID NO: 2153518 - RNA, 16 nt, Homo sapiens
ccaagacaaacuaaac

SEQ ID NO: 2153519 - RNA, 15 nt, Homo sapiens
caucauuaaugugaa

SEQ ID NO: 2153520 - RNA, 18 nt, Homo sapiens
auaaaggcugagcucuua

SEQ ID NO: 2153521 - RNA, 18 nt, Homo sapiens
gaauugguuuaaacuuuu

SEQ ID NO: 2153522 - RNA, 15 nt, Homo sapiens
gcuggccagugcugc

SEQ ID NO: 2153523 - RNA, 12 nt, Homo sapiens
ccucucuugcca

SEQ ID NO: 2153524 - RNA, 22 nt, Homo sapiens
ggaguauauuuccgcacuucag

SEQ ID NO: 2153525 - RNA, 18 nt, Homo sapiens
uagugauucugauuucag

SEQ ID NO: 2153526 - RNA, 15 nt, Homo sapiens
uuucuuuacuccauc

SEQ ID NO: 2153527 - RNA, 15 nt, Homo sapiens
cuuugauuaugacug

SEQ ID NO: 2153528 - RNA, 18 nt, Homo sapiens
ggaaaaguuuaaccuaaa

SEQ ID NO: 2153529 - RNA, 18 nt, Homo sapiens
uaggcuccgucaguauca

SEQ ID NO: 2153530 - RNA, 22 nt, Homo sapiens
uccagccugggaggcacagcaa

SEQ ID NO: 2153531 - RNA, 14 nt, Homo sapiens
uuauuaaugccauu

SEQ ID NO: 2153532 - RNA, 22 nt, Homo sapiens
ucaagugauccuccugacucag

SEQ ID NO: 2153533 - RNA, 22 nt, Homo sapiens
uagucaauauuugguauuucaa

SEQ ID NO: 2153534 - RNA, 20 nt, Homo sapiens
ucccaggacucugaccccag

SEQ ID NO: 2153535 - RNA, 17 nt, Homo sapiens
uguuacuaaaugguguu

SEQ ID NO: 2153536 - RNA, 18 nt, Homo sapiens
gaaagaugggcaaaagac

SEQ ID NO: 2153537 - RNA, 22 nt, Homo sapiens
uguuuuguaucaaaaucacuau

SEQ ID NO: 2153538 - RNA, 15 nt, Homo sapiens
caagugacaugccau

SEQ ID NO: 2153539 - RNA, 13 nt, Homo sapiens
cuaaccccauuca

SEQ ID NO: 2153540 - RNA, 20 nt, Homo sapiens
uccauuaaauggucuaaaau

SEQ ID NO: 2153541 - RNA, 13 nt, Homo sapiens
auccccuuuauua

SEQ ID NO: 2153542 - RNA, 18 nt, Homo sapiens
auaagcauacaacuggac

SEQ ID NO: 2153543 - RNA, 21 nt, Homo sapiens
gaggaugccacgcacuuccuc

SEQ ID NO: 2153544 - RNA, 21 nt, Homo sapiens
gugugguucauccaucaucug

SEQ ID NO: 2153545 - RNA, 13 nt, Homo sapiens
gauggguggcacc

SEQ ID NO: 2153546 - RNA, 20 nt, Homo sapiens
ucuaaucccuucaaggaagu

SEQ ID NO: 2153547 - RNA, 13 nt, Homo sapiens
ccuccucccucaa

SEQ ID NO: 2153548 - RNA, 16 nt, Homo sapiens
uccucaaauacaugca

SEQ ID NO: 2153549 - RNA, 14 nt, Homo sapiens
gcuucaggcaaagc

SEQ ID NO: 2153550 - RNA, 11 nt, Homo sapiens
auuaauggaaa

SEQ ID NO: 2153551 - RNA, 15 nt, Homo sapiens
uaaaaucuuguucca

SEQ ID NO: 2153552 - RNA, 17 nt, Homo sapiens
ccuauuuuucaauggga

SEQ ID NO: 2153553 - RNA, 20 nt, Homo sapiens
cuccugucuccucugucagu

SEQ ID NO: 2153554 - RNA, 20 nt, Homo sapiens
gccaggcccagccgaccccc

SEQ ID NO: 2153555 - RNA, 23 nt, Homo sapiens
aacauaauuguuaggaccacuga

SEQ ID NO: 2153556 - RNA, 22 nt, Homo sapiens
ggugcagguugggaaugaggcu

SEQ ID NO: 2153557 - RNA, 12 nt, Homo sapiens
cagcaaagccau

SEQ ID NO: 2153558 - RNA, 17 nt, Homo sapiens
uccaauuuuaauuuagu

SEQ ID NO: 2153559 - RNA, 16 nt, Homo sapiens
cucuuucuucauucag

SEQ ID NO: 2153560 - RNA, 22 nt, Homo sapiens
cuugaagauauuuauucugggu

SEQ ID NO: 2153561 - RNA, 17 nt, Homo sapiens
cucuauuuuuuacuaca

SEQ ID NO: 2153562 - RNA, 23 nt, Homo sapiens
ggccuugccugggauaucacuuc

SEQ ID NO: 2153563 - RNA, 13 nt, Homo sapiens
gauuugaauccaa

SEQ ID NO: 2153564 - RNA, 16 nt, Homo sapiens
augacucaagauuccc

SEQ ID NO: 2153565 - RNA, 21 nt, Homo sapiens
aaagaacgcgacuuccacaaa

SEQ ID NO: 2153566 - RNA, 19 nt, Homo sapiens
uugcaguaagccaagguca

SEQ ID NO: 2153567 - RNA, 16 nt, Homo sapiens
ugcccuaggugagaac

SEQ ID NO: 2153568 - RNA, 14 nt, Homo sapiens
ucaaaccugugaag

SEQ ID NO: 2153569 - RNA, 18 nt, Homo sapiens
gcccacaacuugccaaaa

SEQ ID NO: 2153570 - RNA, 13 nt, Homo sapiens
uguccucucugug

SEQ ID NO: 2153571 - RNA, 13 nt, Homo sapiens
ugggcuucuagaa

SEQ ID NO: 2153572 - RNA, 17 nt, Homo sapiens
aucuaccucacuauuca

SEQ ID NO: 2153573 - RNA, 14 nt, Homo sapiens
uggcaaucuugccc

SEQ ID NO: 2153574 - RNA, 18 nt, Homo sapiens
gaccuguauuuaagcaaa

SEQ ID NO: 2153575 - RNA, 18 nt, Homo sapiens
caguaucaguauuuacau

SEQ ID NO: 2153576 - RNA, 13 nt, Homo sapiens
uccugggcagcug

SEQ ID NO: 2153577 - RNA, 19 nt, Homo sapiens
acacugcugggaaguggcu

SEQ ID NO: 2153578 - RNA, 19 nt, Homo sapiens
uggaaucuucucuuugaca

SEQ ID NO: 2153579 - RNA, 14 nt, Homo sapiens
gaagggguccugca

SEQ ID NO: 2153580 - RNA, 13 nt, Homo sapiens
aagugaaggagaa

SEQ ID NO: 2153581 - RNA, 13 nt, Homo sapiens
uaguguaccuccu

SEQ ID NO: 2153582 - RNA, 15 nt, Homo sapiens
acuugcacugugcuu

SEQ ID NO: 2153583 - RNA, 20 nt, Homo sapiens
ugcugaggccacccacugac

SEQ ID NO: 2153584 - RNA, 17 nt, Homo sapiens
caucuugaaguuacaca

SEQ ID NO: 2153585 - RNA, 21 nt, Homo sapiens
gcuuguccuuuggccuuucac

SEQ ID NO: 2153586 - RNA, 20 nt, Homo sapiens
caccuuuucccuuucauguu

SEQ ID NO: 2153587 - RNA, 11 nt, Homo sapiens
uuuccagagag

SEQ ID NO: 2153588 - RNA, 19 nt, Homo sapiens
ccccucaaacucauugcag

SEQ ID NO: 2153589 - RNA, 16 nt, Homo sapiens
cacagaggagugcagc

SEQ ID NO: 2153590 - RNA, 21 nt, Homo sapiens
ccccaaacccagaacaugaag

SEQ ID NO: 2153591 - RNA, 18 nt, Homo sapiens
gagagaauucuguucuaa

SEQ ID NO: 2153592 - RNA, 12 nt, Homo sapiens
cuugcucugagc

SEQ ID NO: 2153593 - RNA, 20 nt, Homo sapiens
aaguguuuguuggcaauuau

SEQ ID NO: 2153594 - RNA, 14 nt, Homo sapiens
guucacugcuccuu

SEQ ID NO: 2153595 - RNA, 14 nt, Homo sapiens
gcccucugccucau

SEQ ID NO: 2153596 - RNA, 12 nt, Homo sapiens
uugaacugccaa

SEQ ID NO: 2153597 - RNA, 14 nt, Homo sapiens
aggacuguaaucuu

SEQ ID NO: 2153598 - RNA, 15 nt, Homo sapiens
ggagaauuacuugaa

SEQ ID NO: 2153599 - RNA, 13 nt, Homo sapiens
uuuuaacucuaga

SEQ ID NO: 2153600 - RNA, 14 nt, Homo sapiens
cauuucacucuggg

SEQ ID NO: 2153601 - RNA, 12 nt, Homo sapiens
acaaaaauauua

SEQ ID NO: 2153602 - RNA, 17 nt, Homo sapiens
auucugauggauucaau

SEQ ID NO: 2153603 - RNA, 20 nt, Homo sapiens
aaacgugcccucuguuugau

SEQ ID NO: 2153604 - RNA, 17 nt, Homo sapiens
auuuuauaccaaagcca

SEQ ID NO: 2153605 - RNA, 18 nt, Homo sapiens
ccuuaagauuuugcaccu

SEQ ID NO: 2153606 - RNA, 19 nt, Homo sapiens
gauaguugauucuugccuu

SEQ ID NO: 2153607 - RNA, 19 nt, Homo sapiens
augagagggugcuauccau

SEQ ID NO: 2153608 - RNA, 15 nt, Homo sapiens
cugccaagaguccaa

SEQ ID NO: 2153609 - RNA, 21 nt, Homo sapiens
gcuggcaguagugcuucagua

SEQ ID NO: 2153610 - RNA, 23 nt, Homo sapiens
auaauuaggaucuaugcaauuuu

SEQ ID NO: 2153611 - RNA, 21 nt, Homo sapiens
ccuacagaagggcagugacuc

SEQ ID NO: 2153612 - RNA, 20 nt, Homo sapiens
aaauauggaacuucuaauau

SEQ ID NO: 2153613 - RNA, 19 nt, Homo sapiens
cauguggccauuaacaaug

SEQ ID NO: 2153614 - RNA, 16 nt, Homo sapiens
agucuguggacacugu

SEQ ID NO: 2153615 - RNA, 12 nt, Homo sapiens
uuaucugcuaug

SEQ ID NO: 2153616 - RNA, 12 nt, Homo sapiens
uauucugcuuag

SEQ ID NO: 2153617 - RNA, 23 nt, Homo sapiens
gccaauuuccucuccacugcugg

SEQ ID NO: 2153618 - RNA, 18 nt, Homo sapiens
uuaaccugcauaaaaagg

SEQ ID NO: 2153619 - RNA, 18 nt, Homo sapiens
gaaaauuguugugcuuag

SEQ ID NO: 2153620 - RNA, 18 nt, Homo sapiens
gcaaacugggaugaaacu

SEQ ID NO: 2153621 - RNA, 17 nt, Homo sapiens
uaauguaggacuguaua

SEQ ID NO: 2153622 - RNA, 19 nt, Homo sapiens
cacccuccccucucuugca

SEQ ID NO: 2153623 - RNA, 13 nt, Homo sapiens
gcagacaccagca

SEQ ID NO: 2153624 - RNA, 13 nt, Homo sapiens
cuuggacuccucc

SEQ ID NO: 2153625 - RNA, 23 nt, Homo sapiens
aucuuccaaccccccaguauaaa

SEQ ID NO: 2153626 - RNA, 22 nt, Homo sapiens
caaggcaaggggugccugggaa

SEQ ID NO: 2153627 - RNA, 22 nt, Homo sapiens
cuccacuguuaccuaaguucuc

SEQ ID NO: 2153628 - RNA, 19 nt, Homo sapiens
ugcauuuguaauucaugaa

SEQ ID NO: 2153629 - RNA, 20 nt, Homo sapiens
cagguuccucaaaacaggcc

SEQ ID NO: 2153630 - RNA, 13 nt, Homo sapiens
ugcacucaucaca

SEQ ID NO: 2153631 - RNA, 20 nt, Homo sapiens
caaauuaaaacaaauauaca

SEQ ID NO: 2153632 - RNA, 14 nt, Homo sapiens
gccagcugggccca

SEQ ID NO: 2153633 - RNA, 21 nt, Homo sapiens
agggacuugaaugcacuuuug

SEQ ID NO: 2153634 - RNA, 17 nt, Homo sapiens
guauuuuccugugccuu

SEQ ID NO: 2153635 - RNA, 20 nt, Homo sapiens
aaauuuuucaaaucauuccu

SEQ ID NO: 2153636 - RNA, 23 nt, Homo sapiens
aguuccaggccugaucuugccug

SEQ ID NO: 2153637 - RNA, 14 nt, Homo sapiens
aaagacuguagaag

SEQ ID NO: 2153638 - RNA, 13 nt, Homo sapiens
ucuccaggcauuu

SEQ ID NO: 2153639 - RNA, 18 nt, Homo sapiens
ggagaagcucacccaaua

SEQ ID NO: 2153640 - RNA, 17 nt, Homo sapiens
gagaacuccucauuccc

SEQ ID NO: 2153641 - RNA, 18 nt, Homo sapiens
agcccuuauggccaauaa

SEQ ID NO: 2153642 - RNA, 13 nt, Homo sapiens
cacaggggagcag

SEQ ID NO: 2153643 - RNA, 13 nt, Homo sapiens
ugaaaacagauga

SEQ ID NO: 2153644 - RNA, 17 nt, Homo sapiens
ugacaugcauucacaua

SEQ ID NO: 2153645 - RNA, 17 nt, Homo sapiens
gccuccugcugccacaa

SEQ ID NO: 2153646 - RNA, 21 nt, Homo sapiens
aucagugaaaaagauguacag

SEQ ID NO: 2153647 - RNA, 13 nt, Homo sapiens
agcugcaaagugu

SEQ ID NO: 2153648 - RNA, 14 nt, Homo sapiens
acaauucaaucaaa

SEQ ID NO: 2153649 - RNA, 12 nt, Homo sapiens
aagacgcccucu

SEQ ID NO: 2153650 - RNA, 18 nt, Homo sapiens
gaaauuguagugcaaaau

SEQ ID NO: 2153651 - RNA, 15 nt, Homo sapiens
accagcaaggggcug

SEQ ID NO: 2153652 - RNA, 21 nt, Homo sapiens
cagaaucccguaacaccugau

SEQ ID NO: 2153653 - RNA, 21 nt, Homo sapiens
cauuucauauuauuuuagugu

SEQ ID NO: 2153654 - RNA, 21 nt, Homo sapiens
gacagggaauagugggaucaa

SEQ ID NO: 2153655 - RNA, 17 nt, Homo sapiens
aguggcauuacauugag

SEQ ID NO: 2153656 - RNA, 16 nt, Homo sapiens
acucuuauuugaauug

SEQ ID NO: 2153657 - RNA, 17 nt, Homo sapiens
cauaauucagcacuuaa

SEQ ID NO: 2153658 - RNA, 16 nt, Homo sapiens
augcaugcccucucug

SEQ ID NO: 2153659 - RNA, 11 nt, Homo sapiens
ugcacaggccu

SEQ ID NO: 2153660 - RNA, 17 nt, Homo sapiens
ccuggagccuccacugc

SEQ ID NO: 2153661 - RNA, 22 nt, Homo sapiens
agccuggugggaaaaugcacac

SEQ ID NO: 2153662 - RNA, 15 nt, Homo sapiens
gccagcuucacucuc

SEQ ID NO: 2153663 - RNA, 21 nt, Homo sapiens
uuaaauauuugaaaauuaccu

SEQ ID NO: 2153664 - RNA, 15 nt, Homo sapiens
cucaguaaaaguaaa

SEQ ID NO: 2153665 - RNA, 23 nt, Homo sapiens
guuuguugugcuugcugguacua

SEQ ID NO: 2153666 - RNA, 20 nt, Homo sapiens
cagagacugggaugggaaca

SEQ ID NO: 2153667 - RNA, 13 nt, Homo sapiens
aaaguuugacagg

SEQ ID NO: 2153668 - RNA, 12 nt, Homo sapiens
aguucacuuccu

SEQ ID NO: 2153669 - RNA, 17 nt, Homo sapiens
agaagcugaggccuaug

SEQ ID NO: 2153670 - RNA, 14 nt, Homo sapiens
aagugcugcuccau

SEQ ID NO: 2153671 - RNA, 23 nt, Homo sapiens
acuccugacccagcccugaacaa

SEQ ID NO: 2153672 - RNA, 22 nt, Homo sapiens
gcucccacggagcaucucagaa

SEQ ID NO: 2153673 - RNA, 20 nt, Homo sapiens
gaauggcucacuauggugcc

SEQ ID NO: 2153674 - RNA, 19 nt, Homo sapiens
uugagacauauuacuggaa

SEQ ID NO: 2153675 - RNA, 23 nt, Homo sapiens
cuagcagaaaucuagaagacugu

SEQ ID NO: 2153676 - RNA, 17 nt, Homo sapiens
gauaucaaaagcaaaua

SEQ ID NO: 2153677 - RNA, 12 nt, Homo sapiens
ucacacuguaag

SEQ ID NO: 2153678 - RNA, 23 nt, Homo sapiens
cuauuaaaaagguuuacagaauu

SEQ ID NO: 2153679 - RNA, 17 nt, Homo sapiens
agaacugguucuugccu

SEQ ID NO: 2153680 - RNA, 22 nt, Homo sapiens
auuuuuucagacugugcaauac

SEQ ID NO: 2153681 - RNA, 21 nt, Homo sapiens
aaauagcggugaaucuaguga

SEQ ID NO: 2153682 - RNA, 17 nt, Homo sapiens
aguauaaauaacuaaug

SEQ ID NO: 2153683 - RNA, 12 nt, Homo sapiens
gggaagccaaaa

SEQ ID NO: 2153684 - RNA, 19 nt, Homo sapiens
gugcccaucaagugcaguc

SEQ ID NO: 2153685 - RNA, 15 nt, Homo sapiens
gucaagcuggugcua

SEQ ID NO: 2153686 - RNA, 17 nt, Homo sapiens
cagccuucugacaagca

SEQ ID NO: 2153687 - RNA, 22 nt, Homo sapiens
cuaaaauaagggcagagucaca

SEQ ID NO: 2153688 - RNA, 14 nt, Homo sapiens
ugcuuguuauuaga

SEQ ID NO: 2153689 - RNA, 22 nt, Homo sapiens
ugaguacaucaccuaacagaau

SEQ ID NO: 2153690 - RNA, 18 nt, Homo sapiens
ugcaguucagcaccaccc

SEQ ID NO: 2153691 - RNA, 16 nt, Homo sapiens
uccccagagcauuuga

SEQ ID NO: 2153692 - RNA, 14 nt, Homo sapiens
uagccaagugcagg

SEQ ID NO: 2153693 - RNA, 14 nt, Homo sapiens
ugcuggacugugga

SEQ ID NO: 2153694 - RNA, 21 nt, Homo sapiens
uccggggagaaacccagagau

SEQ ID NO: 2153695 - RNA, 18 nt, Homo sapiens
cuaagguacacacuuuca

SEQ ID NO: 2153696 - RNA, 18 nt, Homo sapiens
ggggaagagagccugcag

SEQ ID NO: 2153697 - RNA, 11 nt, Homo sapiens
gcagaggucag

SEQ ID NO: 2153698 - RNA, 15 nt, Homo sapiens
gcugcuggagugcag

SEQ ID NO: 2153699 - RNA, 17 nt, Homo sapiens
auuuagacucaucuuac

SEQ ID NO: 2153700 - RNA, 18 nt, Homo sapiens
uacaucauuuuaacagcu

SEQ ID NO: 2153701 - RNA, 19 nt, Homo sapiens
ucacaguaaugcaagcaaa

SEQ ID NO: 2153702 - RNA, 20 nt, Homo sapiens
aacugcagucaucaacaaug

SEQ ID NO: 2153703 - RNA, 14 nt, Homo sapiens
ugguggggggucca

SEQ ID NO: 2153704 - RNA, 22 nt, Homo sapiens
caucucaaaaauaaugcauaaa

SEQ ID NO: 2153705 - RNA, 16 nt, Homo sapiens
gaaacauagccucacc

SEQ ID NO: 2153706 - RNA, 19 nt, Homo sapiens
aagucucacagauugcugc

SEQ ID NO: 2153707 - RNA, 21 nt, Homo sapiens
aucugucugugcacaugccuc

SEQ ID NO: 2153708 - RNA, 20 nt, Homo sapiens
aaaaugcaauguaagcauac

SEQ ID NO: 2153709 - RNA, 20 nt, Homo sapiens
cacuuucuucaaagccacau

SEQ ID NO: 2153710 - RNA, 16 nt, Homo sapiens
aaauuauacacuauga

SEQ ID NO: 2153711 - RNA, 20 nt, Homo sapiens
uccacguguggccuccgucc

SEQ ID NO: 2153712 - RNA, 19 nt, Homo sapiens
accaguauuuaacuucuga

SEQ ID NO: 2153713 - RNA, 23 nt, Homo sapiens
uuacauuuucucugaugauguca

SEQ ID NO: 2153714 - RNA, 21 nt, Homo sapiens
gacuaacauaaaaucugugaa

SEQ ID NO: 2153715 - RNA, 22 nt, Homo sapiens
agguccuggggaggcugagacu

SEQ ID NO: 2153716 - RNA, 15 nt, Homo sapiens
cugaccuuccaaaga

SEQ ID NO: 2153717 - RNA, 18 nt, Homo sapiens
uuaaaaaaaaaauucaau

SEQ ID NO: 2153718 - RNA, 22 nt, Homo sapiens
cauugcucugaauaugucauca

SEQ ID NO: 2153719 - RNA, 23 nt, Homo sapiens
cacugggaugagccgcugugagc

SEQ ID NO: 2153720 - RNA, 17 nt, Homo sapiens
cccaaggccuaccccag

SEQ ID NO: 2153721 - RNA, 19 nt, Homo sapiens
ccagcuggguggacuuugg

SEQ ID NO: 2153722 - RNA, 22 nt, Homo sapiens
uauuuagguuaacaauauuaau

SEQ ID NO: 2153723 - RNA, 16 nt, Homo sapiens
gacaaagacucacucu

SEQ ID NO: 2153724 - RNA, 13 nt, Homo sapiens
agcuggagggacc

SEQ ID NO: 2153725 - RNA, 16 nt, Homo sapiens
uuucaaaaaaucugac

SEQ ID NO: 2153726 - RNA, 20 nt, Homo sapiens
aauucugugacauacauauu

SEQ ID NO: 2153727 - RNA, 17 nt, Homo sapiens
ccuuaaagaaaauugca

SEQ ID NO: 2153728 - RNA, 14 nt, Homo sapiens
acugugucuguccc

SEQ ID NO: 2153729 - RNA, 15 nt, Homo sapiens
cagaagggcagugac

SEQ ID NO: 2153730 - RNA, 22 nt, Homo sapiens
uaagugugaguaaucugagaaa

SEQ ID NO: 2153731 - RNA, 18 nt, Homo sapiens
ugaaggagauagauuugu

SEQ ID NO: 2153732 - RNA, 22 nt, Homo sapiens
uuaagaacuagggagggggaaa

SEQ ID NO: 2153733 - RNA, 19 nt, Homo sapiens
cuucccucggggccauacu

SEQ ID NO: 2153734 - RNA, 19 nt, Homo sapiens
cagagggcagagcacaugg

SEQ ID NO: 2153735 - RNA, 21 nt, Homo sapiens
aucucgccaaccccucucuca

SEQ ID NO: 2153736 - RNA, 12 nt, Homo sapiens
uccaucccgaaa

SEQ ID NO: 2153737 - RNA, 13 nt, Homo sapiens
acaacaugcacau

SEQ ID NO: 2153738 - RNA, 12 nt, Homo sapiens
uuuaaacaguga

SEQ ID NO: 2153739 - RNA, 23 nt, Homo sapiens
gaauguaaaacagagccauuccc

SEQ ID NO: 2153740 - RNA, 14 nt, Homo sapiens
ccagccaugcaaug

SEQ ID NO: 2153741 - RNA, 15 nt, Homo sapiens
ugcugguuaagguga

SEQ ID NO: 2153742 - RNA, 20 nt, Homo sapiens
gccgcuuccccagcucagag

SEQ ID NO: 2153743 - RNA, 15 nt, Homo sapiens
acugggucucacucc

SEQ ID NO: 2153744 - RNA, 15 nt, Homo sapiens
uggaaauguauuuua

SEQ ID NO: 2153745 - RNA, 19 nt, Homo sapiens
acuccugguucagugccac

SEQ ID NO: 2153746 - RNA, 21 nt, Homo sapiens
aggaauuaagugaaaggucac

SEQ ID NO: 2153747 - RNA, 13 nt, Homo sapiens
acuaauuuccugc

SEQ ID NO: 2153748 - RNA, 19 nt, Homo sapiens
gugcuucuggaaacuacca

SEQ ID NO: 2153749 - RNA, 13 nt, Homo sapiens
gggaguacaggcg

SEQ ID NO: 2153750 - RNA, 17 nt, Homo sapiens
aguauuucagaugcuuu

SEQ ID NO: 2153751 - RNA, 22 nt, Homo sapiens
gacaguauauaacuaacaacca

SEQ ID NO: 2153752 - RNA, 16 nt, Homo sapiens
aauugggaaugcaaua

SEQ ID NO: 2153753 - RNA, 22 nt, Homo sapiens
uggcaccuuaguugcaugacca

SEQ ID NO: 2153754 - RNA, 12 nt, Homo sapiens
gauacauuugau

SEQ ID NO: 2153755 - RNA, 15 nt, Homo sapiens
ugacuccucaggguu

SEQ ID NO: 2153756 - RNA, 22 nt, Homo sapiens
gggaaugugccucggccuccaa

SEQ ID NO: 2153757 - RNA, 12 nt, Homo sapiens
ugacuaccagcu

SEQ ID NO: 2153758 - RNA, 17 nt, Homo sapiens
auuuucuuuuccuuuau

SEQ ID NO: 2153759 - RNA, 15 nt, Homo sapiens
ugcucauucauauuc

SEQ ID NO: 2153760 - RNA, 16 nt, Homo sapiens
cuguuggcaagccaca

SEQ ID NO: 2153761 - RNA, 18 nt, Homo sapiens
auugcagcuugaaaaaga

SEQ ID NO: 2153762 - RNA, 15 nt, Homo sapiens
agauguuacuaccuu

SEQ ID NO: 2153763 - RNA, 15 nt, Homo sapiens
auauuaaguaaaaaa

SEQ ID NO: 2153764 - RNA, 18 nt, Homo sapiens
gcccuuuucucucaccca

SEQ ID NO: 2153765 - RNA, 18 nt, Homo sapiens
uccuucugucuccagggc

SEQ ID NO: 2153766 - RNA, 21 nt, Homo sapiens
ucacugccccagacacagugc

SEQ ID NO: 2153767 - RNA, 14 nt, Homo sapiens
acuuacuacaaucu

SEQ ID NO: 2153768 - RNA, 15 nt, Homo sapiens
ugggagaaggcagug

SEQ ID NO: 2153769 - RNA, 20 nt, Homo sapiens
agagaaccaugaaaacaaug

SEQ ID NO: 2153770 - RNA, 17 nt, Homo sapiens
cagacaugccacaagga

SEQ ID NO: 2153771 - RNA, 12 nt, Homo sapiens
cgcccucaggcu

SEQ ID NO: 2153772 - RNA, 21 nt, Homo sapiens
agauggaguucuugugccaua

SEQ ID NO: 2153773 - RNA, 12 nt, Homo sapiens
ccuucucagcuc

SEQ ID NO: 2153774 - RNA, 14 nt, Homo sapiens
cauguuuugcuaau

SEQ ID NO: 2153775 - RNA, 13 nt, Homo sapiens
ucccuccaccagc

SEQ ID NO: 2153776 - RNA, 22 nt, Homo sapiens
uccccucacuucucccaccugc

SEQ ID NO: 2153777 - RNA, 13 nt, Homo sapiens
uuuggugaacugu

SEQ ID NO: 2153778 - RNA, 22 nt, Homo sapiens
gagguccuucuguagugccaug

SEQ ID NO: 2153779 - RNA, 22 nt, Homo sapiens
uugagugagcaccuccccagau

SEQ ID NO: 2153780 - RNA, 18 nt, Homo sapiens
gcugaugauuuugcaaaa

SEQ ID NO: 2153781 - RNA, 19 nt, Homo sapiens
guuucagagacaacuuccc

SEQ ID NO: 2153782 - RNA, 22 nt, Homo sapiens
cuuggagaaaauggguuuauuc

SEQ ID NO: 2153783 - RNA, 23 nt, Homo sapiens
ucugggucuuucugacaucagca

SEQ ID NO: 2153784 - RNA, 15 nt, Homo sapiens
agggcauguguaugu

SEQ ID NO: 2153785 - RNA, 20 nt, Homo sapiens
uguguaacuguucuuugcag

SEQ ID NO: 2153786 - RNA, 12 nt, Homo sapiens
uaagacuaugau

SEQ ID NO: 2153787 - RNA, 18 nt, Homo sapiens
uccaguuuaaucuucaca

SEQ ID NO: 2153788 - RNA, 19 nt, Homo sapiens
ugccuggaaauuaaacccu

SEQ ID NO: 2153789 - RNA, 21 nt, Homo sapiens
uuagauauuaggucccaucaa

SEQ ID NO: 2153790 - RNA, 17 nt, Homo sapiens
aagagagagacccucac

SEQ ID NO: 2153791 - RNA, 21 nt, Homo sapiens
cucaaggcugugcaggcacau

SEQ ID NO: 2153792 - RNA, 12 nt, Homo sapiens
cuaguacuauug

SEQ ID NO: 2153793 - RNA, 12 nt, Homo sapiens
cuauuacuauuu

SEQ ID NO: 2153794 - RNA, 12 nt, Homo sapiens
cucaaucucuga

SEQ ID NO: 2153795 - RNA, 19 nt, Homo sapiens
auugaugccaguggaauac

SEQ ID NO: 2153796 - RNA, 15 nt, Homo sapiens
agcagguguacacau

SEQ ID NO: 2153797 - RNA, 23 nt, Homo sapiens
aauaauggucaguccucaucucu

SEQ ID NO: 2153798 - RNA, 23 nt, Homo sapiens
auuuaaaaugugugccauauucu

SEQ ID NO: 2153799 - RNA, 22 nt, Homo sapiens
augggauugcacagagcuggag

SEQ ID NO: 2153800 - RNA, 15 nt, Homo sapiens
cauuuccugugucag

SEQ ID NO: 2153801 - RNA, 13 nt, Homo sapiens
auuguacaagcag

SEQ ID NO: 2153802 - RNA, 23 nt, Homo sapiens
gcgaaaucccugcucacugcagc

SEQ ID NO: 2153803 - RNA, 22 nt, Homo sapiens
cuaagaaaaaggaaaaccauuc

SEQ ID NO: 2153804 - RNA, 14 nt, Homo sapiens
acagaccucaaggg

SEQ ID NO: 2153805 - RNA, 14 nt, Homo sapiens
aauggcuacacuca

SEQ ID NO: 2153806 - RNA, 19 nt, Homo sapiens
gcaaucugagagauuugaa

SEQ ID NO: 2153807 - RNA, 17 nt, Homo sapiens
aaguccugcaagcagag

SEQ ID NO: 2153808 - RNA, 14 nt, Homo sapiens
uuguauauguaauu

SEQ ID NO: 2153809 - RNA, 14 nt, Homo sapiens
aucccccuguggaa

SEQ ID NO: 2153810 - RNA, 21 nt, Homo sapiens
ugagccaccuucccuccucau

SEQ ID NO: 2153811 - RNA, 14 nt, Homo sapiens
ucccauggcccagc

SEQ ID NO: 2153812 - RNA, 18 nt, Homo sapiens
ugccccgccuccccgaaa

SEQ ID NO: 2153813 - RNA, 15 nt, Homo sapiens
agugcaacaucucug

SEQ ID NO: 2153814 - RNA, 20 nt, Homo sapiens
aaguucuuggugguggauga

SEQ ID NO: 2153815 - RNA, 15 nt, Homo sapiens
uaaauaaaacaugca

SEQ ID NO: 2153816 - RNA, 21 nt, Homo sapiens
ccauaggacauacugcaugua

SEQ ID NO: 2153817 - RNA, 20 nt, Homo sapiens
ugagccacugcgcccggcca

SEQ ID NO: 2153818 - RNA, 19 nt, Homo sapiens
uccaucucaagugccauau

SEQ ID NO: 2153819 - RNA, 12 nt, Homo sapiens
cuuaucuugcac

SEQ ID NO: 2153820 - RNA, 12 nt, Homo sapiens
gcucucuucuaa

SEQ ID NO: 2153821 - RNA, 21 nt, Homo sapiens
cuuccaaguccuuuaucugca

SEQ ID NO: 2153822 - RNA, 14 nt, Homo sapiens
caggugacugccac

SEQ ID NO: 2153823 - RNA, 14 nt, Homo sapiens
agaugaacucuucu

SEQ ID NO: 2153824 - RNA, 23 nt, Homo sapiens
uauuuuuuuucuuguauuuuucc

SEQ ID NO: 2153825 - RNA, 22 nt, Homo sapiens
augucuuuuuuuuaaugugcug

SEQ ID NO: 2153826 - RNA, 14 nt, Homo sapiens
ccugcgcaaagggc

SEQ ID NO: 2153827 - RNA, 14 nt, Homo sapiens
cuuggagacuccug

SEQ ID NO: 2153828 - RNA, 21 nt, Homo sapiens
gaucccugugccucuucccau

SEQ ID NO: 2153829 - RNA, 14 nt, Homo sapiens
acugugcaguuuuc

SEQ ID NO: 2153830 - RNA, 14 nt, Homo sapiens
auauuccagcagug

SEQ ID NO: 2153831 - RNA, 16 nt, Homo sapiens
gcgccuggccagagcc

SEQ ID NO: 2153832 - RNA, 23 nt, Homo sapiens
aaaacuuaucugagucacuugaa

SEQ ID NO: 2153833 - RNA, 20 nt, Homo sapiens
agaaaaaauaacacacauau

SEQ ID NO: 2153834 - RNA, 20 nt, Homo sapiens
aacucuuaacugaagaaaga

SEQ ID NO: 2153835 - RNA, 12 nt, Homo sapiens
caggcaccugca

SEQ ID NO: 2153836 - RNA, 22 nt, Homo sapiens
cauuguuggaguguaaaccaaa

SEQ ID NO: 2153837 - RNA, 17 nt, Homo sapiens
ugcugaaaaaucaucca

SEQ ID NO: 2153838 - RNA, 12 nt, Homo sapiens
ucaucaaaaaga

SEQ ID NO: 2153839 - RNA, 13 nt, Homo sapiens
aagauauuguaca

SEQ ID NO: 2153840 - RNA, 19 nt, Homo sapiens
acccagcaugcuaccugaa

SEQ ID NO: 2153841 - RNA, 19 nt, Homo sapiens
cuuaaucaggaguucugcc

SEQ ID NO: 2153842 - RNA, 12 nt, Homo sapiens
aggcugucacag

SEQ ID NO: 2153843 - RNA, 20 nt, Homo sapiens
ucccuacccuaaccaaguuc

SEQ ID NO: 2153844 - RNA, 14 nt, Homo sapiens
ccucuagcucuggu

SEQ ID NO: 2153845 - RNA, 14 nt, Homo sapiens
agcugccaagcacu

SEQ ID NO: 2153846 - RNA, 18 nt, Homo sapiens
uugguuaccuauugcugu

SEQ ID NO: 2153847 - RNA, 14 nt, Homo sapiens
aaauuauagaaucu

SEQ ID NO: 2153848 - RNA, 21 nt, Homo sapiens
ucauuugggcuuucuguugaa

SEQ ID NO: 2153849 - RNA, 16 nt, Homo sapiens
cauagugccuggcaua

SEQ ID NO: 2153850 - RNA, 21 nt, Homo sapiens
agacacaguauugacuucuuu

SEQ ID NO: 2153851 - RNA, 23 nt, Homo sapiens
auuuacuuguuauguuguaauau

SEQ ID NO: 2153852 - RNA, 22 nt, Homo sapiens
uucccaaaagcccauucauucc

SEQ ID NO: 2153853 - RNA, 20 nt, Homo sapiens
ucuucuuuauuauaguccua

SEQ ID NO: 2153854 - RNA, 13 nt, Homo sapiens
guagcacugggaa

SEQ ID NO: 2153855 - RNA, 19 nt, Homo sapiens
uacuguucaauuucagaaa

SEQ ID NO: 2153856 - RNA, 19 nt, Homo sapiens
aucccuacugccaaccugg

SEQ ID NO: 2153857 - RNA, 22 nt, Homo sapiens
agauggggaaacugagggcaga

SEQ ID NO: 2153858 - RNA, 20 nt, Homo sapiens
cuguuaccugaucaaugaca

SEQ ID NO: 2153859 - RNA, 16 nt, Homo sapiens
acuucuccaggucuca

SEQ ID NO: 2153860 - RNA, 16 nt, Homo sapiens
ucucugucuggcugua

SEQ ID NO: 2153861 - RNA, 21 nt, Homo sapiens
uuaaaccgugauucuugaaag

SEQ ID NO: 2153862 - RNA, 22 nt, Homo sapiens
aaaauccccucagccucuucuc

SEQ ID NO: 2153863 - RNA, 17 nt, Homo sapiens
aaggaguaaguacaaau

SEQ ID NO: 2153864 - RNA, 23 nt, Homo sapiens
acuacuaguuaggauauugauuu

SEQ ID NO: 2153865 - RNA, 22 nt, Homo sapiens
ucauauuuggugaugagacuua

SEQ ID NO: 2153866 - RNA, 17 nt, Homo sapiens
ugaauguugcaauguga

SEQ ID NO: 2153867 - RNA, 15 nt, Homo sapiens
cauaaagacuaagua

SEQ ID NO: 2153868 - RNA, 14 nt, Homo sapiens
cguggagacagggc

SEQ ID NO: 2153869 - RNA, 21 nt, Homo sapiens
auccugaguaguaaucucaca

SEQ ID NO: 2153870 - RNA, 14 nt, Homo sapiens
uaugcccacuuuag

SEQ ID NO: 2153871 - RNA, 12 nt, Homo sapiens
cugucucaguga

SEQ ID NO: 2153872 - RNA, 13 nt, Homo sapiens
ugucuucagagaa

SEQ ID NO: 2153873 - RNA, 21 nt, Homo sapiens
uguaaaauauuuaugagaaag

SEQ ID NO: 2153874 - RNA, 17 nt, Homo sapiens
ggugccucucucuugcu

SEQ ID NO: 2153875 - RNA, 18 nt, Homo sapiens
acuuauaccugcuaucag

SEQ ID NO: 2153876 - RNA, 12 nt, Homo sapiens
cuggagauccuc

SEQ ID NO: 2153877 - RNA, 18 nt, Homo sapiens
auccugcuagcuguagaa

SEQ ID NO: 2153878 - RNA, 20 nt, Homo sapiens
caaaugccugguaccagagg

SEQ ID NO: 2153879 - RNA, 16 nt, Homo sapiens
agagcugacacaggau

SEQ ID NO: 2153880 - RNA, 18 nt, Homo sapiens
acuguacucugcacuggu

SEQ ID NO: 2153881 - RNA, 16 nt, Homo sapiens
caacuguaaagcaaau

SEQ ID NO: 2153882 - RNA, 21 nt, Homo sapiens
cuuuauguacaaacauguugu

SEQ ID NO: 2153883 - RNA, 21 nt, Homo sapiens
guugugcagucagugucaauc

SEQ ID NO: 2153884 - RNA, 19 nt, Homo sapiens
ugaacaucgagaugccuga

SEQ ID NO: 2153885 - RNA, 18 nt, Homo sapiens
cuaaaaaugaaaauucua

SEQ ID NO: 2153886 - RNA, 23 nt, Homo sapiens
uuguuuaccauagaaagaugaca

SEQ ID NO: 2153887 - RNA, 15 nt, Homo sapiens
gacaccugccuuaac

SEQ ID NO: 2153888 - RNA, 16 nt, Homo sapiens
caaaaucaaaacagag

SEQ ID NO: 2153889 - RNA, 16 nt, Homo sapiens
augagcucccucgcug

SEQ ID NO: 2153890 - RNA, 19 nt, Homo sapiens
uggaggacuagaaccugga

SEQ ID NO: 2153891 - RNA, 22 nt, Homo sapiens
gcugcacuuauguaaacaauca

SEQ ID NO: 2153892 - RNA, 23 nt, Homo sapiens
ugacauucacccuucaacauaaa

SEQ ID NO: 2153893 - RNA, 23 nt, Homo sapiens
uaucccuugguuuagaggaaccc

SEQ ID NO: 2153894 - RNA, 14 nt, Homo sapiens
acuucccaaggaaa

SEQ ID NO: 2153895 - RNA, 19 nt, Homo sapiens
uaaaauaaaauauacccau

SEQ ID NO: 2153896 - RNA, 14 nt, Homo sapiens
agcacuuacagaua

SEQ ID NO: 2153897 - RNA, 20 nt, Homo sapiens
ccuugcaucaaggggucacu

SEQ ID NO: 2153898 - RNA, 22 nt, Homo sapiens
aaugacauuauauucuguucca

SEQ ID NO: 2153899 - RNA, 19 nt, Homo sapiens
aacuucucuugcuuucuau

SEQ ID NO: 2153900 - RNA, 17 nt, Homo sapiens
uguuccugaugugccag

SEQ ID NO: 2153901 - RNA, 20 nt, Homo sapiens
uuugugggauuuuaguaaga

SEQ ID NO: 2153902 - RNA, 12 nt, Homo sapiens
gccuccaaagca

SEQ ID NO: 2153903 - RNA, 23 nt, Homo sapiens
uuuauuguguguucucacaguga

SEQ ID NO: 2153904 - RNA, 23 nt, Homo sapiens
uuauugaguaauauuacauuuca

SEQ ID NO: 2153905 - RNA, 17 nt, Homo sapiens
cacuguugcccaggcug

SEQ ID NO: 2153906 - RNA, 17 nt, Homo sapiens
auauaugcacuauguau

SEQ ID NO: 2153907 - RNA, 13 nt, Homo sapiens
ucucuaagacaaa

SEQ ID NO: 2153908 - RNA, 13 nt, Homo sapiens
uaaucauauauca

SEQ ID NO: 2153909 - RNA, 13 nt, Homo sapiens
aacccuguguuca

SEQ ID NO: 2153910 - RNA, 19 nt, Homo sapiens
ccuaccguacucccugcac

SEQ ID NO: 2153911 - RNA, 17 nt, Homo sapiens
guugcacggcugcugag

SEQ ID NO: 2153912 - RNA, 17 nt, Homo sapiens
cucugguuuucuugcca

SEQ ID NO: 2153913 - RNA, 16 nt, Homo sapiens
cauaaaggacaggcca

SEQ ID NO: 2153914 - RNA, 22 nt, Homo sapiens
acagcugaacaguguuaauaau

SEQ ID NO: 2153915 - RNA, 16 nt, Homo sapiens
auuguacugguacaaa

SEQ ID NO: 2153916 - RNA, 14 nt, Homo sapiens
ggacuucagcucag

SEQ ID NO: 2153917 - RNA, 23 nt, Homo sapiens
gaucauuugcccuuaaggacaaa

SEQ ID NO: 2153918 - RNA, 21 nt, Homo sapiens
cuguaaagacuuuuucaaaga

SEQ ID NO: 2153919 - RNA, 16 nt, Homo sapiens
aggaacguuuagcuga

SEQ ID NO: 2153920 - RNA, 18 nt, Homo sapiens
ggaaaaacuugugcuaua

SEQ ID NO: 2153921 - RNA, 15 nt, Homo sapiens
augaugaguccagaa

SEQ ID NO: 2153922 - RNA, 15 nt, Homo sapiens
cggcauggugccugg

SEQ ID NO: 2153923 - RNA, 16 nt, Homo sapiens
agucucuugauucaua

SEQ ID NO: 2153924 - RNA, 18 nt, Homo sapiens
cuggccucccaccaggaa

SEQ ID NO: 2153925 - RNA, 13 nt, Homo sapiens
uuaggacuuucca

SEQ ID NO: 2153926 - RNA, 22 nt, Homo sapiens
caggaaaugggcuuuucaggaa

SEQ ID NO: 2153927 - RNA, 12 nt, Homo sapiens
gaacaagccaca

SEQ ID NO: 2153928 - RNA, 17 nt, Homo sapiens
caagucacagacuggga

SEQ ID NO: 2153929 - RNA, 15 nt, Homo sapiens
uacaucaaaugcuca

SEQ ID NO: 2153930 - RNA, 18 nt, Homo sapiens
agcccucaauaagccagc

SEQ ID NO: 2153931 - RNA, 15 nt, Homo sapiens
uaagacaaacacugc

SEQ ID NO: 2153932 - RNA, 15 nt, Homo sapiens
gcaaccauauuugua

SEQ ID NO: 2153933 - RNA, 21 nt, Homo sapiens
ucagccugcuuuccugcagca

SEQ ID NO: 2153934 - RNA, 22 nt, Homo sapiens
cagcagaggcguacuacccagc

SEQ ID NO: 2153935 - RNA, 22 nt, Homo sapiens
caugccuccuucccaggaccca

SEQ ID NO: 2153936 - RNA, 14 nt, Homo sapiens
acccaaagcaaaac

SEQ ID NO: 2153937 - RNA, 14 nt, Homo sapiens
gaccugguacugag

SEQ ID NO: 2153938 - RNA, 20 nt, Homo sapiens
gaauaucagaaguauaucug

SEQ ID NO: 2153939 - RNA, 23 nt, Homo sapiens
auacugcaauaaauuauggcucu

SEQ ID NO: 2153940 - RNA, 16 nt, Homo sapiens
acagaaccugcaaaua

SEQ ID NO: 2153941 - RNA, 16 nt, Homo sapiens
uccucaugaauguaaa

SEQ ID NO: 2153942 - RNA, 19 nt, Homo sapiens
ggaaauuuggaagaugguu

SEQ ID NO: 2153943 - RNA, 16 nt, Homo sapiens
cuggggccaacuggaa

SEQ ID NO: 2153944 - RNA, 15 nt, Homo sapiens
ugcaguagccguuug

SEQ ID NO: 2153945 - RNA, 23 nt, Homo sapiens
gccugucgcaugagaacauuaac

SEQ ID NO: 2153946 - RNA, 17 nt, Homo sapiens
ccuucaacguuucuuca

SEQ ID NO: 2153947 - RNA, 22 nt, Homo sapiens
aacuaauaaaagcauaaaugca

SEQ ID NO: 2153948 - RNA, 17 nt, Homo sapiens
cggucagccacaccagg

SEQ ID NO: 2153949 - RNA, 14 nt, Homo sapiens
auuuuuugaacuuu

SEQ ID NO: 2153950 - RNA, 14 nt, Homo sapiens
cauacaaagcaguu

SEQ ID NO: 2153951 - RNA, 15 nt, Homo sapiens
ggaggagagccacug

SEQ ID NO: 2153952 - RNA, 15 nt, Homo sapiens
agcagagaacuggaa

SEQ ID NO: 2153953 - RNA, 19 nt, Homo sapiens
gaaaguacacucugcuguu

SEQ ID NO: 2153954 - RNA, 20 nt, Homo sapiens
acagggagacugcaucucaa

SEQ ID NO: 2153955 - RNA, 17 nt, Homo sapiens
agaaggcuggggccagu

SEQ ID NO: 2153956 - RNA, 22 nt, Homo sapiens
aauuuucuuccuuugaagcuuu

SEQ ID NO: 2153957 - RNA, 18 nt, Homo sapiens
cauuaaccugaggucucu

SEQ ID NO: 2153958 - RNA, 22 nt, Homo sapiens
agaaggcagcaggcggccuuug

SEQ ID NO: 2153959 - RNA, 13 nt, Homo sapiens
ggccucacucugg

SEQ ID NO: 2153960 - RNA, 17 nt, Homo sapiens
ccucugcgccccagcga

SEQ ID NO: 2153961 - RNA, 17 nt, Homo sapiens
uauaaauauacauauaa

SEQ ID NO: 2153962 - RNA, 16 nt, Homo sapiens
uaucggcucacaaaga

SEQ ID NO: 2153963 - RNA, 21 nt, Homo sapiens
aucuuuagugcuuucuuguca

SEQ ID NO: 2153964 - RNA, 12 nt, Homo sapiens
gcuaaagggaaa

SEQ ID NO: 2153965 - RNA, 23 nt, Homo sapiens
acuguacuuguagaguggugcug

SEQ ID NO: 2153966 - RNA, 13 nt, Homo sapiens
uggaaggggucca

SEQ ID NO: 2153967 - RNA, 18 nt, Homo sapiens
cauugcagcaagcaauaa

SEQ ID NO: 2153968 - RNA, 12 nt, Homo sapiens
aacaacuuguac

SEQ ID NO: 2153969 - RNA, 21 nt, Homo sapiens
uucauuccuaacacagcaugu

SEQ ID NO: 2153970 - RNA, 22 nt, Homo sapiens
uugguuuccaaaggcauuuuau

SEQ ID NO: 2153971 - RNA, 19 nt, Homo sapiens
gccagacuggagugcagug

SEQ ID NO: 2153972 - RNA, 18 nt, Homo sapiens
auuauggugauacuccaa

SEQ ID NO: 2153973 - RNA, 13 nt, Homo sapiens
gcggaaugcauug

SEQ ID NO: 2153974 - RNA, 19 nt, Homo sapiens
gucaccaaacggugaauau

SEQ ID NO: 2153975 - RNA, 16 nt, Homo sapiens
cuuuuauuuccaguga

SEQ ID NO: 2153976 - RNA, 22 nt, Homo sapiens
uacccuauucuauccaucuccu

SEQ ID NO: 2153977 - RNA, 14 nt, Homo sapiens
agagaguccagcua

SEQ ID NO: 2153978 - RNA, 23 nt, Homo sapiens
cuuguaacaagaaaacauaagag

SEQ ID NO: 2153979 - RNA, 12 nt, Homo sapiens
cuuuaaauauca

SEQ ID NO: 2153980 - RNA, 22 nt, Homo sapiens
ucaacacuauuguaaucauuug

SEQ ID NO: 2153981 - RNA, 21 nt, Homo sapiens
cuagagugacaggcaccagau

SEQ ID NO: 2153982 - RNA, 20 nt, Homo sapiens
gggacuggggggccauuucc

SEQ ID NO: 2153983 - RNA, 18 nt, Homo sapiens
uccucuccucguccggcc

SEQ ID NO: 2153984 - RNA, 19 nt, Homo sapiens
ccucauccucuccacagcu

SEQ ID NO: 2153985 - RNA, 19 nt, Homo sapiens
gcaauaagauugcgccuga

SEQ ID NO: 2153986 - RNA, 12 nt, Homo sapiens
aaagccucugau

SEQ ID NO: 2153987 - RNA, 13 nt, Homo sapiens
ccuuccuccauug

SEQ ID NO: 2153988 - RNA, 21 nt, Homo sapiens
aaaacuauguucagaacuuca

SEQ ID NO: 2153989 - RNA, 13 nt, Homo sapiens
ugugggacugaga

SEQ ID NO: 2153990 - RNA, 16 nt, Homo sapiens
ccuaccaguugcccua

SEQ ID NO: 2153991 - RNA, 20 nt, Homo sapiens
uaggccaggcacaguggcuc

SEQ ID NO: 2153992 - RNA, 15 nt, Homo sapiens
guuucuugggguccc

SEQ ID NO: 2153993 - RNA, 21 nt, Homo sapiens
aggucgaccccaaagccccuu

SEQ ID NO: 2153994 - RNA, 17 nt, Homo sapiens
guguauaugaaugaaua

SEQ ID NO: 2153995 - RNA, 21 nt, Homo sapiens
agaucgugccauugcacucca

SEQ ID NO: 2153996 - RNA, 16 nt, Homo sapiens
uagugugugugcaugu

SEQ ID NO: 2153997 - RNA, 18 nt, Homo sapiens
ugcauuagaaacugaaaa

SEQ ID NO: 2153998 - RNA, 14 nt, Homo sapiens
gacuuauguggaac

SEQ ID NO: 2153999 - RNA, 23 nt, Homo sapiens
cccaugccuggucccaagacagu

SEQ ID NO: 2154000 - RNA, 20 nt, Homo sapiens
uaaaaaggaaauuagucuuu

SEQ ID NO: 2154001 - RNA, 13 nt, Homo sapiens
gucagcacuucca

SEQ ID NO: 2154002 - RNA, 17 nt, Homo sapiens
ucggauacacacucgaa

SEQ ID NO: 2154003 - RNA, 24 nt, Homo sapiens
aaucuuuccucuucucauuaccag

SEQ ID NO: 2154004 - RNA, 15 nt, Homo sapiens
gccuccccagcucac

SEQ ID NO: 2154005 - RNA, 15 nt, Homo sapiens
ggccuuaauggacau

SEQ ID NO: 2154006 - RNA, 22 nt, Homo sapiens
caggaaucgguggucuccaccu

SEQ ID NO: 2154007 - RNA, 19 nt, Homo sapiens
agaggagcguguccuaucc

SEQ ID NO: 2154008 - RNA, 17 nt, Homo sapiens
gagagaaagaaugagaa

SEQ ID NO: 2154009 - RNA, 17 nt, Homo sapiens
uuaaaagaauguaaaau

SEQ ID NO: 2154010 - RNA, 17 nt, Homo sapiens
auuugaguauugcugau

SEQ ID NO: 2154011 - RNA, 22 nt, Homo sapiens
gagcagcucuucagcacaaaga

SEQ ID NO: 2154012 - RNA, 19 nt, Homo sapiens
uugaggcuaaguaaccuga

SEQ ID NO: 2154013 - RNA, 16 nt, Homo sapiens
uauugaaugguggugg

SEQ ID NO: 2154014 - RNA, 20 nt, Homo sapiens
ugccauuauauuugcauuau

SEQ ID NO: 2154015 - RNA, 16 nt, Homo sapiens
caggauccagugacau

SEQ ID NO: 2154016 - RNA, 22 nt, Homo sapiens
uauucuccucggacugugugca

SEQ ID NO: 2154017 - RNA, 20 nt, Homo sapiens
caggaaagaauagaagugau

SEQ ID NO: 2154018 - RNA, 22 nt, Homo sapiens
gcacugaagcugcggcccugau

SEQ ID NO: 2154019 - RNA, 19 nt, Homo sapiens
cuuuagagaaguauacaua

SEQ ID NO: 2154020 - RNA, 17 nt, Homo sapiens
gcaacauuaugauuaau

SEQ ID NO: 2154021 - RNA, 14 nt, Homo sapiens
cauccaucuuucca

SEQ ID NO: 2154022 - RNA, 13 nt, Homo sapiens
acacaaagacauu

SEQ ID NO: 2154023 - RNA, 15 nt, Homo sapiens
gucaaaacacugugg

SEQ ID NO: 2154024 - RNA, 16 nt, Homo sapiens
cucuggacgugaaaua

SEQ ID NO: 2154025 - RNA, 15 nt, Homo sapiens
caaaaaccuauucca

SEQ ID NO: 2154026 - RNA, 21 nt, Homo sapiens
aaaaugacaauaucaaucaca

SEQ ID NO: 2154027 - RNA, 16 nt, Homo sapiens
auaaagauacaugauu

SEQ ID NO: 2154028 - RNA, 19 nt, Homo sapiens
uagaagugucacagccaua

SEQ ID NO: 2154029 - RNA, 18 nt, Homo sapiens
caccauuauaaugaauuu

SEQ ID NO: 2154030 - RNA, 14 nt, Homo sapiens
cagaaguguauuca

SEQ ID NO: 2154031 - RNA, 20 nt, Homo sapiens
cauuuguguuuugaaagccc

SEQ ID NO: 2154032 - RNA, 22 nt, Homo sapiens
guauuuguucauguuuggugca

SEQ ID NO: 2154033 - RNA, 20 nt, Homo sapiens
gaaucaagucagcaacagag

SEQ ID NO: 2154034 - RNA, 21 nt, Homo sapiens
uaaauguauacuauaguacca

SEQ ID NO: 2154035 - RNA, 18 nt, Homo sapiens
uguccccuccacugucac

SEQ ID NO: 2154036 - RNA, 15 nt, Homo sapiens
ccucugcuuacuuuu

SEQ ID NO: 2154037 - RNA, 16 nt, Homo sapiens
acauauauaugucagg

SEQ ID NO: 2154038 - RNA, 15 nt, Homo sapiens
aauuuuuacauucau

SEQ ID NO: 2154039 - RNA, 14 nt, Homo sapiens
ugcagggacugcca

SEQ ID NO: 2154040 - RNA, 11 nt, Homo sapiens
agguucacuuu

SEQ ID NO: 2154041 - RNA, 18 nt, Homo sapiens
aagugugaccccacugcc

SEQ ID NO: 2154042 - RNA, 15 nt, Homo sapiens
cucaguucugccuua

SEQ ID NO: 2154043 - RNA, 17 nt, Homo sapiens
acaccaggagagcuucu

SEQ ID NO: 2154044 - RNA, 17 nt, Homo sapiens
ugauauuuuuacuugca

SEQ ID NO: 2154045 - RNA, 17 nt, Homo sapiens
uccuccuugucuuggca

SEQ ID NO: 2154046 - RNA, 17 nt, Homo sapiens
auuuucuaaccaaauac

SEQ ID NO: 2154047 - RNA, 19 nt, Homo sapiens
aagugaggggaacagggug

SEQ ID NO: 2154048 - RNA, 13 nt, Homo sapiens
agcuuuuuuacac

SEQ ID NO: 2154049 - RNA, 22 nt, Homo sapiens
agaccuuuucccugcaccacuc

SEQ ID NO: 2154050 - RNA, 14 nt, Homo sapiens
aaucuuguuuccaa

SEQ ID NO: 2154051 - RNA, 18 nt, Homo sapiens
uuuggggggcgugcaugu

SEQ ID NO: 2154052 - RNA, 18 nt, Homo sapiens
caccucaagguguucucu

SEQ ID NO: 2154053 - RNA, 19 nt, Homo sapiens
caaaccccagggcacugag

SEQ ID NO: 2154054 - RNA, 16 nt, Homo sapiens
acccagggaaugccag

SEQ ID NO: 2154055 - RNA, 14 nt, Homo sapiens
ccucucacaaaaga

SEQ ID NO: 2154056 - RNA, 15 nt, Homo sapiens
ccaccuguuguccug

SEQ ID NO: 2154057 - RNA, 14 nt, Homo sapiens
uccccgggggagga

SEQ ID NO: 2154058 - RNA, 15 nt, Homo sapiens
aaauccuccaaucaa

SEQ ID NO: 2154059 - RNA, 15 nt, Homo sapiens
auucccaccuuccau

SEQ ID NO: 2154060 - RNA, 19 nt, Homo sapiens
ccaaagccacuggaaggag

SEQ ID NO: 2154061 - RNA, 20 nt, Homo sapiens
cuguaucuugauguuuagaa

SEQ ID NO: 2154062 - RNA, 23 nt, Homo sapiens
gagcagugggaggguaccagcag

SEQ ID NO: 2154063 - RNA, 14 nt, Homo sapiens
cuugcuucauucug

SEQ ID NO: 2154064 - RNA, 21 nt, Homo sapiens
ucaacacauauuuuuauauua

SEQ ID NO: 2154065 - RNA, 19 nt, Homo sapiens
gccacccggaucuccaggc

SEQ ID NO: 2154066 - RNA, 17 nt, Homo sapiens
caagcugccugccugag

SEQ ID NO: 2154067 - RNA, 13 nt, Homo sapiens
cucuuugacaaaa

SEQ ID NO: 2154068 - RNA, 20 nt, Homo sapiens
cauggugaaaccccgucucu

SEQ ID NO: 2154069 - RNA, 20 nt, Homo sapiens
caugguaaaaccccaucucu

SEQ ID NO: 2154070 - RNA, 16 nt, Homo sapiens
ugaagagacaggcacc

SEQ ID NO: 2154071 - RNA, 15 nt, Homo sapiens
ggagggagguggucc

SEQ ID NO: 2154072 - RNA, 15 nt, Homo sapiens
acagcuucaugccuu

SEQ ID NO: 2154073 - RNA, 17 nt, Homo sapiens
caaguuauagauucaau

SEQ ID NO: 2154074 - RNA, 14 nt, Homo sapiens
ucaccucucaaggu

SEQ ID NO: 2154075 - RNA, 20 nt, Homo sapiens
uucgccauucauucauacuu

SEQ ID NO: 2154076 - RNA, 18 nt, Homo sapiens
agucuucuccuccaugaa

SEQ ID NO: 2154077 - RNA, 15 nt, Homo sapiens
uaaucucuauuugag

SEQ ID NO: 2154078 - RNA, 18 nt, Homo sapiens
uucucagagugguucuga

SEQ ID NO: 2154079 - RNA, 23 nt, Homo sapiens
cauuaaacuaauuaaacugaugg

SEQ ID NO: 2154080 - RNA, 15 nt, Homo sapiens
gaauaccuucuucgc

SEQ ID NO: 2154081 - RNA, 18 nt, Homo sapiens
acuugucauagacuccuu

SEQ ID NO: 2154082 - RNA, 22 nt, Homo sapiens
cucccuguaaugcacuccugcc

SEQ ID NO: 2154083 - RNA, 20 nt, Homo sapiens
caaauguacagugguccuuu

SEQ ID NO: 2154084 - RNA, 13 nt, Homo sapiens
ugcacuguagggu

SEQ ID NO: 2154085 - RNA, 23 nt, Homo sapiens
caugaagcuguugcggacaucau

SEQ ID NO: 2154086 - RNA, 17 nt, Homo sapiens
gaauccucucagaguca

SEQ ID NO: 2154087 - RNA, 12 nt, Homo sapiens
ggcguguguucc

SEQ ID NO: 2154088 - RNA, 12 nt, Homo sapiens
ugacugugguag

SEQ ID NO: 2154089 - RNA, 16 nt, Homo sapiens
uggagaaagagcugcc

SEQ ID NO: 2154090 - RNA, 20 nt, Homo sapiens
uccaaagcacauugaaagag

SEQ ID NO: 2154091 - RNA, 18 nt, Homo sapiens
ccagguaccucaugggaa

SEQ ID NO: 2154092 - RNA, 22 nt, Homo sapiens
uaaucacaguuuuuccuggaau

SEQ ID NO: 2154093 - RNA, 18 nt, Homo sapiens
ugacaaauggagaagaaa

SEQ ID NO: 2154094 - RNA, 21 nt, Homo sapiens
acuuuagaagugcauuucuga

SEQ ID NO: 2154095 - RNA, 22 nt, Homo sapiens
gugaccuggccagagccaagaa

SEQ ID NO: 2154096 - RNA, 14 nt, Homo sapiens
uuccaaauauguau

SEQ ID NO: 2154097 - RNA, 21 nt, Homo sapiens
acaugcacacacacacaucuc

SEQ ID NO: 2154098 - RNA, 20 nt, Homo sapiens
augugcaaagucaucaaaga

SEQ ID NO: 2154099 - RNA, 18 nt, Homo sapiens
aaaacagaacauuucuca

SEQ ID NO: 2154100 - RNA, 16 nt, Homo sapiens
uaccucuucaguaggu

SEQ ID NO: 2154101 - RNA, 20 nt, Homo sapiens
aagaacaaugccagggccca

SEQ ID NO: 2154102 - RNA, 15 nt, Homo sapiens
cuuuaggcagguuac

SEQ ID NO: 2154103 - RNA, 20 nt, Homo sapiens
cuuugguccucugauuucac

SEQ ID NO: 2154104 - RNA, 15 nt, Homo sapiens
guaaaacagauucua

SEQ ID NO: 2154105 - RNA, 15 nt, Homo sapiens
ggccccaaucuugcc

SEQ ID NO: 2154106 - RNA, 19 nt, Homo sapiens
aggaggcuuggaaagcauc

SEQ ID NO: 2154107 - RNA, 15 nt, Homo sapiens
cguguacaauaccgu

SEQ ID NO: 2154108 - RNA, 14 nt, Homo sapiens
agugcaauggcaca

SEQ ID NO: 2154109 - RNA, 20 nt, Homo sapiens
uuuuucugggucucccacuu

SEQ ID NO: 2154110 - RNA, 21 nt, Homo sapiens
acuaauuuuuaugaugcaaau

SEQ ID NO: 2154111 - RNA, 18 nt, Homo sapiens
cuccccagccaggcugcc

SEQ ID NO: 2154112 - RNA, 22 nt, Homo sapiens
gucuguugaagugcauguuaaa

SEQ ID NO: 2154113 - RNA, 14 nt, Homo sapiens
auauaaaaggcaaa

SEQ ID NO: 2154114 - RNA, 16 nt, Homo sapiens
auuucauugcacuuuc

SEQ ID NO: 2154115 - RNA, 14 nt, Homo sapiens
guauaauuguguug

SEQ ID NO: 2154116 - RNA, 20 nt, Homo sapiens
ugcauuucuaacaagcuccc

SEQ ID NO: 2154117 - RNA, 16 nt, Homo sapiens
guauguauauauacac

SEQ ID NO: 2154118 - RNA, 23 nt, Homo sapiens
cucaccguuggcuacccggucac

SEQ ID NO: 2154119 - RNA, 20 nt, Homo sapiens
ccugcgccaccgcccagaga

SEQ ID NO: 2154120 - RNA, 14 nt, Homo sapiens
aaugguaacuuuac

SEQ ID NO: 2154121 - RNA, 16 nt, Homo sapiens
gaagaccguuuaccua

SEQ ID NO: 2154122 - RNA, 20 nt, Homo sapiens
uacaagccacgaaugaauga

SEQ ID NO: 2154123 - RNA, 19 nt, Homo sapiens
ucacauuuguucaugagug

SEQ ID NO: 2154124 - RNA, 20 nt, Homo sapiens
ggagauaaaacucugugguu

SEQ ID NO: 2154125 - RNA, 18 nt, Homo sapiens
caccacacccuugcuugg

SEQ ID NO: 2154126 - RNA, 18 nt, Homo sapiens
agaugcauuguaguuuaa

SEQ ID NO: 2154127 - RNA, 12 nt, Homo sapiens
uauugccuucca

SEQ ID NO: 2154128 - RNA, 17 nt, Homo sapiens
uggccugaacaaaauaa

SEQ ID NO: 2154129 - RNA, 20 nt, Homo sapiens
gccaagcagagguugggagg

SEQ ID NO: 2154130 - RNA, 18 nt, Homo sapiens
acagcgagaggcagagaa

SEQ ID NO: 2154131 - RNA, 15 nt, Homo sapiens
cccggccucucacaa

SEQ ID NO: 2154132 - RNA, 18 nt, Homo sapiens
gcccugcaccugacagcu

SEQ ID NO: 2154133 - RNA, 13 nt, Homo sapiens
uaaacugaugcuu

SEQ ID NO: 2154134 - RNA, 22 nt, Homo sapiens
gaugauccagagacauguggca

SEQ ID NO: 2154135 - RNA, 13 nt, Homo sapiens
cagaggucuccca

SEQ ID NO: 2154136 - RNA, 22 nt, Homo sapiens
caccuuaacuggagaccagaaa

SEQ ID NO: 2154137 - RNA, 20 nt, Homo sapiens
uucccugaacacucaucccc

SEQ ID NO: 2154138 - RNA, 17 nt, Homo sapiens
acuguuacugugucagg

SEQ ID NO: 2154139 - RNA, 18 nt, Homo sapiens
uaauguuuaauauugaga

SEQ ID NO: 2154140 - RNA, 13 nt, Homo sapiens
ccuccaaguccac

SEQ ID NO: 2154141 - RNA, 18 nt, Homo sapiens
uuccagagcucugaccca

SEQ ID NO: 2154142 - RNA, 12 nt, Homo sapiens
uccuguguacag

SEQ ID NO: 2154143 - RNA, 19 nt, Homo sapiens
cacaugaggagggugcccu

SEQ ID NO: 2154144 - RNA, 22 nt, Homo sapiens
acuggcccucuucuuacuugau

SEQ ID NO: 2154145 - RNA, 14 nt, Homo sapiens
aaucacaucuccag

SEQ ID NO: 2154146 - RNA, 15 nt, Homo sapiens
agagcccccuugaca

SEQ ID NO: 2154147 - RNA, 13 nt, Homo sapiens
ucaugauaauuca

SEQ ID NO: 2154148 - RNA, 15 nt, Homo sapiens
ucagaauguagcauu

SEQ ID NO: 2154149 - RNA, 16 nt, Homo sapiens
uaaauauuucaagaca

SEQ ID NO: 2154150 - RNA, 11 nt, Homo sapiens
cccaucuccac

SEQ ID NO: 2154151 - RNA, 20 nt, Homo sapiens
cuccauuaaagucugaauca

SEQ ID NO: 2154152 - RNA, 18 nt, Homo sapiens
gcccaaucugcaaggaca

SEQ ID NO: 2154153 - RNA, 22 nt, Homo sapiens
aaaauuguguccacauaaucca

SEQ ID NO: 2154154 - RNA, 17 nt, Homo sapiens
aaagucuacacugccuu

SEQ ID NO: 2154155 - RNA, 22 nt, Homo sapiens
uucuuauuuauguaacaaaguu

SEQ ID NO: 2154156 - RNA, 13 nt, Homo sapiens
agccaccucaguc

SEQ ID NO: 2154157 - RNA, 17 nt, Homo sapiens
uguuucuaauuugcugc

SEQ ID NO: 2154158 - RNA, 13 nt, Homo sapiens
augaagcacaaaa

SEQ ID NO: 2154159 - RNA, 19 nt, Homo sapiens
caggccugccuucucaggg

SEQ ID NO: 2154160 - RNA, 21 nt, Homo sapiens
agcaaagugcccaugguggcg

SEQ ID NO: 2154161 - RNA, 12 nt, Homo sapiens
uuuucacuugua

SEQ ID NO: 2154162 - RNA, 14 nt, Homo sapiens
gauuauaaacugac

SEQ ID NO: 2154163 - RNA, 15 nt, Homo sapiens
ccucuaauaaacacu

SEQ ID NO: 2154164 - RNA, 12 nt, Homo sapiens
agcaucuaagaa

SEQ ID NO: 2154165 - RNA, 19 nt, Homo sapiens
ugaguuuuuacaagaugua

SEQ ID NO: 2154166 - RNA, 16 nt, Homo sapiens
cugggguccauucucu

SEQ ID NO: 2154167 - RNA, 21 nt, Homo sapiens
cugaaguguccuaaauauuaa

SEQ ID NO: 2154168 - RNA, 21 nt, Homo sapiens
caauuaaucaaaccacuguua

SEQ ID NO: 2154169 - RNA, 20 nt, Homo sapiens
cuacuguauguaauauuuac

SEQ ID NO: 2154170 - RNA, 15 nt, Homo sapiens
aaugggagacggggg

SEQ ID NO: 2154171 - RNA, 21 nt, Homo sapiens
acaacacacaauuuaugaauu

SEQ ID NO: 2154172 - RNA, 23 nt, Homo sapiens
ggaagagcaggucaguacagagg

SEQ ID NO: 2154173 - RNA, 21 nt, Homo sapiens
aguaacaagagugauucuugc

SEQ ID NO: 2154174 - RNA, 11 nt, Homo sapiens
cguagccucag

SEQ ID NO: 2154175 - RNA, 16 nt, Homo sapiens
caugaauuccuuaaaa

SEQ ID NO: 2154176 - RNA, 15 nt, Homo sapiens
uaaggcauauacaaa

SEQ ID NO: 2154177 - RNA, 21 nt, Homo sapiens
guauucuccuuugcacuguuu

SEQ ID NO: 2154178 - RNA, 20 nt, Homo sapiens
cacaaacaaauggcuguaaa

SEQ ID NO: 2154179 - RNA, 13 nt, Homo sapiens
acagucacuggaa

SEQ ID NO: 2154180 - RNA, 20 nt, Homo sapiens
cugcugaaaaccaucuggcc

SEQ ID NO: 2154181 - RNA, 20 nt, Homo sapiens
caucugauuuacuuaauuca

SEQ ID NO: 2154182 - RNA, 23 nt, Homo sapiens
aacugaggacuguuugcaauuga

SEQ ID NO: 2154183 - RNA, 20 nt, Homo sapiens
aaacuuuuccaaugacauuu

SEQ ID NO: 2154184 - RNA, 21 nt, Homo sapiens
ggauuaauguuuuguacaauu

SEQ ID NO: 2154185 - RNA, 18 nt, Homo sapiens
ucaucaagcaggaauuau

SEQ ID NO: 2154186 - RNA, 23 nt, Homo sapiens
gcauccagugugagauacugugu

SEQ ID NO: 2154187 - RNA, 22 nt, Homo sapiens
cucaaaauaccaugccauuuaa

SEQ ID NO: 2154188 - RNA, 14 nt, Homo sapiens
uuggaauacuaaaa

SEQ ID NO: 2154189 - RNA, 18 nt, Homo sapiens
aacaacuuuguuucucau

SEQ ID NO: 2154190 - RNA, 18 nt, Homo sapiens
aauaaaugccaacauacc

SEQ ID NO: 2154191 - RNA, 19 nt, Homo sapiens
cuggagccugcauuaugca

SEQ ID NO: 2154192 - RNA, 19 nt, Homo sapiens
ugcccacucuaauauucaa

SEQ ID NO: 2154193 - RNA, 18 nt, Homo sapiens
guuuuuacucaaccaaau

SEQ ID NO: 2154194 - RNA, 16 nt, Homo sapiens
cguccucucaguaaug

SEQ ID NO: 2154195 - RNA, 16 nt, Homo sapiens
cgcaaugugacuuaau

SEQ ID NO: 2154196 - RNA, 14 nt, Homo sapiens
aaggcaaaugccca

SEQ ID NO: 2154197 - RNA, 16 nt, Homo sapiens
aaauguguauuaccaa

SEQ ID NO: 2154198 - RNA, 14 nt, Homo sapiens
gcuaggaacaugug

SEQ ID NO: 2154199 - RNA, 11 nt, Homo sapiens
gcugucucucc

SEQ ID NO: 2154200 - RNA, 22 nt, Homo sapiens
gcugguguccauccagcacuga

SEQ ID NO: 2154201 - RNA, 21 nt, Homo sapiens
cauuguccauuacuugccagg

SEQ ID NO: 2154202 - RNA, 13 nt, Homo sapiens
accaugacaugaa

SEQ ID NO: 2154203 - RNA, 22 nt, Homo sapiens
gagugacuuggagagagauuca

SEQ ID NO: 2154204 - RNA, 14 nt, Homo sapiens
caggugugagccac

SEQ ID NO: 2154205 - RNA, 19 nt, Homo sapiens
uucacauucuuacuagugu

SEQ ID NO: 2154206 - RNA, 23 nt, Homo sapiens
aaugauacugcuuuucaccaaaa

SEQ ID NO: 2154207 - RNA, 15 nt, Homo sapiens
agucaaauccagugg

SEQ ID NO: 2154208 - RNA, 12 nt, Homo sapiens
aucacaguauua

SEQ ID NO: 2154209 - RNA, 15 nt, Homo sapiens
uuaguaucucaucaa

SEQ ID NO: 2154210 - RNA, 17 nt, Homo sapiens
ugugcagacagugucag

SEQ ID NO: 2154211 - RNA, 14 nt, Homo sapiens
aaugaauuugcuaa

SEQ ID NO: 2154212 - RNA, 18 nt, Homo sapiens
aggacaggucucugagac

SEQ ID NO: 2154213 - RNA, 18 nt, Homo sapiens
agaaauaacacugugaau

SEQ ID NO: 2154214 - RNA, 18 nt, Homo sapiens
aagaaaaaucauaacuca

SEQ ID NO: 2154215 - RNA, 17 nt, Homo sapiens
agcuaguuaggagccca

SEQ ID NO: 2154216 - RNA, 12 nt, Homo sapiens
caaacccaguga

SEQ ID NO: 2154217 - RNA, 18 nt, Homo sapiens
aagugaagagauccuucu

SEQ ID NO: 2154218 - RNA, 14 nt, Homo sapiens
aaccacacagcuaa

SEQ ID NO: 2154219 - RNA, 22 nt, Homo sapiens
auugggauuuucuacaaguauu

SEQ ID NO: 2154220 - RNA, 22 nt, Homo sapiens
ucucccuucuuuaccuucauuu

SEQ ID NO: 2154221 - RNA, 17 nt, Homo sapiens
ucacaaauaaacauaau

SEQ ID NO: 2154222 - RNA, 21 nt, Homo sapiens
uuccagguuuuucuggcauuu

SEQ ID NO: 2154223 - RNA, 23 nt, Homo sapiens
cagauaaauccuuaacauuucuc

SEQ ID NO: 2154224 - RNA, 12 nt, Homo sapiens
uccagaauucac

SEQ ID NO: 2154225 - RNA, 20 nt, Homo sapiens
ccacugugguggcaguggag

SEQ ID NO: 2154226 - RNA, 20 nt, Homo sapiens
cugaacauaguagauugaca

SEQ ID NO: 2154227 - RNA, 18 nt, Homo sapiens
uccuuuucacuuuauugc

SEQ ID NO: 2154228 - RNA, 17 nt, Homo sapiens
gaucuaucaccugucau

SEQ ID NO: 2154229 - RNA, 20 nt, Homo sapiens
ugcugaguccuuuccagggg

SEQ ID NO: 2154230 - RNA, 22 nt, Homo sapiens
aucuagguucaggaagaccaca

SEQ ID NO: 2154231 - RNA, 15 nt, Homo sapiens
uugccccugagacaa

SEQ ID NO: 2154232 - RNA, 13 nt, Homo sapiens
cccauggccacuu

SEQ ID NO: 2154233 - RNA, 19 nt, Homo sapiens
aaauuggaugcuagagaau

SEQ ID NO: 2154234 - RNA, 11 nt, Homo sapiens
gaaugcuuaau

SEQ ID NO: 2154235 - RNA, 17 nt, Homo sapiens
cccucauucuacugaaa

SEQ ID NO: 2154236 - RNA, 15 nt, Homo sapiens
agaugcuuuugcuaa

SEQ ID NO: 2154237 - RNA, 18 nt, Homo sapiens
gcauuguaaaagcauuuu

SEQ ID NO: 2154238 - RNA, 18 nt, Homo sapiens
ugucgucuuagcaagaag

SEQ ID NO: 2154239 - RNA, 18 nt, Homo sapiens
uccuugcuuccugucuua

SEQ ID NO: 2154240 - RNA, 13 nt, Homo sapiens
gagagcagcagca

SEQ ID NO: 2154241 - RNA, 16 nt, Homo sapiens
ccuugcucagugcaaa

SEQ ID NO: 2154242 - RNA, 14 nt, Homo sapiens
acuuuacugggcuc

SEQ ID NO: 2154243 - RNA, 16 nt, Homo sapiens
auaccugccugggaca

SEQ ID NO: 2154244 - RNA, 18 nt, Homo sapiens
aaugugaggaacucacau

SEQ ID NO: 2154245 - RNA, 18 nt, Homo sapiens
ucugacuggcacagucuu

SEQ ID NO: 2154246 - RNA, 18 nt, Homo sapiens
cucugugaauugaaaugu

SEQ ID NO: 2154247 - RNA, 16 nt, Homo sapiens
acaauuggaauugucu

SEQ ID NO: 2154248 - RNA, 22 nt, Homo sapiens
acuucuggaugcccauccacug

SEQ ID NO: 2154249 - RNA, 14 nt, Homo sapiens
auuuguucagagag

SEQ ID NO: 2154250 - RNA, 22 nt, Homo sapiens
acuguggucccagcuacagggg

SEQ ID NO: 2154251 - RNA, 16 nt, Homo sapiens
cgucagagcagugacc

SEQ ID NO: 2154252 - RNA, 17 nt, Homo sapiens
gggccaauuuacuggcc

SEQ ID NO: 2154253 - RNA, 22 nt, Homo sapiens
uaauaaauuuuagugugccuuc

SEQ ID NO: 2154254 - RNA, 14 nt, Homo sapiens
uguagaccuugaug

SEQ ID NO: 2154255 - RNA, 13 nt, Homo sapiens
agugcugugcugu

SEQ ID NO: 2154256 - RNA, 18 nt, Homo sapiens
aaagccucagaaagggau

SEQ ID NO: 2154257 - RNA, 18 nt, Homo sapiens
auagagauuugucuaauu

SEQ ID NO: 2154258 - RNA, 13 nt, Homo sapiens
aaugcucuugucc

SEQ ID NO: 2154259 - RNA, 18 nt, Homo sapiens
ucagcagguggaaugugu

SEQ ID NO: 2154260 - RNA, 21 nt, Homo sapiens
guauuaaaaaacaauuaacug

SEQ ID NO: 2154261 - RNA, 16 nt, Homo sapiens
accuccucuuccccca

SEQ ID NO: 2154262 - RNA, 14 nt, Homo sapiens
ccaguaggacaaac

SEQ ID NO: 2154263 - RNA, 21 nt, Homo sapiens
aaaacuuccacuaccuuuaaa

SEQ ID NO: 2154264 - RNA, 14 nt, Homo sapiens
auaguuuaccugaa

SEQ ID NO: 2154265 - RNA, 20 nt, Homo sapiens
auaaaaguacuagcuuacuu

SEQ ID NO: 2154266 - RNA, 20 nt, Homo sapiens
gcaauggcacgaucucagcu

SEQ ID NO: 2154267 - RNA, 21 nt, Homo sapiens
cauccucccauugcccaguga

SEQ ID NO: 2154268 - RNA, 17 nt, Homo sapiens
cugcacguaacacuccu

SEQ ID NO: 2154269 - RNA, 22 nt, Homo sapiens
gcaaauaauggaaaaauaguaa

SEQ ID NO: 2154270 - RNA, 23 nt, Homo sapiens
acuugcguggacagucaggguuc

SEQ ID NO: 2154271 - RNA, 20 nt, Homo sapiens
aaugaaaagcugaauccaga

SEQ ID NO: 2154272 - RNA, 14 nt, Homo sapiens
aaucacaacucagc

SEQ ID NO: 2154273 - RNA, 13 nt, Homo sapiens
cuucccaguauua

SEQ ID NO: 2154274 - RNA, 16 nt, Homo sapiens
gcaaagauuugcuuua

SEQ ID NO: 2154275 - RNA, 23 nt, Homo sapiens
cacuguacuuguagaguggugcu

SEQ ID NO: 2154276 - RNA, 19 nt, Homo sapiens
agauggauguuugucaaaa

SEQ ID NO: 2154277 - RNA, 18 nt, Homo sapiens
aaguccagcucagucuca

SEQ ID NO: 2154278 - RNA, 20 nt, Homo sapiens
ggaaaauauaauauuuacug

SEQ ID NO: 2154279 - RNA, 14 nt, Homo sapiens
uuuggaggugcugc

SEQ ID NO: 2154280 - RNA, 10 nt, Homo sapiens
acaacauuuu

SEQ ID NO: 2154281 - RNA, 19 nt, Homo sapiens
agcugcagaugccacaccu

SEQ ID NO: 2154282 - RNA, 15 nt, Homo sapiens
ugauucuaugucuca

SEQ ID NO: 2154283 - RNA, 21 nt, Homo sapiens
augaguuacuuagaaugccau

SEQ ID NO: 2154284 - RNA, 14 nt, Homo sapiens
cuggcaguacuguu

SEQ ID NO: 2154285 - RNA, 22 nt, Homo sapiens
ccuuugugaaaguaacuuuuca

SEQ ID NO: 2154286 - RNA, 17 nt, Homo sapiens
cgugugcacaugcgcac

SEQ ID NO: 2154287 - RNA, 16 nt, Homo sapiens
aaacugcaaaugugca

SEQ ID NO: 2154288 - RNA, 13 nt, Homo sapiens
cgggcgcugccag

SEQ ID NO: 2154289 - RNA, 13 nt, Homo sapiens
cagaguccaguca

SEQ ID NO: 2154290 - RNA, 15 nt, Homo sapiens
uaaacauagcuugua

SEQ ID NO: 2154291 - RNA, 22 nt, Homo sapiens
ucgcuccugugucuugcaaugg

SEQ ID NO: 2154292 - RNA, 21 nt, Homo sapiens
gagguggcggccugcugcugu

SEQ ID NO: 2154293 - RNA, 15 nt, Homo sapiens
uggugucucuugggg

SEQ ID NO: 2154294 - RNA, 20 nt, Homo sapiens
aaugcuacgcacguggagcu

SEQ ID NO: 2154295 - RNA, 14 nt, Homo sapiens
uccaguucugauga

SEQ ID NO: 2154296 - RNA, 23 nt, Homo sapiens
cugaucguagaaaauuugcuuua

SEQ ID NO: 2154297 - RNA, 22 nt, Homo sapiens
caucacaugcucaaugacucuc

SEQ ID NO: 2154298 - RNA, 14 nt, Homo sapiens
gcacagugaucacc

SEQ ID NO: 2154299 - RNA, 20 nt, Homo sapiens
gaaacauguggaguguauua

SEQ ID NO: 2154300 - RNA, 18 nt, Homo sapiens
uuuuauuuuugcaaaaua

SEQ ID NO: 2154301 - RNA, 23 nt, Homo sapiens
auauugcucuuaaaaaucuuggu

SEQ ID NO: 2154302 - RNA, 23 nt, Homo sapiens
uauuuaaaauuuauugcuugaua

SEQ ID NO: 2154303 - RNA, 19 nt, Homo sapiens
uguaucaucuuugccaagu

SEQ ID NO: 2154304 - RNA, 22 nt, Homo sapiens
uucauuuccucugagcuguuau

SEQ ID NO: 2154305 - RNA, 23 nt, Homo sapiens
uaccaacugagccaaaaacaaua

SEQ ID NO: 2154306 - RNA, 21 nt, Homo sapiens
cauuucuucucguuuucacag

SEQ ID NO: 2154307 - RNA, 19 nt, Homo sapiens
ucaggcaaagcuugaauca

SEQ ID NO: 2154308 - RNA, 20 nt, Homo sapiens
caggauggcuggaacacugu

SEQ ID NO: 2154309 - RNA, 18 nt, Homo sapiens
acuuuuuuuuuaaagcca

SEQ ID NO: 2154310 - RNA, 20 nt, Homo sapiens
ugcucaguguuuuugugaau

SEQ ID NO: 2154311 - RNA, 16 nt, Homo sapiens
agcagaggcacugggg

SEQ ID NO: 2154312 - RNA, 12 nt, Homo sapiens
uugugucacugg

SEQ ID NO: 2154313 - RNA, 20 nt, Homo sapiens
guucaaaacauucauaggca

SEQ ID NO: 2154314 - RNA, 15 nt, Homo sapiens
uaucuuugcacugaa

SEQ ID NO: 2154315 - RNA, 22 nt, Homo sapiens
cccagugcagggcuggucuugg

SEQ ID NO: 2154316 - RNA, 19 nt, Homo sapiens
gcccagacauccugugaug

SEQ ID NO: 2154317 - RNA, 14 nt, Homo sapiens
gaauuuggggcuuc

SEQ ID NO: 2154318 - RNA, 20 nt, Homo sapiens
ugucaacaguauacaaaaga

SEQ ID NO: 2154319 - RNA, 11 nt, Homo sapiens
acuucuguucc

SEQ ID NO: 2154320 - RNA, 13 nt, Homo sapiens
auuuuuuuuacau

SEQ ID NO: 2154321 - RNA, 20 nt, Homo sapiens
ugacauugcuucugcuaaau

SEQ ID NO: 2154322 - RNA, 15 nt, Homo sapiens
uauucauuuugcaac

SEQ ID NO: 2154323 - RNA, 14 nt, Homo sapiens
caaugaacugugcu

SEQ ID NO: 2154324 - RNA, 22 nt, Homo sapiens
agaugagccccacguggagcuc

SEQ ID NO: 2154325 - RNA, 15 nt, Homo sapiens
aaaggcagcccucac

SEQ ID NO: 2154326 - RNA, 20 nt, Homo sapiens
uaucauaauucagcacuuaa

SEQ ID NO: 2154327 - RNA, 20 nt, Homo sapiens
uuggaaaaaaaccacagcca

SEQ ID NO: 2154328 - RNA, 17 nt, Homo sapiens
ccuacuguuccuuucag

SEQ ID NO: 2154329 - RNA, 24 nt, Homo sapiens
uggggaggugguaagaacaccuga

SEQ ID NO: 2154330 - RNA, 21 nt, Homo sapiens
gcccuccuccccuccuugcac

SEQ ID NO: 2154331 - RNA, 21 nt, Homo sapiens
uuguuacuuuuaguucuauaa

SEQ ID NO: 2154332 - RNA, 23 nt, Homo sapiens
ccuggggcauccaccuuccugcc

SEQ ID NO: 2154333 - RNA, 21 nt, Homo sapiens
ugaauauaaauguuuuacuca

SEQ ID NO: 2154334 - RNA, 14 nt, Homo sapiens
uagccuguagcuua

SEQ ID NO: 2154335 - RNA, 16 nt, Homo sapiens
cagacaaaaagggugg

SEQ ID NO: 2154336 - RNA, 16 nt, Homo sapiens
uccucuuucaaccuca

SEQ ID NO: 2154337 - RNA, 15 nt, Homo sapiens
acugucgagucccca

SEQ ID NO: 2154338 - RNA, 21 nt, Homo sapiens
guacccuuucaaacuauuuau

SEQ ID NO: 2154339 - RNA, 20 nt, Homo sapiens
uuucuccuuuuguguuccaa

SEQ ID NO: 2154340 - RNA, 23 nt, Homo sapiens
aaaauuauguauuuuugucauau

SEQ ID NO: 2154341 - RNA, 13 nt, Homo sapiens
cugcaccgagaga

SEQ ID NO: 2154342 - RNA, 23 nt, Homo sapiens
uuaagcauugguuauucaaguau

SEQ ID NO: 2154343 - RNA, 17 nt, Homo sapiens
cuaucaguauugugaaa

SEQ ID NO: 2154344 - RNA, 13 nt, Homo sapiens
uuaaaaaacugca

SEQ ID NO: 2154345 - RNA, 12 nt, Homo sapiens
cagacacugcac

SEQ ID NO: 2154346 - RNA, 12 nt, Homo sapiens
caacaacauguc

SEQ ID NO: 2154347 - RNA, 16 nt, Homo sapiens
caauacaacuuuacca

SEQ ID NO: 2154348 - RNA, 10 nt, Homo sapiens
auaccaaaug

SEQ ID NO: 2154349 - RNA, 15 nt, Homo sapiens
aggguagaggggaag

SEQ ID NO: 2154350 - RNA, 15 nt, Homo sapiens
guuuuauaauuuaau

SEQ ID NO: 2154351 - RNA, 21 nt, Homo sapiens
acaaccaugagaccacuguua

SEQ ID NO: 2154352 - RNA, 22 nt, Homo sapiens
aagguguugguguauuugccag

SEQ ID NO: 2154353 - RNA, 20 nt, Homo sapiens
agugcuggaauagcaucucc

SEQ ID NO: 2154354 - RNA, 16 nt, Homo sapiens
acuccuguguguggaa

SEQ ID NO: 2154355 - RNA, 19 nt, Homo sapiens
gaggacuuuuuugauuaag

SEQ ID NO: 2154356 - RNA, 16 nt, Homo sapiens
acuauauauacaauau

SEQ ID NO: 2154357 - RNA, 20 nt, Homo sapiens
uuccagaacgcccugugucc

SEQ ID NO: 2154358 - RNA, 23 nt, Homo sapiens
ugagucugggcaaugaaaccaaa

SEQ ID NO: 2154359 - RNA, 15 nt, Homo sapiens
ugguggagggccaca

SEQ ID NO: 2154360 - RNA, 17 nt, Homo sapiens
ggagcuugggucucucu

SEQ ID NO: 2154361 - RNA, 20 nt, Homo sapiens
acaucauuauuggcaguuuc

SEQ ID NO: 2154362 - RNA, 22 nt, Homo sapiens
uagaaccucaaacaggauggaa

SEQ ID NO: 2154363 - RNA, 16 nt, Homo sapiens
uguaauaaacucucua

SEQ ID NO: 2154364 - RNA, 13 nt, Homo sapiens
ccgugaccaucuu

SEQ ID NO: 2154365 - RNA, 14 nt, Homo sapiens
gcucaaccacacac

SEQ ID NO: 2154366 - RNA, 23 nt, Homo sapiens
cuggguugcugcuguccagugcc

SEQ ID NO: 2154367 - RNA, 22 nt, Homo sapiens
augcaaagaaucccuagacuuu

SEQ ID NO: 2154368 - RNA, 17 nt, Homo sapiens
guaguucaauagucuaa

SEQ ID NO: 2154369 - RNA, 18 nt, Homo sapiens
ugccugcuuacacccugc

SEQ ID NO: 2154370 - RNA, 15 nt, Homo sapiens
ugcaggagcgugaag

SEQ ID NO: 2154371 - RNA, 11 nt, Homo sapiens
uccagccuuug

SEQ ID NO: 2154372 - RNA, 21 nt, Homo sapiens
ugucuguguuucuuuuugcca

SEQ ID NO: 2154373 - RNA, 16 nt, Homo sapiens
ccuguaaagucuaauc

SEQ ID NO: 2154374 - RNA, 18 nt, Homo sapiens
acauucugcuaugaauua

SEQ ID NO: 2154375 - RNA, 15 nt, Homo sapiens
auugcuucugugcaa

SEQ ID NO: 2154376 - RNA, 19 nt, Homo sapiens
cuucacuguccuccaagcc

SEQ ID NO: 2154377 - RNA, 23 nt, Homo sapiens
gacgcacggcauuagcuuccugc

SEQ ID NO: 2154378 - RNA, 13 nt, Homo sapiens
ccgucacagccuc

SEQ ID NO: 2154379 - RNA, 16 nt, Homo sapiens
acuuauuaacaauuag

SEQ ID NO: 2154380 - RNA, 15 nt, Homo sapiens
gggcagcuggcagga

SEQ ID NO: 2154381 - RNA, 18 nt, Homo sapiens
cagcagacugguuugcag

SEQ ID NO: 2154382 - RNA, 12 nt, Homo sapiens
uuauuauauucc

SEQ ID NO: 2154383 - RNA, 18 nt, Homo sapiens
aaaagcugacuacuugau

SEQ ID NO: 2154384 - RNA, 13 nt, Homo sapiens
cagccacaccacu

SEQ ID NO: 2154385 - RNA, 15 nt, Homo sapiens
uguugauuuccucug

SEQ ID NO: 2154386 - RNA, 14 nt, Homo sapiens
ccuuuuauguguug

SEQ ID NO: 2154387 - RNA, 18 nt, Homo sapiens
ucacaugaacuuguaaag

SEQ ID NO: 2154388 - RNA, 22 nt, Homo sapiens
acuucauuuuucuaauaaucau

SEQ ID NO: 2154389 - RNA, 22 nt, Homo sapiens
ucaguccacccccauugugaau

SEQ ID NO: 2154390 - RNA, 17 nt, Homo sapiens
acaugugacacauaugc

SEQ ID NO: 2154391 - RNA, 20 nt, Homo sapiens
aauuccugacgagauaagca

SEQ ID NO: 2154392 - RNA, 17 nt, Homo sapiens
cuauguugaaugcuuaa

SEQ ID NO: 2154393 - RNA, 13 nt, Homo sapiens
uaauguuacauua

SEQ ID NO: 2154394 - RNA, 16 nt, Homo sapiens
cucuuccucaucucau

SEQ ID NO: 2154395 - RNA, 16 nt, Homo sapiens
cucuuccccaucucac

SEQ ID NO: 2154396 - RNA, 20 nt, Homo sapiens
accuggccuuauaucauuuc

SEQ ID NO: 2154397 - RNA, 15 nt, Homo sapiens
ugauugaaccagcuc

SEQ ID NO: 2154398 - RNA, 15 nt, Homo sapiens
ucuucucccaauuca

SEQ ID NO: 2154399 - RNA, 21 nt, Homo sapiens
cagaagggcuacuuuccacau

SEQ ID NO: 2154400 - RNA, 18 nt, Homo sapiens
uccauguucuauuucagu

SEQ ID NO: 2154401 - RNA, 14 nt, Homo sapiens
ucugccugcuuaca

SEQ ID NO: 2154402 - RNA, 13 nt, Homo sapiens
caucaauucucua

SEQ ID NO: 2154403 - RNA, 16 nt, Homo sapiens
ggcucugagggucuga

SEQ ID NO: 2154404 - RNA, 16 nt, Homo sapiens
uucccacuuugccacu

SEQ ID NO: 2154405 - RNA, 12 nt, Homo sapiens
ccucaggugcua

SEQ ID NO: 2154406 - RNA, 14 nt, Homo sapiens
ggguuacuuucaca

SEQ ID NO: 2154407 - RNA, 14 nt, Homo sapiens
aucagcacucugua

SEQ ID NO: 2154408 - RNA, 17 nt, Homo sapiens
uaaauuauuauuugaca

SEQ ID NO: 2154409 - RNA, 21 nt, Homo sapiens
gaacucaugagaaguugauau

SEQ ID NO: 2154410 - RNA, 20 nt, Homo sapiens
agccuccagggcauugcuca

SEQ ID NO: 2154411 - RNA, 17 nt, Homo sapiens
uuugaggcucaccagaa

SEQ ID NO: 2154412 - RNA, 16 nt, Homo sapiens
accgugguuacuguau

SEQ ID NO: 2154413 - RNA, 14 nt, Homo sapiens
auugaacuguacca

SEQ ID NO: 2154414 - RNA, 23 nt, Homo sapiens
aucccaugauuuuuccacugaga

SEQ ID NO: 2154415 - RNA, 19 nt, Homo sapiens
gggcagagucguuggagac

SEQ ID NO: 2154416 - RNA, 14 nt, Homo sapiens
uauggaaggguaaa

SEQ ID NO: 2154417 - RNA, 17 nt, Homo sapiens
aucguaucccgcugaca

SEQ ID NO: 2154418 - RNA, 19 nt, Homo sapiens
ccaggucaggaugcacauu

SEQ ID NO: 2154419 - RNA, 22 nt, Homo sapiens
caggcaucugcuuuacucugga

SEQ ID NO: 2154420 - RNA, 14 nt, Homo sapiens
cagugauucaguaa

SEQ ID NO: 2154421 - RNA, 16 nt, Homo sapiens
uagagacgggauuucc

SEQ ID NO: 2154422 - RNA, 20 nt, Homo sapiens
auucuuugaaaacagaugac

SEQ ID NO: 2154423 - RNA, 20 nt, Homo sapiens
auaaucugaaaugacaggau

SEQ ID NO: 2154424 - RNA, 19 nt, Homo sapiens
cuuuucaaaauauuacuca

SEQ ID NO: 2154425 - RNA, 20 nt, Homo sapiens
gaaugauuuagguacgucaa

SEQ ID NO: 2154426 - RNA, 20 nt, Homo sapiens
ugguuuuucuuuucuuuauu

SEQ ID NO: 2154427 - RNA, 23 nt, Homo sapiens
ugaaacuaacagauaagcaagag

SEQ ID NO: 2154428 - RNA, 16 nt, Homo sapiens
gggcagcccagccucu

SEQ ID NO: 2154429 - RNA, 22 nt, Homo sapiens
uacuaaaugguguuacauuaaa

SEQ ID NO: 2154430 - RNA, 13 nt, Homo sapiens
aauacuacugcac

SEQ ID NO: 2154431 - RNA, 21 nt, Homo sapiens
uugccuguuucuucucuacac

SEQ ID NO: 2154432 - RNA, 18 nt, Homo sapiens
uguugcuaagcuguaacc

SEQ ID NO: 2154433 - RNA, 21 nt, Homo sapiens
gaaaacauuccaaaacuuuaa

SEQ ID NO: 2154434 - RNA, 17 nt, Homo sapiens
ucagccuuaagaaccau

SEQ ID NO: 2154435 - RNA, 19 nt, Homo sapiens
caguuugauaccugcacug

SEQ ID NO: 2154436 - RNA, 21 nt, Homo sapiens
acuuuauagaucagccaguga

SEQ ID NO: 2154437 - RNA, 23 nt, Homo sapiens
aucugaucgggggcguagcauca

SEQ ID NO: 2154438 - RNA, 21 nt, Homo sapiens
ccaauguucuaaaguuuugca

SEQ ID NO: 2154439 - RNA, 21 nt, Homo sapiens
cuugucuuuaaaucuucaaua

SEQ ID NO: 2154440 - RNA, 19 nt, Homo sapiens
guccuuaaugaagagccag

SEQ ID NO: 2154441 - RNA, 21 nt, Homo sapiens
uccuggcaucuuucaacaaug

SEQ ID NO: 2154442 - RNA, 14 nt, Homo sapiens
uagcccaauggaga

SEQ ID NO: 2154443 - RNA, 14 nt, Homo sapiens
guuuauuacugcuu

SEQ ID NO: 2154444 - RNA, 18 nt, Homo sapiens
cuugacuaucacauacaa

SEQ ID NO: 2154445 - RNA, 15 nt, Homo sapiens
agcucugaggaguac

SEQ ID NO: 2154446 - RNA, 14 nt, Homo sapiens
ugcucugaccaagc

SEQ ID NO: 2154447 - RNA, 12 nt, Homo sapiens
uuugaaaacacu

SEQ ID NO: 2154448 - RNA, 10 nt, Homo sapiens
acauugccaa

SEQ ID NO: 2154449 - RNA, 14 nt, Homo sapiens
cacagugaauccag

SEQ ID NO: 2154450 - RNA, 23 nt, Homo sapiens
acaauaaaccuccgccaaugcac

SEQ ID NO: 2154451 - RNA, 11 nt, Homo sapiens
auggagucuug

SEQ ID NO: 2154452 - RNA, 19 nt, Homo sapiens
uaccuagcuggcucuguga

SEQ ID NO: 2154453 - RNA, 23 nt, Homo sapiens
agcagccugccaagaauuuuauu

SEQ ID NO: 2154454 - RNA, 14 nt, Homo sapiens
agcugguaaacuau

SEQ ID NO: 2154455 - RNA, 14 nt, Homo sapiens
acauucacugcuga

SEQ ID NO: 2154456 - RNA, 20 nt, Homo sapiens
cuugcagauaucugcaugug

SEQ ID NO: 2154457 - RNA, 14 nt, Homo sapiens
uuucuacacugagg

SEQ ID NO: 2154458 - RNA, 23 nt, Homo sapiens
ccuucaaaauguucuauuuaaca

SEQ ID NO: 2154459 - RNA, 21 nt, Homo sapiens
uguaacuguguugcugaaaga

SEQ ID NO: 2154460 - RNA, 13 nt, Homo sapiens
cagccccugugac

SEQ ID NO: 2154461 - RNA, 10 nt, Homo sapiens
ggacagugau

SEQ ID NO: 2154462 - RNA, 19 nt, Homo sapiens
aaacacacauuucuuugaa

SEQ ID NO: 2154463 - RNA, 17 nt, Homo sapiens
aaagagagggcuuuaau

SEQ ID NO: 2154464 - RNA, 14 nt, Homo sapiens
cucuggcacaguga

SEQ ID NO: 2154465 - RNA, 21 nt, Homo sapiens
gucacaauaaaagaaacugug

SEQ ID NO: 2154466 - RNA, 21 nt, Homo sapiens
auauacuucacugguguacau

SEQ ID NO: 2154467 - RNA, 17 nt, Homo sapiens
cugcugcauagcucuau

SEQ ID NO: 2154468 - RNA, 16 nt, Homo sapiens
caaggaucucaaagaa

SEQ ID NO: 2154469 - RNA, 18 nt, Homo sapiens
agagggaaguuuaaaacc

SEQ ID NO: 2154470 - RNA, 23 nt, Homo sapiens
acccuugaaccaauaaaggaaca

SEQ ID NO: 2154471 - RNA, 20 nt, Homo sapiens
ugauugaaguauucaaucaa

SEQ ID NO: 2154472 - RNA, 11 nt, Homo sapiens
uucaauuugcg

SEQ ID NO: 2154473 - RNA, 20 nt, Homo sapiens
gcucugucuucuuugcccac

SEQ ID NO: 2154474 - RNA, 21 nt, Homo sapiens
aaucuaaaaugugugccagau

SEQ ID NO: 2154475 - RNA, 14 nt, Homo sapiens
uguccuccuggaag

SEQ ID NO: 2154476 - RNA, 20 nt, Homo sapiens
cuugagccgggccccugggc

SEQ ID NO: 2154477 - RNA, 22 nt, Homo sapiens
cuuagagccaggcacacacugu

SEQ ID NO: 2154478 - RNA, 19 nt, Homo sapiens
uuuguccuggucaugcaca

SEQ ID NO: 2154479 - RNA, 20 nt, Homo sapiens
auauauagagagguacacau

SEQ ID NO: 2154480 - RNA, 15 nt, Homo sapiens
ccaaugugugaagua

SEQ ID NO: 2154481 - RNA, 19 nt, Homo sapiens
gcccacgucccgggcacug

SEQ ID NO: 2154482 - RNA, 22 nt, Homo sapiens
aggcauggucccuuaaggcaca

SEQ ID NO: 2154483 - RNA, 12 nt, Homo sapiens
caacuguucccg

SEQ ID NO: 2154484 - RNA, 16 nt, Homo sapiens
uuccgguguuguacua

SEQ ID NO: 2154485 - RNA, 16 nt, Homo sapiens
gaccgagccucuguca

SEQ ID NO: 2154486 - RNA, 24 nt, Homo sapiens
cacugauagcugaaauagauacaa

SEQ ID NO: 2154487 - RNA, 18 nt, Homo sapiens
cagcugagguucauuaca

SEQ ID NO: 2154488 - RNA, 16 nt, Homo sapiens
gcugcaccugauuagu

SEQ ID NO: 2154489 - RNA, 19 nt, Homo sapiens
uccuaaaguagacuucauu

SEQ ID NO: 2154490 - RNA, 21 nt, Homo sapiens
aaucuuuuauacaauaauuga

SEQ ID NO: 2154491 - RNA, 20 nt, Homo sapiens
accuggaagaacaggccucu

SEQ ID NO: 2154492 - RNA, 15 nt, Homo sapiens
ccucaauguccccaa

SEQ ID NO: 2154493 - RNA, 22 nt, Homo sapiens
gaggccgcuaugcaggguagca

SEQ ID NO: 2154494 - RNA, 16 nt, Homo sapiens
caaaauauaaaucaca

SEQ ID NO: 2154495 - RNA, 19 nt, Homo sapiens
uagguccccauacuccuau

SEQ ID NO: 2154496 - RNA, 19 nt, Homo sapiens
cacugcucguggccaaaag

SEQ ID NO: 2154497 - RNA, 21 nt, Homo sapiens
ugcugacggaagccaacuugg

SEQ ID NO: 2154498 - RNA, 17 nt, Homo sapiens
gagacauccuucauuug

SEQ ID NO: 2154499 - RNA, 12 nt, Homo sapiens
uucaaagugaua

SEQ ID NO: 2154500 - RNA, 18 nt, Homo sapiens
acccaccuucaagcagcu

SEQ ID NO: 2154501 - RNA, 17 nt, Homo sapiens
agcagagacaugacuca

SEQ ID NO: 2154502 - RNA, 19 nt, Homo sapiens
uaugguuaaguaauugcau

SEQ ID NO: 2154503 - RNA, 21 nt, Homo sapiens
aagaugccagugaaacuucaa

SEQ ID NO: 2154504 - RNA, 15 nt, Homo sapiens
uggagauucccaucu

SEQ ID NO: 2154505 - RNA, 16 nt, Homo sapiens
aaugacagcggggaag

SEQ ID NO: 2154506 - RNA, 17 nt, Homo sapiens
ugcgugugcccacugaa

SEQ ID NO: 2154507 - RNA, 13 nt, Homo sapiens
uuugaccagcaca

SEQ ID NO: 2154508 - RNA, 15 nt, Homo sapiens
guaucauuacaauuu

SEQ ID NO: 2154509 - RNA, 21 nt, Homo sapiens
gauuccccaucucaggccaga

SEQ ID NO: 2154510 - RNA, 20 nt, Homo sapiens
agucuucaacauaacccacu

SEQ ID NO: 2154511 - RNA, 19 nt, Homo sapiens
acaugaacagaaacaauaa

SEQ ID NO: 2154512 - RNA, 23 nt, Homo sapiens
ccaaguccaggucgggcucagcu

SEQ ID NO: 2154513 - RNA, 22 nt, Homo sapiens
auacaguauauucuuuccucaa

SEQ ID NO: 2154514 - RNA, 18 nt, Homo sapiens
gggagccugacccucauc

SEQ ID NO: 2154515 - RNA, 19 nt, Homo sapiens
gguuuccaaaggcauuuua

SEQ ID NO: 2154516 - RNA, 14 nt, Homo sapiens
uacuacaugcuuuu

SEQ ID NO: 2154517 - RNA, 19 nt, Homo sapiens
uggaaucagaauuggaauc

SEQ ID NO: 2154518 - RNA, 16 nt, Homo sapiens
gugguuucuacuuccc

SEQ ID NO: 2154519 - RNA, 17 nt, Homo sapiens
uuuuuacuaucacacau

SEQ ID NO: 2154520 - RNA, 22 nt, Homo sapiens
aguggauauagauaacugcaua

SEQ ID NO: 2154521 - RNA, 16 nt, Homo sapiens
accuguaaagugccuu

SEQ ID NO: 2154522 - RNA, 21 nt, Homo sapiens
ucaggaaugcagcacaguacu

SEQ ID NO: 2154523 - RNA, 21 nt, Homo sapiens
uguguuaugagaaauuaguca

SEQ ID NO: 2154524 - RNA, 22 nt, Homo sapiens
caggccucuuggcagucacauc

SEQ ID NO: 2154525 - RNA, 14 nt, Homo sapiens
cacagccauuucaa

SEQ ID NO: 2154526 - RNA, 18 nt, Homo sapiens
aacagguuauaacagugu

SEQ ID NO: 2154527 - RNA, 17 nt, Homo sapiens
cagaccccguggcucug

SEQ ID NO: 2154528 - RNA, 19 nt, Homo sapiens
cuuaacggaccaaagcaag

SEQ ID NO: 2154529 - RNA, 14 nt, Homo sapiens
agacaucaagauac

SEQ ID NO: 2154530 - RNA, 12 nt, Homo sapiens
uuacaugugauu

SEQ ID NO: 2154531 - RNA, 20 nt, Homo sapiens
uuaaaguaaaaacaauucaa

SEQ ID NO: 2154532 - RNA, 19 nt, Homo sapiens
gcucuggcccuuugaauau

SEQ ID NO: 2154533 - RNA, 20 nt, Homo sapiens
cucugcuuccugagcugucc

SEQ ID NO: 2154534 - RNA, 18 nt, Homo sapiens
cauugugccuaaguccag

SEQ ID NO: 2154535 - RNA, 18 nt, Homo sapiens
uaaauagcaucuaguaca

SEQ ID NO: 2154536 - RNA, 12 nt, Homo sapiens
accucaccaaac

SEQ ID NO: 2154537 - RNA, 23 nt, Homo sapiens
cacuuuugaagaggccuaaguca

SEQ ID NO: 2154538 - RNA, 22 nt, Homo sapiens
cugggacuauaggcaugcgcca

SEQ ID NO: 2154539 - RNA, 21 nt, Homo sapiens
ccuauuucaugcagaguugaa

SEQ ID NO: 2154540 - RNA, 19 nt, Homo sapiens
uggccaguuuguuccucua

SEQ ID NO: 2154541 - RNA, 20 nt, Homo sapiens
aaaaaaguuuguuacuuuga

SEQ ID NO: 2154542 - RNA, 15 nt, Homo sapiens
aguucaccagcccug

SEQ ID NO: 2154543 - RNA, 21 nt, Homo sapiens
auugucaggggaacagagaag

SEQ ID NO: 2154544 - RNA, 15 nt, Homo sapiens
aaggacagcaucaaa

SEQ ID NO: 2154545 - RNA, 22 nt, Homo sapiens
ucugaucauuucaaaauuaagu

SEQ ID NO: 2154546 - RNA, 19 nt, Homo sapiens
uggcguaggcuacagagaa

SEQ ID NO: 2154547 - RNA, 21 nt, Homo sapiens
cagagaccccaggaacaauaa

SEQ ID NO: 2154548 - RNA, 22 nt, Homo sapiens
cuucaauuuggauauuuggagg

SEQ ID NO: 2154549 - RNA, 21 nt, Homo sapiens
caucagcuggcaucaguguuu

SEQ ID NO: 2154550 - RNA, 21 nt, Homo sapiens
aaagaauuuuuuugucuuuca

SEQ ID NO: 2154551 - RNA, 16 nt, Homo sapiens
uccaugaucacacagc

SEQ ID NO: 2154552 - RNA, 13 nt, Homo sapiens
cagaaacuagaca

SEQ ID NO: 2154553 - RNA, 15 nt, Homo sapiens
uuguaaguacucuaa

SEQ ID NO: 2154554 - RNA, 14 nt, Homo sapiens
ggaaggagcugccu

SEQ ID NO: 2154555 - RNA, 14 nt, Homo sapiens
ggacggagcugacu

SEQ ID NO: 2154556 - RNA, 21 nt, Homo sapiens
uccccuuucuuugcaacuucc

SEQ ID NO: 2154557 - RNA, 15 nt, Homo sapiens
cauucuuuugcacac

SEQ ID NO: 2154558 - RNA, 16 nt, Homo sapiens
guuuccuuucauuuac

SEQ ID NO: 2154559 - RNA, 19 nt, Homo sapiens
cuuuguaacggcucuuagc

SEQ ID NO: 2154560 - RNA, 18 nt, Homo sapiens
uguauuuuacaagucaaa

SEQ ID NO: 2154561 - RNA, 19 nt, Homo sapiens
ucgucggggggacagcucc

SEQ ID NO: 2154562 - RNA, 16 nt, Homo sapiens
acccucaccugaauaa

SEQ ID NO: 2154563 - RNA, 15 nt, Homo sapiens
gaaucagauucagga

SEQ ID NO: 2154564 - RNA, 22 nt, Homo sapiens
cuaguugaguagccagaugaaa

SEQ ID NO: 2154565 - RNA, 12 nt, Homo sapiens
cuuggugcugcg

SEQ ID NO: 2154566 - RNA, 20 nt, Homo sapiens
ccuuucacacuguggugucu

SEQ ID NO: 2154567 - RNA, 19 nt, Homo sapiens
auuuuacuuuucugccaaa

SEQ ID NO: 2154568 - RNA, 22 nt, Homo sapiens
gaacugggauggaauggcagca

SEQ ID NO: 2154569 - RNA, 13 nt, Homo sapiens
cagcgucuugcuc

SEQ ID NO: 2154570 - RNA, 13 nt, Homo sapiens
aaucuaaucucuu

SEQ ID NO: 2154571 - RNA, 16 nt, Homo sapiens
agaaagguauauauac

SEQ ID NO: 2154572 - RNA, 23 nt, Homo sapiens
cuaaaugucuuuuucacaaucau

SEQ ID NO: 2154573 - RNA, 11 nt, Homo sapiens
uguuacuucaa

SEQ ID NO: 2154574 - RNA, 22 nt, Homo sapiens
cccgucucuauaccaaccaaac

SEQ ID NO: 2154575 - RNA, 14 nt, Homo sapiens
cagcugcccugugu

SEQ ID NO: 2154576 - RNA, 21 nt, Homo sapiens
guacgaaucgaauacaaauca

SEQ ID NO: 2154577 - RNA, 17 nt, Homo sapiens
acucuuauuugguauaa

SEQ ID NO: 2154578 - RNA, 19 nt, Homo sapiens
uuaaaguuacauuaugugu

SEQ ID NO: 2154579 - RNA, 19 nt, Homo sapiens
gaauguuuucaaaaccaag

SEQ ID NO: 2154580 - RNA, 16 nt, Homo sapiens
ugccuuaggccuaccu

SEQ ID NO: 2154581 - RNA, 13 nt, Homo sapiens
agcaaaaggcagc

SEQ ID NO: 2154582 - RNA, 15 nt, Homo sapiens
acaaaugugugacug

SEQ ID NO: 2154583 - RNA, 14 nt, Homo sapiens
ggagagaucuccaa

SEQ ID NO: 2154584 - RNA, 16 nt, Homo sapiens
aaugcugauucaaggc

SEQ ID NO: 2154585 - RNA, 18 nt, Homo sapiens
guacuuuuuuuaaacugu

SEQ ID NO: 2154586 - RNA, 14 nt, Homo sapiens
ucuuuuucugucuc

SEQ ID NO: 2154587 - RNA, 15 nt, Homo sapiens
cuaaaaggaugucua

SEQ ID NO: 2154588 - RNA, 15 nt, Homo sapiens
uaacuucuuaaucua

SEQ ID NO: 2154589 - RNA, 21 nt, Homo sapiens
gcagauacugucucuuucaug

SEQ ID NO: 2154590 - RNA, 18 nt, Homo sapiens
cgggugauuggugcugag

SEQ ID NO: 2154591 - RNA, 17 nt, Homo sapiens
aaggugugcaaacuugu

SEQ ID NO: 2154592 - RNA, 18 nt, Homo sapiens
caucuacaagcauuugcc

SEQ ID NO: 2154593 - RNA, 17 nt, Homo sapiens
gugcuccguagcuucua

SEQ ID NO: 2154594 - RNA, 14 nt, Homo sapiens
acauguguguacau

SEQ ID NO: 2154595 - RNA, 19 nt, Homo sapiens
ggccuggggugacccggca

SEQ ID NO: 2154596 - RNA, 14 nt, Homo sapiens
aggccauccauuca

SEQ ID NO: 2154597 - RNA, 17 nt, Homo sapiens
cucagauacuuaugaaa

SEQ ID NO: 2154598 - RNA, 23 nt, Homo sapiens
gcugagcagauguaauagaaaua

SEQ ID NO: 2154599 - RNA, 16 nt, Homo sapiens
uuauaccccauuugau

SEQ ID NO: 2154600 - RNA, 23 nt, Homo sapiens
ugaauuugaauacugcauuuaca

SEQ ID NO: 2154601 - RNA, 16 nt, Homo sapiens
auuucuucuacugcua

SEQ ID NO: 2154602 - RNA, 16 nt, Homo sapiens
ucuaacuaaacuaaaa

SEQ ID NO: 2154603 - RNA, 20 nt, Homo sapiens
ccuugcacuccuacugaguu

SEQ ID NO: 2154604 - RNA, 21 nt, Homo sapiens
gcuggacuacccacguucuca

SEQ ID NO: 2154605 - RNA, 23 nt, Homo sapiens
gccuuccuggaggugacacuuga

SEQ ID NO: 2154606 - RNA, 14 nt, Homo sapiens
ugcgagcauuuccc

SEQ ID NO: 2154607 - RNA, 15 nt, Homo sapiens
auacuuggaccucag

SEQ ID NO: 2154608 - RNA, 9 nt, Homo sapiens
aaagacaga

SEQ ID NO: 2154609 - RNA, 22 nt, Homo sapiens
auuaaugccuuuaaaguaugaa

SEQ ID NO: 2154610 - RNA, 21 nt, Homo sapiens
uucccacaacuacuaguguga

SEQ ID NO: 2154611 - RNA, 13 nt, Homo sapiens
uucagacucucag

SEQ ID NO: 2154612 - RNA, 13 nt, Homo sapiens
augagugcuuaaa

SEQ ID NO: 2154613 - RNA, 22 nt, Homo sapiens
uccuagccacccaccacacuga

SEQ ID NO: 2154614 - RNA, 15 nt, Homo sapiens
acuuuccacuggagu

SEQ ID NO: 2154615 - RNA, 12 nt, Homo sapiens
ucugcauuugau

SEQ ID NO: 2154616 - RNA, 18 nt, Homo sapiens
auccaaaucagaggugca

SEQ ID NO: 2154617 - RNA, 21 nt, Homo sapiens
cuuuaauacucaccuccuccc

SEQ ID NO: 2154618 - RNA, 20 nt, Homo sapiens
gacccaaaaaaucaucucac

SEQ ID NO: 2154619 - RNA, 13 nt, Homo sapiens
uuaaaguucucaa

SEQ ID NO: 2154620 - RNA, 20 nt, Homo sapiens
cccaaaauacagcuaugaag

SEQ ID NO: 2154621 - RNA, 18 nt, Homo sapiens
gcagugacgugcaccugu

SEQ ID NO: 2154622 - RNA, 23 nt, Homo sapiens
uucagguauaaggcaggguggug

SEQ ID NO: 2154623 - RNA, 16 nt, Homo sapiens
uaaaauauuuucuaca

SEQ ID NO: 2154624 - RNA, 12 nt, Homo sapiens
ugaagcauuuaa

SEQ ID NO: 2154625 - RNA, 16 nt, Homo sapiens
ccuuuuguuuuccacu

SEQ ID NO: 2154626 - RNA, 14 nt, Homo sapiens
auaaccacagggcu

SEQ ID NO: 2154627 - RNA, 21 nt, Homo sapiens
cuggcaucguguauuccauau

SEQ ID NO: 2154628 - RNA, 13 nt, Homo sapiens
gcgccgcugugag

SEQ ID NO: 2154629 - RNA, 19 nt, Homo sapiens
cauaaugaaugcuauugaa

SEQ ID NO: 2154630 - RNA, 12 nt, Homo sapiens
ugccagacauug

SEQ ID NO: 2154631 - RNA, 18 nt, Homo sapiens
cucccugcacgcauuuuc

SEQ ID NO: 2154632 - RNA, 16 nt, Homo sapiens
aucugagguuggauuu

SEQ ID NO: 2154633 - RNA, 15 nt, Homo sapiens
uguccuggaauuauu

SEQ ID NO: 2154634 - RNA, 16 nt, Homo sapiens
aacuaauuucauuuca

SEQ ID NO: 2154635 - RNA, 20 nt, Homo sapiens
ucgaauaaaggaugggacca

SEQ ID NO: 2154636 - RNA, 21 nt, Homo sapiens
gcaccugccagaggaugcucu

SEQ ID NO: 2154637 - RNA, 20 nt, Homo sapiens
auaaacaguuuuacuugugu

SEQ ID NO: 2154638 - RNA, 17 nt, Homo sapiens
ucaugcccgccagugca

SEQ ID NO: 2154639 - RNA, 23 nt, Homo sapiens
uacaaaucauccauccuugccaa

SEQ ID NO: 2154640 - RNA, 17 nt, Homo sapiens
acccacaucuaaugucu

SEQ ID NO: 2154641 - RNA, 17 nt, Homo sapiens
caagauggcgacaaaag

SEQ ID NO: 2154642 - RNA, 15 nt, Homo sapiens
aacuacuuccauccc

SEQ ID NO: 2154643 - RNA, 20 nt, Homo sapiens
aggcuuuuaagaaacacagg

SEQ ID NO: 2154644 - RNA, 23 nt, Homo sapiens
ugaggcugggcgucuaugcugcu

SEQ ID NO: 2154645 - RNA, 20 nt, Homo sapiens
aggacuugaggccugagaca

SEQ ID NO: 2154646 - RNA, 19 nt, Homo sapiens
augaaccuucuuaacauca

SEQ ID NO: 2154647 - RNA, 22 nt, Homo sapiens
auuacagucauuuccuacccuu

SEQ ID NO: 2154648 - RNA, 17 nt, Homo sapiens
cucaagugucuaccugg

SEQ ID NO: 2154649 - RNA, 13 nt, Homo sapiens
auuauugacacug

SEQ ID NO: 2154650 - RNA, 15 nt, Homo sapiens
ucugugucucuggaa

SEQ ID NO: 2154651 - RNA, 20 nt, Homo sapiens
aaggaaaaacugauguuuaa

SEQ ID NO: 2154652 - RNA, 21 nt, Homo sapiens
ccuucgggcugugcccgggga

SEQ ID NO: 2154653 - RNA, 15 nt, Homo sapiens
aaaggcccuuuucag

SEQ ID NO: 2154654 - RNA, 22 nt, Homo sapiens
agcagaaggcaggaccaugagg

SEQ ID NO: 2154655 - RNA, 16 nt, Homo sapiens
ugcccucgagcacuga

SEQ ID NO: 2154656 - RNA, 17 nt, Homo sapiens
aacuaccccacaacacg

SEQ ID NO: 2154657 - RNA, 18 nt, Homo sapiens
ugcaaauuccauagcuca

SEQ ID NO: 2154658 - RNA, 11 nt, Homo sapiens
cauucaucuug

SEQ ID NO: 2154659 - RNA, 23 nt, Homo sapiens
acucucacccgaccggugcauga

SEQ ID NO: 2154660 - RNA, 18 nt, Homo sapiens
cuuuccaauguagcucag

SEQ ID NO: 2154661 - RNA, 19 nt, Homo sapiens
cugcccagcggccuuccac

SEQ ID NO: 2154662 - RNA, 19 nt, Homo sapiens
uacucaagugucuaccugg

SEQ ID NO: 2154663 - RNA, 16 nt, Homo sapiens
ucucccauggcuuugu

SEQ ID NO: 2154664 - RNA, 19 nt, Homo sapiens
agaggcgaaagcaguggcu

SEQ ID NO: 2154665 - RNA, 17 nt, Homo sapiens
uuaguaagauacuguuu

SEQ ID NO: 2154666 - RNA, 15 nt, Homo sapiens
uccaugcauucaccu

SEQ ID NO: 2154667 - RNA, 19 nt, Homo sapiens
cuuuuacagucacauucag

SEQ ID NO: 2154668 - RNA, 20 nt, Homo sapiens
ggaucauguaaaugcucaaa

SEQ ID NO: 2154669 - RNA, 20 nt, Homo sapiens
cacaacucuccaaaacacuu

SEQ ID NO: 2154670 - RNA, 15 nt, Homo sapiens
ucaacuucccaguga

SEQ ID NO: 2154671 - RNA, 24 nt, Homo sapiens
ucacauagguguugucaagugaua

SEQ ID NO: 2154672 - RNA, 20 nt, Homo sapiens
caguguccauggacucagaa

SEQ ID NO: 2154673 - RNA, 17 nt, Homo sapiens
ccuuaagucaaaagaga

SEQ ID NO: 2154674 - RNA, 20 nt, Homo sapiens
gcccacccgucuucaaucuc

SEQ ID NO: 2154675 - RNA, 21 nt, Homo sapiens
caguuccacagcagugucaca

SEQ ID NO: 2154676 - RNA, 22 nt, Homo sapiens
ugccaacgcaguucauguacaa

SEQ ID NO: 2154677 - RNA, 12 nt, Homo sapiens
cagccagucuca

SEQ ID NO: 2154678 - RNA, 23 nt, Homo sapiens
cucgcccuccuuucugugcccua

SEQ ID NO: 2154679 - RNA, 23 nt, Homo sapiens
cugagaccaaagaagcugcuguu

SEQ ID NO: 2154680 - RNA, 13 nt, Homo sapiens
ggcgacaguuuuc

SEQ ID NO: 2154681 - RNA, 21 nt, Homo sapiens
uugauaauuuugaaaugauuc

SEQ ID NO: 2154682 - RNA, 14 nt, Homo sapiens
agccaucuacugga

SEQ ID NO: 2154683 - RNA, 15 nt, Homo sapiens
uccauaccaucuggu

SEQ ID NO: 2154684 - RNA, 16 nt, Homo sapiens
cauguucagucacaug

SEQ ID NO: 2154685 - RNA, 14 nt, Homo sapiens
gagggccagugaug

SEQ ID NO: 2154686 - RNA, 16 nt, Homo sapiens
guguuuauaaugcaau

SEQ ID NO: 2154687 - RNA, 20 nt, Homo sapiens
guagacugaauucagcacca

SEQ ID NO: 2154688 - RNA, 12 nt, Homo sapiens
acaucgucugug

SEQ ID NO: 2154689 - RNA, 16 nt, Homo sapiens
auaaacugugugcaac

SEQ ID NO: 2154690 - RNA, 18 nt, Homo sapiens
cuauuucagcugcuuuga

SEQ ID NO: 2154691 - RNA, 22 nt, Homo sapiens
aauucuauguuggcauuaacaa

SEQ ID NO: 2154692 - RNA, 12 nt, Homo sapiens
agagaccugcuc

SEQ ID NO: 2154693 - RNA, 15 nt, Homo sapiens
uacuuuugcucccua

SEQ ID NO: 2154694 - RNA, 23 nt, Homo sapiens
auuucagguuuuguaaagaugcc

SEQ ID NO: 2154695 - RNA, 20 nt, Homo sapiens
agaauaaccaacacccugag

SEQ ID NO: 2154696 - RNA, 17 nt, Homo sapiens
cagucaagguugucaau

SEQ ID NO: 2154697 - RNA, 18 nt, Homo sapiens
acuguccaguccagugau

SEQ ID NO: 2154698 - RNA, 23 nt, Homo sapiens
gaaauacacagggaggggaugau

SEQ ID NO: 2154699 - RNA, 14 nt, Homo sapiens
guagguucuugaua

SEQ ID NO: 2154700 - RNA, 20 nt, Homo sapiens
ccugacagggccagugcagu

SEQ ID NO: 2154701 - RNA, 17 nt, Homo sapiens
augacuggucucuggcu

SEQ ID NO: 2154702 - RNA, 19 nt, Homo sapiens
augacaaacgggaccaaug

SEQ ID NO: 2154703 - RNA, 19 nt, Homo sapiens
cagaaacaguucaccuuga

SEQ ID NO: 2154704 - RNA, 23 nt, Homo sapiens
aaaagucccaacccaaugggcuc

SEQ ID NO: 2154705 - RNA, 20 nt, Homo sapiens
ugaauuucuagacaguauug

SEQ ID NO: 2154706 - RNA, 18 nt, Homo sapiens
ugaccucauuuguaaaau

SEQ ID NO: 2154707 - RNA, 18 nt, Homo sapiens
auagugaacauauggaaa

SEQ ID NO: 2154708 - RNA, 14 nt, Homo sapiens
ccagaaaggugauu

SEQ ID NO: 2154709 - RNA, 18 nt, Homo sapiens
acucuccccuucuucccc

SEQ ID NO: 2154710 - RNA, 18 nt, Homo sapiens
cugagccccauacagggc

SEQ ID NO: 2154711 - RNA, 17 nt, Homo sapiens
uuaauuuucaacucaau

SEQ ID NO: 2154712 - RNA, 14 nt, Homo sapiens
caucugacuaugac

SEQ ID NO: 2154713 - RNA, 22 nt, Homo sapiens
aguguccuaccacucuaaucaa

SEQ ID NO: 2154714 - RNA, 15 nt, Homo sapiens
ccaaaaaaaguucag

SEQ ID NO: 2154715 - RNA, 17 nt, Homo sapiens
auguguccaaucggaga

SEQ ID NO: 2154716 - RNA, 18 nt, Homo sapiens
cuuuuccaaaucaaggau

SEQ ID NO: 2154717 - RNA, 12 nt, Homo sapiens
gugugcgugcaa

SEQ ID NO: 2154718 - RNA, 18 nt, Homo sapiens
acagccucugaaaaccaa

SEQ ID NO: 2154719 - RNA, 20 nt, Homo sapiens
agcuacuugggaggcugaga

SEQ ID NO: 2154720 - RNA, 14 nt, Homo sapiens
uugacagugccaau

SEQ ID NO: 2154721 - RNA, 15 nt, Homo sapiens
agugcuucuccagcc

SEQ ID NO: 2154722 - RNA, 15 nt, Homo sapiens
auaguggaucacuca

SEQ ID NO: 2154723 - RNA, 18 nt, Homo sapiens
uuguuugugugaaaggaa

SEQ ID NO: 2154724 - RNA, 14 nt, Homo sapiens
cauucuauucucca

SEQ ID NO: 2154725 - RNA, 19 nt, Homo sapiens
cacacaugccacuaugagc

SEQ ID NO: 2154726 - RNA, 22 nt, Homo sapiens
agcugcauuucacaugccuugc

SEQ ID NO: 2154727 - RNA, 20 nt, Homo sapiens
caaccugccacaaugugaua

SEQ ID NO: 2154728 - RNA, 15 nt, Homo sapiens
gaauccaacuuuuaa

SEQ ID NO: 2154729 - RNA, 11 nt, Homo sapiens
gcagggaccaa

SEQ ID NO: 2154730 - RNA, 16 nt, Homo sapiens
aucucagcaaugauua

SEQ ID NO: 2154731 - RNA, 19 nt, Homo sapiens
uaaucccaguacucuggga

SEQ ID NO: 2154732 - RNA, 15 nt, Homo sapiens
ugucuucuuugccca

SEQ ID NO: 2154733 - RNA, 20 nt, Homo sapiens
uccucauggcccaucagggg

SEQ ID NO: 2154734 - RNA, 13 nt, Homo sapiens
aguugaucuggaa

SEQ ID NO: 2154735 - RNA, 20 nt, Homo sapiens
uuccuccccagucggcugaa

SEQ ID NO: 2154736 - RNA, 20 nt, Homo sapiens
uuaacagacacuguaaaaua

SEQ ID NO: 2154737 - RNA, 15 nt, Homo sapiens
gugaguacuguuaag

SEQ ID NO: 2154738 - RNA, 18 nt, Homo sapiens
cugccccggaccuaccuc

SEQ ID NO: 2154739 - RNA, 23 nt, Homo sapiens
gcaguacucaguaacagugcagu

SEQ ID NO: 2154740 - RNA, 14 nt, Homo sapiens
uauucauagcugua

SEQ ID NO: 2154741 - RNA, 19 nt, Homo sapiens
ugaaaaaagcaguucuuaa

SEQ ID NO: 2154742 - RNA, 21 nt, Homo sapiens
uaaggcuuaggccuauagauu

SEQ ID NO: 2154743 - RNA, 18 nt, Homo sapiens
uccuaaaauaaacaugaa

SEQ ID NO: 2154744 - RNA, 15 nt, Homo sapiens
cucaugcuguuccac

SEQ ID NO: 2154745 - RNA, 14 nt, Homo sapiens
gaacacugucaucc

SEQ ID NO: 2154746 - RNA, 20 nt, Homo sapiens
cacccagguuggagugcagu

SEQ ID NO: 2154747 - RNA, 20 nt, Homo sapiens
uacccaggcuggagugcagu

SEQ ID NO: 2154748 - RNA, 15 nt, Homo sapiens
gauucuucagcuuga

SEQ ID NO: 2154749 - RNA, 21 nt, Homo sapiens
acucagauccuccucauucac

SEQ ID NO: 2154750 - RNA, 20 nt, Homo sapiens
acguggccucuugagcagug

SEQ ID NO: 2154751 - RNA, 13 nt, Homo sapiens
auguuggggcccu

SEQ ID NO: 2154752 - RNA, 18 nt, Homo sapiens
cuuacucuugauuguggg

SEQ ID NO: 2154753 - RNA, 20 nt, Homo sapiens
uaacugggguugagggccaa

SEQ ID NO: 2154754 - RNA, 12 nt, Homo sapiens
uuccuucacuca

SEQ ID NO: 2154755 - RNA, 13 nt, Homo sapiens
gggccauggcuca

SEQ ID NO: 2154756 - RNA, 15 nt, Homo sapiens
aaacugaacacauga

SEQ ID NO: 2154757 - RNA, 18 nt, Homo sapiens
ucacucuuccugcaagga

SEQ ID NO: 2154758 - RNA, 19 nt, Homo sapiens
augucagaguagaagauuu

SEQ ID NO: 2154759 - RNA, 13 nt, Homo sapiens
auaguugaugcau

SEQ ID NO: 2154760 - RNA, 16 nt, Homo sapiens
aguaaaccugaacaaa

SEQ ID NO: 2154761 - RNA, 12 nt, Homo sapiens
auuuaaagacua

SEQ ID NO: 2154762 - RNA, 23 nt, Homo sapiens
caaacucccuagucuccaccuga

SEQ ID NO: 2154763 - RNA, 16 nt, Homo sapiens
acacauauauguauac

SEQ ID NO: 2154764 - RNA, 18 nt, Homo sapiens
aguugcagugagcagggu

SEQ ID NO: 2154765 - RNA, 23 nt, Homo sapiens
uuagaacagucauuaauuuucaa

SEQ ID NO: 2154766 - RNA, 18 nt, Homo sapiens
ucauauauuaaacaucca

SEQ ID NO: 2154767 - RNA, 14 nt, Homo sapiens
cucagcaaugauua

SEQ ID NO: 2154768 - RNA, 12 nt, Homo sapiens
gcaguccaucua

SEQ ID NO: 2154769 - RNA, 21 nt, Homo sapiens
cauggguuaucuguauggacu

SEQ ID NO: 2154770 - RNA, 18 nt, Homo sapiens
gagcaggugagcaaaaug

SEQ ID NO: 2154771 - RNA, 16 nt, Homo sapiens
cauauuaaacuucuga

SEQ ID NO: 2154772 - RNA, 14 nt, Homo sapiens
auaaauauauuuau

SEQ ID NO: 2154773 - RNA, 17 nt, Homo sapiens
gaaacuggaccugcaua

SEQ ID NO: 2154774 - RNA, 12 nt, Homo sapiens
ccaugugcaaua

SEQ ID NO: 2154775 - RNA, 13 nt, Homo sapiens
aggccuauuuuca

SEQ ID NO: 2154776 - RNA, 22 nt, Homo sapiens
cucuuccuacccaaccacucaa

SEQ ID NO: 2154777 - RNA, 20 nt, Homo sapiens
acccuccagaauccugaugg

SEQ ID NO: 2154778 - RNA, 15 nt, Homo sapiens
agcuauaacuaagca

SEQ ID NO: 2154779 - RNA, 19 nt, Homo sapiens
agcugucgacuucaugaca

SEQ ID NO: 2154780 - RNA, 14 nt, Homo sapiens
gugccaugcccaag

SEQ ID NO: 2154781 - RNA, 14 nt, Homo sapiens
ggcgagcacuguga

SEQ ID NO: 2154782 - RNA, 16 nt, Homo sapiens
uuccacucccacugcc

SEQ ID NO: 2154783 - RNA, 14 nt, Homo sapiens
uugcuguccucuca

SEQ ID NO: 2154784 - RNA, 15 nt, Homo sapiens
gcuucuucucaaagc

SEQ ID NO: 2154785 - RNA, 22 nt, Homo sapiens
cucuggggaagggaaccagccc

SEQ ID NO: 2154786 - RNA, 20 nt, Homo sapiens
acucaguaauuucaaaauac

SEQ ID NO: 2154787 - RNA, 21 nt, Homo sapiens
cccugaguugggcagccagga

SEQ ID NO: 2154788 - RNA, 20 nt, Homo sapiens
uacaggccuugcucacagcu

SEQ ID NO: 2154789 - RNA, 14 nt, Homo sapiens
uugguggggccauc

SEQ ID NO: 2154790 - RNA, 12 nt, Homo sapiens
gaacucaaagaa

SEQ ID NO: 2154791 - RNA, 13 nt, Homo sapiens
agcuuacugauua

SEQ ID NO: 2154792 - RNA, 23 nt, Homo sapiens
aauaaaugagagggaaucgacug

SEQ ID NO: 2154793 - RNA, 17 nt, Homo sapiens
agaaauaaaauaucucc

SEQ ID NO: 2154794 - RNA, 16 nt, Homo sapiens
cagcccucaacaggcc

SEQ ID NO: 2154795 - RNA, 16 nt, Homo sapiens
uacaucuccaaauauc

SEQ ID NO: 2154796 - RNA, 19 nt, Homo sapiens
ugcuuuaguacauggagcu

SEQ ID NO: 2154797 - RNA, 15 nt, Homo sapiens
uguuaauucuuucuc

SEQ ID NO: 2154798 - RNA, 20 nt, Homo sapiens
uaagaucuaaaaugauacug

SEQ ID NO: 2154799 - RNA, 13 nt, Homo sapiens
gacuuccugaaca

SEQ ID NO: 2154800 - RNA, 20 nt, Homo sapiens
gacaacaacgcggccaccau

SEQ ID NO: 2154801 - RNA, 16 nt, Homo sapiens
guuuauaacacugcuu

SEQ ID NO: 2154802 - RNA, 16 nt, Homo sapiens
cccaauuuacuugcca

SEQ ID NO: 2154803 - RNA, 22 nt, Homo sapiens
caugcucucuuucuuuucucug

SEQ ID NO: 2154804 - RNA, 14 nt, Homo sapiens
gaauuaagcccuaa

SEQ ID NO: 2154805 - RNA, 15 nt, Homo sapiens
cauuaugcaaaugga

SEQ ID NO: 2154806 - RNA, 16 nt, Homo sapiens
cacuuccuccuaccug

SEQ ID NO: 2154807 - RNA, 22 nt, Homo sapiens
ucaauuuccaaccuccccugua

SEQ ID NO: 2154808 - RNA, 17 nt, Homo sapiens
aauucaguuauuugcac

SEQ ID NO: 2154809 - RNA, 19 nt, Homo sapiens
cuuucucauuaccagugac

SEQ ID NO: 2154810 - RNA, 17 nt, Homo sapiens
acuaucugaaccauuaa

SEQ ID NO: 2154811 - RNA, 12 nt, Homo sapiens
uuucauaguuuc

SEQ ID NO: 2154812 - RNA, 12 nt, Homo sapiens
uauuauaguauu

SEQ ID NO: 2154813 - RNA, 17 nt, Homo sapiens
ugaggagcuggaaacac

SEQ ID NO: 2154814 - RNA, 17 nt, Homo sapiens
cacuuugaaauaccuca

SEQ ID NO: 2154815 - RNA, 21 nt, Homo sapiens
ccuuuauaauauuucagugga

SEQ ID NO: 2154816 - RNA, 22 nt, Homo sapiens
uuuggcaaacucuccaccacac

SEQ ID NO: 2154817 - RNA, 19 nt, Homo sapiens
augaaaauaagugaauaau

SEQ ID NO: 2154818 - RNA, 16 nt, Homo sapiens
ugguaguuaugugaag

SEQ ID NO: 2154819 - RNA, 14 nt, Homo sapiens
aacaaauggccuuu

SEQ ID NO: 2154820 - RNA, 18 nt, Homo sapiens
cuucugagugaauguuaa

SEQ ID NO: 2154821 - RNA, 16 nt, Homo sapiens
cccauaccccuggcca

SEQ ID NO: 2154822 - RNA, 15 nt, Homo sapiens
agaaaccuaaaauaa

SEQ ID NO: 2154823 - RNA, 13 nt, Homo sapiens
aaaggcaguuuuc

SEQ ID NO: 2154824 - RNA, 17 nt, Homo sapiens
ucccugccuguggcauu

SEQ ID NO: 2154825 - RNA, 19 nt, Homo sapiens
acugaugaccgucugagcc

SEQ ID NO: 2154826 - RNA, 22 nt, Homo sapiens
gguccagcuugcucuucagugg

SEQ ID NO: 2154827 - RNA, 14 nt, Homo sapiens
cuuuguuugucaca

SEQ ID NO: 2154828 - RNA, 22 nt, Homo sapiens
uaaagcgacggcuuuuguuuca

SEQ ID NO: 2154829 - RNA, 13 nt, Homo sapiens
ccuggugcccuuc

SEQ ID NO: 2154830 - RNA, 16 nt, Homo sapiens
augggugaaaccacau

SEQ ID NO: 2154831 - RNA, 15 nt, Homo sapiens
cacuggagcugucuu

SEQ ID NO: 2154832 - RNA, 15 nt, Homo sapiens
aaguauuccuuuccu

SEQ ID NO: 2154833 - RNA, 15 nt, Homo sapiens
ugguaucucagaaag

SEQ ID NO: 2154834 - RNA, 15 nt, Homo sapiens
ugcagacucacugug

SEQ ID NO: 2154835 - RNA, 15 nt, Homo sapiens
agcuguaacuaacuc

SEQ ID NO: 2154836 - RNA, 23 nt, Homo sapiens
ugcagugaccugcccuacauauc

SEQ ID NO: 2154837 - RNA, 17 nt, Homo sapiens
aaugagggaguccaguc

SEQ ID NO: 2154838 - RNA, 20 nt, Homo sapiens
aaucauuguagaaacacagu

SEQ ID NO: 2154839 - RNA, 20 nt, Homo sapiens
aauucgcagugauauacuua

SEQ ID NO: 2154840 - RNA, 14 nt, Homo sapiens
cauuccaucaauuu

SEQ ID NO: 2154841 - RNA, 22 nt, Homo sapiens
cucugcccuuccccucccgaca

SEQ ID NO: 2154842 - RNA, 16 nt, Homo sapiens
agccugcagacucacu

SEQ ID NO: 2154843 - RNA, 19 nt, Homo sapiens
uguugcacugaaguuugau

SEQ ID NO: 2154844 - RNA, 17 nt, Homo sapiens
aauaugucuuggaagac

SEQ ID NO: 2154845 - RNA, 20 nt, Homo sapiens
gaacgcuuguaauuggaaua

SEQ ID NO: 2154846 - RNA, 22 nt, Homo sapiens
uccauguuucagaagcauucag

SEQ ID NO: 2154847 - RNA, 13 nt, Homo sapiens
cucugauauggcu

SEQ ID NO: 2154848 - RNA, 14 nt, Homo sapiens
gcucuggugcugca

SEQ ID NO: 2154849 - RNA, 17 nt, Homo sapiens
ccuggugcaagugcugu

SEQ ID NO: 2154850 - RNA, 17 nt, Homo sapiens
agccgccgaccugugac

SEQ ID NO: 2154851 - RNA, 18 nt, Homo sapiens
uucuccaauacagcaaac

SEQ ID NO: 2154852 - RNA, 20 nt, Homo sapiens
uucacuagaaaaugagaaaa

SEQ ID NO: 2154853 - RNA, 20 nt, Homo sapiens
caacagagcaagacccaucu

SEQ ID NO: 2154854 - RNA, 22 nt, Homo sapiens
auucuuuccccucagagcucuu

SEQ ID NO: 2154855 - RNA, 21 nt, Homo sapiens
aacuccagccacccagccagg

SEQ ID NO: 2154856 - RNA, 20 nt, Homo sapiens
agacuucucccgugagccag

SEQ ID NO: 2154857 - RNA, 17 nt, Homo sapiens
accuuaagagacacucc

SEQ ID NO: 2154858 - RNA, 16 nt, Homo sapiens
gucugcugcugugcag

SEQ ID NO: 2154859 - RNA, 18 nt, Homo sapiens
acggaaaaugccuguaaa

SEQ ID NO: 2154860 - RNA, 16 nt, Homo sapiens
cuggaacuacaaggaa

SEQ ID NO: 2154861 - RNA, 18 nt, Homo sapiens
ggcugcuggggccucaga

SEQ ID NO: 2154862 - RNA, 21 nt, Homo sapiens
ggaaacuaauaaaauauuuuc

SEQ ID NO: 2154863 - RNA, 16 nt, Homo sapiens
acuugacuugaaugug

SEQ ID NO: 2154864 - RNA, 22 nt, Homo sapiens
gauagcuucaucuugagccuga

SEQ ID NO: 2154865 - RNA, 18 nt, Homo sapiens
uuuuggguguuccuggca

SEQ ID NO: 2154866 - RNA, 15 nt, Homo sapiens
gaaaaacaaacaaaa

SEQ ID NO: 2154867 - RNA, 18 nt, Homo sapiens
uccugcguagaagauaug

SEQ ID NO: 2154868 - RNA, 16 nt, Homo sapiens
ucuuaaaauaacuuau

SEQ ID NO: 2154869 - RNA, 14 nt, Homo sapiens
cugaacaauuaccu

SEQ ID NO: 2154870 - RNA, 14 nt, Homo sapiens
uaugcaaccugugc

SEQ ID NO: 2154871 - RNA, 17 nt, Homo sapiens
ugcuugggacauugcaa

SEQ ID NO: 2154872 - RNA, 14 nt, Homo sapiens
caaacccagucuca

SEQ ID NO: 2154873 - RNA, 18 nt, Homo sapiens
ggaccaaggggugggcca

SEQ ID NO: 2154874 - RNA, 18 nt, Homo sapiens
aagacugguuuucugcca

SEQ ID NO: 2154875 - RNA, 13 nt, Homo sapiens
aggaaacgaugaa

SEQ ID NO: 2154876 - RNA, 13 nt, Homo sapiens
ugaguggugccaa

SEQ ID NO: 2154877 - RNA, 18 nt, Homo sapiens
cuucugccccagcuuugc

SEQ ID NO: 2154878 - RNA, 14 nt, Homo sapiens
uccaucccagacau

SEQ ID NO: 2154879 - RNA, 19 nt, Homo sapiens
uccuccccucuccuagcag

SEQ ID NO: 2154880 - RNA, 23 nt, Homo sapiens
ccuugcaagguuaagcaaggugg

SEQ ID NO: 2154881 - RNA, 18 nt, Homo sapiens
augucuugcaaagccuuu

SEQ ID NO: 2154882 - RNA, 17 nt, Homo sapiens
uugacaggggcucagga

SEQ ID NO: 2154883 - RNA, 18 nt, Homo sapiens
cuugggugguuccuaagg

SEQ ID NO: 2154884 - RNA, 23 nt, Homo sapiens
agacaaucuaaaaaauaucuuag

SEQ ID NO: 2154885 - RNA, 19 nt, Homo sapiens
uacugacuuaggcaauaca

SEQ ID NO: 2154886 - RNA, 19 nt, Homo sapiens
gcguuaugugcaguacuua

SEQ ID NO: 2154887 - RNA, 14 nt, Homo sapiens
aagacgccaaaaac

SEQ ID NO: 2154888 - RNA, 20 nt, Homo sapiens
gcggcaccuuuccucuaauc

SEQ ID NO: 2154889 - RNA, 16 nt, Homo sapiens
ucuaauggacuuucag

SEQ ID NO: 2154890 - RNA, 16 nt, Homo sapiens
cagugcggcagguuca

SEQ ID NO: 2154891 - RNA, 16 nt, Homo sapiens
ugacauuguauguauc

SEQ ID NO: 2154892 - RNA, 15 nt, Homo sapiens
acuaacuuugaaugu

SEQ ID NO: 2154893 - RNA, 21 nt, Homo sapiens
uuucaucuuuuaauucaccuc

SEQ ID NO: 2154894 - RNA, 18 nt, Homo sapiens
ccccucucugcuccagac

SEQ ID NO: 2154895 - RNA, 13 nt, Homo sapiens
uaucccaucucac

SEQ ID NO: 2154896 - RNA, 21 nt, Homo sapiens
uguauaauacauccauucuac

SEQ ID NO: 2154897 - RNA, 21 nt, Homo sapiens
aucuccaguuuauagaccaga

SEQ ID NO: 2154898 - RNA, 20 nt, Homo sapiens
acaagucaguaggacuccuu

SEQ ID NO: 2154899 - RNA, 19 nt, Homo sapiens
uggguaagaagaaagcaaa

SEQ ID NO: 2154900 - RNA, 13 nt, Homo sapiens
ugcggaagccaua

SEQ ID NO: 2154901 - RNA, 18 nt, Homo sapiens
caauccuugccacagugu

SEQ ID NO: 2154902 - RNA, 16 nt, Homo sapiens
auuuuacugaucucuu

SEQ ID NO: 2154903 - RNA, 15 nt, Homo sapiens
uaucuuaaagcacuu

SEQ ID NO: 2154904 - RNA, 22 nt, Homo sapiens
acuccuggccucaagugaucug

SEQ ID NO: 2154905 - RNA, 14 nt, Homo sapiens
ucuuuggccagaag

SEQ ID NO: 2154906 - RNA, 14 nt, Homo sapiens
aaaaacacaugggg

SEQ ID NO: 2154907 - RNA, 18 nt, Homo sapiens
agaccccuggcugguaag

SEQ ID NO: 2154908 - RNA, 17 nt, Homo sapiens
agagcucugacccacag

SEQ ID NO: 2154909 - RNA, 19 nt, Homo sapiens
cagcaccgcagccucugcc

SEQ ID NO: 2154910 - RNA, 20 nt, Homo sapiens
augagacugggcaucucuga

SEQ ID NO: 2154911 - RNA, 18 nt, Homo sapiens
aacuauaacaaucacugg

SEQ ID NO: 2154912 - RNA, 18 nt, Homo sapiens
gagguuugucaacacaaa

SEQ ID NO: 2154913 - RNA, 20 nt, Homo sapiens
ccugaagcuggccuggacca

SEQ ID NO: 2154914 - RNA, 17 nt, Homo sapiens
uagagaaugucacugua

SEQ ID NO: 2154915 - RNA, 13 nt, Homo sapiens
gaugaugaugauc

SEQ ID NO: 2154916 - RNA, 16 nt, Homo sapiens
aauaaagcacugagca

SEQ ID NO: 2154917 - RNA, 16 nt, Homo sapiens
aguucucaaagaccug

SEQ ID NO: 2154918 - RNA, 14 nt, Homo sapiens
ugggggcccaaagg

SEQ ID NO: 2154919 - RNA, 23 nt, Homo sapiens
cuaguaggucugcacacauaaca

SEQ ID NO: 2154920 - RNA, 16 nt, Homo sapiens
cagcccugcucauucc

SEQ ID NO: 2154921 - RNA, 14 nt, Homo sapiens
uacuucuauaucau

SEQ ID NO: 2154922 - RNA, 22 nt, Homo sapiens
uacaaagcccuuguccccauga

SEQ ID NO: 2154923 - RNA, 16 nt, Homo sapiens
aacuagucuguuggca

SEQ ID NO: 2154924 - RNA, 16 nt, Homo sapiens
cguagaaaguuuuagg

SEQ ID NO: 2154925 - RNA, 23 nt, Homo sapiens
acccauaauauuggaagcagccu

SEQ ID NO: 2154926 - RNA, 23 nt, Homo sapiens
uuaauuaugauaauaaagagauu

SEQ ID NO: 2154927 - RNA, 20 nt, Homo sapiens
ucuuggagaaaauaacaaga

SEQ ID NO: 2154928 - RNA, 14 nt, Homo sapiens
gcgccagugacagu

SEQ ID NO: 2154929 - RNA, 20 nt, Homo sapiens
guuuuaaaaggcaagucaaa

SEQ ID NO: 2154930 - RNA, 14 nt, Homo sapiens
aggaacagaguaua

SEQ ID NO: 2154931 - RNA, 19 nt, Homo sapiens
accagcggaaacaggugug

SEQ ID NO: 2154932 - RNA, 11 nt, Homo sapiens
ccuuugcugcc

SEQ ID NO: 2154933 - RNA, 15 nt, Homo sapiens
cauccagcaguccaa

SEQ ID NO: 2154934 - RNA, 23 nt, Homo sapiens
caaaauauauuuuaucugugauu

SEQ ID NO: 2154935 - RNA, 23 nt, Homo sapiens
uggccaggugccgacacugagcu

SEQ ID NO: 2154936 - RNA, 16 nt, Homo sapiens
cauuucucugcaaaau

SEQ ID NO: 2154937 - RNA, 17 nt, Homo sapiens
aucugcaggacagaggg

SEQ ID NO: 2154938 - RNA, 22 nt, Homo sapiens
ugccauccacauuuuaacagua

SEQ ID NO: 2154939 - RNA, 21 nt, Homo sapiens
aaaguguuaggauuacaggca

SEQ ID NO: 2154940 - RNA, 15 nt, Homo sapiens
ugaagucaaaccuua

SEQ ID NO: 2154941 - RNA, 13 nt, Homo sapiens
ggccaacaugaug

SEQ ID NO: 2154942 - RNA, 19 nt, Homo sapiens
uaccaaauccacaagccau

SEQ ID NO: 2154943 - RNA, 19 nt, Homo sapiens
cuuugaaguagguggcuug

SEQ ID NO: 2154944 - RNA, 19 nt, Homo sapiens
acaacaguucugagcugua

SEQ ID NO: 2154945 - RNA, 18 nt, Homo sapiens
cuuccagagaagccaugg

SEQ ID NO: 2154946 - RNA, 17 nt, Homo sapiens
uguggccccaccgagcu

SEQ ID NO: 2154947 - RNA, 19 nt, Homo sapiens
ugaagcaaauuucuagaua

SEQ ID NO: 2154948 - RNA, 20 nt, Homo sapiens
ccugcuagucugucagggcc

SEQ ID NO: 2154949 - RNA, 18 nt, Homo sapiens
ucuaaauaaggaauuucc

SEQ ID NO: 2154950 - RNA, 17 nt, Homo sapiens
aggugcuggcucuuucc

SEQ ID NO: 2154951 - RNA, 17 nt, Homo sapiens
cucugccccugcagcug

SEQ ID NO: 2154952 - RNA, 21 nt, Homo sapiens
guuacugagauguuuuaccau

SEQ ID NO: 2154953 - RNA, 16 nt, Homo sapiens
gcaagauguacuauaa

SEQ ID NO: 2154954 - RNA, 14 nt, Homo sapiens
cuuuacagugccac

SEQ ID NO: 2154955 - RNA, 19 nt, Homo sapiens
aucaucuucucauuuugca

SEQ ID NO: 2154956 - RNA, 21 nt, Homo sapiens
aauuuuuuaaaguuacuuugu

SEQ ID NO: 2154957 - RNA, 18 nt, Homo sapiens
aaacgccaguguguuuaa

SEQ ID NO: 2154958 - RNA, 17 nt, Homo sapiens
acuacauugaguagaca

SEQ ID NO: 2154959 - RNA, 13 nt, Homo sapiens
cuuuaucucaggg

SEQ ID NO: 2154960 - RNA, 16 nt, Homo sapiens
acccuucuccuuagaa

SEQ ID NO: 2154961 - RNA, 18 nt, Homo sapiens
uaauauuguauugcugcu

SEQ ID NO: 2154962 - RNA, 15 nt, Homo sapiens
ugugaaccccaaagu

SEQ ID NO: 2154963 - RNA, 16 nt, Homo sapiens
uagcaguacuaaucau

SEQ ID NO: 2154964 - RNA, 12 nt, Homo sapiens
acaccaguaaua

SEQ ID NO: 2154965 - RNA, 17 nt, Homo sapiens
aucaccaaacaacuuca

SEQ ID NO: 2154966 - RNA, 18 nt, Homo sapiens
ccugcccgccacauggug

SEQ ID NO: 2154967 - RNA, 22 nt, Homo sapiens
ugcucauccccaccugucuuca

SEQ ID NO: 2154968 - RNA, 22 nt, Homo sapiens
ucugagaacaaauacaauucag

SEQ ID NO: 2154969 - RNA, 22 nt, Homo sapiens
caacagaugaccguguacaaua

SEQ ID NO: 2154970 - RNA, 17 nt, Homo sapiens
agguaucacugcaguca

SEQ ID NO: 2154971 - RNA, 15 nt, Homo sapiens
ugcucucucucacca

SEQ ID NO: 2154972 - RNA, 21 nt, Homo sapiens
ugauuagaaggcaaguuucua

SEQ ID NO: 2154973 - RNA, 21 nt, Homo sapiens
cuggucuccguggcacuugua

SEQ ID NO: 2154974 - RNA, 15 nt, Homo sapiens
uaauacagggcauuu

SEQ ID NO: 2154975 - RNA, 16 nt, Homo sapiens
aacaguguucugagcc

SEQ ID NO: 2154976 - RNA, 21 nt, Homo sapiens
gugcaauacggaacacuguca

SEQ ID NO: 2154977 - RNA, 18 nt, Homo sapiens
uggccagccagugccauu

SEQ ID NO: 2154978 - RNA, 15 nt, Homo sapiens
ucccacucaagccaa

SEQ ID NO: 2154979 - RNA, 21 nt, Homo sapiens
cuuucaaguuugucacuaaac

SEQ ID NO: 2154980 - RNA, 20 nt, Homo sapiens
ggcgcacuuuccacuggagu

SEQ ID NO: 2154981 - RNA, 19 nt, Homo sapiens
uuccaggaaaaucugcacu

SEQ ID NO: 2154982 - RNA, 22 nt, Homo sapiens
uaccaccaagggaucugccauu

SEQ ID NO: 2154983 - RNA, 17 nt, Homo sapiens
gaagcagaauugcuuga

SEQ ID NO: 2154984 - RNA, 19 nt, Homo sapiens
ggagccuccaauugcagug

SEQ ID NO: 2154985 - RNA, 20 nt, Homo sapiens
auuagauacaguagugucau

SEQ ID NO: 2154986 - RNA, 16 nt, Homo sapiens
uauuccacuauuugca

SEQ ID NO: 2154987 - RNA, 16 nt, Homo sapiens
aucuccaaaucuugcc

SEQ ID NO: 2154988 - RNA, 17 nt, Homo sapiens
agccauggaaggugcca

SEQ ID NO: 2154989 - RNA, 21 nt, Homo sapiens
guuccuaauauauuguuaaau

SEQ ID NO: 2154990 - RNA, 16 nt, Homo sapiens
cuuuugucauguggcu

SEQ ID NO: 2154991 - RNA, 22 nt, Homo sapiens
ggguuggggugcuuccuuucag

SEQ ID NO: 2154992 - RNA, 18 nt, Homo sapiens
uacacuaaaaaaaugcaa

SEQ ID NO: 2154993 - RNA, 15 nt, Homo sapiens
gcacaggucaggggu

SEQ ID NO: 2154994 - RNA, 15 nt, Homo sapiens
acgucaacgugagcu

SEQ ID NO: 2154995 - RNA, 12 nt, Homo sapiens
auacacacaaaa

SEQ ID NO: 2154996 - RNA, 16 nt, Homo sapiens
gaugagagagugcuga

SEQ ID NO: 2154997 - RNA, 16 nt, Homo sapiens
gaagcuuccuuggcuu

SEQ ID NO: 2154998 - RNA, 17 nt, Homo sapiens
aaguaagaacacugaga

SEQ ID NO: 2154999 - RNA, 17 nt, Homo sapiens
ggacagaguagccaggu

SEQ ID NO: 2155000 - RNA, 13 nt, Homo sapiens
ucuaaucucucac

SEQ ID NO: 2155001 - RNA, 22 nt, Homo sapiens
auacagcaggcagaacucuccu

SEQ ID NO: 2155002 - RNA, 21 nt, Homo sapiens
cuucaagauccucuugccaca

SEQ ID NO: 2155003 - RNA, 20 nt, Homo sapiens
cagaauagcuuccaauaaag

SEQ ID NO: 2155004 - RNA, 12 nt, Homo sapiens
uuccucaccaau

SEQ ID NO: 2155005 - RNA, 13 nt, Homo sapiens
ggaaucagucagc

SEQ ID NO: 2155006 - RNA, 19 nt, Homo sapiens
uaacaauaagccaguauaa

SEQ ID NO: 2155007 - RNA, 19 nt, Homo sapiens
ucccuaccugacugccaca

SEQ ID NO: 2155008 - RNA, 17 nt, Homo sapiens
ggaguggacgcugucca

SEQ ID NO: 2155009 - RNA, 21 nt, Homo sapiens
ugaaucugggacugugccugg

SEQ ID NO: 2155010 - RNA, 16 nt, Homo sapiens
gcuggcagaguuagca

SEQ ID NO: 2155011 - RNA, 18 nt, Homo sapiens
acuacaggaggaaugcac

SEQ ID NO: 2155012 - RNA, 23 nt, Homo sapiens
aucuuugggccuuuccucagugu

SEQ ID NO: 2155013 - RNA, 20 nt, Homo sapiens
aagugagagauguugcccau

SEQ ID NO: 2155014 - RNA, 22 nt, Homo sapiens
ugaguccaagaggguccuuuag

SEQ ID NO: 2155015 - RNA, 22 nt, Homo sapiens
uggcccuccccacaaugccaga

SEQ ID NO: 2155016 - RNA, 15 nt, Homo sapiens
uuuccauccuaguca

SEQ ID NO: 2155017 - RNA, 17 nt, Homo sapiens
ggaguucauaguuggaa

SEQ ID NO: 2155018 - RNA, 22 nt, Homo sapiens
ggcuccccauuuuauaccaaag

SEQ ID NO: 2155019 - RNA, 20 nt, Homo sapiens
cagcucuucuugacaucaag

SEQ ID NO: 2155020 - RNA, 17 nt, Homo sapiens
auaaaauccugugcaau

SEQ ID NO: 2155021 - RNA, 21 nt, Homo sapiens
uacacauguaucuaugcauuu

SEQ ID NO: 2155022 - RNA, 19 nt, Homo sapiens
agguaccagccuuggauac

SEQ ID NO: 2155023 - RNA, 15 nt, Homo sapiens
ugguagacugugaca

SEQ ID NO: 2155024 - RNA, 12 nt, Homo sapiens
agacaacaaaug

SEQ ID NO: 2155025 - RNA, 20 nt, Homo sapiens
uucuuccgcacccucccuag

SEQ ID NO: 2155026 - RNA, 13 nt, Homo sapiens
uuggccucuccuu

SEQ ID NO: 2155027 - RNA, 17 nt, Homo sapiens
ugcuacuuaauuccuuu

SEQ ID NO: 2155028 - RNA, 16 nt, Homo sapiens
caaugaacaucccuuu

SEQ ID NO: 2155029 - RNA, 23 nt, Homo sapiens
ugcuucauuucuuuuucauuuga

SEQ ID NO: 2155030 - RNA, 20 nt, Homo sapiens
uguggagaugagucagugcc

SEQ ID NO: 2155031 - RNA, 16 nt, Homo sapiens
gucacgcaagcuaguu

SEQ ID NO: 2155032 - RNA, 22 nt, Homo sapiens
acacuaucuguacuaaaaacac

SEQ ID NO: 2155033 - RNA, 19 nt, Homo sapiens
caggucuggaggggccaug

SEQ ID NO: 2155034 - RNA, 21 nt, Homo sapiens
caggauaugaguacauacuca

SEQ ID NO: 2155035 - RNA, 14 nt, Homo sapiens
aaaauuauagucaa

SEQ ID NO: 2155036 - RNA, 14 nt, Homo sapiens
agaaaaauaaucuu

SEQ ID NO: 2155037 - RNA, 18 nt, Homo sapiens
gaacuguuggagcccgaa

SEQ ID NO: 2155038 - RNA, 15 nt, Homo sapiens
uaacacuaccaauuu

SEQ ID NO: 2155039 - RNA, 18 nt, Homo sapiens
ugagcuugauuaaaucaa

SEQ ID NO: 2155040 - RNA, 13 nt, Homo sapiens
uagucuuugccag

SEQ ID NO: 2155041 - RNA, 16 nt, Homo sapiens
uaccugagucccaaag

SEQ ID NO: 2155042 - RNA, 23 nt, Homo sapiens
ggcccagugacaccgaguuccac

SEQ ID NO: 2155043 - RNA, 20 nt, Homo sapiens
uguacaacuccacgagguga

SEQ ID NO: 2155044 - RNA, 16 nt, Homo sapiens
aagacagaugccccag

SEQ ID NO: 2155045 - RNA, 14 nt, Homo sapiens
cuuggugcugguuu

SEQ ID NO: 2155046 - RNA, 19 nt, Homo sapiens
ccaggcacacacugugcuu

SEQ ID NO: 2155047 - RNA, 13 nt, Homo sapiens
uaauaacuuuucu

SEQ ID NO: 2155048 - RNA, 12 nt, Homo sapiens
cuggaagccaaa

SEQ ID NO: 2155049 - RNA, 20 nt, Homo sapiens
augaucacauucuuuccaaa

SEQ ID NO: 2155050 - RNA, 18 nt, Homo sapiens
aggaagggacugguccag

SEQ ID NO: 2155051 - RNA, 16 nt, Homo sapiens
cacgaucguuaugcug

SEQ ID NO: 2155052 - RNA, 19 nt, Homo sapiens
uaaaaaaccaacaauguga

SEQ ID NO: 2155053 - RNA, 20 nt, Homo sapiens
caauacagaucaucuuggaa

SEQ ID NO: 2155054 - RNA, 17 nt, Homo sapiens
ucccuucggccaaacag

SEQ ID NO: 2155055 - RNA, 15 nt, Homo sapiens
uaauuggaagugcag

SEQ ID NO: 2155056 - RNA, 21 nt, Homo sapiens
acuaugaaugggcaaaacuga

SEQ ID NO: 2155057 - RNA, 14 nt, Homo sapiens
gaagggaugggaga

SEQ ID NO: 2155058 - RNA, 18 nt, Homo sapiens
ccauuuuguuaaaaucua

SEQ ID NO: 2155059 - RNA, 21 nt, Homo sapiens
ugaccucuauaaacuucagag

SEQ ID NO: 2155060 - RNA, 21 nt, Homo sapiens
gcauaaguuucugggaccuca

SEQ ID NO: 2155061 - RNA, 16 nt, Homo sapiens
cuuauggcugcugaaa

SEQ ID NO: 2155062 - RNA, 22 nt, Homo sapiens
aacccgacauguguaccucagc

SEQ ID NO: 2155063 - RNA, 18 nt, Homo sapiens
uccuacucagacuguugc

SEQ ID NO: 2155064 - RNA, 14 nt, Homo sapiens
ggagcuggaccugc

SEQ ID NO: 2155065 - RNA, 12 nt, Homo sapiens
caagcagugcac

SEQ ID NO: 2155066 - RNA, 19 nt, Homo sapiens
uaucaugcuucuacuccau

SEQ ID NO: 2155067 - RNA, 19 nt, Homo sapiens
accuucaucagaccacucc

SEQ ID NO: 2155068 - RNA, 20 nt, Homo sapiens
cuauaagaauaaggcuuuuu

SEQ ID NO: 2155069 - RNA, 14 nt, Homo sapiens
ccaccccauuaaaa

SEQ ID NO: 2155070 - RNA, 13 nt, Homo sapiens
agcauugccagua

SEQ ID NO: 2155071 - RNA, 13 nt, Homo sapiens
agcuucaacuuuu

SEQ ID NO: 2155072 - RNA, 23 nt, Homo sapiens
gaaaagcuucuuaauuaauuuga

SEQ ID NO: 2155073 - RNA, 13 nt, Homo sapiens
accagauuugcua

SEQ ID NO: 2155074 - RNA, 15 nt, Homo sapiens
guucaagcaauccac

SEQ ID NO: 2155075 - RNA, 22 nt, Homo sapiens
aauguacaaaauaaaguuacau

SEQ ID NO: 2155076 - RNA, 17 nt, Homo sapiens
caccagucucacccacu

SEQ ID NO: 2155077 - RNA, 17 nt, Homo sapiens
uggccagacuucagcug

SEQ ID NO: 2155078 - RNA, 16 nt, Homo sapiens
aacuacugccuuuaga

SEQ ID NO: 2155079 - RNA, 16 nt, Homo sapiens
aauauaagaacuugau

SEQ ID NO: 2155080 - RNA, 16 nt, Homo sapiens
guacaguauuucugga

SEQ ID NO: 2155081 - RNA, 16 nt, Homo sapiens
ugugccacacaaugga

SEQ ID NO: 2155082 - RNA, 17 nt, Homo sapiens
aauggcagucugccugc

SEQ ID NO: 2155083 - RNA, 15 nt, Homo sapiens
gcugcaaggagcaac

SEQ ID NO: 2155084 - RNA, 18 nt, Homo sapiens
aggacacugauccaguca

SEQ ID NO: 2155085 - RNA, 16 nt, Homo sapiens
gaccagagggacacua

SEQ ID NO: 2155086 - RNA, 13 nt, Homo sapiens
gucagccacuguu

SEQ ID NO: 2155087 - RNA, 19 nt, Homo sapiens
caccacugugucccagugu

SEQ ID NO: 2155088 - RNA, 14 nt, Homo sapiens
uauuugaaagcagg

SEQ ID NO: 2155089 - RNA, 17 nt, Homo sapiens
ugcaaaacauugaagag

SEQ ID NO: 2155090 - RNA, 15 nt, Homo sapiens
gaucaaagaaauuca

SEQ ID NO: 2155091 - RNA, 12 nt, Homo sapiens
aucuguuuccaa

SEQ ID NO: 2155092 - RNA, 12 nt, Homo sapiens
cagcagcuccaa

SEQ ID NO: 2155093 - RNA, 22 nt, Homo sapiens
aaaauauuugugaaagugccaa

SEQ ID NO: 2155094 - RNA, 20 nt, Homo sapiens
ugacucgacaccgugucacc

SEQ ID NO: 2155095 - RNA, 20 nt, Homo sapiens
ugcuaucagcaaugccccaa

SEQ ID NO: 2155096 - RNA, 12 nt, Homo sapiens
uuguuguucacg

SEQ ID NO: 2155097 - RNA, 13 nt, Homo sapiens
ugcagaagcagaa

SEQ ID NO: 2155098 - RNA, 19 nt, Homo sapiens
gagacaugagcauggcuga

SEQ ID NO: 2155099 - RNA, 15 nt, Homo sapiens
ugauugagacucaaa

SEQ ID NO: 2155100 - RNA, 15 nt, Homo sapiens
gcgugccguggcacc

SEQ ID NO: 2155101 - RNA, 18 nt, Homo sapiens
ucaggaaauauaucuuaa

SEQ ID NO: 2155102 - RNA, 16 nt, Homo sapiens
gaaucccccuugccac

SEQ ID NO: 2155103 - RNA, 16 nt, Homo sapiens
ugcagggccacuggaa

SEQ ID NO: 2155104 - RNA, 17 nt, Homo sapiens
cagcaauuguucaggga

SEQ ID NO: 2155105 - RNA, 21 nt, Homo sapiens
cuugaugagaagaacacauca

SEQ ID NO: 2155106 - RNA, 19 nt, Homo sapiens
ugggacuguuuacaaauga

SEQ ID NO: 2155107 - RNA, 22 nt, Homo sapiens
aaaggaagagcuauauccuuaa

SEQ ID NO: 2155108 - RNA, 20 nt, Homo sapiens
aacauauuuaaagucuugaa

SEQ ID NO: 2155109 - RNA, 16 nt, Homo sapiens
aaauggccaaugagau

SEQ ID NO: 2155110 - RNA, 17 nt, Homo sapiens
cuugguuaaaauggcua

SEQ ID NO: 2155111 - RNA, 21 nt, Homo sapiens
cucauccaucaaguugcacac

SEQ ID NO: 2155112 - RNA, 12 nt, Homo sapiens
ucauuguucuau

SEQ ID NO: 2155113 - RNA, 12 nt, Homo sapiens
aaacccauuuug

SEQ ID NO: 2155114 - RNA, 20 nt, Homo sapiens
cugacuagaagggccagucc

SEQ ID NO: 2155115 - RNA, 15 nt, Homo sapiens
aauuucuuacuaaac

SEQ ID NO: 2155116 - RNA, 15 nt, Homo sapiens
aauuauaagcauaca

SEQ ID NO: 2155117 - RNA, 18 nt, Homo sapiens
aagaaaaacaucuuuggc

SEQ ID NO: 2155118 - RNA, 17 nt, Homo sapiens
uggcccgcaauacugua

SEQ ID NO: 2155119 - RNA, 16 nt, Homo sapiens
auagccauugaucaua

SEQ ID NO: 2155120 - RNA, 16 nt, Homo sapiens
accacuaccagccagc

SEQ ID NO: 2155121 - RNA, 20 nt, Homo sapiens
cugugauguuaugaauacau

SEQ ID NO: 2155122 - RNA, 22 nt, Homo sapiens
cuuucugggaugucacagucca

SEQ ID NO: 2155123 - RNA, 14 nt, Homo sapiens
uuaaaagagacaaa

SEQ ID NO: 2155124 - RNA, 19 nt, Homo sapiens
uuaaaaggucaaaacugaa

SEQ ID NO: 2155125 - RNA, 18 nt, Homo sapiens
gaauaaaguucagugugc

SEQ ID NO: 2155126 - RNA, 15 nt, Homo sapiens
ucucacuguguuacu

SEQ ID NO: 2155127 - RNA, 15 nt, Homo sapiens
ucucuguguguuugu

SEQ ID NO: 2155128 - RNA, 19 nt, Homo sapiens
ucucaggcuggcaucuccc

SEQ ID NO: 2155129 - RNA, 15 nt, Homo sapiens
uguuuccguucacau

SEQ ID NO: 2155130 - RNA, 18 nt, Homo sapiens
aguaaacuuucucugcaa

SEQ ID NO: 2155131 - RNA, 19 nt, Homo sapiens
guucacaguguuucuuauu

SEQ ID NO: 2155132 - RNA, 15 nt, Homo sapiens
cauggccuaugcaca

SEQ ID NO: 2155133 - RNA, 23 nt, Homo sapiens
gcgcuagugccuugcccacaggu

SEQ ID NO: 2155134 - RNA, 16 nt, Homo sapiens
acucaugccauuccag

SEQ ID NO: 2155135 - RNA, 21 nt, Homo sapiens
cauuauuuuccagauaacuua

SEQ ID NO: 2155136 - RNA, 17 nt, Homo sapiens
caugugcacaagugugc

SEQ ID NO: 2155137 - RNA, 15 nt, Homo sapiens
aaugauuaaugcauu

SEQ ID NO: 2155138 - RNA, 19 nt, Homo sapiens
acauucuggaucugacccu

SEQ ID NO: 2155139 - RNA, 19 nt, Homo sapiens
cugaacaguguuggcuuuc

SEQ ID NO: 2155140 - RNA, 23 nt, Homo sapiens
uccgccuggggcagaaagccaca

SEQ ID NO: 2155141 - RNA, 12 nt, Homo sapiens
ucccaauuagcu

SEQ ID NO: 2155142 - RNA, 16 nt, Homo sapiens
guguuccucuuugcau

SEQ ID NO: 2155143 - RNA, 15 nt, Homo sapiens
uggggugaagauuca

SEQ ID NO: 2155144 - RNA, 16 nt, Homo sapiens
ccuaauuuaugugcua

SEQ ID NO: 2155145 - RNA, 21 nt, Homo sapiens
uucaacccuggagaguucaau

SEQ ID NO: 2155146 - RNA, 17 nt, Homo sapiens
acuacaugcaaggcacu

SEQ ID NO: 2155147 - RNA, 18 nt, Homo sapiens
aacagaaauuguauauug

SEQ ID NO: 2155148 - RNA, 18 nt, Homo sapiens
ccagaaccgcagaagccu

SEQ ID NO: 2155149 - RNA, 15 nt, Homo sapiens
aaaaguagcuuccuc

SEQ ID NO: 2155150 - RNA, 20 nt, Homo sapiens
ugagaugugcuuugcugcac

SEQ ID NO: 2155151 - RNA, 22 nt, Homo sapiens
caagcauguaacuuauauuaau

SEQ ID NO: 2155152 - RNA, 21 nt, Homo sapiens
gugccuccaccaccacuggcc

SEQ ID NO: 2155153 - RNA, 21 nt, Homo sapiens
uguguauucauugaagucaga

SEQ ID NO: 2155154 - RNA, 15 nt, Homo sapiens
cuaucugucauacau

SEQ ID NO: 2155155 - RNA, 18 nt, Homo sapiens
ugcaaauaacugaucuca

SEQ ID NO: 2155156 - RNA, 13 nt, Homo sapiens
augaccaccccuc

SEQ ID NO: 2155157 - RNA, 16 nt, Homo sapiens
acggucaguccauguc

SEQ ID NO: 2155158 - RNA, 13 nt, Homo sapiens
guuuuugagccau

SEQ ID NO: 2155159 - RNA, 15 nt, Homo sapiens
uaaauaaaucauuaa

SEQ ID NO: 2155160 - RNA, 12 nt, Homo sapiens
caaccagacucu

SEQ ID NO: 2155161 - RNA, 19 nt, Homo sapiens
cugggaccaucacccagau

SEQ ID NO: 2155162 - RNA, 13 nt, Homo sapiens
gaaagaugcagug

SEQ ID NO: 2155163 - RNA, 15 nt, Homo sapiens
ucaauagauuguaau

SEQ ID NO: 2155164 - RNA, 15 nt, Homo sapiens
gagaaagacuauuca

SEQ ID NO: 2155165 - RNA, 23 nt, Homo sapiens
aggcuguguguggaaauggccac

SEQ ID NO: 2155166 - RNA, 23 nt, Homo sapiens
uuucccugcagaccucaagccau

SEQ ID NO: 2155167 - RNA, 15 nt, Homo sapiens
ccagccugagugcac

SEQ ID NO: 2155168 - RNA, 19 nt, Homo sapiens
augggcagagcccaaggga

SEQ ID NO: 2155169 - RNA, 20 nt, Homo sapiens
cauagauagaaugaaccaau

SEQ ID NO: 2155170 - RNA, 18 nt, Homo sapiens
uuuucuagccccucugga

SEQ ID NO: 2155171 - RNA, 23 nt, Homo sapiens
uuagaauauccaugaccuaguuu

SEQ ID NO: 2155172 - RNA, 16 nt, Homo sapiens
cacuuuugcacauucc

SEQ ID NO: 2155173 - RNA, 18 nt, Homo sapiens
aaaaugcaacaacaugua

SEQ ID NO: 2155174 - RNA, 21 nt, Homo sapiens
gagcgaagcccccacuacuaa

SEQ ID NO: 2155175 - RNA, 19 nt, Homo sapiens
gaaugccagugugcugaug

SEQ ID NO: 2155176 - RNA, 16 nt, Homo sapiens
uuugcaagucauggcu

SEQ ID NO: 2155177 - RNA, 21 nt, Homo sapiens
auugucuuuugacauccagca

SEQ ID NO: 2155178 - RNA, 24 nt, Homo sapiens
uucugugcauuguaaacauaaaca

SEQ ID NO: 2155179 - RNA, 21 nt, Homo sapiens
aucuuggagacaggccaucca

SEQ ID NO: 2155180 - RNA, 20 nt, Homo sapiens
uucccaaagauccacccaaa

SEQ ID NO: 2155181 - RNA, 16 nt, Homo sapiens
agaaagcaaaccugua

SEQ ID NO: 2155182 - RNA, 20 nt, Homo sapiens
aauacuacugcacagaguca

SEQ ID NO: 2155183 - RNA, 22 nt, Homo sapiens
uuaauuaagcuccuucaguuug

SEQ ID NO: 2155184 - RNA, 13 nt, Homo sapiens
cuccaaaaagaca

SEQ ID NO: 2155185 - RNA, 15 nt, Homo sapiens
uaacuucuccaagga

SEQ ID NO: 2155186 - RNA, 20 nt, Homo sapiens
aauuggagaaaagcacuuaa

SEQ ID NO: 2155187 - RNA, 17 nt, Homo sapiens
uggaggauugcugccag

SEQ ID NO: 2155188 - RNA, 20 nt, Homo sapiens
gagaagucuuagacuugaaa

SEQ ID NO: 2155189 - RNA, 13 nt, Homo sapiens
ccaaaaguuauua

SEQ ID NO: 2155190 - RNA, 19 nt, Homo sapiens
uuucuuccuauuuccuugu

SEQ ID NO: 2155191 - RNA, 18 nt, Homo sapiens
agccaacuuuaauugcuu

SEQ ID NO: 2155192 - RNA, 16 nt, Homo sapiens
acuggggcaagcuccu

SEQ ID NO: 2155193 - RNA, 12 nt, Homo sapiens
uguagcccugga

SEQ ID NO: 2155194 - RNA, 15 nt, Homo sapiens
auaccuaauugugga

SEQ ID NO: 2155195 - RNA, 19 nt, Homo sapiens
uuuaguagccuuacuguga

SEQ ID NO: 2155196 - RNA, 14 nt, Homo sapiens
ccauacugacucaa

SEQ ID NO: 2155197 - RNA, 16 nt, Homo sapiens
cccgcucagguagcca

SEQ ID NO: 2155198 - RNA, 17 nt, Homo sapiens
cuuuuuuaaaugaagaa

SEQ ID NO: 2155199 - RNA, 13 nt, Homo sapiens
gagcucuccagaa

SEQ ID NO: 2155200 - RNA, 17 nt, Homo sapiens
aagcugugcccugacca

SEQ ID NO: 2155201 - RNA, 15 nt, Homo sapiens
uuccaugauacuuua

SEQ ID NO: 2155202 - RNA, 19 nt, Homo sapiens
ugcauacuuugacaaggaa

SEQ ID NO: 2155203 - RNA, 22 nt, Homo sapiens
gugcuccauggcugccaucuca

SEQ ID NO: 2155204 - RNA, 19 nt, Homo sapiens
aggaaacuaauacaauaca

SEQ ID NO: 2155205 - RNA, 22 nt, Homo sapiens
uagucacauggccuaugcacau

SEQ ID NO: 2155206 - RNA, 19 nt, Homo sapiens
cuuuggggcuucugugaaa

SEQ ID NO: 2155207 - RNA, 18 nt, Homo sapiens
agcacuaauucaacauau

SEQ ID NO: 2155208 - RNA, 23 nt, Homo sapiens
aaaggccuuuggaaagacuugaa

SEQ ID NO: 2155209 - RNA, 12 nt, Homo sapiens
ucuugauauauu

SEQ ID NO: 2155210 - RNA, 17 nt, Homo sapiens
gcuggagucgggacuaa

SEQ ID NO: 2155211 - RNA, 19 nt, Homo sapiens
aagccccacccugccucac

SEQ ID NO: 2155212 - RNA, 12 nt, Homo sapiens
gagaacagugau

SEQ ID NO: 2155213 - RNA, 19 nt, Homo sapiens
augcagugcuccauccaaa

SEQ ID NO: 2155214 - RNA, 17 nt, Homo sapiens
cuguuucuaacucaggg

SEQ ID NO: 2155215 - RNA, 17 nt, Homo sapiens
ugagaaaacucaaccag

SEQ ID NO: 2155216 - RNA, 13 nt, Homo sapiens
uuaauaaauugcu

SEQ ID NO: 2155217 - RNA, 14 nt, Homo sapiens
cugcccugugcucc

SEQ ID NO: 2155218 - RNA, 15 nt, Homo sapiens
caucagaacugaaau

SEQ ID NO: 2155219 - RNA, 16 nt, Homo sapiens
ugcaccaagcaggaaa

SEQ ID NO: 2155220 - RNA, 15 nt, Homo sapiens
aagacucugaacaau

SEQ ID NO: 2155221 - RNA, 19 nt, Homo sapiens
aacuggaagauacauaaaa

SEQ ID NO: 2155222 - RNA, 22 nt, Homo sapiens
agaguguuucuuccacaacaga

SEQ ID NO: 2155223 - RNA, 20 nt, Homo sapiens
uguaaucccagcuacucgag

SEQ ID NO: 2155224 - RNA, 17 nt, Homo sapiens
ugacagugggaggggau

SEQ ID NO: 2155225 - RNA, 15 nt, Homo sapiens
gaacauaacuucuca

SEQ ID NO: 2155226 - RNA, 18 nt, Homo sapiens
ccaccaguaugacaguau

SEQ ID NO: 2155227 - RNA, 23 nt, Homo sapiens
gcaacguaagauguccuccuuga

SEQ ID NO: 2155228 - RNA, 14 nt, Homo sapiens
ugucugcacccagg

SEQ ID NO: 2155229 - RNA, 15 nt, Homo sapiens
ccuuaccucuggaac

SEQ ID NO: 2155230 - RNA, 14 nt, Homo sapiens
cacacacaugcaua

SEQ ID NO: 2155231 - RNA, 20 nt, Homo sapiens
aguaacguacauuugugcug

SEQ ID NO: 2155232 - RNA, 17 nt, Homo sapiens
auuuuagacuuccugua

SEQ ID NO: 2155233 - RNA, 17 nt, Homo sapiens
cacuuuauaacccaaaa

SEQ ID NO: 2155234 - RNA, 21 nt, Homo sapiens
cuuuuuauuaggcucagugac

SEQ ID NO: 2155235 - RNA, 12 nt, Homo sapiens
uguuuuggcaag

SEQ ID NO: 2155236 - RNA, 16 nt, Homo sapiens
uuuuguauguggcaug

SEQ ID NO: 2155237 - RNA, 19 nt, Homo sapiens
cuuuuaauguacguuacag

SEQ ID NO: 2155238 - RNA, 18 nt, Homo sapiens
aguggauugugagaaauu

SEQ ID NO: 2155239 - RNA, 17 nt, Homo sapiens
agaugccagggcuggaa

SEQ ID NO: 2155240 - RNA, 21 nt, Homo sapiens
ugagcacucccaagucuacag

SEQ ID NO: 2155241 - RNA, 23 nt, Homo sapiens
agccaagugccuuccguggguca

SEQ ID NO: 2155242 - RNA, 21 nt, Homo sapiens
ugauugaguccuuucuuccau

SEQ ID NO: 2155243 - RNA, 22 nt, Homo sapiens
cuccugggaagaugagguucug

SEQ ID NO: 2155244 - RNA, 11 nt, Homo sapiens
uuaaacugcca

SEQ ID NO: 2155245 - RNA, 21 nt, Homo sapiens
ucuuccuuggaggggggagcc

SEQ ID NO: 2155246 - RNA, 21 nt, Homo sapiens
gccucacuggggcagacaaua

SEQ ID NO: 2155247 - RNA, 17 nt, Homo sapiens
ccugccuccuacuccag

SEQ ID NO: 2155248 - RNA, 16 nt, Homo sapiens
cucacaugcacagggg

SEQ ID NO: 2155249 - RNA, 12 nt, Homo sapiens
aacagugccauu

SEQ ID NO: 2155250 - RNA, 12 nt, Homo sapiens
auaaaaauaccu

SEQ ID NO: 2155251 - RNA, 18 nt, Homo sapiens
aguaucacuuuaacucag

SEQ ID NO: 2155252 - RNA, 20 nt, Homo sapiens
cuaagcugaguuaggugucu

SEQ ID NO: 2155253 - RNA, 22 nt, Homo sapiens
aaauacacauacauauauacau

SEQ ID NO: 2155254 - RNA, 16 nt, Homo sapiens
aagccagcuuuccuca

SEQ ID NO: 2155255 - RNA, 19 nt, Homo sapiens
gaguugaggauguggcaca

SEQ ID NO: 2155256 - RNA, 18 nt, Homo sapiens
gcuucagugacaaacaua

SEQ ID NO: 2155257 - RNA, 17 nt, Homo sapiens
aaacuauuuauaucaca

SEQ ID NO: 2155258 - RNA, 18 nt, Homo sapiens
gaaagccaugaccuugug

SEQ ID NO: 2155259 - RNA, 18 nt, Homo sapiens
ucuccacccccagcugcu

SEQ ID NO: 2155260 - RNA, 11 nt, Homo sapiens
augccaggacc

SEQ ID NO: 2155261 - RNA, 12 nt, Homo sapiens
ugugccagguga

SEQ ID NO: 2155262 - RNA, 15 nt, Homo sapiens
gcagaccgggggcca

SEQ ID NO: 2155263 - RNA, 22 nt, Homo sapiens
gccucuccuguauuuaacaaaa

SEQ ID NO: 2155264 - RNA, 21 nt, Homo sapiens
aaauuaucuauaaucucagaa

SEQ ID NO: 2155265 - RNA, 22 nt, Homo sapiens
ucccacaaguauauacuuuuaa

SEQ ID NO: 2155266 - RNA, 22 nt, Homo sapiens
uguaacaggguagugugguauu

SEQ ID NO: 2155267 - RNA, 18 nt, Homo sapiens
gcaacucuauagacuuuu

SEQ ID NO: 2155268 - RNA, 16 nt, Homo sapiens
acucccuccacuaccg

SEQ ID NO: 2155269 - RNA, 22 nt, Homo sapiens
cacagagauucugaacuaaagu

SEQ ID NO: 2155270 - RNA, 22 nt, Homo sapiens
acccagaugggggaaagcacag

SEQ ID NO: 2155271 - RNA, 16 nt, Homo sapiens
gucucucuccagguca

SEQ ID NO: 2155272 - RNA, 13 nt, Homo sapiens
aauaaccaauccu

SEQ ID NO: 2155273 - RNA, 13 nt, Homo sapiens
accagguaugacc

SEQ ID NO: 2155274 - RNA, 20 nt, Homo sapiens
uuugggggaacuggacacaa

SEQ ID NO: 2155275 - RNA, 17 nt, Homo sapiens
ugguuuguaaaauccac

SEQ ID NO: 2155276 - RNA, 20 nt, Homo sapiens
aaacugcgaagucaagcuca

SEQ ID NO: 2155277 - RNA, 14 nt, Homo sapiens
gaauaacauuuaaa

SEQ ID NO: 2155278 - RNA, 17 nt, Homo sapiens
cuaguuauuuucugaaa

SEQ ID NO: 2155279 - RNA, 22 nt, Homo sapiens
ccucugaguuuugaugcuguau

SEQ ID NO: 2155280 - RNA, 22 nt, Homo sapiens
gcaaagugaaaguaacuguuaa

SEQ ID NO: 2155281 - RNA, 13 nt, Homo sapiens
cgaguauguguuu

SEQ ID NO: 2155282 - RNA, 15 nt, Homo sapiens
gaacgcagaagaaag

SEQ ID NO: 2155283 - RNA, 12 nt, Homo sapiens
uuccuuaguaua

SEQ ID NO: 2155284 - RNA, 16 nt, Homo sapiens
gggccaaagcacagcu

SEQ ID NO: 2155285 - RNA, 16 nt, Homo sapiens
uauagaaaugcugguu

SEQ ID NO: 2155286 - RNA, 16 nt, Homo sapiens
ccacacugaaaccaaa

SEQ ID NO: 2155287 - RNA, 15 nt, Homo sapiens
accucccuaccaaaa

SEQ ID NO: 2155288 - RNA, 15 nt, Homo sapiens
uguuuuccugcuggu

SEQ ID NO: 2155289 - RNA, 17 nt, Homo sapiens
uaccgcugcauaguauu

SEQ ID NO: 2155290 - RNA, 16 nt, Homo sapiens
ugucucugcucuugcc

SEQ ID NO: 2155291 - RNA, 22 nt, Homo sapiens
cuaauguugacuuuaauacucu

SEQ ID NO: 2155292 - RNA, 11 nt, Homo sapiens
cauaaguccuc

SEQ ID NO: 2155293 - RNA, 19 nt, Homo sapiens
ucagccuccugagccugug

SEQ ID NO: 2155294 - RNA, 15 nt, Homo sapiens
agcuguuaccauuca

SEQ ID NO: 2155295 - RNA, 22 nt, Homo sapiens
ucaagccuagcccuucucucau

SEQ ID NO: 2155296 - RNA, 20 nt, Homo sapiens
cacuaggaggucaucaaccg

SEQ ID NO: 2155297 - RNA, 15 nt, Homo sapiens
gaauauuacauugca

SEQ ID NO: 2155298 - RNA, 20 nt, Homo sapiens
auuuugucaccagaacacaa

SEQ ID NO: 2155299 - RNA, 13 nt, Homo sapiens
aagcaugacccag

SEQ ID NO: 2155300 - RNA, 19 nt, Homo sapiens
ucuagauuaugucuuucca

SEQ ID NO: 2155301 - RNA, 19 nt, Homo sapiens
aaauugaaauuauauuaca

SEQ ID NO: 2155302 - RNA, 14 nt, Homo sapiens
aagacuauaccuua

SEQ ID NO: 2155303 - RNA, 22 nt, Homo sapiens
aagaagacagcuuaauaguagu

SEQ ID NO: 2155304 - RNA, 15 nt, Homo sapiens
ggccucugcuuucuc

SEQ ID NO: 2155305 - RNA, 19 nt, Homo sapiens
cagacgggucugagacuga

SEQ ID NO: 2155306 - RNA, 21 nt, Homo sapiens
acagugaugcugugcuaugaa

SEQ ID NO: 2155307 - RNA, 22 nt, Homo sapiens
ucuauuucuuuaaaugcuuuua

SEQ ID NO: 2155308 - RNA, 18 nt, Homo sapiens
ccagagcguguagugaau

SEQ ID NO: 2155309 - RNA, 22 nt, Homo sapiens
cccuuccuguuucucguuguca

SEQ ID NO: 2155310 - RNA, 23 nt, Homo sapiens
acaucucccuuuuccaugacugu

SEQ ID NO: 2155311 - RNA, 13 nt, Homo sapiens
acauaacucugua

SEQ ID NO: 2155312 - RNA, 19 nt, Homo sapiens
agccucucuuccuauccca

SEQ ID NO: 2155313 - RNA, 14 nt, Homo sapiens
caaccuuccauuca

SEQ ID NO: 2155314 - RNA, 11 nt, Homo sapiens
caauauaguga

SEQ ID NO: 2155315 - RNA, 19 nt, Homo sapiens
ugccccggaccuaccuccc

SEQ ID NO: 2155316 - RNA, 18 nt, Homo sapiens
uuguauuguucauaauau

SEQ ID NO: 2155317 - RNA, 14 nt, Homo sapiens
uagugucacugcuu

SEQ ID NO: 2155318 - RNA, 15 nt, Homo sapiens
caacaaauauguucu

SEQ ID NO: 2155319 - RNA, 23 nt, Homo sapiens
cccagggcccacuagcauccacu

SEQ ID NO: 2155320 - RNA, 18 nt, Homo sapiens
gcacaguggccccaucau

SEQ ID NO: 2155321 - RNA, 19 nt, Homo sapiens
aaagucccucccugccuga

SEQ ID NO: 2155322 - RNA, 13 nt, Homo sapiens
aaacacaaaaacc

SEQ ID NO: 2155323 - RNA, 14 nt, Homo sapiens
gcugacaucuugaa

SEQ ID NO: 2155324 - RNA, 17 nt, Homo sapiens
agacuccaaaaggcccu

SEQ ID NO: 2155325 - RNA, 21 nt, Homo sapiens
ggguggacauucagcagagug

SEQ ID NO: 2155326 - RNA, 15 nt, Homo sapiens
caaggucauuugcua

SEQ ID NO: 2155327 - RNA, 15 nt, Homo sapiens
gacuguggcuucucc

SEQ ID NO: 2155328 - RNA, 15 nt, Homo sapiens
accccaagcaggaac

SEQ ID NO: 2155329 - RNA, 16 nt, Homo sapiens
auacauuccuuuuaga

SEQ ID NO: 2155330 - RNA, 21 nt, Homo sapiens
ucaggcagcaccacacugggu

SEQ ID NO: 2155331 - RNA, 17 nt, Homo sapiens
gaagcuuguaucugaua

SEQ ID NO: 2155332 - RNA, 18 nt, Homo sapiens
uaagacauuuuucauuca

SEQ ID NO: 2155333 - RNA, 15 nt, Homo sapiens
aucaacccuaaaaag

SEQ ID NO: 2155334 - RNA, 15 nt, Homo sapiens
aaguuuuaaccucag

SEQ ID NO: 2155335 - RNA, 12 nt, Homo sapiens
ucuggcaugaau

SEQ ID NO: 2155336 - RNA, 13 nt, Homo sapiens
augauuucauuca

SEQ ID NO: 2155337 - RNA, 18 nt, Homo sapiens
uuaaaaugacaagcacua

SEQ ID NO: 2155338 - RNA, 15 nt, Homo sapiens
ccuuccugcugcugc

SEQ ID NO: 2155339 - RNA, 20 nt, Homo sapiens
uccaaauuacagcauauaua

SEQ ID NO: 2155340 - RNA, 20 nt, Homo sapiens
gcugacccaggaauagugga

SEQ ID NO: 2155341 - RNA, 18 nt, Homo sapiens
aaugcacgcacacaucag

SEQ ID NO: 2155342 - RNA, 15 nt, Homo sapiens
aguaaaaagaacaac

SEQ ID NO: 2155343 - RNA, 15 nt, Homo sapiens
aaauacccuccacuc

SEQ ID NO: 2155344 - RNA, 14 nt, Homo sapiens
caggaaacuagcuu

SEQ ID NO: 2155345 - RNA, 19 nt, Homo sapiens
gugugaaccacuguguacu

SEQ ID NO: 2155346 - RNA, 16 nt, Homo sapiens
ucaacagcuaugcugg

SEQ ID NO: 2155347 - RNA, 19 nt, Homo sapiens
ugauugacacacagcacuc

SEQ ID NO: 2155348 - RNA, 15 nt, Homo sapiens
uaccuacaucaguca

SEQ ID NO: 2155349 - RNA, 14 nt, Homo sapiens
cacuggacucuccg

SEQ ID NO: 2155350 - RNA, 16 nt, Homo sapiens
gcaggggcauugcuga

SEQ ID NO: 2155351 - RNA, 22 nt, Homo sapiens
auugguccagcuugcucuucag

SEQ ID NO: 2155352 - RNA, 13 nt, Homo sapiens
gcagcauggagcu

SEQ ID NO: 2155353 - RNA, 14 nt, Homo sapiens
guaacuuccugugg

SEQ ID NO: 2155354 - RNA, 20 nt, Homo sapiens
cuggggcguuuccuacugcg

SEQ ID NO: 2155355 - RNA, 20 nt, Homo sapiens
ugucucgcgcgacugagaac

SEQ ID NO: 2155356 - RNA, 20 nt, Homo sapiens
guuuccacaggaacaacagc

SEQ ID NO: 2155357 - RNA, 10 nt, Homo sapiens
cuacaugaau

SEQ ID NO: 2155358 - RNA, 17 nt, Homo sapiens
guuugagcucaggcauu

SEQ ID NO: 2155359 - RNA, 17 nt, Homo sapiens
gcggauccaagcaaaug

SEQ ID NO: 2155360 - RNA, 22 nt, Homo sapiens
ugccuccauucugaccauuuca

SEQ ID NO: 2155361 - RNA, 15 nt, Homo sapiens
gugcuugucauucca

SEQ ID NO: 2155362 - RNA, 16 nt, Homo sapiens
ucuucaugucaucaaa

SEQ ID NO: 2155363 - RNA, 16 nt, Homo sapiens
cuaugacauuacugua

SEQ ID NO: 2155364 - RNA, 20 nt, Homo sapiens
ugaaauauaguaaacacuug

SEQ ID NO: 2155365 - RNA, 13 nt, Homo sapiens
guguaugucuaug

SEQ ID NO: 2155366 - RNA, 20 nt, Homo sapiens
uagcacuggccugcacggug

SEQ ID NO: 2155367 - RNA, 22 nt, Homo sapiens
agccugaguacuccacacugca

SEQ ID NO: 2155368 - RNA, 14 nt, Homo sapiens
gaagaaagugaaag

SEQ ID NO: 2155369 - RNA, 21 nt, Homo sapiens
acuuggacaugggccccagau

SEQ ID NO: 2155370 - RNA, 19 nt, Homo sapiens
uaaaaaaaaagucagagac

SEQ ID NO: 2155371 - RNA, 19 nt, Homo sapiens
agagcaagaccccaucuca

SEQ ID NO: 2155372 - RNA, 19 nt, Homo sapiens
agagugagacccugucuca

SEQ ID NO: 2155373 - RNA, 14 nt, Homo sapiens
aacuauguacaaua

SEQ ID NO: 2155374 - RNA, 15 nt, Homo sapiens
aguggaauagugaau

SEQ ID NO: 2155375 - RNA, 15 nt, Homo sapiens
agaggcuuagagaca

SEQ ID NO: 2155376 - RNA, 13 nt, Homo sapiens
gggauuacaggca

SEQ ID NO: 2155377 - RNA, 17 nt, Homo sapiens
cacugcggaagccaaag

SEQ ID NO: 2155378 - RNA, 12 nt, Homo sapiens
aguuagccaaac

SEQ ID NO: 2155379 - RNA, 15 nt, Homo sapiens
acaaucuacacugcc

SEQ ID NO: 2155380 - RNA, 14 nt, Homo sapiens
gcaauucuagugua

SEQ ID NO: 2155381 - RNA, 20 nt, Homo sapiens
aaccagaucuagucaaucaa

SEQ ID NO: 2155382 - RNA, 23 nt, Homo sapiens
acaacagaaguauuucuguggau

SEQ ID NO: 2155383 - RNA, 13 nt, Homo sapiens
gcacacacugugc

SEQ ID NO: 2155384 - RNA, 20 nt, Homo sapiens
ggaggaacgugguucagaga

SEQ ID NO: 2155385 - RNA, 23 nt, Homo sapiens
guccaucaaguaccucaucugca

SEQ ID NO: 2155386 - RNA, 17 nt, Homo sapiens
auuaacagaaauguuuc

SEQ ID NO: 2155387 - RNA, 20 nt, Homo sapiens
uucccuccacccacuugccu

SEQ ID NO: 2155388 - RNA, 21 nt, Homo sapiens
acaguuuaacagaguuuucug

SEQ ID NO: 2155389 - RNA, 22 nt, Homo sapiens
ucccucgccccaagguuccaga

SEQ ID NO: 2155390 - RNA, 15 nt, Homo sapiens
agauguguguucuca

SEQ ID NO: 2155391 - RNA, 16 nt, Homo sapiens
cccaacucaggacaga

SEQ ID NO: 2155392 - RNA, 17 nt, Homo sapiens
cgggaaacacacaagca

SEQ ID NO: 2155393 - RNA, 12 nt, Homo sapiens
agguugcauugg

SEQ ID NO: 2155394 - RNA, 13 nt, Homo sapiens
ccaaggagaccaa

SEQ ID NO: 2155395 - RNA, 21 nt, Homo sapiens
gagacuccagggagaaggcau

SEQ ID NO: 2155396 - RNA, 18 nt, Homo sapiens
gcucaaugugcuguugau

SEQ ID NO: 2155397 - RNA, 20 nt, Homo sapiens
aucaaugggugguauuugcu

SEQ ID NO: 2155398 - RNA, 17 nt, Homo sapiens
caaacagaacugcaguc

SEQ ID NO: 2155399 - RNA, 17 nt, Homo sapiens
ugggauccgcauccagc

SEQ ID NO: 2155400 - RNA, 19 nt, Homo sapiens
auacacacauauacauaua

SEQ ID NO: 2155401 - RNA, 19 nt, Homo sapiens
uauugacacugaacuuaau

SEQ ID NO: 2155402 - RNA, 23 nt, Homo sapiens
augucuguauuucauucuuguug

SEQ ID NO: 2155403 - RNA, 16 nt, Homo sapiens
caucaaagugaugauu

SEQ ID NO: 2155404 - RNA, 12 nt, Homo sapiens
uccagccuucca

SEQ ID NO: 2155405 - RNA, 12 nt, Homo sapiens
uuaugccuuuau

SEQ ID NO: 2155406 - RNA, 15 nt, Homo sapiens
uuaauaacagcuccu

SEQ ID NO: 2155407 - RNA, 16 nt, Homo sapiens
uaacgauaaaagguaa

SEQ ID NO: 2155408 - RNA, 15 nt, Homo sapiens
ccggaccuaccuccc

SEQ ID NO: 2155409 - RNA, 21 nt, Homo sapiens
agggucucgcugucacuggcu

SEQ ID NO: 2155410 - RNA, 21 nt, Homo sapiens
cuccaguggcagacaaacaga

SEQ ID NO: 2155411 - RNA, 14 nt, Homo sapiens
uuaccccugcacag

SEQ ID NO: 2155412 - RNA, 19 nt, Homo sapiens
cagucaaaauguuugauau

SEQ ID NO: 2155413 - RNA, 19 nt, Homo sapiens
aaaacccuuggaccucucc

SEQ ID NO: 2155414 - RNA, 21 nt, Homo sapiens
ccuggguuccgguuguugaua

SEQ ID NO: 2155415 - RNA, 19 nt, Homo sapiens
uuggauacgacaacuugca

SEQ ID NO: 2155416 - RNA, 17 nt, Homo sapiens
ugccuuaccuucacuua

SEQ ID NO: 2155417 - RNA, 14 nt, Homo sapiens
uucggccucuccac

SEQ ID NO: 2155418 - RNA, 15 nt, Homo sapiens
ccaggucugacucca

SEQ ID NO: 2155419 - RNA, 19 nt, Homo sapiens
gaaaugcuguuaguaaauu

SEQ ID NO: 2155420 - RNA, 21 nt, Homo sapiens
cccagaggcuuccagucucac

SEQ ID NO: 2155421 - RNA, 20 nt, Homo sapiens
acccuaguucuaccucaggc

SEQ ID NO: 2155422 - RNA, 22 nt, Homo sapiens
ggaagcacagcagguuuaucca

SEQ ID NO: 2155423 - RNA, 20 nt, Homo sapiens
aaaacucuugugguaccuag

SEQ ID NO: 2155424 - RNA, 17 nt, Homo sapiens
ccacagacaacauggaa

SEQ ID NO: 2155425 - RNA, 20 nt, Homo sapiens
aaugucucugcuccuacauc

SEQ ID NO: 2155426 - RNA, 15 nt, Homo sapiens
cagauggguauuaaa

SEQ ID NO: 2155427 - RNA, 18 nt, Homo sapiens
aaugccaaacacuagcuc

SEQ ID NO: 2155428 - RNA, 13 nt, Homo sapiens
agagaugagcuuu

SEQ ID NO: 2155429 - RNA, 15 nt, Homo sapiens
cuacacguugcccau

SEQ ID NO: 2155430 - RNA, 18 nt, Homo sapiens
cauggucccaaaauguca

SEQ ID NO: 2155431 - RNA, 19 nt, Homo sapiens
agcucagaaacgaaaucua

SEQ ID NO: 2155432 - RNA, 15 nt, Homo sapiens
uaguuucaugagucu

SEQ ID NO: 2155433 - RNA, 15 nt, Homo sapiens
gcuauuuguauuucu

SEQ ID NO: 2155434 - RNA, 22 nt, Homo sapiens
gacaacuuccagagaagccaug

SEQ ID NO: 2155435 - RNA, 17 nt, Homo sapiens
cgccuccccaccuccag

SEQ ID NO: 2155436 - RNA, 16 nt, Homo sapiens
uagcuggccacaguga

SEQ ID NO: 2155437 - RNA, 13 nt, Homo sapiens
acaaaauaauuua

SEQ ID NO: 2155438 - RNA, 20 nt, Homo sapiens
aagaugggagcccaguuuca

SEQ ID NO: 2155439 - RNA, 20 nt, Homo sapiens
caauugugcugccauuugau

SEQ ID NO: 2155440 - RNA, 14 nt, Homo sapiens
uaucacaaaaccac

SEQ ID NO: 2155441 - RNA, 14 nt, Homo sapiens
auucaaaauuccaa

SEQ ID NO: 2155442 - RNA, 13 nt, Homo sapiens
uuuggcuguccag

SEQ ID NO: 2155443 - RNA, 13 nt, Homo sapiens
cuucuugcucccc

SEQ ID NO: 2155444 - RNA, 21 nt, Homo sapiens
ucugugaauagcaguggcaaa

SEQ ID NO: 2155445 - RNA, 14 nt, Homo sapiens
auuuacaucacuuu

SEQ ID NO: 2155446 - RNA, 20 nt, Homo sapiens
caacccuucuggaaacugug

SEQ ID NO: 2155447 - RNA, 14 nt, Homo sapiens
acaauuccaaacau

SEQ ID NO: 2155448 - RNA, 19 nt, Homo sapiens
aggcaguaugccaaggguc

SEQ ID NO: 2155449 - RNA, 17 nt, Homo sapiens
guacauaaaaugucauu

SEQ ID NO: 2155450 - RNA, 15 nt, Homo sapiens
cugccucagccuucu

SEQ ID NO: 2155451 - RNA, 20 nt, Homo sapiens
agucaggacuugaacccagg

SEQ ID NO: 2155452 - RNA, 16 nt, Homo sapiens
uuucauaauaccucac

SEQ ID NO: 2155453 - RNA, 21 nt, Homo sapiens
aucccuggggcugugcauucc

SEQ ID NO: 2155454 - RNA, 21 nt, Homo sapiens
cuacagagcagcuccccagga

SEQ ID NO: 2155455 - RNA, 13 nt, Homo sapiens
cuuuccucaggca

SEQ ID NO: 2155456 - RNA, 13 nt, Homo sapiens
uguacauacuggc

SEQ ID NO: 2155457 - RNA, 13 nt, Homo sapiens
uauuuauucacug

SEQ ID NO: 2155458 - RNA, 15 nt, Homo sapiens
ucaauaguguugcuu

SEQ ID NO: 2155459 - RNA, 19 nt, Homo sapiens
ugucugggaaaaagugcac

SEQ ID NO: 2155460 - RNA, 16 nt, Homo sapiens
ucauaaacuauauucu

SEQ ID NO: 2155461 - RNA, 17 nt, Homo sapiens
gaugaaaaagcauguac

SEQ ID NO: 2155462 - RNA, 14 nt, Homo sapiens
acugggccugaugg

SEQ ID NO: 2155463 - RNA, 22 nt, Homo sapiens
uuuggucaccuuccucugccuu

SEQ ID NO: 2155464 - RNA, 17 nt, Homo sapiens
aucaaaucccacuuacu

SEQ ID NO: 2155465 - RNA, 14 nt, Homo sapiens
agauggcagcuuuu

SEQ ID NO: 2155466 - RNA, 20 nt, Homo sapiens
acauaauucuaaggaguuuu

SEQ ID NO: 2155467 - RNA, 14 nt, Homo sapiens
ugagcagcuuuucu

SEQ ID NO: 2155468 - RNA, 16 nt, Homo sapiens
gaaaaugcaaguguuu

SEQ ID NO: 2155469 - RNA, 15 nt, Homo sapiens
ggccuuugcauuuau

SEQ ID NO: 2155470 - RNA, 13 nt, Homo sapiens
gccucucucaggc

SEQ ID NO: 2155471 - RNA, 18 nt, Homo sapiens
ucccaagcccuggugacc

SEQ ID NO: 2155472 - RNA, 15 nt, Homo sapiens
auaauccacuuugcu

SEQ ID NO: 2155473 - RNA, 22 nt, Homo sapiens
agcaaacaaauaaaaugaaaua

SEQ ID NO: 2155474 - RNA, 14 nt, Homo sapiens
uuuccauucugggu

SEQ ID NO: 2155475 - RNA, 18 nt, Homo sapiens
uuugaaaggcuuuccuca

SEQ ID NO: 2155476 - RNA, 21 nt, Homo sapiens
ccuaucucuacuaaaaauaca

SEQ ID NO: 2155477 - RNA, 16 nt, Homo sapiens
auuacaaaaacauggc

SEQ ID NO: 2155478 - RNA, 17 nt, Homo sapiens
uauaauguccauaugcu

SEQ ID NO: 2155479 - RNA, 19 nt, Homo sapiens
aaaagacucugaccagaga

SEQ ID NO: 2155480 - RNA, 22 nt, Homo sapiens
gacuguaacgauugacaccaaa

SEQ ID NO: 2155481 - RNA, 23 nt, Homo sapiens
cacuggucaucaguauuguguaa

SEQ ID NO: 2155482 - RNA, 20 nt, Homo sapiens
acaggcauuuccugcuuauu

SEQ ID NO: 2155483 - RNA, 12 nt, Homo sapiens
ucaauacuaccu

SEQ ID NO: 2155484 - RNA, 16 nt, Homo sapiens
uuaggcaccagaagaa

SEQ ID NO: 2155485 - RNA, 15 nt, Homo sapiens
gcacuuagcccaaga

SEQ ID NO: 2155486 - RNA, 15 nt, Homo sapiens
gccacgcagggccau

SEQ ID NO: 2155487 - RNA, 13 nt, Homo sapiens
ggggcuguccaau

SEQ ID NO: 2155488 - RNA, 18 nt, Homo sapiens
accuuuuucauacaaggc

SEQ ID NO: 2155489 - RNA, 21 nt, Homo sapiens
caguguggccaggcugccugg

SEQ ID NO: 2155490 - RNA, 14 nt, Homo sapiens
aggauaguuucacc

SEQ ID NO: 2155491 - RNA, 16 nt, Homo sapiens
gcuuaugagaccaaga

SEQ ID NO: 2155492 - RNA, 13 nt, Homo sapiens
uccucucuuggca

SEQ ID NO: 2155493 - RNA, 17 nt, Homo sapiens
agaugaaaugcacugua

SEQ ID NO: 2155494 - RNA, 14 nt, Homo sapiens
ucuucucguuuuca

SEQ ID NO: 2155495 - RNA, 16 nt, Homo sapiens
cuucuuauuaaucaua

SEQ ID NO: 2155496 - RNA, 17 nt, Homo sapiens
cugaccaagugcuggcc

SEQ ID NO: 2155497 - RNA, 22 nt, Homo sapiens
uucuucucagaaaagaggccag

SEQ ID NO: 2155498 - RNA, 21 nt, Homo sapiens
uaagacaugauuuccuugaau

SEQ ID NO: 2155499 - RNA, 12 nt, Homo sapiens
caaaugucuauu

SEQ ID NO: 2155500 - RNA, 19 nt, Homo sapiens
ccagaugaucccagucacu

SEQ ID NO: 2155501 - RNA, 14 nt, Homo sapiens
agagagagggagca

SEQ ID NO: 2155502 - RNA, 17 nt, Homo sapiens
gugguuuuuugguguuu

SEQ ID NO: 2155503 - RNA, 20 nt, Homo sapiens
accccaggacgcaugcaggg

SEQ ID NO: 2155504 - RNA, 22 nt, Homo sapiens
ccacagauuuauacaaggguua

SEQ ID NO: 2155505 - RNA, 17 nt, Homo sapiens
uaucauaaauacaagag

SEQ ID NO: 2155506 - RNA, 11 nt, Homo sapiens
auaauucacac

SEQ ID NO: 2155507 - RNA, 19 nt, Homo sapiens
ggcaugccuuucuguaacc

SEQ ID NO: 2155508 - RNA, 21 nt, Homo sapiens
agaaugguaaaauaccaacuc

SEQ ID NO: 2155509 - RNA, 18 nt, Homo sapiens
uugcuggggcuuguccua

SEQ ID NO: 2155510 - RNA, 17 nt, Homo sapiens
agacacgacagcacaca

SEQ ID NO: 2155511 - RNA, 16 nt, Homo sapiens
auacauauguaugugu

SEQ ID NO: 2155512 - RNA, 13 nt, Homo sapiens
acuguuggcucuc

SEQ ID NO: 2155513 - RNA, 21 nt, Homo sapiens
gccccccagggcuagugaagu

SEQ ID NO: 2155514 - RNA, 16 nt, Homo sapiens
ugagacggagucuugc

SEQ ID NO: 2155515 - RNA, 21 nt, Homo sapiens
caguacuguugguuaaaugac

SEQ ID NO: 2155516 - RNA, 18 nt, Homo sapiens
uacagccaguaagugaua

SEQ ID NO: 2155517 - RNA, 14 nt, Homo sapiens
caucaccacuguau

SEQ ID NO: 2155518 - RNA, 10 nt, Homo sapiens
uugauuucaa

SEQ ID NO: 2155519 - RNA, 20 nt, Homo sapiens
aagacucucgcaucuuccca

SEQ ID NO: 2155520 - RNA, 15 nt, Homo sapiens
cagggccucaucuca

SEQ ID NO: 2155521 - RNA, 16 nt, Homo sapiens
uucauuaaccaaagaa

SEQ ID NO: 2155522 - RNA, 21 nt, Homo sapiens
auuugauaauuuugaaaugau

SEQ ID NO: 2155523 - RNA, 23 nt, Homo sapiens
aaucaaugugacauguugcucuu

SEQ ID NO: 2155524 - RNA, 14 nt, Homo sapiens
gcaccagacacuca

SEQ ID NO: 2155525 - RNA, 13 nt, Homo sapiens
uccgcacaccucu

SEQ ID NO: 2155526 - RNA, 16 nt, Homo sapiens
caaauccuaugugauu

SEQ ID NO: 2155527 - RNA, 19 nt, Homo sapiens
uagcagggaguacccagug

SEQ ID NO: 2155528 - RNA, 17 nt, Homo sapiens
aggaguggccacagcac

SEQ ID NO: 2155529 - RNA, 17 nt, Homo sapiens
caaacccagccucuaga

SEQ ID NO: 2155530 - RNA, 20 nt, Homo sapiens
cucacuguggugucuguguu

SEQ ID NO: 2155531 - RNA, 21 nt, Homo sapiens
ccagcuugcgaauaacagucc

SEQ ID NO: 2155532 - RNA, 21 nt, Homo sapiens
aggcagggcaaaugcuugauu

SEQ ID NO: 2155533 - RNA, 21 nt, Homo sapiens
uccccggagccggcacugcau

SEQ ID NO: 2155534 - RNA, 22 nt, Homo sapiens
aucagccagacaugguggcaug

SEQ ID NO: 2155535 - RNA, 13 nt, Homo sapiens
uuaauugucaugg

SEQ ID NO: 2155536 - RNA, 23 nt, Homo sapiens
uagaugcacuuaugcaguaaauu

SEQ ID NO: 2155537 - RNA, 14 nt, Homo sapiens
ucguccacugucaa

SEQ ID NO: 2155538 - RNA, 22 nt, Homo sapiens
augguucccaauaucaugugau

SEQ ID NO: 2155539 - RNA, 16 nt, Homo sapiens
ugagcaauuguagggc

SEQ ID NO: 2155540 - RNA, 13 nt, Homo sapiens
caucuuugccaua

SEQ ID NO: 2155541 - RNA, 12 nt, Homo sapiens
aagaugaagcug

SEQ ID NO: 2155542 - RNA, 23 nt, Homo sapiens
ucuuuagcaguuuccucagugau

SEQ ID NO: 2155543 - RNA, 17 nt, Homo sapiens
ucagaaugggugcaguu

SEQ ID NO: 2155544 - RNA, 23 nt, Homo sapiens
aggguacaaaaaauucagugaug

SEQ ID NO: 2155545 - RNA, 16 nt, Homo sapiens
uucugaccacagcauc

SEQ ID NO: 2155546 - RNA, 18 nt, Homo sapiens
cacaaauggaacucccca

SEQ ID NO: 2155547 - RNA, 20 nt, Homo sapiens
uugcaggaagagaugcucua

SEQ ID NO: 2155548 - RNA, 15 nt, Homo sapiens
cucauuuaagggaaa

SEQ ID NO: 2155549 - RNA, 14 nt, Homo sapiens
aagaaaagcacugg

SEQ ID NO: 2155550 - RNA, 19 nt, Homo sapiens
aaaacaaacccaaagguag

SEQ ID NO: 2155551 - RNA, 16 nt, Homo sapiens
agcccagcacuugaau

SEQ ID NO: 2155552 - RNA, 15 nt, Homo sapiens
ccagugcugugagca

SEQ ID NO: 2155553 - RNA, 15 nt, Homo sapiens
aaucugcaguggcuc

SEQ ID NO: 2155554 - RNA, 16 nt, Homo sapiens
acugagccagucccag

SEQ ID NO: 2155555 - RNA, 23 nt, Homo sapiens
guggagccgagcggggagccagg

SEQ ID NO: 2155556 - RNA, 19 nt, Homo sapiens
augugauuggcagcuucaa

SEQ ID NO: 2155557 - RNA, 12 nt, Homo sapiens
caccucuugaaa

SEQ ID NO: 2155558 - RNA, 12 nt, Homo sapiens
ccaaucuugccc

SEQ ID NO: 2155559 - RNA, 15 nt, Homo sapiens
guacagacgucucaa

SEQ ID NO: 2155560 - RNA, 21 nt, Homo sapiens
aacuucagugcaagagacuuu

SEQ ID NO: 2155561 - RNA, 22 nt, Homo sapiens
ucuucguguauagcugugugaa

SEQ ID NO: 2155562 - RNA, 13 nt, Homo sapiens
gaaagcuuugaaa

SEQ ID NO: 2155563 - RNA, 17 nt, Homo sapiens
uaccacuuuugcaaaua

SEQ ID NO: 2155564 - RNA, 13 nt, Homo sapiens
auacuguuuccau

SEQ ID NO: 2155565 - RNA, 21 nt, Homo sapiens
uuauaaauaaacuguugcucg

SEQ ID NO: 2155566 - RNA, 18 nt, Homo sapiens
auucagcgaagucucaug

SEQ ID NO: 2155567 - RNA, 14 nt, Homo sapiens
ugaaggacuacagg

SEQ ID NO: 2155568 - RNA, 16 nt, Homo sapiens
ggggccuccucaguga

SEQ ID NO: 2155569 - RNA, 15 nt, Homo sapiens
ccuagccaggucucc

SEQ ID NO: 2155570 - RNA, 15 nt, Homo sapiens
uggccccuauugaga

SEQ ID NO: 2155571 - RNA, 15 nt, Homo sapiens
aguguuuaacuggca

SEQ ID NO: 2155572 - RNA, 21 nt, Homo sapiens
uuagcauggccacaucugagc

SEQ ID NO: 2155573 - RNA, 17 nt, Homo sapiens
ugcagaugaucagggau

SEQ ID NO: 2155574 - RNA, 16 nt, Homo sapiens
uuggcaguguggcagu

SEQ ID NO: 2155575 - RNA, 15 nt, Homo sapiens
cuuaaugacauuuca

SEQ ID NO: 2155576 - RNA, 18 nt, Homo sapiens
guguucacaaacugugaa

SEQ ID NO: 2155577 - RNA, 20 nt, Homo sapiens
aauaagaaacuuauuucuca

SEQ ID NO: 2155578 - RNA, 16 nt, Homo sapiens
aaaagucagcgugaca

SEQ ID NO: 2155579 - RNA, 23 nt, Homo sapiens
caagguguccuacagaaaaaccu

SEQ ID NO: 2155580 - RNA, 17 nt, Homo sapiens
cagcaugcugagauuac

SEQ ID NO: 2155581 - RNA, 18 nt, Homo sapiens
auuccaugggauguuaag

SEQ ID NO: 2155582 - RNA, 23 nt, Homo sapiens
uagcuaaauaaauggguguauau

SEQ ID NO: 2155583 - RNA, 12 nt, Homo sapiens
aaugucaucucu

SEQ ID NO: 2155584 - RNA, 12 nt, Homo sapiens
guacuucuugaa

SEQ ID NO: 2155585 - RNA, 17 nt, Homo sapiens
gguaaaaccccaucucu

SEQ ID NO: 2155586 - RNA, 16 nt, Homo sapiens
cagucacuugaucucc

SEQ ID NO: 2155587 - RNA, 21 nt, Homo sapiens
auaauaucaugugcacuucaa

SEQ ID NO: 2155588 - RNA, 17 nt, Homo sapiens
gcuuuauaauuucuacc

SEQ ID NO: 2155589 - RNA, 21 nt, Homo sapiens
gacacagcuuaacaaugcaac

SEQ ID NO: 2155590 - RNA, 23 nt, Homo sapiens
cauugagcgugaccuugcaaugu

SEQ ID NO: 2155591 - RNA, 16 nt, Homo sapiens
ggaccuuuuguacuuu

SEQ ID NO: 2155592 - RNA, 22 nt, Homo sapiens
agcccugacuaaacuaccaccu

SEQ ID NO: 2155593 - RNA, 15 nt, Homo sapiens
uaagugucugugaug

SEQ ID NO: 2155594 - RNA, 20 nt, Homo sapiens
agaauauucucccauaaaca

SEQ ID NO: 2155595 - RNA, 21 nt, Homo sapiens
gaugccaccuucagauccuuu

SEQ ID NO: 2155596 - RNA, 22 nt, Homo sapiens
uccuuggcuuuaugcaaauaca

SEQ ID NO: 2155597 - RNA, 16 nt, Homo sapiens
aguuccaaaagagaag

SEQ ID NO: 2155598 - RNA, 14 nt, Homo sapiens
uggcagcuuuuuca

SEQ ID NO: 2155599 - RNA, 17 nt, Homo sapiens
uauaaauguaccagaga

SEQ ID NO: 2155600 - RNA, 15 nt, Homo sapiens
agcacuuuucacuua

SEQ ID NO: 2155601 - RNA, 13 nt, Homo sapiens
cgagacagaaaaa

SEQ ID NO: 2155602 - RNA, 21 nt, Homo sapiens
uaauagguauauagaacacaa

SEQ ID NO: 2155603 - RNA, 22 nt, Homo sapiens
aauuacaauacaucuaagcuau

SEQ ID NO: 2155604 - RNA, 19 nt, Homo sapiens
ccagcuauuuucugaccaa

SEQ ID NO: 2155605 - RNA, 14 nt, Homo sapiens
aagaugugugauaa

SEQ ID NO: 2155606 - RNA, 14 nt, Homo sapiens
agccucuccuccau

SEQ ID NO: 2155607 - RNA, 16 nt, Homo sapiens
gcucagaagccagucu

SEQ ID NO: 2155608 - RNA, 23 nt, Homo sapiens
aggaagcuguguugaaacagaaa

SEQ ID NO: 2155609 - RNA, 20 nt, Homo sapiens
uauggauugaaggauuguga

SEQ ID NO: 2155610 - RNA, 14 nt, Homo sapiens
gaccagagcaguuu

SEQ ID NO: 2155611 - RNA, 19 nt, Homo sapiens
aggcucagccacacaggaa

SEQ ID NO: 2155612 - RNA, 17 nt, Homo sapiens
guaccacauuccaugac

SEQ ID NO: 2155613 - RNA, 20 nt, Homo sapiens
cauuuaaauaaaacuuucca

SEQ ID NO: 2155614 - RNA, 19 nt, Homo sapiens
cauuuauuugugaugacaa

SEQ ID NO: 2155615 - RNA, 23 nt, Homo sapiens
guacuauauguauaucuuugcac

SEQ ID NO: 2155616 - RNA, 15 nt, Homo sapiens
aacauucauagucuu

SEQ ID NO: 2155617 - RNA, 19 nt, Homo sapiens
ggcugccaggcaccaucug

SEQ ID NO: 2155618 - RNA, 15 nt, Homo sapiens
cuuguuacugugaua

SEQ ID NO: 2155619 - RNA, 15 nt, Homo sapiens
aaggccuacuauaca

SEQ ID NO: 2155620 - RNA, 11 nt, Homo sapiens
acagaccucag

SEQ ID NO: 2155621 - RNA, 19 nt, Homo sapiens
uggaaacagggcagugaca

SEQ ID NO: 2155622 - RNA, 12 nt, Homo sapiens
uggggcucagac

SEQ ID NO: 2155623 - RNA, 22 nt, Homo sapiens
gcuuaauggcucaugaccugga

SEQ ID NO: 2155624 - RNA, 22 nt, Homo sapiens
caauuuuuuuucuguaaaugga

SEQ ID NO: 2155625 - RNA, 17 nt, Homo sapiens
gagguugcggugagcug

SEQ ID NO: 2155626 - RNA, 23 nt, Homo sapiens
cuugacuauuggaggaccaaaaa

SEQ ID NO: 2155627 - RNA, 22 nt, Homo sapiens
ggacucuggauauuugcacuua

SEQ ID NO: 2155628 - RNA, 18 nt, Homo sapiens
guaaauaaacuguuuaua

SEQ ID NO: 2155629 - RNA, 22 nt, Homo sapiens
uucuuugccuguucaguuacag

SEQ ID NO: 2155630 - RNA, 16 nt, Homo sapiens
ccuuccacucuggaac

SEQ ID NO: 2155631 - RNA, 21 nt, Homo sapiens
uucucagggcuccugccuucu

SEQ ID NO: 2155632 - RNA, 20 nt, Homo sapiens
acucuggggugcugccugaa

SEQ ID NO: 2155633 - RNA, 19 nt, Homo sapiens
uuauugccuaaucacucca

SEQ ID NO: 2155634 - RNA, 21 nt, Homo sapiens
agaagcugucagggacccagg

SEQ ID NO: 2155635 - RNA, 22 nt, Homo sapiens
gaauaaauaugcucagccaccc

SEQ ID NO: 2155636 - RNA, 20 nt, Homo sapiens
uccccauucacagagccuuu

SEQ ID NO: 2155637 - RNA, 15 nt, Homo sapiens
acauuuugacacaaa

SEQ ID NO: 2155638 - RNA, 19 nt, Homo sapiens
uuaaaaauacauagcauua

SEQ ID NO: 2155639 - RNA, 15 nt, Homo sapiens
ucuuccuguguccug

SEQ ID NO: 2155640 - RNA, 15 nt, Homo sapiens
gccaauuucucucag

SEQ ID NO: 2155641 - RNA, 23 nt, Homo sapiens
cugguccaguuccuucacuuaca

SEQ ID NO: 2155642 - RNA, 13 nt, Homo sapiens
uugcagugagcua

SEQ ID NO: 2155643 - RNA, 12 nt, Homo sapiens
uugggaggugua

SEQ ID NO: 2155644 - RNA, 21 nt, Homo sapiens
gcagaucuaccccuuacuuau

SEQ ID NO: 2155645 - RNA, 20 nt, Homo sapiens
ccugccccagacagacuuca

SEQ ID NO: 2155646 - RNA, 23 nt, Homo sapiens
ucuggaaaaauaaguacauauag

SEQ ID NO: 2155647 - RNA, 12 nt, Homo sapiens
cgaggugcagua

SEQ ID NO: 2155648 - RNA, 14 nt, Homo sapiens
gagucuuguguuca

SEQ ID NO: 2155649 - RNA, 20 nt, Homo sapiens
ccuguaucagaaucugaaaa

SEQ ID NO: 2155650 - RNA, 16 nt, Homo sapiens
uggacuacacagcucc

SEQ ID NO: 2155651 - RNA, 16 nt, Homo sapiens
gggaacaccugcugag

SEQ ID NO: 2155652 - RNA, 19 nt, Homo sapiens
caaccuaccucaccauggu

SEQ ID NO: 2155653 - RNA, 20 nt, Homo sapiens
uccuguauaagcacugaaaa

SEQ ID NO: 2155654 - RNA, 21 nt, Homo sapiens
ggccaaagagucuccaguuua

SEQ ID NO: 2155655 - RNA, 15 nt, Homo sapiens
gcgccagcacuguau

SEQ ID NO: 2155656 - RNA, 17 nt, Homo sapiens
aaacacuggcucuggga

SEQ ID NO: 2155657 - RNA, 22 nt, Homo sapiens
gaauguuaauuuuuugguacaa

SEQ ID NO: 2155658 - RNA, 14 nt, Homo sapiens
aauuagcauuccau

SEQ ID NO: 2155659 - RNA, 22 nt, Homo sapiens
ucugauaagagaaucaacauuu

SEQ ID NO: 2155660 - RNA, 17 nt, Homo sapiens
ccuucucauaaccucaa

SEQ ID NO: 2155661 - RNA, 20 nt, Homo sapiens
gcuccacgcagucugcuuca

SEQ ID NO: 2155662 - RNA, 23 nt, Homo sapiens
acaccggguaagagcucugaguc

SEQ ID NO: 2155663 - RNA, 16 nt, Homo sapiens
agauugagcucucugc

SEQ ID NO: 2155664 - RNA, 19 nt, Homo sapiens
cuucuugggacugcuguga

SEQ ID NO: 2155665 - RNA, 13 nt, Homo sapiens
guagaaugaccuu

SEQ ID NO: 2155666 - RNA, 21 nt, Homo sapiens
uggguuagggaaaacauucca

SEQ ID NO: 2155667 - RNA, 18 nt, Homo sapiens
aagaaugcaaccuaguca

SEQ ID NO: 2155668 - RNA, 22 nt, Homo sapiens
uuucucuaccuucaagaaccag

SEQ ID NO: 2155669 - RNA, 20 nt, Homo sapiens
cugaauggaguuaaacuuua

SEQ ID NO: 2155670 - RNA, 12 nt, Homo sapiens
ucuauguccaaa

SEQ ID NO: 2155671 - RNA, 23 nt, Homo sapiens
aaggcucgauuuuguaucugcag

SEQ ID NO: 2155672 - RNA, 13 nt, Homo sapiens
cuggagaguaauc

SEQ ID NO: 2155673 - RNA, 13 nt, Homo sapiens
aaugcagccuuaa

SEQ ID NO: 2155674 - RNA, 19 nt, Homo sapiens
ugaauaggcauuaaaugca

SEQ ID NO: 2155675 - RNA, 13 nt, Homo sapiens
cccaguauucuca

SEQ ID NO: 2155676 - RNA, 20 nt, Homo sapiens
aauuugggcuggaacaugua

SEQ ID NO: 2155677 - RNA, 19 nt, Homo sapiens
auccuccuaccuccaaagc

SEQ ID NO: 2155678 - RNA, 19 nt, Homo sapiens
uuuuacagucacauucaga

SEQ ID NO: 2155679 - RNA, 21 nt, Homo sapiens
uugcuauggaaaggacagugu

SEQ ID NO: 2155680 - RNA, 16 nt, Homo sapiens
accuuccccaaaggaa

SEQ ID NO: 2155681 - RNA, 18 nt, Homo sapiens
uaugacucagagaaccag

SEQ ID NO: 2155682 - RNA, 17 nt, Homo sapiens
acuggauucauucucau

SEQ ID NO: 2155683 - RNA, 21 nt, Homo sapiens
ugugaguugcacagcuaugaa

SEQ ID NO: 2155684 - RNA, 19 nt, Homo sapiens
uucaaaaucaaauuccaga

SEQ ID NO: 2155685 - RNA, 18 nt, Homo sapiens
auugcuucaauaauauua

SEQ ID NO: 2155686 - RNA, 22 nt, Homo sapiens
guaccauuuucuaucauggaau

SEQ ID NO: 2155687 - RNA, 21 nt, Homo sapiens
aacccauuaggcaugccuaau

SEQ ID NO: 2155688 - RNA, 15 nt, Homo sapiens
uauuuucagcucaau

SEQ ID NO: 2155689 - RNA, 15 nt, Homo sapiens
gacugaguucuauau

SEQ ID NO: 2155690 - RNA, 23 nt, Homo sapiens
caugacccuuguggcacagaugc

SEQ ID NO: 2155691 - RNA, 14 nt, Homo sapiens
ccaaacugacucaa

SEQ ID NO: 2155692 - RNA, 17 nt, Homo sapiens
cagaggcccaggcugcc

SEQ ID NO: 2155693 - RNA, 17 nt, Homo sapiens
acagggccacaacugcc

SEQ ID NO: 2155694 - RNA, 15 nt, Homo sapiens
aaugcacaguugcca

SEQ ID NO: 2155695 - RNA, 23 nt, Homo sapiens
uaccaacagcuuuucccaggaga

SEQ ID NO: 2155696 - RNA, 21 nt, Homo sapiens
aacaccuuuccuuaugucucc

SEQ ID NO: 2155697 - RNA, 13 nt, Homo sapiens
auuaaacaccuga

SEQ ID NO: 2155698 - RNA, 13 nt, Homo sapiens
agaccccaucucu

SEQ ID NO: 2155699 - RNA, 13 nt, Homo sapiens
cauaaaacagcau

SEQ ID NO: 2155700 - RNA, 21 nt, Homo sapiens
uaaaauaaucaguguuuccaa

SEQ ID NO: 2155701 - RNA, 21 nt, Homo sapiens
acguugcccaagguugcacag

SEQ ID NO: 2155702 - RNA, 13 nt, Homo sapiens
ucuuaaaaacugu

SEQ ID NO: 2155703 - RNA, 19 nt, Homo sapiens
acgggaauucagacaagcu

SEQ ID NO: 2155704 - RNA, 15 nt, Homo sapiens
ccagcccugcugcag

SEQ ID NO: 2155705 - RNA, 16 nt, Homo sapiens
ugggugcccacagccc

SEQ ID NO: 2155706 - RNA, 23 nt, Homo sapiens
auccauaaagacaaucacugcca

SEQ ID NO: 2155707 - RNA, 22 nt, Homo sapiens
uggaaaaaaaauaagauaucaa

SEQ ID NO: 2155708 - RNA, 22 nt, Homo sapiens
cuggucugugaagagccggugg

SEQ ID NO: 2155709 - RNA, 16 nt, Homo sapiens
gaggggagaagccaag

SEQ ID NO: 2155710 - RNA, 19 nt, Homo sapiens
cucaagcagaccuacagca

SEQ ID NO: 2155711 - RNA, 13 nt, Homo sapiens
agucaaggacuaa

SEQ ID NO: 2155712 - RNA, 14 nt, Homo sapiens
caaaacuuuggcac

SEQ ID NO: 2155713 - RNA, 16 nt, Homo sapiens
accugucucuaccuaa

SEQ ID NO: 2155714 - RNA, 22 nt, Homo sapiens
ggaaggaaaugacaccaaauau

SEQ ID NO: 2155715 - RNA, 15 nt, Homo sapiens
uguccaaucacauuc

SEQ ID NO: 2155716 - RNA, 22 nt, Homo sapiens
agggaauuuggcucaacuucag

SEQ ID NO: 2155717 - RNA, 22 nt, Homo sapiens
auuccacugaaauagagugaau

SEQ ID NO: 2155718 - RNA, 23 nt, Homo sapiens
caaagcucaagaugacagcucuu

SEQ ID NO: 2155719 - RNA, 19 nt, Homo sapiens
aaagucugucuuuccugaa

SEQ ID NO: 2155720 - RNA, 17 nt, Homo sapiens
cucaccccccacacuca

SEQ ID NO: 2155721 - RNA, 16 nt, Homo sapiens
uguauaaaauagacaa

SEQ ID NO: 2155722 - RNA, 14 nt, Homo sapiens
uacugugacuuuau

SEQ ID NO: 2155723 - RNA, 21 nt, Homo sapiens
accaaaaaagaaaguuuauuu

SEQ ID NO: 2155724 - RNA, 24 nt, Homo sapiens
uacucuuucugcuuacaaagacaa

SEQ ID NO: 2155725 - RNA, 19 nt, Homo sapiens
uauaacuagacaucugcug

SEQ ID NO: 2155726 - RNA, 18 nt, Homo sapiens
aauauuauuuauuuaacu

SEQ ID NO: 2155727 - RNA, 14 nt, Homo sapiens
gauccagugcugag

SEQ ID NO: 2155728 - RNA, 13 nt, Homo sapiens
ucccaauacaaaa

SEQ ID NO: 2155729 - RNA, 18 nt, Homo sapiens
guauuuuuccucuuucac

SEQ ID NO: 2155730 - RNA, 16 nt, Homo sapiens
ugaaauuuauacacca

SEQ ID NO: 2155731 - RNA, 16 nt, Homo sapiens
guuacaaauaugcaga

SEQ ID NO: 2155732 - RNA, 12 nt, Homo sapiens
acaguggcugcu

SEQ ID NO: 2155733 - RNA, 14 nt, Homo sapiens
uugcugaauaacaa

SEQ ID NO: 2155734 - RNA, 14 nt, Homo sapiens
cuguugaacaauaa

SEQ ID NO: 2155735 - RNA, 17 nt, Homo sapiens
augcuuggacuagugag

SEQ ID NO: 2155736 - RNA, 22 nt, Homo sapiens
gccaggccucagggaccaagga

SEQ ID NO: 2155737 - RNA, 17 nt, Homo sapiens
caccccaucgcccagca

SEQ ID NO: 2155738 - RNA, 15 nt, Homo sapiens
aaaauagaacagcuc

SEQ ID NO: 2155739 - RNA, 12 nt, Homo sapiens
ucuacugugaca

SEQ ID NO: 2155740 - RNA, 12 nt, Homo sapiens
uccucugugauu

SEQ ID NO: 2155741 - RNA, 20 nt, Homo sapiens
ugcuuaucagugugcaauac

SEQ ID NO: 2155742 - RNA, 19 nt, Homo sapiens
augccucagccuacuuuca

SEQ ID NO: 2155743 - RNA, 20 nt, Homo sapiens
cagcacucccucccagagaa

SEQ ID NO: 2155744 - RNA, 18 nt, Homo sapiens
augaccauauuuacucuu

SEQ ID NO: 2155745 - RNA, 16 nt, Homo sapiens
aggguuugcagaaagc

SEQ ID NO: 2155746 - RNA, 23 nt, Homo sapiens
ugccugagaccaggguggccaca

SEQ ID NO: 2155747 - RNA, 13 nt, Homo sapiens
aacuguuaugaaa

SEQ ID NO: 2155748 - RNA, 20 nt, Homo sapiens
acaccaagugaggccauagc

SEQ ID NO: 2155749 - RNA, 14 nt, Homo sapiens
aguuuugucacaau

SEQ ID NO: 2155750 - RNA, 19 nt, Homo sapiens
uccaaguuccugcacucca

SEQ ID NO: 2155751 - RNA, 14 nt, Homo sapiens
ucaaugguaugcaa

SEQ ID NO: 2155752 - RNA, 13 nt, Homo sapiens
gcagcagagccau

SEQ ID NO: 2155753 - RNA, 21 nt, Homo sapiens
gagccuuacuucaaagugccu

SEQ ID NO: 2155754 - RNA, 19 nt, Homo sapiens
aaggcagccugaacacuca

SEQ ID NO: 2155755 - RNA, 21 nt, Homo sapiens
ugcucugcagcccacagagga

SEQ ID NO: 2155756 - RNA, 16 nt, Homo sapiens
guauuuuuucuugcau

SEQ ID NO: 2155757 - RNA, 16 nt, Homo sapiens
agacguccuccgucca

SEQ ID NO: 2155758 - RNA, 14 nt, Homo sapiens
ucuccauuuuacag

SEQ ID NO: 2155759 - RNA, 16 nt, Homo sapiens
uuaacucucuguuaca

SEQ ID NO: 2155760 - RNA, 14 nt, Homo sapiens
ggcucagggccagg

SEQ ID NO: 2155761 - RNA, 16 nt, Homo sapiens
cuuccaguguccuuag

SEQ ID NO: 2155762 - RNA, 14 nt, Homo sapiens
gacugacaaccuca

SEQ ID NO: 2155763 - RNA, 21 nt, Homo sapiens
ccugcugcuguguuuuugcua

SEQ ID NO: 2155764 - RNA, 21 nt, Homo sapiens
acauuguuuuguguaacauau

SEQ ID NO: 2155765 - RNA, 18 nt, Homo sapiens
ccauggcacugaggugcc

SEQ ID NO: 2155766 - RNA, 13 nt, Homo sapiens
agugcuucuugua

SEQ ID NO: 2155767 - RNA, 19 nt, Homo sapiens
gaaaccuugaaagacauuu

SEQ ID NO: 2155768 - RNA, 12 nt, Homo sapiens
guucauucugca

SEQ ID NO: 2155769 - RNA, 19 nt, Homo sapiens
ccuugaauagaaguuuucc

SEQ ID NO: 2155770 - RNA, 16 nt, Homo sapiens
ugcacacacagaugca

SEQ ID NO: 2155771 - RNA, 21 nt, Homo sapiens
caguccaccugagcugccauc

SEQ ID NO: 2155772 - RNA, 19 nt, Homo sapiens
uauacucacuuucccaaau

SEQ ID NO: 2155773 - RNA, 13 nt, Homo sapiens
ccuugaagccacu

SEQ ID NO: 2155774 - RNA, 23 nt, Homo sapiens
gauguuaugcuccugcugaucca

SEQ ID NO: 2155775 - RNA, 23 nt, Homo sapiens
gguaagagauaugcucauuauua

SEQ ID NO: 2155776 - RNA, 21 nt, Homo sapiens
ucccuggugccucugugcaca

SEQ ID NO: 2155777 - RNA, 21 nt, Homo sapiens
cuguagaucaaccugaugauu

SEQ ID NO: 2155778 - RNA, 13 nt, Homo sapiens
cuuuuagcauaaa

SEQ ID NO: 2155779 - RNA, 15 nt, Homo sapiens
uuaaaauacaguaua

SEQ ID NO: 2155780 - RNA, 14 nt, Homo sapiens
aaaccaccuucccu

SEQ ID NO: 2155781 - RNA, 23 nt, Homo sapiens
cuaaaaugauuuuaucugugaau

SEQ ID NO: 2155782 - RNA, 17 nt, Homo sapiens
uacugcacguaacacuc

SEQ ID NO: 2155783 - RNA, 23 nt, Homo sapiens
cuuugaagauaguaacuguagau

SEQ ID NO: 2155784 - RNA, 15 nt, Homo sapiens
auaucaaucaguaau

SEQ ID NO: 2155785 - RNA, 20 nt, Homo sapiens
agacaagcgccgcugugagg

SEQ ID NO: 2155786 - RNA, 15 nt, Homo sapiens
agcaugguauuugaa

SEQ ID NO: 2155787 - RNA, 20 nt, Homo sapiens
agccuuuuccagaagaucug

SEQ ID NO: 2155788 - RNA, 15 nt, Homo sapiens
aaucucaagcaaaca

SEQ ID NO: 2155789 - RNA, 18 nt, Homo sapiens
ugagauccggcagcacaa

SEQ ID NO: 2155790 - RNA, 14 nt, Homo sapiens
aaaacauuuguaca

SEQ ID NO: 2155791 - RNA, 15 nt, Homo sapiens
cucuagccccagcgc

SEQ ID NO: 2155792 - RNA, 23 nt, Homo sapiens
gggcucagcuagacauugcaauu

SEQ ID NO: 2155793 - RNA, 21 nt, Homo sapiens
auugcagcauuuauguuagag

SEQ ID NO: 2155794 - RNA, 17 nt, Homo sapiens
cccaaagcuggagccaa

SEQ ID NO: 2155795 - RNA, 21 nt, Homo sapiens
gaacuuauucuccaucucaag

SEQ ID NO: 2155796 - RNA, 16 nt, Homo sapiens
acugcacaguagagca

SEQ ID NO: 2155797 - RNA, 13 nt, Homo sapiens
ucccucucaggug

SEQ ID NO: 2155798 - RNA, 22 nt, Homo sapiens
uggccuccuuccccguacuuug

SEQ ID NO: 2155799 - RNA, 14 nt, Homo sapiens
acacucuuagcuau

SEQ ID NO: 2155800 - RNA, 19 nt, Homo sapiens
uuccaaauguuuuuaaucc

SEQ ID NO: 2155801 - RNA, 14 nt, Homo sapiens
cuccauaugcugua

SEQ ID NO: 2155802 - RNA, 15 nt, Homo sapiens
accuuuccagccaua

SEQ ID NO: 2155803 - RNA, 15 nt, Homo sapiens
cuagauaugccuuaa

SEQ ID NO: 2155804 - RNA, 21 nt, Homo sapiens
uuaauuaugaaaacuagcauu

SEQ ID NO: 2155805 - RNA, 20 nt, Homo sapiens
acugcaaauuguagcccagu

SEQ ID NO: 2155806 - RNA, 21 nt, Homo sapiens
gcaccucuagugcuacugcua

SEQ ID NO: 2155807 - RNA, 15 nt, Homo sapiens
cagacugaaaagaca

SEQ ID NO: 2155808 - RNA, 12 nt, Homo sapiens
cuggccugagga

SEQ ID NO: 2155809 - RNA, 18 nt, Homo sapiens
aucagggucuaagcaccu

SEQ ID NO: 2155810 - RNA, 23 nt, Homo sapiens
aagaagcccaagauaucagccca

SEQ ID NO: 2155811 - RNA, 14 nt, Homo sapiens
ucccugcagaccuc

SEQ ID NO: 2155812 - RNA, 22 nt, Homo sapiens
cccuuucauaaagucuugccuu

SEQ ID NO: 2155813 - RNA, 19 nt, Homo sapiens
aaguaagaggacuacucag

SEQ ID NO: 2155814 - RNA, 22 nt, Homo sapiens
gggcucuugaucagugugcuaa

SEQ ID NO: 2155815 - RNA, 15 nt, Homo sapiens
ugggggaacugugaa

SEQ ID NO: 2155816 - RNA, 19 nt, Homo sapiens
cuaaauaucccuuggacau

SEQ ID NO: 2155817 - RNA, 16 nt, Homo sapiens
cuggcggccaagugag

SEQ ID NO: 2155818 - RNA, 15 nt, Homo sapiens
ucuguggucacagag

SEQ ID NO: 2155819 - RNA, 15 nt, Homo sapiens
ugagcagaagaucaa

SEQ ID NO: 2155820 - RNA, 14 nt, Homo sapiens
uugcacgugcaaua

SEQ ID NO: 2155821 - RNA, 19 nt, Homo sapiens
aaaauaaacaccauuauuc

SEQ ID NO: 2155822 - RNA, 15 nt, Homo sapiens
cagcacauaugggaa

SEQ ID NO: 2155823 - RNA, 20 nt, Homo sapiens
uuaauuugguagaugacaaa

SEQ ID NO: 2155824 - RNA, 19 nt, Homo sapiens
gugucuagagucaugugag

SEQ ID NO: 2155825 - RNA, 20 nt, Homo sapiens
augcuagcgcguugccuguc

SEQ ID NO: 2155826 - RNA, 18 nt, Homo sapiens
uaauagagauaaguccau

SEQ ID NO: 2155827 - RNA, 19 nt, Homo sapiens
gcaguucagcuccuuccac

SEQ ID NO: 2155828 - RNA, 16 nt, Homo sapiens
uaaauguaucauagaa

SEQ ID NO: 2155829 - RNA, 19 nt, Homo sapiens
ggcagguccccagacucca

SEQ ID NO: 2155830 - RNA, 12 nt, Homo sapiens
aacaacauauuu

SEQ ID NO: 2155831 - RNA, 14 nt, Homo sapiens
gcccuuuucagggc

SEQ ID NO: 2155832 - RNA, 20 nt, Homo sapiens
acacugagaaauagugcacu

SEQ ID NO: 2155833 - RNA, 20 nt, Homo sapiens
agguggggagagacagagaa

SEQ ID NO: 2155834 - RNA, 18 nt, Homo sapiens
acuuuuaugcaaccauaa

SEQ ID NO: 2155835 - RNA, 22 nt, Homo sapiens
gggugccgcucucucugagggg

SEQ ID NO: 2155836 - RNA, 21 nt, Homo sapiens
caugggaaugaaugucagugu

SEQ ID NO: 2155837 - RNA, 19 nt, Homo sapiens
cacuaauuuaaguacuuga

SEQ ID NO: 2155838 - RNA, 14 nt, Homo sapiens
agccuccaguugua

SEQ ID NO: 2155839 - RNA, 21 nt, Homo sapiens
caagucccaaauucauugacu

SEQ ID NO: 2155840 - RNA, 13 nt, Homo sapiens
aaaaucauaacuc

SEQ ID NO: 2155841 - RNA, 14 nt, Homo sapiens
gccuugggcuucau

SEQ ID NO: 2155842 - RNA, 17 nt, Homo sapiens
auuaguugacaguauua

SEQ ID NO: 2155843 - RNA, 14 nt, Homo sapiens
gcagccagacccac

SEQ ID NO: 2155844 - RNA, 11 nt, Homo sapiens
cccaaccuccc

SEQ ID NO: 2155845 - RNA, 20 nt, Homo sapiens
cauguuugauuauaguauua

SEQ ID NO: 2155846 - RNA, 15 nt, Homo sapiens
aguuuccggaaacaa

SEQ ID NO: 2155847 - RNA, 18 nt, Homo sapiens
gccauuggaaccuguuaa

SEQ ID NO: 2155848 - RNA, 15 nt, Homo sapiens
uuuccuuugcgcaaa

SEQ ID NO: 2155849 - RNA, 15 nt, Homo sapiens
caacaaaacuaugga

SEQ ID NO: 2155850 - RNA, 13 nt, Homo sapiens
cuuuuauaacuag

SEQ ID NO: 2155851 - RNA, 22 nt, Homo sapiens
cguuuuccagcauguguucugu

SEQ ID NO: 2155852 - RNA, 19 nt, Homo sapiens
cuucccucaaagcuuccau

SEQ ID NO: 2155853 - RNA, 23 nt, Homo sapiens
cagugggaaggggugauggauga

SEQ ID NO: 2155854 - RNA, 13 nt, Homo sapiens
cgucacaaagacc

SEQ ID NO: 2155855 - RNA, 17 nt, Homo sapiens
auaacuccugucccuuu

SEQ ID NO: 2155856 - RNA, 14 nt, Homo sapiens
uaucagaauucuca

SEQ ID NO: 2155857 - RNA, 20 nt, Homo sapiens
auugcuuguuuguggucaca

SEQ ID NO: 2155858 - RNA, 18 nt, Homo sapiens
auaucugggucaauccac

SEQ ID NO: 2155859 - RNA, 21 nt, Homo sapiens
ucagauauuuuuucagaaaua

SEQ ID NO: 2155860 - RNA, 17 nt, Homo sapiens
gcgaguucucuuuggaa

SEQ ID NO: 2155861 - RNA, 16 nt, Homo sapiens
accgaaaguguuacag

SEQ ID NO: 2155862 - RNA, 16 nt, Homo sapiens
guacuuuuuacauaca

SEQ ID NO: 2155863 - RNA, 17 nt, Homo sapiens
uuaucuguguugucucu

SEQ ID NO: 2155864 - RNA, 16 nt, Homo sapiens
cuccagggacaaagag

SEQ ID NO: 2155865 - RNA, 18 nt, Homo sapiens
cugccccuagacauggac

SEQ ID NO: 2155866 - RNA, 11 nt, Homo sapiens
ccauuagccaa

SEQ ID NO: 2155867 - RNA, 23 nt, Homo sapiens
ugcaggugucuauccaccugggg

SEQ ID NO: 2155868 - RNA, 13 nt, Homo sapiens
agcgucugggaac

SEQ ID NO: 2155869 - RNA, 12 nt, Homo sapiens
gaguuccagacc

SEQ ID NO: 2155870 - RNA, 12 nt, Homo sapiens
gggcuccaggcu

SEQ ID NO: 2155871 - RNA, 20 nt, Homo sapiens
ugacaagugacuuauuugcu

SEQ ID NO: 2155872 - RNA, 19 nt, Homo sapiens
cuccaggcccccguugaag

SEQ ID NO: 2155873 - RNA, 22 nt, Homo sapiens
gaucaucgccagaggugcuuca

SEQ ID NO: 2155874 - RNA, 20 nt, Homo sapiens
acaugcacacaggugcacag

SEQ ID NO: 2155875 - RNA, 21 nt, Homo sapiens
gaaagaagccaggugcaaaag

SEQ ID NO: 2155876 - RNA, 16 nt, Homo sapiens
gagaugucucugugug

SEQ ID NO: 2155877 - RNA, 21 nt, Homo sapiens
auuacugcuaaguauuuccca

SEQ ID NO: 2155878 - RNA, 14 nt, Homo sapiens
ucacugcuaccucu

SEQ ID NO: 2155879 - RNA, 13 nt, Homo sapiens
ugaucuuggcagu

SEQ ID NO: 2155880 - RNA, 17 nt, Homo sapiens
cagcuuagauuucauag

SEQ ID NO: 2155881 - RNA, 22 nt, Homo sapiens
augaccucuuugauuugugcug

SEQ ID NO: 2155882 - RNA, 16 nt, Homo sapiens
augacggcucaugccu

SEQ ID NO: 2155883 - RNA, 21 nt, Homo sapiens
aauuuuauuuuuacaaaaauu

SEQ ID NO: 2155884 - RNA, 18 nt, Homo sapiens
gaagagccggagccucca

SEQ ID NO: 2155885 - RNA, 23 nt, Homo sapiens
agaaaaccuaccacauucacuac

SEQ ID NO: 2155886 - RNA, 21 nt, Homo sapiens
auccuagucuucacaacuuug

SEQ ID NO: 2155887 - RNA, 22 nt, Homo sapiens
uuaugggagaauugcacacaga

SEQ ID NO: 2155888 - RNA, 18 nt, Homo sapiens
uggagggagcuccagaaa

SEQ ID NO: 2155889 - RNA, 16 nt, Homo sapiens
ugaucuagauacagga

SEQ ID NO: 2155890 - RNA, 14 nt, Homo sapiens
ggggaucccucccc

SEQ ID NO: 2155891 - RNA, 22 nt, Homo sapiens
ucuacaggucggggaccaaagg

SEQ ID NO: 2155892 - RNA, 18 nt, Homo sapiens
guaacugauaaaccaaaa

SEQ ID NO: 2155893 - RNA, 12 nt, Homo sapiens
agucaacaacca

SEQ ID NO: 2155894 - RNA, 13 nt, Homo sapiens
cccaaaaggcaga

SEQ ID NO: 2155895 - RNA, 18 nt, Homo sapiens
agcccgcaugcagcagcu

SEQ ID NO: 2155896 - RNA, 21 nt, Homo sapiens
agagaaagagagagaauucuu

SEQ ID NO: 2155897 - RNA, 14 nt, Homo sapiens
cacugaagcuaaaa

SEQ ID NO: 2155898 - RNA, 20 nt, Homo sapiens
uggcaggacccuuaggaauc

SEQ ID NO: 2155899 - RNA, 14 nt, Homo sapiens
aguugucaaauuga

SEQ ID NO: 2155900 - RNA, 18 nt, Homo sapiens
gauccuuagagguccucu

SEQ ID NO: 2155901 - RNA, 19 nt, Homo sapiens
caauaaauaaugaucacag

SEQ ID NO: 2155902 - RNA, 20 nt, Homo sapiens
gagccuucugugcugugagu

SEQ ID NO: 2155903 - RNA, 15 nt, Homo sapiens
aacccacagaccuca

SEQ ID NO: 2155904 - RNA, 18 nt, Homo sapiens
ugacuucagcugccugaa

SEQ ID NO: 2155905 - RNA, 16 nt, Homo sapiens
gauuagaaaauggaac

SEQ ID NO: 2155906 - RNA, 19 nt, Homo sapiens
ucaaaagucuggccuuuca

SEQ ID NO: 2155907 - RNA, 21 nt, Homo sapiens
uuagacauguaauuuguguaa

SEQ ID NO: 2155908 - RNA, 18 nt, Homo sapiens
cacacuuucaugcagugc

SEQ ID NO: 2155909 - RNA, 14 nt, Homo sapiens
uggauaccugugug

SEQ ID NO: 2155910 - RNA, 14 nt, Homo sapiens
agugagccaggaaa

SEQ ID NO: 2155911 - RNA, 22 nt, Homo sapiens
cugggacacuccgucugcucca

SEQ ID NO: 2155912 - RNA, 12 nt, Homo sapiens
cauucugcauuu

SEQ ID NO: 2155913 - RNA, 14 nt, Homo sapiens
gaccacccugccaa

SEQ ID NO: 2155914 - RNA, 13 nt, Homo sapiens
aagccccugugac

SEQ ID NO: 2155915 - RNA, 16 nt, Homo sapiens
ucaggcauuucauuua

SEQ ID NO: 2155916 - RNA, 16 nt, Homo sapiens
ucuccagugcaccugu

SEQ ID NO: 2155917 - RNA, 14 nt, Homo sapiens
uggccugcacuggu

SEQ ID NO: 2155918 - RNA, 14 nt, Homo sapiens
ugagacuugaauca

SEQ ID NO: 2155919 - RNA, 16 nt, Homo sapiens
augacacuacuugaua

SEQ ID NO: 2155920 - RNA, 20 nt, Homo sapiens
aaguuuuucauacuguacac

SEQ ID NO: 2155921 - RNA, 17 nt, Homo sapiens
auuucuccgaaugucaa

SEQ ID NO: 2155922 - RNA, 16 nt, Homo sapiens
ugaucaaauauuucaa

SEQ ID NO: 2155923 - RNA, 20 nt, Homo sapiens
gaggauaugggugggagcga

SEQ ID NO: 2155924 - RNA, 23 nt, Homo sapiens
cauuuagcuuguuccacugcaaa

SEQ ID NO: 2155925 - RNA, 21 nt, Homo sapiens
ugcacaugaguggaaauacac

SEQ ID NO: 2155926 - RNA, 24 nt, Homo sapiens
ugggcacuuuuuaacauugcugau

SEQ ID NO: 2155927 - RNA, 14 nt, Homo sapiens
uacaaguuugcuaa

SEQ ID NO: 2155928 - RNA, 19 nt, Homo sapiens
aaugucauuaaacaugaca

SEQ ID NO: 2155929 - RNA, 20 nt, Homo sapiens
ucuggacagaugaauaccuu

SEQ ID NO: 2155930 - RNA, 16 nt, Homo sapiens
uccauuuucuaugcuu

SEQ ID NO: 2155931 - RNA, 11 nt, Homo sapiens
cagauucugaa

SEQ ID NO: 2155932 - RNA, 22 nt, Homo sapiens
cagacuuggacuaugauuaucu

SEQ ID NO: 2155933 - RNA, 14 nt, Homo sapiens
caaaagcaguaaau

SEQ ID NO: 2155934 - RNA, 20 nt, Homo sapiens
uggccauccuucuguguacc

SEQ ID NO: 2155935 - RNA, 17 nt, Homo sapiens
aagacugcaaacccuuu

SEQ ID NO: 2155936 - RNA, 14 nt, Homo sapiens
acagacucacaucc

SEQ ID NO: 2155937 - RNA, 23 nt, Homo sapiens
caacgaugugacugccaucaucu

SEQ ID NO: 2155938 - RNA, 18 nt, Homo sapiens
guacagguuuugcccuga

SEQ ID NO: 2155939 - RNA, 20 nt, Homo sapiens
auguagagaggagucagauu

SEQ ID NO: 2155940 - RNA, 18 nt, Homo sapiens
ugugaccaggaaggaagu

SEQ ID NO: 2155941 - RNA, 22 nt, Homo sapiens
uccccacagucuugggaucuca

SEQ ID NO: 2155942 - RNA, 17 nt, Homo sapiens
gcaggagcagcugugcu

SEQ ID NO: 2155943 - RNA, 10 nt, Homo sapiens
aaucugggag

SEQ ID NO: 2155944 - RNA, 15 nt, Homo sapiens
guauaguuguggaca

SEQ ID NO: 2155945 - RNA, 14 nt, Homo sapiens
aagcuguugcuauu

SEQ ID NO: 2155946 - RNA, 14 nt, Homo sapiens
caauuguaaugcau

SEQ ID NO: 2155947 - RNA, 23 nt, Homo sapiens
gcucaucgguggaagcagugggg

SEQ ID NO: 2155948 - RNA, 23 nt, Homo sapiens
ggaccccgggagacucaaaggga

SEQ ID NO: 2155949 - RNA, 14 nt, Homo sapiens
uaaacuagaucucc

SEQ ID NO: 2155950 - RNA, 16 nt, Homo sapiens
cuauucuauccaucuc

SEQ ID NO: 2155951 - RNA, 21 nt, Homo sapiens
aauguauuuaaccagucuucu

SEQ ID NO: 2155952 - RNA, 12 nt, Homo sapiens
ccuaaaugaugg

SEQ ID NO: 2155953 - RNA, 17 nt, Homo sapiens
ccauuccagacugcuuc

SEQ ID NO: 2155954 - RNA, 22 nt, Homo sapiens
agcugccuggaggccagaagga

SEQ ID NO: 2155955 - RNA, 20 nt, Homo sapiens
agccugguugcccagggauu

SEQ ID NO: 2155956 - RNA, 18 nt, Homo sapiens
agguuggcaaacgggcuu

SEQ ID NO: 2155957 - RNA, 12 nt, Homo sapiens
guagggcagcag

SEQ ID NO: 2155958 - RNA, 22 nt, Homo sapiens
aauauguagcucauccuuuaca

SEQ ID NO: 2155959 - RNA, 17 nt, Homo sapiens
acagggcugauacaucc

SEQ ID NO: 2155960 - RNA, 21 nt, Homo sapiens
uggcauaguggcuuaacugga

SEQ ID NO: 2155961 - RNA, 21 nt, Homo sapiens
uugcaucagcaacaaccagca

SEQ ID NO: 2155962 - RNA, 23 nt, Homo sapiens
acaguaugagucaaugugcagug

SEQ ID NO: 2155963 - RNA, 14 nt, Homo sapiens
ucagggcugugauc

SEQ ID NO: 2155964 - RNA, 13 nt, Homo sapiens
ugguacauuccau

SEQ ID NO: 2155965 - RNA, 19 nt, Homo sapiens
uaucguuaagcacaagaca

SEQ ID NO: 2155966 - RNA, 12 nt, Homo sapiens
ugccagucccag

SEQ ID NO: 2155967 - RNA, 18 nt, Homo sapiens
cuuauguaugccuauuca

SEQ ID NO: 2155968 - RNA, 17 nt, Homo sapiens
ucugggggauaagggag

SEQ ID NO: 2155969 - RNA, 23 nt, Homo sapiens
cuuuugucaauugcaccaaaaga

SEQ ID NO: 2155970 - RNA, 13 nt, Homo sapiens
cuguuacacaaag

SEQ ID NO: 2155971 - RNA, 17 nt, Homo sapiens
accugcccacccacucc

SEQ ID NO: 2155972 - RNA, 20 nt, Homo sapiens
aauggugguuguuucuucca

SEQ ID NO: 2155973 - RNA, 19 nt, Homo sapiens
caguugggacccaaaacac

SEQ ID NO: 2155974 - RNA, 15 nt, Homo sapiens
aguacuaaaucucac

SEQ ID NO: 2155975 - RNA, 20 nt, Homo sapiens
uaaaccaaugaagaagacaa

SEQ ID NO: 2155976 - RNA, 17 nt, Homo sapiens
uccauuugaaccaguga

SEQ ID NO: 2155977 - RNA, 18 nt, Homo sapiens
cuuuuacagguuaagaca

SEQ ID NO: 2155978 - RNA, 18 nt, Homo sapiens
cuugguucaguaccacau

SEQ ID NO: 2155979 - RNA, 12 nt, Homo sapiens
uauauugcagua

SEQ ID NO: 2155980 - RNA, 13 nt, Homo sapiens
accagacacucac

SEQ ID NO: 2155981 - RNA, 13 nt, Homo sapiens
gaaccuggagcca

SEQ ID NO: 2155982 - RNA, 17 nt, Homo sapiens
auuauuucaucaugacu

SEQ ID NO: 2155983 - RNA, 21 nt, Homo sapiens
agauucaaucccaggauguac

SEQ ID NO: 2155984 - RNA, 21 nt, Homo sapiens
cugucgugacuacacagaguu

SEQ ID NO: 2155985 - RNA, 23 nt, Homo sapiens
gagccacagcugugcaugcucag

SEQ ID NO: 2155986 - RNA, 20 nt, Homo sapiens
uaacacaauuaaaugacuua

SEQ ID NO: 2155987 - RNA, 22 nt, Homo sapiens
uccaauuucucuuuacuugaaa

SEQ ID NO: 2155988 - RNA, 18 nt, Homo sapiens
caagcccaauacagccau

SEQ ID NO: 2155989 - RNA, 23 nt, Homo sapiens
aacgauuuuaugaaaugaccucu

SEQ ID NO: 2155990 - RNA, 14 nt, Homo sapiens
uuugccugcaagag

SEQ ID NO: 2155991 - RNA, 18 nt, Homo sapiens
uaggcugucugugccaug

SEQ ID NO: 2155992 - RNA, 19 nt, Homo sapiens
aucagggccuuucuccucc

SEQ ID NO: 2155993 - RNA, 22 nt, Homo sapiens
gcuuugcuuaccaaaagcucag

SEQ ID NO: 2155994 - RNA, 21 nt, Homo sapiens
aaagacuacaauaaaaccaaa

SEQ ID NO: 2155995 - RNA, 22 nt, Homo sapiens
uugaugugcgugcugucugucc

SEQ ID NO: 2155996 - RNA, 23 nt, Homo sapiens
agcaacagacuucucaauaauca

SEQ ID NO: 2155997 - RNA, 21 nt, Homo sapiens
ugccuagauuagguagacuuu

SEQ ID NO: 2155998 - RNA, 14 nt, Homo sapiens
uucagaaagcaaua

SEQ ID NO: 2155999 - RNA, 16 nt, Homo sapiens
agucaucccagugcac

SEQ ID NO: 2156000 - RNA, 15 nt, Homo sapiens
uccugugguaguccu

SEQ ID NO: 2156001 - RNA, 21 nt, Homo sapiens
uucccuggaccagaugcugaa

SEQ ID NO: 2156002 - RNA, 12 nt, Homo sapiens
auucuuccucaa

SEQ ID NO: 2156003 - RNA, 20 nt, Homo sapiens
uuuccccuccuuggcuuuau

SEQ ID NO: 2156004 - RNA, 20 nt, Homo sapiens
uugaaagggacaaguaucau

SEQ ID NO: 2156005 - RNA, 13 nt, Homo sapiens
acuguugcucaaa

SEQ ID NO: 2156006 - RNA, 17 nt, Homo sapiens
accaaggauauuuacag

SEQ ID NO: 2156007 - RNA, 16 nt, Homo sapiens
aggagcacagguccca

SEQ ID NO: 2156008 - RNA, 19 nt, Homo sapiens
aguggcgugggagccagcc

SEQ ID NO: 2156009 - RNA, 22 nt, Homo sapiens
aacucaagcuucuucacucaca

SEQ ID NO: 2156010 - RNA, 21 nt, Homo sapiens
auuuuccuguugucaagaaua

SEQ ID NO: 2156011 - RNA, 16 nt, Homo sapiens
ugaaguggugugaucc

SEQ ID NO: 2156012 - RNA, 23 nt, Homo sapiens
ggucuagacuauuaggugcaauu

SEQ ID NO: 2156013 - RNA, 20 nt, Homo sapiens
caggugguggcagcaauggu

SEQ ID NO: 2156014 - RNA, 13 nt, Homo sapiens
uccccaaggcacu

SEQ ID NO: 2156015 - RNA, 16 nt, Homo sapiens
caucaguuaggauuag

SEQ ID NO: 2156016 - RNA, 19 nt, Homo sapiens
aggucucuaacauaccuug

SEQ ID NO: 2156017 - RNA, 16 nt, Homo sapiens
cuuauuuaacuuaaca

SEQ ID NO: 2156018 - RNA, 14 nt, Homo sapiens
ugcacacucuccca

SEQ ID NO: 2156019 - RNA, 18 nt, Homo sapiens
cgccaccugugaccagca

SEQ ID NO: 2156020 - RNA, 15 nt, Homo sapiens
caugaguaugugcac

SEQ ID NO: 2156021 - RNA, 16 nt, Homo sapiens
acuagcaggcaugccg

SEQ ID NO: 2156022 - RNA, 19 nt, Homo sapiens
ccagcacccccagugcagc

SEQ ID NO: 2156023 - RNA, 14 nt, Homo sapiens
auauucaaugcaag

SEQ ID NO: 2156024 - RNA, 13 nt, Homo sapiens
aacuauacuucug

SEQ ID NO: 2156025 - RNA, 18 nt, Homo sapiens
uucugacccaaccacaga

SEQ ID NO: 2156026 - RNA, 18 nt, Homo sapiens
agaaaugaugauguggaa

SEQ ID NO: 2156027 - RNA, 18 nt, Homo sapiens
cagaugauccuugcacag

SEQ ID NO: 2156028 - RNA, 12 nt, Homo sapiens
aguuuuaugaga

SEQ ID NO: 2156029 - RNA, 17 nt, Homo sapiens
gaucccgcguaguguca

SEQ ID NO: 2156030 - RNA, 21 nt, Homo sapiens
agaauguuccagacauucucg

SEQ ID NO: 2156031 - RNA, 15 nt, Homo sapiens
aagacagcauugauc

SEQ ID NO: 2156032 - RNA, 18 nt, Homo sapiens
ucugagcuucuaaacuga

SEQ ID NO: 2156033 - RNA, 19 nt, Homo sapiens
gauugugguacaaucucaa

SEQ ID NO: 2156034 - RNA, 19 nt, Homo sapiens
acucacuauauaagucaca

SEQ ID NO: 2156035 - RNA, 21 nt, Homo sapiens
ugccgccaugggaugucaaca

SEQ ID NO: 2156036 - RNA, 17 nt, Homo sapiens
aagcauggcggcaucug

SEQ ID NO: 2156037 - RNA, 19 nt, Homo sapiens
uacaccuguugcaccucag

SEQ ID NO: 2156038 - RNA, 15 nt, Homo sapiens
guuauaucuaugcaa

SEQ ID NO: 2156039 - RNA, 16 nt, Homo sapiens
ccagcagccugccagc

SEQ ID NO: 2156040 - RNA, 16 nt, Homo sapiens
gcagagaaaauuguga

SEQ ID NO: 2156041 - RNA, 21 nt, Homo sapiens
gagcgucacugcccaccaaag

SEQ ID NO: 2156042 - RNA, 15 nt, Homo sapiens
aaauguguugcccuc

SEQ ID NO: 2156043 - RNA, 18 nt, Homo sapiens
gagcccaagcuaagccau

SEQ ID NO: 2156044 - RNA, 15 nt, Homo sapiens
aaugcaaugcucagu

SEQ ID NO: 2156045 - RNA, 19 nt, Homo sapiens
uccacaauucuucugucaa

SEQ ID NO: 2156046 - RNA, 21 nt, Homo sapiens
ucaccaugaagcgaaacacag

SEQ ID NO: 2156047 - RNA, 14 nt, Homo sapiens
aggagcuuucucaa

SEQ ID NO: 2156048 - RNA, 16 nt, Homo sapiens
caguguccuccaagug

SEQ ID NO: 2156049 - RNA, 21 nt, Homo sapiens
uuccccucacuguuugcagcu

SEQ ID NO: 2156050 - RNA, 12 nt, Homo sapiens
uccugacacugc

SEQ ID NO: 2156051 - RNA, 18 nt, Homo sapiens
agcagcuuagacagcagg

SEQ ID NO: 2156052 - RNA, 15 nt, Homo sapiens
cuuggcccacacuga

SEQ ID NO: 2156053 - RNA, 20 nt, Homo sapiens
aucugccggcccccaggaca

SEQ ID NO: 2156054 - RNA, 19 nt, Homo sapiens
gauguugcuauagugacau

SEQ ID NO: 2156055 - RNA, 16 nt, Homo sapiens
agagcacaccuaucuu

SEQ ID NO: 2156056 - RNA, 18 nt, Homo sapiens
uacagauugcugcuucug

SEQ ID NO: 2156057 - RNA, 22 nt, Homo sapiens
gauguguuuugcacgucuugcu

SEQ ID NO: 2156058 - RNA, 15 nt, Homo sapiens
ugauugucaaauaca

SEQ ID NO: 2156059 - RNA, 15 nt, Homo sapiens
uucuuccacuuguaa

SEQ ID NO: 2156060 - RNA, 12 nt, Homo sapiens
cuuuuuuacacu

SEQ ID NO: 2156061 - RNA, 19 nt, Homo sapiens
guggaaugugcauucucug

SEQ ID NO: 2156062 - RNA, 13 nt, Homo sapiens
uacacccaugcac

SEQ ID NO: 2156063 - RNA, 15 nt, Homo sapiens
cuggcuuagugccac

SEQ ID NO: 2156064 - RNA, 21 nt, Homo sapiens
cugagcuuuggugcaucucau

SEQ ID NO: 2156065 - RNA, 13 nt, Homo sapiens
ggaaaagcaagaa

SEQ ID NO: 2156066 - RNA, 17 nt, Homo sapiens
uccuuuuucacuuugaa

SEQ ID NO: 2156067 - RNA, 17 nt, Homo sapiens
aacugugcuccucacuu

SEQ ID NO: 2156068 - RNA, 15 nt, Homo sapiens
cacaaaaaaggcagu

SEQ ID NO: 2156069 - RNA, 21 nt, Homo sapiens
uuuaaacagugucauauacaa

SEQ ID NO: 2156070 - RNA, 15 nt, Homo sapiens
gucuggcuaugcuca

SEQ ID NO: 2156071 - RNA, 15 nt, Homo sapiens
auucuuuuguaauau

SEQ ID NO: 2156072 - RNA, 21 nt, Homo sapiens
ggaaggaacagcaaugguguc

SEQ ID NO: 2156073 - RNA, 14 nt, Homo sapiens
gacugaagccaaag

SEQ ID NO: 2156074 - RNA, 20 nt, Homo sapiens
cagccuacuuucacacuaag

SEQ ID NO: 2156075 - RNA, 23 nt, Homo sapiens
accaucugagccgucagagcagu

SEQ ID NO: 2156076 - RNA, 20 nt, Homo sapiens
aagaacauuauucaucucuc

SEQ ID NO: 2156077 - RNA, 13 nt, Homo sapiens
ugcaaugucugag

SEQ ID NO: 2156078 - RNA, 17 nt, Homo sapiens
cccuggggaaggagcca

SEQ ID NO: 2156079 - RNA, 15 nt, Homo sapiens
auaagaggauaugaa

SEQ ID NO: 2156080 - RNA, 13 nt, Homo sapiens
gucaaagacugua

SEQ ID NO: 2156081 - RNA, 23 nt, Homo sapiens
uuucaaugaugggcgagcgugca

SEQ ID NO: 2156082 - RNA, 13 nt, Homo sapiens
gcgugagacccag

SEQ ID NO: 2156083 - RNA, 12 nt, Homo sapiens
cugacuauuuac

SEQ ID NO: 2156084 - RNA, 22 nt, Homo sapiens
gaaggaacccccucaccaccug

SEQ ID NO: 2156085 - RNA, 12 nt, Homo sapiens
gaaaugcacaau

SEQ ID NO: 2156086 - RNA, 23 nt, Homo sapiens
ggauauucccccugagcugccac

SEQ ID NO: 2156087 - RNA, 23 nt, Homo sapiens
ugugccuauagucccacuacuug

SEQ ID NO: 2156088 - RNA, 12 nt, Homo sapiens
ugauuucuugcu

SEQ ID NO: 2156089 - RNA, 20 nt, Homo sapiens
uucaaaguuuuguuguacuu

SEQ ID NO: 2156090 - RNA, 16 nt, Homo sapiens
auugauucagucuucu

SEQ ID NO: 2156091 - RNA, 19 nt, Homo sapiens
aaauuucuagucaaugugu

SEQ ID NO: 2156092 - RNA, 18 nt, Homo sapiens
guuuggaagauccuguga

SEQ ID NO: 2156093 - RNA, 12 nt, Homo sapiens
gauccagcacaa

SEQ ID NO: 2156094 - RNA, 23 nt, Homo sapiens
ccaggaccagccagaccagcaga

SEQ ID NO: 2156095 - RNA, 15 nt, Homo sapiens
gacugaaucagccca

SEQ ID NO: 2156096 - RNA, 12 nt, Homo sapiens
ggugaaaggcau

SEQ ID NO: 2156097 - RNA, 18 nt, Homo sapiens
auccaauggguuuuuccc

SEQ ID NO: 2156098 - RNA, 19 nt, Homo sapiens
auuaauggauucaguauua

SEQ ID NO: 2156099 - RNA, 14 nt, Homo sapiens
caagugccaaacag

SEQ ID NO: 2156100 - RNA, 17 nt, Homo sapiens
aauguaacaugaagcaa

SEQ ID NO: 2156101 - RNA, 19 nt, Homo sapiens
cagcugaccagacacugcc

SEQ ID NO: 2156102 - RNA, 21 nt, Homo sapiens
gagugagcacacccgugugca

SEQ ID NO: 2156103 - RNA, 14 nt, Homo sapiens
caaacuuugcauua

SEQ ID NO: 2156104 - RNA, 16 nt, Homo sapiens
ucacuauguuacaugu

SEQ ID NO: 2156105 - RNA, 16 nt, Homo sapiens
agaacagaggcauuua

SEQ ID NO: 2156106 - RNA, 14 nt, Homo sapiens
ccuguguacaacuu

SEQ ID NO: 2156107 - RNA, 14 nt, Homo sapiens
aauuuauucuuggu

SEQ ID NO: 2156108 - RNA, 21 nt, Homo sapiens
aauagguuuguaaaaugcacc

SEQ ID NO: 2156109 - RNA, 11 nt, Homo sapiens
aacacacuggc

SEQ ID NO: 2156110 - RNA, 14 nt, Homo sapiens
augacuugacaagu

SEQ ID NO: 2156111 - RNA, 20 nt, Homo sapiens
aacuuggggauggcugaggg

SEQ ID NO: 2156112 - RNA, 12 nt, Homo sapiens
auaagcuccuau

SEQ ID NO: 2156113 - RNA, 15 nt, Homo sapiens
uguauucugugauaa

SEQ ID NO: 2156114 - RNA, 21 nt, Homo sapiens
uacccauuuuuuaaaaaagca

SEQ ID NO: 2156115 - RNA, 22 nt, Homo sapiens
aacguacauuugugcuguuuuc

SEQ ID NO: 2156116 - RNA, 23 nt, Homo sapiens
aaaaugaaaauucuaacccaaga

SEQ ID NO: 2156117 - RNA, 23 nt, Homo sapiens
ucaaucuugccgucacuauucau

SEQ ID NO: 2156118 - RNA, 16 nt, Homo sapiens
ugcauaagaaauguag

SEQ ID NO: 2156119 - RNA, 16 nt, Homo sapiens
ucacucugaauccuca

SEQ ID NO: 2156120 - RNA, 12 nt, Homo sapiens
aaaaucuuggau

SEQ ID NO: 2156121 - RNA, 18 nt, Homo sapiens
uugaaacccauuaggcau

SEQ ID NO: 2156122 - RNA, 14 nt, Homo sapiens
gacgacaagugcug

SEQ ID NO: 2156123 - RNA, 20 nt, Homo sapiens
agcaaauaaaugaacugacu

SEQ ID NO: 2156124 - RNA, 23 nt, Homo sapiens
ccuuaaaugaaaaaaaugaucua

SEQ ID NO: 2156125 - RNA, 15 nt, Homo sapiens
auaaacuucagggau

SEQ ID NO: 2156126 - RNA, 15 nt, Homo sapiens
auggaauucaaagcu

SEQ ID NO: 2156127 - RNA, 19 nt, Homo sapiens
ggacacauaguguuuguaa

SEQ ID NO: 2156128 - RNA, 19 nt, Homo sapiens
ugagccucuuuaacagcuu

SEQ ID NO: 2156129 - RNA, 18 nt, Homo sapiens
cugauagcucugccuuac

SEQ ID NO: 2156130 - RNA, 20 nt, Homo sapiens
ggagaagacuucuuugcaac

SEQ ID NO: 2156131 - RNA, 14 nt, Homo sapiens
cucagcaacuuucc

SEQ ID NO: 2156132 - RNA, 16 nt, Homo sapiens
gaauauggcaauagca

SEQ ID NO: 2156133 - RNA, 12 nt, Homo sapiens
uaauagauuuaa

SEQ ID NO: 2156134 - RNA, 21 nt, Homo sapiens
accugaaggacagcugaaccc

SEQ ID NO: 2156135 - RNA, 21 nt, Homo sapiens
ccuguacuuuucccauuugua

SEQ ID NO: 2156136 - RNA, 19 nt, Homo sapiens
uuuaacauuguugauuuca

SEQ ID NO: 2156137 - RNA, 16 nt, Homo sapiens
aguaguuguuggucug

SEQ ID NO: 2156138 - RNA, 12 nt, Homo sapiens
uugacugcauug

SEQ ID NO: 2156139 - RNA, 18 nt, Homo sapiens
aagugugucucaaaaaua

SEQ ID NO: 2156140 - RNA, 17 nt, Homo sapiens
uuacaaaaaaauacaaa

SEQ ID NO: 2156141 - RNA, 14 nt, Homo sapiens
accucuacuuucca

SEQ ID NO: 2156142 - RNA, 16 nt, Homo sapiens
aucagucauaacuaaa

SEQ ID NO: 2156143 - RNA, 12 nt, Homo sapiens
uaaugaacuuua

SEQ ID NO: 2156144 - RNA, 12 nt, Homo sapiens
uaaagaacuuuu

SEQ ID NO: 2156145 - RNA, 23 nt, Homo sapiens
aaugucugauuuaacacuaucca

SEQ ID NO: 2156146 - RNA, 20 nt, Homo sapiens
ucauauaccagcaauauauc

SEQ ID NO: 2156147 - RNA, 19 nt, Homo sapiens
ggcugccccaaccugcuga

SEQ ID NO: 2156148 - RNA, 14 nt, Homo sapiens
auuuuaaguacuuu

SEQ ID NO: 2156149 - RNA, 15 nt, Homo sapiens
cagcuguccugucag

SEQ ID NO: 2156150 - RNA, 19 nt, Homo sapiens
caucuagcaagcacuugau

SEQ ID NO: 2156151 - RNA, 21 nt, Homo sapiens
ggugccuuuauuuccacugug

SEQ ID NO: 2156152 - RNA, 13 nt, Homo sapiens
cagcgccaccucu

SEQ ID NO: 2156153 - RNA, 22 nt, Homo sapiens
ucuccaaaugagacacauuaaa

SEQ ID NO: 2156154 - RNA, 14 nt, Homo sapiens
cuauaccaacaucu

SEQ ID NO: 2156155 - RNA, 14 nt, Homo sapiens
cacagggacacagu

SEQ ID NO: 2156156 - RNA, 19 nt, Homo sapiens
cugagccgaucuggucucg

SEQ ID NO: 2156157 - RNA, 16 nt, Homo sapiens
aacucuguaaaaccuc

SEQ ID NO: 2156158 - RNA, 18 nt, Homo sapiens
aagaggcauucagcaauu

SEQ ID NO: 2156159 - RNA, 14 nt, Homo sapiens
agggcagauucaag

SEQ ID NO: 2156160 - RNA, 21 nt, Homo sapiens
uuugacaagguucccaagaca

SEQ ID NO: 2156161 - RNA, 15 nt, Homo sapiens
cagaggugucaucca

SEQ ID NO: 2156162 - RNA, 15 nt, Homo sapiens
gccugcucugugagc

SEQ ID NO: 2156163 - RNA, 23 nt, Homo sapiens
acuugaacccgggggacagaggu

SEQ ID NO: 2156164 - RNA, 17 nt, Homo sapiens
gcaaagaucuguccuca

SEQ ID NO: 2156165 - RNA, 16 nt, Homo sapiens
aacgucuuuuuauauc

SEQ ID NO: 2156166 - RNA, 13 nt, Homo sapiens
auggugagcucug

SEQ ID NO: 2156167 - RNA, 18 nt, Homo sapiens
caguacacccaguugcca

SEQ ID NO: 2156168 - RNA, 12 nt, Homo sapiens
aaaauuucaguc

SEQ ID NO: 2156169 - RNA, 18 nt, Homo sapiens
gacaucucaggggccaga

SEQ ID NO: 2156170 - RNA, 13 nt, Homo sapiens
cacuccauuccca

SEQ ID NO: 2156171 - RNA, 14 nt, Homo sapiens
gcucagugaucuca

SEQ ID NO: 2156172 - RNA, 22 nt, Homo sapiens
gagccccuccucccccggcugg

SEQ ID NO: 2156173 - RNA, 22 nt, Homo sapiens
gucaaguuggguucacuugcca

SEQ ID NO: 2156174 - RNA, 12 nt, Homo sapiens
agacuagccacu

SEQ ID NO: 2156175 - RNA, 19 nt, Homo sapiens
uaagagcauagaacucaaa

SEQ ID NO: 2156176 - RNA, 20 nt, Homo sapiens
auuuagaaaaagaacaugca

SEQ ID NO: 2156177 - RNA, 20 nt, Homo sapiens
agcgaguuuucugaccagcu

SEQ ID NO: 2156178 - RNA, 19 nt, Homo sapiens
cacugagacuagauucuca

SEQ ID NO: 2156179 - RNA, 10 nt, Homo sapiens
ggguucaagc

SEQ ID NO: 2156180 - RNA, 16 nt, Homo sapiens
uaagaaaauacauaag

SEQ ID NO: 2156181 - RNA, 21 nt, Homo sapiens
ccaaauauugugcacauuuaa

SEQ ID NO: 2156182 - RNA, 14 nt, Homo sapiens
agaauucacugagu

SEQ ID NO: 2156183 - RNA, 15 nt, Homo sapiens
agaaaacacaaccug

SEQ ID NO: 2156184 - RNA, 14 nt, Homo sapiens
acuucacuuccauu

SEQ ID NO: 2156185 - RNA, 22 nt, Homo sapiens
uggugcguuuauaauuggcuua

SEQ ID NO: 2156186 - RNA, 21 nt, Homo sapiens
guagaaaauaaaacugagcua

SEQ ID NO: 2156187 - RNA, 20 nt, Homo sapiens
cccucauuacugccaacagu

SEQ ID NO: 2156188 - RNA, 18 nt, Homo sapiens
agccacugucacaggcau

SEQ ID NO: 2156189 - RNA, 16 nt, Homo sapiens
ccugugaagcugaaaa

SEQ ID NO: 2156190 - RNA, 21 nt, Homo sapiens
guaccaaaucugacauauuau

SEQ ID NO: 2156191 - RNA, 16 nt, Homo sapiens
uauacagugaagagua

SEQ ID NO: 2156192 - RNA, 13 nt, Homo sapiens
aucuacccaccuc

SEQ ID NO: 2156193 - RNA, 14 nt, Homo sapiens
cucccaccaccagu

SEQ ID NO: 2156194 - RNA, 18 nt, Homo sapiens
ugguguagcuacagagaa

SEQ ID NO: 2156195 - RNA, 18 nt, Homo sapiens
ccuaucagaagcucccag

SEQ ID NO: 2156196 - RNA, 19 nt, Homo sapiens
auauauagaaggacugcag

SEQ ID NO: 2156197 - RNA, 13 nt, Homo sapiens
cugcuccuacauc

SEQ ID NO: 2156198 - RNA, 15 nt, Homo sapiens
uggagcagaaagcca

SEQ ID NO: 2156199 - RNA, 23 nt, Homo sapiens
uguaucccgcuguaauucccaaa

SEQ ID NO: 2156200 - RNA, 15 nt, Homo sapiens
uauuuuuucuugaca

SEQ ID NO: 2156201 - RNA, 15 nt, Homo sapiens
aucaggacugugacc

SEQ ID NO: 2156202 - RNA, 20 nt, Homo sapiens
ugugcuaaccucacugccuc

SEQ ID NO: 2156203 - RNA, 23 nt, Homo sapiens
uauuuaaucaaacaguaaucuag

SEQ ID NO: 2156204 - RNA, 14 nt, Homo sapiens
gauagcuacuguag

SEQ ID NO: 2156205 - RNA, 19 nt, Homo sapiens
agcugcccacaacuugcca

SEQ ID NO: 2156206 - RNA, 17 nt, Homo sapiens
gcccuggcaugucaaca

SEQ ID NO: 2156207 - RNA, 22 nt, Homo sapiens
accucugucauuuguugugaug

SEQ ID NO: 2156208 - RNA, 22 nt, Homo sapiens
guagaacagauaaucagugugu

SEQ ID NO: 2156209 - RNA, 21 nt, Homo sapiens
cucagcucccauuucuacucu

SEQ ID NO: 2156210 - RNA, 21 nt, Homo sapiens
accaucuuggcucacugcaac

SEQ ID NO: 2156211 - RNA, 13 nt, Homo sapiens
gaugccuguugaa

SEQ ID NO: 2156212 - RNA, 21 nt, Homo sapiens
cuuucccccuucccgccuucc

SEQ ID NO: 2156213 - RNA, 14 nt, Homo sapiens
aauacuacuuucuc

SEQ ID NO: 2156214 - RNA, 15 nt, Homo sapiens
accuggcaagucaca

SEQ ID NO: 2156215 - RNA, 15 nt, Homo sapiens
accaggaacccagcg

SEQ ID NO: 2156216 - RNA, 15 nt, Homo sapiens
aauauggacauauca

SEQ ID NO: 2156217 - RNA, 21 nt, Homo sapiens
uugaaaaaaagggcacucuga

SEQ ID NO: 2156218 - RNA, 15 nt, Homo sapiens
aaauccuaccaaagu

SEQ ID NO: 2156219 - RNA, 18 nt, Homo sapiens
acccagucccacacugug

SEQ ID NO: 2156220 - RNA, 16 nt, Homo sapiens
agaggggcggggccag

SEQ ID NO: 2156221 - RNA, 23 nt, Homo sapiens
ccuccagcaggguauggccagcu

SEQ ID NO: 2156222 - RNA, 17 nt, Homo sapiens
uuuucuuuuuuaucuug

SEQ ID NO: 2156223 - RNA, 14 nt, Homo sapiens
agacagggucucac

SEQ ID NO: 2156224 - RNA, 16 nt, Homo sapiens
uuaugcaggcagauua

SEQ ID NO: 2156225 - RNA, 12 nt, Homo sapiens
aaauuggacuua

SEQ ID NO: 2156226 - RNA, 19 nt, Homo sapiens
uacuuauauccacacugca

SEQ ID NO: 2156227 - RNA, 22 nt, Homo sapiens
gacacucaagucccccaagacc

SEQ ID NO: 2156228 - RNA, 17 nt, Homo sapiens
uagaaagugaggcucag

SEQ ID NO: 2156229 - RNA, 17 nt, Homo sapiens
guuuuauaaaagccuug

SEQ ID NO: 2156230 - RNA, 13 nt, Homo sapiens
uguauaauaugca

SEQ ID NO: 2156231 - RNA, 21 nt, Homo sapiens
acaagauggcgaccaccaaag

SEQ ID NO: 2156232 - RNA, 15 nt, Homo sapiens
gccuggccaccagcu

SEQ ID NO: 2156233 - RNA, 18 nt, Homo sapiens
gaccuagaccugggccaa

SEQ ID NO: 2156234 - RNA, 17 nt, Homo sapiens
ugggugggcacacugaa

SEQ ID NO: 2156235 - RNA, 23 nt, Homo sapiens
gagcagccagcaaguaagcuagc

SEQ ID NO: 2156236 - RNA, 20 nt, Homo sapiens
gcaggcuguuuauauguuca

SEQ ID NO: 2156237 - RNA, 19 nt, Homo sapiens
gguaucugcugccucugaa

SEQ ID NO: 2156238 - RNA, 19 nt, Homo sapiens
uuggaaucuaacgggcauu

SEQ ID NO: 2156239 - RNA, 12 nt, Homo sapiens
ucuuccuuucau

SEQ ID NO: 2156240 - RNA, 17 nt, Homo sapiens
gcugcuucuauguuuca

SEQ ID NO: 2156241 - RNA, 22 nt, Homo sapiens
auguuccagugaggaacccuga

SEQ ID NO: 2156242 - RNA, 14 nt, Homo sapiens
agagaguuaaguga

SEQ ID NO: 2156243 - RNA, 23 nt, Homo sapiens
aagagaucacaauacucaaaaga

SEQ ID NO: 2156244 - RNA, 15 nt, Homo sapiens
gaacaauaaaauguc

SEQ ID NO: 2156245 - RNA, 20 nt, Homo sapiens
ugagcagcuuuagcaaagaa

SEQ ID NO: 2156246 - RNA, 17 nt, Homo sapiens
caguaaagagauuaauu

SEQ ID NO: 2156247 - RNA, 22 nt, Homo sapiens
ggcaggcucacugccaggccag

SEQ ID NO: 2156248 - RNA, 19 nt, Homo sapiens
auuguuuggaccugcauau

SEQ ID NO: 2156249 - RNA, 22 nt, Homo sapiens
gaauaggucauuuucuauucac

SEQ ID NO: 2156250 - RNA, 18 nt, Homo sapiens
cugcuuccgguagggagg

SEQ ID NO: 2156251 - RNA, 15 nt, Homo sapiens
agcccaacagcacuu

SEQ ID NO: 2156252 - RNA, 19 nt, Homo sapiens
uguuauuugcacacugcac

SEQ ID NO: 2156253 - RNA, 13 nt, Homo sapiens
acaaccuaugcac

SEQ ID NO: 2156254 - RNA, 19 nt, Homo sapiens
acuuugagcugagugcuga

SEQ ID NO: 2156255 - RNA, 18 nt, Homo sapiens
ccaauguuguguguugca

SEQ ID NO: 2156256 - RNA, 19 nt, Homo sapiens
caacaaacuucaaggguuu

SEQ ID NO: 2156257 - RNA, 12 nt, Homo sapiens
gggccuugcuga

SEQ ID NO: 2156258 - RNA, 14 nt, Homo sapiens
uuaccuccuaucag

SEQ ID NO: 2156259 - RNA, 14 nt, Homo sapiens
auccacaugcucug

SEQ ID NO: 2156260 - RNA, 20 nt, Homo sapiens
cauuaagccucuugucuaca

SEQ ID NO: 2156261 - RNA, 13 nt, Homo sapiens
ucucucuuuauac

SEQ ID NO: 2156262 - RNA, 17 nt, Homo sapiens
ccugaugcgucuaccca

SEQ ID NO: 2156263 - RNA, 15 nt, Homo sapiens
auauguaaacaguga

SEQ ID NO: 2156264 - RNA, 16 nt, Homo sapiens
aaagcuuugugcagau

SEQ ID NO: 2156265 - RNA, 15 nt, Homo sapiens
gccgggccaugauuc

SEQ ID NO: 2156266 - RNA, 19 nt, Homo sapiens
aaacaagcaaugggcaaug

SEQ ID NO: 2156267 - RNA, 22 nt, Homo sapiens
acuuagaccaaaagcaacauuc

SEQ ID NO: 2156268 - RNA, 14 nt, Homo sapiens
aagcucuuguggua

SEQ ID NO: 2156269 - RNA, 20 nt, Homo sapiens
agaggaccaaugcuugcaug

SEQ ID NO: 2156270 - RNA, 12 nt, Homo sapiens
agccauguguau

SEQ ID NO: 2156271 - RNA, 22 nt, Homo sapiens
uaucugugaaaugcuggcauuu

SEQ ID NO: 2156272 - RNA, 17 nt, Homo sapiens
auaaaagcauugucucu

SEQ ID NO: 2156273 - RNA, 14 nt, Homo sapiens
agcccuuccuccca

SEQ ID NO: 2156274 - RNA, 14 nt, Homo sapiens
cuuuguucaguuga

SEQ ID NO: 2156275 - RNA, 22 nt, Homo sapiens
uugacuagaugauggaugccaa

SEQ ID NO: 2156276 - RNA, 23 nt, Homo sapiens
ugacuuugaacacaucucuuagu

SEQ ID NO: 2156277 - RNA, 21 nt, Homo sapiens
caucugaaaguagagguugua

SEQ ID NO: 2156278 - RNA, 15 nt, Homo sapiens
uggcaugugcaggua

SEQ ID NO: 2156279 - RNA, 12 nt, Homo sapiens
aaaacuuccuag

SEQ ID NO: 2156280 - RNA, 16 nt, Homo sapiens
ucuaucauuaaaguuc

SEQ ID NO: 2156281 - RNA, 21 nt, Homo sapiens
ugucuaaggaaugauccaaua

SEQ ID NO: 2156282 - RNA, 18 nt, Homo sapiens
gaucugcaguuuuugccu

SEQ ID NO: 2156283 - RNA, 18 nt, Homo sapiens
aggaagacccugccauuc

SEQ ID NO: 2156284 - RNA, 13 nt, Homo sapiens
acuauauacaucu

SEQ ID NO: 2156285 - RNA, 21 nt, Homo sapiens
guucuuuugacugaagucuga

SEQ ID NO: 2156286 - RNA, 18 nt, Homo sapiens
uaaguucauucaugccaa

SEQ ID NO: 2156287 - RNA, 16 nt, Homo sapiens
cugccccagccuccuc

SEQ ID NO: 2156288 - RNA, 14 nt, Homo sapiens
cagcaaacuuggug

SEQ ID NO: 2156289 - RNA, 15 nt, Homo sapiens
ucuuaccagguucac

SEQ ID NO: 2156290 - RNA, 15 nt, Homo sapiens
ugcacccagccaaac

SEQ ID NO: 2156291 - RNA, 16 nt, Homo sapiens
auauuaguuguauaua

SEQ ID NO: 2156292 - RNA, 22 nt, Homo sapiens
auaugugaaaggauaugaaucu

SEQ ID NO: 2156293 - RNA, 20 nt, Homo sapiens
cuuuugccccagaaagggga

SEQ ID NO: 2156294 - RNA, 17 nt, Homo sapiens
ccuugcuuccuucucau

SEQ ID NO: 2156295 - RNA, 17 nt, Homo sapiens
ucagacuccuagacuca

SEQ ID NO: 2156296 - RNA, 17 nt, Homo sapiens
ucuagcauuuagaucua

SEQ ID NO: 2156297 - RNA, 18 nt, Homo sapiens
caccucuugucagugcuc

SEQ ID NO: 2156298 - RNA, 19 nt, Homo sapiens
cagaugauucaaauaucaa

SEQ ID NO: 2156299 - RNA, 20 nt, Homo sapiens
accguccucagcaguccaca

SEQ ID NO: 2156300 - RNA, 13 nt, Homo sapiens
auggcaucuucaa

SEQ ID NO: 2156301 - RNA, 21 nt, Homo sapiens
acuggcaauaaacuccuacua

SEQ ID NO: 2156302 - RNA, 23 nt, Homo sapiens
aaugucuugcuguugacauauuu

SEQ ID NO: 2156303 - RNA, 13 nt, Homo sapiens
uaguacaauagua

SEQ ID NO: 2156304 - RNA, 13 nt, Homo sapiens
aaacacaaaaaca

SEQ ID NO: 2156305 - RNA, 19 nt, Homo sapiens
uggccuaccccuuucucca

SEQ ID NO: 2156306 - RNA, 13 nt, Homo sapiens
acagucuaaaaau

SEQ ID NO: 2156307 - RNA, 23 nt, Homo sapiens
aaauucucagucaugcacucaca

SEQ ID NO: 2156308 - RNA, 17 nt, Homo sapiens
caacaugugcucaggga

SEQ ID NO: 2156309 - RNA, 20 nt, Homo sapiens
cacaaggcugaccaagagag

SEQ ID NO: 2156310 - RNA, 12 nt, Homo sapiens
aauaaaagcuau

SEQ ID NO: 2156311 - RNA, 16 nt, Homo sapiens
ccaccccuguccagau

SEQ ID NO: 2156312 - RNA, 15 nt, Homo sapiens
uugugguccaaauag

SEQ ID NO: 2156313 - RNA, 18 nt, Homo sapiens
auguacuaaaucuaauca

SEQ ID NO: 2156314 - RNA, 21 nt, Homo sapiens
uaauuuuuguauuuuggcaga

SEQ ID NO: 2156315 - RNA, 21 nt, Homo sapiens
ccaggaauuagagaagcugaa

SEQ ID NO: 2156316 - RNA, 12 nt, Homo sapiens
ugcacgugugua

SEQ ID NO: 2156317 - RNA, 22 nt, Homo sapiens
caguuggauucagaaccaagac

SEQ ID NO: 2156318 - RNA, 15 nt, Homo sapiens
ugccucaaaauugug

SEQ ID NO: 2156319 - RNA, 14 nt, Homo sapiens
ugaaaaucuaauau

SEQ ID NO: 2156320 - RNA, 22 nt, Homo sapiens
aagugucaccccucacugugac

SEQ ID NO: 2156321 - RNA, 17 nt, Homo sapiens
aagcugagaagaaugaa

SEQ ID NO: 2156322 - RNA, 12 nt, Homo sapiens
augucuuuccac

SEQ ID NO: 2156323 - RNA, 13 nt, Homo sapiens
gcaggaugcuaau

SEQ ID NO: 2156324 - RNA, 21 nt, Homo sapiens
gcucagcuagacauugcaauu

SEQ ID NO: 2156325 - RNA, 23 nt, Homo sapiens
ugaaaugacuuuuccauucuccu

SEQ ID NO: 2156326 - RNA, 15 nt, Homo sapiens
uuggcuuccaugaug

SEQ ID NO: 2156327 - RNA, 17 nt, Homo sapiens
accaauaaagccuucaa

SEQ ID NO: 2156328 - RNA, 16 nt, Homo sapiens
uacaguagaaggagau

SEQ ID NO: 2156329 - RNA, 13 nt, Homo sapiens
gauacugcugagu

SEQ ID NO: 2156330 - RNA, 15 nt, Homo sapiens
aaucuaaguuuuaaa

SEQ ID NO: 2156331 - RNA, 12 nt, Homo sapiens
gcaaagagccag

SEQ ID NO: 2156332 - RNA, 20 nt, Homo sapiens
uucuccaucucucuggcccu

SEQ ID NO: 2156333 - RNA, 12 nt, Homo sapiens
uuucauuucuca

SEQ ID NO: 2156334 - RNA, 15 nt, Homo sapiens
cacuagccugugauu

SEQ ID NO: 2156335 - RNA, 15 nt, Homo sapiens
auaaaggacaggcca

SEQ ID NO: 2156336 - RNA, 14 nt, Homo sapiens
gacacccucaccac

SEQ ID NO: 2156337 - RNA, 14 nt, Homo sapiens
gccacucuccccau

SEQ ID NO: 2156338 - RNA, 14 nt, Homo sapiens
cuuccacuguuaaa

SEQ ID NO: 2156339 - RNA, 12 nt, Homo sapiens
ucaucaggccau

SEQ ID NO: 2156340 - RNA, 15 nt, Homo sapiens
aguacagacgucuca

SEQ ID NO: 2156341 - RNA, 18 nt, Homo sapiens
gauggcaggugccuguaa

SEQ ID NO: 2156342 - RNA, 19 nt, Homo sapiens
acaaugacauuuauaucac

SEQ ID NO: 2156343 - RNA, 17 nt, Homo sapiens
augcuuuuacuaagcac

SEQ ID NO: 2156344 - RNA, 19 nt, Homo sapiens
auucucuuguuauugcauc

SEQ ID NO: 2156345 - RNA, 21 nt, Homo sapiens
ggccccagacgcauagacuga

SEQ ID NO: 2156346 - RNA, 20 nt, Homo sapiens
gggauccagcucaagggagu

SEQ ID NO: 2156347 - RNA, 21 nt, Homo sapiens
cuucuucaagauuuauggaaa

SEQ ID NO: 2156348 - RNA, 19 nt, Homo sapiens
cagaaacaaaucucaaagu

SEQ ID NO: 2156349 - RNA, 13 nt, Homo sapiens
acuucuguuccag

SEQ ID NO: 2156350 - RNA, 23 nt, Homo sapiens
aauaacaucucuuucaucuagcu

SEQ ID NO: 2156351 - RNA, 18 nt, Homo sapiens
ccuaguauacccacugca

SEQ ID NO: 2156352 - RNA, 16 nt, Homo sapiens
gugugcagacugaugg

SEQ ID NO: 2156353 - RNA, 13 nt, Homo sapiens
acuuuuugcagcu

SEQ ID NO: 2156354 - RNA, 12 nt, Homo sapiens
caagaucuccaa

SEQ ID NO: 2156355 - RNA, 20 nt, Homo sapiens
gauucagagcuuucaaggau

SEQ ID NO: 2156356 - RNA, 22 nt, Homo sapiens
gccaaugaaucaaugugcuccu

SEQ ID NO: 2156357 - RNA, 20 nt, Homo sapiens
aagcaauuagguagcacagc

SEQ ID NO: 2156358 - RNA, 18 nt, Homo sapiens
agaguauuaucacugcug

SEQ ID NO: 2156359 - RNA, 19 nt, Homo sapiens
ucagacauuuucacuggaa

SEQ ID NO: 2156360 - RNA, 14 nt, Homo sapiens
agguaguuagcuuc

SEQ ID NO: 2156361 - RNA, 18 nt, Homo sapiens
agaucacgccacugcacu

SEQ ID NO: 2156362 - RNA, 23 nt, Homo sapiens
augcaagugcuaugccaagccau

SEQ ID NO: 2156363 - RNA, 15 nt, Homo sapiens
auuuuuacaucaaaa

SEQ ID NO: 2156364 - RNA, 20 nt, Homo sapiens
caaaauucuaaaaauuugca

SEQ ID NO: 2156365 - RNA, 12 nt, Homo sapiens
gugcuugaucua

SEQ ID NO: 2156366 - RNA, 20 nt, Homo sapiens
gaggauggcuugaggccaga

SEQ ID NO: 2156367 - RNA, 20 nt, Homo sapiens
guauuuuguuuuugucuuaa

SEQ ID NO: 2156368 - RNA, 18 nt, Homo sapiens
cuguccugaucugugaua

SEQ ID NO: 2156369 - RNA, 20 nt, Homo sapiens
agugaacauuacauugccau

SEQ ID NO: 2156370 - RNA, 20 nt, Homo sapiens
auggaaugcuugcagagcau

SEQ ID NO: 2156371 - RNA, 22 nt, Homo sapiens
agaacaagucggcuguggagau

SEQ ID NO: 2156372 - RNA, 12 nt, Homo sapiens
cucuucuggaau

SEQ ID NO: 2156373 - RNA, 14 nt, Homo sapiens
ucauggugaugcaa

SEQ ID NO: 2156374 - RNA, 15 nt, Homo sapiens
uuuccaucccuagcc

SEQ ID NO: 2156375 - RNA, 16 nt, Homo sapiens
ccuggcacaggacuga

SEQ ID NO: 2156376 - RNA, 21 nt, Homo sapiens
acucuuaaguuucucagcucc

SEQ ID NO: 2156377 - RNA, 21 nt, Homo sapiens
agcuggaacacucucugagau

SEQ ID NO: 2156378 - RNA, 20 nt, Homo sapiens
cagaaggcuacauauacaua

SEQ ID NO: 2156379 - RNA, 23 nt, Homo sapiens
ccuuaagcaugcuucuauuaguc

SEQ ID NO: 2156380 - RNA, 19 nt, Homo sapiens
caccuccuucucugucuca

SEQ ID NO: 2156381 - RNA, 12 nt, Homo sapiens
gccuaccucucg

SEQ ID NO: 2156382 - RNA, 17 nt, Homo sapiens
acucuuccacauuccca

SEQ ID NO: 2156383 - RNA, 22 nt, Homo sapiens
aacuucuuauacgucuagccua

SEQ ID NO: 2156384 - RNA, 22 nt, Homo sapiens
uacaaagccacccuaccaugaa

SEQ ID NO: 2156385 - RNA, 22 nt, Homo sapiens
augcugaauguacacugauucc

SEQ ID NO: 2156386 - RNA, 15 nt, Homo sapiens
aauguaaagccaugc

SEQ ID NO: 2156387 - RNA, 23 nt, Homo sapiens
gauuacauccguaggacaaguuu

SEQ ID NO: 2156388 - RNA, 11 nt, Homo sapiens
accugagcuuu

SEQ ID NO: 2156389 - RNA, 17 nt, Homo sapiens
caugggaaugaauguca

SEQ ID NO: 2156390 - RNA, 14 nt, Homo sapiens
ggaccccagggugg

SEQ ID NO: 2156391 - RNA, 13 nt, Homo sapiens
cauugaauuugcc

SEQ ID NO: 2156392 - RNA, 18 nt, Homo sapiens
cuuucauccaacucuaaa

SEQ ID NO: 2156393 - RNA, 21 nt, Homo sapiens
gguccccugcccugucuuucc

SEQ ID NO: 2156394 - RNA, 16 nt, Homo sapiens
cuccgcuaaggcuucc

SEQ ID NO: 2156395 - RNA, 15 nt, Homo sapiens
uuccacugucucauc

SEQ ID NO: 2156396 - RNA, 17 nt, Homo sapiens
cacauuauguaucuuag

SEQ ID NO: 2156397 - RNA, 22 nt, Homo sapiens
agccauuucacucucaaacuuc

SEQ ID NO: 2156398 - RNA, 20 nt, Homo sapiens
aauuaaagucuuccauugca

SEQ ID NO: 2156399 - RNA, 14 nt, Homo sapiens
gucucccuuaccuc

SEQ ID NO: 2156400 - RNA, 17 nt, Homo sapiens
ccucuuuuuucuuguca

SEQ ID NO: 2156401 - RNA, 12 nt, Homo sapiens
acagcacuccug

SEQ ID NO: 2156402 - RNA, 19 nt, Homo sapiens
auucagaaggaucuucauc

SEQ ID NO: 2156403 - RNA, 22 nt, Homo sapiens
ccugugcccacccgucuucaau

SEQ ID NO: 2156404 - RNA, 15 nt, Homo sapiens
ugagaaucagacuga

SEQ ID NO: 2156405 - RNA, 20 nt, Homo sapiens
aaguucaccagcaugguagu

SEQ ID NO: 2156406 - RNA, 15 nt, Homo sapiens
ugaaaagaaggaaua

SEQ ID NO: 2156407 - RNA, 22 nt, Homo sapiens
cuuuaacucugcggauagcauu

SEQ ID NO: 2156408 - RNA, 17 nt, Homo sapiens
ucccagccguggucaac

SEQ ID NO: 2156409 - RNA, 14 nt, Homo sapiens
ugccuuauuaccca

SEQ ID NO: 2156410 - RNA, 14 nt, Homo sapiens
agggaaaguuaaaa

SEQ ID NO: 2156411 - RNA, 11 nt, Homo sapiens
agagccaguga

SEQ ID NO: 2156412 - RNA, 13 nt, Homo sapiens
ccaggagcucucu

SEQ ID NO: 2156413 - RNA, 22 nt, Homo sapiens
uaccuuaaaauguaaaacaaaa

SEQ ID NO: 2156414 - RNA, 19 nt, Homo sapiens
gcuugguuuccucaccuug

SEQ ID NO: 2156415 - RNA, 19 nt, Homo sapiens
cuucuuuaccuucauuuca

SEQ ID NO: 2156416 - RNA, 22 nt, Homo sapiens
ugaguggccagccagugccauu

SEQ ID NO: 2156417 - RNA, 13 nt, Homo sapiens
caacaucuaguga

SEQ ID NO: 2156418 - RNA, 21 nt, Homo sapiens
cagcccucccuggcugugagc

SEQ ID NO: 2156419 - RNA, 13 nt, Homo sapiens
gcuuugcagugaa

SEQ ID NO: 2156420 - RNA, 22 nt, Homo sapiens
aucugcuguuccuucgaggguu

SEQ ID NO: 2156421 - RNA, 21 nt, Homo sapiens
uacaugagaaggaacuuccag

SEQ ID NO: 2156422 - RNA, 11 nt, Homo sapiens
uggcagggaua

SEQ ID NO: 2156423 - RNA, 21 nt, Homo sapiens
aaugauguugauaauuucagg

SEQ ID NO: 2156424 - RNA, 12 nt, Homo sapiens
uucuuauggaag

SEQ ID NO: 2156425 - RNA, 22 nt, Homo sapiens
ccagcccggggcaggugcagcc

SEQ ID NO: 2156426 - RNA, 18 nt, Homo sapiens
agugcagcugcugugccu

SEQ ID NO: 2156427 - RNA, 11 nt, Homo sapiens
auacaguauuu

SEQ ID NO: 2156428 - RNA, 11 nt, Homo sapiens
uuucaguaaua

SEQ ID NO: 2156429 - RNA, 22 nt, Homo sapiens
uaaucaaagauugaacacugcg

SEQ ID NO: 2156430 - RNA, 13 nt, Homo sapiens
cauuacuacugua

SEQ ID NO: 2156431 - RNA, 16 nt, Homo sapiens
gaaaaacaagucuuua

SEQ ID NO: 2156432 - RNA, 19 nt, Homo sapiens
aggcaggaggauccccuga

SEQ ID NO: 2156433 - RNA, 17 nt, Homo sapiens
augggauuacauguuau

SEQ ID NO: 2156434 - RNA, 22 nt, Homo sapiens
gaaaaauaaucuuagaacagau

SEQ ID NO: 2156435 - RNA, 20 nt, Homo sapiens
cacagccagacuugcuuccu

SEQ ID NO: 2156436 - RNA, 20 nt, Homo sapiens
aaccugcacguugugcacau

SEQ ID NO: 2156437 - RNA, 13 nt, Homo sapiens
uucccauguggaa

SEQ ID NO: 2156438 - RNA, 16 nt, Homo sapiens
uggaaauggcaugcaa

SEQ ID NO: 2156439 - RNA, 22 nt, Homo sapiens
ggagaagaggcagauucaauuu

SEQ ID NO: 2156440 - RNA, 16 nt, Homo sapiens
cacccaccgcaagcuu

SEQ ID NO: 2156441 - RNA, 14 nt, Homo sapiens
uacagccaaagaua

SEQ ID NO: 2156442 - RNA, 22 nt, Homo sapiens
agaguagagaugcugggacuga

SEQ ID NO: 2156443 - RNA, 16 nt, Homo sapiens
cacagugucuguaaau

SEQ ID NO: 2156444 - RNA, 12 nt, Homo sapiens
cuuucuguggua

SEQ ID NO: 2156445 - RNA, 15 nt, Homo sapiens
uccuggcgacaucuu

SEQ ID NO: 2156446 - RNA, 16 nt, Homo sapiens
uugaggguccucaguc

SEQ ID NO: 2156447 - RNA, 22 nt, Homo sapiens
uucucagaaucuacccaaagga

SEQ ID NO: 2156448 - RNA, 13 nt, Homo sapiens
acauuugcaauua

SEQ ID NO: 2156449 - RNA, 21 nt, Homo sapiens
cugugugaacuaacaugcaaa

SEQ ID NO: 2156450 - RNA, 16 nt, Homo sapiens
caugguagacugugac

SEQ ID NO: 2156451 - RNA, 17 nt, Homo sapiens
acugaggcaagcacaau

SEQ ID NO: 2156452 - RNA, 17 nt, Homo sapiens
cuucuggugucauggug

SEQ ID NO: 2156453 - RNA, 16 nt, Homo sapiens
augcacaguugccaca

SEQ ID NO: 2156454 - RNA, 14 nt, Homo sapiens
ucaagagcaaagua

SEQ ID NO: 2156455 - RNA, 14 nt, Homo sapiens
accuugcaucucac

SEQ ID NO: 2156456 - RNA, 17 nt, Homo sapiens
cccaaccuuucauuucc

SEQ ID NO: 2156457 - RNA, 11 nt, Homo sapiens
gaagcuuuguc

SEQ ID NO: 2156458 - RNA, 16 nt, Homo sapiens
cgugguagucacuugu

SEQ ID NO: 2156459 - RNA, 14 nt, Homo sapiens
ugggaaacugcucc

SEQ ID NO: 2156460 - RNA, 15 nt, Homo sapiens
gcaucagaaaacagg

SEQ ID NO: 2156461 - RNA, 15 nt, Homo sapiens
gaaagccuuccucaa

SEQ ID NO: 2156462 - RNA, 20 nt, Homo sapiens
uuuacuucccagagaacuuc

SEQ ID NO: 2156463 - RNA, 14 nt, Homo sapiens
uggggacuccucaa

SEQ ID NO: 2156464 - RNA, 16 nt, Homo sapiens
uuuuccauccuucaaa

SEQ ID NO: 2156465 - RNA, 15 nt, Homo sapiens
uacugaccaucugca

SEQ ID NO: 2156466 - RNA, 14 nt, Homo sapiens
ucaacccugugauc

SEQ ID NO: 2156467 - RNA, 14 nt, Homo sapiens
gugaucucacuuaa

SEQ ID NO: 2156468 - RNA, 15 nt, Homo sapiens
cucuauuugagaaua

SEQ ID NO: 2156469 - RNA, 17 nt, Homo sapiens
accuauuucugaugaug

SEQ ID NO: 2156470 - RNA, 13 nt, Homo sapiens
ugagacuggaaau

SEQ ID NO: 2156471 - RNA, 23 nt, Homo sapiens
acacuggauuuguuucugugauc

SEQ ID NO: 2156472 - RNA, 19 nt, Homo sapiens
gugauuuucucuaauguaa

SEQ ID NO: 2156473 - RNA, 14 nt, Homo sapiens
caugaaaaucugcc

SEQ ID NO: 2156474 - RNA, 21 nt, Homo sapiens
auucuccuccuucauccugua

SEQ ID NO: 2156475 - RNA, 15 nt, Homo sapiens
caagacuuauuuuca

SEQ ID NO: 2156476 - RNA, 13 nt, Homo sapiens
ggccuaugcacau

SEQ ID NO: 2156477 - RNA, 20 nt, Homo sapiens
agugucaggaggaaggcuua

SEQ ID NO: 2156478 - RNA, 15 nt, Homo sapiens
auguuaaccaaugua

SEQ ID NO: 2156479 - RNA, 18 nt, Homo sapiens
uuuccaacuuuuauuuca

SEQ ID NO: 2156480 - RNA, 20 nt, Homo sapiens
ccauuccuauaguacuuuau

SEQ ID NO: 2156481 - RNA, 17 nt, Homo sapiens
auaggcccagugagaug

SEQ ID NO: 2156482 - RNA, 16 nt, Homo sapiens
aaaagguuaagccaua

SEQ ID NO: 2156483 - RNA, 19 nt, Homo sapiens
ucuuuacugggucuaaagg

SEQ ID NO: 2156484 - RNA, 12 nt, Homo sapiens
cuguucuuccuc

SEQ ID NO: 2156485 - RNA, 20 nt, Homo sapiens
cugaauauaaagcuuaauaa

SEQ ID NO: 2156486 - RNA, 16 nt, Homo sapiens
ggagaaucauguuucu

SEQ ID NO: 2156487 - RNA, 16 nt, Homo sapiens
aaggucaccucacuca

SEQ ID NO: 2156488 - RNA, 18 nt, Homo sapiens
guccuauaauucuauuga

SEQ ID NO: 2156489 - RNA, 20 nt, Homo sapiens
gugucaaucaugcuguguaa

SEQ ID NO: 2156490 - RNA, 23 nt, Homo sapiens
ucaacuggagacacuauuuaucu

SEQ ID NO: 2156491 - RNA, 20 nt, Homo sapiens
caccaagcucuguccaauca

SEQ ID NO: 2156492 - RNA, 21 nt, Homo sapiens
auacauguugggcaugauucu

SEQ ID NO: 2156493 - RNA, 16 nt, Homo sapiens
cagcacugccugccaa

SEQ ID NO: 2156494 - RNA, 15 nt, Homo sapiens
ggcuaucugcauuua

SEQ ID NO: 2156495 - RNA, 16 nt, Homo sapiens
cuguuggggaccucac

SEQ ID NO: 2156496 - RNA, 20 nt, Homo sapiens
caguuauacaugucuaucaa

SEQ ID NO: 2156497 - RNA, 17 nt, Homo sapiens
agcuaauuucuaauggc

SEQ ID NO: 2156498 - RNA, 22 nt, Homo sapiens
cuugaaguugcuuuuuugacuc

SEQ ID NO: 2156499 - RNA, 15 nt, Homo sapiens
ugagaucauugcaaa

SEQ ID NO: 2156500 - RNA, 18 nt, Homo sapiens
uuugcuuuucuuugcuag

SEQ ID NO: 2156501 - RNA, 11 nt, Homo sapiens
auuaccaaaac

SEQ ID NO: 2156502 - RNA, 23 nt, Homo sapiens
gguaugaucacggcucacugcag

SEQ ID NO: 2156503 - RNA, 17 nt, Homo sapiens
aguuucaguggagcuca

SEQ ID NO: 2156504 - RNA, 21 nt, Homo sapiens
uucaaagugucucauucucag

SEQ ID NO: 2156505 - RNA, 16 nt, Homo sapiens
guggcucaacauugug

SEQ ID NO: 2156506 - RNA, 13 nt, Homo sapiens
gcagcugauccag

SEQ ID NO: 2156507 - RNA, 24 nt, Homo sapiens
auuucuuucuuugcaccaaagaca

SEQ ID NO: 2156508 - RNA, 11 nt, Homo sapiens
gggcaccuuuu

SEQ ID NO: 2156509 - RNA, 20 nt, Homo sapiens
gagaagcggauuuccaggga

SEQ ID NO: 2156510 - RNA, 15 nt, Homo sapiens
aaauaguguguccau

SEQ ID NO: 2156511 - RNA, 13 nt, Homo sapiens
uucaugagcacuu

SEQ ID NO: 2156512 - RNA, 20 nt, Homo sapiens
auucauagcuugcaguuuca

SEQ ID NO: 2156513 - RNA, 23 nt, Homo sapiens
ucgguguucugucccagugcggu

SEQ ID NO: 2156514 - RNA, 13 nt, Homo sapiens
agccugggggcca

SEQ ID NO: 2156515 - RNA, 18 nt, Homo sapiens
gcugugaugcaugagcuc

SEQ ID NO: 2156516 - RNA, 17 nt, Homo sapiens
aaaaccuuccaugucaa

SEQ ID NO: 2156517 - RNA, 20 nt, Homo sapiens
uuagcuccauaaaguacaaa

SEQ ID NO: 2156518 - RNA, 22 nt, Homo sapiens
caggacacuggucgagagccaa

SEQ ID NO: 2156519 - RNA, 17 nt, Homo sapiens
aaaaagugaaauaaugu

SEQ ID NO: 2156520 - RNA, 23 nt, Homo sapiens
ccaucagugcacaaaucauucca

SEQ ID NO: 2156521 - RNA, 15 nt, Homo sapiens
cacugaauuaugcca

SEQ ID NO: 2156522 - RNA, 20 nt, Homo sapiens
cagccugggcaacacgguga

SEQ ID NO: 2156523 - RNA, 15 nt, Homo sapiens
ccaaaaauuacuuug

SEQ ID NO: 2156524 - RNA, 16 nt, Homo sapiens
aucugcucuagauuca

SEQ ID NO: 2156525 - RNA, 17 nt, Homo sapiens
acuaucaaaauugccuu

SEQ ID NO: 2156526 - RNA, 23 nt, Homo sapiens
ucaaguagcguuggagacauaca

SEQ ID NO: 2156527 - RNA, 14 nt, Homo sapiens
cuuugucugcaggu

SEQ ID NO: 2156528 - RNA, 16 nt, Homo sapiens
aauagacaauuugcac

SEQ ID NO: 2156529 - RNA, 16 nt, Homo sapiens
auuuguaaacauacau

SEQ ID NO: 2156530 - RNA, 22 nt, Homo sapiens
gcacucauuuggauugccuuac

SEQ ID NO: 2156531 - RNA, 20 nt, Homo sapiens
agugcuaauuuaguucucag

SEQ ID NO: 2156532 - RNA, 15 nt, Homo sapiens
ugcaugaaucuguac

SEQ ID NO: 2156533 - RNA, 14 nt, Homo sapiens
aacccugugaucua

SEQ ID NO: 2156534 - RNA, 13 nt, Homo sapiens
ccugcuuugcauc

SEQ ID NO: 2156535 - RNA, 17 nt, Homo sapiens
guguuuaccuggugcuc

SEQ ID NO: 2156536 - RNA, 21 nt, Homo sapiens
ucacuacagacgauuaacaca

SEQ ID NO: 2156537 - RNA, 20 nt, Homo sapiens
aauauauuuaucuucuucac

SEQ ID NO: 2156538 - RNA, 16 nt, Homo sapiens
cuucuuuaucugugau

SEQ ID NO: 2156539 - RNA, 21 nt, Homo sapiens
aagucaauaaaagagcugucu

SEQ ID NO: 2156540 - RNA, 16 nt, Homo sapiens
caccugaacguucugu

SEQ ID NO: 2156541 - RNA, 19 nt, Homo sapiens
ugucuccaaaaggccuuug

SEQ ID NO: 2156542 - RNA, 21 nt, Homo sapiens
uaccgagccccugaacugcug

SEQ ID NO: 2156543 - RNA, 21 nt, Homo sapiens
ugcaaagacugaguguucaaa

SEQ ID NO: 2156544 - RNA, 18 nt, Homo sapiens
gacuccuuuccaauagaa

SEQ ID NO: 2156545 - RNA, 16 nt, Homo sapiens
caaacuuccagugcaa

SEQ ID NO: 2156546 - RNA, 18 nt, Homo sapiens
aucacauuaucaucugaa

SEQ ID NO: 2156547 - RNA, 23 nt, Homo sapiens
auaaaacagaauauugacaagcu

SEQ ID NO: 2156548 - RNA, 22 nt, Homo sapiens
acuugcuuuaccuuuucagggc

SEQ ID NO: 2156549 - RNA, 21 nt, Homo sapiens
gcuuaaacaugccugguggaa

SEQ ID NO: 2156550 - RNA, 12 nt, Homo sapiens
ccaguguuucua

SEQ ID NO: 2156551 - RNA, 20 nt, Homo sapiens
caugugacacauaugcaccu

SEQ ID NO: 2156552 - RNA, 20 nt, Homo sapiens
aaagauaacaagaucuuuca

SEQ ID NO: 2156553 - RNA, 17 nt, Homo sapiens
agauccccccuuuccuu

SEQ ID NO: 2156554 - RNA, 20 nt, Homo sapiens
gccaguaaucuuuauacugg

SEQ ID NO: 2156555 - RNA, 21 nt, Homo sapiens
uuuaccuccaggaaacaugaa

SEQ ID NO: 2156556 - RNA, 18 nt, Homo sapiens
cuccuuuaccuaccaccu

SEQ ID NO: 2156557 - RNA, 17 nt, Homo sapiens
cugcccugaacccacug

SEQ ID NO: 2156558 - RNA, 14 nt, Homo sapiens
acacacaaccuccu

SEQ ID NO: 2156559 - RNA, 22 nt, Homo sapiens
cuauuuaagugaaaaaagcaaa

SEQ ID NO: 2156560 - RNA, 23 nt, Homo sapiens
cacucaaagauuggauuuuacag

SEQ ID NO: 2156561 - RNA, 12 nt, Homo sapiens
ccauauucacac

SEQ ID NO: 2156562 - RNA, 19 nt, Homo sapiens
cagaccuuuuaacuccuca

SEQ ID NO: 2156563 - RNA, 22 nt, Homo sapiens
ucuauggacucgauuuuaccau

SEQ ID NO: 2156564 - RNA, 21 nt, Homo sapiens
uugaauaaagccugcuuuuua

SEQ ID NO: 2156565 - RNA, 11 nt, Homo sapiens
caacuaccuga

SEQ ID NO: 2156566 - RNA, 11 nt, Homo sapiens
caccuaccugc

SEQ ID NO: 2156567 - RNA, 22 nt, Homo sapiens
caguaaggucaugugcuuccac

SEQ ID NO: 2156568 - RNA, 20 nt, Homo sapiens
acccuagccuugcuuguuaa

SEQ ID NO: 2156569 - RNA, 17 nt, Homo sapiens
caagcaacaagcuauuu

SEQ ID NO: 2156570 - RNA, 15 nt, Homo sapiens
ugugcugcugcuuca

SEQ ID NO: 2156571 - RNA, 15 nt, Homo sapiens
ucauaccuguacaca

SEQ ID NO: 2156572 - RNA, 13 nt, Homo sapiens
cuuccuggcacau

SEQ ID NO: 2156573 - RNA, 22 nt, Homo sapiens
aguccaucaaguaccucaucug

SEQ ID NO: 2156574 - RNA, 14 nt, Homo sapiens
gauguuacugagau

SEQ ID NO: 2156575 - RNA, 15 nt, Homo sapiens
uguuucaccuuccau

SEQ ID NO: 2156576 - RNA, 19 nt, Homo sapiens
ucuaaguaaaaccacagca

SEQ ID NO: 2156577 - RNA, 14 nt, Homo sapiens
caggccccugccac

SEQ ID NO: 2156578 - RNA, 16 nt, Homo sapiens
uucugaggauugcaga

SEQ ID NO: 2156579 - RNA, 17 nt, Homo sapiens
guugauuccuucauuca

SEQ ID NO: 2156580 - RNA, 13 nt, Homo sapiens
auaaaaugaauuc

SEQ ID NO: 2156581 - RNA, 15 nt, Homo sapiens
aggggcaccucucuu

SEQ ID NO: 2156582 - RNA, 16 nt, Homo sapiens
ucuuccauaugcucuu

SEQ ID NO: 2156583 - RNA, 16 nt, Homo sapiens
ucaggggacacuggcc

SEQ ID NO: 2156584 - RNA, 15 nt, Homo sapiens
acauaagcagcauuu

SEQ ID NO: 2156585 - RNA, 17 nt, Homo sapiens
caguguuuuucuucaug

SEQ ID NO: 2156586 - RNA, 15 nt, Homo sapiens
uccauguuauucucu

SEQ ID NO: 2156587 - RNA, 17 nt, Homo sapiens
ccggggccagcaccacu

SEQ ID NO: 2156588 - RNA, 21 nt, Homo sapiens
agaaucuccacuacuuaucca

SEQ ID NO: 2156589 - RNA, 22 nt, Homo sapiens
agccaguuggcuucuaagccaa

SEQ ID NO: 2156590 - RNA, 13 nt, Homo sapiens
guguuaggcacag

SEQ ID NO: 2156591 - RNA, 20 nt, Homo sapiens
ugcugggccucauucuagca

SEQ ID NO: 2156592 - RNA, 15 nt, Homo sapiens
ugagccacuccuucc

SEQ ID NO: 2156593 - RNA, 16 nt, Homo sapiens
aaaucuccugcugauu

SEQ ID NO: 2156594 - RNA, 16 nt, Homo sapiens
caugagcuuuccaguu

SEQ ID NO: 2156595 - RNA, 21 nt, Homo sapiens
acccauucuguuccaccacug

SEQ ID NO: 2156596 - RNA, 22 nt, Homo sapiens
agauuuuacagagcgcaccuca

SEQ ID NO: 2156597 - RNA, 18 nt, Homo sapiens
agggcacuguguuugccu

SEQ ID NO: 2156598 - RNA, 10 nt, Homo sapiens
accacacagu

SEQ ID NO: 2156599 - RNA, 21 nt, Homo sapiens
cauuguaaaguuuaugucacc

SEQ ID NO: 2156600 - RNA, 15 nt, Homo sapiens
uugugauagcacuuu

SEQ ID NO: 2156601 - RNA, 11 nt, Homo sapiens
ugccacuggau

SEQ ID NO: 2156602 - RNA, 14 nt, Homo sapiens
uuacaggugugacc

SEQ ID NO: 2156603 - RNA, 19 nt, Homo sapiens
uucauugauggaugucuuc

SEQ ID NO: 2156604 - RNA, 16 nt, Homo sapiens
ccauugagacuauuua

SEQ ID NO: 2156605 - RNA, 14 nt, Homo sapiens
ccauuguuuugccu

SEQ ID NO: 2156606 - RNA, 15 nt, Homo sapiens
ggccugcacacaagc

SEQ ID NO: 2156607 - RNA, 16 nt, Homo sapiens
gcaucuaucugugcua

SEQ ID NO: 2156608 - RNA, 21 nt, Homo sapiens
aaauaacuaggcguggacuua

SEQ ID NO: 2156609 - RNA, 17 nt, Homo sapiens
aauucaucucucuuuaa

SEQ ID NO: 2156610 - RNA, 17 nt, Homo sapiens
ugaguagaguugaucaa

SEQ ID NO: 2156611 - RNA, 21 nt, Homo sapiens
agauuccauacagugacaaua

SEQ ID NO: 2156612 - RNA, 16 nt, Homo sapiens
aaugcuucuguugauc

SEQ ID NO: 2156613 - RNA, 20 nt, Homo sapiens
caaugcagccagaccuauuc

SEQ ID NO: 2156614 - RNA, 21 nt, Homo sapiens
guauaaaaucugaauuuugca

SEQ ID NO: 2156615 - RNA, 14 nt, Homo sapiens
aaacaugucacaau

SEQ ID NO: 2156616 - RNA, 21 nt, Homo sapiens
ggccccagauaccaugaugcu

SEQ ID NO: 2156617 - RNA, 13 nt, Homo sapiens
uacagugccacga

SEQ ID NO: 2156618 - RNA, 18 nt, Homo sapiens
aaagcuugccacuuucca

SEQ ID NO: 2156619 - RNA, 14 nt, Homo sapiens
ugccugagcccagg

SEQ ID NO: 2156620 - RNA, 13 nt, Homo sapiens
uacauuguaguua

SEQ ID NO: 2156621 - RNA, 16 nt, Homo sapiens
gacuuauucauuccuc

SEQ ID NO: 2156622 - RNA, 20 nt, Homo sapiens
cccagggcugcaaaacugga

SEQ ID NO: 2156623 - RNA, 20 nt, Homo sapiens
aaauggagaagaaaggccau

SEQ ID NO: 2156624 - RNA, 21 nt, Homo sapiens
acgcccgucucuuucucaccu

SEQ ID NO: 2156625 - RNA, 11 nt, Homo sapiens
gaaaaugucag

SEQ ID NO: 2156626 - RNA, 15 nt, Homo sapiens
caccacuuugucucu

SEQ ID NO: 2156627 - RNA, 16 nt, Homo sapiens
auugagaagggacaag

SEQ ID NO: 2156628 - RNA, 18 nt, Homo sapiens
agcccagggccccuguga

SEQ ID NO: 2156629 - RNA, 21 nt, Homo sapiens
gaagugauucugucccuccaa

SEQ ID NO: 2156630 - RNA, 10 nt, Homo sapiens
gcucugggaa

SEQ ID NO: 2156631 - RNA, 17 nt, Homo sapiens
uuccuauuaaucuucag

SEQ ID NO: 2156632 - RNA, 17 nt, Homo sapiens
cuuacgaucucuugaca

SEQ ID NO: 2156633 - RNA, 15 nt, Homo sapiens
cuuuucugugccaga

SEQ ID NO: 2156634 - RNA, 17 nt, Homo sapiens
cugugcccacccuccac

SEQ ID NO: 2156635 - RNA, 21 nt, Homo sapiens
caggggcucacaccuguaauc

SEQ ID NO: 2156636 - RNA, 16 nt, Homo sapiens
auuuuaaaaagucaau

SEQ ID NO: 2156637 - RNA, 12 nt, Homo sapiens
cacuagucucac

SEQ ID NO: 2156638 - RNA, 12 nt, Homo sapiens
caaaagccaaaa

SEQ ID NO: 2156639 - RNA, 12 nt, Homo sapiens
ccagagccacag

SEQ ID NO: 2156640 - RNA, 12 nt, Homo sapiens
gucuaaagugua

SEQ ID NO: 2156641 - RNA, 18 nt, Homo sapiens
ccuuagcccugucugcua

SEQ ID NO: 2156642 - RNA, 19 nt, Homo sapiens
cuuuggggacaguuggcag

SEQ ID NO: 2156643 - RNA, 20 nt, Homo sapiens
agcacguaguuugcauucca

SEQ ID NO: 2156644 - RNA, 22 nt, Homo sapiens
cugacacuucaaggugacagaa

SEQ ID NO: 2156645 - RNA, 15 nt, Homo sapiens
ggagggcuccagaca

SEQ ID NO: 2156646 - RNA, 23 nt, Homo sapiens
uaugcaauauaucuaaauugaau

SEQ ID NO: 2156647 - RNA, 14 nt, Homo sapiens
cugucauauuauga

SEQ ID NO: 2156648 - RNA, 16 nt, Homo sapiens
ucaugccagugccuua

SEQ ID NO: 2156649 - RNA, 18 nt, Homo sapiens
uguucagagaggccuuuu

SEQ ID NO: 2156650 - RNA, 17 nt, Homo sapiens
auaccaccuucaauauc

SEQ ID NO: 2156651 - RNA, 14 nt, Homo sapiens
ucagaaccauuuca

SEQ ID NO: 2156652 - RNA, 23 nt, Homo sapiens
acucagccuugcaaauagccagu

SEQ ID NO: 2156653 - RNA, 15 nt, Homo sapiens
ggucguccaagcaaa

SEQ ID NO: 2156654 - RNA, 19 nt, Homo sapiens
gguaaaagcaucacaugaa

SEQ ID NO: 2156655 - RNA, 12 nt, Homo sapiens
aaagcaaaucag

SEQ ID NO: 2156656 - RNA, 23 nt, Homo sapiens
acagacaccaucuuuugugagau

SEQ ID NO: 2156657 - RNA, 16 nt, Homo sapiens
uccagagauuugcuuu

SEQ ID NO: 2156658 - RNA, 17 nt, Homo sapiens
cugaaaucauacuucuu

SEQ ID NO: 2156659 - RNA, 16 nt, Homo sapiens
uggccugugucccaug

SEQ ID NO: 2156660 - RNA, 22 nt, Homo sapiens
agcagagcaccuuagacagucc

SEQ ID NO: 2156661 - RNA, 23 nt, Homo sapiens
accaagauagauccauuuggaca

SEQ ID NO: 2156662 - RNA, 23 nt, Homo sapiens
uuaugccagggcgcacuuuccac

SEQ ID NO: 2156663 - RNA, 12 nt, Homo sapiens
gaaauaugcaua

SEQ ID NO: 2156664 - RNA, 16 nt, Homo sapiens
ggcuucgucuacuccu

SEQ ID NO: 2156665 - RNA, 22 nt, Homo sapiens
cuuucuccugugguuugcucca

SEQ ID NO: 2156666 - RNA, 17 nt, Homo sapiens
acugucugcauauccau

SEQ ID NO: 2156667 - RNA, 21 nt, Homo sapiens
cuccacaccaaagucagggag

SEQ ID NO: 2156668 - RNA, 19 nt, Homo sapiens
ucccacccugcaaagggaa

SEQ ID NO: 2156669 - RNA, 22 nt, Homo sapiens
ccagcugcagaccaugccagac

SEQ ID NO: 2156670 - RNA, 22 nt, Homo sapiens
caguaaucuuucggucuccuua

SEQ ID NO: 2156671 - RNA, 17 nt, Homo sapiens
ccaaaccagggugcaug

SEQ ID NO: 2156672 - RNA, 18 nt, Homo sapiens
caggagaaucacuugaac

SEQ ID NO: 2156673 - RNA, 18 nt, Homo sapiens
acugaugcuuuuagcuca

SEQ ID NO: 2156674 - RNA, 19 nt, Homo sapiens
ugccuggcuagucccugcc

SEQ ID NO: 2156675 - RNA, 15 nt, Homo sapiens
auguauuuuucacaa

SEQ ID NO: 2156676 - RNA, 15 nt, Homo sapiens
ggccuccaugaccug

SEQ ID NO: 2156677 - RNA, 20 nt, Homo sapiens
ucaaagaacccuagcacaaa

SEQ ID NO: 2156678 - RNA, 19 nt, Homo sapiens
cugggcuuguuguuuuuaa

SEQ ID NO: 2156679 - RNA, 20 nt, Homo sapiens
gcuugugacauuugaauaag

SEQ ID NO: 2156680 - RNA, 14 nt, Homo sapiens
agaauagucucacu

SEQ ID NO: 2156681 - RNA, 16 nt, Homo sapiens
uagaacgcuucgggaa

SEQ ID NO: 2156682 - RNA, 15 nt, Homo sapiens
cugcugcaaagugca

SEQ ID NO: 2156683 - RNA, 14 nt, Homo sapiens
caagaggccucaug

SEQ ID NO: 2156684 - RNA, 19 nt, Homo sapiens
gugagccaucaucauggca

SEQ ID NO: 2156685 - RNA, 23 nt, Homo sapiens
cacuagugggguccugaggccaa

SEQ ID NO: 2156686 - RNA, 18 nt, Homo sapiens
uauaaucuaauacuuauu

SEQ ID NO: 2156687 - RNA, 13 nt, Homo sapiens
aagugccaucuca

SEQ ID NO: 2156688 - RNA, 19 nt, Homo sapiens
uccugaaauaaacacuggu

SEQ ID NO: 2156689 - RNA, 21 nt, Homo sapiens
auuacaucccauaacuuguca

SEQ ID NO: 2156690 - RNA, 23 nt, Homo sapiens
cccauggauguuucuucuuugac

SEQ ID NO: 2156691 - RNA, 17 nt, Homo sapiens
aguucuccuaucuugau

SEQ ID NO: 2156692 - RNA, 17 nt, Homo sapiens
cagagacucucccugac

SEQ ID NO: 2156693 - RNA, 13 nt, Homo sapiens
cacugagggccac

SEQ ID NO: 2156694 - RNA, 21 nt, Homo sapiens
gaaggaaguucagucuugucu

SEQ ID NO: 2156695 - RNA, 18 nt, Homo sapiens
uauuucucaucugcacua

SEQ ID NO: 2156696 - RNA, 14 nt, Homo sapiens
ggaauacuguuuua

SEQ ID NO: 2156697 - RNA, 19 nt, Homo sapiens
acuauuuugguaagugcag

SEQ ID NO: 2156698 - RNA, 20 nt, Homo sapiens
uuaagucccaguauaccuca

SEQ ID NO: 2156699 - RNA, 15 nt, Homo sapiens
guuauucagaaccua

SEQ ID NO: 2156700 - RNA, 14 nt, Homo sapiens
cuuuccaaaaccuu

SEQ ID NO: 2156701 - RNA, 14 nt, Homo sapiens
uaggucaugaagga

SEQ ID NO: 2156702 - RNA, 14 nt, Homo sapiens
gcuaagcuuuacag

SEQ ID NO: 2156703 - RNA, 14 nt, Homo sapiens
gagcaucugucuca

SEQ ID NO: 2156704 - RNA, 14 nt, Homo sapiens
caaguucugugguu

SEQ ID NO: 2156705 - RNA, 22 nt, Homo sapiens
gagcaacagccuaaaggccugc

SEQ ID NO: 2156706 - RNA, 23 nt, Homo sapiens
guaaugggauuugaaucaaugua

SEQ ID NO: 2156707 - RNA, 14 nt, Homo sapiens
gccauauauauuuc

SEQ ID NO: 2156708 - RNA, 20 nt, Homo sapiens
augcuggggacacagcauca

SEQ ID NO: 2156709 - RNA, 20 nt, Homo sapiens
agggcaugauuaacaaagca

SEQ ID NO: 2156710 - RNA, 15 nt, Homo sapiens
accgugucaccuacg

SEQ ID NO: 2156711 - RNA, 16 nt, Homo sapiens
ucauagaggugagaaa

SEQ ID NO: 2156712 - RNA, 14 nt, Homo sapiens
augcggccauucaa

SEQ ID NO: 2156713 - RNA, 15 nt, Homo sapiens
agcaagcccugaccc

SEQ ID NO: 2156714 - RNA, 22 nt, Homo sapiens
aauaacaucucaccuucaguca

SEQ ID NO: 2156715 - RNA, 19 nt, Homo sapiens
uaagccaagagucauguca

SEQ ID NO: 2156716 - RNA, 12 nt, Homo sapiens
aacccuccccaa

SEQ ID NO: 2156717 - RNA, 21 nt, Homo sapiens
ucucuucuuauuacccaaacc

SEQ ID NO: 2156718 - RNA, 14 nt, Homo sapiens
uucaagcagcaucu

SEQ ID NO: 2156719 - RNA, 14 nt, Homo sapiens
auguagccaugacc

SEQ ID NO: 2156720 - RNA, 20 nt, Homo sapiens
uuaauuaagucaccuguaua

SEQ ID NO: 2156721 - RNA, 17 nt, Homo sapiens
ccacaauucuucuguca

SEQ ID NO: 2156722 - RNA, 23 nt, Homo sapiens
ggaaccuaaugggaaucauucca

SEQ ID NO: 2156723 - RNA, 14 nt, Homo sapiens
uuaaaaacaugaau

SEQ ID NO: 2156724 - RNA, 22 nt, Homo sapiens
ugacugugaggugggccuuuga

SEQ ID NO: 2156725 - RNA, 18 nt, Homo sapiens
ucugggaccaaaacauca

SEQ ID NO: 2156726 - RNA, 15 nt, Homo sapiens
cagucacaugugcuc

SEQ ID NO: 2156727 - RNA, 20 nt, Homo sapiens
caucagggaguaagugacac

SEQ ID NO: 2156728 - RNA, 17 nt, Homo sapiens
gugaguggaaauggaaa

SEQ ID NO: 2156729 - RNA, 19 nt, Homo sapiens
auggcugcccaggagacag

SEQ ID NO: 2156730 - RNA, 17 nt, Homo sapiens
gaagccuggacucugcc

SEQ ID NO: 2156731 - RNA, 18 nt, Homo sapiens
cagaugcaccacccaugg

SEQ ID NO: 2156732 - RNA, 16 nt, Homo sapiens
acaaaugacaguuuca

SEQ ID NO: 2156733 - RNA, 18 nt, Homo sapiens
uauagaaucuacuuuaau

SEQ ID NO: 2156734 - RNA, 14 nt, Homo sapiens
acaacuuccagauu

SEQ ID NO: 2156735 - RNA, 20 nt, Homo sapiens
gggacugcaugcaagcucag

SEQ ID NO: 2156736 - RNA, 15 nt, Homo sapiens
ccacguggacucugu

SEQ ID NO: 2156737 - RNA, 14 nt, Homo sapiens
ugucuguguauaca

SEQ ID NO: 2156738 - RNA, 18 nt, Homo sapiens
aacacaauacagccacua

SEQ ID NO: 2156739 - RNA, 20 nt, Homo sapiens
gcaagucauugagugacuuu

SEQ ID NO: 2156740 - RNA, 23 nt, Homo sapiens
ugaggacuuaaaauauuccugca

SEQ ID NO: 2156741 - RNA, 15 nt, Homo sapiens
ucacaaacucaucca

SEQ ID NO: 2156742 - RNA, 13 nt, Homo sapiens
acuccagugccag

SEQ ID NO: 2156743 - RNA, 15 nt, Homo sapiens
guagccacuucacuu

SEQ ID NO: 2156744 - RNA, 19 nt, Homo sapiens
ccagcccauaucuacagua

SEQ ID NO: 2156745 - RNA, 18 nt, Homo sapiens
acucucuauaaguguuca

SEQ ID NO: 2156746 - RNA, 15 nt, Homo sapiens
caaaguagcaauuuc

SEQ ID NO: 2156747 - RNA, 13 nt, Homo sapiens
accuugcaauguu

SEQ ID NO: 2156748 - RNA, 22 nt, Homo sapiens
ccagagggugggcuucagggcg

SEQ ID NO: 2156749 - RNA, 16 nt, Homo sapiens
gcuacuaaccugacau

SEQ ID NO: 2156750 - RNA, 14 nt, Homo sapiens
uuaaggacacuggg

SEQ ID NO: 2156751 - RNA, 14 nt, Homo sapiens
ucuacaacauagca

SEQ ID NO: 2156752 - RNA, 15 nt, Homo sapiens
ugagcaagacauacu

SEQ ID NO: 2156753 - RNA, 20 nt, Homo sapiens
ccaaauccuagacugcuccu

SEQ ID NO: 2156754 - RNA, 13 nt, Homo sapiens
cagagcuguggug

SEQ ID NO: 2156755 - RNA, 14 nt, Homo sapiens
ucuuguagccagaa

SEQ ID NO: 2156756 - RNA, 19 nt, Homo sapiens
ggcauaguccccagagcuc

SEQ ID NO: 2156757 - RNA, 17 nt, Homo sapiens
ccuuaaaccugcaaaau

SEQ ID NO: 2156758 - RNA, 17 nt, Homo sapiens
agugauucccaacuccu

SEQ ID NO: 2156759 - RNA, 13 nt, Homo sapiens
cauguccucaaaa

SEQ ID NO: 2156760 - RNA, 17 nt, Homo sapiens
gagucaugcacucaggc

SEQ ID NO: 2156761 - RNA, 12 nt, Homo sapiens
cacaugccccuu

SEQ ID NO: 2156762 - RNA, 18 nt, Homo sapiens
aaaaagauagcauugggg

SEQ ID NO: 2156763 - RNA, 15 nt, Homo sapiens
gucaagaacaauuca

SEQ ID NO: 2156764 - RNA, 22 nt, Homo sapiens
uggaaaaguaaagaaaaacccu

SEQ ID NO: 2156765 - RNA, 23 nt, Homo sapiens
ugcccaccuccuuccagcacuga

SEQ ID NO: 2156766 - RNA, 20 nt, Homo sapiens
acuuggggauuaucugucau

SEQ ID NO: 2156767 - RNA, 22 nt, Homo sapiens
cucccuguucuuggguaaggaa

SEQ ID NO: 2156768 - RNA, 21 nt, Homo sapiens
caauggcuuguucaucaucca

SEQ ID NO: 2156769 - RNA, 22 nt, Homo sapiens
gaaaggauaggauugacauacc

SEQ ID NO: 2156770 - RNA, 23 nt, Homo sapiens
gaauugaccccuuccuccagggg

SEQ ID NO: 2156771 - RNA, 13 nt, Homo sapiens
aaugcggcccaac

SEQ ID NO: 2156772 - RNA, 19 nt, Homo sapiens
gggaaacugagggcagaga

SEQ ID NO: 2156773 - RNA, 19 nt, Homo sapiens
auuuuaaguaucagagguc

SEQ ID NO: 2156774 - RNA, 14 nt, Homo sapiens
aggcuagagugcaa

SEQ ID NO: 2156775 - RNA, 14 nt, Homo sapiens
aggcuggagugcag

SEQ ID NO: 2156776 - RNA, 21 nt, Homo sapiens
gccccaugacuugaugcaguu

SEQ ID NO: 2156777 - RNA, 23 nt, Homo sapiens
ucuuaccagggagauuugcucaa

SEQ ID NO: 2156778 - RNA, 17 nt, Homo sapiens
ccagacucucacaugca

SEQ ID NO: 2156779 - RNA, 17 nt, Homo sapiens
ucugacccaaagcaaaa

SEQ ID NO: 2156780 - RNA, 17 nt, Homo sapiens
uauguuuccaucuucag

SEQ ID NO: 2156781 - RNA, 22 nt, Homo sapiens
ccugggcagaaaugugcugcaa

SEQ ID NO: 2156782 - RNA, 22 nt, Homo sapiens
cacucccuuuccccucuucccu

SEQ ID NO: 2156783 - RNA, 14 nt, Homo sapiens
uaacuaacuggcag

SEQ ID NO: 2156784 - RNA, 13 nt, Homo sapiens
aaaaaaaaacuua

SEQ ID NO: 2156785 - RNA, 13 nt, Homo sapiens
caaauaaaccuuu

SEQ ID NO: 2156786 - RNA, 22 nt, Homo sapiens
agacugugcugggaacauguac

SEQ ID NO: 2156787 - RNA, 14 nt, Homo sapiens
ccaaugccugugaa

SEQ ID NO: 2156788 - RNA, 18 nt, Homo sapiens
cuggauccucaguucuca

SEQ ID NO: 2156789 - RNA, 22 nt, Homo sapiens
uuaucaaauggaaugaaacuag

SEQ ID NO: 2156790 - RNA, 17 nt, Homo sapiens
uguugcuguugcuguug

SEQ ID NO: 2156791 - RNA, 18 nt, Homo sapiens
ucucuugcucaccaagaa

SEQ ID NO: 2156792 - RNA, 15 nt, Homo sapiens
aagaggauagaauac

SEQ ID NO: 2156793 - RNA, 16 nt, Homo sapiens
gaauaaggauguuguu

SEQ ID NO: 2156794 - RNA, 18 nt, Homo sapiens
ucuuuaucccaucuugau

SEQ ID NO: 2156795 - RNA, 22 nt, Homo sapiens
uuugaacaaauuuucuggugcu

SEQ ID NO: 2156796 - RNA, 23 nt, Homo sapiens
aggaugguggcaggaaaauggac

SEQ ID NO: 2156797 - RNA, 13 nt, Homo sapiens
ucugccuucaggc

SEQ ID NO: 2156798 - RNA, 18 nt, Homo sapiens
ccugggcaaacagagcua

SEQ ID NO: 2156799 - RNA, 14 nt, Homo sapiens
uggaaguaaagccu

SEQ ID NO: 2156800 - RNA, 14 nt, Homo sapiens
gugcuuguucuucc

SEQ ID NO: 2156801 - RNA, 14 nt, Homo sapiens
uugaagagauuuua

SEQ ID NO: 2156802 - RNA, 16 nt, Homo sapiens
auacauuuauaaucua

SEQ ID NO: 2156803 - RNA, 13 nt, Homo sapiens
acuccucaggguu

SEQ ID NO: 2156804 - RNA, 23 nt, Homo sapiens
aggucaggaguucgagaccagcc

SEQ ID NO: 2156805 - RNA, 19 nt, Homo sapiens
acuguggggcacuugauau

SEQ ID NO: 2156806 - RNA, 18 nt, Homo sapiens
aaugacauugauuucuaa

SEQ ID NO: 2156807 - RNA, 19 nt, Homo sapiens
gucuugucagaauuggccu

SEQ ID NO: 2156808 - RNA, 17 nt, Homo sapiens
agcugaccagacacugc

SEQ ID NO: 2156809 - RNA, 20 nt, Homo sapiens
ugauugcuuaucaguaguau

SEQ ID NO: 2156810 - RNA, 16 nt, Homo sapiens
ucauuccaccuuccca

SEQ ID NO: 2156811 - RNA, 22 nt, Homo sapiens
aaaaaugcacaccucaugaguc

SEQ ID NO: 2156812 - RNA, 14 nt, Homo sapiens
agagaaugcuuuga

SEQ ID NO: 2156813 - RNA, 16 nt, Homo sapiens
uuguuaaugagauaaa

SEQ ID NO: 2156814 - RNA, 20 nt, Homo sapiens
acuuccccuucuugccauua

SEQ ID NO: 2156815 - RNA, 15 nt, Homo sapiens
ucugccuucuuuaug

SEQ ID NO: 2156816 - RNA, 20 nt, Homo sapiens
uuaaacuuucaauugucacu

SEQ ID NO: 2156817 - RNA, 23 nt, Homo sapiens
ucacuuggguccaggccuacucc

SEQ ID NO: 2156818 - RNA, 21 nt, Homo sapiens
gccccauggcgaggccccuug

SEQ ID NO: 2156819 - RNA, 19 nt, Homo sapiens
accuguaggucuaugaugu

SEQ ID NO: 2156820 - RNA, 19 nt, Homo sapiens
acuuaagaguggcauauaa

SEQ ID NO: 2156821 - RNA, 10 nt, Homo sapiens
ugccagguau

SEQ ID NO: 2156822 - RNA, 18 nt, Homo sapiens
aggaagggacacauauca

SEQ ID NO: 2156823 - RNA, 23 nt, Homo sapiens
acccaaccacagaggaugcugac

SEQ ID NO: 2156824 - RNA, 23 nt, Homo sapiens
aacuacccagguauuacacaagc

SEQ ID NO: 2156825 - RNA, 18 nt, Homo sapiens
aucuaagccuuuccauaa

SEQ ID NO: 2156826 - RNA, 15 nt, Homo sapiens
aggguauggggcuag

SEQ ID NO: 2156827 - RNA, 16 nt, Homo sapiens
aacagggcacauauuc

SEQ ID NO: 2156828 - RNA, 14 nt, Homo sapiens
uucuuauagauauu

SEQ ID NO: 2156829 - RNA, 20 nt, Homo sapiens
uggccuuugcaauuguggau

SEQ ID NO: 2156830 - RNA, 23 nt, Homo sapiens
ccgggcuggccugacacaauggu

SEQ ID NO: 2156831 - RNA, 18 nt, Homo sapiens
cgaacucgggauuacaga

SEQ ID NO: 2156832 - RNA, 16 nt, Homo sapiens
aagguaugcaaucaaa

SEQ ID NO: 2156833 - RNA, 22 nt, Homo sapiens
aacuaguugucugaauugagaa

SEQ ID NO: 2156834 - RNA, 16 nt, Homo sapiens
acucuucccucucuca

SEQ ID NO: 2156835 - RNA, 11 nt, Homo sapiens
agguaauuccc

SEQ ID NO: 2156836 - RNA, 20 nt, Homo sapiens
agcauauuuaaaacaaagaa

SEQ ID NO: 2156837 - RNA, 14 nt, Homo sapiens
uccgugaaggugac

SEQ ID NO: 2156838 - RNA, 15 nt, Homo sapiens
ucccaacacuuugag

SEQ ID NO: 2156839 - RNA, 19 nt, Homo sapiens
uuguacaaaauuaagcaaa

SEQ ID NO: 2156840 - RNA, 15 nt, Homo sapiens
ggcaggcugggccau

SEQ ID NO: 2156841 - RNA, 20 nt, Homo sapiens
uagaagccuauguccguuca

SEQ ID NO: 2156842 - RNA, 23 nt, Homo sapiens
aauauccuccaaugugugcaugg

SEQ ID NO: 2156843 - RNA, 13 nt, Homo sapiens
acuuccuuugaaa

SEQ ID NO: 2156844 - RNA, 20 nt, Homo sapiens
gaguccacucccagugcuug

SEQ ID NO: 2156845 - RNA, 22 nt, Homo sapiens
auuuguaagggcucucaaagau

SEQ ID NO: 2156846 - RNA, 18 nt, Homo sapiens
cauauacucuucaaggac

SEQ ID NO: 2156847 - RNA, 19 nt, Homo sapiens
guucacgugacuccucaau

SEQ ID NO: 2156848 - RNA, 19 nt, Homo sapiens
acucugcaaccuccacuuc

SEQ ID NO: 2156849 - RNA, 15 nt, Homo sapiens
agccugaaguggaau

SEQ ID NO: 2156850 - RNA, 17 nt, Homo sapiens
cuucuauguccaacaga

SEQ ID NO: 2156851 - RNA, 22 nt, Homo sapiens
auuucccauuaaagagccaguu

SEQ ID NO: 2156852 - RNA, 19 nt, Homo sapiens
ucaacaauuuauccauuca

SEQ ID NO: 2156853 - RNA, 13 nt, Homo sapiens
ccagcggcccaag

SEQ ID NO: 2156854 - RNA, 16 nt, Homo sapiens
cuguacugacuugagg

SEQ ID NO: 2156855 - RNA, 20 nt, Homo sapiens
cucccaaguagcuaggacua

SEQ ID NO: 2156856 - RNA, 18 nt, Homo sapiens
aacaauugaaguaaacuu

SEQ ID NO: 2156857 - RNA, 19 nt, Homo sapiens
cagcugauugggcaccuga

SEQ ID NO: 2156858 - RNA, 20 nt, Homo sapiens
auguaaaacauucuuuugca

SEQ ID NO: 2156859 - RNA, 16 nt, Homo sapiens
cucuucucuauuccug

SEQ ID NO: 2156860 - RNA, 18 nt, Homo sapiens
accggcugguggagcugc

SEQ ID NO: 2156861 - RNA, 14 nt, Homo sapiens
cuccgcaauucaau

SEQ ID NO: 2156862 - RNA, 17 nt, Homo sapiens
uucaaugguugggacaa

SEQ ID NO: 2156863 - RNA, 18 nt, Homo sapiens
ucugggucaugcacugag

SEQ ID NO: 2156864 - RNA, 20 nt, Homo sapiens
uggcccacgcccucccucuc

SEQ ID NO: 2156865 - RNA, 19 nt, Homo sapiens
uccccacucccccacccau

SEQ ID NO: 2156866 - RNA, 15 nt, Homo sapiens
ugcaauaaugcagua

SEQ ID NO: 2156867 - RNA, 15 nt, Homo sapiens
ccaggggaccagagg

SEQ ID NO: 2156868 - RNA, 18 nt, Homo sapiens
gcaaagugcuagccacug

SEQ ID NO: 2156869 - RNA, 16 nt, Homo sapiens
acauguuacugcuuca

SEQ ID NO: 2156870 - RNA, 21 nt, Homo sapiens
uucuaaccuugaaugcugcca

SEQ ID NO: 2156871 - RNA, 13 nt, Homo sapiens
cagucacuuccac

SEQ ID NO: 2156872 - RNA, 15 nt, Homo sapiens
auuguaaauacugga

SEQ ID NO: 2156873 - RNA, 12 nt, Homo sapiens
ucgaaaguguca

SEQ ID NO: 2156874 - RNA, 15 nt, Homo sapiens
gcugcugcugugcag

SEQ ID NO: 2156875 - RNA, 22 nt, Homo sapiens
auaacuuggccauguucuccau

SEQ ID NO: 2156876 - RNA, 16 nt, Homo sapiens
cuuacuuagcaugcac

SEQ ID NO: 2156877 - RNA, 17 nt, Homo sapiens
caagucaccggagcuuu

SEQ ID NO: 2156878 - RNA, 13 nt, Homo sapiens
aggcaaggggugg

SEQ ID NO: 2156879 - RNA, 22 nt, Homo sapiens
ggcagaugaaaagcuaccauca

SEQ ID NO: 2156880 - RNA, 20 nt, Homo sapiens
aauucugcuucucuuucaca

SEQ ID NO: 2156881 - RNA, 15 nt, Homo sapiens
gcuguuuucuucuau

SEQ ID NO: 2156882 - RNA, 20 nt, Homo sapiens
aguaauugccuagaaauauc

SEQ ID NO: 2156883 - RNA, 16 nt, Homo sapiens
uuaagcgugucuguau

SEQ ID NO: 2156884 - RNA, 19 nt, Homo sapiens
gacagugcccaugcaaugg

SEQ ID NO: 2156885 - RNA, 13 nt, Homo sapiens
auacaacauguag

SEQ ID NO: 2156886 - RNA, 22 nt, Homo sapiens
cucgaacuccugaccucaggug

SEQ ID NO: 2156887 - RNA, 18 nt, Homo sapiens
ccgaggcagguugaucac

SEQ ID NO: 2156888 - RNA, 20 nt, Homo sapiens
gcaucccugaaacaucucaa

SEQ ID NO: 2156889 - RNA, 13 nt, Homo sapiens
aaaauuguuucca

SEQ ID NO: 2156890 - RNA, 23 nt, Homo sapiens
ugaaaaaguauaaauaaaaugag

SEQ ID NO: 2156891 - RNA, 18 nt, Homo sapiens
aaccgaugguccucacaa

SEQ ID NO: 2156892 - RNA, 19 nt, Homo sapiens
gcuucccuaaucuaugguc

SEQ ID NO: 2156893 - RNA, 12 nt, Homo sapiens
cgccaggccagc

SEQ ID NO: 2156894 - RNA, 15 nt, Homo sapiens
auggaauaguuuugu

SEQ ID NO: 2156895 - RNA, 13 nt, Homo sapiens
cuacaacauaugg

SEQ ID NO: 2156896 - RNA, 19 nt, Homo sapiens
aacauuuacacauucucac

SEQ ID NO: 2156897 - RNA, 20 nt, Homo sapiens
uuguucuuucauauggaaug

SEQ ID NO: 2156898 - RNA, 15 nt, Homo sapiens
ugggauuugcagggu

SEQ ID NO: 2156899 - RNA, 11 nt, Homo sapiens
ugaaacacugg

SEQ ID NO: 2156900 - RNA, 11 nt, Homo sapiens
agaaacacagg

SEQ ID NO: 2156901 - RNA, 15 nt, Homo sapiens
cuuucugaaauaaca

SEQ ID NO: 2156902 - RNA, 14 nt, Homo sapiens
ccagccuccaugcu

SEQ ID NO: 2156903 - RNA, 14 nt, Homo sapiens
uaugguucucaggc

SEQ ID NO: 2156904 - RNA, 14 nt, Homo sapiens
caucucucccacuu

SEQ ID NO: 2156905 - RNA, 18 nt, Homo sapiens
auuuaaacaaugccaagu

SEQ ID NO: 2156906 - RNA, 19 nt, Homo sapiens
ugcauuuauaugcgcuuaa

SEQ ID NO: 2156907 - RNA, 22 nt, Homo sapiens
aaauuugcuauucccaugcauu

SEQ ID NO: 2156908 - RNA, 22 nt, Homo sapiens
aaauccccucagccucuucucu

SEQ ID NO: 2156909 - RNA, 21 nt, Homo sapiens
gaaaccaaagcuuuauuucaa

SEQ ID NO: 2156910 - RNA, 14 nt, Homo sapiens
aaguuucuaacuua

SEQ ID NO: 2156911 - RNA, 14 nt, Homo sapiens
uggcaucuugccaa

SEQ ID NO: 2156912 - RNA, 21 nt, Homo sapiens
cuacuuuauggcagacauugu

SEQ ID NO: 2156913 - RNA, 11 nt, Homo sapiens
ugaacaucucu

SEQ ID NO: 2156914 - RNA, 20 nt, Homo sapiens
uuuaaaggaaaaucacaucu

SEQ ID NO: 2156915 - RNA, 17 nt, Homo sapiens
aaucacccugacugugg

SEQ ID NO: 2156916 - RNA, 13 nt, Homo sapiens
guggcccagagaa

SEQ ID NO: 2156917 - RNA, 16 nt, Homo sapiens
ccagugccaagcacag

SEQ ID NO: 2156918 - RNA, 17 nt, Homo sapiens
aguucacacccugcaag

SEQ ID NO: 2156919 - RNA, 19 nt, Homo sapiens
uccuucacagaugggugcu

SEQ ID NO: 2156920 - RNA, 20 nt, Homo sapiens
aucuuagguaagacauauaa

SEQ ID NO: 2156921 - RNA, 19 nt, Homo sapiens
ugcaccuuucggcagagga

SEQ ID NO: 2156922 - RNA, 16 nt, Homo sapiens
accucucaacuuacau

SEQ ID NO: 2156923 - RNA, 21 nt, Homo sapiens
agggggugcaaagacucugag

SEQ ID NO: 2156924 - RNA, 23 nt, Homo sapiens
ccacauuaucaguugacagugua

SEQ ID NO: 2156925 - RNA, 15 nt, Homo sapiens
uucaucuucaccaga

SEQ ID NO: 2156926 - RNA, 18 nt, Homo sapiens
ucucuccuccacucugag

SEQ ID NO: 2156927 - RNA, 17 nt, Homo sapiens
aucccagcucacugcaa

SEQ ID NO: 2156928 - RNA, 11 nt, Homo sapiens
acgacacugca

SEQ ID NO: 2156929 - RNA, 19 nt, Homo sapiens
caaagguggcagcuuguga

SEQ ID NO: 2156930 - RNA, 16 nt, Homo sapiens
guuccucuuuguuuau

SEQ ID NO: 2156931 - RNA, 17 nt, Homo sapiens
cugaucgagcgcugucu

SEQ ID NO: 2156932 - RNA, 14 nt, Homo sapiens
gcucugagagggaa

SEQ ID NO: 2156933 - RNA, 20 nt, Homo sapiens
cuccaaugacugagcagcau

SEQ ID NO: 2156934 - RNA, 17 nt, Homo sapiens
gagcucuugcuaucucu

SEQ ID NO: 2156935 - RNA, 17 nt, Homo sapiens
uuugagguaaagauaug

SEQ ID NO: 2156936 - RNA, 16 nt, Homo sapiens
caaagcagcagugucc

SEQ ID NO: 2156937 - RNA, 19 nt, Homo sapiens
uuaaauggcaguauuucau

SEQ ID NO: 2156938 - RNA, 19 nt, Homo sapiens
aauuuaugaagauaguuua

SEQ ID NO: 2156939 - RNA, 22 nt, Homo sapiens
ugcagacgggcaagaagcugcu

SEQ ID NO: 2156940 - RNA, 18 nt, Homo sapiens
acugaauugccuguucau

SEQ ID NO: 2156941 - RNA, 15 nt, Homo sapiens
agaaucugcucugaa

SEQ ID NO: 2156942 - RNA, 16 nt, Homo sapiens
uaagaagaaggccaga

SEQ ID NO: 2156943 - RNA, 19 nt, Homo sapiens
uucaacaaagaaacaaaga

SEQ ID NO: 2156944 - RNA, 16 nt, Homo sapiens
ugauagaguguuauca

SEQ ID NO: 2156945 - RNA, 18 nt, Homo sapiens
cucgucuuucgcacauuc

SEQ ID NO: 2156946 - RNA, 20 nt, Homo sapiens
aggugaugcacccaccucag

SEQ ID NO: 2156947 - RNA, 12 nt, Homo sapiens
uauuagucacaa

SEQ ID NO: 2156948 - RNA, 19 nt, Homo sapiens
aacuauaagcaugaucuug

SEQ ID NO: 2156949 - RNA, 23 nt, Homo sapiens
gcaguuugaggauuaguuuagaa

SEQ ID NO: 2156950 - RNA, 15 nt, Homo sapiens
agcucccagaacuuc

SEQ ID NO: 2156951 - RNA, 15 nt, Homo sapiens
agcauaaaucacuuc

SEQ ID NO: 2156952 - RNA, 14 nt, Homo sapiens
auggggauggcugg

SEQ ID NO: 2156953 - RNA, 14 nt, Homo sapiens
augcuuacagugac

SEQ ID NO: 2156954 - RNA, 16 nt, Homo sapiens
gauacccugcccucca

SEQ ID NO: 2156955 - RNA, 19 nt, Homo sapiens
uacgcugccucaacacuga

SEQ ID NO: 2156956 - RNA, 13 nt, Homo sapiens
ugaucugcaagaa

SEQ ID NO: 2156957 - RNA, 16 nt, Homo sapiens
cggcuuucauguaauu

SEQ ID NO: 2156958 - RNA, 16 nt, Homo sapiens
cauuugaguauuacaa

SEQ ID NO: 2156959 - RNA, 15 nt, Homo sapiens
aggggugcugcuccu

SEQ ID NO: 2156960 - RNA, 20 nt, Homo sapiens
uuaaauagagaaauaugauu

SEQ ID NO: 2156961 - RNA, 21 nt, Homo sapiens
gauugccuuuggcaauucuuc

SEQ ID NO: 2156962 - RNA, 11 nt, Homo sapiens
aaaagggauac

SEQ ID NO: 2156963 - RNA, 22 nt, Homo sapiens
uguuccagggagcuucuaccug

SEQ ID NO: 2156964 - RNA, 14 nt, Homo sapiens
agguuagauucuca

SEQ ID NO: 2156965 - RNA, 23 nt, Homo sapiens
auauacuuauagaauucagucaa

SEQ ID NO: 2156966 - RNA, 19 nt, Homo sapiens
ugguuugggagcaauacuu

SEQ ID NO: 2156967 - RNA, 15 nt, Homo sapiens
cugggcccacaaagg

SEQ ID NO: 2156968 - RNA, 15 nt, Homo sapiens
ugacggcaccaucug

SEQ ID NO: 2156969 - RNA, 12 nt, Homo sapiens
guuccugauuau

SEQ ID NO: 2156970 - RNA, 17 nt, Homo sapiens
gauauauuaagugacug

SEQ ID NO: 2156971 - RNA, 11 nt, Homo sapiens
ucuagccaaau

SEQ ID NO: 2156972 - RNA, 22 nt, Homo sapiens
ugggucucucauaccucuggga

SEQ ID NO: 2156973 - RNA, 20 nt, Homo sapiens
gcaccacucugggcacaagc

SEQ ID NO: 2156974 - RNA, 18 nt, Homo sapiens
ucuugcugcuagaacuuu

SEQ ID NO: 2156975 - RNA, 21 nt, Homo sapiens
cccugaacucccagaaccacu

SEQ ID NO: 2156976 - RNA, 15 nt, Homo sapiens
uauuauugcugccaa

SEQ ID NO: 2156977 - RNA, 16 nt, Homo sapiens
cugggcuugggcacca

SEQ ID NO: 2156978 - RNA, 17 nt, Homo sapiens
ggaucuacccucuaguu

SEQ ID NO: 2156979 - RNA, 16 nt, Homo sapiens
ucccucugcagucucu

SEQ ID NO: 2156980 - RNA, 23 nt, Homo sapiens
uuuaaaaaucauuguauggauag

SEQ ID NO: 2156981 - RNA, 20 nt, Homo sapiens
uacagcagaaaggagaacua

SEQ ID NO: 2156982 - RNA, 17 nt, Homo sapiens
acugcaggcgcgcacac

SEQ ID NO: 2156983 - RNA, 13 nt, Homo sapiens
ucuuccagcccau

SEQ ID NO: 2156984 - RNA, 16 nt, Homo sapiens
ucuaauaaacuuuauu

SEQ ID NO: 2156985 - RNA, 21 nt, Homo sapiens
auguacacacacagaugcaca

SEQ ID NO: 2156986 - RNA, 16 nt, Homo sapiens
ucuuuugaacccagga

SEQ ID NO: 2156987 - RNA, 14 nt, Homo sapiens
aucccuacauguau

SEQ ID NO: 2156988 - RNA, 17 nt, Homo sapiens
gucaaagccuugguaaa

SEQ ID NO: 2156989 - RNA, 18 nt, Homo sapiens
ugugcaggagccucccug

SEQ ID NO: 2156990 - RNA, 17 nt, Homo sapiens
cccccucagcaaggggc

SEQ ID NO: 2156991 - RNA, 20 nt, Homo sapiens
aggccaaaggggaccuggaa

SEQ ID NO: 2156992 - RNA, 23 nt, Homo sapiens
uauucaaagagaaaacaucucau

SEQ ID NO: 2156993 - RNA, 12 nt, Homo sapiens
ccucuuaggcag

SEQ ID NO: 2156994 - RNA, 14 nt, Homo sapiens
cauacuguucaaug

SEQ ID NO: 2156995 - RNA, 16 nt, Homo sapiens
auaugcuuuacaaucu

SEQ ID NO: 2156996 - RNA, 17 nt, Homo sapiens
guauguaauuuaugcaa

SEQ ID NO: 2156997 - RNA, 13 nt, Homo sapiens
ugguuuacuucaa

SEQ ID NO: 2156998 - RNA, 14 nt, Homo sapiens
gccuuggaauucua

SEQ ID NO: 2156999 - RNA, 16 nt, Homo sapiens
uacauaagcagcauuu

SEQ ID NO: 2157000 - RNA, 14 nt, Homo sapiens
gacaaagagccaga

SEQ ID NO: 2157001 - RNA, 22 nt, Homo sapiens
auaaaaugguguuuucauguaa

SEQ ID NO: 2157002 - RNA, 12 nt, Homo sapiens
cuuuagcuguga

SEQ ID NO: 2157003 - RNA, 16 nt, Homo sapiens
ugguaaggcuggugag

SEQ ID NO: 2157004 - RNA, 20 nt, Homo sapiens
acgccguccagauucuccuu

SEQ ID NO: 2157005 - RNA, 12 nt, Homo sapiens
ggcagcaauuua

SEQ ID NO: 2157006 - RNA, 12 nt, Homo sapiens
accauugcuaau

SEQ ID NO: 2157007 - RNA, 19 nt, Homo sapiens
agcagcccccagguugccu

SEQ ID NO: 2157008 - RNA, 13 nt, Homo sapiens
ugauguuacuagc

SEQ ID NO: 2157009 - RNA, 18 nt, Homo sapiens
caaaggaacacugacauc

SEQ ID NO: 2157010 - RNA, 22 nt, Homo sapiens
uuaguaaaaauaaaucaaggcu

SEQ ID NO: 2157011 - RNA, 13 nt, Homo sapiens
auccuaugcaaua

SEQ ID NO: 2157012 - RNA, 18 nt, Homo sapiens
acugcauuaucuugcuca

SEQ ID NO: 2157013 - RNA, 21 nt, Homo sapiens
cagaauguuacugacuccuca

SEQ ID NO: 2157014 - RNA, 17 nt, Homo sapiens
ugccaaggcaagaucua

SEQ ID NO: 2157015 - RNA, 20 nt, Homo sapiens
accuuuucccuugcuguacc

SEQ ID NO: 2157016 - RNA, 15 nt, Homo sapiens
uaacagaauacauag

SEQ ID NO: 2157017 - RNA, 21 nt, Homo sapiens
cauuugcuucaggaguuucau

SEQ ID NO: 2157018 - RNA, 16 nt, Homo sapiens
gucucagucauaauca

SEQ ID NO: 2157019 - RNA, 19 nt, Homo sapiens
augggacacccaacacuuu

SEQ ID NO: 2157020 - RNA, 19 nt, Homo sapiens
gagccccuuucaggaggag

SEQ ID NO: 2157021 - RNA, 12 nt, Homo sapiens
agagugccacau

SEQ ID NO: 2157022 - RNA, 16 nt, Homo sapiens
aggagagcagcuguca

SEQ ID NO: 2157023 - RNA, 18 nt, Homo sapiens
ucaucccacaaucuuaag

SEQ ID NO: 2157024 - RNA, 15 nt, Homo sapiens
uuaacucucuguuac

SEQ ID NO: 2157025 - RNA, 17 nt, Homo sapiens
gaaauaaauaacuuugg

SEQ ID NO: 2157026 - RNA, 13 nt, Homo sapiens
ugcguuacuaauu

SEQ ID NO: 2157027 - RNA, 17 nt, Homo sapiens
cuagacagcuuuucuca

SEQ ID NO: 2157028 - RNA, 15 nt, Homo sapiens
gcuugccugaagcuu

SEQ ID NO: 2157029 - RNA, 22 nt, Homo sapiens
acugcagguugugcccuguggc

SEQ ID NO: 2157030 - RNA, 13 nt, Homo sapiens
cuggaacacaggg

SEQ ID NO: 2157031 - RNA, 19 nt, Homo sapiens
caaauggacauaagacaga

SEQ ID NO: 2157032 - RNA, 23 nt, Homo sapiens
cucacccccagguguugccauuu

SEQ ID NO: 2157033 - RNA, 21 nt, Homo sapiens
aaugagaagaaugacuaugca

SEQ ID NO: 2157034 - RNA, 19 nt, Homo sapiens
uaagauaaauagaguucca

SEQ ID NO: 2157035 - RNA, 23 nt, Homo sapiens
caggagguggagguugcagugag

SEQ ID NO: 2157036 - RNA, 13 nt, Homo sapiens
uugaaugaugcca

SEQ ID NO: 2157037 - RNA, 18 nt, Homo sapiens
caguucccucagcccuca

SEQ ID NO: 2157038 - RNA, 17 nt, Homo sapiens
aaucuaguauacauugu

SEQ ID NO: 2157039 - RNA, 17 nt, Homo sapiens
cuauaauaaguuuugau

SEQ ID NO: 2157040 - RNA, 15 nt, Homo sapiens
caaaaagaaaaccca

SEQ ID NO: 2157041 - RNA, 16 nt, Homo sapiens
auguggagaacuaaag

SEQ ID NO: 2157042 - RNA, 18 nt, Homo sapiens
acacucagaaggcuucau

SEQ ID NO: 2157043 - RNA, 15 nt, Homo sapiens
auugggggacguggg

SEQ ID NO: 2157044 - RNA, 11 nt, Homo sapiens
agaugucaagc

SEQ ID NO: 2157045 - RNA, 22 nt, Homo sapiens
agauaagacuuccucuaccacc

SEQ ID NO: 2157046 - RNA, 19 nt, Homo sapiens
aauuuucaaggagaaucaa

SEQ ID NO: 2157047 - RNA, 13 nt, Homo sapiens
caagugcuuccua

SEQ ID NO: 2157048 - RNA, 13 nt, Homo sapiens
ucaacauaugcaa

SEQ ID NO: 2157049 - RNA, 18 nt, Homo sapiens
gugauggcuaugccuugc

SEQ ID NO: 2157050 - RNA, 13 nt, Homo sapiens
gcugagcugugau

SEQ ID NO: 2157051 - RNA, 18 nt, Homo sapiens
ccaaauaccauguacaua

SEQ ID NO: 2157052 - RNA, 22 nt, Homo sapiens
ugcuugaagcaaacaguugaca

SEQ ID NO: 2157053 - RNA, 13 nt, Homo sapiens
acaggggagaaaa

SEQ ID NO: 2157054 - RNA, 14 nt, Homo sapiens
ugcccaauugagau

SEQ ID NO: 2157055 - RNA, 15 nt, Homo sapiens
ugaaugcacagugaa

SEQ ID NO: 2157056 - RNA, 12 nt, Homo sapiens
gcuuauuucccu

SEQ ID NO: 2157057 - RNA, 20 nt, Homo sapiens
auucuguuauacuucuguac

SEQ ID NO: 2157058 - RNA, 16 nt, Homo sapiens
aauucauuugcuugca

SEQ ID NO: 2157059 - RNA, 22 nt, Homo sapiens
cccaggaagucauccugcaaug

SEQ ID NO: 2157060 - RNA, 20 nt, Homo sapiens
uaaaaaaaaaccuagcaucu

SEQ ID NO: 2157061 - RNA, 20 nt, Homo sapiens
uuucaaaauuaauagcuuuu

SEQ ID NO: 2157062 - RNA, 15 nt, Homo sapiens
augcugggcaaugag

SEQ ID NO: 2157063 - RNA, 22 nt, Homo sapiens
agcuaagugaauuuuugcacau

SEQ ID NO: 2157064 - RNA, 13 nt, Homo sapiens
cugagaccagugu

SEQ ID NO: 2157065 - RNA, 15 nt, Homo sapiens
ucuuagugucacuua

SEQ ID NO: 2157066 - RNA, 12 nt, Homo sapiens
auguaacacugg

SEQ ID NO: 2157067 - RNA, 16 nt, Homo sapiens
cucugugauuaccucu

SEQ ID NO: 2157068 - RNA, 22 nt, Homo sapiens
aagacuggcaagaaaagaguua

SEQ ID NO: 2157069 - RNA, 22 nt, Homo sapiens
uuccugauagagguauggaaag

SEQ ID NO: 2157070 - RNA, 20 nt, Homo sapiens
auuucggaccgaaggugaca

SEQ ID NO: 2157071 - RNA, 17 nt, Homo sapiens
cugggcccgagccugaa

SEQ ID NO: 2157072 - RNA, 22 nt, Homo sapiens
ugucacccugcaggacuugcca

SEQ ID NO: 2157073 - RNA, 15 nt, Homo sapiens
cuuuuggagcugaga

SEQ ID NO: 2157074 - RNA, 21 nt, Homo sapiens
aaagcaaucugagagauuuga

SEQ ID NO: 2157075 - RNA, 15 nt, Homo sapiens
gcuuuagacuugaaa

SEQ ID NO: 2157076 - RNA, 19 nt, Homo sapiens
agguuucuggcagccagua

SEQ ID NO: 2157077 - RNA, 14 nt, Homo sapiens
ccacugacccaaau

SEQ ID NO: 2157078 - RNA, 16 nt, Homo sapiens
guucuuaauugcacuc

SEQ ID NO: 2157079 - RNA, 20 nt, Homo sapiens
auccauuaccuccauccauc

SEQ ID NO: 2157080 - RNA, 20 nt, Homo sapiens
gugaacacucaugcggccca

SEQ ID NO: 2157081 - RNA, 12 nt, Homo sapiens
uccaagcaccca

SEQ ID NO: 2157082 - RNA, 17 nt, Homo sapiens
uuguacccuggcuacaa

SEQ ID NO: 2157083 - RNA, 21 nt, Homo sapiens
ucuucagauauaagacuuucc

SEQ ID NO: 2157084 - RNA, 13 nt, Homo sapiens
uuaggguauuuag

SEQ ID NO: 2157085 - RNA, 13 nt, Homo sapiens
ugaguguauguau

SEQ ID NO: 2157086 - RNA, 14 nt, Homo sapiens
acccccagccuggg

SEQ ID NO: 2157087 - RNA, 16 nt, Homo sapiens
uuauaaaccaaucuua

SEQ ID NO: 2157088 - RNA, 18 nt, Homo sapiens
ugaaauaaaagccucugg

SEQ ID NO: 2157089 - RNA, 16 nt, Homo sapiens
ccagggcauugcucag

SEQ ID NO: 2157090 - RNA, 17 nt, Homo sapiens
gagugacggcaaccugc

SEQ ID NO: 2157091 - RNA, 14 nt, Homo sapiens
cacagcuaaccacu

SEQ ID NO: 2157092 - RNA, 16 nt, Homo sapiens
ccagcccagcacugga

SEQ ID NO: 2157093 - RNA, 20 nt, Homo sapiens
gaauauuaucaguggcugcc

SEQ ID NO: 2157094 - RNA, 14 nt, Homo sapiens
ucccccaaaguuca

SEQ ID NO: 2157095 - RNA, 12 nt, Homo sapiens
agaaaugaauua

SEQ ID NO: 2157096 - RNA, 22 nt, Homo sapiens
aaccaugagaccacuguuauca

SEQ ID NO: 2157097 - RNA, 17 nt, Homo sapiens
uucugaugaaucucaaa

SEQ ID NO: 2157098 - RNA, 13 nt, Homo sapiens
aggcaagagauga

SEQ ID NO: 2157099 - RNA, 19 nt, Homo sapiens
uuucagcaaaacuuuccaa

SEQ ID NO: 2157100 - RNA, 18 nt, Homo sapiens
uucuaaauaaauuuccca

SEQ ID NO: 2157101 - RNA, 19 nt, Homo sapiens
uaucaacuggggggaccaa

SEQ ID NO: 2157102 - RNA, 22 nt, Homo sapiens
uuuacucagaggagcugcaaau

SEQ ID NO: 2157103 - RNA, 15 nt, Homo sapiens
cugccccccaugagg

SEQ ID NO: 2157104 - RNA, 22 nt, Homo sapiens
uccagcacccccagugcagcuc

SEQ ID NO: 2157105 - RNA, 21 nt, Homo sapiens
ugcaucugcuacugugucagg

SEQ ID NO: 2157106 - RNA, 18 nt, Homo sapiens
ucugugcaacaaacucaa

SEQ ID NO: 2157107 - RNA, 20 nt, Homo sapiens
agaaccacacuugaaaccuu

SEQ ID NO: 2157108 - RNA, 17 nt, Homo sapiens
auguuuacucauugccc

SEQ ID NO: 2157109 - RNA, 20 nt, Homo sapiens
cauaucuccuuccccuacac

SEQ ID NO: 2157110 - RNA, 20 nt, Homo sapiens
cuggagggaggggugagaua

SEQ ID NO: 2157111 - RNA, 18 nt, Homo sapiens
uccuuucuuuaaacuaua

SEQ ID NO: 2157112 - RNA, 12 nt, Homo sapiens
acacacaaagag

SEQ ID NO: 2157113 - RNA, 12 nt, Homo sapiens
ugagacaaucac

SEQ ID NO: 2157114 - RNA, 12 nt, Homo sapiens
ccaggcacuguu

SEQ ID NO: 2157115 - RNA, 21 nt, Homo sapiens
uuuugcaauuggaauaaucac

SEQ ID NO: 2157116 - RNA, 21 nt, Homo sapiens
agaauguuacuuuggaaugac

SEQ ID NO: 2157117 - RNA, 13 nt, Homo sapiens
cuugccacugcca

SEQ ID NO: 2157118 - RNA, 23 nt, Homo sapiens
cuggccacuccccagugcuccug

SEQ ID NO: 2157119 - RNA, 13 nt, Homo sapiens
gagagaacuggag

SEQ ID NO: 2157120 - RNA, 18 nt, Homo sapiens
uauggucauauuucacag

SEQ ID NO: 2157121 - RNA, 18 nt, Homo sapiens
cggcaccauggcuacuac

SEQ ID NO: 2157122 - RNA, 22 nt, Homo sapiens
uaugcuuuccuucuuugggaua

SEQ ID NO: 2157123 - RNA, 17 nt, Homo sapiens
agucauuccaagaacua

SEQ ID NO: 2157124 - RNA, 22 nt, Homo sapiens
gaccgcaggccucagcaucucc

SEQ ID NO: 2157125 - RNA, 14 nt, Homo sapiens
uuuucugucucucu

SEQ ID NO: 2157126 - RNA, 21 nt, Homo sapiens
uucuccaccugaagugaugau

SEQ ID NO: 2157127 - RNA, 17 nt, Homo sapiens
ucaaagaaaacauagca

SEQ ID NO: 2157128 - RNA, 19 nt, Homo sapiens
ugccccugcaguuggcaga

SEQ ID NO: 2157129 - RNA, 15 nt, Homo sapiens
uucaguaagucucau

SEQ ID NO: 2157130 - RNA, 17 nt, Homo sapiens
gaagccaggacugugau

SEQ ID NO: 2157131 - RNA, 21 nt, Homo sapiens
cagugugcuugggaucuucaa

SEQ ID NO: 2157132 - RNA, 22 nt, Homo sapiens
cuguaagaagcggcauagcacc

SEQ ID NO: 2157133 - RNA, 13 nt, Homo sapiens
aauaauuaucaca

SEQ ID NO: 2157134 - RNA, 18 nt, Homo sapiens
acccccaucgcucugagc

SEQ ID NO: 2157135 - RNA, 20 nt, Homo sapiens
caggguuuugccauguugcc

SEQ ID NO: 2157136 - RNA, 21 nt, Homo sapiens
aaaaggaaaccaaguggucag

SEQ ID NO: 2157137 - RNA, 17 nt, Homo sapiens
agccuucugacaagcaa

SEQ ID NO: 2157138 - RNA, 23 nt, Homo sapiens
uagcucauuugagauaaagucaa

SEQ ID NO: 2157139 - RNA, 14 nt, Homo sapiens
caccuauugaauua

SEQ ID NO: 2157140 - RNA, 14 nt, Homo sapiens
cccuuguugcacug

SEQ ID NO: 2157141 - RNA, 17 nt, Homo sapiens
uugacugaagacauuuc

SEQ ID NO: 2157142 - RNA, 17 nt, Homo sapiens
cugagaaauguucagaa

SEQ ID NO: 2157143 - RNA, 18 nt, Homo sapiens
auacccugcccuugacau

SEQ ID NO: 2157144 - RNA, 17 nt, Homo sapiens
agccuggucugugcauu

SEQ ID NO: 2157145 - RNA, 22 nt, Homo sapiens
uagauacucuuauuuuacugag

SEQ ID NO: 2157146 - RNA, 22 nt, Homo sapiens
agugcaacagcacuggcucucu

SEQ ID NO: 2157147 - RNA, 17 nt, Homo sapiens
gaaaaucaucuuggcca

SEQ ID NO: 2157148 - RNA, 13 nt, Homo sapiens
uucaagcaaagua

SEQ ID NO: 2157149 - RNA, 14 nt, Homo sapiens
caguaccaguguaa

SEQ ID NO: 2157150 - RNA, 15 nt, Homo sapiens
ucaauuccguagcca

SEQ ID NO: 2157151 - RNA, 14 nt, Homo sapiens
gaggaugagcucua

SEQ ID NO: 2157152 - RNA, 18 nt, Homo sapiens
gucauggcauucgcagug

SEQ ID NO: 2157153 - RNA, 13 nt, Homo sapiens
ugcuaucagaaau

SEQ ID NO: 2157154 - RNA, 13 nt, Homo sapiens
cagugcauaugca

SEQ ID NO: 2157155 - RNA, 15 nt, Homo sapiens
uggauuacuauugca

SEQ ID NO: 2157156 - RNA, 22 nt, Homo sapiens
ugaccacucuucuuuaagccau

SEQ ID NO: 2157157 - RNA, 14 nt, Homo sapiens
cacagucacaugcc

SEQ ID NO: 2157158 - RNA, 23 nt, Homo sapiens
auucccagcaccuaguaugcuca

SEQ ID NO: 2157159 - RNA, 20 nt, Homo sapiens
cuggggcccaaguugcagug

SEQ ID NO: 2157160 - RNA, 15 nt, Homo sapiens
gccuauagacacuua

SEQ ID NO: 2157161 - RNA, 19 nt, Homo sapiens
aaaggccagcugacuagau

SEQ ID NO: 2157162 - RNA, 19 nt, Homo sapiens
acguguuuuuguaucuuua

SEQ ID NO: 2157163 - RNA, 16 nt, Homo sapiens
gcuuggaaaggaaggu

SEQ ID NO: 2157164 - RNA, 23 nt, Homo sapiens
aauggcaucaaccaccauggauu

SEQ ID NO: 2157165 - RNA, 18 nt, Homo sapiens
ucaagucaacaugcauau

SEQ ID NO: 2157166 - RNA, 22 nt, Homo sapiens
gaaaaacccguaagauuccuuu

SEQ ID NO: 2157167 - RNA, 23 nt, Homo sapiens
cccaguguggccccagcccgaca

SEQ ID NO: 2157168 - RNA, 15 nt, Homo sapiens
ccugcaucugaccag

SEQ ID NO: 2157169 - RNA, 20 nt, Homo sapiens
ucgcaccuaccaucagggac

SEQ ID NO: 2157170 - RNA, 23 nt, Homo sapiens
ggcaagaggaauuacgugcucug

SEQ ID NO: 2157171 - RNA, 12 nt, Homo sapiens
gccugcacacaa

SEQ ID NO: 2157172 - RNA, 19 nt, Homo sapiens
agaaaggucauccaaagaa

SEQ ID NO: 2157173 - RNA, 15 nt, Homo sapiens
cugcccagugcacuu

SEQ ID NO: 2157174 - RNA, 12 nt, Homo sapiens
gcauaugauuua

SEQ ID NO: 2157175 - RNA, 20 nt, Homo sapiens
gccugugagccccaggcacu

SEQ ID NO: 2157176 - RNA, 15 nt, Homo sapiens
cgaaaaguugguguc

SEQ ID NO: 2157177 - RNA, 12 nt, Homo sapiens
uaaaauacucuu

SEQ ID NO: 2157178 - RNA, 17 nt, Homo sapiens
cauuauaaacgugauga

SEQ ID NO: 2157179 - RNA, 15 nt, Homo sapiens
gcagaaucucagaga

SEQ ID NO: 2157180 - RNA, 17 nt, Homo sapiens
uggcuagucacauauca

SEQ ID NO: 2157181 - RNA, 17 nt, Homo sapiens
acugcaacuucuguccc

SEQ ID NO: 2157182 - RNA, 23 nt, Homo sapiens
agcugauacaaauugcagacugu

SEQ ID NO: 2157183 - RNA, 17 nt, Homo sapiens
caauuacauaguccagu

SEQ ID NO: 2157184 - RNA, 15 nt, Homo sapiens
acucauuuacacagu

SEQ ID NO: 2157185 - RNA, 23 nt, Homo sapiens
cagccugaauaaaccaagacaag

SEQ ID NO: 2157186 - RNA, 22 nt, Homo sapiens
agaauuauaucacuucacuguu

SEQ ID NO: 2157187 - RNA, 15 nt, Homo sapiens
gaguuaaaucucaaa

SEQ ID NO: 2157188 - RNA, 14 nt, Homo sapiens
aaagguaauggacu

SEQ ID NO: 2157189 - RNA, 19 nt, Homo sapiens
acccucugcuaugucugug

SEQ ID NO: 2157190 - RNA, 13 nt, Homo sapiens
ucaggauaccaua

SEQ ID NO: 2157191 - RNA, 20 nt, Homo sapiens
guccuuuccugaagugucga

SEQ ID NO: 2157192 - RNA, 14 nt, Homo sapiens
cuuucaaugcugac

SEQ ID NO: 2157193 - RNA, 19 nt, Homo sapiens
uaucucuaaaaacauagaa

SEQ ID NO: 2157194 - RNA, 12 nt, Homo sapiens
uguuagccuuag

SEQ ID NO: 2157195 - RNA, 12 nt, Homo sapiens
ugagagccuuuu

SEQ ID NO: 2157196 - RNA, 17 nt, Homo sapiens
gauucuccacggugguc

SEQ ID NO: 2157197 - RNA, 23 nt, Homo sapiens
caaagccgcggggacaccgggaa

SEQ ID NO: 2157198 - RNA, 20 nt, Homo sapiens
aaggcuggauggcaccucag

SEQ ID NO: 2157199 - RNA, 14 nt, Homo sapiens
caauuugcacuuuc

SEQ ID NO: 2157200 - RNA, 17 nt, Homo sapiens
gcagucucagaaagccu

SEQ ID NO: 2157201 - RNA, 14 nt, Homo sapiens
guguucaggauacu

SEQ ID NO: 2157202 - RNA, 15 nt, Homo sapiens
agcccauucccaagg

SEQ ID NO: 2157203 - RNA, 18 nt, Homo sapiens
caaauagguauguagcag

SEQ ID NO: 2157204 - RNA, 21 nt, Homo sapiens
gucacugacucaagacacuga

SEQ ID NO: 2157205 - RNA, 19 nt, Homo sapiens
agaggcugagacaggagaa

SEQ ID NO: 2157206 - RNA, 13 nt, Homo sapiens
gcacugaugcugc

SEQ ID NO: 2157207 - RNA, 14 nt, Homo sapiens
aguauaaucuuuuc

SEQ ID NO: 2157208 - RNA, 20 nt, Homo sapiens
uaagcuuucaauaguggcau

SEQ ID NO: 2157209 - RNA, 20 nt, Homo sapiens
acuugccucacuggacucuu

SEQ ID NO: 2157210 - RNA, 14 nt, Homo sapiens
uggagggagcucca

SEQ ID NO: 2157211 - RNA, 19 nt, Homo sapiens
gugaaacggaugaggucau

SEQ ID NO: 2157212 - RNA, 11 nt, Homo sapiens
agaucacuuga

SEQ ID NO: 2157213 - RNA, 23 nt, Homo sapiens
auguuaaaucaauaaagaccacu

SEQ ID NO: 2157214 - RNA, 22 nt, Homo sapiens
cucguucuuauuuaaucuccau

SEQ ID NO: 2157215 - RNA, 19 nt, Homo sapiens
agguucuggugugaacuaa

SEQ ID NO: 2157216 - RNA, 13 nt, Homo sapiens
aacccccagugua

SEQ ID NO: 2157217 - RNA, 13 nt, Homo sapiens
cuguguaccacug

SEQ ID NO: 2157218 - RNA, 21 nt, Homo sapiens
cuugaggaauaaaugccuuua

SEQ ID NO: 2157219 - RNA, 14 nt, Homo sapiens
gaagggacacagag

SEQ ID NO: 2157220 - RNA, 21 nt, Homo sapiens
gcugugaucagugauuuucaa

SEQ ID NO: 2157221 - RNA, 14 nt, Homo sapiens
aggggacugagcug

SEQ ID NO: 2157222 - RNA, 19 nt, Homo sapiens
uauuuuuacaagaaguuua

SEQ ID NO: 2157223 - RNA, 21 nt, Homo sapiens
cuuauuuuaauuccacuuuaa

SEQ ID NO: 2157224 - RNA, 14 nt, Homo sapiens
agagaauaaucaua

SEQ ID NO: 2157225 - RNA, 19 nt, Homo sapiens
uccccugccuccuacucca

SEQ ID NO: 2157226 - RNA, 20 nt, Homo sapiens
aaaugaaaagagaaugaugc

SEQ ID NO: 2157227 - RNA, 18 nt, Homo sapiens
aaguaaauuuguccaaug

SEQ ID NO: 2157228 - RNA, 14 nt, Homo sapiens
acucagagugcaag

SEQ ID NO: 2157229 - RNA, 13 nt, Homo sapiens
ccuccauccagaa

SEQ ID NO: 2157230 - RNA, 23 nt, Homo sapiens
aguucagcugccccacaggugug

SEQ ID NO: 2157231 - RNA, 21 nt, Homo sapiens
acacuuugccaaacaggaugu

SEQ ID NO: 2157232 - RNA, 21 nt, Homo sapiens
acuucacugcagccuuucaca

SEQ ID NO: 2157233 - RNA, 18 nt, Homo sapiens
ugcuacauucuaaugcau

SEQ ID NO: 2157234 - RNA, 18 nt, Homo sapiens
uucacacaguaaagcagg

SEQ ID NO: 2157235 - RNA, 16 nt, Homo sapiens
ucgucucccuggugcc

SEQ ID NO: 2157236 - RNA, 15 nt, Homo sapiens
uggggaucagacaga

SEQ ID NO: 2157237 - RNA, 18 nt, Homo sapiens
cuacauaaggaugaaggu

SEQ ID NO: 2157238 - RNA, 18 nt, Homo sapiens
uaaaacuggcccuguuuc

SEQ ID NO: 2157239 - RNA, 22 nt, Homo sapiens
agugcaucuuugccucaacucc

SEQ ID NO: 2157240 - RNA, 14 nt, Homo sapiens
ccugucucccccaa

SEQ ID NO: 2157241 - RNA, 11 nt, Homo sapiens
gccgcugugcc

SEQ ID NO: 2157242 - RNA, 13 nt, Homo sapiens
ucuggauauuuca

SEQ ID NO: 2157243 - RNA, 21 nt, Homo sapiens
ccuggacgcccccgcccgcac

SEQ ID NO: 2157244 - RNA, 20 nt, Homo sapiens
cuucaggaauguggcugcaa

SEQ ID NO: 2157245 - RNA, 15 nt, Homo sapiens
aaggccccucugcaa

SEQ ID NO: 2157246 - RNA, 14 nt, Homo sapiens
gcuccaaggcagug

SEQ ID NO: 2157247 - RNA, 23 nt, Homo sapiens
augcuugauuuagguagccuugu

SEQ ID NO: 2157248 - RNA, 21 nt, Homo sapiens
caaagcacuagagaaugcaca

SEQ ID NO: 2157249 - RNA, 15 nt, Homo sapiens
uccagcaucaauucc

SEQ ID NO: 2157250 - RNA, 15 nt, Homo sapiens
aagagaacuaaagcu

SEQ ID NO: 2157251 - RNA, 13 nt, Homo sapiens
acaauacuugcau

SEQ ID NO: 2157252 - RNA, 13 nt, Homo sapiens
gguaggggguccc

SEQ ID NO: 2157253 - RNA, 17 nt, Homo sapiens
accauucuggacacugu

SEQ ID NO: 2157254 - RNA, 14 nt, Homo sapiens
acuugaaccuaaua

SEQ ID NO: 2157255 - RNA, 16 nt, Homo sapiens
cacagacugcgauuug

SEQ ID NO: 2157256 - RNA, 19 nt, Homo sapiens
uccuugaguaguuuuuauc

SEQ ID NO: 2157257 - RNA, 20 nt, Homo sapiens
cucucuuuguucucagcucc

SEQ ID NO: 2157258 - RNA, 17 nt, Homo sapiens
ccagauguuaugcuccu

SEQ ID NO: 2157259 - RNA, 17 nt, Homo sapiens
aagagguaaaaaacugu

SEQ ID NO: 2157260 - RNA, 13 nt, Homo sapiens
ugaaacuucauca

SEQ ID NO: 2157261 - RNA, 20 nt, Homo sapiens
ugcuuaggcuguauauucaa

SEQ ID NO: 2157262 - RNA, 23 nt, Homo sapiens
uaagugccaacaauuuucuagau

SEQ ID NO: 2157263 - RNA, 23 nt, Homo sapiens
caucugcacuaauugacccaaaa

SEQ ID NO: 2157264 - RNA, 14 nt, Homo sapiens
gcccagcucugacu

SEQ ID NO: 2157265 - RNA, 20 nt, Homo sapiens
uauaauuucaaaccacacau

SEQ ID NO: 2157266 - RNA, 21 nt, Homo sapiens
uuaacagagauugaacuccaa

SEQ ID NO: 2157267 - RNA, 20 nt, Homo sapiens
caucagaguauuaucacugc

SEQ ID NO: 2157268 - RNA, 14 nt, Homo sapiens
gcagaaauugaccu

SEQ ID NO: 2157269 - RNA, 20 nt, Homo sapiens
ccuuucuagccuuagacaaa

SEQ ID NO: 2157270 - RNA, 14 nt, Homo sapiens
cuuacuaguguuug

SEQ ID NO: 2157271 - RNA, 17 nt, Homo sapiens
agcugccuuuuuuaaca

SEQ ID NO: 2157272 - RNA, 17 nt, Homo sapiens
cagccccaacuccaggg

SEQ ID NO: 2157273 - RNA, 13 nt, Homo sapiens
aguacauacucaa

SEQ ID NO: 2157274 - RNA, 13 nt, Homo sapiens
aaguaaaaccaca

SEQ ID NO: 2157275 - RNA, 18 nt, Homo sapiens
aauuccagcaucugaaga

SEQ ID NO: 2157276 - RNA, 16 nt, Homo sapiens
aauaucugcuuuaaua

SEQ ID NO: 2157277 - RNA, 22 nt, Homo sapiens
gccuuuugcucacaaaaccugg

SEQ ID NO: 2157278 - RNA, 20 nt, Homo sapiens
cagauucuaggaccuguguc

SEQ ID NO: 2157279 - RNA, 23 nt, Homo sapiens
guguggauuuucuacuguaagaa

SEQ ID NO: 2157280 - RNA, 12 nt, Homo sapiens
cauuucuuccca

SEQ ID NO: 2157281 - RNA, 15 nt, Homo sapiens
ccaggagacauauau

SEQ ID NO: 2157282 - RNA, 17 nt, Homo sapiens
gaauguggcaguuuaaa

SEQ ID NO: 2157283 - RNA, 16 nt, Homo sapiens
cuggucagcauguacu

SEQ ID NO: 2157284 - RNA, 19 nt, Homo sapiens
ucccggcgucccuaccucc

SEQ ID NO: 2157285 - RNA, 20 nt, Homo sapiens
ucagacauuuauauauugga

SEQ ID NO: 2157286 - RNA, 15 nt, Homo sapiens
caggggcaugacugu

SEQ ID NO: 2157287 - RNA, 19 nt, Homo sapiens
uguauuuauaguaaccauu

SEQ ID NO: 2157288 - RNA, 15 nt, Homo sapiens
gcuuuguacugcugu

SEQ ID NO: 2157289 - RNA, 13 nt, Homo sapiens
cacacugcuugug

SEQ ID NO: 2157290 - RNA, 15 nt, Homo sapiens
aauacaaaaagcaaa

SEQ ID NO: 2157291 - RNA, 16 nt, Homo sapiens
aucuguuuucuaccuc

SEQ ID NO: 2157292 - RNA, 23 nt, Homo sapiens
cagaaccccugucacacagggaa

SEQ ID NO: 2157293 - RNA, 17 nt, Homo sapiens
gcccgcagcacauuucc

SEQ ID NO: 2157294 - RNA, 12 nt, Homo sapiens
uuccacaggaca

SEQ ID NO: 2157295 - RNA, 17 nt, Homo sapiens
aagccuuaauuugcaca

SEQ ID NO: 2157296 - RNA, 18 nt, Homo sapiens
cacugaagggaaucacau

SEQ ID NO: 2157297 - RNA, 17 nt, Homo sapiens
aaauggaugcggugaca

SEQ ID NO: 2157298 - RNA, 18 nt, Homo sapiens
ucuccuuuucuccacugu

SEQ ID NO: 2157299 - RNA, 19 nt, Homo sapiens
cuguggagcuccacugcca

SEQ ID NO: 2157300 - RNA, 12 nt, Homo sapiens
cuuugacccagg

SEQ ID NO: 2157301 - RNA, 16 nt, Homo sapiens
uuuaauggacacuuuu

SEQ ID NO: 2157302 - RNA, 13 nt, Homo sapiens
aucuguugcuaug

SEQ ID NO: 2157303 - RNA, 13 nt, Homo sapiens
aaaaauugcacaa

SEQ ID NO: 2157304 - RNA, 11 nt, Homo sapiens
accacagcagc

SEQ ID NO: 2157305 - RNA, 15 nt, Homo sapiens
uccuuggcuuuaugc

SEQ ID NO: 2157306 - RNA, 16 nt, Homo sapiens
guugaggcugucacag

SEQ ID NO: 2157307 - RNA, 16 nt, Homo sapiens
aaaauuaaacuuccuu

SEQ ID NO: 2157308 - RNA, 15 nt, Homo sapiens
agcccauaaggccag

SEQ ID NO: 2157309 - RNA, 13 nt, Homo sapiens
gaacucuggucuc

SEQ ID NO: 2157310 - RNA, 15 nt, Homo sapiens
auuucuuaaguauaa

SEQ ID NO: 2157311 - RNA, 23 nt, Homo sapiens
aaauccucagguaguacugggaa

SEQ ID NO: 2157312 - RNA, 20 nt, Homo sapiens
uccccagcucccccaggcag

SEQ ID NO: 2157313 - RNA, 13 nt, Homo sapiens
aaaucaaaugugc

SEQ ID NO: 2157314 - RNA, 13 nt, Homo sapiens
uguuuaaaaaagu

SEQ ID NO: 2157315 - RNA, 15 nt, Homo sapiens
aggaaccuaauugaa

SEQ ID NO: 2157316 - RNA, 17 nt, Homo sapiens
uuccaaguuuauugccc

SEQ ID NO: 2157317 - RNA, 16 nt, Homo sapiens
cggagggaguggcacu

SEQ ID NO: 2157318 - RNA, 17 nt, Homo sapiens
ugcuguuccaccaaaua

SEQ ID NO: 2157319 - RNA, 20 nt, Homo sapiens
auaaguuauuuuuguacaug

SEQ ID NO: 2157320 - RNA, 18 nt, Homo sapiens
uauuguaaaacauucaca

SEQ ID NO: 2157321 - RNA, 17 nt, Homo sapiens
acuguacugacuugagg

SEQ ID NO: 2157322 - RNA, 16 nt, Homo sapiens
ggcccuggcuguaaua

SEQ ID NO: 2157323 - RNA, 21 nt, Homo sapiens
uucauuuaggugaggaagcaa

SEQ ID NO: 2157324 - RNA, 22 nt, Homo sapiens
cccguggucuccuugcacuuuc

SEQ ID NO: 2157325 - RNA, 19 nt, Homo sapiens
aguaccaacucuccaaaac

SEQ ID NO: 2157326 - RNA, 14 nt, Homo sapiens
auuuuccucugcuu

SEQ ID NO: 2157327 - RNA, 21 nt, Homo sapiens
ggccucugcucuccugggaga

SEQ ID NO: 2157328 - RNA, 15 nt, Homo sapiens
uuauuaauauugugc

SEQ ID NO: 2157329 - RNA, 19 nt, Homo sapiens
uuggacacugugcuacuga

SEQ ID NO: 2157330 - RNA, 21 nt, Homo sapiens
auuucaagacagauugugaag

SEQ ID NO: 2157331 - RNA, 13 nt, Homo sapiens
guauaaaugaagu

SEQ ID NO: 2157332 - RNA, 13 nt, Homo sapiens
uauuuaauuuuga

SEQ ID NO: 2157333 - RNA, 16 nt, Homo sapiens
ucauaggcaguaaugu

SEQ ID NO: 2157334 - RNA, 19 nt, Homo sapiens
aaccuaaugcucucaggga

SEQ ID NO: 2157335 - RNA, 22 nt, Homo sapiens
gccugguucccuccccaaggcc

SEQ ID NO: 2157336 - RNA, 20 nt, Homo sapiens
agcucagcauuuccacacca

SEQ ID NO: 2157337 - RNA, 16 nt, Homo sapiens
cccugcugaugccaca

SEQ ID NO: 2157338 - RNA, 13 nt, Homo sapiens
agcgagacuccac

SEQ ID NO: 2157339 - RNA, 16 nt, Homo sapiens
ucccuaggcaccucug

SEQ ID NO: 2157340 - RNA, 19 nt, Homo sapiens
cuggcagggcucacacucc

SEQ ID NO: 2157341 - RNA, 15 nt, Homo sapiens
aacaaaaauguacaa

SEQ ID NO: 2157342 - RNA, 17 nt, Homo sapiens
cugaguacguugugcau

SEQ ID NO: 2157343 - RNA, 15 nt, Homo sapiens
cagagcugccugcuc

SEQ ID NO: 2157344 - RNA, 23 nt, Homo sapiens
cagacuagacaccuucugugcuc

SEQ ID NO: 2157345 - RNA, 14 nt, Homo sapiens
acucuguugaauau

SEQ ID NO: 2157346 - RNA, 14 nt, Homo sapiens
augcagauugcuac

SEQ ID NO: 2157347 - RNA, 21 nt, Homo sapiens
guuaagauaauuguacuuuga

SEQ ID NO: 2157348 - RNA, 14 nt, Homo sapiens
ucuccuuacugugu

SEQ ID NO: 2157349 - RNA, 15 nt, Homo sapiens
gcgggacugucaaug

SEQ ID NO: 2157350 - RNA, 21 nt, Homo sapiens
cugagaguuuaguuguagcag

SEQ ID NO: 2157351 - RNA, 14 nt, Homo sapiens
auuccaucuuacau

SEQ ID NO: 2157352 - RNA, 13 nt, Homo sapiens
uuauguacuguac

SEQ ID NO: 2157353 - RNA, 17 nt, Homo sapiens
acauacuucuuacuugu

SEQ ID NO: 2157354 - RNA, 12 nt, Homo sapiens
cuuuucugccac

SEQ ID NO: 2157355 - RNA, 12 nt, Homo sapiens
uguacaguuugc

SEQ ID NO: 2157356 - RNA, 12 nt, Homo sapiens
ccuuccacugua

SEQ ID NO: 2157357 - RNA, 16 nt, Homo sapiens
auggacgaacugcgca

SEQ ID NO: 2157358 - RNA, 19 nt, Homo sapiens
uguuuucaccucauaugcu

SEQ ID NO: 2157359 - RNA, 16 nt, Homo sapiens
aaucaccaaaugcuuu

SEQ ID NO: 2157360 - RNA, 20 nt, Homo sapiens
aaaugggcuacuuuguccuu

SEQ ID NO: 2157361 - RNA, 22 nt, Homo sapiens
cauagauucaccuguaaaacuu

SEQ ID NO: 2157362 - RNA, 22 nt, Homo sapiens
guccuacggagggaccaggugu

SEQ ID NO: 2157363 - RNA, 19 nt, Homo sapiens
uggagacagagucucgcua

SEQ ID NO: 2157364 - RNA, 22 nt, Homo sapiens
gcguguucuguuggcaagccac

SEQ ID NO: 2157365 - RNA, 19 nt, Homo sapiens
cccucggugcagagugcag

SEQ ID NO: 2157366 - RNA, 18 nt, Homo sapiens
ugugggaucauugcauuu

SEQ ID NO: 2157367 - RNA, 17 nt, Homo sapiens
ccucaacugagggccag

SEQ ID NO: 2157368 - RNA, 13 nt, Homo sapiens
aaccucuuuccaa

SEQ ID NO: 2157369 - RNA, 15 nt, Homo sapiens
acagaaaacauguaa

SEQ ID NO: 2157370 - RNA, 17 nt, Homo sapiens
cagcagccucccuguca

SEQ ID NO: 2157371 - RNA, 15 nt, Homo sapiens
cgggcacccacaagc

SEQ ID NO: 2157372 - RNA, 22 nt, Homo sapiens
auccccaagccuggcaagggaa

SEQ ID NO: 2157373 - RNA, 19 nt, Homo sapiens
ccagcacuuugggagacca

SEQ ID NO: 2157374 - RNA, 14 nt, Homo sapiens
cuguugagguguga

SEQ ID NO: 2157375 - RNA, 14 nt, Homo sapiens
gguaaaugguauga

SEQ ID NO: 2157376 - RNA, 14 nt, Homo sapiens
aaaugcauguaauc

SEQ ID NO: 2157377 - RNA, 18 nt, Homo sapiens
uaaacagacaggaauuua

SEQ ID NO: 2157378 - RNA, 17 nt, Homo sapiens
uaaaggcaaaguggaau

SEQ ID NO: 2157379 - RNA, 15 nt, Homo sapiens
aacaauuacauguaa

SEQ ID NO: 2157380 - RNA, 18 nt, Homo sapiens
gucuccuuggcugucugu

SEQ ID NO: 2157381 - RNA, 14 nt, Homo sapiens
cuggaagacacuuc

SEQ ID NO: 2157382 - RNA, 13 nt, Homo sapiens
ucugggcacugga

SEQ ID NO: 2157383 - RNA, 13 nt, Homo sapiens
acacaacauguau

SEQ ID NO: 2157384 - RNA, 21 nt, Homo sapiens
uaaucaguuuccacuacauuc

SEQ ID NO: 2157385 - RNA, 14 nt, Homo sapiens
cugaagaccagcug

SEQ ID NO: 2157386 - RNA, 14 nt, Homo sapiens
acccucaaauguca

SEQ ID NO: 2157387 - RNA, 22 nt, Homo sapiens
cagaaacccggcuuccugugcu

SEQ ID NO: 2157388 - RNA, 15 nt, Homo sapiens
uucaucccacuccaa

SEQ ID NO: 2157389 - RNA, 22 nt, Homo sapiens
acagugcccaagcgcuuggccu

SEQ ID NO: 2157390 - RNA, 17 nt, Homo sapiens
ugcccagccuuguuugc

SEQ ID NO: 2157391 - RNA, 17 nt, Homo sapiens
acucucaucacuacagu

SEQ ID NO: 2157392 - RNA, 14 nt, Homo sapiens
gggaugggcucgcu

SEQ ID NO: 2157393 - RNA, 18 nt, Homo sapiens
cacacuggcgaaccaucu

SEQ ID NO: 2157394 - RNA, 23 nt, Homo sapiens
ugauaauaaauuagguaagauaa

SEQ ID NO: 2157395 - RNA, 22 nt, Homo sapiens
auuggucaagaaaagcaugaaa

SEQ ID NO: 2157396 - RNA, 17 nt, Homo sapiens
ucuuaugcaaucuaugu

SEQ ID NO: 2157397 - RNA, 17 nt, Homo sapiens
ugccauguuuuugccaa

SEQ ID NO: 2157398 - RNA, 20 nt, Homo sapiens
uccuucacucugacaguauu

SEQ ID NO: 2157399 - RNA, 19 nt, Homo sapiens
agauuuggaauaggaauaa

SEQ ID NO: 2157400 - RNA, 22 nt, Homo sapiens
ggcgugggggcucaugccugua

SEQ ID NO: 2157401 - RNA, 20 nt, Homo sapiens
agugcuacagaaagcacaaa

SEQ ID NO: 2157402 - RNA, 18 nt, Homo sapiens
acagacauuaaaccugga

SEQ ID NO: 2157403 - RNA, 19 nt, Homo sapiens
uuaccaaagaagaguuuac

SEQ ID NO: 2157404 - RNA, 23 nt, Homo sapiens
gaccccagguucagugcggcccc

SEQ ID NO: 2157405 - RNA, 15 nt, Homo sapiens
auuuuaggcacuguu

SEQ ID NO: 2157406 - RNA, 22 nt, Homo sapiens
guccccccaaaucuacugagcc

SEQ ID NO: 2157407 - RNA, 16 nt, Homo sapiens
aaaaguuaagugucau

SEQ ID NO: 2157408 - RNA, 17 nt, Homo sapiens
ugugauuuccuaaacau

SEQ ID NO: 2157409 - RNA, 20 nt, Homo sapiens
aauguccaagcuauguauuu

SEQ ID NO: 2157410 - RNA, 13 nt, Homo sapiens
gagcaaacugcuc

SEQ ID NO: 2157411 - RNA, 9 nt, Homo sapiens
uucuuccac

SEQ ID NO: 2157412 - RNA, 21 nt, Homo sapiens
aauacugcagagggacagaug

SEQ ID NO: 2157413 - RNA, 17 nt, Homo sapiens
caugcaggugacauucu

SEQ ID NO: 2157414 - RNA, 20 nt, Homo sapiens
cccagaccauacugacucaa

SEQ ID NO: 2157415 - RNA, 16 nt, Homo sapiens
uagauggccaugaaga

SEQ ID NO: 2157416 - RNA, 21 nt, Homo sapiens
cguuuuguucauauucacuau

SEQ ID NO: 2157417 - RNA, 16 nt, Homo sapiens
gacuauuuaugaaggc

SEQ ID NO: 2157418 - RNA, 23 nt, Homo sapiens
auaaagccuugugaucacuuucu

SEQ ID NO: 2157419 - RNA, 16 nt, Homo sapiens
caacaucuguuacauu

SEQ ID NO: 2157420 - RNA, 20 nt, Homo sapiens
cuuaacagacaauuggucaa

SEQ ID NO: 2157421 - RNA, 19 nt, Homo sapiens
ggaaugaauacagcauuua

SEQ ID NO: 2157422 - RNA, 20 nt, Homo sapiens
gcucacagcuggaacccugg

SEQ ID NO: 2157423 - RNA, 19 nt, Homo sapiens
accuuugucuucuauaaua

SEQ ID NO: 2157424 - RNA, 22 nt, Homo sapiens
augccuugagucuuuaauccca

SEQ ID NO: 2157425 - RNA, 13 nt, Homo sapiens
ucuagugcaaaag

SEQ ID NO: 2157426 - RNA, 13 nt, Homo sapiens
uaagaugcacuga

SEQ ID NO: 2157427 - RNA, 21 nt, Homo sapiens
uauucagauauaaaacaguuu

SEQ ID NO: 2157428 - RNA, 20 nt, Homo sapiens
auucugcucugcccaugccu

SEQ ID NO: 2157429 - RNA, 23 nt, Homo sapiens
uuaagcguucauaugcucugcuu

SEQ ID NO: 2157430 - RNA, 14 nt, Homo sapiens
auguguggugcuaa

SEQ ID NO: 2157431 - RNA, 14 nt, Homo sapiens
aaaucucaguggcu

SEQ ID NO: 2157432 - RNA, 16 nt, Homo sapiens
ugccuaguuucuuaca

SEQ ID NO: 2157433 - RNA, 16 nt, Homo sapiens
uaaugucacaacaugg

SEQ ID NO: 2157434 - RNA, 18 nt, Homo sapiens
caaaagggugucugagcc

SEQ ID NO: 2157435 - RNA, 16 nt, Homo sapiens
uauaugugugcccugg

SEQ ID NO: 2157436 - RNA, 23 nt, Homo sapiens
aaccuugcacaggucccacugcc

SEQ ID NO: 2157437 - RNA, 14 nt, Homo sapiens
ccuugauauuugua

SEQ ID NO: 2157438 - RNA, 16 nt, Homo sapiens
ugcacucccccaguuc

SEQ ID NO: 2157439 - RNA, 19 nt, Homo sapiens
cauguucugugacugaaga

SEQ ID NO: 2157440 - RNA, 17 nt, Homo sapiens
gggcugcagagggagac

SEQ ID NO: 2157441 - RNA, 21 nt, Homo sapiens
gccuugcuagcugaccuggag

SEQ ID NO: 2157442 - RNA, 20 nt, Homo sapiens
gugcgugcuugcaugugcug

SEQ ID NO: 2157443 - RNA, 20 nt, Homo sapiens
gucuuagccucccaaagugc

SEQ ID NO: 2157444 - RNA, 21 nt, Homo sapiens
uccuuggcgcugccaccugcc

SEQ ID NO: 2157445 - RNA, 14 nt, Homo sapiens
ccacugagcuccau

SEQ ID NO: 2157446 - RNA, 15 nt, Homo sapiens
cagugugacacugcu

SEQ ID NO: 2157447 - RNA, 19 nt, Homo sapiens
uggaucccaauucauuuca

SEQ ID NO: 2157448 - RNA, 17 nt, Homo sapiens
acaguacuugucuucac

SEQ ID NO: 2157449 - RNA, 23 nt, Homo sapiens
auaugccucauuuuaucauagcc

SEQ ID NO: 2157450 - RNA, 22 nt, Homo sapiens
cuuaucuggcccucgacacuca

SEQ ID NO: 2157451 - RNA, 14 nt, Homo sapiens
ccaugguuccacag

SEQ ID NO: 2157452 - RNA, 12 nt, Homo sapiens
ucugucaugaac

SEQ ID NO: 2157453 - RNA, 13 nt, Homo sapiens
auuuuagucacac

SEQ ID NO: 2157454 - RNA, 19 nt, Homo sapiens
gaagguuggugaauuucac

SEQ ID NO: 2157455 - RNA, 14 nt, Homo sapiens
gccccuaccagcca

SEQ ID NO: 2157456 - RNA, 16 nt, Homo sapiens
cauguguguucaugca

SEQ ID NO: 2157457 - RNA, 14 nt, Homo sapiens
agaucuaugggaag

SEQ ID NO: 2157458 - RNA, 23 nt, Homo sapiens
uaauaugaugccacuuugcagcu

SEQ ID NO: 2157459 - RNA, 19 nt, Homo sapiens
augccaaguaucuuuccag

SEQ ID NO: 2157460 - RNA, 12 nt, Homo sapiens
caguuucugaca

SEQ ID NO: 2157461 - RNA, 12 nt, Homo sapiens
ucucaagugcca

SEQ ID NO: 2157462 - RNA, 18 nt, Homo sapiens
aagaaucuagaagaugug

SEQ ID NO: 2157463 - RNA, 17 nt, Homo sapiens
aucucauccaucacaga

SEQ ID NO: 2157464 - RNA, 16 nt, Homo sapiens
cacuuauguuauacaa

SEQ ID NO: 2157465 - RNA, 20 nt, Homo sapiens
cuccuugacucaauugaucc

SEQ ID NO: 2157466 - RNA, 21 nt, Homo sapiens
gcugaaacugaaauaagcuaa

SEQ ID NO: 2157467 - RNA, 13 nt, Homo sapiens
ucucagcagaaac

SEQ ID NO: 2157468 - RNA, 19 nt, Homo sapiens
aggggaauuuucucuccau

SEQ ID NO: 2157469 - RNA, 19 nt, Homo sapiens
auauguuuuaaaauacucu

SEQ ID NO: 2157470 - RNA, 19 nt, Homo sapiens
uuaaagucuacacugccuu

SEQ ID NO: 2157471 - RNA, 21 nt, Homo sapiens
ccugucccaccccuaccucua

SEQ ID NO: 2157472 - RNA, 20 nt, Homo sapiens
cugugaacagagagcgcuuu

SEQ ID NO: 2157473 - RNA, 20 nt, Homo sapiens
guuucuagcuagaaauauga

SEQ ID NO: 2157474 - RNA, 16 nt, Homo sapiens
uauaccaaggcaaaaa

SEQ ID NO: 2157475 - RNA, 17 nt, Homo sapiens
agaaccaggcugcugca

SEQ ID NO: 2157476 - RNA, 14 nt, Homo sapiens
ugaaagaagucaaa

SEQ ID NO: 2157477 - RNA, 19 nt, Homo sapiens
gccuccagaagcacuggga

SEQ ID NO: 2157478 - RNA, 22 nt, Homo sapiens
ucucauuguguggucauaucua

SEQ ID NO: 2157479 - RNA, 23 nt, Homo sapiens
agauuuuguuuuuaaacuggaaa

SEQ ID NO: 2157480 - RNA, 15 nt, Homo sapiens
cucagucaguauugu

SEQ ID NO: 2157481 - RNA, 15 nt, Homo sapiens
acacaguucugggca

SEQ ID NO: 2157482 - RNA, 18 nt, Homo sapiens
uucuauucuagccugcau

SEQ ID NO: 2157483 - RNA, 17 nt, Homo sapiens
acugaaacagccagauc

SEQ ID NO: 2157484 - RNA, 21 nt, Homo sapiens
accuguaccuggccuggccuc

SEQ ID NO: 2157485 - RNA, 16 nt, Homo sapiens
aaauagcccuguaaca

SEQ ID NO: 2157486 - RNA, 22 nt, Homo sapiens
uacaaaacugcuuugugcauau

SEQ ID NO: 2157487 - RNA, 21 nt, Homo sapiens
gagagauggucagaaauaucc

SEQ ID NO: 2157488 - RNA, 23 nt, Homo sapiens
aaucaugugcauauaucuuucag

SEQ ID NO: 2157489 - RNA, 15 nt, Homo sapiens
ccuacaagauuuccu

SEQ ID NO: 2157490 - RNA, 14 nt, Homo sapiens
cagaaaaauacuuu

SEQ ID NO: 2157491 - RNA, 14 nt, Homo sapiens
cuccagauguuaau

SEQ ID NO: 2157492 - RNA, 20 nt, Homo sapiens
aaagaaguguuccuucauua

SEQ ID NO: 2157493 - RNA, 14 nt, Homo sapiens
ccagccccuuugcc

SEQ ID NO: 2157494 - RNA, 19 nt, Homo sapiens
ccuuuugggaauaauagca

SEQ ID NO: 2157495 - RNA, 18 nt, Homo sapiens
guggcuucuaguuugcaa

SEQ ID NO: 2157496 - RNA, 12 nt, Homo sapiens
uugaaguauuag

SEQ ID NO: 2157497 - RNA, 12 nt, Homo sapiens
aucucagugcag

SEQ ID NO: 2157498 - RNA, 16 nt, Homo sapiens
ucucagugcuuuccaa

SEQ ID NO: 2157499 - RNA, 19 nt, Homo sapiens
gccucucugguugccaaau

SEQ ID NO: 2157500 - RNA, 20 nt, Homo sapiens
guacugaagauuaucacuua

SEQ ID NO: 2157501 - RNA, 21 nt, Homo sapiens
aggcuccugccaguguggaac

SEQ ID NO: 2157502 - RNA, 18 nt, Homo sapiens
uccaauuauuacaguccu

SEQ ID NO: 2157503 - RNA, 18 nt, Homo sapiens
aucugcccucccuguuuc

SEQ ID NO: 2157504 - RNA, 19 nt, Homo sapiens
uggcuuugcuuagcuuguu

SEQ ID NO: 2157505 - RNA, 18 nt, Homo sapiens
aauuuaaaaggugucaac

SEQ ID NO: 2157506 - RNA, 15 nt, Homo sapiens
auacauauacacaaa

SEQ ID NO: 2157507 - RNA, 13 nt, Homo sapiens
acaccacacccag

SEQ ID NO: 2157508 - RNA, 23 nt, Homo sapiens
gccuuggaggacccagcacugac

SEQ ID NO: 2157509 - RNA, 20 nt, Homo sapiens
uaagcacuagaucucccuua

SEQ ID NO: 2157510 - RNA, 19 nt, Homo sapiens
aacuggaaaggaucuguga

SEQ ID NO: 2157511 - RNA, 15 nt, Homo sapiens
aagacuauuugccau

SEQ ID NO: 2157512 - RNA, 15 nt, Homo sapiens
uacacuauaucccau

SEQ ID NO: 2157513 - RNA, 13 nt, Homo sapiens
gacucaagggaaa

SEQ ID NO: 2157514 - RNA, 13 nt, Homo sapiens
uaauaaagugcac

SEQ ID NO: 2157515 - RNA, 23 nt, Homo sapiens
ggaaacaauauaaccacaaagca

SEQ ID NO: 2157516 - RNA, 15 nt, Homo sapiens
cuucccugugccucc

SEQ ID NO: 2157517 - RNA, 23 nt, Homo sapiens
uagccaugugaaacucaucucau

SEQ ID NO: 2157518 - RNA, 15 nt, Homo sapiens
aauacuccagcaccu

SEQ ID NO: 2157519 - RNA, 17 nt, Homo sapiens
gaugcggaaagcccuga

SEQ ID NO: 2157520 - RNA, 20 nt, Homo sapiens
caaaaacauuugauuaauaa

SEQ ID NO: 2157521 - RNA, 16 nt, Homo sapiens
ucuacauuaaaucacu

SEQ ID NO: 2157522 - RNA, 18 nt, Homo sapiens
agggccccacucagggau

SEQ ID NO: 2157523 - RNA, 16 nt, Homo sapiens
ccuuacucugccagag

SEQ ID NO: 2157524 - RNA, 14 nt, Homo sapiens
aggaggaaaauucc

SEQ ID NO: 2157525 - RNA, 17 nt, Homo sapiens
uguacaccccaggacag

SEQ ID NO: 2157526 - RNA, 14 nt, Homo sapiens
guacuucagugcac

SEQ ID NO: 2157527 - RNA, 13 nt, Homo sapiens
ugcagaaggcaau

SEQ ID NO: 2157528 - RNA, 13 nt, Homo sapiens
ugaggaaggccgu

SEQ ID NO: 2157529 - RNA, 23 nt, Homo sapiens
aacauaucaaacauauguauaca

SEQ ID NO: 2157530 - RNA, 18 nt, Homo sapiens
gacucuaagcugugugca

SEQ ID NO: 2157531 - RNA, 15 nt, Homo sapiens
acuacacacaccaga

SEQ ID NO: 2157532 - RNA, 22 nt, Homo sapiens
caauaaucucacuaccuuauua

SEQ ID NO: 2157533 - RNA, 21 nt, Homo sapiens
augagcccagaucaccaccug

SEQ ID NO: 2157534 - RNA, 17 nt, Homo sapiens
ggcagagggagaaucca

SEQ ID NO: 2157535 - RNA, 20 nt, Homo sapiens
ugagaagacaucagauccug

SEQ ID NO: 2157536 - RNA, 16 nt, Homo sapiens
ugcagucucccagaug

SEQ ID NO: 2157537 - RNA, 18 nt, Homo sapiens
cuucaccugcaaagcucu

SEQ ID NO: 2157538 - RNA, 20 nt, Homo sapiens
aauaaggggcaccugggaaa

SEQ ID NO: 2157539 - RNA, 19 nt, Homo sapiens
gacuuggcacuccuggaca

SEQ ID NO: 2157540 - RNA, 13 nt, Homo sapiens
cucagcuuaucuc

SEQ ID NO: 2157541 - RNA, 13 nt, Homo sapiens
cuguuucuuuaaa

SEQ ID NO: 2157542 - RNA, 19 nt, Homo sapiens
caggagauggaagagucau

SEQ ID NO: 2157543 - RNA, 13 nt, Homo sapiens
auucuaagugaaa

SEQ ID NO: 2157544 - RNA, 19 nt, Homo sapiens
ucagauauaaauguuuaau

SEQ ID NO: 2157545 - RNA, 16 nt, Homo sapiens
gaaugcaguggggaca

SEQ ID NO: 2157546 - RNA, 21 nt, Homo sapiens
guaguccagucucuccagcau

SEQ ID NO: 2157547 - RNA, 19 nt, Homo sapiens
gccugcuagcggcugaaca

SEQ ID NO: 2157548 - RNA, 14 nt, Homo sapiens
caccagccacuuua

SEQ ID NO: 2157549 - RNA, 22 nt, Homo sapiens
caccaggaugaaggcgugcaag

SEQ ID NO: 2157550 - RNA, 15 nt, Homo sapiens
ugccaauagugucau

SEQ ID NO: 2157551 - RNA, 19 nt, Homo sapiens
auaaaguccuuggacuguu

SEQ ID NO: 2157552 - RNA, 15 nt, Homo sapiens
uuuucaacauuguau

SEQ ID NO: 2157553 - RNA, 14 nt, Homo sapiens
gcagacccugagca

SEQ ID NO: 2157554 - RNA, 17 nt, Homo sapiens
agccccccguguucaca

SEQ ID NO: 2157555 - RNA, 21 nt, Homo sapiens
aauugucauuuauaaaaccau

SEQ ID NO: 2157556 - RNA, 14 nt, Homo sapiens
gcccugaacaaagc

SEQ ID NO: 2157557 - RNA, 13 nt, Homo sapiens
agaauauauuucc

SEQ ID NO: 2157558 - RNA, 14 nt, Homo sapiens
gaggcucagauuaa

SEQ ID NO: 2157559 - RNA, 21 nt, Homo sapiens
uaaauaugccuaaaauacuua

SEQ ID NO: 2157560 - RNA, 21 nt, Homo sapiens
gaauacucuuggucaccucaa

SEQ ID NO: 2157561 - RNA, 20 nt, Homo sapiens
agaaauuugcaacucacuga

SEQ ID NO: 2157562 - RNA, 14 nt, Homo sapiens
ccaccucaccaaaa

SEQ ID NO: 2157563 - RNA, 15 nt, Homo sapiens
cagacacacacuggc

SEQ ID NO: 2157564 - RNA, 14 nt, Homo sapiens
cagaauuguagcca

SEQ ID NO: 2157565 - RNA, 21 nt, Homo sapiens
uuucaagcaaaacaguucuca

SEQ ID NO: 2157566 - RNA, 24 nt, Homo sapiens
cuauaaaguuuuauuugaaugaac

SEQ ID NO: 2157567 - RNA, 20 nt, Homo sapiens
cugaagucuggaacacuuuc

SEQ ID NO: 2157568 - RNA, 17 nt, Homo sapiens
gugagacacugcacaga

SEQ ID NO: 2157569 - RNA, 16 nt, Homo sapiens
ugccaagaauauaguu

SEQ ID NO: 2157570 - RNA, 18 nt, Homo sapiens
aggugacggacucagacu

SEQ ID NO: 2157571 - RNA, 23 nt, Homo sapiens
acugcaguagugcaccaucucac

SEQ ID NO: 2157572 - RNA, 17 nt, Homo sapiens
ucugcagacugcugcua

SEQ ID NO: 2157573 - RNA, 20 nt, Homo sapiens
ugauggcagaacgaugccug

SEQ ID NO: 2157574 - RNA, 10 nt, Homo sapiens
guuugcacug

SEQ ID NO: 2157575 - RNA, 23 nt, Homo sapiens
augucccuugcugugagcaagaa

SEQ ID NO: 2157576 - RNA, 22 nt, Homo sapiens
acuugcugguuuugcggcuugu

SEQ ID NO: 2157577 - RNA, 17 nt, Homo sapiens
uacucagucagcccagu

SEQ ID NO: 2157578 - RNA, 15 nt, Homo sapiens
cagagaccaccacau

SEQ ID NO: 2157579 - RNA, 19 nt, Homo sapiens
uagccagcugugcacuuuc

SEQ ID NO: 2157580 - RNA, 12 nt, Homo sapiens
cauugcacuuuc

SEQ ID NO: 2157581 - RNA, 15 nt, Homo sapiens
gcauacucugugcaa

SEQ ID NO: 2157582 - RNA, 11 nt, Homo sapiens
ucuaaccucag

SEQ ID NO: 2157583 - RNA, 23 nt, Homo sapiens
cuuuuuugauuaagugguuacuu

SEQ ID NO: 2157584 - RNA, 18 nt, Homo sapiens
agcugcagaaugacucca

SEQ ID NO: 2157585 - RNA, 17 nt, Homo sapiens
aucuugagggcagacag

SEQ ID NO: 2157586 - RNA, 15 nt, Homo sapiens
ugccucccaaagugc

SEQ ID NO: 2157587 - RNA, 18 nt, Homo sapiens
ggaugguuuuaucuuccc

SEQ ID NO: 2157588 - RNA, 17 nt, Homo sapiens
aaucagagauuauucaa

SEQ ID NO: 2157589 - RNA, 22 nt, Homo sapiens
uuccauugaagccgacucuggc

SEQ ID NO: 2157590 - RNA, 22 nt, Homo sapiens
ugaauaaguuguuuuguuuuau

SEQ ID NO: 2157591 - RNA, 14 nt, Homo sapiens
cuuauggacacugc

SEQ ID NO: 2157592 - RNA, 15 nt, Homo sapiens
auguguaagacaaaa

SEQ ID NO: 2157593 - RNA, 17 nt, Homo sapiens
uuagaaaauagagcuuu

SEQ ID NO: 2157594 - RNA, 11 nt, Homo sapiens
gaaaccuucca

SEQ ID NO: 2157595 - RNA, 19 nt, Homo sapiens
cuagucuccuuugcacuga

SEQ ID NO: 2157596 - RNA, 17 nt, Homo sapiens
auggcugacaucaguca

SEQ ID NO: 2157597 - RNA, 20 nt, Homo sapiens
aguaggcccugguuccugcu

SEQ ID NO: 2157598 - RNA, 22 nt, Homo sapiens
gccucucugccugggaugggcu

SEQ ID NO: 2157599 - RNA, 13 nt, Homo sapiens
ucuucauggugau

SEQ ID NO: 2157600 - RNA, 22 nt, Homo sapiens
cuaucugagugaauuacagaca

SEQ ID NO: 2157601 - RNA, 21 nt, Homo sapiens
augauaaaccugccaagaguc

SEQ ID NO: 2157602 - RNA, 23 nt, Homo sapiens
guacaguucugggguacauguua

SEQ ID NO: 2157603 - RNA, 23 nt, Homo sapiens
uggcuuuuuuccuccuguguaca

SEQ ID NO: 2157604 - RNA, 20 nt, Homo sapiens
caguggugugaucauagcuc

SEQ ID NO: 2157605 - RNA, 15 nt, Homo sapiens
aagcaaacacauuaa

SEQ ID NO: 2157606 - RNA, 20 nt, Homo sapiens
acaaacacugaaucauguua

SEQ ID NO: 2157607 - RNA, 13 nt, Homo sapiens
cugccccugcuac

SEQ ID NO: 2157608 - RNA, 18 nt, Homo sapiens
gcugaccagacacugccu

SEQ ID NO: 2157609 - RNA, 15 nt, Homo sapiens
aaagaaagaaggaag

SEQ ID NO: 2157610 - RNA, 12 nt, Homo sapiens
ucaugucuuuau

SEQ ID NO: 2157611 - RNA, 21 nt, Homo sapiens
gggacccuuccccgugcccua

SEQ ID NO: 2157612 - RNA, 16 nt, Homo sapiens
uggcuuuagacacugg

SEQ ID NO: 2157613 - RNA, 12 nt, Homo sapiens
agugcauuugcc

SEQ ID NO: 2157614 - RNA, 20 nt, Homo sapiens
acauuaaagaaggguugagc

SEQ ID NO: 2157615 - RNA, 23 nt, Homo sapiens
aacuucauuaggguaauaucauc

SEQ ID NO: 2157616 - RNA, 22 nt, Homo sapiens
auccucaugaggcuucucagcc

SEQ ID NO: 2157617 - RNA, 16 nt, Homo sapiens
uggacaucucucuggc

SEQ ID NO: 2157618 - RNA, 23 nt, Homo sapiens
accagcauuuacuaugccacaga

SEQ ID NO: 2157619 - RNA, 18 nt, Homo sapiens
uaaugguuuuuaacaccu

SEQ ID NO: 2157620 - RNA, 15 nt, Homo sapiens
cccuaacucagccaa

SEQ ID NO: 2157621 - RNA, 11 nt, Homo sapiens
auacacugugu

SEQ ID NO: 2157622 - RNA, 13 nt, Homo sapiens
cacacacagugau

SEQ ID NO: 2157623 - RNA, 18 nt, Homo sapiens
agcuuugggugaccagcc

SEQ ID NO: 2157624 - RNA, 12 nt, Homo sapiens
acaaaugaagua

SEQ ID NO: 2157625 - RNA, 20 nt, Homo sapiens
agccuccucuggacuccacc

SEQ ID NO: 2157626 - RNA, 17 nt, Homo sapiens
gaccagaagcauuucac

SEQ ID NO: 2157627 - RNA, 20 nt, Homo sapiens
gacuuccaucuagucacaaa

SEQ ID NO: 2157628 - RNA, 11 nt, Homo sapiens
cugacagcuuc

SEQ ID NO: 2157629 - RNA, 21 nt, Homo sapiens
uguguaccugaaguacaguau

SEQ ID NO: 2157630 - RNA, 19 nt, Homo sapiens
auugaggaaaauuaauauc

SEQ ID NO: 2157631 - RNA, 23 nt, Homo sapiens
uggggaaugcucccagcugugcu

SEQ ID NO: 2157632 - RNA, 15 nt, Homo sapiens
uggaucucaagagcc

SEQ ID NO: 2157633 - RNA, 17 nt, Homo sapiens
auuuuguauuccacauu

SEQ ID NO: 2157634 - RNA, 16 nt, Homo sapiens
cuguguacauaacuga

SEQ ID NO: 2157635 - RNA, 18 nt, Homo sapiens
gaagacuuaauucugauu

SEQ ID NO: 2157636 - RNA, 14 nt, Homo sapiens
acugauaaccacuc

SEQ ID NO: 2157637 - RNA, 16 nt, Homo sapiens
cgugagucugcaucuu

SEQ ID NO: 2157638 - RNA, 12 nt, Homo sapiens
aaucaaccagca

SEQ ID NO: 2157639 - RNA, 19 nt, Homo sapiens
uaaauuuguaacuuugcag

SEQ ID NO: 2157640 - RNA, 20 nt, Homo sapiens
acugccaaaaccaaauugag

SEQ ID NO: 2157641 - RNA, 13 nt, Homo sapiens
aaggaagagccaa

SEQ ID NO: 2157642 - RNA, 14 nt, Homo sapiens
uguaaauguacugg

SEQ ID NO: 2157643 - RNA, 23 nt, Homo sapiens
ugucucuacuuuucccuguacuu

SEQ ID NO: 2157644 - RNA, 19 nt, Homo sapiens
uuucccccugugaaagcaa

SEQ ID NO: 2157645 - RNA, 16 nt, Homo sapiens
ucaugccuggagaaac

SEQ ID NO: 2157646 - RNA, 17 nt, Homo sapiens
gcugugcacccgugcca

SEQ ID NO: 2157647 - RNA, 16 nt, Homo sapiens
aaaggagggucaggaa

SEQ ID NO: 2157648 - RNA, 14 nt, Homo sapiens
cgcucguuccugca

SEQ ID NO: 2157649 - RNA, 22 nt, Homo sapiens
agaguacucacuuuucacuugu

SEQ ID NO: 2157650 - RNA, 19 nt, Homo sapiens
ccucugcagcacgcuggac

SEQ ID NO: 2157651 - RNA, 21 nt, Homo sapiens
ugugaucuauaccaccuucaa

SEQ ID NO: 2157652 - RNA, 20 nt, Homo sapiens
gaaguugcugagcaguauuc

SEQ ID NO: 2157653 - RNA, 18 nt, Homo sapiens
uccaagccugcaacucau

SEQ ID NO: 2157654 - RNA, 21 nt, Homo sapiens
cucuuugauuugugcugugua

SEQ ID NO: 2157655 - RNA, 14 nt, Homo sapiens
ugcauaauaagcua

SEQ ID NO: 2157656 - RNA, 15 nt, Homo sapiens
gaagaacgaagccac

SEQ ID NO: 2157657 - RNA, 12 nt, Homo sapiens
uucuauaacaaa

SEQ ID NO: 2157658 - RNA, 18 nt, Homo sapiens
ugccuuccuaagccugug

SEQ ID NO: 2157659 - RNA, 15 nt, Homo sapiens
ucucaaccccaucau

SEQ ID NO: 2157660 - RNA, 18 nt, Homo sapiens
ggacucagggcugguuca

SEQ ID NO: 2157661 - RNA, 17 nt, Homo sapiens
cccuguggucacuuauc

SEQ ID NO: 2157662 - RNA, 17 nt, Homo sapiens
agaaauuuucuacagua

SEQ ID NO: 2157663 - RNA, 14 nt, Homo sapiens
augguuugugucaa

SEQ ID NO: 2157664 - RNA, 16 nt, Homo sapiens
acugucagaucuggau

SEQ ID NO: 2157665 - RNA, 14 nt, Homo sapiens
cuucuaaaccaaaa

SEQ ID NO: 2157666 - RNA, 21 nt, Homo sapiens
cagagauuugguuaagcucac

SEQ ID NO: 2157667 - RNA, 21 nt, Homo sapiens
uaacaaagaaguguauuuaca

SEQ ID NO: 2157668 - RNA, 21 nt, Homo sapiens
cucacgccuguaauucuagca

SEQ ID NO: 2157669 - RNA, 15 nt, Homo sapiens
cuccacccacugugg

SEQ ID NO: 2157670 - RNA, 12 nt, Homo sapiens
ucggaaugucau

SEQ ID NO: 2157671 - RNA, 19 nt, Homo sapiens
cuagaacaguaaaagccuu

SEQ ID NO: 2157672 - RNA, 20 nt, Homo sapiens
uuucagaaauuccaacuccu

SEQ ID NO: 2157673 - RNA, 16 nt, Homo sapiens
uugcugucuugcccca

SEQ ID NO: 2157674 - RNA, 22 nt, Homo sapiens
acucguucuucugggaacccug

SEQ ID NO: 2157675 - RNA, 14 nt, Homo sapiens
uuggaauacuugaa

SEQ ID NO: 2157676 - RNA, 18 nt, Homo sapiens
gacaaaccauaacugaca

SEQ ID NO: 2157677 - RNA, 16 nt, Homo sapiens
uccaacuuuucaucca

SEQ ID NO: 2157678 - RNA, 19 nt, Homo sapiens
uaccuugacuuuguucaca

SEQ ID NO: 2157679 - RNA, 16 nt, Homo sapiens
cagucuuucuucacuc

SEQ ID NO: 2157680 - RNA, 13 nt, Homo sapiens
aauguacaauuau

SEQ ID NO: 2157681 - RNA, 17 nt, Homo sapiens
guccaucucaagugcca

SEQ ID NO: 2157682 - RNA, 12 nt, Homo sapiens
uuguaaagagug

SEQ ID NO: 2157683 - RNA, 23 nt, Homo sapiens
aaaaccacuaugcaaagaacuca

SEQ ID NO: 2157684 - RNA, 22 nt, Homo sapiens
uuguuguuuuuagagacagggu

SEQ ID NO: 2157685 - RNA, 22 nt, Homo sapiens
aaguagcuaggacuacagacau

SEQ ID NO: 2157686 - RNA, 18 nt, Homo sapiens
uaagaauuuagggagaaa

SEQ ID NO: 2157687 - RNA, 23 nt, Homo sapiens
agaacaaaccucuauauguugcu

SEQ ID NO: 2157688 - RNA, 20 nt, Homo sapiens
aggaguguucccugaucccu

SEQ ID NO: 2157689 - RNA, 21 nt, Homo sapiens
ucuucccucacuuuucccagg

SEQ ID NO: 2157690 - RNA, 21 nt, Homo sapiens
cuaaauaaugaauaaacugaa

SEQ ID NO: 2157691 - RNA, 20 nt, Homo sapiens
acugcuggagucuggcuuua

SEQ ID NO: 2157692 - RNA, 16 nt, Homo sapiens
aguucaagcaauccac

SEQ ID NO: 2157693 - RNA, 16 nt, Homo sapiens
ccaaggaaacuugaau

SEQ ID NO: 2157694 - RNA, 11 nt, Homo sapiens
acaauggugcu

SEQ ID NO: 2157695 - RNA, 20 nt, Homo sapiens
caucugaaagugguacuuga

SEQ ID NO: 2157696 - RNA, 21 nt, Homo sapiens
ugacagucugcucaacacgac

SEQ ID NO: 2157697 - RNA, 17 nt, Homo sapiens
ccagaucucaugagaag

SEQ ID NO: 2157698 - RNA, 14 nt, Homo sapiens
cagcacgugcagcc

SEQ ID NO: 2157699 - RNA, 21 nt, Homo sapiens
gccuggggcccaaguugcagu

SEQ ID NO: 2157700 - RNA, 16 nt, Homo sapiens
uccuguacauuucaca

SEQ ID NO: 2157701 - RNA, 15 nt, Homo sapiens
uuaccaaguccuggg

SEQ ID NO: 2157702 - RNA, 13 nt, Homo sapiens
ucauaaccaaaga

SEQ ID NO: 2157703 - RNA, 13 nt, Homo sapiens
ggcacccauagga

SEQ ID NO: 2157704 - RNA, 18 nt, Homo sapiens
agacucagcuccagaaua

SEQ ID NO: 2157705 - RNA, 18 nt, Homo sapiens
uaucagaucuaucuuguc

SEQ ID NO: 2157706 - RNA, 16 nt, Homo sapiens
uggagaaaucuacuga

SEQ ID NO: 2157707 - RNA, 15 nt, Homo sapiens
uaucaguauugugaa

SEQ ID NO: 2157708 - RNA, 12 nt, Homo sapiens
auagccaaaaau

SEQ ID NO: 2157709 - RNA, 20 nt, Homo sapiens
uuaauacagggcauuuuggu

SEQ ID NO: 2157710 - RNA, 14 nt, Homo sapiens
guguucaugaucuc

SEQ ID NO: 2157711 - RNA, 23 nt, Homo sapiens
cagugcugcuguaaauacaggaa

SEQ ID NO: 2157712 - RNA, 21 nt, Homo sapiens
cagggaagcaacccuggguuu

SEQ ID NO: 2157713 - RNA, 17 nt, Homo sapiens
ugaccaguugcagucac

SEQ ID NO: 2157714 - RNA, 16 nt, Homo sapiens
agaauauauugccaaa

SEQ ID NO: 2157715 - RNA, 17 nt, Homo sapiens
uaaugcuacgugugauu

SEQ ID NO: 2157716 - RNA, 13 nt, Homo sapiens
cccacuggccuca

SEQ ID NO: 2157717 - RNA, 18 nt, Homo sapiens
gccugccuucagcuagaa

SEQ ID NO: 2157718 - RNA, 16 nt, Homo sapiens
uuccaucccacuccac

SEQ ID NO: 2157719 - RNA, 21 nt, Homo sapiens
uccacgcaauggaacauuauu

SEQ ID NO: 2157720 - RNA, 16 nt, Homo sapiens
guuaaucugauguaua

SEQ ID NO: 2157721 - RNA, 22 nt, Homo sapiens
ccagucuauuuccacugaacaa

SEQ ID NO: 2157722 - RNA, 19 nt, Homo sapiens
uguuuuaauucaacccagc

SEQ ID NO: 2157723 - RNA, 16 nt, Homo sapiens
aaucucucuccuguau

SEQ ID NO: 2157724 - RNA, 15 nt, Homo sapiens
augucuauuugcaca

SEQ ID NO: 2157725 - RNA, 20 nt, Homo sapiens
uaacaucaacaacacagcaa

SEQ ID NO: 2157726 - RNA, 20 nt, Homo sapiens
cagacacuaacgaaauauca

SEQ ID NO: 2157727 - RNA, 19 nt, Homo sapiens
uagugcacaaaaugaauga

SEQ ID NO: 2157728 - RNA, 22 nt, Homo sapiens
gccauaaaaauaaaucaguuca

SEQ ID NO: 2157729 - RNA, 22 nt, Homo sapiens
cucauaaguuggaccagaggaa

SEQ ID NO: 2157730 - RNA, 16 nt, Homo sapiens
caucagagccuuuccu

SEQ ID NO: 2157731 - RNA, 12 nt, Homo sapiens
agcaaaucugcc

SEQ ID NO: 2157732 - RNA, 16 nt, Homo sapiens
caugugcgaacacagu

SEQ ID NO: 2157733 - RNA, 16 nt, Homo sapiens
ggacuguccaccuuuu

SEQ ID NO: 2157734 - RNA, 18 nt, Homo sapiens
gugugaaaauacuggaau

SEQ ID NO: 2157735 - RNA, 22 nt, Homo sapiens
gaucauuaaagccugaguuugc

SEQ ID NO: 2157736 - RNA, 15 nt, Homo sapiens
uucccuuugugcaca

SEQ ID NO: 2157737 - RNA, 23 nt, Homo sapiens
guuccuccaagaggucuccauca

SEQ ID NO: 2157738 - RNA, 20 nt, Homo sapiens
aggugaucuaccugccucag

SEQ ID NO: 2157739 - RNA, 15 nt, Homo sapiens
cuucuucagagauca

SEQ ID NO: 2157740 - RNA, 23 nt, Homo sapiens
caaggacgcuggcuacugucuau

SEQ ID NO: 2157741 - RNA, 23 nt, Homo sapiens
aggguacagaugugcuguagcag

SEQ ID NO: 2157742 - RNA, 14 nt, Homo sapiens
gacaguuucugaca

SEQ ID NO: 2157743 - RNA, 14 nt, Homo sapiens
cucacauugagagu

SEQ ID NO: 2157744 - RNA, 19 nt, Homo sapiens
gguagagaugggguuucac

SEQ ID NO: 2157745 - RNA, 16 nt, Homo sapiens
aguaccagcuuuggua

SEQ ID NO: 2157746 - RNA, 16 nt, Homo sapiens
agcagcaucucuaccu

SEQ ID NO: 2157747 - RNA, 16 nt, Homo sapiens
cugaaaagcaguucau

SEQ ID NO: 2157748 - RNA, 23 nt, Homo sapiens
gaaacuacuguaucugauguuug

SEQ ID NO: 2157749 - RNA, 15 nt, Homo sapiens
uagcuagcuguguua

SEQ ID NO: 2157750 - RNA, 21 nt, Homo sapiens
uauacauuaguuuuaaucucu

SEQ ID NO: 2157751 - RNA, 15 nt, Homo sapiens
cugagugagccacag

SEQ ID NO: 2157752 - RNA, 15 nt, Homo sapiens
gggaggggaagaaaa

SEQ ID NO: 2157753 - RNA, 18 nt, Homo sapiens
ugcuuugguuccuaagga

SEQ ID NO: 2157754 - RNA, 22 nt, Homo sapiens
agcaagcucuucccuugcucau

SEQ ID NO: 2157755 - RNA, 18 nt, Homo sapiens
gcaccgagagagauggaa

SEQ ID NO: 2157756 - RNA, 13 nt, Homo sapiens
aucggcaggcagu

SEQ ID NO: 2157757 - RNA, 17 nt, Homo sapiens
auugacagcaauucaug

SEQ ID NO: 2157758 - RNA, 18 nt, Homo sapiens
aacuaggcucauacucaa

SEQ ID NO: 2157759 - RNA, 20 nt, Homo sapiens
gcucugcuugacaacaucug

SEQ ID NO: 2157760 - RNA, 20 nt, Homo sapiens
gcucaggggcguguggcuca

SEQ ID NO: 2157761 - RNA, 14 nt, Homo sapiens
uuccugguuugacu

SEQ ID NO: 2157762 - RNA, 14 nt, Homo sapiens
acacuuggaugcag

SEQ ID NO: 2157763 - RNA, 19 nt, Homo sapiens
uagacuggauaaucaacau

SEQ ID NO: 2157764 - RNA, 23 nt, Homo sapiens
uuaucacuucauucacauucaga

SEQ ID NO: 2157765 - RNA, 21 nt, Homo sapiens
gagaaccuugugccuggcuca

SEQ ID NO: 2157766 - RNA, 15 nt, Homo sapiens
gcgguuuaucuuuga

SEQ ID NO: 2157767 - RNA, 18 nt, Homo sapiens
ggacagccccacccuggu

SEQ ID NO: 2157768 - RNA, 14 nt, Homo sapiens
acugaaacauuuaa

SEQ ID NO: 2157769 - RNA, 15 nt, Homo sapiens
caggccauggaggca

SEQ ID NO: 2157770 - RNA, 15 nt, Homo sapiens
aggaauaaagccuuu

SEQ ID NO: 2157771 - RNA, 20 nt, Homo sapiens
gccagauuaucagaccucuu

SEQ ID NO: 2157772 - RNA, 18 nt, Homo sapiens
agugcaccaucucacugc

SEQ ID NO: 2157773 - RNA, 18 nt, Homo sapiens
aaugauuaaugcauuuau

SEQ ID NO: 2157774 - RNA, 17 nt, Homo sapiens
aagucguacuguucaca

SEQ ID NO: 2157775 - RNA, 17 nt, Homo sapiens
aucucuccagagcccuu

SEQ ID NO: 2157776 - RNA, 21 nt, Homo sapiens
uacaguguaucucgaagucuu

SEQ ID NO: 2157777 - RNA, 13 nt, Homo sapiens
cuuuguagcgucu

SEQ ID NO: 2157778 - RNA, 18 nt, Homo sapiens
caaaagcaagaaaaccac

SEQ ID NO: 2157779 - RNA, 20 nt, Homo sapiens
ugugccaugcuaugugcaca

SEQ ID NO: 2157780 - RNA, 20 nt, Homo sapiens
cugagacaucccugauucuc

SEQ ID NO: 2157781 - RNA, 17 nt, Homo sapiens
agguggagguugugcau

SEQ ID NO: 2157782 - RNA, 14 nt, Homo sapiens
caaacaaugcagau

SEQ ID NO: 2157783 - RNA, 17 nt, Homo sapiens
gacuucugucuguaucu

SEQ ID NO: 2157784 - RNA, 23 nt, Homo sapiens
ccuguacucuggagagacugugc

SEQ ID NO: 2157785 - RNA, 23 nt, Homo sapiens
ucuacaguacaugacccggauga

SEQ ID NO: 2157786 - RNA, 20 nt, Homo sapiens
acuuaaaaagaaaaccucau

SEQ ID NO: 2157787 - RNA, 20 nt, Homo sapiens
ggcuuuuugccaucugugau

SEQ ID NO: 2157788 - RNA, 14 nt, Homo sapiens
ugacuucucuugaa

SEQ ID NO: 2157789 - RNA, 23 nt, Homo sapiens
cuucccuugcucaugagcuccug

SEQ ID NO: 2157790 - RNA, 17 nt, Homo sapiens
acgucuuuauuuaggag

SEQ ID NO: 2157791 - RNA, 23 nt, Homo sapiens
uuugaaacacacagugaccaagg

SEQ ID NO: 2157792 - RNA, 14 nt, Homo sapiens
aaggugucucuggu

SEQ ID NO: 2157793 - RNA, 17 nt, Homo sapiens
cuuguuguaaagcaaua

SEQ ID NO: 2157794 - RNA, 13 nt, Homo sapiens
acuuugacuuucu

SEQ ID NO: 2157795 - RNA, 16 nt, Homo sapiens
uuucaguguuggcaag

SEQ ID NO: 2157796 - RNA, 14 nt, Homo sapiens
ugccagaugccaaa

SEQ ID NO: 2157797 - RNA, 17 nt, Homo sapiens
caacccucacuguguug

SEQ ID NO: 2157798 - RNA, 23 nt, Homo sapiens
ucuaucaaaggcagaucaguaag

SEQ ID NO: 2157799 - RNA, 18 nt, Homo sapiens
uaauuuuuauuuuuggca

SEQ ID NO: 2157800 - RNA, 18 nt, Homo sapiens
agaguuuguguguugucu

SEQ ID NO: 2157801 - RNA, 11 nt, Homo sapiens
ccagaccccau
